United States Patent 7,655,785 (BIOINFORMATICALLY DETECTABLE GROUP OF NOVEL REGULATORY OLIGONUCLEOTIDES AND USES THEREOF) - sequence listing, part 4

SEQ ID NO: 118486 - RNA, 22 nt, Homo sapiens
auuauauguguaugugcauacc

SEQ ID NO: 118487 - RNA, 20 nt, Homo sapiens
auucauggaggagcaauugg

SEQ ID NO: 118488 - RNA, 20 nt, Homo sapiens
auugaacucaguauucugaa

SEQ ID NO: 118489 - RNA, 22 nt, Homo sapiens
auugacuugauauauagcugau

SEQ ID NO: 118490 - RNA, 22 nt, Homo sapiens
auugagcaaggucuccuaguau

SEQ ID NO: 118491 - RNA, 22 nt, Homo sapiens
auugcaaagcguagacucuaaa

SEQ ID NO: 118492 - RNA, 22 nt, Homo sapiens
auuggauagucuuuaucuguug

SEQ ID NO: 118493 - RNA, 20 nt, Homo sapiens
auuguccuugauuacacaga

SEQ ID NO: 118494 - RNA, 22 nt, Homo sapiens
auugugauggucaaaggaaaua

SEQ ID NO: 118495 - RNA, 22 nt, Homo sapiens
auuuagcaauggagguagugua

SEQ ID NO: 118496 - RNA, 22 nt, Homo sapiens
auuugggaaugugcauuauacu

SEQ ID NO: 118497 - RNA, 22 nt, Homo sapiens
caaaguaauuacgguuuuggcc

SEQ ID NO: 118498 - RNA, 22 nt, Homo sapiens
caaaguaauugcuguuuugcca

SEQ ID NO: 118499 - RNA, 22 nt, Homo sapiens
caaagucuauucuacccuuacc

SEQ ID NO: 118500 - RNA, 22 nt, Homo sapiens
caaagucuucaguugauucuga

SEQ ID NO: 118501 - RNA, 22 nt, Homo sapiens
caaagucuucucauuaugucuu

SEQ ID NO: 118502 - RNA, 22 nt, Homo sapiens
caaaugcuucuauggacugucu

SEQ ID NO: 118503 - RNA, 22 nt, Homo sapiens
caacacagugaaacccgucucu

SEQ ID NO: 118504 - RNA, 22 nt, Homo sapiens
caacacuguuuauuggauagcc

SEQ ID NO: 118505 - RNA, 22 nt, Homo sapiens
caauggcaaugaaauagugaga

SEQ ID NO: 118506 - RNA, 22 nt, Homo sapiens
caaugugcuuggggcacaugag

SEQ ID NO: 118507 - RNA, 21 nt, Homo sapiens
cacauggaggcagagagugua

SEQ ID NO: 118508 - RNA, 22 nt, Homo sapiens
cacauguuugcuacauuuuucu

SEQ ID NO: 118509 - RNA, 22 nt, Homo sapiens
caccacuacaccccaggcuggg

SEQ ID NO: 118510 - RNA, 22 nt, Homo sapiens
cacccaguaagcaugaggcccu

SEQ ID NO: 118511 - RNA, 22 nt, Homo sapiens
cacucaguuugugguacuuugu

SEQ ID NO: 118512 - RNA, 22 nt, Homo sapiens
cacugcacuccagcuuugguga

SEQ ID NO: 118513 - RNA, 22 nt, Homo sapiens
cacugcacuccaguuuggauga

SEQ ID NO: 118514 - RNA, 22 nt, Homo sapiens
cacuggguuagaacaugcuccu

SEQ ID NO: 118515 - RNA, 22 nt, Homo sapiens
cagacaugucuuguggccgugg

SEQ ID NO: 118516 - RNA, 22 nt, Homo sapiens
cagagaaugucuuuuuuaacca

SEQ ID NO: 118517 - RNA, 22 nt, Homo sapiens
cagagugcauguuuagaugagu

SEQ ID NO: 118518 - RNA, 22 nt, Homo sapiens
cagauacuccuggucucaggag

SEQ ID NO: 118519 - RNA, 22 nt, Homo sapiens
cagcugcuuuggaaaauauuuu

SEQ ID NO: 118520 - RNA, 22 nt, Homo sapiens
caggaccucuugccuggaagcc

SEQ ID NO: 118521 - RNA, 22 nt, Homo sapiens
caggcagucuggggguguaucc

SEQ ID NO: 118522 - RNA, 22 nt, Homo sapiens
caguaaauaucugagcgagguc

SEQ ID NO: 118523 - RNA, 22 nt, Homo sapiens
cauaguacuugcauaguacuau

SEQ ID NO: 118524 - RNA, 22 nt, Homo sapiens
caucaaaguggagggaaggacc

SEQ ID NO: 118525 - RNA, 22 nt, Homo sapiens
caucacaucugcaugguaagua

SEQ ID NO: 118526 - RNA, 22 nt, Homo sapiens
caugaaagacugaggaauugga

SEQ ID NO: 118527 - RNA, 22 nt, Homo sapiens
cauggcccuggguccauaggaa

SEQ ID NO: 118528 - RNA, 21 nt, Homo sapiens
caugucacugcacucuagccu

SEQ ID NO: 118529 - RNA, 22 nt, Homo sapiens
caugugcaugcuuucuuaugug

SEQ ID NO: 118530 - RNA, 22 nt, Homo sapiens
ccaaggaauacccucccuuuuu

SEQ ID NO: 118531 - RNA, 22 nt, Homo sapiens
ccaaguguucucauuguucaau

SEQ ID NO: 118532 - RNA, 22 nt, Homo sapiens
ccacacugucuuggugggaaac

SEQ ID NO: 118533 - RNA, 22 nt, Homo sapiens
ccacagucuaugcaacaagguc

SEQ ID NO: 118534 - RNA, 22 nt, Homo sapiens
ccaguguuuggauuagggaugc

SEQ ID NO: 118535 - RNA, 22 nt, Homo sapiens
cccagugguuacauaaggagua

SEQ ID NO: 118536 - RNA, 19 nt, Homo sapiens
cccagugucagagaagggu

SEQ ID NO: 118537 - RNA, 22 nt, Homo sapiens
ccccagugguugcaacagcaga

SEQ ID NO: 118538 - RNA, 17 nt, Homo sapiens
cccuaguagcugggacu

SEQ ID NO: 118539 - RNA, 22 nt, Homo sapiens
ccucauggagaaccucugcuag

SEQ ID NO: 118540 - RNA, 22 nt, Homo sapiens
ccugagaucauacuguuaguaa

SEQ ID NO: 118541 - RNA, 22 nt, Homo sapiens
ccuggcacugggccccguggcu

SEQ ID NO: 118542 - RNA, 22 nt, Homo sapiens
ccuucuuuuguaaggcugaaua

SEQ ID NO: 118543 - RNA, 22 nt, Homo sapiens
gcaugugaauguguaagaaaau

SEQ ID NO: 118544 - RNA, 22 nt, Homo sapiens
gccagugugaugugaucauggc

SEQ ID NO: 118545 - RNA, 22 nt, Homo sapiens
gccaguguuuuauugagaauuu

SEQ ID NO: 118546 - RNA, 22 nt, Homo sapiens
gccccgggugaugcagccguca

SEQ ID NO: 118547 - RNA, 17 nt, Homo sapiens
gcccuuugugccucuuc

SEQ ID NO: 118548 - RNA, 22 nt, Homo sapiens
gcuaggagauccacugcucucu

SEQ ID NO: 118549 - RNA, 22 nt, Homo sapiens
gcugaguaguauuucauuguau

SEQ ID NO: 118550 - RNA, 22 nt, Homo sapiens
gcugcacuuuaaggcauccccu

SEQ ID NO: 118551 - RNA, 22 nt, Homo sapiens
gcugcuguggcagauuggauuc

SEQ ID NO: 118552 - RNA, 22 nt, Homo sapiens
gcugcuguuauucaucagaacu

SEQ ID NO: 118553 - RNA, 22 nt, Homo sapiens
gcugcuuuugaugacaaaaaca

SEQ ID NO: 118554 - RNA, 22 nt, Homo sapiens
gcuggcuuucuccugaucucag

SEQ ID NO: 118555 - RNA, 22 nt, Homo sapiens
gcuguugugaacuauacaucua

SEQ ID NO: 118556 - RNA, 22 nt, Homo sapiens
gcuucauggaggcugggcgcag

SEQ ID NO: 118557 - RNA, 23 nt, Homo sapiens
ggaaacauccagucuuucaccau

SEQ ID NO: 118558 - RNA, 22 nt, Homo sapiens
ggaagaauaaugggccuuagag

SEQ ID NO: 118559 - RNA, 22 nt, Homo sapiens
ggaagccugcacucgggcaggg

SEQ ID NO: 118560 - RNA, 22 nt, Homo sapiens
ggagaucuuuaggaguuggacu

SEQ ID NO: 118561 - RNA, 22 nt, Homo sapiens
ggagugugauuguucucuguua

SEQ ID NO: 118562 - RNA, 22 nt, Homo sapiens
ggaugcauuuuugguugucaca

SEQ ID NO: 118563 - RNA, 23 nt, Homo sapiens
ggauggaaaguuuugagggccac

SEQ ID NO: 118564 - RNA, 22 nt, Homo sapiens
ggcaaaauauugucugguauag

SEQ ID NO: 118565 - RNA, 22 nt, Homo sapiens
ggcaaggugaugaaugucuaca

SEQ ID NO: 118566 - RNA, 22 nt, Homo sapiens
ggcaaguucuaaugauuagaau

SEQ ID NO: 118567 - RNA, 22 nt, Homo sapiens
ggcccugagacaggaaaaagcu

SEQ ID NO: 118568 - RNA, 22 nt, Homo sapiens
ggcuagagaauagugccacuaa

SEQ ID NO: 118569 - RNA, 22 nt, Homo sapiens
ggcucaguugcaaaucaguuca

SEQ ID NO: 118570 - RNA, 22 nt, Homo sapiens
ggcuuggaggaaugugagggcu

SEQ ID NO: 118571 - RNA, 22 nt, Homo sapiens
gggaagaaggagugguuuacuc

SEQ ID NO: 118572 - RNA, 19 nt, Homo sapiens
ggucacagggguuacaagg

SEQ ID NO: 118573 - RNA, 22 nt, Homo sapiens
ggugcagcacaccaacauggca

SEQ ID NO: 118574 - RNA, 22 nt, Homo sapiens
guaaaguaaagcacaucaaggu

SEQ ID NO: 118575 - RNA, 22 nt, Homo sapiens
guacaugcaugcaugggugugc

SEQ ID NO: 118576 - RNA, 22 nt, Homo sapiens
guacauggaaugaaauucaaaa

SEQ ID NO: 118577 - RNA, 22 nt, Homo sapiens
guagagugcugggcacuggcuc

SEQ ID NO: 118578 - RNA, 22 nt, Homo sapiens
guagcaugcaauauuauagaga

SEQ ID NO: 118579 - RNA, 22 nt, Homo sapiens
guaucacguuguuuuggugaaa

SEQ ID NO: 118580 - RNA, 22 nt, Homo sapiens
gucagcaaagaggaauaguuug

SEQ ID NO: 118581 - RNA, 22 nt, Homo sapiens
gucaguggagaaaaggacaugu

SEQ ID NO: 118582 - RNA, 22 nt, Homo sapiens
gucaguggauacugucucuguc

SEQ ID NO: 118583 - RNA, 22 nt, Homo sapiens
gucauggguuaaagguggauac

SEQ ID NO: 118584 - RNA, 21 nt, Homo sapiens
guccaaaacaguguccaaugc

SEQ ID NO: 118585 - RNA, 22 nt, Homo sapiens
gucccugaggaacauccagggc

SEQ ID NO: 118586 - RNA, 22 nt, Homo sapiens
guccugaagaccuuccucugga

SEQ ID NO: 118587 - RNA, 22 nt, Homo sapiens
gucguggagcucacagugugcc

SEQ ID NO: 118588 - RNA, 22 nt, Homo sapiens
gucucccaaccccugugcccag

SEQ ID NO: 118589 - RNA, 22 nt, Homo sapiens
gucucccagccuacauauuucu

SEQ ID NO: 118590 - RNA, 22 nt, Homo sapiens
gucugguuuuuuauauccucac

SEQ ID NO: 118591 - RNA, 22 nt, Homo sapiens
gucugugguuccuaugucaccu

SEQ ID NO: 118592 - RNA, 22 nt, Homo sapiens
gugaaagacagcauuaauggcu

SEQ ID NO: 118593 - RNA, 22 nt, Homo sapiens
gugaaucauaugccagucaugc

SEQ ID NO: 118594 - RNA, 22 nt, Homo sapiens
gugaaugcauuaagaaggggga

SEQ ID NO: 118595 - RNA, 22 nt, Homo sapiens
gugacacuggagcuggcacaau

SEQ ID NO: 118596 - RNA, 22 nt, Homo sapiens
gugaccaaagauagcucaaguu

SEQ ID NO: 118597 - RNA, 22 nt, Homo sapiens
gugagcacugaaagaaggcaag

SEQ ID NO: 118598 - RNA, 22 nt, Homo sapiens
gugagucagucuguguagggcu

SEQ ID NO: 118599 - RNA, 22 nt, Homo sapiens
gugcacaacaugcaguuuuguu

SEQ ID NO: 118600 - RNA, 22 nt, Homo sapiens
gugcacaacgugcaaguuuguu

SEQ ID NO: 118601 - RNA, 22 nt, Homo sapiens
gugcacaucuguguuccagcua

SEQ ID NO: 118602 - RNA, 22 nt, Homo sapiens
gugcauacucuggagacauugu

SEQ ID NO: 118603 - RNA, 23 nt, Homo sapiens
gugccuucugagccuagucucca

SEQ ID NO: 118604 - RNA, 22 nt, Homo sapiens
guggaaaauuauugcuguuuuu

SEQ ID NO: 118605 - RNA, 22 nt, Homo sapiens
guggcaaacucagcaugcccca

SEQ ID NO: 118606 - RNA, 22 nt, Homo sapiens
guggcaagaauguacaaaaggu

SEQ ID NO: 118607 - RNA, 22 nt, Homo sapiens
guggcaaggaaaugcugcucac

SEQ ID NO: 118608 - RNA, 22 nt, Homo sapiens
guggcaaguguuccaagaggcg

SEQ ID NO: 118609 - RNA, 22 nt, Homo sapiens
gugggaagcuggaacucccucc

SEQ ID NO: 118610 - RNA, 22 nt, Homo sapiens
gugguuguuggaguggcaauuu

SEQ ID NO: 118611 - RNA, 22 nt, Homo sapiens
guguagagaaauagccugaagg

SEQ ID NO: 118612 - RNA, 22 nt, Homo sapiens
gugucacuguugagaaguccac

SEQ ID NO: 118613 - RNA, 22 nt, Homo sapiens
gugucaugggcauguccuuaac

SEQ ID NO: 118614 - RNA, 22 nt, Homo sapiens
gugucccagugugcauacaggu

SEQ ID NO: 118615 - RNA, 22 nt, Homo sapiens
gugugcaacuuucauuaauauu

SEQ ID NO: 118616 - RNA, 22 nt, Homo sapiens
guuaagaaguguaacuuaaguu

SEQ ID NO: 118617 - RNA, 22 nt, Homo sapiens
guuauuguccauuuauuuagca

SEQ ID NO: 118618 - RNA, 20 nt, Homo sapiens
guucauguaauuaguucagg

SEQ ID NO: 118619 - RNA, 22 nt, Homo sapiens
guugcugagucccaucaccaga

SEQ ID NO: 118620 - RNA, 22 nt, Homo sapiens
guuggaauuaaaaggcaaguau

SEQ ID NO: 118621 - RNA, 22 nt, Homo sapiens
guuuacagucgacuugggaaua

SEQ ID NO: 118622 - RNA, 22 nt, Homo sapiens
guuuuuggggucacuauuaccg

SEQ ID NO: 118623 - RNA, 22 nt, Homo sapiens
uaaagccauugucaaguuugua

SEQ ID NO: 118624 - RNA, 22 nt, Homo sapiens
ucccuagacuccugccuuucag

SEQ ID NO: 118625 - RNA, 22 nt, Homo sapiens
ucccugagugauugaaaauaaa

SEQ ID NO: 118626 - RNA, 19 nt, Homo sapiens
ucccuuuguagguaaccug

SEQ ID NO: 118627 - RNA, 22 nt, Homo sapiens
uccuuuaguuaauaaagacaag

SEQ ID NO: 118628 - RNA, 22 nt, Homo sapiens
ucuacagccaguucaggaagaa

SEQ ID NO: 118629 - RNA, 22 nt, Homo sapiens
ucucaguuuucaagcugucgau

SEQ ID NO: 118630 - RNA, 22 nt, Homo sapiens
ucucauagaggcagagaguaaa

SEQ ID NO: 118631 - RNA, 22 nt, Homo sapiens
ucucugacacugaccccaaaaa

SEQ ID NO: 118632 - RNA, 22 nt, Homo sapiens
ucugagaucaugucugugcugu

SEQ ID NO: 118633 - RNA, 22 nt, Homo sapiens
ucugagcaauaaacaacauauu

SEQ ID NO: 118634 - RNA, 22 nt, Homo sapiens
ucugucuuguccucacccuaga

SEQ ID NO: 118635 - RNA, 22 nt, Homo sapiens
ucugugcauggcagaggaauga

SEQ ID NO: 118636 - RNA, 22 nt, Homo sapiens
ucuuaguuuagauuagcaauuc

SEQ ID NO: 118637 - RNA, 22 nt, Homo sapiens
ucuugcuuuugcagagcuucuc

SEQ ID NO: 118638 - RNA, 22 nt, Homo sapiens
ucuuggccaugaauggcaaggc

SEQ ID NO: 118639 - RNA, 22 nt, Homo sapiens
ucuuuguuggaguccaaggaua

SEQ ID NO: 118640 - RNA, 22 nt, Homo sapiens
ugaaacacaccuccucuccauc

SEQ ID NO: 118641 - RNA, 20 nt, Homo sapiens
ugaaacacauggacuggggu

SEQ ID NO: 118642 - RNA, 18 nt, Homo sapiens
ugaaacacauuuuuuccu

SEQ ID NO: 118643 - RNA, 22 nt, Homo sapiens
ugaaacauacacucugaugggg

SEQ ID NO: 118644 - RNA, 22 nt, Homo sapiens
caucagcaauguaugaggguuc

SEQ ID NO: 118645 - RNA, 22 nt, Homo sapiens
caugccacuguggacaaagaca

SEQ ID NO: 118646 - RNA, 22 nt, Homo sapiens
caugucuuuuauucugugugau

SEQ ID NO: 118647 - RNA, 22 nt, Homo sapiens
cauugcaugcauauggcuuggu

SEQ ID NO: 118648 - RNA, 22 nt, Homo sapiens
cauuugguggcuacagaguaac

SEQ ID NO: 118649 - RNA, 22 nt, Homo sapiens
ccaaaguauuuucacugauauc

SEQ ID NO: 118650 - RNA, 23 nt, Homo sapiens
ccacacuguuuagaauggcauca

SEQ ID NO: 118651 - RNA, 22 nt, Homo sapiens
ccacccuuccauucuuccucuu

SEQ ID NO: 118652 - RNA, 22 nt, Homo sapiens
ccagaguuucugauucagcagg

SEQ ID NO: 118653 - RNA, 23 nt, Homo sapiens
ccaguauuuauguaaggaagugu

SEQ ID NO: 118654 - RNA, 22 nt, Homo sapiens
ccagugcauggaucccaggggg

SEQ ID NO: 118655 - RNA, 19 nt, Homo sapiens
ccaguguucugauugcacu

SEQ ID NO: 118656 - RNA, 22 nt, Homo sapiens
ccaguguucuggaaggcugagu

SEQ ID NO: 118657 - RNA, 22 nt, Homo sapiens
ccaguuuucucacuguugcagu

SEQ ID NO: 118658 - RNA, 22 nt, Homo sapiens
cccaguaaucuugccaguuuuc

SEQ ID NO: 118659 - RNA, 22 nt, Homo sapiens
cccagugugcugggugacagcu

SEQ ID NO: 118660 - RNA, 22 nt, Homo sapiens
ccccauuugaacuccuucaacu

SEQ ID NO: 118661 - RNA, 17 nt, Homo sapiens
ccccugagcgaugcagu

SEQ ID NO: 118662 - RNA, 19 nt, Homo sapiens
cccuggcacauggaaaaug

SEQ ID NO: 118663 - RNA, 22 nt, Homo sapiens
ccggguguuuuguucucucaga

SEQ ID NO: 118664 - RNA, 22 nt, Homo sapiens
ccucauggagaacaucugcuag

SEQ ID NO: 118665 - RNA, 22 nt, Homo sapiens
ccuucauccuccagcaggcuag

SEQ ID NO: 118666 - RNA, 22 nt, Homo sapiens
ccuugucacugaguggaaugaa

SEQ ID NO: 118667 - RNA, 22 nt, Homo sapiens
cgcuggugaucuagacccccaa

SEQ ID NO: 118668 - RNA, 16 nt, Homo sapiens
cuaaaaugucuacuug

SEQ ID NO: 118669 - RNA, 22 nt, Homo sapiens
cuaaagugcuuaaaaucucauu

SEQ ID NO: 118670 - RNA, 22 nt, Homo sapiens
cuaacacagagguuuauuucuc

SEQ ID NO: 118671 - RNA, 22 nt, Homo sapiens
cuacagaguaucuaaagaggua

SEQ ID NO: 118672 - RNA, 22 nt, Homo sapiens
cuagaagcauauucagaacaga

SEQ ID NO: 118673 - RNA, 19 nt, Homo sapiens
cuauugcacauagcugaag

SEQ ID NO: 118674 - RNA, 22 nt, Homo sapiens
cucaaagugcugggacuggcug

SEQ ID NO: 118675 - RNA, 22 nt, Homo sapiens
cucacggcccugcgcacuggca

SEQ ID NO: 118676 - RNA, 22 nt, Homo sapiens
cucaggcacucugauuccagug

SEQ ID NO: 118677 - RNA, 22 nt, Homo sapiens
cucaguuuugccuuguuuaagg

SEQ ID NO: 118678 - RNA, 21 nt, Homo sapiens
cucauauugcuuuuccauggu

SEQ ID NO: 118679 - RNA, 22 nt, Homo sapiens
cucccuuugcugaauguuuuuc

SEQ ID NO: 118680 - RNA, 22 nt, Homo sapiens
cucucaagaugcugggauuaca

SEQ ID NO: 118681 - RNA, 22 nt, Homo sapiens
cugaaaguuauucaggggcaag

SEQ ID NO: 118682 - RNA, 22 nt, Homo sapiens
cugaaaucagccaguuaguuuc

SEQ ID NO: 118683 - RNA, 22 nt, Homo sapiens
cugaaauggaaugugugcacag

SEQ ID NO: 118684 - RNA, 22 nt, Homo sapiens
cugagaauguaaaugaagcuuu

SEQ ID NO: 118685 - RNA, 22 nt, Homo sapiens
cugagagaugagaccucucacu

SEQ ID NO: 118686 - RNA, 22 nt, Homo sapiens
cugagaguugaugaaauauggu

SEQ ID NO: 118687 - RNA, 22 nt, Homo sapiens
cugagaucugaaccaggagugu

SEQ ID NO: 118688 - RNA, 22 nt, Homo sapiens
cugaggacaucagggaagcauc

SEQ ID NO: 118689 - RNA, 22 nt, Homo sapiens
cugaggucugaauccagguauc

SEQ ID NO: 118690 - RNA, 22 nt, Homo sapiens
cugagguuguucuucucagugg

SEQ ID NO: 118691 - RNA, 22 nt, Homo sapiens
cugcagaucuuggggcuugcca

SEQ ID NO: 118692 - RNA, 22 nt, Homo sapiens
cugcagucaucugaagauuuug

SEQ ID NO: 118693 - RNA, 22 nt, Homo sapiens
cuggaaagcaaguccauugcuc

SEQ ID NO: 118694 - RNA, 22 nt, Homo sapiens
cuggaaaguagacaaucuaaaa

SEQ ID NO: 118695 - RNA, 22 nt, Homo sapiens
cugggauggaggagaauuagag

SEQ ID NO: 118696 - RNA, 22 nt, Homo sapiens
cugguuguuacaaagagccugg

SEQ ID NO: 118697 - RNA, 22 nt, Homo sapiens
cugguuuguaaaguuccugaga

SEQ ID NO: 118698 - RNA, 22 nt, Homo sapiens
cugucuagagggcacaugaugc

SEQ ID NO: 118699 - RNA, 22 nt, Homo sapiens
cugugauuauauaguuaaggua

SEQ ID NO: 118700 - RNA, 22 nt, Homo sapiens
cugugcuaggcaaugugguaga

SEQ ID NO: 118701 - RNA, 22 nt, Homo sapiens
cuguggguuuuacuguuuuacu

SEQ ID NO: 118702 - RNA, 22 nt, Homo sapiens
cuguugguuaaauuccaugcag

SEQ ID NO: 118703 - RNA, 22 nt, Homo sapiens
cuuccagcuggguucagucagu

SEQ ID NO: 118704 - RNA, 22 nt, Homo sapiens
cuuggacaccucaugcccaccu

SEQ ID NO: 118705 - RNA, 22 nt, Homo sapiens
cuuuacaguuggacucacgagg

SEQ ID NO: 118706 - RNA, 22 nt, Homo sapiens
cuuugugcccuucugcccauca

SEQ ID NO: 118707 - RNA, 22 nt, Homo sapiens
cuuuuggugguucugaugcagg

SEQ ID NO: 118708 - RNA, 22 nt, Homo sapiens
gaaagacuuucugcuguggaua

SEQ ID NO: 118709 - RNA, 22 nt, Homo sapiens
gaaaucucuacuauuuugaucu

SEQ ID NO: 118710 - RNA, 23 nt, Homo sapiens
gaaaugucuuagugaaauugcuu

SEQ ID NO: 118711 - RNA, 22 nt, Homo sapiens
gaaauguugauagugggcauug

SEQ ID NO: 118712 - RNA, 22 nt, Homo sapiens
gaaauguuuuucaugugggcaa

SEQ ID NO: 118713 - RNA, 22 nt, Homo sapiens
gaauacugacuauuucaucugg

SEQ ID NO: 118714 - RNA, 22 nt, Homo sapiens
gaaugcaugaggggaucagaug

SEQ ID NO: 118715 - RNA, 20 nt, Homo sapiens
gacauguugguuugcugcac

SEQ ID NO: 118716 - RNA, 22 nt, Homo sapiens
gacuggcuguuuucuuuauuau

SEQ ID NO: 118717 - RNA, 22 nt, Homo sapiens
gagaacuaaugauguacuaggc

SEQ ID NO: 118718 - RNA, 22 nt, Homo sapiens
gagaacuaaugguuugauaagg

SEQ ID NO: 118719 - RNA, 22 nt, Homo sapiens
gagacugagucucacucuguca

SEQ ID NO: 118720 - RNA, 22 nt, Homo sapiens
gagacugagucuugcucugucg

SEQ ID NO: 118721 - RNA, 22 nt, Homo sapiens
gagaugaagugucaauaaggau

SEQ ID NO: 118722 - RNA, 22 nt, Homo sapiens
gagcacccuuuguugauugcaa

SEQ ID NO: 118723 - RNA, 22 nt, Homo sapiens
gagcuggacuucuuaccuuuuc

SEQ ID NO: 118724 - RNA, 22 nt, Homo sapiens
gaggcagucuguccauucucag

SEQ ID NO: 118725 - RNA, 22 nt, Homo sapiens
ugaaaguaauugcaguuuuuac

SEQ ID NO: 118726 - RNA, 21 nt, Homo sapiens
ugaaaugcaugugcacauuaa

SEQ ID NO: 118727 - RNA, 22 nt, Homo sapiens
ugaaaugcugucuaggggaaau

SEQ ID NO: 118728 - RNA, 22 nt, Homo sapiens
ugaaauuguuugcaaggauagg

SEQ ID NO: 118729 - RNA, 22 nt, Homo sapiens
ugaagagucuaaaucugucuuc

SEQ ID NO: 118730 - RNA, 22 nt, Homo sapiens
ugaagaucuuaggagcugaggg

SEQ ID NO: 118731 - RNA, 22 nt, Homo sapiens
ugaagggcauuguuuugccaaa

SEQ ID NO: 118732 - RNA, 22 nt, Homo sapiens
ugaauagacacuaaagacugua

SEQ ID NO: 118733 - RNA, 22 nt, Homo sapiens
ugaauucuguccaaaauaacug

SEQ ID NO: 118734 - RNA, 21 nt, Homo sapiens
ugacagaaaauugaguuugcu

SEQ ID NO: 118735 - RNA, 17 nt, Homo sapiens
ugacagaaacuuguugu

SEQ ID NO: 118736 - RNA, 22 nt, Homo sapiens
ugacagaggucuuuuaauagcu

SEQ ID NO: 118737 - RNA, 22 nt, Homo sapiens
ugacagugaauaagucucuuaa

SEQ ID NO: 118738 - RNA, 22 nt, Homo sapiens
ugacaguguccuccuccugaga

SEQ ID NO: 118739 - RNA, 20 nt, Homo sapiens
ugacaucagcaauguaauaa

SEQ ID NO: 118740 - RNA, 22 nt, Homo sapiens
ugacaugaugagcaauaauggc

SEQ ID NO: 118741 - RNA, 22 nt, Homo sapiens
ugacuacauaaguaaucucaaa

SEQ ID NO: 118742 - RNA, 22 nt, Homo sapiens
ugacuagacuugcaagguugca

SEQ ID NO: 118743 - RNA, 22 nt, Homo sapiens
ugacucaguuucucagguagua

SEQ ID NO: 118744 - RNA, 20 nt, Homo sapiens
ugacuggauacccuuuggcu

SEQ ID NO: 118745 - RNA, 22 nt, Homo sapiens
ugacuugaaacgugaacagauc

SEQ ID NO: 118746 - RNA, 22 nt, Homo sapiens
ugacuugauccauggggcucca

SEQ ID NO: 118747 - RNA, 22 nt, Homo sapiens
ugacuuuagaauuuuauccaga

SEQ ID NO: 118748 - RNA, 22 nt, Homo sapiens
ugagaacuaaaaugugguauau

SEQ ID NO: 118749 - RNA, 22 nt, Homo sapiens
ugagaacuagagaacaagguga

SEQ ID NO: 118750 - RNA, 22 nt, Homo sapiens
ugagaagugauauagaaguuaa

SEQ ID NO: 118751 - RNA, 22 nt, Homo sapiens
ugagaauauuugaagauguuag

SEQ ID NO: 118752 - RNA, 22 nt, Homo sapiens
ugagagacaguuucgucggagg

SEQ ID NO: 118753 - RNA, 22 nt, Homo sapiens
ugagaguagggguugggauugg

SEQ ID NO: 118754 - RNA, 22 nt, Homo sapiens
ugagauaguuguagauguacau

SEQ ID NO: 118755 - RNA, 22 nt, Homo sapiens
ugagaugaagcuagaagaaugg

SEQ ID NO: 118756 - RNA, 22 nt, Homo sapiens
ugagaugauaucuuauuguaau

SEQ ID NO: 118757 - RNA, 22 nt, Homo sapiens
ugagaugaucaaaguauaggcu

SEQ ID NO: 118758 - RNA, 22 nt, Homo sapiens
ugagauguuuguuucagugccu

SEQ ID NO: 118759 - RNA, 22 nt, Homo sapiens
ugagccauggcaccuugucuaa

SEQ ID NO: 118760 - RNA, 20 nt, Homo sapiens
ugagccccuggacucaagcg

SEQ ID NO: 118761 - RNA, 22 nt, Homo sapiens
ugaggagugagaaauugguuuc

SEQ ID NO: 118762 - RNA, 22 nt, Homo sapiens
ugagggaugcguacccuaugcc

SEQ ID NO: 118763 - RNA, 22 nt, Homo sapiens
ugaguagaacuccuggagaugu

SEQ ID NO: 118764 - RNA, 22 nt, Homo sapiens
ugagugaacgcugagaccaaau

SEQ ID NO: 118765 - RNA, 22 nt, Homo sapiens
ugagugugaggaagaauuagaa

SEQ ID NO: 118766 - RNA, 22 nt, Homo sapiens
ugaguuaauuuuuguaucaugu

SEQ ID NO: 118767 - RNA, 22 nt, Homo sapiens
ugaguucaauuguauuuuauua

SEQ ID NO: 118768 - RNA, 18 nt, Homo sapiens
ugauaucaucacaauuga

SEQ ID NO: 118769 - RNA, 22 nt, Homo sapiens
ugauauguguaaacaauguaua

SEQ ID NO: 118770 - RNA, 20 nt, Homo sapiens
ugauauuucuggaaguggag

SEQ ID NO: 118771 - RNA, 20 nt, Homo sapiens
ugauauuuucugagcaggaa

SEQ ID NO: 118772 - RNA, 21 nt, Homo sapiens
ugaucacaugaaaaccaugca

SEQ ID NO: 118773 - RNA, 22 nt, Homo sapiens
ugaucuguguaacauaggaguc

SEQ ID NO: 118774 - RNA, 22 nt, Homo sapiens
ugaugaaguauaggaagggcuu

SEQ ID NO: 118775 - RNA, 22 nt, Homo sapiens
ugaugacacugauuucuucaau

SEQ ID NO: 118776 - RNA, 22 nt, Homo sapiens
ugauuggagaugaauuucguuu

SEQ ID NO: 118777 - RNA, 22 nt, Homo sapiens
ugcaaauguuaggugucauuau

SEQ ID NO: 118778 - RNA, 22 nt, Homo sapiens
ugcaagauaggcaguuugcacu

SEQ ID NO: 118779 - RNA, 22 nt, Homo sapiens
ugcaauauccucuacuauaggu

SEQ ID NO: 118780 - RNA, 22 nt, Homo sapiens
ugcaaugugaaauaagcacauc

SEQ ID NO: 118781 - RNA, 23 nt, Homo sapiens
ugcaccacuacacacucuugggu

SEQ ID NO: 118782 - RNA, 22 nt, Homo sapiens
ugcagaaucccuucagauccga

SEQ ID NO: 118783 - RNA, 22 nt, Homo sapiens
ugcagcauugcacuccagccug

SEQ ID NO: 118784 - RNA, 22 nt, Homo sapiens
ugcauauucgaguuauuuuggg

SEQ ID NO: 118785 - RNA, 22 nt, Homo sapiens
ugcauccauucuagacucaucu

SEQ ID NO: 118786 - RNA, 22 nt, Homo sapiens
ugcauggaagggagggaaagag

SEQ ID NO: 118787 - RNA, 22 nt, Homo sapiens
ugcauggucauacauggcaccc

SEQ ID NO: 118788 - RNA, 21 nt, Homo sapiens
ugcauugucuugaguuuaaau

SEQ ID NO: 118789 - RNA, 22 nt, Homo sapiens
ugccaagaacauuuucuguuuu

SEQ ID NO: 118790 - RNA, 22 nt, Homo sapiens
ugccaguauuuuauugaagauu

SEQ ID NO: 118791 - RNA, 22 nt, Homo sapiens
ugccaguauuuuauugagcauu

SEQ ID NO: 118792 - RNA, 22 nt, Homo sapiens
ugccaguguugccuuucacuag

SEQ ID NO: 118793 - RNA, 22 nt, Homo sapiens
ugccaguguuuuguugaagauu

SEQ ID NO: 118794 - RNA, 22 nt, Homo sapiens
ugccugagcccagcccuguagu

SEQ ID NO: 118795 - RNA, 22 nt, Homo sapiens
ugcucaccugcugcucaccucc

SEQ ID NO: 118796 - RNA, 21 nt, Homo sapiens
ugcuccauuuucuagccugaa

SEQ ID NO: 118797 - RNA, 22 nt, Homo sapiens
ugcugcuguuguuguuacuagc

SEQ ID NO: 118798 - RNA, 22 nt, Homo sapiens
ugcugguguuuaggaauaagaa

SEQ ID NO: 118799 - RNA, 22 nt, Homo sapiens
ugcuuugguagaaaucuuuggu

SEQ ID NO: 118800 - RNA, 22 nt, Homo sapiens
uggaaaguacugagguccaccu

SEQ ID NO: 118801 - RNA, 22 nt, Homo sapiens
uggaaaguccaagccaaccggg

SEQ ID NO: 118802 - RNA, 22 nt, Homo sapiens
uggaagcauagcagcgugugug

SEQ ID NO: 118803 - RNA, 20 nt, Homo sapiens
uggaagccuggugcuaucuu

SEQ ID NO: 118804 - RNA, 21 nt, Homo sapiens
uggaaucuauuauuccaguuu

SEQ ID NO: 118805 - RNA, 19 nt, Homo sapiens
uggaaugaaauguuagggg

SEQ ID NO: 118806 - RNA, 22 nt, Homo sapiens
uggaaugucuauguuuuugauu

SEQ ID NO: 118807 - RNA, 22 nt, Homo sapiens
uggaauuuagguugauaguaua

SEQ ID NO: 118808 - RNA, 22 nt, Homo sapiens
ucuauggaguuugaaugagaaa

SEQ ID NO: 118809 - RNA, 22 nt, Homo sapiens
ucuauguuuuugcuaguagugu

SEQ ID NO: 118810 - RNA, 22 nt, Homo sapiens
ucucaguguuaucuaucugccu

SEQ ID NO: 118811 - RNA, 17 nt, Homo sapiens
ucucccaucccuuucuc

SEQ ID NO: 118812 - RNA, 22 nt, Homo sapiens
ucucccauccguacacggauug

SEQ ID NO: 118813 - RNA, 22 nt, Homo sapiens
ucugacucuggagucucagguu

SEQ ID NO: 118814 - RNA, 22 nt, Homo sapiens
ucugccuacugguuggaggaac

SEQ ID NO: 118815 - RNA, 20 nt, Homo sapiens
ucuggccccucuaaaucuca

SEQ ID NO: 118816 - RNA, 22 nt, Homo sapiens
ucugguggugaugagagacagu

SEQ ID NO: 118817 - RNA, 22 nt, Homo sapiens
ucugugaaaucauuuccuguaa

SEQ ID NO: 118818 - RNA, 22 nt, Homo sapiens
ucugugaaugaacacuugaaaa

SEQ ID NO: 118819 - RNA, 22 nt, Homo sapiens
ucugugaaugugaccuuauuug

SEQ ID NO: 118820 - RNA, 19 nt, Homo sapiens
ucugugcuugucccccugu

SEQ ID NO: 118821 - RNA, 22 nt, Homo sapiens
ucugugguuguugcauggaaug

SEQ ID NO: 118822 - RNA, 22 nt, Homo sapiens
ucuguguugaugcucauuaauu

SEQ ID NO: 118823 - RNA, 22 nt, Homo sapiens
ucuuaggugaugauugauguga

SEQ ID NO: 118824 - RNA, 17 nt, Homo sapiens
ucuucuguuacuguggc

SEQ ID NO: 118825 - RNA, 22 nt, Homo sapiens
acuagguaguaaucugcagaga

SEQ ID NO: 118826 - RNA, 22 nt, Homo sapiens
acucagagaacauucccagucu

SEQ ID NO: 118827 - RNA, 22 nt, Homo sapiens
acugcacuccagccuuggagac

SEQ ID NO: 118828 - RNA, 22 nt, Homo sapiens
acugcauaaauauguguaauau

SEQ ID NO: 118829 - RNA, 22 nt, Homo sapiens
acuggcaauggcagaaauaguu

SEQ ID NO: 118830 - RNA, 20 nt, Homo sapiens
acugggcuaccgaaguaagg

SEQ ID NO: 118831 - RNA, 22 nt, Homo sapiens
acugggucaaaguagaaaacua

SEQ ID NO: 118832 - RNA, 22 nt, Homo sapiens
agaaaugcagcaugaggcggca

SEQ ID NO: 118833 - RNA, 19 nt, Homo sapiens
agaagugcauggucuagag

SEQ ID NO: 118834 - RNA, 22 nt, Homo sapiens
agaaugucagcuggauucagcu

SEQ ID NO: 118835 - RNA, 22 nt, Homo sapiens
agacagcuggaguaucauagcu

SEQ ID NO: 118836 - RNA, 22 nt, Homo sapiens
agacucauuuccauagucagcu

SEQ ID NO: 118837 - RNA, 22 nt, Homo sapiens
agagcacuguggguccaaauau

SEQ ID NO: 118838 - RNA, 22 nt, Homo sapiens
agaugguguuuucucaccagau

SEQ ID NO: 118839 - RNA, 22 nt, Homo sapiens
agcagcuuugcauggccuguga

SEQ ID NO: 118840 - RNA, 22 nt, Homo sapiens
agcccauuuugcacugagaugc

SEQ ID NO: 118841 - RNA, 17 nt, Homo sapiens
agccccauuagcuaguu

SEQ ID NO: 118842 - RNA, 22 nt, Homo sapiens
agcgccacugcacuccagccug

SEQ ID NO: 118843 - RNA, 22 nt, Homo sapiens
agcgccauugcacuccagccuu

SEQ ID NO: 118844 - RNA, 22 nt, Homo sapiens
agcuccauuguaaucaccuggu

SEQ ID NO: 118845 - RNA, 22 nt, Homo sapiens
agcugauuuuaaguccuugucc

SEQ ID NO: 118846 - RNA, 22 nt, Homo sapiens
agcugcacgugguaaauguaaa

SEQ ID NO: 118847 - RNA, 22 nt, Homo sapiens
agcugccagucuuguaaggccu

SEQ ID NO: 118848 - RNA, 22 nt, Homo sapiens
agcuggcuguagcugcaagucu

SEQ ID NO: 118849 - RNA, 22 nt, Homo sapiens
agcugguauuuugucgaggacu

SEQ ID NO: 118850 - RNA, 22 nt, Homo sapiens
agcuucauuguuaugaauguca

SEQ ID NO: 118851 - RNA, 22 nt, Homo sapiens
aggaagacauauagaacuaaaa

SEQ ID NO: 118852 - RNA, 22 nt, Homo sapiens
aggaagguaaacuaacuugccu

SEQ ID NO: 118853 - RNA, 22 nt, Homo sapiens
aggaauggaaacuuuugauggu

SEQ ID NO: 118854 - RNA, 22 nt, Homo sapiens
aggagaucagccucccugcaac

SEQ ID NO: 118855 - RNA, 22 nt, Homo sapiens
aggcaagugggagacagcauuu

SEQ ID NO: 118856 - RNA, 22 nt, Homo sapiens
aggcagcuguuauauacugagu

SEQ ID NO: 118857 - RNA, 22 nt, Homo sapiens
aggcaugaaauacaugcauuga

SEQ ID NO: 118858 - RNA, 22 nt, Homo sapiens
aggcaugaguucagaggguaug

SEQ ID NO: 118859 - RNA, 22 nt, Homo sapiens
aggugcugagcagagaauccug

SEQ ID NO: 118860 - RNA, 22 nt, Homo sapiens
aggugcuugagggaagaaauua

SEQ ID NO: 118861 - RNA, 22 nt, Homo sapiens
agucaagaugagauuugggugg

SEQ ID NO: 118862 - RNA, 22 nt, Homo sapiens
agucacaugcauuuucuucaau

SEQ ID NO: 118863 - RNA, 22 nt, Homo sapiens
agucagugcauaagaaugaagu

SEQ ID NO: 118864 - RNA, 22 nt, Homo sapiens
agugcaguggcucaaaaugccu

SEQ ID NO: 118865 - RNA, 22 nt, Homo sapiens
agugcaguugucacgugccuuc

SEQ ID NO: 118866 - RNA, 22 nt, Homo sapiens
aguggcaaugugauguccugaa

SEQ ID NO: 118867 - RNA, 22 nt, Homo sapiens
aguggcacuauucucagaguca

SEQ ID NO: 118868 - RNA, 22 nt, Homo sapiens
agugucaggagacagguagcug

SEQ ID NO: 118869 - RNA, 21 nt, Homo sapiens
aguucacauggcuccuguguu

SEQ ID NO: 118870 - RNA, 22 nt, Homo sapiens
auacaguaaugucuuaggcugu

SEQ ID NO: 118871 - RNA, 22 nt, Homo sapiens
auacauguucaagggcauauau

SEQ ID NO: 118872 - RNA, 22 nt, Homo sapiens
auacuguuucugaacuuugauu

SEQ ID NO: 118873 - RNA, 22 nt, Homo sapiens
auagaagcugccaacguuucag

SEQ ID NO: 118874 - RNA, 22 nt, Homo sapiens
auagcauaucccacaugucaga

SEQ ID NO: 118875 - RNA, 22 nt, Homo sapiens
auagcaucauuucuugaaaaga

SEQ ID NO: 118876 - RNA, 22 nt, Homo sapiens
auaguagcaugaaacagccauu

SEQ ID NO: 118877 - RNA, 22 nt, Homo sapiens
auagugaacuuugugagaacaa

SEQ ID NO: 118878 - RNA, 22 nt, Homo sapiens
auauaugcuaagugcuaauaaa

SEQ ID NO: 118879 - RNA, 22 nt, Homo sapiens
auaucacaaacaagucuguacu

SEQ ID NO: 118880 - RNA, 22 nt, Homo sapiens
auaucagugucuuacuguuuuu

SEQ ID NO: 118881 - RNA, 17 nt, Homo sapiens
auaugaauuuuggagau

SEQ ID NO: 118882 - RNA, 22 nt, Homo sapiens
aucaccauguguacauuagacc

SEQ ID NO: 118883 - RNA, 22 nt, Homo sapiens
aucagaaucucuagugggacca

SEQ ID NO: 118884 - RNA, 22 nt, Homo sapiens
aucagauggcuaaaacagaaga

SEQ ID NO: 118885 - RNA, 22 nt, Homo sapiens
auccacagugucaauguuguga

SEQ ID NO: 118886 - RNA, 22 nt, Homo sapiens
auccaguuuuaggagauuucua

SEQ ID NO: 118887 - RNA, 22 nt, Homo sapiens
aucccaguaaaaauggcuucua

SEQ ID NO: 118888 - RNA, 22 nt, Homo sapiens
aucccugagaacuuuuaauguu

SEQ ID NO: 118889 - RNA, 22 nt, Homo sapiens
auccugagacuuugcugaaguu

SEQ ID NO: 118890 - RNA, 22 nt, Homo sapiens
auccuguagagaugagggugga

SEQ ID NO: 118891 - RNA, 22 nt, Homo sapiens
aucucaguucaggcuggccaca

SEQ ID NO: 118892 - RNA, 22 nt, Homo sapiens
aucugugaaugaaguuauuuug

SEQ ID NO: 118893 - RNA, 22 nt, Homo sapiens
aucuuguguugaauggugcaga

SEQ ID NO: 118894 - RNA, 22 nt, Homo sapiens
augaaagguugucuuaagccau

SEQ ID NO: 118895 - RNA, 22 nt, Homo sapiens
augaaaugcauguuaaguccgu

SEQ ID NO: 118896 - RNA, 18 nt, Homo sapiens
augaagucaucacuuuua

SEQ ID NO: 118897 - RNA, 22 nt, Homo sapiens
augacagugagugagcucucac

SEQ ID NO: 118898 - RNA, 22 nt, Homo sapiens
augacaguguggauuauuguaa

SEQ ID NO: 118899 - RNA, 22 nt, Homo sapiens
augacauguauuuccaggauuu

SEQ ID NO: 118900 - RNA, 22 nt, Homo sapiens
augacugucagggcagucauug

SEQ ID NO: 118901 - RNA, 22 nt, Homo sapiens
augagauacuacaaaugaguuu

SEQ ID NO: 118902 - RNA, 22 nt, Homo sapiens
augagauauuuuauaagaucau

SEQ ID NO: 118903 - RNA, 22 nt, Homo sapiens
augagauuguuugugugaaaua

SEQ ID NO: 118904 - RNA, 22 nt, Homo sapiens
augaggugaggucaguaaggua

SEQ ID NO: 118905 - RNA, 22 nt, Homo sapiens
augaggugauaucuggaaauua

SEQ ID NO: 118906 - RNA, 22 nt, Homo sapiens
augaggugggagaaucacuuga

SEQ ID NO: 118907 - RNA, 21 nt, Homo sapiens
augagguguacuguggugaaa

SEQ ID NO: 118908 - RNA, 20 nt, Homo sapiens
augagguguaugacacugaa

SEQ ID NO: 118909 - RNA, 22 nt, Homo sapiens
augauaaguuauuagaagaaga

SEQ ID NO: 118910 - RNA, 22 nt, Homo sapiens
augauagucuugagaagcauuu

SEQ ID NO: 118911 - RNA, 22 nt, Homo sapiens
augauggaggccgugauggacg

SEQ ID NO: 118912 - RNA, 22 nt, Homo sapiens
augauggagguagauuguccau

SEQ ID NO: 118913 - RNA, 22 nt, Homo sapiens
augcacuguuuucuugaugaga

SEQ ID NO: 118914 - RNA, 22 nt, Homo sapiens
augcagcugaggguaguggagc

SEQ ID NO: 118915 - RNA, 22 nt, Homo sapiens
augcauagcaucugcaaauguu

SEQ ID NO: 118916 - RNA, 18 nt, Homo sapiens
augcauauuuuaaguugu

SEQ ID NO: 118917 - RNA, 22 nt, Homo sapiens
augcauauuuuaccuagaagag

SEQ ID NO: 118918 - RNA, 22 nt, Homo sapiens
augcauggagucuuucacaagu

SEQ ID NO: 118919 - RNA, 20 nt, Homo sapiens
augccacugagcagugguga

SEQ ID NO: 118920 - RNA, 19 nt, Homo sapiens
augccucaguuuuguacuu

SEQ ID NO: 118921 - RNA, 22 nt, Homo sapiens
auggaaagcuguuccuacacaa

SEQ ID NO: 118922 - RNA, 22 nt, Homo sapiens
auggacagacacuggccuucug

SEQ ID NO: 118923 - RNA, 22 nt, Homo sapiens
auggaucuuucugcuuuugaau

SEQ ID NO: 118924 - RNA, 22 nt, Homo sapiens
auggcaauaauagcuaccauuu

SEQ ID NO: 118925 - RNA, 22 nt, Homo sapiens
auggcaauaugaugcacuguuu

SEQ ID NO: 118926 - RNA, 22 nt, Homo sapiens
auggcacuccagccugggcaac

SEQ ID NO: 118927 - RNA, 22 nt, Homo sapiens
cuaaaguauugagugguaaaga

SEQ ID NO: 118928 - RNA, 22 nt, Homo sapiens
cuaacaacacagcagauuagaa

SEQ ID NO: 118929 - RNA, 22 nt, Homo sapiens
cuaacacagggcaagucaggcu

SEQ ID NO: 118930 - RNA, 22 nt, Homo sapiens
cuaaugcagucaggagaaggaa

SEQ ID NO: 118931 - RNA, 22 nt, Homo sapiens
cuacagcagcccaguccccgaa

SEQ ID NO: 118932 - RNA, 22 nt, Homo sapiens
cuagaagguaagagcuggaugc

SEQ ID NO: 118933 - RNA, 22 nt, Homo sapiens
cuaucucaggcccaggcccuug

SEQ ID NO: 118934 - RNA, 18 nt, Homo sapiens
cuaugccacuuuauauca

SEQ ID NO: 118935 - RNA, 22 nt, Homo sapiens
cuauuagguuggggcgaaagua

SEQ ID NO: 118936 - RNA, 20 nt, Homo sapiens
cucacagacagcuucuuucu

SEQ ID NO: 118937 - RNA, 22 nt, Homo sapiens
cucacggugcaggcuucuggga

SEQ ID NO: 118938 - RNA, 22 nt, Homo sapiens
cucacugucaacauguauuugg

SEQ ID NO: 118939 - RNA, 22 nt, Homo sapiens
cucacugugguguccuuaggua

SEQ ID NO: 118940 - RNA, 22 nt, Homo sapiens
cucauggagaaccucugcuagg

SEQ ID NO: 118941 - RNA, 19 nt, Homo sapiens
cucauggagaaggagaaua

SEQ ID NO: 118942 - RNA, 22 nt, Homo sapiens
cuccacugagcaggugggaggc

SEQ ID NO: 118943 - RNA, 22 nt, Homo sapiens
cuccccuuuaguuucuuaauaa

SEQ ID NO: 118944 - RNA, 22 nt, Homo sapiens
cucccugagccagggcuuugac

SEQ ID NO: 118945 - RNA, 21 nt, Homo sapiens
cucucugcuuaugaauaguga

SEQ ID NO: 118946 - RNA, 20 nt, Homo sapiens
cucugguugugaauugucuu

SEQ ID NO: 118947 - RNA, 19 nt, Homo sapiens
cugaaacacagagagggcu

SEQ ID NO: 118948 - RNA, 22 nt, Homo sapiens
cugaaaugaauuauuuucuuuc

SEQ ID NO: 118949 - RNA, 22 nt, Homo sapiens
cugacugaggaucaguucauca

SEQ ID NO: 118950 - RNA, 22 nt, Homo sapiens
cugagaacaucauucagauauu

SEQ ID NO: 118951 - RNA, 22 nt, Homo sapiens
cugagaaugaugauuuccaguu

SEQ ID NO: 118952 - RNA, 22 nt, Homo sapiens
cugagacacucuuaucugcaua

SEQ ID NO: 118953 - RNA, 22 nt, Homo sapiens
cugagaucguggggcugcuguc

SEQ ID NO: 118954 - RNA, 22 nt, Homo sapiens
cugagcacugagauccucuagc

SEQ ID NO: 118955 - RNA, 18 nt, Homo sapiens
cugagcacugcuuuauga

SEQ ID NO: 118956 - RNA, 20 nt, Homo sapiens
cugagguugggguccuuccc

SEQ ID NO: 118957 - RNA, 18 nt, Homo sapiens
cugagucauuccuggguc

SEQ ID NO: 118958 - RNA, 22 nt, Homo sapiens
cugauuguuugccucuaaaauc

SEQ ID NO: 118959 - RNA, 18 nt, Homo sapiens
cugccagugugcucuccg

SEQ ID NO: 118960 - RNA, 22 nt, Homo sapiens
cuggaaagaaacccuuaauucu

SEQ ID NO: 118961 - RNA, 22 nt, Homo sapiens
cuggaauguuccuaaagauuca

SEQ ID NO: 118962 - RNA, 22 nt, Homo sapiens
cuggacaaaucuggaaagaacc

SEQ ID NO: 118963 - RNA, 22 nt, Homo sapiens
cuggcaaauguuuucuguaaag

SEQ ID NO: 118964 - RNA, 22 nt, Homo sapiens
cuggcaagagugaaccagcugu

SEQ ID NO: 118965 - RNA, 22 nt, Homo sapiens
cuggcagucugccucuucacug

SEQ ID NO: 118966 - RNA, 22 nt, Homo sapiens
cuggcucuguuagaagaaccag

SEQ ID NO: 118967 - RNA, 22 nt, Homo sapiens
cuguaaagaucacagagcuggu

SEQ ID NO: 118968 - RNA, 22 nt, Homo sapiens
cuguaaaguucucauuguagcc

SEQ ID NO: 118969 - RNA, 22 nt, Homo sapiens
cugucacugggaggggcagcag

SEQ ID NO: 118970 - RNA, 22 nt, Homo sapiens
cugucuggaggccugcaaauaa

SEQ ID NO: 118971 - RNA, 22 nt, Homo sapiens
cugucuggaguccuucgugugc

SEQ ID NO: 118972 - RNA, 22 nt, Homo sapiens
cugugacugcagggcauauuug

SEQ ID NO: 118973 - RNA, 22 nt, Homo sapiens
cugugcacaucuggcggcccga

SEQ ID NO: 118974 - RNA, 19 nt, Homo sapiens
cugugcauuucuguggaag

SEQ ID NO: 118975 - RNA, 22 nt, Homo sapiens
cugugccaagcuugcgaugugc

SEQ ID NO: 118976 - RNA, 22 nt, Homo sapiens
cuguuagguuaaggaauggcaa

SEQ ID NO: 118977 - RNA, 22 nt, Homo sapiens
cuucaugucuucaauggggggg

SEQ ID NO: 118978 - RNA, 22 nt, Homo sapiens
cuuccauauucuaggacaggcu

SEQ ID NO: 118979 - RNA, 22 nt, Homo sapiens
cuucucagugcucaucuuauuu

SEQ ID NO: 118980 - RNA, 22 nt, Homo sapiens
cuucugauugaaaauggaguag

SEQ ID NO: 118981 - RNA, 22 nt, Homo sapiens
cuucuguuaguucugauaacuu

SEQ ID NO: 118982 - RNA, 22 nt, Homo sapiens
cuugggcagugugcauguguau

SEQ ID NO: 118983 - RNA, 18 nt, Homo sapiens
cuugucaaaucuuuccuc

SEQ ID NO: 118984 - RNA, 22 nt, Homo sapiens
cuuucugaggagaauagagaac

SEQ ID NO: 118985 - RNA, 22 nt, Homo sapiens
cuuugggaccgcgguuuauacu

SEQ ID NO: 118986 - RNA, 22 nt, Homo sapiens
cuuugguuaauaggauauggca

SEQ ID NO: 118987 - RNA, 21 nt, Homo sapiens
cuuugguuucugacuugcaua

SEQ ID NO: 118988 - RNA, 22 nt, Homo sapiens
cuuuuggugugaagaagcucuu

SEQ ID NO: 118989 - RNA, 22 nt, Homo sapiens
cuuuugugauucuucaguuacu

SEQ ID NO: 118990 - RNA, 22 nt, Homo sapiens
gaaaugcucagggguuuuccag

SEQ ID NO: 118991 - RNA, 22 nt, Homo sapiens
gaaaugucugagauguggcuca

SEQ ID NO: 118992 - RNA, 22 nt, Homo sapiens
gaacccuggaggcggagguugc

SEQ ID NO: 118993 - RNA, 22 nt, Homo sapiens
gaagacauuuacaugggagacc

SEQ ID NO: 118994 - RNA, 22 nt, Homo sapiens
gaaggcaugcugcauggccaga

SEQ ID NO: 118995 - RNA, 22 nt, Homo sapiens
gaauagugcugcaauaaacaua

SEQ ID NO: 118996 - RNA, 22 nt, Homo sapiens
gaaugcagcagugacagggcug

SEQ ID NO: 118997 - RNA, 18 nt, Homo sapiens
gacaguguggugauuccu

SEQ ID NO: 118998 - RNA, 22 nt, Homo sapiens
gacauguuuacaguguugagag

SEQ ID NO: 118999 - RNA, 22 nt, Homo sapiens
gacauguuucucucuguuuacu

SEQ ID NO: 119000 - RNA, 22 nt, Homo sapiens
gacauguuuucaagauuuauaa

SEQ ID NO: 119001 - RNA, 22 nt, Homo sapiens
gacauguuuuuuaagguuuaug

SEQ ID NO: 119002 - RNA, 22 nt, Homo sapiens
gacuagggaaaauuauuuuguu

SEQ ID NO: 119003 - RNA, 22 nt, Homo sapiens
gacuuagagauguuguauuugg

SEQ ID NO: 119004 - RNA, 22 nt, Homo sapiens
gagaacugagugugcuggcgga

SEQ ID NO: 119005 - RNA, 22 nt, Homo sapiens
gagacugagucucgcucugccg

SEQ ID NO: 119006 - RNA, 22 nt, Homo sapiens
gagagugaaguuugcuaccugu

SEQ ID NO: 119007 - RNA, 22 nt, Homo sapiens
gagauuaauacacaucaaaugc

SEQ ID NO: 119008 - RNA, 22 nt, Homo sapiens
gagcccauuucacuuguccagc

SEQ ID NO: 119009 - RNA, 22 nt, Homo sapiens
gagcucaccuuaccucuggagc

SEQ ID NO: 119010 - RNA, 22 nt, Homo sapiens
gaggaguauuuugucgaauguc

SEQ ID NO: 119011 - RNA, 22 nt, Homo sapiens
gagggcacugcuuuccuuucaa

SEQ ID NO: 119012 - RNA, 22 nt, Homo sapiens
gagguggugguggaggcauagc

SEQ ID NO: 119013 - RNA, 22 nt, Homo sapiens
gaguaaaugucaaguacuuagg

SEQ ID NO: 119014 - RNA, 22 nt, Homo sapiens
gagucagugucuugcucuguca

SEQ ID NO: 119015 - RNA, 22 nt, Homo sapiens
gagugcaauggcaagaucuugg

SEQ ID NO: 119016 - RNA, 18 nt, Homo sapiens
gaguggugcuucccuugu

SEQ ID NO: 119017 - RNA, 22 nt, Homo sapiens
gauaaagauagcaauagggaca

SEQ ID NO: 119018 - RNA, 22 nt, Homo sapiens
gaugaggcuagagacaugugua

SEQ ID NO: 119019 - RNA, 22 nt, Homo sapiens
gauggauuuuaagugaaugaaa

SEQ ID NO: 119020 - RNA, 22 nt, Homo sapiens
gauggcacuuaagagcaagagc

SEQ ID NO: 119021 - RNA, 22 nt, Homo sapiens
gcaaaguguuuuccaacuuggu

SEQ ID NO: 119022 - RNA, 22 nt, Homo sapiens
gcaaaugcuacaccauuuugua

SEQ ID NO: 119023 - RNA, 22 nt, Homo sapiens
gcaagaguauuucaaggaagau

SEQ ID NO: 119024 - RNA, 22 nt, Homo sapiens
gcaaggacucccugggucauuc

SEQ ID NO: 119025 - RNA, 22 nt, Homo sapiens
gcacacuuacacgaaccuagau

SEQ ID NO: 119026 - RNA, 22 nt, Homo sapiens
gcagaguauagagggcugggcc

SEQ ID NO: 119027 - RNA, 22 nt, Homo sapiens
gcaggcaugacauuucacucuu

SEQ ID NO: 119028 - RNA, 22 nt, Homo sapiens
gcaguguucugggcaggaagaa

SEQ ID NO: 119029 - RNA, 21 nt, Homo sapiens
aaacuggcccaauuguuccau

SEQ ID NO: 119030 - RNA, 22 nt, Homo sapiens
aaagaagucagccuguccuuug

SEQ ID NO: 119031 - RNA, 22 nt, Homo sapiens
aaagcugucaaggcaggaggcu

SEQ ID NO: 119032 - RNA, 22 nt, Homo sapiens
aaaggaccacauauaugguggc

SEQ ID NO: 119033 - RNA, 22 nt, Homo sapiens
aaaggauucuaauggaaaugcu

SEQ ID NO: 119034 - RNA, 22 nt, Homo sapiens
aaagucuguuuugucagagacu

SEQ ID NO: 119035 - RNA, 22 nt, Homo sapiens
aaagugaauguaucccguaagu

SEQ ID NO: 119036 - RNA, 22 nt, Homo sapiens
aaagugcacuuggaagagggcc

SEQ ID NO: 119037 - RNA, 22 nt, Homo sapiens
aaagugcaguacuucguauauu

SEQ ID NO: 119038 - RNA, 22 nt, Homo sapiens
aaaguucuguugauagugcuga

SEQ ID NO: 119039 - RNA, 22 nt, Homo sapiens
aaauaguagcugaaugagggaa

SEQ ID NO: 119040 - RNA, 22 nt, Homo sapiens
aaaugcagauuccuaggcccca

SEQ ID NO: 119041 - RNA, 22 nt, Homo sapiens
aaaugcaugaauaagcucgugu

SEQ ID NO: 119042 - RNA, 22 nt, Homo sapiens
aaaugcucuguggguaguaaug

SEQ ID NO: 119043 - RNA, 22 nt, Homo sapiens
aaaugcuguuccaggaccuauc

SEQ ID NO: 119044 - RNA, 22 nt, Homo sapiens
aaauggcuuuuugggcaaggug

SEQ ID NO: 119045 - RNA, 22 nt, Homo sapiens
aaauugcaaugcgaggcagagg

SEQ ID NO: 119046 - RNA, 22 nt, Homo sapiens
aacaguaucuaacgagugauga

SEQ ID NO: 119047 - RNA, 22 nt, Homo sapiens
aacagugcauucagggauauau

SEQ ID NO: 119048 - RNA, 21 nt, Homo sapiens
aacagugcugaacagacaccu

SEQ ID NO: 119049 - RNA, 22 nt, Homo sapiens
aacagugcuguuauaaauguac

SEQ ID NO: 119050 - RNA, 22 nt, Homo sapiens
aagagcauuauuuaguaauuuc

SEQ ID NO: 119051 - RNA, 22 nt, Homo sapiens
aagaggcuguaggauaaugccu

SEQ ID NO: 119052 - RNA, 22 nt, Homo sapiens
aagaugcagucauacuggagua

SEQ ID NO: 119053 - RNA, 22 nt, Homo sapiens
aagcugccaggcaugguggcug

SEQ ID NO: 119054 - RNA, 22 nt, Homo sapiens
aaggagugugauucuucaguuu

SEQ ID NO: 119055 - RNA, 22 nt, Homo sapiens
aaggcaauuuguugugaggauu

SEQ ID NO: 119056 - RNA, 22 nt, Homo sapiens
aaggcuauuugagaaugugugu

SEQ ID NO: 119057 - RNA, 22 nt, Homo sapiens
aagggaaugcuuccaguuugug

SEQ ID NO: 119058 - RNA, 22 nt, Homo sapiens
aagggaaugugguagcugguuu

SEQ ID NO: 119059 - RNA, 22 nt, Homo sapiens
aagggaauguuguagcugguuu

SEQ ID NO: 119060 - RNA, 22 nt, Homo sapiens
aaggucauugugguuuuugcca

SEQ ID NO: 119061 - RNA, 22 nt, Homo sapiens
aagugcaaauucccaggcucug

SEQ ID NO: 119062 - RNA, 22 nt, Homo sapiens
aagugcuuuacacaugcaugau

SEQ ID NO: 119063 - RNA, 21 nt, Homo sapiens
aauaaagcaaccuuaugccau

SEQ ID NO: 119064 - RNA, 22 nt, Homo sapiens
aauaagaaguggaagggaccgg

SEQ ID NO: 119065 - RNA, 22 nt, Homo sapiens
aauaaugucacaggggguuagc

SEQ ID NO: 119066 - RNA, 22 nt, Homo sapiens
aauagcuguccuuagaagugug

SEQ ID NO: 119067 - RNA, 22 nt, Homo sapiens
aauauguccuugaaauggugcu

SEQ ID NO: 119068 - RNA, 22 nt, Homo sapiens
aaucaacauuguuuuaagucaa

SEQ ID NO: 119069 - RNA, 22 nt, Homo sapiens
aaucacauugaaucugcuaccu

SEQ ID NO: 119070 - RNA, 22 nt, Homo sapiens
aaucacuaugccaugaaguaca

SEQ ID NO: 119071 - RNA, 22 nt, Homo sapiens
aaugaaguuagauguugagaag

SEQ ID NO: 119072 - RNA, 22 nt, Homo sapiens
aaugcacauauauuuccuuauu

SEQ ID NO: 119073 - RNA, 22 nt, Homo sapiens
aaugcuguucuuugcuuaaguu

SEQ ID NO: 119074 - RNA, 22 nt, Homo sapiens
aauggcacaagaguaaacuguu

SEQ ID NO: 119075 - RNA, 22 nt, Homo sapiens
aaugucacugugguccuccagu

SEQ ID NO: 119076 - RNA, 22 nt, Homo sapiens
aaugugcuuucuuucacacagu

SEQ ID NO: 119077 - RNA, 22 nt, Homo sapiens
aauucacuucuuuuaggcaggg

SEQ ID NO: 119078 - RNA, 23 nt, Homo sapiens
aauugcacauuccuugcuggcag

SEQ ID NO: 119079 - RNA, 22 nt, Homo sapiens
aauugcuucuguauuuuggaca

SEQ ID NO: 119080 - RNA, 22 nt, Homo sapiens
acaaagcuagggaauccaucuu

SEQ ID NO: 119081 - RNA, 22 nt, Homo sapiens
acaagacuucuuguauucuagu

SEQ ID NO: 119082 - RNA, 22 nt, Homo sapiens
acacuauugagguuuguuugca

SEQ ID NO: 119083 - RNA, 22 nt, Homo sapiens
acagaauucucagaacugggag

SEQ ID NO: 119084 - RNA, 22 nt, Homo sapiens
acagguacaagggauuaggaug

SEQ ID NO: 119085 - RNA, 22 nt, Homo sapiens
acaguacucugcucuuuugauu

SEQ ID NO: 119086 - RNA, 22 nt, Homo sapiens
acaguacuuuuggauuugugaa

SEQ ID NO: 119087 - RNA, 18 nt, Homo sapiens
acagugcuggcaugagau

SEQ ID NO: 119088 - RNA, 22 nt, Homo sapiens
acagugcuuucaauguucagua

SEQ ID NO: 119089 - RNA, 22 nt, Homo sapiens
acauaugaguacaugugccaug

SEQ ID NO: 119090 - RNA, 19 nt, Homo sapiens
acauggauuuugugcaaac

SEQ ID NO: 119091 - RNA, 22 nt, Homo sapiens
accaccauugcacugaacuuuc

SEQ ID NO: 119092 - RNA, 22 nt, Homo sapiens
accagucucagguaugucuuua

SEQ ID NO: 119093 - RNA, 17 nt, Homo sapiens
accagugcaugugcuuu

SEQ ID NO: 119094 - RNA, 22 nt, Homo sapiens
acccagaauucagucuuaggcc

SEQ ID NO: 119095 - RNA, 21 nt, Homo sapiens
acccccacaccuccuuaguuc

SEQ ID NO: 119096 - RNA, 22 nt, Homo sapiens
acccgggaggcaggagucauag

SEQ ID NO: 119097 - RNA, 22 nt, Homo sapiens
acccugucaaaauagaccaauc

SEQ ID NO: 119098 - RNA, 22 nt, Homo sapiens
acccugucauccacauggugcu

SEQ ID NO: 119099 - RNA, 22 nt, Homo sapiens
accucagcccggggaaguugag

SEQ ID NO: 119100 - RNA, 22 nt, Homo sapiens
acuccacuuucaccacagcgga

SEQ ID NO: 119101 - RNA, 23 nt, Homo sapiens
acugagcaauguuuacauacuug

SEQ ID NO: 119102 - RNA, 22 nt, Homo sapiens
acuuugguuaucauacuuucag

SEQ ID NO: 119103 - RNA, 22 nt, Homo sapiens
agaaacacagguggaauugcuu

SEQ ID NO: 119104 - RNA, 22 nt, Homo sapiens
agacaguguguguauauauggu

SEQ ID NO: 119105 - RNA, 22 nt, Homo sapiens
agacucauuuuuaucgagcaug

SEQ ID NO: 119106 - RNA, 22 nt, Homo sapiens
agagaugauuaacauuuuggua

SEQ ID NO: 119107 - RNA, 22 nt, Homo sapiens
agaguauagcaacuuaguaaaa

SEQ ID NO: 119108 - RNA, 19 nt, Homo sapiens
agaguauuguuacuucucu

SEQ ID NO: 119109 - RNA, 22 nt, Homo sapiens
agagugcaauggcaccaucucg

SEQ ID NO: 119110 - RNA, 23 nt, Homo sapiens
agagugcaauggugccaucucgg

SEQ ID NO: 119111 - RNA, 22 nt, Homo sapiens
agauaugucugcuauuugcugu

SEQ ID NO: 119112 - RNA, 22 nt, Homo sapiens
agcaaaucuaugaauguauauu

SEQ ID NO: 119113 - RNA, 22 nt, Homo sapiens
agcacagugguuaaguuucuua

SEQ ID NO: 119114 - RNA, 22 nt, Homo sapiens
agcaccacaauuuccugccuaa

SEQ ID NO: 119115 - RNA, 17 nt, Homo sapiens
agcaccacacucucuug

SEQ ID NO: 119116 - RNA, 22 nt, Homo sapiens
agcaccauuucucuaaagcacu

SEQ ID NO: 119117 - RNA, 19 nt, Homo sapiens
agcagaacaaauguguggg

SEQ ID NO: 119118 - RNA, 22 nt, Homo sapiens
agcaguguggccuuagacccgg

SEQ ID NO: 119119 - RNA, 21 nt, Homo sapiens
agccaguguuccuuguggcuc

SEQ ID NO: 119120 - RNA, 22 nt, Homo sapiens
agcuauauugaggaugccauuc

SEQ ID NO: 119121 - RNA, 22 nt, Homo sapiens
agcuccaugauaguaugucugu

SEQ ID NO: 119122 - RNA, 22 nt, Homo sapiens
agcuccuacuguuacaucauug

SEQ ID NO: 119123 - RNA, 22 nt, Homo sapiens
agcuccuuucugcagguagguu

SEQ ID NO: 119124 - RNA, 22 nt, Homo sapiens
agcucuuguuaguauuagcagu

SEQ ID NO: 119125 - RNA, 22 nt, Homo sapiens
agcugcaauguuuaguauaaua

SEQ ID NO: 119126 - RNA, 22 nt, Homo sapiens
agcugcauucguaucauauugu

SEQ ID NO: 119127 - RNA, 22 nt, Homo sapiens
uugacugggccagacagagauc

SEQ ID NO: 119128 - RNA, 23 nt, Homo sapiens
uugacuguggguacaaugugaua

SEQ ID NO: 119129 - RNA, 22 nt, Homo sapiens
uugagaaucuuucgaauguucu

SEQ ID NO: 119130 - RNA, 22 nt, Homo sapiens
uugagauggagucucgcacugu

SEQ ID NO: 119131 - RNA, 22 nt, Homo sapiens
uugagauguauguauauaaugu

SEQ ID NO: 119132 - RNA, 22 nt, Homo sapiens
uugagauguggcaguuuaugag

SEQ ID NO: 119133 - RNA, 22 nt, Homo sapiens
uugagcacaggaguuuugagac

SEQ ID NO: 119134 - RNA, 22 nt, Homo sapiens
uugaggacugcuaagcauuuga

SEQ ID NO: 119135 - RNA, 22 nt, Homo sapiens
uugagggagcauuuguuuugag

SEQ ID NO: 119136 - RNA, 22 nt, Homo sapiens
uugauaauguuaacuuugguca

SEQ ID NO: 119137 - RNA, 22 nt, Homo sapiens
uugcacagugcuuucuuugccc

SEQ ID NO: 119138 - RNA, 22 nt, Homo sapiens
uugcacuccagccuggaugaca

SEQ ID NO: 119139 - RNA, 22 nt, Homo sapiens
uugcacucuagccugggugaca

SEQ ID NO: 119140 - RNA, 22 nt, Homo sapiens
uugcagugguuucacuggcaaa

SEQ ID NO: 119141 - RNA, 22 nt, Homo sapiens
uugcaugcuccuuaugagaauc

SEQ ID NO: 119142 - RNA, 22 nt, Homo sapiens
uugcuacuuggauguacaugug

SEQ ID NO: 119143 - RNA, 22 nt, Homo sapiens
uuggaaaaauccaccuugaucu

SEQ ID NO: 119144 - RNA, 22 nt, Homo sapiens
uuggaagguaaucaaaaguucu

SEQ ID NO: 119145 - RNA, 22 nt, Homo sapiens
uuggacuaagaacuuaaaauaa

SEQ ID NO: 119146 - RNA, 22 nt, Homo sapiens
uuggcaaucaauucugacgucu

SEQ ID NO: 119147 - RNA, 22 nt, Homo sapiens
uuggcacugggaaaaugaccac

SEQ ID NO: 119148 - RNA, 22 nt, Homo sapiens
uuggcacuugauaauauucugg

SEQ ID NO: 119149 - RNA, 22 nt, Homo sapiens
uuggcuauagauacauggauua

SEQ ID NO: 119150 - RNA, 22 nt, Homo sapiens
uuggucucuuaaucacacuuuu

SEQ ID NO: 119151 - RNA, 22 nt, Homo sapiens
uuguaaagaucauaugcuguuc

SEQ ID NO: 119152 - RNA, 22 nt, Homo sapiens
uuguacaggaguguaagcuuca

SEQ ID NO: 119153 - RNA, 22 nt, Homo sapiens
uuguacuauuuuuaucagugau

SEQ ID NO: 119154 - RNA, 21 nt, Homo sapiens
uuguaugguugaacuugauac

SEQ ID NO: 119155 - RNA, 22 nt, Homo sapiens
uugucacauggggcggcugccc

SEQ ID NO: 119156 - RNA, 22 nt, Homo sapiens
uugucaguguucacucaaagcu

SEQ ID NO: 119157 - RNA, 22 nt, Homo sapiens
uuguccucuccaaaucucaugu

SEQ ID NO: 119158 - RNA, 22 nt, Homo sapiens
uugugcacauguacccuagaac

SEQ ID NO: 119159 - RNA, 22 nt, Homo sapiens
uugugccauucuucugccucag

SEQ ID NO: 119160 - RNA, 22 nt, Homo sapiens
uugugcuuaauaaaaaguggua

SEQ ID NO: 119161 - RNA, 22 nt, Homo sapiens
uugugcuuuugagcugagauga

SEQ ID NO: 119162 - RNA, 22 nt, Homo sapiens
uugugucccugcggcugaggag

SEQ ID NO: 119163 - RNA, 22 nt, Homo sapiens
uuguuugguuagaugggcaagu

SEQ ID NO: 119164 - RNA, 22 nt, Homo sapiens
uuuaaagcacggaguuuguggc

SEQ ID NO: 119165 - RNA, 22 nt, Homo sapiens
uuuacaguuuucuaggcuacca

SEQ ID NO: 119166 - RNA, 22 nt, Homo sapiens
uuuagguaauauuaaguagcug

SEQ ID NO: 119167 - RNA, 22 nt, Homo sapiens
uuuagguauuugguauagcagu

SEQ ID NO: 119168 - RNA, 22 nt, Homo sapiens
uuuauccagccucuagcaaggu

SEQ ID NO: 119169 - RNA, 22 nt, Homo sapiens
uuuaugcuacauguguuggaaa

SEQ ID NO: 119170 - RNA, 22 nt, Homo sapiens
uuuauguggagcacuugacaca

SEQ ID NO: 119171 - RNA, 22 nt, Homo sapiens
uuucacagcaauugccuauugu

SEQ ID NO: 119172 - RNA, 23 nt, Homo sapiens
uuucacaguagcuggaucagccu

SEQ ID NO: 119173 - RNA, 22 nt, Homo sapiens
uuucaguguggcaggcauagcu

SEQ ID NO: 119174 - RNA, 22 nt, Homo sapiens
uuucaucaagcacagaguagau

SEQ ID NO: 119175 - RNA, 19 nt, Homo sapiens
uuucauguuuuuggugaga

SEQ ID NO: 119176 - RNA, 22 nt, Homo sapiens
uuucccauuguucugcucugug

SEQ ID NO: 119177 - RNA, 22 nt, Homo sapiens
uuuccuggagaaucuuaacaaa

SEQ ID NO: 119178 - RNA, 21 nt, Homo sapiens
uuucugggggagcauggcagg

SEQ ID NO: 119179 - RNA, 21 nt, Homo sapiens
uuugaucauuaaaagugaauc

SEQ ID NO: 119180 - RNA, 22 nt, Homo sapiens
uuugcacuuuuguaauaugguu

SEQ ID NO: 119181 - RNA, 18 nt, Homo sapiens
uuugccacuucccagaaa

SEQ ID NO: 119182 - RNA, 22 nt, Homo sapiens
uuugcuuaguaaauguagaaaa

SEQ ID NO: 119183 - RNA, 22 nt, Homo sapiens
uuuggcaugggcuauuugcuuu

SEQ ID NO: 119184 - RNA, 22 nt, Homo sapiens
uuuggcuuuuguaauaacugcc

SEQ ID NO: 119185 - RNA, 22 nt, Homo sapiens
uuugggaaaugaaguugguaga

SEQ ID NO: 119186 - RNA, 22 nt, Homo sapiens
uuugggccucugauuucuuugg

SEQ ID NO: 119187 - RNA, 22 nt, Homo sapiens
uuuguacuccuuggccagcuuc

SEQ ID NO: 119188 - RNA, 18 nt, Homo sapiens
uuugugcuccacaaagga

SEQ ID NO: 119189 - RNA, 22 nt, Homo sapiens
uuugugcuccucucaguaugug

SEQ ID NO: 119190 - RNA, 23 nt, Homo sapiens
uuugugucccucuagaauucaug

SEQ ID NO: 119191 - RNA, 22 nt, Homo sapiens
uuuuacagaggagguugcugau

SEQ ID NO: 119192 - RNA, 22 nt, Homo sapiens
uuuuggcucugucuguaucuuu

SEQ ID NO: 119193 - RNA, 22 nt, Homo sapiens
uuuugguauaugcaggggucuu

SEQ ID NO: 119194 - RNA, 22 nt, Homo sapiens
uuuuggucuccaguuucugcug

SEQ ID NO: 119195 - RNA, 22 nt, Homo sapiens
uuuugugcauggcccaguggua

SEQ ID NO: 119196 - RNA, 22 nt, Homo sapiens
uccacaguaaggacccugccuu

SEQ ID NO: 119197 - RNA, 22 nt, Homo sapiens
uccacuuuugugcugaauugga

SEQ ID NO: 119198 - RNA, 22 nt, Homo sapiens
uccagcuuuuucuaauucugug

SEQ ID NO: 119199 - RNA, 22 nt, Homo sapiens
uccagguacucagggggcugag

SEQ ID NO: 119200 - RNA, 22 nt, Homo sapiens
uccauagacauuuuaagguagu

SEQ ID NO: 119201 - RNA, 22 nt, Homo sapiens
uccauuuguagguagugagaca

SEQ ID NO: 119202 - RNA, 22 nt, Homo sapiens
ucccaagaugagaugggggcug

SEQ ID NO: 119203 - RNA, 19 nt, Homo sapiens
uccccaguuuuccguucag

SEQ ID NO: 119204 - RNA, 22 nt, Homo sapiens
ucccgaggacaucugggggcaa

SEQ ID NO: 119205 - RNA, 18 nt, Homo sapiens
ucccugacucaaauucuu

SEQ ID NO: 119206 - RNA, 19 nt, Homo sapiens
ucccugagucuuagcuuga

SEQ ID NO: 119207 - RNA, 22 nt, Homo sapiens
ucccuugagccuggcuucucac

SEQ ID NO: 119208 - RNA, 22 nt, Homo sapiens
uccuuggugacauuucuugucu

SEQ ID NO: 119209 - RNA, 22 nt, Homo sapiens
ucgcauuucccucuguagcuuc

SEQ ID NO: 119210 - RNA, 22 nt, Homo sapiens
ucgcugggaagacugaaguguc

SEQ ID NO: 119211 - RNA, 22 nt, Homo sapiens
ucgugcugugucaucuuguggc

SEQ ID NO: 119212 - RNA, 22 nt, Homo sapiens
ucuauggauaaaaugcccucau

SEQ ID NO: 119213 - RNA, 22 nt, Homo sapiens
ucucagcacaaacaaaauugcu

SEQ ID NO: 119214 - RNA, 22 nt, Homo sapiens
ucucaguuuucuggggaagaaa

SEQ ID NO: 119215 - RNA, 22 nt, Homo sapiens
ucuccauuuguaaggguuucuc

SEQ ID NO: 119216 - RNA, 22 nt, Homo sapiens
ucucuguuuauuuuugguguau

SEQ ID NO: 119217 - RNA, 22 nt, Homo sapiens
ucugaaucguucccaugcagga

SEQ ID NO: 119218 - RNA, 22 nt, Homo sapiens
ucugacucugugaugggcccaa

SEQ ID NO: 119219 - RNA, 22 nt, Homo sapiens
ucugagacuguuucuaacaagc

SEQ ID NO: 119220 - RNA, 17 nt, Homo sapiens
ucuggcuuucacaccug

SEQ ID NO: 119221 - RNA, 22 nt, Homo sapiens
ucuggcuuuuaacaucuauaaa

SEQ ID NO: 119222 - RNA, 22 nt, Homo sapiens
ucugucaaaucuuauguuguag

SEQ ID NO: 119223 - RNA, 22 nt, Homo sapiens
ucugugcauuacacuuuucuca

SEQ ID NO: 119224 - RNA, 22 nt, Homo sapiens
ucugugcugagaguugaaaguu

SEQ ID NO: 119225 - RNA, 22 nt, Homo sapiens
ucuugccacuucauccccuuuc

SEQ ID NO: 119226 - RNA, 22 nt, Homo sapiens
ucuugguugaaaauucauaaua

SEQ ID NO: 119227 - RNA, 22 nt, Homo sapiens
ucuuucacuuagcaugauguuu

SEQ ID NO: 119228 - RNA, 19 nt, Homo sapiens
ucuuugcuuuucuaagagg

SEQ ID NO: 119229 - RNA, 22 nt, Homo sapiens
ucuuuguguaggucaaucuggc

SEQ ID NO: 119230 - RNA, 22 nt, Homo sapiens
ucuuuugugagucagccucucc

SEQ ID NO: 119231 - RNA, 22 nt, Homo sapiens
ugaaagcuacagucuccuagga

SEQ ID NO: 119232 - RNA, 22 nt, Homo sapiens
ugaaaguuauauugugaaauuc

SEQ ID NO: 119233 - RNA, 22 nt, Homo sapiens
ugaaauguaaguugucuagucu

SEQ ID NO: 119234 - RNA, 21 nt, Homo sapiens
ugaacacuggacugagugucc

SEQ ID NO: 119235 - RNA, 22 nt, Homo sapiens
ugaagacucaauuauuaugaac

SEQ ID NO: 119236 - RNA, 22 nt, Homo sapiens
ugaagugaagacucacagaagg

SEQ ID NO: 119237 - RNA, 22 nt, Homo sapiens
ugaagugaagcaguaguguggg

SEQ ID NO: 119238 - RNA, 22 nt, Homo sapiens
ugaagugcugugggccaggcgu

SEQ ID NO: 119239 - RNA, 22 nt, Homo sapiens
ugaauacugugcaaaggauuug

SEQ ID NO: 119240 - RNA, 22 nt, Homo sapiens
ugaauaggcaguuaaguuuaug

SEQ ID NO: 119241 - RNA, 22 nt, Homo sapiens
ugaauaguaauguguuuggucu

SEQ ID NO: 119242 - RNA, 22 nt, Homo sapiens
ugaauauguuaauuagcaucau

SEQ ID NO: 119243 - RNA, 19 nt, Homo sapiens
ugaaugacaucuaaagucc

SEQ ID NO: 119244 - RNA, 22 nt, Homo sapiens
ugacaaguaaacagucagcacc

SEQ ID NO: 119245 - RNA, 22 nt, Homo sapiens
ugacaagugauuaaggcauauu

SEQ ID NO: 119246 - RNA, 22 nt, Homo sapiens
ugacagagaagcauugaguuca

SEQ ID NO: 119247 - RNA, 22 nt, Homo sapiens
ugacagagcaggacuucaucuc

SEQ ID NO: 119248 - RNA, 18 nt, Homo sapiens
ugacagcacaugugggga

SEQ ID NO: 119249 - RNA, 23 nt, Homo sapiens
ugacagugcuugaaauugcucuu

SEQ ID NO: 119250 - RNA, 22 nt, Homo sapiens
ugacaguguccucauucccaac

SEQ ID NO: 119251 - RNA, 18 nt, Homo sapiens
ugacaucauuuagaaagg

SEQ ID NO: 119252 - RNA, 21 nt, Homo sapiens
ugacauguuggugugcugcac

SEQ ID NO: 119253 - RNA, 22 nt, Homo sapiens
ugacauuacagucacuugcugu

SEQ ID NO: 119254 - RNA, 22 nt, Homo sapiens
ugacucaguuguuagucuucau

SEQ ID NO: 119255 - RNA, 18 nt, Homo sapiens
ugacuguccagguggacc

SEQ ID NO: 119256 - RNA, 22 nt, Homo sapiens
ugacuugaacuucuaugucacc

SEQ ID NO: 119257 - RNA, 22 nt, Homo sapiens
ugacuugaguaacuggcucagg

SEQ ID NO: 119258 - RNA, 22 nt, Homo sapiens
ugacuugaucacccccuaaggg

SEQ ID NO: 119259 - RNA, 22 nt, Homo sapiens
ugacuugaucauuacacauucu

SEQ ID NO: 119260 - RNA, 22 nt, Homo sapiens
ugagaacagauggcuuuauuau

SEQ ID NO: 119261 - RNA, 22 nt, Homo sapiens
ugagaacuguuuugguuugggu

SEQ ID NO: 119262 - RNA, 22 nt, Homo sapiens
ugagaagacaucagcuuucgga

SEQ ID NO: 119263 - RNA, 22 nt, Homo sapiens
ugagaagaugaacuccuugguc

SEQ ID NO: 119264 - RNA, 22 nt, Homo sapiens
ugagacauacuuacaggggaug

SEQ ID NO: 119265 - RNA, 22 nt, Homo sapiens
ugagauaaagcauguacugugu

SEQ ID NO: 119266 - RNA, 22 nt, Homo sapiens
ugagauauugggaguaauguca

SEQ ID NO: 119267 - RNA, 23 nt, Homo sapiens
ugagaucuacagaucucagaucu

SEQ ID NO: 119268 - RNA, 21 nt, Homo sapiens
ugagauuauauuaacauggua

SEQ ID NO: 119269 - RNA, 22 nt, Homo sapiens
ugagauuaucguaauguaucuc

SEQ ID NO: 119270 - RNA, 19 nt, Homo sapiens
ugagauuguaugaggagau

SEQ ID NO: 119271 - RNA, 22 nt, Homo sapiens
ugagcaucucuaaaaggagcaa

SEQ ID NO: 119272 - RNA, 22 nt, Homo sapiens
ugagccaugguuagcuucucau

SEQ ID NO: 119273 - RNA, 22 nt, Homo sapiens
ugagcugguacuaauauuauca

SEQ ID NO: 119274 - RNA, 22 nt, Homo sapiens
ugaggucacuuguuuuaugcuu

SEQ ID NO: 119275 - RNA, 22 nt, Homo sapiens
ugaggugaaguaauauucuaag

SEQ ID NO: 119276 - RNA, 18 nt, Homo sapiens
ugaguucauuagacuucc

SEQ ID NO: 119277 - RNA, 22 nt, Homo sapiens
ugauaacauugggggaagcuga

SEQ ID NO: 119278 - RNA, 22 nt, Homo sapiens
ugauaagaaauuguucauguag

SEQ ID NO: 119279 - RNA, 22 nt, Homo sapiens
ugauaguguccugugccacauu

SEQ ID NO: 119280 - RNA, 22 nt, Homo sapiens
ugauaugaaagggaaauaagug

SEQ ID NO: 119281 - RNA, 22 nt, Homo sapiens
ugauaugucacuugaucauggu

SEQ ID NO: 119282 - RNA, 22 nt, Homo sapiens
ugauauguuagaaucuugcaag

SEQ ID NO: 119283 - RNA, 22 nt, Homo sapiens
ugaucacagcuugacuaaagga

SEQ ID NO: 119284 - RNA, 22 nt, Homo sapiens
ugaucugucacuuaucacauuu

SEQ ID NO: 119285 - RNA, 22 nt, Homo sapiens
ugcaaagucgaaacugcaguuu

SEQ ID NO: 119286 - RNA, 22 nt, Homo sapiens
ugcaaucauuuggaggagaaga

SEQ ID NO: 119287 - RNA, 22 nt, Homo sapiens
ugcaccacugcacuccagcuug

SEQ ID NO: 119288 - RNA, 22 nt, Homo sapiens
ugcaggauguucaguaauuucc

SEQ ID NO: 119289 - RNA, 22 nt, Homo sapiens
ugcagguaggcaguaucauuua

SEQ ID NO: 119290 - RNA, 16 nt, Homo sapiens
ugccuucuucuguauu

SEQ ID NO: 119291 - RNA, 22 nt, Homo sapiens
ugcuacccuucgucucucuggu

SEQ ID NO: 119292 - RNA, 23 nt, Homo sapiens
ugcucgguguugacagucacauc

SEQ ID NO: 119293 - RNA, 22 nt, Homo sapiens
ugcugcacaguucuuaagauua

SEQ ID NO: 119294 - RNA, 22 nt, Homo sapiens
ugcugcacuuauggcucugagg

SEQ ID NO: 119295 - RNA, 22 nt, Homo sapiens
ugcugguggucccauaugauua

SEQ ID NO: 119296 - RNA, 22 nt, Homo sapiens
ugcuucauuggccaccaggaag

SEQ ID NO: 119297 - RNA, 22 nt, Homo sapiens
uggaagguaaguuuugagcauu

SEQ ID NO: 119298 - RNA, 21 nt, Homo sapiens
uggaaugaauggccaacaugg

SEQ ID NO: 119299 - RNA, 22 nt, Homo sapiens
uggaauggagagagggugcacg

SEQ ID NO: 119300 - RNA, 22 nt, Homo sapiens
uggaaugguaucuuguuggggu

SEQ ID NO: 119301 - RNA, 22 nt, Homo sapiens
uggacaagauagguucuauauu

SEQ ID NO: 119302 - RNA, 22 nt, Homo sapiens
uggacaugaagggcacaggagg

SEQ ID NO: 119303 - RNA, 22 nt, Homo sapiens
uggacuaaagaaacauuccgug

SEQ ID NO: 119304 - RNA, 22 nt, Homo sapiens
uggagcccuaguuccucauaac

SEQ ID NO: 119305 - RNA, 22 nt, Homo sapiens
uggauagauacuauccaggacu

SEQ ID NO: 119306 - RNA, 22 nt, Homo sapiens
uggauccaucacgccucuuccc

SEQ ID NO: 119307 - RNA, 22 nt, Homo sapiens
uggauggagaggcuugugaugc

SEQ ID NO: 119308 - RNA, 22 nt, Homo sapiens
uggcaaaauauuuugguuucug

SEQ ID NO: 119309 - RNA, 22 nt, Homo sapiens
uggcaaagugugacgugggggu

SEQ ID NO: 119310 - RNA, 21 nt, Homo sapiens
uggcaacauggauggauucug

SEQ ID NO: 119311 - RNA, 22 nt, Homo sapiens
uggcaagaaccacaauuacuuu

SEQ ID NO: 119312 - RNA, 22 nt, Homo sapiens
uggcaagaaccacaguuacuuu

SEQ ID NO: 119313 - RNA, 22 nt, Homo sapiens
uggcaagagcaaaauguacagu

SEQ ID NO: 119314 - RNA, 22 nt, Homo sapiens
uggcaauauccacaauuacuuu

SEQ ID NO: 119315 - RNA, 18 nt, Homo sapiens
uggcaauaugguucuacc

SEQ ID NO: 119316 - RNA, 22 nt, Homo sapiens
uggcagauaggauacaggacua

SEQ ID NO: 119317 - RNA, 22 nt, Homo sapiens
uggcagcugcuucaugggaugc

SEQ ID NO: 119318 - RNA, 17 nt, Homo sapiens
uggcaugaggguguggg

SEQ ID NO: 119319 - RNA, 22 nt, Homo sapiens
uggcaugauauauauucguuug

SEQ ID NO: 119320 - RNA, 22 nt, Homo sapiens
uggcaugauccuagauucaaca

SEQ ID NO: 119321 - RNA, 22 nt, Homo sapiens
uggcaugauguguucauugaaa

SEQ ID NO: 119322 - RNA, 22 nt, Homo sapiens
uggcaugcauuguggguaauua

SEQ ID NO: 119323 - RNA, 22 nt, Homo sapiens
uggccaagagcacagauauugg

SEQ ID NO: 119324 - RNA, 22 nt, Homo sapiens
uggcgagcugaaauuauaaaag

SEQ ID NO: 119325 - RNA, 22 nt, Homo sapiens
ugggaaauguagccuagcugug

SEQ ID NO: 119326 - RNA, 22 nt, Homo sapiens
ugggaauaugauacaggucuuu

SEQ ID NO: 119327 - RNA, 22 nt, Homo sapiens
ugggagugugcacaauuucagc

SEQ ID NO: 119328 - RNA, 22 nt, Homo sapiens
ugggcggagacgugcagccgcc

SEQ ID NO: 119329 - RNA, 22 nt, Homo sapiens
uggguaggcccucauuggacag

SEQ ID NO: 119330 - RNA, 22 nt, Homo sapiens
ugguaaguuuaacaugcauccc

SEQ ID NO: 119331 - RNA, 22 nt, Homo sapiens
ugguagugugagucuaaauugg

SEQ ID NO: 119332 - RNA, 22 nt, Homo sapiens
uggugagaaaagaugucuuugu

SEQ ID NO: 119333 - RNA, 22 nt, Homo sapiens
uggugagaaacuagauauuuuu

SEQ ID NO: 119334 - RNA, 22 nt, Homo sapiens
uguaguuugaaagcucccucug

SEQ ID NO: 119335 - RNA, 22 nt, Homo sapiens
uguauacugucuaauauguugu

SEQ ID NO: 119336 - RNA, 22 nt, Homo sapiens
uguauaggcaaauuuccucaug

SEQ ID NO: 119337 - RNA, 22 nt, Homo sapiens
uguauauguuuguacauauguc

SEQ ID NO: 119338 - RNA, 18 nt, Homo sapiens
ugucacuggauaaugguc

SEQ ID NO: 119339 - RNA, 22 nt, Homo sapiens
ugucaggagcaaugauaaauuu

SEQ ID NO: 119340 - RNA, 22 nt, Homo sapiens
ugucaggaguuuuagaaucuua

SEQ ID NO: 119341 - RNA, 22 nt, Homo sapiens
ugucauguuucuacugaccaaa

SEQ ID NO: 119342 - RNA, 22 nt, Homo sapiens
uguccaguguuccucagaagaa

SEQ ID NO: 119343 - RNA, 22 nt, Homo sapiens
ugucccugagccuggauuccug

SEQ ID NO: 119344 - RNA, 22 nt, Homo sapiens
ugucuuugguucaggcaaggag

SEQ ID NO: 119345 - RNA, 22 nt, Homo sapiens
ugucuuuguuaguuguccuagu

SEQ ID NO: 119346 - RNA, 22 nt, Homo sapiens
ugugaagaaagucauugguagc

SEQ ID NO: 119347 - RNA, 19 nt, Homo sapiens
ugugaagaaaugcugcaag

SEQ ID NO: 119348 - RNA, 23 nt, Homo sapiens
ugugacacuuccgucaguucauu

SEQ ID NO: 119349 - RNA, 22 nt, Homo sapiens
ugugacagcacagcaucucuuu

SEQ ID NO: 119350 - RNA, 22 nt, Homo sapiens
ugugacugguugucccgcuuuc

SEQ ID NO: 119351 - RNA, 22 nt, Homo sapiens
ugugauguggagggcagaucca

SEQ ID NO: 119352 - RNA, 23 nt, Homo sapiens
ugugcacauuuacauauauacac

SEQ ID NO: 119353 - RNA, 22 nt, Homo sapiens
ugugcaugacagcauacaaacg

SEQ ID NO: 119354 - RNA, 22 nt, Homo sapiens
uguggaaauggugcuacgaaca

SEQ ID NO: 119355 - RNA, 22 nt, Homo sapiens
uguggcaaauggucaggaagaa

SEQ ID NO: 119356 - RNA, 22 nt, Homo sapiens
uguggccuuuguuucaguuggg

SEQ ID NO: 119357 - RNA, 22 nt, Homo sapiens
uguggcuuuacagcaugguuca

SEQ ID NO: 119358 - RNA, 23 nt, Homo sapiens
ugugguauuauuccauuuauagg

SEQ ID NO: 119359 - RNA, 22 nt, Homo sapiens
uguuaacauggucucagucugu

SEQ ID NO: 119360 - RNA, 22 nt, Homo sapiens
uguuaugaagaugccugguaca

SEQ ID NO: 119361 - RNA, 22 nt, Homo sapiens
uuaaggguuuuagaauuuucca

SEQ ID NO: 119362 - RNA, 19 nt, Homo sapiens
uuaagugugauaucucagu

SEQ ID NO: 119363 - RNA, 22 nt, Homo sapiens
uuaauucugucugcccucaucc

SEQ ID NO: 119364 - RNA, 22 nt, Homo sapiens
uuaauuguaucuauagauguca

SEQ ID NO: 119365 - RNA, 22 nt, Homo sapiens
uuaauuguccauuauucuguuc

SEQ ID NO: 119366 - RNA, 22 nt, Homo sapiens
uuacagauggcacacucaaggg

SEQ ID NO: 119367 - RNA, 22 nt, Homo sapiens
uuacaguagaugaggguauaau

SEQ ID NO: 119368 - RNA, 22 nt, Homo sapiens
uuacaguauugcaaggacuagg

SEQ ID NO: 119369 - RNA, 22 nt, Homo sapiens
uuacagugguugcuauugugaa

SEQ ID NO: 119370 - RNA, 22 nt, Homo sapiens
uuagauuauugagcauccacug

SEQ ID NO: 119371 - RNA, 22 nt, Homo sapiens
uuagcacaucuuucuauguaag

SEQ ID NO: 119372 - RNA, 22 nt, Homo sapiens
uuaggcaguuuauugauuuuca

SEQ ID NO: 119373 - RNA, 22 nt, Homo sapiens
uuagguaauauauugcugcuuu

SEQ ID NO: 119374 - RNA, 20 nt, Homo sapiens
uuaguucauuuagaagguuu

SEQ ID NO: 119375 - RNA, 22 nt, Homo sapiens
uuauaacagagacuccugugcu

SEQ ID NO: 119376 - RNA, 19 nt, Homo sapiens
uuauacuguauuguuuagg

SEQ ID NO: 119377 - RNA, 22 nt, Homo sapiens
uuauagcagugcaggaacagac

SEQ ID NO: 119378 - RNA, 22 nt, Homo sapiens
uuauauguuacucccucuagca

SEQ ID NO: 119379 - RNA, 22 nt, Homo sapiens
uuauauguuucuuagggacaga

SEQ ID NO: 119380 - RNA, 22 nt, Homo sapiens
uuaucauagugcaguuuucuga

SEQ ID NO: 119381 - RNA, 22 nt, Homo sapiens
uuaugcuugugugaauuuuccc

SEQ ID NO: 119382 - RNA, 16 nt, Homo sapiens
uuauugcauucuucuc

SEQ ID NO: 119383 - RNA, 22 nt, Homo sapiens
uucaaaggauuuagauuagcua

SEQ ID NO: 119384 - RNA, 22 nt, Homo sapiens
uucaaaguaaaaauguguucac

SEQ ID NO: 119385 - RNA, 22 nt, Homo sapiens
ugggcauggaguggccuuaugu

SEQ ID NO: 119386 - RNA, 21 nt, Homo sapiens
ugggccccuuccuuacaucau

SEQ ID NO: 119387 - RNA, 22 nt, Homo sapiens
ugggccgcugcaggaugguccc

SEQ ID NO: 119388 - RNA, 22 nt, Homo sapiens
ugguauuuaauauaugagaguu

SEQ ID NO: 119389 - RNA, 22 nt, Homo sapiens
uggucauggaaauagaaugcac

SEQ ID NO: 119390 - RNA, 22 nt, Homo sapiens
uggucucuuugcuuuagucauc

SEQ ID NO: 119391 - RNA, 22 nt, Homo sapiens
uguaaaucuauuuuuaguguuu

SEQ ID NO: 119392 - RNA, 22 nt, Homo sapiens
uguacaaauuucugugguggug

SEQ ID NO: 119393 - RNA, 22 nt, Homo sapiens
uguagauauucuuucaguuuuu

SEQ ID NO: 119394 - RNA, 22 nt, Homo sapiens
uguauguugggucaaaguacau

SEQ ID NO: 119395 - RNA, 22 nt, Homo sapiens
ugucaaguugugguucaauuuu

SEQ ID NO: 119396 - RNA, 22 nt, Homo sapiens
ugucaguggacugugaaaggca

SEQ ID NO: 119397 - RNA, 22 nt, Homo sapiens
ugucaguguaugagccccggau

SEQ ID NO: 119398 - RNA, 22 nt, Homo sapiens
ugucauagauugcuuggaaaaa

SEQ ID NO: 119399 - RNA, 23 nt, Homo sapiens
ugucaucaagaugaggucacacu

SEQ ID NO: 119400 - RNA, 22 nt, Homo sapiens
ugucaucauuggaaucugccuc

SEQ ID NO: 119401 - RNA, 20 nt, Homo sapiens
ugucccaaccccauggguuc

SEQ ID NO: 119402 - RNA, 19 nt, Homo sapiens
ugucccagccauagaggca

SEQ ID NO: 119403 - RNA, 22 nt, Homo sapiens
ugucccaguuggguauugaauu

SEQ ID NO: 119404 - RNA, 22 nt, Homo sapiens
ugucuagaaaagccugccuucu

SEQ ID NO: 119405 - RNA, 21 nt, Homo sapiens
ugucuagaccucauccuacag

SEQ ID NO: 119406 - RNA, 22 nt, Homo sapiens
ugucucccuucccauuaggaag

SEQ ID NO: 119407 - RNA, 22 nt, Homo sapiens
ugucuggaguccauagaagugu

SEQ ID NO: 119408 - RNA, 22 nt, Homo sapiens
ugucuuggagaauccuggguuu

SEQ ID NO: 119409 - RNA, 22 nt, Homo sapiens
ugugaacauuuuguauauauua

SEQ ID NO: 119410 - RNA, 22 nt, Homo sapiens
ugugacacugaauggcagaacu

SEQ ID NO: 119411 - RNA, 20 nt, Homo sapiens
ugugauuauuuaguugcaug

SEQ ID NO: 119412 - RNA, 17 nt, Homo sapiens
ugugauugaagucaucc

SEQ ID NO: 119413 - RNA, 22 nt, Homo sapiens
ugugcacaacaugcagguuugu

SEQ ID NO: 119414 - RNA, 22 nt, Homo sapiens
ugugcacaacgugcagguuugu

SEQ ID NO: 119415 - RNA, 22 nt, Homo sapiens
ugugcacaauguacagguuagu

SEQ ID NO: 119416 - RNA, 22 nt, Homo sapiens
ugugcacauaacauuuuuuuag

SEQ ID NO: 119417 - RNA, 22 nt, Homo sapiens
ugugcauaugucuuuauaguag

SEQ ID NO: 119418 - RNA, 22 nt, Homo sapiens
uguggaaauaaaagaaagguua

SEQ ID NO: 119419 - RNA, 20 nt, Homo sapiens
uguggcacuguaucucucag

SEQ ID NO: 119420 - RNA, 22 nt, Homo sapiens
uguggcacuguguccagagaaa

SEQ ID NO: 119421 - RNA, 22 nt, Homo sapiens
uguggcucuucuguucuccacu

SEQ ID NO: 119422 - RNA, 22 nt, Homo sapiens
ugugggaggugcuaauguaaau

SEQ ID NO: 119423 - RNA, 22 nt, Homo sapiens
uguguuuuuauguaaaauggaa

SEQ ID NO: 119424 - RNA, 22 nt, Homo sapiens
uguuaaggcagagauaauacau

SEQ ID NO: 119425 - RNA, 22 nt, Homo sapiens
uguugcacugguaauguacuga

SEQ ID NO: 119426 - RNA, 22 nt, Homo sapiens
uguugcuuaagccacccagucu

SEQ ID NO: 119427 - RNA, 22 nt, Homo sapiens
uguuuguuugauaugggauaaa

SEQ ID NO: 119428 - RNA, 22 nt, Homo sapiens
uuaaaugcacauacuugagaaa

SEQ ID NO: 119429 - RNA, 22 nt, Homo sapiens
uuaagaagugauuuuccucauu

SEQ ID NO: 119430 - RNA, 22 nt, Homo sapiens
uuaagcaguggauuagaauuuu

SEQ ID NO: 119431 - RNA, 22 nt, Homo sapiens
uuaagccacucaagagauagag

SEQ ID NO: 119432 - RNA, 22 nt, Homo sapiens
uuaaggaaagcauuuaauucag

SEQ ID NO: 119433 - RNA, 22 nt, Homo sapiens
uuacaagaugucuguccaacac

SEQ ID NO: 119434 - RNA, 22 nt, Homo sapiens
uuacagucuuaggcagugcuuu

SEQ ID NO: 119435 - RNA, 22 nt, Homo sapiens
uuacuauguuucaaagugucuc

SEQ ID NO: 119436 - RNA, 22 nt, Homo sapiens
uuacuguauagaaucaucuuga

SEQ ID NO: 119437 - RNA, 22 nt, Homo sapiens
uuagcagugugaaaaaagacua

SEQ ID NO: 119438 - RNA, 20 nt, Homo sapiens
uuauagcuacaucuugacug

SEQ ID NO: 119439 - RNA, 21 nt, Homo sapiens
uuauaguggcaugauuuauaa

SEQ ID NO: 119440 - RNA, 22 nt, Homo sapiens
uuaucucagugaacugagugga

SEQ ID NO: 119441 - RNA, 23 nt, Homo sapiens
uuauggcuuuuauuauguugagg

SEQ ID NO: 119442 - RNA, 22 nt, Homo sapiens
uucaaaucuuuggcucccacua

SEQ ID NO: 119443 - RNA, 22 nt, Homo sapiens
uucaagcuacaguggcaggguu

SEQ ID NO: 119444 - RNA, 22 nt, Homo sapiens
uucaccuugggucccacuugcu

SEQ ID NO: 119445 - RNA, 22 nt, Homo sapiens
uucacuguagccucagccucuu

SEQ ID NO: 119446 - RNA, 22 nt, Homo sapiens
uucagauugcauaccgaaagua

SEQ ID NO: 119447 - RNA, 19 nt, Homo sapiens
uucagcagugucugcucuu

SEQ ID NO: 119448 - RNA, 20 nt, Homo sapiens
uucagugcagguaacaaucc

SEQ ID NO: 119449 - RNA, 22 nt, Homo sapiens
uucauguaauauauuucaggcc

SEQ ID NO: 119450 - RNA, 22 nt, Homo sapiens
uucccagagagggacuucuaau

SEQ ID NO: 119451 - RNA, 22 nt, Homo sapiens
uucccugugguauagaagccgu

SEQ ID NO: 119452 - RNA, 22 nt, Homo sapiens
uucccuuuguuaaauuggaaga

SEQ ID NO: 119453 - RNA, 22 nt, Homo sapiens
uuccuacugcccauuaaaaugg

SEQ ID NO: 119454 - RNA, 22 nt, Homo sapiens
uuccuugaaacagucaagagaa

SEQ ID NO: 119455 - RNA, 22 nt, Homo sapiens
uucuaugguuuaauaguuuggg

SEQ ID NO: 119456 - RNA, 21 nt, Homo sapiens
uucucaggguguguccuaccc

SEQ ID NO: 119457 - RNA, 22 nt, Homo sapiens
uucuccugguggacccuaaacg

SEQ ID NO: 119458 - RNA, 22 nt, Homo sapiens
uucuggaaaucagcagagggug

SEQ ID NO: 119459 - RNA, 22 nt, Homo sapiens
uucugugguuucauuuaccugu

SEQ ID NO: 119460 - RNA, 22 nt, Homo sapiens
uucuucugguuaugaaauuuga

SEQ ID NO: 119461 - RNA, 22 nt, Homo sapiens
uugaaaguguucacaaugguau

SEQ ID NO: 119462 - RNA, 22 nt, Homo sapiens
uugaagagaaccgcggcuuauu

SEQ ID NO: 119463 - RNA, 22 nt, Homo sapiens
uugaaugucuauuaaguuguuu

SEQ ID NO: 119464 - RNA, 21 nt, Homo sapiens
uugacagugacagguaaaguu

SEQ ID NO: 119465 - RNA, 22 nt, Homo sapiens
uugacaguggcuuaaauugguu

SEQ ID NO: 119466 - RNA, 22 nt, Homo sapiens
uugacaguugggcagggaaguu

SEQ ID NO: 119467 - RNA, 22 nt, Homo sapiens
ucuugaacuucugcacacucag

SEQ ID NO: 119468 - RNA, 22 nt, Homo sapiens
ucuuugauuuuguuacuaagac

SEQ ID NO: 119469 - RNA, 22 nt, Homo sapiens
ucuuugccuaacccaaggucau

SEQ ID NO: 119470 - RNA, 22 nt, Homo sapiens
ucuuuguuagaacccucuccuu

SEQ ID NO: 119471 - RNA, 22 nt, Homo sapiens
ugaaaagucuaagauuaagguu

SEQ ID NO: 119472 - RNA, 22 nt, Homo sapiens
ugaaaaguuguugaaggcuuca

SEQ ID NO: 119473 - RNA, 22 nt, Homo sapiens
ugaaacacacagagaagggaga

SEQ ID NO: 119474 - RNA, 22 nt, Homo sapiens
ugaaacacacauugcccuuuau

SEQ ID NO: 119475 - RNA, 22 nt, Homo sapiens
ugaaauacuuuggcucuuuguu

SEQ ID NO: 119476 - RNA, 22 nt, Homo sapiens
ugaaaucauguaguuauugcaa

SEQ ID NO: 119477 - RNA, 22 nt, Homo sapiens
ugaaaugguuaugugaggagau

SEQ ID NO: 119478 - RNA, 22 nt, Homo sapiens
ugaacagucaucucucuuguau

SEQ ID NO: 119479 - RNA, 22 nt, Homo sapiens
ugaagacucaguuugagggaca

SEQ ID NO: 119480 - RNA, 22 nt, Homo sapiens
ugaagcuuguuucuguaccuuu

SEQ ID NO: 119481 - RNA, 22 nt, Homo sapiens
ugaagugaaugguaaguaugcc

SEQ ID NO: 119482 - RNA, 22 nt, Homo sapiens
ugaauacagcacacccaugggu

SEQ ID NO: 119483 - RNA, 22 nt, Homo sapiens
ugacagcaucaggauuggagag

SEQ ID NO: 119484 - RNA, 22 nt, Homo sapiens
ugacaguaaacagucuugauua

SEQ ID NO: 119485 - RNA, 22 nt, Homo sapiens
ugacaguaucuacagcuucuua

SEQ ID NO: 119486 - RNA, 22 nt, Homo sapiens
ugacagugaacagguuaccacu

SEQ ID NO: 119487 - RNA, 22 nt, Homo sapiens
ugacagugugagauccugucuc

SEQ ID NO: 119488 - RNA, 22 nt, Homo sapiens
ugacaugauguuccuacacugu

SEQ ID NO: 119489 - RNA, 22 nt, Homo sapiens
ugacauugggagugaagugaag

SEQ ID NO: 119490 - RNA, 21 nt, Homo sapiens
ugacuagauuccagauuggcc

SEQ ID NO: 119491 - RNA, 22 nt, Homo sapiens
ugacuauaggauaacaugcauu

SEQ ID NO: 119492 - RNA, 22 nt, Homo sapiens
ugacuggagucuugcucugucg

SEQ ID NO: 119493 - RNA, 22 nt, Homo sapiens
ugacugugcagcuccaucaggg

SEQ ID NO: 119494 - RNA, 22 nt, Homo sapiens
ugacuucagacugaaaugauuc

SEQ ID NO: 119495 - RNA, 22 nt, Homo sapiens
ugacuugaggcucgcacaaguu

SEQ ID NO: 119496 - RNA, 22 nt, Homo sapiens
ugagaacagcagcuugggacac

SEQ ID NO: 119497 - RNA, 22 nt, Homo sapiens
ugagaacugcagggagcugcau

SEQ ID NO: 119498 - RNA, 21 nt, Homo sapiens
ugagaguaguguauuauucuc

SEQ ID NO: 119499 - RNA, 22 nt, Homo sapiens
ugagauagaaaacauaggagaa

SEQ ID NO: 119500 - RNA, 22 nt, Homo sapiens
ugagauaggaucuugcucuguu

SEQ ID NO: 119501 - RNA, 19 nt, Homo sapiens
ugagauccacugaagauuc

SEQ ID NO: 119502 - RNA, 22 nt, Homo sapiens
ugagaugauagauauguuaauu

SEQ ID NO: 119503 - RNA, 21 nt, Homo sapiens
ugagaugauccugcaugcaug

SEQ ID NO: 119504 - RNA, 22 nt, Homo sapiens
ugagaugauuuaauggagccca

SEQ ID NO: 119505 - RNA, 22 nt, Homo sapiens
ugagauuaucuguacauaggag

SEQ ID NO: 119506 - RNA, 22 nt, Homo sapiens
ugagauuguucuaugucugguu

SEQ ID NO: 119507 - RNA, 22 nt, Homo sapiens
ugagcagaaguuuugauuggcg

SEQ ID NO: 119508 - RNA, 22 nt, Homo sapiens
ugagcugagauuaagcugcugc

SEQ ID NO: 119509 - RNA, 22 nt, Homo sapiens
ugaggaauguguguuaaagaua

SEQ ID NO: 119510 - RNA, 22 nt, Homo sapiens
ugaggagugaacuauuucugau

SEQ ID NO: 119511 - RNA, 22 nt, Homo sapiens
ugaggaguguauuucauucgcu

SEQ ID NO: 119512 - RNA, 22 nt, Homo sapiens
ugaggugcagcaauccucaugu

SEQ ID NO: 119513 - RNA, 22 nt, Homo sapiens
ugagguuauuuguucaagaagu

SEQ ID NO: 119514 - RNA, 22 nt, Homo sapiens
ugagucagucucacucugcugc

SEQ ID NO: 119515 - RNA, 22 nt, Homo sapiens
ugagucuguucucacauugcua

SEQ ID NO: 119516 - RNA, 22 nt, Homo sapiens
ugagugugacuuagcagaagga

SEQ ID NO: 119517 - RNA, 17 nt, Homo sapiens
ugauauuuucccagaua

SEQ ID NO: 119518 - RNA, 22 nt, Homo sapiens
ugauggcacagugaguuccagg

SEQ ID NO: 119519 - RNA, 22 nt, Homo sapiens
ugauggcauuuggaguugggac

SEQ ID NO: 119520 - RNA, 22 nt, Homo sapiens
ugaugguuuuaaaaagaggagu

SEQ ID NO: 119521 - RNA, 20 nt, Homo sapiens
ugauguccaggcagagguuu

SEQ ID NO: 119522 - RNA, 19 nt, Homo sapiens
ugauuguaagcuuggugag

SEQ ID NO: 119523 - RNA, 22 nt, Homo sapiens
ugcaaaucuuguguaguuguga

SEQ ID NO: 119524 - RNA, 22 nt, Homo sapiens
ugcaaaugcugcuauuucucuu

SEQ ID NO: 119525 - RNA, 22 nt, Homo sapiens
ugcaccaauucuaaacaguucu

SEQ ID NO: 119526 - RNA, 23 nt, Homo sapiens
ugcagcuacauguggccaugugc

SEQ ID NO: 119527 - RNA, 22 nt, Homo sapiens
ugcauacacaagcauacaugua

SEQ ID NO: 119528 - RNA, 22 nt, Homo sapiens
ugcauagaauguucuguaaaua

SEQ ID NO: 119529 - RNA, 19 nt, Homo sapiens
ugcauaggguuacauacuc

SEQ ID NO: 119530 - RNA, 21 nt, Homo sapiens
ugcauggagaacacugagggu

SEQ ID NO: 119531 - RNA, 22 nt, Homo sapiens
ugcauggagcucucuuuggacu

SEQ ID NO: 119532 - RNA, 22 nt, Homo sapiens
ugcauggauguuugaacacacu

SEQ ID NO: 119533 - RNA, 22 nt, Homo sapiens
ugcauuaguaaguaauuuuaau

SEQ ID NO: 119534 - RNA, 22 nt, Homo sapiens
ugcauuagucuguucucacacu

SEQ ID NO: 119535 - RNA, 22 nt, Homo sapiens
ugccagaugcuggugugagggg

SEQ ID NO: 119536 - RNA, 22 nt, Homo sapiens
ugccaguauuuuguugaggauu

SEQ ID NO: 119537 - RNA, 22 nt, Homo sapiens
ugccuaguggaaggagagcaaa

SEQ ID NO: 119538 - RNA, 22 nt, Homo sapiens
ugccugagccagguuuuaggag

SEQ ID NO: 119539 - RNA, 22 nt, Homo sapiens
ugcugcaaacaugagaggaagu

SEQ ID NO: 119540 - RNA, 22 nt, Homo sapiens
ugcuggugauucagauucaaau

SEQ ID NO: 119541 - RNA, 22 nt, Homo sapiens
ugcuggugucaucaaggcuuug

SEQ ID NO: 119542 - RNA, 22 nt, Homo sapiens
ugcugguguggucuagccgcuu

SEQ ID NO: 119543 - RNA, 20 nt, Homo sapiens
uggaaaguaagucaugauau

SEQ ID NO: 119544 - RNA, 22 nt, Homo sapiens
uggaaggcuucauauguaaaga

SEQ ID NO: 119545 - RNA, 20 nt, Homo sapiens
uggaaguaagaauauaggug

SEQ ID NO: 119546 - RNA, 20 nt, Homo sapiens
uggaaucugaagaucucagu

SEQ ID NO: 119547 - RNA, 22 nt, Homo sapiens
uggacagaaacauguuuucagu

SEQ ID NO: 119548 - RNA, 21 nt, Homo sapiens
uggaccccuacuucucaccau

SEQ ID NO: 119549 - RNA, 22 nt, Homo sapiens
uggagacugaucccucuuuccu

SEQ ID NO: 119550 - RNA, 22 nt, Homo sapiens
uggagucuugaugauuuucaaa

SEQ ID NO: 119551 - RNA, 22 nt, Homo sapiens
uggaguguagaagccagccucc

SEQ ID NO: 119552 - RNA, 22 nt, Homo sapiens
uaagugaauuugacagguaaug

SEQ ID NO: 119553 - RNA, 22 nt, Homo sapiens
uaaugcacauuuauuuuaccuu

SEQ ID NO: 119554 - RNA, 22 nt, Homo sapiens
uaaugcaucaugguuggcaaac

SEQ ID NO: 119555 - RNA, 22 nt, Homo sapiens
uaaugguuuugcaccaucccuc

SEQ ID NO: 119556 - RNA, 22 nt, Homo sapiens
uaauucuguauguaucagaguu

SEQ ID NO: 119557 - RNA, 22 nt, Homo sapiens
uacacgugcacaacgugcacgu

SEQ ID NO: 119558 - RNA, 20 nt, Homo sapiens
uacacguguagcauucucua

SEQ ID NO: 119559 - RNA, 22 nt, Homo sapiens
uacaggacuauagaacuuuccc

SEQ ID NO: 119560 - RNA, 22 nt, Homo sapiens
uacaggacuucucagaguuauu

SEQ ID NO: 119561 - RNA, 19 nt, Homo sapiens
uacaugcagcaggcacgca

SEQ ID NO: 119562 - RNA, 23 nt, Homo sapiens
uaccacauuccuucuuuccuguu

SEQ ID NO: 119563 - RNA, 22 nt, Homo sapiens
uacucaguaagugcuggcugcu

SEQ ID NO: 119564 - RNA, 22 nt, Homo sapiens
uacucaguagacacucauaugu

SEQ ID NO: 119565 - RNA, 22 nt, Homo sapiens
uacugcacuccaggcucaccug

SEQ ID NO: 119566 - RNA, 22 nt, Homo sapiens
uagaagcacuaucccuccuagu

SEQ ID NO: 119567 - RNA, 22 nt, Homo sapiens
uagaauguaacaguuaaaagca

SEQ ID NO: 119568 - RNA, 23 nt, Homo sapiens
uagaauguuuuuccauguuucuu

SEQ ID NO: 119569 - RNA, 22 nt, Homo sapiens
uagcacaucuucuuggccugca

SEQ ID NO: 119570 - RNA, 22 nt, Homo sapiens
uagcaugacacuuguugaaugc

SEQ ID NO: 119571 - RNA, 21 nt, Homo sapiens
uagcugcacccaggccuccuu

SEQ ID NO: 119572 - RNA, 22 nt, Homo sapiens
uagcugcacuuacaagugagaa

SEQ ID NO: 119573 - RNA, 22 nt, Homo sapiens
uagcugcccagcacgaaguugg

SEQ ID NO: 119574 - RNA, 22 nt, Homo sapiens
uagcugcugcuaggcuaaggau

SEQ ID NO: 119575 - RNA, 22 nt, Homo sapiens
uaggagcacaaacccuacugug

SEQ ID NO: 119576 - RNA, 22 nt, Homo sapiens
uaggcaguggagaaauaaacag

SEQ ID NO: 119577 - RNA, 22 nt, Homo sapiens
uaguucauuuuucuugcuuaga

SEQ ID NO: 119578 - RNA, 22 nt, Homo sapiens
uaguugcauucaggauaugacg

SEQ ID NO: 119579 - RNA, 22 nt, Homo sapiens
uaguugcauuggcugcuaugcu

SEQ ID NO: 119580 - RNA, 22 nt, Homo sapiens
uauagcaguguaagaaucgagu

SEQ ID NO: 119581 - RNA, 22 nt, Homo sapiens
uauagcuugauuauggugaugg

SEQ ID NO: 119582 - RNA, 22 nt, Homo sapiens
uaucacacuguuggauuugauu

SEQ ID NO: 119583 - RNA, 23 nt, Homo sapiens
uaucacacuuucucugugccaca

SEQ ID NO: 119584 - RNA, 22 nt, Homo sapiens
uaucacaguaaaucugggugca

SEQ ID NO: 119585 - RNA, 22 nt, Homo sapiens
uaucauugccucaaucuguauu

SEQ ID NO: 119586 - RNA, 22 nt, Homo sapiens
uaucucaguguacaggaugaua

SEQ ID NO: 119587 - RNA, 22 nt, Homo sapiens
uaugacuuuugaauacagaugg

SEQ ID NO: 119588 - RNA, 22 nt, Homo sapiens
uaugcacuauagcauauguggu

SEQ ID NO: 119589 - RNA, 22 nt, Homo sapiens
uauggcugugacuuaucuuguu

SEQ ID NO: 119590 - RNA, 22 nt, Homo sapiens
uauuacuugucugugucucaau

SEQ ID NO: 119591 - RNA, 22 nt, Homo sapiens
uauuagugucuuuugguuagaa

SEQ ID NO: 119592 - RNA, 22 nt, Homo sapiens
uauuccacaauaugauuuuuaa

SEQ ID NO: 119593 - RNA, 22 nt, Homo sapiens
uauugccugucuccaaaaauca

SEQ ID NO: 119594 - RNA, 22 nt, Homo sapiens
uauuugguagcuauuuugcagu

SEQ ID NO: 119595 - RNA, 22 nt, Homo sapiens
ucaaacacuccauaucgcgauu

SEQ ID NO: 119596 - RNA, 17 nt, Homo sapiens
ucaaaugcucccaguga

SEQ ID NO: 119597 - RNA, 22 nt, Homo sapiens
ucacaauucucaauuugugaaa

SEQ ID NO: 119598 - RNA, 22 nt, Homo sapiens
ucacacugcaucuguuggaauu

SEQ ID NO: 119599 - RNA, 23 nt, Homo sapiens
ucacacuuaagagaaaugcagcu

SEQ ID NO: 119600 - RNA, 22 nt, Homo sapiens
ucacagacauugaggggaccuu

SEQ ID NO: 119601 - RNA, 22 nt, Homo sapiens
ucacagaggagaagaccuuuaa

SEQ ID NO: 119602 - RNA, 22 nt, Homo sapiens
ucacagcuaaaaugaaaguagu

SEQ ID NO: 119603 - RNA, 22 nt, Homo sapiens
ucacaguagggaacugacaaag

SEQ ID NO: 119604 - RNA, 22 nt, Homo sapiens
ucaccuagacucgaucauguag

SEQ ID NO: 119605 - RNA, 22 nt, Homo sapiens
ucaccuggagacaugaagacug

SEQ ID NO: 119606 - RNA, 22 nt, Homo sapiens
ucaccuggagccuucacauucu

SEQ ID NO: 119607 - RNA, 22 nt, Homo sapiens
ucacgugguucauaaggcagaa

SEQ ID NO: 119608 - RNA, 22 nt, Homo sapiens
ucacugaaaccuccgccuucug

SEQ ID NO: 119609 - RNA, 22 nt, Homo sapiens
ucacugaaacuguccuggguua

SEQ ID NO: 119610 - RNA, 22 nt, Homo sapiens
ucacugugguuuugaugugcau

SEQ ID NO: 119611 - RNA, 22 nt, Homo sapiens
ucagaacugaacaaaccagucu

SEQ ID NO: 119612 - RNA, 22 nt, Homo sapiens
ucagacacuguggccuuuggac

SEQ ID NO: 119613 - RNA, 22 nt, Homo sapiens
ucagaguagaaacacuuccaua

SEQ ID NO: 119614 - RNA, 22 nt, Homo sapiens
ucagaucauauucuucgcugcu

SEQ ID NO: 119615 - RNA, 22 nt, Homo sapiens
ucagaugaucugguaagaacuu

SEQ ID NO: 119616 - RNA, 22 nt, Homo sapiens
ucagauguuuuguuuaucugcu

SEQ ID NO: 119617 - RNA, 22 nt, Homo sapiens
ucaggugccuuggcuaauuguu

SEQ ID NO: 119618 - RNA, 23 nt, Homo sapiens
ucaguagucauugggaaagugug

SEQ ID NO: 119619 - RNA, 23 nt, Homo sapiens
ucagugaaggaacaacuaaauag

SEQ ID NO: 119620 - RNA, 22 nt, Homo sapiens
ucagugccauugccauaugagu

SEQ ID NO: 119621 - RNA, 22 nt, Homo sapiens
ucagugccucaguuuuuaaaga

SEQ ID NO: 119622 - RNA, 18 nt, Homo sapiens
ucauagaucaugacagug

SEQ ID NO: 119623 - RNA, 22 nt, Homo sapiens
ucauccauacaguuagcaaagg

SEQ ID NO: 119624 - RNA, 22 nt, Homo sapiens
uccauggagacacauuuuauau

SEQ ID NO: 119625 - RNA, 19 nt, Homo sapiens
ucccaagaugcucauacau

SEQ ID NO: 119626 - RNA, 22 nt, Homo sapiens
ucccagaaacgcauauguucau

SEQ ID NO: 119627 - RNA, 17 nt, Homo sapiens
ucccauguuucuucuac

SEQ ID NO: 119628 - RNA, 22 nt, Homo sapiens
ucccuacuggggcacugccuag

SEQ ID NO: 119629 - RNA, 18 nt, Homo sapiens
ucccucagaauuauagaa

SEQ ID NO: 119630 - RNA, 22 nt, Homo sapiens
ucccugacagucacagagcuac

SEQ ID NO: 119631 - RNA, 22 nt, Homo sapiens
ucccugagcaaaguuuucugua

SEQ ID NO: 119632 - RNA, 22 nt, Homo sapiens
ucccugagguccuggauuauug

SEQ ID NO: 119633 - RNA, 18 nt, Homo sapiens
ucccuuuguagaugaccc

SEQ ID NO: 119634 - RNA, 19 nt, Homo sapiens
ucccuuuguauggacauac

SEQ ID NO: 119635 - RNA, 21 nt, Homo sapiens
uccugagagaggaguaacucu

SEQ ID NO: 119636 - RNA, 22 nt, Homo sapiens
uccuggcuccacuguuuauucc

SEQ ID NO: 119637 - RNA, 22 nt, Homo sapiens
uccuugagccucccagacucag

SEQ ID NO: 119638 - RNA, 22 nt, Homo sapiens
uccuugagucuuugcucagaug

SEQ ID NO: 119639 - RNA, 22 nt, Homo sapiens
uccuuuagacugaauccugaga

SEQ ID NO: 119640 - RNA, 22 nt, Homo sapiens
gagcuguuuuucacuagaccaa

SEQ ID NO: 119641 - RNA, 22 nt, Homo sapiens
gaggaaguuuacaaagcaucug

SEQ ID NO: 119642 - RNA, 18 nt, Homo sapiens
gauaacaguggacuaugc

SEQ ID NO: 119643 - RNA, 22 nt, Homo sapiens
gauacaguaugcaugugguauu

SEQ ID NO: 119644 - RNA, 22 nt, Homo sapiens
gauacuguauccuaaaagcuuu

SEQ ID NO: 119645 - RNA, 21 nt, Homo sapiens
gauaugacauggguaaaacca

SEQ ID NO: 119646 - RNA, 22 nt, Homo sapiens
gaucacauggccauuucuagcu

SEQ ID NO: 119647 - RNA, 22 nt, Homo sapiens
gaucacauuguuucauacauau

SEQ ID NO: 119648 - RNA, 22 nt, Homo sapiens
gauggcacuaagccauguagga

SEQ ID NO: 119649 - RNA, 22 nt, Homo sapiens
gauuagcacuucaguuacagua

SEQ ID NO: 119650 - RNA, 22 nt, Homo sapiens
cuguuauguuugauggaugaau

SEQ ID NO: 119651 - RNA, 22 nt, Homo sapiens
cuugaccuauggaucuguuuuu

SEQ ID NO: 119652 - RNA, 22 nt, Homo sapiens
cuugccuuugucuucaaaggcu

SEQ ID NO: 119653 - RNA, 22 nt, Homo sapiens
cuuggcauuguguugauagaag

SEQ ID NO: 119654 - RNA, 22 nt, Homo sapiens
cuuggcuuguuguccccugcuc

SEQ ID NO: 119655 - RNA, 21 nt, Homo sapiens
cuuuaugcuguguuagaaaag

SEQ ID NO: 119656 - RNA, 21 nt, Homo sapiens
cuuugcacugcuccucagcuc

SEQ ID NO: 119657 - RNA, 22 nt, Homo sapiens
cuuuugugauuccucaguuacu

SEQ ID NO: 119658 - RNA, 22 nt, Homo sapiens
gaaaacugcuucucuggguuuc

SEQ ID NO: 119659 - RNA, 20 nt, Homo sapiens
gaaacaucuauccucuccuu

SEQ ID NO: 119660 - RNA, 22 nt, Homo sapiens
gaaagugcugcaaggccaugca

SEQ ID NO: 119661 - RNA, 22 nt, Homo sapiens
gaaagugcugcuugacugggau

SEQ ID NO: 119662 - RNA, 22 nt, Homo sapiens
gaagaacuaggugagaucuaga

SEQ ID NO: 119663 - RNA, 22 nt, Homo sapiens
gaagguacgcuuaggaaaugau

SEQ ID NO: 119664 - RNA, 17 nt, Homo sapiens
gaaguguuucagcagcu

SEQ ID NO: 119665 - RNA, 22 nt, Homo sapiens
gaauagugcugcaagaaacaua

SEQ ID NO: 119666 - RNA, 22 nt, Homo sapiens
gaauagugcugcaguaaacaua

SEQ ID NO: 119667 - RNA, 19 nt, Homo sapiens
gacaugagauuuggugggg

SEQ ID NO: 119668 - RNA, 17 nt, Homo sapiens
gacgaucaucaggaggc

SEQ ID NO: 119669 - RNA, 22 nt, Homo sapiens
gacucagucuuggauuuuuaau

SEQ ID NO: 119670 - RNA, 22 nt, Homo sapiens
gacuggccuauaauggcgaauu

SEQ ID NO: 119671 - RNA, 22 nt, Homo sapiens
gagaaugaacagacugccucuu

SEQ ID NO: 119672 - RNA, 22 nt, Homo sapiens
gagacagugucagccauugaaa

SEQ ID NO: 119673 - RNA, 22 nt, Homo sapiens
gagacugagucuugcucuguca

SEQ ID NO: 119674 - RNA, 22 nt, Homo sapiens
gagagugcuuuggguguaggcc

SEQ ID NO: 119675 - RNA, 22 nt, Homo sapiens
gagaucaguuaaugaagugagc

SEQ ID NO: 119676 - RNA, 22 nt, Homo sapiens
gagaugaaaucuugcucuguca

SEQ ID NO: 119677 - RNA, 22 nt, Homo sapiens
gagcuaguguuuacuugccacu

SEQ ID NO: 119678 - RNA, 22 nt, Homo sapiens
gaggagucagacugugcaaggu

SEQ ID NO: 119679 - RNA, 22 nt, Homo sapiens
gaggcacucuguacaaaucugc

SEQ ID NO: 119680 - RNA, 22 nt, Homo sapiens
gagguaaguaagaauggcaagc

SEQ ID NO: 119681 - RNA, 22 nt, Homo sapiens
gaguucauaucuaugagugugc

SEQ ID NO: 119682 - RNA, 22 nt, Homo sapiens
gauaacagauaaugucaguuau

SEQ ID NO: 119683 - RNA, 22 nt, Homo sapiens
gauauguaaaaauuauaucuga

SEQ ID NO: 119684 - RNA, 22 nt, Homo sapiens
gaugacagugaguaaccccaac

SEQ ID NO: 119685 - RNA, 22 nt, Homo sapiens
gauggcacuguagcaacacaaa

SEQ ID NO: 119686 - RNA, 22 nt, Homo sapiens
gauguagaaagagugggcugga

SEQ ID NO: 119687 - RNA, 22 nt, Homo sapiens
gauuuugguuagggaaggauac

SEQ ID NO: 119688 - RNA, 22 nt, Homo sapiens
gcaaaauugagaagggaauaua

SEQ ID NO: 119689 - RNA, 22 nt, Homo sapiens
gcaaaguguuuuuaggaagucu

SEQ ID NO: 119690 - RNA, 20 nt, Homo sapiens
gcaaauggaucccacaagcc

SEQ ID NO: 119691 - RNA, 22 nt, Homo sapiens
gcaagacaugucuaagguuuaa

SEQ ID NO: 119692 - RNA, 22 nt, Homo sapiens
gcacaguuaaagggucauguga

SEQ ID NO: 119693 - RNA, 22 nt, Homo sapiens
gcaccaugguagaauaauggua

SEQ ID NO: 119694 - RNA, 22 nt, Homo sapiens
gcacccugucaaaauggaccaa

SEQ ID NO: 119695 - RNA, 22 nt, Homo sapiens
gcaccguggaguauggggagga

SEQ ID NO: 119696 - RNA, 22 nt, Homo sapiens
gcaguguggguagagggcaaga

SEQ ID NO: 119697 - RNA, 22 nt, Homo sapiens
gcauauuuuaaaguguaaccug

SEQ ID NO: 119698 - RNA, 22 nt, Homo sapiens
gcaucacagcuccugugcuggc

SEQ ID NO: 119699 - RNA, 22 nt, Homo sapiens
gccaguguguguuguucuccgc

SEQ ID NO: 119700 - RNA, 22 nt, Homo sapiens
gcccaguagcaguacaucccuu

SEQ ID NO: 119701 - RNA, 22 nt, Homo sapiens
gccuagggacaaaccguccgac

SEQ ID NO: 119702 - RNA, 22 nt, Homo sapiens
gccugagaggauaugauccccu

SEQ ID NO: 119703 - RNA, 23 nt, Homo sapiens
gcuaggagagaugaaacacaggu

SEQ ID NO: 119704 - RNA, 22 nt, Homo sapiens
gcugauggugcaguucuagccu

SEQ ID NO: 119705 - RNA, 22 nt, Homo sapiens
gcuggcaagaugcugaugcaac

SEQ ID NO: 119706 - RNA, 22 nt, Homo sapiens
ggaaauguaaacaauggggcua

SEQ ID NO: 119707 - RNA, 22 nt, Homo sapiens
ggaagaauauuaggggauuucg

SEQ ID NO: 119708 - RNA, 22 nt, Homo sapiens
ggaaugagaaauauuacacaau

SEQ ID NO: 119709 - RNA, 22 nt, Homo sapiens
ggaauguuaaggcgcuguuggu

SEQ ID NO: 119710 - RNA, 22 nt, Homo sapiens
ggacaaaguauuuucaaaugua

SEQ ID NO: 119711 - RNA, 22 nt, Homo sapiens
ggagcugugauuugaguccaga

SEQ ID NO: 119712 - RNA, 22 nt, Homo sapiens
ggagguaauaaguuccagugua

SEQ ID NO: 119713 - RNA, 22 nt, Homo sapiens
ggaugcauucaacuuccaguuc

SEQ ID NO: 119714 - RNA, 22 nt, Homo sapiens
ggcaagugucagcagcaacacc

SEQ ID NO: 119715 - RNA, 22 nt, Homo sapiens
ggcaccauggaaggacgggagc

SEQ ID NO: 119716 - RNA, 22 nt, Homo sapiens
ggcagaauugcugaggaugcua

SEQ ID NO: 119717 - RNA, 22 nt, Homo sapiens
ggcagguaaggagugggagccu

SEQ ID NO: 119718 - RNA, 22 nt, Homo sapiens
ggccagaugcaguggcucacac

SEQ ID NO: 119719 - RNA, 22 nt, Homo sapiens
gggaaaaugucuauugaaugaa

SEQ ID NO: 119720 - RNA, 22 nt, Homo sapiens
gggaagugugguuucuuuacag

SEQ ID NO: 119721 - RNA, 22 nt, Homo sapiens
gggagugugcacacaugguaua

SEQ ID NO: 119722 - RNA, 22 nt, Homo sapiens
gggcaugauggugcacacaugu

SEQ ID NO: 119723 - RNA, 22 nt, Homo sapiens
gggccagaugcauuuguuauuu

SEQ ID NO: 119724 - RNA, 22 nt, Homo sapiens
ggucacauugcuagcauggguu

SEQ ID NO: 119725 - RNA, 22 nt, Homo sapiens
ggugagaaaaacauagucucag

SEQ ID NO: 119726 - RNA, 22 nt, Homo sapiens
ggugucaguuggccccuacugg

SEQ ID NO: 119727 - RNA, 22 nt, Homo sapiens
guaacagucucaacaguggucu

SEQ ID NO: 119728 - RNA, 22 nt, Homo sapiens
guacaguuuucaguguucacug

SEQ ID NO: 119729 - RNA, 17 nt, Homo sapiens
guacucagugaccaugg

SEQ ID NO: 119730 - RNA, 22 nt, Homo sapiens
guagaagcacagggccuguauu

SEQ ID NO: 119731 - RNA, 22 nt, Homo sapiens
guagaagcacaggugaguuggu

SEQ ID NO: 119732 - RNA, 22 nt, Homo sapiens
guaucauugccuaaugcucuca

SEQ ID NO: 119733 - RNA, 22 nt, Homo sapiens
guaugugcauuguaaauuuuga

SEQ ID NO: 119734 - RNA, 22 nt, Homo sapiens
guauuaguuaucuacugcugug

SEQ ID NO: 119735 - RNA, 22 nt, Homo sapiens
gucacauugaugcccauggugg

SEQ ID NO: 119736 - RNA, 22 nt, Homo sapiens
gucagaaucucagaugacaacg

SEQ ID NO: 119737 - RNA, 22 nt, Homo sapiens
gucaguucuugugguugcauuc

SEQ ID NO: 119738 - RNA, 22 nt, Homo sapiens
gucaugaaguuuugaaugaaau

SEQ ID NO: 119739 - RNA, 22 nt, Homo sapiens
gucauugucaauugacaauugu

SEQ ID NO: 119740 - RNA, 22 nt, Homo sapiens
gucauuguguggacauggagaa

SEQ ID NO: 119741 - RNA, 22 nt, Homo sapiens
gucccagagauauugugucuuu

SEQ ID NO: 119742 - RNA, 22 nt, Homo sapiens
gucugcaugucauaugauagua

SEQ ID NO: 119743 - RNA, 22 nt, Homo sapiens
gugaacagcagaugagugagug

SEQ ID NO: 119744 - RNA, 22 nt, Homo sapiens
gugacauuuuuacugaugagag

SEQ ID NO: 119745 - RNA, 22 nt, Homo sapiens
gugagaauauuuuaaauacuaa

SEQ ID NO: 119746 - RNA, 22 nt, Homo sapiens
gugaucuucauggaaggugaaa

SEQ ID NO: 119747 - RNA, 22 nt, Homo sapiens
gugaugcaguacguagaggaga

SEQ ID NO: 119748 - RNA, 22 nt, Homo sapiens
gugcacaacaugcagguuuguu

SEQ ID NO: 119749 - RNA, 22 nt, Homo sapiens
gugcacaacgugcagguuuguu

SEQ ID NO: 119750 - RNA, 22 nt, Homo sapiens
gugcacaacguguagguuuguu

SEQ ID NO: 119751 - RNA, 21 nt, Homo sapiens
gugcacaguaguguuuaauag

SEQ ID NO: 119752 - RNA, 22 nt, Homo sapiens
ucaugaaguaguuaacugguug

SEQ ID NO: 119753 - RNA, 22 nt, Homo sapiens
ucaugaccaugguauagaccac

SEQ ID NO: 119754 - RNA, 23 nt, Homo sapiens
ucaugaggccauucaaauccauu

SEQ ID NO: 119755 - RNA, 22 nt, Homo sapiens
ucaugggagcccccaucaugag

SEQ ID NO: 119756 - RNA, 22 nt, Homo sapiens
ucaugugagcacagagcaagau

SEQ ID NO: 119757 - RNA, 19 nt, Homo sapiens
ucaugugcauacauuuggg

SEQ ID NO: 119758 - RNA, 22 nt, Homo sapiens
ucauucuuucuguggaggggcu

SEQ ID NO: 119759 - RNA, 22 nt, Homo sapiens
uccaagaugcuggcagcuacag

SEQ ID NO: 119760 - RNA, 22 nt, Homo sapiens
uccacaauggagaagaguauga

SEQ ID NO: 119761 - RNA, 22 nt, Homo sapiens
uccacaauggcugaacuagauu

SEQ ID NO: 119762 - RNA, 22 nt, Homo sapiens
agcuggucuuggggaagaguag

SEQ ID NO: 119763 - RNA, 22 nt, Homo sapiens
agcuugugauuuagagugagag

SEQ ID NO: 119764 - RNA, 21 nt, Homo sapiens
agcuuguguguaucacagugu

SEQ ID NO: 119765 - RNA, 22 nt, Homo sapiens
aggaagcuagcauuuguucagu

SEQ ID NO: 119766 - RNA, 22 nt, Homo sapiens
aggagcacaauggucaugugga

SEQ ID NO: 119767 - RNA, 23 nt, Homo sapiens
ucuuuggcucuaauauaccuugu

SEQ ID NO: 119768 - RNA, 22 nt, Homo sapiens
ucuuugguucuguuuauguaau

SEQ ID NO: 119769 - RNA, 22 nt, Homo sapiens
ucuuuguucaggagccaacucc

SEQ ID NO: 119770 - RNA, 22 nt, Homo sapiens
ugaaaugaucaguuugguuacu

SEQ ID NO: 119771 - RNA, 22 nt, Homo sapiens
ugaaaugauuauaugguguuug

SEQ ID NO: 119772 - RNA, 22 nt, Homo sapiens
ugaaaugccuuuaaugaauuua

SEQ ID NO: 119773 - RNA, 22 nt, Homo sapiens
ugaagacauuuuugggugugua

SEQ ID NO: 119774 - RNA, 22 nt, Homo sapiens
ugaaggcaggagggagaaaagu

SEQ ID NO: 119775 - RNA, 22 nt, Homo sapiens
ugaauagugucacaauaaacau

SEQ ID NO: 119776 - RNA, 22 nt, Homo sapiens
ugacacagcaagauggaaccau

SEQ ID NO: 119777 - RNA, 22 nt, Homo sapiens
ugacacagugggggauccuuuu

SEQ ID NO: 119778 - RNA, 19 nt, Homo sapiens
ugacacuguuggugggagg

SEQ ID NO: 119779 - RNA, 22 nt, Homo sapiens
ugacaggagauuaugugauguu

SEQ ID NO: 119780 - RNA, 22 nt, Homo sapiens
ugacaggauggagaucgguauu

SEQ ID NO: 119781 - RNA, 22 nt, Homo sapiens
ugacagugugagacuuugucuc

SEQ ID NO: 119782 - RNA, 22 nt, Homo sapiens
ugacaucaccaccuccgucauc

SEQ ID NO: 119783 - RNA, 22 nt, Homo sapiens
ugacuaaggaaggauuaugugc

SEQ ID NO: 119784 - RNA, 22 nt, Homo sapiens
ugacuagagggcuuuuguguag

SEQ ID NO: 119785 - RNA, 22 nt, Homo sapiens
ugacucaagagccugacucauc

SEQ ID NO: 119786 - RNA, 23 nt, Homo sapiens
ugacuggagacuguugauccuuu

SEQ ID NO: 119787 - RNA, 18 nt, Homo sapiens
ugagaacauguguacaca

SEQ ID NO: 119788 - RNA, 22 nt, Homo sapiens
ugagaaccucugugugcccacu

SEQ ID NO: 119789 - RNA, 22 nt, Homo sapiens
ugagaacugguagcacuuguga

SEQ ID NO: 119790 - RNA, 22 nt, Homo sapiens
ugagaagacaucuuugcuuugu

SEQ ID NO: 119791 - RNA, 22 nt, Homo sapiens
ugagagcugcauucuugaaagc

SEQ ID NO: 119792 - RNA, 22 nt, Homo sapiens
ugagaguauaaauugaugcagc

SEQ ID NO: 119793 - RNA, 22 nt, Homo sapiens
ugagagucacugaccugguaua

SEQ ID NO: 119794 - RNA, 22 nt, Homo sapiens
ugagagucauacaaauaaaaau

SEQ ID NO: 119795 - RNA, 22 nt, Homo sapiens
ugagaugaaagcagaaagacuu

SEQ ID NO: 119796 - RNA, 22 nt, Homo sapiens
ugagaugaagugauguaaaaca

SEQ ID NO: 119797 - RNA, 22 nt, Homo sapiens
ugagaugaugggauaagagggc

SEQ ID NO: 119798 - RNA, 20 nt, Homo sapiens
ugagauuggugugguauaag

SEQ ID NO: 119799 - RNA, 22 nt, Homo sapiens
ugagcaagaucuuuauaauuag

SEQ ID NO: 119800 - RNA, 22 nt, Homo sapiens
ugagcagugaguguggugcagg

SEQ ID NO: 119801 - RNA, 22 nt, Homo sapiens
ugaggacugagaggcacugugg

SEQ ID NO: 119802 - RNA, 22 nt, Homo sapiens
ugaggaguauguucuguagacc

SEQ ID NO: 119803 - RNA, 22 nt, Homo sapiens
ugaggauaguguugaaggcagg

SEQ ID NO: 119804 - RNA, 22 nt, Homo sapiens
ugagggaugccugguuuguuuu

SEQ ID NO: 119805 - RNA, 23 nt, Homo sapiens
ugagguguuaagcagacuugucu

SEQ ID NO: 119806 - RNA, 22 nt, Homo sapiens
ugaguaguauucuaugguaugu

SEQ ID NO: 119807 - RNA, 22 nt, Homo sapiens
ugaguagugccacaauaagcau

SEQ ID NO: 119808 - RNA, 22 nt, Homo sapiens
ugagucuguuccaaagaaauaa

SEQ ID NO: 119809 - RNA, 22 nt, Homo sapiens
ugaguucaauguuaaugaagca

SEQ ID NO: 119810 - RNA, 23 nt, Homo sapiens
ugauaacagcauaugaagauucu

SEQ ID NO: 119811 - RNA, 22 nt, Homo sapiens
ugauaacauuucuucugguaca

SEQ ID NO: 119812 - RNA, 22 nt, Homo sapiens
ugauacuggcuucauagaauga

SEQ ID NO: 119813 - RNA, 22 nt, Homo sapiens
ugauaugaaguucaaaccaggu

SEQ ID NO: 119814 - RNA, 22 nt, Homo sapiens
ugaugacauugucacagucuga

SEQ ID NO: 119815 - RNA, 22 nt, Homo sapiens
ugcaaaguccucauucuuaccc

SEQ ID NO: 119816 - RNA, 22 nt, Homo sapiens
ugcaagaaucuuucaggcuagc

SEQ ID NO: 119817 - RNA, 22 nt, Homo sapiens
ugcaaucaucgcuguuggccac

SEQ ID NO: 119818 - RNA, 22 nt, Homo sapiens
ugcacaguccagugcccacuga

SEQ ID NO: 119819 - RNA, 21 nt, Homo sapiens
ugcagccauucagcccuaugc

SEQ ID NO: 119820 - RNA, 22 nt, Homo sapiens
ugcaggguccauugucccaagu

SEQ ID NO: 119821 - RNA, 20 nt, Homo sapiens
ugcauguccucacuuacuug

SEQ ID NO: 119822 - RNA, 22 nt, Homo sapiens
ugcauugcacuugcaugagaua

SEQ ID NO: 119823 - RNA, 22 nt, Homo sapiens
ugccaguauuuuauugaggauu

SEQ ID NO: 119824 - RNA, 22 nt, Homo sapiens
ugcccuguaucccacuguuuca

SEQ ID NO: 119825 - RNA, 21 nt, Homo sapiens
ugcucaugaguaaugcaguga

SEQ ID NO: 119826 - RNA, 22 nt, Homo sapiens
ugcugcuguuaucauuuuacca

SEQ ID NO: 119827 - RNA, 22 nt, Homo sapiens
ugcuuaguuguauguuccacau

SEQ ID NO: 119828 - RNA, 22 nt, Homo sapiens
uggaaaauuaggggagguuaua

SEQ ID NO: 119829 - RNA, 22 nt, Homo sapiens
uggaaaguacuugaguuuguau

SEQ ID NO: 119830 - RNA, 22 nt, Homo sapiens
uggaagacaggcuguauuuuaa

SEQ ID NO: 119831 - RNA, 20 nt, Homo sapiens
uggaaggcaucugcauuauu

SEQ ID NO: 119832 - RNA, 22 nt, Homo sapiens
uggacagacaagguuauagauc

SEQ ID NO: 119833 - RNA, 22 nt, Homo sapiens
uggacuguaauagagaacagaa

SEQ ID NO: 119834 - RNA, 22 nt, Homo sapiens
uggagcccuaaacuucuaauau

SEQ ID NO: 119835 - RNA, 19 nt, Homo sapiens
uggagucaucaugcugcua

SEQ ID NO: 119836 - RNA, 21 nt, Homo sapiens
uggcaaaaugggcaguggguu

SEQ ID NO: 119837 - RNA, 21 nt, Homo sapiens
uggcacuauucacaauagcaa

SEQ ID NO: 119838 - RNA, 22 nt, Homo sapiens
uggcaguuucacauggcucaac

SEQ ID NO: 119839 - RNA, 22 nt, Homo sapiens
uggcaugaaguguguuuuaucu

SEQ ID NO: 119840 - RNA, 22 nt, Homo sapiens
uggccaguguuuuuccugggcu

SEQ ID NO: 119841 - RNA, 22 nt, Homo sapiens
ugggaaugaaauuacauagcuu

SEQ ID NO: 119842 - RNA, 22 nt, Homo sapiens
ugggaugaugcuugagaauauc

SEQ ID NO: 119843 - RNA, 22 nt, Homo sapiens
ugggcaagagagcaugacccug

SEQ ID NO: 119844 - RNA, 22 nt, Homo sapiens
ugggcaagugacuuggcuucuc

SEQ ID NO: 119845 - RNA, 23 nt, Homo sapiens
ugggucaguuuuucugacaucau

SEQ ID NO: 119846 - RNA, 22 nt, Homo sapiens
ugguaaaaugucauuuaccaga

SEQ ID NO: 119847 - RNA, 22 nt, Homo sapiens
ugucaacauuuaucaaguuauu

SEQ ID NO: 119848 - RNA, 22 nt, Homo sapiens
ugucaaugggaauuuguuuuag

SEQ ID NO: 119849 - RNA, 22 nt, Homo sapiens
ugucacugugcagucaugcauu

SEQ ID NO: 119850 - RNA, 22 nt, Homo sapiens
ugucaguggucuggaugcagcc

SEQ ID NO: 119851 - RNA, 22 nt, Homo sapiens
ugucaguguacuguaagaauua

SEQ ID NO: 119852 - RNA, 21 nt, Homo sapiens
ugucaguuuccagaguucaac

SEQ ID NO: 119853 - RNA, 22 nt, Homo sapiens
ugucauggggaaaauaacagac

SEQ ID NO: 119854 - RNA, 22 nt, Homo sapiens
ugucuacugaugauguaguuaa

SEQ ID NO: 119855 - RNA, 22 nt, Homo sapiens
ugucuggaaggguggccuccug

SEQ ID NO: 119856 - RNA, 22 nt, Homo sapiens
ugugacuaguggugaaugacgc

SEQ ID NO: 119857 - RNA, 22 nt, Homo sapiens
ugugacucuggcacauggugag

SEQ ID NO: 119858 - RNA, 22 nt, Homo sapiens
ugugagaaaugcagaaucucag

SEQ ID NO: 119859 - RNA, 22 nt, Homo sapiens
ugugagaucucagaauugaacu

SEQ ID NO: 119860 - RNA, 22 nt, Homo sapiens
ugugauuauuuauagacaguca

SEQ ID NO: 119861 - RNA, 22 nt, Homo sapiens
ugugcacaaccugcagguuugu

SEQ ID NO: 119862 - RNA, 22 nt, Homo sapiens
ugugcacaaugugcagguuuga

SEQ ID NO: 119863 - RNA, 22 nt, Homo sapiens
ugugcaccucuucacacaggga

SEQ ID NO: 119864 - RNA, 22 nt, Homo sapiens
ugugccacugcacucuggccug

SEQ ID NO: 119865 - RNA, 22 nt, Homo sapiens
ugugccacugcacucugggcaa

SEQ ID NO: 119866 - RNA, 22 nt, Homo sapiens
ugugcuauguuauucacauggg

SEQ ID NO: 119867 - RNA, 22 nt, Homo sapiens
ugugcugaucgggcacgguguc

SEQ ID NO: 119868 - RNA, 22 nt, Homo sapiens
ugugguuuuucacauuuagaga

SEQ ID NO: 119869 - RNA, 22 nt, Homo sapiens
aagugcuuccuuucagaggguu

SEQ ID NO: 119870 - RNA, 22 nt, Homo sapiens
aagugguguuugggagcuggac

SEQ ID NO: 119871 - RNA, 22 nt, Homo sapiens
aagugguguuuguauuuaugca

SEQ ID NO: 119872 - RNA, 22 nt, Homo sapiens
aauaauggcaccaaagcacaag

SEQ ID NO: 119873 - RNA, 22 nt, Homo sapiens
aauauagcuauguacaugucca

SEQ ID NO: 119874 - RNA, 22 nt, Homo sapiens
aaucacaguguucuugugaggg

SEQ ID NO: 119875 - RNA, 22 nt, Homo sapiens
aaucacaguuaguaagggagaa

SEQ ID NO: 119876 - RNA, 22 nt, Homo sapiens
aauccaugugcuuuaccauuuu

SEQ ID NO: 119877 - RNA, 22 nt, Homo sapiens
aaucucagcauuuugggcugag

SEQ ID NO: 119878 - RNA, 22 nt, Homo sapiens
aaugacagugcuaaagaacccu

SEQ ID NO: 119879 - RNA, 22 nt, Homo sapiens
aaugcuguguuauuucaugacc

SEQ ID NO: 119880 - RNA, 22 nt, Homo sapiens
aauggcacuuuauaaauguuaa

SEQ ID NO: 119881 - RNA, 22 nt, Homo sapiens
aauggcuauuucaugugguagg

SEQ ID NO: 119882 - RNA, 22 nt, Homo sapiens
acaccaguacuuuauacaagca

SEQ ID NO: 119883 - RNA, 22 nt, Homo sapiens
acaccaugucuguuucugguuu

SEQ ID NO: 119884 - RNA, 22 nt, Homo sapiens
acacuggguaacauaucuguua

SEQ ID NO: 119885 - RNA, 20 nt, Homo sapiens
acagcauagccuuuuaaagc

SEQ ID NO: 119886 - RNA, 22 nt, Homo sapiens
acagguacacagaauauccaga

SEQ ID NO: 119887 - RNA, 21 nt, Homo sapiens
acaguacuugagaucuuuuga

SEQ ID NO: 119888 - RNA, 22 nt, Homo sapiens
acagugcuucugauaugaugcc

SEQ ID NO: 119889 - RNA, 22 nt, Homo sapiens
acagugcuuggcacacaguaau

SEQ ID NO: 119890 - RNA, 18 nt, Homo sapiens
acagugucauggcucaau

SEQ ID NO: 119891 - RNA, 22 nt, Homo sapiens
acagugucaugucguguucccc

SEQ ID NO: 119892 - RNA, 22 nt, Homo sapiens
acaguguuacuugauaguguau

SEQ ID NO: 119893 - RNA, 22 nt, Homo sapiens
acaguguuccuuuguugugacu

SEQ ID NO: 119894 - RNA, 22 nt, Homo sapiens
accaccacucccgcauucuaaa

SEQ ID NO: 119895 - RNA, 22 nt, Homo sapiens
acccugacacgauucuucacuu

SEQ ID NO: 119896 - RNA, 22 nt, Homo sapiens
acccugcuaaacagcccccugc

SEQ ID NO: 119897 - RNA, 22 nt, Homo sapiens
acccuguaguuagaaacuuuca

SEQ ID NO: 119898 - RNA, 22 nt, Homo sapiens
acccugucaaaauggaccaauc

SEQ ID NO: 119899 - RNA, 22 nt, Homo sapiens
acccuuuagguuggaugaggau

SEQ ID NO: 119900 - RNA, 22 nt, Homo sapiens
accugagacuaggcauuuuaua

SEQ ID NO: 119901 - RNA, 22 nt, Homo sapiens
acggcaguguggugcggucagg

SEQ ID NO: 119902 - RNA, 22 nt, Homo sapiens
acgugcaugcacacacaugcgc

SEQ ID NO: 119903 - RNA, 22 nt, Homo sapiens
acucagagugggccccuagaua

SEQ ID NO: 119904 - RNA, 22 nt, Homo sapiens
acugcacuccaucuuagguggc

SEQ ID NO: 119905 - RNA, 20 nt, Homo sapiens
acuggcacugguaggugugg

SEQ ID NO: 119906 - RNA, 22 nt, Homo sapiens
acuggcuguuaggaauuaccuc

SEQ ID NO: 119907 - RNA, 22 nt, Homo sapiens
acuuugguuuauagaauuuagg

SEQ ID NO: 119908 - RNA, 21 nt, Homo sapiens
agaaaaucuuaugggaaacau

SEQ ID NO: 119909 - RNA, 23 nt, Homo sapiens
agaaaugucuauucagggucccu

SEQ ID NO: 119910 - RNA, 22 nt, Homo sapiens
agaaugucaguauuggcuaaaa

SEQ ID NO: 119911 - RNA, 22 nt, Homo sapiens
agacagcugggaaauggagugu

SEQ ID NO: 119912 - RNA, 20 nt, Homo sapiens
agacaguguggagauuccuu

SEQ ID NO: 119913 - RNA, 22 nt, Homo sapiens
agaugauguuuacugagcauca

SEQ ID NO: 119914 - RNA, 20 nt, Homo sapiens
agaugcaugcacauaaacac

SEQ ID NO: 119915 - RNA, 23 nt, Homo sapiens
agaugcauucuuguaggauauau

SEQ ID NO: 119916 - RNA, 22 nt, Homo sapiens
agcaagacauggcuuccaaaug

SEQ ID NO: 119917 - RNA, 22 nt, Homo sapiens
agcaauaugacauugcuacauc

SEQ ID NO: 119918 - RNA, 22 nt, Homo sapiens
agcacaguuaaaugaggcuucu

SEQ ID NO: 119919 - RNA, 22 nt, Homo sapiens
agcaccaugggcugaguaagug

SEQ ID NO: 119920 - RNA, 22 nt, Homo sapiens
agcaccauugcacuccagccug

SEQ ID NO: 119921 - RNA, 22 nt, Homo sapiens
agcagcuuugcauggccugugg

SEQ ID NO: 119922 - RNA, 20 nt, Homo sapiens
agcauugguuagaacaguag

SEQ ID NO: 119923 - RNA, 22 nt, Homo sapiens
agcccuuagauggcuccuucca

SEQ ID NO: 119924 - RNA, 22 nt, Homo sapiens
agcucauugcaaccuccgccuc

SEQ ID NO: 119925 - RNA, 17 nt, Homo sapiens
agcuggaauuacgggag

SEQ ID NO: 119926 - RNA, 22 nt, Homo sapiens
agcuggucucaggugcccugcu

SEQ ID NO: 119927 - RNA, 22 nt, Homo sapiens
agcuucauucugaauagguuga

SEQ ID NO: 119928 - RNA, 22 nt, Homo sapiens
agcuuguauuuguagccuguug

SEQ ID NO: 119929 - RNA, 22 nt, Homo sapiens
agcuuguuuucccauaacuaga

SEQ ID NO: 119930 - RNA, 23 nt, Homo sapiens
aggaauggaaaaccaaguaucau

SEQ ID NO: 119931 - RNA, 22 nt, Homo sapiens
aggacacugauguaugcugugg

SEQ ID NO: 119932 - RNA, 21 nt, Homo sapiens
aggagcauuguugugguggag

SEQ ID NO: 119933 - RNA, 22 nt, Homo sapiens
aggugaauggauaaacuguggg

SEQ ID NO: 119934 - RNA, 22 nt, Homo sapiens
aguacacuguugaacagaagug

SEQ ID NO: 119935 - RNA, 22 nt, Homo sapiens
aguacaucuggcuggauagaua

SEQ ID NO: 119936 - RNA, 16 nt, Homo sapiens
aguaguuuuacagauu

SEQ ID NO: 119937 - RNA, 22 nt, Homo sapiens
agugcaauggugccaucauagc

SEQ ID NO: 119938 - RNA, 22 nt, Homo sapiens
agugcaguggugccaucauaac

SEQ ID NO: 119939 - RNA, 22 nt, Homo sapiens
agugccaaaucgagggcucuga

SEQ ID NO: 119940 - RNA, 22 nt, Homo sapiens
aguggcacaauuuugacucccc

SEQ ID NO: 119941 - RNA, 22 nt, Homo sapiens
auaaaugcuuccagucauuaaa

SEQ ID NO: 119942 - RNA, 22 nt, Homo sapiens
auacagacacagucagaggggu

SEQ ID NO: 119943 - RNA, 22 nt, Homo sapiens
auacuguauaggauuguagccu

SEQ ID NO: 119944 - RNA, 20 nt, Homo sapiens
auagaagacuagugcagcag

SEQ ID NO: 119945 - RNA, 22 nt, Homo sapiens
auagaucuauuuauguaucccu

SEQ ID NO: 119946 - RNA, 22 nt, Homo sapiens
auagcaauuugggaaucagacu

SEQ ID NO: 119947 - RNA, 20 nt, Homo sapiens
auagcagcaugauuuauagu

SEQ ID NO: 119948 - RNA, 22 nt, Homo sapiens
auauagcaaugaaagagaugaa

SEQ ID NO: 119949 - RNA, 22 nt, Homo sapiens
auauguucucauucauaugugg

SEQ ID NO: 119950 - RNA, 22 nt, Homo sapiens
auauuacagagaggaccuggga

SEQ ID NO: 119951 - RNA, 22 nt, Homo sapiens
auauuacuggccauaucgcagg

SEQ ID NO: 119952 - RNA, 18 nt, Homo sapiens
auauugcauuggauggau

SEQ ID NO: 119953 - RNA, 22 nt, Homo sapiens
auauuugguuaccugugggucu

SEQ ID NO: 119954 - RNA, 22 nt, Homo sapiens
aucaaaguaucucaauauggua

SEQ ID NO: 119955 - RNA, 22 nt, Homo sapiens
aucacagaacuuugagcagaga

SEQ ID NO: 119956 - RNA, 22 nt, Homo sapiens
aucacaguuaagaggugaugaa

SEQ ID NO: 119957 - RNA, 22 nt, Homo sapiens
aucacauuuauaguggcacgca

SEQ ID NO: 119958 - RNA, 22 nt, Homo sapiens
aucagugcauaguauuuaauga

SEQ ID NO: 119959 - RNA, 22 nt, Homo sapiens
auccauugcucaagagaaguca

SEQ ID NO: 119960 - RNA, 22 nt, Homo sapiens
aucccaguucagccucugacac

SEQ ID NO: 119961 - RNA, 22 nt, Homo sapiens
aucccugaggaauuucugcacu

SEQ ID NO: 119962 - RNA, 22 nt, Homo sapiens
aucucaguuaauuccaucuuuc

SEQ ID NO: 119963 - RNA, 22 nt, Homo sapiens
aucucauggagguagagaguaa

SEQ ID NO: 119964 - RNA, 22 nt, Homo sapiens
aucugcaaauaaugaagauugg

SEQ ID NO: 119965 - RNA, 22 nt, Homo sapiens
aucuggcuccuuuugacaaugc

SEQ ID NO: 119966 - RNA, 22 nt, Homo sapiens
augaaagguauguuuucuguga

SEQ ID NO: 119967 - RNA, 22 nt, Homo sapiens
augaaaucuuuccugugaggau

SEQ ID NO: 119968 - RNA, 23 nt, Homo sapiens
augaauguaaggaguguaagaaa

SEQ ID NO: 119969 - RNA, 23 nt, Homo sapiens
augacacuguccuugaccauuuc

SEQ ID NO: 119970 - RNA, 22 nt, Homo sapiens
augacaguaugacuccaaaagu

SEQ ID NO: 119971 - RNA, 22 nt, Homo sapiens
ugcaguacauucagcauccucu

SEQ ID NO: 119972 - RNA, 20 nt, Homo sapiens
ugcaguguccucacuuguca

SEQ ID NO: 119973 - RNA, 21 nt, Homo sapiens
ugcauaucucuaaugaccagu

SEQ ID NO: 119974 - RNA, 22 nt, Homo sapiens
ugcauauucuaggauuuuguau

SEQ ID NO: 119975 - RNA, 22 nt, Homo sapiens
ugcauauuuuauaaagauggaa

SEQ ID NO: 119976 - RNA, 21 nt, Homo sapiens
ugcaugguagucacaugauuc

SEQ ID NO: 119977 - RNA, 22 nt, Homo sapiens
ugcauuaucagauguuugcuuu

SEQ ID NO: 119978 - RNA, 22 nt, Homo sapiens
ugccaguauuuuguugaagauu

SEQ ID NO: 119979 - RNA, 22 nt, Homo sapiens
uucaaaucuucguuuugccaua

SEQ ID NO: 119980 - RNA, 22 nt, Homo sapiens
uucaaguaguucucaugccuca

SEQ ID NO: 119981 - RNA, 22 nt, Homo sapiens
uucacacugggccuacucugug

SEQ ID NO: 119982 - RNA, 22 nt, Homo sapiens
uucaccaguuuugucacgaaug

SEQ ID NO: 119983 - RNA, 22 nt, Homo sapiens
uucacugcacuccagccugagc

SEQ ID NO: 119984 - RNA, 22 nt, Homo sapiens
uucacugugaacucauauucag

SEQ ID NO: 119985 - RNA, 22 nt, Homo sapiens
uucagaguggacagaaauuaag

SEQ ID NO: 119986 - RNA, 18 nt, Homo sapiens
aggagcauagugcuauga

SEQ ID NO: 119987 - RNA, 23 nt, Homo sapiens
aggagcuuagaaguugccauugc

SEQ ID NO: 119988 - RNA, 22 nt, Homo sapiens
aggagcuuuggggaaaacagau

SEQ ID NO: 119989 - RNA, 22 nt, Homo sapiens
aggcaguuucagugagagguga

SEQ ID NO: 119990 - RNA, 22 nt, Homo sapiens
aggcauugugcaucgaugauuu

SEQ ID NO: 119991 - RNA, 23 nt, Homo sapiens
aggccaguuuuuccugcuugcug

SEQ ID NO: 119992 - RNA, 22 nt, Homo sapiens
agguaagaugugacuugguguu

SEQ ID NO: 119993 - RNA, 22 nt, Homo sapiens
agguacuuucccaaccauacug

SEQ ID NO: 119994 - RNA, 22 nt, Homo sapiens
agguauuuucaacuuagaaugg

SEQ ID NO: 119995 - RNA, 20 nt, Homo sapiens
agguuauuauaauuagaaga

SEQ ID NO: 119996 - RNA, 18 nt, Homo sapiens
agguuauuucccaagacu

SEQ ID NO: 119997 - RNA, 22 nt, Homo sapiens
aguaacacaccugcauggugug

SEQ ID NO: 119998 - RNA, 22 nt, Homo sapiens
aguccagguuuuguaauggcaa

SEQ ID NO: 119999 - RNA, 22 nt, Homo sapiens
agucgguguuacugacagaaug

SEQ ID NO: 120000 - RNA, 23 nt, Homo sapiens
agucuguguuuacaggcucucug

SEQ ID NO: 120001 - RNA, 22 nt, Homo sapiens
agugacaugggaucaaaucuga

SEQ ID NO: 120002 - RNA, 22 nt, Homo sapiens
agugcauuuguucugugucagg

SEQ ID NO: 120003 - RNA, 22 nt, Homo sapiens
aguugcaagucuugaguaaaga

SEQ ID NO: 120004 - RNA, 22 nt, Homo sapiens
auaaaugcaaugguauuuuuga

SEQ ID NO: 120005 - RNA, 22 nt, Homo sapiens
auaaaugcauugagaacugcug

SEQ ID NO: 120006 - RNA, 22 nt, Homo sapiens
auaaaugcuuagaucuguauau

SEQ ID NO: 120007 - RNA, 22 nt, Homo sapiens
auaaggcagcugcuaaaaggca

SEQ ID NO: 120008 - RNA, 22 nt, Homo sapiens
auaaguauuuggacuuuacugu

SEQ ID NO: 120009 - RNA, 22 nt, Homo sapiens
auaaucaugucugaaaccuuug

SEQ ID NO: 120010 - RNA, 22 nt, Homo sapiens
auacaguguauguauaguacau

SEQ ID NO: 120011 - RNA, 22 nt, Homo sapiens
auacuguuuuacaucauugccu

SEQ ID NO: 120012 - RNA, 22 nt, Homo sapiens
auagcagcucacuuauuuaugg

SEQ ID NO: 120013 - RNA, 20 nt, Homo sapiens
auagcauugauggacucaaa

SEQ ID NO: 120014 - RNA, 22 nt, Homo sapiens
auaguagcaugcacuggugcug

SEQ ID NO: 120015 - RNA, 19 nt, Homo sapiens
auaguguaggaaaacagcu

SEQ ID NO: 120016 - RNA, 22 nt, Homo sapiens
auaucaaggccauuuucuaaau

SEQ ID NO: 120017 - RNA, 22 nt, Homo sapiens
auaugcauacauguaugcagga

SEQ ID NO: 120018 - RNA, 20 nt, Homo sapiens
auaugcauguguuuucacuu

SEQ ID NO: 120019 - RNA, 22 nt, Homo sapiens
auauucacagguaucagagauu

SEQ ID NO: 120020 - RNA, 20 nt, Homo sapiens
aucaaagacuuagaggggga

SEQ ID NO: 120021 - RNA, 22 nt, Homo sapiens
aucacagcuacuccucugucuu

SEQ ID NO: 120022 - RNA, 22 nt, Homo sapiens
aucacauggccagguaguaauc

SEQ ID NO: 120023 - RNA, 22 nt, Homo sapiens
aucagaaucucuugagaguguu

SEQ ID NO: 120024 - RNA, 22 nt, Homo sapiens
aucaggaaccuuuuuggugugu

SEQ ID NO: 120025 - RNA, 22 nt, Homo sapiens
aucagugcauguuuguugagcu

SEQ ID NO: 120026 - RNA, 22 nt, Homo sapiens
aucccugagccugacucucaga

SEQ ID NO: 120027 - RNA, 21 nt, Homo sapiens
auccuucuuuuucaaccugug

SEQ ID NO: 120028 - RNA, 22 nt, Homo sapiens
aucugguguuuccuucacauug

SEQ ID NO: 120029 - RNA, 21 nt, Homo sapiens
aucugugagaccuuggggguu

SEQ ID NO: 120030 - RNA, 22 nt, Homo sapiens
augaaaacaugauuugccuguu

SEQ ID NO: 120031 - RNA, 22 nt, Homo sapiens
augaaaagcauaaacgcugaag

SEQ ID NO: 120032 - RNA, 22 nt, Homo sapiens
augaaagugauaaaugucucua

SEQ ID NO: 120033 - RNA, 22 nt, Homo sapiens
augaaaguguguggaaacuuga

SEQ ID NO: 120034 - RNA, 22 nt, Homo sapiens
augaacucaucaucuagguuuu

SEQ ID NO: 120035 - RNA, 20 nt, Homo sapiens
augaaggcaggugugaguuu

SEQ ID NO: 120036 - RNA, 22 nt, Homo sapiens
augaaguauuaggacacauuua

SEQ ID NO: 120037 - RNA, 22 nt, Homo sapiens
augaccauuucaauugauaugg

SEQ ID NO: 120038 - RNA, 22 nt, Homo sapiens
augagaaucauuucagcuugua

SEQ ID NO: 120039 - RNA, 22 nt, Homo sapiens
augagaucugugaacaccuguc

SEQ ID NO: 120040 - RNA, 22 nt, Homo sapiens
augagauuauguaaagagacca

SEQ ID NO: 120041 - RNA, 22 nt, Homo sapiens
augagauucuuagagaagucug

SEQ ID NO: 120042 - RNA, 22 nt, Homo sapiens
augaggugauuucuguucgggu

SEQ ID NO: 120043 - RNA, 22 nt, Homo sapiens
augaucacaccacugcacucca

SEQ ID NO: 120044 - RNA, 22 nt, Homo sapiens
augaugaaguaagugcuuagga

SEQ ID NO: 120045 - RNA, 22 nt, Homo sapiens
augauuguucucacucaagaga

SEQ ID NO: 120046 - RNA, 22 nt, Homo sapiens
augcaaaucuuaaguaugugug

SEQ ID NO: 120047 - RNA, 22 nt, Homo sapiens
augcacaugcgaaaacuugugu

SEQ ID NO: 120048 - RNA, 22 nt, Homo sapiens
augcagagaaaucuaaaauaug

SEQ ID NO: 120049 - RNA, 22 nt, Homo sapiens
augcauauuccugggccucacu

SEQ ID NO: 120050 - RNA, 22 nt, Homo sapiens
augccagggagaauuguucaag

SEQ ID NO: 120051 - RNA, 19 nt, Homo sapiens
augccuggagaugguuaua

SEQ ID NO: 120052 - RNA, 22 nt, Homo sapiens
augcuacugaccccuacuuaca

SEQ ID NO: 120053 - RNA, 22 nt, Homo sapiens
augcuacuggacaauggugacu

SEQ ID NO: 120054 - RNA, 22 nt, Homo sapiens
augcuuguguuggggcagugga

SEQ ID NO: 120055 - RNA, 22 nt, Homo sapiens
auggaagacuccucuuugggua

SEQ ID NO: 120056 - RNA, 22 nt, Homo sapiens
auggaagcugauuagauaguac

SEQ ID NO: 120057 - RNA, 22 nt, Homo sapiens
auggcaaaauguuccuaguggu

SEQ ID NO: 120058 - RNA, 22 nt, Homo sapiens
auggcaaugcgauggugacuga

SEQ ID NO: 120059 - RNA, 22 nt, Homo sapiens
auggcacuacugggaaugucuu

SEQ ID NO: 120060 - RNA, 22 nt, Homo sapiens
auggcacuguguccugggguca

SEQ ID NO: 120061 - RNA, 22 nt, Homo sapiens
auggcacuuuggacugcuagau

SEQ ID NO: 120062 - RNA, 22 nt, Homo sapiens
auggcccuguguggagcugcug

SEQ ID NO: 120063 - RNA, 22 nt, Homo sapiens
auggcuagauuguaugguaguu

SEQ ID NO: 120064 - RNA, 22 nt, Homo sapiens
auggcucuguuccaugugucuu

SEQ ID NO: 120065 - RNA, 22 nt, Homo sapiens
auggcuguuuaagaguuucauu

SEQ ID NO: 120066 - RNA, 22 nt, Homo sapiens
augggacugggugccguggagc

SEQ ID NO: 120067 - RNA, 22 nt, Homo sapiens
augggguaggcuugcuguagua

SEQ ID NO: 120068 - RNA, 22 nt, Homo sapiens
auguccaugagcacauguauca

SEQ ID NO: 120069 - RNA, 22 nt, Homo sapiens
augugcauaugaagcacagaca

SEQ ID NO: 120070 - RNA, 22 nt, Homo sapiens
augugcuuuuuaaacagaugcu

SEQ ID NO: 120071 - RNA, 22 nt, Homo sapiens
auucaucagggauauuggucug

SEQ ID NO: 120072 - RNA, 22 nt, Homo sapiens
auugagcaauuccuaugugcuu

SEQ ID NO: 120073 - RNA, 18 nt, Homo sapiens
auugcacaccagccuggg

SEQ ID NO: 120074 - RNA, 22 nt, Homo sapiens
auuggggaaugguggcuuuagu

SEQ ID NO: 120075 - RNA, 22 nt, Homo sapiens
auuguaauuuuagagaaagugg

SEQ ID NO: 120076 - RNA, 22 nt, Homo sapiens
auuugucacuuaacagccauua

SEQ ID NO: 120077 - RNA, 22 nt, Homo sapiens
caaagugcuggccgggcgcagu

SEQ ID NO: 120078 - RNA, 22 nt, Homo sapiens
caaagugcugggacuggccggg

SEQ ID NO: 120079 - RNA, 22 nt, Homo sapiens
caaagugcugggaugggccagg

SEQ ID NO: 120080 - RNA, 22 nt, Homo sapiens
caaauugcuugucuguagugga

SEQ ID NO: 120081 - RNA, 21 nt, Homo sapiens
caaugacacuguagcugugcu

SEQ ID NO: 120082 - RNA, 22 nt, Homo sapiens
cacagcacaggcaugaguguca

SEQ ID NO: 120083 - RNA, 22 nt, Homo sapiens
aaaagucuguagugaaagguga

SEQ ID NO: 120084 - RNA, 18 nt, Homo sapiens
aaacugcuuccuuggccu

SEQ ID NO: 120085 - RNA, 20 nt, Homo sapiens
aaaggcugugagaacgagau

SEQ ID NO: 120086 - RNA, 18 nt, Homo sapiens
aaagugaugucauucuuu

SEQ ID NO: 120087 - RNA, 22 nt, Homo sapiens
aaagugcugggauuggccgggc

SEQ ID NO: 120088 - RNA, 22 nt, Homo sapiens
aaaguucuugcugaaggauuau

SEQ ID NO: 120089 - RNA, 22 nt, Homo sapiens
aaaugacuuuuuaugcagagua

SEQ ID NO: 120090 - RNA, 22 nt, Homo sapiens
uugauauuacucaguaacagau

SEQ ID NO: 120091 - RNA, 22 nt, Homo sapiens
uugauuagauccaguugauuga

SEQ ID NO: 120092 - RNA, 22 nt, Homo sapiens
uugcaaaguugccaaggaagga

SEQ ID NO: 120093 - RNA, 22 nt, Homo sapiens
uugcaaaucucuuguguuuggu

SEQ ID NO: 120094 - RNA, 22 nt, Homo sapiens
uugcacuccggccuggguaaca

SEQ ID NO: 120095 - RNA, 22 nt, Homo sapiens
uugcacucuccagccucggcaa

SEQ ID NO: 120096 - RNA, 22 nt, Homo sapiens
uugccaacauggugaacuccca

SEQ ID NO: 120097 - RNA, 21 nt, Homo sapiens
uugccugacacuggaagaaau

SEQ ID NO: 120098 - RNA, 22 nt, Homo sapiens
uugcuuaggcuggagugcagug

SEQ ID NO: 120099 - RNA, 22 nt, Homo sapiens
uuggaaaguuguuguaguuauu

SEQ ID NO: 120100 - RNA, 22 nt, Homo sapiens
uuggaaugcaacagaaggauaa

SEQ ID NO: 120101 - RNA, 22 nt, Homo sapiens
uuggaauguacucuagccuaug

SEQ ID NO: 120102 - RNA, 22 nt, Homo sapiens
uuggaaugugacugauaauauu

SEQ ID NO: 120103 - RNA, 22 nt, Homo sapiens
uuggaccacuugauuucugguc

SEQ ID NO: 120104 - RNA, 22 nt, Homo sapiens
uuggacuuuaagauagagaugu

SEQ ID NO: 120105 - RNA, 22 nt, Homo sapiens
uuggagugugagagcagccugg

SEQ ID NO: 120106 - RNA, 22 nt, Homo sapiens
uuggcacugagcaagaacaggg

SEQ ID NO: 120107 - RNA, 20 nt, Homo sapiens
aguauucacuuuuuucaugg

SEQ ID NO: 120108 - RNA, 22 nt, Homo sapiens
agucaacaucaugaaguggaaa

SEQ ID NO: 120109 - RNA, 22 nt, Homo sapiens
agucaguggaguaaauguaauu

SEQ ID NO: 120110 - RNA, 22 nt, Homo sapiens
agucagugucuguaaggagaac

SEQ ID NO: 120111 - RNA, 22 nt, Homo sapiens
agucaguguguauugauggcac

SEQ ID NO: 120112 - RNA, 22 nt, Homo sapiens
agucaugguaguaaauuuggac

SEQ ID NO: 120113 - RNA, 22 nt, Homo sapiens
agugauuuuaacuuccagcaau

SEQ ID NO: 120114 - RNA, 22 nt, Homo sapiens
agugcaguggcacaaucuuggc

SEQ ID NO: 120115 - RNA, 22 nt, Homo sapiens
agugcuuaauagauguccagca

SEQ ID NO: 120116 - RNA, 22 nt, Homo sapiens
aguggcuuuuuaguggcagaug

SEQ ID NO: 120117 - RNA, 19 nt, Homo sapiens
auaaaugccuacaagggug

SEQ ID NO: 120118 - RNA, 22 nt, Homo sapiens
auaaaugccuguuguuuuaagc

SEQ ID NO: 120119 - RNA, 19 nt, Homo sapiens
auacacguguauacauaca

SEQ ID NO: 120120 - RNA, 22 nt, Homo sapiens
auacaguaucuucuggcaagca

SEQ ID NO: 120121 - RNA, 22 nt, Homo sapiens
auagaagcuauguauaggggcc

SEQ ID NO: 120122 - RNA, 22 nt, Homo sapiens
auagcacaguguguguacacca

SEQ ID NO: 120123 - RNA, 22 nt, Homo sapiens
auagcagacauuucaaggcagg

SEQ ID NO: 120124 - RNA, 20 nt, Homo sapiens
auagcagcaugauuuauaau

SEQ ID NO: 120125 - RNA, 22 nt, Homo sapiens
auauagcucuggcuggaugacu

SEQ ID NO: 120126 - RNA, 22 nt, Homo sapiens
auauaguguuuuuugguacgcu

SEQ ID NO: 120127 - RNA, 22 nt, Homo sapiens
auaucaacaugguaggguuggu

SEQ ID NO: 120128 - RNA, 22 nt, Homo sapiens
auaucacucccaauaucgcagg

SEQ ID NO: 120129 - RNA, 22 nt, Homo sapiens
auauuacuggcuauaucgcaag

SEQ ID NO: 120130 - RNA, 22 nt, Homo sapiens
aucaaguaaucugaguaagagu

SEQ ID NO: 120131 - RNA, 22 nt, Homo sapiens
aucacuuugcucuccagugugg

SEQ ID NO: 120132 - RNA, 22 nt, Homo sapiens
aucagaaucucuagaggacugu

SEQ ID NO: 120133 - RNA, 22 nt, Homo sapiens
aucaggcacacauuggaguuug

SEQ ID NO: 120134 - RNA, 22 nt, Homo sapiens
aucaucacaguuguguguaaug

SEQ ID NO: 120135 - RNA, 22 nt, Homo sapiens
aucauggaguauuugcaagucu

SEQ ID NO: 120136 - RNA, 22 nt, Homo sapiens
aucauguuuauguguaggauau

SEQ ID NO: 120137 - RNA, 22 nt, Homo sapiens
aucucauuccuucugggcugau

SEQ ID NO: 120138 - RNA, 22 nt, Homo sapiens
aucugcauuagggugaagaccu

SEQ ID NO: 120139 - RNA, 22 nt, Homo sapiens
augaaacuggagcgccuggagg

SEQ ID NO: 120140 - RNA, 22 nt, Homo sapiens
augaaagucaauccccaagugu

SEQ ID NO: 120141 - RNA, 22 nt, Homo sapiens
augaaaucacugugaugcccua

SEQ ID NO: 120142 - RNA, 22 nt, Homo sapiens
augaaaucuuuggcagaucuua

SEQ ID NO: 120143 - RNA, 22 nt, Homo sapiens
augaagagaaaguggaucuugg

SEQ ID NO: 120144 - RNA, 22 nt, Homo sapiens
augacaagaguguucagggaga

SEQ ID NO: 120145 - RNA, 22 nt, Homo sapiens
augacaaugaaucccuguuuca

SEQ ID NO: 120146 - RNA, 22 nt, Homo sapiens
augacagagauaugugaauuuu

SEQ ID NO: 120147 - RNA, 20 nt, Homo sapiens
augacuagaggacaugguaa

SEQ ID NO: 120148 - RNA, 22 nt, Homo sapiens
augagacuagaagagaauaaua

SEQ ID NO: 120149 - RNA, 22 nt, Homo sapiens
augaggcuauaauuuuuaugua

SEQ ID NO: 120150 - RNA, 22 nt, Homo sapiens
augaggugaguaaauaaaugaa

SEQ ID NO: 120151 - RNA, 22 nt, Homo sapiens
augaggugggcggcuuggaaga

SEQ ID NO: 120152 - RNA, 22 nt, Homo sapiens
augaucacuguggaaauucagc

SEQ ID NO: 120153 - RNA, 22 nt, Homo sapiens
augaucaucugaaagcuuuuac

SEQ ID NO: 120154 - RNA, 22 nt, Homo sapiens
augaucauggaagugcacccau

SEQ ID NO: 120155 - RNA, 22 nt, Homo sapiens
augaugcugcaguuguugccaa

SEQ ID NO: 120156 - RNA, 19 nt, Homo sapiens
augauugucuauggaggaa

SEQ ID NO: 120157 - RNA, 19 nt, Homo sapiens
augcaaugucacaggcugc

SEQ ID NO: 120158 - RNA, 22 nt, Homo sapiens
augcacaguccagcccaugugg

SEQ ID NO: 120159 - RNA, 22 nt, Homo sapiens
augcacaucagcuccagggacc

SEQ ID NO: 120160 - RNA, 22 nt, Homo sapiens
augcacauggcuaacuuuuuuc

SEQ ID NO: 120161 - RNA, 22 nt, Homo sapiens
augcauaugucuuuauaguggc

SEQ ID NO: 120162 - RNA, 22 nt, Homo sapiens
augcauggcagagucaggguac

SEQ ID NO: 120163 - RNA, 21 nt, Homo sapiens
auggaaagacugccucuucaa

SEQ ID NO: 120164 - RNA, 22 nt, Homo sapiens
auggaaggagaggaaugaauga

SEQ ID NO: 120165 - RNA, 22 nt, Homo sapiens
auggcaaugcgaugaugacuga

SEQ ID NO: 120166 - RNA, 22 nt, Homo sapiens
auggcaccauguuaugauaaua

SEQ ID NO: 120167 - RNA, 22 nt, Homo sapiens
auggcacuaaguucaacacuua

SEQ ID NO: 120168 - RNA, 22 nt, Homo sapiens
auggcacuaaugggaguuuacu

SEQ ID NO: 120169 - RNA, 22 nt, Homo sapiens
auggcacucaaucaaguugaga

SEQ ID NO: 120170 - RNA, 22 nt, Homo sapiens
auggcacugauggaaguaccuu

SEQ ID NO: 120171 - RNA, 22 nt, Homo sapiens
auggcagcccucuuuauccaug

SEQ ID NO: 120172 - RNA, 22 nt, Homo sapiens
auggcagugagucucuaguauu

SEQ ID NO: 120173 - RNA, 22 nt, Homo sapiens
auggccuuguauaccuggcaaa

SEQ ID NO: 120174 - RNA, 22 nt, Homo sapiens
auggcuuuggucucccagugau

SEQ ID NO: 120175 - RNA, 22 nt, Homo sapiens
auggcuuuguguucagagcuga

SEQ ID NO: 120176 - RNA, 21 nt, Homo sapiens
augugcacuaugucauuuaau

SEQ ID NO: 120177 - RNA, 22 nt, Homo sapiens
augugcuuuuggugagagauuu

SEQ ID NO: 120178 - RNA, 19 nt, Homo sapiens
augugguuagcaugacugc

SEQ ID NO: 120179 - RNA, 22 nt, Homo sapiens
auguuauguucuucucuguaua

SEQ ID NO: 120180 - RNA, 22 nt, Homo sapiens
auguugcuugaaggcauuuugu

SEQ ID NO: 120181 - RNA, 22 nt, Homo sapiens
auuaacaucuagaguuuuggug

SEQ ID NO: 120182 - RNA, 22 nt, Homo sapiens
auuacaugucuauccaugaaca

SEQ ID NO: 120183 - RNA, 22 nt, Homo sapiens
auuauaugucaucacagacacc

SEQ ID NO: 120184 - RNA, 22 nt, Homo sapiens
auuauugacucauagaaaggau

SEQ ID NO: 120185 - RNA, 22 nt, Homo sapiens
aaaugcaguugguggggauaug

SEQ ID NO: 120186 - RNA, 22 nt, Homo sapiens
aaaugcauugagggaaaaggca

SEQ ID NO: 120187 - RNA, 22 nt, Homo sapiens
aaaugcucuuuaugaaguugga

SEQ ID NO: 120188 - RNA, 20 nt, Homo sapiens
aaaugcuguaauguuuggga

SEQ ID NO: 120189 - RNA, 22 nt, Homo sapiens
aaaugcugucugugagccucau

SEQ ID NO: 120190 - RNA, 22 nt, Homo sapiens
aaaugggacugggguccuuuga

SEQ ID NO: 120191 - RNA, 19 nt, Homo sapiens
aaaugugcacuguuuucca

SEQ ID NO: 120192 - RNA, 22 nt, Homo sapiens
aaauugcaguuaggaugauggu

SEQ ID NO: 120193 - RNA, 22 nt, Homo sapiens
aacacggcccgcagagcaagcu

SEQ ID NO: 120194 - RNA, 22 nt, Homo sapiens
aacacuguuuccagucaugauc

SEQ ID NO: 120195 - RNA, 22 nt, Homo sapiens
aacagcacacccgcugcuucca

SEQ ID NO: 120196 - RNA, 22 nt, Homo sapiens
aacaggguggugccugguccau

SEQ ID NO: 120197 - RNA, 22 nt, Homo sapiens
aacaggguguuugcaguuucuu

SEQ ID NO: 120198 - RNA, 22 nt, Homo sapiens
aacagugccugucauuuaguag

SEQ ID NO: 120199 - RNA, 21 nt, Homo sapiens
aacagugcuuaguagauguuc

SEQ ID NO: 120200 - RNA, 22 nt, Homo sapiens
aacugggcaagcauuacauggu

SEQ ID NO: 120201 - RNA, 22 nt, Homo sapiens
aacuugcacuugauugagagcu

SEQ ID NO: 120202 - RNA, 21 nt, Homo sapiens
aagaaagcuggacuugccgcu

SEQ ID NO: 120203 - RNA, 21 nt, Homo sapiens
aagcacauugaguguguguga

SEQ ID NO: 120204 - RNA, 22 nt, Homo sapiens
aagccacuguaccugucucuua

SEQ ID NO: 120205 - RNA, 22 nt, Homo sapiens
aagcugcauuuucuagaugcuu

SEQ ID NO: 120206 - RNA, 22 nt, Homo sapiens
aaggagcuuaagugacuuguac

SEQ ID NO: 120207 - RNA, 22 nt, Homo sapiens
aaggaguguggugaucuugggc

SEQ ID NO: 120208 - RNA, 22 nt, Homo sapiens
aaggcuguuguguaauaggauu

SEQ ID NO: 120209 - RNA, 22 nt, Homo sapiens
aagggaauguuguggcugguuu

SEQ ID NO: 120210 - RNA, 22 nt, Homo sapiens
aagguaguuuucuuuaaugcug

SEQ ID NO: 120211 - RNA, 22 nt, Homo sapiens
aagguggugucagagagcuuau

SEQ ID NO: 120212 - RNA, 22 nt, Homo sapiens
aagguguagucucuggauaagc

SEQ ID NO: 120213 - RNA, 22 nt, Homo sapiens
aaguagcagaggcaagacuuga

SEQ ID NO: 120214 - RNA, 22 nt, Homo sapiens
aaguaucaggaauaguuauugg

SEQ ID NO: 120215 - RNA, 22 nt, Homo sapiens
aagugaccuaacaaugaaggcc

SEQ ID NO: 120216 - RNA, 22 nt, Homo sapiens
aagugcccuauuuggcccuuga

SEQ ID NO: 120217 - RNA, 22 nt, Homo sapiens
aaguggccuagagcgaccauuu

SEQ ID NO: 120218 - RNA, 23 nt, Homo sapiens
aaguucaugcucaucuguuacac

SEQ ID NO: 120219 - RNA, 22 nt, Homo sapiens
aaguugcuuuagguaagucaau

SEQ ID NO: 120220 - RNA, 22 nt, Homo sapiens
aauaaaguaggaggugaggaaa

SEQ ID NO: 120221 - RNA, 22 nt, Homo sapiens
aauacugugauaucgagcgauu

SEQ ID NO: 120222 - RNA, 22 nt, Homo sapiens
aauagcuguuuuuaauuccugc

SEQ ID NO: 120223 - RNA, 22 nt, Homo sapiens
aauaucacaggguguacacuca

SEQ ID NO: 120224 - RNA, 22 nt, Homo sapiens
aaucacacuugauguugagcaa

SEQ ID NO: 120225 - RNA, 22 nt, Homo sapiens
aaucacagccagcuuccgcuau

SEQ ID NO: 120226 - RNA, 22 nt, Homo sapiens
aaucacaggucuuggcugcaug

SEQ ID NO: 120227 - RNA, 22 nt, Homo sapiens
aaucauauugucugccaagagg

SEQ ID NO: 120228 - RNA, 22 nt, Homo sapiens
aaucccuggacuuucggaggcu

SEQ ID NO: 120229 - RNA, 22 nt, Homo sapiens
aaugacagccagauucuucucu

SEQ ID NO: 120230 - RNA, 22 nt, Homo sapiens
aauggcaagagccacagaggcg

SEQ ID NO: 120231 - RNA, 18 nt, Homo sapiens
aauggcucuggguucuaa

SEQ ID NO: 120232 - RNA, 22 nt, Homo sapiens
aauugcacuaagcauaguccag

SEQ ID NO: 120233 - RNA, 22 nt, Homo sapiens
acacaaugguaaguguuugugu

SEQ ID NO: 120234 - RNA, 22 nt, Homo sapiens
acacugcugaguaaauaauuuu

SEQ ID NO: 120235 - RNA, 22 nt, Homo sapiens
acagaucagagauauuuagguu

SEQ ID NO: 120236 - RNA, 22 nt, Homo sapiens
acaggugaaguauuacacuaag

SEQ ID NO: 120237 - RNA, 23 nt, Homo sapiens
acagucuaguuugaagucaggua

SEQ ID NO: 120238 - RNA, 22 nt, Homo sapiens
acaguggaauguaggguuugag

SEQ ID NO: 120239 - RNA, 22 nt, Homo sapiens
acaguggugcgaucucggcuca

SEQ ID NO: 120240 - RNA, 22 nt, Homo sapiens
acauaguagacacugaaaauau

SEQ ID NO: 120241 - RNA, 22 nt, Homo sapiens
acaugacauugggguggggaua

SEQ ID NO: 120242 - RNA, 22 nt, Homo sapiens
acccagaagucauucaggaaca

SEQ ID NO: 120243 - RNA, 22 nt, Homo sapiens
accccauuugcacugagcccuu

SEQ ID NO: 120244 - RNA, 22 nt, Homo sapiens
acccugucagcuggccugggca

SEQ ID NO: 120245 - RNA, 19 nt, Homo sapiens
acccuguccccaccuuuac

SEQ ID NO: 120246 - RNA, 22 nt, Homo sapiens
acugcacuccagccuccugaca

SEQ ID NO: 120247 - RNA, 22 nt, Homo sapiens
acugcacuccagccuuagugac

SEQ ID NO: 120248 - RNA, 22 nt, Homo sapiens
acuggcucugcuuuacaaacag

SEQ ID NO: 120249 - RNA, 22 nt, Homo sapiens
acuggcuuuugagaaaaacacu

SEQ ID NO: 120250 - RNA, 22 nt, Homo sapiens
agaauaauguccccccaaggga

SEQ ID NO: 120251 - RNA, 22 nt, Homo sapiens
agaauguaacucuaugaaggca

SEQ ID NO: 120252 - RNA, 22 nt, Homo sapiens
agaaugugaacaucuugaaagu

SEQ ID NO: 120253 - RNA, 22 nt, Homo sapiens
agaaugugaccuuauuuggaga

SEQ ID NO: 120254 - RNA, 22 nt, Homo sapiens
agagacauugcuccaacucacc

SEQ ID NO: 120255 - RNA, 22 nt, Homo sapiens
agagccacacucuccuaacuca

SEQ ID NO: 120256 - RNA, 22 nt, Homo sapiens
agagccacauuaaauaugggaa

SEQ ID NO: 120257 - RNA, 22 nt, Homo sapiens
agaggaguacuacuccaagucu

SEQ ID NO: 120258 - RNA, 22 nt, Homo sapiens
agaguacugacguuugcaaauu

SEQ ID NO: 120259 - RNA, 19 nt, Homo sapiens
agaguauugaauuugcccu

SEQ ID NO: 120260 - RNA, 22 nt, Homo sapiens
agauauguuuaguuucaaaaug

SEQ ID NO: 120261 - RNA, 22 nt, Homo sapiens
uggaguuugacaugccuuuggg

SEQ ID NO: 120262 - RNA, 22 nt, Homo sapiens
uggauugaaagcuuuaauauug

SEQ ID NO: 120263 - RNA, 22 nt, Homo sapiens
uggcaagaacaacaauuacuuu

SEQ ID NO: 120264 - RNA, 22 nt, Homo sapiens
uggcaagaacugcaauugcuuu

SEQ ID NO: 120265 - RNA, 22 nt, Homo sapiens
uggcaagagcugcauucaucug

SEQ ID NO: 120266 - RNA, 22 nt, Homo sapiens
uggcaagagggaugcaagguuu

SEQ ID NO: 120267 - RNA, 22 nt, Homo sapiens
uggcaagaucacaauuacuuuu

SEQ ID NO: 120268 - RNA, 19 nt, Homo sapiens
uggcaaugucagcagagau

SEQ ID NO: 120269 - RNA, 22 nt, Homo sapiens
uggcacuaugugacaagguuuu

SEQ ID NO: 120270 - RNA, 22 nt, Homo sapiens
uggcagcgugaaagacuuuuuc

SEQ ID NO: 120271 - RNA, 22 nt, Homo sapiens
uggcauauaauauagaagacua

SEQ ID NO: 120272 - RNA, 22 nt, Homo sapiens
uggcauaugguauuugauaucu

SEQ ID NO: 120273 - RNA, 20 nt, Homo sapiens
uggcaugaaauuuuccaagc

SEQ ID NO: 120274 - RNA, 23 nt, Homo sapiens
uggccagaaacuucuuuucaucc

SEQ ID NO: 120275 - RNA, 22 nt, Homo sapiens
uggcccccucccaaaucucaua

SEQ ID NO: 120276 - RNA, 22 nt, Homo sapiens
uggcuacugaccugcuaggggg

SEQ ID NO: 120277 - RNA, 22 nt, Homo sapiens
uggcuacuguacuugagcuauu

SEQ ID NO: 120278 - RNA, 22 nt, Homo sapiens
uggcucuguuuguuaacuagac

SEQ ID NO: 120279 - RNA, 22 nt, Homo sapiens
uggcuuuuaucuacucucaacu

SEQ ID NO: 120280 - RNA, 22 nt, Homo sapiens
ugggaagaagguuuacuugcca

SEQ ID NO: 120281 - RNA, 22 nt, Homo sapiens
guuugccuuuuagauaggaaug

SEQ ID NO: 120282 - RNA, 22 nt, Homo sapiens
guuugugcuccuaugagaaucu

SEQ ID NO: 120283 - RNA, 22 nt, Homo sapiens
uaaaccacguuuacauuugaga

SEQ ID NO: 120284 - RNA, 22 nt, Homo sapiens
uaaagugcugagaugaggcugg

SEQ ID NO: 120285 - RNA, 22 nt, Homo sapiens
uaaaugacugucaguagaugaa

SEQ ID NO: 120286 - RNA, 22 nt, Homo sapiens
uaaauggauauugccaucuccu

SEQ ID NO: 120287 - RNA, 22 nt, Homo sapiens
uaacaagagagucagucagucc

SEQ ID NO: 120288 - RNA, 22 nt, Homo sapiens
uaacaccuugcucugucaauaa

SEQ ID NO: 120289 - RNA, 22 nt, Homo sapiens
uaacaguauaugugguaucuau

SEQ ID NO: 120290 - RNA, 22 nt, Homo sapiens
uaacccugaggggcuuggggac

SEQ ID NO: 120291 - RNA, 22 nt, Homo sapiens
uaacuacuucugcuucagagua

SEQ ID NO: 120292 - RNA, 22 nt, Homo sapiens
uaagacacauguguucccaggc

SEQ ID NO: 120293 - RNA, 16 nt, Homo sapiens
uaagccccacgugcau

SEQ ID NO: 120294 - RNA, 22 nt, Homo sapiens
uaaggcaaaccuuggcugcagu

SEQ ID NO: 120295 - RNA, 22 nt, Homo sapiens
gcaauguuacugaauguguuuu

SEQ ID NO: 120296 - RNA, 22 nt, Homo sapiens
gcagaauugguuucuucuaagg

SEQ ID NO: 120297 - RNA, 19 nt, Homo sapiens
gcagagaugugguagcuug

SEQ ID NO: 120298 - RNA, 23 nt, Homo sapiens
gcagcaaugucacagggguccgg

SEQ ID NO: 120299 - RNA, 22 nt, Homo sapiens
gcaucacagggagacaggccuc

SEQ ID NO: 120300 - RNA, 22 nt, Homo sapiens
gcaugaugaauaauaucacaag

SEQ ID NO: 120301 - RNA, 22 nt, Homo sapiens
gcauugcacuuggcauagacug

SEQ ID NO: 120302 - RNA, 20 nt, Homo sapiens
gccacaguuaagcuucugcc

SEQ ID NO: 120303 - RNA, 22 nt, Homo sapiens
gcccugagauucuuggauucug

SEQ ID NO: 120304 - RNA, 22 nt, Homo sapiens
gcccuuugugucuggcuggggu

SEQ ID NO: 120305 - RNA, 22 nt, Homo sapiens
gcuaaaucuguaaaaugaggag

SEQ ID NO: 120306 - RNA, 22 nt, Homo sapiens
gcuaggagaucugcugcucucu

SEQ ID NO: 120307 - RNA, 22 nt, Homo sapiens
gcucaguuuccucagcugcaaa

SEQ ID NO: 120308 - RNA, 22 nt, Homo sapiens
gcugacacugggcuauagaucu

SEQ ID NO: 120309 - RNA, 22 nt, Homo sapiens
gcugcuguuucucuuucagcau

SEQ ID NO: 120310 - RNA, 22 nt, Homo sapiens
gcugguguugugaaucaggccg

SEQ ID NO: 120311 - RNA, 22 nt, Homo sapiens
gcugucaugagcaacacaugaa

SEQ ID NO: 120312 - RNA, 22 nt, Homo sapiens
gcugugauucuguguagauagu

SEQ ID NO: 120313 - RNA, 22 nt, Homo sapiens
ggaaagacuauuguaaaggaug

SEQ ID NO: 120314 - RNA, 22 nt, Homo sapiens
ggaaagcuagguguggguguac

SEQ ID NO: 120315 - RNA, 19 nt, Homo sapiens
ggaaugcaccaguccuugc

SEQ ID NO: 120316 - RNA, 20 nt, Homo sapiens
ggaauguuaaucuccaugau

SEQ ID NO: 120317 - RNA, 21 nt, Homo sapiens
ggaauguugccagcagccaga

SEQ ID NO: 120318 - RNA, 22 nt, Homo sapiens
ggagaucuuguuaaaguacaga

SEQ ID NO: 120319 - RNA, 22 nt, Homo sapiens
ggauaucauuauuucuagggcu

SEQ ID NO: 120320 - RNA, 22 nt, Homo sapiens
ggcaaaugaagauggagaggcu

SEQ ID NO: 120321 - RNA, 22 nt, Homo sapiens
ggcaagaaaaugcaauuacugu

SEQ ID NO: 120322 - RNA, 22 nt, Homo sapiens
ggcaguggaagugccaguuucu

SEQ ID NO: 120323 - RNA, 22 nt, Homo sapiens
ggcaguuuguucuugcuccuuu

SEQ ID NO: 120324 - RNA, 22 nt, Homo sapiens
ggcaugaaguagcccacaggca

SEQ ID NO: 120325 - RNA, 22 nt, Homo sapiens
ggccagaugcgguggcucacac

SEQ ID NO: 120326 - RNA, 22 nt, Homo sapiens
gggaaauguaaagucauaagau

SEQ ID NO: 120327 - RNA, 22 nt, Homo sapiens
gggaacauggaaauucugcucu

SEQ ID NO: 120328 - RNA, 20 nt, Homo sapiens
gggaaugcaaauucucaucc

SEQ ID NO: 120329 - RNA, 19 nt, Homo sapiens
gggaggaugcgucuucagg

SEQ ID NO: 120330 - RNA, 22 nt, Homo sapiens
gggcaugaugucuuaugccuau

SEQ ID NO: 120331 - RNA, 22 nt, Homo sapiens
gggggagugugguacccagcau

SEQ ID NO: 120332 - RNA, 22 nt, Homo sapiens
ggucagugcauucuaaaggcaa

SEQ ID NO: 120333 - RNA, 22 nt, Homo sapiens
ggucugguguugaaauucuuca

SEQ ID NO: 120334 - RNA, 22 nt, Homo sapiens
ggugacugguuuaucuggcagu

SEQ ID NO: 120335 - RNA, 21 nt, Homo sapiens
ggugagaaaggagacauagac

SEQ ID NO: 120336 - RNA, 19 nt, Homo sapiens
ggugagaaauuaugggucu

SEQ ID NO: 120337 - RNA, 23 nt, Homo sapiens
ggugaggaguacagagucuucau

SEQ ID NO: 120338 - RNA, 19 nt, Homo sapiens
ggugcuugaauauuccucc

SEQ ID NO: 120339 - RNA, 22 nt, Homo sapiens
gguggcuuuuugugauggcuga

SEQ ID NO: 120340 - RNA, 22 nt, Homo sapiens
guaaaugcagaugcaugaccuu

SEQ ID NO: 120341 - RNA, 19 nt, Homo sapiens
guaaucucaguacuuuggu

SEQ ID NO: 120342 - RNA, 22 nt, Homo sapiens
guagagagaaauacaaagcugu

SEQ ID NO: 120343 - RNA, 22 nt, Homo sapiens
guaucacggugucugcguugcu

SEQ ID NO: 120344 - RNA, 22 nt, Homo sapiens
guaugugacuggaacaguagga

SEQ ID NO: 120345 - RNA, 22 nt, Homo sapiens
guauuaguuuccuguugcugcu

SEQ ID NO: 120346 - RNA, 19 nt, Homo sapiens
guauuugguaaacucucca

SEQ ID NO: 120347 - RNA, 22 nt, Homo sapiens
gucaaaugcacagaaccauuaa

SEQ ID NO: 120348 - RNA, 22 nt, Homo sapiens
gucaggaugauuuggggaggug

SEQ ID NO: 120349 - RNA, 22 nt, Homo sapiens
gucagggagggauagaugauua

SEQ ID NO: 120350 - RNA, 22 nt, Homo sapiens
gucaggugcuuacgcggagauc

SEQ ID NO: 120351 - RNA, 18 nt, Homo sapiens
gucauagaaugaugguuc

SEQ ID NO: 120352 - RNA, 22 nt, Homo sapiens
gucauccaggcuggagugaagc

SEQ ID NO: 120353 - RNA, 22 nt, Homo sapiens
gucguggagucucuggcuugua

SEQ ID NO: 120354 - RNA, 22 nt, Homo sapiens
gucucagugcgaaucucaaaga

SEQ ID NO: 120355 - RNA, 22 nt, Homo sapiens
gucucauugcaguuagaccugu

SEQ ID NO: 120356 - RNA, 22 nt, Homo sapiens
gucuccgagccguguggagccg

SEQ ID NO: 120357 - RNA, 22 nt, Homo sapiens
gucugucuuuugucuuugaaau

SEQ ID NO: 120358 - RNA, 22 nt, Homo sapiens
gucugugcauuaauacgugcug

SEQ ID NO: 120359 - RNA, 22 nt, Homo sapiens
gugaacagaaccugggaucgaa

SEQ ID NO: 120360 - RNA, 22 nt, Homo sapiens
gugaccucuguugcugucacua

SEQ ID NO: 120361 - RNA, 22 nt, Homo sapiens
gugacugggaguggugaagaua

SEQ ID NO: 120362 - RNA, 22 nt, Homo sapiens
gugagauuaccauuuaaaucag

SEQ ID NO: 120363 - RNA, 22 nt, Homo sapiens
gugaggaaggaaaccugcuagc

SEQ ID NO: 120364 - RNA, 22 nt, Homo sapiens
gugauuauuaugcacugcaugc

SEQ ID NO: 120365 - RNA, 22 nt, Homo sapiens
gugcacaaaucuuaaauguaca

SEQ ID NO: 120366 - RNA, 22 nt, Homo sapiens
gugcacaacgugcagguuaguu

SEQ ID NO: 120367 - RNA, 22 nt, Homo sapiens
gugcacauauggugcauaagug

SEQ ID NO: 120368 - RNA, 22 nt, Homo sapiens
gugcacaugguagguauugagu

SEQ ID NO: 120369 - RNA, 23 nt, Homo sapiens
gugcaugagucuuuauaguagca

SEQ ID NO: 120370 - RNA, 22 nt, Homo sapiens
gugccuucuagcuaugguuggc

SEQ ID NO: 120371 - RNA, 22 nt, Homo sapiens
gugcucauuuagagagaagcac

SEQ ID NO: 120372 - RNA, 22 nt, Homo sapiens
guggaaaacauaugcuuguuga

SEQ ID NO: 120373 - RNA, 22 nt, Homo sapiens
guggaaagaacacaaaauuagg

SEQ ID NO: 120374 - RNA, 22 nt, Homo sapiens
guggagucaucacucagagugg

SEQ ID NO: 120375 - RNA, 22 nt, Homo sapiens
guggucagaaaucucaguggca

SEQ ID NO: 120376 - RNA, 22 nt, Homo sapiens
gugucaaggaugccugucaggc

SEQ ID NO: 120377 - RNA, 22 nt, Homo sapiens
gugucaguggggagugaucuuc

SEQ ID NO: 120378 - RNA, 22 nt, Homo sapiens
guguccucgaguacacaucagg

SEQ ID NO: 120379 - RNA, 18 nt, Homo sapiens
gugucugguuaugggagu

SEQ ID NO: 120380 - RNA, 22 nt, Homo sapiens
gugugcucaucacaugcaauag

SEQ ID NO: 120381 - RNA, 22 nt, Homo sapiens
guuauguguuuccuuaauugcu

SEQ ID NO: 120382 - RNA, 22 nt, Homo sapiens
guucacacuugcaaccccagca

SEQ ID NO: 120383 - RNA, 22 nt, Homo sapiens
guuccuuguagaugcuggauau

SEQ ID NO: 120384 - RNA, 22 nt, Homo sapiens
guugaggcaggagaauuacuug

SEQ ID NO: 120385 - RNA, 22 nt, Homo sapiens
guugcaauugauguaugucuga

SEQ ID NO: 120386 - RNA, 22 nt, Homo sapiens
guuggaauguauugcuacuucu

SEQ ID NO: 120387 - RNA, 22 nt, Homo sapiens
cacagcgacuuccgccuaccgg

SEQ ID NO: 120388 - RNA, 22 nt, Homo sapiens
cacaguguuccagcuauuugaa

SEQ ID NO: 120389 - RNA, 22 nt, Homo sapiens
caccaaccucaguagcaucugu

SEQ ID NO: 120390 - RNA, 22 nt, Homo sapiens
caccagcuggcauugaauaccu

SEQ ID NO: 120391 - RNA, 19 nt, Homo sapiens
caccgccugcccccugcug

SEQ ID NO: 120392 - RNA, 22 nt, Homo sapiens
cacugcacuccagccuaagagg

SEQ ID NO: 120393 - RNA, 22 nt, Homo sapiens
cacuggucucauggcaugagag

SEQ ID NO: 120394 - RNA, 22 nt, Homo sapiens
cacuguggauggaacuauguga

SEQ ID NO: 120395 - RNA, 22 nt, Homo sapiens
cagaaguauugguaugcucugu

SEQ ID NO: 120396 - RNA, 20 nt, Homo sapiens
cagagcaaagcaguccuggc

SEQ ID NO: 120397 - RNA, 22 nt, Homo sapiens
cagagucaagcucuuguuccau

SEQ ID NO: 120398 - RNA, 22 nt, Homo sapiens
cagcccuacacagacugacuca

SEQ ID NO: 120399 - RNA, 22 nt, Homo sapiens
cagcgaggucugcgucacauug

SEQ ID NO: 120400 - RNA, 22 nt, Homo sapiens
cagcuguguuauaaacuaccau

SEQ ID NO: 120401 - RNA, 22 nt, Homo sapiens
caggaaugugaggguucccugc

SEQ ID NO: 120402 - RNA, 22 nt, Homo sapiens
caggcagugggagacaaaacug

SEQ ID NO: 120403 - RNA, 21 nt, Homo sapiens
cagguagugucugaagccaga

SEQ ID NO: 120404 - RNA, 22 nt, Homo sapiens
cagugaauuucaggucaagagu

SEQ ID NO: 120405 - RNA, 22 nt, Homo sapiens
caguuacuuuugcaccaaccua

SEQ ID NO: 120406 - RNA, 22 nt, Homo sapiens
caguucaugguaggcaccauag

SEQ ID NO: 120407 - RNA, 23 nt, Homo sapiens
caucacagagccuuccuugacuc

SEQ ID NO: 120408 - RNA, 22 nt, Homo sapiens
caucucauugaauugcugagca

SEQ ID NO: 120409 - RNA, 22 nt, Homo sapiens
caugaugcuagguauggaugaa

SEQ ID NO: 120410 - RNA, 22 nt, Homo sapiens
cauggcacagagaauguguucu

SEQ ID NO: 120411 - RNA, 22 nt, Homo sapiens
cauuguacauaaguauggagua

SEQ ID NO: 120412 - RNA, 22 nt, Homo sapiens
ccacaguagucuugggaugggc

SEQ ID NO: 120413 - RNA, 22 nt, Homo sapiens
ccagaauucucauuggaaggaa

SEQ ID NO: 120414 - RNA, 22 nt, Homo sapiens
cccgugucuuggucuagggccu

SEQ ID NO: 120415 - RNA, 20 nt, Homo sapiens
cccuaagccagaugcugggg

SEQ ID NO: 120416 - RNA, 21 nt, Homo sapiens
cccugguguuuggaguuugag

SEQ ID NO: 120417 - RNA, 22 nt, Homo sapiens
ccugaugacacgggagauguac

SEQ ID NO: 120418 - RNA, 19 nt, Homo sapiens
ccugcuguucuuuugcacc

SEQ ID NO: 120419 - RNA, 18 nt, Homo sapiens
ccuuaguuauagagaguc

SEQ ID NO: 120420 - RNA, 22 nt, Homo sapiens
ccuuggcaauggcuggggcuga

SEQ ID NO: 120421 - RNA, 22 nt, Homo sapiens
ccuuuguuaguuugcugagaau

SEQ ID NO: 120422 - RNA, 22 nt, Homo sapiens
cgccgggggaugggcaccagcg

SEQ ID NO: 120423 - RNA, 22 nt, Homo sapiens
cuauuagguuggugcaaaagua

SEQ ID NO: 120424 - RNA, 22 nt, Homo sapiens
cucaccuugugauccuccugcc

SEQ ID NO: 120425 - RNA, 22 nt, Homo sapiens
cucacugggaccacucugaagu

SEQ ID NO: 120426 - RNA, 22 nt, Homo sapiens
cucaguggauuagauaaugcac

SEQ ID NO: 120427 - RNA, 22 nt, Homo sapiens
cucagugguugauuuauuuauc

SEQ ID NO: 120428 - RNA, 22 nt, Homo sapiens
cucauggagaacaucugcuagg

SEQ ID NO: 120429 - RNA, 20 nt, Homo sapiens
cucccugacaaauguggaaa

SEQ ID NO: 120430 - RNA, 22 nt, Homo sapiens
cucucuguuugucuguuauugg

SEQ ID NO: 120431 - RNA, 22 nt, Homo sapiens
cucugguuuuucuuccauuaag

SEQ ID NO: 120432 - RNA, 22 nt, Homo sapiens
cucuuuuguuccuaguuugauc

SEQ ID NO: 120433 - RNA, 22 nt, Homo sapiens
cugacagucucauugauuugcu

SEQ ID NO: 120434 - RNA, 22 nt, Homo sapiens
cugacauggggauccaccuuag

SEQ ID NO: 120435 - RNA, 22 nt, Homo sapiens
cugaccucugucaaagacaccc

SEQ ID NO: 120436 - RNA, 22 nt, Homo sapiens
cugacugugcaugcccagcccc

SEQ ID NO: 120437 - RNA, 22 nt, Homo sapiens
cugagagugguauguuuaagug

SEQ ID NO: 120438 - RNA, 22 nt, Homo sapiens
cugagauacacuaauagucucu

SEQ ID NO: 120439 - RNA, 22 nt, Homo sapiens
cugagaucaugggucagguggu

SEQ ID NO: 120440 - RNA, 22 nt, Homo sapiens
cugagauuaagauauugggagu

SEQ ID NO: 120441 - RNA, 22 nt, Homo sapiens
cugagcaugacaucaugugacu

SEQ ID NO: 120442 - RNA, 19 nt, Homo sapiens
cugcaagguaauaggucag

SEQ ID NO: 120443 - RNA, 21 nt, Homo sapiens
cugcauccauuucugagugau

SEQ ID NO: 120444 - RNA, 20 nt, Homo sapiens
cugcuccccuacaaaucuca

SEQ ID NO: 120445 - RNA, 22 nt, Homo sapiens
cuggaagcacaacgcauuuauu

SEQ ID NO: 120446 - RNA, 18 nt, Homo sapiens
cuggaaggcuacuacagu

SEQ ID NO: 120447 - RNA, 22 nt, Homo sapiens
cuggaauauuagcuggucuuaa

SEQ ID NO: 120448 - RNA, 22 nt, Homo sapiens
cuggaguuugaggcugcaguga

SEQ ID NO: 120449 - RNA, 22 nt, Homo sapiens
cuggauagagauugaugaugcu

SEQ ID NO: 120450 - RNA, 22 nt, Homo sapiens
cuggcaaauaguagagccagga

SEQ ID NO: 120451 - RNA, 19 nt, Homo sapiens
cuggcaaaugcuuuggcca

SEQ ID NO: 120452 - RNA, 22 nt, Homo sapiens
cuggcacagugucagaaacaca

SEQ ID NO: 120453 - RNA, 22 nt, Homo sapiens
cugggaugugacuguugccccc

SEQ ID NO: 120454 - RNA, 22 nt, Homo sapiens
cugguuguuacaugcuugccag

SEQ ID NO: 120455 - RNA, 22 nt, Homo sapiens
cugucagugggaguucaggcuu

SEQ ID NO: 120456 - RNA, 22 nt, Homo sapiens
cugugauagguuagucaugaau

SEQ ID NO: 120457 - RNA, 22 nt, Homo sapiens
cugugcauuggaugucucccug

SEQ ID NO: 120458 - RNA, 23 nt, Homo sapiens
cuguggugaggcccuagaaucug

SEQ ID NO: 120459 - RNA, 22 nt, Homo sapiens
cuuaaugcuacggcucuguguu

SEQ ID NO: 120460 - RNA, 22 nt, Homo sapiens
cuuccaaguggggcacgugcca

SEQ ID NO: 120461 - RNA, 22 nt, Homo sapiens
cuucuugagacuuaggcuuugg

SEQ ID NO: 120462 - RNA, 19 nt, Homo sapiens
cuugccccauucauccucu

SEQ ID NO: 120463 - RNA, 22 nt, Homo sapiens
cuuugaugagaaaauacuuugu

SEQ ID NO: 120464 - RNA, 22 nt, Homo sapiens
cuuugauuauaaaaggguguuu

SEQ ID NO: 120465 - RNA, 22 nt, Homo sapiens
cuuugguugugcucuccacuuu

SEQ ID NO: 120466 - RNA, 23 nt, Homo sapiens
cuuuugcaaugugaucuugccac

SEQ ID NO: 120467 - RNA, 22 nt, Homo sapiens
gaaaguaauuaacgauuguugc

SEQ ID NO: 120468 - RNA, 22 nt, Homo sapiens
gaagacauuugcugcacguccu

SEQ ID NO: 120469 - RNA, 22 nt, Homo sapiens
gaagguaguuuauagauguggu

SEQ ID NO: 120470 - RNA, 22 nt, Homo sapiens
gaaguaguaaaauuuauugcag

SEQ ID NO: 120471 - RNA, 22 nt, Homo sapiens
gaauagugcugcaaugaacaua

SEQ ID NO: 120472 - RNA, 22 nt, Homo sapiens
gaauagugcugcgauaaacaua

SEQ ID NO: 120473 - RNA, 22 nt, Homo sapiens
gaaucacugugguaucccaugc

SEQ ID NO: 120474 - RNA, 22 nt, Homo sapiens
gacagugugauacuuagucuca

SEQ ID NO: 120475 - RNA, 22 nt, Homo sapiens
gacauagagccuugacuucauu

SEQ ID NO: 120476 - RNA, 22 nt, Homo sapiens
gacaucauuaugagauuuaaac

SEQ ID NO: 120477 - RNA, 22 nt, Homo sapiens
gacauguuuucauguauuugga

SEQ ID NO: 120478 - RNA, 22 nt, Homo sapiens
gacuagaaauuauuuagugagc

SEQ ID NO: 120479 - RNA, 18 nt, Homo sapiens
gacucaguuucuaaggca

SEQ ID NO: 120480 - RNA, 22 nt, Homo sapiens
gacuugaagaaucuaagggagg

SEQ ID NO: 120481 - RNA, 21 nt, Homo sapiens
gagaaucaucauggcugcaua

SEQ ID NO: 120482 - RNA, 22 nt, Homo sapiens
gagacauugacuuuguuccaga

SEQ ID NO: 120483 - RNA, 22 nt, Homo sapiens
gagauaguguggguacagcuau

SEQ ID NO: 120484 - RNA, 22 nt, Homo sapiens
gagauauuauuucccuuucaca

SEQ ID NO: 120485 - RNA, 22 nt, Homo sapiens
gagauguuuguuucacugucac

SEQ ID NO: 120486 - RNA, 18 nt, Homo sapiens
gagcaccuuuuuugcaga

SEQ ID NO: 120487 - RNA, 20 nt, Homo sapiens
gagcaucacaggccucugcu

SEQ ID NO: 120488 - RNA, 22 nt, Homo sapiens
gagccuguaggaggagaggugg

SEQ ID NO: 120489 - RNA, 22 nt, Homo sapiens
gcaguucuguaguugaaauuua

SEQ ID NO: 120490 - RNA, 22 nt, Homo sapiens
gcaugacaaugauugcucuuca

SEQ ID NO: 120491 - RNA, 20 nt, Homo sapiens
gcaugagucuuuauaguaga

SEQ ID NO: 120492 - RNA, 22 nt, Homo sapiens
gccaaaaugcugggauuacagg

SEQ ID NO: 120493 - RNA, 21 nt, Homo sapiens
gccaguguggcaauuuuucaa

SEQ ID NO: 120494 - RNA, 22 nt, Homo sapiens
gccauggaggauuuauagaggc

SEQ ID NO: 120495 - RNA, 22 nt, Homo sapiens
gcccagcguucagggaggggcu

SEQ ID NO: 120496 - RNA, 22 nt, Homo sapiens
gccccaguacaggcuccuuaga

SEQ ID NO: 120497 - RNA, 22 nt, Homo sapiens
gcccugauacauucuucugccu

SEQ ID NO: 120498 - RNA, 19 nt, Homo sapiens
gcucaccuugcugcuccag

SEQ ID NO: 120499 - RNA, 22 nt, Homo sapiens
gcugauguuggccucugggcuu

SEQ ID NO: 120500 - RNA, 22 nt, Homo sapiens
gcugcuguaccagaugugguua

SEQ ID NO: 120501 - RNA, 22 nt, Homo sapiens
gcugcuguuuaguuucuccugg

SEQ ID NO: 120502 - RNA, 22 nt, Homo sapiens
ggaaagacaccuuacuauguua

SEQ ID NO: 120503 - RNA, 22 nt, Homo sapiens
ggaaaucaucauucucgguaua

SEQ ID NO: 120504 - RNA, 22 nt, Homo sapiens
ggaacaccauuuuuccugccuu

SEQ ID NO: 120505 - RNA, 17 nt, Homo sapiens
ggaagccuuugguuuaa

SEQ ID NO: 120506 - RNA, 22 nt, Homo sapiens
ggacacguagaugccgacuagc

SEQ ID NO: 120507 - RNA, 22 nt, Homo sapiens
ggacagugaaugccacuccucc

SEQ ID NO: 120508 - RNA, 22 nt, Homo sapiens
ggagaguaauuagacugaaaga

SEQ ID NO: 120509 - RNA, 22 nt, Homo sapiens
ggagauccucugcgggcaaaga

SEQ ID NO: 120510 - RNA, 22 nt, Homo sapiens
ggaguaggcuguccggcaccca

SEQ ID NO: 120511 - RNA, 22 nt, Homo sapiens
ggagucugauguucuaaggcag

SEQ ID NO: 120512 - RNA, 22 nt, Homo sapiens
ggauggcauuucuuuagcuuuu

SEQ ID NO: 120513 - RNA, 22 nt, Homo sapiens
ggcaagaaccagggauuugcgu

SEQ ID NO: 120514 - RNA, 22 nt, Homo sapiens
ggcaaugucagcuaaugaugga

SEQ ID NO: 120515 - RNA, 22 nt, Homo sapiens
ggcccugauacaaguaaggucu

SEQ ID NO: 120516 - RNA, 22 nt, Homo sapiens
gggaauggaagacauuaugaug

SEQ ID NO: 120517 - RNA, 22 nt, Homo sapiens
gggcgagaaucggcugcucagc

SEQ ID NO: 120518 - RNA, 17 nt, Homo sapiens
gggucaccuugcaggua

SEQ ID NO: 120519 - RNA, 22 nt, Homo sapiens
ggucacauuggacuaucaaguu

SEQ ID NO: 120520 - RNA, 22 nt, Homo sapiens
ggucaguguuaucaccgaagga

SEQ ID NO: 120521 - RNA, 22 nt, Homo sapiens
ggugagaaagggauuccuguuc

SEQ ID NO: 120522 - RNA, 22 nt, Homo sapiens
guaaauaccaguuucuggaaca

SEQ ID NO: 120523 - RNA, 22 nt, Homo sapiens
guacauagucacacauauacau

SEQ ID NO: 120524 - RNA, 22 nt, Homo sapiens
guacaugcauaguuuauuucug

SEQ ID NO: 120525 - RNA, 22 nt, Homo sapiens
guagcagucacauagcagauug

SEQ ID NO: 120526 - RNA, 22 nt, Homo sapiens
guaguagcacgagcucugucuc

SEQ ID NO: 120527 - RNA, 22 nt, Homo sapiens
guaucaugaaguuucuucauuu

SEQ ID NO: 120528 - RNA, 22 nt, Homo sapiens
guaugacacaggaagcuuaacc

SEQ ID NO: 120529 - RNA, 22 nt, Homo sapiens
gucaccagcuguguuagccccu

SEQ ID NO: 120530 - RNA, 22 nt, Homo sapiens
gucacugagcagaaggaagcga

SEQ ID NO: 120531 - RNA, 22 nt, Homo sapiens
gucaggcaccgauacaguuuuu

SEQ ID NO: 120532 - RNA, 22 nt, Homo sapiens
gucagggagucucuaucagugg

SEQ ID NO: 120533 - RNA, 22 nt, Homo sapiens
gucagguaccugaaagcagcca

SEQ ID NO: 120534 - RNA, 22 nt, Homo sapiens
gucagugucuuugcagcucaga

SEQ ID NO: 120535 - RNA, 22 nt, Homo sapiens
gucaugggguacuacacauggg

SEQ ID NO: 120536 - RNA, 22 nt, Homo sapiens
gucauguuuaacuucuugagga

SEQ ID NO: 120537 - RNA, 22 nt, Homo sapiens
gucccugcgauugugggauccu

SEQ ID NO: 120538 - RNA, 22 nt, Homo sapiens
gucuagaacuucugaccuuagg

SEQ ID NO: 120539 - RNA, 22 nt, Homo sapiens
gucucccagccuacaucuuucu

SEQ ID NO: 120540 - RNA, 22 nt, Homo sapiens
gucuggagacuugggucaucaa

SEQ ID NO: 120541 - RNA, 23 nt, Homo sapiens
gucuggucccugguuggaaacca

SEQ ID NO: 120542 - RNA, 22 nt, Homo sapiens
gucugguugacagcauguggcc

SEQ ID NO: 120543 - RNA, 20 nt, Homo sapiens
gucugucuccgaguagaauu

SEQ ID NO: 120544 - RNA, 22 nt, Homo sapiens
gucuuugcauguauguucauga

SEQ ID NO: 120545 - RNA, 22 nt, Homo sapiens
gugaaagauuaaaccagugugu

SEQ ID NO: 120546 - RNA, 22 nt, Homo sapiens
gugacagucaaagacaugacuu

SEQ ID NO: 120547 - RNA, 22 nt, Homo sapiens
gugacaguggagacuuacuuca

SEQ ID NO: 120548 - RNA, 22 nt, Homo sapiens
gugaccagaugggcaggggugu

SEQ ID NO: 120549 - RNA, 22 nt, Homo sapiens
gugaggcugguccugccuccca

SEQ ID NO: 120550 - RNA, 22 nt, Homo sapiens
gugaggcuuuuccuguuagacu

SEQ ID NO: 120551 - RNA, 20 nt, Homo sapiens
gugagucauuaguaaccaaa

SEQ ID NO: 120552 - RNA, 22 nt, Homo sapiens
gugauauuuagggggccgggau

SEQ ID NO: 120553 - RNA, 22 nt, Homo sapiens
gugauuuaguagaugcuaguua

SEQ ID NO: 120554 - RNA, 22 nt, Homo sapiens
gugcacaacgugcaggcuuguu

SEQ ID NO: 120555 - RNA, 22 nt, Homo sapiens
gugcacaaucgugcauuccuug

SEQ ID NO: 120556 - RNA, 22 nt, Homo sapiens
gugcacaaugugcagguuuguu

SEQ ID NO: 120557 - RNA, 23 nt, Homo sapiens
gugcaguggcgagauuucggcuc

SEQ ID NO: 120558 - RNA, 22 nt, Homo sapiens
gugcaugcaucuuuauaguagc

SEQ ID NO: 120559 - RNA, 22 nt, Homo sapiens
gugccacaguguuaagggauuc

SEQ ID NO: 120560 - RNA, 22 nt, Homo sapiens
gugccacugcaccuggccuaag

SEQ ID NO: 120561 - RNA, 22 nt, Homo sapiens
guggacagagacuaaauguugu

SEQ ID NO: 120562 - RNA, 22 nt, Homo sapiens
guggcaagaugacuacucacug

SEQ ID NO: 120563 - RNA, 22 nt, Homo sapiens
guggcacgaugaucugggcuca

SEQ ID NO: 120564 - RNA, 22 nt, Homo sapiens
guggcagugugaggauccugcu

SEQ ID NO: 120565 - RNA, 22 nt, Homo sapiens
guggcaugaaagcagauaccac

SEQ ID NO: 120566 - RNA, 22 nt, Homo sapiens
guggguaaaucucuggggcucu

SEQ ID NO: 120567 - RNA, 22 nt, Homo sapiens
gugguucuagaauugaguaucc

SEQ ID NO: 120568 - RNA, 22 nt, Homo sapiens
gugucacagcuuccaucucggu

SEQ ID NO: 120569 - RNA, 21 nt, Homo sapiens
gugugcuugaauucagcuguc

SEQ ID NO: 120570 - RNA, 21 nt, Homo sapiens
gugugcuugagugaugggauu

SEQ ID NO: 120571 - RNA, 22 nt, Homo sapiens
guguggcaggugggggcucaga

SEQ ID NO: 120572 - RNA, 22 nt, Homo sapiens
guuauguuauguuauguuaugu

SEQ ID NO: 120573 - RNA, 22 nt, Homo sapiens
guuauugcucucgaagacucuc

SEQ ID NO: 120574 - RNA, 22 nt, Homo sapiens
guucaguuuugaaauguuaauu

SEQ ID NO: 120575 - RNA, 22 nt, Homo sapiens
guucaucagggauacuggcuua

SEQ ID NO: 120576 - RNA, 22 nt, Homo sapiens
guugguuuccuguaacuggaca

SEQ ID NO: 120577 - RNA, 22 nt, Homo sapiens
guugugcuuaagccuauugauu

SEQ ID NO: 120578 - RNA, 21 nt, Homo sapiens
uaaaacuguaacuuuguccug

SEQ ID NO: 120579 - RNA, 22 nt, Homo sapiens
uaacauagucauauacuugcuu

SEQ ID NO: 120580 - RNA, 22 nt, Homo sapiens
uaacccagugucugugaugggu

SEQ ID NO: 120581 - RNA, 22 nt, Homo sapiens
uaacccuuacaacuacacucgu

SEQ ID NO: 120582 - RNA, 22 nt, Homo sapiens
uaacccuuaguaucuguggguu

SEQ ID NO: 120583 - RNA, 22 nt, Homo sapiens
uaacucugccuagugacauggu

SEQ ID NO: 120584 - RNA, 22 nt, Homo sapiens
uaaggcuagcaagaugagaaua

SEQ ID NO: 120585 - RNA, 22 nt, Homo sapiens
uaagugcaacauaaguguuaaa

SEQ ID NO: 120586 - RNA, 20 nt, Homo sapiens
uaagugcuugaugaaugaac

SEQ ID NO: 120587 - RNA, 22 nt, Homo sapiens
uaaguucauucaugaaacuuag

SEQ ID NO: 120588 - RNA, 22 nt, Homo sapiens
uaauaauguuaggcuuacucaa

SEQ ID NO: 120589 - RNA, 22 nt, Homo sapiens
uaauagagucauuauuauuguu

SEQ ID NO: 120590 - RNA, 22 nt, Homo sapiens
uaaugcauguaaugggcugaua

SEQ ID NO: 120591 - RNA, 22 nt, Homo sapiens
uugggcauugcuauaaauucuu

SEQ ID NO: 120592 - RNA, 22 nt, Homo sapiens
uugggcauugggcuaaacuccc

SEQ ID NO: 120593 - RNA, 22 nt, Homo sapiens
uugggcuugagggugcccaguc

SEQ ID NO: 120594 - RNA, 22 nt, Homo sapiens
uuggucaucucccuccuuuuag

SEQ ID NO: 120595 - RNA, 22 nt, Homo sapiens
uugguccguugugaaaaggccu

SEQ ID NO: 120596 - RNA, 22 nt, Homo sapiens
uugguuccuuagccuaggacua

SEQ ID NO: 120597 - RNA, 22 nt, Homo sapiens
uugucaccucuaaaucucauau

SEQ ID NO: 120598 - RNA, 23 nt, Homo sapiens
uuguccccuccaaagcucauguu

SEQ ID NO: 120599 - RNA, 22 nt, Homo sapiens
uuguccccuuccaaaucucaug

SEQ ID NO: 120600 - RNA, 22 nt, Homo sapiens
uuguccuggagguucuugcaag

SEQ ID NO: 120601 - RNA, 21 nt, Homo sapiens
uugucuagagaaauauaucuc

SEQ ID NO: 120602 - RNA, 22 nt, Homo sapiens
uugugcaugaugcauacauggu

SEQ ID NO: 120603 - RNA, 22 nt, Homo sapiens
uugugcauguauauuaguucac

SEQ ID NO: 120604 - RNA, 22 nt, Homo sapiens
uugugcuuuuuaaauagcuucc

SEQ ID NO: 120605 - RNA, 22 nt, Homo sapiens
uuguuauguaucucaagauaaa

SEQ ID NO: 120606 - RNA, 22 nt, Homo sapiens
uuuaaagcuaaaauauguuuau

SEQ ID NO: 120607 - RNA, 22 nt, Homo sapiens
uuuacagucucauagguggaag

SEQ ID NO: 120608 - RNA, 22 nt, Homo sapiens
uuuacugugggguuucuuagag

SEQ ID NO: 120609 - RNA, 22 nt, Homo sapiens
uuuagcacugugauugacaaaa

SEQ ID NO: 120610 - RNA, 22 nt, Homo sapiens
uuuaucuguuuaaaacuguuca

SEQ ID NO: 120611 - RNA, 22 nt, Homo sapiens
uuucacaguguucucccccaga

SEQ ID NO: 120612 - RNA, 16 nt, Homo sapiens
uuucaucaguuuuaau

SEQ ID NO: 120613 - RNA, 22 nt, Homo sapiens
uuucauggaauauagucauuuu

SEQ ID NO: 120614 - RNA, 22 nt, Homo sapiens
uuuccacauggacuuaccuucg

SEQ ID NO: 120615 - RNA, 22 nt, Homo sapiens
uuuccaguuggaaagccuguuu

SEQ ID NO: 120616 - RNA, 22 nt, Homo sapiens
uuucugguuaauuucuaagagc

SEQ ID NO: 120617 - RNA, 22 nt, Homo sapiens
uuugacuagaguguuuuacaac

SEQ ID NO: 120618 - RNA, 22 nt, Homo sapiens
uuugacuuuuagaauaugaguu

SEQ ID NO: 120619 - RNA, 22 nt, Homo sapiens
uuugcuugaggucuagcuaccc

SEQ ID NO: 120620 - RNA, 22 nt, Homo sapiens
uuuguacucccuuuagauaaaa

SEQ ID NO: 120621 - RNA, 22 nt, Homo sapiens
uuuguacugagccaagauggua

SEQ ID NO: 120622 - RNA, 22 nt, Homo sapiens
uuuguacuugaaacccagggcc

SEQ ID NO: 120623 - RNA, 23 nt, Homo sapiens
uuugugcuaauuuaugggcucuu

SEQ ID NO: 120624 - RNA, 22 nt, Homo sapiens
uuugugcuauguuauauauucu

SEQ ID NO: 120625 - RNA, 22 nt, Homo sapiens
uuugugcuccuguugagaaucu

SEQ ID NO: 120626 - RNA, 22 nt, Homo sapiens
uuuguucaccucaaggauggga

SEQ ID NO: 120627 - RNA, 22 nt, Homo sapiens
aaagaguucagguagauuucaa

SEQ ID NO: 120628 - RNA, 22 nt, Homo sapiens
aaaggcuucggaucagaaggua

SEQ ID NO: 120629 - RNA, 19 nt, Homo sapiens
aaagguaguaaccucugau

SEQ ID NO: 120630 - RNA, 22 nt, Homo sapiens
aaagugcugggauuuuaggcau

SEQ ID NO: 120631 - RNA, 22 nt, Homo sapiens
aaaugcagucuuuguucugggc

SEQ ID NO: 120632 - RNA, 22 nt, Homo sapiens
aaaugcccuaaaauggagcauc

SEQ ID NO: 120633 - RNA, 22 nt, Homo sapiens
aaaugcugcuuuggccucuucu

SEQ ID NO: 120634 - RNA, 22 nt, Homo sapiens
aaauggauuaaguucacuugcu

SEQ ID NO: 120635 - RNA, 22 nt, Homo sapiens
aaaugucauggaguguuucccc

SEQ ID NO: 120636 - RNA, 22 nt, Homo sapiens
aacagugcuucauucacacauu

SEQ ID NO: 120637 - RNA, 22 nt, Homo sapiens
aacccugagucaugagucuaga

SEQ ID NO: 120638 - RNA, 22 nt, Homo sapiens
aaccuucauuccuuucccugcc

SEQ ID NO: 120639 - RNA, 20 nt, Homo sapiens
aagagcucaccagaauaucu

SEQ ID NO: 120640 - RNA, 22 nt, Homo sapiens
aagauaguaaacauuuucugcu

SEQ ID NO: 120641 - RNA, 22 nt, Homo sapiens
aagaugcagaagcccagauguu

SEQ ID NO: 120642 - RNA, 22 nt, Homo sapiens
aagaugcagucauacuggagga

SEQ ID NO: 120643 - RNA, 22 nt, Homo sapiens
aagcacccuuugucuggacaug

SEQ ID NO: 120644 - RNA, 22 nt, Homo sapiens
aagcugccuugugaaggcauuc

SEQ ID NO: 120645 - RNA, 22 nt, Homo sapiens
aagcuggcauucauucguucuu

SEQ ID NO: 120646 - RNA, 22 nt, Homo sapiens
aagcugugucuugucagcuacc

SEQ ID NO: 120647 - RNA, 22 nt, Homo sapiens
aaggcauucucaaacuaguucu

SEQ ID NO: 120648 - RNA, 22 nt, Homo sapiens
aaggcuguucauuuagcacagu

SEQ ID NO: 120649 - RNA, 22 nt, Homo sapiens
aagggaaugcgcugccuguguu

SEQ ID NO: 120650 - RNA, 22 nt, Homo sapiens
aagggaauguugugguugguuu

SEQ ID NO: 120651 - RNA, 23 nt, Homo sapiens
aagguaagcuagaaagauguaga

SEQ ID NO: 120652 - RNA, 22 nt, Homo sapiens
aaggugcucucuuauguagaaa

SEQ ID NO: 120653 - RNA, 22 nt, Homo sapiens
aaguaauggaguuauuuuauga

SEQ ID NO: 120654 - RNA, 22 nt, Homo sapiens
aaguauguaucaagucauacuu

SEQ ID NO: 120655 - RNA, 20 nt, Homo sapiens
aagugcuuccuuuuagaggg

SEQ ID NO: 120656 - RNA, 22 nt, Homo sapiens
aagugucagaguugcuaaugac

SEQ ID NO: 120657 - RNA, 22 nt, Homo sapiens
aauacuuccaaaucuagucauu

SEQ ID NO: 120658 - RNA, 22 nt, Homo sapiens
aauagcacuguagauggaggaa

SEQ ID NO: 120659 - RNA, 22 nt, Homo sapiens
aauaucacaguuggguguacac

SEQ ID NO: 120660 - RNA, 22 nt, Homo sapiens
aaugacuaagaugguacauuuu

SEQ ID NO: 120661 - RNA, 17 nt, Homo sapiens
aaugagacauuucugcu

SEQ ID NO: 120662 - RNA, 22 nt, Homo sapiens
aaugcaagauguuaauuauagg

SEQ ID NO: 120663 - RNA, 22 nt, Homo sapiens
aauggcaaauguuuucuguuga

SEQ ID NO: 120664 - RNA, 22 nt, Homo sapiens
aauugcacuggaaguaacugag

SEQ ID NO: 120665 - RNA, 20 nt, Homo sapiens
acaaaugcauucugugacau

SEQ ID NO: 120666 - RNA, 17 nt, Homo sapiens
acaaauugccagcuagg

SEQ ID NO: 120667 - RNA, 22 nt, Homo sapiens
acaagugcuuuuccuggagaca

SEQ ID NO: 120668 - RNA, 22 nt, Homo sapiens
acacaguaaauauugucuccuc

SEQ ID NO: 120669 - RNA, 22 nt, Homo sapiens
acagugcuguggucaugggucu

SEQ ID NO: 120670 - RNA, 22 nt, Homo sapiens
acaugcauauguuggaagaaag

SEQ ID NO: 120671 - RNA, 22 nt, Homo sapiens
acaugccucccugguccgcugu

SEQ ID NO: 120672 - RNA, 19 nt, Homo sapiens
accagauugcauucuugga

SEQ ID NO: 120673 - RNA, 22 nt, Homo sapiens
acccaguagucauucaggagca

SEQ ID NO: 120674 - RNA, 17 nt, Homo sapiens
accccuaccucagaagc

SEQ ID NO: 120675 - RNA, 22 nt, Homo sapiens
acccucagaccaguuucccugg

SEQ ID NO: 120676 - RNA, 21 nt, Homo sapiens
acccucuaguuuucaacaggc

SEQ ID NO: 120677 - RNA, 22 nt, Homo sapiens
acccuggauucguggccuugaa

SEQ ID NO: 120678 - RNA, 22 nt, Homo sapiens
acccugucaaaacggaccaauc

SEQ ID NO: 120679 - RNA, 22 nt, Homo sapiens
acccuugaguguguuucaggca

SEQ ID NO: 120680 - RNA, 22 nt, Homo sapiens
acccuuugucaaucaguacuaa

SEQ ID NO: 120681 - RNA, 22 nt, Homo sapiens
accuggcacuuagcaaaucuga

SEQ ID NO: 120682 - RNA, 22 nt, Homo sapiens
acuacaugugaugucaguauau

SEQ ID NO: 120683 - RNA, 22 nt, Homo sapiens
auggcacugaagcguauugaca

SEQ ID NO: 120684 - RNA, 22 nt, Homo sapiens
auggcacugccuggcuucaugg

SEQ ID NO: 120685 - RNA, 22 nt, Homo sapiens
auggcaguguaugauuauauua

SEQ ID NO: 120686 - RNA, 22 nt, Homo sapiens
auggcaguuucagcuauaguuu

SEQ ID NO: 120687 - RNA, 22 nt, Homo sapiens
auggccuaugaccguuauguug

SEQ ID NO: 120688 - RNA, 22 nt, Homo sapiens
augguacuagaguaagaauugu

SEQ ID NO: 120689 - RNA, 22 nt, Homo sapiens
auggucuuuucccuggauuaua

SEQ ID NO: 120690 - RNA, 22 nt, Homo sapiens
auguaaacuacagauuuugggu

SEQ ID NO: 120691 - RNA, 22 nt, Homo sapiens
augugcaaagcacuguucagca

SEQ ID NO: 120692 - RNA, 22 nt, Homo sapiens
augugcacaugcuuacauguga

SEQ ID NO: 120693 - RNA, 22 nt, Homo sapiens
auguuagcaucuggcacuaugg

SEQ ID NO: 120694 - RNA, 22 nt, Homo sapiens
auuacauagucaaggugucuca

SEQ ID NO: 120695 - RNA, 22 nt, Homo sapiens
auucacuguggcuuucucugau

SEQ ID NO: 120696 - RNA, 22 nt, Homo sapiens
auucccuuagcugccucagccu

SEQ ID NO: 120697 - RNA, 22 nt, Homo sapiens
auugaacacuucugugugccag

SEQ ID NO: 120698 - RNA, 22 nt, Homo sapiens
auugcacuccagccuagguaac

SEQ ID NO: 120699 - RNA, 22 nt, Homo sapiens
auugcacuccagccugggcuag

SEQ ID NO: 120700 - RNA, 22 nt, Homo sapiens
auugcuaacugaaauaagacca

SEQ ID NO: 120701 - RNA, 22 nt, Homo sapiens
auuggcaagauagcauaugagg

SEQ ID NO: 120702 - RNA, 22 nt, Homo sapiens
caaagugcugaaagaggccagg

SEQ ID NO: 120703 - RNA, 22 nt, Homo sapiens
caaagugcuggaauuggccggg

SEQ ID NO: 120704 - RNA, 22 nt, Homo sapiens
caaauugcuuguggaggauaau

SEQ ID NO: 120705 - RNA, 22 nt, Homo sapiens
caacaguaaagcauuuuuaagu

SEQ ID NO: 120706 - RNA, 22 nt, Homo sapiens
caaguguuuccuuaaauacuug

SEQ ID NO: 120707 - RNA, 22 nt, Homo sapiens
cacaaugucugguaggccacuu

SEQ ID NO: 120708 - RNA, 22 nt, Homo sapiens
cacagagugagacccugucucu

SEQ ID NO: 120709 - RNA, 22 nt, Homo sapiens
cacauagucccugcuaaucuuc

SEQ ID NO: 120710 - RNA, 22 nt, Homo sapiens
cacauguucaggagcacuuaga

SEQ ID NO: 120711 - RNA, 22 nt, Homo sapiens
cacauguuuuagcauggcuguu

SEQ ID NO: 120712 - RNA, 22 nt, Homo sapiens
caccagguuggagugcaguggu

SEQ ID NO: 120713 - RNA, 22 nt, Homo sapiens
caccaguuuuucagugauucaa

SEQ ID NO: 120714 - RNA, 22 nt, Homo sapiens
cacugaaugugagguuggggag

SEQ ID NO: 120715 - RNA, 22 nt, Homo sapiens
cacugcacuccagucugacgac

SEQ ID NO: 120716 - RNA, 22 nt, Homo sapiens
cacugcacuccagucuggcgac

SEQ ID NO: 120717 - RNA, 22 nt, Homo sapiens
cacugcacuccaguuucgguaa

SEQ ID NO: 120718 - RNA, 22 nt, Homo sapiens
cacugcacucuucuucugggca

SEQ ID NO: 120719 - RNA, 22 nt, Homo sapiens
cacuggacauguugaagcuuuu

SEQ ID NO: 120720 - RNA, 17 nt, Homo sapiens
cacugggugcaagagga

SEQ ID NO: 120721 - RNA, 22 nt, Homo sapiens
cagauacucauggaacuggguu

SEQ ID NO: 120722 - RNA, 22 nt, Homo sapiens
caggcauuguauuguaaucccc

SEQ ID NO: 120723 - RNA, 22 nt, Homo sapiens
cagggaauguuauuuaauagca

SEQ ID NO: 120724 - RNA, 22 nt, Homo sapiens
cagugcuuuaucaaguccucca

SEQ ID NO: 120725 - RNA, 22 nt, Homo sapiens
cagugguuuucucaguucagca

SEQ ID NO: 120726 - RNA, 22 nt, Homo sapiens
cauauucacuuuacagagcugu

SEQ ID NO: 120727 - RNA, 22 nt, Homo sapiens
caucacacuuggauguaagaca

SEQ ID NO: 120728 - RNA, 19 nt, Homo sapiens
caucccugagcugaagugg

SEQ ID NO: 120729 - RNA, 22 nt, Homo sapiens
caugcagcacacaugucugugc

SEQ ID NO: 120730 - RNA, 22 nt, Homo sapiens
cauggccuuuggaaugugucua

SEQ ID NO: 120731 - RNA, 22 nt, Homo sapiens
caugggacugucuuggcuauac

SEQ ID NO: 120732 - RNA, 22 nt, Homo sapiens
caugucuuuuaaacauucaacu

SEQ ID NO: 120733 - RNA, 19 nt, Homo sapiens
caugugcacuacuggcuuc

SEQ ID NO: 120734 - RNA, 22 nt, Homo sapiens
cauugcacucuagucuggguga

SEQ ID NO: 120735 - RNA, 22 nt, Homo sapiens
cauugcccuccagccugggcaa

SEQ ID NO: 120736 - RNA, 22 nt, Homo sapiens
ccaaaucucauguugaaaugug

SEQ ID NO: 120737 - RNA, 22 nt, Homo sapiens
ccaaguguuuucauuguuccau

SEQ ID NO: 120738 - RNA, 22 nt, Homo sapiens
ccacccuuccacacccugggua

SEQ ID NO: 120739 - RNA, 22 nt, Homo sapiens
ccacugcacuccagcccggcaa

SEQ ID NO: 120740 - RNA, 22 nt, Homo sapiens
ccagugcugugcaguguaugag

SEQ ID NO: 120741 - RNA, 21 nt, Homo sapiens
ccagugguuggaaacuauggg

SEQ ID NO: 120742 - RNA, 22 nt, Homo sapiens
ccauggcuauucuguaaggguu

SEQ ID NO: 120743 - RNA, 22 nt, Homo sapiens
cccaguguuacgugacagccug

SEQ ID NO: 120744 - RNA, 22 nt, Homo sapiens
ccccggguggauguacauguga

SEQ ID NO: 120745 - RNA, 22 nt, Homo sapiens
cccucauucauucauccuaugu

SEQ ID NO: 120746 - RNA, 22 nt, Homo sapiens
cccugagaugcuguuaaucugu

SEQ ID NO: 120747 - RNA, 22 nt, Homo sapiens
ccuggcacugagcaguguucua

SEQ ID NO: 120748 - RNA, 22 nt, Homo sapiens
ccuguagcauccaagaagcugc

SEQ ID NO: 120749 - RNA, 22 nt, Homo sapiens
ccugucuugaagagauccuccu

SEQ ID NO: 120750 - RNA, 22 nt, Homo sapiens
ccuuuguuuaguugaauuguau

SEQ ID NO: 120751 - RNA, 22 nt, Homo sapiens
cuaaaugcacugucaaaggaag

SEQ ID NO: 120752 - RNA, 22 nt, Homo sapiens
cuaagguacuguuaacauugua

SEQ ID NO: 120753 - RNA, 22 nt, Homo sapiens
cuaagguaggagaaucacucaa

SEQ ID NO: 120754 - RNA, 22 nt, Homo sapiens
cuaagugaguauaauuuuaaga

SEQ ID NO: 120755 - RNA, 22 nt, Homo sapiens
cuaaucugugcauagaagaggc

SEQ ID NO: 120756 - RNA, 22 nt, Homo sapiens
cuacugacacuacugcaaucau

SEQ ID NO: 120757 - RNA, 22 nt, Homo sapiens
cuagacuagacccaaauugaag

SEQ ID NO: 120758 - RNA, 22 nt, Homo sapiens
cuagcacauaguuauucacuca

SEQ ID NO: 120759 - RNA, 22 nt, Homo sapiens
cuagguucucaaaccagcguca

SEQ ID NO: 120760 - RNA, 22 nt, Homo sapiens
cuauaacagugugguuuggaga

SEQ ID NO: 120761 - RNA, 22 nt, Homo sapiens
cuauaugucuguuuugguacca

SEQ ID NO: 120762 - RNA, 22 nt, Homo sapiens
cuauuagguuggugcaaaaguc

SEQ ID NO: 120763 - RNA, 21 nt, Homo sapiens
cucaaaguacugauauuacag

SEQ ID NO: 120764 - RNA, 17 nt, Homo sapiens
cucacugagaacagcua

SEQ ID NO: 120765 - RNA, 22 nt, Homo sapiens
cucccauugcaaacaacagaag

SEQ ID NO: 120766 - RNA, 23 nt, Homo sapiens
cucccugaacaugacacaccaga

SEQ ID NO: 120767 - RNA, 22 nt, Homo sapiens
cuccuguagccccaucaucuuu

SEQ ID NO: 120768 - RNA, 22 nt, Homo sapiens
cucugguucugcagugcacccu

SEQ ID NO: 120769 - RNA, 22 nt, Homo sapiens
cucuuugcuucuggcaucauug

SEQ ID NO: 120770 - RNA, 22 nt, Homo sapiens
cugaaagagcauuugaaugggu

SEQ ID NO: 120771 - RNA, 22 nt, Homo sapiens
cugaaagguauacgcuuguuau

SEQ ID NO: 120772 - RNA, 22 nt, Homo sapiens
cugaauagucaacgauggacug

SEQ ID NO: 120773 - RNA, 22 nt, Homo sapiens
cugagagaggagcuaaaacugc

SEQ ID NO: 120774 - RNA, 22 nt, Homo sapiens
cugagauggagucucgcauugu

SEQ ID NO: 120775 - RNA, 22 nt, Homo sapiens
cugagguacccacuucaucuca

SEQ ID NO: 120776 - RNA, 22 nt, Homo sapiens
cugauuguagagccccagggcu

SEQ ID NO: 120777 - RNA, 22 nt, Homo sapiens
cugcaagaaucguaguauuuga

SEQ ID NO: 120778 - RNA, 22 nt, Homo sapiens
cuggaaagaaucaggcuaaacu

SEQ ID NO: 120779 - RNA, 22 nt, Homo sapiens
cuggaaagcaaagggugcauug

SEQ ID NO: 120780 - RNA, 22 nt, Homo sapiens
cuggagcaaaggugacucuugu

SEQ ID NO: 120781 - RNA, 22 nt, Homo sapiens
cuggagcauugguggauuuguu

SEQ ID NO: 120782 - RNA, 22 nt, Homo sapiens
cuggcaaaaagagggcaauaau

SEQ ID NO: 120783 - RNA, 22 nt, Homo sapiens
cuggcaauaaauuuuuguguug

SEQ ID NO: 120784 - RNA, 22 nt, Homo sapiens
cuggcaauaggcagugucccaa

SEQ ID NO: 120785 - RNA, 22 nt, Homo sapiens
cuggcagugcuuguuauccugg

SEQ ID NO: 120786 - RNA, 22 nt, Homo sapiens
cugugaagaaagucauugguag

SEQ ID NO: 120787 - RNA, 22 nt, Homo sapiens
cugugcauggauuuuaagauug

SEQ ID NO: 120788 - RNA, 23 nt, Homo sapiens
cuguggauaugaguuguaaaugg

SEQ ID NO: 120789 - RNA, 22 nt, Homo sapiens
gugcuuuguuguggcaguggca

SEQ ID NO: 120790 - RNA, 22 nt, Homo sapiens
guggaaaucucugugugacuua

SEQ ID NO: 120791 - RNA, 21 nt, Homo sapiens
guggccuuuggagcaugucag

SEQ ID NO: 120792 - RNA, 22 nt, Homo sapiens
gugggcaaagcuaguguguaga

SEQ ID NO: 120793 - RNA, 21 nt, Homo sapiens
gugguucuagagaaacagaau

SEQ ID NO: 120794 - RNA, 22 nt, Homo sapiens
gugguuuuaauauucagucuag

SEQ ID NO: 120795 - RNA, 22 nt, Homo sapiens
gugguuuuuagauuucuacagu

SEQ ID NO: 120796 - RNA, 22 nt, Homo sapiens
guguaaaucaaucuguugucuu

SEQ ID NO: 120797 - RNA, 22 nt, Homo sapiens
guguauauccuauuaguucugu

SEQ ID NO: 120798 - RNA, 22 nt, Homo sapiens
gugugauuauuucaauugaugc

SEQ ID NO: 120799 - RNA, 22 nt, Homo sapiens
gugugauuguuaauuuuaggug

SEQ ID NO: 120800 - RNA, 22 nt, Homo sapiens
gugugcacaaucuggcaugugc

SEQ ID NO: 120801 - RNA, 22 nt, Homo sapiens
guuagguagaaguuuacuuuga

SEQ ID NO: 120802 - RNA, 18 nt, Homo sapiens
guuagguaguaugaugcu

SEQ ID NO: 120803 - RNA, 22 nt, Homo sapiens
guuaugcagcaauugauaaucu

SEQ ID NO: 120804 - RNA, 22 nt, Homo sapiens
guucaguuugcugaugcguuga

SEQ ID NO: 120805 - RNA, 22 nt, Homo sapiens
guucuggagauaaagccaaggu

SEQ ID NO: 120806 - RNA, 22 nt, Homo sapiens
guugcaaaguaauugugguuuu

SEQ ID NO: 120807 - RNA, 22 nt, Homo sapiens
uaaaugcuuaauugaaugugga

SEQ ID NO: 120808 - RNA, 22 nt, Homo sapiens
uaaauggauaaaugaauaccua

SEQ ID NO: 120809 - RNA, 21 nt, Homo sapiens
uaaaugucauacaaagcaaug

SEQ ID NO: 120810 - RNA, 22 nt, Homo sapiens
uaaauugcauaaguacaaauga

SEQ ID NO: 120811 - RNA, 22 nt, Homo sapiens
uaacagcauuugugucuaguag

SEQ ID NO: 120812 - RNA, 22 nt, Homo sapiens
uaacagucaagguuugaccagg

SEQ ID NO: 120813 - RNA, 21 nt, Homo sapiens
uaacccugaaggagcucugga

SEQ ID NO: 120814 - RNA, 22 nt, Homo sapiens
uaacuauagagaauguugagua

SEQ ID NO: 120815 - RNA, 22 nt, Homo sapiens
uaaguaauugcagcaauuugcc

SEQ ID NO: 120816 - RNA, 22 nt, Homo sapiens
uaagugcaugauuacaugcaua

SEQ ID NO: 120817 - RNA, 22 nt, Homo sapiens
uaaguugcagguugugauucca

SEQ ID NO: 120818 - RNA, 18 nt, Homo sapiens
uaauaacugugaccuuga

SEQ ID NO: 120819 - RNA, 22 nt, Homo sapiens
uaauaguguuaaugcuagagcu

SEQ ID NO: 120820 - RNA, 22 nt, Homo sapiens
uacaaaucuagguuuguuacug

SEQ ID NO: 120821 - RNA, 20 nt, Homo sapiens
uacaggacugagaaucugug

SEQ ID NO: 120822 - RNA, 22 nt, Homo sapiens
uacaguagaaugucuuucaaaa

SEQ ID NO: 120823 - RNA, 22 nt, Homo sapiens
uacaguggcaugucaggugcuu

SEQ ID NO: 120824 - RNA, 22 nt, Homo sapiens
uacaugcaugggcaugugugca

SEQ ID NO: 120825 - RNA, 22 nt, Homo sapiens
uacuuagagacaugcagcacug

SEQ ID NO: 120826 - RNA, 22 nt, Homo sapiens
uagagauaucaauuucauggug

SEQ ID NO: 120827 - RNA, 21 nt, Homo sapiens
uagauacuguauuaaaccuag

SEQ ID NO: 120828 - RNA, 19 nt, Homo sapiens
uagcacagggucccagacu

SEQ ID NO: 120829 - RNA, 22 nt, Homo sapiens
uagcuccacagcuauauauaau

SEQ ID NO: 120830 - RNA, 22 nt, Homo sapiens
uagcugcuguauguacacggau

SEQ ID NO: 120831 - RNA, 22 nt, Homo sapiens
uagcuggaauuacuugcaccug

SEQ ID NO: 120832 - RNA, 22 nt, Homo sapiens
uagcuucuccauagcuccaugu

SEQ ID NO: 120833 - RNA, 22 nt, Homo sapiens
uaggagcacagcagcauguggg

SEQ ID NO: 120834 - RNA, 22 nt, Homo sapiens
uaggcaauggagauagaggaug

SEQ ID NO: 120835 - RNA, 22 nt, Homo sapiens
uagguugucaucagucuccacu

SEQ ID NO: 120836 - RNA, 18 nt, Homo sapiens
uaguacuguucucaugau

SEQ ID NO: 120837 - RNA, 22 nt, Homo sapiens
uagugcugagauugagaagccc

SEQ ID NO: 120838 - RNA, 20 nt, Homo sapiens
uaguggcaugcaccuguagc

SEQ ID NO: 120839 - RNA, 22 nt, Homo sapiens
uauaacaaugcaagaauggccu

SEQ ID NO: 120840 - RNA, 22 nt, Homo sapiens
uauagcuauuguuaauggaacu

SEQ ID NO: 120841 - RNA, 22 nt, Homo sapiens
uauaguguuuucaaaaguaugu

SEQ ID NO: 120842 - RNA, 22 nt, Homo sapiens
uauauguuuucauaaggcuaga

SEQ ID NO: 120843 - RNA, 22 nt, Homo sapiens
uaucacacaucaugguaaaucu

SEQ ID NO: 120844 - RNA, 20 nt, Homo sapiens
uaucacaguucaggaacucu

SEQ ID NO: 120845 - RNA, 22 nt, Homo sapiens
uaucaccauguccguuuuaaaa

SEQ ID NO: 120846 - RNA, 22 nt, Homo sapiens
uaucaccuugguagucuugggg

SEQ ID NO: 120847 - RNA, 22 nt, Homo sapiens
uaucaugucuguguguaccuag

SEQ ID NO: 120848 - RNA, 23 nt, Homo sapiens
uaugacagaggaagggggagcug

SEQ ID NO: 120849 - RNA, 22 nt, Homo sapiens
uaugacauaguccuuaacccuc

SEQ ID NO: 120850 - RNA, 22 nt, Homo sapiens
uaugacuguuugcucauucagg

SEQ ID NO: 120851 - RNA, 22 nt, Homo sapiens
uaugaugcugagguuuggagug

SEQ ID NO: 120852 - RNA, 22 nt, Homo sapiens
uaugcacacacguguuuaugug

SEQ ID NO: 120853 - RNA, 22 nt, Homo sapiens
uauggcuacuacgaauaaugcu

SEQ ID NO: 120854 - RNA, 17 nt, Homo sapiens
uauguaguacuuauaaa

SEQ ID NO: 120855 - RNA, 22 nt, Homo sapiens
uaugucuucuuuagagaaaugu

SEQ ID NO: 120856 - RNA, 22 nt, Homo sapiens
uaugucuuuugcuugcaaauag

SEQ ID NO: 120857 - RNA, 22 nt, Homo sapiens
uauuacauccauaggcucugcu

SEQ ID NO: 120858 - RNA, 22 nt, Homo sapiens
uauugcagaaugugaguuggca

SEQ ID NO: 120859 - RNA, 22 nt, Homo sapiens
uauugccucagugacuuugggg

SEQ ID NO: 120860 - RNA, 22 nt, Homo sapiens
ucaaaugguccacgugaacauu

SEQ ID NO: 120861 - RNA, 22 nt, Homo sapiens
ucaaauuccaagucuagguagg

SEQ ID NO: 120862 - RNA, 22 nt, Homo sapiens
ucaaguaagaagugggcauaaa

SEQ ID NO: 120863 - RNA, 22 nt, Homo sapiens
ucacaagcuccugccuuugcuu

SEQ ID NO: 120864 - RNA, 22 nt, Homo sapiens
ucacacugaaacuaggguguga

SEQ ID NO: 120865 - RNA, 22 nt, Homo sapiens
ucacacuguuuugauuauuaua

SEQ ID NO: 120866 - RNA, 22 nt, Homo sapiens
ucacagacugagccaaauagag

SEQ ID NO: 120867 - RNA, 21 nt, Homo sapiens
ucacagccuaggaccugaaga

SEQ ID NO: 120868 - RNA, 22 nt, Homo sapiens
ucacaggguguuauuagaauua

SEQ ID NO: 120869 - RNA, 19 nt, Homo sapiens
ucacaggguugacuugagg

SEQ ID NO: 120870 - RNA, 22 nt, Homo sapiens
ucacagucacugucacguugaa

SEQ ID NO: 120871 - RNA, 22 nt, Homo sapiens
ucacaucucagguuucuugaca

SEQ ID NO: 120872 - RNA, 23 nt, Homo sapiens
ucacuagaguccuggaguuugag

SEQ ID NO: 120873 - RNA, 22 nt, Homo sapiens
ucacuagggaucacuuuacccg

SEQ ID NO: 120874 - RNA, 22 nt, Homo sapiens
ucacucagaccuggugauaugc

SEQ ID NO: 120875 - RNA, 22 nt, Homo sapiens
ucacugaaaccgccuccaccuc

SEQ ID NO: 120876 - RNA, 22 nt, Homo sapiens
ucacugaaaccuccaccucucg

SEQ ID NO: 120877 - RNA, 20 nt, Homo sapiens
ucacugagugguccacagua

SEQ ID NO: 120878 - RNA, 22 nt, Homo sapiens
ucacuggagauagcaaucuggu

SEQ ID NO: 120879 - RNA, 22 nt, Homo sapiens
ucacuuugacggccaacuucua

SEQ ID NO: 120880 - RNA, 22 nt, Homo sapiens
ucacuuuguuuuuggauaaguu

SEQ ID NO: 120881 - RNA, 22 nt, Homo sapiens
ucagaucaguuccacaagaacu

SEQ ID NO: 120882 - RNA, 22 nt, Homo sapiens
ucagcaaugaccuaagcaaaua

SEQ ID NO: 120883 - RNA, 22 nt, Homo sapiens
ucaggcaugcagcaaugcagug

SEQ ID NO: 120884 - RNA, 22 nt, Homo sapiens
ucagguauuuauagcaaugcaa

SEQ ID NO: 120885 - RNA, 22 nt, Homo sapiens
ucagguauuucuuuuagcugug

SEQ ID NO: 120886 - RNA, 22 nt, Homo sapiens
ucagugaauguuggccacuacu

SEQ ID NO: 120887 - RNA, 22 nt, Homo sapiens
ucagugcuguaccaucuaagga

SEQ ID NO: 120888 - RNA, 22 nt, Homo sapiens
ucaguggagccucacucugugg

SEQ ID NO: 120889 - RNA, 22 nt, Homo sapiens
ucaguggauuauuaaagucacc

SEQ ID NO: 120890 - RNA, 22 nt, Homo sapiens
ucaguuaaugcugccugcugga

SEQ ID NO: 120891 - RNA, 22 nt, Homo sapiens
ucauacuguccaauucuagugg

SEQ ID NO: 120892 - RNA, 22 nt, Homo sapiens
ucauagaucaaguaauaagaca

SEQ ID NO: 120893 - RNA, 20 nt, Homo sapiens
ucauagggugguggcagugg

SEQ ID NO: 120894 - RNA, 22 nt, Homo sapiens
auucaugggagcuacuuuaaaa

SEQ ID NO: 120895 - RNA, 22 nt, Homo sapiens
auuccuuaggcccuuugguuag

SEQ ID NO: 120896 - RNA, 20 nt, Homo sapiens
auugcagcaugauuuauaau

SEQ ID NO: 120897 - RNA, 22 nt, Homo sapiens
auugcucuuagaaauauuucuu

SEQ ID NO: 120898 - RNA, 22 nt, Homo sapiens
auugcuuaagucccuguauuag

SEQ ID NO: 120899 - RNA, 22 nt, Homo sapiens
auuggcaauggcaaagcagagu

SEQ ID NO: 120900 - RNA, 22 nt, Homo sapiens
auuugguuauucaguuguucag

SEQ ID NO: 120901 - RNA, 22 nt, Homo sapiens
caaaguaauugugguuuugcca

SEQ ID NO: 120902 - RNA, 22 nt, Homo sapiens
caaaugaucugcuggccucagc

SEQ ID NO: 120903 - RNA, 19 nt, Homo sapiens
caacccugcagagaaagga

SEQ ID NO: 120904 - RNA, 22 nt, Homo sapiens
cacaguagaauagagcacuagg

SEQ ID NO: 120905 - RNA, 22 nt, Homo sapiens
cacagucugggcuuguuuguac

SEQ ID NO: 120906 - RNA, 22 nt, Homo sapiens
caccccuaccugagucaggagu

SEQ ID NO: 120907 - RNA, 22 nt, Homo sapiens
caccgagguuggagugcagugg

SEQ ID NO: 120908 - RNA, 22 nt, Homo sapiens
cagccggguggcuccuagggua

SEQ ID NO: 120909 - RNA, 22 nt, Homo sapiens
cagcugaugucgaaugcacucu

SEQ ID NO: 120910 - RNA, 22 nt, Homo sapiens
cagcuguuguuaugucugcagg

SEQ ID NO: 120911 - RNA, 22 nt, Homo sapiens
caggugcuuacuuaauagccau

SEQ ID NO: 120912 - RNA, 22 nt, Homo sapiens
cagugcacugggauuauaagug

SEQ ID NO: 120913 - RNA, 23 nt, Homo sapiens
cagugguguuagagaaaucuuuu

SEQ ID NO: 120914 - RNA, 22 nt, Homo sapiens
caguuacuugacacaaccaauu

SEQ ID NO: 120915 - RNA, 22 nt, Homo sapiens
caguugcacuagccccguuuca

SEQ ID NO: 120916 - RNA, 22 nt, Homo sapiens
cauacaguaggcacuauuugua

SEQ ID NO: 120917 - RNA, 22 nt, Homo sapiens
caucacagcaaguagggagugg

SEQ ID NO: 120918 - RNA, 22 nt, Homo sapiens
agaucauaugcaguaaugaacu

SEQ ID NO: 120919 - RNA, 22 nt, Homo sapiens
agcaacauuguucauaauagcu

SEQ ID NO: 120920 - RNA, 22 nt, Homo sapiens
agcaccauuguacuccagccug

SEQ ID NO: 120921 - RNA, 20 nt, Homo sapiens
agcagccacagauuccucag

SEQ ID NO: 120922 - RNA, 22 nt, Homo sapiens
agcagguguggcuuauccugaa

SEQ ID NO: 120923 - RNA, 22 nt, Homo sapiens
agcaugacauauuguagagaaa

SEQ ID NO: 120924 - RNA, 22 nt, Homo sapiens
agcauuaguugugaagccuuua

SEQ ID NO: 120925 - RNA, 19 nt, Homo sapiens
agccaguuuucccagcacc

SEQ ID NO: 120926 - RNA, 23 nt, Homo sapiens
agccugguuucccugcuucuccc

SEQ ID NO: 120927 - RNA, 21 nt, Homo sapiens
agcuccacucguucccaaagc

SEQ ID NO: 120928 - RNA, 22 nt, Homo sapiens
agcuccaucuucagggguucag

SEQ ID NO: 120929 - RNA, 20 nt, Homo sapiens
agcuccauuccugaaggcug

SEQ ID NO: 120930 - RNA, 22 nt, Homo sapiens
agcugcaaagggagagaugauu

SEQ ID NO: 120931 - RNA, 22 nt, Homo sapiens
agcugcacaaauggaugugagg

SEQ ID NO: 120932 - RNA, 22 nt, Homo sapiens
agcuguaguuugguggauguaa

SEQ ID NO: 120933 - RNA, 22 nt, Homo sapiens
agcuguuguuaauuaacucauu

SEQ ID NO: 120934 - RNA, 18 nt, Homo sapiens
aggaaugguaauacuuca

SEQ ID NO: 120935 - RNA, 22 nt, Homo sapiens
aggauaguaaugauagagaggc

SEQ ID NO: 120936 - RNA, 22 nt, Homo sapiens
aggcaaugugagaguuuauuca

SEQ ID NO: 120937 - RNA, 22 nt, Homo sapiens
aggcaugauggcuccagaucau

SEQ ID NO: 120938 - RNA, 22 nt, Homo sapiens
aggcaugauuguauuuugcucu

SEQ ID NO: 120939 - RNA, 22 nt, Homo sapiens
agggaauguaaguuuuaugaga

SEQ ID NO: 120940 - RNA, 22 nt, Homo sapiens
agguagugugaugcuccuguuu

SEQ ID NO: 120941 - RNA, 22 nt, Homo sapiens
agguaguguuauuugcagcuga

SEQ ID NO: 120942 - RNA, 22 nt, Homo sapiens
aggucccauguccucccugacc

SEQ ID NO: 120943 - RNA, 22 nt, Homo sapiens
aguacugucugguuaccugaca

SEQ ID NO: 120944 - RNA, 22 nt, Homo sapiens
uuggccccuccaaaucucaugu

SEQ ID NO: 120945 - RNA, 22 nt, Homo sapiens
uuggccuccuggucauauccag

SEQ ID NO: 120946 - RNA, 22 nt, Homo sapiens
uuggcuguguuuauaugcugga

SEQ ID NO: 120947 - RNA, 21 nt, Homo sapiens
uuggggaauggagagguuuuc

SEQ ID NO: 120948 - RNA, 22 nt, Homo sapiens
uuguacuagucauauuuugaaa

SEQ ID NO: 120949 - RNA, 22 nt, Homo sapiens
uuguauguuuguucuuucagau

SEQ ID NO: 120950 - RNA, 22 nt, Homo sapiens
uugucacuauaaauaagcauuu

SEQ ID NO: 120951 - RNA, 22 nt, Homo sapiens
uuguccccaucugcugccagaa

SEQ ID NO: 120952 - RNA, 22 nt, Homo sapiens
uugugcuuaaugaguguaaggu

SEQ ID NO: 120953 - RNA, 22 nt, Homo sapiens
uugugcuugauuugccuagcug

SEQ ID NO: 120954 - RNA, 22 nt, Homo sapiens
uugugcuugcuguguucuaugc

SEQ ID NO: 120955 - RNA, 22 nt, Homo sapiens
uugugcuuuacuuacuaccaga

SEQ ID NO: 120956 - RNA, 18 nt, Homo sapiens
uuguggccccuacaaauu

SEQ ID NO: 120957 - RNA, 22 nt, Homo sapiens
uugugggaggugauuagaucau

SEQ ID NO: 120958 - RNA, 17 nt, Homo sapiens
uuguucccauuaaaaag

SEQ ID NO: 120959 - RNA, 22 nt, Homo sapiens
uuuaaggcacuucaugguuuca

SEQ ID NO: 120960 - RNA, 22 nt, Homo sapiens
uuuaauacugcaucuuuacucu

SEQ ID NO: 120961 - RNA, 22 nt, Homo sapiens
uuuacugucuucagucccucug

SEQ ID NO: 120962 - RNA, 22 nt, Homo sapiens
uuuagcaaagcaauuuacacca

SEQ ID NO: 120963 - RNA, 22 nt, Homo sapiens
uuucaguagagacacgguuuug

SEQ ID NO: 120964 - RNA, 22 nt, Homo sapiens
uuucauagaucaugcuuuugga

SEQ ID NO: 120965 - RNA, 22 nt, Homo sapiens
uuucauagccuuugucgucuga

SEQ ID NO: 120966 - RNA, 22 nt, Homo sapiens
uuucauggacgcaaugccuuuu

SEQ ID NO: 120967 - RNA, 22 nt, Homo sapiens
uuucauguuuuucugugaggca

SEQ ID NO: 120968 - RNA, 22 nt, Homo sapiens
uuuccuguagggggcaaggccu

SEQ ID NO: 120969 - RNA, 23 nt, Homo sapiens
uuucuugggcaugcuaugucagu

SEQ ID NO: 120970 - RNA, 22 nt, Homo sapiens
uuugacuaccaggaauguucuu

SEQ ID NO: 120971 - RNA, 22 nt, Homo sapiens
uuugagcauuagggcaaaggca

SEQ ID NO: 120972 - RNA, 22 nt, Homo sapiens
uuugaguuugaggugcugauga

SEQ ID NO: 120973 - RNA, 22 nt, Homo sapiens
uuugauuguacuaaaauuguac

SEQ ID NO: 120974 - RNA, 22 nt, Homo sapiens
uuugccaauauuuuacugagga

SEQ ID NO: 120975 - RNA, 22 nt, Homo sapiens
uuugguuuuuguuaucacucau

SEQ ID NO: 120976 - RNA, 22 nt, Homo sapiens
uuugugcuaaugcuagauuacu

SEQ ID NO: 120977 - RNA, 21 nt, Homo sapiens
uuuugugcaugugcagccugc

SEQ ID NO: 120978 - RNA, 22 nt, Homo sapiens
uuuuuggaggagguuagaucau

SEQ ID NO: 120979 - RNA, 22 nt, Homo sapiens
ugggaugaugaaaaggcuuucu

SEQ ID NO: 120980 - RNA, 22 nt, Homo sapiens
uggugccgugguccuggggcca

SEQ ID NO: 120981 - RNA, 20 nt, Homo sapiens
ugguguuugaacagugaaug

SEQ ID NO: 120982 - RNA, 22 nt, Homo sapiens
ugguucaguugcacaggcuguu

SEQ ID NO: 120983 - RNA, 23 nt, Homo sapiens
uguaaagcuaugaauuauucuuu

SEQ ID NO: 120984 - RNA, 22 nt, Homo sapiens
uguacaugggacaggaggagag

SEQ ID NO: 120985 - RNA, 22 nt, Homo sapiens
uguagcagccauaaacacagug

SEQ ID NO: 120986 - RNA, 22 nt, Homo sapiens
ugucaaagagacaucugcacuc

SEQ ID NO: 120987 - RNA, 22 nt, Homo sapiens
ugucaaauucuggguuaaaaca

SEQ ID NO: 120988 - RNA, 22 nt, Homo sapiens
ugucagcacaacucagguuccu

SEQ ID NO: 120989 - RNA, 22 nt, Homo sapiens
ugucaugagucuccuccaucuu

SEQ ID NO: 120990 - RNA, 22 nt, Homo sapiens
ugucccguuuucgaggcugcag

SEQ ID NO: 120991 - RNA, 22 nt, Homo sapiens
uguccugcagagguguuugccu

SEQ ID NO: 120992 - RNA, 22 nt, Homo sapiens
uguccuggugaugcccaaauuc

SEQ ID NO: 120993 - RNA, 22 nt, Homo sapiens
ugucugagacuguuuuacuuuc

SEQ ID NO: 120994 - RNA, 18 nt, Homo sapiens
ugugauggauauguuaau

SEQ ID NO: 120995 - RNA, 22 nt, Homo sapiens
ugugcacaaugugcagguuugu

SEQ ID NO: 120996 - RNA, 22 nt, Homo sapiens
ugugcacaugauauaucacaua

SEQ ID NO: 120997 - RNA, 22 nt, Homo sapiens
ugugcacauugugcagguugau

SEQ ID NO: 120998 - RNA, 22 nt, Homo sapiens
ugugccacugcacuccugccug

SEQ ID NO: 120999 - RNA, 22 nt, Homo sapiens
ugugcuugaauuuaguagcuua

SEQ ID NO: 121000 - RNA, 22 nt, Homo sapiens
uguguuugauaaguccauaguu

SEQ ID NO: 121001 - RNA, 21 nt, Homo sapiens
uguuaacaugcagauuacugg

SEQ ID NO: 121002 - RNA, 22 nt, Homo sapiens
uguucaugaguucucauuuuua

SEQ ID NO: 121003 - RNA, 22 nt, Homo sapiens
uguuuuggaggccagaagucca

SEQ ID NO: 121004 - RNA, 22 nt, Homo sapiens
uuaaaugcauagaauguguagu

SEQ ID NO: 121005 - RNA, 22 nt, Homo sapiens
uuaaaugcuagaauuuucuuug

SEQ ID NO: 121006 - RNA, 22 nt, Homo sapiens
uuaacagugucaaucuguagua

SEQ ID NO: 121007 - RNA, 22 nt, Homo sapiens
uuacaguguuuguucuguuacu

SEQ ID NO: 121008 - RNA, 22 nt, Homo sapiens
uuacaugagacugucgcuaguu

SEQ ID NO: 121009 - RNA, 22 nt, Homo sapiens
uuacuguagugucauaucguau

SEQ ID NO: 121010 - RNA, 22 nt, Homo sapiens
uuagaugaaugucucuuaaaca

SEQ ID NO: 121011 - RNA, 22 nt, Homo sapiens
uuagcacaguucauucauguua

SEQ ID NO: 121012 - RNA, 22 nt, Homo sapiens
uuaggagacuggauaucucuuu

SEQ ID NO: 121013 - RNA, 22 nt, Homo sapiens
uuagggaggagucccucuuuuu

SEQ ID NO: 121014 - RNA, 22 nt, Homo sapiens
uuaugucuuugagcaaugcugu

SEQ ID NO: 121015 - RNA, 22 nt, Homo sapiens
uuauucauuaacagggaccaaa

SEQ ID NO: 121016 - RNA, 22 nt, Homo sapiens
uuauucauuaauugcuaagguu

SEQ ID NO: 121017 - RNA, 22 nt, Homo sapiens
uuauugcacuccagccugggua

SEQ ID NO: 121018 - RNA, 22 nt, Homo sapiens
uucaaaggauagauuaagauca

SEQ ID NO: 121019 - RNA, 22 nt, Homo sapiens
uucaaguaagaaagacaucagg

SEQ ID NO: 121020 - RNA, 22 nt, Homo sapiens
uucacuggagcccaggaguugg

SEQ ID NO: 121021 - RNA, 22 nt, Homo sapiens
uucaggcaccauugucauugau

SEQ ID NO: 121022 - RNA, 22 nt, Homo sapiens
uucaguaaauguucuuacuaua

SEQ ID NO: 121023 - RNA, 22 nt, Homo sapiens
uucaguggguggaugaauauga

SEQ ID NO: 121024 - RNA, 22 nt, Homo sapiens
uucagugucauuaacacaguag

SEQ ID NO: 121025 - RNA, 21 nt, Homo sapiens
uucaucagccagaaaucaagc

SEQ ID NO: 121026 - RNA, 22 nt, Homo sapiens
uucauggaugcauuugaggggu

SEQ ID NO: 121027 - RNA, 22 nt, Homo sapiens
uucauggguuaauuuguucgau

SEQ ID NO: 121028 - RNA, 22 nt, Homo sapiens
uuccaguggaguaaauggacaa

SEQ ID NO: 121029 - RNA, 22 nt, Homo sapiens
uuccauaggcuagaucaaccag

SEQ ID NO: 121030 - RNA, 22 nt, Homo sapiens
uucccagagccugggagugagg

SEQ ID NO: 121031 - RNA, 22 nt, Homo sapiens
uucccagugccaggcacuggga

SEQ ID NO: 121032 - RNA, 22 nt, Homo sapiens
uucccuagaacacauggaggga

SEQ ID NO: 121033 - RNA, 20 nt, Homo sapiens
uucccucagccuugagggua

SEQ ID NO: 121034 - RNA, 22 nt, Homo sapiens
uucccugaaauauucacuuuca

SEQ ID NO: 121035 - RNA, 22 nt, Homo sapiens
uucccugagcaucuguugagcc

SEQ ID NO: 121036 - RNA, 22 nt, Homo sapiens
uucccuuucuuaaagaguuagg

SEQ ID NO: 121037 - RNA, 22 nt, Homo sapiens
uuccuacuguucaucaggaacc

SEQ ID NO: 121038 - RNA, 22 nt, Homo sapiens
uuccuggaggggaaguguccaa

SEQ ID NO: 121039 - RNA, 22 nt, Homo sapiens
uuccugucuuccaagagagauu

SEQ ID NO: 121040 - RNA, 22 nt, Homo sapiens
uuccuugagaaaguacaaggcu

SEQ ID NO: 121041 - RNA, 22 nt, Homo sapiens
uucuauggucacagaugcuuga

SEQ ID NO: 121042 - RNA, 22 nt, Homo sapiens
uucucacaguacagggagcucu

SEQ ID NO: 121043 - RNA, 22 nt, Homo sapiens
uucugaguggcuuucaacacug

SEQ ID NO: 121044 - RNA, 22 nt, Homo sapiens
uucugugcugaaucaaagacug

SEQ ID NO: 121045 - RNA, 20 nt, Homo sapiens
uucuugaguuaacaaguuac

SEQ ID NO: 121046 - RNA, 23 nt, Homo sapiens
uugaaaagucaguagccucugau

SEQ ID NO: 121047 - RNA, 22 nt, Homo sapiens
uugaaagucuaggcuuacagua

SEQ ID NO: 121048 - RNA, 22 nt, Homo sapiens
uugaaauguuuagaaguuugga

SEQ ID NO: 121049 - RNA, 19 nt, Homo sapiens
uugaaggccgccuugcaga

SEQ ID NO: 121050 - RNA, 22 nt, Homo sapiens
uugaaguagcauuucaugucua

SEQ ID NO: 121051 - RNA, 22 nt, Homo sapiens
uugaagugaagaacaauaucac

SEQ ID NO: 121052 - RNA, 23 nt, Homo sapiens
uugaauguuuccccucccaaauu

SEQ ID NO: 121053 - RNA, 22 nt, Homo sapiens
uugacaaugcacugugcuaagu

SEQ ID NO: 121054 - RNA, 20 nt, Homo sapiens
uugacaguggguuguuaaag

SEQ ID NO: 121055 - RNA, 22 nt, Homo sapiens
uugaccuaugggaguuugacua

SEQ ID NO: 121056 - RNA, 22 nt, Homo sapiens
uugagauacauaauuaugaaug

SEQ ID NO: 121057 - RNA, 22 nt, Homo sapiens
uugagauaggagcuguuguucu

SEQ ID NO: 121058 - RNA, 22 nt, Homo sapiens
uugagcacugucugugugcagu

SEQ ID NO: 121059 - RNA, 22 nt, Homo sapiens
uugagcaucauguuagcacuca

SEQ ID NO: 121060 - RNA, 22 nt, Homo sapiens
uugaggaaugugauuucaaaua

SEQ ID NO: 121061 - RNA, 22 nt, Homo sapiens
uugagggaagccagaggucugc

SEQ ID NO: 121062 - RNA, 22 nt, Homo sapiens
uugaggugaauuugcaggaugc

SEQ ID NO: 121063 - RNA, 22 nt, Homo sapiens
uggagaacugaugucuccaaga

SEQ ID NO: 121064 - RNA, 22 nt, Homo sapiens
uggagucuugcucuguugccca

SEQ ID NO: 121065 - RNA, 18 nt, Homo sapiens
uggauuggaaaaguuccu

SEQ ID NO: 121066 - RNA, 22 nt, Homo sapiens
uggcaaaugugagaugagaacu

SEQ ID NO: 121067 - RNA, 22 nt, Homo sapiens
uggcaagaaggauuuauuccuu

SEQ ID NO: 121068 - RNA, 22 nt, Homo sapiens
uggcaagaccccaucucuacaa

SEQ ID NO: 121069 - RNA, 20 nt, Homo sapiens
uggcaagauggcagaauaga

SEQ ID NO: 121070 - RNA, 22 nt, Homo sapiens
uggcaauaaggacuccuuaggu

SEQ ID NO: 121071 - RNA, 22 nt, Homo sapiens
uggcaauguggaaugguccagg

SEQ ID NO: 121072 - RNA, 22 nt, Homo sapiens
uggcaccugacuccgagaugca

SEQ ID NO: 121073 - RNA, 22 nt, Homo sapiens
uggcagcgcaguugaaaaagaa

SEQ ID NO: 121074 - RNA, 22 nt, Homo sapiens
uggcagcgugaauguggcugaa

SEQ ID NO: 121075 - RNA, 22 nt, Homo sapiens
uggcaggugcacuggcuuugaa

SEQ ID NO: 121076 - RNA, 22 nt, Homo sapiens
uggcaugaagaccccauccuuu

SEQ ID NO: 121077 - RNA, 19 nt, Homo sapiens
uggcaugaaugugaacuaa

SEQ ID NO: 121078 - RNA, 22 nt, Homo sapiens
uggccagagggcaauuagcugu

SEQ ID NO: 121079 - RNA, 22 nt, Homo sapiens
uggccagugucggaggccagga

SEQ ID NO: 121080 - RNA, 18 nt, Homo sapiens
ugggaagaaauucuucuc

SEQ ID NO: 121081 - RNA, 22 nt, Homo sapiens
ugggaccccuacucuuuccaca

SEQ ID NO: 121082 - RNA, 22 nt, Homo sapiens
gagguguaaggacaacagagac

SEQ ID NO: 121083 - RNA, 22 nt, Homo sapiens
gaguauguauaugagugugucu

SEQ ID NO: 121084 - RNA, 23 nt, Homo sapiens
gaguggagacucauugauuuccu

SEQ ID NO: 121085 - RNA, 22 nt, Homo sapiens
gagugguaguuucuagaggugu

SEQ ID NO: 121086 - RNA, 22 nt, Homo sapiens
gaguggugguucugaaacuuuu

SEQ ID NO: 121087 - RNA, 22 nt, Homo sapiens
gaguucauuuugaaaccuugau

SEQ ID NO: 121088 - RNA, 22 nt, Homo sapiens
gauauguugaguagaguuuuug

SEQ ID NO: 121089 - RNA, 22 nt, Homo sapiens
gauauugacuuauucuauguuu

SEQ ID NO: 121090 - RNA, 22 nt, Homo sapiens
gaucacaguuccucacgggcau

SEQ ID NO: 121091 - RNA, 22 nt, Homo sapiens
gaucuggucuuugauuagacac

SEQ ID NO: 121092 - RNA, 22 nt, Homo sapiens
gaugacagcugacucccuugcu

SEQ ID NO: 121093 - RNA, 22 nt, Homo sapiens
gaugcaguaagaaugcauagcg

SEQ ID NO: 121094 - RNA, 22 nt, Homo sapiens
gauggaauuaaaaucagaauca

SEQ ID NO: 121095 - RNA, 22 nt, Homo sapiens
gaugugaaaucauaguuucuag

SEQ ID NO: 121096 - RNA, 22 nt, Homo sapiens
gauuuuuggggaagccucuuau

SEQ ID NO: 121097 - RNA, 22 nt, Homo sapiens
gcaaaugcuaugccauuuuaua

SEQ ID NO: 121098 - RNA, 22 nt, Homo sapiens
gcaaugcugucugugcacagau

SEQ ID NO: 121099 - RNA, 22 nt, Homo sapiens
gcacauggccacuaggaauaaa

SEQ ID NO: 121100 - RNA, 22 nt, Homo sapiens
gcagaauugacucuguuuuuuc

SEQ ID NO: 121101 - RNA, 22 nt, Homo sapiens
gcagugugauguuuuaaucuau

SEQ ID NO: 121102 - RNA, 22 nt, Homo sapiens
gcauggagaaggggacugauuc

SEQ ID NO: 121103 - RNA, 20 nt, Homo sapiens
uaaaugccucaugcuuuauu

SEQ ID NO: 121104 - RNA, 22 nt, Homo sapiens
uaaaugcucuuuaaaagugcuu

SEQ ID NO: 121105 - RNA, 22 nt, Homo sapiens
uaaaugcuugagaugauggaua

SEQ ID NO: 121106 - RNA, 18 nt, Homo sapiens
uaagaugcagccuauucc

SEQ ID NO: 121107 - RNA, 20 nt, Homo sapiens
uaagccacacagucuaaggu

SEQ ID NO: 121108 - RNA, 22 nt, Homo sapiens
uaaggaacucugauaucuggaa

SEQ ID NO: 121109 - RNA, 22 nt, Homo sapiens
uaaggcaaucagucaugguguu

SEQ ID NO: 121110 - RNA, 22 nt, Homo sapiens
uaaggcacccuucugaguagag

SEQ ID NO: 121111 - RNA, 22 nt, Homo sapiens
uaaguaaaugaaagguugauuu

SEQ ID NO: 121112 - RNA, 22 nt, Homo sapiens
uaaguauuaugugcugcauuuu

SEQ ID NO: 121113 - RNA, 22 nt, Homo sapiens
uaaugugcuucucuaccauagg

SEQ ID NO: 121114 - RNA, 22 nt, Homo sapiens
uaauucacauaaagcacuuaga

SEQ ID NO: 121115 - RNA, 22 nt, Homo sapiens
uaauugaaugcagacaccaggg

SEQ ID NO: 121116 - RNA, 21 nt, Homo sapiens
uacaagcuguagcacaugcca

SEQ ID NO: 121117 - RNA, 22 nt, Homo sapiens
uacaauagugacaaaucagcau

SEQ ID NO: 121118 - RNA, 22 nt, Homo sapiens
uacaguggaaguuaaccccauu

SEQ ID NO: 121119 - RNA, 22 nt, Homo sapiens
uacauguauccauuguuuuugg

SEQ ID NO: 121120 - RNA, 22 nt, Homo sapiens
uacccuuuaguauaaaaucaga

SEQ ID NO: 121121 - RNA, 22 nt, Homo sapiens
uacuagaaccuuauucagagug

SEQ ID NO: 121122 - RNA, 22 nt, Homo sapiens
uacuagaggaauugcuauaacu

SEQ ID NO: 121123 - RNA, 22 nt, Homo sapiens
uacucacauucuguuucuugcu

SEQ ID NO: 121124 - RNA, 22 nt, Homo sapiens
uacucagugacugguggaucaa

SEQ ID NO: 121125 - RNA, 19 nt, Homo sapiens
uacuggcucgggaauuuuc

SEQ ID NO: 121126 - RNA, 22 nt, Homo sapiens
uagaaguaggcuacgugucugg

SEQ ID NO: 121127 - RNA, 17 nt, Homo sapiens
uagcacagugccuggua

SEQ ID NO: 121128 - RNA, 22 nt, Homo sapiens
uagcacaugucagguaauuugc

SEQ ID NO: 121129 - RNA, 22 nt, Homo sapiens
uagcaguagacagacuuuggcu

SEQ ID NO: 121130 - RNA, 22 nt, Homo sapiens
uagcagugugaaaacagacuaa

SEQ ID NO: 121131 - RNA, 22 nt, Homo sapiens
uagcagugugaaaacggacuaa

SEQ ID NO: 121132 - RNA, 22 nt, Homo sapiens
uagcauggaggcggccauagug

SEQ ID NO: 121133 - RNA, 22 nt, Homo sapiens
uagcuggaguuuuuguuauagg

SEQ ID NO: 121134 - RNA, 20 nt, Homo sapiens
uaggagcaaugagaguagaa

SEQ ID NO: 121135 - RNA, 22 nt, Homo sapiens
uagggaguuuuggggugcagaa

SEQ ID NO: 121136 - RNA, 22 nt, Homo sapiens
uagguacuuuacauguuaucuc

SEQ ID NO: 121137 - RNA, 23 nt, Homo sapiens
uagguuauuugguaaauauaugu

SEQ ID NO: 121138 - RNA, 22 nt, Homo sapiens
uaguacuggcauguauuuccca

SEQ ID NO: 121139 - RNA, 22 nt, Homo sapiens
uagucccauaugauuuagugaa

SEQ ID NO: 121140 - RNA, 17 nt, Homo sapiens
uauagcacuucucacau

SEQ ID NO: 121141 - RNA, 22 nt, Homo sapiens
uauaugucuuuguuauguugag

SEQ ID NO: 121142 - RNA, 22 nt, Homo sapiens
uaucaacaggguggccagugua

SEQ ID NO: 121143 - RNA, 22 nt, Homo sapiens
uaucacacgccuugcuucauuu

SEQ ID NO: 121144 - RNA, 22 nt, Homo sapiens
uaucacagugcuggaguauucc

SEQ ID NO: 121145 - RNA, 22 nt, Homo sapiens
uaucauaguuuggacuuucauu

SEQ ID NO: 121146 - RNA, 22 nt, Homo sapiens
uaucauggaaagauguugaaau

SEQ ID NO: 121147 - RNA, 18 nt, Homo sapiens
uaucauguagggaaguug

SEQ ID NO: 121148 - RNA, 22 nt, Homo sapiens
uaugaauuuuauccaggauaua

SEQ ID NO: 121149 - RNA, 22 nt, Homo sapiens
uaugacuuguuuucuggucugc

SEQ ID NO: 121150 - RNA, 22 nt, Homo sapiens
uaugagagcugguagguagaga

SEQ ID NO: 121151 - RNA, 21 nt, Homo sapiens
uaugagucugcaagaaccaca

SEQ ID NO: 121152 - RNA, 23 nt, Homo sapiens
uaugccuguuucaaacaaacuuu

SEQ ID NO: 121153 - RNA, 22 nt, Homo sapiens
uaugcuuauuaaaacagugugu

SEQ ID NO: 121154 - RNA, 22 nt, Homo sapiens
uauggauuugccuauucuguau

SEQ ID NO: 121155 - RNA, 22 nt, Homo sapiens
uauggauuuucagauucuuauc

SEQ ID NO: 121156 - RNA, 22 nt, Homo sapiens
uauggccugaauuagaaaagug

SEQ ID NO: 121157 - RNA, 22 nt, Homo sapiens
uauggcuucuauaaggaagcuu

SEQ ID NO: 121158 - RNA, 22 nt, Homo sapiens
uaugguuuuaagguuaaggacu

SEQ ID NO: 121159 - RNA, 20 nt, Homo sapiens
uaugguuuuagguauagcau

SEQ ID NO: 121160 - RNA, 22 nt, Homo sapiens
uauuaagcuaguugucagugcu

SEQ ID NO: 121161 - RNA, 22 nt, Homo sapiens
uauuacugucaauaucacagaa

SEQ ID NO: 121162 - RNA, 22 nt, Homo sapiens
uauucaucuuaagcuuuggcuu

SEQ ID NO: 121163 - RNA, 22 nt, Homo sapiens
uauuuguccccuccaaaaguca

SEQ ID NO: 121164 - RNA, 22 nt, Homo sapiens
ucaaaucaucuuuuccaaagcu

SEQ ID NO: 121165 - RNA, 22 nt, Homo sapiens
ucaagaccucacauagaggaga

SEQ ID NO: 121166 - RNA, 18 nt, Homo sapiens
ucaagcaauugucaugcc

SEQ ID NO: 121167 - RNA, 20 nt, Homo sapiens
ucaaggcacgaauaaaaguu

SEQ ID NO: 121168 - RNA, 22 nt, Homo sapiens
ucaaguaguaacuaacugugac

SEQ ID NO: 121169 - RNA, 20 nt, Homo sapiens
ucacaagccaagaucacguc

SEQ ID NO: 121170 - RNA, 22 nt, Homo sapiens
ucacaagugagaggaauuagau

SEQ ID NO: 121171 - RNA, 22 nt, Homo sapiens
ucacaaguguauagacaugucc

SEQ ID NO: 121172 - RNA, 22 nt, Homo sapiens
ucacacugucuugguuacucuu

SEQ ID NO: 121173 - RNA, 19 nt, Homo sapiens
ucacacuguggcuucuuua

SEQ ID NO: 121174 - RNA, 22 nt, Homo sapiens
ucacauuaagcuguuauuucuu

SEQ ID NO: 121175 - RNA, 22 nt, Homo sapiens
ucacgcugcugcaaccagccug

SEQ ID NO: 121176 - RNA, 19 nt, Homo sapiens
ucacgugcagcagccacac

SEQ ID NO: 121177 - RNA, 22 nt, Homo sapiens
ucacugaaaccacugccuccug

SEQ ID NO: 121178 - RNA, 22 nt, Homo sapiens
ucacugggagaccaaagccauc

SEQ ID NO: 121179 - RNA, 22 nt, Homo sapiens
ucacuuuggguacuauggaaau

SEQ ID NO: 121180 - RNA, 21 nt, Homo sapiens
ucagaagcucccagggaggac

SEQ ID NO: 121181 - RNA, 22 nt, Homo sapiens
ucagacacugagcaaacgacua

SEQ ID NO: 121182 - RNA, 22 nt, Homo sapiens
ucagacacugcccuccaccugu

SEQ ID NO: 121183 - RNA, 22 nt, Homo sapiens
ucagagcaaagacacuuuauca

SEQ ID NO: 121184 - RNA, 19 nt, Homo sapiens
ucagaucagcccaagggau

SEQ ID NO: 121185 - RNA, 22 nt, Homo sapiens
ucagaucaugcuuaugauggga

SEQ ID NO: 121186 - RNA, 22 nt, Homo sapiens
ucagaucauuaagguagguuua

SEQ ID NO: 121187 - RNA, 22 nt, Homo sapiens
ucagaugaugucccuguucuaa

SEQ ID NO: 121188 - RNA, 22 nt, Homo sapiens
ucagugaacgaggaggagggug

SEQ ID NO: 121189 - RNA, 22 nt, Homo sapiens
ucagugaauauauaacagcgau

SEQ ID NO: 121190 - RNA, 22 nt, Homo sapiens
ucagugauugcuuucauggaaa

SEQ ID NO: 121191 - RNA, 22 nt, Homo sapiens
ucagugcuguuugcccucguuu

SEQ ID NO: 121192 - RNA, 22 nt, Homo sapiens
ucagugcuuggcacagagagcu

SEQ ID NO: 121193 - RNA, 22 nt, Homo sapiens
ucagugcuuuuuguugucauca

SEQ ID NO: 121194 - RNA, 22 nt, Homo sapiens
ucaguggagcuacaauucuggg

SEQ ID NO: 121195 - RNA, 22 nt, Homo sapiens
ucaguguuuuauccuccagagc

SEQ ID NO: 121196 - RNA, 22 nt, Homo sapiens
ucauacuguugugaaacaaaac

SEQ ID NO: 121197 - RNA, 22 nt, Homo sapiens
ucauaguacuuuguuuugaaaa

SEQ ID NO: 121198 - RNA, 22 nt, Homo sapiens
ucaugacacuggcaggagcuaa

SEQ ID NO: 121199 - RNA, 22 nt, Homo sapiens
ucauggggugcuuugcuagauu

SEQ ID NO: 121200 - RNA, 22 nt, Homo sapiens
ucauguaauuuugugucuauga

SEQ ID NO: 121201 - RNA, 22 nt, Homo sapiens
ucauugcauuccagcccaagca

SEQ ID NO: 121202 - RNA, 22 nt, Homo sapiens
uccaguguuccucagucacccc

SEQ ID NO: 121203 - RNA, 22 nt, Homo sapiens
ucccaguauucauuuacagaag

SEQ ID NO: 121204 - RNA, 19 nt, Homo sapiens
uccccgggucuagugcagc

SEQ ID NO: 121205 - RNA, 22 nt, Homo sapiens
uucagugguuauuugugagauu

SEQ ID NO: 121206 - RNA, 19 nt, Homo sapiens
uucauacagugagagcagc

SEQ ID NO: 121207 - RNA, 22 nt, Homo sapiens
uucauggacucaauaguuucgc

SEQ ID NO: 121208 - RNA, 22 nt, Homo sapiens
uucauggaguugagaaggcuaa

SEQ ID NO: 121209 - RNA, 22 nt, Homo sapiens
uuccagcugggggcaacucugc

SEQ ID NO: 121210 - RNA, 22 nt, Homo sapiens
uuccauguugauacgugaaguu

SEQ ID NO: 121211 - RNA, 22 nt, Homo sapiens
uucccucagaaacacacagccc

SEQ ID NO: 121212 - RNA, 22 nt, Homo sapiens
uucccugaguaucuuaccaugg

SEQ ID NO: 121213 - RNA, 22 nt, Homo sapiens
uucgucaugagacagaugcuga

SEQ ID NO: 121214 - RNA, 22 nt, Homo sapiens
uucuaaacaucuuacaaugcau

SEQ ID NO: 121215 - RNA, 21 nt, Homo sapiens
uucuaaguaaauguuggacau

SEQ ID NO: 121216 - RNA, 23 nt, Homo sapiens
uucuaucaggcccaggagcccug

SEQ ID NO: 121217 - RNA, 23 nt, Homo sapiens
uucugccacugaaaaugccucag

SEQ ID NO: 121218 - RNA, 22 nt, Homo sapiens
uucugguuaauacuugcaaaaa

SEQ ID NO: 121219 - RNA, 22 nt, Homo sapiens
uucugugguagaaaucucaaau

SEQ ID NO: 121220 - RNA, 22 nt, Homo sapiens
uucuuuggauaaaguuuuaugc

SEQ ID NO: 121221 - RNA, 22 nt, Homo sapiens
uugaaagacagaggggcaaguu

SEQ ID NO: 121222 - RNA, 22 nt, Homo sapiens
uugaaaguaaacaucacaaaga

SEQ ID NO: 121223 - RNA, 22 nt, Homo sapiens
uugaaagucauggcacaggcaa

SEQ ID NO: 121224 - RNA, 22 nt, Homo sapiens
uugaagguaggaugugcuauca

SEQ ID NO: 121225 - RNA, 22 nt, Homo sapiens
uugagauggagucucacgcauu

SEQ ID NO: 121226 - RNA, 22 nt, Homo sapiens
uugagauggagucuugcacugu

SEQ ID NO: 121227 - RNA, 22 nt, Homo sapiens
uugagauggauagacauagcau

SEQ ID NO: 121228 - RNA, 22 nt, Homo sapiens
uugagcacaggaguuugagacc

SEQ ID NO: 121229 - RNA, 22 nt, Homo sapiens
uugaggcuuuugaccucaugug

SEQ ID NO: 121230 - RNA, 22 nt, Homo sapiens
uugauaguuuuaaaauuaaucu

SEQ ID NO: 121231 - RNA, 22 nt, Homo sapiens
uugauauguuguuagauucagu

SEQ ID NO: 121232 - RNA, 22 nt, Homo sapiens
uugauauucugagaagcugaag

SEQ ID NO: 121233 - RNA, 22 nt, Homo sapiens
uugcaaagaccucuucacuucc

SEQ ID NO: 121234 - RNA, 21 nt, Homo sapiens
uugcaaaugcugcugccugau

SEQ ID NO: 121235 - RNA, 18 nt, Homo sapiens
uugcaaauucuucccugu

SEQ ID NO: 121236 - RNA, 20 nt, Homo sapiens
uugcacagagaaggaggcag

SEQ ID NO: 121237 - RNA, 22 nt, Homo sapiens
uugcacagugguuuagagccug

SEQ ID NO: 121238 - RNA, 22 nt, Homo sapiens
uugcacaguguguacagcacca

SEQ ID NO: 121239 - RNA, 18 nt, Homo sapiens
uugcacuccugccugggu

SEQ ID NO: 121240 - RNA, 22 nt, Homo sapiens
uugcaugucugcuucuccuccu

SEQ ID NO: 121241 - RNA, 22 nt, Homo sapiens
uugcuucauucaacauugaggg

SEQ ID NO: 121242 - RNA, 23 nt, Homo sapiens
uuggaaugagaccuaagaguuuu

SEQ ID NO: 121243 - RNA, 22 nt, Homo sapiens
uuggaaugcacacugagccugc

SEQ ID NO: 121244 - RNA, 22 nt, Homo sapiens
uuggaauuuuacuucuguaaga

SEQ ID NO: 121245 - RNA, 22 nt, Homo sapiens
uuggcccugcugaccauucccu

SEQ ID NO: 121246 - RNA, 22 nt, Homo sapiens
uuggggcacggccucuguugcc

SEQ ID NO: 121247 - RNA, 22 nt, Homo sapiens
uugguuaccuucagaaaugagu

SEQ ID NO: 121248 - RNA, 22 nt, Homo sapiens
uuguacuagaaaauuauucuuu

SEQ ID NO: 121249 - RNA, 22 nt, Homo sapiens
uugucacccuacauaacaggga

SEQ ID NO: 121250 - RNA, 22 nt, Homo sapiens
uuguccccacccaaaugucauc

SEQ ID NO: 121251 - RNA, 22 nt, Homo sapiens
uuguccuccacauuugaucagu

SEQ ID NO: 121252 - RNA, 22 nt, Homo sapiens
uugucuccuagacgaccaggcg

SEQ ID NO: 121253 - RNA, 22 nt, Homo sapiens
uugugaagaugugaagcaagca

SEQ ID NO: 121254 - RNA, 22 nt, Homo sapiens
uugugauugagugauccuuguu

SEQ ID NO: 121255 - RNA, 22 nt, Homo sapiens
uugugcuucaucaccuagcaga

SEQ ID NO: 121256 - RNA, 22 nt, Homo sapiens
uugugcuuguaacuacauucag

SEQ ID NO: 121257 - RNA, 22 nt, Homo sapiens
uuguggcuuaucucauuuagcg

SEQ ID NO: 121258 - RNA, 22 nt, Homo sapiens
uuuaacauuggaugagaucguc

SEQ ID NO: 121259 - RNA, 18 nt, Homo sapiens
uuuacaguagaaggacuu

SEQ ID NO: 121260 - RNA, 22 nt, Homo sapiens
uuuacagucuuuugugugaguc

SEQ ID NO: 121261 - RNA, 22 nt, Homo sapiens
uuuagguagucaaagguuaguc

SEQ ID NO: 121262 - RNA, 22 nt, Homo sapiens
uuucaacaggucuggggugguc

SEQ ID NO: 121263 - RNA, 19 nt, Homo sapiens
uuucaauguaaggauggag

SEQ ID NO: 121264 - RNA, 22 nt, Homo sapiens
uuucaccguguuggccaggcug

SEQ ID NO: 121265 - RNA, 22 nt, Homo sapiens
uuucaucagccagggucagucu

SEQ ID NO: 121266 - RNA, 22 nt, Homo sapiens
uuucugaggccucaccagaagc

SEQ ID NO: 121267 - RNA, 22 nt, Homo sapiens
uuugacaaugugugcuuguauu

SEQ ID NO: 121268 - RNA, 22 nt, Homo sapiens
uuugagauaucuuccaucagua

SEQ ID NO: 121269 - RNA, 22 nt, Homo sapiens
uuugagcaugcagauugccagg

SEQ ID NO: 121270 - RNA, 22 nt, Homo sapiens
uuugauugguguaccugaaagu

SEQ ID NO: 121271 - RNA, 22 nt, Homo sapiens
uuugcagugucagcuucugugu

SEQ ID NO: 121272 - RNA, 22 nt, Homo sapiens
uuugccaauauuuuauugagga

SEQ ID NO: 121273 - RNA, 22 nt, Homo sapiens
uuugcuauagugaauagugcug

SEQ ID NO: 121274 - RNA, 22 nt, Homo sapiens
uuuggcucugugucccacccaa

SEQ ID NO: 121275 - RNA, 22 nt, Homo sapiens
uuuggcuuaagauugacugcaa

SEQ ID NO: 121276 - RNA, 22 nt, Homo sapiens
uuugggaaugaguuuaucauuu

SEQ ID NO: 121277 - RNA, 22 nt, Homo sapiens
uuugggaaugguuugucuccca

SEQ ID NO: 121278 - RNA, 22 nt, Homo sapiens
uuugguuauuugaaacuagcau

SEQ ID NO: 121279 - RNA, 22 nt, Homo sapiens
uuuguacuugguguucuggaaa

SEQ ID NO: 121280 - RNA, 22 nt, Homo sapiens
uuugugcuaacuuuaacucuua

SEQ ID NO: 121281 - RNA, 22 nt, Homo sapiens
uuugugcuccuaugagaaucua

SEQ ID NO: 121282 - RNA, 22 nt, Homo sapiens
uuugugcuccugugagaaucua

SEQ ID NO: 121283 - RNA, 22 nt, Homo sapiens
uuugugcugcaauuaauuuccc

SEQ ID NO: 121284 - RNA, 20 nt, Homo sapiens
uuuuagcacuuguuauggug

SEQ ID NO: 121285 - RNA, 22 nt, Homo sapiens
uuuuagcuuuucccaggacucc

SEQ ID NO: 121286 - RNA, 22 nt, Homo sapiens
uuuuccagugggacucccauua

SEQ ID NO: 121287 - RNA, 22 nt, Homo sapiens
uuuugguauacacaaggguccu

SEQ ID NO: 121288 - RNA, 22 nt, Homo sapiens
uuuuugugguauauugcaacaa

SEQ ID NO: 121289 - RNA, 23 nt, Homo sapiens
uuuuuguguuucauggaaauagg

SEQ ID NO: 121290 - RNA, 22 nt, Homo sapiens
aaacugucuucugacaguuucc

SEQ ID NO: 121291 - RNA, 22 nt, Homo sapiens
aaaggcacugugacuuuauagg

SEQ ID NO: 121292 - RNA, 15 nt, Homo sapiens
aaauaugucaguucu

SEQ ID NO: 121293 - RNA, 22 nt, Homo sapiens
aaaugcaugaauaagcucgugu

SEQ ID NO: 121294 - RNA, 22 nt, Homo sapiens
aaauggcuuuuugggcaaggug

SEQ ID NO: 121295 - RNA, 22 nt, Homo sapiens
aacagacugucacauaaaauug

SEQ ID NO: 121296 - RNA, 22 nt, Homo sapiens
aacagugccugucauuuaguag

SEQ ID NO: 121297 - RNA, 21 nt, Homo sapiens
aacagugcugaacagacaccu

SEQ ID NO: 121298 - RNA, 21 nt, Homo sapiens
aacagugcuuaguagauguuc

SEQ ID NO: 121299 - RNA, 22 nt, Homo sapiens
aacucugucuccuucaaguuca

SEQ ID NO: 121300 - RNA, 22 nt, Homo sapiens
aacugcacuaggacagguuuuu

SEQ ID NO: 121301 - RNA, 22 nt, Homo sapiens
aacuggcauagccagacuucuc

SEQ ID NO: 121302 - RNA, 19 nt, Homo sapiens
aacuggugugagaugguau

SEQ ID NO: 121303 - RNA, 21 nt, Homo sapiens
aacuggugugagaugguaugu

SEQ ID NO: 121304 - RNA, 22 nt, Homo sapiens
aagaccuaugcaggaagaaaug

SEQ ID NO: 121305 - RNA, 18 nt, Homo sapiens
aaacugcuuccuuggccu

SEQ ID NO: 121306 - RNA, 22 nt, Homo sapiens
aaacugucuggaugcuugugga

SEQ ID NO: 121307 - RNA, 22 nt, Homo sapiens
aaagaagucagccuguccuuug

SEQ ID NO: 121308 - RNA, 22 nt, Homo sapiens
aaaggcaucauuaguaccaagu

SEQ ID NO: 121309 - RNA, 22 nt, Homo sapiens
aaagggcuuuguaaacuucaag

SEQ ID NO: 121310 - RNA, 22 nt, Homo sapiens
aaauaacugucagguucuggaa

SEQ ID NO: 121311 - RNA, 22 nt, Homo sapiens
aaaugcugucaaauuguguucu

SEQ ID NO: 121312 - RNA, 22 nt, Homo sapiens
aaauggcuuugaggguaggaca

SEQ ID NO: 121313 - RNA, 22 nt, Homo sapiens
aacagucaauugcugaugaccu

SEQ ID NO: 121314 - RNA, 22 nt, Homo sapiens
aaccacauggcucaguggacau

SEQ ID NO: 121315 - RNA, 22 nt, Homo sapiens
aacugccucugacauaggcagg

SEQ ID NO: 121316 - RNA, 22 nt, Homo sapiens
aaggaacuggaauauuuugaac

SEQ ID NO: 121317 - RNA, 22 nt, Homo sapiens
aaggauuguaaaguugacaaau

SEQ ID NO: 121318 - RNA, 22 nt, Homo sapiens
aaggcuauuugagaaugugugu

SEQ ID NO: 121319 - RNA, 22 nt, Homo sapiens
aagggagcugcauaaucuugug

SEQ ID NO: 121320 - RNA, 22 nt, Homo sapiens
aaguacuguuuaaauugcagaa

SEQ ID NO: 121321 - RNA, 19 nt, Homo sapiens
aauauugacaguggugucu

SEQ ID NO: 121322 - RNA, 22 nt, Homo sapiens
aaucccugagcuagacacaaag

SEQ ID NO: 121323 - RNA, 22 nt, Homo sapiens
acaagcacaaauuuaauccugu

SEQ ID NO: 121324 - RNA, 22 nt, Homo sapiens
acaagugaauacaggauucucu

SEQ ID NO: 121325 - RNA, 22 nt, Homo sapiens
acagccauuccagccaaauacu

SEQ ID NO: 121326 - RNA, 22 nt, Homo sapiens
acaucauugggggcuacaggug

SEQ ID NO: 121327 - RNA, 22 nt, Homo sapiens
acauccauuugcuuuauuugcu

SEQ ID NO: 121328 - RNA, 22 nt, Homo sapiens
acaucccuuucccacccuucac

SEQ ID NO: 121329 - RNA, 17 nt, Homo sapiens
acaugagacuggauucu

SEQ ID NO: 121330 - RNA, 22 nt, Homo sapiens
accaguguuuaccaaguagcau

SEQ ID NO: 121331 - RNA, 22 nt, Homo sapiens
accauugcacuccuuucugggc

SEQ ID NO: 121332 - RNA, 23 nt, Homo sapiens
acugagcaauguuuacauacuug

SEQ ID NO: 121333 - RNA, 22 nt, Homo sapiens
acugcacuccaccuugggcaac

SEQ ID NO: 121334 - RNA, 22 nt, Homo sapiens
acugcacuccagcccgggugac

SEQ ID NO: 121335 - RNA, 22 nt, Homo sapiens
acugcacuccagccucccgucu

SEQ ID NO: 121336 - RNA, 22 nt, Homo sapiens
acugcacuccagccucguggac

SEQ ID NO: 121337 - RNA, 22 nt, Homo sapiens
acugcacuccagccuggacgaa

SEQ ID NO: 121338 - RNA, 22 nt, Homo sapiens
acugcacuccagccuggacgac

SEQ ID NO: 121339 - RNA, 22 nt, Homo sapiens
acugcacuccagccugugcgua

SEQ ID NO: 121340 - RNA, 20 nt, Homo sapiens
acugcacuccagccuuccag

SEQ ID NO: 121341 - RNA, 22 nt, Homo sapiens
acugcacuccagccuuggagac

SEQ ID NO: 121342 - RNA, 22 nt, Homo sapiens
acugcacuccagcuuuggguga

SEQ ID NO: 121343 - RNA, 22 nt, Homo sapiens
acugcacuccaguuccgggcaa

SEQ ID NO: 121344 - RNA, 18 nt, Homo sapiens
acugcacuccauccuagg

SEQ ID NO: 121345 - RNA, 22 nt, Homo sapiens
acugcacuccggccuggcaaca

SEQ ID NO: 121346 - RNA, 19 nt, Homo sapiens
acugcacuccuccuugggu

SEQ ID NO: 121347 - RNA, 22 nt, Homo sapiens
acugcacucuagccccugcgac

SEQ ID NO: 121348 - RNA, 22 nt, Homo sapiens
acugcacucuagcuugggugac

SEQ ID NO: 121349 - RNA, 22 nt, Homo sapiens
acugcacugucaaccuccuggg

SEQ ID NO: 121350 - RNA, 22 nt, Homo sapiens
acugcacuucagccuuggcuac

SEQ ID NO: 121351 - RNA, 22 nt, Homo sapiens
acugcacuucagccuugugaca

SEQ ID NO: 121352 - RNA, 22 nt, Homo sapiens
agaaccaaucccacauggauac

SEQ ID NO: 121353 - RNA, 22 nt, Homo sapiens
agacaguauuggcaaagugugu

SEQ ID NO: 121354 - RNA, 22 nt, Homo sapiens
agagaccuguaaaguucaggca

SEQ ID NO: 121355 - RNA, 22 nt, Homo sapiens
agagagguggguggagccccca

SEQ ID NO: 121356 - RNA, 22 nt, Homo sapiens
agaugccucauguucuagguuc

SEQ ID NO: 121357 - RNA, 22 nt, Homo sapiens
agcaggacaauaugggaucagg

SEQ ID NO: 121358 - RNA, 16 nt, Homo sapiens
agcagguguuagguga

SEQ ID NO: 121359 - RNA, 19 nt, Homo sapiens
agcuguguugccugugaga

SEQ ID NO: 121360 - RNA, 22 nt, Homo sapiens
aggagcacaggacuuugauuau

SEQ ID NO: 121361 - RNA, 22 nt, Homo sapiens
agguacuugagauucugaacug

SEQ ID NO: 121362 - RNA, 22 nt, Homo sapiens
agguagcauagcgggaauauca

SEQ ID NO: 121363 - RNA, 22 nt, Homo sapiens
ccacaguugaaauuuugacugu

SEQ ID NO: 121364 - RNA, 22 nt, Homo sapiens
ccagugcugugcaguguaugag

SEQ ID NO: 121365 - RNA, 22 nt, Homo sapiens
ccauuucacucuuccugaagga

SEQ ID NO: 121366 - RNA, 19 nt, Homo sapiens
cccuggcacauggaaaaug

SEQ ID NO: 121367 - RNA, 22 nt, Homo sapiens
ccugagacugauugacucacaa

SEQ ID NO: 121368 - RNA, 22 nt, Homo sapiens
cuaacacagagguuuauuucuc

SEQ ID NO: 121369 - RNA, 22 nt, Homo sapiens
cuacugcacaucaucugaguua

SEQ ID NO: 121370 - RNA, 22 nt, Homo sapiens
cucagggugguggacucuaaua

SEQ ID NO: 121371 - RNA, 22 nt, Homo sapiens
cuccauuuaguccuuuuagaag

SEQ ID NO: 121372 - RNA, 22 nt, Homo sapiens
cucugguucugcagugcacccu

SEQ ID NO: 121373 - RNA, 22 nt, Homo sapiens
cucuuuuguuccuaguuugauc

SEQ ID NO: 121374 - RNA, 22 nt, Homo sapiens
cugacacuucaaaacugccaau

SEQ ID NO: 121375 - RNA, 22 nt, Homo sapiens
auguaaacauuuggucuaaauu

SEQ ID NO: 121376 - RNA, 22 nt, Homo sapiens
augucaaggugaagaaagauca

SEQ ID NO: 121377 - RNA, 22 nt, Homo sapiens
augugcuuaaaaaugcagagaa

SEQ ID NO: 121378 - RNA, 22 nt, Homo sapiens
augugcuugagggaaaucaguu

SEQ ID NO: 121379 - RNA, 22 nt, Homo sapiens
auguguaaagcuuuucuuuguu

SEQ ID NO: 121380 - RNA, 23 nt, Homo sapiens
augugugcuuggagagcaggaug

SEQ ID NO: 121381 - RNA, 22 nt, Homo sapiens
auguuauguucuucucuguaua

SEQ ID NO: 121382 - RNA, 22 nt, Homo sapiens
auuggcaauccauauauuuucu

SEQ ID NO: 121383 - RNA, 22 nt, Homo sapiens
auuggcaauguacauaucuugc

SEQ ID NO: 121384 - RNA, 22 nt, Homo sapiens
auuguacuagguccuagggcuu

SEQ ID NO: 121385 - RNA, 22 nt, Homo sapiens
auuguacuccagccugggcaaa

SEQ ID NO: 121386 - RNA, 22 nt, Homo sapiens
auuguacugccccccuguugcu

SEQ ID NO: 121387 - RNA, 22 nt, Homo sapiens
auuguacuuaagccugggugaa

SEQ ID NO: 121388 - RNA, 22 nt, Homo sapiens
auuuggcauagaguaucauucu

SEQ ID NO: 121389 - RNA, 22 nt, Homo sapiens
caaauccucaccucaucaugaa

SEQ ID NO: 121390 - RNA, 22 nt, Homo sapiens
cacacugucuucauuacuguag

SEQ ID NO: 121391 - RNA, 22 nt, Homo sapiens
cacagcuagucaaugguagaca

SEQ ID NO: 121392 - RNA, 22 nt, Homo sapiens
cacugcacuccagcuuugguga

SEQ ID NO: 121393 - RNA, 22 nt, Homo sapiens
cacugcacuccagucccgucuc

SEQ ID NO: 121394 - RNA, 22 nt, Homo sapiens
cacugcacuccagucugacgac

SEQ ID NO: 121395 - RNA, 22 nt, Homo sapiens
cacugcacuccaguuuggauga

SEQ ID NO: 121396 - RNA, 21 nt, Homo sapiens
cacugcacuugccuucugggu

SEQ ID NO: 121397 - RNA, 22 nt, Homo sapiens
cacugcauccuccauauccugg

SEQ ID NO: 121398 - RNA, 22 nt, Homo sapiens
cagcugcuuuggaaaauauuuu

SEQ ID NO: 121399 - RNA, 22 nt, Homo sapiens
cagugcuuuaucaaguccucca

SEQ ID NO: 121400 - RNA, 22 nt, Homo sapiens
cauaaagauggaggaggccagg

SEQ ID NO: 121401 - RNA, 22 nt, Homo sapiens
caucagagugagauauaagauc

SEQ ID NO: 121402 - RNA, 22 nt, Homo sapiens
caugcauuggucuauuauguga

SEQ ID NO: 121403 - RNA, 19 nt, Homo sapiens
cauggcuuauaauuuuaau

SEQ ID NO: 121404 - RNA, 20 nt, Homo sapiens
cauugcacuccagcuugggc

SEQ ID NO: 121405 - RNA, 22 nt, Homo sapiens
cauugguuaguuaacuuuaaga

SEQ ID NO: 121406 - RNA, 19 nt, Homo sapiens
ccacaaugguugaacuaga

SEQ ID NO: 121407 - RNA, 22 nt, Homo sapiens
ccacagucuaugcaacaagguc

SEQ ID NO: 121408 - RNA, 22 nt, Homo sapiens
ccacauuggaaaggaucccccc

SEQ ID NO: 121409 - RNA, 22 nt, Homo sapiens
ccaguguuuggauuagggaugc

SEQ ID NO: 121410 - RNA, 22 nt, Homo sapiens
ccauacugucaaauagauuucc

SEQ ID NO: 121411 - RNA, 19 nt, Homo sapiens
cccagugucagagaagggu

SEQ ID NO: 121412 - RNA, 22 nt, Homo sapiens
cccagugugaacuuggcauuuu

SEQ ID NO: 121413 - RNA, 22 nt, Homo sapiens
cccaguguuacgugacagccug

SEQ ID NO: 121414 - RNA, 22 nt, Homo sapiens
cccaguguuuauuuugagccaa

SEQ ID NO: 121415 - RNA, 22 nt, Homo sapiens
cccgugucuuggucuagggccu

SEQ ID NO: 121416 - RNA, 22 nt, Homo sapiens
cgccgggggaugggcaccagcg

SEQ ID NO: 121417 - RNA, 20 nt, Homo sapiens
cuaaucaucccagaagaaau

SEQ ID NO: 121418 - RNA, 22 nt, Homo sapiens
cuagagagaagcugugugaccu

SEQ ID NO: 121419 - RNA, 22 nt, Homo sapiens
cuauggcucugguuauggcugu

SEQ ID NO: 121420 - RNA, 22 nt, Homo sapiens
cucaaguacaugggauuacagg

SEQ ID NO: 121421 - RNA, 22 nt, Homo sapiens
cucaguuuugccuuguuuaagg

SEQ ID NO: 121422 - RNA, 22 nt, Homo sapiens
cuccagugcaaagucaugauca

SEQ ID NO: 121423 - RNA, 20 nt, Homo sapiens
cugauacagccugagcucuc

SEQ ID NO: 121424 - RNA, 22 nt, Homo sapiens
cugcacugagacccucuuugcu

SEQ ID NO: 121425 - RNA, 22 nt, Homo sapiens
cugcccuuucuauaugauguaa

SEQ ID NO: 121426 - RNA, 22 nt, Homo sapiens
cuggaaagcaaagggugcauug

SEQ ID NO: 121427 - RNA, 22 nt, Homo sapiens
cuguaacagaauaaauuuguuu

SEQ ID NO: 121428 - RNA, 22 nt, Homo sapiens
cugucucagugaauugguuuua

SEQ ID NO: 121429 - RNA, 22 nt, Homo sapiens
cugugcauaugacuuuauugga

SEQ ID NO: 121430 - RNA, 22 nt, Homo sapiens
cuuggcauuguguugauagaag

SEQ ID NO: 121431 - RNA, 22 nt, Homo sapiens
cuuuggcaaugucauuuucaau

SEQ ID NO: 121432 - RNA, 23 nt, Homo sapiens
cuuuguccccacccaaaucucau

SEQ ID NO: 121433 - RNA, 22 nt, Homo sapiens
gaaagauuuccugagcuagaaa

SEQ ID NO: 121434 - RNA, 22 nt, Homo sapiens
gaaauguuuuucaugugggcaa

SEQ ID NO: 121435 - RNA, 22 nt, Homo sapiens
gaagaaguacaagacaaauuuu

SEQ ID NO: 121436 - RNA, 22 nt, Homo sapiens
gaauagugcugcaguaaacaua

SEQ ID NO: 121437 - RNA, 20 nt, Homo sapiens
gacauagagacucucaaaaa

SEQ ID NO: 121438 - RNA, 22 nt, Homo sapiens
gacauagagccuugacuucauu

SEQ ID NO: 121439 - RNA, 22 nt, Homo sapiens
gacuagauauuguucuauguca

SEQ ID NO: 121440 - RNA, 22 nt, Homo sapiens
gagauaggauucacuuucaugu

SEQ ID NO: 121441 - RNA, 22 nt, Homo sapiens
gagaugaaaucuugcucuguca

SEQ ID NO: 121442 - RNA, 22 nt, Homo sapiens
gagcugguccuuuaaggaugca

SEQ ID NO: 121443 - RNA, 23 nt, Homo sapiens
gaguggagacucauugauuuccu

SEQ ID NO: 121444 - RNA, 22 nt, Homo sapiens
gaguuagguugucaaugucuua

SEQ ID NO: 121445 - RNA, 22 nt, Homo sapiens
gauauguaaaaauuauaucuga

SEQ ID NO: 121446 - RNA, 22 nt, Homo sapiens
gaucacaguuccucacgggcau

SEQ ID NO: 121447 - RNA, 22 nt, Homo sapiens
gaugagguaguguaccuagucu

SEQ ID NO: 121448 - RNA, 22 nt, Homo sapiens
gauggaguugacuaagacaaca

SEQ ID NO: 121449 - RNA, 22 nt, Homo sapiens
gauuagagaaauacugcugcua

SEQ ID NO: 121450 - RNA, 20 nt, Homo sapiens
gauuagagagaggcugugca

SEQ ID NO: 121451 - RNA, 22 nt, Homo sapiens
gcacaguuaaagggucauguga

SEQ ID NO: 121452 - RNA, 22 nt, Homo sapiens
gcaguagugugaucuuggcuca

SEQ ID NO: 121453 - RNA, 22 nt, Homo sapiens
gcagugcaguggcgcgaucucg

SEQ ID NO: 121454 - RNA, 20 nt, Homo sapiens
gcaguguucacuguauuccu

SEQ ID NO: 121455 - RNA, 20 nt, Homo sapiens
gcaguguucugaccugaauc

SEQ ID NO: 121456 - RNA, 22 nt, Homo sapiens
gcaguguucugggcaggaagaa

SEQ ID NO: 121457 - RNA, 22 nt, Homo sapiens
gcauaugucuuuauagcagcau

SEQ ID NO: 121458 - RNA, 22 nt, Homo sapiens
gcauggagaaggggacugauuc

SEQ ID NO: 121459 - RNA, 22 nt, Homo sapiens
gccaagaugcugcccacagaca

SEQ ID NO: 121460 - RNA, 22 nt, Homo sapiens
gccaagauuuaauucaucaguu

SEQ ID NO: 121461 - RNA, 22 nt, Homo sapiens
gcugcacuuuaaggcauccccu

SEQ ID NO: 121462 - RNA, 22 nt, Homo sapiens
gcuguauugacuuuguaucaua

SEQ ID NO: 121463 - RNA, 22 nt, Homo sapiens
gcuuuguugauggugagucugu

SEQ ID NO: 121464 - RNA, 22 nt, Homo sapiens
ggaaaguccuucuguaggcucc

SEQ ID NO: 121465 - RNA, 22 nt, Homo sapiens
ugaaggccgggcaugguggcuc

SEQ ID NO: 121466 - RNA, 20 nt, Homo sapiens
ugacaguuaagggauagaag

SEQ ID NO: 121467 - RNA, 22 nt, Homo sapiens
ugacucaguuucucagguagua

SEQ ID NO: 121468 - RNA, 22 nt, Homo sapiens
ugagauuaaucuuuaaguaaga

SEQ ID NO: 121469 - RNA, 22 nt, Homo sapiens
ugagcucaugcauucuugagga

SEQ ID NO: 121470 - RNA, 22 nt, Homo sapiens
ugaguacuacuaguuacugcua

SEQ ID NO: 121471 - RNA, 22 nt, Homo sapiens
ugauaugaaagggaaauaagug

SEQ ID NO: 121472 - RNA, 22 nt, Homo sapiens
ugauaugucccucgacaucagg

SEQ ID NO: 121473 - RNA, 20 nt, Homo sapiens
ugauauuucuggaaguggag

SEQ ID NO: 121474 - RNA, 22 nt, Homo sapiens
ugauauuuuugauccuuaaguu

SEQ ID NO: 121475 - RNA, 22 nt, Homo sapiens
ugcaaaucuuguguaguuguga

SEQ ID NO: 121476 - RNA, 22 nt, Homo sapiens
ugccaguguuuuguugaagauu

SEQ ID NO: 121477 - RNA, 22 nt, Homo sapiens
ugccuaggcuggagugcagugg

SEQ ID NO: 121478 - RNA, 22 nt, Homo sapiens
ugcuuuguugaaaaucauuugg

SEQ ID NO: 121479 - RNA, 22 nt, Homo sapiens
uggaaaguacuugaguuuguau

SEQ ID NO: 121480 - RNA, 22 nt, Homo sapiens
uggaagaugggaccucaguuuu

SEQ ID NO: 121481 - RNA, 22 nt, Homo sapiens
uggaagugaacaaccaaggcag

SEQ ID NO: 121482 - RNA, 22 nt, Homo sapiens
uggaaugucagcuacaagaggg

SEQ ID NO: 121483 - RNA, 22 nt, Homo sapiens
uggacaagugcccuccaccuca

SEQ ID NO: 121484 - RNA, 18 nt, Homo sapiens
uggacagugauuauccau

SEQ ID NO: 121485 - RNA, 19 nt, Homo sapiens
uggagucaucaugcugcua

SEQ ID NO: 121486 - RNA, 22 nt, Homo sapiens
uggcacuggagauacauuaaua

SEQ ID NO: 121487 - RNA, 22 nt, Homo sapiens
uggcuguuuauuucaccuggau

SEQ ID NO: 121488 - RNA, 22 nt, Homo sapiens
ugggaacugaggugaaaagaca

SEQ ID NO: 121489 - RNA, 22 nt, Homo sapiens
ugggagcauugcauuagaagcc

SEQ ID NO: 121490 - RNA, 22 nt, Homo sapiens
ugggaugugagucuucgcuuuc

SEQ ID NO: 121491 - RNA, 22 nt, Homo sapiens
ugggcuagaugcuuugggguca

SEQ ID NO: 121492 - RNA, 22 nt, Homo sapiens
ugguauguaugauuaacaugga

SEQ ID NO: 121493 - RNA, 22 nt, Homo sapiens
ugguaugucuuucuuccuguag

SEQ ID NO: 121494 - RNA, 22 nt, Homo sapiens
ugguauguugucucuuuguucu

SEQ ID NO: 121495 - RNA, 22 nt, Homo sapiens
uguaaggcaguuagagcaaauu

SEQ ID NO: 121496 - RNA, 22 nt, Homo sapiens
uguagucauuccuuuuugcuuu

SEQ ID NO: 121497 - RNA, 23 nt, Homo sapiens
uguauacacccugugcaucuggg

SEQ ID NO: 121498 - RNA, 22 nt, Homo sapiens
uguauguaaagacaggauaaca

SEQ ID NO: 121499 - RNA, 22 nt, Homo sapiens
ugucaagaugguuugauguugu

SEQ ID NO: 121500 - RNA, 22 nt, Homo sapiens
ugucacagagauuuugguaugu

SEQ ID NO: 121501 - RNA, 22 nt, Homo sapiens
ugucacugugaguuugacugcu

SEQ ID NO: 121502 - RNA, 22 nt, Homo sapiens
ugucagcacaacucagguuccu

SEQ ID NO: 121503 - RNA, 22 nt, Homo sapiens
uguccauuuuuaugcuuauggu

SEQ ID NO: 121504 - RNA, 22 nt, Homo sapiens
uguccuagagggaugucacccc

SEQ ID NO: 121505 - RNA, 22 nt, Homo sapiens
ugucuaaagaauggcagacuca

SEQ ID NO: 121506 - RNA, 22 nt, Homo sapiens
ugugacucuggcacauggugag

SEQ ID NO: 121507 - RNA, 18 nt, Homo sapiens
ugugcaauauuaaccacc

SEQ ID NO: 121508 - RNA, 22 nt, Homo sapiens
ugugucuacugagaugaucaug

SEQ ID NO: 121509 - RNA, 22 nt, Homo sapiens
uguuauguucuacuuuuaggug

SEQ ID NO: 121510 - RNA, 22 nt, Homo sapiens
uguuauguuguuugagaaaguc

SEQ ID NO: 121511 - RNA, 22 nt, Homo sapiens
uuaaagccauaccugagagagu

SEQ ID NO: 121512 - RNA, 22 nt, Homo sapiens
uuaagcaaagguaacaugagaa

SEQ ID NO: 121513 - RNA, 22 nt, Homo sapiens
uuaauuguaucuauagauguca

SEQ ID NO: 121514 - RNA, 19 nt, Homo sapiens
uuacauccauugcauuuca

SEQ ID NO: 121515 - RNA, 22 nt, Homo sapiens
uuacugcauaauuccugggaag

SEQ ID NO: 121516 - RNA, 22 nt, Homo sapiens
uuagauuauugguguuuugcaa

SEQ ID NO: 121517 - RNA, 22 nt, Homo sapiens
uuagcagugugagcacagacua

SEQ ID NO: 121518 - RNA, 21 nt, Homo sapiens
uuagcauccauguucaucaac

SEQ ID NO: 121519 - RNA, 22 nt, Homo sapiens
uuagcaugucuacuaauuugcu

SEQ ID NO: 121520 - RNA, 22 nt, Homo sapiens
uuaggcaguuuauugauuuuca

SEQ ID NO: 121521 - RNA, 22 nt, Homo sapiens
uuagggaggcucaggacaagag

SEQ ID NO: 121522 - RNA, 21 nt, Homo sapiens
uuauccagcacuguuucggac

SEQ ID NO: 121523 - RNA, 22 nt, Homo sapiens
uuauguguuuaauguuucugaa

SEQ ID NO: 121524 - RNA, 22 nt, Homo sapiens
uucagagagggagggauaccua

SEQ ID NO: 121525 - RNA, 20 nt, Homo sapiens
uucagcaaaggaaugggagu

SEQ ID NO: 121526 - RNA, 22 nt, Homo sapiens
uucaggcuccugugagaaucua

SEQ ID NO: 121527 - RNA, 22 nt, Homo sapiens
uucaguggagaggcugaguggu

SEQ ID NO: 121528 - RNA, 22 nt, Homo sapiens
uucaucagggagaaauaauuuc

SEQ ID NO: 121529 - RNA, 22 nt, Homo sapiens
uucaucaguuauauuggccuga

SEQ ID NO: 121530 - RNA, 22 nt, Homo sapiens
uucauggaguugagaaggcuaa

SEQ ID NO: 121531 - RNA, 22 nt, Homo sapiens
uucccugugugcagaugggugu

SEQ ID NO: 121532 - RNA, 22 nt, Homo sapiens
uucccuugcaggaugaucugga

SEQ ID NO: 121533 - RNA, 22 nt, Homo sapiens
uuccugugacccccaagcccac

SEQ ID NO: 121534 - RNA, 22 nt, Homo sapiens
uucuauugguaauauuuucugu

SEQ ID NO: 121535 - RNA, 22 nt, Homo sapiens
uucuggcucgauucucugaccg

SEQ ID NO: 121536 - RNA, 22 nt, Homo sapiens
uucugugguugaaaggagagau

SEQ ID NO: 121537 - RNA, 22 nt, Homo sapiens
uucugugguuucauuuaccugu

SEQ ID NO: 121538 - RNA, 22 nt, Homo sapiens
uucuuccagccuugaggggccc

SEQ ID NO: 121539 - RNA, 21 nt, Homo sapiens
uucuuugcucaguguuagagu

SEQ ID NO: 121540 - RNA, 22 nt, Homo sapiens
uugaaauguuuagaaguuugga

SEQ ID NO: 121541 - RNA, 22 nt, Homo sapiens
uugagaaucuuucgaauguucu

SEQ ID NO: 121542 - RNA, 20 nt, Homo sapiens
uugauucccucuaaacucgc

SEQ ID NO: 121543 - RNA, 22 nt, Homo sapiens
uugcacauggcaggugcucaau

SEQ ID NO: 121544 - RNA, 22 nt, Homo sapiens
uugcagagaaauuucugguuua

SEQ ID NO: 121545 - RNA, 22 nt, Homo sapiens
uugcauguacguacagagagag

SEQ ID NO: 121546 - RNA, 22 nt, Homo sapiens
uugcauuuucuaggagggcaaa

SEQ ID NO: 121547 - RNA, 22 nt, Homo sapiens
uugcuacauugauugccucuuu

SEQ ID NO: 121548 - RNA, 22 nt, Homo sapiens
uugcuagaugaaaaugguaccu

SEQ ID NO: 121549 - RNA, 22 nt, Homo sapiens
uugcuucauucaacauugaggg

SEQ ID NO: 121550 - RNA, 22 nt, Homo sapiens
uuggaaauauguuaagugucau

SEQ ID NO: 121551 - RNA, 22 nt, Homo sapiens
uuggacucccuccccagcuuca

SEQ ID NO: 121552 - RNA, 22 nt, Homo sapiens
uuggcauagaggcucucaagcu

SEQ ID NO: 121553 - RNA, 22 nt, Homo sapiens
aaacugcuuuccaugguggcug

SEQ ID NO: 121554 - RNA, 22 nt, Homo sapiens
aaagcacuggagucaucaucua

SEQ ID NO: 121555 - RNA, 22 nt, Homo sapiens
aaagcagcaggugguuuucaau

SEQ ID NO: 121556 - RNA, 18 nt, Homo sapiens
aaagugaugucauucuuu

SEQ ID NO: 121557 - RNA, 22 nt, Homo sapiens
aaagugauguccaggcuuucag

SEQ ID NO: 121558 - RNA, 22 nt, Homo sapiens
aaaugcauugagggaaaaggca

SEQ ID NO: 121559 - RNA, 22 nt, Homo sapiens
aaaugguguuaguagaucuuua

SEQ ID NO: 121560 - RNA, 22 nt, Homo sapiens
aaauugcacaaguggugauuug

SEQ ID NO: 121561 - RNA, 22 nt, Homo sapiens
aaauugcuuuugaagacuuagu

SEQ ID NO: 121562 - RNA, 22 nt, Homo sapiens
aaauuguccuacugguuugagu

SEQ ID NO: 121563 - RNA, 22 nt, Homo sapiens
aacagugcuguuauaaauguac

SEQ ID NO: 121564 - RNA, 22 nt, Homo sapiens
aacagugcuucauucacacauu

SEQ ID NO: 121565 - RNA, 22 nt, Homo sapiens
aacauguuuagcagauaccugu

SEQ ID NO: 121566 - RNA, 22 nt, Homo sapiens
aacugcacauauuuguaugggu

SEQ ID NO: 121567 - RNA, 22 nt, Homo sapiens
aagagguagcagucacaaaaga

SEQ ID NO: 121568 - RNA, 22 nt, Homo sapiens
aagcaguguggacuaaugggaa

SEQ ID NO: 121569 - RNA, 22 nt, Homo sapiens
aagcaucauuuggaauuugaga

SEQ ID NO: 121570 - RNA, 22 nt, Homo sapiens
aagcuggagugcaguggugcga

SEQ ID NO: 121571 - RNA, 22 nt, Homo sapiens
aaguggaauguuuguggcacaa

SEQ ID NO: 121572 - RNA, 22 nt, Homo sapiens
aaucacaguguucuugugaggg

SEQ ID NO: 121573 - RNA, 22 nt, Homo sapiens
aaugccaucagagaaaacucuu

SEQ ID NO: 121574 - RNA, 22 nt, Homo sapiens
aaugucaugaguccaaccagaa

SEQ ID NO: 121575 - RNA, 22 nt, Homo sapiens
aauuacauggcaauugggaaau

SEQ ID NO: 121576 - RNA, 22 nt, Homo sapiens
aauuaguuggcugccuaugauu

SEQ ID NO: 121577 - RNA, 22 nt, Homo sapiens
aauugcuucuguauuuuggaca

SEQ ID NO: 121578 - RNA, 22 nt, Homo sapiens
aauuguacucccaucauuccua

SEQ ID NO: 121579 - RNA, 22 nt, Homo sapiens
acaaaguauggaauguuggugu

SEQ ID NO: 121580 - RNA, 22 nt, Homo sapiens
acaagcacaaaugcauagaugg

SEQ ID NO: 121581 - RNA, 22 nt, Homo sapiens
acacuggaguuaaaggugauuu

SEQ ID NO: 121582 - RNA, 20 nt, Homo sapiens
acagcacugguuucaagcaa

SEQ ID NO: 121583 - RNA, 22 nt, Homo sapiens
acagcagugccccacucuacug

SEQ ID NO: 121584 - RNA, 22 nt, Homo sapiens
acagugcuuucaauguucagua

SEQ ID NO: 121585 - RNA, 22 nt, Homo sapiens
acaguguuccuuuguugugacu

SEQ ID NO: 121586 - RNA, 22 nt, Homo sapiens
acauugcucuuaccaaguuugu

SEQ ID NO: 121587 - RNA, 19 nt, Homo sapiens
accagauugcauucuugga

SEQ ID NO: 121588 - RNA, 22 nt, Homo sapiens
acuacauaugacaucuucuuua

SEQ ID NO: 121589 - RNA, 22 nt, Homo sapiens
acugcacuccaaccuguugggc

SEQ ID NO: 121590 - RNA, 22 nt, Homo sapiens
acugcacuccagccucggggac

SEQ ID NO: 121591 - RNA, 22 nt, Homo sapiens
acugcacuccagccucgugaca

SEQ ID NO: 121592 - RNA, 22 nt, Homo sapiens
acugcacuccagccugaugaaa

SEQ ID NO: 121593 - RNA, 22 nt, Homo sapiens
acugcacuccagccuuagugac

SEQ ID NO: 121594 - RNA, 22 nt, Homo sapiens
acugcacuccagccuucggaca

SEQ ID NO: 121595 - RNA, 22 nt, Homo sapiens
acugcacuccagccuucgugac

SEQ ID NO: 121596 - RNA, 22 nt, Homo sapiens
acugcacuccagccuugcgaca

SEQ ID NO: 121597 - RNA, 22 nt, Homo sapiens
acugcacuccagccuugugaca

SEQ ID NO: 121598 - RNA, 22 nt, Homo sapiens
acugcacuccagcuccagggug

SEQ ID NO: 121599 - RNA, 22 nt, Homo sapiens
acugcacuccaucuuagguggc

SEQ ID NO: 121600 - RNA, 22 nt, Homo sapiens
acugcacucccgcccgggugac

SEQ ID NO: 121601 - RNA, 22 nt, Homo sapiens
acugcacuucaaccucauugac

SEQ ID NO: 121602 - RNA, 22 nt, Homo sapiens
acuuugcuuagagggcauuaaa

SEQ ID NO: 121603 - RNA, 20 nt, Homo sapiens
agaagcauugcucucuucag

SEQ ID NO: 121604 - RNA, 22 nt, Homo sapiens
agaauguuuuagaccaauacaa

SEQ ID NO: 121605 - RNA, 22 nt, Homo sapiens
agacaucauuugauggugggag

SEQ ID NO: 121606 - RNA, 22 nt, Homo sapiens
agacuagagggaaaugaguugg

SEQ ID NO: 121607 - RNA, 22 nt, Homo sapiens
agacuuagagagucuauucuau

SEQ ID NO: 121608 - RNA, 22 nt, Homo sapiens
agagacauugcuccaacucacc

SEQ ID NO: 121609 - RNA, 22 nt, Homo sapiens
agagaugaagauggggcucccg

SEQ ID NO: 121610 - RNA, 22 nt, Homo sapiens
agagcacugcugcaggguucug

SEQ ID NO: 121611 - RNA, 22 nt, Homo sapiens
cucaaguagugguuuucauuga

SEQ ID NO: 121612 - RNA, 22 nt, Homo sapiens
cucaauuuggaauugucaguaa

SEQ ID NO: 121613 - RNA, 18 nt, Homo sapiens
cucacaguaacuuuuaag

SEQ ID NO: 121614 - RNA, 22 nt, Homo sapiens
cucacagucucucccuaauuuu

SEQ ID NO: 121615 - RNA, 21 nt, Homo sapiens
cucugguuugcauuggauuau

SEQ ID NO: 121616 - RNA, 22 nt, Homo sapiens
cucuuggguagauuuugcagag

SEQ ID NO: 121617 - RNA, 22 nt, Homo sapiens
cugacagaugacugccacugua

SEQ ID NO: 121618 - RNA, 22 nt, Homo sapiens
cugacuaguuuuaaugcagauu

SEQ ID NO: 121619 - RNA, 19 nt, Homo sapiens
cugcacugagaaaaggagg

SEQ ID NO: 121620 - RNA, 22 nt, Homo sapiens
cugccuagauguuguagggggu

SEQ ID NO: 121621 - RNA, 22 nt, Homo sapiens
cuggaaagaaucaggcuaaacu

SEQ ID NO: 121622 - RNA, 22 nt, Homo sapiens
cuggcagucugccucuucacug

SEQ ID NO: 121623 - RNA, 22 nt, Homo sapiens
cugucuagagggcacaugaugc

SEQ ID NO: 121624 - RNA, 22 nt, Homo sapiens
cugucuaugagccaggaagcca

SEQ ID NO: 121625 - RNA, 22 nt, Homo sapiens
cuguggauguauugcacagucu

SEQ ID NO: 121626 - RNA, 22 nt, Homo sapiens
cuguuugaggguuugcuuucag

SEQ ID NO: 121627 - RNA, 22 nt, Homo sapiens
cuuccugaguccugggcucaca

SEQ ID NO: 121628 - RNA, 20 nt, Homo sapiens
cuugaagacuaugcugcuga

SEQ ID NO: 121629 - RNA, 18 nt, Homo sapiens
cuugucaaaucuuuccuc

SEQ ID NO: 121630 - RNA, 22 nt, Homo sapiens
cuuucugaggagaauagagaac

SEQ ID NO: 121631 - RNA, 22 nt, Homo sapiens
cuuuggcauuagccuguauaga

SEQ ID NO: 121632 - RNA, 22 nt, Homo sapiens
gaaaauccauccccagggagua

SEQ ID NO: 121633 - RNA, 22 nt, Homo sapiens
gaaggcaugcugcauggccaga

SEQ ID NO: 121634 - RNA, 22 nt, Homo sapiens
gaauagugcugcaagaaacaua

SEQ ID NO: 121635 - RNA, 22 nt, Homo sapiens
gaaucauuggguugauucaaga

SEQ ID NO: 121636 - RNA, 22 nt, Homo sapiens
gaaucauuguuucuaaguuugu

SEQ ID NO: 121637 - RNA, 22 nt, Homo sapiens
gaauguuuacuuuguuuaauac

SEQ ID NO: 121638 - RNA, 22 nt, Homo sapiens
gacccucuagauggaagcacug

SEQ ID NO: 121639 - RNA, 22 nt, Homo sapiens
gagaugaaguuaaggaucuuua

SEQ ID NO: 121640 - RNA, 22 nt, Homo sapiens
gagaugucuauuucagagaugu

SEQ ID NO: 121641 - RNA, 22 nt, Homo sapiens
gagcaacaguggcagugguggg

SEQ ID NO: 121642 - RNA, 17 nt, Homo sapiens
gaucacagucgucuccu

SEQ ID NO: 121643 - RNA, 22 nt, Homo sapiens
gauuagaacagaagucagauua

SEQ ID NO: 121644 - RNA, 22 nt, Homo sapiens
gcaaaguaauuguuguuuuugc

SEQ ID NO: 121645 - RNA, 22 nt, Homo sapiens
gcaaaugcuacaccauuuugua

SEQ ID NO: 121646 - RNA, 22 nt, Homo sapiens
gcacagucaacacuuauucacc

SEQ ID NO: 121647 - RNA, 22 nt, Homo sapiens
gcaguguucaaaucaugcccau

SEQ ID NO: 121648 - RNA, 22 nt, Homo sapiens
gcaguguuggggccggaggcug

SEQ ID NO: 121649 - RNA, 22 nt, Homo sapiens
gcaguguugugauccaggucuu

SEQ ID NO: 121650 - RNA, 17 nt, Homo sapiens
gcauauguugaaccagc

SEQ ID NO: 121651 - RNA, 22 nt, Homo sapiens
gcaugaugaauaauaucacaag

SEQ ID NO: 121652 - RNA, 22 nt, Homo sapiens
gcauggaaggcgcuuugugacu

SEQ ID NO: 121653 - RNA, 22 nt, Homo sapiens
gccagugugaugugaucauggc

SEQ ID NO: 121654 - RNA, 21 nt, Homo sapiens
gccaguguggcaauuuuucaa

SEQ ID NO: 121655 - RNA, 22 nt, Homo sapiens
gccaguguguguuguucuccgc

SEQ ID NO: 121656 - RNA, 22 nt, Homo sapiens
gccuagagaaguaaauauuauc

SEQ ID NO: 121657 - RNA, 22 nt, Homo sapiens
gccuuuggugacaggcaugugu

SEQ ID NO: 121658 - RNA, 22 nt, Homo sapiens
gcuuuguuaaaacacagccaca

SEQ ID NO: 121659 - RNA, 22 nt, Homo sapiens
ggcaaauucuuguaugccuacu

SEQ ID NO: 121660 - RNA, 22 nt, Homo sapiens
ggcaaggugcuacagacaguga

SEQ ID NO: 121661 - RNA, 22 nt, Homo sapiens
ggcacuguggcucaagccugua

SEQ ID NO: 121662 - RNA, 18 nt, Homo sapiens
ggcggguguuuuauucac

SEQ ID NO: 121663 - RNA, 22 nt, Homo sapiens
ggcucaguuuccuccgucugcu

SEQ ID NO: 121664 - RNA, 22 nt, Homo sapiens
ggcuuggaggaaugugagggcu

SEQ ID NO: 121665 - RNA, 22 nt, Homo sapiens
gggaaaaugucuauugaaugaa

SEQ ID NO: 121666 - RNA, 22 nt, Homo sapiens
gggcauugugggcagagggcag

SEQ ID NO: 121667 - RNA, 22 nt, Homo sapiens
ggguaggcaagcggaugucaga

SEQ ID NO: 121668 - RNA, 19 nt, Homo sapiens
ggucagcaaagucuagcug

SEQ ID NO: 121669 - RNA, 22 nt, Homo sapiens
ggugacugguuuaucuggcagu

SEQ ID NO: 121670 - RNA, 21 nt, Homo sapiens
ggugagaaaggagacauagac

SEQ ID NO: 121671 - RNA, 22 nt, Homo sapiens
ggugcagcacaccaacauggca

SEQ ID NO: 121672 - RNA, 17 nt, Homo sapiens
guacacuucuucuguga

SEQ ID NO: 121673 - RNA, 22 nt, Homo sapiens
guagagagaaauacaaagcugu

SEQ ID NO: 121674 - RNA, 22 nt, Homo sapiens
guagugcaguuugagaaucagu

SEQ ID NO: 121675 - RNA, 22 nt, Homo sapiens
guauuguacuacaagcucuuua

SEQ ID NO: 121676 - RNA, 22 nt, Homo sapiens
gucagcaaagaggaauaguuug

SEQ ID NO: 121677 - RNA, 22 nt, Homo sapiens
gucccugugucuuuauguggcc

SEQ ID NO: 121678 - RNA, 22 nt, Homo sapiens
gucucacaggcaugaugccagc

SEQ ID NO: 121679 - RNA, 22 nt, Homo sapiens
gucuuuugcuagccagagagcu

SEQ ID NO: 121680 - RNA, 22 nt, Homo sapiens
gugaaauguguagaggaucugg

SEQ ID NO: 121681 - RNA, 22 nt, Homo sapiens
gugacuaagauucuuugauaug

SEQ ID NO: 121682 - RNA, 22 nt, Homo sapiens
gugagcuccucuucugcugcag

SEQ ID NO: 121683 - RNA, 22 nt, Homo sapiens
gugauguguuuguucuaucucu

SEQ ID NO: 121684 - RNA, 22 nt, Homo sapiens
gugccacaguguuaagggauuc

SEQ ID NO: 121685 - RNA, 22 nt, Homo sapiens
guggaaagaacacaaaauuagg

SEQ ID NO: 121686 - RNA, 22 nt, Homo sapiens
guggaagguaaugcagcuuacu

SEQ ID NO: 121687 - RNA, 22 nt, Homo sapiens
guggaaugauaucucauugugg

SEQ ID NO: 121688 - RNA, 17 nt, Homo sapiens
guggaaugucaugucaa

SEQ ID NO: 121689 - RNA, 22 nt, Homo sapiens
gugucacagcuuccaucucggu

SEQ ID NO: 121690 - RNA, 22 nt, Homo sapiens
gugucucagcccagaccuauuu

SEQ ID NO: 121691 - RNA, 22 nt, Homo sapiens
guuaagaaguguaacuuaaguu

SEQ ID NO: 121692 - RNA, 22 nt, Homo sapiens
guuaaugcuggaauaaguuaag

SEQ ID NO: 121693 - RNA, 22 nt, Homo sapiens
guucacaguuaggacaacugcu

SEQ ID NO: 121694 - RNA, 22 nt, Homo sapiens
guucagcaggggcuucaauggu

SEQ ID NO: 121695 - RNA, 22 nt, Homo sapiens
guucaucagggauauuggcuua

SEQ ID NO: 121696 - RNA, 22 nt, Homo sapiens
guugaucuauguugcuggcagu

SEQ ID NO: 121697 - RNA, 22 nt, Homo sapiens
guuuggcucuuguuucugucaa

SEQ ID NO: 121698 - RNA, 22 nt, Homo sapiens
uaaacugucuuuggagcuuugc

SEQ ID NO: 121699 - RNA, 22 nt, Homo sapiens
uaaaguuauugccccucaguua

SEQ ID NO: 121700 - RNA, 22 nt, Homo sapiens
auugcauaaacacauuucuuau

SEQ ID NO: 121701 - RNA, 22 nt, Homo sapiens
auugcuaacugaaauaagacca

SEQ ID NO: 121702 - RNA, 22 nt, Homo sapiens
auugcuauuauuugaccauugu

SEQ ID NO: 121703 - RNA, 22 nt, Homo sapiens
auugcugagacauugcuaaucu

SEQ ID NO: 121704 - RNA, 22 nt, Homo sapiens
auuggcuuuauacauaagaaua

SEQ ID NO: 121705 - RNA, 22 nt, Homo sapiens
auuguacuccagccugggcagc

SEQ ID NO: 121706 - RNA, 22 nt, Homo sapiens
auuguacuccagccugggcugc

SEQ ID NO: 121707 - RNA, 22 nt, Homo sapiens
auuguacuccagccugggugac

SEQ ID NO: 121708 - RNA, 22 nt, Homo sapiens
auuguacucuagccucugggca

SEQ ID NO: 121709 - RNA, 22 nt, Homo sapiens
auugucauuuauaacuguguag

SEQ ID NO: 121710 - RNA, 22 nt, Homo sapiens
caaagcacuuggcuuggaagau

SEQ ID NO: 121711 - RNA, 22 nt, Homo sapiens
caaauugcuugucuguagugga

SEQ ID NO: 121712 - RNA, 22 nt, Homo sapiens
caagagagcugaugguuuuaaa

SEQ ID NO: 121713 - RNA, 22 nt, Homo sapiens
caaguguuuccuuaaauacuug

SEQ ID NO: 121714 - RNA, 23 nt, Homo sapiens
caauacugaccucacguuaauag

SEQ ID NO: 121715 - RNA, 22 nt, Homo sapiens
caauacuguuaccugaaauagg

SEQ ID NO: 121716 - RNA, 22 nt, Homo sapiens
cacacugucuuucagaaugguu

SEQ ID NO: 121717 - RNA, 22 nt, Homo sapiens
cacauugcaggaaaguucauua

SEQ ID NO: 121718 - RNA, 18 nt, Homo sapiens
cacugagcccuucacucu

SEQ ID NO: 121719 - RNA, 22 nt, Homo sapiens
cacugcacuccagucuggcgac

SEQ ID NO: 121720 - RNA, 22 nt, Homo sapiens
cacugcacucuucuucugggca

SEQ ID NO: 121721 - RNA, 22 nt, Homo sapiens
cacugcauggucuagcuggguu

SEQ ID NO: 121722 - RNA, 22 nt, Homo sapiens
cacugcauuacucaugagcaug

SEQ ID NO: 121723 - RNA, 22 nt, Homo sapiens
cagcaaaucauccuauuugagc

SEQ ID NO: 121724 - RNA, 22 nt, Homo sapiens
cagugucugcauuuggaacuca

SEQ ID NO: 121725 - RNA, 22 nt, Homo sapiens
caucagauugagaucaucuaag

SEQ ID NO: 121726 - RNA, 22 nt, Homo sapiens
caucagcaauguaugaggguuc

SEQ ID NO: 121727 - RNA, 22 nt, Homo sapiens
cauggcaucuguguggccucca

SEQ ID NO: 121728 - RNA, 22 nt, Homo sapiens
ugcauggagcucucuuuggacu

SEQ ID NO: 121729 - RNA, 22 nt, Homo sapiens
ugcugcuguuaucauuuuacca

SEQ ID NO: 121730 - RNA, 22 nt, Homo sapiens
uggaaauuaacagggauugucc

SEQ ID NO: 121731 - RNA, 22 nt, Homo sapiens
uggacagaaacauguuuucagu

SEQ ID NO: 121732 - RNA, 22 nt, Homo sapiens
uggaggacugcagaacugaggc

SEQ ID NO: 121733 - RNA, 19 nt, Homo sapiens
uggcuagaggccaggcguu

SEQ ID NO: 121734 - RNA, 22 nt, Homo sapiens
uggcuguuuauuucacaugggu

SEQ ID NO: 121735 - RNA, 22 nt, Homo sapiens
uggcuguuuauuucaccugggu

SEQ ID NO: 121736 - RNA, 22 nt, Homo sapiens
uggcuuuuaucuacucucaacu

SEQ ID NO: 121737 - RNA, 22 nt, Homo sapiens
ugggaauaugauacaggucuuu

SEQ ID NO: 121738 - RNA, 22 nt, Homo sapiens
ugggaaugaaauuacauagcuu

SEQ ID NO: 121739 - RNA, 22 nt, Homo sapiens
ugggauguagccuucuauuuuc

SEQ ID NO: 121740 - RNA, 22 nt, Homo sapiens
uggguaggaccagaaaugcacu

SEQ ID NO: 121741 - RNA, 22 nt, Homo sapiens
ugguauuuaauauaugagaguu

SEQ ID NO: 121742 - RNA, 22 nt, Homo sapiens
uguagcaaaucgauacuauugg

SEQ ID NO: 121743 - RNA, 22 nt, Homo sapiens
ugucacaguuuguacuuuauag

SEQ ID NO: 121744 - RNA, 20 nt, Homo sapiens
ugucauuaagcacugugcca

SEQ ID NO: 121745 - RNA, 22 nt, Homo sapiens
ugucuuguagacaauguauagu

SEQ ID NO: 121746 - RNA, 19 nt, Homo sapiens
ugugaacaucacagagugu

SEQ ID NO: 121747 - RNA, 22 nt, Homo sapiens
uguggcaaagucuugugaauau

SEQ ID NO: 121748 - RNA, 22 nt, Homo sapiens
uguguauaucacugcaugagug

SEQ ID NO: 121749 - RNA, 22 nt, Homo sapiens
uguuauguauggagugauccca

SEQ ID NO: 121750 - RNA, 22 nt, Homo sapiens
uguuauugagguuacuuauaag

SEQ ID NO: 121751 - RNA, 22 nt, Homo sapiens
uguuggacuuacuuggcagauu

SEQ ID NO: 121752 - RNA, 22 nt, Homo sapiens
uuaagagcauggugccagguug

SEQ ID NO: 121753 - RNA, 22 nt, Homo sapiens
uuaauacucuucuaaguagucc

SEQ ID NO: 121754 - RNA, 22 nt, Homo sapiens
uuaaugcuuuugggauauuucu

SEQ ID NO: 121755 - RNA, 22 nt, Homo sapiens
uuagcagcucuggugacaaggu

SEQ ID NO: 121756 - RNA, 22 nt, Homo sapiens
uuaggcuuuucagacacuucau

SEQ ID NO: 121757 - RNA, 22 nt, Homo sapiens
uuagggaggagucccucuuuuu

SEQ ID NO: 121758 - RNA, 22 nt, Homo sapiens
uuauauguuucuguuuggaggc

SEQ ID NO: 121759 - RNA, 22 nt, Homo sapiens
uuauugcacuccagccugggua

SEQ ID NO: 121760 - RNA, 22 nt, Homo sapiens
uucacaguggugggagacguca

SEQ ID NO: 121761 - RNA, 21 nt, Homo sapiens
uucaccauggcuccacacucu

SEQ ID NO: 121762 - RNA, 22 nt, Homo sapiens
uucaggcuuuuauuuacugaua

SEQ ID NO: 121763 - RNA, 22 nt, Homo sapiens
uucaguggacuuaguagugcuu

SEQ ID NO: 121764 - RNA, 22 nt, Homo sapiens
uucaguggguggaugaauauga

SEQ ID NO: 121765 - RNA, 22 nt, Homo sapiens
uucauaguaacaguaacuaugg

SEQ ID NO: 121766 - RNA, 22 nt, Homo sapiens
uucaucaggaauauugaccugu

SEQ ID NO: 121767 - RNA, 20 nt, Homo sapiens
uucaucaggauauuggucua

SEQ ID NO: 121768 - RNA, 22 nt, Homo sapiens
uucaucagggguauuggccaau

SEQ ID NO: 121769 - RNA, 18 nt, Homo sapiens
uucaucaguccucagcug

SEQ ID NO: 121770 - RNA, 22 nt, Homo sapiens
uuccacaauggcugaacuaguu

SEQ ID NO: 121771 - RNA, 22 nt, Homo sapiens
uuccacagggauuugcauugau

SEQ ID NO: 121772 - RNA, 23 nt, Homo sapiens
uuccaccauugacuaguuacaua

SEQ ID NO: 121773 - RNA, 22 nt, Homo sapiens
uucccuguaucuucugccaugu

SEQ ID NO: 121774 - RNA, 22 nt, Homo sapiens
uucccugugguauagaagccgu

SEQ ID NO: 121775 - RNA, 21 nt, Homo sapiens
uucuacuccggcguuguuuuu

SEQ ID NO: 121776 - RNA, 22 nt, Homo sapiens
uucuggcuuuuaaagaaauguu

SEQ ID NO: 121777 - RNA, 22 nt, Homo sapiens
uugaaagaaaggagacugaguu

SEQ ID NO: 121778 - RNA, 22 nt, Homo sapiens
uugaaagacaucaccuacugcu

SEQ ID NO: 121779 - RNA, 22 nt, Homo sapiens
uugacagagaaaagugugacuu

SEQ ID NO: 121780 - RNA, 22 nt, Homo sapiens
aggugguuuugaugagcaggua

SEQ ID NO: 121781 - RNA, 23 nt, Homo sapiens
aguacuguaguaauugaggggaa

SEQ ID NO: 121782 - RNA, 22 nt, Homo sapiens
aguacugucagcaggguguuga

SEQ ID NO: 121783 - RNA, 17 nt, Homo sapiens
aguacugucccauccuu

SEQ ID NO: 121784 - RNA, 22 nt, Homo sapiens
agucacaugcauuuucuucaau

SEQ ID NO: 121785 - RNA, 22 nt, Homo sapiens
agucauggcagaaggcaccucu

SEQ ID NO: 121786 - RNA, 19 nt, Homo sapiens
agugucauggucauuauuu

SEQ ID NO: 121787 - RNA, 21 nt, Homo sapiens
aguucacauggcuccuguguu

SEQ ID NO: 121788 - RNA, 22 nt, Homo sapiens
auaagagcaggcuucuggccag

SEQ ID NO: 121789 - RNA, 22 nt, Homo sapiens
auaagugagugauucaguguua

SEQ ID NO: 121790 - RNA, 22 nt, Homo sapiens
auaggcacauuaggaacuuuug

SEQ ID NO: 121791 - RNA, 22 nt, Homo sapiens
auagguauuuuuaaaugacugu

SEQ ID NO: 121792 - RNA, 22 nt, Homo sapiens
auaucacaaacaagucuguacu

SEQ ID NO: 121793 - RNA, 22 nt, Homo sapiens
auauggcuaugugagcauacca

SEQ ID NO: 121794 - RNA, 22 nt, Homo sapiens
auaugucuauuauuagggcagg

SEQ ID NO: 121795 - RNA, 22 nt, Homo sapiens
aucaagccaaagaaaguccuug

SEQ ID NO: 121796 - RNA, 22 nt, Homo sapiens
aucacaauuguacguaggagcc

SEQ ID NO: 121797 - RNA, 22 nt, Homo sapiens
aucacagaacuuugagcagaga

SEQ ID NO: 121798 - RNA, 22 nt, Homo sapiens
aucacaguuauaacauccuuuu

SEQ ID NO: 121799 - RNA, 22 nt, Homo sapiens
aucacaguuuuaccauuuggua

SEQ ID NO: 121800 - RNA, 22 nt, Homo sapiens
auccacagugucaauguuguga

SEQ ID NO: 121801 - RNA, 22 nt, Homo sapiens
aucuagagaggcagucuggccg

SEQ ID NO: 121802 - RNA, 22 nt, Homo sapiens
aucugcauucccauguuuauug

SEQ ID NO: 121803 - RNA, 22 nt, Homo sapiens
aucuggcuccuuuugacaaugc

SEQ ID NO: 121804 - RNA, 22 nt, Homo sapiens
aucuggcuucuuuuaguccaca

SEQ ID NO: 121805 - RNA, 23 nt, Homo sapiens
augacacuguccuugaccauuuc

SEQ ID NO: 121806 - RNA, 22 nt, Homo sapiens
augacguugugggcucucaagc

SEQ ID NO: 121807 - RNA, 22 nt, Homo sapiens
augacuagaggagggauggcca

SEQ ID NO: 121808 - RNA, 22 nt, Homo sapiens
augagagcuaacuguggguaca

SEQ ID NO: 121809 - RNA, 22 nt, Homo sapiens
augcacuguuuucuugaugaga

SEQ ID NO: 121810 - RNA, 22 nt, Homo sapiens
augcuggugguucacaugcgca

SEQ ID NO: 121811 - RNA, 22 nt, Homo sapiens
auggaaagcuguuccuacacaa

SEQ ID NO: 121812 - RNA, 22 nt, Homo sapiens
auggacucauugaauuaagucc

SEQ ID NO: 121813 - RNA, 22 nt, Homo sapiens
auggcggugugaucuuggcuca

SEQ ID NO: 121814 - RNA, 22 nt, Homo sapiens
auggcuagaaccuguauauuca

SEQ ID NO: 121815 - RNA, 22 nt, Homo sapiens
auggcuuuguguucagagcuga

SEQ ID NO: 121816 - RNA, 22 nt, Homo sapiens
auggcuuuuccugucuugcaug

SEQ ID NO: 121817 - RNA, 22 nt, Homo sapiens
augguacucucuugucugcaaa

SEQ ID NO: 121818 - RNA, 22 nt, Homo sapiens
augucuagagcaagagaugcug

SEQ ID NO: 121819 - RNA, 22 nt, Homo sapiens
auguguauuaccucgauuguga

SEQ ID NO: 121820 - RNA, 22 nt, Homo sapiens
auuaagagcacauguucugggu

SEQ ID NO: 121821 - RNA, 22 nt, Homo sapiens
auuagaugguuauaggugugag

SEQ ID NO: 121822 - RNA, 22 nt, Homo sapiens
auuauauguguaugugcauacc

SEQ ID NO: 121823 - RNA, 22 nt, Homo sapiens
auucagaggggcagcugucuug

SEQ ID NO: 121824 - RNA, 18 nt, Homo sapiens
auucuacaggccuuuuga

SEQ ID NO: 121825 - RNA, 23 nt, Homo sapiens
auugaacacuuucauaugugagg

SEQ ID NO: 121826 - RNA, 18 nt, Homo sapiens
auugcacaccagccuggg

SEQ ID NO: 121827 - RNA, 22 nt, Homo sapiens
auugcacuccagccugagcaaa

SEQ ID NO: 121828 - RNA, 22 nt, Homo sapiens
auugcucaaaucaguacuugag

SEQ ID NO: 121829 - RNA, 22 nt, Homo sapiens
auugcuuacccuguauuagauc

SEQ ID NO: 121830 - RNA, 22 nt, Homo sapiens
auugcuuuuacugggagcuuug

SEQ ID NO: 121831 - RNA, 22 nt, Homo sapiens
auuggacagcauuucuagacuu

SEQ ID NO: 121832 - RNA, 22 nt, Homo sapiens
auuguacuccagccugggcaag

SEQ ID NO: 121833 - RNA, 22 nt, Homo sapiens
auuguacuccagccugggcuaa

SEQ ID NO: 121834 - RNA, 22 nt, Homo sapiens
auuguacuccagccuguggagc

SEQ ID NO: 121835 - RNA, 22 nt, Homo sapiens
auuguaguuugcuauggcaaua

SEQ ID NO: 121836 - RNA, 21 nt, Homo sapiens
auuguauguaaaccaaaugag

SEQ ID NO: 121837 - RNA, 22 nt, Homo sapiens
auugucacuuaaaagugcaugu

SEQ ID NO: 121838 - RNA, 22 nt, Homo sapiens
auugugcuaaaguaauaaguca

SEQ ID NO: 121839 - RNA, 22 nt, Homo sapiens
caagacuguccaacauauuggg

SEQ ID NO: 121840 - RNA, 22 nt, Homo sapiens
caaguguuggcuuguauacaaa

SEQ ID NO: 121841 - RNA, 22 nt, Homo sapiens
caauacuguguugaauaagagu

SEQ ID NO: 121842 - RNA, 19 nt, Homo sapiens
caauacuucuuggcauaca

SEQ ID NO: 121843 - RNA, 22 nt, Homo sapiens
cacaguugccuaucuccugaag

SEQ ID NO: 121844 - RNA, 21 nt, Homo sapiens
cacauggaggcagagagugua

SEQ ID NO: 121845 - RNA, 22 nt, Homo sapiens
caccacauuccauugaucaggc

SEQ ID NO: 121846 - RNA, 22 nt, Homo sapiens
cacugcacuccagccuaagagg

SEQ ID NO: 121847 - RNA, 22 nt, Homo sapiens
cacugcacuccagcuugugggc

SEQ ID NO: 121848 - RNA, 22 nt, Homo sapiens
cagagguaagcaagucagcauu

SEQ ID NO: 121849 - RNA, 22 nt, Homo sapiens
cagugcuuguuauuguucuauu

SEQ ID NO: 121850 - RNA, 22 nt, Homo sapiens
cauaugguuuuauguucuucau

SEQ ID NO: 121851 - RNA, 22 nt, Homo sapiens
caucacuguugguacaaguaau

SEQ ID NO: 121852 - RNA, 22 nt, Homo sapiens
caugauauugcagaauguuggu

SEQ ID NO: 121853 - RNA, 22 nt, Homo sapiens
cauuaagcuacuuagaaggugc

SEQ ID NO: 121854 - RNA, 20 nt, Homo sapiens
cauuacacuccaaccugggu

SEQ ID NO: 121855 - RNA, 23 nt, Homo sapiens
ccacaaugguugaacuagauuac

SEQ ID NO: 121856 - RNA, 19 nt, Homo sapiens
acagugcuuugucagaagc

SEQ ID NO: 121857 - RNA, 23 nt, Homo sapiens
acaguggugugaucuuggcucag

SEQ ID NO: 121858 - RNA, 22 nt, Homo sapiens
acaguguuacuugauaguguau

SEQ ID NO: 121859 - RNA, 19 nt, Homo sapiens
acauugcauuuguaggcuu

SEQ ID NO: 121860 - RNA, 22 nt, Homo sapiens
accaccauugcacugaacuuuc

SEQ ID NO: 121861 - RNA, 22 nt, Homo sapiens
acccucagaccaguuucccugg

SEQ ID NO: 121862 - RNA, 22 nt, Homo sapiens
accuuguaucuguuaggauugc

SEQ ID NO: 121863 - RNA, 21 nt, Homo sapiens
acugcacuccaaccucaacag

SEQ ID NO: 121864 - RNA, 22 nt, Homo sapiens
acugcacuccagacucugucuc

SEQ ID NO: 121865 - RNA, 22 nt, Homo sapiens
acugcacuccagcccaggugac

SEQ ID NO: 121866 - RNA, 22 nt, Homo sapiens
acugcacuccagccucaugaca

SEQ ID NO: 121867 - RNA, 22 nt, Homo sapiens
acugcacuccagccuccugaca

SEQ ID NO: 121868 - RNA, 22 nt, Homo sapiens
acugcacuccagccugcuggau

SEQ ID NO: 121869 - RNA, 22 nt, Homo sapiens
acugcacuccagccugcuggca

SEQ ID NO: 121870 - RNA, 22 nt, Homo sapiens
acugcacuccagccugcugggu

SEQ ID NO: 121871 - RNA, 22 nt, Homo sapiens
acugcacuccagccuggaccac

SEQ ID NO: 121872 - RNA, 22 nt, Homo sapiens
acugcacuccagccuggcggac

SEQ ID NO: 121873 - RNA, 22 nt, Homo sapiens
acugcacuccagccugugagac

SEQ ID NO: 121874 - RNA, 22 nt, Homo sapiens
acugcacuccagccuguugaca

SEQ ID NO: 121875 - RNA, 22 nt, Homo sapiens
acugcacuccagccuugagagc

SEQ ID NO: 121876 - RNA, 22 nt, Homo sapiens
acugcacuccagccuuggcaac

SEQ ID NO: 121877 - RNA, 22 nt, Homo sapiens
acugcacuccagccuuggcggc

SEQ ID NO: 121878 - RNA, 22 nt, Homo sapiens
acugcacuccagcuugggugac

SEQ ID NO: 121879 - RNA, 20 nt, Homo sapiens
acugcacuccaggcugccca

SEQ ID NO: 121880 - RNA, 22 nt, Homo sapiens
agagguauacauuugagagcca

SEQ ID NO: 121881 - RNA, 22 nt, Homo sapiens
agcagcaauuuuguaugguuua

SEQ ID NO: 121882 - RNA, 22 nt, Homo sapiens
agcuggcuguggagaaaccccu

SEQ ID NO: 121883 - RNA, 22 nt, Homo sapiens
agggaauguaaguuuuaugaga

SEQ ID NO: 121884 - RNA, 21 nt, Homo sapiens
aggugucuuggguucccuggc

SEQ ID NO: 121885 - RNA, 22 nt, Homo sapiens
aguaccacgugaugccauuuuc

SEQ ID NO: 121886 - RNA, 22 nt, Homo sapiens
agucaagaaucucagcaucuuu

SEQ ID NO: 121887 - RNA, 22 nt, Homo sapiens
agucagugucuguaaggagaac

SEQ ID NO: 121888 - RNA, 22 nt, Homo sapiens
agugcacugcccgcuuccuguc

SEQ ID NO: 121889 - RNA, 22 nt, Homo sapiens
aguggaaucuguuauacuaacu

SEQ ID NO: 121890 - RNA, 22 nt, Homo sapiens
aguggaguguaaagcgucuuuu

SEQ ID NO: 121891 - RNA, 22 nt, Homo sapiens
auaacagcauuauugcauacgu

SEQ ID NO: 121892 - RNA, 22 nt, Homo sapiens
auaacauggaguuugucauuua

SEQ ID NO: 121893 - RNA, 22 nt, Homo sapiens
auaagauaguggaagugggauu

SEQ ID NO: 121894 - RNA, 22 nt, Homo sapiens
auaaguauuuggacuuuacugu

SEQ ID NO: 121895 - RNA, 20 nt, Homo sapiens
auaccacagacuggguaguu

SEQ ID NO: 121896 - RNA, 16 nt, Homo sapiens
auaccacagugacaca

SEQ ID NO: 121897 - RNA, 22 nt, Homo sapiens
auagcagugugaaaauugacug

SEQ ID NO: 121898 - RNA, 21 nt, Homo sapiens
auagugcuagagaguagcagg

SEQ ID NO: 121899 - RNA, 22 nt, Homo sapiens
auagugcugcaacaaauauacg

SEQ ID NO: 121900 - RNA, 22 nt, Homo sapiens
auaugucuguuuagucuguaau

SEQ ID NO: 121901 - RNA, 22 nt, Homo sapiens
auauugacuuucucuuagauca

SEQ ID NO: 121902 - RNA, 22 nt, Homo sapiens
auauuguacugcuacugguucu

SEQ ID NO: 121903 - RNA, 22 nt, Homo sapiens
aucacagagucacgggcaacuu

SEQ ID NO: 121904 - RNA, 22 nt, Homo sapiens
aucacauggccagguaguaauc

SEQ ID NO: 121905 - RNA, 22 nt, Homo sapiens
aucacuuugcucuccagugugg

SEQ ID NO: 121906 - RNA, 22 nt, Homo sapiens
aucccuguaguaauauucuagc

SEQ ID NO: 121907 - RNA, 22 nt, Homo sapiens
aucccuguguccagcaccugug

SEQ ID NO: 121908 - RNA, 22 nt, Homo sapiens
augaaguuagcucauuucuuuu

SEQ ID NO: 121909 - RNA, 22 nt, Homo sapiens
augacugucagggcagucauug

SEQ ID NO: 121910 - RNA, 22 nt, Homo sapiens
augagaacauaucaagugauug

SEQ ID NO: 121911 - RNA, 22 nt, Homo sapiens
augagacaguucccuuuaucuu

SEQ ID NO: 121912 - RNA, 22 nt, Homo sapiens
augaggagguaugauuuucuga

SEQ ID NO: 121913 - RNA, 22 nt, Homo sapiens
augaggugggagaaucacuuga

SEQ ID NO: 121914 - RNA, 22 nt, Homo sapiens
augaguugaagcuacaagaggc

SEQ ID NO: 121915 - RNA, 22 nt, Homo sapiens
augauacuguucuaagauuuuu

SEQ ID NO: 121916 - RNA, 22 nt, Homo sapiens
augauggagguagauuguccau

SEQ ID NO: 121917 - RNA, 22 nt, Homo sapiens
augcacuguuguuauuggauaa

SEQ ID NO: 121918 - RNA, 20 nt, Homo sapiens
augccacugagcagugguga

SEQ ID NO: 121919 - RNA, 22 nt, Homo sapiens
auggcaauguaagucagaaaaa

SEQ ID NO: 121920 - RNA, 22 nt, Homo sapiens
auggcuagauuguaugguaguu

SEQ ID NO: 121921 - RNA, 22 nt, Homo sapiens
auggugugugaauuaaauguua

SEQ ID NO: 121922 - RNA, 20 nt, Homo sapiens
augucaggaagggagucagg

SEQ ID NO: 121923 - RNA, 22 nt, Homo sapiens
augucuagagugauacugaagc

SEQ ID NO: 121924 - RNA, 22 nt, Homo sapiens
augugcagauguuacaaauugu

SEQ ID NO: 121925 - RNA, 22 nt, Homo sapiens
auucacagcuuuaaaaggcgug

SEQ ID NO: 121926 - RNA, 22 nt, Homo sapiens
auuccacagccgauaccaugac

SEQ ID NO: 121927 - RNA, 16 nt, Homo sapiens
auugacaguggguguu

SEQ ID NO: 121928 - RNA, 22 nt, Homo sapiens
auugacaguuggccaguaagug

SEQ ID NO: 121929 - RNA, 22 nt, Homo sapiens
auugcacacagaaucaggguaa

SEQ ID NO: 121930 - RNA, 22 nt, Homo sapiens
auugcacaccagucugggcaaa

SEQ ID NO: 121931 - RNA, 22 nt, Homo sapiens
auugcacuccagccuugggcaa

SEQ ID NO: 121932 - RNA, 22 nt, Homo sapiens
auugcacuccagccuugugaca

SEQ ID NO: 121933 - RNA, 22 nt, Homo sapiens
auugcacucugaucugcacucc

SEQ ID NO: 121934 - RNA, 19 nt, Homo sapiens
auugcaguguaaaacuauu

SEQ ID NO: 121935 - RNA, 22 nt, Homo sapiens
auugcuucugauuuuaaaugag

SEQ ID NO: 121936 - RNA, 22 nt, Homo sapiens
auuguacauacaccggugugua

SEQ ID NO: 121937 - RNA, 22 nt, Homo sapiens
auuguacuccagccuaggcaac

SEQ ID NO: 121938 - RNA, 22 nt, Homo sapiens
auuguacuccagccugggcgac

SEQ ID NO: 121939 - RNA, 22 nt, Homo sapiens
auuuggcaacguagggaggcau

SEQ ID NO: 121940 - RNA, 22 nt, Homo sapiens
auuuggcaauuuugaagaugcc

SEQ ID NO: 121941 - RNA, 22 nt, Homo sapiens
caaaggugcuuuccagguccaa

SEQ ID NO: 121942 - RNA, 22 nt, Homo sapiens
caaaugacaucauuucauucaa

SEQ ID NO: 121943 - RNA, 22 nt, Homo sapiens
caagagaccugagugucauucu

SEQ ID NO: 121944 - RNA, 22 nt, Homo sapiens
caaggugcugagacaggagccc

SEQ ID NO: 121945 - RNA, 21 nt, Homo sapiens
caagugaugcuucugcuuuaa

SEQ ID NO: 121946 - RNA, 22 nt, Homo sapiens
cacagucugggcuuguuuguac

SEQ ID NO: 121947 - RNA, 22 nt, Homo sapiens
cacauugaauuucugaugacaa

SEQ ID NO: 121948 - RNA, 16 nt, Homo sapiens
cacauugcugcauggc

SEQ ID NO: 121949 - RNA, 22 nt, Homo sapiens
caccauguguucagaaggauug

SEQ ID NO: 121950 - RNA, 22 nt, Homo sapiens
cacugcacuccaguuucgguaa

SEQ ID NO: 121951 - RNA, 22 nt, Homo sapiens
cagagguauugcaaaagccuag

SEQ ID NO: 121952 - RNA, 22 nt, Homo sapiens
cagccggguggcuccuagggua

SEQ ID NO: 121953 - RNA, 22 nt, Homo sapiens
cagugguuuucucaguucagca

SEQ ID NO: 121954 - RNA, 22 nt, Homo sapiens
caugacacauguuuaccuaugu

SEQ ID NO: 121955 - RNA, 22 nt, Homo sapiens
cauugcauuuucuuuguaccuu

SEQ ID NO: 121956 - RNA, 22 nt, Homo sapiens
cauugcuuuuggugguuuagac

SEQ ID NO: 121957 - RNA, 22 nt, Homo sapiens
cauugguuccaguuuguccuua

SEQ ID NO: 121958 - RNA, 22 nt, Homo sapiens
cauugguugaacagauuguguu

SEQ ID NO: 121959 - RNA, 22 nt, Homo sapiens
ccaagccucaguuucccucugu

SEQ ID NO: 121960 - RNA, 23 nt, Homo sapiens
ccaguauuuauguaaggaagugu

SEQ ID NO: 121961 - RNA, 22 nt, Homo sapiens
ccaguguucuggaaggcugagu

SEQ ID NO: 121962 - RNA, 19 nt, Homo sapiens
ccaguguugccagagcuga

SEQ ID NO: 121963 - RNA, 22 nt, Homo sapiens
cccagugugcugggugacagcu

SEQ ID NO: 121964 - RNA, 22 nt, Homo sapiens
ccccauuguugugguuuuaucu

SEQ ID NO: 121965 - RNA, 17 nt, Homo sapiens
cccuaguagcugggacu

SEQ ID NO: 121966 - RNA, 21 nt, Homo sapiens
ccugaguacaacccacuccac

SEQ ID NO: 121967 - RNA, 22 nt, Homo sapiens
cuaagcaccuuaguggggaauc

SEQ ID NO: 121968 - RNA, 22 nt, Homo sapiens
cuaagggaggaagcugugcagg

SEQ ID NO: 121969 - RNA, 22 nt, Homo sapiens
uggaguaggccuaagaaugaca

SEQ ID NO: 121970 - RNA, 22 nt, Homo sapiens
uggauggagaggcuugugaugc

SEQ ID NO: 121971 - RNA, 22 nt, Homo sapiens
uggcagauaggauacaggacua

SEQ ID NO: 121972 - RNA, 22 nt, Homo sapiens
uggcaguuuacaaaugccauga

SEQ ID NO: 121973 - RNA, 22 nt, Homo sapiens
uggcuguuuauuucaccugggc

SEQ ID NO: 121974 - RNA, 22 nt, Homo sapiens
uggcuguuuauuucacgugggu

SEQ ID NO: 121975 - RNA, 22 nt, Homo sapiens
uggcuuuuauuauguugaggua

SEQ ID NO: 121976 - RNA, 22 nt, Homo sapiens
uggcuuuucauccugggacauu

SEQ ID NO: 121977 - RNA, 22 nt, Homo sapiens
ugggcggagacgugcagccgcc

SEQ ID NO: 121978 - RNA, 22 nt, Homo sapiens
ugguucaguugcacaggcuguu

SEQ ID NO: 121979 - RNA, 22 nt, Homo sapiens
uguaaacucaguauguuuuacu

SEQ ID NO: 121980 - RNA, 19 nt, Homo sapiens
ugucaaaugucuccugggg

SEQ ID NO: 121981 - RNA, 22 nt, Homo sapiens
ugucaaauucuggguuaaaaca

SEQ ID NO: 121982 - RNA, 22 nt, Homo sapiens
ugucagggaggcucggccgcac

SEQ ID NO: 121983 - RNA, 22 nt, Homo sapiens
ugucuguuugcgaaauugcuuc

SEQ ID NO: 121984 - RNA, 18 nt, Homo sapiens
ugugacauugagcauguc

SEQ ID NO: 121985 - RNA, 22 nt, Homo sapiens
ugugucuuuuaucacacaaugu

SEQ ID NO: 121986 - RNA, 22 nt, Homo sapiens
uguuauguuuuagagguuucaa

SEQ ID NO: 121987 - RNA, 22 nt, Homo sapiens
uuaaaugcauagaauguguagu

SEQ ID NO: 121988 - RNA, 22 nt, Homo sapiens
uuaagcaguggauuagaauuuu

SEQ ID NO: 121989 - RNA, 22 nt, Homo sapiens
uuaaucaggccguuuccuaaga

SEQ ID NO: 121990 - RNA, 22 nt, Homo sapiens
uuaauguaauugauugauugac

SEQ ID NO: 121991 - RNA, 22 nt, Homo sapiens
uuacaucaucacauuaguuugc

SEQ ID NO: 121992 - RNA, 22 nt, Homo sapiens
uuagagcacugaucugcucuuu

SEQ ID NO: 121993 - RNA, 22 nt, Homo sapiens
uuagcagcaucccuggccugua

SEQ ID NO: 121994 - RNA, 22 nt, Homo sapiens
uuagccccuuugagccucaacu

SEQ ID NO: 121995 - RNA, 22 nt, Homo sapiens
uuagggaguaaucuaaaaaugg

SEQ ID NO: 121996 - RNA, 22 nt, Homo sapiens
uuauauguuacucccucuagca

SEQ ID NO: 121997 - RNA, 22 nt, Homo sapiens
uuaucacauugacugauuugca

SEQ ID NO: 121998 - RNA, 22 nt, Homo sapiens
uuauugcuuaugauuagguguu

SEQ ID NO: 121999 - RNA, 22 nt, Homo sapiens
uucacacuagccacucugguag

SEQ ID NO: 122000 - RNA, 22 nt, Homo sapiens
uucagagugguaugaagugaug

SEQ ID NO: 122001 - RNA, 22 nt, Homo sapiens
uucagugguuauuugugagauu

SEQ ID NO: 122002 - RNA, 21 nt, Homo sapiens
uucaucagccagaaaucaagc

SEQ ID NO: 122003 - RNA, 23 nt, Homo sapiens
uucaucagggauauuggccugaa

SEQ ID NO: 122004 - RNA, 22 nt, Homo sapiens
uucaucaguugagcugguugcu

SEQ ID NO: 122005 - RNA, 22 nt, Homo sapiens
uuccacaaugguugaacuaauu

SEQ ID NO: 122006 - RNA, 22 nt, Homo sapiens
uuccacaaugguugaacuagcu

SEQ ID NO: 122007 - RNA, 22 nt, Homo sapiens
uuccacaaugguugaacuaguu

SEQ ID NO: 122008 - RNA, 22 nt, Homo sapiens
uucccugugggaguaggaaagu

SEQ ID NO: 122009 - RNA, 22 nt, Homo sapiens
uucccugugggcuggugcucca

SEQ ID NO: 122010 - RNA, 22 nt, Homo sapiens
uucccuuucugaaaaucucauu

SEQ ID NO: 122011 - RNA, 22 nt, Homo sapiens
uucuacuccucauggcagguug

SEQ ID NO: 122012 - RNA, 22 nt, Homo sapiens
uucuggcuaugggauacuaaau

SEQ ID NO: 122013 - RNA, 22 nt, Homo sapiens
uucuggcuuauaaacgugacuu

SEQ ID NO: 122014 - RNA, 22 nt, Homo sapiens
uugaaggaggugcucacucucg

SEQ ID NO: 122015 - RNA, 22 nt, Homo sapiens
uugaaugaaaugaugucauuug

SEQ ID NO: 122016 - RNA, 20 nt, Homo sapiens
uugacagagggaaaguugcu

SEQ ID NO: 122017 - RNA, 22 nt, Homo sapiens
uugagauacauaauuaugaaug

SEQ ID NO: 122018 - RNA, 22 nt, Homo sapiens
uugagauguauguauauaaugu

SEQ ID NO: 122019 - RNA, 22 nt, Homo sapiens
uugaucacuguacuaugacuau

SEQ ID NO: 122020 - RNA, 22 nt, Homo sapiens
uugcacauguugaaccagcaaa

SEQ ID NO: 122021 - RNA, 22 nt, Homo sapiens
uugcacuccagccuggaugaca

SEQ ID NO: 122022 - RNA, 22 nt, Homo sapiens
uugcacuccagccuuggggaga

SEQ ID NO: 122023 - RNA, 18 nt, Homo sapiens
uugcaucauuuuguuguu

SEQ ID NO: 122024 - RNA, 22 nt, Homo sapiens
uugcuucuuucgucuggcccca

SEQ ID NO: 122025 - RNA, 22 nt, Homo sapiens
uuggaaagagguguuuaugacu

SEQ ID NO: 122026 - RNA, 22 nt, Homo sapiens
uugggauggaacuuuucaguga

SEQ ID NO: 122027 - RNA, 22 nt, Homo sapiens
uugggcaauaggaagcaggugg

SEQ ID NO: 122028 - RNA, 23 nt, Homo sapiens
uuggucucccaaaguguugagau

SEQ ID NO: 122029 - RNA, 22 nt, Homo sapiens
uuguauguugaaugaugguaua

SEQ ID NO: 122030 - RNA, 22 nt, Homo sapiens
uugucuagugaauacauuaaug

SEQ ID NO: 122031 - RNA, 22 nt, Homo sapiens
uuguuauguuggucaguaaugu

SEQ ID NO: 122032 - RNA, 22 nt, Homo sapiens
uuugaauguaaugagcaggaag

SEQ ID NO: 122033 - RNA, 22 nt, Homo sapiens
uuugacucacagccuggcugcc

SEQ ID NO: 122034 - RNA, 22 nt, Homo sapiens
uuuggacuucuagccuccagag

SEQ ID NO: 122035 - RNA, 22 nt, Homo sapiens
uuuggcagaaaacuaaaaggua

SEQ ID NO: 122036 - RNA, 22 nt, Homo sapiens
uuuggcaguuauuuacucagug

SEQ ID NO: 122037 - RNA, 22 nt, Homo sapiens
uuuggcuuuuguaauaacugcc

SEQ ID NO: 122038 - RNA, 22 nt, Homo sapiens
uuuguacacuguugguaggauu

SEQ ID NO: 122039 - RNA, 22 nt, Homo sapiens
uuuuguacaacagcucugggga

SEQ ID NO: 122040 - RNA, 22 nt, Homo sapiens
uuuuugagaauuggugaaacac

SEQ ID NO: 122041 - RNA, 22 nt, Homo sapiens
aagaggcuguaggauaaugccu

SEQ ID NO: 122042 - RNA, 22 nt, Homo sapiens
aagagguaauaacaaagcuucu

SEQ ID NO: 122043 - RNA, 22 nt, Homo sapiens
aagagguagucugucccuuagc

SEQ ID NO: 122044 - RNA, 23 nt, Homo sapiens
aagagguaugacuaugaagugga

SEQ ID NO: 122045 - RNA, 22 nt, Homo sapiens
aagcacaauuucaccuucuugu

SEQ ID NO: 122046 - RNA, 21 nt, Homo sapiens
aagcacauugaguguguguga

SEQ ID NO: 122047 - RNA, 22 nt, Homo sapiens
aagcuggagugcaguggugcaa

SEQ ID NO: 122048 - RNA, 22 nt, Homo sapiens
aaucuguagaaggugcacauuc

SEQ ID NO: 122049 - RNA, 22 nt, Homo sapiens
acacauuggcaauucuggagca

SEQ ID NO: 122050 - RNA, 23 nt, Homo sapiens
acacuugcugaguaaaucaaaua

SEQ ID NO: 122051 - RNA, 22 nt, Homo sapiens
acagaacugggcuugcuuuugg

SEQ ID NO: 122052 - RNA, 18 nt, Homo sapiens
acagugcuggcaugagau

SEQ ID NO: 122053 - RNA, 22 nt, Homo sapiens
acagugcuucugauaugaugcc

SEQ ID NO: 122054 - RNA, 22 nt, Homo sapiens
acagugcuuuuguuccucuccu

SEQ ID NO: 122055 - RNA, 22 nt, Homo sapiens
acauggcuuaugaauuuggaga

SEQ ID NO: 122056 - RNA, 22 nt, Homo sapiens
accaccacucccgcauucuaaa

SEQ ID NO: 122057 - RNA, 23 nt, Homo sapiens
accugauguuucuguggggagcc

SEQ ID NO: 122058 - RNA, 19 nt, Homo sapiens
acugcacuccaaccuccug

SEQ ID NO: 122059 - RNA, 22 nt, Homo sapiens
acugcacuccaaccuuggugac

SEQ ID NO: 122060 - RNA, 20 nt, Homo sapiens
acugcacuccaaccuuugug

SEQ ID NO: 122061 - RNA, 22 nt, Homo sapiens
acugcacuccacccuuggcagc

SEQ ID NO: 122062 - RNA, 18 nt, Homo sapiens
acugcacuccaccuuggg

SEQ ID NO: 122063 - RNA, 22 nt, Homo sapiens
acugcacuccagccuaggcgac

SEQ ID NO: 122064 - RNA, 22 nt, Homo sapiens
acugcacuccagccuccugggu

SEQ ID NO: 122065 - RNA, 22 nt, Homo sapiens
acugcacuccagccucgcaaca

SEQ ID NO: 122066 - RNA, 22 nt, Homo sapiens
acugcacuccagccucggcaau

SEQ ID NO: 122067 - RNA, 22 nt, Homo sapiens
acugcacuccagccucggugac

SEQ ID NO: 122068 - RNA, 22 nt, Homo sapiens
acugcacuccagccugagccug

SEQ ID NO: 122069 - RNA, 22 nt, Homo sapiens
acugcacuccagccugcccaac

SEQ ID NO: 122070 - RNA, 22 nt, Homo sapiens
acugcacuccagccugccgaca

SEQ ID NO: 122071 - RNA, 22 nt, Homo sapiens
acugcacuccagccugcugaca

SEQ ID NO: 122072 - RNA, 22 nt, Homo sapiens
acugcacuccagccuucaggac

SEQ ID NO: 122073 - RNA, 22 nt, Homo sapiens
acugcacuccagccuugauggc

SEQ ID NO: 122074 - RNA, 22 nt, Homo sapiens
acugcacuccagccuuggccac

SEQ ID NO: 122075 - RNA, 22 nt, Homo sapiens
acugcacuccagccuuugcgau

SEQ ID NO: 122076 - RNA, 22 nt, Homo sapiens
acugcacuccagcuuuggugac

SEQ ID NO: 122077 - RNA, 22 nt, Homo sapiens
acugcacuccaguuugggcagc

SEQ ID NO: 122078 - RNA, 22 nt, Homo sapiens
acugcacuccggccucgugaca

SEQ ID NO: 122079 - RNA, 22 nt, Homo sapiens
acugcacugcagccuggccaac

SEQ ID NO: 122080 - RNA, 20 nt, Homo sapiens
acugcacuucagccugcugg

SEQ ID NO: 122081 - RNA, 22 nt, Homo sapiens
acugcacuucagccuguugaca

SEQ ID NO: 122082 - RNA, 22 nt, Homo sapiens
acugcacuucagccuugggaaa

SEQ ID NO: 122083 - RNA, 22 nt, Homo sapiens
acugcacuucagccuuggggac

SEQ ID NO: 122084 - RNA, 22 nt, Homo sapiens
acuuugguuaucauacuuucag

SEQ ID NO: 122085 - RNA, 22 nt, Homo sapiens
acuuugguuuauagaauuuagg

SEQ ID NO: 122086 - RNA, 22 nt, Homo sapiens
agaaagugcuucccuuugguga

SEQ ID NO: 122087 - RNA, 22 nt, Homo sapiens
agaaaugcagcaugaggcggca

SEQ ID NO: 122088 - RNA, 22 nt, Homo sapiens
agaauguaaacagaauagagga

SEQ ID NO: 122089 - RNA, 19 nt, Homo sapiens
agagacucauuguagcauu

SEQ ID NO: 122090 - RNA, 22 nt, Homo sapiens
agagcaaugacaugcuaugugg

SEQ ID NO: 122091 - RNA, 20 nt, Homo sapiens
agagugcuggacugaggagc

SEQ ID NO: 122092 - RNA, 22 nt, Homo sapiens
agagugcuuuauuagauguagc

SEQ ID NO: 122093 - RNA, 22 nt, Homo sapiens
agcaaaucuaugaauguauauu

SEQ ID NO: 122094 - RNA, 22 nt, Homo sapiens
agcagagcauauucauucgggg

SEQ ID NO: 122095 - RNA, 22 nt, Homo sapiens
agcucacagccuagcacuguga

SEQ ID NO: 122096 - RNA, 22 nt, Homo sapiens
agcuguguugucugaagucaga

SEQ ID NO: 122097 - RNA, 22 nt, Homo sapiens
agcuucauuccaacuuccuucu

SEQ ID NO: 122098 - RNA, 22 nt, Homo sapiens
agcuuguguuugucugccuggg

SEQ ID NO: 122099 - RNA, 22 nt, Homo sapiens
aggagcacuggccuuggaguca

SEQ ID NO: 122100 - RNA, 23 nt, Homo sapiens
aggagcuuagaaguugccauugc

SEQ ID NO: 122101 - RNA, 22 nt, Homo sapiens
agggagcaaaguggucuuucuc

SEQ ID NO: 122102 - RNA, 22 nt, Homo sapiens
agggcuuuugagcugagauggu

SEQ ID NO: 122103 - RNA, 22 nt, Homo sapiens
aggugcugacaggauagguuuc

SEQ ID NO: 122104 - RNA, 22 nt, Homo sapiens
aguaagauggcaacucuccaca

SEQ ID NO: 122105 - RNA, 22 nt, Homo sapiens
aguacugucugguuaccugaca

SEQ ID NO: 122106 - RNA, 22 nt, Homo sapiens
agucaaaugcuuauguauaaag

SEQ ID NO: 122107 - RNA, 22 nt, Homo sapiens
aguccaguguuaugaucaguag

SEQ ID NO: 122108 - RNA, 22 nt, Homo sapiens
agugcauuugcaucucaauaua

SEQ ID NO: 122109 - RNA, 22 nt, Homo sapiens
auauguauuuuaacguguaagg

SEQ ID NO: 122110 - RNA, 21 nt, Homo sapiens
auaugugcuguggaagucagc

SEQ ID NO: 122111 - RNA, 22 nt, Homo sapiens
auauuacagagaggaccuggga

SEQ ID NO: 122112 - RNA, 22 nt, Homo sapiens
aucacuguccacucaucuuucu

SEQ ID NO: 122113 - RNA, 23 nt, Homo sapiens
aucagauaguuguagguaugugg

SEQ ID NO: 122114 - RNA, 22 nt, Homo sapiens
aucaucacaguuguguguaaug

SEQ ID NO: 122115 - RNA, 23 nt, Homo sapiens
auccacauucuaguccuuuaugc

SEQ ID NO: 122116 - RNA, 22 nt, Homo sapiens
aucccuguaacuagcagccccu

SEQ ID NO: 122117 - RNA, 22 nt, Homo sapiens
aucccugugacgagcaucccua

SEQ ID NO: 122118 - RNA, 22 nt, Homo sapiens
auccuguaggcuaguagacagu

SEQ ID NO: 122119 - RNA, 22 nt, Homo sapiens
aucucauggagguagagaguaa

SEQ ID NO: 122120 - RNA, 22 nt, Homo sapiens
augaacagagccuugagaaccu

SEQ ID NO: 122121 - RNA, 22 nt, Homo sapiens
augaagagaaaguggaucuugg

SEQ ID NO: 122122 - RNA, 22 nt, Homo sapiens
augaauuuucugauguugggua

SEQ ID NO: 122123 - RNA, 22 nt, Homo sapiens
augacacugcagagauguccca

SEQ ID NO: 122124 - RNA, 22 nt, Homo sapiens
augauacuggcuucauagaaug

SEQ ID NO: 122125 - RNA, 22 nt, Homo sapiens
augcacaguccagcccaugugg

SEQ ID NO: 122126 - RNA, 22 nt, Homo sapiens
augccacugcacuccaaccugg

SEQ ID NO: 122127 - RNA, 22 nt, Homo sapiens
auggaggaggaagcugaaacaa

SEQ ID NO: 122128 - RNA, 22 nt, Homo sapiens
augggcacugauguauucugug

SEQ ID NO: 122129 - RNA, 22 nt, Homo sapiens
uuggcuuuuaugcagcuuaggu

SEQ ID NO: 122130 - RNA, 23 nt, Homo sapiens
uugggcaaaucacuaacgucucc

SEQ ID NO: 122131 - RNA, 23 nt, Homo sapiens
uugggcaaaucacugagggcaga

SEQ ID NO: 122132 - RNA, 22 nt, Homo sapiens
uuguacaggaguguaagcuuca

SEQ ID NO: 122133 - RNA, 22 nt, Homo sapiens
uuguagaucuucaguugcuaca

SEQ ID NO: 122134 - RNA, 22 nt, Homo sapiens
uugucucacuggaguuuaguaa

SEQ ID NO: 122135 - RNA, 22 nt, Homo sapiens
uuguuauguaucucaagauaaa

SEQ ID NO: 122136 - RNA, 22 nt, Homo sapiens
uuuaaagcuaaaauauguuuau

SEQ ID NO: 122137 - RNA, 22 nt, Homo sapiens
uuuagcaauucauuuugugucu

SEQ ID NO: 122138 - RNA, 22 nt, Homo sapiens
uuuauucggcuaggagcuucgg

SEQ ID NO: 122139 - RNA, 22 nt, Homo sapiens
uuucaacuaauuuuuuggugag

SEQ ID NO: 122140 - RNA, 22 nt, Homo sapiens
uuucacaguguucucccccaga

SEQ ID NO: 122141 - RNA, 22 nt, Homo sapiens
uuucauccggcuguguauuaug

SEQ ID NO: 122142 - RNA, 22 nt, Homo sapiens
uuucauggaauauagucauuuu

SEQ ID NO: 122143 - RNA, 22 nt, Homo sapiens
uuucauggaggauuugcuucuu

SEQ ID NO: 122144 - RNA, 22 nt, Homo sapiens
uuugagcaugcagauugccagg

SEQ ID NO: 122145 - RNA, 22 nt, Homo sapiens
uuugcugagucugacuucaugg

SEQ ID NO: 122146 - RNA, 22 nt, Homo sapiens
uuuggcagaugacccucaaguu

SEQ ID NO: 122147 - RNA, 22 nt, Homo sapiens
uuuugcaguuacagagagugag

SEQ ID NO: 122148 - RNA, 22 nt, Homo sapiens
uuuuugaguaaauauaaauugu

SEQ ID NO: 122149 - RNA, 22 nt, Homo sapiens
uuuuugaguagcuggagagcag

SEQ ID NO: 122150 - RNA, 22 nt, Homo sapiens
ggaaaucaucauucucgguaua

SEQ ID NO: 122151 - RNA, 19 nt, Homo sapiens
ggaaaugucuauuaagauc

SEQ ID NO: 122152 - RNA, 22 nt, Homo sapiens
ggacaucauuaccauggaccca

SEQ ID NO: 122153 - RNA, 22 nt, Homo sapiens
ggauaacagccaggucaaacaa

SEQ ID NO: 122154 - RNA, 22 nt, Homo sapiens
ggcaagaacuucacucacuuuu

SEQ ID NO: 122155 - RNA, 22 nt, Homo sapiens
gggaauggaagacauuaugaug

SEQ ID NO: 122156 - RNA, 22 nt, Homo sapiens
ggggaauguuaaagaauuugca

SEQ ID NO: 122157 - RNA, 22 nt, Homo sapiens
guauugccacuuuugaacaguu

SEQ ID NO: 122158 - RNA, 22 nt, Homo sapiens
gucauggguuaaagguggauac

SEQ ID NO: 122159 - RNA, 22 nt, Homo sapiens
gucauugcuuaucugcugacgu

SEQ ID NO: 122160 - RNA, 22 nt, Homo sapiens
gucuggagacuugggucaucaa

SEQ ID NO: 122161 - RNA, 22 nt, Homo sapiens
gucuggcuccugucuaaucacu

SEQ ID NO: 122162 - RNA, 22 nt, Homo sapiens
gucuggcuuaucucacuuacca

SEQ ID NO: 122163 - RNA, 22 nt, Homo sapiens
gucugugguuccuaugucaccu

SEQ ID NO: 122164 - RNA, 22 nt, Homo sapiens
gugaaguuuuuugcugagaguc

SEQ ID NO: 122165 - RNA, 22 nt, Homo sapiens
gugacuggacucugaagaaaau

SEQ ID NO: 122166 - RNA, 22 nt, Homo sapiens
gugacugggaguggugaagaua

SEQ ID NO: 122167 - RNA, 22 nt, Homo sapiens
gugauguguuucaacagcuccu

SEQ ID NO: 122168 - RNA, 22 nt, Homo sapiens
gugauuuaguagaugcuaguua

SEQ ID NO: 122169 - RNA, 22 nt, Homo sapiens
gugcacuguagaacccuuuguu

SEQ ID NO: 122170 - RNA, 21 nt, Homo sapiens
guggaaauggaauuuacuaau

SEQ ID NO: 122171 - RNA, 21 nt, Homo sapiens
gugugcuugaauucagcuguc

SEQ ID NO: 122172 - RNA, 22 nt, Homo sapiens
uaaacugucuugcaguuacaug

SEQ ID NO: 122173 - RNA, 22 nt, Homo sapiens
uaaagcacuuuuuucugcaugg

SEQ ID NO: 122174 - RNA, 21 nt, Homo sapiens
uaaaggcuccaauuauacccc

SEQ ID NO: 122175 - RNA, 22 nt, Homo sapiens
uaacaguggucugugguaucug

SEQ ID NO: 122176 - RNA, 18 nt, Homo sapiens
uaacugugggaacuaacu

SEQ ID NO: 122177 - RNA, 19 nt, Homo sapiens
uaagaugaagcugucuggg

SEQ ID NO: 122178 - RNA, 22 nt, Homo sapiens
uaagguguagacuggucacaag

SEQ ID NO: 122179 - RNA, 22 nt, Homo sapiens
uaaguaauuuguauuuuaccca

SEQ ID NO: 122180 - RNA, 22 nt, Homo sapiens
uaaucacagagguuuggccuca

SEQ ID NO: 122181 - RNA, 22 nt, Homo sapiens
uacaguaggauuuucagggucu

SEQ ID NO: 122182 - RNA, 22 nt, Homo sapiens
uacugcacuccagccuugccaa

SEQ ID NO: 122183 - RNA, 20 nt, Homo sapiens
uacugcacuccauccugggu

SEQ ID NO: 122184 - RNA, 22 nt, Homo sapiens
uacugcacucuagccuggguga

SEQ ID NO: 122185 - RNA, 22 nt, Homo sapiens
uacugcacuugaccuccugggc

SEQ ID NO: 122186 - RNA, 19 nt, Homo sapiens
uacuggcucgggaauuuuc

SEQ ID NO: 122187 - RNA, 22 nt, Homo sapiens
uagacccauuguucagagagug

SEQ ID NO: 122188 - RNA, 22 nt, Homo sapiens
uagagguagagugacuucccca

SEQ ID NO: 122189 - RNA, 22 nt, Homo sapiens
uagagguagguguaugaacuag

SEQ ID NO: 122190 - RNA, 22 nt, Homo sapiens
uagagguauaccaaaaaggcau

SEQ ID NO: 122191 - RNA, 22 nt, Homo sapiens
uagagguauguauaguauucuu

SEQ ID NO: 122192 - RNA, 22 nt, Homo sapiens
uagcacugucuugcaccugugc

SEQ ID NO: 122193 - RNA, 22 nt, Homo sapiens
uagcugcuguauguacacggau

SEQ ID NO: 122194 - RNA, 22 nt, Homo sapiens
uagguaaguaauauacagauga

SEQ ID NO: 122195 - RNA, 22 nt, Homo sapiens
uaguacuggcauguauuuccca

SEQ ID NO: 122196 - RNA, 18 nt, Homo sapiens
uaguacuguucucaugau

SEQ ID NO: 122197 - RNA, 22 nt, Homo sapiens
uaguagcauaccuaaguauacu

SEQ ID NO: 122198 - RNA, 22 nt, Homo sapiens
uauauguucuugcacuggaaag

SEQ ID NO: 122199 - RNA, 22 nt, Homo sapiens
uaucacagcgggguguacaccc

SEQ ID NO: 122200 - RNA, 22 nt, Homo sapiens
uaucacaguagaacucuuucca

SEQ ID NO: 122201 - RNA, 22 nt, Homo sapiens
uaucauaguuuggacuuucauu

SEQ ID NO: 122202 - RNA, 22 nt, Homo sapiens
uaugauuuuugggagaggucaa

SEQ ID NO: 122203 - RNA, 22 nt, Homo sapiens
uauggcuaugggaacugggagu

SEQ ID NO: 122204 - RNA, 19 nt, Homo sapiens
uauguaguuuucucaauau

SEQ ID NO: 122205 - RNA, 22 nt, Homo sapiens
uauuacugucaauaucacagaa

SEQ ID NO: 122206 - RNA, 22 nt, Homo sapiens
uauugcuaacaucccuuaugua

SEQ ID NO: 122207 - RNA, 22 nt, Homo sapiens
uauugcuuaugaugcugaauua

SEQ ID NO: 122208 - RNA, 18 nt, Homo sapiens
uauugcuugguuuggaga

SEQ ID NO: 122209 - RNA, 22 nt, Homo sapiens
uauugcuuuuaacccaaucucu

SEQ ID NO: 122210 - RNA, 22 nt, Homo sapiens
ucaaagacacacaaggagaagg

SEQ ID NO: 122211 - RNA, 22 nt, Homo sapiens
ucaaaguaaagccucaggaugg

SEQ ID NO: 122212 - RNA, 22 nt, Homo sapiens
ucaaagugagcuccuucucacu

SEQ ID NO: 122213 - RNA, 22 nt, Homo sapiens
ucaaaucaucuuuuccaaagcu

SEQ ID NO: 122214 - RNA, 22 nt, Homo sapiens
ucaaaugcacguagagaaaaua

SEQ ID NO: 122215 - RNA, 20 nt, Homo sapiens
ucaaggcaggaacuguacau

SEQ ID NO: 122216 - RNA, 22 nt, Homo sapiens
ucacaguagagcuucuuucaga

SEQ ID NO: 122217 - RNA, 22 nt, Homo sapiens
ucacagucaaaguaaucauaga

SEQ ID NO: 122218 - RNA, 23 nt, Homo sapiens
ucacaguuacuuuugcaucaacc

SEQ ID NO: 122219 - RNA, 22 nt, Homo sapiens
ucacaguuggccuggccuuuua

SEQ ID NO: 122220 - RNA, 22 nt, Homo sapiens
ucacauggggaagggacuagcu

SEQ ID NO: 122221 - RNA, 22 nt, Homo sapiens
ucacuuugacggccaacuucua

SEQ ID NO: 122222 - RNA, 22 nt, Homo sapiens
ucagaucauauucuucgcugcu

SEQ ID NO: 122223 - RNA, 22 nt, Homo sapiens
ucagugauugcuuucauggaaa

SEQ ID NO: 122224 - RNA, 22 nt, Homo sapiens
ucaguguuuuauccuccagagc

SEQ ID NO: 122225 - RNA, 22 nt, Homo sapiens
ucaguuaaugcugccugcugga

SEQ ID NO: 122226 - RNA, 22 nt, Homo sapiens
ucaguuuguauuucagguugca

SEQ ID NO: 122227 - RNA, 22 nt, Homo sapiens
ucauugcuuauuuguuggugga

SEQ ID NO: 122228 - RNA, 22 nt, Homo sapiens
uccaguguuauaauaugcgucu

SEQ ID NO: 122229 - RNA, 22 nt, Homo sapiens
ucuccggguggcggcgaaggga

SEQ ID NO: 122230 - RNA, 22 nt, Homo sapiens
ucucuuggcggaaguugcagug

SEQ ID NO: 122231 - RNA, 22 nt, Homo sapiens
ucuggcaagagccgagggcagu

SEQ ID NO: 122232 - RNA, 22 nt, Homo sapiens
ucuguaguuaacagcuucagcu

SEQ ID NO: 122233 - RNA, 22 nt, Homo sapiens
ucugugaaugaacacuugaaaa

SEQ ID NO: 122234 - RNA, 23 nt, Homo sapiens
ucuuguacuuugagugagcaugg

SEQ ID NO: 122235 - RNA, 22 nt, Homo sapiens
ugaaacugcagugggcuuggca

SEQ ID NO: 122236 - RNA, 22 nt, Homo sapiens
gcugaguaguauuucauuguau

SEQ ID NO: 122237 - RNA, 22 nt, Homo sapiens
gcugguguagagugcagaaagg

SEQ ID NO: 122238 - RNA, 22 nt, Homo sapiens
gcugucaugagcaacacaugaa

SEQ ID NO: 122239 - RNA, 22 nt, Homo sapiens
ggaagccugcacucgggcaggg

SEQ ID NO: 122240 - RNA, 22 nt, Homo sapiens
ggaaugagaaauauuacacaau

SEQ ID NO: 122241 - RNA, 22 nt, Homo sapiens
ggaguaggcuguccggcaccca

SEQ ID NO: 122242 - RNA, 22 nt, Homo sapiens
ggcaagaaccagggauuugcgu

SEQ ID NO: 122243 - RNA, 23 nt, Homo sapiens
ggcacggaauucaaagaggcauu

SEQ ID NO: 122244 - RNA, 22 nt, Homo sapiens
ggcaguguauuacuuaggguuc

SEQ ID NO: 122245 - RNA, 22 nt, Homo sapiens
ggccagaugaucuaugaaggaa

SEQ ID NO: 122246 - RNA, 22 nt, Homo sapiens
ggcuauagauaugugaacacuu

SEQ ID NO: 122247 - RNA, 22 nt, Homo sapiens
ggcuguguguuaaaauaggcuu

SEQ ID NO: 122248 - RNA, 22 nt, Homo sapiens
gggcaagaagucuuguaguuuu

SEQ ID NO: 122249 - RNA, 22 nt, Homo sapiens
guacaguuuagugcuuugagaa

SEQ ID NO: 122250 - RNA, 22 nt, Homo sapiens
guaccacaguugcucacggguu

SEQ ID NO: 122251 - RNA, 22 nt, Homo sapiens
gucaucaggacgggucaucugc

SEQ ID NO: 122252 - RNA, 22 nt, Homo sapiens
gucucacagcuagcugcuuuau

SEQ ID NO: 122253 - RNA, 22 nt, Homo sapiens
gucuggcuccuucuacuacaug

SEQ ID NO: 122254 - RNA, 22 nt, Homo sapiens
gucuuuaguugaaacauguggu

SEQ ID NO: 122255 - RNA, 22 nt, Homo sapiens
gugaagaucccuguccuguucc

SEQ ID NO: 122256 - RNA, 22 nt, Homo sapiens
gugaagugugaccucagcaucu

SEQ ID NO: 122257 - RNA, 22 nt, Homo sapiens
gugacagucaaagacaugacuu

SEQ ID NO: 122258 - RNA, 22 nt, Homo sapiens
gugagacugaguuucgcucuug

SEQ ID NO: 122259 - RNA, 22 nt, Homo sapiens
gugagcauaacaacagaguuua

SEQ ID NO: 122260 - RNA, 22 nt, Homo sapiens
gugagcauaggaggcuucuguu

SEQ ID NO: 122261 - RNA, 19 nt, Homo sapiens
gugcauaguuauuaaagag

SEQ ID NO: 122262 - RNA, 22 nt, Homo sapiens
gugcgggaggcgcgccuaggug

SEQ ID NO: 122263 - RNA, 22 nt, Homo sapiens
guggaagaccagacuuuccaac

SEQ ID NO: 122264 - RNA, 22 nt, Homo sapiens
guggacggagguugcagugagc

SEQ ID NO: 122265 - RNA, 22 nt, Homo sapiens
guggcuagaaugaagguagcug

SEQ ID NO: 122266 - RNA, 22 nt, Homo sapiens
gugggauggagagaagguauga

SEQ ID NO: 122267 - RNA, 22 nt, Homo sapiens
guuauuguccauuuauuuagca

SEQ ID NO: 122268 - RNA, 22 nt, Homo sapiens
guucuggagauaaagccaaggu

SEQ ID NO: 122269 - RNA, 23 nt, Homo sapiens
uaacauguuuuuaagggaagcuu

SEQ ID NO: 122270 - RNA, 23 nt, Homo sapiens
uaacauugcaugauuaccugcau

SEQ ID NO: 122271 - RNA, 22 nt, Homo sapiens
uaacauuguugauuauacuaag

SEQ ID NO: 122272 - RNA, 22 nt, Homo sapiens
uaacuguggaaaugacuuuaaa

SEQ ID NO: 122273 - RNA, 22 nt, Homo sapiens
uaagagagcuccaucuuuuccu

SEQ ID NO: 122274 - RNA, 22 nt, Homo sapiens
uaaguagugugcauguauguau

SEQ ID NO: 122275 - RNA, 22 nt, Homo sapiens
uacauugcacuuuauuagauac

SEQ ID NO: 122276 - RNA, 23 nt, Homo sapiens
uaccacauuccuucuuuccuguu

SEQ ID NO: 122277 - RNA, 22 nt, Homo sapiens
uacugcacuccaaccugagaga

SEQ ID NO: 122278 - RNA, 22 nt, Homo sapiens
uacugcacuccagccuggguga

SEQ ID NO: 122279 - RNA, 22 nt, Homo sapiens
uacugcacuccagcuuaggaga

SEQ ID NO: 122280 - RNA, 22 nt, Homo sapiens
uacugcacuccaggcucaccug

SEQ ID NO: 122281 - RNA, 18 nt, Homo sapiens
uacugcacucuccagccu

SEQ ID NO: 122282 - RNA, 22 nt, Homo sapiens
uacugcacuggaggccucagau

SEQ ID NO: 122283 - RNA, 20 nt, Homo sapiens
uacugcacuuuccucauggu

SEQ ID NO: 122284 - RNA, 22 nt, Homo sapiens
uagagcacaagguagauuucua

SEQ ID NO: 122285 - RNA, 22 nt, Homo sapiens
uagagguauuaacaguagaaga

SEQ ID NO: 122286 - RNA, 22 nt, Homo sapiens
uagcagcaccccacucuacugg

SEQ ID NO: 122287 - RNA, 22 nt, Homo sapiens
uagcagccaggaagggcuggcu

SEQ ID NO: 122288 - RNA, 22 nt, Homo sapiens
uagcugcugcuaggcuaaggau

SEQ ID NO: 122289 - RNA, 22 nt, Homo sapiens
uaggucuccuuuuugccuaaau

SEQ ID NO: 122290 - RNA, 22 nt, Homo sapiens
uauagcuaugggauguauuugc

SEQ ID NO: 122291 - RNA, 22 nt, Homo sapiens
uaucacagguggacugcacacc

SEQ ID NO: 122292 - RNA, 22 nt, Homo sapiens
uaucaccauguccguuuuaaaa

SEQ ID NO: 122293 - RNA, 22 nt, Homo sapiens
uauuacauccauaggcucugcu

SEQ ID NO: 122294 - RNA, 22 nt, Homo sapiens
uauuacuguuauuccuaucaaa

SEQ ID NO: 122295 - RNA, 22 nt, Homo sapiens
uauugcacgccagccugagcaa

SEQ ID NO: 122296 - RNA, 22 nt, Homo sapiens
uauugcacuccagccuuggcaa

SEQ ID NO: 122297 - RNA, 22 nt, Homo sapiens
uauugcugaugcugaagggaag

SEQ ID NO: 122298 - RNA, 22 nt, Homo sapiens
uauuguacauguuauagauuuu

SEQ ID NO: 122299 - RNA, 22 nt, Homo sapiens
uauuugcacucccaucauggug

SEQ ID NO: 122300 - RNA, 22 nt, Homo sapiens
ucaaacugcuugaggccauuua

SEQ ID NO: 122301 - RNA, 22 nt, Homo sapiens
ucaacauugcugucaggcaucu

SEQ ID NO: 122302 - RNA, 22 nt, Homo sapiens
ucaaggcacauuugacauuuuc

SEQ ID NO: 122303 - RNA, 22 nt, Homo sapiens
ucacagauaaauaaagaugauu

SEQ ID NO: 122304 - RNA, 22 nt, Homo sapiens
ucacaguucagcauggcugagg

SEQ ID NO: 122305 - RNA, 22 nt, Homo sapiens
ucacauggaggugauaguugaa

SEQ ID NO: 122306 - RNA, 18 nt, Homo sapiens
ucacauggccgagagaga

SEQ ID NO: 122307 - RNA, 22 nt, Homo sapiens
ucacauuguauauguaccuauc

SEQ ID NO: 122308 - RNA, 22 nt, Homo sapiens
ucaccuggagacaugaagacug

SEQ ID NO: 122309 - RNA, 22 nt, Homo sapiens
ucacgugguucauaaggcagaa

SEQ ID NO: 122310 - RNA, 22 nt, Homo sapiens
ucacugcacuccagccuuuaug

SEQ ID NO: 122311 - RNA, 22 nt, Homo sapiens
ucacugugagaguuuauccugu

SEQ ID NO: 122312 - RNA, 22 nt, Homo sapiens
ucacugugguuggaaggcuuaa

SEQ ID NO: 122313 - RNA, 22 nt, Homo sapiens
ucacuguugaugggcaugcagg

SEQ ID NO: 122314 - RNA, 22 nt, Homo sapiens
ucacuuggccgcagccuucucu

SEQ ID NO: 122315 - RNA, 22 nt, Homo sapiens
ucagagugcagggaguagcagc

SEQ ID NO: 122316 - RNA, 19 nt, Homo sapiens
ucagaucagcccaagggau

SEQ ID NO: 122317 - RNA, 20 nt, Homo sapiens
ucagcagucuggagcagagg

SEQ ID NO: 122318 - RNA, 22 nt, Homo sapiens
ucaggcaugcagcaaugcagug

SEQ ID NO: 122319 - RNA, 22 nt, Homo sapiens
ucaggcuuuucccagagugaug

SEQ ID NO: 122320 - RNA, 22 nt, Homo sapiens
ucaguagcauugcuuauacagu

SEQ ID NO: 122321 - RNA, 22 nt, Homo sapiens
ucauaguagucacuuaauaaau

SEQ ID NO: 122322 - RNA, 22 nt, Homo sapiens
ucauaugucauaguaugaucuu

SEQ ID NO: 122323 - RNA, 21 nt, Homo sapiens
ucaucaagcuguagacaugau

SEQ ID NO: 122324 - RNA, 22 nt, Homo sapiens
cugagcacugagauccucuagc

SEQ ID NO: 122325 - RNA, 22 nt, Homo sapiens
cugagcuagaccacuuggcucc

SEQ ID NO: 122326 - RNA, 22 nt, Homo sapiens
cugagcuaugccuggaaaggca

SEQ ID NO: 122327 - RNA, 22 nt, Homo sapiens
cugauaguucucuuuagaguuu

SEQ ID NO: 122328 - RNA, 18 nt, Homo sapiens
cugccagugugcucuccg

SEQ ID NO: 122329 - RNA, 22 nt, Homo sapiens
cugccuagaucugaaccuggcu

SEQ ID NO: 122330 - RNA, 22 nt, Homo sapiens
cugcuaagagaaugagacuuag

SEQ ID NO: 122331 - RNA, 22 nt, Homo sapiens
cuggaaaguagacaaucuaaaa

SEQ ID NO: 122332 - RNA, 22 nt, Homo sapiens
cuggcaaauguuuucuguaaag

SEQ ID NO: 122333 - RNA, 22 nt, Homo sapiens
cuggcaagagugaaccagcugu

SEQ ID NO: 122334 - RNA, 22 nt, Homo sapiens
cugugaucuuuuuucauguggu

SEQ ID NO: 122335 - RNA, 22 nt, Homo sapiens
cugugcauucuuaaaucaggaa

SEQ ID NO: 122336 - RNA, 22 nt, Homo sapiens
cuuagguuaugauaaauuuagu

SEQ ID NO: 122337 - RNA, 22 nt, Homo sapiens
cuucacuggagucccuggauuc

SEQ ID NO: 122338 - RNA, 22 nt, Homo sapiens
cuuccaaguggggcacgugcca

SEQ ID NO: 122339 - RNA, 22 nt, Homo sapiens
cuucugauugaaaauggaguag

SEQ ID NO: 122340 - RNA, 20 nt, Homo sapiens
cuuuguccuccugcugugcu

SEQ ID NO: 122341 - RNA, 22 nt, Homo sapiens
gaaauguugauagugggcauug

SEQ ID NO: 122342 - RNA, 18 nt, Homo sapiens
gaagaaguaggcauggca

SEQ ID NO: 122343 - RNA, 22 nt, Homo sapiens
gacaucauuaugagauuuaaac

SEQ ID NO: 122344 - RNA, 22 nt, Homo sapiens
gaccacauuccacacaggcuuu

SEQ ID NO: 122345 - RNA, 22 nt, Homo sapiens
gacccucuagagggaagcgcuu

SEQ ID NO: 122346 - RNA, 22 nt, Homo sapiens
gacuacaacuucuauuauucag

SEQ ID NO: 122347 - RNA, 22 nt, Homo sapiens
gacugaguaagcagaagcaauu

SEQ ID NO: 122348 - RNA, 20 nt, Homo sapiens
gacuucagaagcuucagagu

SEQ ID NO: 122349 - RNA, 20 nt, Homo sapiens
gacuugagagugggagagua

SEQ ID NO: 122350 - RNA, 18 nt, Homo sapiens
gacuuggaguuuacagug

SEQ ID NO: 122351 - RNA, 22 nt, Homo sapiens
gagaacauuuaagccacucagg

SEQ ID NO: 122352 - RNA, 22 nt, Homo sapiens
gagaaguaaauuuauuugcaaa

SEQ ID NO: 122353 - RNA, 22 nt, Homo sapiens
gagagguaguuuuuuggucguc

SEQ ID NO: 122354 - RNA, 22 nt, Homo sapiens
gagccuguaggaggagaggugg

SEQ ID NO: 122355 - RNA, 22 nt, Homo sapiens
gaggagauauucugcuggaugg

SEQ ID NO: 122356 - RNA, 22 nt, Homo sapiens
gaggcauugaagauauggaagu

SEQ ID NO: 122357 - RNA, 22 nt, Homo sapiens
gauuccacuuacuuagcauucc

SEQ ID NO: 122358 - RNA, 22 nt, Homo sapiens
gcaagagguaucuuauuuuccc

SEQ ID NO: 122359 - RNA, 20 nt, Homo sapiens
gcauaugucuuuauggcagc

SEQ ID NO: 122360 - RNA, 22 nt, Homo sapiens
gcauauguuuggguguguauau

SEQ ID NO: 122361 - RNA, 22 nt, Homo sapiens
gcauggagcauacauuucuguu

SEQ ID NO: 122362 - RNA, 22 nt, Homo sapiens
gccaguguuuuauugagaauuu

SEQ ID NO: 122363 - RNA, 22 nt, Homo sapiens
gcucaaguaauggcaguuuugc

SEQ ID NO: 122364 - RNA, 22 nt, Homo sapiens
gcuccauuuuccauuucucuaa

SEQ ID NO: 122365 - RNA, 22 nt, Homo sapiens
gcugcuguuuaguuucuccugg

SEQ ID NO: 122366 - RNA, 22 nt, Homo sapiens
ggaaaucucugaggcucccuuc

SEQ ID NO: 122367 - RNA, 22 nt, Homo sapiens
ggacuagggacauggggagcug

SEQ ID NO: 122368 - RNA, 22 nt, Homo sapiens
ggacugagaggacuacagugua

SEQ ID NO: 122369 - RNA, 22 nt, Homo sapiens
ggauauguagggcauaucuaca

SEQ ID NO: 122370 - RNA, 21 nt, Homo sapiens
ggcaagagaauacaacauaaa

SEQ ID NO: 122371 - RNA, 19 nt, Homo sapiens
ggcacugugugagugagga

SEQ ID NO: 122372 - RNA, 22 nt, Homo sapiens
ggccggguggccauggcugccc

SEQ ID NO: 122373 - RNA, 22 nt, Homo sapiens
gguaaaucuucacuaagacuga

SEQ ID NO: 122374 - RNA, 22 nt, Homo sapiens
guacugagagacaguuacuguu

SEQ ID NO: 122375 - RNA, 22 nt, Homo sapiens
guagcagaauaucagauaauuu

SEQ ID NO: 122376 - RNA, 22 nt, Homo sapiens
guaucauugccuaaugcucuca

SEQ ID NO: 122377 - RNA, 22 nt, Homo sapiens
guauugccugugugccagccac

SEQ ID NO: 122378 - RNA, 22 nt, Homo sapiens
gucaacauauuaauuauguucu

SEQ ID NO: 122379 - RNA, 22 nt, Homo sapiens
gucacaguguuuguucauccca

SEQ ID NO: 122380 - RNA, 22 nt, Homo sapiens
gugaaguuuuugugaggccuaa

SEQ ID NO: 122381 - RNA, 22 nt, Homo sapiens
gugagcacugaaagaaggcaag

SEQ ID NO: 122382 - RNA, 22 nt, Homo sapiens
gugagcaguguccuugggggca

SEQ ID NO: 122383 - RNA, 22 nt, Homo sapiens
gugcacaugguagguauugagu

SEQ ID NO: 122384 - RNA, 22 nt, Homo sapiens
guggaauggaaugauuguguau

SEQ ID NO: 122385 - RNA, 22 nt, Homo sapiens
gugguaaaauggcauagagcua

SEQ ID NO: 122386 - RNA, 22 nt, Homo sapiens
guucaucagggauacuggcuua

SEQ ID NO: 122387 - RNA, 22 nt, Homo sapiens
guuugcacuccuaugagaaucu

SEQ ID NO: 122388 - RNA, 22 nt, Homo sapiens
uaaagcacaaguaaagaauacu

SEQ ID NO: 122389 - RNA, 16 nt, Homo sapiens
uaagccccacgugcau

SEQ ID NO: 122390 - RNA, 22 nt, Homo sapiens
uaauacuugucauaaaggcauu

SEQ ID NO: 122391 - RNA, 22 nt, Homo sapiens
uacagccacauaauguaugauu

SEQ ID NO: 122392 - RNA, 22 nt, Homo sapiens
uacaucagccugaaagagcucg

SEQ ID NO: 122393 - RNA, 22 nt, Homo sapiens
uacauccauccugcugggcagu

SEQ ID NO: 122394 - RNA, 22 nt, Homo sapiens
uacauguauguguuuauggcug

SEQ ID NO: 122395 - RNA, 22 nt, Homo sapiens
uaccacauuguagagggcauuc

SEQ ID NO: 122396 - RNA, 22 nt, Homo sapiens
uaccagcauuucucuuuaagua

SEQ ID NO: 122397 - RNA, 22 nt, Homo sapiens
uacucaauugcagucaccuggc

SEQ ID NO: 122398 - RNA, 19 nt, Homo sapiens
uacugcaccucaaccuggg

SEQ ID NO: 122399 - RNA, 20 nt, Homo sapiens
uacugcacuccaaccuaggc

SEQ ID NO: 122400 - RNA, 22 nt, Homo sapiens
uacugcacuccacccuggguga

SEQ ID NO: 122401 - RNA, 22 nt, Homo sapiens
uacugcacuccagccugccaac

SEQ ID NO: 122402 - RNA, 22 nt, Homo sapiens
uacugcacuccagccugggaga

SEQ ID NO: 122403 - RNA, 19 nt, Homo sapiens
ugggaauguaaauuaguuc

SEQ ID NO: 122404 - RNA, 22 nt, Homo sapiens
uggguaggcccucauuggacag

SEQ ID NO: 122405 - RNA, 22 nt, Homo sapiens
ugguguccugucucugcgcuug

SEQ ID NO: 122406 - RNA, 22 nt, Homo sapiens
uguaaaaagcccagccgcugag

SEQ ID NO: 122407 - RNA, 22 nt, Homo sapiens
uguauaacucacauugaaguuu

SEQ ID NO: 122408 - RNA, 22 nt, Homo sapiens
ugucaaguugugguucaauuuu

SEQ ID NO: 122409 - RNA, 18 nt, Homo sapiens
ugucacuggauaaugguc

SEQ ID NO: 122410 - RNA, 22 nt, Homo sapiens
ugucagaaucuagaggcugcua

SEQ ID NO: 122411 - RNA, 22 nt, Homo sapiens
ugucaucauuggaaucugccuc

SEQ ID NO: 122412 - RNA, 19 nt, Homo sapiens
ugucccagccauagaggca

SEQ ID NO: 122413 - RNA, 22 nt, Homo sapiens
ugucccguuuucgaggcugcag

SEQ ID NO: 122414 - RNA, 21 nt, Homo sapiens
ugucugagagaggagaucuac

SEQ ID NO: 122415 - RNA, 21 nt, Homo sapiens
ugugaaaucuaggcagagguu

SEQ ID NO: 122416 - RNA, 22 nt, Homo sapiens
ugugccacuccaaccuggguga

SEQ ID NO: 122417 - RNA, 22 nt, Homo sapiens
uguguaaauaugauagaggaau

SEQ ID NO: 122418 - RNA, 22 nt, Homo sapiens
uguucacaguguuucuuugaga

SEQ ID NO: 122419 - RNA, 22 nt, Homo sapiens
uguugcaccugccuugcuuuag

SEQ ID NO: 122420 - RNA, 22 nt, Homo sapiens
uguugcauuugucaaggucaag

SEQ ID NO: 122421 - RNA, 22 nt, Homo sapiens
uuaacagcacuacguggggauc

SEQ ID NO: 122422 - RNA, 22 nt, Homo sapiens
uuaacagucacuuagcucauuu

SEQ ID NO: 122423 - RNA, 22 nt, Homo sapiens
uuaacaguuaauucuuuggcaa

SEQ ID NO: 122424 - RNA, 22 nt, Homo sapiens
uuaagacaccaaucauuggauu

SEQ ID NO: 122425 - RNA, 22 nt, Homo sapiens
uuaagagugggaguuggccaca

SEQ ID NO: 122426 - RNA, 22 nt, Homo sapiens
uuaaggcauucuuugucuucau

SEQ ID NO: 122427 - RNA, 22 nt, Homo sapiens
uuaaguagaugaaugugaaugu

SEQ ID NO: 122428 - RNA, 19 nt, Homo sapiens
uuacacaaccuaguggggc

SEQ ID NO: 122429 - RNA, 22 nt, Homo sapiens
uuacacaguugguaggggcaga

SEQ ID NO: 122430 - RNA, 22 nt, Homo sapiens
uuaccacagugccugucuaaug

SEQ ID NO: 122431 - RNA, 22 nt, Homo sapiens
uuagggaggacaguuacaacag

SEQ ID NO: 122432 - RNA, 22 nt, Homo sapiens
uuagugaaugggugugauuugu

SEQ ID NO: 122433 - RNA, 22 nt, Homo sapiens
uuauauguuuguacuuaggccu

SEQ ID NO: 122434 - RNA, 22 nt, Homo sapiens
uuauccagcgcuguuuuggaga

SEQ ID NO: 122435 - RNA, 22 nt, Homo sapiens
uuaugucuuuuguguucagcua

SEQ ID NO: 122436 - RNA, 22 nt, Homo sapiens
uuauuacuccuauuuuguagau

SEQ ID NO: 122437 - RNA, 22 nt, Homo sapiens
uucacagagagaacucaaacca

SEQ ID NO: 122438 - RNA, 22 nt, Homo sapiens
uucacaguacucccuggaauua

SEQ ID NO: 122439 - RNA, 22 nt, Homo sapiens
uucacagucacccuucuccaug

SEQ ID NO: 122440 - RNA, 22 nt, Homo sapiens
uucaccuggaguucaggauaag

SEQ ID NO: 122441 - RNA, 22 nt, Homo sapiens
uucagcaaugacagccuauaua

SEQ ID NO: 122442 - RNA, 22 nt, Homo sapiens
uucaggcuccgugccagcuccg

SEQ ID NO: 122443 - RNA, 22 nt, Homo sapiens
uucauagugaaaaauucaaagu

SEQ ID NO: 122444 - RNA, 22 nt, Homo sapiens
uucaucagcuguagaugucaug

SEQ ID NO: 122445 - RNA, 21 nt, Homo sapiens
uucaucuggccguauuccagg

SEQ ID NO: 122446 - RNA, 22 nt, Homo sapiens
uucauggaauauugaccauuuu

SEQ ID NO: 122447 - RNA, 22 nt, Homo sapiens
uucuggcucaggucaacacuuc

SEQ ID NO: 122448 - RNA, 19 nt, Homo sapiens
uucugguguuuuaagccaa

SEQ ID NO: 122449 - RNA, 22 nt, Homo sapiens
uugaaugucuauuaaguuguuu

SEQ ID NO: 122450 - RNA, 22 nt, Homo sapiens
uugacagaccuuggucauaucc

SEQ ID NO: 122451 - RNA, 22 nt, Homo sapiens
uugacuuuuaggaggaaaauga

SEQ ID NO: 122452 - RNA, 22 nt, Homo sapiens
uugagagaaaaggccaugccuu

SEQ ID NO: 122453 - RNA, 22 nt, Homo sapiens
uugaggacugguugaaagcuuu

SEQ ID NO: 122454 - RNA, 22 nt, Homo sapiens
uugagggaaacauucacaucau

SEQ ID NO: 122455 - RNA, 22 nt, Homo sapiens
uugauauuaaguacugaagugg

SEQ ID NO: 122456 - RNA, 22 nt, Homo sapiens
uugcaaaucucuuguguuuggu

SEQ ID NO: 122457 - RNA, 22 nt, Homo sapiens
uugcacauuuuuucuggcagaa

SEQ ID NO: 122458 - RNA, 22 nt, Homo sapiens
uugcacugagauuuugcuuaca

SEQ ID NO: 122459 - RNA, 22 nt, Homo sapiens
uugcacuguaauuuauuuaugu

SEQ ID NO: 122460 - RNA, 22 nt, Homo sapiens
uugcauuagugugguacauuug

SEQ ID NO: 122461 - RNA, 22 nt, Homo sapiens
uugccugagaagccaagaauaa

SEQ ID NO: 122462 - RNA, 22 nt, Homo sapiens
uugguuccuuagccuaggacua

SEQ ID NO: 122463 - RNA, 22 nt, Homo sapiens
uugucaaacucauucuccaucc

SEQ ID NO: 122464 - RNA, 21 nt, Homo sapiens
uugucuagagaaauauaucuc

SEQ ID NO: 122465 - RNA, 22 nt, Homo sapiens
uugugcaaaguugugguuucug

SEQ ID NO: 122466 - RNA, 20 nt, Homo sapiens
uugugcauugggccauuggg

SEQ ID NO: 122467 - RNA, 22 nt, Homo sapiens
uugugcuuuuuaaauagcuucc

SEQ ID NO: 122468 - RNA, 22 nt, Homo sapiens
uuuauagucaggaacuugagga

SEQ ID NO: 122469 - RNA, 22 nt, Homo sapiens
uuucauggaggcauuuuagauu

SEQ ID NO: 122470 - RNA, 22 nt, Homo sapiens
uuucauggcgaggcuucauggg

SEQ ID NO: 122471 - RNA, 23 nt, Homo sapiens
uuucauggggauuuacucauucc

SEQ ID NO: 122472 - RNA, 22 nt, Homo sapiens
uuucccugaaggcucugaaguc

SEQ ID NO: 122473 - RNA, 22 nt, Homo sapiens
uuucgugucuggucugugaugg

SEQ ID NO: 122474 - RNA, 22 nt, Homo sapiens
uuugagaucuuuagaaucaggc

SEQ ID NO: 122475 - RNA, 22 nt, Homo sapiens
uuugcacuggagauucaauggg

SEQ ID NO: 122476 - RNA, 20 nt, Homo sapiens
uuuggcaauaggguuuuugu

SEQ ID NO: 122477 - RNA, 22 nt, Homo sapiens
uuuggcagaaaacaagaaucug

SEQ ID NO: 122478 - RNA, 22 nt, Homo sapiens
uuuguacacgugggugaauugu

SEQ ID NO: 122479 - RNA, 22 nt, Homo sapiens
uuuguagcucacucugagcuga

SEQ ID NO: 122480 - RNA, 22 nt, Homo sapiens
uuuuccagugggacucccauua

SEQ ID NO: 122481 - RNA, 22 nt, Homo sapiens
aaacugaucugaaggccaggcu

SEQ ID NO: 122482 - RNA, 22 nt, Homo sapiens
aaagggcuguuucuugacuugg

SEQ ID NO: 122483 - RNA, 22 nt, Homo sapiens
aaauccauuuguucagcuaugc

SEQ ID NO: 122484 - RNA, 22 nt, Homo sapiens
aaauucaugucaccucuaggua

SEQ ID NO: 122485 - RNA, 22 nt, Homo sapiens
aacacuguuuccagucaugauc

SEQ ID NO: 122486 - RNA, 22 nt, Homo sapiens
aacaggcuccuaggggugcacc

SEQ ID NO: 122487 - RNA, 22 nt, Homo sapiens
aacugcuguuuggguacuggug

SEQ ID NO: 122488 - RNA, 19 nt, Homo sapiens
aacuggugugagaugauau

SEQ ID NO: 122489 - RNA, 22 nt, Homo sapiens
aagagguagaagcuugccuucu

SEQ ID NO: 122490 - RNA, 22 nt, Homo sapiens
aagagguaggaaauggucauuu

SEQ ID NO: 122491 - RNA, 22 nt, Homo sapiens
aagagguuguaccuaaaguguu

SEQ ID NO: 122492 - RNA, 22 nt, Homo sapiens
aagagguuuaacugacucacag

SEQ ID NO: 122493 - RNA, 22 nt, Homo sapiens
aagcuggauuuaguguggagca

SEQ ID NO: 122494 - RNA, 22 nt, Homo sapiens
aaggcaguggcagaagauguca

SEQ ID NO: 122495 - RNA, 22 nt, Homo sapiens
aauagugcugugcagugagugg

SEQ ID NO: 122496 - RNA, 22 nt, Homo sapiens
aaucagcacacugugcuuucca

SEQ ID NO: 122497 - RNA, 22 nt, Homo sapiens
aaugacacugagcaucuuucau

SEQ ID NO: 122498 - RNA, 22 nt, Homo sapiens
aaugcuaucuggaacauuguug

SEQ ID NO: 122499 - RNA, 22 nt, Homo sapiens
aaugugcuuucuuucacacagu

SEQ ID NO: 122500 - RNA, 22 nt, Homo sapiens
aauuaggcuagaauguuauuaa

SEQ ID NO: 122501 - RNA, 22 nt, Homo sapiens
aauugcuuuuauuuagggccag

SEQ ID NO: 122502 - RNA, 23 nt, Homo sapiens
aauugcuuuugaggacuuaguug

SEQ ID NO: 122503 - RNA, 22 nt, Homo sapiens
aauuguacucccauaauucccu

SEQ ID NO: 122504 - RNA, 22 nt, Homo sapiens
acaaaguaggcagugggcugga

SEQ ID NO: 122505 - RNA, 19 nt, Homo sapiens
acagauagaauguucuaca

SEQ ID NO: 122506 - RNA, 22 nt, Homo sapiens
acagucauagcagccuuuguua

SEQ ID NO: 122507 - RNA, 18 nt, Homo sapiens
acagugcugucacugcuu

SEQ ID NO: 122508 - RNA, 22 nt, Homo sapiens
acagugcuuggcacacaguaau

SEQ ID NO: 122509 - RNA, 22 nt, Homo sapiens
uugacauugcuguaguguccag

SEQ ID NO: 122510 - RNA, 22 nt, Homo sapiens
uugacugggccagacagagauc

SEQ ID NO: 122511 - RNA, 21 nt, Homo sapiens
uugagcuuuuaguacagacag

SEQ ID NO: 122512 - RNA, 22 nt, Homo sapiens
uugcuuuguugucuggggaaua

SEQ ID NO: 122513 - RNA, 22 nt, Homo sapiens
uuggaauuuuacuucuguaaga

SEQ ID NO: 122514 - RNA, 22 nt, Homo sapiens
uuggacugugagguuucguggg

SEQ ID NO: 122515 - RNA, 20 nt, Homo sapiens
uuggcauuuagacaagaguu

SEQ ID NO: 122516 - RNA, 21 nt, Homo sapiens
uuggggaauggagagguuuuc

SEQ ID NO: 122517 - RNA, 22 nt, Homo sapiens
uuguacuuuuaguagagacggg

SEQ ID NO: 122518 - RNA, 22 nt, Homo sapiens
uuguauguuguuugucagagaa

SEQ ID NO: 122519 - RNA, 22 nt, Homo sapiens
uugugacacagcugggccuaua

SEQ ID NO: 122520 - RNA, 23 nt, Homo sapiens
uuuaagcuucauguccuaacauc

SEQ ID NO: 122521 - RNA, 22 nt, Homo sapiens
uuuacaguuuucuaggcuacca

SEQ ID NO: 122522 - RNA, 22 nt, Homo sapiens
uuuacugucuucagucccucug

SEQ ID NO: 122523 - RNA, 22 nt, Homo sapiens
uuuagcaaagcaauuuacacca

SEQ ID NO: 122524 - RNA, 22 nt, Homo sapiens
uuuaggcaauauauucaugucu

SEQ ID NO: 122525 - RNA, 22 nt, Homo sapiens
uuuaggcaugcaguucuauuua

SEQ ID NO: 122526 - RNA, 22 nt, Homo sapiens
uuuauugcucuaaaguugccau

SEQ ID NO: 122527 - RNA, 22 nt, Homo sapiens
uuucacagagggcuucuuucua

SEQ ID NO: 122528 - RNA, 22 nt, Homo sapiens
uuucauggacgcaaugccuuuu

SEQ ID NO: 122529 - RNA, 22 nt, Homo sapiens
uuucauggagaaucuucuuacu

SEQ ID NO: 122530 - RNA, 19 nt, Homo sapiens
uuucccugcagaccuacua

SEQ ID NO: 122531 - RNA, 22 nt, Homo sapiens
uuugaauggaaguuuugugaaa

SEQ ID NO: 122532 - RNA, 22 nt, Homo sapiens
uuugaggaaaggcauaaguagg

SEQ ID NO: 122533 - RNA, 22 nt, Homo sapiens
uuugcacauauuugggcaaaag

SEQ ID NO: 122534 - RNA, 22 nt, Homo sapiens
uuuggaaugugcacucagauug

SEQ ID NO: 122535 - RNA, 22 nt, Homo sapiens
uuuguacacuguuggugguuau

SEQ ID NO: 122536 - RNA, 22 nt, Homo sapiens
uuuugguguacaauucuaugga

SEQ ID NO: 122537 - RNA, 22 nt, Homo sapiens
uuuugguguauuguauaaggua

SEQ ID NO: 122538 - RNA, 18 nt, Homo sapiens
uuuuugaggcacagggga

SEQ ID NO: 122539 - RNA, 22 nt, Homo sapiens
uuuuugagguauaguguggcua

SEQ ID NO: 122540 - RNA, 22 nt, Homo sapiens
ucaucagaaucccuuagggaug

SEQ ID NO: 122541 - RNA, 22 nt, Homo sapiens
ucauguaauuuugugucuauga

SEQ ID NO: 122542 - RNA, 22 nt, Homo sapiens
uccacagugguugaacuaguaa

SEQ ID NO: 122543 - RNA, 22 nt, Homo sapiens
uccacagugguugaacuaguuu

SEQ ID NO: 122544 - RNA, 22 nt, Homo sapiens
uccacuuuugugcugaauugga

SEQ ID NO: 122545 - RNA, 22 nt, Homo sapiens
uccaguguuccucagucacccc

SEQ ID NO: 122546 - RNA, 22 nt, Homo sapiens
uccaguguuucuuccacuauuu

SEQ ID NO: 122547 - RNA, 20 nt, Homo sapiens
uccaguuuuggagacauucu

SEQ ID NO: 122548 - RNA, 22 nt, Homo sapiens
ucccacugucuucucgugcucg

SEQ ID NO: 122549 - RNA, 19 nt, Homo sapiens
ucccuguagaccacagugc

SEQ ID NO: 122550 - RNA, 19 nt, Homo sapiens
ucucacagcucuacuaugu

SEQ ID NO: 122551 - RNA, 23 nt, Homo sapiens
ucugauguuauaaaauucuuugg

SEQ ID NO: 122552 - RNA, 22 nt, Homo sapiens
ucugccuuuucaugugggaugg

SEQ ID NO: 122553 - RNA, 23 nt, Homo sapiens
ucugcggguguggacccuagugc

SEQ ID NO: 122554 - RNA, 22 nt, Homo sapiens
ucuggcuucugacuuaggggac

SEQ ID NO: 122555 - RNA, 22 nt, Homo sapiens
ucuuaguuggaaugggauaagg

SEQ ID NO: 122556 - RNA, 22 nt, Homo sapiens
ucuuuuguucuauucaggccuu

SEQ ID NO: 122557 - RNA, 22 nt, Homo sapiens
ugaaaucuaaaauguuccaaga

SEQ ID NO: 122558 - RNA, 21 nt, Homo sapiens
ugaaaugcaugugcacauuaa

SEQ ID NO: 122559 - RNA, 22 nt, Homo sapiens
ugaaaugccuugagauuuugac

SEQ ID NO: 122560 - RNA, 22 nt, Homo sapiens
ugaaaugccuuuaaugaauuua

SEQ ID NO: 122561 - RNA, 22 nt, Homo sapiens
ugacacagugggggauccuuuu

SEQ ID NO: 122562 - RNA, 18 nt, Homo sapiens
ugacaguuucuuuauauu

SEQ ID NO: 122563 - RNA, 22 nt, Homo sapiens
ugacauagcuauuaagugaugc

SEQ ID NO: 122564 - RNA, 22 nt, Homo sapiens
ugacucaguuguuagucuucau

SEQ ID NO: 122565 - RNA, 22 nt, Homo sapiens
ugacuggagaccucaguagggu

SEQ ID NO: 122566 - RNA, 22 nt, Homo sapiens
ugaguacugauuuaagauacac

SEQ ID NO: 122567 - RNA, 22 nt, Homo sapiens
ugauauguguaaacaauguaua

SEQ ID NO: 122568 - RNA, 22 nt, Homo sapiens
ugaugacacugauuucuucaau

SEQ ID NO: 122569 - RNA, 22 nt, Homo sapiens
ugauguugacuguaggcagaga

SEQ ID NO: 122570 - RNA, 22 nt, Homo sapiens
ugcaaaugucaaggguuagugu

SEQ ID NO: 122571 - RNA, 22 nt, Homo sapiens
ugcaagaaacauauuccacaag

SEQ ID NO: 122572 - RNA, 22 nt, Homo sapiens
ugcaagaggagacuguacucag

SEQ ID NO: 122573 - RNA, 22 nt, Homo sapiens
ugcacugucuugucgcauagca

SEQ ID NO: 122574 - RNA, 22 nt, Homo sapiens
ugcagcacugaacuucugggcu

SEQ ID NO: 122575 - RNA, 19 nt, Homo sapiens
ugcauaggguuacauacuc

SEQ ID NO: 122576 - RNA, 22 nt, Homo sapiens
cauggcuacugcagauguaggg

SEQ ID NO: 122577 - RNA, 22 nt, Homo sapiens
cauugcuaaaagucauauauaa

SEQ ID NO: 122578 - RNA, 22 nt, Homo sapiens
cauuguacauaaguauggagua

SEQ ID NO: 122579 - RNA, 22 nt, Homo sapiens
cauuuuacuuuccagacgugga

SEQ ID NO: 122580 - RNA, 22 nt, Homo sapiens
ccaaaguauuuucacugauauc

SEQ ID NO: 122581 - RNA, 23 nt, Homo sapiens
ccacacuguuuagaauggcauca

SEQ ID NO: 122582 - RNA, 22 nt, Homo sapiens
ccacugugguaucugauacugg

SEQ ID NO: 122583 - RNA, 20 nt, Homo sapiens
ccaguguuauuuauguucua

SEQ ID NO: 122584 - RNA, 19 nt, Homo sapiens
ccaguguucugauugcacu

SEQ ID NO: 122585 - RNA, 22 nt, Homo sapiens
ccaguguuuuugaauuccagga

SEQ ID NO: 122586 - RNA, 21 nt, Homo sapiens
ccaugggacggaaugaauaca

SEQ ID NO: 122587 - RNA, 22 nt, Homo sapiens
cccaguguguuguggauauuua

SEQ ID NO: 122588 - RNA, 22 nt, Homo sapiens
cuacagaguaucuaaagaggua

SEQ ID NO: 122589 - RNA, 22 nt, Homo sapiens
cuagcacauuuaucuuuauaca

SEQ ID NO: 122590 - RNA, 22 nt, Homo sapiens
cuagcagacacuuccagagagu

SEQ ID NO: 122591 - RNA, 22 nt, Homo sapiens
cuaggaaguauguguuauugcu

SEQ ID NO: 122592 - RNA, 22 nt, Homo sapiens
cucacaguucuaaaggcaagaa

SEQ ID NO: 122593 - RNA, 22 nt, Homo sapiens
cucacugugguguccuuaggua

SEQ ID NO: 122594 - RNA, 22 nt, Homo sapiens
cucagugucuggcacacagaaa

SEQ ID NO: 122595 - RNA, 21 nt, Homo sapiens
cucauauugcuuuuccauggu

SEQ ID NO: 122596 - RNA, 22 nt, Homo sapiens
cucugguuaaggcugaacuaua

SEQ ID NO: 122597 - RNA, 22 nt, Homo sapiens
cucuuuuguuuagcugagaggg

SEQ ID NO: 122598 - RNA, 22 nt, Homo sapiens
cugagaagaaacagguaaggac

SEQ ID NO: 122599 - RNA, 18 nt, Homo sapiens
cugagcacugcuuuauga

SEQ ID NO: 122600 - RNA, 22 nt, Homo sapiens
cugagcuaguagcauuguguca

SEQ ID NO: 122601 - RNA, 22 nt, Homo sapiens
cugauacucuccuuuuagagag

SEQ ID NO: 122602 - RNA, 22 nt, Homo sapiens
cugcaaauacuugugggauuuu

SEQ ID NO: 122603 - RNA, 22 nt, Homo sapiens
cugcauuagucuguuuaguguu

SEQ ID NO: 122604 - RNA, 22 nt, Homo sapiens
cuggaaagaaacccuuaauucu

SEQ ID NO: 122605 - RNA, 22 nt, Homo sapiens
cuggaaggaaaaacaaccacag

SEQ ID NO: 122606 - RNA, 22 nt, Homo sapiens
cuggaggccugaacauaaaugg

SEQ ID NO: 122607 - RNA, 22 nt, Homo sapiens
cuguaaggcacuaagcauaugu

SEQ ID NO: 122608 - RNA, 22 nt, Homo sapiens
cugucucagccucuccaguagc

SEQ ID NO: 122609 - RNA, 22 nt, Homo sapiens
cuuccagcuggguucagucagu

SEQ ID NO: 122610 - RNA, 22 nt, Homo sapiens
cuugggcagugugcauguguau

SEQ ID NO: 122611 - RNA, 22 nt, Homo sapiens
cuuguacacuguuggugggaau

SEQ ID NO: 122612 - RNA, 19 nt, Homo sapiens
cuuguacucggcgcaguug

SEQ ID NO: 122613 - RNA, 20 nt, Homo sapiens
cuuuggcaaugagaacaggg

SEQ ID NO: 122614 - RNA, 22 nt, Homo sapiens
cuuuugugauuccucaguuacu

SEQ ID NO: 122615 - RNA, 22 nt, Homo sapiens
cuuuugugauucuucaguuacu

SEQ ID NO: 122616 - RNA, 22 nt, Homo sapiens
gaaaugcucagggguuuuccag

SEQ ID NO: 122617 - RNA, 23 nt, Homo sapiens
gaaaugucuuagugaaauugcuu

SEQ ID NO: 122618 - RNA, 22 nt, Homo sapiens
gaacuuguguugcuucacaugu

SEQ ID NO: 122619 - RNA, 22 nt, Homo sapiens
gaauagugcugcaauaaacaua

SEQ ID NO: 122620 - RNA, 22 nt, Homo sapiens
gaauagugcugcaaugaacaua

SEQ ID NO: 122621 - RNA, 22 nt, Homo sapiens
gaauagugcugcgauaaacaua

SEQ ID NO: 122622 - RNA, 22 nt, Homo sapiens
gacagacacaauugauccauga

SEQ ID NO: 122623 - RNA, 21 nt, Homo sapiens
gagaaucaucauggcugcaua

SEQ ID NO: 122624 - RNA, 22 nt, Homo sapiens
gagauacacccagugcagaggc

SEQ ID NO: 122625 - RNA, 22 nt, Homo sapiens
gagcuagggucaugcuacugca

SEQ ID NO: 122626 - RNA, 22 nt, Homo sapiens
gagugcugagcccacuuccuug

SEQ ID NO: 122627 - RNA, 22 nt, Homo sapiens
gauauguacagcucucuaggau

SEQ ID NO: 122628 - RNA, 22 nt, Homo sapiens
gauauguaguaguugaaaaaga

SEQ ID NO: 122629 - RNA, 20 nt, Homo sapiens
gaucaguuuggaguaagugc

SEQ ID NO: 122630 - RNA, 17 nt, Homo sapiens
gcauaugucgaaccagc

SEQ ID NO: 122631 - RNA, 20 nt, Homo sapiens
gcauaugucuuuauagcaga

SEQ ID NO: 122632 - RNA, 17 nt, Homo sapiens
gcauauguugaaccagu

SEQ ID NO: 122633 - RNA, 22 nt, Homo sapiens
gcauggaguggaaauucuuggg

SEQ ID NO: 122634 - RNA, 22 nt, Homo sapiens
gccauggaggauuuauagaggc

SEQ ID NO: 122635 - RNA, 22 nt, Homo sapiens
gcccacuguuaaauuuguuuua

SEQ ID NO: 122636 - RNA, 22 nt, Homo sapiens
uaggcagccagcuguggauuga

SEQ ID NO: 122637 - RNA, 22 nt, Homo sapiens
uaggcgagauguguguuucaug

SEQ ID NO: 122638 - RNA, 22 nt, Homo sapiens
uagggaguguccuuucgggaaa

SEQ ID NO: 122639 - RNA, 22 nt, Homo sapiens
uagggcuuuaguuugcuugugu

SEQ ID NO: 122640 - RNA, 20 nt, Homo sapiens
uauaacaguuuggacccagu

SEQ ID NO: 122641 - RNA, 22 nt, Homo sapiens
uaucacagcauugucuauaaua

SEQ ID NO: 122642 - RNA, 19 nt, Homo sapiens
uaucacuucccuggaaaca

SEQ ID NO: 122643 - RNA, 22 nt, Homo sapiens
uaucucagagaaucagauuuac

SEQ ID NO: 122644 - RNA, 22 nt, Homo sapiens
uaucucauccuccuugauccca

SEQ ID NO: 122645 - RNA, 22 nt, Homo sapiens
uaugcacuauggaaguagcuca

SEQ ID NO: 122646 - RNA, 20 nt, Homo sapiens
uauugcacuccagucugggc

SEQ ID NO: 122647 - RNA, 22 nt, Homo sapiens
uauugcuugaggaaaugguaau

SEQ ID NO: 122648 - RNA, 22 nt, Homo sapiens
ucaaaguagaaaaggggcaauu

SEQ ID NO: 122649 - RNA, 22 nt, Homo sapiens
ucacaagugagaggaauuagau

SEQ ID NO: 122650 - RNA, 22 nt, Homo sapiens
ucacaguccuguuuaggagagg

SEQ ID NO: 122651 - RNA, 22 nt, Homo sapiens
ucacagucuccucuagggaggg

SEQ ID NO: 122652 - RNA, 22 nt, Homo sapiens
ucacauggcagagaagaagcuc

SEQ ID NO: 122653 - RNA, 21 nt, Homo sapiens
ucacauggccagaguaggaac

SEQ ID NO: 122654 - RNA, 22 nt, Homo sapiens
ucacaugggugcaauauaauca

SEQ ID NO: 122655 - RNA, 22 nt, Homo sapiens
ucacauuguacaaacagguaag

SEQ ID NO: 122656 - RNA, 22 nt, Homo sapiens
ucacauuguguagccugcucac

SEQ ID NO: 122657 - RNA, 22 nt, Homo sapiens
ucacauuguuauguaaauguuu

SEQ ID NO: 122658 - RNA, 20 nt, Homo sapiens
ucacugagugguccacagua

SEQ ID NO: 122659 - RNA, 22 nt, Homo sapiens
ucacugcacucuccgccuugcg

SEQ ID NO: 122660 - RNA, 22 nt, Homo sapiens
ucacugugcaugaaggaugcug

SEQ ID NO: 122661 - RNA, 18 nt, Homo sapiens
ucagagugcagacuauac

SEQ ID NO: 122662 - RNA, 22 nt, Homo sapiens
ucagagugguuguaccauuuga

SEQ ID NO: 122663 - RNA, 22 nt, Homo sapiens
ucagaguguuuuccaacuuggu

SEQ ID NO: 122664 - RNA, 22 nt, Homo sapiens
ucagaucaguuccacaagaacu

SEQ ID NO: 122665 - RNA, 22 nt, Homo sapiens
ucagcaaugaccuaagcaaaua

SEQ ID NO: 122666 - RNA, 22 nt, Homo sapiens
ucaguguugauggcugcugacu

SEQ ID NO: 122667 - RNA, 22 nt, Homo sapiens
ucauauguaugugcaauuuugu

SEQ ID NO: 122668 - RNA, 22 nt, Homo sapiens
ucaucagaguuuacaagcucag

SEQ ID NO: 122669 - RNA, 22 nt, Homo sapiens
ucauggggugcuuugcuagauu

SEQ ID NO: 122670 - RNA, 22 nt, Homo sapiens
uccagugugcaggcaaguuuga

SEQ ID NO: 122671 - RNA, 22 nt, Homo sapiens
uccauggagacacauuuuauau

SEQ ID NO: 122672 - RNA, 22 nt, Homo sapiens
uccuugagccucccagacucag

SEQ ID NO: 122673 - RNA, 17 nt, Homo sapiens
ucuaauaauaugcauuu

SEQ ID NO: 122674 - RNA, 22 nt, Homo sapiens
ucucagcacaaacaaaauugcu

SEQ ID NO: 122675 - RNA, 21 nt, Homo sapiens
ucucauuacugaugagccaga

SEQ ID NO: 122676 - RNA, 22 nt, Homo sapiens
ucugacuagacaagcaguguac

SEQ ID NO: 122677 - RNA, 22 nt, Homo sapiens
ucugacucuggagucucagguu

SEQ ID NO: 122678 - RNA, 22 nt, Homo sapiens
ucugccuacugguuggaggaac

SEQ ID NO: 122679 - RNA, 22 nt, Homo sapiens
ucuggcuuuagcaugugggaag

SEQ ID NO: 122680 - RNA, 22 nt, Homo sapiens
ucugguuccugcauucauucaa

SEQ ID NO: 122681 - RNA, 22 nt, Homo sapiens
ucuuuggaggcgaucuguuuga

SEQ ID NO: 122682 - RNA, 22 nt, Homo sapiens
ucuuugucuacauccuguuaaa

SEQ ID NO: 122683 - RNA, 22 nt, Homo sapiens
ucuuuuguaaaaugaggaggug

SEQ ID NO: 122684 - RNA, 22 nt, Homo sapiens
ucuuuugugagucagccucucc

SEQ ID NO: 122685 - RNA, 22 nt, Homo sapiens
ugaaaugcuaauucguagcuaa

SEQ ID NO: 122686 - RNA, 22 nt, Homo sapiens
ugaaaugcugucuaggggaaau

SEQ ID NO: 122687 - RNA, 22 nt, Homo sapiens
ugaaauuauucuuaccaaggug

SEQ ID NO: 122688 - RNA, 22 nt, Homo sapiens
ugaaucaugcugcuauaaagac

SEQ ID NO: 122689 - RNA, 22 nt, Homo sapiens
ugacaguaaacagucuugauua

SEQ ID NO: 122690 - RNA, 22 nt, Homo sapiens
ugacaugauuguauauuuagaa

SEQ ID NO: 122691 - RNA, 22 nt, Homo sapiens
ugacauuacagucacuugcugu

SEQ ID NO: 122692 - RNA, 21 nt, Homo sapiens
ugacauuauuucaugucagua

SEQ ID NO: 122693 - RNA, 22 nt, Homo sapiens
ugacggaggacaccugcggaau

SEQ ID NO: 122694 - RNA, 22 nt, Homo sapiens
ugacuacacacaauuugucaag

SEQ ID NO: 122695 - RNA, 22 nt, Homo sapiens
ugacucagauagguguguauuc

SEQ ID NO: 122696 - RNA, 22 nt, Homo sapiens
ugagaacauggagaacccccca

SEQ ID NO: 122697 - RNA, 22 nt, Homo sapiens
ugagaacuuugucuuuuacucu

SEQ ID NO: 122698 - RNA, 22 nt, Homo sapiens
ugagaagugacgcagcaggguu

SEQ ID NO: 122699 - RNA, 22 nt, Homo sapiens
ugagauaguacuuuuuuaaagg

SEQ ID NO: 122700 - RNA, 22 nt, Homo sapiens
ugagcacaggugcgcgguuacu

SEQ ID NO: 122701 - RNA, 22 nt, Homo sapiens
ugagcacuguacuuuaucaggu

SEQ ID NO: 122702 - RNA, 20 nt, Homo sapiens
ugagcuauauauguccuuga

SEQ ID NO: 122703 - RNA, 22 nt, Homo sapiens
ugagcuauguucuucuuguuuu

SEQ ID NO: 122704 - RNA, 20 nt, Homo sapiens
ugagcuuguaaacacuguuu

SEQ ID NO: 122705 - RNA, 22 nt, Homo sapiens
ugaggacugagaggcacugugg

SEQ ID NO: 122706 - RNA, 22 nt, Homo sapiens
ugaguagcuaauguuuacugag

SEQ ID NO: 122707 - RNA, 19 nt, Homo sapiens
ugaguaucuuuacacaucu

SEQ ID NO: 122708 - RNA, 22 nt, Homo sapiens
ugagucaugcuggagucauggc

SEQ ID NO: 122709 - RNA, 22 nt, Homo sapiens
ugagucauguaauaaugcugcu

SEQ ID NO: 122710 - RNA, 17 nt, Homo sapiens
ugauauuuucccagaua

SEQ ID NO: 122711 - RNA, 21 nt, Homo sapiens
ugaucacaugaaaaccaugca

SEQ ID NO: 122712 - RNA, 22 nt, Homo sapiens
ugcacuguggucugagagacag

SEQ ID NO: 122713 - RNA, 19 nt, Homo sapiens
ugcagcaauguaaaagaca

SEQ ID NO: 122714 - RNA, 22 nt, Homo sapiens
ugcauugccgugauuacugucu

SEQ ID NO: 122715 - RNA, 22 nt, Homo sapiens
ugccaguguugccuuucacuag

SEQ ID NO: 122716 - RNA, 22 nt, Homo sapiens
ugccuaggcuggaaugcaaugg

SEQ ID NO: 122717 - RNA, 22 nt, Homo sapiens
ugccuaggcuggaaugcagugg

SEQ ID NO: 122718 - RNA, 22 nt, Homo sapiens
ugcuagaagaucacacacauca

SEQ ID NO: 122719 - RNA, 22 nt, Homo sapiens
ugcuaucauugauuagugaugu

SEQ ID NO: 122720 - RNA, 22 nt, Homo sapiens
ugcugcuguuguuguuacuagc

SEQ ID NO: 122721 - RNA, 22 nt, Homo sapiens
uggaauaugagacgggguuguc

SEQ ID NO: 122722 - RNA, 22 nt, Homo sapiens
uggcacaaugacccuugugggc

SEQ ID NO: 122723 - RNA, 22 nt, Homo sapiens
uggcaguuuuugccuucaauac

SEQ ID NO: 122724 - RNA, 22 nt, Homo sapiens
uagaagcacuaucccuccuagu

SEQ ID NO: 122725 - RNA, 20 nt, Homo sapiens
uagagagauauggggguucc

SEQ ID NO: 122726 - RNA, 22 nt, Homo sapiens
uagagguaggucuucgagucuc

SEQ ID NO: 122727 - RNA, 19 nt, Homo sapiens
uagaugucuuugcauagau

SEQ ID NO: 122728 - RNA, 20 nt, Homo sapiens
uagcacaucuggcuguagag

SEQ ID NO: 122729 - RNA, 20 nt, Homo sapiens
uagcagcagacagagggagg

SEQ ID NO: 122730 - RNA, 22 nt, Homo sapiens
uagcagcauaaauggacuaaga

SEQ ID NO: 122731 - RNA, 22 nt, Homo sapiens
uagcagcauuuuuguagaguau

SEQ ID NO: 122732 - RNA, 22 nt, Homo sapiens
uaggagcacagcagcauguggg

SEQ ID NO: 122733 - RNA, 20 nt, Homo sapiens
acugcacuccagucucuggg

SEQ ID NO: 122734 - RNA, 22 nt, Homo sapiens
acugcacuccuccuugggugac

SEQ ID NO: 122735 - RNA, 22 nt, Homo sapiens
acugcacucuagcauggguaau

SEQ ID NO: 122736 - RNA, 22 nt, Homo sapiens
acugcacucuagccuuggcaac

SEQ ID NO: 122737 - RNA, 22 nt, Homo sapiens
acugcacuguccuagaguccuc

SEQ ID NO: 122738 - RNA, 22 nt, Homo sapiens
acugcacuuauccuccaauguu

SEQ ID NO: 122739 - RNA, 22 nt, Homo sapiens
acuggaguuuguucaagaaaua

SEQ ID NO: 122740 - RNA, 22 nt, Homo sapiens
agagccacauuaaauaugggaa

SEQ ID NO: 122741 - RNA, 22 nt, Homo sapiens
agaguacugacguuugcaaauu

SEQ ID NO: 122742 - RNA, 22 nt, Homo sapiens
agaguaguaggaugaauggacu

SEQ ID NO: 122743 - RNA, 22 nt, Homo sapiens
agaugguguuuucucaccagau

SEQ ID NO: 122744 - RNA, 23 nt, Homo sapiens
agcaaaugcucuagcacuccaac

SEQ ID NO: 122745 - RNA, 22 nt, Homo sapiens
agcaacauuuuugaccuuucuu

SEQ ID NO: 122746 - RNA, 22 nt, Homo sapiens
agcaucauguuuucgagguuca

SEQ ID NO: 122747 - RNA, 22 nt, Homo sapiens
agcauuaguugugaagccuuua

SEQ ID NO: 122748 - RNA, 22 nt, Homo sapiens
agcuguuguucucagaggcuuu

SEQ ID NO: 122749 - RNA, 21 nt, Homo sapiens
agcuuguguguaucacagugu

SEQ ID NO: 122750 - RNA, 22 nt, Homo sapiens
aggaauuuaauguaugauaaua

SEQ ID NO: 122751 - RNA, 22 nt, Homo sapiens
aggacacugauguaugcugugg

SEQ ID NO: 122752 - RNA, 21 nt, Homo sapiens
aggcaagguguuauuauugaa

SEQ ID NO: 122753 - RNA, 22 nt, Homo sapiens
agggcuuguuuaacuaucauua

SEQ ID NO: 122754 - RNA, 22 nt, Homo sapiens
agguguuguugaggagauuuca

SEQ ID NO: 122755 - RNA, 22 nt, Homo sapiens
agucacagugaccuugucugac

SEQ ID NO: 122756 - RNA, 22 nt, Homo sapiens
agucaguguguauugauggcac

SEQ ID NO: 122757 - RNA, 22 nt, Homo sapiens
agugaaaucugaagaaggucau

SEQ ID NO: 122758 - RNA, 22 nt, Homo sapiens
aguggcuuuuuaguggcagaug

SEQ ID NO: 122759 - RNA, 22 nt, Homo sapiens
agugucaggagacagguagcug

SEQ ID NO: 122760 - RNA, 22 nt, Homo sapiens
auaaggcugguauagacauuca

SEQ ID NO: 122761 - RNA, 22 nt, Homo sapiens
auacauguucaagggcauauau

SEQ ID NO: 122762 - RNA, 22 nt, Homo sapiens
auacuccugucucagcugagau

SEQ ID NO: 122763 - RNA, 22 nt, Homo sapiens
auacugcacauuuagggaggga

SEQ ID NO: 122764 - RNA, 22 nt, Homo sapiens
auagcagugugaaaauguacua

SEQ ID NO: 122765 - RNA, 22 nt, Homo sapiens
auagguauguaauacaaaugaa

SEQ ID NO: 122766 - RNA, 22 nt, Homo sapiens
auagugcuggaauaaauauacg

SEQ ID NO: 122767 - RNA, 22 nt, Homo sapiens
auauaugcacacgugugcauau

SEQ ID NO: 122768 - RNA, 22 nt, Homo sapiens
auauauguuuucugggaagaaa

SEQ ID NO: 122769 - RNA, 22 nt, Homo sapiens
auaugguuuuuggaagcauauc

SEQ ID NO: 122770 - RNA, 21 nt, Homo sapiens
auauuacuguuagaggacugc

SEQ ID NO: 122771 - RNA, 18 nt, Homo sapiens
auauugccuucagacuag

SEQ ID NO: 122772 - RNA, 22 nt, Homo sapiens
aucaaagcagcauggcccaguc

SEQ ID NO: 122773 - RNA, 22 nt, Homo sapiens
aucacagugaaaacagucaauu

SEQ ID NO: 122774 - RNA, 22 nt, Homo sapiens
aucauggaguauuugcaagucu

SEQ ID NO: 122775 - RNA, 22 nt, Homo sapiens
aucauugugcaucuucauucca

SEQ ID NO: 122776 - RNA, 22 nt, Homo sapiens
auccaucagacggcaggcguug

SEQ ID NO: 122777 - RNA, 22 nt, Homo sapiens
aucccugugauccaaucacuuc

SEQ ID NO: 122778 - RNA, 22 nt, Homo sapiens
auccucugagaucuaggcagag

SEQ ID NO: 122779 - RNA, 20 nt, Homo sapiens
augagguguaugacacugaa

SEQ ID NO: 122780 - RNA, 22 nt, Homo sapiens
augaucauggaaguuuuccugu

SEQ ID NO: 122781 - RNA, 19 nt, Homo sapiens
augcaaugucacaggcugc

SEQ ID NO: 122782 - RNA, 22 nt, Homo sapiens
augcacuguauaggaucuugcg

SEQ ID NO: 122783 - RNA, 22 nt, Homo sapiens
auggagcaaaacagauuuggga

SEQ ID NO: 122784 - RNA, 19 nt, Homo sapiens
auggauacauuuucugcua

SEQ ID NO: 122785 - RNA, 22 nt, Homo sapiens
auggcaguuuggucucugugcu

SEQ ID NO: 122786 - RNA, 22 nt, Homo sapiens
auggcuuuuauuguguugaggu

SEQ ID NO: 122787 - RNA, 22 nt, Homo sapiens
augggagugugguuagagaccu

SEQ ID NO: 122788 - RNA, 21 nt, Homo sapiens
auggugagaaaguagugucaa

SEQ ID NO: 122789 - RNA, 22 nt, Homo sapiens
augugacagugguuuuaagcgu

SEQ ID NO: 122790 - RNA, 22 nt, Homo sapiens
augugcuuauagguguauguuu

SEQ ID NO: 122791 - RNA, 18 nt, Homo sapiens
auguuauguuuguagaag

SEQ ID NO: 122792 - RNA, 22 nt, Homo sapiens
auguuguaguaugagucaaaau

SEQ ID NO: 122793 - RNA, 20 nt, Homo sapiens
auuagagcuacauggcuaca

SEQ ID NO: 122794 - RNA, 22 nt, Homo sapiens
auuauaugucaucacagacacc

SEQ ID NO: 122795 - RNA, 22 nt, Homo sapiens
auugaacaugccauauguacca

SEQ ID NO: 122796 - RNA, 22 nt, Homo sapiens
auugcacuggggguuagaauuu

SEQ ID NO: 122797 - RNA, 22 nt, Homo sapiens
uaacaagagagucagucagucc

SEQ ID NO: 122798 - RNA, 22 nt, Homo sapiens
uaacuaaagagaagucaauguc

SEQ ID NO: 122799 - RNA, 20 nt, Homo sapiens
uaacuguggcuucuuuuggc

SEQ ID NO: 122800 - RNA, 22 nt, Homo sapiens
uaagcaguaaaugaagucuugc

SEQ ID NO: 122801 - RNA, 22 nt, Homo sapiens
uaagcagugcaagaauggaaua

SEQ ID NO: 122802 - RNA, 22 nt, Homo sapiens
uaagggacauguguugccuaag

SEQ ID NO: 122803 - RNA, 22 nt, Homo sapiens
uaagugaugucuuuuugugugc

SEQ ID NO: 122804 - RNA, 22 nt, Homo sapiens
uacagucuggaggccuguguug

SEQ ID NO: 122805 - RNA, 22 nt, Homo sapiens
uacucacauucuguuucuugcu

SEQ ID NO: 122806 - RNA, 22 nt, Homo sapiens
uacugcacauaugaagguuccc

SEQ ID NO: 122807 - RNA, 22 nt, Homo sapiens
uacugcacuccagccucgguga

SEQ ID NO: 122808 - RNA, 19 nt, Homo sapiens
uacugcacuccagucuggg

SEQ ID NO: 122809 - RNA, 22 nt, Homo sapiens
uagaacauuccaggugauguug

SEQ ID NO: 122810 - RNA, 22 nt, Homo sapiens
uagagguagccuacuacacacc

SEQ ID NO: 122811 - RNA, 22 nt, Homo sapiens
uagauuguaauaugcagaaugg

SEQ ID NO: 122812 - RNA, 22 nt, Homo sapiens
uagcacaugucagguaauuugc

SEQ ID NO: 122813 - RNA, 22 nt, Homo sapiens
uagcagaauaacuugccagccu

SEQ ID NO: 122814 - RNA, 22 nt, Homo sapiens
uagcagcaucucuggcuucuac

SEQ ID NO: 122815 - RNA, 20 nt, Homo sapiens
uaggagcaaugagaguagaa

SEQ ID NO: 122816 - RNA, 22 nt, Homo sapiens
uaguaaacauaguucuuuugcu

SEQ ID NO: 122817 - RNA, 22 nt, Homo sapiens
uagugcugagauugagaagccc

SEQ ID NO: 122818 - RNA, 22 nt, Homo sapiens
uauacaugugggcaucaggaga

SEQ ID NO: 122819 - RNA, 22 nt, Homo sapiens
uauaucacaugcacucauuuuc

SEQ ID NO: 122820 - RNA, 22 nt, Homo sapiens
uaucaguauggauucauggauu

SEQ ID NO: 122821 - RNA, 22 nt, Homo sapiens
uaucauagacaaucaguuauug

SEQ ID NO: 122822 - RNA, 22 nt, Homo sapiens
uauugaacgugggauauugaag

SEQ ID NO: 122823 - RNA, 22 nt, Homo sapiens
uauugcacaugaggagacauug

SEQ ID NO: 122824 - RNA, 22 nt, Homo sapiens
uauugcuaaauucuuuuccuag

SEQ ID NO: 122825 - RNA, 22 nt, Homo sapiens
uauugcuuuacucucuuauccu

SEQ ID NO: 122826 - RNA, 22 nt, Homo sapiens
uauugcuuuugauucaaggcag

SEQ ID NO: 122827 - RNA, 22 nt, Homo sapiens
uauuguacauauccucccuuca

SEQ ID NO: 122828 - RNA, 22 nt, Homo sapiens
uauuguccacuuugcacugugu

SEQ ID NO: 122829 - RNA, 20 nt, Homo sapiens
ucaaaguaugcucugcacua

SEQ ID NO: 122830 - RNA, 22 nt, Homo sapiens
ucaaaguauucuucugagaacc

SEQ ID NO: 122831 - RNA, 22 nt, Homo sapiens
ucaaaugguccacgugaacauu

SEQ ID NO: 122832 - RNA, 23 nt, Homo sapiens
ucaagugaugguggccacaaggg

SEQ ID NO: 122833 - RNA, 22 nt, Homo sapiens
ucaagugauucuugugccuuag

SEQ ID NO: 122834 - RNA, 18 nt, Homo sapiens
ucacagguaauuaggauu

SEQ ID NO: 122835 - RNA, 20 nt, Homo sapiens
ucacagucacacauaauccu

SEQ ID NO: 122836 - RNA, 22 nt, Homo sapiens
ucacaguugauugaaacacagc

SEQ ID NO: 122837 - RNA, 22 nt, Homo sapiens
ucacccugacaugcggccgaac

SEQ ID NO: 122838 - RNA, 20 nt, Homo sapiens
ucacugugaacuucuugagg

SEQ ID NO: 122839 - RNA, 22 nt, Homo sapiens
ucacugugcacauaugauaggu

SEQ ID NO: 122840 - RNA, 22 nt, Homo sapiens
ucacugugguuuugaugugcau

SEQ ID NO: 122841 - RNA, 22 nt, Homo sapiens
ucagaguggagucugcagccuu

SEQ ID NO: 122842 - RNA, 22 nt, Homo sapiens
ucaguccccucgcugagucuac

SEQ ID NO: 122843 - RNA, 21 nt, Homo sapiens
ucagugcugugggcaaggugc

SEQ ID NO: 122844 - RNA, 22 nt, Homo sapiens
ucaguguuuggaaucucaauuu

SEQ ID NO: 122845 - RNA, 21 nt, Homo sapiens
ucauauguaucuuugugccuc

SEQ ID NO: 122846 - RNA, 21 nt, Homo sapiens
ucaucagucaaagacaauggu

SEQ ID NO: 122847 - RNA, 22 nt, Homo sapiens
ucaugagacacacuggaaagga

SEQ ID NO: 122848 - RNA, 22 nt, Homo sapiens
ucauuagagacagggugucacu

SEQ ID NO: 122849 - RNA, 22 nt, Homo sapiens
ucauuagagaucuuggggaaaa

SEQ ID NO: 122850 - RNA, 22 nt, Homo sapiens
uccccugagaacuugcuagaaa

SEQ ID NO: 122851 - RNA, 22 nt, Homo sapiens
ucccgaggacaucugggggcaa

SEQ ID NO: 122852 - RNA, 19 nt, Homo sapiens
ucugacagccccagucaac

SEQ ID NO: 122853 - RNA, 22 nt, Homo sapiens
ucugacagugagagaaaucuga

SEQ ID NO: 122854 - RNA, 22 nt, Homo sapiens
ucugacagugugaauauugacu

SEQ ID NO: 122855 - RNA, 22 nt, Homo sapiens
ucugagcaauagauguggauau

SEQ ID NO: 122856 - RNA, 22 nt, Homo sapiens
ucuuugauuuuguuacuaagac

SEQ ID NO: 122857 - RNA, 22 nt, Homo sapiens
ugaaaucauguaguuauugcaa

SEQ ID NO: 122858 - RNA, 22 nt, Homo sapiens
ugaaaugcagaacuuuaggucu

SEQ ID NO: 122859 - RNA, 22 nt, Homo sapiens
ugaaauuguuugcaaggauagg

SEQ ID NO: 122860 - RNA, 18 nt, Homo sapiens
ugacaaugcuaguccugg

SEQ ID NO: 122861 - RNA, 22 nt, Homo sapiens
ugacaguuuccagggcugucuc

SEQ ID NO: 122862 - RNA, 22 nt, Homo sapiens
ugacuagagcaauuggaaacaa

SEQ ID NO: 122863 - RNA, 22 nt, Homo sapiens
ugacuaggaggcuggaggauga

SEQ ID NO: 122864 - RNA, 22 nt, Homo sapiens
ugacuuuagaauuuuauccaga

SEQ ID NO: 122865 - RNA, 22 nt, Homo sapiens
ugagaacugguagcacuuguga

SEQ ID NO: 122866 - RNA, 22 nt, Homo sapiens
ugagacugagucuugcucuugu

SEQ ID NO: 122867 - RNA, 22 nt, Homo sapiens
ugagacugaguuuugcucuugu

SEQ ID NO: 122868 - RNA, 23 nt, Homo sapiens
ugagauuacccagaaagaguaua

SEQ ID NO: 122869 - RNA, 22 nt, Homo sapiens
ugagcuagggccuggaauaggg

SEQ ID NO: 122870 - RNA, 22 nt, Homo sapiens
ugaggaauguguguuaaagaua

SEQ ID NO: 122871 - RNA, 22 nt, Homo sapiens
ugaguguguaugugcauacaca

SEQ ID NO: 122872 - RNA, 20 nt, Homo sapiens
ugauauuuucugagcaggaa

SEQ ID NO: 122873 - RNA, 22 nt, Homo sapiens
ugaucacagcuugacuaaagga

SEQ ID NO: 122874 - RNA, 22 nt, Homo sapiens
ugaugcugaguggcuauuugaa

SEQ ID NO: 122875 - RNA, 22 nt, Homo sapiens
ugauuuguccauguggcacgug

SEQ ID NO: 122876 - RNA, 22 nt, Homo sapiens
ugcaaaugcugcuauuucucuu

SEQ ID NO: 122877 - RNA, 22 nt, Homo sapiens
ugcauagcaaaauaggauuaga

SEQ ID NO: 122878 - RNA, 22 nt, Homo sapiens
ugcauccauucuagacucaucu

SEQ ID NO: 122879 - RNA, 20 nt, Homo sapiens
ugccagugugucaauuuaua

SEQ ID NO: 122880 - RNA, 21 nt, Homo sapiens
ugcugcacuucuuuugcugug

SEQ ID NO: 122881 - RNA, 22 nt, Homo sapiens
ugcugguuuucaucaucagugg

SEQ ID NO: 122882 - RNA, 21 nt, Homo sapiens
uggaaugaauggccaacaugg

SEQ ID NO: 122883 - RNA, 22 nt, Homo sapiens
uggaauguggacucuuaugggg

SEQ ID NO: 122884 - RNA, 21 nt, Homo sapiens
uggaauuaauggagagguguu

SEQ ID NO: 122885 - RNA, 22 nt, Homo sapiens
uggacuagagggugggcgaggu

SEQ ID NO: 122886 - RNA, 22 nt, Homo sapiens
aagugcuuaggauagugugugg

SEQ ID NO: 122887 - RNA, 22 nt, Homo sapiens
aagugcuuuuuagauaugguuu

SEQ ID NO: 122888 - RNA, 22 nt, Homo sapiens
aaguggaauguuuguggcacaa

SEQ ID NO: 122889 - RNA, 22 nt, Homo sapiens
aagugguagggucaggauugga

SEQ ID NO: 122890 - RNA, 22 nt, Homo sapiens
aagugguucuaugaguuugcaa

SEQ ID NO: 122891 - RNA, 22 nt, Homo sapiens
aagugguuuuaaucuggugagu

SEQ ID NO: 122892 - RNA, 23 nt, Homo sapiens
aaguucaugcucaucuguuacac

SEQ ID NO: 122893 - RNA, 22 nt, Homo sapiens
aaguuguaguuagagaguugcu

SEQ ID NO: 122894 - RNA, 22 nt, Homo sapiens
aaguuguuggaguuccauuguu

SEQ ID NO: 122895 - RNA, 22 nt, Homo sapiens
aauaaagcagcuuuuugggacu

SEQ ID NO: 122896 - RNA, 22 nt, Homo sapiens
aauaaagcaggguccuugcacu

SEQ ID NO: 122897 - RNA, 22 nt, Homo sapiens
aauaaagcuuugagcuuugcug

SEQ ID NO: 122898 - RNA, 22 nt, Homo sapiens
aauaaaguaggaggugaggaaa

SEQ ID NO: 122899 - RNA, 22 nt, Homo sapiens
aauaagaaguggaagggaccgg

SEQ ID NO: 122900 - RNA, 22 nt, Homo sapiens
aauaagcugagagaauucuaca

SEQ ID NO: 122901 - RNA, 22 nt, Homo sapiens
aauaaguugagaugaggucaua

SEQ ID NO: 122902 - RNA, 22 nt, Homo sapiens
aauaaugucacaggggguuagc

SEQ ID NO: 122903 - RNA, 22 nt, Homo sapiens
aauagcuguuuuuaauuccugc

SEQ ID NO: 122904 - RNA, 22 nt, Homo sapiens
aauaguggcuuggacuaaauau

SEQ ID NO: 122905 - RNA, 22 nt, Homo sapiens
aauaucacaggguguacacuca

SEQ ID NO: 122906 - RNA, 22 nt, Homo sapiens
aauaucacaguuggguguacac

SEQ ID NO: 122907 - RNA, 22 nt, Homo sapiens
aauauguccaguguuuugggag

SEQ ID NO: 122908 - RNA, 22 nt, Homo sapiens
aauauguccuugaaauggugcu

SEQ ID NO: 122909 - RNA, 22 nt, Homo sapiens
aauaugucuugaaauuggguaa

SEQ ID NO: 122910 - RNA, 22 nt, Homo sapiens
aauauugucaaaauggauucca

SEQ ID NO: 122911 - RNA, 22 nt, Homo sapiens
aaucacauuaaugcucccucag

SEQ ID NO: 122912 - RNA, 22 nt, Homo sapiens
aaucacuaugccaugaaguaca

SEQ ID NO: 122913 - RNA, 22 nt, Homo sapiens
aaucugggguuguuuggggagu

SEQ ID NO: 122914 - RNA, 22 nt, Homo sapiens
aaucugucaguuuuguguuaau

SEQ ID NO: 122915 - RNA, 22 nt, Homo sapiens
aaucugucuagacaaggagucu

SEQ ID NO: 122916 - RNA, 23 nt, Homo sapiens
aaucugucuuuguuauagggguc

SEQ ID NO: 122917 - RNA, 22 nt, Homo sapiens
aaugacacugagcaucuuucau

SEQ ID NO: 122918 - RNA, 22 nt, Homo sapiens
aaugacugugauauuuuucuuc

SEQ ID NO: 122919 - RNA, 17 nt, Homo sapiens
aaugagacauuucugcu

SEQ ID NO: 122920 - RNA, 22 nt, Homo sapiens
aaugaucaauguuugaggugau

SEQ ID NO: 122921 - RNA, 22 nt, Homo sapiens
aaugcacauaaaauccuccagg

SEQ ID NO: 122922 - RNA, 22 nt, Homo sapiens
aaugccaucagagaaaacucuu

SEQ ID NO: 122923 - RNA, 22 nt, Homo sapiens
aaugcuguucuuugcuuaaguu

SEQ ID NO: 122924 - RNA, 22 nt, Homo sapiens
aauggcaagagccacagaggcg

SEQ ID NO: 122925 - RNA, 22 nt, Homo sapiens
aauggcuuucagcuuuucccca

SEQ ID NO: 122926 - RNA, 22 nt, Homo sapiens
aauggguaguacugugguaaca

SEQ ID NO: 122927 - RNA, 22 nt, Homo sapiens
aaugguguuuccguuaagcuga

SEQ ID NO: 122928 - RNA, 22 nt, Homo sapiens
aaugucaucuucaguuguacag

SEQ ID NO: 122929 - RNA, 22 nt, Homo sapiens
aauuacauggcaauugggaaau

SEQ ID NO: 122930 - RNA, 22 nt, Homo sapiens
aauuaggcuagaauguuauuaa

SEQ ID NO: 122931 - RNA, 22 nt, Homo sapiens
aauuaguugaaagucugcuuuu

SEQ ID NO: 122932 - RNA, 22 nt, Homo sapiens
aauugcaccaucuagaucaaga

SEQ ID NO: 122933 - RNA, 22 nt, Homo sapiens
aauugcacuacugcacucccac

SEQ ID NO: 122934 - RNA, 22 nt, Homo sapiens
aauugcauugaauuuguagcuu

SEQ ID NO: 122935 - RNA, 22 nt, Homo sapiens
aauugccucaagugaucauggc

SEQ ID NO: 122936 - RNA, 22 nt, Homo sapiens
aauugcuuuuauuuagggccag

SEQ ID NO: 122937 - RNA, 22 nt, Homo sapiens
aauuguacucccauaauucccu

SEQ ID NO: 122938 - RNA, 22 nt, Homo sapiens
acaagacuucuuguauucuagu

SEQ ID NO: 122939 - RNA, 22 nt, Homo sapiens
acaagcacaaauuuaauccugu

SEQ ID NO: 122940 - RNA, 22 nt, Homo sapiens
acaauguauauuuuacuguagg

SEQ ID NO: 122941 - RNA, 22 nt, Homo sapiens
acacaguaagcacaguguagau

SEQ ID NO: 122942 - RNA, 22 nt, Homo sapiens
acaccaugucuguuucugguuu

SEQ ID NO: 122943 - RNA, 22 nt, Homo sapiens
acaccauugcauuccagccugg

SEQ ID NO: 122944 - RNA, 22 nt, Homo sapiens
acacucucucauuacuuguuug

SEQ ID NO: 122945 - RNA, 20 nt, Homo sapiens
acacuggaguaucaaggccc

SEQ ID NO: 122946 - RNA, 22 nt, Homo sapiens
acacuggaguuaaaggugauuu

SEQ ID NO: 122947 - RNA, 22 nt, Homo sapiens
acacuggguaacauaucuguua

SEQ ID NO: 122948 - RNA, 22 nt, Homo sapiens
acacuguacuuauguuuugcag

SEQ ID NO: 122949 - RNA, 22 nt, Homo sapiens
acacuguagcugagggcaugcg

SEQ ID NO: 122950 - RNA, 22 nt, Homo sapiens
acacuguuuuguggagaaugua

SEQ ID NO: 122951 - RNA, 19 nt, Homo sapiens
acagauagaauguucuaca

SEQ ID NO: 122952 - RNA, 22 nt, Homo sapiens
acagauagacauauauagcuca

SEQ ID NO: 122953 - RNA, 22 nt, Homo sapiens
acagauagcacuaagggaucug

SEQ ID NO: 122954 - RNA, 22 nt, Homo sapiens
acagaucagagauauuuagguu

SEQ ID NO: 122955 - RNA, 22 nt, Homo sapiens
acagcacugccaagugacccau

SEQ ID NO: 122956 - RNA, 22 nt, Homo sapiens
acaguagugggcuacagaauca

SEQ ID NO: 122957 - RNA, 23 nt, Homo sapiens
acagucuaguuugaagucaggua

SEQ ID NO: 122958 - RNA, 22 nt, Homo sapiens
acagugcuguuguguuuucacg

SEQ ID NO: 122959 - RNA, 23 nt, Homo sapiens
acaguggugugaucuuggcucag

SEQ ID NO: 122960 - RNA, 22 nt, Homo sapiens
acagugucaugucguguucccc

SEQ ID NO: 122961 - RNA, 19 nt, Homo sapiens
acagugucucuauaaugau

SEQ ID NO: 122962 - RNA, 18 nt, Homo sapiens
acagugucuuacaccugu

SEQ ID NO: 122963 - RNA, 22 nt, Homo sapiens
acauaaagaagcaggacauugu

SEQ ID NO: 122964 - RNA, 22 nt, Homo sapiens
acauagaguaguggugaggaug

SEQ ID NO: 122965 - RNA, 22 nt, Homo sapiens
acaugccucccugguccgcugu

SEQ ID NO: 122966 - RNA, 22 nt, Homo sapiens
acauggcacugcgggcuucuug

SEQ ID NO: 122967 - RNA, 21 nt, Homo sapiens
acauguacacauguaugcaca

SEQ ID NO: 122968 - RNA, 22 nt, Homo sapiens
accacagugcuuccugcucacg

SEQ ID NO: 122969 - RNA, 22 nt, Homo sapiens
accaucuagauuuguguaggua

SEQ ID NO: 122970 - RNA, 22 nt, Homo sapiens
accaugcaguccaauaugcaca

SEQ ID NO: 122971 - RNA, 22 nt, Homo sapiens
accauugcacuccagccuuggc

SEQ ID NO: 122972 - RNA, 22 nt, Homo sapiens
acccaguagccagauguagcug

SEQ ID NO: 122973 - RNA, 22 nt, Homo sapiens
accccauuugcacugagcccuu

SEQ ID NO: 122974 - RNA, 21 nt, Homo sapiens
acccccacaccuccuuaguuc

SEQ ID NO: 122975 - RNA, 17 nt, Homo sapiens
accccuaccucagaagc

SEQ ID NO: 122976 - RNA, 22 nt, Homo sapiens
acccgcccagguguggccggga

SEQ ID NO: 122977 - RNA, 22 nt, Homo sapiens
aguaccauuccguuggagcugg

SEQ ID NO: 122978 - RNA, 22 nt, Homo sapiens
aguagcaauggcucugagcuau

SEQ ID NO: 122979 - RNA, 22 nt, Homo sapiens
aguagcauuggggggcauccuc

SEQ ID NO: 122980 - RNA, 16 nt, Homo sapiens
aguaguuuuacagauu

SEQ ID NO: 122981 - RNA, 22 nt, Homo sapiens
aguaucaagccacacaugguca

SEQ ID NO: 122982 - RNA, 22 nt, Homo sapiens
aguaucacaggcaaaacagaau

SEQ ID NO: 122983 - RNA, 22 nt, Homo sapiens
aguaucacaguggguguauacc

SEQ ID NO: 122984 - RNA, 22 nt, Homo sapiens
aguauguagugcaaucagucag

SEQ ID NO: 122985 - RNA, 22 nt, Homo sapiens
aguauuaggugaguguauuuca

SEQ ID NO: 122986 - RNA, 22 nt, Homo sapiens
aguauuuguuggaauaccuguu

SEQ ID NO: 122987 - RNA, 22 nt, Homo sapiens
agucaagaaucucagcaucuuu

SEQ ID NO: 122988 - RNA, 22 nt, Homo sapiens
agucacagugaccuugucugac

SEQ ID NO: 122989 - RNA, 23 nt, Homo sapiens
agucaguaugcuccuuggauccc

SEQ ID NO: 122990 - RNA, 22 nt, Homo sapiens
agucagugcauaagaaugaagu

SEQ ID NO: 122991 - RNA, 22 nt, Homo sapiens
agucaguggaguaaauguaauu

SEQ ID NO: 122992 - RNA, 22 nt, Homo sapiens
agucagugucuguaaggagaac

SEQ ID NO: 122993 - RNA, 21 nt, Homo sapiens
agucauaggaguacauaaugc

SEQ ID NO: 122994 - RNA, 23 nt, Homo sapiens
agucuguguuuacaggcucucug

SEQ ID NO: 122995 - RNA, 22 nt, Homo sapiens
agugaauguuggaaaguuauuu

SEQ ID NO: 122996 - RNA, 22 nt, Homo sapiens
agugagcugcagucuggggucc

SEQ ID NO: 122997 - RNA, 22 nt, Homo sapiens
agugagcuggagaaaagaaacu

SEQ ID NO: 122998 - RNA, 22 nt, Homo sapiens
agugcaauggcgugaucuuggc

SEQ ID NO: 122999 - RNA, 22 nt, Homo sapiens
agugcaguggcacaaucuuggc

SEQ ID NO: 123000 - RNA, 22 nt, Homo sapiens
agugcaguggugccaucauaac

SEQ ID NO: 123001 - RNA, 22 nt, Homo sapiens
agugcaguugucacgugccuuc

SEQ ID NO: 123002 - RNA, 22 nt, Homo sapiens
agugcauaugucuuuuuggaag

SEQ ID NO: 123003 - RNA, 22 nt, Homo sapiens
agugcauugagacuugugaguu

SEQ ID NO: 123004 - RNA, 22 nt, Homo sapiens
agugcauugcaucucugcuuca

SEQ ID NO: 123005 - RNA, 22 nt, Homo sapiens
agugcauuugcaucucaauaua

SEQ ID NO: 123006 - RNA, 22 nt, Homo sapiens
agugccacugcacucuagccug

SEQ ID NO: 123007 - RNA, 22 nt, Homo sapiens
agugccauggcugcuagauggc

SEQ ID NO: 123008 - RNA, 22 nt, Homo sapiens
agugccuacuauguagaugcug

SEQ ID NO: 123009 - RNA, 22 nt, Homo sapiens
aguggauuuuagacugagauuu

SEQ ID NO: 123010 - RNA, 22 nt, Homo sapiens
aguggcacaauuuugacucccc

SEQ ID NO: 123011 - RNA, 22 nt, Homo sapiens
aguggcacuauucucagaguca

SEQ ID NO: 123012 - RNA, 19 nt, Homo sapiens
aguggguguuuucuguuug

SEQ ID NO: 123013 - RNA, 22 nt, Homo sapiens
agugguguugccuguugaccua

SEQ ID NO: 123014 - RNA, 22 nt, Homo sapiens
agugguuugaucacagcucacu

SEQ ID NO: 123015 - RNA, 22 nt, Homo sapiens
agugucaggagacagguagcug

SEQ ID NO: 123016 - RNA, 22 nt, Homo sapiens
aguucaaugcucuuucuacuau

SEQ ID NO: 123017 - RNA, 22 nt, Homo sapiens
aguucaauggguuuucacucau

SEQ ID NO: 123018 - RNA, 22 nt, Homo sapiens
aguuccauuuauucucgucucu

SEQ ID NO: 123019 - RNA, 22 nt, Homo sapiens
aguuuugguugaguuacuagca

SEQ ID NO: 123020 - RNA, 22 nt, Homo sapiens
auaaacagcuuauccucuauuc

SEQ ID NO: 123021 - RNA, 17 nt, Homo sapiens
auaaacucaucauuuuu

SEQ ID NO: 123022 - RNA, 22 nt, Homo sapiens
auaaacugucaguggagaguaa

SEQ ID NO: 123023 - RNA, 22 nt, Homo sapiens
auaaagcaagucucuggccuca

SEQ ID NO: 123024 - RNA, 22 nt, Homo sapiens
auaaagcuauuccucucuuuuu

SEQ ID NO: 123025 - RNA, 22 nt, Homo sapiens
auaaagguaagcacuauccuga

SEQ ID NO: 123026 - RNA, 22 nt, Homo sapiens
auaaauaguaguugugguggcc

SEQ ID NO: 123027 - RNA, 19 nt, Homo sapiens
auaaaugccuacaagggug

SEQ ID NO: 123028 - RNA, 22 nt, Homo sapiens
auaaaugcuuccagucauuaaa

SEQ ID NO: 123029 - RNA, 22 nt, Homo sapiens
auaacauggaguuugucauuua

SEQ ID NO: 123030 - RNA, 22 nt, Homo sapiens
auaagaagugaaccagacgucu

SEQ ID NO: 123031 - RNA, 22 nt, Homo sapiens
auaaggcugguauagacauuca

SEQ ID NO: 123032 - RNA, 22 nt, Homo sapiens
auaagugagugauucaguguua

SEQ ID NO: 123033 - RNA, 22 nt, Homo sapiens
auaauacuuuuauuuugaggaa

SEQ ID NO: 123034 - RNA, 22 nt, Homo sapiens
auaauagguugauugacauugc

SEQ ID NO: 123035 - RNA, 22 nt, Homo sapiens
auaauaguguuuagauuuggga

SEQ ID NO: 123036 - RNA, 22 nt, Homo sapiens
auaaucacacccagguuaaaug

SEQ ID NO: 123037 - RNA, 22 nt, Homo sapiens
auaaugcuuuucuagguugcau

SEQ ID NO: 123038 - RNA, 22 nt, Homo sapiens
auacaagcaguccaacuccaua

SEQ ID NO: 123039 - RNA, 22 nt, Homo sapiens
auacaagugccauguuggugug

SEQ ID NO: 123040 - RNA, 22 nt, Homo sapiens
auacacgugcagaacaugcagg

SEQ ID NO: 123041 - RNA, 22 nt, Homo sapiens
auacacuggagcaaaccuggag

SEQ ID NO: 123042 - RNA, 22 nt, Homo sapiens
auacaguaaugucuuaggcugu

SEQ ID NO: 123043 - RNA, 22 nt, Homo sapiens
auacaguaucuucuggcaagca

SEQ ID NO: 123044 - RNA, 22 nt, Homo sapiens
auacagugaauacuuacagugu

SEQ ID NO: 123045 - RNA, 22 nt, Homo sapiens
auacaguugccauuucuugugc

SEQ ID NO: 123046 - RNA, 22 nt, Homo sapiens
auacaugcauuugcacgagagu

SEQ ID NO: 123047 - RNA, 22 nt, Homo sapiens
auacaugugccaugcuggugug

SEQ ID NO: 123048 - RNA, 22 nt, Homo sapiens
auacaugugccauguugguaug

SEQ ID NO: 123049 - RNA, 22 nt, Homo sapiens
auacccaguaguggaauugcua

SEQ ID NO: 123050 - RNA, 20 nt, Homo sapiens
auagaagacuagugcagcag

SEQ ID NO: 123051 - RNA, 22 nt, Homo sapiens
auagaagcuauguauaggggcc

SEQ ID NO: 123052 - RNA, 22 nt, Homo sapiens
auagagcuggcagacacccuua

SEQ ID NO: 123053 - RNA, 22 nt, Homo sapiens
auagauucauuugaggagauuu

SEQ ID NO: 123054 - RNA, 22 nt, Homo sapiens
auagcaaugccccaauccuugg

SEQ ID NO: 123055 - RNA, 22 nt, Homo sapiens
auagcaauuugggaaucagacu

SEQ ID NO: 123056 - RNA, 22 nt, Homo sapiens
auagcacacuauagcuucaaac

SEQ ID NO: 123057 - RNA, 22 nt, Homo sapiens
auagcagcaccccacuaccuca

SEQ ID NO: 123058 - RNA, 22 nt, Homo sapiens
auagcagugucccacuccuugg

SEQ ID NO: 123059 - RNA, 22 nt, Homo sapiens
auagcagugugagaaugaacua

SEQ ID NO: 123060 - RNA, 22 nt, Homo sapiens
auagcauagucagcuucgcuga

SEQ ID NO: 123061 - RNA, 22 nt, Homo sapiens
auagcccauuuguugguccugg

SEQ ID NO: 123062 - RNA, 22 nt, Homo sapiens
auagccucauucuucagaugag

SEQ ID NO: 123063 - RNA, 22 nt, Homo sapiens
auagcugcucaggcuuuccuca

SEQ ID NO: 123064 - RNA, 19 nt, Homo sapiens
auagggcuagcauauacug

SEQ ID NO: 123065 - RNA, 22 nt, Homo sapiens
auagugaacuuugugagaacaa

SEQ ID NO: 123066 - RNA, 22 nt, Homo sapiens
auagugcuauggcagaccuuga

SEQ ID NO: 123067 - RNA, 22 nt, Homo sapiens
auagugcugcaauaaacauacg

SEQ ID NO: 123068 - RNA, 19 nt, Homo sapiens
augaguuaggggaaauuuc

SEQ ID NO: 123069 - RNA, 22 nt, Homo sapiens
augaguuccuuccuugccuagg

SEQ ID NO: 123070 - RNA, 22 nt, Homo sapiens
augauacugaguugaguucuca

SEQ ID NO: 123071 - RNA, 22 nt, Homo sapiens
augauacuguucuaagauuuuu

SEQ ID NO: 123072 - RNA, 22 nt, Homo sapiens
augauauguuuguagcuaucuc

SEQ ID NO: 123073 - RNA, 22 nt, Homo sapiens
augauauuauucuagcccagag

SEQ ID NO: 123074 - RNA, 22 nt, Homo sapiens
augaugcaguacuuugggaaca

SEQ ID NO: 123075 - RNA, 22 nt, Homo sapiens
augauggaggccgugauggacg

SEQ ID NO: 123076 - RNA, 22 nt, Homo sapiens
augauggagguagauuguccau

SEQ ID NO: 123077 - RNA, 22 nt, Homo sapiens
augauguguguuuaagaugucu

SEQ ID NO: 123078 - RNA, 22 nt, Homo sapiens
augauugaccaucugcugggcu

SEQ ID NO: 123079 - RNA, 22 nt, Homo sapiens
augcaaacaucauagaguguac

SEQ ID NO: 123080 - RNA, 22 nt, Homo sapiens
augcaaacaucugaagagacau

SEQ ID NO: 123081 - RNA, 20 nt, Homo sapiens
augcaaacccugcuuugugg

SEQ ID NO: 123082 - RNA, 22 nt, Homo sapiens
augcaagaaauaucucuuuuuc

SEQ ID NO: 123083 - RNA, 19 nt, Homo sapiens
augcaaugucacaggcugc

SEQ ID NO: 123084 - RNA, 22 nt, Homo sapiens
augcacuguuuucuugaugaga

SEQ ID NO: 123085 - RNA, 22 nt, Homo sapiens
augcagugugcaacagauuaag

SEQ ID NO: 123086 - RNA, 22 nt, Homo sapiens
augcauagugggaugcucugug

SEQ ID NO: 123087 - RNA, 18 nt, Homo sapiens
augcauauuuuaaguugu

SEQ ID NO: 123088 - RNA, 22 nt, Homo sapiens
augccaagagacaaagggaauc

SEQ ID NO: 123089 - RNA, 22 nt, Homo sapiens
augccacugcacucuagccugg

SEQ ID NO: 123090 - RNA, 22 nt, Homo sapiens
augccacugcacuucagccugg

SEQ ID NO: 123091 - RNA, 22 nt, Homo sapiens
augccagggagaauuguucaag

SEQ ID NO: 123092 - RNA, 22 nt, Homo sapiens
augccauugcacuccagccugg

SEQ ID NO: 123093 - RNA, 19 nt, Homo sapiens
augccuggagaugguuaua

SEQ ID NO: 123094 - RNA, 22 nt, Homo sapiens
auggaaacauaagaguauagau

SEQ ID NO: 123095 - RNA, 22 nt, Homo sapiens
auggaaaugaagggcuggcccu

SEQ ID NO: 123096 - RNA, 22 nt, Homo sapiens
auggaacauuauagauguaaaa

SEQ ID NO: 123097 - RNA, 22 nt, Homo sapiens
auggaacuggagaugguuauau

SEQ ID NO: 123098 - RNA, 22 nt, Homo sapiens
auggaaugguugggucauaagg

SEQ ID NO: 123099 - RNA, 21 nt, Homo sapiens
auggacaugguuaggcuuugu

SEQ ID NO: 123100 - RNA, 22 nt, Homo sapiens
auggagagaauuauucucucag

SEQ ID NO: 123101 - RNA, 22 nt, Homo sapiens
auggagaugaauaucaucuguu

SEQ ID NO: 123102 - RNA, 22 nt, Homo sapiens
auggaggacaaugucaccuuca

SEQ ID NO: 123103 - RNA, 22 nt, Homo sapiens
auggagguguggggagugaguu

SEQ ID NO: 123104 - RNA, 22 nt, Homo sapiens
auggauaugcuuccaacugccu

SEQ ID NO: 123105 - RNA, 22 nt, Homo sapiens
auggcaauguaagucagaaaaa

SEQ ID NO: 123106 - RNA, 22 nt, Homo sapiens
auggcacugauggaaguaccuu

SEQ ID NO: 123107 - RNA, 22 nt, Homo sapiens
auggcacugccuggcuucaugg

SEQ ID NO: 123108 - RNA, 18 nt, Homo sapiens
auggcagaacaauuuaca

SEQ ID NO: 123109 - RNA, 22 nt, Homo sapiens
auggcagcaccccacucuacug

SEQ ID NO: 123110 - RNA, 22 nt, Homo sapiens
auggcagcccucuuuauccaug

SEQ ID NO: 123111 - RNA, 22 nt, Homo sapiens
auggcagcugacacuuccgucu

SEQ ID NO: 123112 - RNA, 22 nt, Homo sapiens
auggcaguuucacucugggauu

SEQ ID NO: 123113 - RNA, 22 nt, Homo sapiens
auggcauggugaagucuuugga

SEQ ID NO: 123114 - RNA, 22 nt, Homo sapiens
auggcauggugcaggguuuaag

SEQ ID NO: 123115 - RNA, 22 nt, Homo sapiens
auggcauugaagaguugucccu

SEQ ID NO: 123116 - RNA, 22 nt, Homo sapiens
auggcccaguuugcuaucccua

SEQ ID NO: 123117 - RNA, 22 nt, Homo sapiens
auggcccccuguuugugaacau

SEQ ID NO: 123118 - RNA, 22 nt, Homo sapiens
auggcccugcuaccacuuuucu

SEQ ID NO: 123119 - RNA, 20 nt, Homo sapiens
auggcccugcugggaguguc

SEQ ID NO: 123120 - RNA, 22 nt, Homo sapiens
auggcccugggaaaggaggcau

SEQ ID NO: 123121 - RNA, 23 nt, Homo sapiens
auggcccuggugggagugucuuu

SEQ ID NO: 123122 - RNA, 22 nt, Homo sapiens
auggccuuguauaccuggcaaa

SEQ ID NO: 123123 - RNA, 22 nt, Homo sapiens
auggcucuggauagaaugcagg

SEQ ID NO: 123124 - RNA, 22 nt, Homo sapiens
auggcucuguuccaugugucuu

SEQ ID NO: 123125 - RNA, 22 nt, Homo sapiens
auggcuucuucuaaaagugggg

SEQ ID NO: 123126 - RNA, 22 nt, Homo sapiens
auggcuugugacccaugcuuca

SEQ ID NO: 123127 - RNA, 22 nt, Homo sapiens
auggcuuuuauuguguugaggu

SEQ ID NO: 123128 - RNA, 22 nt, Homo sapiens
auggcuuuugaccugguaggau

SEQ ID NO: 123129 - RNA, 22 nt, Homo sapiens
augggauaguaucaguggaaua

SEQ ID NO: 123130 - RNA, 22 nt, Homo sapiens
augggucuccugaauacagcac

SEQ ID NO: 123131 - RNA, 22 nt, Homo sapiens
augguagacucucgggucaugg

SEQ ID NO: 123132 - RNA, 22 nt, Homo sapiens
auggucccauucauucacguau

SEQ ID NO: 123133 - RNA, 22 nt, Homo sapiens
auggucccuguuccaugcuccu

SEQ ID NO: 123134 - RNA, 22 nt, Homo sapiens
auggucuuuauuguguugagug

SEQ ID NO: 123135 - RNA, 22 nt, Homo sapiens
auggugugugaauuaaauguua

SEQ ID NO: 123136 - RNA, 22 nt, Homo sapiens
augguugguuaaaucuguguau

SEQ ID NO: 123137 - RNA, 22 nt, Homo sapiens
augguuuuacugcaaaauggga

SEQ ID NO: 123138 - RNA, 22 nt, Homo sapiens
auguaaacauuuggucuaaauu

SEQ ID NO: 123139 - RNA, 22 nt, Homo sapiens
auguaagugugcucaaauguua

SEQ ID NO: 123140 - RNA, 22 nt, Homo sapiens
auguaguagauauuuauggaaa

SEQ ID NO: 123141 - RNA, 22 nt, Homo sapiens
auguaguagcagaaaauauuuu

SEQ ID NO: 123142 - RNA, 22 nt, Homo sapiens
auguauggagauauuuuugguu

SEQ ID NO: 123143 - RNA, 22 nt, Homo sapiens
augucaacauagacaguagagu

SEQ ID NO: 123144 - RNA, 22 nt, Homo sapiens
augucacugcacuccugccugg

SEQ ID NO: 123145 - RNA, 20 nt, Homo sapiens
augucagaguguggguacgg

SEQ ID NO: 123146 - RNA, 22 nt, Homo sapiens
augucuggcagaagacuucuca

SEQ ID NO: 123147 - RNA, 22 nt, Homo sapiens
augugaaugugaucggauaguc

SEQ ID NO: 123148 - RNA, 22 nt, Homo sapiens
augugacagugguuuuaagcgu

SEQ ID NO: 123149 - RNA, 22 nt, Homo sapiens
augugacuuuuuccugugccuu

SEQ ID NO: 123150 - RNA, 22 nt, Homo sapiens
augugcaaauuuccaaacucuu

SEQ ID NO: 123151 - RNA, 18 nt, Homo sapiens
augugcaauuuuguauuu

SEQ ID NO: 123152 - RNA, 22 nt, Homo sapiens
augugcagauguuacaaauugu

SEQ ID NO: 123153 - RNA, 22 nt, Homo sapiens
augugccauucucauggcgcuu

SEQ ID NO: 123154 - RNA, 22 nt, Homo sapiens
augugcuuauagguguauguuu

SEQ ID NO: 123155 - RNA, 22 nt, Homo sapiens
auguggcacuugacuuucucgc

SEQ ID NO: 123156 - RNA, 22 nt, Homo sapiens
augugguaggcccaugagucau

SEQ ID NO: 123157 - RNA, 19 nt, Homo sapiens
augugguuagcaugacugc

SEQ ID NO: 123158 - RNA, 22 nt, Homo sapiens
auguguauuaccucgauuguga

SEQ ID NO: 123159 - RNA, 17 nt, Homo sapiens
uaaagccagucaaguca

SEQ ID NO: 123160 - RNA, 16 nt, Homo sapiens
uaaagcuaaucacuuu

SEQ ID NO: 123161 - RNA, 22 nt, Homo sapiens
uaaagcuagagcuggaguggca

SEQ ID NO: 123162 - RNA, 22 nt, Homo sapiens
uaaagcuuagauccaugguggc

SEQ ID NO: 123163 - RNA, 22 nt, Homo sapiens
uaaagugcugagaugaggcugg

SEQ ID NO: 123164 - RNA, 22 nt, Homo sapiens
uaacaacauucuaacugacggc

SEQ ID NO: 123165 - RNA, 18 nt, Homo sapiens
uaacagucucucaggauc

SEQ ID NO: 123166 - RNA, 23 nt, Homo sapiens
uaacauugcaugauuaccugcau

SEQ ID NO: 123167 - RNA, 22 nt, Homo sapiens
uaacauugcuggacuaccugcu

SEQ ID NO: 123168 - RNA, 22 nt, Homo sapiens
uaacauuguugauuauacuaag

SEQ ID NO: 123169 - RNA, 22 nt, Homo sapiens
uaacuacuucugcuucagagua

SEQ ID NO: 123170 - RNA, 22 nt, Homo sapiens
uaacuucaucauaagucaagaa

SEQ ID NO: 123171 - RNA, 20 nt, Homo sapiens
uaagacaugguccacaugcc

SEQ ID NO: 123172 - RNA, 21 nt, Homo sapiens
uaagacugccaguagggcugu

SEQ ID NO: 123173 - RNA, 22 nt, Homo sapiens
uaagagagcuccaucuuuuccu

SEQ ID NO: 123174 - RNA, 22 nt, Homo sapiens
uaaggauuuuggugauuacacu

SEQ ID NO: 123175 - RNA, 22 nt, Homo sapiens
uaaggcaaucagucaugguguu

SEQ ID NO: 123176 - RNA, 22 nt, Homo sapiens
uaaggcccggccuuuccaagca

SEQ ID NO: 123177 - RNA, 22 nt, Homo sapiens
uaaggcuugaucuuggugagau

SEQ ID NO: 123178 - RNA, 22 nt, Homo sapiens
uaaggcuugcuucagucuugaa

SEQ ID NO: 123179 - RNA, 22 nt, Homo sapiens
uaaguagaggaaucauuuugug

SEQ ID NO: 123180 - RNA, 22 nt, Homo sapiens
uaaguaguguugagacaaguuu

SEQ ID NO: 123181 - RNA, 22 nt, Homo sapiens
uaaguauuaugugcugcauuuu

SEQ ID NO: 123182 - RNA, 22 nt, Homo sapiens
uaagugaauauggacaguuagc

SEQ ID NO: 123183 - RNA, 22 nt, Homo sapiens
uaagugcaugauuacaugcaua

SEQ ID NO: 123184 - RNA, 20 nt, Homo sapiens
uaagugcuugaugaaugaac

SEQ ID NO: 123185 - RNA, 22 nt, Homo sapiens
uaaguguaaugucugaaguuug

SEQ ID NO: 123186 - RNA, 18 nt, Homo sapiens
uaauaacugugaccuuga

SEQ ID NO: 123187 - RNA, 22 nt, Homo sapiens
uaauaauguuaggcuuacucaa

SEQ ID NO: 123188 - RNA, 22 nt, Homo sapiens
uaauacuagugaauagcaggau

SEQ ID NO: 123189 - RNA, 22 nt, Homo sapiens
uaauagcucggauaaacaugau

SEQ ID NO: 123190 - RNA, 22 nt, Homo sapiens
uaauaguuucagaaguuguuuu

SEQ ID NO: 123191 - RNA, 22 nt, Homo sapiens
uaaugcaucaugguuggcaaac

SEQ ID NO: 123192 - RNA, 22 nt, Homo sapiens
uaaugcuguggucugguuuaaa

SEQ ID NO: 123193 - RNA, 22 nt, Homo sapiens
uaaugcuugguuguuuggaaaa

SEQ ID NO: 123194 - RNA, 22 nt, Homo sapiens
uaaugugcuucucuaccauagg

SEQ ID NO: 123195 - RNA, 22 nt, Homo sapiens
uaauucacauaaagcacuuaga

SEQ ID NO: 123196 - RNA, 22 nt, Homo sapiens
uaauugcaguucuguguuauau

SEQ ID NO: 123197 - RNA, 22 nt, Homo sapiens
uacaaagcuuugaugugucuuu

SEQ ID NO: 123198 - RNA, 22 nt, Homo sapiens
uacaaaguaacaguuccuguau

SEQ ID NO: 123199 - RNA, 22 nt, Homo sapiens
uacaaaucuagguuuguuacug

SEQ ID NO: 123200 - RNA, 22 nt, Homo sapiens
uacaagcacaggcagcaggcug

SEQ ID NO: 123201 - RNA, 22 nt, Homo sapiens
uacaaguaauaagggaagaauu

SEQ ID NO: 123202 - RNA, 22 nt, Homo sapiens
uacacacguguguauauauaca

SEQ ID NO: 123203 - RNA, 22 nt, Homo sapiens
uacaccugaguuugugguuuuc

SEQ ID NO: 123204 - RNA, 22 nt, Homo sapiens
uacagaauugcagguguggcag

SEQ ID NO: 123205 - RNA, 22 nt, Homo sapiens
uacagaguauccauuugaguuc

SEQ ID NO: 123206 - RNA, 22 nt, Homo sapiens
uacaggcaccuggcuaauuuuu

SEQ ID NO: 123207 - RNA, 22 nt, Homo sapiens
uacaguacagugacaccauuau

SEQ ID NO: 123208 - RNA, 22 nt, Homo sapiens
uacaguagaaugucuuucaaaa

SEQ ID NO: 123209 - RNA, 22 nt, Homo sapiens
uacaguagagaucagcaaacua

SEQ ID NO: 123210 - RNA, 22 nt, Homo sapiens
uacagugggcacuggcgcccug

SEQ ID NO: 123211 - RNA, 22 nt, Homo sapiens
uacaguggugugaucucagcuc

SEQ ID NO: 123212 - RNA, 22 nt, Homo sapiens
uacauaguaagcacuaugccaa

SEQ ID NO: 123213 - RNA, 19 nt, Homo sapiens
uacauaguauuuaguggca

SEQ ID NO: 123214 - RNA, 22 nt, Homo sapiens
uacauagucuucuuuugguuau

SEQ ID NO: 123215 - RNA, 22 nt, Homo sapiens
uacaucagccugaaagagcucg

SEQ ID NO: 123216 - RNA, 19 nt, Homo sapiens
uacaugcagcaggcacgca

SEQ ID NO: 123217 - RNA, 22 nt, Homo sapiens
uacauguauguguuuauggcug

SEQ ID NO: 123218 - RNA, 22 nt, Homo sapiens
uacaugugcacaacgugcaggu

SEQ ID NO: 123219 - RNA, 22 nt, Homo sapiens
uacaugugccauguugguuugc

SEQ ID NO: 123220 - RNA, 22 nt, Homo sapiens
uacauugucauauucucucucu

SEQ ID NO: 123221 - RNA, 22 nt, Homo sapiens
uaccacaggcuggguaaucuau

SEQ ID NO: 123222 - RNA, 22 nt, Homo sapiens
uaccacagucauuacacuugua

SEQ ID NO: 123223 - RNA, 22 nt, Homo sapiens
uaccaguaaugguucuagagga

SEQ ID NO: 123224 - RNA, 22 nt, Homo sapiens
uaccagugucagcuuccugugu

SEQ ID NO: 123225 - RNA, 22 nt, Homo sapiens
uaccauguaucugggaugcuuu

SEQ ID NO: 123226 - RNA, 22 nt, Homo sapiens
uaccauguauguuucuccauug

SEQ ID NO: 123227 - RNA, 22 nt, Homo sapiens
uacccaguaacaaguauuuugg

SEQ ID NO: 123228 - RNA, 22 nt, Homo sapiens
uaccugagaaagaaagcccucg

SEQ ID NO: 123229 - RNA, 22 nt, Homo sapiens
uaccuuugucaguuacucaccu

SEQ ID NO: 123230 - RNA, 22 nt, Homo sapiens
uacuaguaagggugguuuggcu

SEQ ID NO: 123231 - RNA, 22 nt, Homo sapiens
uacucugcagagaugcauaaca

SEQ ID NO: 123232 - RNA, 22 nt, Homo sapiens
uacucugcaguaauuccagccc

SEQ ID NO: 123233 - RNA, 22 nt, Homo sapiens
uacucuuuagcuccuuaaggaa

SEQ ID NO: 123234 - RNA, 19 nt, Homo sapiens
uacugcaccucaaccuggg

SEQ ID NO: 123235 - RNA, 22 nt, Homo sapiens
uacugcacuccagccugggaga

SEQ ID NO: 123236 - RNA, 20 nt, Homo sapiens
uacugcacuuuccucauggu

SEQ ID NO: 123237 - RNA, 22 nt, Homo sapiens
uacugcaguugcagcuugagga

SEQ ID NO: 123238 - RNA, 22 nt, Homo sapiens
uacugcaucgaaaugcuuuuau

SEQ ID NO: 123239 - RNA, 22 nt, Homo sapiens
uacugcauuccaaucugggcga

SEQ ID NO: 123240 - RNA, 22 nt, Homo sapiens
uacugcugucagugccaaguag

SEQ ID NO: 123241 - RNA, 22 nt, Homo sapiens
uacuguguaguuagaccucaga

SEQ ID NO: 123242 - RNA, 22 nt, Homo sapiens
uagaagcugagaauguccucag

SEQ ID NO: 123243 - RNA, 22 nt, Homo sapiens
uagaaucuaacucgcaugaaaa

SEQ ID NO: 123244 - RNA, 22 nt, Homo sapiens
uagaauggaagguugagaagaa

SEQ ID NO: 123245 - RNA, 22 nt, Homo sapiens
uagaaugucagcuucuugaggg

SEQ ID NO: 123246 - RNA, 22 nt, Homo sapiens
uagacuguaagauccaggagag

SEQ ID NO: 123247 - RNA, 22 nt, Homo sapiens
uagagcacagugauuagaccua

SEQ ID NO: 123248 - RNA, 22 nt, Homo sapiens
uagagcuugacacuuuccaugg

SEQ ID NO: 123249 - RNA, 22 nt, Homo sapiens
uagaggaaugaauuuggccaga

SEQ ID NO: 123250 - RNA, 22 nt, Homo sapiens
ucacuuuggguacuauggaaau

SEQ ID NO: 123251 - RNA, 21 nt, Homo sapiens
ucagaagcucccagggaggac

SEQ ID NO: 123252 - RNA, 22 nt, Homo sapiens
ucagaauguaacuuuaguugga

SEQ ID NO: 123253 - RNA, 22 nt, Homo sapiens
ucagaccauuucauuacagacu

SEQ ID NO: 123254 - RNA, 22 nt, Homo sapiens
ucagaguagaaacacuuccaua

SEQ ID NO: 123255 - RNA, 22 nt, Homo sapiens
ucagauacuggugacaugaaug

SEQ ID NO: 123256 - RNA, 22 nt, Homo sapiens
ucagaucauauucuucgcugcu

SEQ ID NO: 123257 - RNA, 22 nt, Homo sapiens
ucagaucauuaagguagguuua

SEQ ID NO: 123258 - RNA, 22 nt, Homo sapiens
ucagaugauuccguugacgaga

SEQ ID NO: 123259 - RNA, 22 nt, Homo sapiens
ucagaugcauccauaccccacu

SEQ ID NO: 123260 - RNA, 19 nt, Homo sapiens
ucagaugcauuagggguua

SEQ ID NO: 123261 - RNA, 22 nt, Homo sapiens
ucagcaaugaccuaagcaaaua

SEQ ID NO: 123262 - RNA, 22 nt, Homo sapiens
ucagcacauucaaggccugccu

SEQ ID NO: 123263 - RNA, 22 nt, Homo sapiens
ucagcagugugaaaacaaacua

SEQ ID NO: 123264 - RNA, 22 nt, Homo sapiens
ucagcgcauggucgugcggcau

SEQ ID NO: 123265 - RNA, 21 nt, Homo sapiens
ucagcucaucacugccuggag

SEQ ID NO: 123266 - RNA, 21 nt, Homo sapiens
ucagggaccugcuguacugau

SEQ ID NO: 123267 - RNA, 20 nt, Homo sapiens
ucagguagaucuuugagguc

SEQ ID NO: 123268 - RNA, 22 nt, Homo sapiens
ucagguaguuugugggagauga

SEQ ID NO: 123269 - RNA, 22 nt, Homo sapiens
ucagguaucuucauagcaaugc

SEQ ID NO: 123270 - RNA, 22 nt, Homo sapiens
ucaggugcagagaagaaauggg

SEQ ID NO: 123271 - RNA, 22 nt, Homo sapiens
ucaggugcaguggcucaugcuu

SEQ ID NO: 123272 - RNA, 22 nt, Homo sapiens
ucaggugcaguggcucugaccu

SEQ ID NO: 123273 - RNA, 22 nt, Homo sapiens
ucaggugccuuggcuaauuguu

SEQ ID NO: 123274 - RNA, 22 nt, Homo sapiens
ucaguagagacaggauuucacc

SEQ ID NO: 123275 - RNA, 22 nt, Homo sapiens
ucaguagcaugaaaacagacua

SEQ ID NO: 123276 - RNA, 22 nt, Homo sapiens
ucagucauugauggaguagguc

SEQ ID NO: 123277 - RNA, 22 nt, Homo sapiens
ucagucuuuuuuuggcaagcau

SEQ ID NO: 123278 - RNA, 22 nt, Homo sapiens
ucagugaauauauaacagcgau

SEQ ID NO: 123279 - RNA, 22 nt, Homo sapiens
ucagugauugcuuucauggaaa

SEQ ID NO: 123280 - RNA, 20 nt, Homo sapiens
ucagugcagauuguccaagu

SEQ ID NO: 123281 - RNA, 22 nt, Homo sapiens
ucagugcaggaaucucuagcca

SEQ ID NO: 123282 - RNA, 17 nt, Homo sapiens
ucagugcauuuaagaga

SEQ ID NO: 123283 - RNA, 22 nt, Homo sapiens
ucaguggagcuacaauucuggg

SEQ ID NO: 123284 - RNA, 22 nt, Homo sapiens
ucaguggauuuaaccugaauca

SEQ ID NO: 123285 - RNA, 22 nt, Homo sapiens
ucaguguuuuauccuccagagc

SEQ ID NO: 123286 - RNA, 22 nt, Homo sapiens
ucaguucauggaggugucugcu

SEQ ID NO: 123287 - RNA, 22 nt, Homo sapiens
ucaguuuguauuucagguugca

SEQ ID NO: 123288 - RNA, 22 nt, Homo sapiens
ucauacaggccaccagggaagu

SEQ ID NO: 123289 - RNA, 22 nt, Homo sapiens
ucauacuguuaaaugguuuagu

SEQ ID NO: 123290 - RNA, 18 nt, Homo sapiens
ucauagaucaugacagug

SEQ ID NO: 123291 - RNA, 20 nt, Homo sapiens
ucauagggugguggcagugg

SEQ ID NO: 123292 - RNA, 22 nt, Homo sapiens
ucauaggucugagaagaaaaua

SEQ ID NO: 123293 - RNA, 16 nt, Homo sapiens
ucauaguaucucuucu

SEQ ID NO: 123294 - RNA, 22 nt, Homo sapiens
ucauauguaugugcaauuuugu

SEQ ID NO: 123295 - RNA, 23 nt, Homo sapiens
ucaucacagcauuuccugguauu

SEQ ID NO: 123296 - RNA, 21 nt, Homo sapiens
ucaucagucaaagacaauggu

SEQ ID NO: 123297 - RNA, 20 nt, Homo sapiens
ucaucaguuggugcucgcug

SEQ ID NO: 123298 - RNA, 22 nt, Homo sapiens
ucaucaguuuuuuauaugugau

SEQ ID NO: 123299 - RNA, 22 nt, Homo sapiens
ucaucuggcgaaugugaagagu

SEQ ID NO: 123300 - RNA, 22 nt, Homo sapiens
ucaugcaaugagucaggaggca

SEQ ID NO: 123301 - RNA, 22 nt, Homo sapiens
ucauggcuuuuauuauguugag

SEQ ID NO: 123302 - RNA, 22 nt, Homo sapiens
ucaugugagcaaguugggcuca

SEQ ID NO: 123303 - RNA, 22 nt, Homo sapiens
ucauguguugcacugaggaccu

SEQ ID NO: 123304 - RNA, 22 nt, Homo sapiens
ucauuagucaccuagccagcuu

SEQ ID NO: 123305 - RNA, 22 nt, Homo sapiens
ucauugguucuggguguuguug

SEQ ID NO: 123306 - RNA, 22 nt, Homo sapiens
uccacaguggugaggugcagca

SEQ ID NO: 123307 - RNA, 22 nt, Homo sapiens
uccacagugguggaauuguuca

SEQ ID NO: 123308 - RNA, 19 nt, Homo sapiens
uccacagugguugaacuag

SEQ ID NO: 123309 - RNA, 22 nt, Homo sapiens
uccaccgugggcugcggggcuc

SEQ ID NO: 123310 - RNA, 22 nt, Homo sapiens
uccacugagcuagaccacuugg

SEQ ID NO: 123311 - RNA, 22 nt, Homo sapiens
uccagguacucagggggcugag

SEQ ID NO: 123312 - RNA, 22 nt, Homo sapiens
uccaguacaggucucucauuuc

SEQ ID NO: 123313 - RNA, 22 nt, Homo sapiens
uccaguggacagacauaccaug

SEQ ID NO: 123314 - RNA, 22 nt, Homo sapiens
uccaguguuccucagucacccc

SEQ ID NO: 123315 - RNA, 22 nt, Homo sapiens
uccaguguuucuuccacuauuu

SEQ ID NO: 123316 - RNA, 22 nt, Homo sapiens
uccaguuguuauuuuuauaaag

SEQ ID NO: 123317 - RNA, 22 nt, Homo sapiens
uccauaguacuagaaacugacc

SEQ ID NO: 123318 - RNA, 22 nt, Homo sapiens
uccauguagaagacaggggaga

SEQ ID NO: 123319 - RNA, 22 nt, Homo sapiens
uccauugucuagauguaacaca

SEQ ID NO: 123320 - RNA, 18 nt, Homo sapiens
uccauuuguaugggaugg

SEQ ID NO: 123321 - RNA, 22 nt, Homo sapiens
uccauuugucuauguuucuguu

SEQ ID NO: 123322 - RNA, 22 nt, Homo sapiens
ucccagaaacgcauauguucau

SEQ ID NO: 123323 - RNA, 22 nt, Homo sapiens
ucccagugaaaccccaccuuca

SEQ ID NO: 123324 - RNA, 17 nt, Homo sapiens
ucccauguuucuucuac

SEQ ID NO: 123325 - RNA, 22 nt, Homo sapiens
uccccugagaccccucagcacu

SEQ ID NO: 123326 - RNA, 22 nt, Homo sapiens
uccccugauaccaaccaccaug

SEQ ID NO: 123327 - RNA, 22 nt, Homo sapiens
ucccgaggacaucugggggcaa

SEQ ID NO: 123328 - RNA, 22 nt, Homo sapiens
ucccuagagaagugauuuuuga

SEQ ID NO: 123329 - RNA, 22 nt, Homo sapiens
ucccugacagggucugagcuuu

SEQ ID NO: 123330 - RNA, 22 nt, Homo sapiens
ucccuggagcaagagaagaagg

SEQ ID NO: 123331 - RNA, 22 nt, Homo sapiens
ucccuugagccuggcuucucac

SEQ ID NO: 123332 - RNA, 22 nt, Homo sapiens
uccucauggagaaccucugcua

SEQ ID NO: 123333 - RNA, 22 nt, Homo sapiens
uccucugaacuccagacccaua

SEQ ID NO: 123334 - RNA, 22 nt, Homo sapiens
uccugagacucacaggcucccc

SEQ ID NO: 123335 - RNA, 22 nt, Homo sapiens
uccugagacugaggagcuuugg

SEQ ID NO: 123336 - RNA, 22 nt, Homo sapiens
uccugagagcagacccucuaua

SEQ ID NO: 123337 - RNA, 22 nt, Homo sapiens
uccuucacucuacaucuuuguu

SEQ ID NO: 123338 - RNA, 22 nt, Homo sapiens
uccuucaguccaguggguuuug

SEQ ID NO: 123339 - RNA, 22 nt, Homo sapiens
uccuugagucuuugcucagaug

SEQ ID NO: 123340 - RNA, 22 nt, Homo sapiens
uccuuggucaaaaagaaagugu

SEQ ID NO: 123341 - RNA, 22 nt, Homo sapiens
ugagauggaucuuggauuugaa

SEQ ID NO: 123342 - RNA, 22 nt, Homo sapiens
ugagauggcugaauucagaaua

SEQ ID NO: 123343 - RNA, 23 nt, Homo sapiens
ugagauuacccagaaagaguaua

SEQ ID NO: 123344 - RNA, 21 nt, Homo sapiens
ugagauuauauuaacauggua

SEQ ID NO: 123345 - RNA, 22 nt, Homo sapiens
ugagauuaucuguacauaggag

SEQ ID NO: 123346 - RNA, 22 nt, Homo sapiens
ugagauuaucuugaucuugaaa

SEQ ID NO: 123347 - RNA, 22 nt, Homo sapiens
ugagcaauaaaguuacacaguu

SEQ ID NO: 123348 - RNA, 22 nt, Homo sapiens
ugagcagaaagcugcaaggucg

SEQ ID NO: 123349 - RNA, 22 nt, Homo sapiens
ugagcagagaucacggcauugu

SEQ ID NO: 123350 - RNA, 22 nt, Homo sapiens
ugagccaaguucacaccauugc

SEQ ID NO: 123351 - RNA, 20 nt, Homo sapiens
ugagccccuggacucaagcg

SEQ ID NO: 123352 - RNA, 22 nt, Homo sapiens
ugagcuaggaucacaccugcau

SEQ ID NO: 123353 - RNA, 22 nt, Homo sapiens
ugagcucagcuaguugaggugu

SEQ ID NO: 123354 - RNA, 20 nt, Homo sapiens
ugagcucaugacauuuuucu

SEQ ID NO: 123355 - RNA, 22 nt, Homo sapiens
ugagcuccuucauaaaaaggca

SEQ ID NO: 123356 - RNA, 22 nt, Homo sapiens
ugagcugagaucacacuacugu

SEQ ID NO: 123357 - RNA, 22 nt, Homo sapiens
ugagcugagaucgugccauugu

SEQ ID NO: 123358 - RNA, 22 nt, Homo sapiens
ugagcugagauuaagcugcugc

SEQ ID NO: 123359 - RNA, 18 nt, Homo sapiens
ugaggaaaggguuugcua

SEQ ID NO: 123360 - RNA, 22 nt, Homo sapiens
ugaggcaaggcugaaugaaggc

SEQ ID NO: 123361 - RNA, 17 nt, Homo sapiens
ugaggcacuaguaucac

SEQ ID NO: 123362 - RNA, 22 nt, Homo sapiens
ugaggcuaggauaggcugauuc

SEQ ID NO: 123363 - RNA, 22 nt, Homo sapiens
ugaggcuagucagaucagauga

SEQ ID NO: 123364 - RNA, 22 nt, Homo sapiens
ugagggaugccugguuuguuuu

SEQ ID NO: 123365 - RNA, 22 nt, Homo sapiens
ugagguaaugcuguagcuguga

SEQ ID NO: 123366 - RNA, 22 nt, Homo sapiens
ugagguacaacauggacugaag

SEQ ID NO: 123367 - RNA, 22 nt, Homo sapiens
ugagguagaaugauucuaauau

SEQ ID NO: 123368 - RNA, 22 nt, Homo sapiens
ugagguaggugaagaaugcacg

SEQ ID NO: 123369 - RNA, 19 nt, Homo sapiens
ugagguauuuguugggaga

SEQ ID NO: 123370 - RNA, 21 nt, Homo sapiens
ugaggucaugaugcugcuucc

SEQ ID NO: 123371 - RNA, 22 nt, Homo sapiens
ugaggucauguucugucagguu

SEQ ID NO: 123372 - RNA, 20 nt, Homo sapiens
ugaggucugagaaagaauga

SEQ ID NO: 123373 - RNA, 22 nt, Homo sapiens
ugaggugagggguuaggugcua

SEQ ID NO: 123374 - RNA, 22 nt, Homo sapiens
ugagguguauugggggaaauuc

SEQ ID NO: 123375 - RNA, 22 nt, Homo sapiens
ugagguguuaacuuuacuuuua

SEQ ID NO: 123376 - RNA, 19 nt, Homo sapiens
ugaguauauuguauucauu

SEQ ID NO: 123377 - RNA, 22 nt, Homo sapiens
ugaguaucuugaugaauuugaa

SEQ ID NO: 123378 - RNA, 22 nt, Homo sapiens
ugaguaugaguucaggaaaggc

SEQ ID NO: 123379 - RNA, 22 nt, Homo sapiens
ugagucaauggaggcucagagc

SEQ ID NO: 123380 - RNA, 22 nt, Homo sapiens
ugagucaauucuaacaauggca

SEQ ID NO: 123381 - RNA, 22 nt, Homo sapiens
ugagucagucucacucugcugc

SEQ ID NO: 123382 - RNA, 22 nt, Homo sapiens
ugagucuguuccaaagaaauaa

SEQ ID NO: 123383 - RNA, 22 nt, Homo sapiens
ugagucuguucucacauugcua

SEQ ID NO: 123384 - RNA, 22 nt, Homo sapiens
ugagugaaugugaaggcuaggg

SEQ ID NO: 123385 - RNA, 22 nt, Homo sapiens
ugagugaggcugggcagucccu

SEQ ID NO: 123386 - RNA, 22 nt, Homo sapiens
ugagugagguucuacucuguga

SEQ ID NO: 123387 - RNA, 22 nt, Homo sapiens
ugaguguccaaguaaggugaaa

SEQ ID NO: 123388 - RNA, 22 nt, Homo sapiens
ugaguguguaugugcauacaca

SEQ ID NO: 123389 - RNA, 22 nt, Homo sapiens
ugaguucaauguuaaugaagca

SEQ ID NO: 123390 - RNA, 22 nt, Homo sapiens
ugaguucuuuguagauucugug

SEQ ID NO: 123391 - RNA, 22 nt, Homo sapiens
ugaguucuuuuagggauauugc

SEQ ID NO: 123392 - RNA, 22 nt, Homo sapiens
ugauacuggcuucauagaauga

SEQ ID NO: 123393 - RNA, 22 nt, Homo sapiens
ugauauauugaaugaugaaaca

SEQ ID NO: 123394 - RNA, 18 nt, Homo sapiens
ugauaucaucacaauuga

SEQ ID NO: 123395 - RNA, 22 nt, Homo sapiens
ugauauguaacuacuccuuaua

SEQ ID NO: 123396 - RNA, 22 nt, Homo sapiens
ugauauguagguggcaagcaua

SEQ ID NO: 123397 - RNA, 22 nt, Homo sapiens
ugauauguaugugaccuagaaa

SEQ ID NO: 123398 - RNA, 22 nt, Homo sapiens
ugauaugucacuugaucauggu

SEQ ID NO: 123399 - RNA, 22 nt, Homo sapiens
ugauaugugaguauaugguuau

SEQ ID NO: 123400 - RNA, 17 nt, Homo sapiens
ugauauuuucccagaua

SEQ ID NO: 123401 - RNA, 22 nt, Homo sapiens
ugaucaaagugcuggaauuaca

SEQ ID NO: 123402 - RNA, 22 nt, Homo sapiens
ugaugaaguauaggaagggcuu

SEQ ID NO: 123403 - RNA, 22 nt, Homo sapiens
ugaugcugaugccugccagaag

SEQ ID NO: 123404 - RNA, 22 nt, Homo sapiens
ugauggcauuucauguuuguaa

SEQ ID NO: 123405 - RNA, 22 nt, Homo sapiens
ugaugguaguucagucaaugua

SEQ ID NO: 123406 - RNA, 22 nt, Homo sapiens
ugaugguccauaguucauggua

SEQ ID NO: 123407 - RNA, 22 nt, Homo sapiens
ugaugguuuuauuaauaggacc

SEQ ID NO: 123408 - RNA, 22 nt, Homo sapiens
ugauguguuuuguaguucaacu

SEQ ID NO: 123409 - RNA, 22 nt, Homo sapiens
ugauugacauacauaggugugg

SEQ ID NO: 123410 - RNA, 22 nt, Homo sapiens
ugauuggagaacaaacugcaua

SEQ ID NO: 123411 - RNA, 22 nt, Homo sapiens
ugauugucucuccugccccauc

SEQ ID NO: 123412 - RNA, 22 nt, Homo sapiens
ugauuugucugcaggaauagug

SEQ ID NO: 123413 - RNA, 22 nt, Homo sapiens
ugauuuguuucaggaguuuucu

SEQ ID NO: 123414 - RNA, 22 nt, Homo sapiens
ugcaaacuuccuugggcagcau

SEQ ID NO: 123415 - RNA, 22 nt, Homo sapiens
ugcaaagucgaaacugcaguuu

SEQ ID NO: 123416 - RNA, 19 nt, Homo sapiens
ugcaaagucuuuuccuauu

SEQ ID NO: 123417 - RNA, 22 nt, Homo sapiens
ugcaacauguguaccacucugu

SEQ ID NO: 123418 - RNA, 22 nt, Homo sapiens
ugcaagaaucagccuaucauua

SEQ ID NO: 123419 - RNA, 22 nt, Homo sapiens
ugcaagacacuguccugggcau

SEQ ID NO: 123420 - RNA, 22 nt, Homo sapiens
ugcaaguggauuuuuccccaga

SEQ ID NO: 123421 - RNA, 22 nt, Homo sapiens
ugcaauauccucuacuauaggu

SEQ ID NO: 123422 - RNA, 22 nt, Homo sapiens
ugcaaugugaaauaagcacauc

SEQ ID NO: 123423 - RNA, 23 nt, Homo sapiens
ugcaccacuacacacucuugggu

SEQ ID NO: 123424 - RNA, 22 nt, Homo sapiens
ugcaccacuacacuccaggcug

SEQ ID NO: 123425 - RNA, 18 nt, Homo sapiens
ugcagcaucaguacccag

SEQ ID NO: 123426 - RNA, 18 nt, Homo sapiens
ugcagcuuugugauuggc

SEQ ID NO: 123427 - RNA, 22 nt, Homo sapiens
ugcagguaggcaguaucauuua

SEQ ID NO: 123428 - RNA, 22 nt, Homo sapiens
ugcaguacauucagcauccucu

SEQ ID NO: 123429 - RNA, 22 nt, Homo sapiens
ugcaguacuuugaaauauacug

SEQ ID NO: 123430 - RNA, 23 nt, Homo sapiens
ugcaguagugagaucuaggcuca

SEQ ID NO: 123431 - RNA, 22 nt, Homo sapiens
ugcagugugaaagagccugaca

SEQ ID NO: 123432 - RNA, 20 nt, Homo sapiens
uuagaguaguaugauuuaua

SEQ ID NO: 123433 - RNA, 22 nt, Homo sapiens
uuagaugaaugucucuuaaaca

SEQ ID NO: 123434 - RNA, 22 nt, Homo sapiens
uuagauguuuagaagugggcca

SEQ ID NO: 123435 - RNA, 22 nt, Homo sapiens
uuagauguuugacugggccuua

SEQ ID NO: 123436 - RNA, 22 nt, Homo sapiens
uuagcacaguucauucauguua

SEQ ID NO: 123437 - RNA, 22 nt, Homo sapiens
uuagcacugagaauggcuugcu

SEQ ID NO: 123438 - RNA, 22 nt, Homo sapiens
uuagcacuugggaguauuuauu

SEQ ID NO: 123439 - RNA, 22 nt, Homo sapiens
uuagcagcaugagaauggacua

SEQ ID NO: 123440 - RNA, 22 nt, Homo sapiens
uuagcagcucuaauaacugcua

SEQ ID NO: 123441 - RNA, 22 nt, Homo sapiens
uuagcaugucuacuaauuugcu

SEQ ID NO: 123442 - RNA, 22 nt, Homo sapiens
uuaggcaggauaguuacauauu

SEQ ID NO: 123443 - RNA, 22 nt, Homo sapiens
uuaggcuuuuuaaccaguuguu

SEQ ID NO: 123444 - RNA, 22 nt, Homo sapiens
uuagggaggcucaggacaagag

SEQ ID NO: 123445 - RNA, 22 nt, Homo sapiens
uuagguaauauauugcugcuuu

SEQ ID NO: 123446 - RNA, 22 nt, Homo sapiens
uuaggucaucgcuguccuucag

SEQ ID NO: 123447 - RNA, 22 nt, Homo sapiens
uuaguaguaguuugcauuuacc

SEQ ID NO: 123448 - RNA, 22 nt, Homo sapiens
uuaguaguugugauagguaccu

SEQ ID NO: 123449 - RNA, 20 nt, Homo sapiens
uuagucuccucugcccuguc

SEQ ID NO: 123450 - RNA, 22 nt, Homo sapiens
uuauacucgucugaaugauucu

SEQ ID NO: 123451 - RNA, 22 nt, Homo sapiens
uuauagcagugcaggaacagac

SEQ ID NO: 123452 - RNA, 22 nt, Homo sapiens
uuauaggcaggugguguagaug

SEQ ID NO: 123453 - RNA, 22 nt, Homo sapiens
uuauauguuacucccucuagca

SEQ ID NO: 123454 - RNA, 22 nt, Homo sapiens
uuauauguuagacauggugggu

SEQ ID NO: 123455 - RNA, 22 nt, Homo sapiens
uuauauguuuguacuuaggccu

SEQ ID NO: 123456 - RNA, 22 nt, Homo sapiens
uuaucagcagcaugaaaauaga

SEQ ID NO: 123457 - RNA, 22 nt, Homo sapiens
uuaucauagugcaguuuucuga

SEQ ID NO: 123458 - RNA, 21 nt, Homo sapiens
uuauccagcacuguuucggac

SEQ ID NO: 123459 - RNA, 22 nt, Homo sapiens
uuaugcagcaaagugcuugaaa

SEQ ID NO: 123460 - RNA, 22 nt, Homo sapiens
uuaugccagugauuauaagggc

SEQ ID NO: 123461 - RNA, 22 nt, Homo sapiens
uuaugcuguuuucuggagauuu

SEQ ID NO: 123462 - RNA, 22 nt, Homo sapiens
uuauguccuuuaacuucaucac

SEQ ID NO: 123463 - RNA, 22 nt, Homo sapiens
uuauuagagauauuugguuagg

SEQ ID NO: 123464 - RNA, 22 nt, Homo sapiens
uuauuagguugguggaaaagua

SEQ ID NO: 123465 - RNA, 22 nt, Homo sapiens
uuauuauguuggugcaaaggua

SEQ ID NO: 123466 - RNA, 22 nt, Homo sapiens
uuauucauuaauugcuaagguu

SEQ ID NO: 123467 - RNA, 22 nt, Homo sapiens
uuauuugguuauuguaauuggg

SEQ ID NO: 123468 - RNA, 22 nt, Homo sapiens
uucaaaguguugguuuugggcu

SEQ ID NO: 123469 - RNA, 22 nt, Homo sapiens
uucaacagugauggccuuugua

SEQ ID NO: 123470 - RNA, 22 nt, Homo sapiens
uucaagaauuaaaguggcuuuu

SEQ ID NO: 123471 - RNA, 22 nt, Homo sapiens
uucaagucaacaagcacuugag

SEQ ID NO: 123472 - RNA, 22 nt, Homo sapiens
uucaaguguucaggagcuacag

SEQ ID NO: 123473 - RNA, 22 nt, Homo sapiens
uucacagaaaaaggcgaugagg

SEQ ID NO: 123474 - RNA, 22 nt, Homo sapiens
uucacagccgcaccccaucacu

SEQ ID NO: 123475 - RNA, 20 nt, Homo sapiens
uucacaggcagcuucuuucu

SEQ ID NO: 123476 - RNA, 22 nt, Homo sapiens
uucacaguacucccuggaauua

SEQ ID NO: 123477 - RNA, 22 nt, Homo sapiens
uucacaguguuucucacgguua

SEQ ID NO: 123478 - RNA, 22 nt, Homo sapiens
uucaccagggaagucucaacuc

SEQ ID NO: 123479 - RNA, 22 nt, Homo sapiens
uucaccaguuuugucacgaaug

SEQ ID NO: 123480 - RNA, 22 nt, Homo sapiens
uucagagagggagggauaccua

SEQ ID NO: 123481 - RNA, 22 nt, Homo sapiens
uucagcacaguguggaucauuc

SEQ ID NO: 123482 - RNA, 22 nt, Homo sapiens
uucagcuacuugggaggcugaa

SEQ ID NO: 123483 - RNA, 22 nt, Homo sapiens
uucagggacuuuagacaagaga

SEQ ID NO: 123484 - RNA, 22 nt, Homo sapiens
uucagggagaaggcaaacguug

SEQ ID NO: 123485 - RNA, 22 nt, Homo sapiens
uucagggcauuggaguuucuga

SEQ ID NO: 123486 - RNA, 22 nt, Homo sapiens
uucaguaguaaguuggaacucu

SEQ ID NO: 123487 - RNA, 22 nt, Homo sapiens
uucaguagucaaaagauaaggg

SEQ ID NO: 123488 - RNA, 22 nt, Homo sapiens
uucaguccauuuccuuggucac

SEQ ID NO: 123489 - RNA, 22 nt, Homo sapiens
uucagugagacgaaaacaacaa

SEQ ID NO: 123490 - RNA, 22 nt, Homo sapiens
uucagugguuauuugugagauu

SEQ ID NO: 123491 - RNA, 18 nt, Homo sapiens
uucaguuuguaucugggg

SEQ ID NO: 123492 - RNA, 22 nt, Homo sapiens
uucauacaguggcugcacucca

SEQ ID NO: 123493 - RNA, 22 nt, Homo sapiens
uucauagaggacauuacuggag

SEQ ID NO: 123494 - RNA, 22 nt, Homo sapiens
uucauaguaacaguaacuaugg

SEQ ID NO: 123495 - RNA, 22 nt, Homo sapiens
uucauaguauuuuucuccaaau

SEQ ID NO: 123496 - RNA, 22 nt, Homo sapiens
uucauaguuuauacugauauuu

SEQ ID NO: 123497 - RNA, 22 nt, Homo sapiens
uucaucagggguauuggccaau

SEQ ID NO: 123498 - RNA, 22 nt, Homo sapiens
uucaucaguugagcugguugcu

SEQ ID NO: 123499 - RNA, 22 nt, Homo sapiens
uucauccccuccaaaucucaug

SEQ ID NO: 123500 - RNA, 22 nt, Homo sapiens
uucaugcaucuguagugguuaa

SEQ ID NO: 123501 - RNA, 22 nt, Homo sapiens
uucauggugguacaaaagcaau

SEQ ID NO: 123502 - RNA, 22 nt, Homo sapiens
uucauguaauauauuucaggcc

SEQ ID NO: 123503 - RNA, 22 nt, Homo sapiens
uucauugaaugauuuuuagaag

SEQ ID NO: 123504 - RNA, 22 nt, Homo sapiens
uucauuggacuuguguucuuga

SEQ ID NO: 123505 - RNA, 22 nt, Homo sapiens
uuccacaauggcugaacuaguu

SEQ ID NO: 123506 - RNA, 22 nt, Homo sapiens
uuccacaaugguugaacuagcu

SEQ ID NO: 123507 - RNA, 16 nt, Homo sapiens
uuccacagucgaggug

SEQ ID NO: 123508 - RNA, 22 nt, Homo sapiens
uuccagagucaccuuucugucg

SEQ ID NO: 123509 - RNA, 22 nt, Homo sapiens
uuccaguauuugggcaagcgca

SEQ ID NO: 123510 - RNA, 21 nt, Homo sapiens
uuccagugagccuagaugccu

SEQ ID NO: 123511 - RNA, 22 nt, Homo sapiens
uuccaguggaguaaauggacaa

SEQ ID NO: 123512 - RNA, 22 nt, Homo sapiens
uuccaguguuugacucaccuuu

SEQ ID NO: 123513 - RNA, 22 nt, Homo sapiens
uuccaguugugagcuauccggg

SEQ ID NO: 123514 - RNA, 22 nt, Homo sapiens
uuccaugagaugcaucaaagcu

SEQ ID NO: 123515 - RNA, 22 nt, Homo sapiens
uuccauuuguucggugucgcca

SEQ ID NO: 123516 - RNA, 22 nt, Homo sapiens
uucccagagaaaaggguuucuu

SEQ ID NO: 123517 - RNA, 22 nt, Homo sapiens
uucccuagaacacauggaggga

SEQ ID NO: 123518 - RNA, 22 nt, Homo sapiens
uucccugugggaguaggaaagu

SEQ ID NO: 123519 - RNA, 22 nt, Homo sapiens
uuccugagaucagaauucaaau

SEQ ID NO: 123520 - RNA, 22 nt, Homo sapiens
uuccugaggccuccccagaagc

SEQ ID NO: 123521 - RNA, 22 nt, Homo sapiens
uuccuggaggggaaguguccaa

SEQ ID NO: 123522 - RNA, 22 nt, Homo sapiens
uuccugugacuguguggcaccc

SEQ ID NO: 123523 - RNA, 22 nt, Homo sapiens
uuucugggggugcugauggaaa

SEQ ID NO: 123524 - RNA, 23 nt, Homo sapiens
uuucuugggcaugcuaugucagu

SEQ ID NO: 123525 - RNA, 22 nt, Homo sapiens
uuucuugguuguauuuagacuu

SEQ ID NO: 123526 - RNA, 20 nt, Homo sapiens
uuugaauguaaagcauguca

SEQ ID NO: 123527 - RNA, 22 nt, Homo sapiens
uuugaauguaaugagcaggaag

SEQ ID NO: 123528 - RNA, 22 nt, Homo sapiens
uuugagauaucuuccaucagua

SEQ ID NO: 123529 - RNA, 22 nt, Homo sapiens
uuugagcaugcagauugccagg

SEQ ID NO: 123530 - RNA, 22 nt, Homo sapiens
uuugauguugauacuaccuuca

SEQ ID NO: 123531 - RNA, 22 nt, Homo sapiens
uuugcaagaugaaaaaguucua

SEQ ID NO: 123532 - RNA, 22 nt, Homo sapiens
uuugcacucaguaagugggagc

SEQ ID NO: 123533 - RNA, 22 nt, Homo sapiens
uuugcacuuuuguaauaugguu

SEQ ID NO: 123534 - RNA, 22 nt, Homo sapiens
uuugcagagacuuguuaggaau

SEQ ID NO: 123535 - RNA, 22 nt, Homo sapiens
uuugcaucuuuugcuuccugga

SEQ ID NO: 123536 - RNA, 23 nt, Homo sapiens
uuugccacuuauuagcugggagg

SEQ ID NO: 123537 - RNA, 22 nt, Homo sapiens
uuugcugagucugacuucaugg

SEQ ID NO: 123538 - RNA, 22 nt, Homo sapiens
uuugcuucacuguuuggcaaaa

SEQ ID NO: 123539 - RNA, 22 nt, Homo sapiens
uuugcuugaggucuagcuaccc

SEQ ID NO: 123540 - RNA, 22 nt, Homo sapiens
uuugcuuguguaaaaaucugga

SEQ ID NO: 123541 - RNA, 22 nt, Homo sapiens
uuuggcaaagaucaacauguua

SEQ ID NO: 123542 - RNA, 22 nt, Homo sapiens
uuuggcaauuugacuguauagg

SEQ ID NO: 123543 - RNA, 22 nt, Homo sapiens
uuuggcaguuauuuacucagug

SEQ ID NO: 123544 - RNA, 22 nt, Homo sapiens
uuuggcauuagagagacuugca

SEQ ID NO: 123545 - RNA, 23 nt, Homo sapiens
uuuggcauuccagaaauuuucau

SEQ ID NO: 123546 - RNA, 22 nt, Homo sapiens
uuuggcauuuuacuacucaaau

SEQ ID NO: 123547 - RNA, 22 nt, Homo sapiens
uuuggcuguuucuggacuaaga

SEQ ID NO: 123548 - RNA, 22 nt, Homo sapiens
uuuggcuuugagaagcagugga

SEQ ID NO: 123549 - RNA, 22 nt, Homo sapiens
uuugggacuguauuaaaugccu

SEQ ID NO: 123550 - RNA, 22 nt, Homo sapiens
uuugguccaguguucagguccu

SEQ ID NO: 123551 - RNA, 22 nt, Homo sapiens
uuuggucuuuuauuuaaagcag

SEQ ID NO: 123552 - RNA, 22 nt, Homo sapiens
uuuggucuuuuguaaguuaucu

SEQ ID NO: 123553 - RNA, 22 nt, Homo sapiens
uuugguguauaaaaaugcuagu

SEQ ID NO: 123554 - RNA, 22 nt, Homo sapiens
uuugguuauuugaaacuagcau

SEQ ID NO: 123555 - RNA, 22 nt, Homo sapiens
uuuguaauccuauuccaaagga

SEQ ID NO: 123556 - RNA, 23 nt, Homo sapiens
uuuguacuaugucaguuuagaua

SEQ ID NO: 123557 - RNA, 22 nt, Homo sapiens
uuuguacuugguguucuggaaa

SEQ ID NO: 123558 - RNA, 22 nt, Homo sapiens
uuuguagcucacucugagcuga

SEQ ID NO: 123559 - RNA, 21 nt, Homo sapiens
uuuguaguagcaugauuuaua

SEQ ID NO: 123560 - RNA, 19 nt, Homo sapiens
uuuguauguuuccaguaau

SEQ ID NO: 123561 - RNA, 21 nt, Homo sapiens
uuuguccaccuguguucacca

SEQ ID NO: 123562 - RNA, 22 nt, Homo sapiens
uuuguccugccaugguuuauuu

SEQ ID NO: 123563 - RNA, 22 nt, Homo sapiens
uuugugaaugucauaagcucca

SEQ ID NO: 123564 - RNA, 22 nt, Homo sapiens
uuugugacuugcuucucagaau

SEQ ID NO: 123565 - RNA, 22 nt, Homo sapiens
uuugugaggugauggauauguc

SEQ ID NO: 123566 - RNA, 21 nt, Homo sapiens
uuugugguuacugugugagcu

SEQ ID NO: 123567 - RNA, 23 nt, Homo sapiens
uuuguguccccacccaaaucuca

SEQ ID NO: 123568 - RNA, 22 nt, Homo sapiens
uuugugucccucuaaaauuuau

SEQ ID NO: 123569 - RNA, 22 nt, Homo sapiens
uuuguucaccucaaggauggga

SEQ ID NO: 123570 - RNA, 22 nt, Homo sapiens
uuuuaagcuacaagagacauau

SEQ ID NO: 123571 - RNA, 22 nt, Homo sapiens
uuuuacacuguugguuggaaug

SEQ ID NO: 123572 - RNA, 20 nt, Homo sapiens
uuuuagcacuuguuauggug

SEQ ID NO: 123573 - RNA, 20 nt, Homo sapiens
uuuuagcuuuuauugaaagc

SEQ ID NO: 123574 - RNA, 23 nt, Homo sapiens
uuuugcaauaagucacuggaaua

SEQ ID NO: 123575 - RNA, 22 nt, Homo sapiens
uuuugcaauauguuccugaaua

SEQ ID NO: 123576 - RNA, 22 nt, Homo sapiens
uuuugcuccuggcaaacucaua

SEQ ID NO: 123577 - RNA, 19 nt, Homo sapiens
uuuugcucuuuauaccuau

SEQ ID NO: 123578 - RNA, 22 nt, Homo sapiens
uuuuggcacuuugucugauucu

SEQ ID NO: 123579 - RNA, 22 nt, Homo sapiens
uuuugguauaugcaggggucuu

SEQ ID NO: 123580 - RNA, 22 nt, Homo sapiens
uuuugguuuuauccagggucuc

SEQ ID NO: 123581 - RNA, 21 nt, Homo sapiens
uuuuugguggucauggauaga

SEQ ID NO: 123582 - RNA, 22 nt, Homo sapiens
uuuuuuaguuagcugggcauga

SEQ ID NO: 123583 - RNA, 22 nt, Homo sapiens
uuuuuugcuguaugcaaacauc

SEQ ID NO: 123584 - RNA, 22 nt, Homo sapiens
caaaggcuucugaaacugcaga

SEQ ID NO: 123585 - RNA, 22 nt, Homo sapiens
caaaggugcuuuccagguccaa

SEQ ID NO: 123586 - RNA, 22 nt, Homo sapiens
caaagugcugggacuggccggg

SEQ ID NO: 123587 - RNA, 22 nt, Homo sapiens
caaagugguuuauacaugauug

SEQ ID NO: 123588 - RNA, 22 nt, Homo sapiens
caaauccucaccucaucaugaa

SEQ ID NO: 123589 - RNA, 22 nt, Homo sapiens
caaauugcuugucuguagugga

SEQ ID NO: 123590 - RNA, 22 nt, Homo sapiens
caacacagugaaacccgucucu

SEQ ID NO: 123591 - RNA, 22 nt, Homo sapiens
caaccaguagcugaguucaaaa

SEQ ID NO: 123592 - RNA, 22 nt, Homo sapiens
caagacuguccaacauauuggg

SEQ ID NO: 123593 - RNA, 22 nt, Homo sapiens
caagagaccugagugucauucu

SEQ ID NO: 123594 - RNA, 22 nt, Homo sapiens
caagagagcugaugguuuuaaa

SEQ ID NO: 123595 - RNA, 22 nt, Homo sapiens
caagugcuugaugaaugaucaa

SEQ ID NO: 123596 - RNA, 22 nt, Homo sapiens
caaucugucuuuuagggggcca

SEQ ID NO: 123597 - RNA, 21 nt, Homo sapiens
caauggcacgaucuuggcuca

SEQ ID NO: 123598 - RNA, 22 nt, Homo sapiens
cacaccuacuagggccgugggc

SEQ ID NO: 123599 - RNA, 22 nt, Homo sapiens
cacacuguuuuccauggggguu

SEQ ID NO: 123600 - RNA, 22 nt, Homo sapiens
cacagaauucauuggauuaccu

SEQ ID NO: 123601 - RNA, 22 nt, Homo sapiens
cacagagugagacccugucucu

SEQ ID NO: 123602 - RNA, 22 nt, Homo sapiens
cacagcuaacaacuguuucuuc

SEQ ID NO: 123603 - RNA, 22 nt, Homo sapiens
cacagggcuaacauuuuugccc

SEQ ID NO: 123604 - RNA, 22 nt, Homo sapiens
cacagucugggcuuguuuguac

SEQ ID NO: 123605 - RNA, 22 nt, Homo sapiens
cacaguguucauagccaucagg

SEQ ID NO: 123606 - RNA, 22 nt, Homo sapiens
caccugagcgggaugcucgccu

SEQ ID NO: 123607 - RNA, 22 nt, Homo sapiens
cacucaguuugugguacuuugu

SEQ ID NO: 123608 - RNA, 22 nt, Homo sapiens
cacugcaauuacuuuugcacca

SEQ ID NO: 123609 - RNA, 22 nt, Homo sapiens
cacugcacuccagcuugugggc

SEQ ID NO: 123610 - RNA, 20 nt, Homo sapiens
augugcuaauauuaauaugu

SEQ ID NO: 123611 - RNA, 22 nt, Homo sapiens
augugcuagguacuguuuagca

SEQ ID NO: 123612 - RNA, 22 nt, Homo sapiens
augugcuuaaaaaugcagagaa

SEQ ID NO: 123613 - RNA, 22 nt, Homo sapiens
augugcuuuuuaaacagaugcu

SEQ ID NO: 123614 - RNA, 22 nt, Homo sapiens
auguggcuuuccuagaucuuag

SEQ ID NO: 123615 - RNA, 22 nt, Homo sapiens
auguggugguagccaggacagg

SEQ ID NO: 123616 - RNA, 22 nt, Homo sapiens
augugugaaucccagaaccugu

SEQ ID NO: 123617 - RNA, 22 nt, Homo sapiens
augugugcuugauguaaaaagu

SEQ ID NO: 123618 - RNA, 23 nt, Homo sapiens
augugugcuuggagagcaggaug

SEQ ID NO: 123619 - RNA, 22 nt, Homo sapiens
auguuaacaucuuaguuuucau

SEQ ID NO: 123620 - RNA, 22 nt, Homo sapiens
auguuagcaucuggcacuaugg

SEQ ID NO: 123621 - RNA, 20 nt, Homo sapiens
auguucuggaggacagaagc

SEQ ID NO: 123622 - RNA, 22 nt, Homo sapiens
auguuugguaagaauauuguua

SEQ ID NO: 123623 - RNA, 22 nt, Homo sapiens
auuaagagcacauguucugggu

SEQ ID NO: 123624 - RNA, 23 nt, Homo sapiens
auuaagguuacuacaguaugagg

SEQ ID NO: 123625 - RNA, 22 nt, Homo sapiens
auuaagugcuugccagugcugg

SEQ ID NO: 123626 - RNA, 22 nt, Homo sapiens
auuagguuggugcaaaacuuuc

SEQ ID NO: 123627 - RNA, 22 nt, Homo sapiens
auuagguuggugcaaaaguaau

SEQ ID NO: 123628 - RNA, 22 nt, Homo sapiens
auuaucacaguuuugcauaugg

SEQ ID NO: 123629 - RNA, 22 nt, Homo sapiens
auuauuagucggccagcuguua

SEQ ID NO: 123630 - RNA, 22 nt, Homo sapiens
auucaaggacuggauugcggga

SEQ ID NO: 123631 - RNA, 22 nt, Homo sapiens
auucaagggauuucaggaggcu

SEQ ID NO: 123632 - RNA, 20 nt, Homo sapiens
auucaaguaugccuugagaa

SEQ ID NO: 123633 - RNA, 22 nt, Homo sapiens
auucacagcuuuaaaaggcgug

SEQ ID NO: 123634 - RNA, 22 nt, Homo sapiens
auucacuguggcuuucucugau

SEQ ID NO: 123635 - RNA, 22 nt, Homo sapiens
auucacuuuuauagacaggucu

SEQ ID NO: 123636 - RNA, 22 nt, Homo sapiens
auuccacaguuaacacagaccg

SEQ ID NO: 123637 - RNA, 22 nt, Homo sapiens
auuccacuuacaugaaguaccu

SEQ ID NO: 123638 - RNA, 22 nt, Homo sapiens
auuccacuuagugacucauuug

SEQ ID NO: 123639 - RNA, 22 nt, Homo sapiens
auuccagguggcgccauucaca

SEQ ID NO: 123640 - RNA, 22 nt, Homo sapiens
auuccaguggguuuacauccca

SEQ ID NO: 123641 - RNA, 22 nt, Homo sapiens
auuccaguuguaagguuuuuca

SEQ ID NO: 123642 - RNA, 22 nt, Homo sapiens
auucccuguagaauaaggaugg

SEQ ID NO: 123643 - RNA, 22 nt, Homo sapiens
auuccuuaggcccuuugguuag

SEQ ID NO: 123644 - RNA, 22 nt, Homo sapiens
auucuauaguccuaggauuggg

SEQ ID NO: 123645 - RNA, 22 nt, Homo sapiens
auugagcaaggucuccuaguau

SEQ ID NO: 123646 - RNA, 22 nt, Homo sapiens
auugagcaauuccuaugugcuu

SEQ ID NO: 123647 - RNA, 22 nt, Homo sapiens
auugagcacugacucugugcca

SEQ ID NO: 123648 - RNA, 22 nt, Homo sapiens
auugaggcauguaccaaugguc

SEQ ID NO: 123649 - RNA, 22 nt, Homo sapiens
auugaguaaaaaauagugaugu

SEQ ID NO: 123650 - RNA, 22 nt, Homo sapiens
auugauaguuuaauaggaauug

SEQ ID NO: 123651 - RNA, 22 nt, Homo sapiens
auugcaacuuccgccuccuggg

SEQ ID NO: 123652 - RNA, 22 nt, Homo sapiens
auugcacaucugcacuacagcc

SEQ ID NO: 123653 - RNA, 22 nt, Homo sapiens
auugcacuccagccuggcaaua

SEQ ID NO: 123654 - RNA, 22 nt, Homo sapiens
auugcacuccagccuggccaac

SEQ ID NO: 123655 - RNA, 22 nt, Homo sapiens
auugcacuccagccuggccgag

SEQ ID NO: 123656 - RNA, 21 nt, Homo sapiens
auugcacuccagccugggcga

SEQ ID NO: 123657 - RNA, 22 nt, Homo sapiens
auugcacuccagucugggcaac

SEQ ID NO: 123658 - RNA, 22 nt, Homo sapiens
auugcacugcagccugggcaac

SEQ ID NO: 123659 - RNA, 20 nt, Homo sapiens
auugcagcaugauuuauaau

SEQ ID NO: 123660 - RNA, 19 nt, Homo sapiens
auugcaguguaaaacuauu

SEQ ID NO: 123661 - RNA, 22 nt, Homo sapiens
auugcauuuucagguuggucug

SEQ ID NO: 123662 - RNA, 22 nt, Homo sapiens
auugcccaggcuggagugcagu

SEQ ID NO: 123663 - RNA, 18 nt, Homo sapiens
auugcccucauggggcuu

SEQ ID NO: 123664 - RNA, 22 nt, Homo sapiens
auugcucacacaaagccuguuu

SEQ ID NO: 123665 - RNA, 22 nt, Homo sapiens
auugcuuuuacugggagcuuug

SEQ ID NO: 123666 - RNA, 22 nt, Homo sapiens
auuggccccguuuuaaauguca

SEQ ID NO: 123667 - RNA, 22 nt, Homo sapiens
auuguacugccccccuguugcu

SEQ ID NO: 123668 - RNA, 22 nt, Homo sapiens
auugucacccgggcaguaagca

SEQ ID NO: 123669 - RNA, 22 nt, Homo sapiens
auugucauuuauaacuguguag

SEQ ID NO: 123670 - RNA, 22 nt, Homo sapiens
auugucccucuuaaucccagca

SEQ ID NO: 123671 - RNA, 22 nt, Homo sapiens
auugugauugcugcuaggccua

SEQ ID NO: 123672 - RNA, 22 nt, Homo sapiens
auuuggcaguauaaugcuuugg

SEQ ID NO: 123673 - RNA, 22 nt, Homo sapiens
auuuggcagugaagggaucaca

SEQ ID NO: 123674 - RNA, 22 nt, Homo sapiens
auuugguugggugcgguggcuu

SEQ ID NO: 123675 - RNA, 22 nt, Homo sapiens
auuuugguuacauaguugagcu

SEQ ID NO: 123676 - RNA, 22 nt, Homo sapiens
caaaagugguucuuauccuuuu

SEQ ID NO: 123677 - RNA, 22 nt, Homo sapiens
caaaggcuuccacugcauccuu

SEQ ID NO: 123678 - RNA, 22 nt, Homo sapiens
ccaguguuuuugaauuccagga

SEQ ID NO: 123679 - RNA, 22 nt, Homo sapiens
ccauacugucaaauagauuucc

SEQ ID NO: 123680 - RNA, 22 nt, Homo sapiens
ccaucacaggccucagugggaa

SEQ ID NO: 123681 - RNA, 22 nt, Homo sapiens
ccaucccuuucugagcaguucc

SEQ ID NO: 123682 - RNA, 19 nt, Homo sapiens
ccauggcaaugaucugaug

SEQ ID NO: 123683 - RNA, 22 nt, Homo sapiens
ccauggcuucugcauucuguca

SEQ ID NO: 123684 - RNA, 22 nt, Homo sapiens
ccauugaacaugaaggaaugug

SEQ ID NO: 123685 - RNA, 22 nt, Homo sapiens
ccauugcacucuggccuaggug

SEQ ID NO: 123686 - RNA, 22 nt, Homo sapiens
ccauugcacuucagccuaggug

SEQ ID NO: 123687 - RNA, 22 nt, Homo sapiens
cccagaguucuuaaauacugag

SEQ ID NO: 123688 - RNA, 18 nt, Homo sapiens
cccagugacuuauggccu

SEQ ID NO: 123689 - RNA, 22 nt, Homo sapiens
cccagugguuacauaaggagua

SEQ ID NO: 123690 - RNA, 22 nt, Homo sapiens
cccagugugcugggugacagcu

SEQ ID NO: 123691 - RNA, 22 nt, Homo sapiens
cccauuguuaaguugaguaucu

SEQ ID NO: 123692 - RNA, 22 nt, Homo sapiens
ccccaguguguaaaggccuugc

SEQ ID NO: 123693 - RNA, 20 nt, Homo sapiens
ccccaguuuuucuauuagcu

SEQ ID NO: 123694 - RNA, 22 nt, Homo sapiens
ccccuguaaacuggcuucccug

SEQ ID NO: 123695 - RNA, 19 nt, Homo sapiens
ccccuguggauaccgaggg

SEQ ID NO: 123696 - RNA, 22 nt, Homo sapiens
cccgugucuuggucuagggccu

SEQ ID NO: 123697 - RNA, 22 nt, Homo sapiens
cccucauucauucauccuaugu

SEQ ID NO: 123698 - RNA, 22 nt, Homo sapiens
cccugaagauacagaguuuggg

SEQ ID NO: 123699 - RNA, 22 nt, Homo sapiens
cccugagcagccugaguuuccc

SEQ ID NO: 123700 - RNA, 22 nt, Homo sapiens
cccuguguuguucaaggaucug

SEQ ID NO: 123701 - RNA, 22 nt, Homo sapiens
cccuguguuuagcugaagguuu

SEQ ID NO: 123702 - RNA, 22 nt, Homo sapiens
ccggguguuuuguucucucaga

SEQ ID NO: 123703 - RNA, 22 nt, Homo sapiens
ccuaggcacugggguccagccc

SEQ ID NO: 123704 - RNA, 19 nt, Homo sapiens
ccucaaguacuaauauguu

SEQ ID NO: 123705 - RNA, 21 nt, Homo sapiens
ccucuuugagggaagaaaggg

SEQ ID NO: 123706 - RNA, 22 nt, Homo sapiens
ccugagacugauugacucacaa

SEQ ID NO: 123707 - RNA, 22 nt, Homo sapiens
ccugagacuugagggggcuucu

SEQ ID NO: 123708 - RNA, 22 nt, Homo sapiens
ccugagaucauacuguuaguaa

SEQ ID NO: 123709 - RNA, 22 nt, Homo sapiens
ccuggcaagagacugaagauag

SEQ ID NO: 123710 - RNA, 22 nt, Homo sapiens
ccuucuuuuguaaggcugaaua

SEQ ID NO: 123711 - RNA, 22 nt, Homo sapiens
ccuuggcacuacugacauugua

SEQ ID NO: 123712 - RNA, 22 nt, Homo sapiens
ccuugguaauguguuuuauucu

SEQ ID NO: 123713 - RNA, 22 nt, Homo sapiens
ccuugguggccacaagacauug

SEQ ID NO: 123714 - RNA, 22 nt, Homo sapiens
cgccgggggaugggcaccagcg

SEQ ID NO: 123715 - RNA, 22 nt, Homo sapiens
cgccugagcugaggaagcugca

SEQ ID NO: 123716 - RNA, 22 nt, Homo sapiens
cuaaaguauugagugguaaaga

SEQ ID NO: 123717 - RNA, 23 nt, Homo sapiens
cuaaagucugucacugaggacuu

SEQ ID NO: 123718 - RNA, 22 nt, Homo sapiens
cuaaagugcuuaaaaucucauu

SEQ ID NO: 123719 - RNA, 22 nt, Homo sapiens
cuaaaugucucuacuaaguuua

SEQ ID NO: 123720 - RNA, 22 nt, Homo sapiens
cuaagauugucuuaguguguug

SEQ ID NO: 123721 - RNA, 17 nt, Homo sapiens
cuaaggcaagagucugc

SEQ ID NO: 123722 - RNA, 22 nt, Homo sapiens
cuaaucuagccuuauaaguauu

SEQ ID NO: 123723 - RNA, 23 nt, Homo sapiens
cuacagugccugucucuuuggcc

SEQ ID NO: 123724 - RNA, 22 nt, Homo sapiens
cuacauuguagguauucaaacu

SEQ ID NO: 123725 - RNA, 22 nt, Homo sapiens
cuacccuuaaguuucugugggg

SEQ ID NO: 123726 - RNA, 22 nt, Homo sapiens
cuaccuggguggcucaugacuu

SEQ ID NO: 123727 - RNA, 22 nt, Homo sapiens
cuacucuggagagugacaauca

SEQ ID NO: 123728 - RNA, 22 nt, Homo sapiens
cuacugcacaucaucugaguua

SEQ ID NO: 123729 - RNA, 22 nt, Homo sapiens
cuagaacuagaacugcuggggu

SEQ ID NO: 123730 - RNA, 22 nt, Homo sapiens
cuagaggcacagccuaggcacu

SEQ ID NO: 123731 - RNA, 22 nt, Homo sapiens
cuagcaggcaagauaagauuca

SEQ ID NO: 123732 - RNA, 22 nt, Homo sapiens
cuagccuggagugcaguggugc

SEQ ID NO: 123733 - RNA, 22 nt, Homo sapiens
cuagcuuuuuaugacaaucuug

SEQ ID NO: 123734 - RNA, 22 nt, Homo sapiens
cuauaugucuguuuugguacca

SEQ ID NO: 123735 - RNA, 22 nt, Homo sapiens
cuaucacuguuuugaugcccgg

SEQ ID NO: 123736 - RNA, 22 nt, Homo sapiens
cuauggcagccacggccuggag

SEQ ID NO: 123737 - RNA, 22 nt, Homo sapiens
cuauggcuguaaggauaguaac

SEQ ID NO: 123738 - RNA, 22 nt, Homo sapiens
cuauggcuguagucccugugua

SEQ ID NO: 123739 - RNA, 22 nt, Homo sapiens
cuaugguuucucaaacuccuga

SEQ ID NO: 123740 - RNA, 22 nt, Homo sapiens
cuauuacuuuuauugaacucag

SEQ ID NO: 123741 - RNA, 22 nt, Homo sapiens
cuauucacaggcaauauguaca

SEQ ID NO: 123742 - RNA, 22 nt, Homo sapiens
cuauuugguuggugaaaaaagu

SEQ ID NO: 123743 - RNA, 22 nt, Homo sapiens
cucaaagugcugggacuggcug

SEQ ID NO: 123744 - RNA, 19 nt, Homo sapiens
cucaaagugguauuuggag

SEQ ID NO: 123745 - RNA, 22 nt, Homo sapiens
cucacagucucucccuaauuuu

SEQ ID NO: 123746 - RNA, 22 nt, Homo sapiens
cucacagugacacgaaccccca

SEQ ID NO: 123747 - RNA, 22 nt, Homo sapiens
cucacaugcucaccugguguuc

SEQ ID NO: 123748 - RNA, 22 nt, Homo sapiens
cucacuggguguaaaacaugua

SEQ ID NO: 123749 - RNA, 22 nt, Homo sapiens
cucagagcacaguuuaugacag

SEQ ID NO: 123750 - RNA, 22 nt, Homo sapiens
aagcugccuugugaaggcauuc

SEQ ID NO: 123751 - RNA, 22 nt, Homo sapiens
aagcuggauuuaguguggagca

SEQ ID NO: 123752 - RNA, 22 nt, Homo sapiens
aagcuggcauucaugagauuac

SEQ ID NO: 123753 - RNA, 22 nt, Homo sapiens
aagcuggcauucauucguucuu

SEQ ID NO: 123754 - RNA, 22 nt, Homo sapiens
aagcuguugguggaucuaccau

SEQ ID NO: 123755 - RNA, 22 nt, Homo sapiens
aaggaauacuggugguugcuau

SEQ ID NO: 123756 - RNA, 22 nt, Homo sapiens
aaggcaagaaaauggauucucc

SEQ ID NO: 123757 - RNA, 22 nt, Homo sapiens
aaggcuguucauuuagcacagu

SEQ ID NO: 123758 - RNA, 22 nt, Homo sapiens
aaggcuguuguguaauaggauu

SEQ ID NO: 123759 - RNA, 20 nt, Homo sapiens
aaggcuuucgaguuccaggg

SEQ ID NO: 123760 - RNA, 22 nt, Homo sapiens
aagggaauguuguggcugguuu

SEQ ID NO: 123761 - RNA, 22 nt, Homo sapiens
aagggaauguugugguugguuu

SEQ ID NO: 123762 - RNA, 22 nt, Homo sapiens
aaggucauugugguuuuugcca

SEQ ID NO: 123763 - RNA, 17 nt, Homo sapiens
aaggugcuucgaccucc

SEQ ID NO: 123764 - RNA, 22 nt, Homo sapiens
aagguggaguugacaauuuuca

SEQ ID NO: 123765 - RNA, 22 nt, Homo sapiens
aagguucuugcuugcaugacug

SEQ ID NO: 123766 - RNA, 22 nt, Homo sapiens
aaguaagcauccaauaaauguu

SEQ ID NO: 123767 - RNA, 22 nt, Homo sapiens
aaguagcagaggcaagacuuga

SEQ ID NO: 123768 - RNA, 22 nt, Homo sapiens
aaguagcuggaugcaguggcac

SEQ ID NO: 123769 - RNA, 22 nt, Homo sapiens
aagucaaggagagaagcuucag

SEQ ID NO: 123770 - RNA, 23 nt, Homo sapiens
aagucauggaaucaaaugaggug

SEQ ID NO: 123771 - RNA, 22 nt, Homo sapiens
aagugaaugaugugaaguguaa

SEQ ID NO: 123772 - RNA, 22 nt, Homo sapiens
aagugcuggccuacucaaucga

SEQ ID NO: 123773 - RNA, 22 nt, Homo sapiens
aagugcuguaugggagccuagg

SEQ ID NO: 123774 - RNA, 22 nt, Homo sapiens
aagugcuguccuaccuuuggga

SEQ ID NO: 123775 - RNA, 22 nt, Homo sapiens
aagugcuuccuuucagaggguu

SEQ ID NO: 123776 - RNA, 22 nt, Homo sapiens
aaguggcauugaggaaaaaaau

SEQ ID NO: 123777 - RNA, 22 nt, Homo sapiens
aagugguguuugggagcuggac

SEQ ID NO: 123778 - RNA, 22 nt, Homo sapiens
aagugguguuuguauuuaugca

SEQ ID NO: 123779 - RNA, 22 nt, Homo sapiens
aaguguaaguuaauguuuaggu

SEQ ID NO: 123780 - RNA, 22 nt, Homo sapiens
aagugucuuaccgggagggagu

SEQ ID NO: 123781 - RNA, 22 nt, Homo sapiens
aaguugcuuuagguaagucaau

SEQ ID NO: 123782 - RNA, 21 nt, Homo sapiens
aauaaagcaaccuuaugccau

SEQ ID NO: 123783 - RNA, 22 nt, Homo sapiens
aauaaagcauggcuacuccaua

SEQ ID NO: 123784 - RNA, 22 nt, Homo sapiens
aauaaagccugucucuuuagag

SEQ ID NO: 123785 - RNA, 22 nt, Homo sapiens
aauaaagcugaauccuuccuga

SEQ ID NO: 123786 - RNA, 20 nt, Homo sapiens
aauaacagccccagggaggu

SEQ ID NO: 123787 - RNA, 22 nt, Homo sapiens
aauaauggcaccaaagcacaag

SEQ ID NO: 123788 - RNA, 22 nt, Homo sapiens
aauacucuauaagggaagcugu

SEQ ID NO: 123789 - RNA, 22 nt, Homo sapiens
aauacuggcacugaagaccaug

SEQ ID NO: 123790 - RNA, 22 nt, Homo sapiens
aauacuuccaaaucuagucauu

SEQ ID NO: 123791 - RNA, 22 nt, Homo sapiens
aauauagcuauguacaugucca

SEQ ID NO: 123792 - RNA, 22 nt, Homo sapiens
aauaugucugcuaauuguuucu

SEQ ID NO: 123793 - RNA, 19 nt, Homo sapiens
aauauugacaguggugucu

SEQ ID NO: 123794 - RNA, 22 nt, Homo sapiens
aaucacacuugauguugagcaa

SEQ ID NO: 123795 - RNA, 22 nt, Homo sapiens
aaucacaguguucuugugaggg

SEQ ID NO: 123796 - RNA, 22 nt, Homo sapiens
acuguacuccagccugggcaac

SEQ ID NO: 123797 - RNA, 22 nt, Homo sapiens
acuuauuguggcugacccaaac

SEQ ID NO: 123798 - RNA, 22 nt, Homo sapiens
acuuugcuuaucccaggcacug

SEQ ID NO: 123799 - RNA, 22 nt, Homo sapiens
acuuuguguuacccagcaagga

SEQ ID NO: 123800 - RNA, 22 nt, Homo sapiens
acuuuguuauggcaacccuaag

SEQ ID NO: 123801 - RNA, 22 nt, Homo sapiens
acuuuuugauggggagaacauu

SEQ ID NO: 123802 - RNA, 21 nt, Homo sapiens
agaaaaucuuaugggaaacau

SEQ ID NO: 123803 - RNA, 23 nt, Homo sapiens
agaaaugucuauucagggucccu

SEQ ID NO: 123804 - RNA, 22 nt, Homo sapiens
agaaccauuagagggagauauu

SEQ ID NO: 123805 - RNA, 19 nt, Homo sapiens
agaaucuaaauuauuucug

SEQ ID NO: 123806 - RNA, 22 nt, Homo sapiens
agaauguauauucuguaguugu

SEQ ID NO: 123807 - RNA, 22 nt, Homo sapiens
agacccuguauguguuuaguuu

SEQ ID NO: 123808 - RNA, 20 nt, Homo sapiens
agacuagggagcagaaagcc

SEQ ID NO: 123809 - RNA, 22 nt, Homo sapiens
agagauaaagauuuuaauuuug

SEQ ID NO: 123810 - RNA, 22 nt, Homo sapiens
agagauaguuuccaacucauac

SEQ ID NO: 123811 - RNA, 22 nt, Homo sapiens
agagaucacugaaucacggggg

SEQ ID NO: 123812 - RNA, 20 nt, Homo sapiens
agagaucaguaauucaucaa

SEQ ID NO: 123813 - RNA, 22 nt, Homo sapiens
agagaugauuaacauuuuggua

SEQ ID NO: 123814 - RNA, 22 nt, Homo sapiens
agagcacuguggguccaaauau

SEQ ID NO: 123815 - RNA, 22 nt, Homo sapiens
agaggaguacuacuccaagucu

SEQ ID NO: 123816 - RNA, 22 nt, Homo sapiens
agagguauuggaaggaguguca

SEQ ID NO: 123817 - RNA, 22 nt, Homo sapiens
agagguuuuggggcugagagcu

SEQ ID NO: 123818 - RNA, 22 nt, Homo sapiens
agaguacugacguuugcaaauu

SEQ ID NO: 123819 - RNA, 22 nt, Homo sapiens
agagugaagcuuuuuauauucu

SEQ ID NO: 123820 - RNA, 23 nt, Homo sapiens
agagugcaauggugccaucucgg

SEQ ID NO: 123821 - RNA, 20 nt, Homo sapiens
agagugcuggacugaggagc

SEQ ID NO: 123822 - RNA, 22 nt, Homo sapiens
agauacaucuaugugucugugu

SEQ ID NO: 123823 - RNA, 23 nt, Homo sapiens
agaugcaucuggcugcgaggcaa

SEQ ID NO: 123824 - RNA, 23 nt, Homo sapiens
agauggcauuucaguucuuuagg

SEQ ID NO: 123825 - RNA, 22 nt, Homo sapiens
agauggguuuucacauguuggc

SEQ ID NO: 123826 - RNA, 22 nt, Homo sapiens
agaugguguuuucucaccagau

SEQ ID NO: 123827 - RNA, 23 nt, Homo sapiens
agcaaaugcucuagcacuccaac

SEQ ID NO: 123828 - RNA, 22 nt, Homo sapiens
agcaacaucagcagcaggaaaa

SEQ ID NO: 123829 - RNA, 22 nt, Homo sapiens
agcaacauuuuugaccuuucuu

SEQ ID NO: 123830 - RNA, 22 nt, Homo sapiens
agcaagacauggcuuccaaaug

SEQ ID NO: 123831 - RNA, 22 nt, Homo sapiens
agcaagauuguucccauuuucu

SEQ ID NO: 123832 - RNA, 22 nt, Homo sapiens
agcaauaugacauugcuacauc

SEQ ID NO: 123833 - RNA, 22 nt, Homo sapiens
agcacauauauuucccaaaaca

SEQ ID NO: 123834 - RNA, 22 nt, Homo sapiens
agcaccaauaacaguuucuagc

SEQ ID NO: 123835 - RNA, 22 nt, Homo sapiens
agcaccaauaaucagaguucuu

SEQ ID NO: 123836 - RNA, 20 nt, Homo sapiens
ggaauguuaaucuccaugau

SEQ ID NO: 123837 - RNA, 21 nt, Homo sapiens
ggaauguugccagcagccaga

SEQ ID NO: 123838 - RNA, 21 nt, Homo sapiens
ggaauuuagggaaugauuuag

SEQ ID NO: 123839 - RNA, 22 nt, Homo sapiens
ggacacguagaugccgacuagc

SEQ ID NO: 123840 - RNA, 22 nt, Homo sapiens
ggacauuaacugcaagauagau

SEQ ID NO: 123841 - RNA, 22 nt, Homo sapiens
ggacuagggacauggggagcug

SEQ ID NO: 123842 - RNA, 22 nt, Homo sapiens
ggacugucagggcuauuaguca

SEQ ID NO: 123843 - RNA, 22 nt, Homo sapiens
ggagagcuaggcagagguuugu

SEQ ID NO: 123844 - RNA, 20 nt, Homo sapiens
ggagagugacauaauucugg

SEQ ID NO: 123845 - RNA, 22 nt, Homo sapiens
ggagaucauuuccuauuugaag

SEQ ID NO: 123846 - RNA, 22 nt, Homo sapiens
ggagauccucugcgggcaaaga

SEQ ID NO: 123847 - RNA, 22 nt, Homo sapiens
ggagcucaucuagcauagaggu

SEQ ID NO: 123848 - RNA, 22 nt, Homo sapiens
ggaguaggaaggaaauguuaaa

SEQ ID NO: 123849 - RNA, 22 nt, Homo sapiens
ggaguaggcuguccggcaccca

SEQ ID NO: 123850 - RNA, 22 nt, Homo sapiens
ggagucugauguucuaaggcag

SEQ ID NO: 123851 - RNA, 22 nt, Homo sapiens
ggagugucagaaacaguguccu

SEQ ID NO: 123852 - RNA, 22 nt, Homo sapiens
ggagugucccaaucucagcuca

SEQ ID NO: 123853 - RNA, 22 nt, Homo sapiens
ggaguguguaggagaaagguaa

SEQ ID NO: 123854 - RNA, 22 nt, Homo sapiens
ggauaucauuauuucuagggcu

SEQ ID NO: 123855 - RNA, 22 nt, Homo sapiens
ggaucacagagcuugggaaagg

SEQ ID NO: 123856 - RNA, 22 nt, Homo sapiens
ggaucacagccagcucccagaa

SEQ ID NO: 123857 - RNA, 22 nt, Homo sapiens
ggaugcauucaacuuccaguuc

SEQ ID NO: 123858 - RNA, 22 nt, Homo sapiens
ggaugcauuuuugguugucaca

SEQ ID NO: 123859 - RNA, 22 nt, Homo sapiens
ggcaaaucugcaauuacuuuug

SEQ ID NO: 123860 - RNA, 22 nt, Homo sapiens
ggcaaaugaagauggagaggcu

SEQ ID NO: 123861 - RNA, 22 nt, Homo sapiens
ggcaacaaagacauuucaacau

SEQ ID NO: 123862 - RNA, 17 nt, Homo sapiens
ggcaagaaguggaacuc

SEQ ID NO: 123863 - RNA, 20 nt, Homo sapiens
ggcaagacccaaagugugug

SEQ ID NO: 123864 - RNA, 22 nt, Homo sapiens
ggcaaggaggggcacuuucacu

SEQ ID NO: 123865 - RNA, 22 nt, Homo sapiens
ggcaaggauguuuuucuggcaa

SEQ ID NO: 123866 - RNA, 22 nt, Homo sapiens
ggcaaggugcuacagacaguga

SEQ ID NO: 123867 - RNA, 22 nt, Homo sapiens
ggcaagugucagcagcaacacc

SEQ ID NO: 123868 - RNA, 22 nt, Homo sapiens
ggcaauauuauuaacccucugu

SEQ ID NO: 123869 - RNA, 22 nt, Homo sapiens
ggcaaugaggcggaccagcagg

SEQ ID NO: 123870 - RNA, 22 nt, Homo sapiens
ggcacaauugcagcaauaaaca

SEQ ID NO: 123871 - RNA, 22 nt, Homo sapiens
ggcacgguggcucacgccugua

SEQ ID NO: 123872 - RNA, 22 nt, Homo sapiens
ggcacugugaugugagggggua

SEQ ID NO: 123873 - RNA, 22 nt, Homo sapiens
ggcacuguggcucaagccugua

SEQ ID NO: 123874 - RNA, 22 nt, Homo sapiens
ggcagcaugggugccuuuguga

SEQ ID NO: 123875 - RNA, 22 nt, Homo sapiens
ggcagcauugccuuugcaguga

SEQ ID NO: 123876 - RNA, 22 nt, Homo sapiens
ggcagcgugcacuuucgccacu

SEQ ID NO: 123877 - RNA, 17 nt, Homo sapiens
ggcaggauccaggaucc

SEQ ID NO: 123878 - RNA, 23 nt, Homo sapiens
ggcagguuggucuaggucuauuc

SEQ ID NO: 123879 - RNA, 22 nt, Homo sapiens
ggcaugcauuguacuaguaugc

SEQ ID NO: 123880 - RNA, 22 nt, Homo sapiens
ggcauugugaacauuucccugc

SEQ ID NO: 123881 - RNA, 23 nt, Homo sapiens
ggcauuguggcucacaucuguaa

SEQ ID NO: 123882 - RNA, 22 nt, Homo sapiens
ggccagaugcgguggcucacac

SEQ ID NO: 123883 - RNA, 22 nt, Homo sapiens
ggcuagaugcuagagauaucau

SEQ ID NO: 123884 - RNA, 22 nt, Homo sapiens
ggcucagugaucuguuucugua

SEQ ID NO: 123885 - RNA, 22 nt, Homo sapiens
ggcucaguugcaaaucaguuca

SEQ ID NO: 123886 - RNA, 22 nt, Homo sapiens
ggcucuguugcuaccaauuaag

SEQ ID NO: 123887 - RNA, 22 nt, Homo sapiens
gucuggcuccuucuacuacaug

SEQ ID NO: 123888 - RNA, 22 nt, Homo sapiens
gucugugcauuaauacgugcug

SEQ ID NO: 123889 - RNA, 22 nt, Homo sapiens
gucuugaaggcugaguaccugu

SEQ ID NO: 123890 - RNA, 22 nt, Homo sapiens
gucuuggagacauugccauuga

SEQ ID NO: 123891 - RNA, 22 nt, Homo sapiens
gucuuugaugucuaugugcuuc

SEQ ID NO: 123892 - RNA, 22 nt, Homo sapiens
gucuuugcauguauguucauga

SEQ ID NO: 123893 - RNA, 22 nt, Homo sapiens
gucuuuggaaagacaaaguuca

SEQ ID NO: 123894 - RNA, 22 nt, Homo sapiens
gugaaagcaucugacugugcca

SEQ ID NO: 123895 - RNA, 22 nt, Homo sapiens
gugaacagaaccugggaucgaa

SEQ ID NO: 123896 - RNA, 22 nt, Homo sapiens
gugaaucauaugccagucaugc

SEQ ID NO: 123897 - RNA, 22 nt, Homo sapiens
gugacaguggagacuuacuuca

SEQ ID NO: 123898 - RNA, 22 nt, Homo sapiens
gugaccagaugggcaggggugu

SEQ ID NO: 123899 - RNA, 22 nt, Homo sapiens
gugaccucauuacggggccugc

SEQ ID NO: 123900 - RNA, 22 nt, Homo sapiens
gugagaaucaaacuacauaaau

SEQ ID NO: 123901 - RNA, 22 nt, Homo sapiens
gugagagaaugacuauguguuu

SEQ ID NO: 123902 - RNA, 22 nt, Homo sapiens
gugagaugugacuucugccucu

SEQ ID NO: 123903 - RNA, 19 nt, Homo sapiens
gugagcaaugcauugcacu

SEQ ID NO: 123904 - RNA, 22 nt, Homo sapiens
gugagcacugaaagaaggcaag

SEQ ID NO: 123905 - RNA, 22 nt, Homo sapiens
gugagccaugauuuuaccacug

SEQ ID NO: 123906 - RNA, 22 nt, Homo sapiens
gugagcuaagcaaauaugagcc

SEQ ID NO: 123907 - RNA, 22 nt, Homo sapiens
gugaggaaggaaaccugcuagc

SEQ ID NO: 123908 - RNA, 22 nt, Homo sapiens
gugaggcacugcugcuuuccag

SEQ ID NO: 123909 - RNA, 22 nt, Homo sapiens
gugagggagcuggaauauuuau

SEQ ID NO: 123910 - RNA, 22 nt, Homo sapiens
gugagggaugugaaaaagguca

SEQ ID NO: 123911 - RNA, 22 nt, Homo sapiens
gugagguagagcaugugaaaga

SEQ ID NO: 123912 - RNA, 17 nt, Homo sapiens
gugagguggguaguauc

SEQ ID NO: 123913 - RNA, 22 nt, Homo sapiens
gugagguugaaaauaauggaaa

SEQ ID NO: 123914 - RNA, 22 nt, Homo sapiens
gugagucaaucugagggguuca

SEQ ID NO: 123915 - RNA, 22 nt, Homo sapiens
gugauagaucugggauucagaa

SEQ ID NO: 123916 - RNA, 22 nt, Homo sapiens
gugauaucacuguaucacucca

SEQ ID NO: 123917 - RNA, 22 nt, Homo sapiens
gugauauguuaggaucuaaguc

SEQ ID NO: 123918 - RNA, 22 nt, Homo sapiens
gugaucucauuuggaauuagag

SEQ ID NO: 123919 - RNA, 22 nt, Homo sapiens
gugauuuaguagaugcuaguua

SEQ ID NO: 123920 - RNA, 22 nt, Homo sapiens
gugcaacaugccuggcuaauuu

SEQ ID NO: 123921 - RNA, 22 nt, Homo sapiens
gugcacaaaucuuaaauguaca

SEQ ID NO: 123922 - RNA, 22 nt, Homo sapiens
gugcacaacaugcagguuuguu

SEQ ID NO: 123923 - RNA, 22 nt, Homo sapiens
gugcacaacgugcagguuuguu

SEQ ID NO: 123924 - RNA, 22 nt, Homo sapiens
aaagagaucuaugggcacuaug

SEQ ID NO: 123925 - RNA, 22 nt, Homo sapiens
aaagcacugaauaaauuugcuu

SEQ ID NO: 123926 - RNA, 22 nt, Homo sapiens
aaagcuaagguagcauuggaga

SEQ ID NO: 123927 - RNA, 22 nt, Homo sapiens
ucaaguaagaagugggcauaaa

SEQ ID NO: 123928 - RNA, 23 nt, Homo sapiens
ucaagugaugguggccacaaggg

SEQ ID NO: 123929 - RNA, 22 nt, Homo sapiens
ucaagugcauugauucaguauu

SEQ ID NO: 123930 - RNA, 22 nt, Homo sapiens
ucaaugaaugaugguugguaug

SEQ ID NO: 123931 - RNA, 19 nt, Homo sapiens
ucaauucugucaauggcuu

SEQ ID NO: 123932 - RNA, 22 nt, Homo sapiens
ucacaaggcaggaaugaaaggg

SEQ ID NO: 123933 - RNA, 22 nt, Homo sapiens
ucacaaguguauagacaugucc

SEQ ID NO: 123934 - RNA, 22 nt, Homo sapiens
ucacacgugaacucaucacaga

SEQ ID NO: 123935 - RNA, 22 nt, Homo sapiens
ucacacugucuugguuacucuu

SEQ ID NO: 123936 - RNA, 23 nt, Homo sapiens
ucacacuuaagagaaaugcagcu

SEQ ID NO: 123937 - RNA, 22 nt, Homo sapiens
ucacagaggagaagaccuuuaa

SEQ ID NO: 123938 - RNA, 21 nt, Homo sapiens
ucacagccuaggaccugaaga

SEQ ID NO: 123939 - RNA, 22 nt, Homo sapiens
ucacaguaaauccagaagaaau

SEQ ID NO: 123940 - RNA, 22 nt, Homo sapiens
ucacaguagagcuucuuucaga

SEQ ID NO: 123941 - RNA, 22 nt, Homo sapiens
ucacagucggugacuucuugcu

SEQ ID NO: 123942 - RNA, 22 nt, Homo sapiens
ucacagucugcgugaugagaca

SEQ ID NO: 123943 - RNA, 17 nt, Homo sapiens
ucacaguguuaggauga

SEQ ID NO: 123944 - RNA, 23 nt, Homo sapiens
ucacaguuacuuuugcaucaacc

SEQ ID NO: 123945 - RNA, 22 nt, Homo sapiens
ucacaucucagguuucuugaca

SEQ ID NO: 123946 - RNA, 22 nt, Homo sapiens
ucacaugcacaucucuggaacc

SEQ ID NO: 123947 - RNA, 22 nt, Homo sapiens
ucacauggggaagggacuagcu

SEQ ID NO: 123948 - RNA, 22 nt, Homo sapiens
ucacauguguaaauugguguaa

SEQ ID NO: 123949 - RNA, 22 nt, Homo sapiens
ucacauguguaugagcuuugau

SEQ ID NO: 123950 - RNA, 22 nt, Homo sapiens
ucacauuaagcuguuauuucuu

SEQ ID NO: 123951 - RNA, 22 nt, Homo sapiens
ucacauuguacaaacagguaag

SEQ ID NO: 123952 - RNA, 22 nt, Homo sapiens
ucaccaccuuccaggaccacug

SEQ ID NO: 123953 - RNA, 20 nt, Homo sapiens
ucacccugacaucugcccag

SEQ ID NO: 123954 - RNA, 22 nt, Homo sapiens
ucaccggcagacguggccugau

SEQ ID NO: 123955 - RNA, 22 nt, Homo sapiens
ucaccgugaauuaacaacacuu

SEQ ID NO: 123956 - RNA, 22 nt, Homo sapiens
ucaccuggagacaugaagacug

SEQ ID NO: 123957 - RNA, 22 nt, Homo sapiens
ucaccuggggaucuuguuuaca

SEQ ID NO: 123958 - RNA, 22 nt, Homo sapiens
ucaccuguagcuaagaccuaau

SEQ ID NO: 123959 - RNA, 22 nt, Homo sapiens
ucacuagaucaagggagagaaa

SEQ ID NO: 123960 - RNA, 22 nt, Homo sapiens
ucacucagaccuggugauaugc

SEQ ID NO: 123961 - RNA, 22 nt, Homo sapiens
ucacugaaaccuccaccucucg

SEQ ID NO: 123962 - RNA, 21 nt, Homo sapiens
ucacugagguuaaauaggguu

SEQ ID NO: 123963 - RNA, 22 nt, Homo sapiens
ucacugggagaccaaagccauc

SEQ ID NO: 123964 - RNA, 22 nt, Homo sapiens
ucacuggucuaaguggaggggg

SEQ ID NO: 123965 - RNA, 22 nt, Homo sapiens
ucacugugguuggaaggcuuaa

SEQ ID NO: 123966 - RNA, 22 nt, Homo sapiens
ucacugugguuugggaaagugc

SEQ ID NO: 123967 - RNA, 22 nt, Homo sapiens
ucacuguugaugggcaugcagg

SEQ ID NO: 123968 - RNA, 22 nt, Homo sapiens
ucacuuggugaacacauuaugu

SEQ ID NO: 123969 - RNA, 22 nt, Homo sapiens
ucacuugguggcaaaguuuaug

SEQ ID NO: 123970 - RNA, 22 nt, Homo sapiens
ucagacacugagcaaacgacua

SEQ ID NO: 123971 - RNA, 22 nt, Homo sapiens
ucagacacuguggccuuuggac

SEQ ID NO: 123972 - RNA, 22 nt, Homo sapiens
ucagaucacuggcgcuggcgga

SEQ ID NO: 123973 - RNA, 22 nt, Homo sapiens
ucagaucaugcuuaugauggga

SEQ ID NO: 123974 - RNA, 22 nt, Homo sapiens
ucagaugaucugguaagaacuu

SEQ ID NO: 123975 - RNA, 22 nt, Homo sapiens
ucagcaucacgugggcucccgu

SEQ ID NO: 123976 - RNA, 21 nt, Homo sapiens
ucaggaccucuaguuagccag

SEQ ID NO: 123977 - RNA, 22 nt, Homo sapiens
ucaggcaccuuccucuuaucug

SEQ ID NO: 123978 - RNA, 20 nt, Homo sapiens
ucaggcuccgcauuaacuua

SEQ ID NO: 123979 - RNA, 21 nt, Homo sapiens
ucaggcuuuuugagugccaau

SEQ ID NO: 123980 - RNA, 22 nt, Homo sapiens
ucagguaaucuauuugucuuuu

SEQ ID NO: 123981 - RNA, 22 nt, Homo sapiens
ucagguagcuagauuaugugag

SEQ ID NO: 123982 - RNA, 23 nt, Homo sapiens
ucagguaggccuagaguauucuu

SEQ ID NO: 123983 - RNA, 23 nt, Homo sapiens
ucagguaguuucagaggaccuug

SEQ ID NO: 123984 - RNA, 22 nt, Homo sapiens
ucagguaucucuauagcaaugu

SEQ ID NO: 123985 - RNA, 22 nt, Homo sapiens
ucaggucauuccaggagggcca

SEQ ID NO: 123986 - RNA, 22 nt, Homo sapiens
ucaguacuuuggagcucacaua

SEQ ID NO: 123987 - RNA, 23 nt, Homo sapiens
ucaguagucauugggaaagugug

SEQ ID NO: 123988 - RNA, 22 nt, Homo sapiens
ucagucauguuuaccagacgua

SEQ ID NO: 123989 - RNA, 22 nt, Homo sapiens
ucagugacugcugcuuguauac

SEQ ID NO: 123990 - RNA, 22 nt, Homo sapiens
ucagugauugguuauuuuaggc

SEQ ID NO: 123991 - RNA, 22 nt, Homo sapiens
ucagugcuguaccaucuaagga

SEQ ID NO: 123992 - RNA, 22 nt, Homo sapiens
ucaguggacuuagucuuucccc

SEQ ID NO: 123993 - RNA, 22 nt, Homo sapiens
ucaguggagagcuuccaggauu

SEQ ID NO: 123994 - RNA, 22 nt, Homo sapiens
ucaguggauuauuaaagucacc

SEQ ID NO: 123995 - RNA, 22 nt, Homo sapiens
ucagugggcuauguaauuaacu

SEQ ID NO: 123996 - RNA, 22 nt, Homo sapiens
ucagugucugcauucuuauugu

SEQ ID NO: 123997 - RNA, 22 nt, Homo sapiens
ucaguuuagguguaacggccac

SEQ ID NO: 123998 - RNA, 22 nt, Homo sapiens
ucauacaguaguccucacuugu

SEQ ID NO: 123999 - RNA, 20 nt, Homo sapiens
ucauacuguggaguaccagg

SEQ ID NO: 124000 - RNA, 22 nt, Homo sapiens
ucauaggucacuguaaccucgu

SEQ ID NO: 124001 - RNA, 21 nt, Homo sapiens
ucauauguaucuuugugccuc

SEQ ID NO: 124002 - RNA, 22 nt, Homo sapiens
ucauaugucauaguaugaucuu

SEQ ID NO: 124003 - RNA, 21 nt, Homo sapiens
ucaucaagcuguagacaugau

SEQ ID NO: 124004 - RNA, 16 nt, Homo sapiens
ucaucacagucucugg

SEQ ID NO: 124005 - RNA, 22 nt, Homo sapiens
ucaucagaguuuacaagcucag

SEQ ID NO: 124006 - RNA, 22 nt, Homo sapiens
ucaucaggaaacuuaugcagug

SEQ ID NO: 124007 - RNA, 22 nt, Homo sapiens
ucaugaaguaguuaacugguug

SEQ ID NO: 124008 - RNA, 22 nt, Homo sapiens
ucauggcauuguuaaggguuuu

SEQ ID NO: 124009 - RNA, 19 nt, Homo sapiens
ucauggcuuuuucagcugu

SEQ ID NO: 124010 - RNA, 22 nt, Homo sapiens
ucaugggagcccccaucaugag

SEQ ID NO: 124011 - RNA, 22 nt, Homo sapiens
ucaugugaggauaacaauagug

SEQ ID NO: 124012 - RNA, 22 nt, Homo sapiens
ucauuagagacagggugucacu

SEQ ID NO: 124013 - RNA, 22 nt, Homo sapiens
ucauucauucauccagcuugag

SEQ ID NO: 124014 - RNA, 22 nt, Homo sapiens
ucauugcauguuaauuaaacag

SEQ ID NO: 124015 - RNA, 22 nt, Homo sapiens
ucauugguagcuugaaggggau

SEQ ID NO: 124016 - RNA, 18 nt, Homo sapiens
ucauuggugagcaccucc

SEQ ID NO: 124017 - RNA, 22 nt, Homo sapiens
uauugcaauuggggaaacuggg

SEQ ID NO: 124018 - RNA, 22 nt, Homo sapiens
uauugcacgccagccugagcaa

SEQ ID NO: 124019 - RNA, 22 nt, Homo sapiens
uauugcauguugagcaguaccu

SEQ ID NO: 124020 - RNA, 22 nt, Homo sapiens
uauugcuccccauaucgcagug

SEQ ID NO: 124021 - RNA, 22 nt, Homo sapiens
uauugcucugacugauuggaug

SEQ ID NO: 124022 - RNA, 22 nt, Homo sapiens
uauugcugaaaaugcuaaugau

SEQ ID NO: 124023 - RNA, 22 nt, Homo sapiens
uauugcuggauguauuacaugu

SEQ ID NO: 124024 - RNA, 22 nt, Homo sapiens
uauugcuuuacucucuuauccu

SEQ ID NO: 124025 - RNA, 22 nt, Homo sapiens
uauugcuuuuaacccaaucucu

SEQ ID NO: 124026 - RNA, 22 nt, Homo sapiens
uauuguacauguuauagauuuu

SEQ ID NO: 124027 - RNA, 22 nt, Homo sapiens
uauuguuaaagauguuaaugau

SEQ ID NO: 124028 - RNA, 22 nt, Homo sapiens
uauuguuuuucccaggagucua

SEQ ID NO: 124029 - RNA, 22 nt, Homo sapiens
uauuucaguugcguuucccgag

SEQ ID NO: 124030 - RNA, 22 nt, Homo sapiens
uauuucaguugugcagguaguu

SEQ ID NO: 124031 - RNA, 22 nt, Homo sapiens
ucaaaaccucagagaguagagc

SEQ ID NO: 124032 - RNA, 22 nt, Homo sapiens
ucaaaaucucuuagcugugucu

SEQ ID NO: 124033 - RNA, 22 nt, Homo sapiens
ucaaaucaucuuuuccaaagcu

SEQ ID NO: 124034 - RNA, 22 nt, Homo sapiens
ucaaaugauucuccugccucag

SEQ ID NO: 124035 - RNA, 22 nt, Homo sapiens
ucaaaugguccacgugaacauu

SEQ ID NO: 124036 - RNA, 22 nt, Homo sapiens
ucaacagugggcacuguaaaug

SEQ ID NO: 124037 - RNA, 22 nt, Homo sapiens
ucaacauugcugucaggcaucu

SEQ ID NO: 124038 - RNA, 21 nt, Homo sapiens
ucaacccuugcgucaccaagc

SEQ ID NO: 124039 - RNA, 19 nt, Homo sapiens
ucaagcuauucuccugccu

SEQ ID NO: 124040 - RNA, 18 nt, Homo sapiens
ucaagcuauugucaugcc

SEQ ID NO: 124041 - RNA, 22 nt, Homo sapiens
ucaaggacucagagagggauua

SEQ ID NO: 124042 - RNA, 21 nt, Homo sapiens
ucaaggaguauacguaugcca

SEQ ID NO: 124043 - RNA, 22 nt, Homo sapiens
aggucccauguccucccugacc

SEQ ID NO: 124044 - RNA, 22 nt, Homo sapiens
aggugaauggauaaacuguggg

SEQ ID NO: 124045 - RNA, 22 nt, Homo sapiens
aggugacugguuuaucuggcag

SEQ ID NO: 124046 - RNA, 22 nt, Homo sapiens
aggugcuaucugguuuuauagu

SEQ ID NO: 124047 - RNA, 22 nt, Homo sapiens
aggugcugagcagagaauccug

SEQ ID NO: 124048 - RNA, 22 nt, Homo sapiens
agguuaugauuauagagcgagg

SEQ ID NO: 124049 - RNA, 22 nt, Homo sapiens
agguuguguuugugauuagaua

SEQ ID NO: 124050 - RNA, 22 nt, Homo sapiens
agguuguugcaugcuccuuagg

SEQ ID NO: 124051 - RNA, 22 nt, Homo sapiens
aguaaauuucugugcuuucaua

SEQ ID NO: 124052 - RNA, 22 nt, Homo sapiens
aguaacaggauccaaagaaugu

SEQ ID NO: 124053 - RNA, 22 nt, Homo sapiens
aguacacuguugaacagaagug

SEQ ID NO: 124054 - RNA, 22 nt, Homo sapiens
aguaccauuagauuaggaugac

SEQ ID NO: 124055 - RNA, 23 nt, Homo sapiens
aguacuguaguaauugaggggaa

SEQ ID NO: 124056 - RNA, 22 nt, Homo sapiens
aguagguguugguagagguuuc

SEQ ID NO: 124057 - RNA, 20 nt, Homo sapiens
aguauucacuuuuuucaugg

SEQ ID NO: 124058 - RNA, 22 nt, Homo sapiens
agucaaggaggccuuucagaug

SEQ ID NO: 124059 - RNA, 22 nt, Homo sapiens
agucacagguucuugggauuag

SEQ ID NO: 124060 - RNA, 22 nt, Homo sapiens
agucacaugcauuuucuucaau

SEQ ID NO: 124061 - RNA, 17 nt, Homo sapiens
agucaguaguuuguauu

SEQ ID NO: 124062 - RNA, 22 nt, Homo sapiens
agucaugggagagaugugaucg

SEQ ID NO: 124063 - RNA, 22 nt, Homo sapiens
aguccaguguuaugaucaguag

SEQ ID NO: 124064 - RNA, 22 nt, Homo sapiens
aguccauuugaugaugauucca

SEQ ID NO: 124065 - RNA, 22 nt, Homo sapiens
agugacuagaauaugaauuuua

SEQ ID NO: 124066 - RNA, 17 nt, Homo sapiens
agugagaucauggcuua

SEQ ID NO: 124067 - RNA, 19 nt, Homo sapiens
agugagccaagauccuacc

SEQ ID NO: 124068 - RNA, 22 nt, Homo sapiens
agugauggagccaggauuuaau

SEQ ID NO: 124069 - RNA, 22 nt, Homo sapiens
agugauguggaguuuggaugga

SEQ ID NO: 124070 - RNA, 22 nt, Homo sapiens
agugauuuuaacuuccagcaau

SEQ ID NO: 124071 - RNA, 22 nt, Homo sapiens
agugcaauaaggauguagaacu

SEQ ID NO: 124072 - RNA, 22 nt, Homo sapiens
agugcacugcccgcuuccuguc

SEQ ID NO: 124073 - RNA, 22 nt, Homo sapiens
agugcaguggcucaaaaugccu

SEQ ID NO: 124074 - RNA, 22 nt, Homo sapiens
agugcauuuguucugugucagg

SEQ ID NO: 124075 - RNA, 22 nt, Homo sapiens
agugccuacuugaauuguagug

SEQ ID NO: 124076 - RNA, 22 nt, Homo sapiens
aguggaauuaagaaacugaauu

SEQ ID NO: 124077 - RNA, 22 nt, Homo sapiens
aguggcuuuuuaguggcagaug

SEQ ID NO: 124078 - RNA, 22 nt, Homo sapiens
aguggguguuccauuggauaaa

SEQ ID NO: 124079 - RNA, 22 nt, Homo sapiens
agugguuuuggaauggaauuca

SEQ ID NO: 124080 - RNA, 19 nt, Homo sapiens
agugucauggucauuauuu

SEQ ID NO: 124081 - RNA, 22 nt, Homo sapiens
aguguuuuuaacaagaaagggu

SEQ ID NO: 124082 - RNA, 22 nt, Homo sapiens
aguguuuuuacaagcacucugg

SEQ ID NO: 124083 - RNA, 22 nt, Homo sapiens
aguguuuuucaugggauacuuu

SEQ ID NO: 124084 - RNA, 22 nt, Homo sapiens
aguuagcaaaacucccaaaggu

SEQ ID NO: 124085 - RNA, 21 nt, Homo sapiens
aguucacauggcuccuguguu

SEQ ID NO: 124086 - RNA, 22 nt, Homo sapiens
aguugcaagucuugaguaaaga

SEQ ID NO: 124087 - RNA, 18 nt, Homo sapiens
aguuguuuuauccugccc

SEQ ID NO: 124088 - RNA, 22 nt, Homo sapiens
auaaaagcaggucuaggucagg

SEQ ID NO: 124089 - RNA, 23 nt, Homo sapiens
auaaacugucaaaagccagcccu

SEQ ID NO: 124090 - RNA, 22 nt, Homo sapiens
auaaagacacuuggcaugauuu

SEQ ID NO: 124091 - RNA, 22 nt, Homo sapiens
auaaaguguuuaguauaggcaa

SEQ ID NO: 124092 - RNA, 22 nt, Homo sapiens
auaaauucauuuaagcuccuua

SEQ ID NO: 124093 - RNA, 22 nt, Homo sapiens
auaagagcaggcuucuggccag

SEQ ID NO: 124094 - RNA, 22 nt, Homo sapiens
auaagauaguggaagugggauu

SEQ ID NO: 124095 - RNA, 22 nt, Homo sapiens
auaagaucauuugcuaagaggg

SEQ ID NO: 124096 - RNA, 22 nt, Homo sapiens
auaaggcuaaggacuugaguua

SEQ ID NO: 124097 - RNA, 22 nt, Homo sapiens
auaaguauuuggacuuuacugu

SEQ ID NO: 124098 - RNA, 22 nt, Homo sapiens
auaauaccugccacauuugaau

SEQ ID NO: 124099 - RNA, 22 nt, Homo sapiens
auaauacugggaagaugagcau

SEQ ID NO: 124100 - RNA, 22 nt, Homo sapiens
auaaugacuuccaguuccacuc

SEQ ID NO: 124101 - RNA, 23 nt, Homo sapiens
auaaugcaaguggugguaaucug

SEQ ID NO: 124102 - RNA, 22 nt, Homo sapiens
auacaaggaaugaagagauuug

SEQ ID NO: 124103 - RNA, 22 nt, Homo sapiens
auacaaguuauuugaacugcgg

SEQ ID NO: 124104 - RNA, 22 nt, Homo sapiens
auacacauuccugggccucacc

SEQ ID NO: 124105 - RNA, 22 nt, Homo sapiens
auacagacacagucagaggggu

SEQ ID NO: 124106 - RNA, 22 nt, Homo sapiens
auacagcuaaaauauuaaguua

SEQ ID NO: 124107 - RNA, 22 nt, Homo sapiens
auacaguguauguauaguacau

SEQ ID NO: 124108 - RNA, 22 nt, Homo sapiens
auacaugugucauguugguuug

SEQ ID NO: 124109 - RNA, 22 nt, Homo sapiens
auacaugugugagcgaagaugu

SEQ ID NO: 124110 - RNA, 22 nt, Homo sapiens
auacauguuucauguuggugug

SEQ ID NO: 124111 - RNA, 22 nt, Homo sapiens
auaccuuguagugcuauuugau

SEQ ID NO: 124112 - RNA, 22 nt, Homo sapiens
auacuguacugaaguacccauu

SEQ ID NO: 124113 - RNA, 22 nt, Homo sapiens
auacuguauaggauuguagccu

SEQ ID NO: 124114 - RNA, 22 nt, Homo sapiens
auacuguuuuacaucauugccu

SEQ ID NO: 124115 - RNA, 21 nt, Homo sapiens
auacuugagacuggguaauuu

SEQ ID NO: 124116 - RNA, 22 nt, Homo sapiens
auagaggacugaggugaucuuu

SEQ ID NO: 124117 - RNA, 22 nt, Homo sapiens
auagagugcuucaucaguagua

SEQ ID NO: 124118 - RNA, 22 nt, Homo sapiens
auagcaaugcaagaauggcuua

SEQ ID NO: 124119 - RNA, 22 nt, Homo sapiens
auagcacuuaccacaggcugca

SEQ ID NO: 124120 - RNA, 22 nt, Homo sapiens
auagcacuuauagauuuggucu

SEQ ID NO: 124121 - RNA, 22 nt, Homo sapiens
auagcagaacagugucucacug

SEQ ID NO: 124122 - RNA, 22 nt, Homo sapiens
auagcagacauuucaaggcagg

SEQ ID NO: 124123 - RNA, 22 nt, Homo sapiens
auagcagcagcuaguagugaua

SEQ ID NO: 124124 - RNA, 22 nt, Homo sapiens
auagcagcauauguaauguuga

SEQ ID NO: 124125 - RNA, 20 nt, Homo sapiens
auagcagcaugauuuauaau

SEQ ID NO: 124126 - RNA, 22 nt, Homo sapiens
auagcagcuugucagggcagac

SEQ ID NO: 124127 - RNA, 22 nt, Homo sapiens
auagcagugccccaaacuccug

SEQ ID NO: 124128 - RNA, 22 nt, Homo sapiens
auagcauaucccacaugucaga

SEQ ID NO: 124129 - RNA, 22 nt, Homo sapiens
auaggcacauuaggaacuuuug

SEQ ID NO: 124130 - RNA, 21 nt, Homo sapiens
auagggcuuguugauaguuaa

SEQ ID NO: 124131 - RNA, 22 nt, Homo sapiens
auagguagcauagcaggaauau

SEQ ID NO: 124132 - RNA, 22 nt, Homo sapiens
auaguauaguugaggauggcau

SEQ ID NO: 124133 - RNA, 20 nt, Homo sapiens
cucugguugugaauugucuu

SEQ ID NO: 124134 - RNA, 21 nt, Homo sapiens
cucugguuugcauuggauuau

SEQ ID NO: 124135 - RNA, 22 nt, Homo sapiens
cucuuugaguuccuccuggugu

SEQ ID NO: 124136 - RNA, 22 nt, Homo sapiens
cucuuuggaugccuuaggguua

SEQ ID NO: 124137 - RNA, 22 nt, Homo sapiens
cugaaaagcaucugcauagcug

SEQ ID NO: 124138 - RNA, 22 nt, Homo sapiens
cugaaagagcauguaacacagu

SEQ ID NO: 124139 - RNA, 22 nt, Homo sapiens
cugaaauggaaugugugcacag

SEQ ID NO: 124140 - RNA, 22 nt, Homo sapiens
cugaaggcagguagaauagaga

SEQ ID NO: 124141 - RNA, 22 nt, Homo sapiens
cugaagugcuugccacauaaaa

SEQ ID NO: 124142 - RNA, 22 nt, Homo sapiens
cugacaagugaucacagcagca

SEQ ID NO: 124143 - RNA, 22 nt, Homo sapiens
cugacagaugacugccacugua

SEQ ID NO: 124144 - RNA, 22 nt, Homo sapiens
cugacaucuucaagugaggaga

SEQ ID NO: 124145 - RNA, 22 nt, Homo sapiens
cugacauuguugaucacagcca

SEQ ID NO: 124146 - RNA, 22 nt, Homo sapiens
cugaccauagacuacucugggc

SEQ ID NO: 124147 - RNA, 17 nt, Homo sapiens
cugaccucauuguguac

SEQ ID NO: 124148 - RNA, 22 nt, Homo sapiens
cugagaaugaugauuuccaguu

SEQ ID NO: 124149 - RNA, 22 nt, Homo sapiens
cugagagaugagaccucucacu

SEQ ID NO: 124150 - RNA, 22 nt, Homo sapiens
cugagaucguggggcugcuguc

SEQ ID NO: 124151 - RNA, 22 nt, Homo sapiens
cugagcaaaaugaagacacgau

SEQ ID NO: 124152 - RNA, 22 nt, Homo sapiens
cugagcucauuucuuuugcuac

SEQ ID NO: 124153 - RNA, 22 nt, Homo sapiens
cugagguauaucccauuagaag

SEQ ID NO: 124154 - RNA, 22 nt, Homo sapiens
cugaggucugaauccagguauc

SEQ ID NO: 124155 - RNA, 22 nt, Homo sapiens
cugaggugggaguuuuucucau

SEQ ID NO: 124156 - RNA, 20 nt, Homo sapiens
cugagguugggguccuuccc

SEQ ID NO: 124157 - RNA, 22 nt, Homo sapiens
cugagguuguucuucucagugg

SEQ ID NO: 124158 - RNA, 22 nt, Homo sapiens
cugaguauaacugaccuuauga

SEQ ID NO: 124159 - RNA, 22 nt, Homo sapiens
cugauaguucucuuuagaguuu

SEQ ID NO: 124160 - RNA, 22 nt, Homo sapiens
cugauaugaugggugauuuuca

SEQ ID NO: 124161 - RNA, 22 nt, Homo sapiens
cugauauuuuaaaauuggcugg

SEQ ID NO: 124162 - RNA, 22 nt, Homo sapiens
cugauauuuuucuggcuugugu

SEQ ID NO: 124163 - RNA, 22 nt, Homo sapiens
cugaucuguagcagccaccaca

SEQ ID NO: 124164 - RNA, 22 nt, Homo sapiens
cugaucuguuauacuuuucuau

SEQ ID NO: 124165 - RNA, 22 nt, Homo sapiens
cugaugaaguauuuguucugga

SEQ ID NO: 124166 - RNA, 22 nt, Homo sapiens
cugauuuguccccagccucaug

SEQ ID NO: 124167 - RNA, 19 nt, Homo sapiens
cugcaagguaauaggucag

SEQ ID NO: 124168 - RNA, 20 nt, Homo sapiens
cugcacauccacucuacuuc

SEQ ID NO: 124169 - RNA, 19 nt, Homo sapiens
cugcacugagaaaaggagg

SEQ ID NO: 124170 - RNA, 22 nt, Homo sapiens
cugcauuggguuaugcauuuuu

SEQ ID NO: 124171 - RNA, 22 nt, Homo sapiens
cugccacugacaccucaaggac

SEQ ID NO: 124172 - RNA, 22 nt, Homo sapiens
cugcuaagagaaugagacuuag

SEQ ID NO: 124173 - RNA, 22 nt, Homo sapiens
cuggaaagaaacccuuaauucu

SEQ ID NO: 124174 - RNA, 22 nt, Homo sapiens
cuggaaagcaaagggugcauug

SEQ ID NO: 124175 - RNA, 22 nt, Homo sapiens
cuggaagaaaaucacgccaucu

SEQ ID NO: 124176 - RNA, 18 nt, Homo sapiens
cuggaaggcuacuacagu

SEQ ID NO: 124177 - RNA, 22 nt, Homo sapiens
cuggaaucuauggauaacaucg

SEQ ID NO: 124178 - RNA, 22 nt, Homo sapiens
cuggacaaaucuggaaagaacc

SEQ ID NO: 124179 - RNA, 22 nt, Homo sapiens
cuggacguugaggcugcaguga

SEQ ID NO: 124180 - RNA, 22 nt, Homo sapiens
cuggagauuaaccaauugccau

SEQ ID NO: 124181 - RNA, 22 nt, Homo sapiens
cuggagcauugguggauuuguu

SEQ ID NO: 124182 - RNA, 22 nt, Homo sapiens
cuggauagucaggagauauaua

SEQ ID NO: 124183 - RNA, 22 nt, Homo sapiens
cuggcaaauguuuucuguaaag

SEQ ID NO: 124184 - RNA, 22 nt, Homo sapiens
cuggcagucugccucuucacug

SEQ ID NO: 124185 - RNA, 22 nt, Homo sapiens
cuggcucugagguguuuagggc

SEQ ID NO: 124186 - RNA, 22 nt, Homo sapiens
cugggaugauguaaauaggcua

SEQ ID NO: 124187 - RNA, 22 nt, Homo sapiens
cugggaugugacuguugccccc

SEQ ID NO: 124188 - RNA, 21 nt, Homo sapiens
auagugcuagagaguagcagg

SEQ ID NO: 124189 - RNA, 22 nt, Homo sapiens
auagugcugcaacaaauauacg

SEQ ID NO: 124190 - RNA, 22 nt, Homo sapiens
auagugcugcaauaaccauggg

SEQ ID NO: 124191 - RNA, 22 nt, Homo sapiens
auagugcuguauuaaacauacg

SEQ ID NO: 124192 - RNA, 22 nt, Homo sapiens
auaguggcaugaucauagcuca

SEQ ID NO: 124193 - RNA, 19 nt, Homo sapiens
auauaacauccaggagcag

SEQ ID NO: 124194 - RNA, 22 nt, Homo sapiens
auauaccuaggcuacaugguuu

SEQ ID NO: 124195 - RNA, 23 nt, Homo sapiens
auauaguagaugugcaguaacau

SEQ ID NO: 124196 - RNA, 22 nt, Homo sapiens
auauaugcuaagugcuaauaaa

SEQ ID NO: 124197 - RNA, 22 nt, Homo sapiens
auaucacucccaauaucgcagg

SEQ ID NO: 124198 - RNA, 22 nt, Homo sapiens
auaucccaguguguaaacacug

SEQ ID NO: 124199 - RNA, 22 nt, Homo sapiens
auaucccuguauaagugaaugu

SEQ ID NO: 124200 - RNA, 22 nt, Homo sapiens
auaucugcauugccauuuaugu

SEQ ID NO: 124201 - RNA, 22 nt, Homo sapiens
auaugcacaguggaguacuauu

SEQ ID NO: 124202 - RNA, 20 nt, Homo sapiens
auaugcauguguuuucacuu

SEQ ID NO: 124203 - RNA, 22 nt, Homo sapiens
auauggguuuuauauuaggcuc

SEQ ID NO: 124204 - RNA, 22 nt, Homo sapiens
aaaacgcauccucacaggucug

SEQ ID NO: 124205 - RNA, 22 nt, Homo sapiens
aaaagcuuagaugggcuuguau

SEQ ID NO: 124206 - RNA, 22 nt, Homo sapiens
aaaaggcuagcuaguaacagaa

SEQ ID NO: 124207 - RNA, 22 nt, Homo sapiens
aaacucuguagcagagacagau

SEQ ID NO: 124208 - RNA, 22 nt, Homo sapiens
aaacugccuuccuuguaggugc

SEQ ID NO: 124209 - RNA, 22 nt, Homo sapiens
aaagaagucagccuguccuuug

SEQ ID NO: 124210 - RNA, 22 nt, Homo sapiens
aaagaguucagguagauuucaa

SEQ ID NO: 124211 - RNA, 22 nt, Homo sapiens
aaaggcacugugacuuuauagg

SEQ ID NO: 124212 - RNA, 22 nt, Homo sapiens
aaaggcaucauuaguaccaagu

SEQ ID NO: 124213 - RNA, 22 nt, Homo sapiens
gaccuuguagaaucucaugauu

SEQ ID NO: 124214 - RNA, 22 nt, Homo sapiens
gacuaaugaaagagugugauau

SEQ ID NO: 124215 - RNA, 22 nt, Homo sapiens
gacuagggaaaauuauuuuguu

SEQ ID NO: 124216 - RNA, 22 nt, Homo sapiens
gacuggcuguuuucuuuauuau

SEQ ID NO: 124217 - RNA, 22 nt, Homo sapiens
gacuugaagaaucuaagggagg

SEQ ID NO: 124218 - RNA, 18 nt, Homo sapiens
gacuuggaguuuacagug

SEQ ID NO: 124219 - RNA, 22 nt, Homo sapiens
gacuuugguagaggaaaaaucu

SEQ ID NO: 124220 - RNA, 22 nt, Homo sapiens
gagaacagaagcauuccuaauu

SEQ ID NO: 124221 - RNA, 22 nt, Homo sapiens
gagaacauuaauaguuaauuuu

SEQ ID NO: 124222 - RNA, 22 nt, Homo sapiens
gagaaccuccagcaagguagua

SEQ ID NO: 124223 - RNA, 22 nt, Homo sapiens
gagaacuaaugguuugauaagg

SEQ ID NO: 124224 - RNA, 22 nt, Homo sapiens
gagaacugagauaagugauauu

SEQ ID NO: 124225 - RNA, 22 nt, Homo sapiens
gagaacuggcugauucaaggac

SEQ ID NO: 124226 - RNA, 22 nt, Homo sapiens
gagaaguaaauuuauuugcaaa

SEQ ID NO: 124227 - RNA, 22 nt, Homo sapiens
gagaagugcgucguuugaugau

SEQ ID NO: 124228 - RNA, 21 nt, Homo sapiens
gagaaucaucauggcugcaua

SEQ ID NO: 124229 - RNA, 22 nt, Homo sapiens
gagacagugucagccauugaaa

SEQ ID NO: 124230 - RNA, 22 nt, Homo sapiens
gagacauguuugccaauaauuu

SEQ ID NO: 124231 - RNA, 22 nt, Homo sapiens
gagacauugacuuuguuccaga

SEQ ID NO: 124232 - RNA, 23 nt, Homo sapiens
gagaccagcuucagaaagcacga

SEQ ID NO: 124233 - RNA, 22 nt, Homo sapiens
gagacugagucucacucuguca

SEQ ID NO: 124234 - RNA, 22 nt, Homo sapiens
gagacugagucuugcucugucg

SEQ ID NO: 124235 - RNA, 22 nt, Homo sapiens
gagacugaguuuugcucuuguu

SEQ ID NO: 124236 - RNA, 22 nt, Homo sapiens
gagagucacagugaauguggca

SEQ ID NO: 124237 - RNA, 22 nt, Homo sapiens
gagagugugucagaggcugcga

SEQ ID NO: 124238 - RNA, 22 nt, Homo sapiens
gagauaaauaggucacaguucu

SEQ ID NO: 124239 - RNA, 22 nt, Homo sapiens
gagauauuauuucccuuucaca

SEQ ID NO: 124240 - RNA, 22 nt, Homo sapiens
gagauauucugguuuacuaaau

SEQ ID NO: 124241 - RNA, 22 nt, Homo sapiens
gagaucaugcugguucucucau

SEQ ID NO: 124242 - RNA, 22 nt, Homo sapiens
gagaugaaaucuugcucuguca

SEQ ID NO: 124243 - RNA, 22 nt, Homo sapiens
gagaugauuugccccauguauu

SEQ ID NO: 124244 - RNA, 22 nt, Homo sapiens
gagaugcaccuugucacguuuc

SEQ ID NO: 124245 - RNA, 20 nt, Homo sapiens
gagauguugaucagggcuau

SEQ ID NO: 124246 - RNA, 22 nt, Homo sapiens
gagauguuuguuucacugucac

SEQ ID NO: 124247 - RNA, 22 nt, Homo sapiens
gagauguuuuguuaucaaagga

SEQ ID NO: 124248 - RNA, 22 nt, Homo sapiens
gagauuaauacacaucaaaugc

SEQ ID NO: 124249 - RNA, 22 nt, Homo sapiens
gagauuauugucucccucacca

SEQ ID NO: 124250 - RNA, 22 nt, Homo sapiens
gagauucaucuagguccagaga

SEQ ID NO: 124251 - RNA, 22 nt, Homo sapiens
gagcaaugauugagccacugua

SEQ ID NO: 124252 - RNA, 22 nt, Homo sapiens
gagcacugaauacugugguggu

SEQ ID NO: 124253 - RNA, 22 nt, Homo sapiens
gagcuagcauuuagacaucugg

SEQ ID NO: 124254 - RNA, 21 nt, Homo sapiens
gagcuaggugaggcuguaaug

SEQ ID NO: 124255 - RNA, 22 nt, Homo sapiens
gagcuagugcuuaugcaccacu

SEQ ID NO: 124256 - RNA, 22 nt, Homo sapiens
cuggugagaugucuuuccucuu

SEQ ID NO: 124257 - RNA, 22 nt, Homo sapiens
cugguuguuacaugcuugccag

SEQ ID NO: 124258 - RNA, 22 nt, Homo sapiens
cugucacaguuuuggaggccag

SEQ ID NO: 124259 - RNA, 22 nt, Homo sapiens
cugucaucauuucuaugugcca

SEQ ID NO: 124260 - RNA, 22 nt, Homo sapiens
cuguccugcagagucagaauga

SEQ ID NO: 124261 - RNA, 22 nt, Homo sapiens
cugucucagccucuccaguagc

SEQ ID NO: 124262 - RNA, 22 nt, Homo sapiens
cugucuggaggccugcaaauaa

SEQ ID NO: 124263 - RNA, 17 nt, Homo sapiens
cugugaugaucuugucu

SEQ ID NO: 124264 - RNA, 22 nt, Homo sapiens
cugugcauaucuuggacugugu

SEQ ID NO: 124265 - RNA, 22 nt, Homo sapiens
cugugcauguuguccaauucuu

SEQ ID NO: 124266 - RNA, 19 nt, Homo sapiens
cugugcauuucuguggaag

SEQ ID NO: 124267 - RNA, 23 nt, Homo sapiens
cuguggauaugaguuguaaaugg

SEQ ID NO: 124268 - RNA, 22 nt, Homo sapiens
cuguggauguauugcacagucu

SEQ ID NO: 124269 - RNA, 20 nt, Homo sapiens
cugugguagggaccaggaau

SEQ ID NO: 124270 - RNA, 23 nt, Homo sapiens
cuguggugaggcccuagaaucug

SEQ ID NO: 124271 - RNA, 22 nt, Homo sapiens
cugugguugagcuuugccauga

SEQ ID NO: 124272 - RNA, 22 nt, Homo sapiens
cuguucaaauuguuugugaagu

SEQ ID NO: 124273 - RNA, 22 nt, Homo sapiens
cuguugcaguuauggcugcagg

SEQ ID NO: 124274 - RNA, 22 nt, Homo sapiens
cuguugguguuuaaucacugca

SEQ ID NO: 124275 - RNA, 22 nt, Homo sapiens
cuguuugguaaggaugccucag

SEQ ID NO: 124276 - RNA, 22 nt, Homo sapiens
cuguuugguuaucuuuuccugu

SEQ ID NO: 124277 - RNA, 18 nt, Homo sapiens
cuuaacauugggaugaua

SEQ ID NO: 124278 - RNA, 22 nt, Homo sapiens
cuuacagucuaucagccacaac

SEQ ID NO: 124279 - RNA, 22 nt, Homo sapiens
cuuaggguacuuuggugcauca

SEQ ID NO: 124280 - RNA, 22 nt, Homo sapiens
cuucaaaguuggcuaggagaca

SEQ ID NO: 124281 - RNA, 20 nt, Homo sapiens
cuucacagaaguggaaucau

SEQ ID NO: 124282 - RNA, 22 nt, Homo sapiens
cuucaugucuucaauggggggg

SEQ ID NO: 124283 - RNA, 22 nt, Homo sapiens
cuuccaaguggggcacgugcca

SEQ ID NO: 124284 - RNA, 22 nt, Homo sapiens
cuuccagcuggguucagucagu

SEQ ID NO: 124285 - RNA, 22 nt, Homo sapiens
cuuccauauucuaggacaggcu

SEQ ID NO: 124286 - RNA, 20 nt, Homo sapiens
cuugaagacuaugcugcuga

SEQ ID NO: 124287 - RNA, 22 nt, Homo sapiens
cuugacacugcaguuuuccugg

SEQ ID NO: 124288 - RNA, 22 nt, Homo sapiens
cuugcacuccacuguucuccug

SEQ ID NO: 124289 - RNA, 19 nt, Homo sapiens
cuugccccauucauccucu

SEQ ID NO: 124290 - RNA, 22 nt, Homo sapiens
cuugggcagugugcauguguau

SEQ ID NO: 124291 - RNA, 22 nt, Homo sapiens
cuugucuugcacacgguugcca

SEQ ID NO: 124292 - RNA, 19 nt, Homo sapiens
cuugugccugaagcuuggg

SEQ ID NO: 124293 - RNA, 22 nt, Homo sapiens
cuuguguuacauauuuaagaga

SEQ ID NO: 124294 - RNA, 22 nt, Homo sapiens
cuuguucuccuaagaugaaugc

SEQ ID NO: 124295 - RNA, 22 nt, Homo sapiens
auagguuauuagagcaaagcuu

SEQ ID NO: 124296 - RNA, 22 nt, Homo sapiens
auaguagagagggcaaaaugcu

SEQ ID NO: 124297 - RNA, 22 nt, Homo sapiens
auaguagcaugcacuggugcug

SEQ ID NO: 124298 - RNA, 22 nt, Homo sapiens
auagucaguagucucauaauga

SEQ ID NO: 124299 - RNA, 22 nt, Homo sapiens
auagugcugcaagaaacauacg

SEQ ID NO: 124300 - RNA, 22 nt, Homo sapiens
auagugcugcaauaaacacacg

SEQ ID NO: 124301 - RNA, 22 nt, Homo sapiens
auagugcugcaauaaacauaca

SEQ ID NO: 124302 - RNA, 22 nt, Homo sapiens
auagugcugcaauuaacauaca

SEQ ID NO: 124303 - RNA, 22 nt, Homo sapiens
auagugcugcagucaauguacg

SEQ ID NO: 124304 - RNA, 22 nt, Homo sapiens
auauagcucuggcuggaugacu

SEQ ID NO: 124305 - RNA, 22 nt, Homo sapiens
auauaugcacacgugugcauau

SEQ ID NO: 124306 - RNA, 22 nt, Homo sapiens
auaucaaggccauuuucuaaau

SEQ ID NO: 124307 - RNA, 22 nt, Homo sapiens
auaucacaggaaaggaagauac

SEQ ID NO: 124308 - RNA, 22 nt, Homo sapiens
auauccuggagcauuuuugcaa

SEQ ID NO: 124309 - RNA, 20 nt, Homo sapiens
auaugcagacacauacauac

SEQ ID NO: 124310 - RNA, 22 nt, Homo sapiens
auaugcauacauguaugcagga

SEQ ID NO: 124311 - RNA, 22 nt, Homo sapiens
auauggcauucagaacuguaua

SEQ ID NO: 124312 - RNA, 22 nt, Homo sapiens
auauggcuuuuauuauguugag

SEQ ID NO: 124313 - RNA, 22 nt, Homo sapiens
auauggucccuguucucaagga

SEQ ID NO: 124314 - RNA, 22 nt, Homo sapiens
auauguaguuucagaaguggaa

SEQ ID NO: 124315 - RNA, 17 nt, Homo sapiens
auaugucugcuggggga

SEQ ID NO: 124316 - RNA, 21 nt, Homo sapiens
auaugugcuguggaagucagc

SEQ ID NO: 124317 - RNA, 22 nt, Homo sapiens
auauucaagugaggauggcuaa

SEQ ID NO: 124318 - RNA, 22 nt, Homo sapiens
auauucacuauaugcagaacca

SEQ ID NO: 124319 - RNA, 18 nt, Homo sapiens
auauugccuucagacuag

SEQ ID NO: 124320 - RNA, 22 nt, Homo sapiens
auauugguuaaauauuauguga

SEQ ID NO: 124321 - RNA, 19 nt, Homo sapiens
aucaaacugcucuuugagg

SEQ ID NO: 124322 - RNA, 22 nt, Homo sapiens
aucaaagcagcauggcccaguc

SEQ ID NO: 124323 - RNA, 22 nt, Homo sapiens
aucaaaguuucccagaaguugu

SEQ ID NO: 124324 - RNA, 22 nt, Homo sapiens
aucaagcuacacccuuuggaaa

SEQ ID NO: 124325 - RNA, 22 nt, Homo sapiens
aucacagaguuaaaacuuucuu

SEQ ID NO: 124326 - RNA, 22 nt, Homo sapiens
uaacaguauaugugguaucuau

SEQ ID NO: 124327 - RNA, 22 nt, Homo sapiens
uaacauucacaugcugcaaaaa

SEQ ID NO: 124328 - RNA, 22 nt, Homo sapiens
uaacauugucuugcuuaguuuu

SEQ ID NO: 124329 - RNA, 22 nt, Homo sapiens
uaacucugccuagugacauggu

SEQ ID NO: 124330 - RNA, 22 nt, Homo sapiens
uaacugcaaccuccgccucccg

SEQ ID NO: 124331 - RNA, 18 nt, Homo sapiens
uaacuggugugagauggu

SEQ ID NO: 124332 - RNA, 22 nt, Homo sapiens
uaacuguggaaaugacuuuaaa

SEQ ID NO: 124333 - RNA, 18 nt, Homo sapiens
uaacugugggaacuaacu

SEQ ID NO: 124334 - RNA, 22 nt, Homo sapiens
uaagacacauguguucccaggc

SEQ ID NO: 124335 - RNA, 22 nt, Homo sapiens
uaagacacuuaaaauguuacau

SEQ ID NO: 124336 - RNA, 22 nt, Homo sapiens
uaagacuguguaauuuaugaag

SEQ ID NO: 124337 - RNA, 22 nt, Homo sapiens
uaagacuguuggcaauuuuugc

SEQ ID NO: 124338 - RNA, 19 nt, Homo sapiens
uaagaugaagcugucuggg

SEQ ID NO: 124339 - RNA, 22 nt, Homo sapiens
uaagcuauagugaauaaauugc

SEQ ID NO: 124340 - RNA, 22 nt, Homo sapiens
uaaggaaggcugugugcuuuua

SEQ ID NO: 124341 - RNA, 22 nt, Homo sapiens
uaaggcuucuuggaauacugca

SEQ ID NO: 124342 - RNA, 22 nt, Homo sapiens
uaaggcuuugucuuaggacuuu

SEQ ID NO: 124343 - RNA, 22 nt, Homo sapiens
uaaguaauugcagcaauuugcc

SEQ ID NO: 124344 - RNA, 22 nt, Homo sapiens
uaaguaguuucuggauauucuc

SEQ ID NO: 124345 - RNA, 22 nt, Homo sapiens
uaaguauuuuaauuccuggcau

SEQ ID NO: 124346 - RNA, 22 nt, Homo sapiens
uaagugaaggaaguguguuuac

SEQ ID NO: 124347 - RNA, 22 nt, Homo sapiens
uaagugacuuugagauuccuca

SEQ ID NO: 124348 - RNA, 22 nt, Homo sapiens
uaagugcaacauaaguguuaaa

SEQ ID NO: 124349 - RNA, 22 nt, Homo sapiens
uaagugcuguguuguuaccuaa

SEQ ID NO: 124350 - RNA, 22 nt, Homo sapiens
uaagugcuugacuuugauguuu

SEQ ID NO: 124351 - RNA, 18 nt, Homo sapiens
uaagugcuuuaaacacau

SEQ ID NO: 124352 - RNA, 22 nt, Homo sapiens
uaaguuguagaacguuuucuua

SEQ ID NO: 124353 - RNA, 20 nt, Homo sapiens
uaaguuguauuugucaugaa

SEQ ID NO: 124354 - RNA, 22 nt, Homo sapiens
uaauacuugucauaaaggcauu

SEQ ID NO: 124355 - RNA, 22 nt, Homo sapiens
uaauaugugguugcuugggcac

SEQ ID NO: 124356 - RNA, 22 nt, Homo sapiens
uaaucacagagguuuggccuca

SEQ ID NO: 124357 - RNA, 22 nt, Homo sapiens
uaauccuggcacuuugggaggc

SEQ ID NO: 124358 - RNA, 22 nt, Homo sapiens
uaaucucagcugagcugagauu

SEQ ID NO: 124359 - RNA, 22 nt, Homo sapiens
uaaugcauacagaagguguuuu

SEQ ID NO: 124360 - RNA, 22 nt, Homo sapiens
uaaugcaucagugguaguucuu

SEQ ID NO: 124361 - RNA, 22 nt, Homo sapiens
uaaugcucauuagcaggccaau

SEQ ID NO: 124362 - RNA, 22 nt, Homo sapiens
uaaugcuguggucuaaugggga

SEQ ID NO: 124363 - RNA, 16 nt, Homo sapiens
uacaacagugaguaug

SEQ ID NO: 124364 - RNA, 22 nt, Homo sapiens
uacaagcaggaaaugguauaug

SEQ ID NO: 124365 - RNA, 22 nt, Homo sapiens
uacaagcuaaaauggaagauca

SEQ ID NO: 124366 - RNA, 21 nt, Homo sapiens
uacaagcuguagcacaugcca

SEQ ID NO: 124367 - RNA, 22 nt, Homo sapiens
uacaaguauuuuuauuagugcc

SEQ ID NO: 124368 - RNA, 22 nt, Homo sapiens
uacaauagugacaaaucagcau

SEQ ID NO: 124369 - RNA, 22 nt, Homo sapiens
uacacagucaaaaauuuccagg

SEQ ID NO: 124370 - RNA, 22 nt, Homo sapiens
uacaccugcacucuagccuggg

SEQ ID NO: 124371 - RNA, 22 nt, Homo sapiens
uacacgugcacaacgugcacgu

SEQ ID NO: 124372 - RNA, 20 nt, Homo sapiens
uacacguguagcauucucua

SEQ ID NO: 124373 - RNA, 22 nt, Homo sapiens
uacagaauauuucugcccugag

SEQ ID NO: 124374 - RNA, 22 nt, Homo sapiens
uacagaauucugucccuugagu

SEQ ID NO: 124375 - RNA, 22 nt, Homo sapiens
uacagaguagaagauuugcaga

SEQ ID NO: 124376 - RNA, 22 nt, Homo sapiens
uacagcacaggugcagguguug

SEQ ID NO: 124377 - RNA, 22 nt, Homo sapiens
uacagccacauaauguaugauu

SEQ ID NO: 124378 - RNA, 22 nt, Homo sapiens
uacaggacuucucagaguuauu

SEQ ID NO: 124379 - RNA, 22 nt, Homo sapiens
uacagguauagauguguguucu

SEQ ID NO: 124380 - RNA, 22 nt, Homo sapiens
uacaggugcucuacagacagga

SEQ ID NO: 124381 - RNA, 22 nt, Homo sapiens
uacaguaguaucuucauuuguu

SEQ ID NO: 124382 - RNA, 22 nt, Homo sapiens
uacagucacauuccugaccaua

SEQ ID NO: 124383 - RNA, 22 nt, Homo sapiens
uacaguccaugcauuauccucc

SEQ ID NO: 124384 - RNA, 22 nt, Homo sapiens
uacagucuagaggagaaucagg

SEQ ID NO: 124385 - RNA, 22 nt, Homo sapiens
uacauacuucacagacuuuaaa

SEQ ID NO: 124386 - RNA, 22 nt, Homo sapiens
augagauaggaacaaacuuaca

SEQ ID NO: 124387 - RNA, 22 nt, Homo sapiens
augagauauuuuauaagaucau

SEQ ID NO: 124388 - RNA, 22 nt, Homo sapiens
augagaugaauaccgacgaugu

SEQ ID NO: 124389 - RNA, 22 nt, Homo sapiens
augagaugcaagauuagauggg

SEQ ID NO: 124390 - RNA, 22 nt, Homo sapiens
augagauuguuugugugaaaua

SEQ ID NO: 124391 - RNA, 22 nt, Homo sapiens
augagcagaagagauacacugu

SEQ ID NO: 124392 - RNA, 22 nt, Homo sapiens
augagcaucaccagaaucaaua

SEQ ID NO: 124393 - RNA, 22 nt, Homo sapiens
augagcuauggagacagggcca

SEQ ID NO: 124394 - RNA, 17 nt, Homo sapiens
augagcucaucauuuuu

SEQ ID NO: 124395 - RNA, 22 nt, Homo sapiens
augaggaaggagccuuugucug

SEQ ID NO: 124396 - RNA, 22 nt, Homo sapiens
augaggacaucuuccuuaugga

SEQ ID NO: 124397 - RNA, 22 nt, Homo sapiens
augaggagguaugauuuucuga

SEQ ID NO: 124398 - RNA, 22 nt, Homo sapiens
augagggagggcaccugaccuu

SEQ ID NO: 124399 - RNA, 22 nt, Homo sapiens
augagguaauaaguccuuggaa

SEQ ID NO: 124400 - RNA, 22 nt, Homo sapiens
augaggugauaucuggaaauua

SEQ ID NO: 124401 - RNA, 21 nt, Homo sapiens
augagguguacuguggugaaa

SEQ ID NO: 124402 - RNA, 22 nt, Homo sapiens
augagucacuuauuauuggggu

SEQ ID NO: 124403 - RNA, 22 nt, Homo sapiens
augauacguuacuucacugggg

SEQ ID NO: 124404 - RNA, 22 nt, Homo sapiens
augauacuggcuucauagaaug

SEQ ID NO: 124405 - RNA, 22 nt, Homo sapiens
augauagucuugagaagcauuu

SEQ ID NO: 124406 - RNA, 22 nt, Homo sapiens
augauaucuuguuuuucaugca

SEQ ID NO: 124407 - RNA, 22 nt, Homo sapiens
augauaugagaaaggaucaaca

SEQ ID NO: 124408 - RNA, 22 nt, Homo sapiens
augaucacaccacugcacucca

SEQ ID NO: 124409 - RNA, 22 nt, Homo sapiens
augaucacugugccuccuguga

SEQ ID NO: 124410 - RNA, 22 nt, Homo sapiens
augaucacuguggaaauucagc

SEQ ID NO: 124411 - RNA, 22 nt, Homo sapiens
augaucaucugaaagcuuuuac

SEQ ID NO: 124412 - RNA, 22 nt, Homo sapiens
augauucugaucuagagcuugg

SEQ ID NO: 124413 - RNA, 22 nt, Homo sapiens
augauuguucucacucaagaga

SEQ ID NO: 124414 - RNA, 22 nt, Homo sapiens
uagcacaguucacccucgauuu

SEQ ID NO: 124415 - RNA, 22 nt, Homo sapiens
uagcacaucccuaaaaugcugu

SEQ ID NO: 124416 - RNA, 22 nt, Homo sapiens
uagcaccaaacauauacucagu

SEQ ID NO: 124417 - RNA, 22 nt, Homo sapiens
uagcacuauuuauugaaaagga

SEQ ID NO: 124418 - RNA, 22 nt, Homo sapiens
uagcacugucuugcaccugugc

SEQ ID NO: 124419 - RNA, 22 nt, Homo sapiens
uagcagaauaacuugccagccu

SEQ ID NO: 124420 - RNA, 22 nt, Homo sapiens
uagcagcaccccacucuacugg

SEQ ID NO: 124421 - RNA, 20 nt, Homo sapiens
uagcagcagacagagggagg

SEQ ID NO: 124422 - RNA, 22 nt, Homo sapiens
uagcagcaucucuggcuucuac

SEQ ID NO: 124423 - RNA, 19 nt, Homo sapiens
uagcagcaugauuuauaau

SEQ ID NO: 124424 - RNA, 22 nt, Homo sapiens
uagcagcauuuuuguagaguau

SEQ ID NO: 124425 - RNA, 22 nt, Homo sapiens
uagcaggaaaggggucagaucu

SEQ ID NO: 124426 - RNA, 22 nt, Homo sapiens
uagcaguaaagaaugugauguu

SEQ ID NO: 124427 - RNA, 22 nt, Homo sapiens
uagcaguauggagcgaggccca

SEQ ID NO: 124428 - RNA, 22 nt, Homo sapiens
uagcagucaagauagucauuau

SEQ ID NO: 124429 - RNA, 22 nt, Homo sapiens
uagcagugugaaaacggacuaa

SEQ ID NO: 124430 - RNA, 22 nt, Homo sapiens
uagcaucagauuccauauucua

SEQ ID NO: 124431 - RNA, 22 nt, Homo sapiens
uagcaugacacuuguugaaugc

SEQ ID NO: 124432 - RNA, 22 nt, Homo sapiens
uagcccagugagguugauuugg

SEQ ID NO: 124433 - RNA, 20 nt, Homo sapiens
uagccggguguugugucaug

SEQ ID NO: 124434 - RNA, 21 nt, Homo sapiens
uagcucagugguguugccaua

SEQ ID NO: 124435 - RNA, 22 nt, Homo sapiens
uagcugguucuccaggagcuag

SEQ ID NO: 124436 - RNA, 22 nt, Homo sapiens
uagcuucuccauagcuccaugu

SEQ ID NO: 124437 - RNA, 22 nt, Homo sapiens
uaggagcacagcagcauguggg

SEQ ID NO: 124438 - RNA, 22 nt, Homo sapiens
uaggagcauaggauuguuugag

SEQ ID NO: 124439 - RNA, 22 nt, Homo sapiens
uaggagugugaacccuguuuug

SEQ ID NO: 124440 - RNA, 22 nt, Homo sapiens
uaggcaaguugcccaaucucuc

SEQ ID NO: 124441 - RNA, 22 nt, Homo sapiens
uaggcacacaucuacuacaaau

SEQ ID NO: 124442 - RNA, 22 nt, Homo sapiens
uaggcaguguucucacuuguaa

SEQ ID NO: 124443 - RNA, 21 nt, Homo sapiens
uaggccgggugcaggaugcuu

SEQ ID NO: 124444 - RNA, 22 nt, Homo sapiens
uaggcuguguggccguggggcu

SEQ ID NO: 124445 - RNA, 22 nt, Homo sapiens
uagggaguguccuuucgggaaa

SEQ ID NO: 124446 - RNA, 22 nt, Homo sapiens
uagggaguuuuggggugcagaa

SEQ ID NO: 124447 - RNA, 22 nt, Homo sapiens
uagggcuuuaguuugcuugugu

SEQ ID NO: 124448 - RNA, 19 nt, Homo sapiens
uagguacauucaagucucc

SEQ ID NO: 124449 - RNA, 22 nt, Homo sapiens
uaggucuccuuuuugccuaaau

SEQ ID NO: 124450 - RNA, 22 nt, Homo sapiens
uaggucuuuuaugaaauauauu

SEQ ID NO: 124451 - RNA, 22 nt, Homo sapiens
uaggugauugaagguggaaugu

SEQ ID NO: 124452 - RNA, 22 nt, Homo sapiens
uagguuaucucaaguguaauuu

SEQ ID NO: 124453 - RNA, 18 nt, Homo sapiens
uaguacuguucucaugau

SEQ ID NO: 124454 - RNA, 22 nt, Homo sapiens
uaguagcaccucucaugagcuu

SEQ ID NO: 124455 - RNA, 22 nt, Homo sapiens
uaguaguuuuguguauaauaau

SEQ ID NO: 124456 - RNA, 22 nt, Homo sapiens
uaguauguuuauagcauugagu

SEQ ID NO: 124457 - RNA, 21 nt, Homo sapiens
uagugcugaggcaguauggga

SEQ ID NO: 124458 - RNA, 22 nt, Homo sapiens
uaguuaguagacucugauuauu

SEQ ID NO: 124459 - RNA, 22 nt, Homo sapiens
uaguucauuuuucuugcuuaga

SEQ ID NO: 124460 - RNA, 22 nt, Homo sapiens
uaguugcaucuuaggucuguga

SEQ ID NO: 124461 - RNA, 22 nt, Homo sapiens
uaguugcauucaggauaugacg

SEQ ID NO: 124462 - RNA, 22 nt, Homo sapiens
uaguugcauuggcugcuaugcu

SEQ ID NO: 124463 - RNA, 22 nt, Homo sapiens
uauaacaaugcaagaauggccu

SEQ ID NO: 124464 - RNA, 22 nt, Homo sapiens
uauaagacuagcagcugaauug

SEQ ID NO: 124465 - RNA, 22 nt, Homo sapiens
uauacaugugccauguuggugu

SEQ ID NO: 124466 - RNA, 20 nt, Homo sapiens
uauagcaauuuuuuucuccu

SEQ ID NO: 124467 - RNA, 22 nt, Homo sapiens
uauagcacugagaauguaauuc

SEQ ID NO: 124468 - RNA, 17 nt, Homo sapiens
uauagcacuucucacau

SEQ ID NO: 124469 - RNA, 22 nt, Homo sapiens
uauagcccuugguguggaaaug

SEQ ID NO: 124470 - RNA, 22 nt, Homo sapiens
uauaggacuugguguaguuucu

SEQ ID NO: 124471 - RNA, 21 nt, Homo sapiens
uauaguaguaugauuuacaau

SEQ ID NO: 124472 - RNA, 22 nt, Homo sapiens
uauauaagcugaugagccacaa

SEQ ID NO: 124473 - RNA, 22 nt, Homo sapiens
uauaucacaugcacucauuuuc

SEQ ID NO: 124474 - RNA, 22 nt, Homo sapiens
uauaucuguccauggcccugcu

SEQ ID NO: 124475 - RNA, 21 nt, Homo sapiens
uauaugacuuacuauugccuc

SEQ ID NO: 124476 - RNA, 22 nt, Homo sapiens
uauaugcauugugggguacuga

SEQ ID NO: 124477 - RNA, 22 nt, Homo sapiens
aggagcacaauggucaugugga

SEQ ID NO: 124478 - RNA, 21 nt, Homo sapiens
aggagcauucucuugcuuugu

SEQ ID NO: 124479 - RNA, 22 nt, Homo sapiens
aggauuagagacuucucuaccu

SEQ ID NO: 124480 - RNA, 21 nt, Homo sapiens
aggcaagacuuuuagguuugu

SEQ ID NO: 124481 - RNA, 22 nt, Homo sapiens
aggcaagugggagacagcauuu

SEQ ID NO: 124482 - RNA, 22 nt, Homo sapiens
aggcaugaaauacaugcauuga

SEQ ID NO: 124483 - RNA, 22 nt, Homo sapiens
aggcauugugcaucgaugauuu

SEQ ID NO: 124484 - RNA, 22 nt, Homo sapiens
aggccaguuuuuggagggaaac

SEQ ID NO: 124485 - RNA, 22 nt, Homo sapiens
aggcuagaaucuuccaucuugg

SEQ ID NO: 124486 - RNA, 22 nt, Homo sapiens
aggcuagacuuugagaauuuuu

SEQ ID NO: 124487 - RNA, 22 nt, Homo sapiens
aggcuguguggauaauauuggg

SEQ ID NO: 124488 - RNA, 21 nt, Homo sapiens
aggcuguuguuuugggaugga

SEQ ID NO: 124489 - RNA, 22 nt, Homo sapiens
agggcaguguuaggacugucug

SEQ ID NO: 124490 - RNA, 22 nt, Homo sapiens
agguauguauguaugggagaaa

SEQ ID NO: 124491 - RNA, 22 nt, Homo sapiens
aggucaccucaggaaauacuga

SEQ ID NO: 124492 - RNA, 22 nt, Homo sapiens
agguccacuuacuacuccuguu

SEQ ID NO: 124493 - RNA, 22 nt, Homo sapiens
agguccauuauuuucauucaug

SEQ ID NO: 124494 - RNA, 22 nt, Homo sapiens
aggugcaugcuucacuggauau

SEQ ID NO: 124495 - RNA, 22 nt, Homo sapiens
aggugcugacaggauagguuuc

SEQ ID NO: 124496 - RNA, 22 nt, Homo sapiens
aggugguauuuaaaauuauuug

SEQ ID NO: 124497 - RNA, 22 nt, Homo sapiens
agguuaccuggugauuuugucu

SEQ ID NO: 124498 - RNA, 20 nt, Homo sapiens
agguuauuauaauuagaaga

SEQ ID NO: 124499 - RNA, 22 nt, Homo sapiens
agguuuucagccccagccuagg

SEQ ID NO: 124500 - RNA, 22 nt, Homo sapiens
aguaagauggcaacucuccaca

SEQ ID NO: 124501 - RNA, 22 nt, Homo sapiens
aguaaucaucugagggcagaaa

SEQ ID NO: 124502 - RNA, 22 nt, Homo sapiens
aguaccauuacucacuuauuuu

SEQ ID NO: 124503 - RNA, 22 nt, Homo sapiens
aguaucacaagguguacaccca

SEQ ID NO: 124504 - RNA, 22 nt, Homo sapiens
aguauugcuaauaagagauuug

SEQ ID NO: 124505 - RNA, 22 nt, Homo sapiens
agucaaaugcuuauguauaaag

SEQ ID NO: 124506 - RNA, 22 nt, Homo sapiens
agucaagugggguuagauaguu

SEQ ID NO: 124507 - RNA, 22 nt, Homo sapiens
agucaaguuuuuucagagaaua

SEQ ID NO: 124508 - RNA, 22 nt, Homo sapiens
agucacagccuuuuacuuuaga

SEQ ID NO: 124509 - RNA, 22 nt, Homo sapiens
agucacaugccagcacacccag

SEQ ID NO: 124510 - RNA, 22 nt, Homo sapiens
agucagauuggcauuuguuggg

SEQ ID NO: 124511 - RNA, 22 nt, Homo sapiens
agucaguguguauugauggcac

SEQ ID NO: 124512 - RNA, 22 nt, Homo sapiens
gugcacaacguguagguuuguu

SEQ ID NO: 124513 - RNA, 21 nt, Homo sapiens
gugcacaguaguguuuaauag

SEQ ID NO: 124514 - RNA, 22 nt, Homo sapiens
gugcacaucuguguuccagcua

SEQ ID NO: 124515 - RNA, 21 nt, Homo sapiens
gugcagaugccacagucacuc

SEQ ID NO: 124516 - RNA, 22 nt, Homo sapiens
gugcaguuuuaagugaguuucu

SEQ ID NO: 124517 - RNA, 22 nt, Homo sapiens
gugcauacgucuuuauaguagc

SEQ ID NO: 124518 - RNA, 19 nt, Homo sapiens
gugcauaguuauuaaagag

SEQ ID NO: 124519 - RNA, 22 nt, Homo sapiens
gugccacaguguuaagggauuc

SEQ ID NO: 124520 - RNA, 22 nt, Homo sapiens
gugccacugcacuccggccugg

SEQ ID NO: 124521 - RNA, 22 nt, Homo sapiens
gugccuagugcuauugugcccu

SEQ ID NO: 124522 - RNA, 16 nt, Homo sapiens
gugcuguguuguuagg

SEQ ID NO: 124523 - RNA, 21 nt, Homo sapiens
gugcuuguagccucacuucug

SEQ ID NO: 124524 - RNA, 22 nt, Homo sapiens
gugcuuuguuguggcaguggca

SEQ ID NO: 124525 - RNA, 21 nt, Homo sapiens
guggaaauggaauuuacuaau

SEQ ID NO: 124526 - RNA, 22 nt, Homo sapiens
guggaagaaaucagguuauuug

SEQ ID NO: 124527 - RNA, 22 nt, Homo sapiens
guggaaugauaucucauugugg

SEQ ID NO: 124528 - RNA, 17 nt, Homo sapiens
guggaaugucaugucaa

SEQ ID NO: 124529 - RNA, 22 nt, Homo sapiens
guggacaugaauuuuggaggca

SEQ ID NO: 124530 - RNA, 22 nt, Homo sapiens
guggagcuguguggccuugggc

SEQ ID NO: 124531 - RNA, 22 nt, Homo sapiens
guggagucaucacucagagugg

SEQ ID NO: 124532 - RNA, 18 nt, Homo sapiens
guggagugucuuccugga

SEQ ID NO: 124533 - RNA, 22 nt, Homo sapiens
guggcaaacucagcaugcccca

SEQ ID NO: 124534 - RNA, 22 nt, Homo sapiens
guggcaagaugacuacucacug

SEQ ID NO: 124535 - RNA, 22 nt, Homo sapiens
guggcagaacagguaggguucu

SEQ ID NO: 124536 - RNA, 22 nt, Homo sapiens
guggcagagucagagggaaaug

SEQ ID NO: 124537 - RNA, 22 nt, Homo sapiens
guggcaguuuuaaauaugaaaa

SEQ ID NO: 124538 - RNA, 22 nt, Homo sapiens
guggcaugaaagcaucugugau

SEQ ID NO: 124539 - RNA, 22 nt, Homo sapiens
guggcgagaucauagcucauug

SEQ ID NO: 124540 - RNA, 22 nt, Homo sapiens
gugggauaauuuuuggugcugu

SEQ ID NO: 124541 - RNA, 22 nt, Homo sapiens
gugggcucguucguguuagaca

SEQ ID NO: 124542 - RNA, 22 nt, Homo sapiens
gugggguaggguaggacucaac

SEQ ID NO: 124543 - RNA, 22 nt, Homo sapiens
gugguacuaucuuugguuucag

SEQ ID NO: 124544 - RNA, 22 nt, Homo sapiens
gugguaggaaagugcaaaugua

SEQ ID NO: 124545 - RNA, 22 nt, Homo sapiens
gugguuguuggaguggcaauuu

SEQ ID NO: 124546 - RNA, 22 nt, Homo sapiens
gugguuuuaauauucagucuag

SEQ ID NO: 124547 - RNA, 22 nt, Homo sapiens
gugguuuuuagauuucuacagu

SEQ ID NO: 124548 - RNA, 22 nt, Homo sapiens
guguaaaucugcugugaacauu

SEQ ID NO: 124549 - RNA, 22 nt, Homo sapiens
guguaacaacagcacuccacug

SEQ ID NO: 124550 - RNA, 22 nt, Homo sapiens
gugucacugugaggauauugua

SEQ ID NO: 124551 - RNA, 22 nt, Homo sapiens
gugucaugaagguuuuaugcag

SEQ ID NO: 124552 - RNA, 22 nt, Homo sapiens
guguccucgaguacacaucagg

SEQ ID NO: 124553 - RNA, 22 nt, Homo sapiens
gugucucagcccagaccuauuu

SEQ ID NO: 124554 - RNA, 22 nt, Homo sapiens
gugugacugcucuauuagggcg

SEQ ID NO: 124555 - RNA, 22 nt, Homo sapiens
gugugcaaauguguaccuacau

SEQ ID NO: 124556 - RNA, 19 nt, Homo sapiens
gugugcauaucacagagca

SEQ ID NO: 124557 - RNA, 22 nt, Homo sapiens
gugugcauaugucuuuauagua

SEQ ID NO: 124558 - RNA, 21 nt, Homo sapiens
gugugcuugaauucagcuguc

SEQ ID NO: 124559 - RNA, 22 nt, Homo sapiens
guguucaaacccaggucugucu

SEQ ID NO: 124560 - RNA, 22 nt, Homo sapiens
guguucaaagcugauugagauu

SEQ ID NO: 124561 - RNA, 22 nt, Homo sapiens
guuaaugcuggaauaaguuaag

SEQ ID NO: 124562 - RNA, 22 nt, Homo sapiens
guuacagucuuguguaagguua

SEQ ID NO: 124563 - RNA, 22 nt, Homo sapiens
guuagguagaaguuuacuuuga

SEQ ID NO: 124564 - RNA, 22 nt, Homo sapiens
guuauguuauguuauguuaugu

SEQ ID NO: 124565 - RNA, 22 nt, Homo sapiens
guuauuguccauuuauuuagca

SEQ ID NO: 124566 - RNA, 22 nt, Homo sapiens
guucaagugauagcugggauua

SEQ ID NO: 124567 - RNA, 20 nt, Homo sapiens
guucacagagguuaugauua

SEQ ID NO: 124568 - RNA, 22 nt, Homo sapiens
guucaguaguucauucauuuau

SEQ ID NO: 124569 - RNA, 22 nt, Homo sapiens
guucaucaggcuuucucuagag

SEQ ID NO: 124570 - RNA, 22 nt, Homo sapiens
guucaucagggacacugguuug

SEQ ID NO: 124571 - RNA, 22 nt, Homo sapiens
guucaucagggauauuggcuua

SEQ ID NO: 124572 - RNA, 22 nt, Homo sapiens
guucuauguugggaguucacua

SEQ ID NO: 124573 - RNA, 22 nt, Homo sapiens
guucuggagauaaagccaaggu

SEQ ID NO: 124574 - RNA, 20 nt, Homo sapiens
guucuugcucguguaucuuc

SEQ ID NO: 124575 - RNA, 19 nt, Homo sapiens
guugacacuggcucuucag

SEQ ID NO: 124576 - RNA, 22 nt, Homo sapiens
guugagcaagcuuuggagccua

SEQ ID NO: 124577 - RNA, 18 nt, Homo sapiens
guugagcuuuuccuuuag

SEQ ID NO: 124578 - RNA, 22 nt, Homo sapiens
guugcccuuagcacuucagccu

SEQ ID NO: 124579 - RNA, 22 nt, Homo sapiens
guugccuaggcuggagugcagu

SEQ ID NO: 124580 - RNA, 22 nt, Homo sapiens
guugcucaggcuggagugcagu

SEQ ID NO: 124581 - RNA, 22 nt, Homo sapiens
guugguuuccuguaacuggaca

SEQ ID NO: 124582 - RNA, 22 nt, Homo sapiens
guuguauaggcauggggagaau

SEQ ID NO: 124583 - RNA, 22 nt, Homo sapiens
guuuguaacucuagugacuaga

SEQ ID NO: 124584 - RNA, 15 nt, Homo sapiens
guuuuuggauacaau

SEQ ID NO: 124585 - RNA, 22 nt, Homo sapiens
uaaagcacaaguaaagaauacu

SEQ ID NO: 124586 - RNA, 22 nt, Homo sapiens
uaaagccagugauuaugucucu

SEQ ID NO: 124587 - RNA, 22 nt, Homo sapiens
uaaagccauugucaaguuugua

SEQ ID NO: 124588 - RNA, 22 nt, Homo sapiens
uaaagccuagaacuuucagccc

SEQ ID NO: 124589 - RNA, 22 nt, Homo sapiens
uaaagcuacaguauaugguauu

SEQ ID NO: 124590 - RNA, 22 nt, Homo sapiens
uaaagcuaucacauuggugauu

SEQ ID NO: 124591 - RNA, 22 nt, Homo sapiens
uaaagcuuggauuuaggcuaau

SEQ ID NO: 124592 - RNA, 22 nt, Homo sapiens
uaaaguuauugccccucaguua

SEQ ID NO: 124593 - RNA, 22 nt, Homo sapiens
uaaaugacugucaguagaugaa

SEQ ID NO: 124594 - RNA, 22 nt, Homo sapiens
uaaaugcucuuuaaaagugcuu

SEQ ID NO: 124595 - RNA, 22 nt, Homo sapiens
uaaaugcuugagaugauggaua

SEQ ID NO: 124596 - RNA, 22 nt, Homo sapiens
uaaauggauaaaugaauaccua

SEQ ID NO: 124597 - RNA, 22 nt, Homo sapiens
uaaauugcauaaguacaaauga

SEQ ID NO: 124598 - RNA, 22 nt, Homo sapiens
uaacaagagagucagucagucc

SEQ ID NO: 124599 - RNA, 16 nt, Homo sapiens
uaacacaguucccacc

SEQ ID NO: 124600 - RNA, 19 nt, Homo sapiens
uaacacaguuguguuugag

SEQ ID NO: 124601 - RNA, 22 nt, Homo sapiens
uaacagcauuugugucuaguag

SEQ ID NO: 124602 - RNA, 22 nt, Homo sapiens
gagcaucaguggccucaucuca

SEQ ID NO: 124603 - RNA, 22 nt, Homo sapiens
gagcuacauggauagucugcau

SEQ ID NO: 124604 - RNA, 22 nt, Homo sapiens
gagcuagguuuugaauccagac

SEQ ID NO: 124605 - RNA, 22 nt, Homo sapiens
gagcucaccuuaccucuggagc

SEQ ID NO: 124606 - RNA, 20 nt, Homo sapiens
gagcucaucuucuuuaccac

SEQ ID NO: 124607 - RNA, 22 nt, Homo sapiens
gagcugaucuuuauguaaauuc

SEQ ID NO: 124608 - RNA, 22 nt, Homo sapiens
gagcugaucuuuucugauucca

SEQ ID NO: 124609 - RNA, 22 nt, Homo sapiens
gagcuguugguuugaaagaauu

SEQ ID NO: 124610 - RNA, 22 nt, Homo sapiens
gagcuuguggucuucguguuau

SEQ ID NO: 124611 - RNA, 22 nt, Homo sapiens
gaggagauauucugcuggaugg

SEQ ID NO: 124612 - RNA, 22 nt, Homo sapiens
gaggaguagggcacaaagccuu

SEQ ID NO: 124613 - RNA, 22 nt, Homo sapiens
gaggcaagaguaguuaaguuag

SEQ ID NO: 124614 - RNA, 22 nt, Homo sapiens
gaggcaauaugagggaggcuuc

SEQ ID NO: 124615 - RNA, 22 nt, Homo sapiens
gagguaagaguuuuccauuucu

SEQ ID NO: 124616 - RNA, 20 nt, Homo sapiens
ugccagugugucaauuuaua

SEQ ID NO: 124617 - RNA, 22 nt, Homo sapiens
ugccauagagauuuguggaacu

SEQ ID NO: 124618 - RNA, 22 nt, Homo sapiens
ugccaucauuaauauuaggcau

SEQ ID NO: 124619 - RNA, 22 nt, Homo sapiens
ugccaugaagagaggaagcagu

SEQ ID NO: 124620 - RNA, 22 nt, Homo sapiens
ugccauugcacuccagccuggg

SEQ ID NO: 124621 - RNA, 21 nt, Homo sapiens
ugcccaguggcuuggggucag

SEQ ID NO: 124622 - RNA, 18 nt, Homo sapiens
ugccuacugggcucaagc

SEQ ID NO: 124623 - RNA, 22 nt, Homo sapiens
ugccuacugguuguucugggca

SEQ ID NO: 124624 - RNA, 22 nt, Homo sapiens
ugccuagaaacacuauuucucc

SEQ ID NO: 124625 - RNA, 22 nt, Homo sapiens
ugccuuauuccaacugagcucu

SEQ ID NO: 124626 - RNA, 22 nt, Homo sapiens
ugcguucauuuggccaguggcg

SEQ ID NO: 124627 - RNA, 22 nt, Homo sapiens
ugcuauagcuauaucaucuccu

SEQ ID NO: 124628 - RNA, 22 nt, Homo sapiens
ugcuauguuuucccuccuuauc

SEQ ID NO: 124629 - RNA, 21 nt, Homo sapiens
ugcucaugaguaaugcaguga

SEQ ID NO: 124630 - RNA, 21 nt, Homo sapiens
ugcuccauuuucuagccugaa

SEQ ID NO: 124631 - RNA, 22 nt, Homo sapiens
ugcugcaaacaggcaucugugg

SEQ ID NO: 124632 - RNA, 20 nt, Homo sapiens
ugcugcacuuaagcaugggc

SEQ ID NO: 124633 - RNA, 22 nt, Homo sapiens
ugcugcuguuguuguuacuagc

SEQ ID NO: 124634 - RNA, 22 nt, Homo sapiens
ugcugguauuauguuauccaga

SEQ ID NO: 124635 - RNA, 22 nt, Homo sapiens
ugcuggugauuaaauccugaag

SEQ ID NO: 124636 - RNA, 22 nt, Homo sapiens
ugcuggugucaucaaggcuuug

SEQ ID NO: 124637 - RNA, 22 nt, Homo sapiens
ugcuuugguagaaaucuuuggu

SEQ ID NO: 124638 - RNA, 22 nt, Homo sapiens
uggaaaucuaaguuuggauuga

SEQ ID NO: 124639 - RNA, 22 nt, Homo sapiens
uggaacacaucuaaggaagcag

SEQ ID NO: 124640 - RNA, 22 nt, Homo sapiens
uggaacaccaggcuggcguggc

SEQ ID NO: 124641 - RNA, 19 nt, Homo sapiens
uggaacugauucaguucug

SEQ ID NO: 124642 - RNA, 22 nt, Homo sapiens
uggaagacaaguguuagcaugg

SEQ ID NO: 124643 - RNA, 22 nt, Homo sapiens
uggaagacacauaccugauaac

SEQ ID NO: 124644 - RNA, 22 nt, Homo sapiens
uggaagacauuuuggaccuugg

SEQ ID NO: 124645 - RNA, 23 nt, Homo sapiens
uggaagacuccucucuuggcugc

SEQ ID NO: 124646 - RNA, 22 nt, Homo sapiens
uggaagccuagauucuuuucuu

SEQ ID NO: 124647 - RNA, 22 nt, Homo sapiens
uggaaggcuucauauguaaaga

SEQ ID NO: 124648 - RNA, 22 nt, Homo sapiens
uggaagguaaguuuugagcauu

SEQ ID NO: 124649 - RNA, 22 nt, Homo sapiens
uggaagucauugagguguguua

SEQ ID NO: 124650 - RNA, 21 nt, Homo sapiens
uggaaguguacaauuauaccc

SEQ ID NO: 124651 - RNA, 22 nt, Homo sapiens
uggaauacaugucgcugagcug

SEQ ID NO: 124652 - RNA, 22 nt, Homo sapiens
uggaauaucaugagaguuuguu

SEQ ID NO: 124653 - RNA, 22 nt, Homo sapiens
uggaauaugagacgggguuguc

SEQ ID NO: 124654 - RNA, 19 nt, Homo sapiens
uggaaugaaauguuagggg

SEQ ID NO: 124655 - RNA, 21 nt, Homo sapiens
uggaaugaauggccaacaugg

SEQ ID NO: 124656 - RNA, 20 nt, Homo sapiens
uggaaugcagccuccuucug

SEQ ID NO: 124657 - RNA, 22 nt, Homo sapiens
uggaaugguuggugugauuuua

SEQ ID NO: 124658 - RNA, 22 nt, Homo sapiens
uggaaugucuuuuccccaaagc

SEQ ID NO: 124659 - RNA, 22 nt, Homo sapiens
uggaaugugaauaacuuccuuc

SEQ ID NO: 124660 - RNA, 18 nt, Homo sapiens
uggaauguuuggguuaau

SEQ ID NO: 124661 - RNA, 22 nt, Homo sapiens
uggacagacaagguuauagauc

SEQ ID NO: 124662 - RNA, 21 nt, Homo sapiens
uggaccccuuccuuacaucau

SEQ ID NO: 124663 - RNA, 22 nt, Homo sapiens
uggacuagagggugggcgaggu

SEQ ID NO: 124664 - RNA, 22 nt, Homo sapiens
uggagaacugaugucuccaaga

SEQ ID NO: 124665 - RNA, 22 nt, Homo sapiens
uggagacugaucccucuuuccu

SEQ ID NO: 124666 - RNA, 22 nt, Homo sapiens
uggagagugauaaguaaaugga

SEQ ID NO: 124667 - RNA, 22 nt, Homo sapiens
uggagcccuaaacuucuaauau

SEQ ID NO: 124668 - RNA, 21 nt, Homo sapiens
uggagugcaacacuagguaua

SEQ ID NO: 124669 - RNA, 22 nt, Homo sapiens
uggagugcaauggugagaucuu

SEQ ID NO: 124670 - RNA, 22 nt, Homo sapiens
uggaguguaaauuaguucagcc

SEQ ID NO: 124671 - RNA, 20 nt, Homo sapiens
uggaguuguggcaguuugga

SEQ ID NO: 124672 - RNA, 22 nt, Homo sapiens
uggaguuugacaugccuuuggg

SEQ ID NO: 124673 - RNA, 20 nt, Homo sapiens
uggaguuugaguucuuggag

SEQ ID NO: 124674 - RNA, 18 nt, Homo sapiens
uggauaugaaauucugga

SEQ ID NO: 124675 - RNA, 22 nt, Homo sapiens
uggaucaugcgaggccuccccu

SEQ ID NO: 124676 - RNA, 22 nt, Homo sapiens
uggaugccuaauaaaugcagac

SEQ ID NO: 124677 - RNA, 22 nt, Homo sapiens
uggauggagaggcuugugaugc

SEQ ID NO: 124678 - RNA, 22 nt, Homo sapiens
uggcaaaaaaacgcaauuacgu

SEQ ID NO: 124679 - RNA, 22 nt, Homo sapiens
uggcaaaauggaauauguuggg

SEQ ID NO: 124680 - RNA, 22 nt, Homo sapiens
uggcaaagugugacgugggggu

SEQ ID NO: 124681 - RNA, 22 nt, Homo sapiens
uggcaaauagcaauaggagggu

SEQ ID NO: 124682 - RNA, 22 nt, Homo sapiens
uggcaaaugugagaugagaacu

SEQ ID NO: 124683 - RNA, 22 nt, Homo sapiens
uggcaagaacugcaauugcuuu

SEQ ID NO: 124684 - RNA, 22 nt, Homo sapiens
uggcaagaccccaucucuacaa

SEQ ID NO: 124685 - RNA, 22 nt, Homo sapiens
uggcaagagcugcauucaucug

SEQ ID NO: 124686 - RNA, 23 nt, Homo sapiens
uggcaagauuuguauugccugga

SEQ ID NO: 124687 - RNA, 18 nt, Homo sapiens
uggcaauaugguucuacc

SEQ ID NO: 124688 - RNA, 22 nt, Homo sapiens
uggcacuaugugacaagguuuu

SEQ ID NO: 124689 - RNA, 22 nt, Homo sapiens
uggcacuggagauacauuaaua

SEQ ID NO: 124690 - RNA, 22 nt, Homo sapiens
uggcagcgcaguugaaaaagaa

SEQ ID NO: 124691 - RNA, 22 nt, Homo sapiens
uggcaguuuacagcuuuaggag

SEQ ID NO: 124692 - RNA, 22 nt, Homo sapiens
uggcaguuucacauggcucaac

SEQ ID NO: 124693 - RNA, 22 nt, Homo sapiens
augauuuuuguaucgccugaug

SEQ ID NO: 124694 - RNA, 22 nt, Homo sapiens
augcaaaucuuaaguaugugug

SEQ ID NO: 124695 - RNA, 22 nt, Homo sapiens
augcaagcacacaagaggaaau

SEQ ID NO: 124696 - RNA, 22 nt, Homo sapiens
augcacauauguacugcccuau

SEQ ID NO: 124697 - RNA, 22 nt, Homo sapiens
augcacaucagcuccagggacc

SEQ ID NO: 124698 - RNA, 22 nt, Homo sapiens
augcacaugcgaaaacuugugu

SEQ ID NO: 124699 - RNA, 22 nt, Homo sapiens
augcacauggcuaacuuuuuuc

SEQ ID NO: 124700 - RNA, 22 nt, Homo sapiens
augcacuuggcaggaugauucc

SEQ ID NO: 124701 - RNA, 22 nt, Homo sapiens
augcagagucccagccccuagc

SEQ ID NO: 124702 - RNA, 22 nt, Homo sapiens
augcagcugaggguaguggagc

SEQ ID NO: 124703 - RNA, 22 nt, Homo sapiens
augcauagcaucugcaaauguu

SEQ ID NO: 124704 - RNA, 22 nt, Homo sapiens
augcauaugucuuuauaguggc

SEQ ID NO: 124705 - RNA, 22 nt, Homo sapiens
augcauauuccugggccucacu

SEQ ID NO: 124706 - RNA, 22 nt, Homo sapiens
augcauggcagagucaggguac

SEQ ID NO: 124707 - RNA, 22 nt, Homo sapiens
augccaagaugagcacgcgucu

SEQ ID NO: 124708 - RNA, 22 nt, Homo sapiens
augccacugcacuccaaccugg

SEQ ID NO: 124709 - RNA, 22 nt, Homo sapiens
augccacugcacuucagcuugg

SEQ ID NO: 124710 - RNA, 22 nt, Homo sapiens
augccacugcgcucuagccugg

SEQ ID NO: 124711 - RNA, 22 nt, Homo sapiens
augccacuguccuccugccuag

SEQ ID NO: 124712 - RNA, 22 nt, Homo sapiens
augccacuucucuaagucaugu

SEQ ID NO: 124713 - RNA, 22 nt, Homo sapiens
augcccauuuguuuucugaaag

SEQ ID NO: 124714 - RNA, 22 nt, Homo sapiens
augcuacuggacaauggugacu

SEQ ID NO: 124715 - RNA, 19 nt, Homo sapiens
augcugguguugcucaaac

SEQ ID NO: 124716 - RNA, 22 nt, Homo sapiens
augcuuguguuggggcagugga

SEQ ID NO: 124717 - RNA, 21 nt, Homo sapiens
auggaaagacugccucuucaa

SEQ ID NO: 124718 - RNA, 19 nt, Homo sapiens
auggaacugcuggagccac

SEQ ID NO: 124719 - RNA, 22 nt, Homo sapiens
auggaagaauugucggggaugu

SEQ ID NO: 124720 - RNA, 22 nt, Homo sapiens
auggaagacuccucuuugggua

SEQ ID NO: 124721 - RNA, 22 nt, Homo sapiens
auggaagcauaguauucuauug

SEQ ID NO: 124722 - RNA, 22 nt, Homo sapiens
auggacagaaaaaaauagaugu

SEQ ID NO: 124723 - RNA, 22 nt, Homo sapiens
auggacagacacuggccuucug

SEQ ID NO: 124724 - RNA, 22 nt, Homo sapiens
auggaggaggaagcugaaacaa

SEQ ID NO: 124725 - RNA, 22 nt, Homo sapiens
auggaggccuacagaauuuugg

SEQ ID NO: 124726 - RNA, 22 nt, Homo sapiens
auggaguguucugaauccuuug

SEQ ID NO: 124727 - RNA, 22 nt, Homo sapiens
auggauuuuaggauacaguuga

SEQ ID NO: 124728 - RNA, 22 nt, Homo sapiens
auggcacagaguagaugcucaa

SEQ ID NO: 124729 - RNA, 22 nt, Homo sapiens
auggcaccauguuaugauaaua

SEQ ID NO: 124730 - RNA, 22 nt, Homo sapiens
auggcacuaaugggaguuuacu

SEQ ID NO: 124731 - RNA, 22 nt, Homo sapiens
auggcacucaaucaaguugaga

SEQ ID NO: 124732 - RNA, 22 nt, Homo sapiens
auggcagaaucaagccgacagc

SEQ ID NO: 124733 - RNA, 22 nt, Homo sapiens
auggcagcugguuuuacccuag

SEQ ID NO: 124734 - RNA, 22 nt, Homo sapiens
auggcuagaaccuguauauuca

SEQ ID NO: 124735 - RNA, 22 nt, Homo sapiens
auggcucuuauuauuugaggua

SEQ ID NO: 124736 - RNA, 22 nt, Homo sapiens
auggcuguuuaagaguuucauu

SEQ ID NO: 124737 - RNA, 22 nt, Homo sapiens
auggcuguuucugcaaugucua

SEQ ID NO: 124738 - RNA, 22 nt, Homo sapiens
auggcuguuuuuuauguuacag

SEQ ID NO: 124739 - RNA, 22 nt, Homo sapiens
auggcuugugggaacuuuuaaa

SEQ ID NO: 124740 - RNA, 22 nt, Homo sapiens
auggcuuguuaugcauuaguac

SEQ ID NO: 124741 - RNA, 22 nt, Homo sapiens
auggcuuugggcugcucugccc

SEQ ID NO: 124742 - RNA, 22 nt, Homo sapiens
auggcuuuguguucagagcuga

SEQ ID NO: 124743 - RNA, 22 nt, Homo sapiens
auggcuuuuccugucuugcaug

SEQ ID NO: 124744 - RNA, 22 nt, Homo sapiens
augggaaaaucagaaggccugg

SEQ ID NO: 124745 - RNA, 22 nt, Homo sapiens
augggacugggugccguggagc

SEQ ID NO: 124746 - RNA, 22 nt, Homo sapiens
augggcuaguaaagacaaacuu

SEQ ID NO: 124747 - RNA, 22 nt, Homo sapiens
augggguaggcuuugcugcagu

SEQ ID NO: 124748 - RNA, 17 nt, Homo sapiens
augggguuguagcccca

SEQ ID NO: 124749 - RNA, 22 nt, Homo sapiens
augguacucucuugucugcaaa

SEQ ID NO: 124750 - RNA, 22 nt, Homo sapiens
augguaguagaugugugguuuu

SEQ ID NO: 124751 - RNA, 22 nt, Homo sapiens
augguauuuugugauaccuugu

SEQ ID NO: 124752 - RNA, 22 nt, Homo sapiens
auggucuuuucccuggauuaua

SEQ ID NO: 124753 - RNA, 21 nt, Homo sapiens
auggugagaaaguagugucaa

SEQ ID NO: 124754 - RNA, 22 nt, Homo sapiens
augguguccuguuuccccagga

SEQ ID NO: 124755 - RNA, 22 nt, Homo sapiens
auguaacaguauuuggagaugu

SEQ ID NO: 124756 - RNA, 22 nt, Homo sapiens
auguaacuaucugagccauggg

SEQ ID NO: 124757 - RNA, 22 nt, Homo sapiens
cuugacaaugcuucaggcugaa

SEQ ID NO: 124758 - RNA, 22 nt, Homo sapiens
cuugacacugguuuucugaaua

SEQ ID NO: 124759 - RNA, 22 nt, Homo sapiens
cuugagacauuguuuuccaagu

SEQ ID NO: 124760 - RNA, 22 nt, Homo sapiens
cuugcacucagaagauucaguu

SEQ ID NO: 124761 - RNA, 22 nt, Homo sapiens
cuugcagagucauucuaauuuc

SEQ ID NO: 124762 - RNA, 22 nt, Homo sapiens
cuugccuaaucugcaugauuuu

SEQ ID NO: 124763 - RNA, 20 nt, Homo sapiens
cuugcuccccuuguucuaga

SEQ ID NO: 124764 - RNA, 22 nt, Homo sapiens
cuuggauuauaauggaauauuu

SEQ ID NO: 124765 - RNA, 22 nt, Homo sapiens
cuuggcauugccccuggaauuu

SEQ ID NO: 124766 - RNA, 22 nt, Homo sapiens
cuuggcuagucaaaccuccccg

SEQ ID NO: 124767 - RNA, 22 nt, Homo sapiens
cuuggcuucuuuauguggcuau

SEQ ID NO: 124768 - RNA, 22 nt, Homo sapiens
cuuggcuuguuguccccugcuc

SEQ ID NO: 124769 - RNA, 21 nt, Homo sapiens
cuugucuugcuuagaauagac

SEQ ID NO: 124770 - RNA, 22 nt, Homo sapiens
cuugugcaugaccccagguggg

SEQ ID NO: 124771 - RNA, 22 nt, Homo sapiens
cuuguuguggaggggagugcag

SEQ ID NO: 124772 - RNA, 22 nt, Homo sapiens
cuuuagcaauugauuaugccau

SEQ ID NO: 124773 - RNA, 22 nt, Homo sapiens
ugagguugaaggacauuuuuau

SEQ ID NO: 124774 - RNA, 22 nt, Homo sapiens
ugagguugguauuacugucucu

SEQ ID NO: 124775 - RNA, 22 nt, Homo sapiens
ugaguaauguugaucuuugaua

SEQ ID NO: 124776 - RNA, 22 nt, Homo sapiens
ugaguacuacuaguuacugcua

SEQ ID NO: 124777 - RNA, 22 nt, Homo sapiens
ugaguagaaauaaacgcaaacu

SEQ ID NO: 124778 - RNA, 22 nt, Homo sapiens
ugaguagauccaagacuguccu

SEQ ID NO: 124779 - RNA, 21 nt, Homo sapiens
ugaguagcuagaacuaggggc

SEQ ID NO: 124780 - RNA, 22 nt, Homo sapiens
ugaguaggauugguauuucuuc

SEQ ID NO: 124781 - RNA, 23 nt, Homo sapiens
ugaguaggcaguuuuccccucac

SEQ ID NO: 124782 - RNA, 23 nt, Homo sapiens
ugaguagguccacguaugugagu

SEQ ID NO: 124783 - RNA, 23 nt, Homo sapiens
ugaguaggugguuuuccccucac

SEQ ID NO: 124784 - RNA, 22 nt, Homo sapiens
ugaguauguaggaugugucuua

SEQ ID NO: 124785 - RNA, 22 nt, Homo sapiens
ugagucaugcuggagucauggc

SEQ ID NO: 124786 - RNA, 22 nt, Homo sapiens
ugagucauguaauaaugcugcu

SEQ ID NO: 124787 - RNA, 22 nt, Homo sapiens
ugagucauuuccuuaugcuacu

SEQ ID NO: 124788 - RNA, 22 nt, Homo sapiens
ugagugaaagaagcacuaagga

SEQ ID NO: 124789 - RNA, 22 nt, Homo sapiens
ugagugaacgcugagaccaaau

SEQ ID NO: 124790 - RNA, 22 nt, Homo sapiens
ugaguggagacuguguguagag

SEQ ID NO: 124791 - RNA, 22 nt, Homo sapiens
ugaguuaggagaguguggcucu

SEQ ID NO: 124792 - RNA, 22 nt, Homo sapiens
ugaguuagguaauaauaaauau

SEQ ID NO: 124793 - RNA, 20 nt, Homo sapiens
ugaguuccuuguucagaagc

SEQ ID NO: 124794 - RNA, 22 nt, Homo sapiens
ugaguuuaucuaaagaccuggg

SEQ ID NO: 124795 - RNA, 22 nt, Homo sapiens
ugauaacauugggggaagcuga

SEQ ID NO: 124796 - RNA, 22 nt, Homo sapiens
ugauaacauuucuucugguaca

SEQ ID NO: 124797 - RNA, 22 nt, Homo sapiens
ugauaauguuaggcuuuauuca

SEQ ID NO: 124798 - RNA, 22 nt, Homo sapiens
ugauacugugcauuagaggcua

SEQ ID NO: 124799 - RNA, 22 nt, Homo sapiens
ugauaucugaauagauacacaa

SEQ ID NO: 124800 - RNA, 22 nt, Homo sapiens
ugauauggcuuggcuaugucac

SEQ ID NO: 124801 - RNA, 21 nt, Homo sapiens
ugauaugguuuggauaugugu

SEQ ID NO: 124802 - RNA, 22 nt, Homo sapiens
ugauauguggauucagcucaaa

SEQ ID NO: 124803 - RNA, 22 nt, Homo sapiens
ugauauguggcuauugagauug

SEQ ID NO: 124804 - RNA, 22 nt, Homo sapiens
ugauauguguaaacaauguaua

SEQ ID NO: 124805 - RNA, 22 nt, Homo sapiens
ugaucuguccaccucagcuucc

SEQ ID NO: 124806 - RNA, 22 nt, Homo sapiens
ugaugacacugauuucuucaau

SEQ ID NO: 124807 - RNA, 22 nt, Homo sapiens
ugaugacauugucacagucuga

SEQ ID NO: 124808 - RNA, 21 nt, Homo sapiens
ugaugcuuuucuuaaccuugc

SEQ ID NO: 124809 - RNA, 22 nt, Homo sapiens
ugauggcaauggcauucauuuu

SEQ ID NO: 124810 - RNA, 22 nt, Homo sapiens
ugauggcauuuggaguugggac

SEQ ID NO: 124811 - RNA, 22 nt, Homo sapiens
ugauggccuguucuccauaugu

SEQ ID NO: 124812 - RNA, 23 nt, Homo sapiens
ugauguccacuuagggucuaggu

SEQ ID NO: 124813 - RNA, 20 nt, Homo sapiens
ugauguccaggcagagguuu

SEQ ID NO: 124814 - RNA, 22 nt, Homo sapiens
ugaugucuugagauggagcuua

SEQ ID NO: 124815 - RNA, 22 nt, Homo sapiens
ugaugucuugcaggcacgagau

SEQ ID NO: 124816 - RNA, 22 nt, Homo sapiens
ugauuagaggaaugguagauua

SEQ ID NO: 124817 - RNA, 20 nt, Homo sapiens
ugauugaccagagcaguuuu

SEQ ID NO: 124818 - RNA, 22 nt, Homo sapiens
ugauugcacaccugcacucaag

SEQ ID NO: 124819 - RNA, 22 nt, Homo sapiens
ugauuguucuguccccaggggc

SEQ ID NO: 124820 - RNA, 22 nt, Homo sapiens
ugcaaaucuuguguaguuguga

SEQ ID NO: 124821 - RNA, 19 nt, Homo sapiens
ugcaaauucuaaaaacuga

SEQ ID NO: 124822 - RNA, 22 nt, Homo sapiens
ugcaagaaacauauuccacaag

SEQ ID NO: 124823 - RNA, 22 nt, Homo sapiens
ugcaagauaggcaguuugcacu

SEQ ID NO: 124824 - RNA, 22 nt, Homo sapiens
ugcaagucaucuguccuucaga

SEQ ID NO: 124825 - RNA, 17 nt, Homo sapiens
ugcaauuuaagcuagau

SEQ ID NO: 124826 - RNA, 22 nt, Homo sapiens
ugcaccaucuugcuucuguggu

SEQ ID NO: 124827 - RNA, 22 nt, Homo sapiens
ugcacugucuugucgcauagca

SEQ ID NO: 124828 - RNA, 22 nt, Homo sapiens
ugcagaaucccuucagauccga

SEQ ID NO: 124829 - RNA, 16 nt, Homo sapiens
ugcagaguaggugaau

SEQ ID NO: 124830 - RNA, 22 nt, Homo sapiens
ugcagauucguuuugaggggua

SEQ ID NO: 124831 - RNA, 23 nt, Homo sapiens
ugcagcacacugaugggucuuga

SEQ ID NO: 124832 - RNA, 22 nt, Homo sapiens
ugcagcacugaacuucugggcu

SEQ ID NO: 124833 - RNA, 20 nt, Homo sapiens
ugcagcacugggaaugcagu

SEQ ID NO: 124834 - RNA, 22 nt, Homo sapiens
ugcaguaggcccagcgggaggc

SEQ ID NO: 124835 - RNA, 22 nt, Homo sapiens
ugcagugcaugacuguguuaug

SEQ ID NO: 124836 - RNA, 22 nt, Homo sapiens
ugcagugucaauaauaauuagu

SEQ ID NO: 124837 - RNA, 22 nt, Homo sapiens
ugcagugugauuuucuggcuga

SEQ ID NO: 124838 - RNA, 22 nt, Homo sapiens
ugcaguguucuuuagaggaaau

SEQ ID NO: 124839 - RNA, 22 nt, Homo sapiens
ugcauaauuccuugcaccagaa

SEQ ID NO: 124840 - RNA, 18 nt, Homo sapiens
ugcauacuaucugauuuu

SEQ ID NO: 124841 - RNA, 22 nt, Homo sapiens
ugcauacugaaauauuuuagag

SEQ ID NO: 124842 - RNA, 22 nt, Homo sapiens
ugcauagaauguucuguaaaua

SEQ ID NO: 124843 - RNA, 22 nt, Homo sapiens
ugcauagcaaaauaggauuaga

SEQ ID NO: 124844 - RNA, 22 nt, Homo sapiens
ugcauaucuucagccgggcacg

SEQ ID NO: 124845 - RNA, 22 nt, Homo sapiens
ugcauaugucuuuauagcagca

SEQ ID NO: 124846 - RNA, 22 nt, Homo sapiens
ugcauaugucuuuauaguagca

SEQ ID NO: 124847 - RNA, 22 nt, Homo sapiens
ugcauauguucaaaguauucug

SEQ ID NO: 124848 - RNA, 21 nt, Homo sapiens
ccuugguuaucuucccauuca

SEQ ID NO: 124849 - RNA, 22 nt, Homo sapiens
ccuugguugugcuucaacuucu

SEQ ID NO: 124850 - RNA, 22 nt, Homo sapiens
ccuugucacugaguggaaugaa

SEQ ID NO: 124851 - RNA, 22 nt, Homo sapiens
ccuuuguuuaguugaauuguau

SEQ ID NO: 124852 - RNA, 22 nt, Homo sapiens
cggucacagugauucaaggguc

SEQ ID NO: 124853 - RNA, 16 nt, Homo sapiens
cuaaaaugucuacuug

SEQ ID NO: 124854 - RNA, 22 nt, Homo sapiens
cuaaagauagugacaugauuug

SEQ ID NO: 124855 - RNA, 22 nt, Homo sapiens
cuaaaguagccaggacugcagg

SEQ ID NO: 124856 - RNA, 22 nt, Homo sapiens
cuaaaguucuucugagagaaca

SEQ ID NO: 124857 - RNA, 22 nt, Homo sapiens
cuaaaugcacugucaaaggaag

SEQ ID NO: 124858 - RNA, 22 nt, Homo sapiens
cuaacacagagguuuauuucuc

SEQ ID NO: 124859 - RNA, 21 nt, Homo sapiens
cuaaucucacccuuuucuggg

SEQ ID NO: 124860 - RNA, 22 nt, Homo sapiens
cuaaugcagucaggagaaggaa

SEQ ID NO: 124861 - RNA, 22 nt, Homo sapiens
cuacacaugcaggcucccugcc

SEQ ID NO: 124862 - RNA, 22 nt, Homo sapiens
cuacagcacugagcugugugca

SEQ ID NO: 124863 - RNA, 22 nt, Homo sapiens
cuacagcagcccaguccccgaa

SEQ ID NO: 124864 - RNA, 22 nt, Homo sapiens
cuacaguaugaaaccuuuacuc

SEQ ID NO: 124865 - RNA, 21 nt, Homo sapiens
cuacccuguauuagagaaaga

SEQ ID NO: 124866 - RNA, 22 nt, Homo sapiens
cuagaagguaagagcuggaugc

SEQ ID NO: 124867 - RNA, 22 nt, Homo sapiens
cuagaguguaguuuucuuagga

SEQ ID NO: 124868 - RNA, 22 nt, Homo sapiens
cuagcaacauuucagugaguuu

SEQ ID NO: 124869 - RNA, 22 nt, Homo sapiens
cuagcagacacuuccagagagu

SEQ ID NO: 124870 - RNA, 22 nt, Homo sapiens
cuagcagacaggcugggagcag

SEQ ID NO: 124871 - RNA, 22 nt, Homo sapiens
cuagcagacaugggcugaacca

SEQ ID NO: 124872 - RNA, 22 nt, Homo sapiens
cuagcccugagauaaaugucau

SEQ ID NO: 124873 - RNA, 21 nt, Homo sapiens
cuaggaccaguucuguaauuc

SEQ ID NO: 124874 - RNA, 22 nt, Homo sapiens
cuaggcuguagagaaguucagu

SEQ ID NO: 124875 - RNA, 22 nt, Homo sapiens
cuagucacauuuucaucaaaua

SEQ ID NO: 124876 - RNA, 22 nt, Homo sapiens
cuaugcuucuuaaauuaguuau

SEQ ID NO: 124877 - RNA, 22 nt, Homo sapiens
cuauggccugcuuagaacauac

SEQ ID NO: 124878 - RNA, 19 nt, Homo sapiens
cuauugcacauagcugaag

SEQ ID NO: 124879 - RNA, 21 nt, Homo sapiens
cucaaaguacugauauuacag

SEQ ID NO: 124880 - RNA, 22 nt, Homo sapiens
cucaaagucaagggaaagcagg

SEQ ID NO: 124881 - RNA, 22 nt, Homo sapiens
cucaaagugcuaagauuaggcu

SEQ ID NO: 124882 - RNA, 22 nt, Homo sapiens
cucaaguaauccucccgccuug

SEQ ID NO: 124883 - RNA, 22 nt, Homo sapiens
cucaaguacaugggauuacagg

SEQ ID NO: 124884 - RNA, 22 nt, Homo sapiens
cucaauuuggaauugucaguaa

SEQ ID NO: 124885 - RNA, 20 nt, Homo sapiens
cucacagacagcuucuuucu

SEQ ID NO: 124886 - RNA, 22 nt, Homo sapiens
cucacagucagaagggacuugc

SEQ ID NO: 124887 - RNA, 22 nt, Homo sapiens
cucaccuugugauccaccggcc

SEQ ID NO: 124888 - RNA, 22 nt, Homo sapiens
cucacugucaacauguauuugg

SEQ ID NO: 124889 - RNA, 22 nt, Homo sapiens
cucacugugguguccuuaggua

SEQ ID NO: 124890 - RNA, 22 nt, Homo sapiens
cucagaguacuuuucccacuuc

SEQ ID NO: 124891 - RNA, 22 nt, Homo sapiens
cucagcuacuugggaagcugag

SEQ ID NO: 124892 - RNA, 22 nt, Homo sapiens
cucagucuaugauacuuugcua

SEQ ID NO: 124893 - RNA, 20 nt, Homo sapiens
cucagugcacccccauaaaa

SEQ ID NO: 124894 - RNA, 22 nt, Homo sapiens
cucaguuuugccuuguuuaagg

SEQ ID NO: 124895 - RNA, 22 nt, Homo sapiens
cucauggauggucuggcagcca

SEQ ID NO: 124896 - RNA, 22 nt, Homo sapiens
cucauugcaaucuccaccuccc

SEQ ID NO: 124897 - RNA, 22 nt, Homo sapiens
cuccaggugucauccaccuccu

SEQ ID NO: 124898 - RNA, 22 nt, Homo sapiens
cuccauagucuucgaagaauga

SEQ ID NO: 124899 - RNA, 22 nt, Homo sapiens
cuccaugagauuguugaaguag

SEQ ID NO: 124900 - RNA, 22 nt, Homo sapiens
cuccccuuuaguuucuuaauaa

SEQ ID NO: 124901 - RNA, 22 nt, Homo sapiens
cucccuuugcugaauguuuuuc

SEQ ID NO: 124902 - RNA, 22 nt, Homo sapiens
cuccgggugcgucggcgcccug

SEQ ID NO: 124903 - RNA, 22 nt, Homo sapiens
gcugaaauguuuaauuugggag

SEQ ID NO: 124904 - RNA, 22 nt, Homo sapiens
gcugagguucaagaagguuaaa

SEQ ID NO: 124905 - RNA, 22 nt, Homo sapiens
gcuggcaaguggccuacuuugu

SEQ ID NO: 124906 - RNA, 22 nt, Homo sapiens
gcuggguugccagguuacuuaa

SEQ ID NO: 124907 - RNA, 22 nt, Homo sapiens
gcugguauuacaggcaugagcc

SEQ ID NO: 124908 - RNA, 19 nt, Homo sapiens
gcugguuguccacucucuc

SEQ ID NO: 124909 - RNA, 18 nt, Homo sapiens
gcuguugucagagcacau

SEQ ID NO: 124910 - RNA, 22 nt, Homo sapiens
gcuguuugccgccaucgcagac

SEQ ID NO: 124911 - RNA, 22 nt, Homo sapiens
gcuuguguuugcuccccagaau

SEQ ID NO: 124912 - RNA, 22 nt, Homo sapiens
gcuuugguucaaccaggcaauu

SEQ ID NO: 124913 - RNA, 22 nt, Homo sapiens
gcuuuguuguugaugggaaauc

SEQ ID NO: 124914 - RNA, 22 nt, Homo sapiens
ggaaaguaacccauucucuuac

SEQ ID NO: 124915 - RNA, 22 nt, Homo sapiens
ggaaauguaaacaauggggcua

SEQ ID NO: 124916 - RNA, 22 nt, Homo sapiens
ggaaauguuggugucaugaguu

SEQ ID NO: 124917 - RNA, 22 nt, Homo sapiens
ggaagaauauuaggggauuucg

SEQ ID NO: 124918 - RNA, 20 nt, Homo sapiens
ggaagagugacacaagguau

SEQ ID NO: 124919 - RNA, 17 nt, Homo sapiens
ggaagccuuugguuuaa

SEQ ID NO: 124920 - RNA, 22 nt, Homo sapiens
ggaauauaaaacuuuugacagg

SEQ ID NO: 124921 - RNA, 19 nt, Homo sapiens
ggaaugcuauucaaccuuu

SEQ ID NO: 124922 - RNA, 22 nt, Homo sapiens
ggaauggaacaaagucuugaaa

SEQ ID NO: 124923 - RNA, 22 nt, Homo sapiens
ggaauguuaaagacuacacuga

SEQ ID NO: 124924 - RNA, 22 nt, Homo sapiens
ggaauuaaggcaauugaaagcu

SEQ ID NO: 124925 - RNA, 22 nt, Homo sapiens
ggacaagaucuuccaccauuca

SEQ ID NO: 124926 - RNA, 22 nt, Homo sapiens
ggacaguagugcuuucuaucau

SEQ ID NO: 124927 - RNA, 22 nt, Homo sapiens
ggacaucauuaccauggaccca

SEQ ID NO: 124928 - RNA, 22 nt, Homo sapiens
ggacuagagaugagauuuuuca

SEQ ID NO: 124929 - RNA, 22 nt, Homo sapiens
ggacuagaggugaaaagaagac

SEQ ID NO: 124930 - RNA, 22 nt, Homo sapiens
ggacugagaggacuacagugua

SEQ ID NO: 124931 - RNA, 22 nt, Homo sapiens
ggacuggaagcauauuuauuuu

SEQ ID NO: 124932 - RNA, 22 nt, Homo sapiens
ggagaauguaauugguauuuug

SEQ ID NO: 124933 - RNA, 22 nt, Homo sapiens
ggagauaauccagggagggacu

SEQ ID NO: 124934 - RNA, 22 nt, Homo sapiens
ggagaugauuaugaaucacuua

SEQ ID NO: 124935 - RNA, 22 nt, Homo sapiens
ggagauuauuaguguuucaugc

SEQ ID NO: 124936 - RNA, 16 nt, Homo sapiens
ggaggucaucugggaa

SEQ ID NO: 124937 - RNA, 22 nt, Homo sapiens
ggagugugauuguucucuguua

SEQ ID NO: 124938 - RNA, 22 nt, Homo sapiens
ggauacaucuggacagccgaau

SEQ ID NO: 124939 - RNA, 22 nt, Homo sapiens
ggaucacuugagaccaggaguu

SEQ ID NO: 124940 - RNA, 21 nt, Homo sapiens
ggauucaucccucaugaauuu

SEQ ID NO: 124941 - RNA, 23 nt, Homo sapiens
ggauucaucuguuuguucgcugu

SEQ ID NO: 124942 - RNA, 22 nt, Homo sapiens
ggcaaaauauugucugguauag

SEQ ID NO: 124943 - RNA, 22 nt, Homo sapiens
ggcaagaaaaugcaauuacugu

SEQ ID NO: 124944 - RNA, 21 nt, Homo sapiens
ggcaagaaacacaaucaagua

SEQ ID NO: 124945 - RNA, 22 nt, Homo sapiens
ggcaagaaccacaauuacuuuu

SEQ ID NO: 124946 - RNA, 22 nt, Homo sapiens
ggcaagaacuucacucacuuuu

SEQ ID NO: 124947 - RNA, 22 nt, Homo sapiens
ggcaagaagagaguuuaaacau

SEQ ID NO: 124948 - RNA, 23 nt, Homo sapiens
ggcaagaucucagcucacugcaa

SEQ ID NO: 124949 - RNA, 22 nt, Homo sapiens
ggcaaggauuagauucuccccu

SEQ ID NO: 124950 - RNA, 22 nt, Homo sapiens
ggcaaggugaugaaugucuaca

SEQ ID NO: 124951 - RNA, 22 nt, Homo sapiens
gugggaugaucacaguucacug

SEQ ID NO: 124952 - RNA, 22 nt, Homo sapiens
gugggaugaucgcuugagccca

SEQ ID NO: 124953 - RNA, 22 nt, Homo sapiens
gugggcaaagcuaguguguaga

SEQ ID NO: 124954 - RNA, 22 nt, Homo sapiens
gugggguagcaggcuccuaucu

SEQ ID NO: 124955 - RNA, 22 nt, Homo sapiens
gugggguaggaggaguacuucc

SEQ ID NO: 124956 - RNA, 22 nt, Homo sapiens
guggggucaucucauuugugga

SEQ ID NO: 124957 - RNA, 22 nt, Homo sapiens
gugguguccugcaccuauaguc

SEQ ID NO: 124958 - RNA, 22 nt, Homo sapiens
guggugucuuguuuaauauaua

SEQ ID NO: 124959 - RNA, 22 nt, Homo sapiens
gugguuuuaucccagaaauuaa

SEQ ID NO: 124960 - RNA, 22 nt, Homo sapiens
gugguuuucaacuccaccugca

SEQ ID NO: 124961 - RNA, 22 nt, Homo sapiens
guguaaaacaauuagaggauuu

SEQ ID NO: 124962 - RNA, 20 nt, Homo sapiens
guguaagagcaagcuuccua

SEQ ID NO: 124963 - RNA, 22 nt, Homo sapiens
guguaauacacacauauaugca

SEQ ID NO: 124964 - RNA, 22 nt, Homo sapiens
guguagagaaauagccugaagg

SEQ ID NO: 124965 - RNA, 22 nt, Homo sapiens
guguaugugagaaugcucaugu

SEQ ID NO: 124966 - RNA, 22 nt, Homo sapiens
guguauguuucucccugucccu

SEQ ID NO: 124967 - RNA, 21 nt, Homo sapiens
gugucacagacaugacagaug

SEQ ID NO: 124968 - RNA, 22 nt, Homo sapiens
gugucaugagggggacaggaag

SEQ ID NO: 124969 - RNA, 22 nt, Homo sapiens
gugucccagugugcauacaggu

SEQ ID NO: 124970 - RNA, 22 nt, Homo sapiens
gugucuccuguggagcuaugua

SEQ ID NO: 124971 - RNA, 22 nt, Homo sapiens
gugugaacaucauagaguguau

SEQ ID NO: 124972 - RNA, 22 nt, Homo sapiens
gugugacagcuauagacaugau

SEQ ID NO: 124973 - RNA, 22 nt, Homo sapiens
gugugcacaaucuggcaugugc

SEQ ID NO: 124974 - RNA, 22 nt, Homo sapiens
gugugcucaucacaugcaauag

SEQ ID NO: 124975 - RNA, 21 nt, Homo sapiens
gugugcuugagugaugggauu

SEQ ID NO: 124976 - RNA, 22 nt, Homo sapiens
guguggcaggugggggcucaga

SEQ ID NO: 124977 - RNA, 22 nt, Homo sapiens
gugugguaggauugguuacuca

SEQ ID NO: 124978 - RNA, 22 nt, Homo sapiens
gugugguauuauaacuagguau

SEQ ID NO: 124979 - RNA, 20 nt, Homo sapiens
guuaaggcagcauuacucuu

SEQ ID NO: 124980 - RNA, 23 nt, Homo sapiens
guuaagugaauguguacucuauu

SEQ ID NO: 124981 - RNA, 22 nt, Homo sapiens
guuagaugaagaccaagggcaa

SEQ ID NO: 124982 - RNA, 22 nt, Homo sapiens
guuauggaguauaugugaacug

SEQ ID NO: 124983 - RNA, 22 nt, Homo sapiens
guuauguuaaauuguuguaugc

SEQ ID NO: 124984 - RNA, 22 nt, Homo sapiens
guuauguuaguuacaaggcuag

SEQ ID NO: 124985 - RNA, 22 nt, Homo sapiens
guucaagcaauucugcugccuc

SEQ ID NO: 124986 - RNA, 22 nt, Homo sapiens
guucaaggaauguuggcuucuc

SEQ ID NO: 124987 - RNA, 23 nt, Homo sapiens
ucugguguugucaaaugcugguu

SEQ ID NO: 124988 - RNA, 22 nt, Homo sapiens
ucugucacugguggacgaucac

SEQ ID NO: 124989 - RNA, 22 nt, Homo sapiens
ucugucuugugguuugagugcc

SEQ ID NO: 124990 - RNA, 22 nt, Homo sapiens
ucugugcggucuguguuaugaa

SEQ ID NO: 124991 - RNA, 19 nt, Homo sapiens
ucugugcuugucccccugu

SEQ ID NO: 124992 - RNA, 22 nt, Homo sapiens
ucuguggucagaguccuuggcc

SEQ ID NO: 124993 - RNA, 22 nt, Homo sapiens
ucuguggucagcauccgccacu

SEQ ID NO: 124994 - RNA, 22 nt, Homo sapiens
ucuguggugggcuccacccagu

SEQ ID NO: 124995 - RNA, 18 nt, Homo sapiens
ucugugguguaaauacgu

SEQ ID NO: 124996 - RNA, 22 nt, Homo sapiens
ucugugguucaggcuggagugc

SEQ ID NO: 124997 - RNA, 22 nt, Homo sapiens
ucuguguugaucacacugggag

SEQ ID NO: 124998 - RNA, 22 nt, Homo sapiens
ucuguguuugaucaagauugua

SEQ ID NO: 124999 - RNA, 22 nt, Homo sapiens
ucuguuguuaucauaauauuga

SEQ ID NO: 125000 - RNA, 22 nt, Homo sapiens
ucuuaggauacugaagucgguu

SEQ ID NO: 125001 - RNA, 22 nt, Homo sapiens
ucuuaguuugggguggggauag

SEQ ID NO: 125002 - RNA, 22 nt, Homo sapiens
ucuucaugcuugaaauaauagc

SEQ ID NO: 125003 - RNA, 20 nt, Homo sapiens
ucuugaacuuagucaacagg

SEQ ID NO: 125004 - RNA, 22 nt, Homo sapiens
ucuugcuuguuguucccuucau

SEQ ID NO: 125005 - RNA, 22 nt, Homo sapiens
ucuuggcauggcugaagauucc

SEQ ID NO: 125006 - RNA, 22 nt, Homo sapiens
ucuugggugaguuugugaauaa

SEQ ID NO: 125007 - RNA, 21 nt, Homo sapiens
ucuuggguugaauucucccag

SEQ ID NO: 125008 - RNA, 22 nt, Homo sapiens
ucuuggguuguuggcuucuccu

SEQ ID NO: 125009 - RNA, 22 nt, Homo sapiens
ucuuggguuugccuugcugcug

SEQ ID NO: 125010 - RNA, 21 nt, Homo sapiens
ucuugguauguauuuaggagg

SEQ ID NO: 125011 - RNA, 23 nt, Homo sapiens
ucuugguuauagaaaaauaguug

SEQ ID NO: 125012 - RNA, 23 nt, Homo sapiens
ucuuguacuuugagugagcaugg

SEQ ID NO: 125013 - RNA, 22 nt, Homo sapiens
ucuuugagugcccugagucccu

SEQ ID NO: 125014 - RNA, 22 nt, Homo sapiens
ucuuugauuaugcagauggguu

SEQ ID NO: 125015 - RNA, 22 nt, Homo sapiens
ucuuuggugaauggucauccag

SEQ ID NO: 125016 - RNA, 22 nt, Homo sapiens
ucuuuguguaggucaaucuggc

SEQ ID NO: 125017 - RNA, 22 nt, Homo sapiens
ucuuuuguucuauucaggccuu

SEQ ID NO: 125018 - RNA, 18 nt, Homo sapiens
ugaaacacauuuuuuccu

SEQ ID NO: 125019 - RNA, 22 nt, Homo sapiens
ugaaagacugaaagcuuuucuu

SEQ ID NO: 125020 - RNA, 22 nt, Homo sapiens
ugaaaguuauauugugaaauuc

SEQ ID NO: 125021 - RNA, 22 nt, Homo sapiens
ugaaauacuuuggcucuuuguu

SEQ ID NO: 125022 - RNA, 22 nt, Homo sapiens
ugaaauggaagaagucccuuuu

SEQ ID NO: 125023 - RNA, 22 nt, Homo sapiens
ugaacacuggauaaggagucag

SEQ ID NO: 125024 - RNA, 22 nt, Homo sapiens
ugaacagucaucucucuuguau

SEQ ID NO: 125025 - RNA, 22 nt, Homo sapiens
ugaacuguaagguauaggugau

SEQ ID NO: 125026 - RNA, 22 nt, Homo sapiens
ugaagacucaauuauuaugaac

SEQ ID NO: 125027 - RNA, 22 nt, Homo sapiens
ugaagagucuaaaucugucuuc

SEQ ID NO: 125028 - RNA, 22 nt, Homo sapiens
ugaagcuuguuucuguaccuuu

SEQ ID NO: 125029 - RNA, 22 nt, Homo sapiens
ugaaggacauaaggcagaguga

SEQ ID NO: 125030 - RNA, 22 nt, Homo sapiens
ugaaggaguauggauaagucgu

SEQ ID NO: 125031 - RNA, 22 nt, Homo sapiens
ugaaguaauguuuuauucuauu

SEQ ID NO: 125032 - RNA, 19 nt, Homo sapiens
ugaaguauagggcuucuga

SEQ ID NO: 125033 - RNA, 22 nt, Homo sapiens
ugaagugaagcaguaguguggg

SEQ ID NO: 125034 - RNA, 22 nt, Homo sapiens
ugaagugggaaaugaguauuaa

SEQ ID NO: 125035 - RNA, 21 nt, Homo sapiens
ugaauacugcugcucccuuug

SEQ ID NO: 125036 - RNA, 22 nt, Homo sapiens
ugaauacuucguucaaagauaa

SEQ ID NO: 125037 - RNA, 22 nt, Homo sapiens
ugaaucauuucuugucuucagu

SEQ ID NO: 125038 - RNA, 22 nt, Homo sapiens
ugaaugauuuuaaaagccucuc

SEQ ID NO: 125039 - RNA, 22 nt, Homo sapiens
ugaaugcauggggccaagaagg

SEQ ID NO: 125040 - RNA, 22 nt, Homo sapiens
ugaaugcuaaaggaaaacagua

SEQ ID NO: 125041 - RNA, 22 nt, Homo sapiens
ugaauggauccaauucuuagua

SEQ ID NO: 125042 - RNA, 22 nt, Homo sapiens
ugaaugguaaagaaaagcacug

SEQ ID NO: 125043 - RNA, 22 nt, Homo sapiens
ugaauguacacgcguacuuguu

SEQ ID NO: 125044 - RNA, 21 nt, Homo sapiens
ugaaugucuaggcagaaguuu

SEQ ID NO: 125045 - RNA, 22 nt, Homo sapiens
ugaauucuguccaaaauaacug

SEQ ID NO: 125046 - RNA, 22 nt, Homo sapiens
ugacaacugauuaacuccuuua

SEQ ID NO: 125047 - RNA, 22 nt, Homo sapiens
ugacaagaaagcgucuucuuuu

SEQ ID NO: 125048 - RNA, 22 nt, Homo sapiens
ugacaagacuacauaucccauu

SEQ ID NO: 125049 - RNA, 20 nt, Homo sapiens
ugacaagugagaauuauggg

SEQ ID NO: 125050 - RNA, 22 nt, Homo sapiens
ugacaagugauuaaggcauauu

SEQ ID NO: 125051 - RNA, 22 nt, Homo sapiens
ugacacagugggggauccuuuu

SEQ ID NO: 125052 - RNA, 22 nt, Homo sapiens
ugacacauguagacaucuggug

SEQ ID NO: 125053 - RNA, 22 nt, Homo sapiens
ugacacuugcccuuagaaacau

SEQ ID NO: 125054 - RNA, 22 nt, Homo sapiens
ugacagcuguugaggcauuuau

SEQ ID NO: 125055 - RNA, 22 nt, Homo sapiens
ugacagguugauaggugcagca

SEQ ID NO: 125056 - RNA, 22 nt, Homo sapiens
ugacagguuggaauuaugggag

SEQ ID NO: 125057 - RNA, 22 nt, Homo sapiens
ugacaguaucuacagcuucuua

SEQ ID NO: 125058 - RNA, 22 nt, Homo sapiens
ugacagucaccaggacccacag

SEQ ID NO: 125059 - RNA, 22 nt, Homo sapiens
ugacagugaacagguuaccacu

SEQ ID NO: 125060 - RNA, 22 nt, Homo sapiens
ugacaguguccuccuccugaga

SEQ ID NO: 125061 - RNA, 20 nt, Homo sapiens
ugacaguuaagggauagaag

SEQ ID NO: 125062 - RNA, 22 nt, Homo sapiens
ugacaugaagaaaaacagauuu

SEQ ID NO: 125063 - RNA, 22 nt, Homo sapiens
ugacaugaaggcaccucugucc

SEQ ID NO: 125064 - RNA, 22 nt, Homo sapiens
ugacauguauuagcucagugcu

SEQ ID NO: 125065 - RNA, 22 nt, Homo sapiens
ugacccuguggcagcgucuaag

SEQ ID NO: 125066 - RNA, 22 nt, Homo sapiens
ugacggaggcauuggaagcuug

SEQ ID NO: 125067 - RNA, 22 nt, Homo sapiens
ugacuacagauuugcugccaga

SEQ ID NO: 125068 - RNA, 22 nt, Homo sapiens
ugacuaggggcccuggcuucuu

SEQ ID NO: 125069 - RNA, 22 nt, Homo sapiens
ugacuauaaauaagcaagggcu

SEQ ID NO: 125070 - RNA, 22 nt, Homo sapiens
ugacuauaguuuucuugacaca

SEQ ID NO: 125071 - RNA, 22 nt, Homo sapiens
ugacuauaucucuguauaaacu

SEQ ID NO: 125072 - RNA, 22 nt, Homo sapiens
ugacuucagacugaaaugauuc

SEQ ID NO: 125073 - RNA, 22 nt, Homo sapiens
ugacuugaacuucuaugucacc

SEQ ID NO: 125074 - RNA, 22 nt, Homo sapiens
ugacuugaggcucgcacaaguu

SEQ ID NO: 125075 - RNA, 22 nt, Homo sapiens
ugacuugaguaacuggcucagg

SEQ ID NO: 125076 - RNA, 22 nt, Homo sapiens
ugacuuuagaauuuuauccaga

SEQ ID NO: 125077 - RNA, 22 nt, Homo sapiens
uuccccgugaaacuuucucauu

SEQ ID NO: 125078 - RNA, 20 nt, Homo sapiens
uucccucagccuugagggua

SEQ ID NO: 125079 - RNA, 22 nt, Homo sapiens
uucccugaaauauucacuuuca

SEQ ID NO: 125080 - RNA, 22 nt, Homo sapiens
uucccugaaguguuacucuaga

SEQ ID NO: 125081 - RNA, 22 nt, Homo sapiens
uucccugagcaucuguugagcc

SEQ ID NO: 125082 - RNA, 22 nt, Homo sapiens
uucccugugugcagaugggugu

SEQ ID NO: 125083 - RNA, 23 nt, Homo sapiens
uucccuuagaagaaggggagaaa

SEQ ID NO: 125084 - RNA, 22 nt, Homo sapiens
uucccuugcaggaugaucugga

SEQ ID NO: 125085 - RNA, 22 nt, Homo sapiens
uucccuuucugccuugaaucuu

SEQ ID NO: 125086 - RNA, 22 nt, Homo sapiens
uuccuacugcccauuaaaaugg

SEQ ID NO: 125087 - RNA, 22 nt, Homo sapiens
uuccuagagauuagcaagcugc

SEQ ID NO: 125088 - RNA, 22 nt, Homo sapiens
uuccuaguccugagucucugcg

SEQ ID NO: 125089 - RNA, 19 nt, Homo sapiens
uuccugagaacaagggcuu

SEQ ID NO: 125090 - RNA, 22 nt, Homo sapiens
uuccugagagggcugggugcag

SEQ ID NO: 125091 - RNA, 22 nt, Homo sapiens
uuccuguagcgauuuuaguaau

SEQ ID NO: 125092 - RNA, 22 nt, Homo sapiens
uuccuugagaaaguacaaggcu

SEQ ID NO: 125093 - RNA, 22 nt, Homo sapiens
uuccuugugacuaguagugacc

SEQ ID NO: 125094 - RNA, 22 nt, Homo sapiens
uucuaaacaucuuacaaugcau

SEQ ID NO: 125095 - RNA, 22 nt, Homo sapiens
uucuaaguaauuuugcaugccu

SEQ ID NO: 125096 - RNA, 22 nt, Homo sapiens
uucuacaugggucgucggugag

SEQ ID NO: 125097 - RNA, 22 nt, Homo sapiens
uucuagcacuuugggagacuga

SEQ ID NO: 125098 - RNA, 20 nt, Homo sapiens
uucuauggugaugaguccug

SEQ ID NO: 125099 - RNA, 22 nt, Homo sapiens
uucuaugguuaccaggcuaguc

SEQ ID NO: 125100 - RNA, 22 nt, Homo sapiens
uucuauguuugaaaaugccaaa

SEQ ID NO: 125101 - RNA, 22 nt, Homo sapiens
uucucacaguacagggagcucu

SEQ ID NO: 125102 - RNA, 21 nt, Homo sapiens
uucucagaggcaggggauaaa

SEQ ID NO: 125103 - RNA, 22 nt, Homo sapiens
uucucagugaaguuuagaacau

SEQ ID NO: 125104 - RNA, 22 nt, Homo sapiens
uucucaguuccuacuuugguga

SEQ ID NO: 125105 - RNA, 22 nt, Homo sapiens
uucucaguucgguggcagugcu

SEQ ID NO: 125106 - RNA, 17 nt, Homo sapiens
uucucaguucugaucuc

SEQ ID NO: 125107 - RNA, 22 nt, Homo sapiens
uucucgcuuuuuccaccuguau

SEQ ID NO: 125108 - RNA, 23 nt, Homo sapiens
uucugccacugaaaaugccucag

SEQ ID NO: 125109 - RNA, 22 nt, Homo sapiens
uucuggaaaucagcagagggug

SEQ ID NO: 125110 - RNA, 22 nt, Homo sapiens
uucuggcuuauaaacgugacuu

SEQ ID NO: 125111 - RNA, 22 nt, Homo sapiens
uucuggcuuuuaaagaaauguu

SEQ ID NO: 125112 - RNA, 22 nt, Homo sapiens
uucugguuaauacuugcaaaaa

SEQ ID NO: 125113 - RNA, 22 nt, Homo sapiens
uucugugguugaaaggagagau

SEQ ID NO: 125114 - RNA, 22 nt, Homo sapiens
uucuuaguggcaccacuuuuuu

SEQ ID NO: 125115 - RNA, 22 nt, Homo sapiens
uucuucaggcauucccagaagc

SEQ ID NO: 125116 - RNA, 22 nt, Homo sapiens
uucuucaggccacaaaaauggu

SEQ ID NO: 125117 - RNA, 22 nt, Homo sapiens
uucuugcacuuaacugacauuc

SEQ ID NO: 125118 - RNA, 22 nt, Homo sapiens
uucuugcacuuggcccucauua

SEQ ID NO: 125119 - RNA, 22 nt, Homo sapiens
uucuugcuguauccucacaugg

SEQ ID NO: 125120 - RNA, 22 nt, Homo sapiens
uucuugguuggcaaccaacagu

SEQ ID NO: 125121 - RNA, 18 nt, Homo sapiens
uucuuguguugauauuuu

SEQ ID NO: 125122 - RNA, 22 nt, Homo sapiens
uucuuugcuuggaagcggggga

SEQ ID NO: 125123 - RNA, 22 nt, Homo sapiens
uugaaagaugaacuggauugga

SEQ ID NO: 125124 - RNA, 22 nt, Homo sapiens
uugaaagcuaucucaaaucgcu

SEQ ID NO: 125125 - RNA, 22 nt, Homo sapiens
uugaaagucauuucuucuaagu

SEQ ID NO: 125126 - RNA, 22 nt, Homo sapiens
uugaaagucuaggcuuacagua

SEQ ID NO: 125127 - RNA, 22 nt, Homo sapiens
uugaaaucuuccacagcccaag

SEQ ID NO: 125128 - RNA, 22 nt, Homo sapiens
uugaaauguuuagaaguuugga

SEQ ID NO: 125129 - RNA, 22 nt, Homo sapiens
uugaaccauucuuuugauagag

SEQ ID NO: 125130 - RNA, 22 nt, Homo sapiens
uugaacuguaagggucugugug

SEQ ID NO: 125131 - RNA, 22 nt, Homo sapiens
uugaagacuaauuuagauaaug

SEQ ID NO: 125132 - RNA, 22 nt, Homo sapiens
uugaagacuauaugauucuuca

SEQ ID NO: 125133 - RNA, 22 nt, Homo sapiens
uugaagagaaccgcggcuuauu

SEQ ID NO: 125134 - RNA, 22 nt, Homo sapiens
uugaaguaguacuuuauuauag

SEQ ID NO: 125135 - RNA, 19 nt, Homo sapiens
uugauaugauuaggagcac

SEQ ID NO: 125136 - RNA, 20 nt, Homo sapiens
uugauucccucuaaacucgc

SEQ ID NO: 125137 - RNA, 22 nt, Homo sapiens
uugauugacaugucucuguuca

SEQ ID NO: 125138 - RNA, 22 nt, Homo sapiens
uugcaaacaucuuguuucacau

SEQ ID NO: 125139 - RNA, 22 nt, Homo sapiens
uugcaaagaccucuucacuucc

SEQ ID NO: 125140 - RNA, 23 nt, Homo sapiens
uugcaaagccugaaacucuucag

SEQ ID NO: 125141 - RNA, 21 nt, Homo sapiens
uugcaaaugcugcugccugau

SEQ ID NO: 125142 - RNA, 18 nt, Homo sapiens
uugcaaauucuucccugu

SEQ ID NO: 125143 - RNA, 22 nt, Homo sapiens
uugcaacauguauucuggugau

SEQ ID NO: 125144 - RNA, 22 nt, Homo sapiens
uugcaagaaaugcagauucuca

SEQ ID NO: 125145 - RNA, 22 nt, Homo sapiens
uugcaaugugaugugauuugga

SEQ ID NO: 125146 - RNA, 22 nt, Homo sapiens
uugcacaauccugugagugagu

SEQ ID NO: 125147 - RNA, 22 nt, Homo sapiens
uugcacagucuagcuccaccuu

SEQ ID NO: 125148 - RNA, 22 nt, Homo sapiens
uugcacauggcuggggaggccu

SEQ ID NO: 125149 - RNA, 22 nt, Homo sapiens
uugcacauugcaccuuuuguau

SEQ ID NO: 125150 - RNA, 22 nt, Homo sapiens
uugcacuauuaguauagauguc

SEQ ID NO: 125151 - RNA, 22 nt, Homo sapiens
uugcacuccagcucuaggugac

SEQ ID NO: 125152 - RNA, 18 nt, Homo sapiens
uugcacuccugccugggu

SEQ ID NO: 125153 - RNA, 22 nt, Homo sapiens
uugcagagccccacacugggcu

SEQ ID NO: 125154 - RNA, 22 nt, Homo sapiens
uugcagcaaagagggaggggca

SEQ ID NO: 125155 - RNA, 22 nt, Homo sapiens
uugcagcauucugguuccuggu

SEQ ID NO: 125156 - RNA, 22 nt, Homo sapiens
uugcaggcaugagccaccgugc

SEQ ID NO: 125157 - RNA, 22 nt, Homo sapiens
uugcaguagucugaaagcaaua

SEQ ID NO: 125158 - RNA, 23 nt, Homo sapiens
uugcauagacauccucauagauu

SEQ ID NO: 125159 - RNA, 19 nt, Homo sapiens
uugcauagguugaaccagc

SEQ ID NO: 125160 - RNA, 18 nt, Homo sapiens
uugcauaguguauccaaa

SEQ ID NO: 125161 - RNA, 22 nt, Homo sapiens
uugcauauguugaaccaagcgu

SEQ ID NO: 125162 - RNA, 22 nt, Homo sapiens
uugcauauguugaaccagccuu

SEQ ID NO: 125163 - RNA, 22 nt, Homo sapiens
uugcauauucucugaggcagga

SEQ ID NO: 125164 - RNA, 18 nt, Homo sapiens
uugcaucauuuuguuguu

SEQ ID NO: 125165 - RNA, 22 nt, Homo sapiens
uugcauuagugugguacauuug

SEQ ID NO: 125166 - RNA, 22 nt, Homo sapiens
uugcauuguacuugguacggcu

SEQ ID NO: 125167 - RNA, 22 nt, Homo sapiens
uugccauggaguagaauugaag

SEQ ID NO: 125168 - RNA, 21 nt, Homo sapiens
uugccugacacuggaagaaau

SEQ ID NO: 125169 - RNA, 22 nt, Homo sapiens
uugccugagaagccaagaauaa

SEQ ID NO: 125170 - RNA, 22 nt, Homo sapiens
uugcuacuuggauguacaugug

SEQ ID NO: 125171 - RNA, 20 nt, Homo sapiens
uugcugguguuagaggaggc

SEQ ID NO: 125172 - RNA, 22 nt, Homo sapiens
uuggaaaccucugcagguguuu

SEQ ID NO: 125173 - RNA, 22 nt, Homo sapiens
uuggaaacgucaccuuuuccuu

SEQ ID NO: 125174 - RNA, 20 nt, Homo sapiens
uuggaaaugugaauugggag

SEQ ID NO: 125175 - RNA, 22 nt, Homo sapiens
uuggaagacaaugcugauucuc

SEQ ID NO: 125176 - RNA, 22 nt, Homo sapiens
uuggacagaugguuacauuuuu

SEQ ID NO: 125177 - RNA, 22 nt, Homo sapiens
uuggaccacuugauuucugguc

SEQ ID NO: 125178 - RNA, 22 nt, Homo sapiens
uuggacucccuccccagcuuca

SEQ ID NO: 125179 - RNA, 22 nt, Homo sapiens
uuggacugugagguuucguggg

SEQ ID NO: 125180 - RNA, 22 nt, Homo sapiens
uuggagagagaggacucccggc

SEQ ID NO: 125181 - RNA, 22 nt, Homo sapiens
uuggagagucacuaguuagugc

SEQ ID NO: 125182 - RNA, 22 nt, Homo sapiens
uuggagagugauauucagaugc

SEQ ID NO: 125183 - RNA, 22 nt, Homo sapiens
uuggagugugagagcagccugg

SEQ ID NO: 125184 - RNA, 22 nt, Homo sapiens
uuggaugauaaagaagccuaag

SEQ ID NO: 125185 - RNA, 22 nt, Homo sapiens
uuggauggucuuuauauaguau

SEQ ID NO: 125186 - RNA, 22 nt, Homo sapiens
uuggauuuuaacaaacuaggug

SEQ ID NO: 125187 - RNA, 19 nt, Homo sapiens
uuggcagaguugcccccua

SEQ ID NO: 125188 - RNA, 22 nt, Homo sapiens
uuggcagcuguggaaucugggc

SEQ ID NO: 125189 - RNA, 20 nt, Homo sapiens
uuggcauuuagacaagaguu

SEQ ID NO: 125190 - RNA, 22 nt, Homo sapiens
uuggcauuuuggacacccagga

SEQ ID NO: 125191 - RNA, 22 nt, Homo sapiens
uuggcauuuuuagucaugggaa

SEQ ID NO: 125192 - RNA, 23 nt, Homo sapiens
uuggccuccuugugucuagggcu

SEQ ID NO: 125193 - RNA, 22 nt, Homo sapiens
uuggcuaugaguccuaugugca

SEQ ID NO: 125194 - RNA, 22 nt, Homo sapiens
uuggcucugcgucucgcggacg

SEQ ID NO: 125195 - RNA, 22 nt, Homo sapiens
uugggaauguccuaauaucucg

SEQ ID NO: 125196 - RNA, 22 nt, Homo sapiens
uugggcuugagggugcccaguc

SEQ ID NO: 125197 - RNA, 21 nt, Homo sapiens
uuggggaauggagagguuuuc

SEQ ID NO: 125198 - RNA, 22 nt, Homo sapiens
uuggguccucugguccuugguu

SEQ ID NO: 125199 - RNA, 22 nt, Homo sapiens
uugguaagguggaugaugaaua

SEQ ID NO: 125200 - RNA, 22 nt, Homo sapiens
uugguaggcuggccucucucag

SEQ ID NO: 125201 - RNA, 22 nt, Homo sapiens
uuggucagcucaauggagaggg

SEQ ID NO: 125202 - RNA, 22 nt, Homo sapiens
uuggucaggagccucccucuuu

SEQ ID NO: 125203 - RNA, 22 nt, Homo sapiens
uuggucaggcuaaucucgaacg

SEQ ID NO: 125204 - RNA, 22 nt, Homo sapiens
uuggucucuuaaucacacuuuu

SEQ ID NO: 125205 - RNA, 22 nt, Homo sapiens
uuggucuucuaauguaccuguu

SEQ ID NO: 125206 - RNA, 20 nt, Homo sapiens
uuggugaccuacagaugugg

SEQ ID NO: 125207 - RNA, 22 nt, Homo sapiens
uugguuaccuucagaaaugagu

SEQ ID NO: 125208 - RNA, 22 nt, Homo sapiens
uugguucaguuuaacgaguaau

SEQ ID NO: 125209 - RNA, 22 nt, Homo sapiens
uuguaaagucugucucagucag

SEQ ID NO: 125210 - RNA, 22 nt, Homo sapiens
uuguaaaguucucucccgaaaa

SEQ ID NO: 125211 - RNA, 22 nt, Homo sapiens
uuguacuagaaaauuauucuuu

SEQ ID NO: 125212 - RNA, 22 nt, Homo sapiens
uuguacuagucauauuuugaaa

SEQ ID NO: 125213 - RNA, 22 nt, Homo sapiens
uuguagcuuuuuaaugugcugc

SEQ ID NO: 125214 - RNA, 22 nt, Homo sapiens
uuguaguagcauuauuuauaau

SEQ ID NO: 125215 - RNA, 22 nt, Homo sapiens
uuguauaguucuauguguuuug

SEQ ID NO: 125216 - RNA, 22 nt, Homo sapiens
uuguaugucuucauuugaaaaa

SEQ ID NO: 125217 - RNA, 22 nt, Homo sapiens
uuguauguugaaugaugguaua

SEQ ID NO: 125218 - RNA, 22 nt, Homo sapiens
uuguauguuucugugcacauga

SEQ ID NO: 125219 - RNA, 22 nt, Homo sapiens
uugucacauggggcggcugccc

SEQ ID NO: 125220 - RNA, 22 nt, Homo sapiens
uugucacucuuccuaggguagg

SEQ ID NO: 125221 - RNA, 22 nt, Homo sapiens
uugucauuuucagaguguuacg

SEQ ID NO: 125222 - RNA, 22 nt, Homo sapiens
uuguccaagucccauuuguuga

SEQ ID NO: 125223 - RNA, 22 nt, Homo sapiens
uuguccccaucugcugccagaa

SEQ ID NO: 125224 - RNA, 23 nt, Homo sapiens
uuguccccuccaaagcucauguu

SEQ ID NO: 125225 - RNA, 22 nt, Homo sapiens
uuguccuccacauuugaucagu

SEQ ID NO: 125226 - RNA, 22 nt, Homo sapiens
uugucucacuggaguuuaguaa

SEQ ID NO: 125227 - RNA, 22 nt, Homo sapiens
uugugaaaaaccucucguggaa

SEQ ID NO: 125228 - RNA, 22 nt, Homo sapiens
uugugaucauugucaaauagug

SEQ ID NO: 125229 - RNA, 22 nt, Homo sapiens
uugugcaaaaguaauugcgguu

SEQ ID NO: 125230 - RNA, 22 nt, Homo sapiens
uugugcacauguacccuagaac

SEQ ID NO: 125231 - RNA, 22 nt, Homo sapiens
uugugcuugcuguguucuaugc

SEQ ID NO: 125232 - RNA, 22 nt, Homo sapiens
uugugcuuuugagcugagauga

SEQ ID NO: 125233 - RNA, 22 nt, Homo sapiens
uugugguaaucugugacagcag

SEQ ID NO: 125234 - RNA, 22 nt, Homo sapiens
uugugguugauacacguaggaa

SEQ ID NO: 125235 - RNA, 19 nt, Homo sapiens
uuguguccccacaaaauuc

SEQ ID NO: 125236 - RNA, 22 nt, Homo sapiens
uuguguccccacucaaauuaca

SEQ ID NO: 125237 - RNA, 22 nt, Homo sapiens
uuguuauguuggucaguaaugu

SEQ ID NO: 125238 - RNA, 22 nt, Homo sapiens
uuguugcacugcuuuccuggcc

SEQ ID NO: 125239 - RNA, 22 nt, Homo sapiens
uuguuuuggagaugagcuaaaa

SEQ ID NO: 125240 - RNA, 22 nt, Homo sapiens
uuuaaagcaugacgagaagaag

SEQ ID NO: 125241 - RNA, 23 nt, Homo sapiens
uuuaagcuucauguccuaacauc

SEQ ID NO: 125242 - RNA, 22 nt, Homo sapiens
uuuaaggcacuucaugguuuca

SEQ ID NO: 125243 - RNA, 22 nt, Homo sapiens
uuuaaguguuuguuccugaaaa

SEQ ID NO: 125244 - RNA, 22 nt, Homo sapiens
uuuaaugcugcccagucauggg

SEQ ID NO: 125245 - RNA, 18 nt, Homo sapiens
uuuacaguagaaggacuu

SEQ ID NO: 125246 - RNA, 22 nt, Homo sapiens
uuuacagucucauagguggaag

SEQ ID NO: 125247 - RNA, 22 nt, Homo sapiens
uuuacagucuuuugugugaguc

SEQ ID NO: 125248 - RNA, 22 nt, Homo sapiens
uuuacugugggguuucuuagag

SEQ ID NO: 125249 - RNA, 22 nt, Homo sapiens
uuuagcaauucauuuugugucu

SEQ ID NO: 125250 - RNA, 22 nt, Homo sapiens
uuuagcacugugauugacaaaa

SEQ ID NO: 125251 - RNA, 22 nt, Homo sapiens
uuuagcagcaaagagcuguguu

SEQ ID NO: 125252 - RNA, 22 nt, Homo sapiens
uuuaggcaauauauucaugucu

SEQ ID NO: 125253 - RNA, 22 nt, Homo sapiens
uuuaggcaugcaguucuauuua

SEQ ID NO: 125254 - RNA, 22 nt, Homo sapiens
uuuauagucaggaacuugagga

SEQ ID NO: 125255 - RNA, 22 nt, Homo sapiens
uuuauccagccucuagcaaggu

SEQ ID NO: 125256 - RNA, 22 nt, Homo sapiens
uuuaugcuacauguguuggaaa

SEQ ID NO: 125257 - RNA, 22 nt, Homo sapiens
uuuauggagagauauuuauggu

SEQ ID NO: 125258 - RNA, 22 nt, Homo sapiens
uuuaugucuguacaucgggcgg

SEQ ID NO: 125259 - RNA, 18 nt, Homo sapiens
uuucaagucuuaggugac

SEQ ID NO: 125260 - RNA, 19 nt, Homo sapiens
uuucacacucgccuacuuc

SEQ ID NO: 125261 - RNA, 22 nt, Homo sapiens
uuucacagcaauugccuauugu

SEQ ID NO: 125262 - RNA, 22 nt, Homo sapiens
uuucacagcugucuuccgucuc

SEQ ID NO: 125263 - RNA, 22 nt, Homo sapiens
uuucaccguguuggccaggcug

SEQ ID NO: 125264 - RNA, 22 nt, Homo sapiens
uuucagagucaucugcccaagu

SEQ ID NO: 125265 - RNA, 23 nt, Homo sapiens
uuucaggcaggugaaagaccagc

SEQ ID NO: 125266 - RNA, 22 nt, Homo sapiens
uuucaucagccagggucagucu

SEQ ID NO: 125267 - RNA, 23 nt, Homo sapiens
uuucauggggauuuacucauucc

SEQ ID NO: 125268 - RNA, 19 nt, Homo sapiens
uuucauguuuuuggugaga

SEQ ID NO: 125269 - RNA, 19 nt, Homo sapiens
uuuccaguaaucuuaugug

SEQ ID NO: 125270 - RNA, 22 nt, Homo sapiens
uuuccauguuggugaaaugagg

SEQ ID NO: 125271 - RNA, 22 nt, Homo sapiens
uuucccauuguucugcucugug

SEQ ID NO: 125272 - RNA, 19 nt, Homo sapiens
uuucccugcagaccuacua

SEQ ID NO: 125273 - RNA, 22 nt, Homo sapiens
uuucccuuacuuaaacuuacuc

SEQ ID NO: 125274 - RNA, 16 nt, Homo sapiens
uuucccuuugguguuu

SEQ ID NO: 125275 - RNA, 22 nt, Homo sapiens
uuucuacagugaacgauuucua

SEQ ID NO: 125276 - RNA, 22 nt, Homo sapiens
uuucugugguccucuugaaggu

SEQ ID NO: 125277 - RNA, 22 nt, Homo sapiens
uuugaagacuacugggagugaa

SEQ ID NO: 125278 - RNA, 22 nt, Homo sapiens
ucauuguccaacuucuuucagu

SEQ ID NO: 125279 - RNA, 22 nt, Homo sapiens
uccacaguaaggacccugccuu

SEQ ID NO: 125280 - RNA, 22 nt, Homo sapiens
uccacagugguugaacuaguaa

SEQ ID NO: 125281 - RNA, 19 nt, Homo sapiens
uccaccgcgugcaccucua

SEQ ID NO: 125282 - RNA, 18 nt, Homo sapiens
uccacgugcuuuccagau

SEQ ID NO: 125283 - RNA, 22 nt, Homo sapiens
uccagcuuuuucuaauucugug

SEQ ID NO: 125284 - RNA, 22 nt, Homo sapiens
uccagguuuugugaguuuaaau

SEQ ID NO: 125285 - RNA, 22 nt, Homo sapiens
uccaguuuggaggcuugaugug

SEQ ID NO: 125286 - RNA, 22 nt, Homo sapiens
uccaguuuucuuuccuagggcu

SEQ ID NO: 125287 - RNA, 22 nt, Homo sapiens
uccauagacauuuuaagguagu

SEQ ID NO: 125288 - RNA, 22 nt, Homo sapiens
uccauagugagcagucaaugua

SEQ ID NO: 125289 - RNA, 22 nt, Homo sapiens
uccaugagaauaguuaggcucu

SEQ ID NO: 125290 - RNA, 19 nt, Homo sapiens
uccaugagcccacagugau

SEQ ID NO: 125291 - RNA, 22 nt, Homo sapiens
uccaugaguccauuagaaaaaa

SEQ ID NO: 125292 - RNA, 22 nt, Homo sapiens
uccauggagacacauuuuauau

SEQ ID NO: 125293 - RNA, 22 nt, Homo sapiens
uccauuuguagguagugagaca

SEQ ID NO: 125294 - RNA, 22 nt, Homo sapiens
ucccaagaugagaugggggcug

SEQ ID NO: 125295 - RNA, 20 nt, Homo sapiens
ucccaguaggagaaggaagg

SEQ ID NO: 125296 - RNA, 22 nt, Homo sapiens
uccccgagcccaggcugugacu

SEQ ID NO: 125297 - RNA, 22 nt, Homo sapiens
uccccggaugacggccgcuuca

SEQ ID NO: 125298 - RNA, 22 nt, Homo sapiens
uccccugagaacuugcuagaaa

SEQ ID NO: 125299 - RNA, 22 nt, Homo sapiens
uccccugagucaccugcuucuc

SEQ ID NO: 125300 - RNA, 20 nt, Homo sapiens
ucccuaagagccuuuccuuc

SEQ ID NO: 125301 - RNA, 22 nt, Homo sapiens
ucccugaagcugcagcaacaca

SEQ ID NO: 125302 - RNA, 22 nt, Homo sapiens
ucccugaaucucagguucugua

SEQ ID NO: 125303 - RNA, 22 nt, Homo sapiens
ucccugagcaaaguuuucugua

SEQ ID NO: 125304 - RNA, 22 nt, Homo sapiens
ucccugaguaucuaauguguuu

SEQ ID NO: 125305 - RNA, 19 nt, Homo sapiens
ucccugagucuuagcuuga

SEQ ID NO: 125306 - RNA, 22 nt, Homo sapiens
ucccugagugauugaaaauaaa

SEQ ID NO: 125307 - RNA, 22 nt, Homo sapiens
ucccuggacagccuugccuggg

SEQ ID NO: 125308 - RNA, 19 nt, Homo sapiens
ucccuguagaccacagugc

SEQ ID NO: 125309 - RNA, 22 nt, Homo sapiens
ucccuguguccugggggcaccu

SEQ ID NO: 125310 - RNA, 22 nt, Homo sapiens
ucccuuucuggaguuucccaag

SEQ ID NO: 125311 - RNA, 22 nt, Homo sapiens
uccugauacgguugcaguucuc

SEQ ID NO: 125312 - RNA, 22 nt, Homo sapiens
uccugcauucauccugguguug

SEQ ID NO: 125313 - RNA, 22 nt, Homo sapiens
uccuggcuccacuguuuauucc

SEQ ID NO: 125314 - RNA, 22 nt, Homo sapiens
uccuguaaucccagcuaccaga

SEQ ID NO: 125315 - RNA, 22 nt, Homo sapiens
uccuucauuugucaacucuagu

SEQ ID NO: 125316 - RNA, 22 nt, Homo sapiens
uccuugagccucccagacucag

SEQ ID NO: 125317 - RNA, 22 nt, Homo sapiens
uccuugagccugggaguuauag

SEQ ID NO: 125318 - RNA, 22 nt, Homo sapiens
uccuugagccuuaaauuauaaa

SEQ ID NO: 125319 - RNA, 22 nt, Homo sapiens
uccuugagucugaacuuuggau

SEQ ID NO: 125320 - RNA, 22 nt, Homo sapiens
uccuuuaguuaauaaagacaag

SEQ ID NO: 125321 - RNA, 22 nt, Homo sapiens
uccuuuggguagcuguucagau

SEQ ID NO: 125322 - RNA, 22 nt, Homo sapiens
uccuuugguggagucuuuaggg

SEQ ID NO: 125323 - RNA, 22 nt, Homo sapiens
uccuuugguucuugucacccca

SEQ ID NO: 125324 - RNA, 22 nt, Homo sapiens
ucgcauuucccucuguagcuuc

SEQ ID NO: 125325 - RNA, 22 nt, Homo sapiens
ucgugccacugcacuccagccu

SEQ ID NO: 125326 - RNA, 22 nt, Homo sapiens
ucuaaguaguagcuggucagaa

SEQ ID NO: 125327 - RNA, 17 nt, Homo sapiens
ucuaauaauaugcauuu

SEQ ID NO: 125328 - RNA, 22 nt, Homo sapiens
ucuaauguaaccugcaaauauu

SEQ ID NO: 125329 - RNA, 18 nt, Homo sapiens
ucuagacacugugucuau

SEQ ID NO: 125330 - RNA, 22 nt, Homo sapiens
ucuagaugaaguauaaaguagu

SEQ ID NO: 125331 - RNA, 22 nt, Homo sapiens
ucuaucacagccccacacucuc

SEQ ID NO: 125332 - RNA, 22 nt, Homo sapiens
ucucacagccauuucucccucu

SEQ ID NO: 125333 - RNA, 19 nt, Homo sapiens
ucucacagcucuacuaugu

SEQ ID NO: 125334 - RNA, 22 nt, Homo sapiens
ucucagcacagucagggcgccu

SEQ ID NO: 125335 - RNA, 22 nt, Homo sapiens
ucucaguguuaucuaucugccu

SEQ ID NO: 125336 - RNA, 22 nt, Homo sapiens
ucucauagaggcagagaguaaa

SEQ ID NO: 125337 - RNA, 21 nt, Homo sapiens
ucucauagaguuucacuuucu

SEQ ID NO: 125338 - RNA, 22 nt, Homo sapiens
ucucaugaagauagagaauaga

SEQ ID NO: 125339 - RNA, 20 nt, Homo sapiens
ucucauggagggaaagagca

SEQ ID NO: 125340 - RNA, 22 nt, Homo sapiens
ucuccauuuguaaggguuucuc

SEQ ID NO: 125341 - RNA, 22 nt, Homo sapiens
ucucuagagagccugguguuca

SEQ ID NO: 125342 - RNA, 21 nt, Homo sapiens
ucucucaaccaggaagugggc

SEQ ID NO: 125343 - RNA, 22 nt, Homo sapiens
ucucuggauaucuacuuauguu

SEQ ID NO: 125344 - RNA, 19 nt, Homo sapiens
ucucugguguuggagggga

SEQ ID NO: 125345 - RNA, 22 nt, Homo sapiens
ucucugguuaugucauuaagca

SEQ ID NO: 125346 - RNA, 22 nt, Homo sapiens
ucucugguuuucaaagcaguau

SEQ ID NO: 125347 - RNA, 22 nt, Homo sapiens
ucucuguuuagagccagcaauu

SEQ ID NO: 125348 - RNA, 22 nt, Homo sapiens
ucucuuggcggaaguugcagug

SEQ ID NO: 125349 - RNA, 22 nt, Homo sapiens
ucugacaaugaacaaucuauag

SEQ ID NO: 125350 - RNA, 22 nt, Homo sapiens
ucugacagugagagaaaucuga

SEQ ID NO: 125351 - RNA, 22 nt, Homo sapiens
uaagugaauuucacuacugagu

SEQ ID NO: 125352 - RNA, 22 nt, Homo sapiens
uaagugaauuugacagguaaug

SEQ ID NO: 125353 - RNA, 20 nt, Homo sapiens
uaagugcauaggauauuucu

SEQ ID NO: 125354 - RNA, 22 nt, Homo sapiens
uaaguugcagguugugauucca

SEQ ID NO: 125355 - RNA, 22 nt, Homo sapiens
uaauacauucaaggugguaguu

SEQ ID NO: 125356 - RNA, 22 nt, Homo sapiens
uaauccuagcacuuuggaagac

SEQ ID NO: 125357 - RNA, 22 nt, Homo sapiens
uaauccugucuugaccaucagg

SEQ ID NO: 125358 - RNA, 22 nt, Homo sapiens
uaaugcauguaaugggcugaua

SEQ ID NO: 125359 - RNA, 22 nt, Homo sapiens
uaaugugaauagugcuguaaug

SEQ ID NO: 125360 - RNA, 22 nt, Homo sapiens
uaauucuguauguaucagaguu

SEQ ID NO: 125361 - RNA, 22 nt, Homo sapiens
uacaaagcuacucgagggcagg

SEQ ID NO: 125362 - RNA, 22 nt, Homo sapiens
uacaaagcuuucugcaaaucau

SEQ ID NO: 125363 - RNA, 22 nt, Homo sapiens
uacaaagugggaaacgaagguu

SEQ ID NO: 125364 - RNA, 21 nt, Homo sapiens
uacaaugcacaggagagccuc

SEQ ID NO: 125365 - RNA, 22 nt, Homo sapiens
uacacaugugaguucuuuucua

SEQ ID NO: 125366 - RNA, 22 nt, Homo sapiens
uacaccauuugauucuuuaagc

SEQ ID NO: 125367 - RNA, 23 nt, Homo sapiens
uacagcacacugaugggucuuga

SEQ ID NO: 125368 - RNA, 22 nt, Homo sapiens
uacagcacugugcauagugguu

SEQ ID NO: 125369 - RNA, 22 nt, Homo sapiens
uacagcuaugugcaugcaugcu

SEQ ID NO: 125370 - RNA, 23 nt, Homo sapiens
uacagcugcagaaucaggcuaag

SEQ ID NO: 125371 - RNA, 22 nt, Homo sapiens
uacaggaaugucagguugcugu

SEQ ID NO: 125372 - RNA, 22 nt, Homo sapiens
uacaggauagacaauuuauuaa

SEQ ID NO: 125373 - RNA, 22 nt, Homo sapiens
uacaguaauguuaaucuuugug

SEQ ID NO: 125374 - RNA, 22 nt, Homo sapiens
uacagucauaaugccuagugac

SEQ ID NO: 125375 - RNA, 22 nt, Homo sapiens
uacagucuggaggccuguguug

SEQ ID NO: 125376 - RNA, 22 nt, Homo sapiens
uacagugcuuuuugguggagaa

SEQ ID NO: 125377 - RNA, 22 nt, Homo sapiens
uacaguggcaugucaggugcuu

SEQ ID NO: 125378 - RNA, 22 nt, Homo sapiens
uacaguguuuugguauuccaca

SEQ ID NO: 125379 - RNA, 22 nt, Homo sapiens
uacauacuguaugguucuguuu

SEQ ID NO: 125380 - RNA, 22 nt, Homo sapiens
uacauaguagauauaggguuua

SEQ ID NO: 125381 - RNA, 22 nt, Homo sapiens
uacaugugcaggucuguggggg

SEQ ID NO: 125382 - RNA, 22 nt, Homo sapiens
uacauuggcuagguuuggaggc

SEQ ID NO: 125383 - RNA, 22 nt, Homo sapiens
augugugcuugugacacagccu

SEQ ID NO: 125384 - RNA, 22 nt, Homo sapiens
auguuagcaucaauauucauca

SEQ ID NO: 125385 - RNA, 22 nt, Homo sapiens
auguuauguuaaugauaaugga

SEQ ID NO: 125386 - RNA, 22 nt, Homo sapiens
auuaacaucuagaguuuuggug

SEQ ID NO: 125387 - RNA, 22 nt, Homo sapiens
auuaauguaauuaguaaaguug

SEQ ID NO: 125388 - RNA, 22 nt, Homo sapiens
auuagguuagugcaaaaguaau

SEQ ID NO: 125389 - RNA, 22 nt, Homo sapiens
auuagugaaugugaugucuuga

SEQ ID NO: 125390 - RNA, 22 nt, Homo sapiens
auuauaugucaucacagacacc

SEQ ID NO: 125391 - RNA, 22 nt, Homo sapiens
auucaaagugcauguucccacu

SEQ ID NO: 125392 - RNA, 23 nt, Homo sapiens
auucaaguagugagagugguuau

SEQ ID NO: 125393 - RNA, 22 nt, Homo sapiens
auucaagugaugcagcuguuuu

SEQ ID NO: 125394 - RNA, 22 nt, Homo sapiens
auucaagugaugugauucuucu

SEQ ID NO: 125395 - RNA, 22 nt, Homo sapiens
auucacuguggguccuuuggau

SEQ ID NO: 125396 - RNA, 22 nt, Homo sapiens
auucagaggggcagcugucuug

SEQ ID NO: 125397 - RNA, 22 nt, Homo sapiens
auucauagugcuaagguguauc

SEQ ID NO: 125398 - RNA, 22 nt, Homo sapiens
auucaucagggauauuggucug

SEQ ID NO: 125399 - RNA, 23 nt, Homo sapiens
auuccaguggcaauuggagaaac

SEQ ID NO: 125400 - RNA, 22 nt, Homo sapiens
auuccauuuguguggaauggcu

SEQ ID NO: 125401 - RNA, 22 nt, Homo sapiens
auucccuuagcugccucagccu

SEQ ID NO: 125402 - RNA, 22 nt, Homo sapiens
auucccuuggucaacggaugca

SEQ ID NO: 125403 - RNA, 22 nt, Homo sapiens
auucuugcuugaacuuggugca

SEQ ID NO: 125404 - RNA, 22 nt, Homo sapiens
auugaacaugccauauguacca

SEQ ID NO: 125405 - RNA, 22 nt, Homo sapiens
auugaacuuaaaagacuugcca

SEQ ID NO: 125406 - RNA, 22 nt, Homo sapiens
auugaacuuacuaucuaaacua

SEQ ID NO: 125407 - RNA, 21 nt, Homo sapiens
auugagcacaugaaacauggc

SEQ ID NO: 125408 - RNA, 22 nt, Homo sapiens
auugaggcaggaggaccaucua

SEQ ID NO: 125409 - RNA, 19 nt, Homo sapiens
auugauuaaguuugcuguc

SEQ ID NO: 125410 - RNA, 22 nt, Homo sapiens
auugcaaagcguagacucuaaa

SEQ ID NO: 125411 - RNA, 22 nt, Homo sapiens
auugcaauuaguccauagaguu

SEQ ID NO: 125412 - RNA, 22 nt, Homo sapiens
auugcacaaagagggaaacuga

SEQ ID NO: 125413 - RNA, 21 nt, Homo sapiens
auugcacaauauacccaugua

SEQ ID NO: 125414 - RNA, 22 nt, Homo sapiens
auugcacuccagccuaggcaac

SEQ ID NO: 125415 - RNA, 22 nt, Homo sapiens
auugcacuccagccugggcagc

SEQ ID NO: 125416 - RNA, 22 nt, Homo sapiens
auugcacuccagccugggcuag

SEQ ID NO: 125417 - RNA, 22 nt, Homo sapiens
auugcacuccagccuugugaca

SEQ ID NO: 125418 - RNA, 22 nt, Homo sapiens
auugcagcuugcagggugugua

SEQ ID NO: 125419 - RNA, 22 nt, Homo sapiens
auugcaguuucaacuccagggc

SEQ ID NO: 125420 - RNA, 22 nt, Homo sapiens
auugcaugucauguuuagugua

SEQ ID NO: 125421 - RNA, 23 nt, Homo sapiens
auugcccuugaaggcuaaacucu

SEQ ID NO: 125422 - RNA, 22 nt, Homo sapiens
auugcuuacccuguauuagauc

SEQ ID NO: 125423 - RNA, 22 nt, Homo sapiens
auugcuuacuaaucaucuucag

SEQ ID NO: 125424 - RNA, 22 nt, Homo sapiens
auugcuucugauuuuaaaugag

SEQ ID NO: 125425 - RNA, 22 nt, Homo sapiens
auuggcaauccauauauuuucu

SEQ ID NO: 125426 - RNA, 22 nt, Homo sapiens
auuggcuauuuggugagugauu

SEQ ID NO: 125427 - RNA, 22 nt, Homo sapiens
auuggcuuuauacauaagaaua

SEQ ID NO: 125428 - RNA, 22 nt, Homo sapiens
auuggggaaugguggcuuuagu

SEQ ID NO: 125429 - RNA, 22 nt, Homo sapiens
auuguaauuuuagagaaagugg

SEQ ID NO: 125430 - RNA, 22 nt, Homo sapiens
auuguacauacaccggugugua

SEQ ID NO: 125431 - RNA, 22 nt, Homo sapiens
auuguacuccagccugggcaag

SEQ ID NO: 125432 - RNA, 22 nt, Homo sapiens
auuguacuccagccugggcagc

SEQ ID NO: 125433 - RNA, 22 nt, Homo sapiens
auugucacugugcuccaccagu

SEQ ID NO: 125434 - RNA, 22 nt, Homo sapiens
auugugcuaaaguaauaaguca

SEQ ID NO: 125435 - RNA, 22 nt, Homo sapiens
auugugucuuguagagagauau

SEQ ID NO: 125436 - RNA, 22 nt, Homo sapiens
auuguucuuacaugcugucauc

SEQ ID NO: 125437 - RNA, 22 nt, Homo sapiens
auuguucuuguguccuuuuccu

SEQ ID NO: 125438 - RNA, 22 nt, Homo sapiens
auuuggcaacguagggaggcau

SEQ ID NO: 125439 - RNA, 22 nt, Homo sapiens
auuuggcauagaguaucauucu

SEQ ID NO: 125440 - RNA, 22 nt, Homo sapiens
auuugggaaugugcauuauacu

SEQ ID NO: 125441 - RNA, 22 nt, Homo sapiens
auuuggguaaugagugcaaggg

SEQ ID NO: 125442 - RNA, 22 nt, Homo sapiens
auuugguuauggucauggacac

SEQ ID NO: 125443 - RNA, 22 nt, Homo sapiens
auuugucacuauguggcuaaua

SEQ ID NO: 125444 - RNA, 22 nt, Homo sapiens
auuugucacuuaacagccauua

SEQ ID NO: 125445 - RNA, 22 nt, Homo sapiens
auuuugcauugcuguaaaggaa

SEQ ID NO: 125446 - RNA, 21 nt, Homo sapiens
auuuuugcagagcugguagug

SEQ ID NO: 125447 - RNA, 22 nt, Homo sapiens
auuuuugguugguaggcuauua

SEQ ID NO: 125448 - RNA, 22 nt, Homo sapiens
auuuuugguugucagcacuagg

SEQ ID NO: 125449 - RNA, 22 nt, Homo sapiens
caaagcacuuggcuuggaagau

SEQ ID NO: 125450 - RNA, 22 nt, Homo sapiens
caaagcuauagcaccagaggga

SEQ ID NO: 125451 - RNA, 22 nt, Homo sapiens
caaaggauucauuuccaggagu

SEQ ID NO: 125452 - RNA, 22 nt, Homo sapiens
caaaguaauuacgguuuuggcc

SEQ ID NO: 125453 - RNA, 22 nt, Homo sapiens
caaagugcugggaugggccagg

SEQ ID NO: 125454 - RNA, 22 nt, Homo sapiens
caaaugacaucauuucauucaa

SEQ ID NO: 125455 - RNA, 22 nt, Homo sapiens
caacauccaccuccuggguuca

SEQ ID NO: 125456 - RNA, 22 nt, Homo sapiens
caacucuguaggauccaggugg

SEQ ID NO: 125457 - RNA, 22 nt, Homo sapiens
caacugcucacuccuggguuca

SEQ ID NO: 125458 - RNA, 22 nt, Homo sapiens
caagaucauuuaugcuaaaauu

SEQ ID NO: 125459 - RNA, 22 nt, Homo sapiens
caagggguggaaaugguagugu

SEQ ID NO: 125460 - RNA, 22 nt, Homo sapiens
caaggugcugagacaggagccc

SEQ ID NO: 125461 - RNA, 22 nt, Homo sapiens
caaguguuggcuuguauacaaa

SEQ ID NO: 125462 - RNA, 22 nt, Homo sapiens
caaguguuuccuuaaauacuug

SEQ ID NO: 125463 - RNA, 22 nt, Homo sapiens
caauacuguuaccugaaauagg

SEQ ID NO: 125464 - RNA, 22 nt, Homo sapiens
caaugcauuauucucccacuuc

SEQ ID NO: 125465 - RNA, 21 nt, Homo sapiens
caauggcacaaucucugcuca

SEQ ID NO: 125466 - RNA, 22 nt, Homo sapiens
caaugguacuagauaucuucag

SEQ ID NO: 125467 - RNA, 22 nt, Homo sapiens
cacagcgacuuccgccuaccgg

SEQ ID NO: 125468 - RNA, 22 nt, Homo sapiens
cacaggccugucucuuucuaac

SEQ ID NO: 125469 - RNA, 23 nt, Homo sapiens
cacagggugaacaccccuaaucc

SEQ ID NO: 125470 - RNA, 22 nt, Homo sapiens
cacaggucauccuggaucaagg

SEQ ID NO: 125471 - RNA, 22 nt, Homo sapiens
cacagucuugcaauauugagau

SEQ ID NO: 125472 - RNA, 22 nt, Homo sapiens
cacagugaaugucaucauugcc

SEQ ID NO: 125473 - RNA, 22 nt, Homo sapiens
cacauagcuagucaguagugaa

SEQ ID NO: 125474 - RNA, 22 nt, Homo sapiens
cugaauguucuggauggaagag

SEQ ID NO: 125475 - RNA, 22 nt, Homo sapiens
cugacaagauucaucacucagu

SEQ ID NO: 125476 - RNA, 22 nt, Homo sapiens
cugacacuucaaaacugccaau

SEQ ID NO: 125477 - RNA, 22 nt, Homo sapiens
cugacuaguuuuaaugcagauu

SEQ ID NO: 125478 - RNA, 22 nt, Homo sapiens
cugacuuuagaacccaaaaagu

SEQ ID NO: 125479 - RNA, 22 nt, Homo sapiens
cugagaagaaacagguaaggac

SEQ ID NO: 125480 - RNA, 22 nt, Homo sapiens
cugagagugguauguuuaagug

SEQ ID NO: 125481 - RNA, 22 nt, Homo sapiens
cugagaucaagucuugcucugu

SEQ ID NO: 125482 - RNA, 22 nt, Homo sapiens
cugagaucugaaccaggagugu

SEQ ID NO: 125483 - RNA, 22 nt, Homo sapiens
cugagauggagucucgcauugu

SEQ ID NO: 125484 - RNA, 18 nt, Homo sapiens
cugagcacugcuuuauga

SEQ ID NO: 125485 - RNA, 22 nt, Homo sapiens
cugagcaucauggcagaaucuu

SEQ ID NO: 125486 - RNA, 22 nt, Homo sapiens
cugagguaauuuguugccagua

SEQ ID NO: 125487 - RNA, 22 nt, Homo sapiens
cugagguacugggggccaggau

SEQ ID NO: 125488 - RNA, 22 nt, Homo sapiens
cugagguaggcccugagaauau

SEQ ID NO: 125489 - RNA, 22 nt, Homo sapiens
cugaggugggagaaucacauaa

SEQ ID NO: 125490 - RNA, 22 nt, Homo sapiens
cugaggugggaggauuggcuug

SEQ ID NO: 125491 - RNA, 22 nt, Homo sapiens
cugagguuaggaguuugagacc

SEQ ID NO: 125492 - RNA, 18 nt, Homo sapiens
cugagucauuccuggguc

SEQ ID NO: 125493 - RNA, 22 nt, Homo sapiens
cugauaaguuuuucuuuauaag

SEQ ID NO: 125494 - RNA, 20 nt, Homo sapiens
cugauacagccugagcucuc

SEQ ID NO: 125495 - RNA, 22 nt, Homo sapiens
cugaucuggaggugucugggga

SEQ ID NO: 125496 - RNA, 22 nt, Homo sapiens
cugauugucaucaauauuauua

SEQ ID NO: 125497 - RNA, 21 nt, Homo sapiens
cugcaaaugcugcugccugau

SEQ ID NO: 125498 - RNA, 22 nt, Homo sapiens
cugcaagaaucguaguauuuga

SEQ ID NO: 125499 - RNA, 22 nt, Homo sapiens
cugcaagaugcauaggaauuuu

SEQ ID NO: 125500 - RNA, 22 nt, Homo sapiens
cugcacugagacccucuuugcu

SEQ ID NO: 125501 - RNA, 22 nt, Homo sapiens
cugcagaucuuggggcuugcca

SEQ ID NO: 125502 - RNA, 21 nt, Homo sapiens
cugcauccauuucugagugau

SEQ ID NO: 125503 - RNA, 19 nt, Homo sapiens
cugcaugagacaguugguu

SEQ ID NO: 125504 - RNA, 22 nt, Homo sapiens
cugcauuugaugacguauggug

SEQ ID NO: 125505 - RNA, 22 nt, Homo sapiens
cugcccuuucuauaugauguaa

SEQ ID NO: 125506 - RNA, 22 nt, Homo sapiens
cugccuagaucugaaccuggcu

SEQ ID NO: 125507 - RNA, 22 nt, Homo sapiens
cugcuauauugguucaggcuug

SEQ ID NO: 125508 - RNA, 22 nt, Homo sapiens
cugcuggucuuuaaggucuagg

SEQ ID NO: 125509 - RNA, 22 nt, Homo sapiens
cuggaaacaucuuaggaaugca

SEQ ID NO: 125510 - RNA, 22 nt, Homo sapiens
cuggaagcacaacgcauuuauu

SEQ ID NO: 125511 - RNA, 22 nt, Homo sapiens
cuggaauguuccuaaagauuca

SEQ ID NO: 125512 - RNA, 22 nt, Homo sapiens
cuggagauauuggaagaaagaa

SEQ ID NO: 125513 - RNA, 22 nt, Homo sapiens
cuggagaucuugacauugaagu

SEQ ID NO: 125514 - RNA, 22 nt, Homo sapiens
cuggaggccugaacauaaaugg

SEQ ID NO: 125515 - RNA, 22 nt, Homo sapiens
cuggaguaugaaccauguauca

SEQ ID NO: 125516 - RNA, 22 nt, Homo sapiens
cuggaguaugauguuagcguug

SEQ ID NO: 125517 - RNA, 22 nt, Homo sapiens
cuggagucugacugacacaagg

SEQ ID NO: 125518 - RNA, 20 nt, Homo sapiens
cuggaugucgaggcagaggu

SEQ ID NO: 125519 - RNA, 18 nt, Homo sapiens
cuggaugucgaguguguu

SEQ ID NO: 125520 - RNA, 22 nt, Homo sapiens
cuggcaaaaagagggcaauaau

SEQ ID NO: 125521 - RNA, 22 nt, Homo sapiens
cuggcacagugucagaaacaca

SEQ ID NO: 125522 - RNA, 22 nt, Homo sapiens
cuggcagugcuuguuauccugg

SEQ ID NO: 125523 - RNA, 22 nt, Homo sapiens
cuggcccaguucugcguuuugc

SEQ ID NO: 125524 - RNA, 22 nt, Homo sapiens
cuggcuaagugcuugagugugc

SEQ ID NO: 125525 - RNA, 22 nt, Homo sapiens
cuggcucugggcuaaagaaaua

SEQ ID NO: 125526 - RNA, 22 nt, Homo sapiens
cuggcugagugguaaguagagg

SEQ ID NO: 125527 - RNA, 22 nt, Homo sapiens
cugggaucaguucuagucagaa

SEQ ID NO: 125528 - RNA, 22 nt, Homo sapiens
cugggauggaggagaauuagag

SEQ ID NO: 125529 - RNA, 22 nt, Homo sapiens
cugggcaaugcggcuggauaga

SEQ ID NO: 125530 - RNA, 22 nt, Homo sapiens
cugggguaggacuggcuuuuga

SEQ ID NO: 125531 - RNA, 21 nt, Homo sapiens
cugguccccuuuauguaugug

SEQ ID NO: 125532 - RNA, 22 nt, Homo sapiens
cuguacucaucccauaugcacu

SEQ ID NO: 125533 - RNA, 22 nt, Homo sapiens
cuguagcuuuuauaugcuuagc

SEQ ID NO: 125534 - RNA, 22 nt, Homo sapiens
cuguauguuucuaugaauguga

SEQ ID NO: 125535 - RNA, 22 nt, Homo sapiens
cugucuagagggcacaugaugc

SEQ ID NO: 125536 - RNA, 22 nt, Homo sapiens
cugugaacaugggagaaauggc

SEQ ID NO: 125537 - RNA, 22 nt, Homo sapiens
cugugaucuuuuuucauguggu

SEQ ID NO: 125538 - RNA, 22 nt, Homo sapiens
cugugcaaguuauaggccaggu

SEQ ID NO: 125539 - RNA, 22 nt, Homo sapiens
cugugcacaucuggcggcccga

SEQ ID NO: 125540 - RNA, 22 nt, Homo sapiens
cugugcauaugacuuuauugga

SEQ ID NO: 125541 - RNA, 22 nt, Homo sapiens
cugugcaugcgcggagcugaaa

SEQ ID NO: 125542 - RNA, 22 nt, Homo sapiens
cugugcauucuuaaaucaggaa

SEQ ID NO: 125543 - RNA, 22 nt, Homo sapiens
cugugcauuggaugucucccug

SEQ ID NO: 125544 - RNA, 22 nt, Homo sapiens
cugugcuugauuauaugagugu

SEQ ID NO: 125545 - RNA, 22 nt, Homo sapiens
cuguugguuaaauuccaugcag

SEQ ID NO: 125546 - RNA, 22 nt, Homo sapiens
cuucacuuuguuaaacuccaau

SEQ ID NO: 125547 - RNA, 22 nt, Homo sapiens
cuucaucugguuugugaacuuu

SEQ ID NO: 125548 - RNA, 22 nt, Homo sapiens
cuuccaguggcagccgggcaug

SEQ ID NO: 125549 - RNA, 22 nt, Homo sapiens
cuuccauaguauuuuuacaaaa

SEQ ID NO: 125550 - RNA, 22 nt, Homo sapiens
cuucugauugaaaauggaguag

SEQ ID NO: 125551 - RNA, 22 nt, Homo sapiens
cuucuguuaguucugauaacuu

SEQ ID NO: 125552 - RNA, 23 nt, Homo sapiens
cuugagacaaaugcgugugugca

SEQ ID NO: 125553 - RNA, 22 nt, Homo sapiens
cuugagcauauucuauauuaaa

SEQ ID NO: 125554 - RNA, 22 nt, Homo sapiens
cuugcacauuacagaucugcau

SEQ ID NO: 125555 - RNA, 22 nt, Homo sapiens
cuugcagagcccauggauguca

SEQ ID NO: 125556 - RNA, 22 nt, Homo sapiens
cuugguuacauuuuccuagaaa

SEQ ID NO: 125557 - RNA, 22 nt, Homo sapiens
cuuguacacuguuggugggaau

SEQ ID NO: 125558 - RNA, 22 nt, Homo sapiens
cuugucacuguuggcuuuagaa

SEQ ID NO: 125559 - RNA, 22 nt, Homo sapiens
cuugugauugcacggcugccug

SEQ ID NO: 125560 - RNA, 22 nt, Homo sapiens
cuugugccugaucuuagggggc

SEQ ID NO: 125561 - RNA, 21 nt, Homo sapiens
cuuuaugcuguguuagaaaag

SEQ ID NO: 125562 - RNA, 22 nt, Homo sapiens
cuuucucagugagacccgagau

SEQ ID NO: 125563 - RNA, 22 nt, Homo sapiens
cuuugauuauaaaaggguguuu

SEQ ID NO: 125564 - RNA, 21 nt, Homo sapiens
cuuugcacugcuccucagcuc

SEQ ID NO: 125565 - RNA, 22 nt, Homo sapiens
gcugcuguggcagauuggauuc

SEQ ID NO: 125566 - RNA, 22 nt, Homo sapiens
gcugcuguuuaguuucuccugg

SEQ ID NO: 125567 - RNA, 22 nt, Homo sapiens
gcuggauguuucaauacaaaua

SEQ ID NO: 125568 - RNA, 22 nt, Homo sapiens
gcuggugaaggcugaaaagugg

SEQ ID NO: 125569 - RNA, 22 nt, Homo sapiens
gcugguguucaggcccucaguc

SEQ ID NO: 125570 - RNA, 22 nt, Homo sapiens
gcugucuggagucuguucaaug

SEQ ID NO: 125571 - RNA, 22 nt, Homo sapiens
gcugugguuuaguagaaagaag

SEQ ID NO: 125572 - RNA, 22 nt, Homo sapiens
gcuguguguuaucagaaauugc

SEQ ID NO: 125573 - RNA, 22 nt, Homo sapiens
gcuguugguaaaaaggacauga

SEQ ID NO: 125574 - RNA, 19 nt, Homo sapiens
gcuuguccacgugagauaa

SEQ ID NO: 125575 - RNA, 21 nt, Homo sapiens
gcuuuuucggaagucuuuggc

SEQ ID NO: 125576 - RNA, 22 nt, Homo sapiens
ggaaagacaccuuacuauguua

SEQ ID NO: 125577 - RNA, 22 nt, Homo sapiens
ggaaaguccuucuguaggcucc

SEQ ID NO: 125578 - RNA, 22 nt, Homo sapiens
ggaagacuuagaguagcaucag

SEQ ID NO: 125579 - RNA, 22 nt, Homo sapiens
ggaagagugaauuaucuugacu

SEQ ID NO: 125580 - RNA, 22 nt, Homo sapiens
ggaagguaauuggguaaugaga

SEQ ID NO: 125581 - RNA, 22 nt, Homo sapiens
ggaagugcuguguggaagucug

SEQ ID NO: 125582 - RNA, 22 nt, Homo sapiens
ggaauaguauaaauaccacaaa

SEQ ID NO: 125583 - RNA, 20 nt, Homo sapiens
ggaauagucuacacucugac

SEQ ID NO: 125584 - RNA, 22 nt, Homo sapiens
ggaaugagaaauauuacacaau

SEQ ID NO: 125585 - RNA, 22 nt, Homo sapiens
ggaaugcagugagcauuagaua

SEQ ID NO: 125586 - RNA, 22 nt, Homo sapiens
ggaauguuaaggcgcuguuggu

SEQ ID NO: 125587 - RNA, 22 nt, Homo sapiens
ggaauugcaucaaaugcaggua

SEQ ID NO: 125588 - RNA, 22 nt, Homo sapiens
ggacaagagacugggacacuga

SEQ ID NO: 125589 - RNA, 22 nt, Homo sapiens
ggacagugaaugccacuccucc

SEQ ID NO: 125590 - RNA, 22 nt, Homo sapiens
ggacuguacuccuggccagugu

SEQ ID NO: 125591 - RNA, 22 nt, Homo sapiens
ggagaucuuuguuaucuuuuga

SEQ ID NO: 125592 - RNA, 22 nt, Homo sapiens
ggagaugugccugcucugcucu

SEQ ID NO: 125593 - RNA, 22 nt, Homo sapiens
ggagcugugauuugaguccaga

SEQ ID NO: 125594 - RNA, 22 nt, Homo sapiens
ggagggugagaucaauuuggga

SEQ ID NO: 125595 - RNA, 20 nt, Homo sapiens
ggagguuguauaaguacauc

SEQ ID NO: 125596 - RNA, 22 nt, Homo sapiens
ggagucugaacuggacaaugac

SEQ ID NO: 125597 - RNA, 22 nt, Homo sapiens
ggagugcuguuguuacacaagg

SEQ ID NO: 125598 - RNA, 22 nt, Homo sapiens
ggaguguaauggcgccaucuca

SEQ ID NO: 125599 - RNA, 22 nt, Homo sapiens
ggaguguguuuuccaacuuggu

SEQ ID NO: 125600 - RNA, 21 nt, Homo sapiens
ggauagaaaacuuggcuguau

SEQ ID NO: 125601 - RNA, 22 nt, Homo sapiens
ggauggcauuucuuuagcuuuu

SEQ ID NO: 125602 - RNA, 22 nt, Homo sapiens
ggcaaaaucgcaauuacuuuug

SEQ ID NO: 125603 - RNA, 22 nt, Homo sapiens
ggcaaaauggccagugggucac

SEQ ID NO: 125604 - RNA, 22 nt, Homo sapiens
ggcaaagagacaugcaucgggg

SEQ ID NO: 125605 - RNA, 22 nt, Homo sapiens
ggcaacaauuccuacuucuuuu

SEQ ID NO: 125606 - RNA, 22 nt, Homo sapiens
ggcaacauggugaaacucuguc

SEQ ID NO: 125607 - RNA, 22 nt, Homo sapiens
ggcaagaaagaaaucaucuguc

SEQ ID NO: 125608 - RNA, 22 nt, Homo sapiens
ggcaagaggagauucugcuccc

SEQ ID NO: 125609 - RNA, 19 nt, Homo sapiens
ggcaagaguuguucugugu

SEQ ID NO: 125610 - RNA, 22 nt, Homo sapiens
ggcaagcucaggccucaggugu

SEQ ID NO: 125611 - RNA, 20 nt, Homo sapiens
ggcaagguagcauuucuucu

SEQ ID NO: 125612 - RNA, 21 nt, Homo sapiens
ggcaagugugagguuuggggu

SEQ ID NO: 125613 - RNA, 22 nt, Homo sapiens
ggcaaguucuaaugauuagaau

SEQ ID NO: 125614 - RNA, 22 nt, Homo sapiens
ggcacaaugucagcucacugca

SEQ ID NO: 125615 - RNA, 19 nt, Homo sapiens
ggcaccuuuuccaaaaaug

SEQ ID NO: 125616 - RNA, 23 nt, Homo sapiens
ggcacggaauucaaagaggcauu

SEQ ID NO: 125617 - RNA, 22 nt, Homo sapiens
ggcagagucuugcaucuuuaga

SEQ ID NO: 125618 - RNA, 22 nt, Homo sapiens
ggcagaguggacauuuaaaugu

SEQ ID NO: 125619 - RNA, 22 nt, Homo sapiens
ggcagguaaggagugggagccu

SEQ ID NO: 125620 - RNA, 22 nt, Homo sapiens
ggcaguguuauuauauuuuugg

SEQ ID NO: 125621 - RNA, 22 nt, Homo sapiens
ggcaguuucucaggcaggggua

SEQ ID NO: 125622 - RNA, 22 nt, Homo sapiens
ggcaguuuguuugugaggucca

SEQ ID NO: 125623 - RNA, 22 nt, Homo sapiens
ggcaugaaguagcccacaggca

SEQ ID NO: 125624 - RNA, 21 nt, Homo sapiens
ggcaugaauggaaaagugaga

SEQ ID NO: 125625 - RNA, 22 nt, Homo sapiens
ggccagaugcaguggcucacac

SEQ ID NO: 125626 - RNA, 22 nt, Homo sapiens
ggcccugagacaggaaaaagcu

SEQ ID NO: 125627 - RNA, 22 nt, Homo sapiens
ggccggguggccauggcugccc

SEQ ID NO: 125628 - RNA, 22 nt, Homo sapiens
ggccuguaggguauugguaggg

SEQ ID NO: 125629 - RNA, 22 nt, Homo sapiens
ggcuagagacaaguugcugaga

SEQ ID NO: 125630 - RNA, 22 nt, Homo sapiens
ggcucagugggguccugguucu

SEQ ID NO: 125631 - RNA, 22 nt, Homo sapiens
ggcucaguuuccuccgucugcu

SEQ ID NO: 125632 - RNA, 22 nt, Homo sapiens
ggcuuuggucacacaggggcaa

SEQ ID NO: 125633 - RNA, 22 nt, Homo sapiens
gggaagugugcagaguucucuu

SEQ ID NO: 125634 - RNA, 22 nt, Homo sapiens
gggaauggaagacauuaugaug

SEQ ID NO: 125635 - RNA, 22 nt, Homo sapiens
gggagcaaaaaugaugcccaag

SEQ ID NO: 125636 - RNA, 22 nt, Homo sapiens
gggagguaggaguuauuauuuu

SEQ ID NO: 125637 - RNA, 22 nt, Homo sapiens
gggaguguguaggacccagugu

SEQ ID NO: 125638 - RNA, 22 nt, Homo sapiens
gggaucaacuuauacuaaaauu

SEQ ID NO: 125639 - RNA, 22 nt, Homo sapiens
gggaugauuaugguucacuaca

SEQ ID NO: 125640 - RNA, 22 nt, Homo sapiens
gggauguuuuauacugagccug

SEQ ID NO: 125641 - RNA, 22 nt, Homo sapiens
gggcaaaacuguacugccaagg

SEQ ID NO: 125642 - RNA, 19 nt, Homo sapiens
gggcaaaucuggaaauuua

SEQ ID NO: 125643 - RNA, 21 nt, Homo sapiens
gggcaaaucuuuauccuaagc

SEQ ID NO: 125644 - RNA, 22 nt, Homo sapiens
gggcacgugugugcugugcuca

SEQ ID NO: 125645 - RNA, 22 nt, Homo sapiens
gggguaggcuacacugaguucc

SEQ ID NO: 125646 - RNA, 22 nt, Homo sapiens
gggugguuuuauuaucagugac

SEQ ID NO: 125647 - RNA, 22 nt, Homo sapiens
gguaacaguggggcuaugcuua

SEQ ID NO: 125648 - RNA, 22 nt, Homo sapiens
gguaaguuuggggcuaauuugu

SEQ ID NO: 125649 - RNA, 22 nt, Homo sapiens
ggucacauuggacuaucaaguu

SEQ ID NO: 125650 - RNA, 22 nt, Homo sapiens
ggucagauggcagcugggccug

SEQ ID NO: 125651 - RNA, 22 nt, Homo sapiens
ggucagugcauucuaaaggcaa

SEQ ID NO: 125652 - RNA, 22 nt, Homo sapiens
ggucaguguuaucaccgaagga

SEQ ID NO: 125653 - RNA, 19 nt, Homo sapiens
ggucauggagguuguguga

SEQ ID NO: 125654 - RNA, 22 nt, Homo sapiens
ggucugguguugaaauucuuca

SEQ ID NO: 125655 - RNA, 22 nt, Homo sapiens
ggugacugguuuaucuggcagu

SEQ ID NO: 125656 - RNA, 22 nt, Homo sapiens
augguacuagaguaagaauugu

SEQ ID NO: 125657 - RNA, 22 nt, Homo sapiens
augguacuggggucccggaguu

SEQ ID NO: 125658 - RNA, 22 nt, Homo sapiens
augguacuggguaaaagugggg

SEQ ID NO: 125659 - RNA, 21 nt, Homo sapiens
augguacugucucuggagaua

SEQ ID NO: 125660 - RNA, 22 nt, Homo sapiens
augguauggaaggucuggagga

SEQ ID NO: 125661 - RNA, 22 nt, Homo sapiens
augguauuuaacagucuuucua

SEQ ID NO: 125662 - RNA, 22 nt, Homo sapiens
auggucuuuguuucuaauucug

SEQ ID NO: 125663 - RNA, 22 nt, Homo sapiens
auguaaacuacagauuuugggu

SEQ ID NO: 125664 - RNA, 21 nt, Homo sapiens
auguaacugggaaugugagag

SEQ ID NO: 125665 - RNA, 22 nt, Homo sapiens
auguaacugggacacaagccuc

SEQ ID NO: 125666 - RNA, 17 nt, Homo sapiens
auguaauccucaucucu

SEQ ID NO: 125667 - RNA, 22 nt, Homo sapiens
auguagauaucaagaggcauau

SEQ ID NO: 125668 - RNA, 22 nt, Homo sapiens
auguauacaugcaggucacagg

SEQ ID NO: 125669 - RNA, 21 nt, Homo sapiens
augucauggaugacuaauuca

SEQ ID NO: 125670 - RNA, 22 nt, Homo sapiens
augugaacaucauagaaugcac

SEQ ID NO: 125671 - RNA, 22 nt, Homo sapiens
augugaacugaauuaauucaca

SEQ ID NO: 125672 - RNA, 22 nt, Homo sapiens
augugacugauggagaauaugu

SEQ ID NO: 125673 - RNA, 22 nt, Homo sapiens
augugacugauguaaucagaca

SEQ ID NO: 125674 - RNA, 22 nt, Homo sapiens
augugacuggaucauggggacg

SEQ ID NO: 125675 - RNA, 22 nt, Homo sapiens
augugaugguuaauuuuaugug

SEQ ID NO: 125676 - RNA, 22 nt, Homo sapiens
augugcacaacgugcagguuug

SEQ ID NO: 125677 - RNA, 22 nt, Homo sapiens
augugccaauuaggauuccaag

SEQ ID NO: 125678 - RNA, 22 nt, Homo sapiens
acacuguaacucuuugagggca

SEQ ID NO: 125679 - RNA, 22 nt, Homo sapiens
acacuguauccuucuguccuuu

SEQ ID NO: 125680 - RNA, 22 nt, Homo sapiens
acacuuucuggagcugcacaua

SEQ ID NO: 125681 - RNA, 20 nt, Homo sapiens
acagcacugguuucaagcaa

SEQ ID NO: 125682 - RNA, 22 nt, Homo sapiens
acagcagugccccacucuacug

SEQ ID NO: 125683 - RNA, 20 nt, Homo sapiens
acagcauagccuuuuaaagc

SEQ ID NO: 125684 - RNA, 19 nt, Homo sapiens
acagcugguuuugguuucu

SEQ ID NO: 125685 - RNA, 22 nt, Homo sapiens
acaggugaaguauuacacuaag

SEQ ID NO: 125686 - RNA, 22 nt, Homo sapiens
acaguaaugggccccuuuuccu

SEQ ID NO: 125687 - RNA, 22 nt, Homo sapiens
acaguacaugauaaauaaggua

SEQ ID NO: 125688 - RNA, 21 nt, Homo sapiens
acaguacuugagaucuuuuga

SEQ ID NO: 125689 - RNA, 22 nt, Homo sapiens
acaguacuuuuggauuugugaa

SEQ ID NO: 125690 - RNA, 22 nt, Homo sapiens
acaguagcgcaaucucggcuca

SEQ ID NO: 125691 - RNA, 22 nt, Homo sapiens
acaguauaaugcuguagggaga

SEQ ID NO: 125692 - RNA, 22 nt, Homo sapiens
acaguaugcuuuaaacuuuguu

SEQ ID NO: 125693 - RNA, 20 nt, Homo sapiens
acaguauguuuggaugcaua

SEQ ID NO: 125694 - RNA, 22 nt, Homo sapiens
acagucacaauuuguaccuuuu

SEQ ID NO: 125695 - RNA, 22 nt, Homo sapiens
acagugacagaaagcugauuau

SEQ ID NO: 125696 - RNA, 22 nt, Homo sapiens
acagugcugucugcuuuggcua

SEQ ID NO: 125697 - RNA, 22 nt, Homo sapiens
acagugcuguggucaugggucu

SEQ ID NO: 125698 - RNA, 22 nt, Homo sapiens
acaucccaugccuggguacucc

SEQ ID NO: 125699 - RNA, 22 nt, Homo sapiens
acaucuguacaguggguguggu

SEQ ID NO: 125700 - RNA, 22 nt, Homo sapiens
acaugcauggcaugcauuguac

SEQ ID NO: 125701 - RNA, 22 nt, Homo sapiens
acauggcuuaugaauuuggaga

SEQ ID NO: 125702 - RNA, 22 nt, Homo sapiens
accacaggguaaaguuagauau

SEQ ID NO: 125703 - RNA, 22 nt, Homo sapiens
accaccacucccgcauucuaaa

SEQ ID NO: 125704 - RNA, 19 nt, Homo sapiens
accagauugcauucuugga

SEQ ID NO: 125705 - RNA, 22 nt, Homo sapiens
acccacuagaugccaguggcac

SEQ ID NO: 125706 - RNA, 22 nt, Homo sapiens
acccaguguugggcagaacugu

SEQ ID NO: 125707 - RNA, 22 nt, Homo sapiens
acccuggaggucuacagugcag

SEQ ID NO: 125708 - RNA, 22 nt, Homo sapiens
acccuguaacauacaagugguu

SEQ ID NO: 125709 - RNA, 22 nt, Homo sapiens
acccugucauccacauggugcu

SEQ ID NO: 125710 - RNA, 22 nt, Homo sapiens
acccuuagguuaaaguugaguc

SEQ ID NO: 125711 - RNA, 22 nt, Homo sapiens
accucagcccggggaaguugag

SEQ ID NO: 125712 - RNA, 22 nt, Homo sapiens
accuggacacuuugggcuccuc

SEQ ID NO: 125713 - RNA, 22 nt, Homo sapiens
accugggugcugaugggcuuua

SEQ ID NO: 125714 - RNA, 22 nt, Homo sapiens
accugugguuacagucugucuc

SEQ ID NO: 125715 - RNA, 22 nt, Homo sapiens
acuacaugugaugucaguauau

SEQ ID NO: 125716 - RNA, 22 nt, Homo sapiens
acuacuucuaaguuuuggaaga

SEQ ID NO: 125717 - RNA, 19 nt, Homo sapiens
acuaggccuacaaagcuau

SEQ ID NO: 125718 - RNA, 22 nt, Homo sapiens
acuauacuguaacuguauucag

SEQ ID NO: 125719 - RNA, 22 nt, Homo sapiens
acucauugcucauaccuuaucu

SEQ ID NO: 125720 - RNA, 23 nt, Homo sapiens
acugagcaauguuuacauacuug

SEQ ID NO: 125721 - RNA, 22 nt, Homo sapiens
acugagucauugaggcccucuc

SEQ ID NO: 125722 - RNA, 22 nt, Homo sapiens
acugcacuccagccuuggcggc

SEQ ID NO: 125723 - RNA, 22 nt, Homo sapiens
acugcacuccagccuuugcgau

SEQ ID NO: 125724 - RNA, 20 nt, Homo sapiens
acugcacuccagucucuggg

SEQ ID NO: 125725 - RNA, 22 nt, Homo sapiens
acugcauuugguaaagucaaga

SEQ ID NO: 125726 - RNA, 22 nt, Homo sapiens
acuggaguuuguucaagaaaua

SEQ ID NO: 125727 - RNA, 20 nt, Homo sapiens
acugggcuaccgaaguaagg

SEQ ID NO: 125728 - RNA, 22 nt, Homo sapiens
guagaaagcauuucagauuugc

SEQ ID NO: 125729 - RNA, 22 nt, Homo sapiens
guagaaaguuugcugucacaug

SEQ ID NO: 125730 - RNA, 22 nt, Homo sapiens
guagagguagauucuguuuuga

SEQ ID NO: 125731 - RNA, 22 nt, Homo sapiens
guagaucucaacacuggaagua

SEQ ID NO: 125732 - RNA, 22 nt, Homo sapiens
guagcagcaauuuacuccauac

SEQ ID NO: 125733 - RNA, 23 nt, Homo sapiens
guaguuugaugcaauccacuugu

SEQ ID NO: 125734 - RNA, 22 nt, Homo sapiens
guauacuucugaaaauagcuau

SEQ ID NO: 125735 - RNA, 21 nt, Homo sapiens
guauggcauugauuaguuacu

SEQ ID NO: 125736 - RNA, 21 nt, Homo sapiens
guaugguugaagugacaagcc

SEQ ID NO: 125737 - RNA, 22 nt, Homo sapiens
guaugucuuuauagcagugugg

SEQ ID NO: 125738 - RNA, 22 nt, Homo sapiens
guaugugacuggaacaguagga

SEQ ID NO: 125739 - RNA, 22 nt, Homo sapiens
guauugcuugagcccaggaguu

SEQ ID NO: 125740 - RNA, 22 nt, Homo sapiens
guauuguacuacaagcucuuua

SEQ ID NO: 125741 - RNA, 22 nt, Homo sapiens
guauuuggugaugccuccaaac

SEQ ID NO: 125742 - RNA, 22 nt, Homo sapiens
guauuuuguuagggugugguau

SEQ ID NO: 125743 - RNA, 22 nt, Homo sapiens
gucaaaugcacagaaccauuaa

SEQ ID NO: 125744 - RNA, 22 nt, Homo sapiens
gucaauguaucuagcuguauua

SEQ ID NO: 125745 - RNA, 22 nt, Homo sapiens
gucacaguguuuguucauccca

SEQ ID NO: 125746 - RNA, 22 nt, Homo sapiens
gucacauugaugcccauggugg

SEQ ID NO: 125747 - RNA, 22 nt, Homo sapiens
gucacugagauugguauuaaug

SEQ ID NO: 125748 - RNA, 22 nt, Homo sapiens
gucacugagcagaaggaagcga

SEQ ID NO: 125749 - RNA, 20 nt, Homo sapiens
gucacuggcccagggcuugu

SEQ ID NO: 125750 - RNA, 22 nt, Homo sapiens
gucacugggugcugcgccuguc

SEQ ID NO: 125751 - RNA, 22 nt, Homo sapiens
gucacugucuacuguaauagcc

SEQ ID NO: 125752 - RNA, 22 nt, Homo sapiens
gucacugugacggcaguuacau

SEQ ID NO: 125753 - RNA, 22 nt, Homo sapiens
gucagaaucucagaugacaacg

SEQ ID NO: 125754 - RNA, 22 nt, Homo sapiens
gucagaugcagauuccaguucu

SEQ ID NO: 125755 - RNA, 22 nt, Homo sapiens
gucagcuuguccagagacucug

SEQ ID NO: 125756 - RNA, 22 nt, Homo sapiens
gucaggugcuuacgcggagauc

SEQ ID NO: 125757 - RNA, 22 nt, Homo sapiens
gucagugccugucccaggcuuu

SEQ ID NO: 125758 - RNA, 22 nt, Homo sapiens
gucagugcuuuaguucaggaug

SEQ ID NO: 125759 - RNA, 22 nt, Homo sapiens
gucaguggauacugucucuguc

SEQ ID NO: 125760 - RNA, 22 nt, Homo sapiens
gucagugucuuugcagcucaga

SEQ ID NO: 125761 - RNA, 22 nt, Homo sapiens
gucagugugauaucugcagggg

SEQ ID NO: 125762 - RNA, 22 nt, Homo sapiens
gucaguuugguuaaucauucca

SEQ ID NO: 125763 - RNA, 22 nt, Homo sapiens
gucaugcaggguucgccagccc

SEQ ID NO: 125764 - RNA, 22 nt, Homo sapiens
gucauggaaaucuacauuguua

SEQ ID NO: 125765 - RNA, 22 nt, Homo sapiens
gucauggagggacauaacuaac

SEQ ID NO: 125766 - RNA, 22 nt, Homo sapiens
gucaugucugcacauaguaaaa

SEQ ID NO: 125767 - RNA, 22 nt, Homo sapiens
gucauguuuaacuucuugagga

SEQ ID NO: 125768 - RNA, 22 nt, Homo sapiens
guccaaagugggagaggugggg

SEQ ID NO: 125769 - RNA, 22 nt, Homo sapiens
guccagagaagucauuacuuca

SEQ ID NO: 125770 - RNA, 22 nt, Homo sapiens
guccaguguuggagguuuuacc

SEQ ID NO: 125771 - RNA, 22 nt, Homo sapiens
guccaugagaugaauccacaca

SEQ ID NO: 125772 - RNA, 22 nt, Homo sapiens
gucgguguuuccugagaacgaa

SEQ ID NO: 125773 - RNA, 22 nt, Homo sapiens
gucguggagcucacagugugcc

SEQ ID NO: 125774 - RNA, 22 nt, Homo sapiens
gucuaugagucccugaauuuaa

SEQ ID NO: 125775 - RNA, 22 nt, Homo sapiens
gucucccagccuacauauuucu

SEQ ID NO: 125776 - RNA, 22 nt, Homo sapiens
gucucugguugcuuuuguacca

SEQ ID NO: 125777 - RNA, 22 nt, Homo sapiens
gucucuugguuuagagcauuua

SEQ ID NO: 125778 - RNA, 22 nt, Homo sapiens
gucuggagacuugggucaucaa

SEQ ID NO: 125779 - RNA, 22 nt, Homo sapiens
gucuggcaauggcagacuggca

SEQ ID NO: 125780 - RNA, 22 nt, Homo sapiens
gucuggcacagggaaaguacaa

SEQ ID NO: 125781 - RNA, 22 nt, Homo sapiens
cauugcacuccagccugccugg

SEQ ID NO: 125782 - RNA, 22 nt, Homo sapiens
cauugcacucuagccucggcaa

SEQ ID NO: 125783 - RNA, 22 nt, Homo sapiens
cauugcacugcuucuugggugu

SEQ ID NO: 125784 - RNA, 22 nt, Homo sapiens
cauugcaguggaguggggaaga

SEQ ID NO: 125785 - RNA, 20 nt, Homo sapiens
cauugcccuccagccugggc

SEQ ID NO: 125786 - RNA, 19 nt, Homo sapiens
cauuggacuugcuuuugcc

SEQ ID NO: 125787 - RNA, 22 nt, Homo sapiens
cauuugcacugagacucagcuu

SEQ ID NO: 125788 - RNA, 22 nt, Homo sapiens
ccaagccucaguuucccucugu

SEQ ID NO: 125789 - RNA, 22 nt, Homo sapiens
ccaaggaauacccucccuuuuu

SEQ ID NO: 125790 - RNA, 22 nt, Homo sapiens
ccaaguguucucauuguucaau

SEQ ID NO: 125791 - RNA, 22 nt, Homo sapiens
ccaaguguuuucauuguuccau

SEQ ID NO: 125792 - RNA, 22 nt, Homo sapiens
ccacacugucuuggugggaaac

SEQ ID NO: 125793 - RNA, 22 nt, Homo sapiens
ccacccuggagaauuugagguc

SEQ ID NO: 125794 - RNA, 22 nt, Homo sapiens
ccagaauucucauuggaaggaa

SEQ ID NO: 125795 - RNA, 22 nt, Homo sapiens
ccagaguggagccuuugcgagg

SEQ ID NO: 125796 - RNA, 22 nt, Homo sapiens
ccagaguugccucagguuucug

SEQ ID NO: 125797 - RNA, 22 nt, Homo sapiens
ccagcaccauuuauuaaauagg

SEQ ID NO: 125798 - RNA, 23 nt, Homo sapiens
ccaguauuuauguaaggaagugu

SEQ ID NO: 125799 - RNA, 22 nt, Homo sapiens
ccagucuuggugucuguagcac

SEQ ID NO: 125800 - RNA, 20 nt, Homo sapiens
ccaguguuauuuauguucua

SEQ ID NO: 125801 - RNA, 22 nt, Homo sapiens
ccaguguucuggaaggcugagu

SEQ ID NO: 125802 - RNA, 20 nt, Homo sapiens
ucucauggagguagagaaua

SEQ ID NO: 125803 - RNA, 23 nt, Homo sapiens
ucucauuccuugaaaauaaugac

SEQ ID NO: 125804 - RNA, 22 nt, Homo sapiens
ucuccauugaaauggacauaau

SEQ ID NO: 125805 - RNA, 22 nt, Homo sapiens
ucucccauccaugaacuucugu

SEQ ID NO: 125806 - RNA, 22 nt, Homo sapiens
ucucugagaccacuccaaacuc

SEQ ID NO: 125807 - RNA, 22 nt, Homo sapiens
ucucugguuuguggaaucuuag

SEQ ID NO: 125808 - RNA, 22 nt, Homo sapiens
ucugagacuguuucuaacaagc

SEQ ID NO: 125809 - RNA, 22 nt, Homo sapiens
ucugagcaauagauguggauau

SEQ ID NO: 125810 - RNA, 22 nt, Homo sapiens
ucugagucaucacaaaugaugc

SEQ ID NO: 125811 - RNA, 22 nt, Homo sapiens
ucugcaagucuaaacuagccau

SEQ ID NO: 125812 - RNA, 22 nt, Homo sapiens
ucugccuacugguuggaggaac

SEQ ID NO: 125813 - RNA, 22 nt, Homo sapiens
ucugccuuuucaugugggaugg

SEQ ID NO: 125814 - RNA, 22 nt, Homo sapiens
ucuggagugugaaguggauaug

SEQ ID NO: 125815 - RNA, 22 nt, Homo sapiens
ucuggcacugaugugggaugcu

SEQ ID NO: 125816 - RNA, 22 nt, Homo sapiens
ucuggccccucucaaaucucau

SEQ ID NO: 125817 - RNA, 22 nt, Homo sapiens
ucuggccuccuaugagaaucga

SEQ ID NO: 125818 - RNA, 15 nt, Homo sapiens
ucuggcucugucacu

SEQ ID NO: 125819 - RNA, 22 nt, Homo sapiens
ucuggcuuauuucacuuagcau

SEQ ID NO: 125820 - RNA, 22 nt, Homo sapiens
ucuggcuucugacuuaggggac

SEQ ID NO: 125821 - RNA, 17 nt, Homo sapiens
ucuggcuuucacaccug

SEQ ID NO: 125822 - RNA, 22 nt, Homo sapiens
ucuggcuuucuuuacuuaaugu

SEQ ID NO: 125823 - RNA, 23 nt, Homo sapiens
ucuggcuuugggaugcucaaggg

SEQ ID NO: 125824 - RNA, 22 nt, Homo sapiens
ucugggguuagucaaagguaug

SEQ ID NO: 125825 - RNA, 22 nt, Homo sapiens
ucugggguuuccacuuuuacuu

SEQ ID NO: 125826 - RNA, 22 nt, Homo sapiens
ucuggguuuuuacaauguuuac

SEQ ID NO: 125827 - RNA, 22 nt, Homo sapiens
ucugguguuauucauguaguuu

SEQ ID NO: 125828 - RNA, 22 nt, Homo sapiens
ucugguuccuuggcuucggguc

SEQ ID NO: 125829 - RNA, 22 nt, Homo sapiens
ucuguaguuaacagcuucagcu

SEQ ID NO: 125830 - RNA, 22 nt, Homo sapiens
ucugucacugaaucccugucac

SEQ ID NO: 125831 - RNA, 22 nt, Homo sapiens
ucugugaaugaacacuugaaaa

SEQ ID NO: 125832 - RNA, 22 nt, Homo sapiens
ucugugcauuguaggauguuua

SEQ ID NO: 125833 - RNA, 22 nt, Homo sapiens
ucugugcuugucauaugcuuug

SEQ ID NO: 125834 - RNA, 22 nt, Homo sapiens
ucugugguaagaaacgcauguc

SEQ ID NO: 125835 - RNA, 22 nt, Homo sapiens
ucuguguugaugcucauuaauu

SEQ ID NO: 125836 - RNA, 22 nt, Homo sapiens
ucuguguuugguuggcaauuuc

SEQ ID NO: 125837 - RNA, 22 nt, Homo sapiens
ucuucagucauauuggccugga

SEQ ID NO: 125838 - RNA, 17 nt, Homo sapiens
ucuucuguuacuguggc

SEQ ID NO: 125839 - RNA, 22 nt, Homo sapiens
ucuugcacaaauuauuuuaacu

SEQ ID NO: 125840 - RNA, 22 nt, Homo sapiens
ucuugccacuucauccccuuuc

SEQ ID NO: 125841 - RNA, 22 nt, Homo sapiens
ucuuggccaugaauggcaaggc

SEQ ID NO: 125842 - RNA, 22 nt, Homo sapiens
ucuuggguuuguccuucuccua

SEQ ID NO: 125843 - RNA, 22 nt, Homo sapiens
ucuugguuaggggaaauaggca

SEQ ID NO: 125844 - RNA, 22 nt, Homo sapiens
ucuuuaguuaagggacauuuua

SEQ ID NO: 125845 - RNA, 22 nt, Homo sapiens
ucuuugaguggagcgaggcaga

SEQ ID NO: 125846 - RNA, 22 nt, Homo sapiens
ucuuugaguuauugugcagacu

SEQ ID NO: 125847 - RNA, 22 nt, Homo sapiens
ucuuugauaagauccagaagaa

SEQ ID NO: 125848 - RNA, 22 nt, Homo sapiens
ucuuugccuaacccaaggucau

SEQ ID NO: 125849 - RNA, 22 nt, Homo sapiens
ucuuuggagacaaccccagucu

SEQ ID NO: 125850 - RNA, 22 nt, Homo sapiens
ucuuuggaggcgaucuguuuga

SEQ ID NO: 125851 - RNA, 22 nt, Homo sapiens
ucuuuggcugugaagaauaaug

SEQ ID NO: 125852 - RNA, 22 nt, Homo sapiens
ucuuuggguguauuucacagcc

SEQ ID NO: 125853 - RNA, 22 nt, Homo sapiens
ucuuugguaauggaugucugau

SEQ ID NO: 125854 - RNA, 22 nt, Homo sapiens
ucuuugguugcacugcaggugu

SEQ ID NO: 125855 - RNA, 22 nt, Homo sapiens
ucuuugguuguuuagggugcau

SEQ ID NO: 125856 - RNA, 22 nt, Homo sapiens
ucuuugucuacauccuguuaaa

SEQ ID NO: 125857 - RNA, 22 nt, Homo sapiens
ucuuuguguucaggagccacgu

SEQ ID NO: 125858 - RNA, 22 nt, Homo sapiens
ugaaaagucuaagauuaagguu

SEQ ID NO: 125859 - RNA, 20 nt, Homo sapiens
ugaaacacauggacuggggu

SEQ ID NO: 125860 - RNA, 22 nt, Homo sapiens
ugaaacugcagugggcuuggca

SEQ ID NO: 125861 - RNA, 22 nt, Homo sapiens
ugaaagcuacaggaaaguauuu

SEQ ID NO: 125862 - RNA, 22 nt, Homo sapiens
ugaaagcuacagucuccuagga

SEQ ID NO: 125863 - RNA, 22 nt, Homo sapiens
ugaaagguuuaauucugugaga

SEQ ID NO: 125864 - RNA, 22 nt, Homo sapiens
ugaaauacuuaauuucuccaug

SEQ ID NO: 125865 - RNA, 22 nt, Homo sapiens
ugaaaugaucaguuugguuacu

SEQ ID NO: 125866 - RNA, 22 nt, Homo sapiens
ugaaaugcuaauucguagcuaa

SEQ ID NO: 125867 - RNA, 22 nt, Homo sapiens
ugaaauguaaguugucuagucu

SEQ ID NO: 125868 - RNA, 22 nt, Homo sapiens
ugaaaugucuuuaggaggcuuc

SEQ ID NO: 125869 - RNA, 22 nt, Homo sapiens
ugaaauguugggugauggaauc

SEQ ID NO: 125870 - RNA, 21 nt, Homo sapiens
ugaacacuggacugagugucc

SEQ ID NO: 125871 - RNA, 22 nt, Homo sapiens
ugaacagcaccuccuagaguug

SEQ ID NO: 125872 - RNA, 20 nt, Homo sapiens
cucagauuauucugaagcaa

SEQ ID NO: 125873 - RNA, 21 nt, Homo sapiens
cucauauugcuuuuccauggu

SEQ ID NO: 125874 - RNA, 22 nt, Homo sapiens
cucauggaauacuucacagcca

SEQ ID NO: 125875 - RNA, 22 nt, Homo sapiens
cucauggagaacaucugcuagg

SEQ ID NO: 125876 - RNA, 22 nt, Homo sapiens
cucauggagaaccucugcuagg

SEQ ID NO: 125877 - RNA, 22 nt, Homo sapiens
cucauugcaaucucugccuccc

SEQ ID NO: 125878 - RNA, 22 nt, Homo sapiens
cuccacugagcaggugggaggc

SEQ ID NO: 125879 - RNA, 22 nt, Homo sapiens
cuccaguacagagagguuccuc

SEQ ID NO: 125880 - RNA, 22 nt, Homo sapiens
cuccauguggcuaacuuuuaaa

SEQ ID NO: 125881 - RNA, 22 nt, Homo sapiens
cuccauuuaucugaaauuuuau

SEQ ID NO: 125882 - RNA, 23 nt, Homo sapiens
cucccugaacaugacacaccaga

SEQ ID NO: 125883 - RNA, 22 nt, Homo sapiens
cucccugagccagggcuuugac

SEQ ID NO: 125884 - RNA, 22 nt, Homo sapiens
cucucaagaugcugggauuaca

SEQ ID NO: 125885 - RNA, 22 nt, Homo sapiens
cucucaguugucuaauuaguuu

SEQ ID NO: 125886 - RNA, 22 nt, Homo sapiens
cucugagguuauucguaauauu

SEQ ID NO: 125887 - RNA, 22 nt, Homo sapiens
cucugcuuaaugucccacuuga

SEQ ID NO: 125888 - RNA, 22 nt, Homo sapiens
cucugguuaaggcugaacuaua

SEQ ID NO: 125889 - RNA, 22 nt, Homo sapiens
cucugguucugcagugcacccu

SEQ ID NO: 125890 - RNA, 22 nt, Homo sapiens
guucucacuggugcugguaagu

SEQ ID NO: 125891 - RNA, 22 nt, Homo sapiens
guugaaaucaucacuuggcaug

SEQ ID NO: 125892 - RNA, 22 nt, Homo sapiens
guugaaauccuaacccccuagu

SEQ ID NO: 125893 - RNA, 22 nt, Homo sapiens
guugacuaggagcuacuacuac

SEQ ID NO: 125894 - RNA, 22 nt, Homo sapiens
guugagcaaacagcuuaacagu

SEQ ID NO: 125895 - RNA, 22 nt, Homo sapiens
guugcaaaguaauugugguuuu

SEQ ID NO: 125896 - RNA, 22 nt, Homo sapiens
gucccugugucuuuauguggcc

SEQ ID NO: 125897 - RNA, 22 nt, Homo sapiens
guccugaagaccuuccucugga

SEQ ID NO: 125898 - RNA, 22 nt, Homo sapiens
guccuggagaagcguggaccgg

SEQ ID NO: 125899 - RNA, 22 nt, Homo sapiens
guccuguuuuuaagguucauag

SEQ ID NO: 125900 - RNA, 22 nt, Homo sapiens
gucugguuccugggagauuucu

SEQ ID NO: 125901 - RNA, 22 nt, Homo sapiens
gucugguuggaguaguuuucag

SEQ ID NO: 125902 - RNA, 22 nt, Homo sapiens
gucugucuuuugucuuugaaau

SEQ ID NO: 125903 - RNA, 22 nt, Homo sapiens
augaccaaugggcagagcuaga

SEQ ID NO: 125904 - RNA, 22 nt, Homo sapiens
augaccagagagugcgcagggu

SEQ ID NO: 125905 - RNA, 18 nt, Homo sapiens
augaccugcggguuauau

SEQ ID NO: 125906 - RNA, 22 nt, Homo sapiens
augacuggaacagcaauuuaca

SEQ ID NO: 125907 - RNA, 22 nt, Homo sapiens
augacuggaacggcacuuuaca

SEQ ID NO: 125908 - RNA, 17 nt, Homo sapiens
augacuucuucagugug

SEQ ID NO: 125909 - RNA, 22 nt, Homo sapiens
augagaaugaagccuggcgugu

SEQ ID NO: 125910 - RNA, 22 nt, Homo sapiens
augagauaaaccaucucuuaag

SEQ ID NO: 125911 - RNA, 22 nt, Homo sapiens
augagaugaggaauggcccucc

SEQ ID NO: 125912 - RNA, 21 nt, Homo sapiens
augagauguuagacuuuagac

SEQ ID NO: 125913 - RNA, 22 nt, Homo sapiens
augagauucuuagagaagucug

SEQ ID NO: 125914 - RNA, 22 nt, Homo sapiens
augagcugauuuccuuaccaua

SEQ ID NO: 125915 - RNA, 22 nt, Homo sapiens
augagcuguuuggaagacacuu

SEQ ID NO: 125916 - RNA, 22 nt, Homo sapiens
augaggcacugcgcccuacuga

SEQ ID NO: 125917 - RNA, 22 nt, Homo sapiens
augagggcggacgcccuggaga

SEQ ID NO: 125918 - RNA, 22 nt, Homo sapiens
augaggugcagaggaaaugagu

SEQ ID NO: 125919 - RNA, 22 nt, Homo sapiens
augaggugggcggcuuggaaga

SEQ ID NO: 125920 - RNA, 20 nt, Homo sapiens
augagguguaugacacugaa

SEQ ID NO: 125921 - RNA, 22 nt, Homo sapiens
augagguguuuauuguauccug

SEQ ID NO: 125922 - RNA, 22 nt, Homo sapiens
augaguaugagaauacauuaag

SEQ ID NO: 125923 - RNA, 22 nt, Homo sapiens
augauauggguugucaguugua

SEQ ID NO: 125924 - RNA, 22 nt, Homo sapiens
augaucuguagaacuaguccuu

SEQ ID NO: 125925 - RNA, 22 nt, Homo sapiens
augauuagaacucauuuccagg

SEQ ID NO: 125926 - RNA, 22 nt, Homo sapiens
augcaaacagcuaucuggcugg

SEQ ID NO: 125927 - RNA, 22 nt, Homo sapiens
augcaagacaccgauuagcuuu

SEQ ID NO: 125928 - RNA, 22 nt, Homo sapiens
augcaaggaugguuagauauau

SEQ ID NO: 125929 - RNA, 22 nt, Homo sapiens
augcacuguauaggaucuugcg

SEQ ID NO: 125930 - RNA, 22 nt, Homo sapiens
augcacuguuguuauuggauaa

SEQ ID NO: 125931 - RNA, 22 nt, Homo sapiens
augcagauauuuuugugguugc

SEQ ID NO: 125932 - RNA, 22 nt, Homo sapiens
augcagaucacauuuuucuguc

SEQ ID NO: 125933 - RNA, 22 nt, Homo sapiens
augcauauuuuaccuagaagag

SEQ ID NO: 125934 - RNA, 22 nt, Homo sapiens
augcauggagucuuucacaagu

SEQ ID NO: 125935 - RNA, 22 nt, Homo sapiens
augcaugucaaauuuguagguu

SEQ ID NO: 125936 - RNA, 22 nt, Homo sapiens
augccacagaaauaaccaaaau

SEQ ID NO: 125937 - RNA, 19 nt, Homo sapiens
augccacagugaggucaga

SEQ ID NO: 125938 - RNA, 20 nt, Homo sapiens
augccacugagcagugguga

SEQ ID NO: 125939 - RNA, 22 nt, Homo sapiens
augccacugcacuucagccugc

SEQ ID NO: 125940 - RNA, 22 nt, Homo sapiens
augccacuguacucuagccuag

SEQ ID NO: 125941 - RNA, 22 nt, Homo sapiens
augccacuguuuaugucacuua

SEQ ID NO: 125942 - RNA, 22 nt, Homo sapiens
augccaguguccagaguggguu

SEQ ID NO: 125943 - RNA, 19 nt, Homo sapiens
augccucaguuuuguacuu

SEQ ID NO: 125944 - RNA, 22 nt, Homo sapiens
augcuacauucuacaauuaggc

SEQ ID NO: 125945 - RNA, 22 nt, Homo sapiens
augcuacugaccccuacuuaca

SEQ ID NO: 125946 - RNA, 22 nt, Homo sapiens
augcuacuggauuuguauaaau

SEQ ID NO: 125947 - RNA, 22 nt, Homo sapiens
auggaaagcuguuccuacacaa

SEQ ID NO: 125948 - RNA, 22 nt, Homo sapiens
auggaacuggagaucauuaugu

SEQ ID NO: 125949 - RNA, 22 nt, Homo sapiens
auggaagaaacgauuuucugga

SEQ ID NO: 125950 - RNA, 22 nt, Homo sapiens
auggaagaaaguuggguucuug

SEQ ID NO: 125951 - RNA, 22 nt, Homo sapiens
auggaaggagaauggucuuuga

SEQ ID NO: 125952 - RNA, 22 nt, Homo sapiens
auggaagucucuguuaaguuuc

SEQ ID NO: 125953 - RNA, 22 nt, Homo sapiens
auggaaugccauuuauaaugga

SEQ ID NO: 125954 - RNA, 22 nt, Homo sapiens
auggaauggcacuuugaagauu

SEQ ID NO: 125955 - RNA, 22 nt, Homo sapiens
auggaauguauagucauguagg

SEQ ID NO: 125956 - RNA, 22 nt, Homo sapiens
auggaauguggaaugguaagua

SEQ ID NO: 125957 - RNA, 22 nt, Homo sapiens
auggaguguggaacugggaauc

SEQ ID NO: 125958 - RNA, 22 nt, Homo sapiens
auggauagucucacucacauac

SEQ ID NO: 125959 - RNA, 22 nt, Homo sapiens
auggauauuuuuugaacauaga

SEQ ID NO: 125960 - RNA, 22 nt, Homo sapiens
auggauuuugaacuugagaguu

SEQ ID NO: 125961 - RNA, 22 nt, Homo sapiens
auggauuuuggggccagaggca

SEQ ID NO: 125962 - RNA, 22 nt, Homo sapiens
auggcaagaagagcaauuauuu

SEQ ID NO: 125963 - RNA, 22 nt, Homo sapiens
auggcaauaauagcuaccauuu

SEQ ID NO: 125964 - RNA, 22 nt, Homo sapiens
auggcacagacucuuggucaag

SEQ ID NO: 125965 - RNA, 22 nt, Homo sapiens
auggcacuaaguucaacacuua

SEQ ID NO: 125966 - RNA, 22 nt, Homo sapiens
auggcacuguguauuuuucugu

SEQ ID NO: 125967 - RNA, 22 nt, Homo sapiens
auggcacuguguccugggguca

SEQ ID NO: 125968 - RNA, 22 nt, Homo sapiens
auggcacuuuggacugcuagau

SEQ ID NO: 125969 - RNA, 22 nt, Homo sapiens
auggcaguguaugauuauauua

SEQ ID NO: 125970 - RNA, 22 nt, Homo sapiens
auggcaguuucagcuauaguuu

SEQ ID NO: 125971 - RNA, 22 nt, Homo sapiens
auggcaguuuggucucugugcu

SEQ ID NO: 125972 - RNA, 22 nt, Homo sapiens
auggcaucgucaccuuuucagu

SEQ ID NO: 125973 - RNA, 22 nt, Homo sapiens
auggcauuuuuagggcugggug

SEQ ID NO: 125974 - RNA, 22 nt, Homo sapiens
auggccauuacuaagaauguuu

SEQ ID NO: 125975 - RNA, 22 nt, Homo sapiens
auggcccugaguucaauauauu

SEQ ID NO: 125976 - RNA, 22 nt, Homo sapiens
auggcccuguguggagcugcug

SEQ ID NO: 125977 - RNA, 22 nt, Homo sapiens
auggccgggugcgguggcucac

SEQ ID NO: 125978 - RNA, 22 nt, Homo sapiens
auggccugaugcaccuguccca

SEQ ID NO: 125979 - RNA, 22 nt, Homo sapiens
auggccuuuacaauuugguaug

SEQ ID NO: 125980 - RNA, 22 nt, Homo sapiens
auggccuuucuggcacauuucc

SEQ ID NO: 125981 - RNA, 22 nt, Homo sapiens
auggcuagauuguaugguaguu

SEQ ID NO: 125982 - RNA, 22 nt, Homo sapiens
auggcucaauucuuucccugaa

SEQ ID NO: 125983 - RNA, 22 nt, Homo sapiens
auggcucaguguguaucuauca

SEQ ID NO: 125984 - RNA, 22 nt, Homo sapiens
auggcugagugauuucaaacag

SEQ ID NO: 125985 - RNA, 22 nt, Homo sapiens
auggcuguuccugggaguucua

SEQ ID NO: 125986 - RNA, 22 nt, Homo sapiens
auggcuuaagacaaccuuucau

SEQ ID NO: 125987 - RNA, 22 nt, Homo sapiens
auggcuucuuacucuucugcau

SEQ ID NO: 125988 - RNA, 22 nt, Homo sapiens
augggagugugguuagagaccu

SEQ ID NO: 125989 - RNA, 22 nt, Homo sapiens
augggcacugauguauucugug

SEQ ID NO: 125990 - RNA, 22 nt, Homo sapiens
augggguaggcuugcuguagua

SEQ ID NO: 125991 - RNA, 18 nt, Homo sapiens
auggguguuggaaaauga

SEQ ID NO: 125992 - RNA, 22 nt, Homo sapiens
augguaagcugaaaauaucgaa

SEQ ID NO: 125993 - RNA, 19 nt, Homo sapiens
aaguaguugugacagaugc

SEQ ID NO: 125994 - RNA, 18 nt, Homo sapiens
aaguauagagagcccuua

SEQ ID NO: 125995 - RNA, 22 nt, Homo sapiens
aaguauagcuaugauaaacauu

SEQ ID NO: 125996 - RNA, 22 nt, Homo sapiens
aagucaaggagagaggcgucag

SEQ ID NO: 125997 - RNA, 22 nt, Homo sapiens
aaguccaugaagucuugugggu

SEQ ID NO: 125998 - RNA, 22 nt, Homo sapiens
aagugagaugcaguggaguucc

SEQ ID NO: 125999 - RNA, 23 nt, Homo sapiens
aagugagcuccaauugggugaga

SEQ ID NO: 126000 - RNA, 22 nt, Homo sapiens
aagugagugacaaaaacugggc

SEQ ID NO: 126001 - RNA, 22 nt, Homo sapiens
aagugauguuauugggugacuc

SEQ ID NO: 126002 - RNA, 22 nt, Homo sapiens
aagugcacuguaagugcaggau

SEQ ID NO: 126003 - RNA, 22 nt, Homo sapiens
aagugcccuauuuggcccuuga

SEQ ID NO: 126004 - RNA, 22 nt, Homo sapiens
aagugcucuugugggaagagag

SEQ ID NO: 126005 - RNA, 22 nt, Homo sapiens
aagugcugggauuggccgggca

SEQ ID NO: 126006 - RNA, 20 nt, Homo sapiens
aagugcuuccuuuuagaggg

SEQ ID NO: 126007 - RNA, 22 nt, Homo sapiens
aagugcuuuguacagggguuga

SEQ ID NO: 126008 - RNA, 19 nt, Homo sapiens
aagugguuuaaacuuguau

SEQ ID NO: 126009 - RNA, 23 nt, Homo sapiens
aagugguuuugaacccggacccu

SEQ ID NO: 126010 - RNA, 22 nt, Homo sapiens
aaguuaauguuuaagacuccua

SEQ ID NO: 126011 - RNA, 22 nt, Homo sapiens
aauaaagucugaagugugcuua

SEQ ID NO: 126012 - RNA, 22 nt, Homo sapiens
aauaagcauaguaccugauagg

SEQ ID NO: 126013 - RNA, 19 nt, Homo sapiens
aauaaugccagaugucugu

SEQ ID NO: 126014 - RNA, 22 nt, Homo sapiens
aauacucaguccuggugaggcu

SEQ ID NO: 126015 - RNA, 22 nt, Homo sapiens
aauacugcuuugauguaagcua

SEQ ID NO: 126016 - RNA, 22 nt, Homo sapiens
aauagcauugaaucuaccaauu

SEQ ID NO: 126017 - RNA, 22 nt, Homo sapiens
aauagcuguccuuagaagugug

SEQ ID NO: 126018 - RNA, 23 nt, Homo sapiens
aauaucacaguggguguacaccc

SEQ ID NO: 126019 - RNA, 22 nt, Homo sapiens
aaucacaggucuuggcugcaug

SEQ ID NO: 126020 - RNA, 22 nt, Homo sapiens
aaucacaguuaguaagggagaa

SEQ ID NO: 126021 - RNA, 22 nt, Homo sapiens
aaucaccaugcacuacagccuu

SEQ ID NO: 126022 - RNA, 21 nt, Homo sapiens
aaucacugucuguuuccccuu

SEQ ID NO: 126023 - RNA, 22 nt, Homo sapiens
aaucgcuuuugguaggcaagga

SEQ ID NO: 126024 - RNA, 22 nt, Homo sapiens
aaucucaacacuuugggaggcu

SEQ ID NO: 126025 - RNA, 22 nt, Homo sapiens
aaucugauguuaucagcuuaag

SEQ ID NO: 126026 - RNA, 22 nt, Homo sapiens
aaugaaguuagauguugagaag

SEQ ID NO: 126027 - RNA, 22 nt, Homo sapiens
aaugauauguuauguuuagguu

SEQ ID NO: 126028 - RNA, 22 nt, Homo sapiens
aaugcaagauguuaauuauagg

SEQ ID NO: 126029 - RNA, 22 nt, Homo sapiens
aaugcaucuagaaaggugaauu

SEQ ID NO: 126030 - RNA, 22 nt, Homo sapiens
aaugcuaucuggaacauuguug

SEQ ID NO: 126031 - RNA, 22 nt, Homo sapiens
aauggcaaauguuuucuguuga

SEQ ID NO: 126032 - RNA, 22 nt, Homo sapiens
aauggcacaagacaugaagaag

SEQ ID NO: 126033 - RNA, 22 nt, Homo sapiens
aauggcacaagaguaaacuguu

SEQ ID NO: 126034 - RNA, 22 nt, Homo sapiens
aauggcacuuuauaaauguuaa

SEQ ID NO: 126035 - RNA, 22 nt, Homo sapiens
aauggccuuuuucauuauacug

SEQ ID NO: 126036 - RNA, 22 nt, Homo sapiens
aauggcucuuccuggaguugug

SEQ ID NO: 126037 - RNA, 22 nt, Homo sapiens
aauggcuuuuaauauccauaau

SEQ ID NO: 126038 - RNA, 19 nt, Homo sapiens
aauggcuuuuccuguuccc

SEQ ID NO: 126039 - RNA, 22 nt, Homo sapiens
aaugucacugugguccuccagu

SEQ ID NO: 126040 - RNA, 22 nt, Homo sapiens
aaugugcuuugaaaagagcuga

SEQ ID NO: 126041 - RNA, 22 nt, Homo sapiens
aauguguuuugaaaucaggaag

SEQ ID NO: 126042 - RNA, 22 nt, Homo sapiens
aauuacucgugucuuuacugcu

SEQ ID NO: 126043 - RNA, 22 nt, Homo sapiens
aauuaguuggcugggugcggug

SEQ ID NO: 126044 - RNA, 22 nt, Homo sapiens
aauugcaauggacaaugcagca

SEQ ID NO: 126045 - RNA, 23 nt, Homo sapiens
aauugcacauuccuugcuggcag

SEQ ID NO: 126046 - RNA, 23 nt, Homo sapiens
aauugcuuuugaggacuuaguug

SEQ ID NO: 126047 - RNA, 20 nt, Homo sapiens
acaaaugcauucugugacau

SEQ ID NO: 126048 - RNA, 22 nt, Homo sapiens
acacaguaaauauguauugaau

SEQ ID NO: 126049 - RNA, 22 nt, Homo sapiens
acacauuagcaagugcuguuau

SEQ ID NO: 126050 - RNA, 22 nt, Homo sapiens
acacauuggcaauucuggagca

SEQ ID NO: 126051 - RNA, 22 nt, Homo sapiens
acaccaucuccuuauuucucuu

SEQ ID NO: 126052 - RNA, 22 nt, Homo sapiens
acacuauugagguuuguuugca

SEQ ID NO: 126053 - RNA, 22 nt, Homo sapiens
acacucuaguguucuuaaucag

SEQ ID NO: 126054 - RNA, 22 nt, Homo sapiens
acacugucaugucucacaggca

SEQ ID NO: 126055 - RNA, 22 nt, Homo sapiens
acacuguccaguuaggcuacau

SEQ ID NO: 126056 - RNA, 20 nt, Homo sapiens
acacugugcuaaggauuuuc

SEQ ID NO: 126057 - RNA, 22 nt, Homo sapiens
acacuguuggugggaguguaaa

SEQ ID NO: 126058 - RNA, 22 nt, Homo sapiens
acacuuucuagacaagggaaua

SEQ ID NO: 126059 - RNA, 22 nt, Homo sapiens
acagagcaaugagcuacggucu

SEQ ID NO: 126060 - RNA, 22 nt, Homo sapiens
acaggguuauuguaauaaugua

SEQ ID NO: 126061 - RNA, 22 nt, Homo sapiens
acagguacacagaauauccaga

SEQ ID NO: 126062 - RNA, 22 nt, Homo sapiens
acaguacucugcucuuuugauu

SEQ ID NO: 126063 - RNA, 20 nt, Homo sapiens
acaguagaagggauuucaaa

SEQ ID NO: 126064 - RNA, 21 nt, Homo sapiens
acaguaguaauaguguagcca

SEQ ID NO: 126065 - RNA, 19 nt, Homo sapiens
acaguauugugcacagguu

SEQ ID NO: 126066 - RNA, 22 nt, Homo sapiens
acagugcuuucaauguucagua

SEQ ID NO: 126067 - RNA, 17 nt, Homo sapiens
acagugcuuugcuuucc

SEQ ID NO: 126068 - RNA, 22 nt, Homo sapiens
acaguguguguguucaccuaga

SEQ ID NO: 126069 - RNA, 22 nt, Homo sapiens
acaguguuacuugauaguguau

SEQ ID NO: 126070 - RNA, 22 nt, Homo sapiens
acaguguuccuuuguugugacu

SEQ ID NO: 126071 - RNA, 22 nt, Homo sapiens
acauagaguagcuaccuguaga

SEQ ID NO: 126072 - RNA, 22 nt, Homo sapiens
acauaguagacacugaaaauau

SEQ ID NO: 126073 - RNA, 22 nt, Homo sapiens
acauauaaggagacuagggcau

SEQ ID NO: 126074 - RNA, 22 nt, Homo sapiens
acaucacuguuugauugauuga

SEQ ID NO: 126075 - RNA, 22 nt, Homo sapiens
acaucauugggggcuacaggug

SEQ ID NO: 126076 - RNA, 22 nt, Homo sapiens
acaugcaucauuaggugguuua

SEQ ID NO: 126077 - RNA, 22 nt, Homo sapiens
acaugcauccaugugaagagac

SEQ ID NO: 126078 - RNA, 22 nt, Homo sapiens
acauguaauugauuuuguguua

SEQ ID NO: 126079 - RNA, 22 nt, Homo sapiens
acauucagcuguuguuucaaug

SEQ ID NO: 126080 - RNA, 22 nt, Homo sapiens
uuaaaaguauaggccuggcaua

SEQ ID NO: 126081 - RNA, 22 nt, Homo sapiens
uuaaaguaauugaaauggccuu

SEQ ID NO: 126082 - RNA, 22 nt, Homo sapiens
uuaaaguguuugcagacaggug

SEQ ID NO: 126083 - RNA, 22 nt, Homo sapiens
uuaaaguguuuucaaaauguca

SEQ ID NO: 126084 - RNA, 22 nt, Homo sapiens
uuaacaguugcaugagacugag

SEQ ID NO: 126085 - RNA, 22 nt, Homo sapiens
uuaagagcauggugccagguug

SEQ ID NO: 126086 - RNA, 22 nt, Homo sapiens
uuaagaugcauuuugaaguuaa

SEQ ID NO: 126087 - RNA, 22 nt, Homo sapiens
uuaagcuaguuuauucaggaaa

SEQ ID NO: 126088 - RNA, 22 nt, Homo sapiens
uuaaggaguagugucugguauu

SEQ ID NO: 126089 - RNA, 22 nt, Homo sapiens
uuaaggcuuguacuuguuuucu

SEQ ID NO: 126090 - RNA, 23 nt, Homo sapiens
uuaaggugaugucuuugugccuc

SEQ ID NO: 126091 - RNA, 19 nt, Homo sapiens
uuaaguaguuagagggucu

SEQ ID NO: 126092 - RNA, 21 nt, Homo sapiens
uuaagugcuuuguaugcacua

SEQ ID NO: 126093 - RNA, 22 nt, Homo sapiens
uuaauccugccuuauuucagua

SEQ ID NO: 126094 - RNA, 21 nt, Homo sapiens
uuaaugcuaugcagaaaaucu

SEQ ID NO: 126095 - RNA, 22 nt, Homo sapiens
uuaauucugucugcccucaucc

SEQ ID NO: 126096 - RNA, 22 nt, Homo sapiens
uuacaagaugucuguccaacac

SEQ ID NO: 126097 - RNA, 19 nt, Homo sapiens
uuacacaaccuaguggggc

SEQ ID NO: 126098 - RNA, 22 nt, Homo sapiens
uuacagauggauggcagcuggc

SEQ ID NO: 126099 - RNA, 22 nt, Homo sapiens
uuacaggacuaagcagcuuugc

SEQ ID NO: 126100 - RNA, 17 nt, Homo sapiens
uuacaggugcugagagu

SEQ ID NO: 126101 - RNA, 22 nt, Homo sapiens
uuacaguagaugaggguauaau

SEQ ID NO: 126102 - RNA, 22 nt, Homo sapiens
uuacagucucaagagugcugca

SEQ ID NO: 126103 - RNA, 23 nt, Homo sapiens
uuacaguggcaugaucucugcuc

SEQ ID NO: 126104 - RNA, 22 nt, Homo sapiens
uuacauugcuucaaauucagug

SEQ ID NO: 126105 - RNA, 22 nt, Homo sapiens
uuaccagucugauaaacagaaa

SEQ ID NO: 126106 - RNA, 22 nt, Homo sapiens
uuaccuuuuuaagacagguuag

SEQ ID NO: 126107 - RNA, 22 nt, Homo sapiens
uuacuagaacauuuagggaacu

SEQ ID NO: 126108 - RNA, 22 nt, Homo sapiens
uuacuugagauggggugucacu

SEQ ID NO: 126109 - RNA, 22 nt, Homo sapiens
uuagaguguagcaggaagaggc

SEQ ID NO: 126110 - RNA, 22 nt, Homo sapiens
uuagauuauugagcauccacug

SEQ ID NO: 126111 - RNA, 22 nt, Homo sapiens
uuagcacauuuccagcacaugg

SEQ ID NO: 126112 - RNA, 22 nt, Homo sapiens
uuagcagcucuggugacaaggu

SEQ ID NO: 126113 - RNA, 22 nt, Homo sapiens
uuaggaucacagaaaauccucu

SEQ ID NO: 126114 - RNA, 22 nt, Homo sapiens
uuaggcucuuuaucaguuaacu

SEQ ID NO: 126115 - RNA, 22 nt, Homo sapiens
uuagguuauuacugacaauaau

SEQ ID NO: 126116 - RNA, 23 nt, Homo sapiens
uuaguaaacucaaugacaccaca

SEQ ID NO: 126117 - RNA, 22 nt, Homo sapiens
uuaguagcacagaguaucagca

SEQ ID NO: 126118 - RNA, 22 nt, Homo sapiens
uuaguaguagugcuguaauuuu

SEQ ID NO: 126119 - RNA, 22 nt, Homo sapiens
uuagucaaguguacugugaaug

SEQ ID NO: 126120 - RNA, 22 nt, Homo sapiens
uuaguuuaucagugguuucuga

SEQ ID NO: 126121 - RNA, 20 nt, Homo sapiens
uuauaacuuuuguucugggg

SEQ ID NO: 126122 - RNA, 22 nt, Homo sapiens
uuauacuacuauaaagagguag

SEQ ID NO: 126123 - RNA, 22 nt, Homo sapiens
uuauauguuucuuagggacaga

SEQ ID NO: 126124 - RNA, 22 nt, Homo sapiens
uuauccagcgcuguuuuggaga

SEQ ID NO: 126125 - RNA, 22 nt, Homo sapiens
uuaucccacuuucuguuccugu

SEQ ID NO: 126126 - RNA, 22 nt, Homo sapiens
uuaucucagugaacugagugga

SEQ ID NO: 126127 - RNA, 22 nt, Homo sapiens
uuaugacaggcucaggagcccc

SEQ ID NO: 126128 - RNA, 22 nt, Homo sapiens
uuaugacauugacaguuuuuag

SEQ ID NO: 126129 - RNA, 22 nt, Homo sapiens
uuauggcuuugcgguguuagca

SEQ ID NO: 126130 - RNA, 23 nt, Homo sapiens
uuauggcuuuuauuauguugagg

SEQ ID NO: 126131 - RNA, 22 nt, Homo sapiens
uuaugggucuuggaaugcaaua

SEQ ID NO: 126132 - RNA, 22 nt, Homo sapiens
uuaugguuuuucugugagaugg

SEQ ID NO: 126133 - RNA, 22 nt, Homo sapiens
uuauucugucuuuggucucaau

SEQ ID NO: 126134 - RNA, 17 nt, Homo sapiens
uuauugcuauaagcuga

SEQ ID NO: 126135 - RNA, 22 nt, Homo sapiens
uucaaaggauagauuaagauca

SEQ ID NO: 126136 - RNA, 22 nt, Homo sapiens
uucaaaguaaagggauggagac

SEQ ID NO: 126137 - RNA, 23 nt, Homo sapiens
uucaacagguagacccucccugc

SEQ ID NO: 126138 - RNA, 22 nt, Homo sapiens
uucaacugcuucagccucccaa

SEQ ID NO: 126139 - RNA, 22 nt, Homo sapiens
uucaagcuauggugaucuuuuc

SEQ ID NO: 126140 - RNA, 20 nt, Homo sapiens
uucaagugauucucaugccu

SEQ ID NO: 126141 - RNA, 22 nt, Homo sapiens
uucaauacuguugauccuuaug

SEQ ID NO: 126142 - RNA, 22 nt, Homo sapiens
uucaauaugucauuggcaggca

SEQ ID NO: 126143 - RNA, 21 nt, Homo sapiens
uucacaagggaaguagggggc

SEQ ID NO: 126144 - RNA, 22 nt, Homo sapiens
uucacacugggccuacucugug

SEQ ID NO: 126145 - RNA, 21 nt, Homo sapiens
uucaccauggcuccacacucu

SEQ ID NO: 126146 - RNA, 23 nt, Homo sapiens
uucaccguguuggccaggcuggu

SEQ ID NO: 126147 - RNA, 22 nt, Homo sapiens
uucaccuugggucccacuugcu

SEQ ID NO: 126148 - RNA, 22 nt, Homo sapiens
uucacgguguucacgggggucc

SEQ ID NO: 126149 - RNA, 22 nt, Homo sapiens
uucacugcauuucagccugggc

SEQ ID NO: 126150 - RNA, 22 nt, Homo sapiens
uucacuggagcccaggaguugg

SEQ ID NO: 126151 - RNA, 21 nt, Homo sapiens
uucacuggucuauuucccuuu

SEQ ID NO: 126152 - RNA, 22 nt, Homo sapiens
uucacuguaaaaugaagagggu

SEQ ID NO: 126153 - RNA, 22 nt, Homo sapiens
uucacugugaacucauauucag

SEQ ID NO: 126154 - RNA, 22 nt, Homo sapiens
uucacuguuaagcaguuaaacu

SEQ ID NO: 126155 - RNA, 22 nt, Homo sapiens
uucagacugggugaagagggua

SEQ ID NO: 126156 - RNA, 22 nt, Homo sapiens
uucagaguggacagaaauuaag

SEQ ID NO: 126157 - RNA, 22 nt, Homo sapiens
uucagauugcauaccgaaagua

SEQ ID NO: 126158 - RNA, 22 nt, Homo sapiens
uucagcaaugacagccuauaua

SEQ ID NO: 126159 - RNA, 22 nt, Homo sapiens
uucagcacugaaaauaugucau

SEQ ID NO: 126160 - RNA, 22 nt, Homo sapiens
uucaggcuuuuauuuacugaua

SEQ ID NO: 126161 - RNA, 22 nt, Homo sapiens
uucagguaguuuaacuguucca

SEQ ID NO: 126162 - RNA, 22 nt, Homo sapiens
uucaguacacguguucucauuu

SEQ ID NO: 126163 - RNA, 20 nt, Homo sapiens
uucagugcagguaacaaucc

SEQ ID NO: 126164 - RNA, 22 nt, Homo sapiens
uucagugccuggaagucgugcu

SEQ ID NO: 126165 - RNA, 22 nt, Homo sapiens
uucagugucauuaacacaguag

SEQ ID NO: 126166 - RNA, 22 nt, Homo sapiens
uucaguucugcacugaucuuag

SEQ ID NO: 126167 - RNA, 22 nt, Homo sapiens
uucaguucugcucugaucuuag

SEQ ID NO: 126168 - RNA, 18 nt, Homo sapiens
uucauaguagcaugauuu

SEQ ID NO: 126169 - RNA, 22 nt, Homo sapiens
uucauaguguuuccuuccagug

SEQ ID NO: 126170 - RNA, 21 nt, Homo sapiens
uucaucuggccguauuccagg

SEQ ID NO: 126171 - RNA, 22 nt, Homo sapiens
uucauggaguugagaaggcuaa

SEQ ID NO: 126172 - RNA, 22 nt, Homo sapiens
uuuguacacuguuggugguuau

SEQ ID NO: 126173 - RNA, 22 nt, Homo sapiens
uuuguacuucauacaauaacuc

SEQ ID NO: 126174 - RNA, 22 nt, Homo sapiens
uuuguacuugaagaaucuuuau

SEQ ID NO: 126175 - RNA, 22 nt, Homo sapiens
uuugucauagcagcaggaaugg

SEQ ID NO: 126176 - RNA, 19 nt, Homo sapiens
uuuguccugcccuuucuca

SEQ ID NO: 126177 - RNA, 22 nt, Homo sapiens
uuugucuccuaagacucugugg

SEQ ID NO: 126178 - RNA, 22 nt, Homo sapiens
uuugugcaaacuaggauugcga

SEQ ID NO: 126179 - RNA, 22 nt, Homo sapiens
uuugugcuaaugcuagauuacu

SEQ ID NO: 126180 - RNA, 22 nt, Homo sapiens
uuugugcuauguuauauauucu

SEQ ID NO: 126181 - RNA, 22 nt, Homo sapiens
uuuguggaaugcccuuauuuau

SEQ ID NO: 126182 - RNA, 22 nt, Homo sapiens
uuuguggaaugcucauguguag

SEQ ID NO: 126183 - RNA, 22 nt, Homo sapiens
uuugugucccuacccgaaucuc

SEQ ID NO: 126184 - RNA, 22 nt, Homo sapiens
uuuguucuucguuccugagcca

SEQ ID NO: 126185 - RNA, 22 nt, Homo sapiens
uuuuacacaucaccgcucgugu

SEQ ID NO: 126186 - RNA, 22 nt, Homo sapiens
uuuuacacuucgguugugugca

SEQ ID NO: 126187 - RNA, 22 nt, Homo sapiens
uuuuacagaggagguugcugau

SEQ ID NO: 126188 - RNA, 21 nt, Homo sapiens
uuuugcacacuaugcagcuuu

SEQ ID NO: 126189 - RNA, 22 nt, Homo sapiens
uuuugcaggucaggggcagaga

SEQ ID NO: 126190 - RNA, 22 nt, Homo sapiens
uuuugcucuugguaaugaaaga

SEQ ID NO: 126191 - RNA, 19 nt, Homo sapiens
uuuuggaaaugugaacagc

SEQ ID NO: 126192 - RNA, 22 nt, Homo sapiens
uuuuggcuuaaagagaauguau

SEQ ID NO: 126193 - RNA, 22 nt, Homo sapiens
uuuuggcuuuuccucagcaagc

SEQ ID NO: 126194 - RNA, 22 nt, Homo sapiens
uuuuggugguuaugugucaaug

SEQ ID NO: 126195 - RNA, 22 nt, Homo sapiens
uuuugguucaauuaauuugcua

SEQ ID NO: 126196 - RNA, 22 nt, Homo sapiens
uuuuucacuuaaguuaggcuca

SEQ ID NO: 126197 - RNA, 16 nt, Homo sapiens
uuuuugcagaaaugac

SEQ ID NO: 126198 - RNA, 22 nt, Homo sapiens
uuuuuggauaaugguacaugua

SEQ ID NO: 126199 - RNA, 22 nt, Homo sapiens
uuuuuggguaaugauuaucaau

SEQ ID NO: 126200 - RNA, 22 nt, Homo sapiens
uuuuugguugguaggcuauuaa

SEQ ID NO: 126201 - RNA, 23 nt, Homo sapiens
uuuuuguguuucauggaaauagg

SEQ ID NO: 126202 - RNA, 18 nt, Homo sapiens
aaaaagugcucaggccua

SEQ ID NO: 126203 - RNA, 22 nt, Homo sapiens
aaaagcauucagagugcugggc

SEQ ID NO: 126204 - RNA, 22 nt, Homo sapiens
aaaagugguguuguuucuaaau

SEQ ID NO: 126205 - RNA, 22 nt, Homo sapiens
aaaaugcugauauugggcccca

SEQ ID NO: 126206 - RNA, 22 nt, Homo sapiens
aaacaccacgcggucccucgga

SEQ ID NO: 126207 - RNA, 18 nt, Homo sapiens
aaacagugucucuuucug

SEQ ID NO: 126208 - RNA, 20 nt, Homo sapiens
aaacucugucuucuuuauca

SEQ ID NO: 126209 - RNA, 19 nt, Homo sapiens
ccaguguucugauugcacu

SEQ ID NO: 126210 - RNA, 19 nt, Homo sapiens
ccaguguugccagagcuga

SEQ ID NO: 126211 - RNA, 22 nt, Homo sapiens
ccaucacacugugauuauuauc

SEQ ID NO: 126212 - RNA, 22 nt, Homo sapiens
ccauggcaauggucagucuauu

SEQ ID NO: 126213 - RNA, 18 nt, Homo sapiens
ccauucaacagauuuguc

SEQ ID NO: 126214 - RNA, 22 nt, Homo sapiens
ccauugcacuccagccuaggca

SEQ ID NO: 126215 - RNA, 23 nt, Homo sapiens
ccauugcacuccagccucaguga

SEQ ID NO: 126216 - RNA, 22 nt, Homo sapiens
ccauuucacucuuccugaagga

SEQ ID NO: 126217 - RNA, 22 nt, Homo sapiens
cccaguaaucuugccaguuuuc

SEQ ID NO: 126218 - RNA, 22 nt, Homo sapiens
cccagugaagagaaccuuacga

SEQ ID NO: 126219 - RNA, 22 nt, Homo sapiens
ccccugaaacucacucauuauc

SEQ ID NO: 126220 - RNA, 18 nt, Homo sapiens
cccgggugggcuguuccc

SEQ ID NO: 126221 - RNA, 22 nt, Homo sapiens
cccugaagaaagccuaggacau

SEQ ID NO: 126222 - RNA, 22 nt, Homo sapiens
cccugacauucggagauguagu

SEQ ID NO: 126223 - RNA, 22 nt, Homo sapiens
cccugagagcagggucuuucuc

SEQ ID NO: 126224 - RNA, 22 nt, Homo sapiens
cccugagaugcuguuaaucugu

SEQ ID NO: 126225 - RNA, 22 nt, Homo sapiens
cccuggacauucaucauuaugu

SEQ ID NO: 126226 - RNA, 21 nt, Homo sapiens
cccugguguuuggaguuugag

SEQ ID NO: 126227 - RNA, 22 nt, Homo sapiens
cccuugcacuucagagcugcau

SEQ ID NO: 126228 - RNA, 22 nt, Homo sapiens
ccggcugugugacugugggcag

SEQ ID NO: 126229 - RNA, 22 nt, Homo sapiens
ccggcuguguggagaggccccu

SEQ ID NO: 126230 - RNA, 22 nt, Homo sapiens
ccucauggagaacaucugcuag

SEQ ID NO: 126231 - RNA, 22 nt, Homo sapiens
ccucuguaguccugcaagagga

SEQ ID NO: 126232 - RNA, 21 nt, Homo sapiens
ccugaagaagugaccucugag

SEQ ID NO: 126233 - RNA, 22 nt, Homo sapiens
ccugagacgaauggagugaaca

SEQ ID NO: 126234 - RNA, 22 nt, Homo sapiens
ccugagguagaguuuauauuga

SEQ ID NO: 126235 - RNA, 22 nt, Homo sapiens
ccugcauaguucaccgcugaua

SEQ ID NO: 126236 - RNA, 19 nt, Homo sapiens
ccugcuguucuuuugcacc

SEQ ID NO: 126237 - RNA, 22 nt, Homo sapiens
ccugugguuaaccagcuagaug

SEQ ID NO: 126238 - RNA, 22 nt, Homo sapiens
ccuguguuaugguuucuaaugu

SEQ ID NO: 126239 - RNA, 22 nt, Homo sapiens
ccuugcacuucccaggugaggc

SEQ ID NO: 126240 - RNA, 22 nt, Homo sapiens
ccuuggcaauggcuggggcuga

SEQ ID NO: 126241 - RNA, 22 nt, Homo sapiens
ccuuggcacuuugccacagugc

SEQ ID NO: 126242 - RNA, 22 nt, Homo sapiens
cgcaguguuugugucccugggu

SEQ ID NO: 126243 - RNA, 22 nt, Homo sapiens
cgcccuguagcuagcuagaggu

SEQ ID NO: 126244 - RNA, 22 nt, Homo sapiens
cuaacacagggcaagucaggcu

SEQ ID NO: 126245 - RNA, 22 nt, Homo sapiens
cuaacuaugucucaggaugucc

SEQ ID NO: 126246 - RNA, 22 nt, Homo sapiens
cuaauccugugguagcacucaa

SEQ ID NO: 126247 - RNA, 22 nt, Homo sapiens
cuaauucuggccaaagggauaa

SEQ ID NO: 126248 - RNA, 22 nt, Homo sapiens
cuacagaguaucuaaagaggua

SEQ ID NO: 126249 - RNA, 22 nt, Homo sapiens
cuacagguaugaaagggaguau

SEQ ID NO: 126250 - RNA, 22 nt, Homo sapiens
cuacaguagagaggauguagaa

SEQ ID NO: 126251 - RNA, 22 nt, Homo sapiens
cuacagugggucuguaguccuu

SEQ ID NO: 126252 - RNA, 22 nt, Homo sapiens
cuacaguucuuaauuaaguagu

SEQ ID NO: 126253 - RNA, 23 nt, Homo sapiens
cuacuagucaagucuuuuccagu

SEQ ID NO: 126254 - RNA, 22 nt, Homo sapiens
cuacuauguagagauauugaau

SEQ ID NO: 126255 - RNA, 22 nt, Homo sapiens
cuacucugugguguauuugcau

SEQ ID NO: 126256 - RNA, 22 nt, Homo sapiens
cuagacacugacguuccuccga

SEQ ID NO: 126257 - RNA, 22 nt, Homo sapiens
cuagagagaagcugugugaccu

SEQ ID NO: 126258 - RNA, 22 nt, Homo sapiens
cuagauuauccaacuuauuagc

SEQ ID NO: 126259 - RNA, 22 nt, Homo sapiens
cuagcacauaguuauucacuca

SEQ ID NO: 126260 - RNA, 22 nt, Homo sapiens
cuagcugcacuuccugcuacug

SEQ ID NO: 126261 - RNA, 22 nt, Homo sapiens
cuaggcacugauaguuguauuu

SEQ ID NO: 126262 - RNA, 22 nt, Homo sapiens
cuaggcuuuucuuggauccagg

SEQ ID NO: 126263 - RNA, 22 nt, Homo sapiens
cuagguuauacucugaaauggu

SEQ ID NO: 126264 - RNA, 22 nt, Homo sapiens
cuagguucucaaaccagcguca

SEQ ID NO: 126265 - RNA, 22 nt, Homo sapiens
cuagugcaguuccccugucuua

SEQ ID NO: 126266 - RNA, 22 nt, Homo sapiens
cuauauacugccugcugauuag

SEQ ID NO: 126267 - RNA, 22 nt, Homo sapiens
cuaucucaggcccaggcccuug

SEQ ID NO: 126268 - RNA, 22 nt, Homo sapiens
agcaccauuguacuccagccug

SEQ ID NO: 126269 - RNA, 23 nt, Homo sapiens
agcaccuuuccuccacuaucugc

SEQ ID NO: 126270 - RNA, 19 nt, Homo sapiens
agcagaacaaauguguggg

SEQ ID NO: 126271 - RNA, 22 nt, Homo sapiens
agcagagcaguggauuuuguga

SEQ ID NO: 126272 - RNA, 22 nt, Homo sapiens
agcagcaugaggggacuucugc

SEQ ID NO: 126273 - RNA, 22 nt, Homo sapiens
agcagcauuaguggaaucuugu

SEQ ID NO: 126274 - RNA, 22 nt, Homo sapiens
agcagcauuccaaaaaucugcu

SEQ ID NO: 126275 - RNA, 22 nt, Homo sapiens
agcagcucaugccuuugggagg

SEQ ID NO: 126276 - RNA, 22 nt, Homo sapiens
agcagcuuugaucugaaugauu

SEQ ID NO: 126277 - RNA, 22 nt, Homo sapiens
agcagcuuugcauggccuguga

SEQ ID NO: 126278 - RNA, 22 nt, Homo sapiens
agcaggacaauaugggaucagg

SEQ ID NO: 126279 - RNA, 22 nt, Homo sapiens
agcagguauucgggucaugggg

SEQ ID NO: 126280 - RNA, 16 nt, Homo sapiens
agcagguguuagguga

SEQ ID NO: 126281 - RNA, 22 nt, Homo sapiens
agcaguacauaaaaagcauccu

SEQ ID NO: 126282 - RNA, 22 nt, Homo sapiens
agcaucauguuuucgagguuca

SEQ ID NO: 126283 - RNA, 22 nt, Homo sapiens
agcaugacauauuguagagaaa

SEQ ID NO: 126284 - RNA, 17 nt, Homo sapiens
agcauguguuugagauu

SEQ ID NO: 126285 - RNA, 20 nt, Homo sapiens
agcauugguuagaacaguag

SEQ ID NO: 126286 - RNA, 21 nt, Homo sapiens
agccaguguuccuuguggcuc

SEQ ID NO: 126287 - RNA, 19 nt, Homo sapiens
agccaguuuucccagcacc

SEQ ID NO: 126288 - RNA, 22 nt, Homo sapiens
agcccagagacuguguaaauuu

SEQ ID NO: 126289 - RNA, 20 nt, Homo sapiens
agccccauguaaaccacaug

SEQ ID NO: 126290 - RNA, 22 nt, Homo sapiens
agccucauucuacauguuaaug

SEQ ID NO: 126291 - RNA, 23 nt, Homo sapiens
agccugguuucccugcuucuccc

SEQ ID NO: 126292 - RNA, 18 nt, Homo sapiens
agcucaguguuugcuuac

SEQ ID NO: 126293 - RNA, 22 nt, Homo sapiens
agcuccaugauaguaugucugu

SEQ ID NO: 126294 - RNA, 20 nt, Homo sapiens
agcuccauuccugaaggcug

SEQ ID NO: 126295 - RNA, 22 nt, Homo sapiens
agcuccuuugcuuuuuccagga

SEQ ID NO: 126296 - RNA, 22 nt, Homo sapiens
agcugaguguuccaagagcgag

SEQ ID NO: 126297 - RNA, 22 nt, Homo sapiens
agcugcaaagggagagaugauu

SEQ ID NO: 126298 - RNA, 22 nt, Homo sapiens
agcugcaauguuuaguauaaua

SEQ ID NO: 126299 - RNA, 22 nt, Homo sapiens
agcugcacgugguaaauguaaa

SEQ ID NO: 126300 - RNA, 22 nt, Homo sapiens
agcugcauucguaucauauugu

SEQ ID NO: 126301 - RNA, 22 nt, Homo sapiens
agcuggauguggaugacccugu

SEQ ID NO: 126302 - RNA, 22 nt, Homo sapiens
agcugguauuuugucaaggaua

SEQ ID NO: 126303 - RNA, 22 nt, Homo sapiens
agcugguccugugacuugcuuc

SEQ ID NO: 126304 - RNA, 22 nt, Homo sapiens
agcugguucuuugccuuguaga

SEQ ID NO: 126305 - RNA, 22 nt, Homo sapiens
agcugguuuaauaugcugucug

SEQ ID NO: 126306 - RNA, 22 nt, Homo sapiens
agcuguuguuuuaagauacuaa

SEQ ID NO: 126307 - RNA, 22 nt, Homo sapiens
agcuucauuguuaugaauguca

SEQ ID NO: 126308 - RNA, 22 nt, Homo sapiens
agcuuguauuuguagccuguug

SEQ ID NO: 126309 - RNA, 22 nt, Homo sapiens
agcuuguggugaauacugcuag

SEQ ID NO: 126310 - RNA, 21 nt, Homo sapiens
agcuuguguguaucacagugu

SEQ ID NO: 126311 - RNA, 22 nt, Homo sapiens
agcuuguuuuccugcaacuaga

SEQ ID NO: 126312 - RNA, 22 nt, Homo sapiens
agcuuuuugggcagcuauugac

SEQ ID NO: 126313 - RNA, 22 nt, Homo sapiens
aggaagugucuucuuuuaggca

SEQ ID NO: 126314 - RNA, 22 nt, Homo sapiens
aggaagugugcaauuaauuucu

SEQ ID NO: 126315 - RNA, 22 nt, Homo sapiens
aggaaugucaaugguaguuuaa

SEQ ID NO: 126316 - RNA, 22 nt, Homo sapiens
aggacacugauguaugcugugg

SEQ ID NO: 126317 - RNA, 22 nt, Homo sapiens
aggaccaugguauugcuuuggg

SEQ ID NO: 126318 - RNA, 22 nt, Homo sapiens
aggaccccucaucagcaccagu

SEQ ID NO: 126319 - RNA, 22 nt, Homo sapiens
aggagcacaggacuuugauuau

SEQ ID NO: 126320 - RNA, 23 nt, Homo sapiens
aggagcuuagaaguugccauugc

SEQ ID NO: 126321 - RNA, 22 nt, Homo sapiens
aggagguaggaauugugcuagg

SEQ ID NO: 126322 - RNA, 22 nt, Homo sapiens
aggagguagucugucccuuagc

SEQ ID NO: 126323 - RNA, 22 nt, Homo sapiens
aggagguugguaccaucuguuu

SEQ ID NO: 126324 - RNA, 22 nt, Homo sapiens
aggaguguguauuaaugaaauu

SEQ ID NO: 126325 - RNA, 22 nt, Homo sapiens
aggcaaaugccagcaaucacac

SEQ ID NO: 126326 - RNA, 22 nt, Homo sapiens
aggcaagaaugcuuguuucacc

SEQ ID NO: 126327 - RNA, 22 nt, Homo sapiens
aggcaagagugacuacgugaaa

SEQ ID NO: 126328 - RNA, 22 nt, Homo sapiens
aggcaaguugcucaaaugcaaa

SEQ ID NO: 126329 - RNA, 22 nt, Homo sapiens
aggcacacaacccuggaccuga

SEQ ID NO: 126330 - RNA, 22 nt, Homo sapiens
aggcacgguggcucacaccugu

SEQ ID NO: 126331 - RNA, 22 nt, Homo sapiens
aggcagaugagguccucagcug

SEQ ID NO: 126332 - RNA, 22 nt, Homo sapiens
aggcagucugaguuuugaaagg

SEQ ID NO: 126333 - RNA, 22 nt, Homo sapiens
aggcaugauggcuccagaucau

SEQ ID NO: 126334 - RNA, 22 nt, Homo sapiens
aggcauguggcucuguucugac

SEQ ID NO: 126335 - RNA, 19 nt, Homo sapiens
aggcauugugcucaucugu

SEQ ID NO: 126336 - RNA, 22 nt, Homo sapiens
aggcuuuuguuuuggucucagg

SEQ ID NO: 126337 - RNA, 22 nt, Homo sapiens
agggcauuguacaaaucaucau

SEQ ID NO: 126338 - RNA, 22 nt, Homo sapiens
agggcuuuugagcugagauggu

SEQ ID NO: 126339 - RNA, 22 nt, Homo sapiens
agguaaacauggggacugcuac

SEQ ID NO: 126340 - RNA, 22 nt, Homo sapiens
agguaagaugugacuugguguu

SEQ ID NO: 126341 - RNA, 22 nt, Homo sapiens
agguaauagcacaugauaccuu

SEQ ID NO: 126342 - RNA, 22 nt, Homo sapiens
agguaauuuucccagagggaaa

SEQ ID NO: 126343 - RNA, 20 nt, Homo sapiens
agguacacugacaugccuuc

SEQ ID NO: 126344 - RNA, 22 nt, Homo sapiens
agguagcauagcgggaauauca

SEQ ID NO: 126345 - RNA, 22 nt, Homo sapiens
agguagugugaugcuccuguuu

SEQ ID NO: 126346 - RNA, 22 nt, Homo sapiens
agguauauuggacagauguaaa

SEQ ID NO: 126347 - RNA, 22 nt, Homo sapiens
agguauuuuuuauccuccagca

SEQ ID NO: 126348 - RNA, 21 nt, Homo sapiens
aggucaguaagaaugcagcac

SEQ ID NO: 126349 - RNA, 18 nt, Homo sapiens
acauucagcuugaagaua

SEQ ID NO: 126350 - RNA, 22 nt, Homo sapiens
accauugcacuucagccuaggc

SEQ ID NO: 126351 - RNA, 22 nt, Homo sapiens
acccagaauucagucuuaggcc

SEQ ID NO: 126352 - RNA, 17 nt, Homo sapiens
acccagucuuuuugcac

SEQ ID NO: 126353 - RNA, 22 nt, Homo sapiens
acccgggaggcaggagucauag

SEQ ID NO: 126354 - RNA, 22 nt, Homo sapiens
acccucagaccaguuucccugg

SEQ ID NO: 126355 - RNA, 22 nt, Homo sapiens
acccugcuaaacagcccccugc

SEQ ID NO: 126356 - RNA, 21 nt, Homo sapiens
cuaucucaguguuuacauuug

SEQ ID NO: 126357 - RNA, 22 nt, Homo sapiens
cuauggguuauaauucauuagu

SEQ ID NO: 126358 - RNA, 22 nt, Homo sapiens
cuauggugauagaaaucagaau

SEQ ID NO: 126359 - RNA, 22 nt, Homo sapiens
cuauucacaauggugaagauau

SEQ ID NO: 126360 - RNA, 22 nt, Homo sapiens
cucaaagugcugggauuggcca

SEQ ID NO: 126361 - RNA, 22 nt, Homo sapiens
cucaaaguguggucuguggguu

SEQ ID NO: 126362 - RNA, 20 nt, Homo sapiens
cucaccagguguaggcugag

SEQ ID NO: 126363 - RNA, 22 nt, Homo sapiens
cucaccuugugauccacccacc

SEQ ID NO: 126364 - RNA, 22 nt, Homo sapiens
cucaccuugugauccacccgcc

SEQ ID NO: 126365 - RNA, 22 nt, Homo sapiens
cucacggcccugcgcacuggca

SEQ ID NO: 126366 - RNA, 22 nt, Homo sapiens
cucacggugcaggcuucuggga

SEQ ID NO: 126367 - RNA, 22 nt, Homo sapiens
cucagauacuugggagguugag

SEQ ID NO: 126368 - RNA, 22 nt, Homo sapiens
cucagcuacuugagaggcuuag

SEQ ID NO: 126369 - RNA, 22 nt, Homo sapiens
cucaggguacuucuccuuugcu

SEQ ID NO: 126370 - RNA, 22 nt, Homo sapiens
cucagggugguggacucuaaua

SEQ ID NO: 126371 - RNA, 20 nt, Homo sapiens
cucagguauuugaggcugca

SEQ ID NO: 126372 - RNA, 22 nt, Homo sapiens
cucagugaagggcaagaggcaa

SEQ ID NO: 126373 - RNA, 22 nt, Homo sapiens
cucaguggauuagauaaugcac

SEQ ID NO: 126374 - RNA, 22 nt, Homo sapiens
cucaguguuucagcugcucaga

SEQ ID NO: 126375 - RNA, 22 nt, Homo sapiens
cucaugcugucuucugggguaa

SEQ ID NO: 126376 - RNA, 19 nt, Homo sapiens
cucauggagaaggagaaua

SEQ ID NO: 126377 - RNA, 22 nt, Homo sapiens
cuccagugcaaagucaugauca

SEQ ID NO: 126378 - RNA, 22 nt, Homo sapiens
cuccaguuucagaaucccaugu

SEQ ID NO: 126379 - RNA, 23 nt, Homo sapiens
cuccaugagccguccagggccug

SEQ ID NO: 126380 - RNA, 22 nt, Homo sapiens
cuccauuuaguccuuuuagaag

SEQ ID NO: 126381 - RNA, 22 nt, Homo sapiens
cuccauuuggaacagauguccu

SEQ ID NO: 126382 - RNA, 22 nt, Homo sapiens
cucccagagccaguuauaggcu

SEQ ID NO: 126383 - RNA, 20 nt, Homo sapiens
cucccugacaaauguggaaa

SEQ ID NO: 126384 - RNA, 22 nt, Homo sapiens
cuccuaaccagggcuguuaguc

SEQ ID NO: 126385 - RNA, 22 nt, Homo sapiens
cuccuggugauuggagugugaa

SEQ ID NO: 126386 - RNA, 22 nt, Homo sapiens
cuccuguagccccaucaucuuu

SEQ ID NO: 126387 - RNA, 22 nt, Homo sapiens
cucugagccugagguuccuacu

SEQ ID NO: 126388 - RNA, 22 nt, Homo sapiens
cucugauggagauauacaagga

SEQ ID NO: 126389 - RNA, 22 nt, Homo sapiens
cucuggauauuccugucuaaaa

SEQ ID NO: 126390 - RNA, 22 nt, Homo sapiens
cucugguggaagcagggggcaa

SEQ ID NO: 126391 - RNA, 18 nt, Homo sapiens
ucacggggagcagcagcc

SEQ ID NO: 126392 - RNA, 22 nt, Homo sapiens
ucacgugcucuuguguguucug

SEQ ID NO: 126393 - RNA, 22 nt, Homo sapiens
ucacgugguucauaaggcagaa

SEQ ID NO: 126394 - RNA, 22 nt, Homo sapiens
ucacuaaagaaaauggcaugga

SEQ ID NO: 126395 - RNA, 22 nt, Homo sapiens
ucacuagggagaaacugaggcu

SEQ ID NO: 126396 - RNA, 20 nt, Homo sapiens
ucacuauggagcucuuucuu

SEQ ID NO: 126397 - RNA, 22 nt, Homo sapiens
ucacugaaacuguccuggguua

SEQ ID NO: 126398 - RNA, 22 nt, Homo sapiens
ucacugaggucugagcuuuaug

SEQ ID NO: 126399 - RNA, 20 nt, Homo sapiens
ucacugaguaucuacgauua

SEQ ID NO: 126400 - RNA, 22 nt, Homo sapiens
ucacugcacucuccgccuugcg

SEQ ID NO: 126401 - RNA, 22 nt, Homo sapiens
ucacugcgaccuccgccucccg

SEQ ID NO: 126402 - RNA, 22 nt, Homo sapiens
ucacuggacagaaauaaaggug

SEQ ID NO: 126403 - RNA, 22 nt, Homo sapiens
ucacuggagauagcaaucuggu

SEQ ID NO: 126404 - RNA, 22 nt, Homo sapiens
ucacuggccaaauucuggguga

SEQ ID NO: 126405 - RNA, 20 nt, Homo sapiens
ucacugugaacuucuugagg

SEQ ID NO: 126406 - RNA, 22 nt, Homo sapiens
ucacuguggaacucaaaaagcu

SEQ ID NO: 126407 - RNA, 22 nt, Homo sapiens
ucacuguguauguauaugcagg

SEQ ID NO: 126408 - RNA, 22 nt, Homo sapiens
ucacuuggccgcagccuucucu

SEQ ID NO: 126409 - RNA, 22 nt, Homo sapiens
ucagaacugauacuagaacuuu

SEQ ID NO: 126410 - RNA, 22 nt, Homo sapiens
ucagacacugcccuccaccugu

SEQ ID NO: 126411 - RNA, 22 nt, Homo sapiens
ucagaguaguuccuggcagaaa

SEQ ID NO: 126412 - RNA, 22 nt, Homo sapiens
ucagagucuagaucacucacug

SEQ ID NO: 126413 - RNA, 22 nt, Homo sapiens
ucagagugcagggaguagcagc

SEQ ID NO: 126414 - RNA, 22 nt, Homo sapiens
ucagaguggagucugcagccuu

SEQ ID NO: 126415 - RNA, 22 nt, Homo sapiens
ucagaguggccucucuugaaga

SEQ ID NO: 126416 - RNA, 22 nt, Homo sapiens
ucagaguguuuuccaacuuggu

SEQ ID NO: 126417 - RNA, 22 nt, Homo sapiens
ucagaugaugucccuguucuaa

SEQ ID NO: 126418 - RNA, 22 nt, Homo sapiens
ucagauguuuuguuuaucugcu

SEQ ID NO: 126419 - RNA, 19 nt, Homo sapiens
ucagcaguaaucaacuuca

SEQ ID NO: 126420 - RNA, 22 nt, Homo sapiens
ucagcaguggacagaaugguag

SEQ ID NO: 126421 - RNA, 22 nt, Homo sapiens
ucagcgggaguggaaagucaga

SEQ ID NO: 126422 - RNA, 22 nt, Homo sapiens
ucaggcacucagcuuagagucu

SEQ ID NO: 126423 - RNA, 22 nt, Homo sapiens
ucaggcuuuucccagagugaug

SEQ ID NO: 126424 - RNA, 20 nt, Homo sapiens
ucagguagggcuucaacauu

SEQ ID NO: 126425 - RNA, 22 nt, Homo sapiens
ucagguagugccaugauugauu

SEQ ID NO: 126426 - RNA, 22 nt, Homo sapiens
ucagguauuucuuuuagcugug

SEQ ID NO: 126427 - RNA, 22 nt, Homo sapiens
ucagguccuuacugugcucccu

SEQ ID NO: 126428 - RNA, 22 nt, Homo sapiens
ucaguaaaugcuguucucuuuu

SEQ ID NO: 126429 - RNA, 22 nt, Homo sapiens
ucaguaaauguuaggacauuuc

SEQ ID NO: 126430 - RNA, 23 nt, Homo sapiens
ucaguacuccacuuucaauagug

SEQ ID NO: 126431 - RNA, 22 nt, Homo sapiens
ucaguagcauugcuuauacagu

SEQ ID NO: 126432 - RNA, 22 nt, Homo sapiens
ucagucauucaauuguugaaug

SEQ ID NO: 126433 - RNA, 22 nt, Homo sapiens
ucaguccccucgcugagucuac

SEQ ID NO: 126434 - RNA, 22 nt, Homo sapiens
ucagucuuuuaccauuaaguau

SEQ ID NO: 126435 - RNA, 22 nt, Homo sapiens
ucagugaacgaggaggagggug

SEQ ID NO: 126436 - RNA, 23 nt, Homo sapiens
ucagugaaggaacaacuaaauag

SEQ ID NO: 126437 - RNA, 22 nt, Homo sapiens
ucagugacuggguauuaaauca

SEQ ID NO: 126438 - RNA, 20 nt, Homo sapiens
ucagugauugguuuaguuau

SEQ ID NO: 126439 - RNA, 21 nt, Homo sapiens
ucagugcaauucuauggggaa

SEQ ID NO: 126440 - RNA, 22 nt, Homo sapiens
ucagugcaggaauuuccuuaga

SEQ ID NO: 126441 - RNA, 22 nt, Homo sapiens
ucagugccauugccauaugagu

SEQ ID NO: 126442 - RNA, 19 nt, Homo sapiens
ucagugcuauguaauguag

SEQ ID NO: 126443 - RNA, 21 nt, Homo sapiens
ucagugcugugggcaaggugc

SEQ ID NO: 126444 - RNA, 22 nt, Homo sapiens
ucagugcuguuugcccucguuu

SEQ ID NO: 126445 - RNA, 22 nt, Homo sapiens
ucagugcuuuuuguugucauca

SEQ ID NO: 126446 - RNA, 22 nt, Homo sapiens
ucagugguuaaaagauucuaga

SEQ ID NO: 126447 - RNA, 22 nt, Homo sapiens
ucaguguugauggcugcugacu

SEQ ID NO: 126448 - RNA, 22 nt, Homo sapiens
ucaguguuuggaaucucaauuu

SEQ ID NO: 126449 - RNA, 22 nt, Homo sapiens
ucaguuaaugcugccugcugga

SEQ ID NO: 126450 - RNA, 22 nt, Homo sapiens
ucauaaaguuguuuuaauggga

SEQ ID NO: 126451 - RNA, 22 nt, Homo sapiens
ucauacgucuccuugugccacc

SEQ ID NO: 126452 - RNA, 22 nt, Homo sapiens
ucauagaucaaguaauaagaca

SEQ ID NO: 126453 - RNA, 22 nt, Homo sapiens
ucauaguacuuuguuuugaaaa

SEQ ID NO: 126454 - RNA, 22 nt, Homo sapiens
ucauaguagucacuuaauaaau

SEQ ID NO: 126455 - RNA, 19 nt, Homo sapiens
ucauagucuaagaugagaa

SEQ ID NO: 126456 - RNA, 22 nt, Homo sapiens
ucauaucauuagaucuacugua

SEQ ID NO: 126457 - RNA, 22 nt, Homo sapiens
ucaucagaaucccuuagggaug

SEQ ID NO: 126458 - RNA, 22 nt, Homo sapiens
ucaucaggcucauucaagcuga

SEQ ID NO: 126459 - RNA, 22 nt, Homo sapiens
ucaucagguaugucagcggagu

SEQ ID NO: 126460 - RNA, 22 nt, Homo sapiens
ucauccauacaguuagcaaagg

SEQ ID NO: 126461 - RNA, 22 nt, Homo sapiens
ucaugacacuggcaggagcuaa

SEQ ID NO: 126462 - RNA, 22 nt, Homo sapiens
ucaugcaucuuguggaauuuga

SEQ ID NO: 126463 - RNA, 22 nt, Homo sapiens
ucauggcacugaugagaguuuc

SEQ ID NO: 126464 - RNA, 22 nt, Homo sapiens
ucauggggugcuuugcuagauu

SEQ ID NO: 126465 - RNA, 22 nt, Homo sapiens
ucauguaauuuugugucuauga

SEQ ID NO: 126466 - RNA, 22 nt, Homo sapiens
ucaugugagcacagagcaagau

SEQ ID NO: 126467 - RNA, 19 nt, Homo sapiens
ucaugugcauacauuuggg

SEQ ID NO: 126468 - RNA, 22 nt, Homo sapiens
ucauucacucccuugaaguuag

SEQ ID NO: 126469 - RNA, 22 nt, Homo sapiens
ucauucauucuucaguggguac

SEQ ID NO: 126470 - RNA, 22 nt, Homo sapiens
ucauucauuugcucacuccaca

SEQ ID NO: 126471 - RNA, 22 nt, Homo sapiens
ucauucuuucuguggaggggcu

SEQ ID NO: 126472 - RNA, 21 nt, Homo sapiens
ucauugguuggcugcccugua

SEQ ID NO: 126473 - RNA, 22 nt, Homo sapiens
uccaauguaaucaucauugaau

SEQ ID NO: 126474 - RNA, 22 nt, Homo sapiens
uccacaauggcugaacuagauu

SEQ ID NO: 126475 - RNA, 22 nt, Homo sapiens
uccacagugguugaacuaguuu

SEQ ID NO: 126476 - RNA, 20 nt, Homo sapiens
uccacugagcgucacggcag

SEQ ID NO: 126477 - RNA, 22 nt, Homo sapiens
uccacuuuugugcugaauugga

SEQ ID NO: 126478 - RNA, 17 nt, Homo sapiens
uccagauuucaauugaa

SEQ ID NO: 126479 - RNA, 22 nt, Homo sapiens
uccagguuucaugcucuuuauu

SEQ ID NO: 126480 - RNA, 22 nt, Homo sapiens
uccagugugcaggcaaguuuga

SEQ ID NO: 126481 - RNA, 22 nt, Homo sapiens
uugggauaaucacaaaguaaaa

SEQ ID NO: 126482 - RNA, 22 nt, Homo sapiens
uugggauggaaauuuguacccc

SEQ ID NO: 126483 - RNA, 23 nt, Homo sapiens
uugggcaaaucacuaacgucucc

SEQ ID NO: 126484 - RNA, 23 nt, Homo sapiens
uugggcaaaucacugagggcaga

SEQ ID NO: 126485 - RNA, 22 nt, Homo sapiens
ucccaguuuuucugaauaguca

SEQ ID NO: 126486 - RNA, 22 nt, Homo sapiens
ucccauguagcuaggauuacag

SEQ ID NO: 126487 - RNA, 22 nt, Homo sapiens
uccccaguaggcaauuaacacc

SEQ ID NO: 126488 - RNA, 22 nt, Homo sapiens
uccccgaggcuggagugcagug

SEQ ID NO: 126489 - RNA, 22 nt, Homo sapiens
uccccgucacacgcaggcuuac

SEQ ID NO: 126490 - RNA, 22 nt, Homo sapiens
ucccuagacuccugccuuucag

SEQ ID NO: 126491 - RNA, 20 nt, Homo sapiens
ucccucaaacuuuuccacug

SEQ ID NO: 126492 - RNA, 22 nt, Homo sapiens
ucccugaaaaauuggcuuaaca

SEQ ID NO: 126493 - RNA, 22 nt, Homo sapiens
ucccugaaaauuagcauuuuaa

SEQ ID NO: 126494 - RNA, 22 nt, Homo sapiens
ucccugaaagcugagauuggaa

SEQ ID NO: 126495 - RNA, 22 nt, Homo sapiens
ucccugaacacauguugagaag

SEQ ID NO: 126496 - RNA, 22 nt, Homo sapiens
ucccugacagucacagagcuac

SEQ ID NO: 126497 - RNA, 22 nt, Homo sapiens
ucccuuaaugaugaacaaugag

SEQ ID NO: 126498 - RNA, 22 nt, Homo sapiens
ucccuuagccaaauccccagcc

SEQ ID NO: 126499 - RNA, 22 nt, Homo sapiens
ucccuugguaauucuguuccuu

SEQ ID NO: 126500 - RNA, 18 nt, Homo sapiens
ucccuuuguagaugaccc

SEQ ID NO: 126501 - RNA, 21 nt, Homo sapiens
uccugagagaggaguaacucu

SEQ ID NO: 126502 - RNA, 20 nt, Homo sapiens
uccugagauucccaguucuc

SEQ ID NO: 126503 - RNA, 22 nt, Homo sapiens
uccuucaugcaucaauguaucc

SEQ ID NO: 126504 - RNA, 22 nt, Homo sapiens
uccuugaaacaggaagaauuca

SEQ ID NO: 126505 - RNA, 22 nt, Homo sapiens
uccuugagaggacagagccaua

SEQ ID NO: 126506 - RNA, 21 nt, Homo sapiens
uccuuggugaugcccugcagu

SEQ ID NO: 126507 - RNA, 23 nt, Homo sapiens
uccuugguuggcgcccuaugugu

SEQ ID NO: 126508 - RNA, 18 nt, Homo sapiens
uccuuuugggguaggaga

SEQ ID NO: 126509 - RNA, 20 nt, Homo sapiens
ucgcaccacuauacuccagc

SEQ ID NO: 126510 - RNA, 22 nt, Homo sapiens
ucgcagcucacuggagccucga

SEQ ID NO: 126511 - RNA, 22 nt, Homo sapiens
ucguucuugucaguuuauaaag

SEQ ID NO: 126512 - RNA, 22 nt, Homo sapiens
ucuaaggcaccuagagucauca

SEQ ID NO: 126513 - RNA, 22 nt, Homo sapiens
ucuaaugcucugagaacagugc

SEQ ID NO: 126514 - RNA, 22 nt, Homo sapiens
ucuacagccaguucaggaagaa

SEQ ID NO: 126515 - RNA, 22 nt, Homo sapiens
ucuacccugugagggacacagu

SEQ ID NO: 126516 - RNA, 22 nt, Homo sapiens
ucuagcacuuacuggcugugug

SEQ ID NO: 126517 - RNA, 22 nt, Homo sapiens
ucucaagaugguagaugggaau

SEQ ID NO: 126518 - RNA, 22 nt, Homo sapiens
ucucaaguggucgcaguuagau

SEQ ID NO: 126519 - RNA, 22 nt, Homo sapiens
ucucaauggguuguagacaaag

SEQ ID NO: 126520 - RNA, 22 nt, Homo sapiens
ucucacagaguugaauguuucu

SEQ ID NO: 126521 - RNA, 22 nt, Homo sapiens
ucucacauuucacagggauggg

SEQ ID NO: 126522 - RNA, 22 nt, Homo sapiens
ucucagugaaauaaauuauuuu

SEQ ID NO: 126523 - RNA, 22 nt, Homo sapiens
ucucaguggugcuggcagggga

SEQ ID NO: 126524 - RNA, 22 nt, Homo sapiens
ucucagugugguaaaaguuuuu

SEQ ID NO: 126525 - RNA, 19 nt, Homo sapiens
ucucaguguuggucaggug

SEQ ID NO: 126526 - RNA, 22 nt, Homo sapiens
ucucauggagguagagaguaaa

SEQ ID NO: 126527 - RNA, 22 nt, Homo sapiens
ucucauggcucacccugcauag

SEQ ID NO: 126528 - RNA, 22 nt, Homo sapiens
ucuccaguuuccuucgucuauc

SEQ ID NO: 126529 - RNA, 22 nt, Homo sapiens
ucuccauuguccagaugaggaa

SEQ ID NO: 126530 - RNA, 20 nt, Homo sapiens
ucucccaaacagcaggcccu

SEQ ID NO: 126531 - RNA, 17 nt, Homo sapiens
ucucccaucccuuucuc

SEQ ID NO: 126532 - RNA, 22 nt, Homo sapiens
ucucccuaccugagccgagcca

SEQ ID NO: 126533 - RNA, 22 nt, Homo sapiens
ucuccggguggcggcgaaggga

SEQ ID NO: 126534 - RNA, 22 nt, Homo sapiens
ucucugaaacucuugacauccu

SEQ ID NO: 126535 - RNA, 22 nt, Homo sapiens
ucucugacacugaccccaaaaa

SEQ ID NO: 126536 - RNA, 22 nt, Homo sapiens
ucucugagaaaaguuucuccca

SEQ ID NO: 126537 - RNA, 22 nt, Homo sapiens
ucucugauuauugcauuucauu

SEQ ID NO: 126538 - RNA, 22 nt, Homo sapiens
ucucuguuuauuuuugguguau

SEQ ID NO: 126539 - RNA, 22 nt, Homo sapiens
ucucuguuugucuguuacuggu

SEQ ID NO: 126540 - RNA, 22 nt, Homo sapiens
ucugagguuaaauuuuauaguu

SEQ ID NO: 126541 - RNA, 22 nt, Homo sapiens
ucugaguggcagaaugagcuga

SEQ ID NO: 126542 - RNA, 22 nt, Homo sapiens
ucugccaaccacaaaauuuauu

SEQ ID NO: 126543 - RNA, 22 nt, Homo sapiens
ucugccuacugagcacacagug

SEQ ID NO: 126544 - RNA, 21 nt, Homo sapiens
ucuggcccccucaaaucucau

SEQ ID NO: 126545 - RNA, 20 nt, Homo sapiens
ucuggccccuccaaaucuca

SEQ ID NO: 126546 - RNA, 22 nt, Homo sapiens
ucuggccuagaacaauuaauua

SEQ ID NO: 126547 - RNA, 22 nt, Homo sapiens
ucuggcuuuuaacaucuauaaa

SEQ ID NO: 126548 - RNA, 20 nt, Homo sapiens
ucuggguuuuggccacgccc

SEQ ID NO: 126549 - RNA, 22 nt, Homo sapiens
ucugguguuacugagccuccca

SEQ ID NO: 126550 - RNA, 22 nt, Homo sapiens
ucuguacugccaaguuucuuua

SEQ ID NO: 126551 - RNA, 22 nt, Homo sapiens
ucuguacuuccguaccuaaagu

SEQ ID NO: 126552 - RNA, 22 nt, Homo sapiens
ucugucaaaucuuauguuguag

SEQ ID NO: 126553 - RNA, 19 nt, Homo sapiens
ucugucacuggggguauuc

SEQ ID NO: 126554 - RNA, 22 nt, Homo sapiens
ucugugcauggcagaggaauga

SEQ ID NO: 126555 - RNA, 22 nt, Homo sapiens
ucugugcauuacacuuuucuca

SEQ ID NO: 126556 - RNA, 22 nt, Homo sapiens
ucugugcauuguaacaacuaaa

SEQ ID NO: 126557 - RNA, 22 nt, Homo sapiens
ucugugcauuuucuuuuagacu

SEQ ID NO: 126558 - RNA, 22 nt, Homo sapiens
ucugugcugagaguugaaaguu

SEQ ID NO: 126559 - RNA, 22 nt, Homo sapiens
ucugugguuguugcauggaaug

SEQ ID NO: 126560 - RNA, 22 nt, Homo sapiens
ucuguguuuagacccaggguag

SEQ ID NO: 126561 - RNA, 22 nt, Homo sapiens
ucuuagugcggcugcugcagcc

SEQ ID NO: 126562 - RNA, 22 nt, Homo sapiens
ucuuauuuggggaaaggguccu

SEQ ID NO: 126563 - RNA, 22 nt, Homo sapiens
ucuugcaguucccaaauucaca

SEQ ID NO: 126564 - RNA, 22 nt, Homo sapiens
ucuugcuuuugcagagcuucuc

SEQ ID NO: 126565 - RNA, 22 nt, Homo sapiens
ucuuggcaaagaauuuuuggcu

SEQ ID NO: 126566 - RNA, 20 nt, Homo sapiens
ucuugggaauguagccuagg

SEQ ID NO: 126567 - RNA, 22 nt, Homo sapiens
ucuuggguggauucauucuuuc

SEQ ID NO: 126568 - RNA, 22 nt, Homo sapiens
ucuugguaaugucacauuuccu

SEQ ID NO: 126569 - RNA, 22 nt, Homo sapiens
uuugacuacugaugguguacgc

SEQ ID NO: 126570 - RNA, 22 nt, Homo sapiens
uuugagcauuagggcaaaggca

SEQ ID NO: 126571 - RNA, 22 nt, Homo sapiens
uuugaggaaaggcauaaguagg

SEQ ID NO: 126572 - RNA, 22 nt, Homo sapiens
uuugaguaggcuuauauuuugg

SEQ ID NO: 126573 - RNA, 22 nt, Homo sapiens
uuugauugguguaccugaaagu

SEQ ID NO: 126574 - RNA, 22 nt, Homo sapiens
uuugcaauagguuguggggagg

SEQ ID NO: 126575 - RNA, 22 nt, Homo sapiens
uuugcacuucugagugugacau

SEQ ID NO: 126576 - RNA, 22 nt, Homo sapiens
uuugcacuugaaaacacucuca

SEQ ID NO: 126577 - RNA, 22 nt, Homo sapiens
uuugccaaugggaauuuuccua

SEQ ID NO: 126578 - RNA, 22 nt, Homo sapiens
uuugccuguagacacuuacccu

SEQ ID NO: 126579 - RNA, 22 nt, Homo sapiens
uuugcuuaaaucuuaaucagau

SEQ ID NO: 126580 - RNA, 20 nt, Homo sapiens
uuuggcaauaggguuuuugu

SEQ ID NO: 126581 - RNA, 22 nt, Homo sapiens
uuuggcagaaaacaagaaucug

SEQ ID NO: 126582 - RNA, 22 nt, Homo sapiens
uuuggcauuaagaugcuguauc

SEQ ID NO: 126583 - RNA, 21 nt, Homo sapiens
uuuggcauuaugucaccagag

SEQ ID NO: 126584 - RNA, 22 nt, Homo sapiens
uuuggcuauguuguaucuuucc

SEQ ID NO: 126585 - RNA, 22 nt, Homo sapiens
uuuggcuuaagauugacugcaa

SEQ ID NO: 126586 - RNA, 22 nt, Homo sapiens
uuuggcuuuugugauacguaau

SEQ ID NO: 126587 - RNA, 22 nt, Homo sapiens
uuugggaaugaguuuaucauuu

SEQ ID NO: 126588 - RNA, 22 nt, Homo sapiens
uuugggcuuuuaaucuagagca

SEQ ID NO: 126589 - RNA, 22 nt, Homo sapiens
uuuggguuaguuuuccaaucuu

SEQ ID NO: 126590 - RNA, 18 nt, Homo sapiens
uuugguccuuuauaaaca

SEQ ID NO: 126591 - RNA, 22 nt, Homo sapiens
uuugguguauauguaaacuaug

SEQ ID NO: 126592 - RNA, 22 nt, Homo sapiens
uuugguugccucuaugagccug

SEQ ID NO: 126593 - RNA, 22 nt, Homo sapiens
uuugguuuuuguuaucacucau

SEQ ID NO: 126594 - RNA, 22 nt, Homo sapiens
uuuguacacuguugguaggauu

SEQ ID NO: 126595 - RNA, 22 nt, Homo sapiens
uuuguacucccuuuagauaaaa

SEQ ID NO: 126596 - RNA, 22 nt, Homo sapiens
uuuguacuccuuggccagcuuc

SEQ ID NO: 126597 - RNA, 18 nt, Homo sapiens
uuuguacuuuuucuaaug

SEQ ID NO: 126598 - RNA, 23 nt, Homo sapiens
uuuguaguagcaugauuuauaau

SEQ ID NO: 126599 - RNA, 22 nt, Homo sapiens
uuugucacccugaauguaagau

SEQ ID NO: 126600 - RNA, 22 nt, Homo sapiens
uuugugacacaaacacauauau

SEQ ID NO: 126601 - RNA, 18 nt, Homo sapiens
uuugugcuccacaaagga

SEQ ID NO: 126602 - RNA, 22 nt, Homo sapiens
uuugugugugauuauaaaaggu

SEQ ID NO: 126603 - RNA, 22 nt, Homo sapiens
uuuguuugaagucgagacaacu

SEQ ID NO: 126604 - RNA, 22 nt, Homo sapiens
uuuuagcaaagagacugguggc

SEQ ID NO: 126605 - RNA, 22 nt, Homo sapiens
uuuuagcagccaugacaaagau

SEQ ID NO: 126606 - RNA, 22 nt, Homo sapiens
uuuuaguggaauauuuacaguu

SEQ ID NO: 126607 - RNA, 22 nt, Homo sapiens
uuuuaguggacaaagguauuua

SEQ ID NO: 126608 - RNA, 22 nt, Homo sapiens
uuuucacggugucccagagagu

SEQ ID NO: 126609 - RNA, 22 nt, Homo sapiens
uuuucaguggccauaguggaga

SEQ ID NO: 126610 - RNA, 22 nt, Homo sapiens
uuuucaguuuuccagguagccg

SEQ ID NO: 126611 - RNA, 19 nt, Homo sapiens
uuuuccccuuucuuaagac

SEQ ID NO: 126612 - RNA, 20 nt, Homo sapiens
uuuugaacuuggcaaccugu

SEQ ID NO: 126613 - RNA, 22 nt, Homo sapiens
uuuugcacauugauuugguauc

SEQ ID NO: 126614 - RNA, 20 nt, Homo sapiens
uuuugcacuccuacuaaggu

SEQ ID NO: 126615 - RNA, 22 nt, Homo sapiens
uuuugcacuguuuuaucugaca

SEQ ID NO: 126616 - RNA, 22 nt, Homo sapiens
uuuugcaggcauuggaaguuua

SEQ ID NO: 126617 - RNA, 22 nt, Homo sapiens
uuuugcaguuacagagagugag

SEQ ID NO: 126618 - RNA, 22 nt, Homo sapiens
uuuuggacuugcuccccugucc

SEQ ID NO: 126619 - RNA, 20 nt, Homo sapiens
uuuuggcuuaaagcagucug

SEQ ID NO: 126620 - RNA, 22 nt, Homo sapiens
uuuugggggugauucacacagu

SEQ ID NO: 126621 - RNA, 21 nt, Homo sapiens
uuuuggucauucaggaagaaa

SEQ ID NO: 126622 - RNA, 22 nt, Homo sapiens
uuuugguguacaauucuaugga

SEQ ID NO: 126623 - RNA, 22 nt, Homo sapiens
uuuugguuguuggguaagagua

SEQ ID NO: 126624 - RNA, 22 nt, Homo sapiens
uuuugugacuauuguaaauggg

SEQ ID NO: 126625 - RNA, 22 nt, Homo sapiens
uuuuuauggccaauccucagaa

SEQ ID NO: 126626 - RNA, 22 nt, Homo sapiens
uuuuugagaauuggugaaacac

SEQ ID NO: 126627 - RNA, 22 nt, Homo sapiens
uuuuugaguaaauauaaauugu

SEQ ID NO: 126628 - RNA, 22 nt, Homo sapiens
uuuuugaguagcuggagagcag

SEQ ID NO: 126629 - RNA, 22 nt, Homo sapiens
uuuuuggaggagguuagaucau

SEQ ID NO: 126630 - RNA, 22 nt, Homo sapiens
uuuuugugguauauugcaacaa

SEQ ID NO: 126631 - RNA, 22 nt, Homo sapiens
uuuuuugguaauugaacaauga

SEQ ID NO: 126632 - RNA, 22 nt, Homo sapiens
ugugaagauggacuaauauagu

SEQ ID NO: 126633 - RNA, 22 nt, Homo sapiens
ugugaaugauggagugucgaau

SEQ ID NO: 126634 - RNA, 22 nt, Homo sapiens
ugugaauggugcugcaaugaac

SEQ ID NO: 126635 - RNA, 22 nt, Homo sapiens
ugugaauguaagaaaauccaac

SEQ ID NO: 126636 - RNA, 22 nt, Homo sapiens
ugugacagcacgguucaacugc

SEQ ID NO: 126637 - RNA, 22 nt, Homo sapiens
ugugacagguagguaauuuuug

SEQ ID NO: 126638 - RNA, 22 nt, Homo sapiens
ugugaccaaaaucaacauaccu

SEQ ID NO: 126639 - RNA, 22 nt, Homo sapiens
ugugagacugacagggcagggu

SEQ ID NO: 126640 - RNA, 22 nt, Homo sapiens
ugugagacugguucugaaccca

SEQ ID NO: 126641 - RNA, 20 nt, Homo sapiens
ugugagacugguuuugaacu

SEQ ID NO: 126642 - RNA, 19 nt, Homo sapiens
ugugagcauuagcauuuag

SEQ ID NO: 126643 - RNA, 22 nt, Homo sapiens
ugugaucaugcuccaggcgaga

SEQ ID NO: 126644 - RNA, 22 nt, Homo sapiens
ugugaucauuucaggaauuuug

SEQ ID NO: 126645 - RNA, 22 nt, Homo sapiens
ugugaugguuuagcauuuucuu

SEQ ID NO: 126646 - RNA, 22 nt, Homo sapiens
ugugauguggagggcagaucca

SEQ ID NO: 126647 - RNA, 22 nt, Homo sapiens
ugugauuauuuaaauaggacag

SEQ ID NO: 126648 - RNA, 22 nt, Homo sapiens
ugugcacaaccugcagguuugu

SEQ ID NO: 126649 - RNA, 22 nt, Homo sapiens
ugugcacaugauauaucacaua

SEQ ID NO: 126650 - RNA, 22 nt, Homo sapiens
ugugccaaucauagggcuuggu

SEQ ID NO: 126651 - RNA, 22 nt, Homo sapiens
ugugccacuccaggaggcuguu

SEQ ID NO: 126652 - RNA, 22 nt, Homo sapiens
ugugccacugcacuccugccug

SEQ ID NO: 126653 - RNA, 22 nt, Homo sapiens
ugugccacugcacuccugggug

SEQ ID NO: 126654 - RNA, 22 nt, Homo sapiens
ugugcgcaucggggccugcuuc

SEQ ID NO: 126655 - RNA, 22 nt, Homo sapiens
ugugcgugugccuguaagaauu

SEQ ID NO: 126656 - RNA, 22 nt, Homo sapiens
ugugcuaauacauacagugcua

SEQ ID NO: 126657 - RNA, 22 nt, Homo sapiens
ugugcuauguuauucacauggg

SEQ ID NO: 126658 - RNA, 22 nt, Homo sapiens
ugugcuugcuucuucuccuagu

SEQ ID NO: 126659 - RNA, 22 nt, Homo sapiens
ugugcuuguaaaggccagagca

SEQ ID NO: 126660 - RNA, 22 nt, Homo sapiens
uguggaaauuguuguauuuaau

SEQ ID NO: 126661 - RNA, 21 nt, Homo sapiens
uguggcaauggccucacagau

SEQ ID NO: 126662 - RNA, 20 nt, Homo sapiens
uguggcacuguaucucucag

SEQ ID NO: 126663 - RNA, 22 nt, Homo sapiens
uguggcauugaauaaccuugga

SEQ ID NO: 126664 - RNA, 22 nt, Homo sapiens
uguggcuuuacagcaugguuca

SEQ ID NO: 126665 - RNA, 22 nt, Homo sapiens
uguggcuuuuucuuggcugagg

SEQ ID NO: 126666 - RNA, 22 nt, Homo sapiens
ugugguagugcuuaccugcagu

SEQ ID NO: 126667 - RNA, 22 nt, Homo sapiens
uguguaaagcuuguuccagaaa

SEQ ID NO: 126668 - RNA, 22 nt, Homo sapiens
uguguaaauagcuacggaucug

SEQ ID NO: 126669 - RNA, 22 nt, Homo sapiens
uguguaauaccuuugacuauau

SEQ ID NO: 126670 - RNA, 22 nt, Homo sapiens
ugugucuugcuggugccugcau

SEQ ID NO: 126671 - RNA, 22 nt, Homo sapiens
ugugucuuguuuauagcuuucu

SEQ ID NO: 126672 - RNA, 22 nt, Homo sapiens
uguguuugauaaguccauaguu

SEQ ID NO: 126673 - RNA, 21 nt, Homo sapiens
uguuaacaugcagauuacugg

SEQ ID NO: 126674 - RNA, 22 nt, Homo sapiens
uguuaacauggucucagucugu

SEQ ID NO: 126675 - RNA, 22 nt, Homo sapiens
uguuaacauuuuagagugggaa

SEQ ID NO: 126676 - RNA, 22 nt, Homo sapiens
uguuacagcagcacaaaaugga

SEQ ID NO: 126677 - RNA, 22 nt, Homo sapiens
uguuaucauuacguucuuaguu

SEQ ID NO: 126678 - RNA, 22 nt, Homo sapiens
uguuauguucuacuuuuaggug

SEQ ID NO: 126679 - RNA, 22 nt, Homo sapiens
uguucaauucccaccuaugagu

SEQ ID NO: 126680 - RNA, 22 nt, Homo sapiens
uguucacaguguuucuuugaga

SEQ ID NO: 126681 - RNA, 22 nt, Homo sapiens
uguucaugaguucucauuuuua

SEQ ID NO: 126682 - RNA, 22 nt, Homo sapiens
uguucauggauccaguggcuuc

SEQ ID NO: 126683 - RNA, 22 nt, Homo sapiens
uguucuggagaggcaggccaca

SEQ ID NO: 126684 - RNA, 20 nt, Homo sapiens
uguugcacucuagccugggu

SEQ ID NO: 126685 - RNA, 22 nt, Homo sapiens
uguugcuuaagccacccagucu

SEQ ID NO: 126686 - RNA, 22 nt, Homo sapiens
uguuugcuguguggaguagcag

SEQ ID NO: 126687 - RNA, 19 nt, Homo sapiens
uguuuggcuauaggucuaa

SEQ ID NO: 126688 - RNA, 22 nt, Homo sapiens
uguuuuggagguccucacuaga

SEQ ID NO: 126689 - RNA, 22 nt, Homo sapiens
uguuuuguuagcacucugggaa

SEQ ID NO: 126690 - RNA, 22 nt, Homo sapiens
uuaaagccauaccugagagagu

SEQ ID NO: 126691 - RNA, 22 nt, Homo sapiens
uuaaaggcaugguuagacaugg

SEQ ID NO: 126692 - RNA, 22 nt, Homo sapiens
uuaaaugcuagaauuuucuuug

SEQ ID NO: 126693 - RNA, 22 nt, Homo sapiens
uuaacacugccauugauacugu

SEQ ID NO: 126694 - RNA, 22 nt, Homo sapiens
uuaacagucacuuagcucauuu

SEQ ID NO: 126695 - RNA, 22 nt, Homo sapiens
uuaacagugucaaucuguagua

SEQ ID NO: 126696 - RNA, 22 nt, Homo sapiens
uuaagcaaagguaacaugagaa

SEQ ID NO: 126697 - RNA, 22 nt, Homo sapiens
uuaagcaguaguuaaggagagg

SEQ ID NO: 126698 - RNA, 18 nt, Homo sapiens
uuaaggcaggacuuuaag

SEQ ID NO: 126699 - RNA, 22 nt, Homo sapiens
uuaaggcagugcaucuggaguu

SEQ ID NO: 126700 - RNA, 22 nt, Homo sapiens
uuaaggcagugucuaugccagu

SEQ ID NO: 126701 - RNA, 22 nt, Homo sapiens
uuaaggcuuucccuauguaaaa

SEQ ID NO: 126702 - RNA, 22 nt, Homo sapiens
uuaagucacacuagacaacuga

SEQ ID NO: 126703 - RNA, 22 nt, Homo sapiens
uuaagugcucaguuacucaguu

SEQ ID NO: 126704 - RNA, 22 nt, Homo sapiens
uuaaguuaggcuucagcagucu

SEQ ID NO: 126705 - RNA, 22 nt, Homo sapiens
uuaaguuguagcuacaaauaca

SEQ ID NO: 126706 - RNA, 22 nt, Homo sapiens
uuaauacucuucuaaguagucc

SEQ ID NO: 126707 - RNA, 22 nt, Homo sapiens
uuaauacugcuuaacuuuagga

SEQ ID NO: 126708 - RNA, 22 nt, Homo sapiens
uuaaugcuuggggaguaguucu

SEQ ID NO: 126709 - RNA, 22 nt, Homo sapiens
uuacaacugucuuacugguuau

SEQ ID NO: 126710 - RNA, 21 nt, Homo sapiens
uuacaauggcuccuugaaggu

SEQ ID NO: 126711 - RNA, 22 nt, Homo sapiens
uuacacaguaggucccuaguaa

SEQ ID NO: 126712 - RNA, 22 nt, Homo sapiens
uuacaccuguaauccagcacuu

SEQ ID NO: 126713 - RNA, 22 nt, Homo sapiens
uuacagcugggugugucuggua

SEQ ID NO: 126714 - RNA, 22 nt, Homo sapiens
uuacaguaugaguaagaguucu

SEQ ID NO: 126715 - RNA, 22 nt, Homo sapiens
uuacaguauugcaaggacuagg

SEQ ID NO: 126716 - RNA, 20 nt, Homo sapiens
uuacagugggaccuuccuga

SEQ ID NO: 126717 - RNA, 22 nt, Homo sapiens
uuacagugguugcuauugugaa

SEQ ID NO: 126718 - RNA, 21 nt, Homo sapiens
uuacaguugguugugaggugg

SEQ ID NO: 126719 - RNA, 22 nt, Homo sapiens
uuacaguugugagccaccaugc

SEQ ID NO: 126720 - RNA, 22 nt, Homo sapiens
uuacaugagacugucgcuaguu

SEQ ID NO: 126721 - RNA, 22 nt, Homo sapiens
uuacaugucuugguaagguuag

SEQ ID NO: 126722 - RNA, 22 nt, Homo sapiens
gggaauguagcaaaucugcaau

SEQ ID NO: 126723 - RNA, 22 nt, Homo sapiens
gggaguagagaguuucucugac

SEQ ID NO: 126724 - RNA, 22 nt, Homo sapiens
gggaugaagcccuaggguuggu

SEQ ID NO: 126725 - RNA, 22 nt, Homo sapiens
gggaugaauuagguauguuuau

SEQ ID NO: 126726 - RNA, 20 nt, Homo sapiens
gggaugugagguacacucuu

SEQ ID NO: 126727 - RNA, 18 nt, Homo sapiens
gggcaaguugccuggcuu

SEQ ID NO: 126728 - RNA, 22 nt, Homo sapiens
gggccagaugcauuuguuauuu

SEQ ID NO: 126729 - RNA, 22 nt, Homo sapiens
gggcgagaaucggcugcucagc

SEQ ID NO: 126730 - RNA, 23 nt, Homo sapiens
gggcuagaugagagcuuccuggg

SEQ ID NO: 126731 - RNA, 22 nt, Homo sapiens
ggggaauguuaaagaauuugca

SEQ ID NO: 126732 - RNA, 19 nt, Homo sapiens
gggucaguuugaaugauua

SEQ ID NO: 126733 - RNA, 15 nt, Homo sapiens
ggguccucucccaaa

SEQ ID NO: 126734 - RNA, 22 nt, Homo sapiens
gggugguuuuaucucuucccuu

SEQ ID NO: 126735 - RNA, 22 nt, Homo sapiens
ggguucaaaucuuggcucuuac

SEQ ID NO: 126736 - RNA, 22 nt, Homo sapiens
ggguucccuucuggcucagggu

SEQ ID NO: 126737 - RNA, 22 nt, Homo sapiens
gguaaacauacugcugucuucu

SEQ ID NO: 126738 - RNA, 22 nt, Homo sapiens
gguaucuuggagagagaaguga

SEQ ID NO: 126739 - RNA, 22 nt, Homo sapiens
gguauguaggucuacgguacaa

SEQ ID NO: 126740 - RNA, 22 nt, Homo sapiens
ggucacauugcuagcauggguu

SEQ ID NO: 126741 - RNA, 22 nt, Homo sapiens
ggucagaaagacaggcauucag

SEQ ID NO: 126742 - RNA, 19 nt, Homo sapiens
ggucagcaaagucuagcug

SEQ ID NO: 126743 - RNA, 22 nt, Homo sapiens
ggucaggagaaugguaacugag

SEQ ID NO: 126744 - RNA, 22 nt, Homo sapiens
ggucaguuuucuccaggaucca

SEQ ID NO: 126745 - RNA, 21 nt, Homo sapiens
ggugagaaaggagacauagac

SEQ ID NO: 126746 - RNA, 22 nt, Homo sapiens
ggugagcacagaaugcccugag

SEQ ID NO: 126747 - RNA, 22 nt, Homo sapiens
ggugaggaaaguugaguuucua

SEQ ID NO: 126748 - RNA, 22 nt, Homo sapiens
ggugaucauugucucuaguaug

SEQ ID NO: 126749 - RNA, 22 nt, Homo sapiens
gguggucuuccccuggaguucg

SEQ ID NO: 126750 - RNA, 22 nt, Homo sapiens
gguggugguauuucagaaaaug

SEQ ID NO: 126751 - RNA, 22 nt, Homo sapiens
ggugucaguuggccccuacugg

SEQ ID NO: 126752 - RNA, 22 nt, Homo sapiens
gguuagaaacagguccucagga

SEQ ID NO: 126753 - RNA, 22 nt, Homo sapiens
guaaaugcagaugcaugaccuu

SEQ ID NO: 126754 - RNA, 18 nt, Homo sapiens
guaaauguaucuauugcc

SEQ ID NO: 126755 - RNA, 22 nt, Homo sapiens
guaacacaugcugcucucuggu

SEQ ID NO: 126756 - RNA, 22 nt, Homo sapiens
guaagauaguauguuuaaccca

SEQ ID NO: 126757 - RNA, 22 nt, Homo sapiens
guaauaacuguggaaaaagguu

SEQ ID NO: 126758 - RNA, 22 nt, Homo sapiens
guaauacuggacaggguaucag

SEQ ID NO: 126759 - RNA, 22 nt, Homo sapiens
guaaucucagcuacucaggagg

SEQ ID NO: 126760 - RNA, 22 nt, Homo sapiens
guaaucucagcuacucgggaga

SEQ ID NO: 126761 - RNA, 22 nt, Homo sapiens
guaaucucagcuacuugggagu

SEQ ID NO: 126762 - RNA, 22 nt, Homo sapiens
guaaucucagcuucuugggagg

SEQ ID NO: 126763 - RNA, 22 nt, Homo sapiens
guaaucuguaguaaagcaccau

SEQ ID NO: 126764 - RNA, 16 nt, Homo sapiens
guacacaguaaguaug

SEQ ID NO: 126765 - RNA, 22 nt, Homo sapiens
guacaugugcacagugugcagg

SEQ ID NO: 126766 - RNA, 22 nt, Homo sapiens
guacuuuguuauaacccacagg

SEQ ID NO: 126767 - RNA, 22 nt, Homo sapiens
guagaagcacagggccuguauu

SEQ ID NO: 126768 - RNA, 22 nt, Homo sapiens
guagaauguauacaguauacag

SEQ ID NO: 126769 - RNA, 22 nt, Homo sapiens
guagagagaaauacaaagcugu

SEQ ID NO: 126770 - RNA, 22 nt, Homo sapiens
guagagguagacuuccuugucu

SEQ ID NO: 126771 - RNA, 22 nt, Homo sapiens
guagagugcugggcacuggcuc

SEQ ID NO: 126772 - RNA, 22 nt, Homo sapiens
guagaugcauggauuuacuucu

SEQ ID NO: 126773 - RNA, 22 nt, Homo sapiens
guagcagcuacuaaguugcugu

SEQ ID NO: 126774 - RNA, 22 nt, Homo sapiens
guagcagucacauagcagauug

SEQ ID NO: 126775 - RNA, 22 nt, Homo sapiens
guaguuuaucagaaagaauagg

SEQ ID NO: 126776 - RNA, 22 nt, Homo sapiens
guauacacccugugauauuauu

SEQ ID NO: 126777 - RNA, 22 nt, Homo sapiens
guauagcacauaauacuugaug

SEQ ID NO: 126778 - RNA, 22 nt, Homo sapiens
guauggaauuugugaccuuaua

SEQ ID NO: 126779 - RNA, 22 nt, Homo sapiens
guauggcaugcaugagaauuuc

SEQ ID NO: 126780 - RNA, 22 nt, Homo sapiens
guauggcauuuguggauuggcc

SEQ ID NO: 126781 - RNA, 22 nt, Homo sapiens
guauuagaugguauuugaagau

SEQ ID NO: 126782 - RNA, 22 nt, Homo sapiens
guauuaguuuccuguugcugcu

SEQ ID NO: 126783 - RNA, 22 nt, Homo sapiens
guauugacuaucaaucaugugc

SEQ ID NO: 126784 - RNA, 22 nt, Homo sapiens
guauugaguaaauguuuauugg

SEQ ID NO: 126785 - RNA, 19 nt, Homo sapiens
guauuugacuuucuuguuu

SEQ ID NO: 126786 - RNA, 19 nt, Homo sapiens
guauuugguaaacucucca

SEQ ID NO: 126787 - RNA, 22 nt, Homo sapiens
guauuuguugcagcagcacuau

SEQ ID NO: 126788 - RNA, 22 nt, Homo sapiens
gucaaagugauuguaauuaggu

SEQ ID NO: 126789 - RNA, 22 nt, Homo sapiens
gucaacauauuaauuauguucu

SEQ ID NO: 126790 - RNA, 22 nt, Homo sapiens
gucaaggaauuuauccauuucu

SEQ ID NO: 126791 - RNA, 22 nt, Homo sapiens
gucagcaaaguucuccugcaga

SEQ ID NO: 126792 - RNA, 22 nt, Homo sapiens
gucaggcaccgauacaguuuuu

SEQ ID NO: 126793 - RNA, 22 nt, Homo sapiens
gucagggagucucuaucagugg

SEQ ID NO: 126794 - RNA, 22 nt, Homo sapiens
gucagucugucccugccuggcg

SEQ ID NO: 126795 - RNA, 22 nt, Homo sapiens
gucagugcauguaaacauaaaa

SEQ ID NO: 126796 - RNA, 18 nt, Homo sapiens
gucauagaaugaugguuc

SEQ ID NO: 126797 - RNA, 22 nt, Homo sapiens
gucauauaggguuuaccuguau

SEQ ID NO: 126798 - RNA, 22 nt, Homo sapiens
gucaucaggacgggucaucugc

SEQ ID NO: 126799 - RNA, 22 nt, Homo sapiens
gucauccaggcuggagugaagc

SEQ ID NO: 126800 - RNA, 22 nt, Homo sapiens
gucaugaaguuuugaaugaaau

SEQ ID NO: 126801 - RNA, 22 nt, Homo sapiens
gucauucauucagcaagcacug

SEQ ID NO: 126802 - RNA, 22 nt, Homo sapiens
guccaguuguuuucugagguug

SEQ ID NO: 126803 - RNA, 22 nt, Homo sapiens
guccauuuguuuccagagcacu

SEQ ID NO: 126804 - RNA, 22 nt, Homo sapiens
gucccagagauauugugucuuu

SEQ ID NO: 126805 - RNA, 22 nt, Homo sapiens
uaucagagcugucagccuaccu

SEQ ID NO: 126806 - RNA, 22 nt, Homo sapiens
uaucagaguuacacugaagacu

SEQ ID NO: 126807 - RNA, 22 nt, Homo sapiens
ugucucagugauuggcuuucug

SEQ ID NO: 126808 - RNA, 22 nt, Homo sapiens
ugucucaguuacggcaauucca

SEQ ID NO: 126809 - RNA, 22 nt, Homo sapiens
ugucuugagagaggacaugacu

SEQ ID NO: 126810 - RNA, 22 nt, Homo sapiens
ugucuuggagaauccuggguuu

SEQ ID NO: 126811 - RNA, 22 nt, Homo sapiens
ugucuuguagacaauguauagu

SEQ ID NO: 126812 - RNA, 22 nt, Homo sapiens
ugugaaacacgaaagucuaaaa

SEQ ID NO: 126813 - RNA, 22 nt, Homo sapiens
ugugaaacauggauagaacugg

SEQ ID NO: 126814 - RNA, 21 nt, Homo sapiens
ugugaaaucuaggcagagguu

SEQ ID NO: 126815 - RNA, 20 nt, Homo sapiens
ugugaacuguagauagucuu

SEQ ID NO: 126816 - RNA, 19 nt, Homo sapiens
ugugaagaaaugcugcaag

SEQ ID NO: 126817 - RNA, 22 nt, Homo sapiens
gcccugauacauucuucugccu

SEQ ID NO: 126818 - RNA, 22 nt, Homo sapiens
gcccuguaguauaguuugaagu

SEQ ID NO: 126819 - RNA, 22 nt, Homo sapiens
gcccuguguuuggguaugguca

SEQ ID NO: 126820 - RNA, 22 nt, Homo sapiens
gccuguagaagaguagaugacc

SEQ ID NO: 126821 - RNA, 22 nt, Homo sapiens
gcgguagcauagacugcaggac

SEQ ID NO: 126822 - RNA, 22 nt, Homo sapiens
gcgguuuuaagugaguuucuua

SEQ ID NO: 126823 - RNA, 22 nt, Homo sapiens
gcuauggccugaauguuugugu

SEQ ID NO: 126824 - RNA, 22 nt, Homo sapiens
gcuaugucuguugcucuugggc

SEQ ID NO: 126825 - RNA, 22 nt, Homo sapiens
gcuccauuuuccauuucucuaa

SEQ ID NO: 126826 - RNA, 22 nt, Homo sapiens
gcucuuuugggguaauucugag

SEQ ID NO: 126827 - RNA, 17 nt, Homo sapiens
gcugauguuugcauuuu

SEQ ID NO: 126828 - RNA, 22 nt, Homo sapiens
gcugcuguaccagaugugguua

SEQ ID NO: 126829 - RNA, 22 nt, Homo sapiens
gcugcuguuauucaucagaacu

SEQ ID NO: 126830 - RNA, 22 nt, Homo sapiens
gcuggcuuucuccugaucucag

SEQ ID NO: 126831 - RNA, 22 nt, Homo sapiens
gcuggguucagagugggcugcg

SEQ ID NO: 126832 - RNA, 22 nt, Homo sapiens
gcuggucugccguaguaggugc

SEQ ID NO: 126833 - RNA, 22 nt, Homo sapiens
gcuggugacuuuaaguugaagc

SEQ ID NO: 126834 - RNA, 22 nt, Homo sapiens
gcugguguugugaaucaggccg

SEQ ID NO: 126835 - RNA, 22 nt, Homo sapiens
gcuguaguugaggauuuuaaga

SEQ ID NO: 126836 - RNA, 22 nt, Homo sapiens
gcugugauucuguguagauagu

SEQ ID NO: 126837 - RNA, 22 nt, Homo sapiens
gcuguguugugcccagcaucau

SEQ ID NO: 126838 - RNA, 22 nt, Homo sapiens
gcuguugugaacuauacaucua

SEQ ID NO: 126839 - RNA, 22 nt, Homo sapiens
gcuucauggaggcugggcgcag

SEQ ID NO: 126840 - RNA, 19 nt, Homo sapiens
gcuucuugaggacgaugac

SEQ ID NO: 126841 - RNA, 22 nt, Homo sapiens
gcuuguguuuacuguaguuacu

SEQ ID NO: 126842 - RNA, 22 nt, Homo sapiens
gcuuuguugauggugagucugu

SEQ ID NO: 126843 - RNA, 21 nt, Homo sapiens
ggaaaguuaaggaaauacccc

SEQ ID NO: 126844 - RNA, 23 nt, Homo sapiens
ggaaauguuuaagggguugggag

SEQ ID NO: 126845 - RNA, 22 nt, Homo sapiens
ggaauauaaaaagccccagaau

SEQ ID NO: 126846 - RNA, 23 nt, Homo sapiens
ggaaugaaaccugguuaugauau

SEQ ID NO: 126847 - RNA, 19 nt, Homo sapiens
ggaaugcaccaguccuugc

SEQ ID NO: 126848 - RNA, 22 nt, Homo sapiens
ggaaugcuaaaauaggaugcug

SEQ ID NO: 126849 - RNA, 22 nt, Homo sapiens
ggaaugggauuugaagucuggc

SEQ ID NO: 126850 - RNA, 22 nt, Homo sapiens
ggaauguaguaauuugguuagu

SEQ ID NO: 126851 - RNA, 22 nt, Homo sapiens
ggacaaaguauuuucaaaugua

SEQ ID NO: 126852 - RNA, 22 nt, Homo sapiens
ggacagaaaggguucaccaaac

SEQ ID NO: 126853 - RNA, 22 nt, Homo sapiens
ggacagaugggcucccgggucu

SEQ ID NO: 126854 - RNA, 22 nt, Homo sapiens
ggacauguauauauaugugugu

SEQ ID NO: 126855 - RNA, 22 nt, Homo sapiens
ggacuaggagcuaggaagaucu

SEQ ID NO: 126856 - RNA, 19 nt, Homo sapiens
ggacugucauggaguaguu

SEQ ID NO: 126857 - RNA, 22 nt, Homo sapiens
ggagaucuuguuaaaguacaga

SEQ ID NO: 126858 - RNA, 22 nt, Homo sapiens
ggagaucuuuaggaguuggacu

SEQ ID NO: 126859 - RNA, 22 nt, Homo sapiens
ggagaucuuugaaguguugugc

SEQ ID NO: 126860 - RNA, 22 nt, Homo sapiens
ggaggcuaguaaaaagguagaa

SEQ ID NO: 126861 - RNA, 22 nt, Homo sapiens
ggagguaauaaguuccagugua

SEQ ID NO: 126862 - RNA, 22 nt, Homo sapiens
ggagguagguuugugauuugua

SEQ ID NO: 126863 - RNA, 22 nt, Homo sapiens
ggagguagucuuucccuuauca

SEQ ID NO: 126864 - RNA, 20 nt, Homo sapiens
ggagguguugauuuuucuuu

SEQ ID NO: 126865 - RNA, 22 nt, Homo sapiens
ggaguaaaagaguaggaggaau

SEQ ID NO: 126866 - RNA, 21 nt, Homo sapiens
ggaguauaaggcaaaggagug

SEQ ID NO: 126867 - RNA, 22 nt, Homo sapiens
ggagucugauuuuuauguugcu

SEQ ID NO: 126868 - RNA, 22 nt, Homo sapiens
ggagucuugcuauguugccaag

SEQ ID NO: 126869 - RNA, 22 nt, Homo sapiens
ggagugugauucaguauaauau

SEQ ID NO: 126870 - RNA, 22 nt, Homo sapiens
ggaguguuccauuugucacauu

SEQ ID NO: 126871 - RNA, 22 nt, Homo sapiens
ggaguuuaagucuugugcaucu

SEQ ID NO: 126872 - RNA, 22 nt, Homo sapiens
ggauacauuuuuccuccucuuc

SEQ ID NO: 126873 - RNA, 22 nt, Homo sapiens
ggauauguagggcauaucuaca

SEQ ID NO: 126874 - RNA, 22 nt, Homo sapiens
ggauugcuuaagaaguuucauu

SEQ ID NO: 126875 - RNA, 22 nt, Homo sapiens
ggcaagaaccagggauuugcgu

SEQ ID NO: 126876 - RNA, 22 nt, Homo sapiens
ggcaagaaccucaauuaccuuu

SEQ ID NO: 126877 - RNA, 22 nt, Homo sapiens
ggcaagaagaacuauaacuuuu

SEQ ID NO: 126878 - RNA, 21 nt, Homo sapiens
ggcaagagaauacaacauaaa

SEQ ID NO: 126879 - RNA, 22 nt, Homo sapiens
ggcaagauagauaucaguguca

SEQ ID NO: 126880 - RNA, 22 nt, Homo sapiens
ggcaagaucuuggcucacugaa

SEQ ID NO: 126881 - RNA, 22 nt, Homo sapiens
ggcaaguauguuuuaggaugcu

SEQ ID NO: 126882 - RNA, 22 nt, Homo sapiens
ggcaaguugcuauucuuuaaug

SEQ ID NO: 126883 - RNA, 22 nt, Homo sapiens
ggcaaugucagcuaaugaugga

SEQ ID NO: 126884 - RNA, 22 nt, Homo sapiens
ggcacaguuaagugcuaccuaa

SEQ ID NO: 126885 - RNA, 22 nt, Homo sapiens
ggcacgguggcucacaccugua

SEQ ID NO: 126886 - RNA, 22 nt, Homo sapiens
ggcagacuguggaguucuuucu

SEQ ID NO: 126887 - RNA, 22 nt, Homo sapiens
ggcagaucauuggccucaguuu

SEQ ID NO: 126888 - RNA, 22 nt, Homo sapiens
ggcagcacaauuuucugaugga

SEQ ID NO: 126889 - RNA, 22 nt, Homo sapiens
ggcagcuguguccuucguaagg

SEQ ID NO: 126890 - RNA, 17 nt, Homo sapiens
ggcaggaauuaauguca

SEQ ID NO: 126891 - RNA, 22 nt, Homo sapiens
ggcaguguaauaauuuauuaau

SEQ ID NO: 126892 - RNA, 22 nt, Homo sapiens
ggcaguguggcugcauauagca

SEQ ID NO: 126893 - RNA, 22 nt, Homo sapiens
ggcaguuuguucuugcuccuuu

SEQ ID NO: 126894 - RNA, 22 nt, Homo sapiens
ggcaugguggugugugccuaua

SEQ ID NO: 126895 - RNA, 22 nt, Homo sapiens
ggcauguugauagguagaugua

SEQ ID NO: 126896 - RNA, 22 nt, Homo sapiens
ggcauguuuaguagaauguggu

SEQ ID NO: 126897 - RNA, 22 nt, Homo sapiens
ggcauugugauccaccagccuu

SEQ ID NO: 126898 - RNA, 22 nt, Homo sapiens
auguauacauagauacgugugu

SEQ ID NO: 126899 - RNA, 22 nt, Homo sapiens
augucaaagaggaaaacuggau

SEQ ID NO: 126900 - RNA, 22 nt, Homo sapiens
augucaaggugggugauaguuu

SEQ ID NO: 126901 - RNA, 22 nt, Homo sapiens
augucauagaagccugugaacc

SEQ ID NO: 126902 - RNA, 22 nt, Homo sapiens
augucauagauaaggaagugga

SEQ ID NO: 126903 - RNA, 22 nt, Homo sapiens
auguccaugagcacauguauca

SEQ ID NO: 126904 - RNA, 22 nt, Homo sapiens
auguccauggaaucuguagcaa

SEQ ID NO: 126905 - RNA, 22 nt, Homo sapiens
auguccuggacccagacaaagc

SEQ ID NO: 126906 - RNA, 22 nt, Homo sapiens
augucuagagcaagagaugcug

SEQ ID NO: 126907 - RNA, 22 nt, Homo sapiens
augucuuucauagagacccaga

SEQ ID NO: 126908 - RNA, 22 nt, Homo sapiens
augugacagcaacccccagccc

SEQ ID NO: 126909 - RNA, 22 nt, Homo sapiens
augugcaaaguuaagaucccag

SEQ ID NO: 126910 - RNA, 22 nt, Homo sapiens
augugcaauggugucaccacau

SEQ ID NO: 126911 - RNA, 22 nt, Homo sapiens
augugcacaugcuuacauguga

SEQ ID NO: 126912 - RNA, 22 nt, Homo sapiens
augugcacauucugguaaauau

SEQ ID NO: 126913 - RNA, 22 nt, Homo sapiens
augugcuugagggaaaucaguu

SEQ ID NO: 126914 - RNA, 22 nt, Homo sapiens
auguggaaauguauaugugucu

SEQ ID NO: 126915 - RNA, 22 nt, Homo sapiens
auguggcauuucucauucauuu

SEQ ID NO: 126916 - RNA, 22 nt, Homo sapiens
augugggaggacuuggcuguug

SEQ ID NO: 126917 - RNA, 22 nt, Homo sapiens
augugguaguuauagugauaag

SEQ ID NO: 126918 - RNA, 22 nt, Homo sapiens
auguguaaagcuuuucuuuguu

SEQ ID NO: 126919 - RNA, 22 nt, Homo sapiens
augugucaaaucuaggccaaag

SEQ ID NO: 126920 - RNA, 22 nt, Homo sapiens
auguguucaucacagcacaauu

SEQ ID NO: 126921 - RNA, 22 nt, Homo sapiens
auguuauguucuucucuguaua

SEQ ID NO: 126922 - RNA, 18 nt, Homo sapiens
auguuauguuuguagaag

SEQ ID NO: 126923 - RNA, 22 nt, Homo sapiens
auuaaggaguggguucauggug

SEQ ID NO: 126924 - RNA, 22 nt, Homo sapiens
uaugcacaugcaugcuugaaua

SEQ ID NO: 126925 - RNA, 22 nt, Homo sapiens
uaugccuuugaccauuuuguga

SEQ ID NO: 126926 - RNA, 19 nt, Homo sapiens
uaugcuauuuauuagaagu

SEQ ID NO: 126927 - RNA, 22 nt, Homo sapiens
uauggacuuuaggauagcuuuu

SEQ ID NO: 126928 - RNA, 22 nt, Homo sapiens
uauggauuugccuauucuguau

SEQ ID NO: 126929 - RNA, 22 nt, Homo sapiens
uauggcauuguuggugaugaua

SEQ ID NO: 126930 - RNA, 22 nt, Homo sapiens
uauggccacugucuuugaguca

SEQ ID NO: 126931 - RNA, 21 nt, Homo sapiens
uauggcuuagucaguguuucc

SEQ ID NO: 126932 - RNA, 22 nt, Homo sapiens
uauggcuuuuaacugucguaug

SEQ ID NO: 126933 - RNA, 22 nt, Homo sapiens
uauggcuuuuauuauguuguag

SEQ ID NO: 126934 - RNA, 22 nt, Homo sapiens
uaugggucuuaaaucacuuagu

SEQ ID NO: 126935 - RNA, 20 nt, Homo sapiens
uaugguuuuagguauagcau

SEQ ID NO: 126936 - RNA, 17 nt, Homo sapiens
uauguaguacuuauaaa

SEQ ID NO: 126937 - RNA, 22 nt, Homo sapiens
uaugucuauuauguagcaggaa

SEQ ID NO: 126938 - RNA, 22 nt, Homo sapiens
uaugucuucuuuagagaaaugu

SEQ ID NO: 126939 - RNA, 22 nt, Homo sapiens
uauuagguuggggcaaaaguaa

SEQ ID NO: 126940 - RNA, 22 nt, Homo sapiens
uauucaagccaaauucaagcca

SEQ ID NO: 126941 - RNA, 22 nt, Homo sapiens
uauuccauuugggucaggauga

SEQ ID NO: 126942 - RNA, 22 nt, Homo sapiens
uauuccauuugugaaaggaagu

SEQ ID NO: 126943 - RNA, 22 nt, Homo sapiens
uauugaacgugggauauugaag

SEQ ID NO: 126944 - RNA, 22 nt, Homo sapiens
uauugaauuuuuaagcccuuug

SEQ ID NO: 126945 - RNA, 22 nt, Homo sapiens
uauugcacuccagccuuggcaa

SEQ ID NO: 126946 - RNA, 22 nt, Homo sapiens
uauugcacuccucaugcauuug

SEQ ID NO: 126947 - RNA, 22 nt, Homo sapiens
uauugcagauacccaggaaguu

SEQ ID NO: 126948 - RNA, 22 nt, Homo sapiens
uauugcauuugagguugguuga

SEQ ID NO: 126949 - RNA, 22 nt, Homo sapiens
uauugcccugcuuuguucuaaa

SEQ ID NO: 126950 - RNA, 22 nt, Homo sapiens
uauugcuaaauucuuuuccuag

SEQ ID NO: 126951 - RNA, 22 nt, Homo sapiens
uauugcuuaugaugcugaauua

SEQ ID NO: 126952 - RNA, 22 nt, Homo sapiens
uauugcuuuugauucaaggcag

SEQ ID NO: 126953 - RNA, 22 nt, Homo sapiens
uauugucacuaaaggaagcugg

SEQ ID NO: 126954 - RNA, 22 nt, Homo sapiens
uauuugauuaacaagagccuaa

SEQ ID NO: 126955 - RNA, 22 nt, Homo sapiens
uauuugauugacuuuagcagga

SEQ ID NO: 126956 - RNA, 22 nt, Homo sapiens
uauuuggauagucuggaaaaaa

SEQ ID NO: 126957 - RNA, 22 nt, Homo sapiens
uauuugguagcuauuuugcagu

SEQ ID NO: 126958 - RNA, 22 nt, Homo sapiens
uauuugguuauaugaguaaguu

SEQ ID NO: 126959 - RNA, 20 nt, Homo sapiens
uauuugguuauuuccauggu

SEQ ID NO: 126960 - RNA, 22 nt, Homo sapiens
ucaaacacuccauaucgcgauu

SEQ ID NO: 126961 - RNA, 20 nt, Homo sapiens
ucaaagacauggcugucaga

SEQ ID NO: 126962 - RNA, 22 nt, Homo sapiens
ucaaaguagaaaaggggcaauu

SEQ ID NO: 126963 - RNA, 20 nt, Homo sapiens
ucaaaguaugcucugcacua

SEQ ID NO: 126964 - RNA, 22 nt, Homo sapiens
ucaaagugacaaaguugcagca

SEQ ID NO: 126965 - RNA, 21 nt, Homo sapiens
ucaaaguguucuuuuguugaa

SEQ ID NO: 126966 - RNA, 18 nt, Homo sapiens
ucaaauacuuugggcagu

SEQ ID NO: 126967 - RNA, 22 nt, Homo sapiens
ucaaaugauucacccaccuuug

SEQ ID NO: 126968 - RNA, 22 nt, Homo sapiens
ucaaauuccaagucuagguagg

SEQ ID NO: 126969 - RNA, 20 nt, Homo sapiens
ucaaauucuuggccuccagc

SEQ ID NO: 126970 - RNA, 21 nt, Homo sapiens
ucaaauugaaauuaggucauu

SEQ ID NO: 126971 - RNA, 22 nt, Homo sapiens
ucaagaccucacauagaggaga

SEQ ID NO: 126972 - RNA, 22 nt, Homo sapiens
ucaagcaauucgccugucucag

SEQ ID NO: 126973 - RNA, 22 nt, Homo sapiens
ucaagcaauucuccugccucag

SEQ ID NO: 126974 - RNA, 22 nt, Homo sapiens
ucaaggacuacauggggugaaa

SEQ ID NO: 126975 - RNA, 22 nt, Homo sapiens
ucaaggcacauuugacauuuuc

SEQ ID NO: 126976 - RNA, 20 nt, Homo sapiens
ucaaggcaggaacuguacau

SEQ ID NO: 126977 - RNA, 22 nt, Homo sapiens
ucaaguaguaacuaacugugac

SEQ ID NO: 126978 - RNA, 22 nt, Homo sapiens
ucaaugcaugugacaaagagua

SEQ ID NO: 126979 - RNA, 22 nt, Homo sapiens
ucacaagugagaggaauuagau

SEQ ID NO: 126980 - RNA, 22 nt, Homo sapiens
ucacacugaauuugaagcaaug

SEQ ID NO: 126981 - RNA, 19 nt, Homo sapiens
ucacacuguggcuucuuua

SEQ ID NO: 126982 - RNA, 22 nt, Homo sapiens
ucacagauaaauaaagaugauu

SEQ ID NO: 126983 - RNA, 22 nt, Homo sapiens
ucacagcuaaaaugaaaguagu

SEQ ID NO: 126984 - RNA, 22 nt, Homo sapiens
ucacaggguguuauuagaauua

SEQ ID NO: 126985 - RNA, 22 nt, Homo sapiens
ucacaguagggaacugacaaag

SEQ ID NO: 126986 - RNA, 22 nt, Homo sapiens
ucacaguauucaugaacaugga

SEQ ID NO: 126987 - RNA, 22 nt, Homo sapiens
ucacagucaaaguaaucauaga

SEQ ID NO: 126988 - RNA, 22 nt, Homo sapiens
ucacaguucagcauggcugagg

SEQ ID NO: 126989 - RNA, 22 nt, Homo sapiens
ucacaguuggccuggccuuuua

SEQ ID NO: 126990 - RNA, 22 nt, Homo sapiens
ucacauagcauaaugucugcaa

SEQ ID NO: 126991 - RNA, 21 nt, Homo sapiens
ucacaucguuuagcugugccu

SEQ ID NO: 126992 - RNA, 22 nt, Homo sapiens
ucacaugaagauuuuaguauac

SEQ ID NO: 126993 - RNA, 22 nt, Homo sapiens
ucacaugaauugucuuguucca

SEQ ID NO: 126994 - RNA, 22 nt, Homo sapiens
ucacauggaaaaguccaguaaa

SEQ ID NO: 126995 - RNA, 22 nt, Homo sapiens
ucacauggaggugauaguugaa

SEQ ID NO: 126996 - RNA, 22 nt, Homo sapiens
ucacaugugaagauugggagua

SEQ ID NO: 126997 - RNA, 22 nt, Homo sapiens
ucaccagugucagggaacugcu

SEQ ID NO: 126998 - RNA, 22 nt, Homo sapiens
ucacccugacaugcggccgaac

SEQ ID NO: 126999 - RNA, 22 nt, Homo sapiens
ucaccuggagagcuugcuaaua

SEQ ID NO: 127000 - RNA, 22 nt, Homo sapiens
ucaccuggagccuucacauucu

SEQ ID NO: 127001 - RNA, 22 nt, Homo sapiens
ucacuaggcuggagugcagugg

SEQ ID NO: 127002 - RNA, 22 nt, Homo sapiens
ucacuauagaaaacagugugga

SEQ ID NO: 127003 - RNA, 22 nt, Homo sapiens
ucacugagaaugauguuucuga

SEQ ID NO: 127004 - RNA, 21 nt, Homo sapiens
ucacugagcaucaugguuuca

SEQ ID NO: 127005 - RNA, 22 nt, Homo sapiens
ucacugcacuccagccuuuaug

SEQ ID NO: 127006 - RNA, 22 nt, Homo sapiens
ucacugcgaccuccaccucccg

SEQ ID NO: 127007 - RNA, 22 nt, Homo sapiens
ucacugcgaccuccaccuccug

SEQ ID NO: 127008 - RNA, 22 nt, Homo sapiens
ucacuggacucuagccugggug

SEQ ID NO: 127009 - RNA, 20 nt, Homo sapiens
ucacuggagcucauuugauu

SEQ ID NO: 127010 - RNA, 22 nt, Homo sapiens
ucacuggaggagaggaagugga

SEQ ID NO: 127011 - RNA, 22 nt, Homo sapiens
ucacugggagcauuugagccuu

SEQ ID NO: 127012 - RNA, 22 nt, Homo sapiens
ucacugugagaguuuauccugu

SEQ ID NO: 127013 - RNA, 22 nt, Homo sapiens
ucacugugcacauaugauaggu

SEQ ID NO: 127014 - RNA, 22 nt, Homo sapiens
ugagcagagaagugcccugcgc

SEQ ID NO: 127015 - RNA, 22 nt, Homo sapiens
ugagcagaguuguuucuccuga

SEQ ID NO: 127016 - RNA, 21 nt, Homo sapiens
ugagcauuaguacaguaggga

SEQ ID NO: 127017 - RNA, 22 nt, Homo sapiens
ugagccaugguuagcuucucau

SEQ ID NO: 127018 - RNA, 22 nt, Homo sapiens
ugagcuagagaguuuaguguca

SEQ ID NO: 127019 - RNA, 22 nt, Homo sapiens
ugagcuagggccuggaauaggg

SEQ ID NO: 127020 - RNA, 22 nt, Homo sapiens
ugagcucaugcauucuugagga

SEQ ID NO: 127021 - RNA, 22 nt, Homo sapiens
ugagcugagaucuuaccacugc

SEQ ID NO: 127022 - RNA, 22 nt, Homo sapiens
ugagcuguuugaagaagcauuu

SEQ ID NO: 127023 - RNA, 22 nt, Homo sapiens
ugaggagugaacuauuucugau

SEQ ID NO: 127024 - RNA, 22 nt, Homo sapiens
ugaggagugagaaauugguuuc

SEQ ID NO: 127025 - RNA, 22 nt, Homo sapiens
ugaggcaagauacugauuucau

SEQ ID NO: 127026 - RNA, 22 nt, Homo sapiens
ugaggcacucuagacuuauuca

SEQ ID NO: 127027 - RNA, 22 nt, Homo sapiens
ugagguaugugaugucuuuuag

SEQ ID NO: 127028 - RNA, 22 nt, Homo sapiens
ugaggucacuuguuuuaugcuu

SEQ ID NO: 127029 - RNA, 22 nt, Homo sapiens
ugaggucuuuauuuagugcuca

SEQ ID NO: 127030 - RNA, 22 nt, Homo sapiens
ugagguguuugugcaccaucug

SEQ ID NO: 127031 - RNA, 22 nt, Homo sapiens
uauaugucuuuguuauguugag

SEQ ID NO: 127032 - RNA, 23 nt, Homo sapiens
uauaugugucuaggagcuauggu

SEQ ID NO: 127033 - RNA, 22 nt, Homo sapiens
uauauguuuucauaaggcuaga

SEQ ID NO: 127034 - RNA, 22 nt, Homo sapiens
uaucaagaugacaaacuuugcu

SEQ ID NO: 127035 - RNA, 19 nt, Homo sapiens
uaucaaguaugcacuguac

SEQ ID NO: 127036 - RNA, 22 nt, Homo sapiens
uaucacaaacuuagcaguuuaa

SEQ ID NO: 127037 - RNA, 23 nt, Homo sapiens
uaucacacuuucucugugccaca

SEQ ID NO: 127038 - RNA, 22 nt, Homo sapiens
uaucacagcaaggacccauuau

SEQ ID NO: 127039 - RNA, 22 nt, Homo sapiens
uaucacagcauugucuauaaua

SEQ ID NO: 127040 - RNA, 22 nt, Homo sapiens
uaucacagcgggguguacaccc

SEQ ID NO: 127041 - RNA, 21 nt, Homo sapiens
uaucacauuggugauuaaguu

SEQ ID NO: 127042 - RNA, 22 nt, Homo sapiens
uaucacugucaggcccucauau

SEQ ID NO: 127043 - RNA, 22 nt, Homo sapiens
uauccugaagcuuuauuuaagu

SEQ ID NO: 127044 - RNA, 22 nt, Homo sapiens
uaucucaguguacaggaugaua

SEQ ID NO: 127045 - RNA, 20 nt, Homo sapiens
uaucucaguuuguccuaaac

SEQ ID NO: 127046 - RNA, 22 nt, Homo sapiens
uaucucuguggguagugcugaa

SEQ ID NO: 127047 - RNA, 22 nt, Homo sapiens
uaucugcacauacacuuauagc

SEQ ID NO: 127048 - RNA, 22 nt, Homo sapiens
uaugaaagcuacuucucacaau

SEQ ID NO: 127049 - RNA, 22 nt, Homo sapiens
uaugaaucugagagaucuggaa

SEQ ID NO: 127050 - RNA, 22 nt, Homo sapiens
uaugaccuuguccccucucgcc

SEQ ID NO: 127051 - RNA, 22 nt, Homo sapiens
uaugacucagaaggcacacaca

SEQ ID NO: 127052 - RNA, 22 nt, Homo sapiens
uaugacuuuugaauacagaugg

SEQ ID NO: 127053 - RNA, 22 nt, Homo sapiens
uaugagagcugguagguagaga

SEQ ID NO: 127054 - RNA, 22 nt, Homo sapiens
uaugaucauuauguuauugcag

SEQ ID NO: 127055 - RNA, 22 nt, Homo sapiens
uaugaugcuguuuagaaucucu

SEQ ID NO: 127056 - RNA, 22 nt, Homo sapiens
uaugauuuuugggagaggucaa

SEQ ID NO: 127057 - RNA, 22 nt, Homo sapiens
uaugcacacguguccaugugca

SEQ ID NO: 127058 - RNA, 22 nt, Homo sapiens
agcaccagaaucugaguuauuc

SEQ ID NO: 127059 - RNA, 22 nt, Homo sapiens
agcaccauugcacuccagccug

SEQ ID NO: 127060 - RNA, 22 nt, Homo sapiens
agcaccauuucucuaaagcacu

SEQ ID NO: 127061 - RNA, 22 nt, Homo sapiens
agcaccguucaaacccagguua

SEQ ID NO: 127062 - RNA, 22 nt, Homo sapiens
agcagagcauauucauucgggg

SEQ ID NO: 127063 - RNA, 21 nt, Homo sapiens
agcagaguggcagcucuuuug

SEQ ID NO: 127064 - RNA, 22 nt, Homo sapiens
agcagcaccaaacagacuaaga

SEQ ID NO: 127065 - RNA, 22 nt, Homo sapiens
agcagcauauuuuuauaaugua

SEQ ID NO: 127066 - RNA, 21 nt, Homo sapiens
agcagcuuugguugaagcaga

SEQ ID NO: 127067 - RNA, 22 nt, Homo sapiens
agcaggauuguuacaauaguaa

SEQ ID NO: 127068 - RNA, 22 nt, Homo sapiens
agcagguguggcuuauccugaa

SEQ ID NO: 127069 - RNA, 22 nt, Homo sapiens
agcagugucauuuucuggugag

SEQ ID NO: 127070 - RNA, 22 nt, Homo sapiens
agcauagugccuugaaaacaau

SEQ ID NO: 127071 - RNA, 19 nt, Homo sapiens
agcaucauuauuguuuugg

SEQ ID NO: 127072 - RNA, 22 nt, Homo sapiens
agcaugauugggguugggcaca

SEQ ID NO: 127073 - RNA, 22 nt, Homo sapiens
agcauggucacuuugggcccca

SEQ ID NO: 127074 - RNA, 22 nt, Homo sapiens
agccaguuuggcuaauuuuggc

SEQ ID NO: 127075 - RNA, 17 nt, Homo sapiens
agccccauuagcuaguu

SEQ ID NO: 127076 - RNA, 22 nt, Homo sapiens
agccccauuuguugaaaagacg

SEQ ID NO: 127077 - RNA, 22 nt, Homo sapiens
agccuagagagccacuuugaga

SEQ ID NO: 127078 - RNA, 22 nt, Homo sapiens
agcggcuguuccccuggucuau

SEQ ID NO: 127079 - RNA, 22 nt, Homo sapiens
agcuaaaucucauguugaauug

SEQ ID NO: 127080 - RNA, 22 nt, Homo sapiens
agcuacuguuagucuaguuagg

SEQ ID NO: 127081 - RNA, 20 nt, Homo sapiens
agcuaguauuuccaugguua

SEQ ID NO: 127082 - RNA, 22 nt, Homo sapiens
agcucacagccuagcacuguga

SEQ ID NO: 127083 - RNA, 22 nt, Homo sapiens
agcucauugcaaccuccgccuc

SEQ ID NO: 127084 - RNA, 22 nt, Homo sapiens
agcuccaucuucagggguucag

SEQ ID NO: 127085 - RNA, 22 nt, Homo sapiens
agcuccauuguaaucaccuggu

SEQ ID NO: 127086 - RNA, 17 nt, Homo sapiens
agcuggaauuacgggag

SEQ ID NO: 127087 - RNA, 22 nt, Homo sapiens
agcuggaauuuaagguagauag

SEQ ID NO: 127088 - RNA, 20 nt, Homo sapiens
agcuggguguguuggugcau

SEQ ID NO: 127089 - RNA, 22 nt, Homo sapiens
agcuggucuacguguguaugag

SEQ ID NO: 127090 - RNA, 22 nt, Homo sapiens
agcuggucuuggggaagaguag

SEQ ID NO: 127091 - RNA, 21 nt, Homo sapiens
agcugguuucuucuuacuccu

SEQ ID NO: 127092 - RNA, 20 nt, Homo sapiens
agcugguuuuaugaaucuuu

SEQ ID NO: 127093 - RNA, 22 nt, Homo sapiens
agcuguaguuuauucauguuaa

SEQ ID NO: 127094 - RNA, 22 nt, Homo sapiens
agcuguaguuugguggauguaa

SEQ ID NO: 127095 - RNA, 22 nt, Homo sapiens
agcugugucuucuuaaagauuu

SEQ ID NO: 127096 - RNA, 19 nt, Homo sapiens
agcuguguugccugugaga

SEQ ID NO: 127097 - RNA, 22 nt, Homo sapiens
agcuucauucugaauagguuga

SEQ ID NO: 127098 - RNA, 20 nt, Homo sapiens
agcuugguuuggaugaucac

SEQ ID NO: 127099 - RNA, 22 nt, Homo sapiens
agcuuguagugauuugugguaa

SEQ ID NO: 127100 - RNA, 22 nt, Homo sapiens
agcuugugauucuccaucaugu

SEQ ID NO: 127101 - RNA, 22 nt, Homo sapiens
agcuugugauuuagagugagag

SEQ ID NO: 127102 - RNA, 22 nt, Homo sapiens
agcuuguuuucccauaacuaga

SEQ ID NO: 127103 - RNA, 19 nt, Homo sapiens
agcuuuggcuaacuuucuc

SEQ ID NO: 127104 - RNA, 22 nt, Homo sapiens
agcuuuuugggaggccuuagga

SEQ ID NO: 127105 - RNA, 23 nt, Homo sapiens
aggaaguaacuaucuuuucuguc

SEQ ID NO: 127106 - RNA, 22 nt, Homo sapiens
aggaaucuaagguaucagguua

SEQ ID NO: 127107 - RNA, 22 nt, Homo sapiens
aggaaugcuaaguuuuccuccu

SEQ ID NO: 127108 - RNA, 22 nt, Homo sapiens
aggaauggaaacuuuugauggu

SEQ ID NO: 127109 - RNA, 22 nt, Homo sapiens
aggaauguuaguacuucuuagu

SEQ ID NO: 127110 - RNA, 22 nt, Homo sapiens
aggaccauuguguagcagacau

SEQ ID NO: 127111 - RNA, 22 nt, Homo sapiens
aggagaugaagcuuuaucuaaa

SEQ ID NO: 127112 - RNA, 21 nt, Homo sapiens
aggagauguuuguccuuuuag

SEQ ID NO: 127113 - RNA, 22 nt, Homo sapiens
aaaagagcugagagguauucuu

SEQ ID NO: 127114 - RNA, 22 nt, Homo sapiens
aaacauugaccucauccuggca

SEQ ID NO: 127115 - RNA, 18 nt, Homo sapiens
aaacugcuuccuuggccu

SEQ ID NO: 127116 - RNA, 22 nt, Homo sapiens
aaacugcuuuccaugguggcug

SEQ ID NO: 127117 - RNA, 21 nt, Homo sapiens
aaacuggcccaauuguuccau

SEQ ID NO: 127118 - RNA, 22 nt, Homo sapiens
aaacugucuucugacaguuucc

SEQ ID NO: 127119 - RNA, 22 nt, Homo sapiens
aaagcagcaggugguuuucaau

SEQ ID NO: 127120 - RNA, 22 nt, Homo sapiens
aaaggcacacacuccuuguuau

SEQ ID NO: 127121 - RNA, 22 nt, Homo sapiens
aaaggcacuagaaguuaccuuu

SEQ ID NO: 127122 - RNA, 22 nt, Homo sapiens
aaaggcacugaucuuauccagu

SEQ ID NO: 127123 - RNA, 22 nt, Homo sapiens
aaaggcuucggaucagaaggua

SEQ ID NO: 127124 - RNA, 19 nt, Homo sapiens
aaagguaguaaccucugau

SEQ ID NO: 127125 - RNA, 22 nt, Homo sapiens
aaagugacuuagugccccauuu

SEQ ID NO: 127126 - RNA, 18 nt, Homo sapiens
aaagugaugucauucuuu

SEQ ID NO: 127127 - RNA, 22 nt, Homo sapiens
aaagugcacuuggaagagggcc

SEQ ID NO: 127128 - RNA, 22 nt, Homo sapiens
aaagugcugggauuaggccagg

SEQ ID NO: 127129 - RNA, 22 nt, Homo sapiens
aaagugcugggauuggcugggc

SEQ ID NO: 127130 - RNA, 22 nt, Homo sapiens
aaagugcugggauuuuaggcau

SEQ ID NO: 127131 - RNA, 22 nt, Homo sapiens
aaagugcuguagacugggcgca

SEQ ID NO: 127132 - RNA, 22 nt, Homo sapiens
aaauaguagcugaaugagggaa

SEQ ID NO: 127133 - RNA, 22 nt, Homo sapiens
aaaugccucccauucuacugac

SEQ ID NO: 127134 - RNA, 22 nt, Homo sapiens
aaaugcugucugugagccucau

SEQ ID NO: 127135 - RNA, 22 nt, Homo sapiens
aaaugguguuaguagaucuuua

SEQ ID NO: 127136 - RNA, 22 nt, Homo sapiens
aaauugcuuuugaagacuuagu

SEQ ID NO: 127137 - RNA, 22 nt, Homo sapiens
aacaccuugcagggauuaugac

SEQ ID NO: 127138 - RNA, 22 nt, Homo sapiens
aacacuaucugccuuacaggga

SEQ ID NO: 127139 - RNA, 22 nt, Homo sapiens
aacaggguggugccugguccau

SEQ ID NO: 127140 - RNA, 22 nt, Homo sapiens
aacagugcauuccuguccauau

SEQ ID NO: 127141 - RNA, 22 nt, Homo sapiens
aacagugccugucauuuaguag

SEQ ID NO: 127142 - RNA, 20 nt, Homo sapiens
aacaguguguaaguuuccuu

SEQ ID NO: 127143 - RNA, 22 nt, Homo sapiens
aacauguuuagcagauaccugu

SEQ ID NO: 127144 - RNA, 22 nt, Homo sapiens
aaccuacauucuuaacuguugc

SEQ ID NO: 127145 - RNA, 22 nt, Homo sapiens
aacucacauucuuucuugguac

SEQ ID NO: 127146 - RNA, 22 nt, Homo sapiens
aacuggcauaugaacuuguucu

SEQ ID NO: 127147 - RNA, 22 nt, Homo sapiens
aacuggcauguuuuaaggcuua

SEQ ID NO: 127148 - RNA, 22 nt, Homo sapiens
aacuggccuggcgugcagaggg

SEQ ID NO: 127149 - RNA, 22 nt, Homo sapiens
aacugggcaagcauuacauggu

SEQ ID NO: 127150 - RNA, 22 nt, Homo sapiens
aagagcauuggauggggagauu

SEQ ID NO: 127151 - RNA, 22 nt, Homo sapiens
aagagguagaagcuugccuucu

SEQ ID NO: 127152 - RNA, 22 nt, Homo sapiens
aagagguagcagucacaaaaga

SEQ ID NO: 127153 - RNA, 22 nt, Homo sapiens
aagagguuuaacugacucacag

SEQ ID NO: 127154 - RNA, 22 nt, Homo sapiens
aagagugucuuugugcuggccc

SEQ ID NO: 127155 - RNA, 22 nt, Homo sapiens
aagauaguaaacauuuucugcu

SEQ ID NO: 127156 - RNA, 22 nt, Homo sapiens
aagaugcagucauacuggagga

SEQ ID NO: 127157 - RNA, 22 nt, Homo sapiens
aagaugguauuucauuaguuuu

SEQ ID NO: 127158 - RNA, 20 nt, Homo sapiens
aagcaagcauuugcaaucau

SEQ ID NO: 127159 - RNA, 22 nt, Homo sapiens
aagcacaauuucaccuucuugu

SEQ ID NO: 127160 - RNA, 22 nt, Homo sapiens
aagcaccaauaggagauuuguc

SEQ ID NO: 127161 - RNA, 22 nt, Homo sapiens
aagcaggugaugagugggugug

SEQ ID NO: 127162 - RNA, 22 nt, Homo sapiens
aagcaugguuuccaggggucac

SEQ ID NO: 127163 - RNA, 22 nt, Homo sapiens
aagcuacuuuggugguuccuua

SEQ ID NO: 127164 - RNA, 22 nt, Homo sapiens
aagcuccauuucugccaugaga

SEQ ID NO: 127165 - RNA, 22 nt, Homo sapiens
aagcuggagugcaguggugcaa

SEQ ID NO: 127166 - RNA, 22 nt, Homo sapiens
aagcuggagugcaguggugcga

SEQ ID NO: 127167 - RNA, 22 nt, Homo sapiens
aagcuggauuucgcauccuguu

SEQ ID NO: 127168 - RNA, 22 nt, Homo sapiens
aagcugguguugcugcucuguu

SEQ ID NO: 127169 - RNA, 22 nt, Homo sapiens
aagcuguguguaagcucucaca

SEQ ID NO: 127170 - RNA, 22 nt, Homo sapiens
aagcuguuguucauccugaauu

SEQ ID NO: 127171 - RNA, 22 nt, Homo sapiens
aaggaacuggaauauuuugaac

SEQ ID NO: 127172 - RNA, 22 nt, Homo sapiens
aaggaauucaaauuuucucugg

SEQ ID NO: 127173 - RNA, 22 nt, Homo sapiens
aaggagcagagagcccuguuuc

SEQ ID NO: 127174 - RNA, 22 nt, Homo sapiens
aaggaguguggugaucuugggc

SEQ ID NO: 127175 - RNA, 22 nt, Homo sapiens
aaggcaagagaaaauuucgagu

SEQ ID NO: 127176 - RNA, 22 nt, Homo sapiens
aaggcacugaacuuaaauucug

SEQ ID NO: 127177 - RNA, 22 nt, Homo sapiens
aaggcagucacuaaauagugag

SEQ ID NO: 127178 - RNA, 22 nt, Homo sapiens
aaggcaguggcagaagauguca

SEQ ID NO: 127179 - RNA, 22 nt, Homo sapiens
aaggcaugcugaguccuaaaag

SEQ ID NO: 127180 - RNA, 22 nt, Homo sapiens
aaggcauggugacuauuuaggc

SEQ ID NO: 127181 - RNA, 22 nt, Homo sapiens
uaucagaucccaauuucuggcc

SEQ ID NO: 127182 - RNA, 22 nt, Homo sapiens
uaucagcacaguggguucaugg

SEQ ID NO: 127183 - RNA, 22 nt, Homo sapiens
uaucagcagagucauacuucaa

SEQ ID NO: 127184 - RNA, 22 nt, Homo sapiens
uaucagcagcaggggcugcaga

SEQ ID NO: 127185 - RNA, 22 nt, Homo sapiens
uaucaguauggauucauggauu

SEQ ID NO: 127186 - RNA, 22 nt, Homo sapiens
uaucauaguuuggacuuucauu

SEQ ID NO: 127187 - RNA, 22 nt, Homo sapiens
uaucaucauguuuuugcugugu

SEQ ID NO: 127188 - RNA, 22 nt, Homo sapiens
uaucccuguggacuucccaaca

SEQ ID NO: 127189 - RNA, 23 nt, Homo sapiens
uaucccuugccuuaugaugugag

SEQ ID NO: 127190 - RNA, 22 nt, Homo sapiens
uaucucagagaaucagauuuac

SEQ ID NO: 127191 - RNA, 21 nt, Homo sapiens
uaucucaguuuuccuuugugg

SEQ ID NO: 127192 - RNA, 18 nt, Homo sapiens
uaucucauuucuuagguc

SEQ ID NO: 127193 - RNA, 22 nt, Homo sapiens
uaugaauuuuauccaggauaua

SEQ ID NO: 127194 - RNA, 20 nt, Homo sapiens
uaugacaaagccuagugagu

SEQ ID NO: 127195 - RNA, 22 nt, Homo sapiens
uaugacuuuggaaaaauuacuu

SEQ ID NO: 127196 - RNA, 22 nt, Homo sapiens
uaugagguagguaugacuauca

SEQ ID NO: 127197 - RNA, 21 nt, Homo sapiens
uaugagucugcaagaaccaca

SEQ ID NO: 127198 - RNA, 22 nt, Homo sapiens
uaugcacacacguguuuaugug

SEQ ID NO: 127199 - RNA, 22 nt, Homo sapiens
uaugcacuaggcacuguguuug

SEQ ID NO: 127200 - RNA, 22 nt, Homo sapiens
uaugccuuuugguucaagcaac

SEQ ID NO: 127201 - RNA, 19 nt, Homo sapiens
uaugcuagagagggaagcu

SEQ ID NO: 127202 - RNA, 22 nt, Homo sapiens
uaugcuguuucugauuuaggga

SEQ ID NO: 127203 - RNA, 22 nt, Homo sapiens
uaugcuuauuaaaacagugugu

SEQ ID NO: 127204 - RNA, 22 nt, Homo sapiens
uauggauguuaagguucacagc

SEQ ID NO: 127205 - RNA, 22 nt, Homo sapiens
uauggcuauggcuguggcuaug

SEQ ID NO: 127206 - RNA, 22 nt, Homo sapiens
uauggcuuuucacuuaaguccu

SEQ ID NO: 127207 - RNA, 19 nt, Homo sapiens
uaugggauuuuuagggugu

SEQ ID NO: 127208 - RNA, 22 nt, Homo sapiens
uauggucuuugagaggugacug

SEQ ID NO: 127209 - RNA, 22 nt, Homo sapiens
uaugucaugggguuuuugagau

SEQ ID NO: 127210 - RNA, 18 nt, Homo sapiens
uauuaagcuagauauuau

SEQ ID NO: 127211 - RNA, 22 nt, Homo sapiens
uauuacacuuuagugucuucca

SEQ ID NO: 127212 - RNA, 22 nt, Homo sapiens
uauuacauccauaggcucugcu

SEQ ID NO: 127213 - RNA, 22 nt, Homo sapiens
uauuacugucaauaucacagaa

SEQ ID NO: 127214 - RNA, 22 nt, Homo sapiens
uauuagguuggugcaaaaguaa

SEQ ID NO: 127215 - RNA, 22 nt, Homo sapiens
uauuagguuggugcaaaaguua

SEQ ID NO: 127216 - RNA, 22 nt, Homo sapiens
uauuagugucuuuugguuagaa

SEQ ID NO: 127217 - RNA, 22 nt, Homo sapiens
uauuaugcacuuuauaaaaauu

SEQ ID NO: 127218 - RNA, 18 nt, Homo sapiens
uauuccucuuccucuauc

SEQ ID NO: 127219 - RNA, 22 nt, Homo sapiens
uauuccuuuugcauuuccacau

SEQ ID NO: 127220 - RNA, 22 nt, Homo sapiens
uauugauuaauugugauuaggc

SEQ ID NO: 127221 - RNA, 23 nt, Homo sapiens
uauugcacuaugguaacccuuuu

SEQ ID NO: 127222 - RNA, 22 nt, Homo sapiens
uauugcacuuuuccauaggagu

SEQ ID NO: 127223 - RNA, 22 nt, Homo sapiens
uauugccugucuccaaaaauca

SEQ ID NO: 127224 - RNA, 22 nt, Homo sapiens
uauugcuaaaacucaugguugc

SEQ ID NO: 127225 - RNA, 22 nt, Homo sapiens
uauugcucaugcauuuaauuuc

SEQ ID NO: 127226 - RNA, 22 nt, Homo sapiens
uauugcuggcacauaguagguc

SEQ ID NO: 127227 - RNA, 22 nt, Homo sapiens
uauugcuugaggaaaugguaau

SEQ ID NO: 127228 - RNA, 18 nt, Homo sapiens
uauugcuugguuuggaga

SEQ ID NO: 127229 - RNA, 22 nt, Homo sapiens
uauuggcucuguuucucugaag

SEQ ID NO: 127230 - RNA, 22 nt, Homo sapiens
uauuguacauauccucccuuca

SEQ ID NO: 127231 - RNA, 22 nt, Homo sapiens
uauugucaccaucccuguuuua

SEQ ID NO: 127232 - RNA, 22 nt, Homo sapiens
uauuuggugaaugaaugcaugu

SEQ ID NO: 127233 - RNA, 22 nt, Homo sapiens
uauuugguuacuugaauagcua

SEQ ID NO: 127234 - RNA, 22 nt, Homo sapiens
uauuugguuggugcaaaaguaa

SEQ ID NO: 127235 - RNA, 22 nt, Homo sapiens
ucaaacauccccaccagggacu

SEQ ID NO: 127236 - RNA, 22 nt, Homo sapiens
ucaaaguaaagccucaggaugg

SEQ ID NO: 127237 - RNA, 22 nt, Homo sapiens
ucaaagugcuauggcucagguu

SEQ ID NO: 127238 - RNA, 22 nt, Homo sapiens
ucaaaugcucuuugcagagagg

SEQ ID NO: 127239 - RNA, 22 nt, Homo sapiens
ucaaauguucccuguacuggcc

SEQ ID NO: 127240 - RNA, 22 nt, Homo sapiens
ucaaauguuuguuuaaggcuua

SEQ ID NO: 127241 - RNA, 22 nt, Homo sapiens
ucaacaggucaauugcauagaa

SEQ ID NO: 127242 - RNA, 22 nt, Homo sapiens
ucaacugcuugagaucacaaau

SEQ ID NO: 127243 - RNA, 22 nt, Homo sapiens
ucaagcaauucugcugccucag

SEQ ID NO: 127244 - RNA, 22 nt, Homo sapiens
ucaaggcacuagcugagcugca

SEQ ID NO: 127245 - RNA, 22 nt, Homo sapiens
ucaaguacugccuugcucuggc

SEQ ID NO: 127246 - RNA, 18 nt, Homo sapiens
ucaauguggauguucuuu

SEQ ID NO: 127247 - RNA, 22 nt, Homo sapiens
ucacaaagcuuggccugcuucu

SEQ ID NO: 127248 - RNA, 20 nt, Homo sapiens
ucacaagccaagaucacguc

SEQ ID NO: 127249 - RNA, 22 nt, Homo sapiens
ucacaauggagacucgggcgga

SEQ ID NO: 127250 - RNA, 22 nt, Homo sapiens
ucacaauggcugaacuaauuua

SEQ ID NO: 127251 - RNA, 22 nt, Homo sapiens
ucacaauguaaaugaggguugg

SEQ ID NO: 127252 - RNA, 22 nt, Homo sapiens
ucacacucucaccaacauuugg

SEQ ID NO: 127253 - RNA, 22 nt, Homo sapiens
ucacacugaaacuaggguguga

SEQ ID NO: 127254 - RNA, 22 nt, Homo sapiens
ucacacugcaucuguuggaauu

SEQ ID NO: 127255 - RNA, 22 nt, Homo sapiens
ucacacuguuuugauuauuaua

SEQ ID NO: 127256 - RNA, 22 nt, Homo sapiens
ucacagacauugaggggaccuu

SEQ ID NO: 127257 - RNA, 22 nt, Homo sapiens
ucacagaugcuugacccauuuc

SEQ ID NO: 127258 - RNA, 19 nt, Homo sapiens
ucacaggguugacuugagg

SEQ ID NO: 127259 - RNA, 18 nt, Homo sapiens
ucacagguaaaguugaca

SEQ ID NO: 127260 - RNA, 22 nt, Homo sapiens
ucacagugaguggaguggggug

SEQ ID NO: 127261 - RNA, 22 nt, Homo sapiens
ucacagugcaggaucaguuaau

SEQ ID NO: 127262 - RNA, 22 nt, Homo sapiens
ucacaguugauugaaacacagc

SEQ ID NO: 127263 - RNA, 22 nt, Homo sapiens
ucacauagcugaguaaaaugga

SEQ ID NO: 127264 - RNA, 22 nt, Homo sapiens
ucacauaguuuucgggaccuug

SEQ ID NO: 127265 - RNA, 22 nt, Homo sapiens
ucacaugugacauauauauuug

SEQ ID NO: 127266 - RNA, 22 nt, Homo sapiens
ucaccaccugcugauuguagag

SEQ ID NO: 127267 - RNA, 22 nt, Homo sapiens
ucaccuggggcacagcugaaga

SEQ ID NO: 127268 - RNA, 21 nt, Homo sapiens
ucaccuguagcugcauguucu

SEQ ID NO: 127269 - RNA, 19 nt, Homo sapiens
ucaccuugcccugcacaca

SEQ ID NO: 127270 - RNA, 22 nt, Homo sapiens
ucacgcugcugcaaccagccug

SEQ ID NO: 127271 - RNA, 23 nt, Homo sapiens
uuguacacuaagaaucgcagaug

SEQ ID NO: 127272 - RNA, 22 nt, Homo sapiens
uuguacaggaguguaagcuuca

SEQ ID NO: 127273 - RNA, 22 nt, Homo sapiens
uuguacccuuucuaugaggcca

SEQ ID NO: 127274 - RNA, 22 nt, Homo sapiens
uuguacuauuuuuaucagugau

SEQ ID NO: 127275 - RNA, 22 nt, Homo sapiens
uuguagaucuucaguugcuaca

SEQ ID NO: 127276 - RNA, 22 nt, Homo sapiens
uuguagcaaauauauuuuggaa

SEQ ID NO: 127277 - RNA, 22 nt, Homo sapiens
uuguagcaaauguguaaacaaa

SEQ ID NO: 127278 - RNA, 22 nt, Homo sapiens
uuguaguagucucguucuuuua

SEQ ID NO: 127279 - RNA, 21 nt, Homo sapiens
uuguaugguugaacuugauac

SEQ ID NO: 127280 - RNA, 22 nt, Homo sapiens
uuguauugucuugaugaguuga

SEQ ID NO: 127281 - RNA, 22 nt, Homo sapiens
uugucaaacucauucuccaucc

SEQ ID NO: 127282 - RNA, 22 nt, Homo sapiens
uugucccauggggucuuccuuu

SEQ ID NO: 127283 - RNA, 22 nt, Homo sapiens
uuguccuugagauaguuugcag

SEQ ID NO: 127284 - RNA, 22 nt, Homo sapiens
uuguccuugagauaguuugcug

SEQ ID NO: 127285 - RNA, 22 nt, Homo sapiens
uugucuccuagacgaccaggcg

SEQ ID NO: 127286 - RNA, 19 nt, Homo sapiens
uugucuuagaguugucauu

SEQ ID NO: 127287 - RNA, 22 nt, Homo sapiens
uugugaauggaguagcaggauc

SEQ ID NO: 127288 - RNA, 22 nt, Homo sapiens
uugugagggagcuaagaugagu

SEQ ID NO: 127289 - RNA, 22 nt, Homo sapiens
uugugcauaucagagguuugcu

SEQ ID NO: 127290 - RNA, 22 nt, Homo sapiens
uugugcaugaugcauacauggu

SEQ ID NO: 127291 - RNA, 22 nt, Homo sapiens
uugugcauguauauuaguucac

SEQ ID NO: 127292 - RNA, 22 nt, Homo sapiens
uugugccugguacauggagaaa

SEQ ID NO: 127293 - RNA, 22 nt, Homo sapiens
uugugcuugauuugccuagcug

SEQ ID NO: 127294 - RNA, 22 nt, Homo sapiens
uugugcuuuacuuacuaccaga

SEQ ID NO: 127295 - RNA, 22 nt, Homo sapiens
uugugggaggugauuagaucau

SEQ ID NO: 127296 - RNA, 22 nt, Homo sapiens
uugugguuuuaucuaccuuugg

SEQ ID NO: 127297 - RNA, 22 nt, Homo sapiens
uugugguuuuuaaaacuaggug

SEQ ID NO: 127298 - RNA, 22 nt, Homo sapiens
uugugucaaauggcaauuagca

SEQ ID NO: 127299 - RNA, 22 nt, Homo sapiens
uuguguuugaugcugacacgca

SEQ ID NO: 127300 - RNA, 22 nt, Homo sapiens
uuguuuagagacuggaauuaaa

SEQ ID NO: 127301 - RNA, 22 nt, Homo sapiens
uuuaaagcuaaaauauguuuau

SEQ ID NO: 127302 - RNA, 22 nt, Homo sapiens
uuuaaggcaggucuggugguga

SEQ ID NO: 127303 - RNA, 22 nt, Homo sapiens
uuuaaugcaucccaaaauguag

SEQ ID NO: 127304 - RNA, 22 nt, Homo sapiens
uuuacaguuuucuaggcuacca

SEQ ID NO: 127305 - RNA, 21 nt, Homo sapiens
uuuacuguggacccauugcuu

SEQ ID NO: 127306 - RNA, 22 nt, Homo sapiens
uuuagguauuugguauagcagu

SEQ ID NO: 127307 - RNA, 23 nt, Homo sapiens
uuuaguccccuaugagcuggugu

SEQ ID NO: 127308 - RNA, 22 nt, Homo sapiens
uuuaguucauuaaggaaucucc

SEQ ID NO: 127309 - RNA, 22 nt, Homo sapiens
uuuauguggagcacuugacaca

SEQ ID NO: 127310 - RNA, 22 nt, Homo sapiens
uuuauucggcuaggagcuucgg

SEQ ID NO: 127311 - RNA, 23 nt, Homo sapiens
uuucacagaaggauuguagggcc

SEQ ID NO: 127312 - RNA, 23 nt, Homo sapiens
uuucacaguagcuggaucagccu

SEQ ID NO: 127313 - RNA, 22 nt, Homo sapiens
uuucagguauuuaagggccguu

SEQ ID NO: 127314 - RNA, 23 nt, Homo sapiens
uuucaguaguuguauccuguugc

SEQ ID NO: 127315 - RNA, 22 nt, Homo sapiens
uuucaguguggcaggcauagcu

SEQ ID NO: 127316 - RNA, 22 nt, Homo sapiens
uuucauagccuucuaaugaguu

SEQ ID NO: 127317 - RNA, 22 nt, Homo sapiens
uuucauagccuuugucgucuga

SEQ ID NO: 127318 - RNA, 16 nt, Homo sapiens
uuucaucaguuuuaau

SEQ ID NO: 127319 - RNA, 22 nt, Homo sapiens
uuucauggacgcaaugccuuuu

SEQ ID NO: 127320 - RNA, 22 nt, Homo sapiens
uuucauggaggauuugcuucuu

SEQ ID NO: 127321 - RNA, 22 nt, Homo sapiens
uuucauggcaguuuggggccug

SEQ ID NO: 127322 - RNA, 22 nt, Homo sapiens
uuuccaagaugcuuacuuucuc

SEQ ID NO: 127323 - RNA, 22 nt, Homo sapiens
uuuccaguuggaaagccuguuu

SEQ ID NO: 127324 - RNA, 22 nt, Homo sapiens
uuuccaguuggaagaaggggga

SEQ ID NO: 127325 - RNA, 22 nt, Homo sapiens
uuuccaguuuggaggaugcauu

SEQ ID NO: 127326 - RNA, 22 nt, Homo sapiens
uuucccagugguacaguuuaua

SEQ ID NO: 127327 - RNA, 22 nt, Homo sapiens
uuuccuggagaaucuuaacaaa

SEQ ID NO: 127328 - RNA, 22 nt, Homo sapiens
uuuccuguagggggcaaggccu

SEQ ID NO: 127329 - RNA, 15 nt, Homo sapiens
uuucuacugcacuuc

SEQ ID NO: 127330 - RNA, 22 nt, Homo sapiens
uuucuauguugaccagucuaga

SEQ ID NO: 127331 - RNA, 22 nt, Homo sapiens
uuucucaguguuucaggguagg

SEQ ID NO: 127332 - RNA, 20 nt, Homo sapiens
uuucuccccuauaaaucuca

SEQ ID NO: 127333 - RNA, 22 nt, Homo sapiens
uuucugcuugagagaauugcug

SEQ ID NO: 127334 - RNA, 22 nt, Homo sapiens
uuucugguuaauuucuaagagc

SEQ ID NO: 127335 - RNA, 22 nt, Homo sapiens
uuucuuggagcucuuagggucg

SEQ ID NO: 127336 - RNA, 22 nt, Homo sapiens
uuugaaccauuugaagaaugau

SEQ ID NO: 127337 - RNA, 22 nt, Homo sapiens
uuugaagugugaugccuugaug

SEQ ID NO: 127338 - RNA, 22 nt, Homo sapiens
uuugaauggaaguuuugugaaa

SEQ ID NO: 127339 - RNA, 22 nt, Homo sapiens
uuugacacugggagugugggug

SEQ ID NO: 127340 - RNA, 22 nt, Homo sapiens
uuugacucacagccuggcugcc

SEQ ID NO: 127341 - RNA, 22 nt, Homo sapiens
uuugacuuuuagaauaugaguu

SEQ ID NO: 127342 - RNA, 22 nt, Homo sapiens
uuugagaucuuuagaaucaggc

SEQ ID NO: 127343 - RNA, 22 nt, Homo sapiens
uuugagcaggcuaaucaauaua

SEQ ID NO: 127344 - RNA, 22 nt, Homo sapiens
uuugagcauggaaauggcauga

SEQ ID NO: 127345 - RNA, 22 nt, Homo sapiens
uuugagguguauggcaaguuga

SEQ ID NO: 127346 - RNA, 22 nt, Homo sapiens
uuugagugugauaucgauugga

SEQ ID NO: 127347 - RNA, 22 nt, Homo sapiens
uuugaguuugaggugcugauga

SEQ ID NO: 127348 - RNA, 21 nt, Homo sapiens
uuugaucauuaaaagugaauc

SEQ ID NO: 127349 - RNA, 22 nt, Homo sapiens
uuugauguccaccucagcccac

SEQ ID NO: 127350 - RNA, 22 nt, Homo sapiens
uuugcacauauuugggcaaaag

SEQ ID NO: 127351 - RNA, 23 nt, Homo sapiens
uuugcacuugcuccuucuauggc

SEQ ID NO: 127352 - RNA, 21 nt, Homo sapiens
uuugcacuuugcaaaucccua

SEQ ID NO: 127353 - RNA, 22 nt, Homo sapiens
uuugcaucuuagaaaguucucc

SEQ ID NO: 127354 - RNA, 22 nt, Homo sapiens
uuugcuuaguaaauguagaaaa

SEQ ID NO: 127355 - RNA, 22 nt, Homo sapiens
uuuggaaugugcacucagauug

SEQ ID NO: 127356 - RNA, 22 nt, Homo sapiens
uuuggauagugugguccuuuua

SEQ ID NO: 127357 - RNA, 22 nt, Homo sapiens
uuuggccauguuggucaggcug

SEQ ID NO: 127358 - RNA, 22 nt, Homo sapiens
uuuggcucugugucccacccaa

SEQ ID NO: 127359 - RNA, 21 nt, Homo sapiens
uuuggcuucucugcugcagcc

SEQ ID NO: 127360 - RNA, 22 nt, Homo sapiens
uuuggcuuuuguaauaacugcc

SEQ ID NO: 127361 - RNA, 22 nt, Homo sapiens
uuugggaaaugaaguugguaga

SEQ ID NO: 127362 - RNA, 22 nt, Homo sapiens
uuugguccuccuacagggcagg

SEQ ID NO: 127363 - RNA, 22 nt, Homo sapiens
uuuguaagaugcauagauugca

SEQ ID NO: 127364 - RNA, 22 nt, Homo sapiens
uucauggaguuuaaauuguagu

SEQ ID NO: 127365 - RNA, 22 nt, Homo sapiens
uucaugucuuggcuguuagagu

SEQ ID NO: 127366 - RNA, 22 nt, Homo sapiens
uuccaauguuccguguugcagu

SEQ ID NO: 127367 - RNA, 22 nt, Homo sapiens
ccaguuuucaagauaaugguuu

SEQ ID NO: 127368 - RNA, 22 nt, Homo sapiens
ccaguuuuuggcaaugaugaau

SEQ ID NO: 127369 - RNA, 20 nt, Homo sapiens
ccaucaguccucucuuguuc

SEQ ID NO: 127370 - RNA, 22 nt, Homo sapiens
ccaugaacuagaauagaacaug

SEQ ID NO: 127371 - RNA, 21 nt, Homo sapiens
ccaugggacggaaugaauaca

SEQ ID NO: 127372 - RNA, 21 nt, Homo sapiens
cccagguucucugaggguaga

SEQ ID NO: 127373 - RNA, 22 nt, Homo sapiens
cccaguguguuguggauauuua

SEQ ID NO: 127374 - RNA, 22 nt, Homo sapiens
cccaguguuacgugacagccug

SEQ ID NO: 127375 - RNA, 22 nt, Homo sapiens
cccaguuuugccacuuacuagc

SEQ ID NO: 127376 - RNA, 22 nt, Homo sapiens
cccaguuuugcuucucaugagg

SEQ ID NO: 127377 - RNA, 22 nt, Homo sapiens
ccccauguucucucugcagcuc

SEQ ID NO: 127378 - RNA, 22 nt, Homo sapiens
ccccggguggauguacauguga

SEQ ID NO: 127379 - RNA, 22 nt, Homo sapiens
ccccggguucugucugcccuug

SEQ ID NO: 127380 - RNA, 17 nt, Homo sapiens
ccccugagcgaugcagu

SEQ ID NO: 127381 - RNA, 21 nt, Homo sapiens
ccccugauacuuagucaagag

SEQ ID NO: 127382 - RNA, 22 nt, Homo sapiens
ccccuguaucucagcgucuuca

SEQ ID NO: 127383 - RNA, 22 nt, Homo sapiens
cccgggcugaaaucagauuugu

SEQ ID NO: 127384 - RNA, 23 nt, Homo sapiens
cccucagaagugcagggagagaa

SEQ ID NO: 127385 - RNA, 22 nt, Homo sapiens
cccuguagcagcauucuuaaau

SEQ ID NO: 127386 - RNA, 22 nt, Homo sapiens
cccuucauucaaggguugugag

SEQ ID NO: 127387 - RNA, 22 nt, Homo sapiens
ccucacaaccuuuauugaagag

SEQ ID NO: 127388 - RNA, 22 nt, Homo sapiens
ccucaguguuuaucauuauuuu

SEQ ID NO: 127389 - RNA, 22 nt, Homo sapiens
ccucuuuguugagacuucacca

SEQ ID NO: 127390 - RNA, 22 nt, Homo sapiens
ccuggaagaaaggugcuaaaua

SEQ ID NO: 127391 - RNA, 22 nt, Homo sapiens
ccuggaaugaagcuuauauugc

SEQ ID NO: 127392 - RNA, 22 nt, Homo sapiens
ccuggaucauugucauucccaa

SEQ ID NO: 127393 - RNA, 22 nt, Homo sapiens
ccuggcacugagcaguguucua

SEQ ID NO: 127394 - RNA, 22 nt, Homo sapiens
ccugucuugaagagauccuccu

SEQ ID NO: 127395 - RNA, 18 nt, Homo sapiens
ccuuaguuauagagaguc

SEQ ID NO: 127396 - RNA, 22 nt, Homo sapiens
ccuucauccuccagcaggcuag

SEQ ID NO: 127397 - RNA, 22 nt, Homo sapiens
ccuucauucauuaauuuagccc

SEQ ID NO: 127398 - RNA, 22 nt, Homo sapiens
ccuucauugcaucuuuaagaga

SEQ ID NO: 127399 - RNA, 21 nt, Homo sapiens
ccuugagaacaucaauuugcu

SEQ ID NO: 127400 - RNA, 19 nt, Homo sapiens
ccuuugguuuccaugacau

SEQ ID NO: 127401 - RNA, 22 nt, Homo sapiens
ccuuuguuaguuugcugagaau

SEQ ID NO: 127402 - RNA, 22 nt, Homo sapiens
cgacuggccuagacuaguguuu

SEQ ID NO: 127403 - RNA, 22 nt, Homo sapiens
cgcuggugucuaagcgacagcu

SEQ ID NO: 127404 - RNA, 22 nt, Homo sapiens
cggaaugaaaauguccuucagu

SEQ ID NO: 127405 - RNA, 22 nt, Homo sapiens
cggcaguggguaagccaagcuu

SEQ ID NO: 127406 - RNA, 22 nt, Homo sapiens
cgugaggaaaacagaggguguu

SEQ ID NO: 127407 - RNA, 22 nt, Homo sapiens
cuaaaacuuucugagugcagca

SEQ ID NO: 127408 - RNA, 22 nt, Homo sapiens
cuaaggcaguagccugaauaau

SEQ ID NO: 127409 - RNA, 22 nt, Homo sapiens
cuaagguacuguuaacauugua

SEQ ID NO: 127410 - RNA, 22 nt, Homo sapiens
cuaagugaguauaauuuuaaga

SEQ ID NO: 127411 - RNA, 18 nt, Homo sapiens
cuaauacuauucaacaag

SEQ ID NO: 127412 - RNA, 20 nt, Homo sapiens
cuaaucaucccagaagaaau

SEQ ID NO: 127413 - RNA, 22 nt, Homo sapiens
cuacaguguauuuauggagggu

SEQ ID NO: 127414 - RNA, 22 nt, Homo sapiens
cuagaagcauauucagaacaga

SEQ ID NO: 127415 - RNA, 22 nt, Homo sapiens
cuagcuuuugauguaaagugag

SEQ ID NO: 127416 - RNA, 22 nt, Homo sapiens
cuaggaaguauguguuauugcu

SEQ ID NO: 127417 - RNA, 22 nt, Homo sapiens
cuaggcacgccugggucuccag

SEQ ID NO: 127418 - RNA, 18 nt, Homo sapiens
cuaguguuucuugaauca

SEQ ID NO: 127419 - RNA, 22 nt, Homo sapiens
cuaucucauugguuuuugaaag

SEQ ID NO: 127420 - RNA, 18 nt, Homo sapiens
cuaugccacuuuauauca

SEQ ID NO: 127421 - RNA, 22 nt, Homo sapiens
cuauguaccuggaacuguauua

SEQ ID NO: 127422 - RNA, 22 nt, Homo sapiens
cuaugucuuucauauuuugggg

SEQ ID NO: 127423 - RNA, 22 nt, Homo sapiens
cucaaaugguccagcuaguggu

SEQ ID NO: 127424 - RNA, 18 nt, Homo sapiens
cucaaccucaugcagggc

SEQ ID NO: 127425 - RNA, 18 nt, Homo sapiens
cucacaguaacuuuuaag

SEQ ID NO: 127426 - RNA, 22 nt, Homo sapiens
cucacaguucuaaaggcaagaa

SEQ ID NO: 127427 - RNA, 22 nt, Homo sapiens
cucaccuugugauccuccugcc

SEQ ID NO: 127428 - RNA, 22 nt, Homo sapiens
cucacuaguaaggcuguuuagu

SEQ ID NO: 127429 - RNA, 17 nt, Homo sapiens
cucacugagaacagcua

SEQ ID NO: 127430 - RNA, 22 nt, Homo sapiens
cucacugcauuucaguuuuguu

SEQ ID NO: 127431 - RNA, 22 nt, Homo sapiens
cucacugggaccacucugaagu

SEQ ID NO: 127432 - RNA, 22 nt, Homo sapiens
cucagcaguggauuuaccacca

SEQ ID NO: 127433 - RNA, 22 nt, Homo sapiens
cucaggcacucugauuccagug

SEQ ID NO: 127434 - RNA, 22 nt, Homo sapiens
cucagguaguuccuuauagcaa

SEQ ID NO: 127435 - RNA, 22 nt, Homo sapiens
cucaguacuugcacagaagaac

SEQ ID NO: 127436 - RNA, 22 nt, Homo sapiens
cucaguagaaaauacauggacu

SEQ ID NO: 127437 - RNA, 22 nt, Homo sapiens
cucagugucuggcacacagaaa

SEQ ID NO: 127438 - RNA, 22 nt, Homo sapiens
cucauuggcuacugaggcuugu

SEQ ID NO: 127439 - RNA, 22 nt, Homo sapiens
cuccaggugagguuaagggacu

SEQ ID NO: 127440 - RNA, 22 nt, Homo sapiens
cucccacccucauuuuuaggca

SEQ ID NO: 127441 - RNA, 22 nt, Homo sapiens
cucccagugacccaggaacagg

SEQ ID NO: 127442 - RNA, 22 nt, Homo sapiens
cucccauugcaaacaacagaag

SEQ ID NO: 127443 - RNA, 20 nt, Homo sapiens
cuccuucauuccuuuggacc

SEQ ID NO: 127444 - RNA, 22 nt, Homo sapiens
cucgcuccauuucggugaucaa

SEQ ID NO: 127445 - RNA, 20 nt, Homo sapiens
cucuaguaauaaaguuuccc

SEQ ID NO: 127446 - RNA, 22 nt, Homo sapiens
cucucugagccauggcugcccu

SEQ ID NO: 127447 - RNA, 21 nt, Homo sapiens
cucucugcuuaugaauaguga

SEQ ID NO: 127448 - RNA, 22 nt, Homo sapiens
cucugguuucgcaggaaauaga

SEQ ID NO: 127449 - RNA, 15 nt, Homo sapiens
cucugguuuuucuuc

SEQ ID NO: 127450 - RNA, 22 nt, Homo sapiens
cucugguuuuucuuccauuaag

SEQ ID NO: 127451 - RNA, 22 nt, Homo sapiens
cucuuagauuagccauccuaau

SEQ ID NO: 127452 - RNA, 19 nt, Homo sapiens
cucuuuggugucucuucuu

SEQ ID NO: 127453 - RNA, 22 nt, Homo sapiens
cucuuuuguuccuaguuugauc

SEQ ID NO: 127454 - RNA, 19 nt, Homo sapiens
cugaaacacagagagggcu

SEQ ID NO: 127455 - RNA, 22 nt, Homo sapiens
cugaaagguauacgcuuguuau

SEQ ID NO: 127456 - RNA, 22 nt, Homo sapiens
cugaauagucaacgauggacug

SEQ ID NO: 127457 - RNA, 22 nt, Homo sapiens
cugaaucauugguuaugaguac

SEQ ID NO: 127458 - RNA, 22 nt, Homo sapiens
cugaauguucuauagaagccgc

SEQ ID NO: 127459 - RNA, 22 nt, Homo sapiens
gaggugauaucucauugugguu

SEQ ID NO: 127460 - RNA, 22 nt, Homo sapiens
gagguggauacauuaaauaaug

SEQ ID NO: 127461 - RNA, 22 nt, Homo sapiens
gaguagugcugcaguaaacaca

SEQ ID NO: 127462 - RNA, 22 nt, Homo sapiens
gagugcaaagguccugaggugg

SEQ ID NO: 127463 - RNA, 22 nt, Homo sapiens
gagugcaauggcaugaucuggg

SEQ ID NO: 127464 - RNA, 22 nt, Homo sapiens
gagugcaauggcgcgaucucgg

SEQ ID NO: 127465 - RNA, 22 nt, Homo sapiens
gaguucaauuuccagcuguucu

SEQ ID NO: 127466 - RNA, 19 nt, Homo sapiens
gaguugggguuuacuguaa

SEQ ID NO: 127467 - RNA, 22 nt, Homo sapiens
gauaaaucuuggcuagucuaag

SEQ ID NO: 127468 - RNA, 22 nt, Homo sapiens
gauaacagauaaugucaguuau

SEQ ID NO: 127469 - RNA, 22 nt, Homo sapiens
gauacaguaugcaugugguauu

SEQ ID NO: 127470 - RNA, 19 nt, Homo sapiens
gauagacaucacagugcca

SEQ ID NO: 127471 - RNA, 22 nt, Homo sapiens
gauaguugugagaacucuuacu

SEQ ID NO: 127472 - RNA, 22 nt, Homo sapiens
gauaugucuauuagcuugauug

SEQ ID NO: 127473 - RNA, 22 nt, Homo sapiens
gauauguguaucuauguacaug

SEQ ID NO: 127474 - RNA, 22 nt, Homo sapiens
gaucacaguuccucacgggcau

SEQ ID NO: 127475 - RNA, 22 nt, Homo sapiens
gaucacaugggagaaugagagu

SEQ ID NO: 127476 - RNA, 22 nt, Homo sapiens
gaucagagugaaccuuguuaug

SEQ ID NO: 127477 - RNA, 22 nt, Homo sapiens
gaucuggagguuuuccucauga

SEQ ID NO: 127478 - RNA, 22 nt, Homo sapiens
gaucuguguuuguaugcauaag

SEQ ID NO: 127479 - RNA, 19 nt, Homo sapiens
gaucuguugaucaaugugu

SEQ ID NO: 127480 - RNA, 22 nt, Homo sapiens
gaucuguuucaauugucuuagu

SEQ ID NO: 127481 - RNA, 22 nt, Homo sapiens
gaugacagcugacucccuugcu

SEQ ID NO: 127482 - RNA, 22 nt, Homo sapiens
gaugagguaguguaccuagucu

SEQ ID NO: 127483 - RNA, 22 nt, Homo sapiens
gaugauauuugagucauuagaa

SEQ ID NO: 127484 - RNA, 22 nt, Homo sapiens
gaugccuuuuuguccucaguua

SEQ ID NO: 127485 - RNA, 22 nt, Homo sapiens
gauggaauuaaaaucagaauca

SEQ ID NO: 127486 - RNA, 22 nt, Homo sapiens
gauggcacuguagcaacacaaa

SEQ ID NO: 127487 - RNA, 22 nt, Homo sapiens
gauggcauuucuggaucugaca

SEQ ID NO: 127488 - RNA, 22 nt, Homo sapiens
gauggcauuucuggaucugccc

SEQ ID NO: 127489 - RNA, 22 nt, Homo sapiens
gauguuguuuagccuuugaugu

SEQ ID NO: 127490 - RNA, 20 nt, Homo sapiens
gauuagagagaggcugugca

SEQ ID NO: 127491 - RNA, 22 nt, Homo sapiens
gauuccacuuacuuagcauucc

SEQ ID NO: 127492 - RNA, 22 nt, Homo sapiens
gauuggcauugcugcaccugag

SEQ ID NO: 127493 - RNA, 22 nt, Homo sapiens
gauuugagagaggguguuuaua

SEQ ID NO: 127494 - RNA, 22 nt, Homo sapiens
gcaaagaaugcagauuugccuc

SEQ ID NO: 127495 - RNA, 21 nt, Homo sapiens
gcaaaggaauugccuaagcuu

SEQ ID NO: 127496 - RNA, 22 nt, Homo sapiens
gcaagaaucugggaguaaaauu

SEQ ID NO: 127497 - RNA, 22 nt, Homo sapiens
gcacagaugaggagaggucuca

SEQ ID NO: 127498 - RNA, 22 nt, Homo sapiens
gcacaguaggugguaggacuuu

SEQ ID NO: 127499 - RNA, 22 nt, Homo sapiens
gcacaguggcucccgucuauaa

SEQ ID NO: 127500 - RNA, 22 nt, Homo sapiens
gcacaguguuacuugauauauu

SEQ ID NO: 127501 - RNA, 22 nt, Homo sapiens
gcacauauguaaauagcugccu

SEQ ID NO: 127502 - RNA, 22 nt, Homo sapiens
gcaccauugacaagaaauaggu

SEQ ID NO: 127503 - RNA, 22 nt, Homo sapiens
gcaccguggaguauggggagga

SEQ ID NO: 127504 - RNA, 22 nt, Homo sapiens
gcacuacugcacuccagucuag

SEQ ID NO: 127505 - RNA, 17 nt, Homo sapiens
gcacuggcguaucccac

SEQ ID NO: 127506 - RNA, 22 nt, Homo sapiens
gcagagaaacaggucuaaggag

SEQ ID NO: 127507 - RNA, 22 nt, Homo sapiens
gcagaucucuucauuucucuua

SEQ ID NO: 127508 - RNA, 22 nt, Homo sapiens
gcagcacauggcagaacauauu

SEQ ID NO: 127509 - RNA, 20 nt, Homo sapiens
gcagcaccauauuucuaaga

SEQ ID NO: 127510 - RNA, 22 nt, Homo sapiens
gcagcagugcccuggauggaaa

SEQ ID NO: 127511 - RNA, 22 nt, Homo sapiens
gcagcauuaccaagacauggca

SEQ ID NO: 127512 - RNA, 22 nt, Homo sapiens
gcaggaauuucucugcagaccc

SEQ ID NO: 127513 - RNA, 22 nt, Homo sapiens
gcaggauuggagccucucugaa

SEQ ID NO: 127514 - RNA, 22 nt, Homo sapiens
gcagucacagggagauggugac

SEQ ID NO: 127515 - RNA, 22 nt, Homo sapiens
gcagugaugugaucauagcuca

SEQ ID NO: 127516 - RNA, 22 nt, Homo sapiens
gcaguggugugugccagccuag

SEQ ID NO: 127517 - RNA, 22 nt, Homo sapiens
gcaguguggguagagggcaaga

SEQ ID NO: 127518 - RNA, 16 nt, Homo sapiens
gcaguguguuuaauag

SEQ ID NO: 127519 - RNA, 22 nt, Homo sapiens
gcauaugucuuuauagcagcau

SEQ ID NO: 127520 - RNA, 22 nt, Homo sapiens
gcauauguuuggguguguauau

SEQ ID NO: 127521 - RNA, 20 nt, Homo sapiens
gcaugagucuuuauaguaga

SEQ ID NO: 127522 - RNA, 22 nt, Homo sapiens
gcaugcacaugugaaaaaauga

SEQ ID NO: 127523 - RNA, 22 nt, Homo sapiens
gcauggccuuuaaaugucacag

SEQ ID NO: 127524 - RNA, 22 nt, Homo sapiens
gcauguaguagauguugaauaa

SEQ ID NO: 127525 - RNA, 22 nt, Homo sapiens
gccaacauggcgcuccauucuu

SEQ ID NO: 127526 - RNA, 22 nt, Homo sapiens
gccaagaucugaauaauuaaga

SEQ ID NO: 127527 - RNA, 22 nt, Homo sapiens
gccaagaugcugcccacagaca

SEQ ID NO: 127528 - RNA, 22 nt, Homo sapiens
gccaguguguguuguucuccgc

SEQ ID NO: 127529 - RNA, 22 nt, Homo sapiens
gccauugcacuccagccuaggu

SEQ ID NO: 127530 - RNA, 22 nt, Homo sapiens
gccauugcacuccagccugagc

SEQ ID NO: 127531 - RNA, 22 nt, Homo sapiens
gccauugcacucuagccuaggu

SEQ ID NO: 127532 - RNA, 22 nt, Homo sapiens
gcccagcguucagggaggggcu

SEQ ID NO: 127533 - RNA, 22 nt, Homo sapiens
gccccaguacaggcuccuuaga

SEQ ID NO: 127534 - RNA, 22 nt, Homo sapiens
gcccuguugcccaggcuggagu

SEQ ID NO: 127535 - RNA, 22 nt, Homo sapiens
gcccuuugugucuggcuggggu

SEQ ID NO: 127536 - RNA, 22 nt, Homo sapiens
gccucaguuguggccagggauu

SEQ ID NO: 127537 - RNA, 22 nt, Homo sapiens
gcgcagugggcugugccaucca

SEQ ID NO: 127538 - RNA, 22 nt, Homo sapiens
gcuacugucuaucugugcuucu

SEQ ID NO: 127539 - RNA, 22 nt, Homo sapiens
gcuagcacauugucaccucuca

SEQ ID NO: 127540 - RNA, 23 nt, Homo sapiens
gcuaggagagaugaaacacaggu

SEQ ID NO: 127541 - RNA, 19 nt, Homo sapiens
gcucaccuugcugcuccag

SEQ ID NO: 127542 - RNA, 22 nt, Homo sapiens
gcucaugagacaagcaggagua

SEQ ID NO: 127543 - RNA, 22 nt, Homo sapiens
gcugacagugguuauacuuaga

SEQ ID NO: 127544 - RNA, 22 nt, Homo sapiens
gcugagacauugguuuucuccu

SEQ ID NO: 127545 - RNA, 22 nt, Homo sapiens
gcugagaucucuugccugaacu

SEQ ID NO: 127546 - RNA, 22 nt, Homo sapiens
gcugagcuaugccauauaugcc

SEQ ID NO: 127547 - RNA, 22 nt, Homo sapiens
gcugauggugcaguucuagccu

SEQ ID NO: 127548 - RNA, 22 nt, Homo sapiens
gcugauguugaccuugaucacc

SEQ ID NO: 127549 - RNA, 22 nt, Homo sapiens
gcugcacuuuaaggcauccccu

SEQ ID NO: 127550 - RNA, 22 nt, Homo sapiens
ggugagaaagggauuccuguuc

SEQ ID NO: 127551 - RNA, 22 nt, Homo sapiens
ggugagguaguaagguacaaua

SEQ ID NO: 127552 - RNA, 22 nt, Homo sapiens
gguguuccccuuaccucuuggc

SEQ ID NO: 127553 - RNA, 22 nt, Homo sapiens
guaaauaccaguuucuggaaca

SEQ ID NO: 127554 - RNA, 22 nt, Homo sapiens
guaagguuguauuucaagaaac

SEQ ID NO: 127555 - RNA, 22 nt, Homo sapiens
guaauaccuuccccugcuggag

SEQ ID NO: 127556 - RNA, 23 nt, Homo sapiens
guaauacuagucauaguagcagg

SEQ ID NO: 127557 - RNA, 22 nt, Homo sapiens
guaaucucaccuacuugggagg

SEQ ID NO: 127558 - RNA, 19 nt, Homo sapiens
guaaugugcuucaguagca

SEQ ID NO: 127559 - RNA, 22 nt, Homo sapiens
guacaaguaagaaaauugccca

SEQ ID NO: 127560 - RNA, 22 nt, Homo sapiens
guacacaacaugcagguuuguu

SEQ ID NO: 127561 - RNA, 22 nt, Homo sapiens
guacaggugcaggaugggcagg

SEQ ID NO: 127562 - RNA, 22 nt, Homo sapiens
guacaguacugaaugaauguau

SEQ ID NO: 127563 - RNA, 22 nt, Homo sapiens
guacaguaguaaaagugaauga

SEQ ID NO: 127564 - RNA, 22 nt, Homo sapiens
guacaugcauaguuuauuucug

SEQ ID NO: 127565 - RNA, 22 nt, Homo sapiens
guacauggaaugaaauucaaaa

SEQ ID NO: 127566 - RNA, 22 nt, Homo sapiens
guacauguaugcaugcaugcau

SEQ ID NO: 127567 - RNA, 22 nt, Homo sapiens
guacccaguagauaguuuuuca

SEQ ID NO: 127568 - RNA, 22 nt, Homo sapiens
guaccucaguuggaaaugcaga

SEQ ID NO: 127569 - RNA, 22 nt, Homo sapiens
guacuuagagauagggucuuua

SEQ ID NO: 127570 - RNA, 22 nt, Homo sapiens
guagugcaguuugagaaucagu

SEQ ID NO: 127571 - RNA, 22 nt, Homo sapiens
guauacaguugacccuugaacc

SEQ ID NO: 127572 - RNA, 22 nt, Homo sapiens
guauacaugucaaaacucacau

SEQ ID NO: 127573 - RNA, 22 nt, Homo sapiens
guauagaucguagaccaauaaa

SEQ ID NO: 127574 - RNA, 22 nt, Homo sapiens
guaucaugaaguuucuucauuu

SEQ ID NO: 127575 - RNA, 22 nt, Homo sapiens
guaucucaguucucgugauuag

SEQ ID NO: 127576 - RNA, 22 nt, Homo sapiens
guaugaaaaucggagauugggu

SEQ ID NO: 127577 - RNA, 22 nt, Homo sapiens
guaugcaagugauaugacauau

SEQ ID NO: 127578 - RNA, 22 nt, Homo sapiens
guaugguugaagugacaagcca

SEQ ID NO: 127579 - RNA, 22 nt, Homo sapiens
guaugguuuauagggaaauugu

SEQ ID NO: 127580 - RNA, 22 nt, Homo sapiens
guauuugauuauagcaugcuua

SEQ ID NO: 127581 - RNA, 19 nt, Homo sapiens
gucaaagucgguauucaaa

SEQ ID NO: 127582 - RNA, 22 nt, Homo sapiens
gucaagagaacuuucuaucacu

SEQ ID NO: 127583 - RNA, 22 nt, Homo sapiens
gucaaguaaauguuaugguuau

SEQ ID NO: 127584 - RNA, 22 nt, Homo sapiens
gucacagaaaaagauaugccaa

SEQ ID NO: 127585 - RNA, 22 nt, Homo sapiens
gucacagcuggcauugucugca

SEQ ID NO: 127586 - RNA, 22 nt, Homo sapiens
gucacggaauguaaguggaagu

SEQ ID NO: 127587 - RNA, 21 nt, Homo sapiens
gucacuggggcuggauaauuc

SEQ ID NO: 127588 - RNA, 22 nt, Homo sapiens
gucacugugaggaggggccagg

SEQ ID NO: 127589 - RNA, 22 nt, Homo sapiens
gucacuguggagaagaaagugg

SEQ ID NO: 127590 - RNA, 22 nt, Homo sapiens
gucagagcacugaguugugggc

SEQ ID NO: 127591 - RNA, 22 nt, Homo sapiens
gucagcaaagaggaauaguuug

SEQ ID NO: 127592 - RNA, 22 nt, Homo sapiens
gucagcuuuuccuuacuuuagg

SEQ ID NO: 127593 - RNA, 22 nt, Homo sapiens
gucaggaugauuuggggaggug

SEQ ID NO: 127594 - RNA, 22 nt, Homo sapiens
gucagugauugauuuaaagacg

SEQ ID NO: 127595 - RNA, 22 nt, Homo sapiens
gucaguucuugugguugcauuc

SEQ ID NO: 127596 - RNA, 22 nt, Homo sapiens
gucauaugcucggaaaauguua

SEQ ID NO: 127597 - RNA, 22 nt, Homo sapiens
gucaucaucaguccucugugca

SEQ ID NO: 127598 - RNA, 22 nt, Homo sapiens
gucaugggguacuacacauggg

SEQ ID NO: 127599 - RNA, 22 nt, Homo sapiens
gucauuguguggacauggagaa

SEQ ID NO: 127600 - RNA, 21 nt, Homo sapiens
guccaaaacaguguccaaugc

SEQ ID NO: 127601 - RNA, 22 nt, Homo sapiens
guccaagacuaggaguuggcag

SEQ ID NO: 127602 - RNA, 22 nt, Homo sapiens
guccaguacucuuuccugaaaa

SEQ ID NO: 127603 - RNA, 22 nt, Homo sapiens
gucccugaggaacauccagggc

SEQ ID NO: 127604 - RNA, 22 nt, Homo sapiens
gucccugcgauugugggauccu

SEQ ID NO: 127605 - RNA, 22 nt, Homo sapiens
gucgugcagaccucacagcauu

SEQ ID NO: 127606 - RNA, 22 nt, Homo sapiens
gucguggagucucuggcuugua

SEQ ID NO: 127607 - RNA, 22 nt, Homo sapiens
gucucacaggcaugaugccagc

SEQ ID NO: 127608 - RNA, 22 nt, Homo sapiens
gucucauugcaguuagaccugu

SEQ ID NO: 127609 - RNA, 22 nt, Homo sapiens
gucuggcuuaucucacuuacca

SEQ ID NO: 127610 - RNA, 22 nt, Homo sapiens
gucugguuuuuuauauccucac

SEQ ID NO: 127611 - RNA, 20 nt, Homo sapiens
gucugucuccgaguagaauu

SEQ ID NO: 127612 - RNA, 22 nt, Homo sapiens
gucuguuugauccagaucaaaa

SEQ ID NO: 127613 - RNA, 22 nt, Homo sapiens
gucuugcacuuaccuaagaacu

SEQ ID NO: 127614 - RNA, 22 nt, Homo sapiens
gucuuugagauaggguuauuuu

SEQ ID NO: 127615 - RNA, 22 nt, Homo sapiens
gucuuugcuuuuaaccagaggu

SEQ ID NO: 127616 - RNA, 22 nt, Homo sapiens
gucuuuugcuagccagagagcu

SEQ ID NO: 127617 - RNA, 22 nt, Homo sapiens
gugaaauacauaaucccaagug

SEQ ID NO: 127618 - RNA, 22 nt, Homo sapiens
gugaaauauuuaacguccaggu

SEQ ID NO: 127619 - RNA, 17 nt, Homo sapiens
gugaaaucaucauuuuu

SEQ ID NO: 127620 - RNA, 22 nt, Homo sapiens
gugaaaugaaucuggaaauauu

SEQ ID NO: 127621 - RNA, 22 nt, Homo sapiens
gugaaucuguuuucuucuguuc

SEQ ID NO: 127622 - RNA, 22 nt, Homo sapiens
gugaaugaaugggugaauacau

SEQ ID NO: 127623 - RNA, 22 nt, Homo sapiens
gugaauguuuucuuacauggua

SEQ ID NO: 127624 - RNA, 22 nt, Homo sapiens
gugaauugagagaacuguguua

SEQ ID NO: 127625 - RNA, 22 nt, Homo sapiens
gugacagaguaagacccuguau

SEQ ID NO: 127626 - RNA, 22 nt, Homo sapiens
gugacauuauuucagcuacaug

SEQ ID NO: 127627 - RNA, 22 nt, Homo sapiens
gugacauuuuuacugaugagag

SEQ ID NO: 127628 - RNA, 22 nt, Homo sapiens
gugacugcauccauccaggcuu

SEQ ID NO: 127629 - RNA, 22 nt, Homo sapiens
gugagaagaaaaauauggcugu

SEQ ID NO: 127630 - RNA, 22 nt, Homo sapiens
gugagacugaguuucgcucuug

SEQ ID NO: 127631 - RNA, 22 nt, Homo sapiens
gugagauggagucuugcuuugu

SEQ ID NO: 127632 - RNA, 22 nt, Homo sapiens
gugagaugguaucucauugugg

SEQ ID NO: 127633 - RNA, 22 nt, Homo sapiens
gugagcaauugauacuugaagu

SEQ ID NO: 127634 - RNA, 22 nt, Homo sapiens
gugagcauaggaggcuucuguu

SEQ ID NO: 127635 - RNA, 22 nt, Homo sapiens
gugagguacgugucaagaacca

SEQ ID NO: 127636 - RNA, 17 nt, Homo sapiens
gugagguauccucaaaa

SEQ ID NO: 127637 - RNA, 22 nt, Homo sapiens
gugaggucagggcuguggacag

SEQ ID NO: 127638 - RNA, 22 nt, Homo sapiens
gugaggucguagucauaggcaa

SEQ ID NO: 127639 - RNA, 22 nt, Homo sapiens
gugagguguuaaccaaccugug

SEQ ID NO: 127640 - RNA, 22 nt, Homo sapiens
gugaguaaagguucauugaauu

SEQ ID NO: 127641 - RNA, 22 nt, Homo sapiens
aaaagucuguagugaaagguga

SEQ ID NO: 127642 - RNA, 22 nt, Homo sapiens
aaacagucuucuccugagggac

SEQ ID NO: 127643 - RNA, 22 nt, Homo sapiens
aaaccacagugugcugcugggg

SEQ ID NO: 127644 - RNA, 15 nt, Homo sapiens
aaacccugucucaag

SEQ ID NO: 127645 - RNA, 23 nt, Homo sapiens
aaagacuagucaggugcaguggu

SEQ ID NO: 127646 - RNA, 22 nt, Homo sapiens
aaagcacuggagucaucaucua

SEQ ID NO: 127647 - RNA, 22 nt, Homo sapiens
aaagcaucacuuuuccuacuuu

SEQ ID NO: 127648 - RNA, 22 nt, Homo sapiens
aaagcuacaggaccugcucauu

SEQ ID NO: 127649 - RNA, 20 nt, Homo sapiens
aaaggcugugagaacgagau

SEQ ID NO: 127650 - RNA, 22 nt, Homo sapiens
aaagggcuugaauacucuuuuu

SEQ ID NO: 127651 - RNA, 22 nt, Homo sapiens
aaagggcuuuguaaacuucaag

SEQ ID NO: 127652 - RNA, 22 nt, Homo sapiens
aaaguacucaguucaguuccgu

SEQ ID NO: 127653 - RNA, 22 nt, Homo sapiens
aaagucuagaggaucaugugug

SEQ ID NO: 127654 - RNA, 22 nt, Homo sapiens
aaagugcaguacuucguauauu

SEQ ID NO: 127655 - RNA, 22 nt, Homo sapiens
aaagugcaguauuugggcagaa

SEQ ID NO: 127656 - RNA, 22 nt, Homo sapiens
aaagugcaguauuugggcagga

SEQ ID NO: 127657 - RNA, 22 nt, Homo sapiens
aaagugcugagacagacuggga

SEQ ID NO: 127658 - RNA, 22 nt, Homo sapiens
aaagugcugagauuguaggcau

SEQ ID NO: 127659 - RNA, 22 nt, Homo sapiens
acccuguaggugcuggcagaga

SEQ ID NO: 127660 - RNA, 22 nt, Homo sapiens
acccuguaguuagaaacuuuca

SEQ ID NO: 127661 - RNA, 22 nt, Homo sapiens
acccugucaaaauggaccaauc

SEQ ID NO: 127662 - RNA, 22 nt, Homo sapiens
acccuuaagcacuaguucagcu

SEQ ID NO: 127663 - RNA, 22 nt, Homo sapiens
accgggcugagcgcaggccccg

SEQ ID NO: 127664 - RNA, 22 nt, Homo sapiens
accugcacagccgaacauagac

SEQ ID NO: 127665 - RNA, 22 nt, Homo sapiens
accuggguguauguucaguuug

SEQ ID NO: 127666 - RNA, 22 nt, Homo sapiens
accugguuuucucacaguggcu

SEQ ID NO: 127667 - RNA, 19 nt, Homo sapiens
accuguagaaaguacaaca

SEQ ID NO: 127668 - RNA, 22 nt, Homo sapiens
accuucauuguugccaugucca

SEQ ID NO: 127669 - RNA, 22 nt, Homo sapiens
accuuguagcaaaccuaacaua

SEQ ID NO: 127670 - RNA, 22 nt, Homo sapiens
acgcagcacauucacagcuaug

SEQ ID NO: 127671 - RNA, 22 nt, Homo sapiens
acgugccuuguuguucauauga

SEQ ID NO: 127672 - RNA, 22 nt, Homo sapiens
acuacauaugacaucuucuuua

SEQ ID NO: 127673 - RNA, 22 nt, Homo sapiens
acucagagauuagcacauguuu

SEQ ID NO: 127674 - RNA, 22 nt, Homo sapiens
acuccauuucauuuuagcucuu

SEQ ID NO: 127675 - RNA, 20 nt, Homo sapiens
acugauauguuccuguucuc

SEQ ID NO: 127676 - RNA, 23 nt, Homo sapiens
acugcaauuacguuugcaccaac

SEQ ID NO: 127677 - RNA, 22 nt, Homo sapiens
acugcacuccaaccuuggugac

SEQ ID NO: 127678 - RNA, 22 nt, Homo sapiens
acugcacuccagcccgggugac

SEQ ID NO: 127679 - RNA, 22 nt, Homo sapiens
acugcacuccagccucaugaca

SEQ ID NO: 127680 - RNA, 22 nt, Homo sapiens
acugcacuccagccucgcaaca

SEQ ID NO: 127681 - RNA, 22 nt, Homo sapiens
acugcacuccagccucguggac

SEQ ID NO: 127682 - RNA, 22 nt, Homo sapiens
acugcacuccagccugcccaac

SEQ ID NO: 127683 - RNA, 22 nt, Homo sapiens
acugcacuccagccugcugaca

SEQ ID NO: 127684 - RNA, 22 nt, Homo sapiens
acugcacuccagccuguugaca

SEQ ID NO: 127685 - RNA, 22 nt, Homo sapiens
acugcacuccagccuugagagc

SEQ ID NO: 127686 - RNA, 22 nt, Homo sapiens
acugcacuccagccuugcgaca

SEQ ID NO: 127687 - RNA, 22 nt, Homo sapiens
acugcacuccagcuuuggguga

SEQ ID NO: 127688 - RNA, 22 nt, Homo sapiens
acugcacuccaguuugggcagc

SEQ ID NO: 127689 - RNA, 22 nt, Homo sapiens
acugcacuccaucuuagguggc

SEQ ID NO: 127690 - RNA, 22 nt, Homo sapiens
acugcacuccuccuugggugac

SEQ ID NO: 127691 - RNA, 22 nt, Homo sapiens
acugcacucuagccuuggcaac

SEQ ID NO: 127692 - RNA, 22 nt, Homo sapiens
acugcacugcagccuggccaac

SEQ ID NO: 127693 - RNA, 22 nt, Homo sapiens
acugcacuuauccuccaauguu

SEQ ID NO: 127694 - RNA, 22 nt, Homo sapiens
acugcacuucagccuguugaca

SEQ ID NO: 127695 - RNA, 22 nt, Homo sapiens
acugcacuucagccuugugaca

SEQ ID NO: 127696 - RNA, 20 nt, Homo sapiens
acugcauuuaguccucagga

SEQ ID NO: 127697 - RNA, 22 nt, Homo sapiens
acugccuaaugacuuauguuuu

SEQ ID NO: 127698 - RNA, 22 nt, Homo sapiens
acuggcuguuaggaauuaccuc

SEQ ID NO: 127699 - RNA, 22 nt, Homo sapiens
acuggcuuaaggaugggccacu

SEQ ID NO: 127700 - RNA, 22 nt, Homo sapiens
acuggcuuuugagaaaaacacu

SEQ ID NO: 127701 - RNA, 22 nt, Homo sapiens
acugggauauuauugguaauau

SEQ ID NO: 127702 - RNA, 22 nt, Homo sapiens
acugguguaugggaggucccaa

SEQ ID NO: 127703 - RNA, 22 nt, Homo sapiens
acuguacucuacccugggcaac

SEQ ID NO: 127704 - RNA, 22 nt, Homo sapiens
acuguguguuugucuagcacag

SEQ ID NO: 127705 - RNA, 22 nt, Homo sapiens
acuuggcaaaguuuuaaacagc

SEQ ID NO: 127706 - RNA, 21 nt, Homo sapiens
acuuucuguggcaguccauuc

SEQ ID NO: 127707 - RNA, 19 nt, Homo sapiens
acuuuggugauuagaggga

SEQ ID NO: 127708 - RNA, 21 nt, Homo sapiens
acuuuguugggggcugaggca

SEQ ID NO: 127709 - RNA, 22 nt, Homo sapiens
acuuuuugaugaggucguuugu

SEQ ID NO: 127710 - RNA, 22 nt, Homo sapiens
agaaacauucucuugccuccuu

SEQ ID NO: 127711 - RNA, 22 nt, Homo sapiens
agaaauguuuacucacccccuu

SEQ ID NO: 127712 - RNA, 22 nt, Homo sapiens
agaaccaaucccacauggauac

SEQ ID NO: 127713 - RNA, 22 nt, Homo sapiens
agaacccuuugaaauguguuug

SEQ ID NO: 127714 - RNA, 20 nt, Homo sapiens
agaagcauugcucucuucag

SEQ ID NO: 127715 - RNA, 19 nt, Homo sapiens
agaagugcauggucuagag

SEQ ID NO: 127716 - RNA, 22 nt, Homo sapiens
agaaugucagcuggauucagcu

SEQ ID NO: 127717 - RNA, 22 nt, Homo sapiens
agaaugucaguauuggcuaaaa

SEQ ID NO: 127718 - RNA, 22 nt, Homo sapiens
agaauucugucauguuuauauu

SEQ ID NO: 127719 - RNA, 22 nt, Homo sapiens
agacacugaaauguauugaaga

SEQ ID NO: 127720 - RNA, 20 nt, Homo sapiens
agacagcugcagcccacauc

SEQ ID NO: 127721 - RNA, 22 nt, Homo sapiens
agacagcuggaguaucauagcu

SEQ ID NO: 127722 - RNA, 22 nt, Homo sapiens
agacagcugggaaauggagugu

SEQ ID NO: 127723 - RNA, 22 nt, Homo sapiens
agacaguguguguauauauggu

SEQ ID NO: 127724 - RNA, 22 nt, Homo sapiens
agacaucauuugauggugggag

SEQ ID NO: 127725 - RNA, 22 nt, Homo sapiens
agacuagagggaaaugaguugg

SEQ ID NO: 127726 - RNA, 19 nt, Homo sapiens
agacuggcccaggcgggug

SEQ ID NO: 127727 - RNA, 22 nt, Homo sapiens
agagaacugauucagggaaaau

SEQ ID NO: 127728 - RNA, 22 nt, Homo sapiens
agagagcuuuaacuacccauuu

SEQ ID NO: 127729 - RNA, 22 nt, Homo sapiens
agagagcuuuugguugcccuaa

SEQ ID NO: 127730 - RNA, 22 nt, Homo sapiens
agagauaauuagguuaaaugag

SEQ ID NO: 127731 - RNA, 22 nt, Homo sapiens
agagaucaacugaauuacugga

SEQ ID NO: 127732 - RNA, 18 nt, Homo sapiens
agagcacugaguuuuaga

SEQ ID NO: 127733 - RNA, 22 nt, Homo sapiens
agagcacugcugcaggguucug

SEQ ID NO: 127734 - RNA, 22 nt, Homo sapiens
agagcauugaguuaaugguuca

SEQ ID NO: 127735 - RNA, 22 nt, Homo sapiens
agagcuaguauuuacggagcau

SEQ ID NO: 127736 - RNA, 22 nt, Homo sapiens
agagguguuaaagucucuuuua

SEQ ID NO: 127737 - RNA, 22 nt, Homo sapiens
agagguuuaacuggcuuauggu

SEQ ID NO: 127738 - RNA, 22 nt, Homo sapiens
agaguacaggcaaguuagucau

SEQ ID NO: 127739 - RNA, 18 nt, Homo sapiens
agaguaucauuuccccca

SEQ ID NO: 127740 - RNA, 22 nt, Homo sapiens
agagugcaaagguuggggcugg

SEQ ID NO: 127741 - RNA, 22 nt, Homo sapiens
agauauguuauugauguuaaug

SEQ ID NO: 127742 - RNA, 22 nt, Homo sapiens
agaucacaguaccguaaggcug

SEQ ID NO: 127743 - RNA, 22 nt, Homo sapiens
agaucauaugcaguaaugaacu

SEQ ID NO: 127744 - RNA, 22 nt, Homo sapiens
agaugauguuucuggcacauga

SEQ ID NO: 127745 - RNA, 20 nt, Homo sapiens
agaugcaugcacauaaacac

SEQ ID NO: 127746 - RNA, 22 nt, Homo sapiens
agaugcuguuaucaacuguagc

SEQ ID NO: 127747 - RNA, 22 nt, Homo sapiens
agauggugauaaaugugguacc

SEQ ID NO: 127748 - RNA, 22 nt, Homo sapiens
agcaaaucuaugaauguauauu

SEQ ID NO: 127749 - RNA, 22 nt, Homo sapiens
agcaacauugagacugcaguug

SEQ ID NO: 127750 - RNA, 22 nt, Homo sapiens
auagugcugcaaugaacauaca

SEQ ID NO: 127751 - RNA, 22 nt, Homo sapiens
auagugcugcacuaaacauaca

SEQ ID NO: 127752 - RNA, 22 nt, Homo sapiens
auagugcugcauuaaacauacg

SEQ ID NO: 127753 - RNA, 22 nt, Homo sapiens
auagugcuggaauaaauauacg

SEQ ID NO: 127754 - RNA, 22 nt, Homo sapiens
auagugcugugaugaacauaca

SEQ ID NO: 127755 - RNA, 22 nt, Homo sapiens
auaucaacaucgugucauuagu

SEQ ID NO: 127756 - RNA, 22 nt, Homo sapiens
auauccaugccauagguuuuga

SEQ ID NO: 127757 - RNA, 22 nt, Homo sapiens
auaugcaaauccauagagacag

SEQ ID NO: 127758 - RNA, 21 nt, Homo sapiens
auauggaacuggugacguguu

SEQ ID NO: 127759 - RNA, 22 nt, Homo sapiens
auaugguuuuuggaagcauauc

SEQ ID NO: 127760 - RNA, 22 nt, Homo sapiens
auauguauuuuaacguguaagg

SEQ ID NO: 127761 - RNA, 22 nt, Homo sapiens
auaugucuuaguuaccuugggc

SEQ ID NO: 127762 - RNA, 22 nt, Homo sapiens
auauucacagguaucagagauu

SEQ ID NO: 127763 - RNA, 22 nt, Homo sapiens
auauuggccuaaaauucucuuu

SEQ ID NO: 127764 - RNA, 22 nt, Homo sapiens
aucaaauugucauuuuaaggau

SEQ ID NO: 127765 - RNA, 22 nt, Homo sapiens
aucaagguaggacuugaacccu

SEQ ID NO: 127766 - RNA, 22 nt, Homo sapiens
aucaaguaaucugaguaagagu

SEQ ID NO: 127767 - RNA, 22 nt, Homo sapiens
aucaaguaguuauacguaaagg

SEQ ID NO: 127768 - RNA, 22 nt, Homo sapiens
aucacaggucaaaucauuauuu

SEQ ID NO: 127769 - RNA, 22 nt, Homo sapiens
aucaccagaugcuucaagcaga

SEQ ID NO: 127770 - RNA, 22 nt, Homo sapiens
aucaccuuucccuuucugaauc

SEQ ID NO: 127771 - RNA, 20 nt, Homo sapiens
aucacuggagaaggaaaccu

SEQ ID NO: 127772 - RNA, 22 nt, Homo sapiens
aucacuguaaguuuacacuuug

SEQ ID NO: 127773 - RNA, 16 nt, Homo sapiens
aucacuugcuucuuuu

SEQ ID NO: 127774 - RNA, 22 nt, Homo sapiens
aucagaaucucuugagaguguu

SEQ ID NO: 127775 - RNA, 21 nt, Homo sapiens
aucagagacccaggcuuccuc

SEQ ID NO: 127776 - RNA, 22 nt, Homo sapiens
aucagagugaauaaugacaaaa

SEQ ID NO: 127777 - RNA, 22 nt, Homo sapiens
aucagaguugucagggagcuuu

SEQ ID NO: 127778 - RNA, 23 nt, Homo sapiens
aucagauaguuguagguaugugg

SEQ ID NO: 127779 - RNA, 22 nt, Homo sapiens
aucagauguuuguauaggagua

SEQ ID NO: 127780 - RNA, 22 nt, Homo sapiens
aucagauuccacauuuuaucag

SEQ ID NO: 127781 - RNA, 22 nt, Homo sapiens
aucagcagcaugaaaacaggcu

SEQ ID NO: 127782 - RNA, 22 nt, Homo sapiens
aucagucuguuggaauaucgcu

SEQ ID NO: 127783 - RNA, 22 nt, Homo sapiens
aucagugaaagugaaaucuccg

SEQ ID NO: 127784 - RNA, 22 nt, Homo sapiens
aucauacuguuuugauuacugu

SEQ ID NO: 127785 - RNA, 22 nt, Homo sapiens
aucauaucaucugcaaacaaag

SEQ ID NO: 127786 - RNA, 22 nt, Homo sapiens
aucaugcacaugcauagguaug

SEQ ID NO: 127787 - RNA, 22 nt, Homo sapiens
aucauggaguauuugcaagucu

SEQ ID NO: 127788 - RNA, 22 nt, Homo sapiens
auccaucagacggcaggcguug

SEQ ID NO: 127789 - RNA, 20 nt, Homo sapiens
aucccauuccugaagauacu

SEQ ID NO: 127790 - RNA, 22 nt, Homo sapiens
auccccuugcagugaccggggc

SEQ ID NO: 127791 - RNA, 22 nt, Homo sapiens
aucccuguaguaauauucuagc

SEQ ID NO: 127792 - RNA, 22 nt, Homo sapiens
auccucaguggcuuaaguauag

SEQ ID NO: 127793 - RNA, 22 nt, Homo sapiens
auccuguacuaagguuuuccca

SEQ ID NO: 127794 - RNA, 22 nt, Homo sapiens
auccuguaggcuaguagacagu

SEQ ID NO: 127795 - RNA, 22 nt, Homo sapiens
auccuugagaaaauaaaugacc

SEQ ID NO: 127796 - RNA, 22 nt, Homo sapiens
aucgcaccauugcacuccagca

SEQ ID NO: 127797 - RNA, 22 nt, Homo sapiens
aucgcauaaucucuaaaaagca

SEQ ID NO: 127798 - RNA, 22 nt, Homo sapiens
aucuaaaucucauaugggcaca

SEQ ID NO: 127799 - RNA, 22 nt, Homo sapiens
aucuaaucaucgcaaccuucaa

SEQ ID NO: 127800 - RNA, 22 nt, Homo sapiens
aucuacuugcugggucucugga

SEQ ID NO: 127801 - RNA, 22 nt, Homo sapiens
aucucagcaacuaaagauccuu

SEQ ID NO: 127802 - RNA, 22 nt, Homo sapiens
aucuccaggugccagcugcgcc

SEQ ID NO: 127803 - RNA, 20 nt, Homo sapiens
aucucugggcaaaggaaaau

SEQ ID NO: 127804 - RNA, 22 nt, Homo sapiens
aucugcaaauaaugaagauugg

SEQ ID NO: 127805 - RNA, 22 nt, Homo sapiens
aucugguguggcugugauccuc

SEQ ID NO: 127806 - RNA, 22 nt, Homo sapiens
aucuugggugggaacugagaau

SEQ ID NO: 127807 - RNA, 22 nt, Homo sapiens
aucuuguguugaauggugcaga

SEQ ID NO: 127808 - RNA, 22 nt, Homo sapiens
aucuuuggauacuugauauagu

SEQ ID NO: 127809 - RNA, 22 nt, Homo sapiens
aucuuuggucaucacagcuaga

SEQ ID NO: 127810 - RNA, 22 nt, Homo sapiens
aucuuuggugaguucuuugguc

SEQ ID NO: 127811 - RNA, 22 nt, Homo sapiens
augaaaucuuuccugugaggau

SEQ ID NO: 127812 - RNA, 22 nt, Homo sapiens
augaaauugcuaucgcaguacu

SEQ ID NO: 127813 - RNA, 22 nt, Homo sapiens
augaacagagccuugagaaccu

SEQ ID NO: 127814 - RNA, 19 nt, Homo sapiens
augaacucaucauuucuca

SEQ ID NO: 127815 - RNA, 18 nt, Homo sapiens
augaacucaucauuuuua

SEQ ID NO: 127816 - RNA, 22 nt, Homo sapiens
augaacucaucauuuuuuaugg

SEQ ID NO: 127817 - RNA, 22 nt, Homo sapiens
augaagagaaaguggaucuugg

SEQ ID NO: 127818 - RNA, 22 nt, Homo sapiens
augaagaucucugccuuguguc

SEQ ID NO: 127819 - RNA, 22 nt, Homo sapiens
augaagauguugccuuuuuaau

SEQ ID NO: 127820 - RNA, 20 nt, Homo sapiens
augaaggcaggugugaguuu

SEQ ID NO: 127821 - RNA, 22 nt, Homo sapiens
augaaugcaucuaucaaagcau

SEQ ID NO: 127822 - RNA, 22 nt, Homo sapiens
augaaugucuuauuuugagaaa

SEQ ID NO: 127823 - RNA, 22 nt, Homo sapiens
augacagagauaugugaauuuu

SEQ ID NO: 127824 - RNA, 22 nt, Homo sapiens
augacaguaugacuccaaaagu

SEQ ID NO: 127825 - RNA, 22 nt, Homo sapiens
augacauguauuuccaggauuu

SEQ ID NO: 127826 - RNA, 22 nt, Homo sapiens
augacauugaugcucuggcugg

SEQ ID NO: 127827 - RNA, 19 nt, Homo sapiens
augacauuuggggguggac

SEQ ID NO: 127828 - RNA, 22 nt, Homo sapiens
augaccaugauccuugccgacc

SEQ ID NO: 127829 - RNA, 19 nt, Homo sapiens
augaccauggggugguuuu

SEQ ID NO: 127830 - RNA, 19 nt, Homo sapiens
augaccauuuccauaguau

SEQ ID NO: 127831 - RNA, 18 nt, Homo sapiens
augacucuggguguuccu

SEQ ID NO: 127832 - RNA, 22 nt, Homo sapiens
augacuuuucugaaaaccacca

SEQ ID NO: 127833 - RNA, 22 nt, Homo sapiens
augagacauuaaaguguguuug

SEQ ID NO: 127834 - RNA, 22 nt, Homo sapiens
augagacuagaagagaauaaua

SEQ ID NO: 127835 - RNA, 22 nt, Homo sapiens
augagagugagagcagccccuu

SEQ ID NO: 127836 - RNA, 22 nt, Homo sapiens
augagcacuuguuuugggcaca

SEQ ID NO: 127837 - RNA, 22 nt, Homo sapiens
augagcagaugcuccugccucu

SEQ ID NO: 127838 - RNA, 22 nt, Homo sapiens
augaggcaggaaaggcguaucu

SEQ ID NO: 127839 - RNA, 22 nt, Homo sapiens
augagguccuagccaacuuuuu

SEQ ID NO: 127840 - RNA, 22 nt, Homo sapiens
augaggugauuucuguucgggu

SEQ ID NO: 127841 - RNA, 22 nt, Homo sapiens
uagagguauguauaguauucuu

SEQ ID NO: 127842 - RNA, 19 nt, Homo sapiens
uagagguuuaagaaaagaa

SEQ ID NO: 127843 - RNA, 22 nt, Homo sapiens
uagaguacucugguaaguucuu

SEQ ID NO: 127844 - RNA, 21 nt, Homo sapiens
uagauacuguauuaaaccuag

SEQ ID NO: 127845 - RNA, 22 nt, Homo sapiens
uagauaguaaagccauuagcuu

SEQ ID NO: 127846 - RNA, 21 nt, Homo sapiens
uagauaguugguucugaaucu

SEQ ID NO: 127847 - RNA, 22 nt, Homo sapiens
uagaucauauacuugccaugac

SEQ ID NO: 127848 - RNA, 22 nt, Homo sapiens
uagauuaucauucauacaggga

SEQ ID NO: 127849 - RNA, 22 nt, Homo sapiens
uagauuaucuguaugugcucuu

SEQ ID NO: 127850 - RNA, 22 nt, Homo sapiens
uagauuauuggcugauuugauc

SEQ ID NO: 127851 - RNA, 22 nt, Homo sapiens
uagcacagggaauugguucucu

SEQ ID NO: 127852 - RNA, 20 nt, Homo sapiens
uagcacaucuggcuguagag

SEQ ID NO: 127853 - RNA, 22 nt, Homo sapiens
uagcacaucuucuuggccugca

SEQ ID NO: 127854 - RNA, 22 nt, Homo sapiens
uagcaccugugcacaccaggca

SEQ ID NO: 127855 - RNA, 23 nt, Homo sapiens
uagcacuuuuuacauauggacau

SEQ ID NO: 127856 - RNA, 22 nt, Homo sapiens
uagcagacuauuuugugauaau

SEQ ID NO: 127857 - RNA, 22 nt, Homo sapiens
uagcagcaaagcaggaucugcu

SEQ ID NO: 127858 - RNA, 22 nt, Homo sapiens
uagcagcuuuauugagguaaau

SEQ ID NO: 127859 - RNA, 20 nt, Homo sapiens
uagcaggugucaggugauau

SEQ ID NO: 127860 - RNA, 22 nt, Homo sapiens
uagcaguauacguacugggucc

SEQ ID NO: 127861 - RNA, 22 nt, Homo sapiens
uagcaguauugaaagaugaggg

SEQ ID NO: 127862 - RNA, 21 nt, Homo sapiens
uagcauacauuuugcaucuua

SEQ ID NO: 127863 - RNA, 22 nt, Homo sapiens
uagcauggagucaugcacggcu

SEQ ID NO: 127864 - RNA, 22 nt, Homo sapiens
uagccgggugugguggaacucc

SEQ ID NO: 127865 - RNA, 22 nt, Homo sapiens
uagccuguggugaauguuucug

SEQ ID NO: 127866 - RNA, 22 nt, Homo sapiens
uagcugcauccugugcacucaa

SEQ ID NO: 127867 - RNA, 22 nt, Homo sapiens
uagcuggaauuacuugcaccug

SEQ ID NO: 127868 - RNA, 17 nt, Homo sapiens
uagcuucacauuaggaa

SEQ ID NO: 127869 - RNA, 22 nt, Homo sapiens
uaggaaugaacgauuuauuggu

SEQ ID NO: 127870 - RNA, 22 nt, Homo sapiens
uaggagcacaaacccuacugug

SEQ ID NO: 127871 - RNA, 22 nt, Homo sapiens
uaggcaaaugcaagaguagaac

SEQ ID NO: 127872 - RNA, 22 nt, Homo sapiens
uaggcaauggagauagaggaug

SEQ ID NO: 127873 - RNA, 22 nt, Homo sapiens
uaggcacugagaauaugaggau

SEQ ID NO: 127874 - RNA, 22 nt, Homo sapiens
uaggcaguggagaaauaaacag

SEQ ID NO: 127875 - RNA, 22 nt, Homo sapiens
uaggcauuuuucugauaaacua

SEQ ID NO: 127876 - RNA, 22 nt, Homo sapiens
uagggagugucuucauuuugua

SEQ ID NO: 127877 - RNA, 22 nt, Homo sapiens
uagggcauuuagaggcuauuaa

SEQ ID NO: 127878 - RNA, 22 nt, Homo sapiens
uagguaaguaugugugaugggg

SEQ ID NO: 127879 - RNA, 22 nt, Homo sapiens
uagguauguauauacacacaca

SEQ ID NO: 127880 - RNA, 22 nt, Homo sapiens
uaggugaaugcuggaagaaaug

SEQ ID NO: 127881 - RNA, 22 nt, Homo sapiens
uaggugauccauuuguauuuua

SEQ ID NO: 127882 - RNA, 22 nt, Homo sapiens
uaggugguuugaaauacucaag

SEQ ID NO: 127883 - RNA, 22 nt, Homo sapiens
uaguaaacagcucugccacaau

SEQ ID NO: 127884 - RNA, 22 nt, Homo sapiens
uaguaaacauuuuucuaucauu

SEQ ID NO: 127885 - RNA, 22 nt, Homo sapiens
uaguaacacauugaacgaucgc

SEQ ID NO: 127886 - RNA, 22 nt, Homo sapiens
uaguaucacaagguguacaccc

SEQ ID NO: 127887 - RNA, 22 nt, Homo sapiens
uaguccauuuucaugcugcuau

SEQ ID NO: 127888 - RNA, 22 nt, Homo sapiens
uagucccauaugauuuagugaa

SEQ ID NO: 127889 - RNA, 22 nt, Homo sapiens
uagucccuuucuauuaaugaga

SEQ ID NO: 127890 - RNA, 22 nt, Homo sapiens
uagugcauguugaguucccgac

SEQ ID NO: 127891 - RNA, 22 nt, Homo sapiens
uagugcugagauugagaagccc

SEQ ID NO: 127892 - RNA, 22 nt, Homo sapiens
uagugcugugauaaacauauau

SEQ ID NO: 127893 - RNA, 22 nt, Homo sapiens
uagugcugugauauuuuuggcc

SEQ ID NO: 127894 - RNA, 22 nt, Homo sapiens
uagugcugugauuaacauaaug

SEQ ID NO: 127895 - RNA, 22 nt, Homo sapiens
uagugguaguuauggauuugcu

SEQ ID NO: 127896 - RNA, 22 nt, Homo sapiens
uaguuauggaguaauuuuaagc

SEQ ID NO: 127897 - RNA, 22 nt, Homo sapiens
uaguucauuauguguugcucag

SEQ ID NO: 127898 - RNA, 22 nt, Homo sapiens
uauaacacccacauauagucuu

SEQ ID NO: 127899 - RNA, 22 nt, Homo sapiens
uauacaugugggcaucaggaga

SEQ ID NO: 127900 - RNA, 22 nt, Homo sapiens
uauagcaaugugccacucucug

SEQ ID NO: 127901 - RNA, 22 nt, Homo sapiens
uauagcacugaccuuccaggac

SEQ ID NO: 127902 - RNA, 22 nt, Homo sapiens
uauagcuaugggauguauuugc

SEQ ID NO: 127903 - RNA, 22 nt, Homo sapiens
uauaugcacucagguguaugug

SEQ ID NO: 127904 - RNA, 22 nt, Homo sapiens
uauaugcucugggauccugaaa

SEQ ID NO: 127905 - RNA, 22 nt, Homo sapiens
uauaugucugagacugggggau

SEQ ID NO: 127906 - RNA, 22 nt, Homo sapiens
uauauguucuugcacuggaaag

SEQ ID NO: 127907 - RNA, 22 nt, Homo sapiens
uaucaagauggauaaggauaga

SEQ ID NO: 127908 - RNA, 22 nt, Homo sapiens
uaucaaguguuagggagaugug

SEQ ID NO: 127909 - RNA, 22 nt, Homo sapiens
uaucacagaggguauccuagag

SEQ ID NO: 127910 - RNA, 20 nt, Homo sapiens
uaucacaggucagaaacccu

SEQ ID NO: 127911 - RNA, 22 nt, Homo sapiens
uaucacaggucaggaaucuugc

SEQ ID NO: 127912 - RNA, 21 nt, Homo sapiens
uaucacaguagaauaggaucu

SEQ ID NO: 127913 - RNA, 20 nt, Homo sapiens
uaucacauggggagaaaccu

SEQ ID NO: 127914 - RNA, 22 nt, Homo sapiens
uaucaccuugguagucuugggg

SEQ ID NO: 127915 - RNA, 19 nt, Homo sapiens
uaucacuucccuggaaaca

SEQ ID NO: 127916 - RNA, 22 nt, Homo sapiens
uaucauagacaaucaguuauug

SEQ ID NO: 127917 - RNA, 22 nt, Homo sapiens
uaucauggaaagauguugaaau

SEQ ID NO: 127918 - RNA, 22 nt, Homo sapiens
uaucaugucuguguguaccuag

SEQ ID NO: 127919 - RNA, 22 nt, Homo sapiens
uaucauuguguuauuucuucca

SEQ ID NO: 127920 - RNA, 21 nt, Homo sapiens
uaucccagucacaucuaccca

SEQ ID NO: 127921 - RNA, 22 nt, Homo sapiens
uaucccuuagagcggggugguu

SEQ ID NO: 127922 - RNA, 22 nt, Homo sapiens
uaucuacauguagguauguaug

SEQ ID NO: 127923 - RNA, 23 nt, Homo sapiens
uaucucaaugcacagagaggaaa

SEQ ID NO: 127924 - RNA, 22 nt, Homo sapiens
uaucucacauauucaguagguu

SEQ ID NO: 127925 - RNA, 22 nt, Homo sapiens
uaucucauccuccuugauccca

SEQ ID NO: 127926 - RNA, 22 nt, Homo sapiens
uaucucuuuucauguguaaaug

SEQ ID NO: 127927 - RNA, 22 nt, Homo sapiens
uaucugcacuucugucuagguc

SEQ ID NO: 127928 - RNA, 22 nt, Homo sapiens
uaucugcaucccauuuuuauca

SEQ ID NO: 127929 - RNA, 22 nt, Homo sapiens
uaucugguuauugcugcugauu

SEQ ID NO: 127930 - RNA, 22 nt, Homo sapiens
uaucuuggaguuugacaaccaa

SEQ ID NO: 127931 - RNA, 22 nt, Homo sapiens
uaugaagccaggauuuauuauu

SEQ ID NO: 127932 - RNA, 22 nt, Homo sapiens
uccuugguugauccugugcaga

SEQ ID NO: 127933 - RNA, 22 nt, Homo sapiens
uccuuuagacugaauccugaga

SEQ ID NO: 127934 - RNA, 22 nt, Homo sapiens
uccuuuggcuaacuuucuaagu

SEQ ID NO: 127935 - RNA, 22 nt, Homo sapiens
uccuuuggucaguauucuuuug

SEQ ID NO: 127936 - RNA, 22 nt, Homo sapiens
uccuuuguuacaguuggcucug

SEQ ID NO: 127937 - RNA, 20 nt, Homo sapiens
ucuaccuguagguaauuggu

SEQ ID NO: 127938 - RNA, 22 nt, Homo sapiens
ucuaucacagugauguuccaga

SEQ ID NO: 127939 - RNA, 22 nt, Homo sapiens
ucucaauuugauuacauucaua

SEQ ID NO: 127940 - RNA, 22 nt, Homo sapiens
ucucacagaguugaacuuucuu

SEQ ID NO: 127941 - RNA, 22 nt, Homo sapiens
ucucagagccuaggguuuuuca

SEQ ID NO: 127942 - RNA, 22 nt, Homo sapiens
ucucagcacaaacaaaauugcu

SEQ ID NO: 127943 - RNA, 22 nt, Homo sapiens
ucucagugacugcugggucccc

SEQ ID NO: 127944 - RNA, 22 nt, Homo sapiens
ucucaguuuucuggggaagaaa

SEQ ID NO: 127945 - RNA, 20 nt, Homo sapiens
ucucauagagguagagaaua

SEQ ID NO: 127946 - RNA, 22 nt, Homo sapiens
ucucaugaagguggagaguagg

SEQ ID NO: 127947 - RNA, 22 nt, Homo sapiens
ucucauggagucaggagcagaa

SEQ ID NO: 127948 - RNA, 21 nt, Homo sapiens
ucucauuacugaugagccaga

SEQ ID NO: 127949 - RNA, 22 nt, Homo sapiens
ucucauuggucugagucaccug

SEQ ID NO: 127950 - RNA, 22 nt, Homo sapiens
ucucccauccguacacggauug

SEQ ID NO: 127951 - RNA, 22 nt, Homo sapiens
ucucugauuaaacaagauagug

SEQ ID NO: 127952 - RNA, 22 nt, Homo sapiens
ucucuuggugacuuaaaauguu

SEQ ID NO: 127953 - RNA, 22 nt, Homo sapiens
ucucuugguugaacaguuugga

SEQ ID NO: 127954 - RNA, 22 nt, Homo sapiens
ucugacacuucugcagaauuga

SEQ ID NO: 127955 - RNA, 19 nt, Homo sapiens
ucugacagccccagucaac

SEQ ID NO: 127956 - RNA, 22 nt, Homo sapiens
ucugacucuggagucucagguu

SEQ ID NO: 127957 - RNA, 22 nt, Homo sapiens
ucugacucugugaugggcccaa

SEQ ID NO: 127958 - RNA, 22 nt, Homo sapiens
ucugagaucaugucugugcugu

SEQ ID NO: 127959 - RNA, 22 nt, Homo sapiens
ucugagcaugcaucuugccugg

SEQ ID NO: 127960 - RNA, 22 nt, Homo sapiens
ucugagguaggugcauggauac

SEQ ID NO: 127961 - RNA, 23 nt, Homo sapiens
ucugauguuauaaaauucuuugg

SEQ ID NO: 127962 - RNA, 22 nt, Homo sapiens
ucugccacugucauugugugau

SEQ ID NO: 127963 - RNA, 23 nt, Homo sapiens
ucuggaucauucguagugccagc

SEQ ID NO: 127964 - RNA, 22 nt, Homo sapiens
ucuggcauuuucucugcuugca

SEQ ID NO: 127965 - RNA, 22 nt, Homo sapiens
ucuggccccucccaaaucucau

SEQ ID NO: 127966 - RNA, 22 nt, Homo sapiens
ucuggcuccacacuuuauuaac

SEQ ID NO: 127967 - RNA, 22 nt, Homo sapiens
ucuggcuuuagcaugugggaag

SEQ ID NO: 127968 - RNA, 22 nt, Homo sapiens
ucuggcuuugugaguugccaga

SEQ ID NO: 127969 - RNA, 22 nt, Homo sapiens
ucuggguuuuguaccgugcucg

SEQ ID NO: 127970 - RNA, 22 nt, Homo sapiens
ucugguggugaugagagacagu

SEQ ID NO: 127971 - RNA, 22 nt, Homo sapiens
ucuggugugcucuggacuugca

SEQ ID NO: 127972 - RNA, 22 nt, Homo sapiens
ucugguuccugcauucauucaa

SEQ ID NO: 127973 - RNA, 22 nt, Homo sapiens
ucuguacuccuugaguagugcu

SEQ ID NO: 127974 - RNA, 22 nt, Homo sapiens
ucugucuuguccucacccuaga

SEQ ID NO: 127975 - RNA, 22 nt, Homo sapiens
ucugucuuugccuaaguuuguc

SEQ ID NO: 127976 - RNA, 22 nt, Homo sapiens
ucugucuuugucaggaccagag

SEQ ID NO: 127977 - RNA, 22 nt, Homo sapiens
ucugugaaaucauuuccuguaa

SEQ ID NO: 127978 - RNA, 22 nt, Homo sapiens
ucugugaaugugaccuuauuug

SEQ ID NO: 127979 - RNA, 22 nt, Homo sapiens
ucugugguucuagcuacuuugg

SEQ ID NO: 127980 - RNA, 21 nt, Homo sapiens
ucuguguugaucucacuggga

SEQ ID NO: 127981 - RNA, 22 nt, Homo sapiens
ucuguugguucuuugaggagga

SEQ ID NO: 127982 - RNA, 22 nt, Homo sapiens
ucuguuguuguuuuaagagaca

SEQ ID NO: 127983 - RNA, 22 nt, Homo sapiens
ucuuaggugaugauugauguga

SEQ ID NO: 127984 - RNA, 22 nt, Homo sapiens
ucuuaguuuagauuagcaauuc

SEQ ID NO: 127985 - RNA, 22 nt, Homo sapiens
ucuucuagcggaacccucuugu

SEQ ID NO: 127986 - RNA, 22 nt, Homo sapiens
ucuugaacuucauaggucuaga

SEQ ID NO: 127987 - RNA, 22 nt, Homo sapiens
ucuugcaccuacaugcuuuguc

SEQ ID NO: 127988 - RNA, 22 nt, Homo sapiens
ucuugguugaaaauucauaaua

SEQ ID NO: 127989 - RNA, 20 nt, Homo sapiens
ucuugguuggaggucuuuua

SEQ ID NO: 127990 - RNA, 22 nt, Homo sapiens
ucuugguuuauugugguaugaa

SEQ ID NO: 127991 - RNA, 22 nt, Homo sapiens
ucuugucacugcauccccagcu

SEQ ID NO: 127992 - RNA, 17 nt, Homo sapiens
ucuugugguucuugaau

SEQ ID NO: 127993 - RNA, 22 nt, Homo sapiens
ucuuuaguaauuucuguaaggc

SEQ ID NO: 127994 - RNA, 22 nt, Homo sapiens
ucuuuagugacaguugugcaag

SEQ ID NO: 127995 - RNA, 22 nt, Homo sapiens
ucuuucacuuagcaugauguuu

SEQ ID NO: 127996 - RNA, 22 nt, Homo sapiens
ucuuugauuuuguuacuaagac

SEQ ID NO: 127997 - RNA, 19 nt, Homo sapiens
ucuuugcuuuucuaagagg

SEQ ID NO: 127998 - RNA, 22 nt, Homo sapiens
ucuuuggauggaaauuggaguc

SEQ ID NO: 127999 - RNA, 22 nt, Homo sapiens
ucuuuggguagauauguagcug

SEQ ID NO: 128000 - RNA, 22 nt, Homo sapiens
ucuuugguauuuguggggaauu

SEQ ID NO: 128001 - RNA, 22 nt, Homo sapiens
ucuuuggucagaaagauuacac

SEQ ID NO: 128002 - RNA, 22 nt, Homo sapiens
ucuuuggucaucaugggaagca

SEQ ID NO: 128003 - RNA, 22 nt, Homo sapiens
ucuuuggucuacuuucauaugu

SEQ ID NO: 128004 - RNA, 22 nt, Homo sapiens
ucuuugguucugugcagccuau

SEQ ID NO: 128005 - RNA, 22 nt, Homo sapiens
ucuuugguuucugucucuguaa

SEQ ID NO: 128006 - RNA, 22 nt, Homo sapiens
ucuuuguuuucugauccugaag

SEQ ID NO: 128007 - RNA, 22 nt, Homo sapiens
ucuuuuggguauggagccauca

SEQ ID NO: 128008 - RNA, 22 nt, Homo sapiens
ugaaaaguuguugaaggcuuca

SEQ ID NO: 128009 - RNA, 22 nt, Homo sapiens
ugaaacacacagagaagggaga

SEQ ID NO: 128010 - RNA, 22 nt, Homo sapiens
ugaaaucuuugaugguggcauu

SEQ ID NO: 128011 - RNA, 21 nt, Homo sapiens
ugaaaugcaugugcacauuaa

SEQ ID NO: 128012 - RNA, 22 nt, Homo sapiens
ugaaaugccuugagauuuugac

SEQ ID NO: 128013 - RNA, 22 nt, Homo sapiens
ugaaauuauucuuaccaaggug

SEQ ID NO: 128014 - RNA, 22 nt, Homo sapiens
ugaaauuguuugcaaggauagg

SEQ ID NO: 128015 - RNA, 22 nt, Homo sapiens
ugaacacagccugccucugcca

SEQ ID NO: 128016 - RNA, 22 nt, Homo sapiens
ugaacacaucuccugguaccug

SEQ ID NO: 128017 - RNA, 22 nt, Homo sapiens
ugaacagcuaucuugucagugu

SEQ ID NO: 128018 - RNA, 22 nt, Homo sapiens
ugaacucagcauccagggccaa

SEQ ID NO: 128019 - RNA, 22 nt, Homo sapiens
ugaagaucauacugguggaggg

SEQ ID NO: 128020 - RNA, 22 nt, Homo sapiens
ugaaggccgggcaugguggcuc

SEQ ID NO: 128021 - RNA, 22 nt, Homo sapiens
ugaaguagguucucguaucgcc

SEQ ID NO: 128022 - RNA, 22 nt, Homo sapiens
ugaagugaagacucacagaagg

SEQ ID NO: 128023 - RNA, 22 nt, Homo sapiens
ugcagugugcuggggucuccau

SEQ ID NO: 128024 - RNA, 21 nt, Homo sapiens
ugcagugugguugcccugcug

SEQ ID NO: 128025 - RNA, 22 nt, Homo sapiens
ugcauaggagcagggucuaugu

SEQ ID NO: 128026 - RNA, 19 nt, Homo sapiens
ugcauaggguuacauacuc

SEQ ID NO: 128027 - RNA, 22 nt, Homo sapiens
ugcauaucuucuuuugagaaau

SEQ ID NO: 128028 - RNA, 22 nt, Homo sapiens
ugcauauguauacaugugccau

SEQ ID NO: 128029 - RNA, 22 nt, Homo sapiens
ugcauauguugaaccagccuug

SEQ ID NO: 128030 - RNA, 22 nt, Homo sapiens
ugcauauucaaggcaggccauu

SEQ ID NO: 128031 - RNA, 22 nt, Homo sapiens
ugcauauucuaggauuuuguau

SEQ ID NO: 128032 - RNA, 22 nt, Homo sapiens
ugcauccauucuagacucaucu

SEQ ID NO: 128033 - RNA, 21 nt, Homo sapiens
ugcauggagaacacugagggu

SEQ ID NO: 128034 - RNA, 22 nt, Homo sapiens
ugcauuaguaaguaauuuuaau

SEQ ID NO: 128035 - RNA, 21 nt, Homo sapiens
ugcauuggagaauguuucuca

SEQ ID NO: 128036 - RNA, 22 nt, Homo sapiens
ugccaagauuucaggaauuaag

SEQ ID NO: 128037 - RNA, 22 nt, Homo sapiens
ugccaggaugaggucaauguuu

SEQ ID NO: 128038 - RNA, 22 nt, Homo sapiens
ugccaguguuuuguugaagauu

SEQ ID NO: 128039 - RNA, 19 nt, Homo sapiens
ugccauguagcacaugguc

SEQ ID NO: 128040 - RNA, 22 nt, Homo sapiens
ugcccuuugucagaugaguagg

SEQ ID NO: 128041 - RNA, 22 nt, Homo sapiens
ugccuagagagaaccauaacug

SEQ ID NO: 128042 - RNA, 22 nt, Homo sapiens
ugccuaggcccaguccucagaa

SEQ ID NO: 128043 - RNA, 22 nt, Homo sapiens
ugccuaggcuggaaugcagugg

SEQ ID NO: 128044 - RNA, 22 nt, Homo sapiens
ugccugagcccagcccuguagu

SEQ ID NO: 128045 - RNA, 22 nt, Homo sapiens
ugccugauacccucugucucuc

SEQ ID NO: 128046 - RNA, 22 nt, Homo sapiens
ugccugcugucuaauauauucu

SEQ ID NO: 128047 - RNA, 22 nt, Homo sapiens
ugccuucuguuaaacgaggaug

SEQ ID NO: 128048 - RNA, 16 nt, Homo sapiens
ugccuucuucuguauu

SEQ ID NO: 128049 - RNA, 22 nt, Homo sapiens
ugccuuuguucuggaaugggaa

SEQ ID NO: 128050 - RNA, 21 nt, Homo sapiens
ugcuacugucacuuccuuugu

SEQ ID NO: 128051 - RNA, 22 nt, Homo sapiens
ugcuaucauugauuagugaugu

SEQ ID NO: 128052 - RNA, 22 nt, Homo sapiens
ugcuauguccccacccaaaucu

SEQ ID NO: 128053 - RNA, 22 nt, Homo sapiens
ugcucaguuuaaaacuuuugag

SEQ ID NO: 128054 - RNA, 18 nt, Homo sapiens
ugcuccccugggugagca

SEQ ID NO: 128055 - RNA, 22 nt, Homo sapiens
ugcugcaaacaugagaggaagu

SEQ ID NO: 128056 - RNA, 22 nt, Homo sapiens
ugcugcaaucucggcacuuugg

SEQ ID NO: 128057 - RNA, 22 nt, Homo sapiens
ugcugcacaguucuuaagauua

SEQ ID NO: 128058 - RNA, 22 nt, Homo sapiens
ugcuggcguuacucuccaucag

SEQ ID NO: 128059 - RNA, 22 nt, Homo sapiens
ugcugguauuuggaccagccug

SEQ ID NO: 128060 - RNA, 22 nt, Homo sapiens
ugcuggugauucagauucaaau

SEQ ID NO: 128061 - RNA, 22 nt, Homo sapiens
ugcugguggucccauaugauua

SEQ ID NO: 128062 - RNA, 22 nt, Homo sapiens
ugcugguguggucuagccgcuu

SEQ ID NO: 128063 - RNA, 22 nt, Homo sapiens
ugcugguuuucaucaucagugg

SEQ ID NO: 128064 - RNA, 22 nt, Homo sapiens
ugcuguuguuugaugaaguaau

SEQ ID NO: 128065 - RNA, 21 nt, Homo sapiens
ugcuuacugaauguuaauuuc

SEQ ID NO: 128066 - RNA, 17 nt, Homo sapiens
ugcuuagagagccucag

SEQ ID NO: 128067 - RNA, 22 nt, Homo sapiens
ugcuuaggcuaacaaaaauagc

SEQ ID NO: 128068 - RNA, 22 nt, Homo sapiens
ugcuuguguucagguaaccuuu

SEQ ID NO: 128069 - RNA, 22 nt, Homo sapiens
uggaaaacaugcacauuggauu

SEQ ID NO: 128070 - RNA, 21 nt, Homo sapiens
uggaaacuucuagcuuacgua

SEQ ID NO: 128071 - RNA, 22 nt, Homo sapiens
uggaaaguacuugaguuuguau

SEQ ID NO: 128072 - RNA, 22 nt, Homo sapiens
uggaaaguaguucuaaucuaag

SEQ ID NO: 128073 - RNA, 22 nt, Homo sapiens
uggaaauaaaauagaguuugcc

SEQ ID NO: 128074 - RNA, 22 nt, Homo sapiens
uggaagacucaagguggugaau

SEQ ID NO: 128075 - RNA, 22 nt, Homo sapiens
uggaagcauagcagcgugugug

SEQ ID NO: 128076 - RNA, 22 nt, Homo sapiens
uggaagucaugcugcaagaaca

SEQ ID NO: 128077 - RNA, 22 nt, Homo sapiens
uggaagucuauggcauuugagu

SEQ ID NO: 128078 - RNA, 22 nt, Homo sapiens
uggaagugaacaaccaaggcag

SEQ ID NO: 128079 - RNA, 22 nt, Homo sapiens
uggaaguuaaauuaguugauga

SEQ ID NO: 128080 - RNA, 22 nt, Homo sapiens
uggaaucaucaacgaaugaaau

SEQ ID NO: 128081 - RNA, 21 nt, Homo sapiens
uggaaucuauagaggcaguag

SEQ ID NO: 128082 - RNA, 21 nt, Homo sapiens
uggaaucuauuauuccaguuu

SEQ ID NO: 128083 - RNA, 20 nt, Homo sapiens
uggaaucugaagaucucagu

SEQ ID NO: 128084 - RNA, 22 nt, Homo sapiens
uggaaucuuaggugaaggcuuu

SEQ ID NO: 128085 - RNA, 22 nt, Homo sapiens
uggaaugucuauguuuuugauu

SEQ ID NO: 128086 - RNA, 22 nt, Homo sapiens
uggaauguuauggcuuuaaucu

SEQ ID NO: 128087 - RNA, 22 nt, Homo sapiens
uggaauuuagguugauaguaua

SEQ ID NO: 128088 - RNA, 22 nt, Homo sapiens
uggacaagauagguucuauauu

SEQ ID NO: 128089 - RNA, 22 nt, Homo sapiens
uggacagaaacauguuuucagu

SEQ ID NO: 128090 - RNA, 22 nt, Homo sapiens
uggacauguacauauguguaug

SEQ ID NO: 128091 - RNA, 22 nt, Homo sapiens
uggagagucauuuauaguauuu

SEQ ID NO: 128092 - RNA, 22 nt, Homo sapiens
uggagagugagggccuccuuaa

SEQ ID NO: 128093 - RNA, 22 nt, Homo sapiens
uggagcaaaguugaggccaagc

SEQ ID NO: 128094 - RNA, 22 nt, Homo sapiens
uggaggacugcagaacugaggc

SEQ ID NO: 128095 - RNA, 22 nt, Homo sapiens
uggagggcuagucauuucuuuu

SEQ ID NO: 128096 - RNA, 22 nt, Homo sapiens
uggagguagacauugggaagag

SEQ ID NO: 128097 - RNA, 22 nt, Homo sapiens
uggagguagagaugggaucucc

SEQ ID NO: 128098 - RNA, 22 nt, Homo sapiens
uggagguaggugauauguagca

SEQ ID NO: 128099 - RNA, 22 nt, Homo sapiens
uggaguauuauguaauuucaau

SEQ ID NO: 128100 - RNA, 22 nt, Homo sapiens
uggagucuugcucuguugccca

SEQ ID NO: 128101 - RNA, 22 nt, Homo sapiens
uggagugagaacuucaaugaug

SEQ ID NO: 128102 - RNA, 22 nt, Homo sapiens
uggaguguaauuagccaucagu

SEQ ID NO: 128103 - RNA, 22 nt, Homo sapiens
uggauagaacuaagugcuuaga

SEQ ID NO: 128104 - RNA, 22 nt, Homo sapiens
uggauagauacuauccaggacu

SEQ ID NO: 128105 - RNA, 22 nt, Homo sapiens
uggauaguaaagucagauuccc

SEQ ID NO: 128106 - RNA, 22 nt, Homo sapiens
uggauaguuuacugaagagugg

SEQ ID NO: 128107 - RNA, 22 nt, Homo sapiens
uggauauguucuuuguguaagg

SEQ ID NO: 128108 - RNA, 22 nt, Homo sapiens
uggaugacuguuauaugcauau

SEQ ID NO: 128109 - RNA, 22 nt, Homo sapiens
uggauggucagaggguuucugu

SEQ ID NO: 128110 - RNA, 18 nt, Homo sapiens
uggauuguacuguguucu

SEQ ID NO: 128111 - RNA, 19 nt, Homo sapiens
uggauuguuagagcagugu

SEQ ID NO: 128112 - RNA, 22 nt, Homo sapiens
uggauuuuaauuauucugucau

SEQ ID NO: 128113 - RNA, 22 nt, Homo sapiens
uggcaaaaaaccgcaguugccu

SEQ ID NO: 128114 - RNA, 22 nt, Homo sapiens
uggcaaaaaucacaaguaccuu

SEQ ID NO: 128115 - RNA, 22 nt, Homo sapiens
uggcaaauuccaaaguuaauuc

SEQ ID NO: 128116 - RNA, 21 nt, Homo sapiens
uggcaacauggauggauucug

SEQ ID NO: 128117 - RNA, 22 nt, Homo sapiens
uggcaagaaccacaauuacuuu

SEQ ID NO: 128118 - RNA, 22 nt, Homo sapiens
uggcaagaacgaaauguagggu

SEQ ID NO: 128119 - RNA, 22 nt, Homo sapiens
uggcaagagaacaacaucucuc

SEQ ID NO: 128120 - RNA, 22 nt, Homo sapiens
uggcaagagcaaaauguacagu

SEQ ID NO: 128121 - RNA, 22 nt, Homo sapiens
uggcaagcuuuaauugacucuu

SEQ ID NO: 128122 - RNA, 18 nt, Homo sapiens
uggcaaguuuaguagcac

SEQ ID NO: 128123 - RNA, 22 nt, Homo sapiens
uggcacaaugacccuugugggc

SEQ ID NO: 128124 - RNA, 22 nt, Homo sapiens
uggcaccauccaggugucucua

SEQ ID NO: 128125 - RNA, 22 nt, Homo sapiens
uggcagcgugaaagacuuuuuc

SEQ ID NO: 128126 - RNA, 22 nt, Homo sapiens
uggcaggugcacuggcuuugaa

SEQ ID NO: 128127 - RNA, 22 nt, Homo sapiens
uggcauggaguggauggcccca

SEQ ID NO: 128128 - RNA, 22 nt, Homo sapiens
uggcaugggguaguagcgcugg

SEQ ID NO: 128129 - RNA, 22 nt, Homo sapiens
uggcaugucagguuucuggguu

SEQ ID NO: 128130 - RNA, 22 nt, Homo sapiens
uggcauuguccaauaaaauuuu

SEQ ID NO: 128131 - RNA, 22 nt, Homo sapiens
uggcauuuugugugaauuagaa

SEQ ID NO: 128132 - RNA, 22 nt, Homo sapiens
uggcauuuuguuuuagaauuag

SEQ ID NO: 128133 - RNA, 23 nt, Homo sapiens
uggcauuuuuggcaaugccuucu

SEQ ID NO: 128134 - RNA, 22 nt, Homo sapiens
uggccagugucggaggccagga

SEQ ID NO: 128135 - RNA, 22 nt, Homo sapiens
uggccuguaacccucucauagg

SEQ ID NO: 128136 - RNA, 22 nt, Homo sapiens
uggccuuuuccaagaacuacua

SEQ ID NO: 128137 - RNA, 22 nt, Homo sapiens
uggcgagaaaccauaugcuuuc

SEQ ID NO: 128138 - RNA, 20 nt, Homo sapiens
uggcuaaaugaaugauagca

SEQ ID NO: 128139 - RNA, 22 nt, Homo sapiens
uggcuaaguuaaucaaggagau

SEQ ID NO: 128140 - RNA, 22 nt, Homo sapiens
uggcuacugacugaugauuaua

SEQ ID NO: 128141 - RNA, 22 nt, Homo sapiens
uggcuagaccugcauaacagcu

SEQ ID NO: 128142 - RNA, 22 nt, Homo sapiens
uggcuauuucgucaugcucccc

SEQ ID NO: 128143 - RNA, 21 nt, Homo sapiens
uggcuauuucuguggcauaca

SEQ ID NO: 128144 - RNA, 22 nt, Homo sapiens
uggcuccguuguacaggcugga

SEQ ID NO: 128145 - RNA, 22 nt, Homo sapiens
uggcucuuucuagacuuaauua

SEQ ID NO: 128146 - RNA, 20 nt, Homo sapiens
uggcucuuugcugcuaaagu

SEQ ID NO: 128147 - RNA, 21 nt, Homo sapiens
uggcuguuuucaugcuagaac

SEQ ID NO: 128148 - RNA, 21 nt, Homo sapiens
uggcuuauuugaaucuggcuu

SEQ ID NO: 128149 - RNA, 20 nt, Homo sapiens
uggcuucuuaauugcaggca

SEQ ID NO: 128150 - RNA, 22 nt, Homo sapiens
uggcuuuuaucuacucucaacu

SEQ ID NO: 128151 - RNA, 22 nt, Homo sapiens
ugggaagaagguuuacuugcca

SEQ ID NO: 128152 - RNA, 22 nt, Homo sapiens
ugggaagaugcugcuucuuccu

SEQ ID NO: 128153 - RNA, 22 nt, Homo sapiens
ugggaucagucuggaauauuga

SEQ ID NO: 128154 - RNA, 22 nt, Homo sapiens
ugggaucauucaaugacgaaau

SEQ ID NO: 128155 - RNA, 22 nt, Homo sapiens
ugggaucuuuccuauuagcgag

SEQ ID NO: 128156 - RNA, 22 nt, Homo sapiens
ugggaugaauacaaugggauca

SEQ ID NO: 128157 - RNA, 22 nt, Homo sapiens
ugggaugugagucuucgcuuuc

SEQ ID NO: 128158 - RNA, 22 nt, Homo sapiens
ugggcaagagagcaugacccug

SEQ ID NO: 128159 - RNA, 21 nt, Homo sapiens
ugggccccuuccuuacaucau

SEQ ID NO: 128160 - RNA, 22 nt, Homo sapiens
ugggcggagacgugcagccgcc

SEQ ID NO: 128161 - RNA, 22 nt, Homo sapiens
ugggguagaauagaauugauau

SEQ ID NO: 128162 - RNA, 22 nt, Homo sapiens
ugggguaggcuguauacucugu

SEQ ID NO: 128163 - RNA, 22 nt, Homo sapiens
uggggucguaggugcccgccag

SEQ ID NO: 128164 - RNA, 22 nt, Homo sapiens
uggguagaugaauccauuccaa

SEQ ID NO: 128165 - RNA, 19 nt, Homo sapiens
uggguagugaugagacaua

SEQ ID NO: 128166 - RNA, 22 nt, Homo sapiens
uggguaguguaaagcacuccag

SEQ ID NO: 128167 - RNA, 22 nt, Homo sapiens
ugggugaguaucuauuauucag

SEQ ID NO: 128168 - RNA, 17 nt, Homo sapiens
ugguagguuuuucuggc

SEQ ID NO: 128169 - RNA, 22 nt, Homo sapiens
ugguaugucuuucuuccuguag

SEQ ID NO: 128170 - RNA, 22 nt, Homo sapiens
ugguauguugucucuuuguucu

SEQ ID NO: 128171 - RNA, 22 nt, Homo sapiens
ugguauguuuauaaguauagga

SEQ ID NO: 128172 - RNA, 22 nt, Homo sapiens
uggucaaaugccaaucuguagu

SEQ ID NO: 128173 - RNA, 22 nt, Homo sapiens
uggucaccugaauuaugcaugu

SEQ ID NO: 128174 - RNA, 22 nt, Homo sapiens
uggucaccuucuugcucugucu

SEQ ID NO: 128175 - RNA, 22 nt, Homo sapiens
uggucagaugcugaguggaucu

SEQ ID NO: 128176 - RNA, 19 nt, Homo sapiens
uggucaguucugggagcug

SEQ ID NO: 128177 - RNA, 22 nt, Homo sapiens
uggucaguugaguccuugccaa

SEQ ID NO: 128178 - RNA, 22 nt, Homo sapiens
ugguccacuaacccucaguauc

SEQ ID NO: 128179 - RNA, 22 nt, Homo sapiens
ugguccucugcuuccagaauuc

SEQ ID NO: 128180 - RNA, 22 nt, Homo sapiens
uggucucuuugcuuuagucauc

SEQ ID NO: 128181 - RNA, 22 nt, Homo sapiens
uggugcaaugaagugaucucaa

SEQ ID NO: 128182 - RNA, 22 nt, Homo sapiens
uggugcccuguccuucuguggc

SEQ ID NO: 128183 - RNA, 17 nt, Homo sapiens
uggugcuugaaaguugc

SEQ ID NO: 128184 - RNA, 22 nt, Homo sapiens
uggugcuugaugaggguggagc

SEQ ID NO: 128185 - RNA, 20 nt, Homo sapiens
ugguguuugaacagugaaug

SEQ ID NO: 128186 - RNA, 22 nt, Homo sapiens
uguaaagaaagcuguuguugua

SEQ ID NO: 128187 - RNA, 22 nt, Homo sapiens
uguaacaggaggaaaaugugaa

SEQ ID NO: 128188 - RNA, 22 nt, Homo sapiens
uguaacaguaguuacuauucuu

SEQ ID NO: 128189 - RNA, 22 nt, Homo sapiens
uguaauuuaaaugauccuugga

SEQ ID NO: 128190 - RNA, 22 nt, Homo sapiens
uguacaaauuucugugguggug

SEQ ID NO: 128191 - RNA, 22 nt, Homo sapiens
uguagacaccaaagacagcaua

SEQ ID NO: 128192 - RNA, 22 nt, Homo sapiens
uguagauaucauuagugcugug

SEQ ID NO: 128193 - RNA, 22 nt, Homo sapiens
uguagauauucuuucaguuuuu

SEQ ID NO: 128194 - RNA, 21 nt, Homo sapiens
uguagcagcaugauucauagu

SEQ ID NO: 128195 - RNA, 22 nt, Homo sapiens
uguagcagccauaaacacagug

SEQ ID NO: 128196 - RNA, 20 nt, Homo sapiens
uguagguguacaguaaggag

SEQ ID NO: 128197 - RNA, 22 nt, Homo sapiens
uguagucauuccuuuuugcuuu

SEQ ID NO: 128198 - RNA, 22 nt, Homo sapiens
uguaugguuauuuguggauggu

SEQ ID NO: 128199 - RNA, 22 nt, Homo sapiens
uguauguaaagacaggauaaca

SEQ ID NO: 128200 - RNA, 22 nt, Homo sapiens
uguauguugauguuauauucug

SEQ ID NO: 128201 - RNA, 22 nt, Homo sapiens
uguauuuguuguuaaauggaga

SEQ ID NO: 128202 - RNA, 20 nt, Homo sapiens
ugucaagaaacauuacuuau

SEQ ID NO: 128203 - RNA, 22 nt, Homo sapiens
ugucaaguugugguucaauuuu

SEQ ID NO: 128204 - RNA, 22 nt, Homo sapiens
ugucacauccaagaaggugcag

SEQ ID NO: 128205 - RNA, 22 nt, Homo sapiens
uuccuugagucuuuuuccugag

SEQ ID NO: 128206 - RNA, 22 nt, Homo sapiens
uuccuugguucagggaaggucc

SEQ ID NO: 128207 - RNA, 22 nt, Homo sapiens
uuccuuguuuauuuacaggagg

SEQ ID NO: 128208 - RNA, 21 nt, Homo sapiens
uucuaaguaaauguuggacau

SEQ ID NO: 128209 - RNA, 22 nt, Homo sapiens
uucuacagugacugcagccaua

SEQ ID NO: 128210 - RNA, 22 nt, Homo sapiens
uucuagagagaagacuuaagcu

SEQ ID NO: 128211 - RNA, 21 nt, Homo sapiens
uucuauggucagaauucaaua

SEQ ID NO: 128212 - RNA, 22 nt, Homo sapiens
uucucaauggaugugggaccag

SEQ ID NO: 128213 - RNA, 22 nt, Homo sapiens
uucucaauggcaacuuguugcu

SEQ ID NO: 128214 - RNA, 21 nt, Homo sapiens
uucucaggguguguccuaccc

SEQ ID NO: 128215 - RNA, 22 nt, Homo sapiens
uucucuaguuacuuuaauggag

SEQ ID NO: 128216 - RNA, 22 nt, Homo sapiens
uucucugggacauaggucgggu

SEQ ID NO: 128217 - RNA, 22 nt, Homo sapiens
uucugccaaucaacccacaucc

SEQ ID NO: 128218 - RNA, 22 nt, Homo sapiens
uucuggccuccauuuuucuccu

SEQ ID NO: 128219 - RNA, 22 nt, Homo sapiens
uucuggcucgauucucugaccg

SEQ ID NO: 128220 - RNA, 22 nt, Homo sapiens
uucugugguagaaaucucaaau

SEQ ID NO: 128221 - RNA, 22 nt, Homo sapiens
uucugugguuucauuuaccugu

SEQ ID NO: 128222 - RNA, 22 nt, Homo sapiens
uucuuagucaaguuguauuuca

SEQ ID NO: 128223 - RNA, 22 nt, Homo sapiens
uucuuccagccuugaggggccc

SEQ ID NO: 128224 - RNA, 22 nt, Homo sapiens
uucuucugguuaugaaauuuga

SEQ ID NO: 128225 - RNA, 22 nt, Homo sapiens
uucuugcugaauugugcccuuc

SEQ ID NO: 128226 - RNA, 22 nt, Homo sapiens
uucuuuaguucacuugcuccag

SEQ ID NO: 128227 - RNA, 21 nt, Homo sapiens
uucuuugcucaguguuagagu

SEQ ID NO: 128228 - RNA, 22 nt, Homo sapiens
uucuuugguacaagggccgacc

SEQ ID NO: 128229 - RNA, 22 nt, Homo sapiens
uugaaagucauggcacaggcaa

SEQ ID NO: 128230 - RNA, 22 nt, Homo sapiens
uugaaauguguaagcuccgaaa

SEQ ID NO: 128231 - RNA, 22 nt, Homo sapiens
uugaacuagaaccugcaaauuu

SEQ ID NO: 128232 - RNA, 22 nt, Homo sapiens
uugaaggaggugcucacucucg

SEQ ID NO: 128233 - RNA, 22 nt, Homo sapiens
uugaagguaauugguuuuauga

SEQ ID NO: 128234 - RNA, 22 nt, Homo sapiens
uugaagguagaaguucucaauu

SEQ ID NO: 128235 - RNA, 22 nt, Homo sapiens
uugaagguaggaugugcuauca

SEQ ID NO: 128236 - RNA, 22 nt, Homo sapiens
uugaaguagaaagacgaaauuu

SEQ ID NO: 128237 - RNA, 22 nt, Homo sapiens
uugaaguagcauuucaugucua

SEQ ID NO: 128238 - RNA, 22 nt, Homo sapiens
uugaaguaggaaaggaggaggu

SEQ ID NO: 128239 - RNA, 22 nt, Homo sapiens
uugaaguaugaccgcugagaau

SEQ ID NO: 128240 - RNA, 22 nt, Homo sapiens
uugaauaggcucaugcuuauca

SEQ ID NO: 128241 - RNA, 22 nt, Homo sapiens
uugaaugaaauuggugugggga

SEQ ID NO: 128242 - RNA, 18 nt, Homo sapiens
uugaaugcgucccagaga

SEQ ID NO: 128243 - RNA, 23 nt, Homo sapiens
uugaauguuuccccucccaaauu

SEQ ID NO: 128244 - RNA, 22 nt, Homo sapiens
uugacagagaaaagugugacuu

SEQ ID NO: 128245 - RNA, 22 nt, Homo sapiens
uugacaggaugcucagggccca

SEQ ID NO: 128246 - RNA, 22 nt, Homo sapiens
uugacaguggcuuaaauugguu

SEQ ID NO: 128247 - RNA, 22 nt, Homo sapiens
uugacauaaucauuucacagug

SEQ ID NO: 128248 - RNA, 22 nt, Homo sapiens
uugacuucagagcugauucaag

SEQ ID NO: 128249 - RNA, 22 nt, Homo sapiens
uugacuuuuaggaggaaaauga

SEQ ID NO: 128250 - RNA, 22 nt, Homo sapiens
uugagacugaacauuuguguac

SEQ ID NO: 128251 - RNA, 22 nt, Homo sapiens
uugagauagggucuaccucugu

SEQ ID NO: 128252 - RNA, 22 nt, Homo sapiens
uugagauaucuuggccuuugca

SEQ ID NO: 128253 - RNA, 22 nt, Homo sapiens
uugagaucaugcuacugcacuc

SEQ ID NO: 128254 - RNA, 22 nt, Homo sapiens
uugagauggagucucacucuuc

SEQ ID NO: 128255 - RNA, 22 nt, Homo sapiens
uugagauggagucucgcacugu

SEQ ID NO: 128256 - RNA, 22 nt, Homo sapiens
uugagauggagucucgcucugu

SEQ ID NO: 128257 - RNA, 22 nt, Homo sapiens
uugagauggagucucguucugu

SEQ ID NO: 128258 - RNA, 22 nt, Homo sapiens
uugagauggagucuugcgcugu

SEQ ID NO: 128259 - RNA, 22 nt, Homo sapiens
uugagauggugccacuguacuc

SEQ ID NO: 128260 - RNA, 22 nt, Homo sapiens
uugagauguaagauguuaauau

SEQ ID NO: 128261 - RNA, 22 nt, Homo sapiens
uugagauguaguuucacuccug

SEQ ID NO: 128262 - RNA, 22 nt, Homo sapiens
uugagauguauguauauaaugu

SEQ ID NO: 128263 - RNA, 22 nt, Homo sapiens
uugagcacaggaguuuugagac

SEQ ID NO: 128264 - RNA, 22 nt, Homo sapiens
uugagcaccaugccuggccaug

SEQ ID NO: 128265 - RNA, 22 nt, Homo sapiens
uugagcaucauguuagcacuca

SEQ ID NO: 128266 - RNA, 22 nt, Homo sapiens
uugagcucaucaagauagagaa

SEQ ID NO: 128267 - RNA, 23 nt, Homo sapiens
uugaggcauguaccaucaauauc

SEQ ID NO: 128268 - RNA, 22 nt, Homo sapiens
uugagggaaacauucacaucau

SEQ ID NO: 128269 - RNA, 22 nt, Homo sapiens
uugagggagccuguuagucccg

SEQ ID NO: 128270 - RNA, 22 nt, Homo sapiens
uugagggcugaauaccaaucag

SEQ ID NO: 128271 - RNA, 22 nt, Homo sapiens
uugaggguggcauauauugauu

SEQ ID NO: 128272 - RNA, 22 nt, Homo sapiens
uugagguauugauaaaacauuu

SEQ ID NO: 128273 - RNA, 20 nt, Homo sapiens
uugaggucaggaguuuggga

SEQ ID NO: 128274 - RNA, 22 nt, Homo sapiens
uugaguagauaccuaggaauag

SEQ ID NO: 128275 - RNA, 22 nt, Homo sapiens
uugaguaguaagugguucaccg

SEQ ID NO: 128276 - RNA, 22 nt, Homo sapiens
uugagugaaggcuguguucuug

SEQ ID NO: 128277 - RNA, 22 nt, Homo sapiens
uugauagguuuuauguauaguu

SEQ ID NO: 128278 - RNA, 22 nt, Homo sapiens
uugauaugacuaucuuuuaugu

SEQ ID NO: 128279 - RNA, 22 nt, Homo sapiens
uugauauguguauagcaugugg

SEQ ID NO: 128280 - RNA, 22 nt, Homo sapiens
uugauauucugagaagcugaag

SEQ ID NO: 128281 - RNA, 22 nt, Homo sapiens
uugaucaaaucugagugagaau

SEQ ID NO: 128282 - RNA, 22 nt, Homo sapiens
uugaucacuguacuaugacuau

SEQ ID NO: 128283 - RNA, 22 nt, Homo sapiens
uugaucaucagcuuugucaucu

SEQ ID NO: 128284 - RNA, 22 nt, Homo sapiens
uugauguguuuccaggauuugu

SEQ ID NO: 128285 - RNA, 22 nt, Homo sapiens
uugauguugaggacauaaaccu

SEQ ID NO: 128286 - RNA, 22 nt, Homo sapiens
uugauuuguagaaugccccaac

SEQ ID NO: 128287 - RNA, 22 nt, Homo sapiens
uugcaagaaaucagagccuucc

SEQ ID NO: 128288 - RNA, 22 nt, Homo sapiens
uugcaaggugcagcuuaugcaa

SEQ ID NO: 128289 - RNA, 22 nt, Homo sapiens
uugcaagugccguaacuaccaa

SEQ ID NO: 128290 - RNA, 22 nt, Homo sapiens
uugcacauggcaggugcucaau

SEQ ID NO: 128291 - RNA, 22 nt, Homo sapiens
uugcacuauaggaaaauguguc

SEQ ID NO: 128292 - RNA, 22 nt, Homo sapiens
uugcagugugacgacuauauuu

SEQ ID NO: 128293 - RNA, 19 nt, Homo sapiens
uugcauauguugaaccagg

SEQ ID NO: 128294 - RNA, 22 nt, Homo sapiens
uugcaugcacaguucucaauag

SEQ ID NO: 128295 - RNA, 22 nt, Homo sapiens
uugcaugcuccuuaugagaauc

SEQ ID NO: 128296 - RNA, 22 nt, Homo sapiens
uugcaugguuuuuaucugaaau

SEQ ID NO: 128297 - RNA, 22 nt, Homo sapiens
uugcauguacguacagagagag

SEQ ID NO: 128298 - RNA, 22 nt, Homo sapiens
uugccaucaucucuuacucagu

SEQ ID NO: 128299 - RNA, 20 nt, Homo sapiens
uugccgagagaaagguguua

SEQ ID NO: 128300 - RNA, 22 nt, Homo sapiens
uugcgaugaagacaaaacaugc

SEQ ID NO: 128301 - RNA, 22 nt, Homo sapiens
uugcuauguugcccagucugga

SEQ ID NO: 128302 - RNA, 22 nt, Homo sapiens
uugcuccccaggaaaggaagca

SEQ ID NO: 128303 - RNA, 22 nt, Homo sapiens
uugcugagucuuucuagguugc

SEQ ID NO: 128304 - RNA, 22 nt, Homo sapiens
uugcuuagagccaaucuugauu

SEQ ID NO: 128305 - RNA, 22 nt, Homo sapiens
uugcuucauucaacauugaggg

SEQ ID NO: 128306 - RNA, 22 nt, Homo sapiens
uugcuuuguugucuggggaaua

SEQ ID NO: 128307 - RNA, 22 nt, Homo sapiens
uuggaaaaauccaccuugaucu

SEQ ID NO: 128308 - RNA, 22 nt, Homo sapiens
uuggaaacaccuggugagguua

SEQ ID NO: 128309 - RNA, 22 nt, Homo sapiens
uuggaaacauuuaugguaacag

SEQ ID NO: 128310 - RNA, 22 nt, Homo sapiens
uuggaaagagguguuuaugacu

SEQ ID NO: 128311 - RNA, 22 nt, Homo sapiens
uuggaaaugguaaaggguuaau

SEQ ID NO: 128312 - RNA, 22 nt, Homo sapiens
uuggaagauuacuuaguuuucu

SEQ ID NO: 128313 - RNA, 23 nt, Homo sapiens
uuggaaugagaccuaagaguuuu

SEQ ID NO: 128314 - RNA, 22 nt, Homo sapiens
uuggaaugcacacugagccugc

SEQ ID NO: 128315 - RNA, 22 nt, Homo sapiens
uuggaauguacucuagccuaug

SEQ ID NO: 128316 - RNA, 22 nt, Homo sapiens
uuggaauuaaccuggugcugga

SEQ ID NO: 128317 - RNA, 22 nt, Homo sapiens
uuggaauuaagagauauuuucu

SEQ ID NO: 128318 - RNA, 19 nt, Homo sapiens
uuggaauuuuagaguuuga

SEQ ID NO: 128319 - RNA, 22 nt, Homo sapiens
uuggacuuuaagauagagaugu

SEQ ID NO: 128320 - RNA, 22 nt, Homo sapiens
uuggagcccuaacucucaguac

SEQ ID NO: 128321 - RNA, 22 nt, Homo sapiens
uuggagugugcucauaacugcu

SEQ ID NO: 128322 - RNA, 22 nt, Homo sapiens
uuggaguguucugguccgggcu

SEQ ID NO: 128323 - RNA, 22 nt, Homo sapiens
uuggauauucaguuuuuccauc

SEQ ID NO: 128324 - RNA, 22 nt, Homo sapiens
uuggcaaauagguuuuauugca

SEQ ID NO: 128325 - RNA, 22 nt, Homo sapiens
uuggcaaaugucacaaaucagg

SEQ ID NO: 128326 - RNA, 22 nt, Homo sapiens
uuggcaaguccccaccucucuc

SEQ ID NO: 128327 - RNA, 22 nt, Homo sapiens
uuggcacgugguggggcucgga

SEQ ID NO: 128328 - RNA, 22 nt, Homo sapiens
uuggcacugagcaagaacaggg

SEQ ID NO: 128329 - RNA, 22 nt, Homo sapiens
uuggcacugggaaaaugaccac

SEQ ID NO: 128330 - RNA, 20 nt, Homo sapiens
uuggcagagucuuuagggua

SEQ ID NO: 128331 - RNA, 22 nt, Homo sapiens
uuggcauuuauucuaaggucaa

SEQ ID NO: 128332 - RNA, 22 nt, Homo sapiens
uuggccauaugacuugcuuugg

SEQ ID NO: 128333 - RNA, 22 nt, Homo sapiens
uuggccccuccaaaucucaugu

SEQ ID NO: 128334 - RNA, 22 nt, Homo sapiens
uuggccccuuucauccacagcu

SEQ ID NO: 128335 - RNA, 19 nt, Homo sapiens
uuggcccugguucucuucu

SEQ ID NO: 128336 - RNA, 22 nt, Homo sapiens
uuggccuccuggucauauccag

SEQ ID NO: 128337 - RNA, 22 nt, Homo sapiens
uuggcuacagauuaugaauuuc

SEQ ID NO: 128338 - RNA, 22 nt, Homo sapiens
uuggcuuggagaguugaaaugu

SEQ ID NO: 128339 - RNA, 22 nt, Homo sapiens
uuggcuuguaaaaugaaaagcu

SEQ ID NO: 128340 - RNA, 22 nt, Homo sapiens
uugggaaugcuaaaccucuauu

SEQ ID NO: 128341 - RNA, 22 nt, Homo sapiens
uugggacuggaaggaguaaggg

SEQ ID NO: 128342 - RNA, 22 nt, Homo sapiens
uugggcaaguggcaugaccaug

SEQ ID NO: 128343 - RNA, 22 nt, Homo sapiens
uugggcuuuuagguccuuaaca

SEQ ID NO: 128344 - RNA, 22 nt, Homo sapiens
uuggguagugaguuccuccagg

SEQ ID NO: 128345 - RNA, 22 nt, Homo sapiens
uugguaaucccuagugucuaga

SEQ ID NO: 128346 - RNA, 22 nt, Homo sapiens
uugguacuagcugaucgcagag

SEQ ID NO: 128347 - RNA, 22 nt, Homo sapiens
uuggucucaucaagagcagcuu

SEQ ID NO: 128348 - RNA, 22 nt, Homo sapiens
uuggucugcucugauguuuucu

SEQ ID NO: 128349 - RNA, 22 nt, Homo sapiens
uugguuaucaucauuucagcaa

SEQ ID NO: 128350 - RNA, 22 nt, Homo sapiens
uuguaagaaucuagcucuuuau

SEQ ID NO: 128351 - RNA, 21 nt, Homo sapiens
uuguagcagcauaaucccaga

SEQ ID NO: 128352 - RNA, 22 nt, Homo sapiens
uuguaguguuuauucugucaac

SEQ ID NO: 128353 - RNA, 22 nt, Homo sapiens
uuguauaggcucaguaagaauc

SEQ ID NO: 128354 - RNA, 22 nt, Homo sapiens
uuguauguaaccauuuggcaaa

SEQ ID NO: 128355 - RNA, 22 nt, Homo sapiens
uuguauguuuguucuuucagau

SEQ ID NO: 128356 - RNA, 22 nt, Homo sapiens
uugucaaugggugagugcagag

SEQ ID NO: 128357 - RNA, 22 nt, Homo sapiens
uugucacccuacauaacaggga

SEQ ID NO: 128358 - RNA, 22 nt, Homo sapiens
uugucacccucucuuggugucu

SEQ ID NO: 128359 - RNA, 22 nt, Homo sapiens
uugucacuauaaauaagcauuu

SEQ ID NO: 128360 - RNA, 21 nt, Homo sapiens
uuguccccacccaaaucucau

SEQ ID NO: 128361 - RNA, 16 nt, Homo sapiens
uugucccuucccaaau

SEQ ID NO: 128362 - RNA, 22 nt, Homo sapiens
uuguccucuccaaaucucaugu

SEQ ID NO: 128363 - RNA, 22 nt, Homo sapiens
uugucuugcagcuuaggcauca

SEQ ID NO: 128364 - RNA, 22 nt, Homo sapiens
uugugaauggugcugcaguaaa

SEQ ID NO: 128365 - RNA, 22 nt, Homo sapiens
uugugcuucaucaccuagcaga

SEQ ID NO: 128366 - RNA, 22 nt, Homo sapiens
uugugcuuguaacuacauucag

SEQ ID NO: 128367 - RNA, 22 nt, Homo sapiens
uugugguaggaugaagagauga

SEQ ID NO: 128368 - RNA, 22 nt, Homo sapiens
uugugguuuucagcuuauauau

SEQ ID NO: 128369 - RNA, 22 nt, Homo sapiens
uuguuaugggguggcuugaaag

SEQ ID NO: 128370 - RNA, 22 nt, Homo sapiens
uuguuauguuaaacuacugaaa

SEQ ID NO: 128371 - RNA, 22 nt, Homo sapiens
uuuaaagcacggaguuuguggc

SEQ ID NO: 128372 - RNA, 22 nt, Homo sapiens
uuuaacauuggaugagaucguc

SEQ ID NO: 128373 - RNA, 20 nt, Homo sapiens
uuuaagacaugcugaauuga

SEQ ID NO: 128374 - RNA, 22 nt, Homo sapiens
uuuaaugcgucucugaguuuug

SEQ ID NO: 128375 - RNA, 17 nt, Homo sapiens
uuuaaugcuaggacucu

SEQ ID NO: 128376 - RNA, 19 nt, Homo sapiens
uuuagaucuuuuaugcagc

SEQ ID NO: 128377 - RNA, 22 nt, Homo sapiens
uuuagcucauucaauuucaguc

SEQ ID NO: 128378 - RNA, 22 nt, Homo sapiens
uuucacaguguucucccccaga

SEQ ID NO: 128379 - RNA, 21 nt, Homo sapiens
uuucacugugaguuuuucugu

SEQ ID NO: 128380 - RNA, 22 nt, Homo sapiens
uuucauggcgaggcuucauggg

SEQ ID NO: 128381 - RNA, 18 nt, Homo sapiens
uuucauugagugugauau

SEQ ID NO: 128382 - RNA, 21 nt, Homo sapiens
uuuccuggagcguauggcuuc

SEQ ID NO: 128383 - RNA, 22 nt, Homo sapiens
uuuccuguaggaaggaaauaga

SEQ ID NO: 128384 - RNA, 22 nt, Homo sapiens
uuucgugucuggucugugaugg

SEQ ID NO: 128385 - RNA, 22 nt, Homo sapiens
uuucuacagggcuugccaggua

SEQ ID NO: 128386 - RNA, 22 nt, Homo sapiens
uuucugagaccaaaacuuguaa

SEQ ID NO: 128387 - RNA, 22 nt, Homo sapiens
cacugcauccuccaccuccugg

SEQ ID NO: 128388 - RNA, 22 nt, Homo sapiens
cacugcgaccuccaccucccgg

SEQ ID NO: 128389 - RNA, 22 nt, Homo sapiens
cacuggacauguugaagcuuuu

SEQ ID NO: 128390 - RNA, 22 nt, Homo sapiens
cacugggugagauccauguuua

SEQ ID NO: 128391 - RNA, 17 nt, Homo sapiens
cacugggugcaagagga

SEQ ID NO: 128392 - RNA, 22 nt, Homo sapiens
cacugugcaaccuccaccuccc

SEQ ID NO: 128393 - RNA, 22 nt, Homo sapiens
cagagaucaugcaacugcucgc

SEQ ID NO: 128394 - RNA, 22 nt, Homo sapiens
cagagcaaugcuuuugcuuuga

SEQ ID NO: 128395 - RNA, 22 nt, Homo sapiens
cagagguaagcaagucagcauu

SEQ ID NO: 128396 - RNA, 22 nt, Homo sapiens
cagauacuccuggucucaggag

SEQ ID NO: 128397 - RNA, 22 nt, Homo sapiens
cagcaaaucauccuauuugagc

SEQ ID NO: 128398 - RNA, 22 nt, Homo sapiens
cagcaguuguuucggauuggga

SEQ ID NO: 128399 - RNA, 22 nt, Homo sapiens
cagcaucauucaucugggguaa

SEQ ID NO: 128400 - RNA, 22 nt, Homo sapiens
cagcucuuguuaaaacuaacua

SEQ ID NO: 128401 - RNA, 22 nt, Homo sapiens
cagcuggugcugcaccaguggg

SEQ ID NO: 128402 - RNA, 23 nt, Homo sapiens
cagcuucauugaacauaacuccu

SEQ ID NO: 128403 - RNA, 22 nt, Homo sapiens
caggcagucuggggguguaucc

SEQ ID NO: 128404 - RNA, 22 nt, Homo sapiens
caggcagugggagacaaaacug

SEQ ID NO: 128405 - RNA, 22 nt, Homo sapiens
cagguaagaugcuuucucuuau

SEQ ID NO: 128406 - RNA, 22 nt, Homo sapiens
cagguaggccaauguuuuccaa

SEQ ID NO: 128407 - RNA, 22 nt, Homo sapiens
caggugaaugccucuccuucug

SEQ ID NO: 128408 - RNA, 22 nt, Homo sapiens
caguagcaugccucagaaugag

SEQ ID NO: 128409 - RNA, 22 nt, Homo sapiens
cagucacagugacaggaugugg

SEQ ID NO: 128410 - RNA, 20 nt, Homo sapiens
cagucaugaagaacugugag

SEQ ID NO: 128411 - RNA, 22 nt, Homo sapiens
cagugacacugaaaaguucggg

SEQ ID NO: 128412 - RNA, 18 nt, Homo sapiens
cagugcaauacaggagag

SEQ ID NO: 128413 - RNA, 20 nt, Homo sapiens
cagugcacuuucccacuggu

SEQ ID NO: 128414 - RNA, 22 nt, Homo sapiens
cagugcauaggaucuaaaauuu

SEQ ID NO: 128415 - RNA, 23 nt, Homo sapiens
cagugcaugacuguauaugcaaa

SEQ ID NO: 128416 - RNA, 20 nt, Homo sapiens
cagugcauugcuucugauuu

SEQ ID NO: 128417 - RNA, 22 nt, Homo sapiens
cagugcuuguuauuguucuauu

SEQ ID NO: 128418 - RNA, 23 nt, Homo sapiens
cagugguguuagagaaaucuuuu

SEQ ID NO: 128419 - RNA, 22 nt, Homo sapiens
cagugucugcauuuggaacuca

SEQ ID NO: 128420 - RNA, 22 nt, Homo sapiens
caguuacuuuugcaccaaccua

SEQ ID NO: 128421 - RNA, 22 nt, Homo sapiens
cauacaugugcuugucuuaugc

SEQ ID NO: 128422 - RNA, 18 nt, Homo sapiens
cauagcacuucagcacau

SEQ ID NO: 128423 - RNA, 22 nt, Homo sapiens
caucacaguacuaaucgucaua

SEQ ID NO: 128424 - RNA, 23 nt, Homo sapiens
caucacauagaggaaagaggaca

SEQ ID NO: 128425 - RNA, 22 nt, Homo sapiens
caucagcaauguaugaggguuc

SEQ ID NO: 128426 - RNA, 19 nt, Homo sapiens
caucccugagcugaagugg

SEQ ID NO: 128427 - RNA, 22 nt, Homo sapiens
caucucauugaauugcugagca

SEQ ID NO: 128428 - RNA, 22 nt, Homo sapiens
caugaaagacugaggaauugga

SEQ ID NO: 128429 - RNA, 22 nt, Homo sapiens
caugauauugcagaauguuggu

SEQ ID NO: 128430 - RNA, 22 nt, Homo sapiens
caugcacugagagggucucggc

SEQ ID NO: 128431 - RNA, 22 nt, Homo sapiens
caugcacugaguccaccucugg

SEQ ID NO: 128432 - RNA, 22 nt, Homo sapiens
cauggauuuuuuugaauggcag

SEQ ID NO: 128433 - RNA, 22 nt, Homo sapiens
cauggcacaucuuuucugacua

SEQ ID NO: 128434 - RNA, 22 nt, Homo sapiens
cauggcccuggguccauaggaa

SEQ ID NO: 128435 - RNA, 22 nt, Homo sapiens
cauggcucuuugcugcuaaagu

SEQ ID NO: 128436 - RNA, 19 nt, Homo sapiens
cauggcuuauaauuuuaau

SEQ ID NO: 128437 - RNA, 22 nt, Homo sapiens
caugggacugucuuggcuauac

SEQ ID NO: 128438 - RNA, 22 nt, Homo sapiens
cauggguuuucucaaguaguca

SEQ ID NO: 128439 - RNA, 22 nt, Homo sapiens
cauguaguagaaggagccagac

SEQ ID NO: 128440 - RNA, 22 nt, Homo sapiens
cauugcaaugaggucuugcagu

SEQ ID NO: 128441 - RNA, 22 nt, Homo sapiens
cauugcacuccagccucggcaa

SEQ ID NO: 128442 - RNA, 20 nt, Homo sapiens
cauugcacuccagccugcug

SEQ ID NO: 128443 - RNA, 22 nt, Homo sapiens
cauugcacuccagccuggcaac

SEQ ID NO: 128444 - RNA, 22 nt, Homo sapiens
cauugcacuccagccuugguga

SEQ ID NO: 128445 - RNA, 22 nt, Homo sapiens
cauugcacuccagcuugggcaa

SEQ ID NO: 128446 - RNA, 22 nt, Homo sapiens
cauugcacuccagcuugggcga

SEQ ID NO: 128447 - RNA, 22 nt, Homo sapiens
cauugcacuccaucccgggaaa

SEQ ID NO: 128448 - RNA, 22 nt, Homo sapiens
cauugcacucuagucuggguga

SEQ ID NO: 128449 - RNA, 22 nt, Homo sapiens
cauugcacucuaucccgguggg

SEQ ID NO: 128450 - RNA, 22 nt, Homo sapiens
cauugcacucugcauuccaguc

SEQ ID NO: 128451 - RNA, 21 nt, Homo sapiens
aaucacaguuguucugccuuc

SEQ ID NO: 128452 - RNA, 22 nt, Homo sapiens
aaucagcacacugugcuuucca

SEQ ID NO: 128453 - RNA, 22 nt, Homo sapiens
aauccaugugcuuuaccauuuu

SEQ ID NO: 128454 - RNA, 22 nt, Homo sapiens
aauccauuugccgucuauccau

SEQ ID NO: 128455 - RNA, 22 nt, Homo sapiens
aaucucagagauaucugugucc

SEQ ID NO: 128456 - RNA, 22 nt, Homo sapiens
aaucugucuuuuguuauugagg

SEQ ID NO: 128457 - RNA, 22 nt, Homo sapiens
aaugauacuguguacaagggca

SEQ ID NO: 128458 - RNA, 22 nt, Homo sapiens
aaugcacauauauuuccuuauu

SEQ ID NO: 128459 - RNA, 22 nt, Homo sapiens
aaugccuagugugugacaggug

SEQ ID NO: 128460 - RNA, 22 nt, Homo sapiens
aaugcuguguuauuucaugacc

SEQ ID NO: 128461 - RNA, 22 nt, Homo sapiens
aauggagcugaguggccuuggg

SEQ ID NO: 128462 - RNA, 22 nt, Homo sapiens
aauggagcuguuuggaugacuu

SEQ ID NO: 128463 - RNA, 22 nt, Homo sapiens
aauggcagaugaaauugucauu

SEQ ID NO: 128464 - RNA, 22 nt, Homo sapiens
aauggcaguagauggaugggua

SEQ ID NO: 128465 - RNA, 22 nt, Homo sapiens
aauggcaucuagaguggugaau

SEQ ID NO: 128466 - RNA, 22 nt, Homo sapiens
aauggcuauuucaugugguagg

SEQ ID NO: 128467 - RNA, 21 nt, Homo sapiens
aaugguguugccaacaaggug

SEQ ID NO: 128468 - RNA, 22 nt, Homo sapiens
aaugguuuuaucagcguccaaa

SEQ ID NO: 128469 - RNA, 22 nt, Homo sapiens
aaugugcuguucagaggagucc

SEQ ID NO: 128470 - RNA, 22 nt, Homo sapiens
aauuacuucuacaccaaccuaa

SEQ ID NO: 128471 - RNA, 22 nt, Homo sapiens
aauuaguaaccuaauuccaucu

SEQ ID NO: 128472 - RNA, 22 nt, Homo sapiens
aauuaguuggcugccuaugauu

SEQ ID NO: 128473 - RNA, 22 nt, Homo sapiens
aauucugugagauggugcagau

SEQ ID NO: 128474 - RNA, 22 nt, Homo sapiens
aauugaaucaugugggcagacu

SEQ ID NO: 128475 - RNA, 22 nt, Homo sapiens
aauugaaugauaugggacauuu

SEQ ID NO: 128476 - RNA, 22 nt, Homo sapiens
aauugaaugcagaugccaggga

SEQ ID NO: 128477 - RNA, 22 nt, Homo sapiens
aauugaccuaaucugauuacug

SEQ ID NO: 128478 - RNA, 22 nt, Homo sapiens
aauugcacuaagcauaguccag

SEQ ID NO: 128479 - RNA, 22 nt, Homo sapiens
aauugcauaugcaguagaucua

SEQ ID NO: 128480 - RNA, 22 nt, Homo sapiens
aauuggcagugcucuugccaca

SEQ ID NO: 128481 - RNA, 22 nt, Homo sapiens
aauugguuaagauaagaucaua

SEQ ID NO: 128482 - RNA, 22 nt, Homo sapiens
aauugugcuuguaggccaggca

SEQ ID NO: 128483 - RNA, 22 nt, Homo sapiens
acaaagcuagggaauccaucuu

SEQ ID NO: 128484 - RNA, 22 nt, Homo sapiens
acaaagugccuccuuuuagagu

SEQ ID NO: 128485 - RNA, 22 nt, Homo sapiens
acaaaguguuuucugaaggccu

SEQ ID NO: 128486 - RNA, 22 nt, Homo sapiens
acaagugaauacaggauucucu

SEQ ID NO: 128487 - RNA, 22 nt, Homo sapiens
acaagugcuuuuccuggagaca

SEQ ID NO: 128488 - RNA, 22 nt, Homo sapiens
acacaguaaauauugucuccuc

SEQ ID NO: 128489 - RNA, 22 nt, Homo sapiens
acacagucaaauccacuuggcu

SEQ ID NO: 128490 - RNA, 22 nt, Homo sapiens
acacaugugaaaaaaauguuac

SEQ ID NO: 128491 - RNA, 22 nt, Homo sapiens
acacaugugcguagacucuuua

SEQ ID NO: 128492 - RNA, 22 nt, Homo sapiens
acacugcugaguaaauaauuuu

SEQ ID NO: 128493 - RNA, 22 nt, Homo sapiens
acacuggaggagagcuguugcu

SEQ ID NO: 128494 - RNA, 20 nt, Homo sapiens
acacuggcuuugagauuuag

SEQ ID NO: 128495 - RNA, 22 nt, Homo sapiens
gauggcacuaagccauguagga

SEQ ID NO: 128496 - RNA, 22 nt, Homo sapiens
gauggcaugugcugccaccaag

SEQ ID NO: 128497 - RNA, 22 nt, Homo sapiens
gaugugaaaucauaguuucuag

SEQ ID NO: 128498 - RNA, 22 nt, Homo sapiens
gauguguuuccaggauuuguuu

SEQ ID NO: 128499 - RNA, 22 nt, Homo sapiens
gauguguuuuaggaucucagca

SEQ ID NO: 128500 - RNA, 22 nt, Homo sapiens
gauuccauugcgaauuuucaga

SEQ ID NO: 128501 - RNA, 22 nt, Homo sapiens
gauuccauuuguggcuauuuac

SEQ ID NO: 128502 - RNA, 22 nt, Homo sapiens
gauuuuccaguggcccugauca

SEQ ID NO: 128503 - RNA, 22 nt, Homo sapiens
gauuuugguuagggaaggauac

SEQ ID NO: 128504 - RNA, 22 nt, Homo sapiens
gcaaaaaguagugcugguuagg

SEQ ID NO: 128505 - RNA, 22 nt, Homo sapiens
gcaaaauugagaagggaauaua

SEQ ID NO: 128506 - RNA, 23 nt, Homo sapiens
gcaaauaucguagagugucccug

SEQ ID NO: 128507 - RNA, 22 nt, Homo sapiens
gcaaaucuuauguccucacauu

SEQ ID NO: 128508 - RNA, 20 nt, Homo sapiens
gcaaauggaucccacaagcc

SEQ ID NO: 128509 - RNA, 22 nt, Homo sapiens
gcaacugguuucaguuuuucag

SEQ ID NO: 128510 - RNA, 22 nt, Homo sapiens
gcaagaguauuucaaggaagau

SEQ ID NO: 128511 - RNA, 22 nt, Homo sapiens
gcaagauuguguggcugaagua

SEQ ID NO: 128512 - RNA, 22 nt, Homo sapiens
gcaaugcugucugugcacagau

SEQ ID NO: 128513 - RNA, 22 nt, Homo sapiens
gcaauggaaucccuugaucaau

SEQ ID NO: 128514 - RNA, 22 nt, Homo sapiens
gcacacguagaagcaugcauca

SEQ ID NO: 128515 - RNA, 22 nt, Homo sapiens
gcacaggguuacauucuaaggu

SEQ ID NO: 128516 - RNA, 22 nt, Homo sapiens
gcacauggccccaucgugccga

SEQ ID NO: 128517 - RNA, 22 nt, Homo sapiens
gcacauuacaaguauuagcuca

SEQ ID NO: 128518 - RNA, 22 nt, Homo sapiens
gcaccacugcacucucagcuug

SEQ ID NO: 128519 - RNA, 22 nt, Homo sapiens
gcacgugcucauuugaggucuu

SEQ ID NO: 128520 - RNA, 22 nt, Homo sapiens
gcagaauugguuucuucuaagg

SEQ ID NO: 128521 - RNA, 22 nt, Homo sapiens
gcaggcaugacauuucacucuu

SEQ ID NO: 128522 - RNA, 22 nt, Homo sapiens
gcaguacuuuauguccuaauua

SEQ ID NO: 128523 - RNA, 20 nt, Homo sapiens
gcaguacuuuuaguucuaag

SEQ ID NO: 128524 - RNA, 22 nt, Homo sapiens
gcagugcaguggcgcgaucucg

SEQ ID NO: 128525 - RNA, 22 nt, Homo sapiens
gcagugugauguuuuaaucuau

SEQ ID NO: 128526 - RNA, 22 nt, Homo sapiens
gcagugugugaggaauuugggu

SEQ ID NO: 128527 - RNA, 22 nt, Homo sapiens
gcaguguucaaaucaugcccau

SEQ ID NO: 128528 - RNA, 22 nt, Homo sapiens
gcauaaagcuaauaagacgaag

SEQ ID NO: 128529 - RNA, 17 nt, Homo sapiens
gcauaugucgaaccagc

SEQ ID NO: 128530 - RNA, 17 nt, Homo sapiens
gcauauguugaaccagc

SEQ ID NO: 128531 - RNA, 17 nt, Homo sapiens
gcauauguugaaccagu

SEQ ID NO: 128532 - RNA, 22 nt, Homo sapiens
gcauauuuuaaaguguaaccug

SEQ ID NO: 128533 - RNA, 22 nt, Homo sapiens
gcaucacagggagacaggccuc

SEQ ID NO: 128534 - RNA, 22 nt, Homo sapiens
gcauggaaggcgcuuugugacu

SEQ ID NO: 128535 - RNA, 22 nt, Homo sapiens
gcauggaguggaaauucuuggg

SEQ ID NO: 128536 - RNA, 22 nt, Homo sapiens
gcaugugaauguguaagaaaau

SEQ ID NO: 128537 - RNA, 22 nt, Homo sapiens
gcauugcacuuggcauagacug

SEQ ID NO: 128538 - RNA, 18 nt, Homo sapiens
gccaacauguaaacaggu

SEQ ID NO: 128539 - RNA, 19 nt, Homo sapiens
gccaccuggugcguguucu

SEQ ID NO: 128540 - RNA, 22 nt, Homo sapiens
gccauggaggauuuauagaggc

SEQ ID NO: 128541 - RNA, 22 nt, Homo sapiens
gccauugcacuccagccuagcg

SEQ ID NO: 128542 - RNA, 22 nt, Homo sapiens
gccauugcacuccagccuaggc

SEQ ID NO: 128543 - RNA, 22 nt, Homo sapiens
gcccaguagcaguacaucccuu

SEQ ID NO: 128544 - RNA, 22 nt, Homo sapiens
gcccauuguuccuaggcuacaa

SEQ ID NO: 128545 - RNA, 22 nt, Homo sapiens
gccuagagaaguaaauauuauc

SEQ ID NO: 128546 - RNA, 22 nt, Homo sapiens
gccuaguguuaauguguguuca

SEQ ID NO: 128547 - RNA, 22 nt, Homo sapiens
gcgagcauuguaggaaguucag

SEQ ID NO: 128548 - RNA, 19 nt, Homo sapiens
gcggcacuggagacacagc

SEQ ID NO: 128549 - RNA, 22 nt, Homo sapiens
gcggguguuuuacccuugcaga

SEQ ID NO: 128550 - RNA, 22 nt, Homo sapiens
gcgugguguuagaaugagaagu

SEQ ID NO: 128551 - RNA, 22 nt, Homo sapiens
gcuaggagaucugcugcucucu

SEQ ID NO: 128552 - RNA, 22 nt, Homo sapiens
gcuaugguuuuuagcuccauca

SEQ ID NO: 128553 - RNA, 22 nt, Homo sapiens
gcucaguuuccucagcugcaaa

SEQ ID NO: 128554 - RNA, 22 nt, Homo sapiens
gcucguccccuccugacucugc

SEQ ID NO: 128555 - RNA, 17 nt, Homo sapiens
gcugcauucauguagaa

SEQ ID NO: 128556 - RNA, 22 nt, Homo sapiens
gcugcguguagaguucucacug

SEQ ID NO: 128557 - RNA, 22 nt, Homo sapiens
gcugcuguuucucuuucagcau

SEQ ID NO: 128558 - RNA, 22 nt, Homo sapiens
gcugcuuuugaugacaaaaaca

SEQ ID NO: 128559 - RNA, 22 nt, Homo sapiens
gcuggaauuaacauagaugugc

SEQ ID NO: 128560 - RNA, 22 nt, Homo sapiens
gcugguguagagugcagaaagg

SEQ ID NO: 128561 - RNA, 22 nt, Homo sapiens
gcuguauuguugaaggaaaugu

SEQ ID NO: 128562 - RNA, 22 nt, Homo sapiens
gcugucaugagcaacacaugaa

SEQ ID NO: 128563 - RNA, 20 nt, Homo sapiens
gcugugcuuaauacacuuuc

SEQ ID NO: 128564 - RNA, 22 nt, Homo sapiens
gcuguguucucgaggcggggga

SEQ ID NO: 128565 - RNA, 22 nt, Homo sapiens
gcuugguccccacccaaaucgc

SEQ ID NO: 128566 - RNA, 22 nt, Homo sapiens
gcuuggugugcaagugguacua

SEQ ID NO: 128567 - RNA, 22 nt, Homo sapiens
gcuuugcaauggcauugaccau

SEQ ID NO: 128568 - RNA, 22 nt, Homo sapiens
gcuuuggauaaaugucaguuua

SEQ ID NO: 128569 - RNA, 18 nt, Homo sapiens
ggaaaacuuuucuaagua

SEQ ID NO: 128570 - RNA, 22 nt, Homo sapiens
ggaaagacuauuguaaaggaug

SEQ ID NO: 128571 - RNA, 22 nt, Homo sapiens
ggaaagaucagcuaaauguaag

SEQ ID NO: 128572 - RNA, 22 nt, Homo sapiens
ggaaagauguaauauuaucuaa

SEQ ID NO: 128573 - RNA, 22 nt, Homo sapiens
ggaaagcuagguguggguguac

SEQ ID NO: 128574 - RNA, 22 nt, Homo sapiens
ggaaaucaucauucucgguaua

SEQ ID NO: 128575 - RNA, 22 nt, Homo sapiens
ggaaaucucugaggcucccuuc

SEQ ID NO: 128576 - RNA, 22 nt, Homo sapiens
ggaacaccauuuuuccugccuu

SEQ ID NO: 128577 - RNA, 22 nt, Homo sapiens
ggaagaauaaugggccuuagag

SEQ ID NO: 128578 - RNA, 22 nt, Homo sapiens
ggaagacaguguggugauuccu

SEQ ID NO: 128579 - RNA, 22 nt, Homo sapiens
ggaagacuggcuuguuuaccca

SEQ ID NO: 128580 - RNA, 18 nt, Homo sapiens
ggaagauuggcuaugugc

SEQ ID NO: 128581 - RNA, 22 nt, Homo sapiens
ggaagguaauugucagcucaua

SEQ ID NO: 128582 - RNA, 22 nt, Homo sapiens
ggaagugugaguaggauuugga

SEQ ID NO: 128583 - RNA, 22 nt, Homo sapiens
ggaaguuaauacagauagagua

SEQ ID NO: 128584 - RNA, 22 nt, Homo sapiens
ggaauguauuaaggcauugggc

SEQ ID NO: 128585 - RNA, 22 nt, Homo sapiens
cacugcacuccagucuggcgac

SEQ ID NO: 128586 - RNA, 22 nt, Homo sapiens
cacugcacucuucuucugggca

SEQ ID NO: 128587 - RNA, 22 nt, Homo sapiens
cacugcauucuccaccucccag

SEQ ID NO: 128588 - RNA, 22 nt, Homo sapiens
cacugcgacguccgccucccgg

SEQ ID NO: 128589 - RNA, 22 nt, Homo sapiens
cacugggccaucacuuaauauu

SEQ ID NO: 128590 - RNA, 22 nt, Homo sapiens
cagaaguauugguaugcucugu

SEQ ID NO: 128591 - RNA, 21 nt, Homo sapiens
cagagaucaucucuguuuuaa

SEQ ID NO: 128592 - RNA, 20 nt, Homo sapiens
cagagcaaagcaguccuggc

SEQ ID NO: 128593 - RNA, 22 nt, Homo sapiens
cagauacuggaguccugaaguu

SEQ ID NO: 128594 - RNA, 22 nt, Homo sapiens
cagaucaucuugagcuuaggaa

SEQ ID NO: 128595 - RNA, 22 nt, Homo sapiens
cagaugcaugaccugggcuugg

SEQ ID NO: 128596 - RNA, 22 nt, Homo sapiens
cagauggucuuaaggcagccuu

SEQ ID NO: 128597 - RNA, 22 nt, Homo sapiens
cagcaagucucuaagaguucau

SEQ ID NO: 128598 - RNA, 22 nt, Homo sapiens
cagcacauuacaaguacuuggu

SEQ ID NO: 128599 - RNA, 22 nt, Homo sapiens
cagcuaaauuguuaaauccaag

SEQ ID NO: 128600 - RNA, 22 nt, Homo sapiens
cagcucauugcagucucgaccu

SEQ ID NO: 128601 - RNA, 23 nt, Homo sapiens
cagcucauuuggguccccuuguc

SEQ ID NO: 128602 - RNA, 23 nt, Homo sapiens
cagcuggugauuuuaaguugaag

SEQ ID NO: 128603 - RNA, 22 nt, Homo sapiens
cagcugguguuacaaaccagag

SEQ ID NO: 128604 - RNA, 22 nt, Homo sapiens
caggaaugugaggguucccugc

SEQ ID NO: 128605 - RNA, 22 nt, Homo sapiens
caggcagucuggcucccaagug

SEQ ID NO: 128606 - RNA, 22 nt, Homo sapiens
caggcauagucuugaguuuuau

SEQ ID NO: 128607 - RNA, 22 nt, Homo sapiens
caggcuuuuccacacauggguu

SEQ ID NO: 128608 - RNA, 22 nt, Homo sapiens
cagggaauguuauuuaauagca

SEQ ID NO: 128609 - RNA, 22 nt, Homo sapiens
caggguccccuaccuuuugaug

SEQ ID NO: 128610 - RNA, 22 nt, Homo sapiens
cagguacaugcaugugugugca

SEQ ID NO: 128611 - RNA, 19 nt, Homo sapiens
cagguagugugcugacaug

SEQ ID NO: 128612 - RNA, 23 nt, Homo sapiens
cagguaguucuuuauaguagugu

SEQ ID NO: 128613 - RNA, 22 nt, Homo sapiens
caggugcauuggcugacaccug

SEQ ID NO: 128614 - RNA, 22 nt, Homo sapiens
caggugguauuugguuuucugu

SEQ ID NO: 128615 - RNA, 22 nt, Homo sapiens
caguaaauaucugagcgagguc

SEQ ID NO: 128616 - RNA, 20 nt, Homo sapiens
cagucauagacaucagaguc

SEQ ID NO: 128617 - RNA, 22 nt, Homo sapiens
cagugaauuucaggucaagagu

SEQ ID NO: 128618 - RNA, 22 nt, Homo sapiens
cagugcuuuaucaaguccucca

SEQ ID NO: 128619 - RNA, 22 nt, Homo sapiens
caguggaugaacaagaagugau

SEQ ID NO: 128620 - RNA, 22 nt, Homo sapiens
caguggaugauguuuucugugg

SEQ ID NO: 128621 - RNA, 22 nt, Homo sapiens
cagugguuuucaacccugguug

SEQ ID NO: 128622 - RNA, 22 nt, Homo sapiens
cagugguuuucucaguucagca

SEQ ID NO: 128623 - RNA, 22 nt, Homo sapiens
cagugguuuuuagcuugcuggg

SEQ ID NO: 128624 - RNA, 22 nt, Homo sapiens
cauacaagcuacaaucacaaag

SEQ ID NO: 128625 - RNA, 22 nt, Homo sapiens
cauaguacuugcauaguacuau

SEQ ID NO: 128626 - RNA, 22 nt, Homo sapiens
cauaugguuuuauguucuucau

SEQ ID NO: 128627 - RNA, 22 nt, Homo sapiens
caucaaaguggagggaaggacc

SEQ ID NO: 128628 - RNA, 22 nt, Homo sapiens
caucacacuuggauguaagaca

SEQ ID NO: 128629 - RNA, 22 nt, Homo sapiens
caucacaucugcaugguaagua

SEQ ID NO: 128630 - RNA, 20 nt, Homo sapiens
caucaccuggcaggauuugu

SEQ ID NO: 128631 - RNA, 22 nt, Homo sapiens
caucagagugagauauaagauc

SEQ ID NO: 128632 - RNA, 22 nt, Homo sapiens
caucauugcacccuauagagaa

SEQ ID NO: 128633 - RNA, 22 nt, Homo sapiens
caucccugaaccccagaaaucu

SEQ ID NO: 128634 - RNA, 22 nt, Homo sapiens
caugcagcacacaugucugugc

SEQ ID NO: 128635 - RNA, 22 nt, Homo sapiens
caugcauuggucuauuauguga

SEQ ID NO: 128636 - RNA, 19 nt, Homo sapiens
caugccacugcacuugagu

SEQ ID NO: 128637 - RNA, 22 nt, Homo sapiens
caugccauugcucuccugggug

SEQ ID NO: 128638 - RNA, 22 nt, Homo sapiens
cauggcacuguaugaaaugugc

SEQ ID NO: 128639 - RNA, 22 nt, Homo sapiens
cauggcucuuguuuacucccag

SEQ ID NO: 128640 - RNA, 22 nt, Homo sapiens
cauggcuuguauaagauucuca

SEQ ID NO: 128641 - RNA, 22 nt, Homo sapiens
cauggcuuucacaguaaagccu

SEQ ID NO: 128642 - RNA, 22 nt, Homo sapiens
cauggucaccuuccaaguuauu

SEQ ID NO: 128643 - RNA, 22 nt, Homo sapiens
cauguauagauuccauaguggu

SEQ ID NO: 128644 - RNA, 21 nt, Homo sapiens
caugucacugcacucuagccu

SEQ ID NO: 128645 - RNA, 20 nt, Homo sapiens
cauuacacuccaaccugggu

SEQ ID NO: 128646 - RNA, 22 nt, Homo sapiens
cauuacacuuguaagguuuuuc

SEQ ID NO: 128647 - RNA, 22 nt, Homo sapiens
cauuccacuggauaaacaaggu

SEQ ID NO: 128648 - RNA, 20 nt, Homo sapiens
cauuccacuuuccugucagu

SEQ ID NO: 128649 - RNA, 22 nt, Homo sapiens
cauugcacacauuuaccuaugu

SEQ ID NO: 128650 - RNA, 19 nt, Homo sapiens
cauugcacuccacccuggg

SEQ ID NO: 128651 - RNA, 22 nt, Homo sapiens
cauugcacuccagccuaggcaa

SEQ ID NO: 128652 - RNA, 22 nt, Homo sapiens
cauugcacuccagccugaccaa

SEQ ID NO: 128653 - RNA, 22 nt, Homo sapiens
cauugcacuccagccugcacga

SEQ ID NO: 128654 - RNA, 22 nt, Homo sapiens
ugaacugagacuagacuuguuc

SEQ ID NO: 128655 - RNA, 22 nt, Homo sapiens
ugaacuguugggggaaauucag

SEQ ID NO: 128656 - RNA, 22 nt, Homo sapiens
ugaagugaaugguaaguaugcc

SEQ ID NO: 128657 - RNA, 22 nt, Homo sapiens
ugaagugcugugggccaggcgu

SEQ ID NO: 128658 - RNA, 22 nt, Homo sapiens
ugaauacuucaaaaaaauagcu

SEQ ID NO: 128659 - RNA, 22 nt, Homo sapiens
ugaauagaaguggcaggaguag

SEQ ID NO: 128660 - RNA, 22 nt, Homo sapiens
ugaauagacagucacugccucc

SEQ ID NO: 128661 - RNA, 22 nt, Homo sapiens
ugaauaguuugacagaacucuu

SEQ ID NO: 128662 - RNA, 21 nt, Homo sapiens
ugaauauuuggguugugucca

SEQ ID NO: 128663 - RNA, 22 nt, Homo sapiens
ugaaugcaucuagaaauuuauu

SEQ ID NO: 128664 - RNA, 22 nt, Homo sapiens
ugaauguaagaugucugcuggu

SEQ ID NO: 128665 - RNA, 23 nt, Homo sapiens
ugacaagagcgagacuuggucuc

SEQ ID NO: 128666 - RNA, 22 nt, Homo sapiens
ugacaagauauggucuuaucaa

SEQ ID NO: 128667 - RNA, 22 nt, Homo sapiens
ugacaaguaaacagucagcacc

SEQ ID NO: 128668 - RNA, 23 nt, Homo sapiens
ugacagaccuucuggaagaaguc

SEQ ID NO: 128669 - RNA, 22 nt, Homo sapiens
ugacagagaagcauugaguuca

SEQ ID NO: 128670 - RNA, 22 nt, Homo sapiens
ugacaggauggagaucgguauu

SEQ ID NO: 128671 - RNA, 22 nt, Homo sapiens
ugacaggucuaauuuacugaca

SEQ ID NO: 128672 - RNA, 22 nt, Homo sapiens
ugacaguaaacagucuugauua

SEQ ID NO: 128673 - RNA, 22 nt, Homo sapiens
ugacaucaccaccuccgucauc

SEQ ID NO: 128674 - RNA, 22 nt, Homo sapiens
caacagucagcccauccacaga

SEQ ID NO: 128675 - RNA, 19 nt, Homo sapiens
caacccugcagagaaagga

SEQ ID NO: 128676 - RNA, 22 nt, Homo sapiens
caaugcagcuuuuggagagaaa

SEQ ID NO: 128677 - RNA, 22 nt, Homo sapiens
caaugugcuuggggcacaugag

SEQ ID NO: 128678 - RNA, 22 nt, Homo sapiens
cacaaugucugguaggccacuu

SEQ ID NO: 128679 - RNA, 22 nt, Homo sapiens
cacacugucuucaauggguggu

SEQ ID NO: 128680 - RNA, 22 nt, Homo sapiens
cacacugucuuucagaaugguu

SEQ ID NO: 128681 - RNA, 22 nt, Homo sapiens
cacaguagaauagagcacuagg

SEQ ID NO: 128682 - RNA, 22 nt, Homo sapiens
cacagugaacugguggguuuuu

SEQ ID NO: 128683 - RNA, 22 nt, Homo sapiens
cacaguguuacugguaugaagu

SEQ ID NO: 128684 - RNA, 22 nt, Homo sapiens
cacaguugccuaucuccugaag

SEQ ID NO: 128685 - RNA, 22 nt, Homo sapiens
cacauagucccugcuaaucuuc

SEQ ID NO: 128686 - RNA, 21 nt, Homo sapiens
cacauggaggcagagagugua

SEQ ID NO: 128687 - RNA, 22 nt, Homo sapiens
caccacagccauuauugucccc

SEQ ID NO: 128688 - RNA, 23 nt, Homo sapiens
caccaguagaaugugugggaggg

SEQ ID NO: 128689 - RNA, 22 nt, Homo sapiens
cacccaguaagcaugaggcccu

SEQ ID NO: 128690 - RNA, 22 nt, Homo sapiens
cacccagucaucuuggguuuuu

SEQ ID NO: 128691 - RNA, 22 nt, Homo sapiens
caccccuaccugagucaggagu

SEQ ID NO: 128692 - RNA, 22 nt, Homo sapiens
cacccuugcagggacagcuuug

SEQ ID NO: 128693 - RNA, 22 nt, Homo sapiens
caccuagacuggagugcagugg

SEQ ID NO: 128694 - RNA, 22 nt, Homo sapiens
cacuaccucuacaggcagcugg

SEQ ID NO: 128695 - RNA, 22 nt, Homo sapiens
cacugcacuccagcuuugguga

SEQ ID NO: 128696 - RNA, 22 nt, Homo sapiens
cacugcacuccagucccgucuc

SEQ ID NO: 128697 - RNA, 22 nt, Homo sapiens
cacugcacuccagucugacgac

SEQ ID NO: 128698 - RNA, 22 nt, Homo sapiens
ucacugugcaugaaggaugcug

SEQ ID NO: 128699 - RNA, 22 nt, Homo sapiens
ucacugugguuuugaugugcau

SEQ ID NO: 128700 - RNA, 22 nt, Homo sapiens
ucacuuuguauagcgacuggcu

SEQ ID NO: 128701 - RNA, 22 nt, Homo sapiens
ucacuuuguuuuuggauaaguu

SEQ ID NO: 128702 - RNA, 22 nt, Homo sapiens
ucagaacugaacaaaccagucu

SEQ ID NO: 128703 - RNA, 22 nt, Homo sapiens
ucagagcaaagacacuuuauca

SEQ ID NO: 128704 - RNA, 22 nt, Homo sapiens
ucagaguagcugucugaggugc

SEQ ID NO: 128705 - RNA, 22 nt, Homo sapiens
ucagaucaguuccacaagaacu

SEQ ID NO: 128706 - RNA, 22 nt, Homo sapiens
ucagaucuucagcaggggcccc

SEQ ID NO: 128707 - RNA, 22 nt, Homo sapiens
ucagcaccauguaacaauugau

SEQ ID NO: 128708 - RNA, 20 nt, Homo sapiens
ucagcagucuggagcagagg

SEQ ID NO: 128709 - RNA, 22 nt, Homo sapiens
ucagcagugagagaccucaccc

SEQ ID NO: 128710 - RNA, 22 nt, Homo sapiens
ucagcaucacaggcagugagug

SEQ ID NO: 128711 - RNA, 22 nt, Homo sapiens
ucaggcacuaguaagaaaaagg

SEQ ID NO: 128712 - RNA, 22 nt, Homo sapiens
ucaggcaugcagcaaugcagug

SEQ ID NO: 128713 - RNA, 22 nt, Homo sapiens
ucagguagcauuuuggaaacag

SEQ ID NO: 128714 - RNA, 22 nt, Homo sapiens
ucagguaugucuuuaacagcag

SEQ ID NO: 128715 - RNA, 22 nt, Homo sapiens
ucagguugcuaaguauaauauu

SEQ ID NO: 128716 - RNA, 22 nt, Homo sapiens
ucaguaccugagagugggcaga

SEQ ID NO: 128717 - RNA, 23 nt, Homo sapiens
ucaguacucuauaagugccagcu

SEQ ID NO: 128718 - RNA, 18 nt, Homo sapiens
ucagucacugccuggcuu

SEQ ID NO: 128719 - RNA, 22 nt, Homo sapiens
ucagugaauguuggccacuacu

SEQ ID NO: 128720 - RNA, 22 nt, Homo sapiens
ucagugcuuggcacagagagcu

SEQ ID NO: 128721 - RNA, 22 nt, Homo sapiens
ucaguggagccucacucugugg

SEQ ID NO: 128722 - RNA, 22 nt, Homo sapiens
ucagugucaucuggguuguuug

SEQ ID NO: 128723 - RNA, 23 nt, Homo sapiens
ucagugucuggauccugcucagu

SEQ ID NO: 128724 - RNA, 22 nt, Homo sapiens
ucagugucugugauggagaggu

SEQ ID NO: 128725 - RNA, 22 nt, Homo sapiens
ucagugucugugcaccgcugga

SEQ ID NO: 128726 - RNA, 21 nt, Homo sapiens
ucaguuacugagagagaagug

SEQ ID NO: 128727 - RNA, 21 nt, Homo sapiens
ucauaagcucaacaucuguag

SEQ ID NO: 128728 - RNA, 22 nt, Homo sapiens
ucauacuguugugaaacaaaac

SEQ ID NO: 128729 - RNA, 22 nt, Homo sapiens
ucauagucuaagguucuuuugc

SEQ ID NO: 128730 - RNA, 22 nt, Homo sapiens
ucauauugcgguucauugacuu

SEQ ID NO: 128731 - RNA, 22 nt, Homo sapiens
ucauauugguuaaaauaguggg

SEQ ID NO: 128732 - RNA, 22 nt, Homo sapiens
ucaucagugcuugcaaauuauu

SEQ ID NO: 128733 - RNA, 22 nt, Homo sapiens
ucaucaguggggaugugguuga

SEQ ID NO: 128734 - RNA, 22 nt, Homo sapiens
ucaucucaguuucuugccguac

SEQ ID NO: 128735 - RNA, 22 nt, Homo sapiens
ucaugagacacacuggaaagga

SEQ ID NO: 128736 - RNA, 23 nt, Homo sapiens
ucaugaggccauucaaauccauu

SEQ ID NO: 128737 - RNA, 22 nt, Homo sapiens
ucauggggugagcuacaggcac

SEQ ID NO: 128738 - RNA, 22 nt, Homo sapiens
ucaugguuuuauaacccucuug

SEQ ID NO: 128739 - RNA, 22 nt, Homo sapiens
ucauguauuaucauuagugggu

SEQ ID NO: 128740 - RNA, 23 nt, Homo sapiens
ucauguauucccuguaaugggua

SEQ ID NO: 128741 - RNA, 22 nt, Homo sapiens
ucauuagagaucuuggggaaaa

SEQ ID NO: 128742 - RNA, 22 nt, Homo sapiens
ucauugcuuauuuguuggugga

SEQ ID NO: 128743 - RNA, 21 nt, Homo sapiens
ucauugggugcagcccacccu

SEQ ID NO: 128744 - RNA, 22 nt, Homo sapiens
ucauugguagcucauggaaccg

SEQ ID NO: 128745 - RNA, 22 nt, Homo sapiens
ucauugguugcguaauuugauu

SEQ ID NO: 128746 - RNA, 22 nt, Homo sapiens
uccagaguggugaugcuggggc

SEQ ID NO: 128747 - RNA, 21 nt, Homo sapiens
uccagcuuugagaguuguggu

SEQ ID NO: 128748 - RNA, 22 nt, Homo sapiens
uccagguuuggcuuuauaacuu

SEQ ID NO: 128749 - RNA, 22 nt, Homo sapiens
uccagugcauucagacacuugg

SEQ ID NO: 128750 - RNA, 22 nt, Homo sapiens
uccaguguuauaauaugcgucu

SEQ ID NO: 128751 - RNA, 18 nt, Homo sapiens
uccaguuuucccagcauc

SEQ ID NO: 128752 - RNA, 22 nt, Homo sapiens
uccauaguugcacucuggagcc

SEQ ID NO: 128753 - RNA, 22 nt, Homo sapiens
uccauguagaugcuauguuguc

SEQ ID NO: 128754 - RNA, 22 nt, Homo sapiens
uccaugugaaaucuaugaggac

SEQ ID NO: 128755 - RNA, 23 nt, Homo sapiens
ucccaagauggaccagaccaagg

SEQ ID NO: 128756 - RNA, 19 nt, Homo sapiens
ucccaauguuuccaggcag

SEQ ID NO: 128757 - RNA, 16 nt, Homo sapiens
ucccaccauugcuugu

SEQ ID NO: 128758 - RNA, 22 nt, Homo sapiens
ucccagucuagagccggauugg

SEQ ID NO: 128759 - RNA, 22 nt, Homo sapiens
ucccagugcuaugcaaaagccu

SEQ ID NO: 128760 - RNA, 22 nt, Homo sapiens
ucccaguggucuugaaacaggg

SEQ ID NO: 128761 - RNA, 22 nt, Homo sapiens
ucccaguguguagcuugucucu

SEQ ID NO: 128762 - RNA, 19 nt, Homo sapiens
uccccaguuuuccguucag

SEQ ID NO: 128763 - RNA, 19 nt, Homo sapiens
uccccuguggauaccaaga

SEQ ID NO: 128764 - RNA, 22 nt, Homo sapiens
ucccugagguccuggauuauug

SEQ ID NO: 128765 - RNA, 22 nt, Homo sapiens
aaagggcuguuucuugacuugg

SEQ ID NO: 128766 - RNA, 22 nt, Homo sapiens
aaaguaauugcaguuuuugcaa

SEQ ID NO: 128767 - RNA, 19 nt, Homo sapiens
aaaguacucugaugccucu

SEQ ID NO: 128768 - RNA, 20 nt, Homo sapiens
aaaguaggcuaauaccaaaa

SEQ ID NO: 128769 - RNA, 22 nt, Homo sapiens
aaaguaguagcaguuucugcca

SEQ ID NO: 128770 - RNA, 22 nt, Homo sapiens
aaagucuguuacagcuauuucu

SEQ ID NO: 128771 - RNA, 22 nt, Homo sapiens
aaagugcugagaguucuaacuu

SEQ ID NO: 128772 - RNA, 22 nt, Homo sapiens
aaagugcugggaucacacugaa

SEQ ID NO: 128773 - RNA, 22 nt, Homo sapiens
aaagugcuuacuaaguugccaa

SEQ ID NO: 128774 - RNA, 22 nt, Homo sapiens
aaagugcuucucuuuggugggu

SEQ ID NO: 128775 - RNA, 22 nt, Homo sapiens
aaaguggacuaagugaauauga

SEQ ID NO: 128776 - RNA, 22 nt, Homo sapiens
aaaguggugggauuccaggcau

SEQ ID NO: 128777 - RNA, 22 nt, Homo sapiens
aaaguguguuuccaaccugugg

SEQ ID NO: 128778 - RNA, 19 nt, Homo sapiens
aaaguguuuuaaagaggau

SEQ ID NO: 128779 - RNA, 22 nt, Homo sapiens
aaaguucuugcugaaggauuau

SEQ ID NO: 128780 - RNA, 22 nt, Homo sapiens
aaaugcacagaaaggaugugga

SEQ ID NO: 128781 - RNA, 22 nt, Homo sapiens
aaaugcauaucaagauugcccu

SEQ ID NO: 128782 - RNA, 22 nt, Homo sapiens
aaaugcaugaauaagcucgugu

SEQ ID NO: 128783 - RNA, 22 nt, Homo sapiens
aaaugcaugaggugggaagaaa

SEQ ID NO: 128784 - RNA, 22 nt, Homo sapiens
aaaugcauggacagcuggucuu

SEQ ID NO: 128785 - RNA, 22 nt, Homo sapiens
aaaugcauugagggaaaaggca

SEQ ID NO: 128786 - RNA, 22 nt, Homo sapiens
aaaugcccuaaaauggagcauc

SEQ ID NO: 128787 - RNA, 22 nt, Homo sapiens
aaaugcucucuacacguuucug

SEQ ID NO: 128788 - RNA, 22 nt, Homo sapiens
aaauggcuuuuugggcaaggug

SEQ ID NO: 128789 - RNA, 18 nt, Homo sapiens
aaauucugucccuucuuc

SEQ ID NO: 128790 - RNA, 22 nt, Homo sapiens
aaauugcacaaguggugauuug

SEQ ID NO: 128791 - RNA, 22 nt, Homo sapiens
aaauugcaguuaggaugauggu

SEQ ID NO: 128792 - RNA, 22 nt, Homo sapiens
aaauugcauugagcugcuuauu

SEQ ID NO: 128793 - RNA, 22 nt, Homo sapiens
aacaccaucccuuugaugcuuu

SEQ ID NO: 128794 - RNA, 22 nt, Homo sapiens
aacacuggcugcucgaguucuc

SEQ ID NO: 128795 - RNA, 22 nt, Homo sapiens
aacacuguuuccagucaugauc

SEQ ID NO: 128796 - RNA, 22 nt, Homo sapiens
aacagaauccucuuuuccuggg

SEQ ID NO: 128797 - RNA, 22 nt, Homo sapiens
aacagcauaguacccgugauaa

SEQ ID NO: 128798 - RNA, 22 nt, Homo sapiens
aacagucaauugcugaugaccu

SEQ ID NO: 128799 - RNA, 22 nt, Homo sapiens
aacagugcauucagggauauau

SEQ ID NO: 128800 - RNA, 21 nt, Homo sapiens
aacagugcugaacagacaccu

SEQ ID NO: 128801 - RNA, 22 nt, Homo sapiens
aacagugcuucauucacacauu

SEQ ID NO: 128802 - RNA, 22 nt, Homo sapiens
aaccugaagaaaauauuugcug

SEQ ID NO: 128803 - RNA, 22 nt, Homo sapiens
aacuacaucucuuugaggcagg

SEQ ID NO: 128804 - RNA, 22 nt, Homo sapiens
aacuaggccuagaaguugagua

SEQ ID NO: 128805 - RNA, 22 nt, Homo sapiens
aacucugucuccuucaaguuca

SEQ ID NO: 128806 - RNA, 22 nt, Homo sapiens
aacugcuguuuggguacuggug

SEQ ID NO: 128807 - RNA, 22 nt, Homo sapiens
aacuggcauauucugguugcgg

SEQ ID NO: 128808 - RNA, 22 nt, Homo sapiens
aacuggccuccuugggaaauua

SEQ ID NO: 128809 - RNA, 22 nt, Homo sapiens
aacuggccugagaugaaaagug

SEQ ID NO: 128810 - RNA, 19 nt, Homo sapiens
aacuggugugagaugguau

SEQ ID NO: 128811 - RNA, 21 nt, Homo sapiens
aacuggugugagaugguaugu

SEQ ID NO: 128812 - RNA, 20 nt, Homo sapiens
aagacacuguccccacugga

SEQ ID NO: 128813 - RNA, 22 nt, Homo sapiens
aagaccuaugcaggaagaaaug

SEQ ID NO: 128814 - RNA, 22 nt, Homo sapiens
aagacuguaauccaucuugagu

SEQ ID NO: 128815 - RNA, 22 nt, Homo sapiens
aagagaacugacaguaccuggg

SEQ ID NO: 128816 - RNA, 22 nt, Homo sapiens
aagagaugaagguccugacugu

SEQ ID NO: 128817 - RNA, 22 nt, Homo sapiens
aagagcauuauuuaguaauuuc

SEQ ID NO: 128818 - RNA, 22 nt, Homo sapiens
aagagcgcugauaacauguuug

SEQ ID NO: 128819 - RNA, 20 nt, Homo sapiens
aagagcucaccagaauaucu

SEQ ID NO: 128820 - RNA, 18 nt, Homo sapiens
aagagcucagcacagguu

SEQ ID NO: 128821 - RNA, 22 nt, Homo sapiens
aagagguaggaaauggucauuu

SEQ ID NO: 128822 - RNA, 22 nt, Homo sapiens
aagauagcuaagcuucuucuaa

SEQ ID NO: 128823 - RNA, 22 nt, Homo sapiens
aagcaacacaucugccccgguu

SEQ ID NO: 128824 - RNA, 22 nt, Homo sapiens
aagcaucacauaauggaucaug

SEQ ID NO: 128825 - RNA, 22 nt, Homo sapiens
aagcuacauuuuauuuauguca

SEQ ID NO: 128826 - RNA, 22 nt, Homo sapiens
aagcucuuguugaaucuuguca

SEQ ID NO: 128827 - RNA, 22 nt, Homo sapiens
aagcugcauuuucuagaugcuu

SEQ ID NO: 128828 - RNA, 22 nt, Homo sapiens
aagcugccaggcaugguggcug

SEQ ID NO: 128829 - RNA, 22 nt, Homo sapiens
aagcugccuugcugaggagaaa

SEQ ID NO: 128830 - RNA, 22 nt, Homo sapiens
aagcugguguguauuauucacu

SEQ ID NO: 128831 - RNA, 22 nt, Homo sapiens
aagcugguuuuauaucugugag

SEQ ID NO: 128832 - RNA, 22 nt, Homo sapiens
aagcuguugguggauguaccau

SEQ ID NO: 128833 - RNA, 22 nt, Homo sapiens
aaggagcaguggacggguccua

SEQ ID NO: 128834 - RNA, 22 nt, Homo sapiens
aaggagcuuaagugacuuguac

SEQ ID NO: 128835 - RNA, 22 nt, Homo sapiens
aaggaguagaauagaugcaccu

SEQ ID NO: 128836 - RNA, 22 nt, Homo sapiens
aaggaguagaggaauagcaaug

SEQ ID NO: 128837 - RNA, 22 nt, Homo sapiens
aaggcaacgugaguuguugauu

SEQ ID NO: 128838 - RNA, 22 nt, Homo sapiens
aaggcaagaaugcgugcuuuca

SEQ ID NO: 128839 - RNA, 22 nt, Homo sapiens
aaggcaagguggauaaugaagc

SEQ ID NO: 128840 - RNA, 22 nt, Homo sapiens
aaggcagugugcacauaacacu

SEQ ID NO: 128841 - RNA, 22 nt, Homo sapiens
aaggcauucucaaacuaguucu

SEQ ID NO: 128842 - RNA, 22 nt, Homo sapiens
aaggcgguguggauccuacagc

SEQ ID NO: 128843 - RNA, 22 nt, Homo sapiens
aaggcuuuuugcugacguccuu

SEQ ID NO: 128844 - RNA, 22 nt, Homo sapiens
aagggaaugcuuccaguuugug

SEQ ID NO: 128845 - RNA, 22 nt, Homo sapiens
aagggaaugugguagcugguuu

SEQ ID NO: 128846 - RNA, 22 nt, Homo sapiens
aagggaauguuguagcugguuu

SEQ ID NO: 128847 - RNA, 22 nt, Homo sapiens
aagguaguuagaaaauauaacu

SEQ ID NO: 128848 - RNA, 22 nt, Homo sapiens
aaggugcucucuuauguagaaa

SEQ ID NO: 128849 - RNA, 22 nt, Homo sapiens
aaggugcuguaagcauccaugu

SEQ ID NO: 128850 - RNA, 18 nt, Homo sapiens
aaggugcuucuguucuga

SEQ ID NO: 128851 - RNA, 21 nt, Homo sapiens
aaggugguggugauugagaug

SEQ ID NO: 128852 - RNA, 21 nt, Homo sapiens
aagguuuuuagugcuugacuu

SEQ ID NO: 128853 - RNA, 22 nt, Homo sapiens
aaguaaacauuuuguacaauaa

SEQ ID NO: 128854 - RNA, 22 nt, Homo sapiens
aaguaaauauccgguaguccca

SEQ ID NO: 128855 - RNA, 22 nt, Homo sapiens
aaguacuguuuaaauugcagaa

SEQ ID NO: 128856 - RNA, 19 nt, Homo sapiens
aaguacuugucuuuugaag

SEQ ID NO: 128857 - RNA, 22 nt, Homo sapiens
aaguaguuaggaacauucucuc

SEQ ID NO: 128858 - RNA, 22 nt, Homo sapiens
uuaccagucuagggcucaguuu

SEQ ID NO: 128859 - RNA, 22 nt, Homo sapiens
uuacccauuagagaauuuaaga

SEQ ID NO: 128860 - RNA, 22 nt, Homo sapiens
uuacuacucucuaugaccaguu

SEQ ID NO: 128861 - RNA, 20 nt, Homo sapiens
uuacuccuuaaugagguuuu

SEQ ID NO: 128862 - RNA, 22 nt, Homo sapiens
uuacugcucuuuugucaugagu

SEQ ID NO: 128863 - RNA, 22 nt, Homo sapiens
uuacuguauagaaucaucuuga

SEQ ID NO: 128864 - RNA, 22 nt, Homo sapiens
uuacuugagaugaguuggacaa

SEQ ID NO: 128865 - RNA, 22 nt, Homo sapiens
uuagacacacauacauuuaucu

SEQ ID NO: 128866 - RNA, 22 nt, Homo sapiens
uuagacaguggugcacugcacu

SEQ ID NO: 128867 - RNA, 23 nt, Homo sapiens
uuagaucuuuaaggaaucuccac

SEQ ID NO: 128868 - RNA, 22 nt, Homo sapiens
uuagauuauugguguuuugcaa

SEQ ID NO: 128869 - RNA, 22 nt, Homo sapiens
uuagcacaucuuucuauguaag

SEQ ID NO: 128870 - RNA, 22 nt, Homo sapiens
uuagcagcacaaaagcagacua

SEQ ID NO: 128871 - RNA, 22 nt, Homo sapiens
uuagcagcaucccuggccugua

SEQ ID NO: 128872 - RNA, 22 nt, Homo sapiens
uuagcagugugagcacagacua

SEQ ID NO: 128873 - RNA, 22 nt, Homo sapiens
uuagccccuuugagccucaacu

SEQ ID NO: 128874 - RNA, 22 nt, Homo sapiens
uuaggacaauguucguuuuuug

SEQ ID NO: 128875 - RNA, 21 nt, Homo sapiens
uuaggcagugucagaggugag

SEQ ID NO: 128876 - RNA, 16 nt, Homo sapiens
uuaggcagugugauac

SEQ ID NO: 128877 - RNA, 22 nt, Homo sapiens
uuaggcaguuuauugauuuuca

SEQ ID NO: 128878 - RNA, 22 nt, Homo sapiens
uuaggcuaguugauauaguuug

SEQ ID NO: 128879 - RNA, 22 nt, Homo sapiens
uuaggcuaguuucuuaaacucu

SEQ ID NO: 128880 - RNA, 22 nt, Homo sapiens
uuaggcuuuauugaaaacaaua

SEQ ID NO: 128881 - RNA, 22 nt, Homo sapiens
uuagguacuuuggagagauuca

SEQ ID NO: 128882 - RNA, 21 nt, Homo sapiens
uuagugcucaguuugacaaaa

SEQ ID NO: 128883 - RNA, 22 nt, Homo sapiens
uuauaacagagacuccugugcu

SEQ ID NO: 128884 - RNA, 22 nt, Homo sapiens
uuauacacugugggaguguaaa

SEQ ID NO: 128885 - RNA, 22 nt, Homo sapiens
uuauauguuucuguuuggaggc

SEQ ID NO: 128886 - RNA, 22 nt, Homo sapiens
uuaucaaacccuaggagguggu

SEQ ID NO: 128887 - RNA, 21 nt, Homo sapiens
uuaucccagugucucugcagg

SEQ ID NO: 128888 - RNA, 22 nt, Homo sapiens
uuaucucaguguuuguaaacaa

SEQ ID NO: 128889 - RNA, 22 nt, Homo sapiens
uuaugaaguagguuaagagcag

SEQ ID NO: 128890 - RNA, 22 nt, Homo sapiens
uuauggauuuauauucuguagu

SEQ ID NO: 128891 - RNA, 22 nt, Homo sapiens
uuauggcaaugccccacuccua

SEQ ID NO: 128892 - RNA, 22 nt, Homo sapiens
uuauggcuauugaugacaauug

SEQ ID NO: 128893 - RNA, 22 nt, Homo sapiens
uuaugguuguuaucuugguucg

SEQ ID NO: 128894 - RNA, 22 nt, Homo sapiens
uuaugguuuauuagcaggguua

SEQ ID NO: 128895 - RNA, 22 nt, Homo sapiens
uuaugucuuugagcaaugcugu

SEQ ID NO: 128896 - RNA, 22 nt, Homo sapiens
uuaugucuuuuguguucagcua

SEQ ID NO: 128897 - RNA, 22 nt, Homo sapiens
uuaugugccuuuuugccauuca

SEQ ID NO: 128898 - RNA, 22 nt, Homo sapiens
uuauguguuuaauguuucugaa

SEQ ID NO: 128899 - RNA, 22 nt, Homo sapiens
uuauuagcacccuaccaugugg

SEQ ID NO: 128900 - RNA, 22 nt, Homo sapiens
uuauucagcaccugcuguguuc

SEQ ID NO: 128901 - RNA, 22 nt, Homo sapiens
uuauugcucauuugggcauucu

SEQ ID NO: 128902 - RNA, 22 nt, Homo sapiens
uuauugcuccagaggcugauuu

SEQ ID NO: 128903 - RNA, 22 nt, Homo sapiens
uucaaaaccucugcuuaagccc

SEQ ID NO: 128904 - RNA, 22 nt, Homo sapiens
uucaaaucuuuggcucccacua

SEQ ID NO: 128905 - RNA, 23 nt, Homo sapiens
uucaaauguucucugguugucag

SEQ ID NO: 128906 - RNA, 22 nt, Homo sapiens
uucaagauggcaccagugagug

SEQ ID NO: 128907 - RNA, 22 nt, Homo sapiens
uucaaguaagaaagacaucagg

SEQ ID NO: 128908 - RNA, 22 nt, Homo sapiens
uucaaguaguucucaugccuca

SEQ ID NO: 128909 - RNA, 22 nt, Homo sapiens
uucaagucaaggaaagaggucu

SEQ ID NO: 128910 - RNA, 22 nt, Homo sapiens
uucaagucaauuuuugaaugac

SEQ ID NO: 128911 - RNA, 22 nt, Homo sapiens
uucaagugaacaaaaugaggag

SEQ ID NO: 128912 - RNA, 22 nt, Homo sapiens
uucaauuaauauuauacucuca

SEQ ID NO: 128913 - RNA, 22 nt, Homo sapiens
uucaccggggaccccuggcugu

SEQ ID NO: 128914 - RNA, 22 nt, Homo sapiens
uucaccuggguuggccaucauu

SEQ ID NO: 128915 - RNA, 22 nt, Homo sapiens
uucaccuugcccacagcagucu

SEQ ID NO: 128916 - RNA, 22 nt, Homo sapiens
uucacugcacuccagccugggu

SEQ ID NO: 128917 - RNA, 20 nt, Homo sapiens
uucacugggcucucuguugg

SEQ ID NO: 128918 - RNA, 22 nt, Homo sapiens
uucagagcauugguuuuuugaa

SEQ ID NO: 128919 - RNA, 22 nt, Homo sapiens
uucagagugaggcucucggaac

SEQ ID NO: 128920 - RNA, 22 nt, Homo sapiens
uucagagugguaugaagugaug

SEQ ID NO: 128921 - RNA, 22 nt, Homo sapiens
uucagaugcacacuguagucua

SEQ ID NO: 128922 - RNA, 22 nt, Homo sapiens
uucagcaggccaggcccugacu

SEQ ID NO: 128923 - RNA, 22 nt, Homo sapiens
uucagcaguggccaguggaaau

SEQ ID NO: 128924 - RNA, 22 nt, Homo sapiens
uucaggcaccauggucauugau

SEQ ID NO: 128925 - RNA, 22 nt, Homo sapiens
uucaggcaccauugucauugau

SEQ ID NO: 128926 - RNA, 22 nt, Homo sapiens
uucaggcuccgugccagcuccg

SEQ ID NO: 128927 - RNA, 22 nt, Homo sapiens
uucaggcuccugugagaaucua

SEQ ID NO: 128928 - RNA, 22 nt, Homo sapiens
uucaggguggagaguaugaggu

SEQ ID NO: 128929 - RNA, 22 nt, Homo sapiens
uucagguaucccuugucuauag

SEQ ID NO: 128930 - RNA, 22 nt, Homo sapiens
uucaguaaauguucuuacuaua

SEQ ID NO: 128931 - RNA, 22 nt, Homo sapiens
uucaguacuucaaaaucuuuaa

SEQ ID NO: 128932 - RNA, 22 nt, Homo sapiens
uucaguagucuccauagaaccg

SEQ ID NO: 128933 - RNA, 22 nt, Homo sapiens
uucauagucuaugcaaguaaga

SEQ ID NO: 128934 - RNA, 22 nt, Homo sapiens
uucauagugaaaaauucaaagu

SEQ ID NO: 128935 - RNA, 21 nt, Homo sapiens
uucaucagccagaaaucaagc

SEQ ID NO: 128936 - RNA, 22 nt, Homo sapiens
uucaucagcuguagaugucaug

SEQ ID NO: 128937 - RNA, 22 nt, Homo sapiens
uucauggagccauccuuugauc

SEQ ID NO: 128938 - RNA, 22 nt, Homo sapiens
uucauggaugcauuugaggggu

SEQ ID NO: 128939 - RNA, 22 nt, Homo sapiens
uucauggauggaaaugauuuug

SEQ ID NO: 128940 - RNA, 22 nt, Homo sapiens
uucauggguuaauuuguucgau

SEQ ID NO: 128941 - RNA, 22 nt, Homo sapiens
uucauguaaucaaggcagcuaa

SEQ ID NO: 128942 - RNA, 22 nt, Homo sapiens
uucauguaauuccauaagguaa

SEQ ID NO: 128943 - RNA, 22 nt, Homo sapiens
uaccaguaaugggucaaaggca

SEQ ID NO: 128944 - RNA, 19 nt, Homo sapiens
uacccagaagcagcauugu

SEQ ID NO: 128945 - RNA, 22 nt, Homo sapiens
uacccucuggauacccuuguuc

SEQ ID NO: 128946 - RNA, 22 nt, Homo sapiens
uacccuuuaguauaaaaucaga

SEQ ID NO: 128947 - RNA, 22 nt, Homo sapiens
uuccacgugaaguauucuaaag

SEQ ID NO: 128948 - RNA, 22 nt, Homo sapiens
uuccagcugggggcaacucugc

SEQ ID NO: 128949 - RNA, 22 nt, Homo sapiens
uuccaggugggcgugggccugg

SEQ ID NO: 128950 - RNA, 22 nt, Homo sapiens
uuccaguggacuacuucauccu

SEQ ID NO: 128951 - RNA, 22 nt, Homo sapiens
uuccaguuauuauaccucuuaa

SEQ ID NO: 128952 - RNA, 22 nt, Homo sapiens
uuccaguuuuauggguauagag

SEQ ID NO: 128953 - RNA, 22 nt, Homo sapiens
uuccauguaguugaacgguuuu

SEQ ID NO: 128954 - RNA, 22 nt, Homo sapiens
uuccaugugggcuugucaagua

SEQ ID NO: 128955 - RNA, 22 nt, Homo sapiens
uuccauugugucaucuuggugg

SEQ ID NO: 128956 - RNA, 22 nt, Homo sapiens
uucccagagccugggagugagg

SEQ ID NO: 128957 - RNA, 22 nt, Homo sapiens
uucccaguaaacucuaucccuc

SEQ ID NO: 128958 - RNA, 22 nt, Homo sapiens
uucccagucaaacgaaggacuu

SEQ ID NO: 128959 - RNA, 22 nt, Homo sapiens
uucccaguggaacauguaguca

SEQ ID NO: 128960 - RNA, 22 nt, Homo sapiens
uucccgggguggaaugcaguga

SEQ ID NO: 128961 - RNA, 22 nt, Homo sapiens
uucccguacugguguugccuau

SEQ ID NO: 128962 - RNA, 22 nt, Homo sapiens
uucccugugggcuggugcucca

SEQ ID NO: 128963 - RNA, 22 nt, Homo sapiens
uucccuuugaauuggaaaggug

SEQ ID NO: 128964 - RNA, 22 nt, Homo sapiens
uuccuacugugcaaaguugcaa

SEQ ID NO: 128965 - RNA, 22 nt, Homo sapiens
uuccuacuguucaucaggaacc

SEQ ID NO: 128966 - RNA, 22 nt, Homo sapiens
uuccugagccuuguaucuagua

SEQ ID NO: 128967 - RNA, 22 nt, Homo sapiens
uuccugucuuccaagagagauu

SEQ ID NO: 128968 - RNA, 22 nt, Homo sapiens
uuccugugacccccaagcccac

SEQ ID NO: 128969 - RNA, 20 nt, Homo sapiens
uuccuuaggcauuggaagaa

SEQ ID NO: 128970 - RNA, 22 nt, Homo sapiens
uuccuuaguuauuugguccccu

SEQ ID NO: 128971 - RNA, 22 nt, Homo sapiens
uuccuugaaacagucaagagaa

SEQ ID NO: 128972 - RNA, 22 nt, Homo sapiens
uuccuuguagcaaaugcgauga

SEQ ID NO: 128973 - RNA, 20 nt, Homo sapiens
uucuacagucacaggaagau

SEQ ID NO: 128974 - RNA, 22 nt, Homo sapiens
uucuacuucauuaggaggauug

SEQ ID NO: 128975 - RNA, 22 nt, Homo sapiens
uucuauggucacagaugcuuga

SEQ ID NO: 128976 - RNA, 22 nt, Homo sapiens
uucuaugguuuaauaguuuggg

SEQ ID NO: 128977 - RNA, 22 nt, Homo sapiens
uucuaugguuuuuaugguguua

SEQ ID NO: 128978 - RNA, 22 nt, Homo sapiens
uucuauugguaauauuuucugu

SEQ ID NO: 128979 - RNA, 22 nt, Homo sapiens
uucucaguaauuccagauuuuu

SEQ ID NO: 128980 - RNA, 22 nt, Homo sapiens
uucucagugaacuccagcuugu

SEQ ID NO: 128981 - RNA, 22 nt, Homo sapiens
uucucagugcuaucuuuuaugc

SEQ ID NO: 128982 - RNA, 22 nt, Homo sapiens
uucucauggaacaucuguacug

SEQ ID NO: 128983 - RNA, 22 nt, Homo sapiens
uucucauggugauggcaaaauc

SEQ ID NO: 128984 - RNA, 22 nt, Homo sapiens
uucuccugguggacccuaaacg

SEQ ID NO: 128985 - RNA, 22 nt, Homo sapiens
uucucuggucagaggggagguu

SEQ ID NO: 128986 - RNA, 22 nt, Homo sapiens
uucugacuggugugagauggua

SEQ ID NO: 128987 - RNA, 22 nt, Homo sapiens
uucugauggaguaguccacaga

SEQ ID NO: 128988 - RNA, 22 nt, Homo sapiens
uucugcuagucugucagaucuu

SEQ ID NO: 128989 - RNA, 22 nt, Homo sapiens
uucugcuugaucuaguguguug

SEQ ID NO: 128990 - RNA, 22 nt, Homo sapiens
uucuggccccucccaaucucau

SEQ ID NO: 128991 - RNA, 22 nt, Homo sapiens
uucuggcucaggucaacacuuc

SEQ ID NO: 128992 - RNA, 22 nt, Homo sapiens
uucugugcugaaucaaagacug

SEQ ID NO: 128993 - RNA, 22 nt, Homo sapiens
uucugugcuuguggaugaagug

SEQ ID NO: 128994 - RNA, 22 nt, Homo sapiens
uucuuagguuaaggcugagaga

SEQ ID NO: 128995 - RNA, 22 nt, Homo sapiens
uucuuagucauguaauagucca

SEQ ID NO: 128996 - RNA, 21 nt, Homo sapiens
uucuucaggcagaaggauuau

SEQ ID NO: 128997 - RNA, 22 nt, Homo sapiens
uucuucaguuacaacaaggggg

SEQ ID NO: 128998 - RNA, 22 nt, Homo sapiens
uucuugaggcaugccgcuggga

SEQ ID NO: 128999 - RNA, 22 nt, Homo sapiens
uucuugguuuaucgcuuuaaaa

SEQ ID NO: 129000 - RNA, 22 nt, Homo sapiens
uucuuugcaugaucucaaaguc

SEQ ID NO: 129001 - RNA, 22 nt, Homo sapiens
uugaagacuaccuaccauacuu

SEQ ID NO: 129002 - RNA, 22 nt, Homo sapiens
uugaaggaacgcuguucccuug

SEQ ID NO: 129003 - RNA, 19 nt, Homo sapiens
uugaaggccgccuugcaga

SEQ ID NO: 129004 - RNA, 22 nt, Homo sapiens
uugaaguauagaguuuaagaac

SEQ ID NO: 129005 - RNA, 22 nt, Homo sapiens
uugaaugaauggaaagaagggu

SEQ ID NO: 129006 - RNA, 22 nt, Homo sapiens
uugaaugcguuguguggcccgu

SEQ ID NO: 129007 - RNA, 22 nt, Homo sapiens
uugaaugucuauuaaguuguuu

SEQ ID NO: 129008 - RNA, 22 nt, Homo sapiens
uugacaaugcacugugcuaagu

SEQ ID NO: 129009 - RNA, 22 nt, Homo sapiens
uugacacuaauuauuauaggug

SEQ ID NO: 129010 - RNA, 21 nt, Homo sapiens
uugacagugacagguaaaguu

SEQ ID NO: 129011 - RNA, 20 nt, Homo sapiens
uugacaguggguuguuaaag

SEQ ID NO: 129012 - RNA, 22 nt, Homo sapiens
uugacauauguguguccacaua

SEQ ID NO: 129013 - RNA, 22 nt, Homo sapiens
uugacauugcuguaguguccag

SEQ ID NO: 129014 - RNA, 22 nt, Homo sapiens
uugaccacugggcacaguaagu

SEQ ID NO: 129015 - RNA, 22 nt, Homo sapiens
uugacuccagagugaguaaaug

SEQ ID NO: 129016 - RNA, 22 nt, Homo sapiens
uugacugggccagacagagauc

SEQ ID NO: 129017 - RNA, 22 nt, Homo sapiens
uugacuguaagauggcuauuac

SEQ ID NO: 129018 - RNA, 22 nt, Homo sapiens
uugagauaggaacucacuaugc

SEQ ID NO: 129019 - RNA, 22 nt, Homo sapiens
uugagauaggagcuguuguucu

SEQ ID NO: 129020 - RNA, 22 nt, Homo sapiens
uugagaucuacuacuguaggag

SEQ ID NO: 129021 - RNA, 22 nt, Homo sapiens
uugagauggagccucacucugc

SEQ ID NO: 129022 - RNA, 22 nt, Homo sapiens
uugagauggagucucacuccuu

SEQ ID NO: 129023 - RNA, 22 nt, Homo sapiens
uugagauggagucucacucuug

SEQ ID NO: 129024 - RNA, 22 nt, Homo sapiens
uugagauggagucucacucuuu

SEQ ID NO: 129025 - RNA, 22 nt, Homo sapiens
uugagauggagucucacugugu

SEQ ID NO: 129026 - RNA, 22 nt, Homo sapiens
uugagauggaguucauuuuugu

SEQ ID NO: 129027 - RNA, 22 nt, Homo sapiens
uugagauggaguuucacucucg

SEQ ID NO: 129028 - RNA, 22 nt, Homo sapiens
uugagauggaguuucacucuug

SEQ ID NO: 129029 - RNA, 19 nt, Homo sapiens
uugagaugugaacucacac

SEQ ID NO: 129030 - RNA, 22 nt, Homo sapiens
uugagauguggguuggugacuu

SEQ ID NO: 129031 - RNA, 22 nt, Homo sapiens
uugagauuuuccucaaauauuu

SEQ ID NO: 129032 - RNA, 22 nt, Homo sapiens
uugagcaacauagugagacugu

SEQ ID NO: 129033 - RNA, 21 nt, Homo sapiens
uugagcaacuaggguuauagg

SEQ ID NO: 129034 - RNA, 18 nt, Homo sapiens
acaucccaugcuggggug

SEQ ID NO: 129035 - RNA, 22 nt, Homo sapiens
acaucccuugcucggggccccu

SEQ ID NO: 129036 - RNA, 22 nt, Homo sapiens
acaucccuuucccacccuucac

SEQ ID NO: 129037 - RNA, 22 nt, Homo sapiens
acaugacauugggguggggaua

SEQ ID NO: 129038 - RNA, 17 nt, Homo sapiens
acaugagacuggauucu

SEQ ID NO: 129039 - RNA, 22 nt, Homo sapiens
acaugagacuggguuuguaggg

SEQ ID NO: 129040 - RNA, 22 nt, Homo sapiens
acaugcauauguuggaagaaag

SEQ ID NO: 129041 - RNA, 23 nt, Homo sapiens
acauguauagacuuuuuuuccuu

SEQ ID NO: 129042 - RNA, 22 nt, Homo sapiens
acauguauauaaugcauagcga

SEQ ID NO: 129043 - RNA, 22 nt, Homo sapiens
acauugcagauguguuuaaugu

SEQ ID NO: 129044 - RNA, 22 nt, Homo sapiens
accagucucagguaugucuuua

SEQ ID NO: 129045 - RNA, 17 nt, Homo sapiens
accagugcaugugcuuu

SEQ ID NO: 129046 - RNA, 22 nt, Homo sapiens
accaguguuuaccaaguagcau

SEQ ID NO: 129047 - RNA, 22 nt, Homo sapiens
accaguuuuuuauacaucuucu

SEQ ID NO: 129048 - RNA, 22 nt, Homo sapiens
accauugcacuccagccugggc

SEQ ID NO: 129049 - RNA, 22 nt, Homo sapiens
acccagaagucauucaggaaca

SEQ ID NO: 129050 - RNA, 22 nt, Homo sapiens
acccagaguuccuugucuuuca

SEQ ID NO: 129051 - RNA, 22 nt, Homo sapiens
acccaguaacauaugggaggga

SEQ ID NO: 129052 - RNA, 22 nt, Homo sapiens
acccaguagucauucaggagca

SEQ ID NO: 129053 - RNA, 22 nt, Homo sapiens
acccaguguucaacauucacau

SEQ ID NO: 129054 - RNA, 22 nt, Homo sapiens
acccaguguucagacuaccugu

SEQ ID NO: 129055 - RNA, 22 nt, Homo sapiens
acccauguaggugggauuacag

SEQ ID NO: 129056 - RNA, 23 nt, Homo sapiens
accccuacaggcuuguguccugc

SEQ ID NO: 129057 - RNA, 22 nt, Homo sapiens
acccuacauaguagauccuaca

SEQ ID NO: 129058 - RNA, 21 nt, Homo sapiens
acccucuaguuuucaacaggc

SEQ ID NO: 129059 - RNA, 22 nt, Homo sapiens
acccugacacgauucuucacuu

SEQ ID NO: 129060 - RNA, 22 nt, Homo sapiens
acccuggaguaguaggaaucug

SEQ ID NO: 129061 - RNA, 22 nt, Homo sapiens
acccugguagcuaugaagucuu

SEQ ID NO: 129062 - RNA, 19 nt, Homo sapiens
acccuguccccaccuuuac

SEQ ID NO: 129063 - RNA, 18 nt, Homo sapiens
acccuucagcacugggcc

SEQ ID NO: 129064 - RNA, 22 nt, Homo sapiens
acccuugaguguguuucaggca

SEQ ID NO: 129065 - RNA, 22 nt, Homo sapiens
accugagauuacaggugcuggc

SEQ ID NO: 129066 - RNA, 21 nt, Homo sapiens
accugauguuucaguuggagu

SEQ ID NO: 129067 - RNA, 23 nt, Homo sapiens
accugauguuucuguggggagcc

SEQ ID NO: 129068 - RNA, 22 nt, Homo sapiens
acggcacugguggaaguguagc

SEQ ID NO: 129069 - RNA, 22 nt, Homo sapiens
acgugcaugcacacacaugcgc

SEQ ID NO: 129070 - RNA, 22 nt, Homo sapiens
acuagagaugcauuuguaguuu

SEQ ID NO: 129071 - RNA, 22 nt, Homo sapiens
acuagaugauuauguuccauug

SEQ ID NO: 129072 - RNA, 22 nt, Homo sapiens
acucacagcaaccuccgccucc

SEQ ID NO: 129073 - RNA, 22 nt, Homo sapiens
acucagagaacauucccagucu

SEQ ID NO: 129074 - RNA, 22 nt, Homo sapiens
acucagagagaacugucauuug

SEQ ID NO: 129075 - RNA, 22 nt, Homo sapiens
acucugucuaguuguaaaauuu

SEQ ID NO: 129076 - RNA, 22 nt, Homo sapiens
acugaauguaaacacggagugu

SEQ ID NO: 129077 - RNA, 22 nt, Homo sapiens
acugagacugagaauguuucuu

SEQ ID NO: 129078 - RNA, 21 nt, Homo sapiens
acugagagaucuggggcacau

SEQ ID NO: 129079 - RNA, 22 nt, Homo sapiens
acugagaucuuuaaauaaauaa

SEQ ID NO: 129080 - RNA, 19 nt, Homo sapiens
acugagcuaccugggggca

SEQ ID NO: 129081 - RNA, 22 nt, Homo sapiens
acugaucaauguuaaggcuuau

SEQ ID NO: 129082 - RNA, 22 nt, Homo sapiens
acugcaaugucgaauagagaug

SEQ ID NO: 129083 - RNA, 22 nt, Homo sapiens
acugcacuccaccuugggcaac

SEQ ID NO: 129084 - RNA, 22 nt, Homo sapiens
acugcacuccagccuccugggu

SEQ ID NO: 129085 - RNA, 22 nt, Homo sapiens
acugcacuccagccucggggac

SEQ ID NO: 129086 - RNA, 22 nt, Homo sapiens
acugcacuccagccucgugaca

SEQ ID NO: 129087 - RNA, 22 nt, Homo sapiens
acugcacuccagccugugagac

SEQ ID NO: 129088 - RNA, 22 nt, Homo sapiens
acugcacuccagccuucggaca

SEQ ID NO: 129089 - RNA, 22 nt, Homo sapiens
acugcacuccagccuucgugac

SEQ ID NO: 129090 - RNA, 22 nt, Homo sapiens
acugcacuccagccuuggagac

SEQ ID NO: 129091 - RNA, 22 nt, Homo sapiens
acugcacuccagccuugugaca

SEQ ID NO: 129092 - RNA, 22 nt, Homo sapiens
acugcacuccagcuccagggug

SEQ ID NO: 129093 - RNA, 20 nt, Homo sapiens
acugcacuccaggcugccca

SEQ ID NO: 129094 - RNA, 18 nt, Homo sapiens
acugcacuccauccuagg

SEQ ID NO: 129095 - RNA, 22 nt, Homo sapiens
acugcacucccgcccgggugac

SEQ ID NO: 129096 - RNA, 22 nt, Homo sapiens
acugcacuccggccucgugaca

SEQ ID NO: 129097 - RNA, 22 nt, Homo sapiens
acugcacuccggccuggcaaca

SEQ ID NO: 129098 - RNA, 22 nt, Homo sapiens
acugcacucuagcauggguaau

SEQ ID NO: 129099 - RNA, 22 nt, Homo sapiens
acugcacucuagcuugggugac

SEQ ID NO: 129100 - RNA, 22 nt, Homo sapiens
acugcacuucaaccucauugac

SEQ ID NO: 129101 - RNA, 22 nt, Homo sapiens
acugcacuucagccuuggggac

SEQ ID NO: 129102 - RNA, 22 nt, Homo sapiens
acugcauuugucccuuuugaac

SEQ ID NO: 129103 - RNA, 22 nt, Homo sapiens
acugcauuugucugucucaauu

SEQ ID NO: 129104 - RNA, 22 nt, Homo sapiens
acuggguuaauuugaagguuga

SEQ ID NO: 129105 - RNA, 19 nt, Homo sapiens
acuguacuccagucugggc

SEQ ID NO: 129106 - RNA, 22 nt, Homo sapiens
acuguauagauggaguugauuu

SEQ ID NO: 129107 - RNA, 22 nt, Homo sapiens
acuucauucucuggaucagaau

SEQ ID NO: 129108 - RNA, 22 nt, Homo sapiens
acuuugcuuagagggcauuaaa

SEQ ID NO: 129109 - RNA, 20 nt, Homo sapiens
ugauuaguccacuuggcucu

SEQ ID NO: 129110 - RNA, 18 nt, Homo sapiens
ugcaaacauguguguguu

SEQ ID NO: 129111 - RNA, 22 nt, Homo sapiens
ugcaaauguuaguaacaccacu

SEQ ID NO: 129112 - RNA, 22 nt, Homo sapiens
ugcaaauguuauuuugguuucu

SEQ ID NO: 129113 - RNA, 22 nt, Homo sapiens
ugcaagaaucuuucaggcuagc

SEQ ID NO: 129114 - RNA, 22 nt, Homo sapiens
ugcaagaugauuucaauugaua

SEQ ID NO: 129115 - RNA, 22 nt, Homo sapiens
ugcaagcacacccagggauugu

SEQ ID NO: 129116 - RNA, 22 nt, Homo sapiens
ugcaaguaauuccagcuacuga

SEQ ID NO: 129117 - RNA, 22 nt, Homo sapiens
ugcaaugucuucugaggggagc

SEQ ID NO: 129118 - RNA, 22 nt, Homo sapiens
ugcaccacugcacuccagcuug

SEQ ID NO: 129119 - RNA, 22 nt, Homo sapiens
ugcaccacugcacuccaggcug

SEQ ID NO: 129120 - RNA, 22 nt, Homo sapiens
ugcaccacugcacugccugggu

SEQ ID NO: 129121 - RNA, 22 nt, Homo sapiens
ugcaccacugcacuucagccug

SEQ ID NO: 129122 - RNA, 22 nt, Homo sapiens
ugcagagucuguccugccugcc

SEQ ID NO: 129123 - RNA, 20 nt, Homo sapiens
ugcagauucaaccaacugug

SEQ ID NO: 129124 - RNA, 22 nt, Homo sapiens
ugcauacacaagcauacaugua

SEQ ID NO: 129125 - RNA, 22 nt, Homo sapiens
ugcauacugggagguugggugu

SEQ ID NO: 129126 - RNA, 22 nt, Homo sapiens
ugcauacuguaugcgugcauac

SEQ ID NO: 129127 - RNA, 22 nt, Homo sapiens
ugcauaggcuaaaauccuggcc

SEQ ID NO: 129128 - RNA, 21 nt, Homo sapiens
ugcauaucucuaaugaccagu

SEQ ID NO: 129129 - RNA, 22 nt, Homo sapiens
ugcauaucuuguggaauaucuc

SEQ ID NO: 129130 - RNA, 22 nt, Homo sapiens
ugcauauguugaaccaggcuug

SEQ ID NO: 129131 - RNA, 21 nt, Homo sapiens
ugcauauuggaacuuucucuc

SEQ ID NO: 129132 - RNA, 22 nt, Homo sapiens
ugcauggagcucucuuuggacu

SEQ ID NO: 129133 - RNA, 22 nt, Homo sapiens
ugcauuagucuguucucacacu

SEQ ID NO: 129134 - RNA, 22 nt, Homo sapiens
ugcauuguggaucuaaaugcau

SEQ ID NO: 129135 - RNA, 22 nt, Homo sapiens
ugcauuguuuagaaacacuggg

SEQ ID NO: 129136 - RNA, 22 nt, Homo sapiens
ugcauuguuuuugguucccagg

SEQ ID NO: 129137 - RNA, 22 nt, Homo sapiens
ugccaacaugccuggcuguuuu

SEQ ID NO: 129138 - RNA, 22 nt, Homo sapiens
ugccaacugguuucuuuuaguu

SEQ ID NO: 129139 - RNA, 19 nt, Homo sapiens
ugccaagaaagucagcuua

SEQ ID NO: 129140 - RNA, 20 nt, Homo sapiens
ugccaagaaaugaggguauu

SEQ ID NO: 129141 - RNA, 22 nt, Homo sapiens
ugccagaugugcccucuccacc

SEQ ID NO: 129142 - RNA, 22 nt, Homo sapiens
ugccaguauuuuacugaggauu

SEQ ID NO: 129143 - RNA, 22 nt, Homo sapiens
ugccaguauuuuauuaagaauu

SEQ ID NO: 129144 - RNA, 22 nt, Homo sapiens
ugccaguguugccuuucacuag

SEQ ID NO: 129145 - RNA, 22 nt, Homo sapiens
ugccaugaaguaauggcaaaaa

SEQ ID NO: 129146 - RNA, 22 nt, Homo sapiens
ugcccaguggacagaaagucau

SEQ ID NO: 129147 - RNA, 22 nt, Homo sapiens
ugccuacuuugcaucugucagg

SEQ ID NO: 129148 - RNA, 22 nt, Homo sapiens
ugccuaggcuggaaugcaaugg

SEQ ID NO: 129149 - RNA, 22 nt, Homo sapiens
ugccuaggcuggagugcagugg

SEQ ID NO: 129150 - RNA, 20 nt, Homo sapiens
ugccugacacucuuugcuuc

SEQ ID NO: 129151 - RNA, 22 nt, Homo sapiens
ugccugagccagguuuuaggag

SEQ ID NO: 129152 - RNA, 22 nt, Homo sapiens
ugcuagaagaucacacacauca

SEQ ID NO: 129153 - RNA, 22 nt, Homo sapiens
ugcuaugucagccaggcugguc

SEQ ID NO: 129154 - RNA, 22 nt, Homo sapiens
ugcuaugucuucucucacagag

SEQ ID NO: 129155 - RNA, 23 nt, Homo sapiens
ugcugagaccuagauccuaaaga

SEQ ID NO: 129156 - RNA, 22 nt, Homo sapiens
ugcugguaguuuaugacuaauu

SEQ ID NO: 129157 - RNA, 22 nt, Homo sapiens
ugcugguguuuaggaauaagaa

SEQ ID NO: 129158 - RNA, 22 nt, Homo sapiens
ugcuuaggcuuccuuacaguau

SEQ ID NO: 129159 - RNA, 22 nt, Homo sapiens
ugcuuagucuugcuuuagcuau

SEQ ID NO: 129160 - RNA, 19 nt, Homo sapiens
ugcuuaguuuuauguguaa

SEQ ID NO: 129161 - RNA, 22 nt, Homo sapiens
ugcuucauuggccaccaggaag

SEQ ID NO: 129162 - RNA, 22 nt, Homo sapiens
ugcuuuguugaaaaucauuugg

SEQ ID NO: 129163 - RNA, 20 nt, Homo sapiens
uggaaaguaagucaugauau

SEQ ID NO: 129164 - RNA, 22 nt, Homo sapiens
uggaaauuaacagggauugucc

SEQ ID NO: 129165 - RNA, 20 nt, Homo sapiens
uggaaauuaaccuuucaggu

SEQ ID NO: 129166 - RNA, 22 nt, Homo sapiens
uggaaauuaagucuuuccugag

SEQ ID NO: 129167 - RNA, 22 nt, Homo sapiens
uggaagacaggcuguauuuuaa

SEQ ID NO: 129168 - RNA, 22 nt, Homo sapiens
uggaagacauugggugaagggu

SEQ ID NO: 129169 - RNA, 22 nt, Homo sapiens
uggaagaugggaccucaguuuu

SEQ ID NO: 129170 - RNA, 22 nt, Homo sapiens
uggaagauuacuuuuuguugaa

SEQ ID NO: 129171 - RNA, 22 nt, Homo sapiens
uggaagauucuagaagauucca

SEQ ID NO: 129172 - RNA, 22 nt, Homo sapiens
uggaaggucauuguucauuuga

SEQ ID NO: 129173 - RNA, 22 nt, Homo sapiens
uggaaguauagauaauugaaag

SEQ ID NO: 129174 - RNA, 22 nt, Homo sapiens
uggaagucuucauuauguauag

SEQ ID NO: 129175 - RNA, 22 nt, Homo sapiens
uggaagugucugugcccagcuc

SEQ ID NO: 129176 - RNA, 22 nt, Homo sapiens
uggaauacuauucugugcugga

SEQ ID NO: 129177 - RNA, 22 nt, Homo sapiens
uggaaugcucuccccacggacu

SEQ ID NO: 129178 - RNA, 22 nt, Homo sapiens
uggaauggagagagggugcacg

SEQ ID NO: 129179 - RNA, 22 nt, Homo sapiens
uggaaugggauuggaaauuuug

SEQ ID NO: 129180 - RNA, 22 nt, Homo sapiens
uggaaugguaucuuguuggggu

SEQ ID NO: 129181 - RNA, 22 nt, Homo sapiens
uggaauguaacuugaaacuuuu

SEQ ID NO: 129182 - RNA, 22 nt, Homo sapiens
acuuugguuaucauacuuucag

SEQ ID NO: 129183 - RNA, 22 nt, Homo sapiens
acuuuuguuauacagugugaua

SEQ ID NO: 129184 - RNA, 22 nt, Homo sapiens
acuuuuugcaaccauuuggacc

SEQ ID NO: 129185 - RNA, 22 nt, Homo sapiens
agaaagugcuucccuuugguga

SEQ ID NO: 129186 - RNA, 22 nt, Homo sapiens
agaaauguuuauucaaacccgu

SEQ ID NO: 129187 - RNA, 20 nt, Homo sapiens
agaaccuguaguguagaggg

SEQ ID NO: 129188 - RNA, 22 nt, Homo sapiens
agaaugugaccuuauuuggaga

SEQ ID NO: 129189 - RNA, 22 nt, Homo sapiens
agaauguuuuagaccaauacaa

SEQ ID NO: 129190 - RNA, 22 nt, Homo sapiens
agacaagauggcuugagguuca

SEQ ID NO: 129191 - RNA, 20 nt, Homo sapiens
agacaguguggagauuccuu

SEQ ID NO: 129192 - RNA, 22 nt, Homo sapiens
agagaacugauuggaugugggc

SEQ ID NO: 129193 - RNA, 22 nt, Homo sapiens
agagacauugcuccaacucacc

SEQ ID NO: 129194 - RNA, 22 nt, Homo sapiens
agagagcuugggguguuaaauu

SEQ ID NO: 129195 - RNA, 22 nt, Homo sapiens
agagagguggguggagccccca

SEQ ID NO: 129196 - RNA, 22 nt, Homo sapiens
agagauuauccuggcuucucug

SEQ ID NO: 129197 - RNA, 22 nt, Homo sapiens
agagcaauguuaucagucucug

SEQ ID NO: 129198 - RNA, 22 nt, Homo sapiens
agagccacauuaaauaugggaa

SEQ ID NO: 129199 - RNA, 21 nt, Homo sapiens
agaggacugaccacagcccua

SEQ ID NO: 129200 - RNA, 22 nt, Homo sapiens
auagugcuuuugaaucuuguug

SEQ ID NO: 129201 - RNA, 19 nt, Homo sapiens
auaguguaggaaaacagcu

SEQ ID NO: 129202 - RNA, 22 nt, Homo sapiens
auauagcaaugaaagagaugaa

SEQ ID NO: 129203 - RNA, 22 nt, Homo sapiens
auauauguuuucugggaagaaa

SEQ ID NO: 129204 - RNA, 22 nt, Homo sapiens
auaucacaaacaagucuguacu

SEQ ID NO: 129205 - RNA, 17 nt, Homo sapiens
auaugaauuuuggagau

SEQ ID NO: 129206 - RNA, 22 nt, Homo sapiens
auaugcacgugcauacacacuu

SEQ ID NO: 129207 - RNA, 22 nt, Homo sapiens
auaugcacuauacacacguaua

SEQ ID NO: 129208 - RNA, 22 nt, Homo sapiens
auaugguacuuaugcucaaacu

SEQ ID NO: 129209 - RNA, 22 nt, Homo sapiens
auaugguguuugcuauucagcu

SEQ ID NO: 129210 - RNA, 20 nt, Homo sapiens
auaugguugugagugauuuu

SEQ ID NO: 129211 - RNA, 22 nt, Homo sapiens
auaugucuguuuagucuguaau

SEQ ID NO: 129212 - RNA, 22 nt, Homo sapiens
auaugugacuucaugcaaggcu

SEQ ID NO: 129213 - RNA, 22 nt, Homo sapiens
auauguucucauucauaugugg

SEQ ID NO: 129214 - RNA, 22 nt, Homo sapiens
auauuacagagaggaccuggga

SEQ ID NO: 129215 - RNA, 18 nt, Homo sapiens
auauugcauuggauggau

SEQ ID NO: 129216 - RNA, 22 nt, Homo sapiens
auauugcuccuaauaccacggu

SEQ ID NO: 129217 - RNA, 22 nt, Homo sapiens
auauugcuuagugaugaagucu

SEQ ID NO: 129218 - RNA, 22 nt, Homo sapiens
auauugcuugaggccaggaggu

SEQ ID NO: 129219 - RNA, 22 nt, Homo sapiens
auauuggacucugugcuaggaa

SEQ ID NO: 129220 - RNA, 22 nt, Homo sapiens
auauuggacugugcuaguuaga

SEQ ID NO: 129221 - RNA, 22 nt, Homo sapiens
auauuguacugcuacugguucu

SEQ ID NO: 129222 - RNA, 20 nt, Homo sapiens
aucaaagacuuagaggggga

SEQ ID NO: 129223 - RNA, 22 nt, Homo sapiens
cuggcaccauacacuguuguug

SEQ ID NO: 129224 - RNA, 22 nt, Homo sapiens
cuggcaucuaaauacuugaugu

SEQ ID NO: 129225 - RNA, 22 nt, Homo sapiens
cuggccagagacauucauuaaa

SEQ ID NO: 129226 - RNA, 22 nt, Homo sapiens
cuggguacccuuuaaacaggaa

SEQ ID NO: 129227 - RNA, 22 nt, Homo sapiens
cugguaagaaggucuaagucaa

SEQ ID NO: 129228 - RNA, 22 nt, Homo sapiens
cuggucaagagcaaaggccagg

SEQ ID NO: 129229 - RNA, 22 nt, Homo sapiens
cuggucaugggggcacccucug

SEQ ID NO: 129230 - RNA, 21 nt, Homo sapiens
cugguguuagcacuucuuccc

SEQ ID NO: 129231 - RNA, 22 nt, Homo sapiens
cugguuguuacaaagagccugg

SEQ ID NO: 129232 - RNA, 22 nt, Homo sapiens
cuguaaaguucucauuguagcc

SEQ ID NO: 129233 - RNA, 22 nt, Homo sapiens
cuguaacagaauaaauuuguuu

SEQ ID NO: 129234 - RNA, 22 nt, Homo sapiens
cuguaaggcacuaagcauaugu

SEQ ID NO: 129235 - RNA, 22 nt, Homo sapiens
cuguaguuagcagaugaugaau

SEQ ID NO: 129236 - RNA, 22 nt, Homo sapiens
cuguaugugagaaauaauaagu

SEQ ID NO: 129237 - RNA, 19 nt, Homo sapiens
cugucacugaggaagacug

SEQ ID NO: 129238 - RNA, 22 nt, Homo sapiens
cugucacugggaggggcagcag

SEQ ID NO: 129239 - RNA, 22 nt, Homo sapiens
cugucacuggggcacauguccc

SEQ ID NO: 129240 - RNA, 22 nt, Homo sapiens
cugucuggaguccuucgugugc

SEQ ID NO: 129241 - RNA, 22 nt, Homo sapiens
cugugaagaaagucauugguag

SEQ ID NO: 129242 - RNA, 22 nt, Homo sapiens
cugugauagguuagucaugaau

SEQ ID NO: 129243 - RNA, 22 nt, Homo sapiens
cugugcaaacaagugaaccccu

SEQ ID NO: 129244 - RNA, 22 nt, Homo sapiens
cugugcaaagcgcucucggggu

SEQ ID NO: 129245 - RNA, 22 nt, Homo sapiens
cugugccaagcuugcgaugugc

SEQ ID NO: 129246 - RNA, 22 nt, Homo sapiens
cuguggguuuuacuguuuuacu

SEQ ID NO: 129247 - RNA, 22 nt, Homo sapiens
cugugguguaacucuuggggcg

SEQ ID NO: 129248 - RNA, 22 nt, Homo sapiens
cuuaaguaguuguggaaugaau

SEQ ID NO: 129249 - RNA, 19 nt, Homo sapiens
cuuaggugaccaguuccca

SEQ ID NO: 129250 - RNA, 22 nt, Homo sapiens
cuucaugggagaaccacaggua

SEQ ID NO: 129251 - RNA, 22 nt, Homo sapiens
cuuccauaguuacacccaggga

SEQ ID NO: 129252 - RNA, 22 nt, Homo sapiens
cuucccguuauugcccuugggu

SEQ ID NO: 129253 - RNA, 22 nt, Homo sapiens
cuucuugagacuuaggcuuugg

SEQ ID NO: 129254 - RNA, 22 nt, Homo sapiens
cuucuugagggccugcugggaa

SEQ ID NO: 129255 - RNA, 22 nt, Homo sapiens
cuugacacugucacucaggcca

SEQ ID NO: 129256 - RNA, 22 nt, Homo sapiens
cuugaccaauauggugaaaccc

SEQ ID NO: 129257 - RNA, 22 nt, Homo sapiens
cuugagcaaacaaaggugguag

SEQ ID NO: 129258 - RNA, 22 nt, Homo sapiens
cuugaucaaugugguacuugau

SEQ ID NO: 129259 - RNA, 22 nt, Homo sapiens
cuugcacuugaaauuccaguuu

SEQ ID NO: 129260 - RNA, 22 nt, Homo sapiens
cuugcagaggcccuggggagag

SEQ ID NO: 129261 - RNA, 22 nt, Homo sapiens
cuugcauagaguuauugcccuu

SEQ ID NO: 129262 - RNA, 22 nt, Homo sapiens
cuugcauuuuggagaaugcuga

SEQ ID NO: 129263 - RNA, 22 nt, Homo sapiens
cuugccuuugucuucaaaggcu

SEQ ID NO: 129264 - RNA, 22 nt, Homo sapiens
cuuggacaccucaugcccaccu

SEQ ID NO: 129265 - RNA, 22 nt, Homo sapiens
cuuggcacugcucacccuccuu

SEQ ID NO: 129266 - RNA, 22 nt, Homo sapiens
cuuggcaugaagaauaauuuuu

SEQ ID NO: 129267 - RNA, 22 nt, Homo sapiens
cuuggcuccgacuccccuccaa

SEQ ID NO: 129268 - RNA, 20 nt, Homo sapiens
cuuggcuuucuugguguuaa

SEQ ID NO: 129269 - RNA, 22 nt, Homo sapiens
cuugggauauguguuacucugu

SEQ ID NO: 129270 - RNA, 22 nt, Homo sapiens
cuuggguaagucauuaaaauua

SEQ ID NO: 129271 - RNA, 17 nt, Homo sapiens
cuuguugugguaguuug

SEQ ID NO: 129272 - RNA, 19 nt, Homo sapiens
uuugaauauaaugcagcua

SEQ ID NO: 129273 - RNA, 22 nt, Homo sapiens
uuugacuaccaggaauguucuu

SEQ ID NO: 129274 - RNA, 22 nt, Homo sapiens
uuugacuagaguguuuuacaac

SEQ ID NO: 129275 - RNA, 22 nt, Homo sapiens
uuugagaaugcuaccagagaag

SEQ ID NO: 129276 - RNA, 22 nt, Homo sapiens
uuugagcaagaggugacauuau

SEQ ID NO: 129277 - RNA, 22 nt, Homo sapiens
uuugagcauguaguuuaacccu

SEQ ID NO: 129278 - RNA, 22 nt, Homo sapiens
uuugagcuagagucucacucug

SEQ ID NO: 129279 - RNA, 22 nt, Homo sapiens
uuugagcuugacucagcuggag

SEQ ID NO: 129280 - RNA, 23 nt, Homo sapiens
uuugagugugauaaacacuguca

SEQ ID NO: 129281 - RNA, 22 nt, Homo sapiens
uuugauguugagacuauaaagc

SEQ ID NO: 129282 - RNA, 22 nt, Homo sapiens
uuugcaauguugugauggugaa

SEQ ID NO: 129283 - RNA, 22 nt, Homo sapiens
uuugcacuggagauucaauggg

SEQ ID NO: 129284 - RNA, 20 nt, Homo sapiens
uuugcagaaucuaagaagag

SEQ ID NO: 129285 - RNA, 22 nt, Homo sapiens
uuugcagugucagcuucugugu

SEQ ID NO: 129286 - RNA, 22 nt, Homo sapiens
uuugcauaauaagauuagggug

SEQ ID NO: 129287 - RNA, 19 nt, Homo sapiens
uuugcauagugagaauaua

SEQ ID NO: 129288 - RNA, 22 nt, Homo sapiens
uuugccaauauuuuacugagga

SEQ ID NO: 129289 - RNA, 22 nt, Homo sapiens
uuugccaaucagaggcaucuug

SEQ ID NO: 129290 - RNA, 22 nt, Homo sapiens
uuugccuuugugauauggucua

SEQ ID NO: 129291 - RNA, 22 nt, Homo sapiens
uuugcuuaaaguccuuguggga

SEQ ID NO: 129292 - RNA, 22 nt, Homo sapiens
uuuggaagaugccacuguauca

SEQ ID NO: 129293 - RNA, 22 nt, Homo sapiens
uuuggcaacguuggaucccuca

SEQ ID NO: 129294 - RNA, 22 nt, Homo sapiens
uuuggcaugggcuauuugcuuu

SEQ ID NO: 129295 - RNA, 22 nt, Homo sapiens
uuuggcauuuaaauaugcaugg

SEQ ID NO: 129296 - RNA, 18 nt, Homo sapiens
uuuggcuguucaugacuc

SEQ ID NO: 129297 - RNA, 22 nt, Homo sapiens
uuugggaaugguuugucuccca

SEQ ID NO: 129298 - RNA, 22 nt, Homo sapiens
uuugggccucugauuucuuugg

SEQ ID NO: 129299 - RNA, 22 nt, Homo sapiens
uuuggucacugccgccgccagc

SEQ ID NO: 129300 - RNA, 22 nt, Homo sapiens
uuuggucagcugcgggucagcu

SEQ ID NO: 129301 - RNA, 22 nt, Homo sapiens
uuugguuauauauauacacucu

SEQ ID NO: 129302 - RNA, 22 nt, Homo sapiens
uuugguugucacaacuggggga

SEQ ID NO: 129303 - RNA, 22 nt, Homo sapiens
uuuguacacgugggugaauugu

SEQ ID NO: 129304 - RNA, 22 nt, Homo sapiens
uuuguacuaugguuuuucacua

SEQ ID NO: 129305 - RNA, 22 nt, Homo sapiens
uuuguacuucauugguucuacu

SEQ ID NO: 129306 - RNA, 22 nt, Homo sapiens
uuuguagcuacaaagugagaug

SEQ ID NO: 129307 - RNA, 22 nt, Homo sapiens
uuugucccccguaguucauaua

SEQ ID NO: 129308 - RNA, 23 nt, Homo sapiens
uuugugacacucuccaucuccag

SEQ ID NO: 129309 - RNA, 22 nt, Homo sapiens
uuugugagguggauagauugca

SEQ ID NO: 129310 - RNA, 22 nt, Homo sapiens
uuugugcaugaagagggggugc

SEQ ID NO: 129311 - RNA, 22 nt, Homo sapiens
uuuguguggccuuggccuggca

SEQ ID NO: 129312 - RNA, 16 nt, Homo sapiens
uuugugugugacgaga

SEQ ID NO: 129313 - RNA, 22 nt, Homo sapiens
uuuuaacagccaggggacggcc

SEQ ID NO: 129314 - RNA, 22 nt, Homo sapiens
gucuguuuggggaccuguggcc

SEQ ID NO: 129315 - RNA, 22 nt, Homo sapiens
gucuuccagccuccaucuuucu

SEQ ID NO: 129316 - RNA, 22 nt, Homo sapiens
gucuuuggaaaaaaugucuguu

SEQ ID NO: 129317 - RNA, 22 nt, Homo sapiens
gucuuuguuuggucuguaucag

SEQ ID NO: 129318 - RNA, 22 nt, Homo sapiens
gugaaaagaugagcaccauaca

SEQ ID NO: 129319 - RNA, 22 nt, Homo sapiens
gugaacaagcaaaggcaggagg

SEQ ID NO: 129320 - RNA, 22 nt, Homo sapiens
gugaacagcagaugagugagug

SEQ ID NO: 129321 - RNA, 22 nt, Homo sapiens
gugacaucagcuccagguauaa

SEQ ID NO: 129322 - RNA, 22 nt, Homo sapiens
gugaccaaagauagcucaaguu

SEQ ID NO: 129323 - RNA, 22 nt, Homo sapiens
gugacugggaguggugaagaua

SEQ ID NO: 129324 - RNA, 22 nt, Homo sapiens
gugagaacugcuggggccacag

SEQ ID NO: 129325 - RNA, 22 nt, Homo sapiens
gugagaccaauguacuaccuuc

SEQ ID NO: 129326 - RNA, 16 nt, Homo sapiens
gugagagaugacaaac

SEQ ID NO: 129327 - RNA, 22 nt, Homo sapiens
gugagaggaggcagcuuuuaca

SEQ ID NO: 129328 - RNA, 22 nt, Homo sapiens
gugagauaaugucucauugugg

SEQ ID NO: 129329 - RNA, 22 nt, Homo sapiens
gugagaugaggucucacucugu

SEQ ID NO: 129330 - RNA, 22 nt, Homo sapiens
gugagaugauggguauguuaau

SEQ ID NO: 129331 - RNA, 22 nt, Homo sapiens
gugagauggaguuggugucuuu

SEQ ID NO: 129332 - RNA, 22 nt, Homo sapiens
gugagauuaccauuuaaaucag

SEQ ID NO: 129333 - RNA, 19 nt, Homo sapiens
gugagcacagacaauacaa

SEQ ID NO: 129334 - RNA, 22 nt, Homo sapiens
gugagcaguguccuugggggca

SEQ ID NO: 129335 - RNA, 22 nt, Homo sapiens
gugagcauauuaguauugcacu

SEQ ID NO: 129336 - RNA, 22 nt, Homo sapiens
gugagcauuacucaugggauca

SEQ ID NO: 129337 - RNA, 22 nt, Homo sapiens
gugaggcugguccugccuccca

SEQ ID NO: 129338 - RNA, 21 nt, Homo sapiens
gugaggucauugggcuuucug

SEQ ID NO: 129339 - RNA, 22 nt, Homo sapiens
gugaggugguacaauauuaacu

SEQ ID NO: 129340 - RNA, 22 nt, Homo sapiens
gugagucagucuguguagggcu

SEQ ID NO: 129341 - RNA, 22 nt, Homo sapiens
gugagucaugucccaucugauu

SEQ ID NO: 129342 - RNA, 22 nt, Homo sapiens
gugauaucuuacaauucucuuu

SEQ ID NO: 129343 - RNA, 22 nt, Homo sapiens
gugaucucagcucacuggaacc

SEQ ID NO: 129344 - RNA, 22 nt, Homo sapiens
gugaucuuucaggcuugaccau

SEQ ID NO: 129345 - RNA, 22 nt, Homo sapiens
gugauguguuuguucuaucucu

SEQ ID NO: 129346 - RNA, 22 nt, Homo sapiens
gugauugucuaaucaagauaca

SEQ ID NO: 129347 - RNA, 21 nt, Homo sapiens
gugcaaacaucauagaaugua

SEQ ID NO: 129348 - RNA, 22 nt, Homo sapiens
gugcaaacuccaggucucuuca

SEQ ID NO: 129349 - RNA, 22 nt, Homo sapiens
gugcaagcaucauggaguguac

SEQ ID NO: 129350 - RNA, 22 nt, Homo sapiens
gugcaaugucaggagaugcagc

SEQ ID NO: 129351 - RNA, 22 nt, Homo sapiens
gugcaauguuaauuacuugacu

SEQ ID NO: 129352 - RNA, 22 nt, Homo sapiens
gugcaauucacuguuaugucug

SEQ ID NO: 129353 - RNA, 22 nt, Homo sapiens
gugcacaacaugcaguuuuguu

SEQ ID NO: 129354 - RNA, 22 nt, Homo sapiens
gugcacauauggugcauaagug

SEQ ID NO: 129355 - RNA, 22 nt, Homo sapiens
gugcacuguagaacccuuuguu

SEQ ID NO: 129356 - RNA, 21 nt, Homo sapiens
gugcagacacacauauaggcu

SEQ ID NO: 129357 - RNA, 23 nt, Homo sapiens
gugcaguggcgagauuucggcuc

SEQ ID NO: 129358 - RNA, 22 nt, Homo sapiens
gugcaguguuugcauggaauca

SEQ ID NO: 129359 - RNA, 22 nt, Homo sapiens
gugcaguuuugagugaguuucu

SEQ ID NO: 129360 - RNA, 23 nt, Homo sapiens
gugcaugagucuuuauaguagca

SEQ ID NO: 129361 - RNA, 22 nt, Homo sapiens
gugcauguccacuaguccauau

SEQ ID NO: 129362 - RNA, 22 nt, Homo sapiens
gugcccacugucuguccuguag

SEQ ID NO: 129363 - RNA, 23 nt, Homo sapiens
gugccuucugagccuagucucca

SEQ ID NO: 129364 - RNA, 22 nt, Homo sapiens
gugcuuauccccauucuggagg

SEQ ID NO: 129365 - RNA, 22 nt, Homo sapiens
gugcuuguguuaauauguagcu

SEQ ID NO: 129366 - RNA, 22 nt, Homo sapiens
guggaaaauuauugcuguuuuu

SEQ ID NO: 129367 - RNA, 22 nt, Homo sapiens
guggaaagaacacaaaauuagg

SEQ ID NO: 129368 - RNA, 22 nt, Homo sapiens
guggacagagacuaaauguugu

SEQ ID NO: 129369 - RNA, 22 nt, Homo sapiens
guggagacaaaggcugagugag

SEQ ID NO: 129370 - RNA, 22 nt, Homo sapiens
guggaguaugaaaacugacuuu

SEQ ID NO: 129371 - RNA, 22 nt, Homo sapiens
guggcaaguguuccaagaggcg

SEQ ID NO: 129372 - RNA, 22 nt, Homo sapiens
guggcagaaaagagaagcaaug

SEQ ID NO: 129373 - RNA, 22 nt, Homo sapiens
guggcaugaaagcagauaccac

SEQ ID NO: 129374 - RNA, 21 nt, Homo sapiens
guggccuuuggagcaugucag

SEQ ID NO: 129375 - RNA, 22 nt, Homo sapiens
guggucagaaaucucaguggca

SEQ ID NO: 129376 - RNA, 22 nt, Homo sapiens
gugguucuagaauugaguaucc

SEQ ID NO: 129377 - RNA, 22 nt, Homo sapiens
gugguuuuacaaagagaaagau

SEQ ID NO: 129378 - RNA, 22 nt, Homo sapiens
guguaaguccugaguuuggaua

SEQ ID NO: 129379 - RNA, 22 nt, Homo sapiens
guguaugguaggaugacggagu

SEQ ID NO: 129380 - RNA, 22 nt, Homo sapiens
guguauguuguccauggaugcg

SEQ ID NO: 129381 - RNA, 22 nt, Homo sapiens
gugucacagcuuccaucucggu

SEQ ID NO: 129382 - RNA, 22 nt, Homo sapiens
gugucacuguauaauauuuauu

SEQ ID NO: 129383 - RNA, 22 nt, Homo sapiens
gugucacuguugagaaguccac

SEQ ID NO: 129384 - RNA, 22 nt, Homo sapiens
gugucaguggggagugaucuuc

SEQ ID NO: 129385 - RNA, 18 nt, Homo sapiens
gugucugguuaugggagu

SEQ ID NO: 129386 - RNA, 22 nt, Homo sapiens
gugugcauggagggggcaguga

SEQ ID NO: 129387 - RNA, 20 nt, Homo sapiens
gugugcauuucagauuuugg

SEQ ID NO: 129388 - RNA, 22 nt, Homo sapiens
guguugcacauucuguggaugu

SEQ ID NO: 129389 - RNA, 22 nt, Homo sapiens
guuaagaaguguaacuuaaguu

SEQ ID NO: 129390 - RNA, 22 nt, Homo sapiens
guuacugucuuccugauugcuu

SEQ ID NO: 129391 - RNA, 22 nt, Homo sapiens
guuaugcagcaauugauaaucu

SEQ ID NO: 129392 - RNA, 22 nt, Homo sapiens
guuauuaguugauauuaaguuc

SEQ ID NO: 129393 - RNA, 22 nt, Homo sapiens
guucaaguuuucucuugugggu

SEQ ID NO: 129394 - RNA, 22 nt, Homo sapiens
guucaguuuuaaagggaaauug

SEQ ID NO: 129395 - RNA, 22 nt, Homo sapiens
guucaucagggauacuggccuu

SEQ ID NO: 129396 - RNA, 23 nt, Homo sapiens
guucaucagggauauuggccuga

SEQ ID NO: 129397 - RNA, 22 nt, Homo sapiens
guuccuuguagaugcuggauau

SEQ ID NO: 129398 - RNA, 22 nt, Homo sapiens
ugguguuugagaagcugauguc

SEQ ID NO: 129399 - RNA, 22 nt, Homo sapiens
ugguuagucuguguguauauau

SEQ ID NO: 129400 - RNA, 22 nt, Homo sapiens
uguaaacauguauguguuuaug

SEQ ID NO: 129401 - RNA, 18 nt, Homo sapiens
uguaaacuaccucaaccu

SEQ ID NO: 129402 - RNA, 20 nt, Homo sapiens
uguaacacauggagaacucu

SEQ ID NO: 129403 - RNA, 21 nt, Homo sapiens
uguaacugcaaaccucagauu

SEQ ID NO: 129404 - RNA, 22 nt, Homo sapiens
uguaagcauugggcaugcaguc

SEQ ID NO: 129405 - RNA, 22 nt, Homo sapiens
uguacccuuagagagugaucga

SEQ ID NO: 129406 - RNA, 22 nt, Homo sapiens
uguagcaaaucgauacuauugg

SEQ ID NO: 129407 - RNA, 22 nt, Homo sapiens
uguagcacauuugaagagaagc

SEQ ID NO: 129408 - RNA, 22 nt, Homo sapiens
uguagcuuuugagauuuauauu

SEQ ID NO: 129409 - RNA, 23 nt, Homo sapiens
uguauacacccugugcaucuggg

SEQ ID NO: 129410 - RNA, 21 nt, Homo sapiens
uguauacauauguuaggugca

SEQ ID NO: 129411 - RNA, 21 nt, Homo sapiens
uguauacauggaagaaugguc

SEQ ID NO: 129412 - RNA, 22 nt, Homo sapiens
uguauauguuuguacauauguc

SEQ ID NO: 129413 - RNA, 22 nt, Homo sapiens
uguaugaguuguuuauaaauuu

SEQ ID NO: 129414 - RNA, 22 nt, Homo sapiens
uguaugucugcucuuuggaacu

SEQ ID NO: 129415 - RNA, 22 nt, Homo sapiens
ugucaaaugcagugauauuuga

SEQ ID NO: 129416 - RNA, 22 nt, Homo sapiens
ugucaauauguaauaacugaau

SEQ ID NO: 129417 - RNA, 22 nt, Homo sapiens
ugucaaugggaauuuguuuuag

SEQ ID NO: 129418 - RNA, 22 nt, Homo sapiens
ugucacagagauuuugguaugu

SEQ ID NO: 129419 - RNA, 22 nt, Homo sapiens
ugucaccauuuguaggugagga

SEQ ID NO: 129420 - RNA, 22 nt, Homo sapiens
ugucacccuuuauccauuuccu

SEQ ID NO: 129421 - RNA, 18 nt, Homo sapiens
ugucacuggauaaugguc

SEQ ID NO: 129422 - RNA, 22 nt, Homo sapiens
ugucagaaucugagacgacaac

SEQ ID NO: 129423 - RNA, 22 nt, Homo sapiens
ugucaggaguuuuagaaucuua

SEQ ID NO: 129424 - RNA, 22 nt, Homo sapiens
ugucaguggucuggaugcagcc

SEQ ID NO: 129425 - RNA, 22 nt, Homo sapiens
ugucaucauuggaaucugccuc

SEQ ID NO: 129426 - RNA, 22 nt, Homo sapiens
ugucaugucuuuguguaucaau

SEQ ID NO: 129427 - RNA, 22 nt, Homo sapiens
ugucauguugagaaacuuggau

SEQ ID NO: 129428 - RNA, 22 nt, Homo sapiens
ugucauguugguguacugcacc

SEQ ID NO: 129429 - RNA, 20 nt, Homo sapiens
ugucauuaagcacugugcca

SEQ ID NO: 129430 - RNA, 22 nt, Homo sapiens
ugucauucaggaaauucuaagu

SEQ ID NO: 129431 - RNA, 21 nt, Homo sapiens
uguccagcuuuuggaauauaa

SEQ ID NO: 129432 - RNA, 22 nt, Homo sapiens
uguccuggugaugcccaaauuc

SEQ ID NO: 129433 - RNA, 22 nt, Homo sapiens
ugucucaguucccuucucugga

SEQ ID NO: 129434 - RNA, 22 nt, Homo sapiens
ugucuuugguucaggcaaggag

SEQ ID NO: 129435 - RNA, 22 nt, Homo sapiens
ugugaaaucagauagccuuuuu

SEQ ID NO: 129436 - RNA, 22 nt, Homo sapiens
ugugaacaaaauuuguugcaua

SEQ ID NO: 129437 - RNA, 22 nt, Homo sapiens
ugugaacagcuccaaaugugga

SEQ ID NO: 129438 - RNA, 22 nt, Homo sapiens
ugugaaugaagaaugcuaaccu

SEQ ID NO: 129439 - RNA, 22 nt, Homo sapiens
ugugacacugaauggcagaacu

SEQ ID NO: 129440 - RNA, 22 nt, Homo sapiens
ugugacaguguuacauuucaug

SEQ ID NO: 129441 - RNA, 22 nt, Homo sapiens
ugugacugguugucccacuuuc

SEQ ID NO: 129442 - RNA, 22 nt, Homo sapiens
ugugacugguugucccgcuuuc

SEQ ID NO: 129443 - RNA, 22 nt, Homo sapiens
ugugagaaaugcagaaucucag

SEQ ID NO: 129444 - RNA, 22 nt, Homo sapiens
ugugaguguguacuaguuauca

SEQ ID NO: 129445 - RNA, 22 nt, Homo sapiens
ugugaucaaccugcagggcugg

SEQ ID NO: 129446 - RNA, 22 nt, Homo sapiens
ugugaucaugugugccuuaguc

SEQ ID NO: 129447 - RNA, 18 nt, Homo sapiens
ugugauggauauguuaau

SEQ ID NO: 129448 - RNA, 22 nt, Homo sapiens
ugugcaaaaguaauugcgguuu

SEQ ID NO: 129449 - RNA, 22 nt, Homo sapiens
ugugcaauucgauggagcucau

SEQ ID NO: 129450 - RNA, 22 nt, Homo sapiens
ugugcacaacaugcagguuugu

SEQ ID NO: 129451 - RNA, 22 nt, Homo sapiens
ugugcacaauguacagguuagu

SEQ ID NO: 129452 - RNA, 22 nt, Homo sapiens
ugugcacaaugugcagguuuga

SEQ ID NO: 129453 - RNA, 22 nt, Homo sapiens
ugugcacaaugugcagguuugu

SEQ ID NO: 129454 - RNA, 22 nt, Homo sapiens
ugugcacauaacauuuuuuuag

SEQ ID NO: 129455 - RNA, 22 nt, Homo sapiens
ugugcaccucuucacacaggga

SEQ ID NO: 129456 - RNA, 22 nt, Homo sapiens
ugugcauauaaguguguauaua

SEQ ID NO: 129457 - RNA, 22 nt, Homo sapiens
ugugccacuccagcucuagcuu

SEQ ID NO: 129458 - RNA, 22 nt, Homo sapiens
ugugccacugcacucuggccug

SEQ ID NO: 129459 - RNA, 22 nt, Homo sapiens
ugugccacuguucuguaaagug

SEQ ID NO: 129460 - RNA, 22 nt, Homo sapiens
ugugccuacugauagagccaag

SEQ ID NO: 129461 - RNA, 22 nt, Homo sapiens
ugugcuugaaauucaguuuuga

SEQ ID NO: 129462 - RNA, 22 nt, Homo sapiens
uguggaaauaaaagaaagguua

SEQ ID NO: 129463 - RNA, 22 nt, Homo sapiens
uguggcaaauggucaggaagaa

SEQ ID NO: 129464 - RNA, 22 nt, Homo sapiens
ugugggugguaaaauacaauga

SEQ ID NO: 129465 - RNA, 23 nt, Homo sapiens
ugugguauuauuccauuuauagg

SEQ ID NO: 129466 - RNA, 22 nt, Homo sapiens
uguggucaucacuugaagguaa

SEQ ID NO: 129467 - RNA, 19 nt, Homo sapiens
uguggucauccugggacga

SEQ ID NO: 129468 - RNA, 22 nt, Homo sapiens
ugugguuuuauaaacgugaccu

SEQ ID NO: 129469 - RNA, 22 nt, Homo sapiens
ugugguuuuucacauuuagaga

SEQ ID NO: 129470 - RNA, 22 nt, Homo sapiens
uguguacugcagaguauucugu

SEQ ID NO: 129471 - RNA, 22 nt, Homo sapiens
ugugucacugaggguuagugua

SEQ ID NO: 129472 - RNA, 22 nt, Homo sapiens
ugugucacugcacuccagccug

SEQ ID NO: 129473 - RNA, 22 nt, Homo sapiens
ugugucuugagagucucgagaa

SEQ ID NO: 129474 - RNA, 22 nt, Homo sapiens
uguuacagcagaauugaaagag

SEQ ID NO: 129475 - RNA, 22 nt, Homo sapiens
uguuagguuggugcaaaaguga

SEQ ID NO: 129476 - RNA, 22 nt, Homo sapiens
uguuaguuguucauguuaagag

SEQ ID NO: 129477 - RNA, 22 nt, Homo sapiens
uguuauguuuuagagguuucaa

SEQ ID NO: 129478 - RNA, 22 nt, Homo sapiens
uguuauuuuguguuagggcaca

SEQ ID NO: 129479 - RNA, 22 nt, Homo sapiens
uguucuggagccgguucaaaug

SEQ ID NO: 129480 - RNA, 22 nt, Homo sapiens
uguucuugaguugggaguacaa

SEQ ID NO: 129481 - RNA, 22 nt, Homo sapiens
uguugcacuccagccuagguga

SEQ ID NO: 129482 - RNA, 22 nt, Homo sapiens
uguugcacucuagccugggcaa

SEQ ID NO: 129483 - RNA, 22 nt, Homo sapiens
uguugcacugguaauguacuga

SEQ ID NO: 129484 - RNA, 22 nt, Homo sapiens
uguugcauuugucaaggucaag

SEQ ID NO: 129485 - RNA, 22 nt, Homo sapiens
uguuuguuugauaugggauaaa

SEQ ID NO: 129486 - RNA, 22 nt, Homo sapiens
uggaauguggacucuuaugggg

SEQ ID NO: 129487 - RNA, 21 nt, Homo sapiens
uggaauguucugacuucaggg

SEQ ID NO: 129488 - RNA, 22 nt, Homo sapiens
uggaauguuuaucaaaacagua

SEQ ID NO: 129489 - RNA, 22 nt, Homo sapiens
uggacacuggagauucgucagu

SEQ ID NO: 129490 - RNA, 18 nt, Homo sapiens
uggacagugauuauccau

SEQ ID NO: 129491 - RNA, 22 nt, Homo sapiens
uggacaugaagggcacaggagg

SEQ ID NO: 129492 - RNA, 20 nt, Homo sapiens
uggaccagagagguggggac

SEQ ID NO: 129493 - RNA, 21 nt, Homo sapiens
uggaccccuuccagucaucau

SEQ ID NO: 129494 - RNA, 22 nt, Homo sapiens
uggacuguaauagagaacagaa

SEQ ID NO: 129495 - RNA, 22 nt, Homo sapiens
uggacuguaauuuuauaggcau

SEQ ID NO: 129496 - RNA, 22 nt, Homo sapiens
uggacuuuaauaaaagggaaau

SEQ ID NO: 129497 - RNA, 22 nt, Homo sapiens
uggagacaaagauagaaaagca

SEQ ID NO: 129498 - RNA, 22 nt, Homo sapiens
uggagauguuuaaaauccacug

SEQ ID NO: 129499 - RNA, 22 nt, Homo sapiens
uggagguaggacgaagaacucu

SEQ ID NO: 129500 - RNA, 20 nt, Homo sapiens
uggaggucaucugucacuac

SEQ ID NO: 129501 - RNA, 19 nt, Homo sapiens
uggagucaucaugcugcua

SEQ ID NO: 129502 - RNA, 22 nt, Homo sapiens
uggagugauaugguuauauggg

SEQ ID NO: 129503 - RNA, 22 nt, Homo sapiens
uggagugcgagggugaaacuuu

SEQ ID NO: 129504 - RNA, 22 nt, Homo sapiens
uggauaguaauaaacauauagg

SEQ ID NO: 129505 - RNA, 18 nt, Homo sapiens
uggauaguuguuggcaga

SEQ ID NO: 129506 - RNA, 22 nt, Homo sapiens
cuuuagcaaggauauggggaug

SEQ ID NO: 129507 - RNA, 22 nt, Homo sapiens
cuuugcaaauggccuuuccaag

SEQ ID NO: 129508 - RNA, 18 nt, Homo sapiens
cuuugcagcuuccagagg

SEQ ID NO: 129509 - RNA, 22 nt, Homo sapiens
cuuuggagaaaaguucuugggc

SEQ ID NO: 129510 - RNA, 22 nt, Homo sapiens
cuuuggauggaaccucucuuuc

SEQ ID NO: 129511 - RNA, 20 nt, Homo sapiens
cuuuggcaaugagaacaggg

SEQ ID NO: 129512 - RNA, 22 nt, Homo sapiens
cuuugggaccgcgguuuauacu

SEQ ID NO: 129513 - RNA, 22 nt, Homo sapiens
cuuuggguauucucccuugggg

SEQ ID NO: 129514 - RNA, 22 nt, Homo sapiens
cuuuuacacugcuggugggaau

SEQ ID NO: 129515 - RNA, 20 nt, Homo sapiens
cuuuuagcagcagcaagaga

SEQ ID NO: 129516 - RNA, 22 nt, Homo sapiens
cuuuuggugugaagaagcucuu

SEQ ID NO: 129517 - RNA, 22 nt, Homo sapiens
cuuuugugauuccucaguuacu

SEQ ID NO: 129518 - RNA, 22 nt, Homo sapiens
cuuuugugauucuucaguugcu

SEQ ID NO: 129519 - RNA, 22 nt, Homo sapiens
cuuuuguggaucuucuguugcu

SEQ ID NO: 129520 - RNA, 21 nt, Homo sapiens
cuuuuuacucguucauaugca

SEQ ID NO: 129521 - RNA, 22 nt, Homo sapiens
cuuuuugcaaauacaacucuga

SEQ ID NO: 129522 - RNA, 22 nt, Homo sapiens
cuuuuugcuagagucuaggguc

SEQ ID NO: 129523 - RNA, 22 nt, Homo sapiens
cuuuuugguagagcaggugugc

SEQ ID NO: 129524 - RNA, 22 nt, Homo sapiens
gaaaacugcuucucuggguuuc

SEQ ID NO: 129525 - RNA, 20 nt, Homo sapiens
gaaacaucuauccucuccuu

SEQ ID NO: 129526 - RNA, 22 nt, Homo sapiens
gaaagauuuccugagcuagaaa

SEQ ID NO: 129527 - RNA, 22 nt, Homo sapiens
gaaaugcucagggguuuuccag

SEQ ID NO: 129528 - RNA, 22 nt, Homo sapiens
gaaauggaucagagcaagcuuu

SEQ ID NO: 129529 - RNA, 23 nt, Homo sapiens
gaaauguaagugaugccccacag

SEQ ID NO: 129530 - RNA, 22 nt, Homo sapiens
gaaaugucugagauguggcuca

SEQ ID NO: 129531 - RNA, 22 nt, Homo sapiens
gaaauguugauagugggcauug

SEQ ID NO: 129532 - RNA, 22 nt, Homo sapiens
gaacuguuucuggugaaagagu

SEQ ID NO: 129533 - RNA, 18 nt, Homo sapiens
gaagaaguaggcauggca

SEQ ID NO: 129534 - RNA, 22 nt, Homo sapiens
gaagacauuugcugcacguccu

SEQ ID NO: 129535 - RNA, 22 nt, Homo sapiens
gaagauaucuaguaccauuguc

SEQ ID NO: 129536 - RNA, 22 nt, Homo sapiens
gaaggcaugcugcauggccaga

SEQ ID NO: 129537 - RNA, 22 nt, Homo sapiens
gaaguaggugcuguuauuaucu

SEQ ID NO: 129538 - RNA, 22 nt, Homo sapiens
gaagugguaggauugcuuuuga

SEQ ID NO: 129539 - RNA, 22 nt, Homo sapiens
gaaucaauugaucuaugugucu

SEQ ID NO: 129540 - RNA, 22 nt, Homo sapiens
gaaucacagauuaugaguaucu

SEQ ID NO: 129541 - RNA, 22 nt, Homo sapiens
gaaucauuggguugauucaaga

SEQ ID NO: 129542 - RNA, 22 nt, Homo sapiens
gaaugcagcagugacagggcug

SEQ ID NO: 129543 - RNA, 22 nt, Homo sapiens
gaaugucuuauugcucguugua

SEQ ID NO: 129544 - RNA, 22 nt, Homo sapiens
gaauguuuacuuuguuuaauac

SEQ ID NO: 129545 - RNA, 22 nt, Homo sapiens
gacaccugguguggaacuggag

SEQ ID NO: 129546 - RNA, 22 nt, Homo sapiens
gacagagcaagacccuauuuaa

SEQ ID NO: 129547 - RNA, 22 nt, Homo sapiens
gacagugagaugucaugugaaa

SEQ ID NO: 129548 - RNA, 18 nt, Homo sapiens
gacaguguggcaauuccu

SEQ ID NO: 129549 - RNA, 22 nt, Homo sapiens
gacaguuuggugaggaagacga

SEQ ID NO: 129550 - RNA, 20 nt, Homo sapiens
gacauguugguuugcugcac

SEQ ID NO: 129551 - RNA, 22 nt, Homo sapiens
gacauguuuacaguguugagag

SEQ ID NO: 129552 - RNA, 22 nt, Homo sapiens
gacauuaucagguuuguuuucu

SEQ ID NO: 129553 - RNA, 22 nt, Homo sapiens
gaccacagacuggaaagagggc

SEQ ID NO: 129554 - RNA, 22 nt, Homo sapiens
gaccccuagagauaggaggaac

SEQ ID NO: 129555 - RNA, 22 nt, Homo sapiens
gacccucuagagggaagcgcuu

SEQ ID NO: 129556 - RNA, 22 nt, Homo sapiens
gaccugagagguacauguauuu

SEQ ID NO: 129557 - RNA, 22 nt, Homo sapiens
gagcuaguguaauauuuugggg

SEQ ID NO: 129558 - RNA, 22 nt, Homo sapiens
gagcucguuuuugcugacucuu

SEQ ID NO: 129559 - RNA, 22 nt, Homo sapiens
gagcugaaguuuccauuuguac

SEQ ID NO: 129560 - RNA, 22 nt, Homo sapiens
gagcugccuugccuaugcaaga

SEQ ID NO: 129561 - RNA, 22 nt, Homo sapiens
gagcuuggguuaaaguugccuu

SEQ ID NO: 129562 - RNA, 22 nt, Homo sapiens
gagcuuguagugugaaugguau

SEQ ID NO: 129563 - RNA, 22 nt, Homo sapiens
gaggcacucuguacaaaucugc

SEQ ID NO: 129564 - RNA, 22 nt, Homo sapiens
gaggcagucuguccauucucag

SEQ ID NO: 129565 - RNA, 22 nt, Homo sapiens
gaggcauuauucccaucuuaca

SEQ ID NO: 129566 - RNA, 22 nt, Homo sapiens
gaggcuagauggggaugugucc

SEQ ID NO: 129567 - RNA, 22 nt, Homo sapiens
gagguaaguaagaauggcaagc

SEQ ID NO: 129568 - RNA, 22 nt, Homo sapiens
gagguaggaggauugcuuaagg

SEQ ID NO: 129569 - RNA, 22 nt, Homo sapiens
gagguagguacaauugccacca

SEQ ID NO: 129570 - RNA, 22 nt, Homo sapiens
gagguaguuaaugcauucacua

SEQ ID NO: 129571 - RNA, 22 nt, Homo sapiens
gagguaugugggcagacauuua

SEQ ID NO: 129572 - RNA, 22 nt, Homo sapiens
gaggugaaggucucaauaaaua

SEQ ID NO: 129573 - RNA, 22 nt, Homo sapiens
gagguguagucaugccaagauc

SEQ ID NO: 129574 - RNA, 22 nt, Homo sapiens
gagguugggaugagggauacag

SEQ ID NO: 129575 - RNA, 22 nt, Homo sapiens
gaguauauuugcacuguuaugu

SEQ ID NO: 129576 - RNA, 22 nt, Homo sapiens
gaguaucuuuaaggugguuugg

SEQ ID NO: 129577 - RNA, 23 nt, Homo sapiens
gagugcaaugacaugaucucgga

SEQ ID NO: 129578 - RNA, 22 nt, Homo sapiens
gagugcaauggcaccgucucgg

SEQ ID NO: 129579 - RNA, 22 nt, Homo sapiens
gagugcaauggcagaucuccgc

SEQ ID NO: 129580 - RNA, 22 nt, Homo sapiens
gagugcaauggcaugaucuugg

SEQ ID NO: 129581 - RNA, 22 nt, Homo sapiens
gagugcaauggcgcgaucuggg

SEQ ID NO: 129582 - RNA, 22 nt, Homo sapiens
gagugcaauggugccaucucgg

SEQ ID NO: 129583 - RNA, 23 nt, Homo sapiens
gaguggagacucauugauuuccu

SEQ ID NO: 129584 - RNA, 18 nt, Homo sapiens
gaguggugcuucccuugu

SEQ ID NO: 129585 - RNA, 22 nt, Homo sapiens
gaguuacauuguaauugccgag

SEQ ID NO: 129586 - RNA, 22 nt, Homo sapiens
gaguuaggaucucacuguguca

SEQ ID NO: 129587 - RNA, 22 nt, Homo sapiens
gaguuagguugucaaugucuua

SEQ ID NO: 129588 - RNA, 22 nt, Homo sapiens
gaguucauaucuaugagugugc

SEQ ID NO: 129589 - RNA, 22 nt, Homo sapiens
gaguuuguaaacuauucacuaa

SEQ ID NO: 129590 - RNA, 22 nt, Homo sapiens
gauagcauucaauuaucuguug

SEQ ID NO: 129591 - RNA, 22 nt, Homo sapiens
gauauguaaaaauuauaucuga

SEQ ID NO: 129592 - RNA, 22 nt, Homo sapiens
gauauguacagcucucuaggau

SEQ ID NO: 129593 - RNA, 22 nt, Homo sapiens
gauauguaguaguugaaaaaga

SEQ ID NO: 129594 - RNA, 19 nt, Homo sapiens
gauauguugagcacccuuu

SEQ ID NO: 129595 - RNA, 22 nt, Homo sapiens
gaucacauguguacucaaugug

SEQ ID NO: 129596 - RNA, 22 nt, Homo sapiens
gaucacuuugaugccaggaacu

SEQ ID NO: 129597 - RNA, 22 nt, Homo sapiens
gaucucaguggauacugugaug

SEQ ID NO: 129598 - RNA, 22 nt, Homo sapiens
gaucugucuuuccuuauagucu

SEQ ID NO: 129599 - RNA, 22 nt, Homo sapiens
gaugacacugggucaaaucuca

SEQ ID NO: 129600 - RNA, 22 nt, Homo sapiens
gaugagcuaaguucucacagca

SEQ ID NO: 129601 - RNA, 22 nt, Homo sapiens
gaugaucucuggugguaaagac

SEQ ID NO: 129602 - RNA, 22 nt, Homo sapiens
gaugauguuugauaaauaauaa

SEQ ID NO: 129603 - RNA, 19 nt, Homo sapiens
gaugcaaugcacugagguc

SEQ ID NO: 129604 - RNA, 22 nt, Homo sapiens
aaagguaguacuucuagaaggg

SEQ ID NO: 129605 - RNA, 22 nt, Homo sapiens
aaagucacuggagaaggaauau

SEQ ID NO: 129606 - RNA, 17 nt, Homo sapiens
aaaguccuuugcuaucu

SEQ ID NO: 129607 - RNA, 22 nt, Homo sapiens
aaagucuguuuugucagagacu

SEQ ID NO: 129608 - RNA, 22 nt, Homo sapiens
aaagugaauguaucccguaagu

SEQ ID NO: 129609 - RNA, 22 nt, Homo sapiens
aaagugauguccaggcuuucag

SEQ ID NO: 129610 - RNA, 22 nt, Homo sapiens
aaagugauugcgguuuuugcca

SEQ ID NO: 129611 - RNA, 22 nt, Homo sapiens
aaagugauuguaguuuuugcca

SEQ ID NO: 129612 - RNA, 22 nt, Homo sapiens
aaagugcuaggauuaccugggg

SEQ ID NO: 129613 - RNA, 22 nt, Homo sapiens
aaaguggugugaguauguaucu

SEQ ID NO: 129614 - RNA, 15 nt, Homo sapiens
aaauaugucaguucu

SEQ ID NO: 129615 - RNA, 22 nt, Homo sapiens
aaaucccuugcucucucagacc

SEQ ID NO: 129616 - RNA, 21 nt, Homo sapiens
aaaugcacauuacugcuggug

SEQ ID NO: 129617 - RNA, 22 nt, Homo sapiens
aaaugcacgcuacccagcuaga

SEQ ID NO: 129618 - RNA, 22 nt, Homo sapiens
aaaugcaguugguggggauaug

SEQ ID NO: 129619 - RNA, 22 nt, Homo sapiens
aaaugcucuuuaugaaguugga

SEQ ID NO: 129620 - RNA, 22 nt, Homo sapiens
aaaugcugcuuuggccucuucu

SEQ ID NO: 129621 - RNA, 22 nt, Homo sapiens
aaaugcugucaaauuguguucu

SEQ ID NO: 129622 - RNA, 22 nt, Homo sapiens
aaaugcuguuccaggaccuauc

SEQ ID NO: 129623 - RNA, 22 nt, Homo sapiens
aaaugcuucuauguggcauguu

SEQ ID NO: 129624 - RNA, 22 nt, Homo sapiens
aaauggcacaguaagggcauuu

SEQ ID NO: 129625 - RNA, 22 nt, Homo sapiens
aaauggcaccggcucuucccuc

SEQ ID NO: 129626 - RNA, 19 nt, Homo sapiens
aaaugugcacuguuuucca

SEQ ID NO: 129627 - RNA, 22 nt, Homo sapiens
aaauucauuucagcucugggua

SEQ ID NO: 129628 - RNA, 22 nt, Homo sapiens
aacaccauucucuguaacaaga

SEQ ID NO: 129629 - RNA, 22 nt, Homo sapiens
aacagagcuggugacuccaggu

SEQ ID NO: 129630 - RNA, 22 nt, Homo sapiens
aacaggguguuugcaguuucuu

SEQ ID NO: 129631 - RNA, 22 nt, Homo sapiens
aacaguaucuaacgagugauga

SEQ ID NO: 129632 - RNA, 22 nt, Homo sapiens
aacagugcuguuauaaauguac

SEQ ID NO: 129633 - RNA, 21 nt, Homo sapiens
aacagugcuuaguagauguuc

SEQ ID NO: 129634 - RNA, 22 nt, Homo sapiens
aacaguguuuuggguuuucugg

SEQ ID NO: 129635 - RNA, 22 nt, Homo sapiens
aacaucaaccaugaggguugga

SEQ ID NO: 129636 - RNA, 22 nt, Homo sapiens
aaccuauaguauugaaaucaag

SEQ ID NO: 129637 - RNA, 22 nt, Homo sapiens
aaccuucauuccuuucccugcc

SEQ ID NO: 129638 - RNA, 22 nt, Homo sapiens
aacugcacauauuuguaugggu

SEQ ID NO: 129639 - RNA, 22 nt, Homo sapiens
aacugguauugaauuuaggaag

SEQ ID NO: 129640 - RNA, 22 nt, Homo sapiens
aagaggcuguaggauaaugccu

SEQ ID NO: 129641 - RNA, 23 nt, Homo sapiens
aagagguaugacuaugaagugga

SEQ ID NO: 129642 - RNA, 22 nt, Homo sapiens
aagaguuaguaaaauuuccucu

SEQ ID NO: 129643 - RNA, 22 nt, Homo sapiens
aagauauguuaguuauaaacuc

SEQ ID NO: 129644 - RNA, 22 nt, Homo sapiens
aagaucauucagggaaggcuga

SEQ ID NO: 129645 - RNA, 21 nt, Homo sapiens
aagcacauugaguguguguga

SEQ ID NO: 129646 - RNA, 20 nt, Homo sapiens
aagcagacauuuggaugaaa

SEQ ID NO: 129647 - RNA, 22 nt, Homo sapiens
aagcagauguguugaaaguacu

SEQ ID NO: 129648 - RNA, 22 nt, Homo sapiens
aagcaucauuuggaauuugaga

SEQ ID NO: 129649 - RNA, 20 nt, Homo sapiens
aagcauggguuuuaggguca

SEQ ID NO: 129650 - RNA, 22 nt, Homo sapiens
aagccacuguaccugucucuua

SEQ ID NO: 129651 - RNA, 22 nt, Homo sapiens
aagcuaggguuaauuuauuauu

SEQ ID NO: 129652 - RNA, 20 nt, Homo sapiens
aagcugaguguuuuuuuaau

SEQ ID NO: 129653 - RNA, 22 nt, Homo sapiens
cauugcacugcauucugggcaa

SEQ ID NO: 129654 - RNA, 22 nt, Homo sapiens
cauugcauuccagucugggcaa

SEQ ID NO: 129655 - RNA, 22 nt, Homo sapiens
cauugcuaaaagucauauauaa

SEQ ID NO: 129656 - RNA, 22 nt, Homo sapiens
cauugguuaguuaacuuuaaga

SEQ ID NO: 129657 - RNA, 22 nt, Homo sapiens
cauugguugaacagauuguguu

SEQ ID NO: 129658 - RNA, 22 nt, Homo sapiens
cauugucccucaaugacuauga

SEQ ID NO: 129659 - RNA, 22 nt, Homo sapiens
cauuuugcaguuucugucucca

SEQ ID NO: 129660 - RNA, 22 nt, Homo sapiens
cauuuugguuaaauagguagcu

SEQ ID NO: 129661 - RNA, 22 nt, Homo sapiens
ccaaaucucauguugaaaugug

SEQ ID NO: 129662 - RNA, 22 nt, Homo sapiens
ccaaggcacugauucuguacuc

SEQ ID NO: 129663 - RNA, 22 nt, Homo sapiens
ccaagugcuuaaaauuucauuu

SEQ ID NO: 129664 - RNA, 22 nt, Homo sapiens
ccacaaccucaacagcaucuau

SEQ ID NO: 129665 - RNA, 19 nt, Homo sapiens
ccacaaugguugaacuaga

SEQ ID NO: 129666 - RNA, 23 nt, Homo sapiens
ccacacuguuuagaauggcauca

SEQ ID NO: 129667 - RNA, 22 nt, Homo sapiens
ccacaguagucuugggaugggc

SEQ ID NO: 129668 - RNA, 22 nt, Homo sapiens
ccacagucuaugcaacaagguc

SEQ ID NO: 129669 - RNA, 22 nt, Homo sapiens
ccacaguugaaauuuugacugu

SEQ ID NO: 129670 - RNA, 22 nt, Homo sapiens
ccacauuaccuugcuugcucca

SEQ ID NO: 129671 - RNA, 22 nt, Homo sapiens
ccacccuuccacacccugggua

SEQ ID NO: 129672 - RNA, 22 nt, Homo sapiens
ccacccuuccauucuuccucuu

SEQ ID NO: 129673 - RNA, 22 nt, Homo sapiens
ccaccgggucccagcucugcuc

SEQ ID NO: 129674 - RNA, 22 nt, Homo sapiens
ccagaguucuaggcauuggaaa

SEQ ID NO: 129675 - RNA, 22 nt, Homo sapiens
ccagaguuucugauucagcagg

SEQ ID NO: 129676 - RNA, 22 nt, Homo sapiens
ccagcaccauuuguugaauagg

SEQ ID NO: 129677 - RNA, 20 nt, Homo sapiens
ccagcaucauuagauucugg

SEQ ID NO: 129678 - RNA, 22 nt, Homo sapiens
ccagccgggugcaguggcucac

SEQ ID NO: 129679 - RNA, 18 nt, Homo sapiens
ccagugcaaggaaagccc

SEQ ID NO: 129680 - RNA, 22 nt, Homo sapiens
ccagugcauggaucccaggggg

SEQ ID NO: 129681 - RNA, 21 nt, Homo sapiens
ccagugguuggaaacuauggg

SEQ ID NO: 129682 - RNA, 21 nt, Homo sapiens
ccaguguaaugauagcaggca

SEQ ID NO: 129683 - RNA, 22 nt, Homo sapiens
ccagugucugacagacacggcg

SEQ ID NO: 129684 - RNA, 22 nt, Homo sapiens
auauguaguauggaaacauugu

SEQ ID NO: 129685 - RNA, 22 nt, Homo sapiens
auaugucuauuauuagggcagg

SEQ ID NO: 129686 - RNA, 21 nt, Homo sapiens
auauuacuguuagaggacugc

SEQ ID NO: 129687 - RNA, 22 nt, Homo sapiens
auauuugguuaccugugggucu

SEQ ID NO: 129688 - RNA, 22 nt, Homo sapiens
aucaaagccaugcucaguuuuc

SEQ ID NO: 129689 - RNA, 22 nt, Homo sapiens
aucaaaguaggcauauguuuuu

SEQ ID NO: 129690 - RNA, 22 nt, Homo sapiens
aucaaaguaucucaauauggua

SEQ ID NO: 129691 - RNA, 22 nt, Homo sapiens
aucaaaucuccagaaccugucu

SEQ ID NO: 129692 - RNA, 22 nt, Homo sapiens
aucaaaugcuggcagagugccu

SEQ ID NO: 129693 - RNA, 22 nt, Homo sapiens
aucaagccaaagaaaguccuug

SEQ ID NO: 129694 - RNA, 22 nt, Homo sapiens
aucaagcuggcauauguaguuc

SEQ ID NO: 129695 - RNA, 22 nt, Homo sapiens
aucaaguacuguacugaaagug

SEQ ID NO: 129696 - RNA, 22 nt, Homo sapiens
aucacacucaccuucuguccuu

SEQ ID NO: 129697 - RNA, 22 nt, Homo sapiens
aucacagaacuuugagcagaga

SEQ ID NO: 129698 - RNA, 22 nt, Homo sapiens
aucacagcccuccucuuggaug

SEQ ID NO: 129699 - RNA, 22 nt, Homo sapiens
aucacagguacuauggcugaca

SEQ ID NO: 129700 - RNA, 22 nt, Homo sapiens
aucacagugaaaacagucaauu

SEQ ID NO: 129701 - RNA, 22 nt, Homo sapiens
aucaccauguguacauuagacc

SEQ ID NO: 129702 - RNA, 22 nt, Homo sapiens
aucaccugagcaguauacacug

SEQ ID NO: 129703 - RNA, 22 nt, Homo sapiens
aucacugggagcagccauuaau

SEQ ID NO: 129704 - RNA, 22 nt, Homo sapiens
aucacuggucaugagagaagua

SEQ ID NO: 129705 - RNA, 22 nt, Homo sapiens
aucacuguccacucaucuuucu

SEQ ID NO: 129706 - RNA, 22 nt, Homo sapiens
aucacugugauuucuacugugc

SEQ ID NO: 129707 - RNA, 22 nt, Homo sapiens
aucacuguuuugaugcucggac

SEQ ID NO: 129708 - RNA, 22 nt, Homo sapiens
aucacuuucuauuucugugcca

SEQ ID NO: 129709 - RNA, 22 nt, Homo sapiens
aucagaaucucuagugggacca

SEQ ID NO: 129710 - RNA, 22 nt, Homo sapiens
aucagagugaaacaugggagau

SEQ ID NO: 129711 - RNA, 19 nt, Homo sapiens
aucagcacaagugugcuuu

SEQ ID NO: 129712 - RNA, 22 nt, Homo sapiens
aucagcacugaucauacagcuu

SEQ ID NO: 129713 - RNA, 22 nt, Homo sapiens
aucagcaguguaaaaacggacu

SEQ ID NO: 129714 - RNA, 18 nt, Homo sapiens
aucagggugaagagagga

SEQ ID NO: 129715 - RNA, 22 nt, Homo sapiens
aucagugcagugggaacuagaa

SEQ ID NO: 129716 - RNA, 22 nt, Homo sapiens
aucauguaguaagacacauuua

SEQ ID NO: 129717 - RNA, 22 nt, Homo sapiens
aucauugcacaucacagccuca

SEQ ID NO: 129718 - RNA, 22 nt, Homo sapiens
aucauugugugaguugauggga

SEQ ID NO: 129719 - RNA, 22 nt, Homo sapiens
auccaguguuuucuuuugucac

SEQ ID NO: 129720 - RNA, 22 nt, Homo sapiens
auccccugcacggggugucauu

SEQ ID NO: 129721 - RNA, 22 nt, Homo sapiens
aucccugaggaauuucugcacu

SEQ ID NO: 129722 - RNA, 22 nt, Homo sapiens
aucccugugacgagcaucccua

SEQ ID NO: 129723 - RNA, 22 nt, Homo sapiens
aucccuguguccagcaccugug

SEQ ID NO: 129724 - RNA, 22 nt, Homo sapiens
aucccuuccuagcacuuggugu

SEQ ID NO: 129725 - RNA, 22 nt, Homo sapiens
auccucugagaucuaggcagag

SEQ ID NO: 129726 - RNA, 22 nt, Homo sapiens
auccugagacuuugcugaaguu

SEQ ID NO: 129727 - RNA, 22 nt, Homo sapiens
auccugagacuuuucugaaguu

SEQ ID NO: 129728 - RNA, 22 nt, Homo sapiens
aucgcugagaaagggacuuuca

SEQ ID NO: 129729 - RNA, 22 nt, Homo sapiens
aucuacagccagucugguuugu

SEQ ID NO: 129730 - RNA, 22 nt, Homo sapiens
aucucaaugcuuuuguaggcca

SEQ ID NO: 129731 - RNA, 22 nt, Homo sapiens
aucucaguuaauuccaucuuuc

SEQ ID NO: 129732 - RNA, 22 nt, Homo sapiens
aucucaguucaggcuggccaca

SEQ ID NO: 129733 - RNA, 22 nt, Homo sapiens
aucugcaaagcugggcugagac

SEQ ID NO: 129734 - RNA, 22 nt, Homo sapiens
aucugcuccuggugaggguuuc

SEQ ID NO: 129735 - RNA, 22 nt, Homo sapiens
aucuggcuucuuuuaguccaca

SEQ ID NO: 129736 - RNA, 22 nt, Homo sapiens
aucugguauuacugcaacugua

SEQ ID NO: 129737 - RNA, 22 nt, Homo sapiens
aucugguguccucgugggaguc

SEQ ID NO: 129738 - RNA, 22 nt, Homo sapiens
aucugguguuuccuucacauug

SEQ ID NO: 129739 - RNA, 22 nt, Homo sapiens
aucuguguuuaaggucccagaa

SEQ ID NO: 129740 - RNA, 22 nt, Homo sapiens
aucuuugauuagacugauggau

SEQ ID NO: 129741 - RNA, 22 nt, Homo sapiens
aucuuugauugaagggacccug

SEQ ID NO: 129742 - RNA, 22 nt, Homo sapiens
aucuuugcugagaugcauggca

SEQ ID NO: 129743 - RNA, 22 nt, Homo sapiens
augaaaacaugauuugccuguu

SEQ ID NO: 129744 - RNA, 22 nt, Homo sapiens
augaaagugauaaaugucucua

SEQ ID NO: 129745 - RNA, 22 nt, Homo sapiens
augaaaucacugugaugcccua

SEQ ID NO: 129746 - RNA, 17 nt, Homo sapiens
augaacucaucguucuu

SEQ ID NO: 129747 - RNA, 22 nt, Homo sapiens
augaagcuagcugauugcugau

SEQ ID NO: 129748 - RNA, 18 nt, Homo sapiens
augaagucaucacuuuua

SEQ ID NO: 129749 - RNA, 17 nt, Homo sapiens
augaagucaucauuuuu

SEQ ID NO: 129750 - RNA, 22 nt, Homo sapiens
augaagucguuacuaccaauug

SEQ ID NO: 129751 - RNA, 20 nt, Homo sapiens
augaagugaaguuagggaac

SEQ ID NO: 129752 - RNA, 22 nt, Homo sapiens
augaauacugcugcaaugaaca

SEQ ID NO: 129753 - RNA, 21 nt, Homo sapiens
augaauguaaagaauguggga

SEQ ID NO: 129754 - RNA, 22 nt, Homo sapiens
augacaagagccuucuuuccuu

SEQ ID NO: 129755 - RNA, 22 nt, Homo sapiens
augacaagaguguucagggaga

SEQ ID NO: 129756 - RNA, 22 nt, Homo sapiens
augacacugcagagauguccca

SEQ ID NO: 129757 - RNA, 22 nt, Homo sapiens
augacagcaucugugaaguugu

SEQ ID NO: 129758 - RNA, 22 nt, Homo sapiens
agauggauuuuguagccccagc

SEQ ID NO: 129759 - RNA, 22 nt, Homo sapiens
agauggugugcuaggaaaugua

SEQ ID NO: 129760 - RNA, 18 nt, Homo sapiens
agaugguguugcuucugu

SEQ ID NO: 129761 - RNA, 22 nt, Homo sapiens
agauguuguucaucugauuguu

SEQ ID NO: 129762 - RNA, 22 nt, Homo sapiens
agauucauccaaguuguugcau

SEQ ID NO: 129763 - RNA, 22 nt, Homo sapiens
agcaagaaugaacucucccaga

SEQ ID NO: 129764 - RNA, 22 nt, Homo sapiens
agcacagccuuguguuuucuug

SEQ ID NO: 129765 - RNA, 22 nt, Homo sapiens
agcacauuaguaucuaagaaca

SEQ ID NO: 129766 - RNA, 22 nt, Homo sapiens
agcaccaccguugcucuauccc

SEQ ID NO: 129767 - RNA, 22 nt, Homo sapiens
acccuggagagugcuguaguaa

SEQ ID NO: 129768 - RNA, 22 nt, Homo sapiens
acccuggauucguggccuugaa

SEQ ID NO: 129769 - RNA, 22 nt, Homo sapiens
acccuguaggacuauucuaauc

SEQ ID NO: 129770 - RNA, 22 nt, Homo sapiens
acccugucaaaacggaccaauc

SEQ ID NO: 129771 - RNA, 22 nt, Homo sapiens
acccugucaaaauagaccaauc

SEQ ID NO: 129772 - RNA, 22 nt, Homo sapiens
acccugucacucccaucaauuu

SEQ ID NO: 129773 - RNA, 22 nt, Homo sapiens
acccugucagcuggccugggca

SEQ ID NO: 129774 - RNA, 22 nt, Homo sapiens
accuggcacuuagcaaaucuga

SEQ ID NO: 129775 - RNA, 23 nt, Homo sapiens
accugugguuauuuuacucuucc

SEQ ID NO: 129776 - RNA, 23 nt, Homo sapiens
accuucauucauucagcugaagu

SEQ ID NO: 129777 - RNA, 18 nt, Homo sapiens
accuucauuccuuugccu

SEQ ID NO: 129778 - RNA, 22 nt, Homo sapiens
accuuguaucuguuaggauugc

SEQ ID NO: 129779 - RNA, 22 nt, Homo sapiens
acguaguagguuuauaauauua

SEQ ID NO: 129780 - RNA, 22 nt, Homo sapiens
acuauacugaagcaaauuaaca

SEQ ID NO: 129781 - RNA, 22 nt, Homo sapiens
acucagagugggccccuagaua

SEQ ID NO: 129782 - RNA, 22 nt, Homo sapiens
acuccauuuggacucugggagg

SEQ ID NO: 129783 - RNA, 22 nt, Homo sapiens
acucuguugucuggccuuccug

SEQ ID NO: 129784 - RNA, 22 nt, Homo sapiens
acugacaugaucaggcauguuc

SEQ ID NO: 129785 - RNA, 22 nt, Homo sapiens
acugagccuuuaaaugacuuca

SEQ ID NO: 129786 - RNA, 22 nt, Homo sapiens
acugcacuccacccuuggcagc

SEQ ID NO: 129787 - RNA, 18 nt, Homo sapiens
acugcacuccaccuuggg

SEQ ID NO: 129788 - RNA, 22 nt, Homo sapiens
acugcacuccagacucugucuc

SEQ ID NO: 129789 - RNA, 22 nt, Homo sapiens
acugcacuccagcccaggugac

SEQ ID NO: 129790 - RNA, 22 nt, Homo sapiens
acugcacuccagccuccugaca

SEQ ID NO: 129791 - RNA, 22 nt, Homo sapiens
acugcacuccagccucggcaau

SEQ ID NO: 129792 - RNA, 22 nt, Homo sapiens
acugcacuccagccucggugac

SEQ ID NO: 129793 - RNA, 22 nt, Homo sapiens
acugcacuccagccugaugaaa

SEQ ID NO: 129794 - RNA, 22 nt, Homo sapiens
acugcacuccagccugccgaca

SEQ ID NO: 129795 - RNA, 22 nt, Homo sapiens
acugcacuccagccuuagugac

SEQ ID NO: 129796 - RNA, 22 nt, Homo sapiens
acugcacuccagccuucaggac

SEQ ID NO: 129797 - RNA, 22 nt, Homo sapiens
acugcacuccagccuugauggc

SEQ ID NO: 129798 - RNA, 22 nt, Homo sapiens
acugcacuccagccuuggcaac

SEQ ID NO: 129799 - RNA, 22 nt, Homo sapiens
acugcacuccagcuugggugac

SEQ ID NO: 129800 - RNA, 22 nt, Homo sapiens
acugcacuccagcuuuggugac

SEQ ID NO: 129801 - RNA, 22 nt, Homo sapiens
acugcacugucaaccuccuggg

SEQ ID NO: 129802 - RNA, 22 nt, Homo sapiens
acugcacuguccuagaguccuc

SEQ ID NO: 129803 - RNA, 22 nt, Homo sapiens
acugcacuucagccuugggaaa

SEQ ID NO: 129804 - RNA, 22 nt, Homo sapiens
acuggacuuaaugaugaauugu

SEQ ID NO: 129805 - RNA, 18 nt, Homo sapiens
acuggauguaaagggucc

SEQ ID NO: 129806 - RNA, 22 nt, Homo sapiens
acuggcaauggcagaaauaguu

SEQ ID NO: 129807 - RNA, 20 nt, Homo sapiens
acuggcacugguaggugugg

SEQ ID NO: 129808 - RNA, 22 nt, Homo sapiens
acuggcucugcuuuacaaacag

SEQ ID NO: 129809 - RNA, 22 nt, Homo sapiens
acuggcuuauuucacuuagcau

SEQ ID NO: 129810 - RNA, 22 nt, Homo sapiens
acuguacugucuggggcagucu

SEQ ID NO: 129811 - RNA, 22 nt, Homo sapiens
acuugacacuuauauuacucac

SEQ ID NO: 129812 - RNA, 17 nt, Homo sapiens
acuuuuugaggaggcau

SEQ ID NO: 129813 - RNA, 20 nt, Homo sapiens
acuuuuugaugaggucguuu

SEQ ID NO: 129814 - RNA, 22 nt, Homo sapiens
agaaacacagguggaauugcuu

SEQ ID NO: 129815 - RNA, 22 nt, Homo sapiens
agaaaugcagcaugaggcggca

SEQ ID NO: 129816 - RNA, 22 nt, Homo sapiens
agaacacugaguucagggucag

SEQ ID NO: 129817 - RNA, 22 nt, Homo sapiens
agaagugcuggguucaggcugg

SEQ ID NO: 129818 - RNA, 22 nt, Homo sapiens
agaauaauguccccccaaggga

SEQ ID NO: 129819 - RNA, 22 nt, Homo sapiens
agaauacugucuauucauggua

SEQ ID NO: 129820 - RNA, 22 nt, Homo sapiens
agaauguaaacagaauagagga

SEQ ID NO: 129821 - RNA, 22 nt, Homo sapiens
agaauguaacucuaugaaggca

SEQ ID NO: 129822 - RNA, 22 nt, Homo sapiens
agaaugugaacaucuugaaagu

SEQ ID NO: 129823 - RNA, 22 nt, Homo sapiens
agacacuguugaaaaggcccca

SEQ ID NO: 129824 - RNA, 22 nt, Homo sapiens
agacagcugguagcacuuccug

SEQ ID NO: 129825 - RNA, 22 nt, Homo sapiens
agacuagacagaugaacagcac

SEQ ID NO: 129826 - RNA, 22 nt, Homo sapiens
agacuuagagagucuauucuau

SEQ ID NO: 129827 - RNA, 22 nt, Homo sapiens
agagaacugauuggaguugggc

SEQ ID NO: 129828 - RNA, 22 nt, Homo sapiens
agagaccuguaaaguucaggca

SEQ ID NO: 129829 - RNA, 19 nt, Homo sapiens
agagacucauuguagcauu

SEQ ID NO: 129830 - RNA, 22 nt, Homo sapiens
agagauacauucugagaagugc

SEQ ID NO: 129831 - RNA, 22 nt, Homo sapiens
agagaucaauaugaaggaaaug

SEQ ID NO: 129832 - RNA, 22 nt, Homo sapiens
agagaucauuuuguuucaaauc

SEQ ID NO: 129833 - RNA, 20 nt, Homo sapiens
agagcaaagccgcaccccua

SEQ ID NO: 129834 - RNA, 22 nt, Homo sapiens
agagccacacucuccuaacuca

SEQ ID NO: 129835 - RNA, 22 nt, Homo sapiens
agagcuguguuuuaacuuuuua

SEQ ID NO: 129836 - RNA, 22 nt, Homo sapiens
agagguaagcaguggcaagugc

SEQ ID NO: 129837 - RNA, 22 nt, Homo sapiens
agaggucuuaucaaacaugcuu

SEQ ID NO: 129838 - RNA, 23 nt, Homo sapiens
agagguuuaaucaggcaguugcu

SEQ ID NO: 129839 - RNA, 22 nt, Homo sapiens
agagguuuaauugauucacagu

SEQ ID NO: 129840 - RNA, 22 nt, Homo sapiens
agaguauacaugugagugagau

SEQ ID NO: 129841 - RNA, 22 nt, Homo sapiens
agaguauagcaacuuaguaaaa

SEQ ID NO: 129842 - RNA, 22 nt, Homo sapiens
agagucacaugaggcccuucau

SEQ ID NO: 129843 - RNA, 22 nt, Homo sapiens
agagugcaauggcaccaucucg

SEQ ID NO: 129844 - RNA, 22 nt, Homo sapiens
agagugcuauagauuagauuuc

SEQ ID NO: 129845 - RNA, 22 nt, Homo sapiens
agauauguuuaguuucaaaaug

SEQ ID NO: 129846 - RNA, 22 nt, Homo sapiens
agauauuuguuaggucugucag

SEQ ID NO: 129847 - RNA, 18 nt, Homo sapiens
agaugcaugcucacuaca

SEQ ID NO: 129848 - RNA, 22 nt, Homo sapiens
agaugcauugguggcauauuca

SEQ ID NO: 129849 - RNA, 22 nt, Homo sapiens
agaugccucauguucuagguuc

SEQ ID NO: 129850 - RNA, 22 nt, Homo sapiens
cuuuacacauccuaaccagugu

SEQ ID NO: 129851 - RNA, 22 nt, Homo sapiens
cuuuacaguuggacucacgagg

SEQ ID NO: 129852 - RNA, 22 nt, Homo sapiens
cuuuaguuaaaauugggguugu

SEQ ID NO: 129853 - RNA, 22 nt, Homo sapiens
cuuucacacuguuggugggaau

SEQ ID NO: 129854 - RNA, 22 nt, Homo sapiens
cuuuccauuguuggagcauaaa

SEQ ID NO: 129855 - RNA, 22 nt, Homo sapiens
cuuugcaaaacauugagaccuc

SEQ ID NO: 129856 - RNA, 22 nt, Homo sapiens
cuuugcuaauccaacccucauc

SEQ ID NO: 129857 - RNA, 22 nt, Homo sapiens
cuuuggcaaugucauuuucaau

SEQ ID NO: 129858 - RNA, 22 nt, Homo sapiens
cuuuggcauuagccuguauaga

SEQ ID NO: 129859 - RNA, 22 nt, Homo sapiens
cuuuggucaaaauaaguaaguu

SEQ ID NO: 129860 - RNA, 22 nt, Homo sapiens
cuuuggucaauugcugugggga

SEQ ID NO: 129861 - RNA, 18 nt, Homo sapiens
cuuugguccccgcacccu

SEQ ID NO: 129862 - RNA, 23 nt, Homo sapiens
cuuuggucucugguugacuucag

SEQ ID NO: 129863 - RNA, 22 nt, Homo sapiens
cuuugguguauuuucagagacc

SEQ ID NO: 129864 - RNA, 22 nt, Homo sapiens
cuuugguucuguuuauaugcug

SEQ ID NO: 129865 - RNA, 22 nt, Homo sapiens
cuuugguugugcucuccacuuu

SEQ ID NO: 129866 - RNA, 23 nt, Homo sapiens
cuuuguacagcuugacuacuggg

SEQ ID NO: 129867 - RNA, 20 nt, Homo sapiens
cuuuguccuccugcugugcu

SEQ ID NO: 129868 - RNA, 22 nt, Homo sapiens
cuuugugcccuucugcccauca

SEQ ID NO: 129869 - RNA, 22 nt, Homo sapiens
cuuuguguggacauuucaggca

SEQ ID NO: 129870 - RNA, 22 nt, Homo sapiens
cuuuuacacuguuagugggaau

SEQ ID NO: 129871 - RNA, 22 nt, Homo sapiens
cuuuuggucuaucagagaagca

SEQ ID NO: 129872 - RNA, 22 nt, Homo sapiens
cuuuuggugguucugaugcagg

SEQ ID NO: 129873 - RNA, 22 nt, Homo sapiens
cuuuuugcugcagcaauacugg

SEQ ID NO: 129874 - RNA, 22 nt, Homo sapiens
gaaagacuuucugcuguggaua

SEQ ID NO: 129875 - RNA, 22 nt, Homo sapiens
gaaagauuuuaacugggagacu

SEQ ID NO: 129876 - RNA, 22 nt, Homo sapiens
gaaagguaggaacagggugcag

SEQ ID NO: 129877 - RNA, 22 nt, Homo sapiens
gaaaugcucauuuuggauccuu

SEQ ID NO: 129878 - RNA, 22 nt, Homo sapiens
gaaauguuuuucaugugggcaa

SEQ ID NO: 129879 - RNA, 22 nt, Homo sapiens
gaagaaguacaagacaaauuuu

SEQ ID NO: 129880 - RNA, 22 nt, Homo sapiens
gaagauucaaccaaaccagaac

SEQ ID NO: 129881 - RNA, 22 nt, Homo sapiens
gaagcgaggugauuagcagaca

SEQ ID NO: 129882 - RNA, 22 nt, Homo sapiens
gaagguacgcuuaggaaaugau

SEQ ID NO: 129883 - RNA, 22 nt, Homo sapiens
gaagguaguuuauagauguggu

SEQ ID NO: 129884 - RNA, 19 nt, Homo sapiens
gaaguguuguccuccagua

SEQ ID NO: 129885 - RNA, 17 nt, Homo sapiens
gaaguguuucuucauga

SEQ ID NO: 129886 - RNA, 22 nt, Homo sapiens
gaauagugcugcaauaaacaua

SEQ ID NO: 129887 - RNA, 22 nt, Homo sapiens
gaauagugcugcaaugaacaua

SEQ ID NO: 129888 - RNA, 22 nt, Homo sapiens
gaaugauacuguuaacgaaaga

SEQ ID NO: 129889 - RNA, 22 nt, Homo sapiens
gaaugcaugaggggaucagaug

SEQ ID NO: 129890 - RNA, 22 nt, Homo sapiens
gaaugugcuguuggcugggcgu

SEQ ID NO: 129891 - RNA, 22 nt, Homo sapiens
gacaaguuugauuuauuccaag

SEQ ID NO: 129892 - RNA, 22 nt, Homo sapiens
gacagugugauacuuagucuca

SEQ ID NO: 129893 - RNA, 22 nt, Homo sapiens
gacaguguggcgauuccucaag

SEQ ID NO: 129894 - RNA, 22 nt, Homo sapiens
aucaaagugaaauauuaguuau

SEQ ID NO: 129895 - RNA, 22 nt, Homo sapiens
aucaaagugaauuaaugagaau

SEQ ID NO: 129896 - RNA, 22 nt, Homo sapiens
aucaagcugcuuguuugaaucu

SEQ ID NO: 129897 - RNA, 22 nt, Homo sapiens
aucacacuguuauuuuaguuaa

SEQ ID NO: 129898 - RNA, 22 nt, Homo sapiens
aucacagagucacgggcaacuu

SEQ ID NO: 129899 - RNA, 22 nt, Homo sapiens
aucacagcuacuccucugucuu

SEQ ID NO: 129900 - RNA, 22 nt, Homo sapiens
aucacauggccuagccuaaccu

SEQ ID NO: 129901 - RNA, 22 nt, Homo sapiens
aucacauuuauaguggcacgca

SEQ ID NO: 129902 - RNA, 22 nt, Homo sapiens
aucacuggccuuuuuaaaugcu

SEQ ID NO: 129903 - RNA, 22 nt, Homo sapiens
aucacugggcaagauaucauga

SEQ ID NO: 129904 - RNA, 22 nt, Homo sapiens
aucagaaucucuagaggacugu

SEQ ID NO: 129905 - RNA, 22 nt, Homo sapiens
aucagagccugugugcccugaa

SEQ ID NO: 129906 - RNA, 22 nt, Homo sapiens
aucagauggcuaaaacagaaga

SEQ ID NO: 129907 - RNA, 22 nt, Homo sapiens
aucagauuccagaggcagcacc

SEQ ID NO: 129908 - RNA, 22 nt, Homo sapiens
aucagcagcaugaaaagcaacu

SEQ ID NO: 129909 - RNA, 22 nt, Homo sapiens
aucagcaugcagaagucggggg

SEQ ID NO: 129910 - RNA, 22 nt, Homo sapiens
aucagcauucccaaaugaugug

SEQ ID NO: 129911 - RNA, 22 nt, Homo sapiens
aucaggaaccuuuuuggugugu

SEQ ID NO: 129912 - RNA, 22 nt, Homo sapiens
aucagugauugauuuaaagacg

SEQ ID NO: 129913 - RNA, 22 nt, Homo sapiens
aucagugcauaguauuuaauga

SEQ ID NO: 129914 - RNA, 22 nt, Homo sapiens
aucauagcucacugcagccucg

SEQ ID NO: 129915 - RNA, 22 nt, Homo sapiens
aucaucacaguuguguguaaug

SEQ ID NO: 129916 - RNA, 22 nt, Homo sapiens
aucauccugucaggagcuguga

SEQ ID NO: 129917 - RNA, 22 nt, Homo sapiens
aucaugucuucccagugauucu

SEQ ID NO: 129918 - RNA, 22 nt, Homo sapiens
aucauguuuauguguaggauau

SEQ ID NO: 129919 - RNA, 18 nt, Homo sapiens
aucauugcacugucuugc

SEQ ID NO: 129920 - RNA, 22 nt, Homo sapiens
auccaagagacugaugacuucc

SEQ ID NO: 129921 - RNA, 22 nt, Homo sapiens
auccacaugcaguuggaaacag

SEQ ID NO: 129922 - RNA, 22 nt, Homo sapiens
auccaguuuuaggagauuucua

SEQ ID NO: 129923 - RNA, 22 nt, Homo sapiens
auccauguggauaaauguguau

SEQ ID NO: 129924 - RNA, 22 nt, Homo sapiens
aucccagaaacucggguuucuc

SEQ ID NO: 129925 - RNA, 22 nt, Homo sapiens
aucccaguaaaaauggcuucua

SEQ ID NO: 129926 - RNA, 22 nt, Homo sapiens
aucccuguaacuagcagccccu

SEQ ID NO: 129927 - RNA, 22 nt, Homo sapiens
aucccugugauccaaucacuuc

SEQ ID NO: 129928 - RNA, 22 nt, Homo sapiens
auccucugagagaguuucauaa

SEQ ID NO: 129929 - RNA, 22 nt, Homo sapiens
auccugaugacacagugcugca

SEQ ID NO: 129930 - RNA, 22 nt, Homo sapiens
auccuuuagacuguccaguuga

SEQ ID NO: 129931 - RNA, 21 nt, Homo sapiens
aucgcacaauauaccccugua

SEQ ID NO: 129932 - RNA, 22 nt, Homo sapiens
aucgcacuccauccugggcaac

SEQ ID NO: 129933 - RNA, 16 nt, Homo sapiens
aucucagaccugcuga

SEQ ID NO: 129934 - RNA, 22 nt, Homo sapiens
aucucaguuaaugacccuaugc

SEQ ID NO: 129935 - RNA, 22 nt, Homo sapiens
aucucauggagguagagaguaa

SEQ ID NO: 129936 - RNA, 22 nt, Homo sapiens
aucucuugccagucagaauggu

SEQ ID NO: 129937 - RNA, 22 nt, Homo sapiens
aucuggcuccuuuugacaaugc

SEQ ID NO: 129938 - RNA, 22 nt, Homo sapiens
aucugguguauuggugcugggu

SEQ ID NO: 129939 - RNA, 22 nt, Homo sapiens
aucuucucuugaagggugggga

SEQ ID NO: 129940 - RNA, 22 nt, Homo sapiens
aucuugcauuugcuaaaaugca

SEQ ID NO: 129941 - RNA, 22 nt, Homo sapiens
aucuuggauuaccugggugggu

SEQ ID NO: 129942 - RNA, 22 nt, Homo sapiens
aucuuuaguggcuguuuucaga

SEQ ID NO: 129943 - RNA, 22 nt, Homo sapiens
aucuuuggcgggaauaucacag

SEQ ID NO: 129944 - RNA, 22 nt, Homo sapiens
aucuuuggugcaugauacuuug

SEQ ID NO: 129945 - RNA, 22 nt, Homo sapiens
augaaaagcauaaacgcugaag

SEQ ID NO: 129946 - RNA, 23 nt, Homo sapiens
augaaagcccuugcaaaugcugg

SEQ ID NO: 129947 - RNA, 22 nt, Homo sapiens
augaaaguguguggaaacuuga

SEQ ID NO: 129948 - RNA, 22 nt, Homo sapiens
augaaaucuuuggcagaucuua

SEQ ID NO: 129949 - RNA, 22 nt, Homo sapiens
augaaaugcauguuaaguccgu

SEQ ID NO: 129950 - RNA, 18 nt, Homo sapiens
augaacucaucauuuuuu

SEQ ID NO: 129951 - RNA, 22 nt, Homo sapiens
augaagacaucgucugggauua

SEQ ID NO: 129952 - RNA, 22 nt, Homo sapiens
augaagugcaugauaguugguu

SEQ ID NO: 129953 - RNA, 22 nt, Homo sapiens
augaaguguguguucaagucuu

SEQ ID NO: 129954 - RNA, 23 nt, Homo sapiens
augaauguaaggaguguaagaaa

SEQ ID NO: 129955 - RNA, 23 nt, Homo sapiens
augacacuccugugcgcacccug

SEQ ID NO: 129956 - RNA, 22 nt, Homo sapiens
augacauugaaaagcaagugga

SEQ ID NO: 129957 - RNA, 22 nt, Homo sapiens
augaccauuucaauugauaugg

SEQ ID NO: 129958 - RNA, 22 nt, Homo sapiens
augaccuuggggaaccaugucu

SEQ ID NO: 129959 - RNA, 22 nt, Homo sapiens
augacugaguagcauuccauua

SEQ ID NO: 129960 - RNA, 22 nt, Homo sapiens
augagaauguaaguuaaugaaa

SEQ ID NO: 129961 - RNA, 22 nt, Homo sapiens
uguuaugaagaugccugguaca

SEQ ID NO: 129962 - RNA, 22 nt, Homo sapiens
uguuauguuguuugagaaaguc

SEQ ID NO: 129963 - RNA, 22 nt, Homo sapiens
uguucuugagccuuuagaccua

SEQ ID NO: 129964 - RNA, 19 nt, Homo sapiens
uguugcacauaucaauaug

SEQ ID NO: 129965 - RNA, 22 nt, Homo sapiens
uguugcacuccagccuggguga

SEQ ID NO: 129966 - RNA, 19 nt, Homo sapiens
uguugcacuccagcuuggg

SEQ ID NO: 129967 - RNA, 22 nt, Homo sapiens
uguugcacuccauccugggcga

SEQ ID NO: 129968 - RNA, 22 nt, Homo sapiens
uguuggacuuacuuggcagauu

SEQ ID NO: 129969 - RNA, 22 nt, Homo sapiens
uguuuaguuaagacauagaauu

SEQ ID NO: 129970 - RNA, 21 nt, Homo sapiens
uguuuuugcuguguaucucuc

SEQ ID NO: 129971 - RNA, 22 nt, Homo sapiens
uuaaagcuggcguuacaguuug

SEQ ID NO: 129972 - RNA, 22 nt, Homo sapiens
uuaaaggcauguacacuagagu

SEQ ID NO: 129973 - RNA, 20 nt, Homo sapiens
uuaaaucuagugcagacuca

SEQ ID NO: 129974 - RNA, 22 nt, Homo sapiens
uuaaaugcacauacuugagaaa

SEQ ID NO: 129975 - RNA, 22 nt, Homo sapiens
uuaaaugcucacauaaagguag

SEQ ID NO: 129976 - RNA, 21 nt, Homo sapiens
uuaacagacaagugucuuccc

SEQ ID NO: 129977 - RNA, 22 nt, Homo sapiens
uuaagaagugauuuuccucauu

SEQ ID NO: 129978 - RNA, 22 nt, Homo sapiens
uuaagacaccaaucauuggauu

SEQ ID NO: 129979 - RNA, 23 nt, Homo sapiens
uuaagcaacggcugcuuuucaga

SEQ ID NO: 129980 - RNA, 22 nt, Homo sapiens
uuaaggcuccuguuggcuuuua

SEQ ID NO: 129981 - RNA, 22 nt, Homo sapiens
uuaaggugaaguucucagaugc

SEQ ID NO: 129982 - RNA, 22 nt, Homo sapiens
uuaaguaaucagagaagagaac

SEQ ID NO: 129983 - RNA, 21 nt, Homo sapiens
uuaaguaauuacccaacucuc

SEQ ID NO: 129984 - RNA, 22 nt, Homo sapiens
uuaagugguagguggugcccaa

SEQ ID NO: 129985 - RNA, 22 nt, Homo sapiens
uuaaucaggccguuuccuaaga

SEQ ID NO: 129986 - RNA, 22 nt, Homo sapiens
uuaaugaacuuuauuuuguaga

SEQ ID NO: 129987 - RNA, 22 nt, Homo sapiens
uuaauguaauugauugauugac

SEQ ID NO: 129988 - RNA, 22 nt, Homo sapiens
uuaauguaucuaucacaucaca

SEQ ID NO: 129989 - RNA, 22 nt, Homo sapiens
auugaacacuucugugugccag

SEQ ID NO: 129990 - RNA, 23 nt, Homo sapiens
auugaacacuuucauaugugagg

SEQ ID NO: 129991 - RNA, 22 nt, Homo sapiens
auugaacuguuggagagguuuu

SEQ ID NO: 129992 - RNA, 22 nt, Homo sapiens
auugaauuugguuugcuaagaa

SEQ ID NO: 129993 - RNA, 22 nt, Homo sapiens
auugacaguuggccaguaagug

SEQ ID NO: 129994 - RNA, 22 nt, Homo sapiens
auugagacaaauuuguaugcag

SEQ ID NO: 129995 - RNA, 22 nt, Homo sapiens
auugagucauuucaaauccaag

SEQ ID NO: 129996 - RNA, 22 nt, Homo sapiens
auugcaacaguguugagaggug

SEQ ID NO: 129997 - RNA, 22 nt, Homo sapiens
auugcaaugggaaacuaugaaa

SEQ ID NO: 129998 - RNA, 22 nt, Homo sapiens
auugcacacagaaucaggguaa

SEQ ID NO: 129999 - RNA, 18 nt, Homo sapiens
auugcacaccagccuggg

SEQ ID NO: 130000 - RNA, 22 nt, Homo sapiens
auugcacuccagccugggcaac

SEQ ID NO: 130001 - RNA, 22 nt, Homo sapiens
auugcacuccagccuggugaca

SEQ ID NO: 130002 - RNA, 22 nt, Homo sapiens
auugcacuccagucucaccagg

SEQ ID NO: 130003 - RNA, 18 nt, Homo sapiens
auugcacuccugccuggg

SEQ ID NO: 130004 - RNA, 22 nt, Homo sapiens
auugcacucugaucugcacucc

SEQ ID NO: 130005 - RNA, 22 nt, Homo sapiens
auugcauaaacacauuucuuau

SEQ ID NO: 130006 - RNA, 22 nt, Homo sapiens
auugccuaacauagauguucag

SEQ ID NO: 130007 - RNA, 22 nt, Homo sapiens
auugccuagccuggucucaaaa

SEQ ID NO: 130008 - RNA, 22 nt, Homo sapiens
auugcuaacugaaauaagacca

SEQ ID NO: 130009 - RNA, 22 nt, Homo sapiens
auugcucaaaucaguacuugag

SEQ ID NO: 130010 - RNA, 22 nt, Homo sapiens
auugcuuaagucccuguauuag

SEQ ID NO: 130011 - RNA, 22 nt, Homo sapiens
auuggaacugaaauaauaacuu

SEQ ID NO: 130012 - RNA, 22 nt, Homo sapiens
auuggcaagauagcauaugagg

SEQ ID NO: 130013 - RNA, 22 nt, Homo sapiens
auuggcagaaaucuuuauagua

SEQ ID NO: 130014 - RNA, 22 nt, Homo sapiens
auuggucuugaaaccagagaga

SEQ ID NO: 130015 - RNA, 22 nt, Homo sapiens
auugucauuuucugagaaguaa

SEQ ID NO: 130016 - RNA, 22 nt, Homo sapiens
auugugauggucaaaggaaaua

SEQ ID NO: 130017 - RNA, 19 nt, Homo sapiens
auuuccuggagcuggucuc

SEQ ID NO: 130018 - RNA, 22 nt, Homo sapiens
auuuccuguaggggcuugcgaa

SEQ ID NO: 130019 - RNA, 22 nt, Homo sapiens
auuugguuauucaguuguucag

SEQ ID NO: 130020 - RNA, 22 nt, Homo sapiens
auuugucaauacacuucuucca

SEQ ID NO: 130021 - RNA, 22 nt, Homo sapiens
auuuguccugccuuuuccuccu

SEQ ID NO: 130022 - RNA, 22 nt, Homo sapiens
auuuuuggauauagggaaggau

SEQ ID NO: 130023 - RNA, 22 nt, Homo sapiens
caaaagugauugcgguuuuugc

SEQ ID NO: 130024 - RNA, 22 nt, Homo sapiens
caaaguaauugugguuuugcca

SEQ ID NO: 130025 - RNA, 22 nt, Homo sapiens
caaagucuucucauuaugucuu

SEQ ID NO: 130026 - RNA, 22 nt, Homo sapiens
caaagugcuggaauuggccggg

SEQ ID NO: 130027 - RNA, 22 nt, Homo sapiens
caaagugcuggccgggcgcagu

SEQ ID NO: 130028 - RNA, 22 nt, Homo sapiens
caaauacuuucauguugucuug

SEQ ID NO: 130029 - RNA, 22 nt, Homo sapiens
caaaugaucugcuggccucagc

SEQ ID NO: 130030 - RNA, 22 nt, Homo sapiens
caagaggcuguguauaaagcca

SEQ ID NO: 130031 - RNA, 22 nt, Homo sapiens
caaggaauucucaauagaguua

SEQ ID NO: 130032 - RNA, 22 nt, Homo sapiens
caaggcacagccccuacuuccu

SEQ ID NO: 130033 - RNA, 22 nt, Homo sapiens
caagguacuuuuacaauuuccc

SEQ ID NO: 130034 - RNA, 21 nt, Homo sapiens
caagugaugcuucugcuuuaa

SEQ ID NO: 130035 - RNA, 22 nt, Homo sapiens
caagugcuacagagaaaucuuu

SEQ ID NO: 130036 - RNA, 22 nt, Homo sapiens
caagugcucuaggauccugagu

SEQ ID NO: 130037 - RNA, 22 nt, Homo sapiens
caagugcuuucuuggggauuua

SEQ ID NO: 130038 - RNA, 19 nt, Homo sapiens
caauacuucuuggcauaca

SEQ ID NO: 130039 - RNA, 21 nt, Homo sapiens
caaugacacuguagcugugcu

SEQ ID NO: 130040 - RNA, 22 nt, Homo sapiens
caauggcacgaucucgucucac

SEQ ID NO: 130041 - RNA, 22 nt, Homo sapiens
caauggcacuauuggaaaaggu

SEQ ID NO: 130042 - RNA, 22 nt, Homo sapiens
caauugcacucuuagguguaca

SEQ ID NO: 130043 - RNA, 22 nt, Homo sapiens
cacaaaguagauuagucuucca

SEQ ID NO: 130044 - RNA, 22 nt, Homo sapiens
cacaaugucuaagauguuucua

SEQ ID NO: 130045 - RNA, 22 nt, Homo sapiens
cacaccuaccucauuauggaca

SEQ ID NO: 130046 - RNA, 22 nt, Homo sapiens
cacacugucuucauuacuguag

SEQ ID NO: 130047 - RNA, 22 nt, Homo sapiens
cacagcacaggcaugaguguca

SEQ ID NO: 130048 - RNA, 22 nt, Homo sapiens
cacagcuagucaaugguagaca

SEQ ID NO: 130049 - RNA, 22 nt, Homo sapiens
cacaggaagaggcacggucccu

SEQ ID NO: 130050 - RNA, 22 nt, Homo sapiens
uguaauguuucaucauuauuaa

SEQ ID NO: 130051 - RNA, 22 nt, Homo sapiens
uguacaaaacaagaugggggua

SEQ ID NO: 130052 - RNA, 22 nt, Homo sapiens
uguacacauaugugggguacau

SEQ ID NO: 130053 - RNA, 19 nt, Homo sapiens
uguacacuguaaaccugug

SEQ ID NO: 130054 - RNA, 22 nt, Homo sapiens
uguagcaaauaaaagucuggau

SEQ ID NO: 130055 - RNA, 22 nt, Homo sapiens
uguagggagagggaguugcacc

SEQ ID NO: 130056 - RNA, 22 nt, Homo sapiens
uguagguguacauacaugguua

SEQ ID NO: 130057 - RNA, 22 nt, Homo sapiens
uguagucauuuggaguccagcu

SEQ ID NO: 130058 - RNA, 22 nt, Homo sapiens
uguauacauauguauguuuugu

SEQ ID NO: 130059 - RNA, 22 nt, Homo sapiens
uguauacugucuaauauguugu

SEQ ID NO: 130060 - RNA, 22 nt, Homo sapiens
uguauaggcaaauuuccucaug

SEQ ID NO: 130061 - RNA, 22 nt, Homo sapiens
uguaugagagugaaagcauuuc

SEQ ID NO: 130062 - RNA, 22 nt, Homo sapiens
uguaugcuuuugagagauauuu

SEQ ID NO: 130063 - RNA, 16 nt, Homo sapiens
uguauugcuaaaaaga

SEQ ID NO: 130064 - RNA, 22 nt, Homo sapiens
ugucaaagagacaucugcacuc

SEQ ID NO: 130065 - RNA, 22 nt, Homo sapiens
ugucaacauuuaucaaguuauu

SEQ ID NO: 130066 - RNA, 22 nt, Homo sapiens
ugucaagaaaucaaggugugag

SEQ ID NO: 130067 - RNA, 22 nt, Homo sapiens
ugucaagaugguuugauguugu

SEQ ID NO: 130068 - RNA, 22 nt, Homo sapiens
ugucacaguuuguacuuuauag

SEQ ID NO: 130069 - RNA, 22 nt, Homo sapiens
ugucaccuugcucauccucgga

SEQ ID NO: 130070 - RNA, 22 nt, Homo sapiens
ugucacugugaguuugacugcu

SEQ ID NO: 130071 - RNA, 22 nt, Homo sapiens
ugucacugugcagucaugcauu

SEQ ID NO: 130072 - RNA, 22 nt, Homo sapiens
ugucagaaucuagaggcugcua

SEQ ID NO: 130073 - RNA, 22 nt, Homo sapiens
ugucagcacaacucagguuccu

SEQ ID NO: 130074 - RNA, 22 nt, Homo sapiens
ugucaggagcaaugauaaauuu

SEQ ID NO: 130075 - RNA, 22 nt, Homo sapiens
ugucagggaggcucggccgcac

SEQ ID NO: 130076 - RNA, 22 nt, Homo sapiens
ugucaguggacugugaaaggca

SEQ ID NO: 130077 - RNA, 22 nt, Homo sapiens
ugucaguuucuugagauggaac

SEQ ID NO: 130078 - RNA, 23 nt, Homo sapiens
ugucaucaagaugaggucacacu

SEQ ID NO: 130079 - RNA, 22 nt, Homo sapiens
ugucaucauuccaucagggcuu

SEQ ID NO: 130080 - RNA, 22 nt, Homo sapiens
ugucaugaacucacauucuggg

SEQ ID NO: 130081 - RNA, 22 nt, Homo sapiens
ugucauguaaagaguaaauggu

SEQ ID NO: 130082 - RNA, 22 nt, Homo sapiens
ugucaugucaacuauggaauuu

SEQ ID NO: 130083 - RNA, 22 nt, Homo sapiens
ugucaugugagggaacuuguuc

SEQ ID NO: 130084 - RNA, 22 nt, Homo sapiens
ugucauguuucuacugaccaaa

SEQ ID NO: 130085 - RNA, 22 nt, Homo sapiens
ugucauuguggugcagauauaa

SEQ ID NO: 130086 - RNA, 20 nt, Homo sapiens
ugucccaaccccauggguuc

SEQ ID NO: 130087 - RNA, 22 nt, Homo sapiens
ugucccugagccuggauuccug

SEQ ID NO: 130088 - RNA, 22 nt, Homo sapiens
uguccuagagggaugucacccc

SEQ ID NO: 130089 - RNA, 22 nt, Homo sapiens
ugucuacugaugauguaguuaa

SEQ ID NO: 130090 - RNA, 22 nt, Homo sapiens
ugucucaguuucuguggguuag

SEQ ID NO: 130091 - RNA, 21 nt, Homo sapiens
ugucugagagaggagaucuac

SEQ ID NO: 130092 - RNA, 22 nt, Homo sapiens
ugucuuguagacugaaggcuuc

SEQ ID NO: 130093 - RNA, 22 nt, Homo sapiens
ugucuuuguuaguuguccuagu

SEQ ID NO: 130094 - RNA, 22 nt, Homo sapiens
ugugaacagaauuagucaccua

SEQ ID NO: 130095 - RNA, 19 nt, Homo sapiens
ugugaacaucacagagugu

SEQ ID NO: 130096 - RNA, 21 nt, Homo sapiens
ugugaacauguuggguggcau

SEQ ID NO: 130097 - RNA, 22 nt, Homo sapiens
ugugaacauuuuguauauauua

SEQ ID NO: 130098 - RNA, 22 nt, Homo sapiens
ugugaagaaagucauugguagc

SEQ ID NO: 130099 - RNA, 23 nt, Homo sapiens
ugugacacuuccgucaguucauu

SEQ ID NO: 130100 - RNA, 22 nt, Homo sapiens
ugugacagcacagcaucucuuu

SEQ ID NO: 130101 - RNA, 22 nt, Homo sapiens
ugugacagguauccuguguucu

SEQ ID NO: 130102 - RNA, 22 nt, Homo sapiens
ugugacaguuaguuugguguua

SEQ ID NO: 130103 - RNA, 19 nt, Homo sapiens
ugugacugggccagccuag

SEQ ID NO: 130104 - RNA, 22 nt, Homo sapiens
ugugagcuauggaguuguagag

SEQ ID NO: 130105 - RNA, 22 nt, Homo sapiens
ugugauagagaaugguggagaa

SEQ ID NO: 130106 - RNA, 22 nt, Homo sapiens
ugugaucauugcuguuaaagug

SEQ ID NO: 130107 - RNA, 22 nt, Homo sapiens
ugugaugaagaguccaagaaca

SEQ ID NO: 130108 - RNA, 22 nt, Homo sapiens
ugugaugauuugauaaacguau

SEQ ID NO: 130109 - RNA, 22 nt, Homo sapiens
ugugauggaguuucauggacug

SEQ ID NO: 130110 - RNA, 20 nt, Homo sapiens
ugugauuauuuaguugcaug

SEQ ID NO: 130111 - RNA, 17 nt, Homo sapiens
ugugauugaagucaucc

SEQ ID NO: 130112 - RNA, 22 nt, Homo sapiens
ugugcaaauuagcacaacccga

SEQ ID NO: 130113 - RNA, 22 nt, Homo sapiens
ugugcaaggcucucaaccugug

SEQ ID NO: 130114 - RNA, 18 nt, Homo sapiens
ugugcaauauuaaccacc

SEQ ID NO: 130115 - RNA, 22 nt, Homo sapiens
ugugcaaucagcuucauuacau

SEQ ID NO: 130116 - RNA, 22 nt, Homo sapiens
ugugcacaacgugcagguuugu

SEQ ID NO: 130117 - RNA, 22 nt, Homo sapiens
ugugcaguuuuagcguauuuua

SEQ ID NO: 130118 - RNA, 22 nt, Homo sapiens
ugugcaguuuugagugaauuuc

SEQ ID NO: 130119 - RNA, 22 nt, Homo sapiens
ugugcauagugugugcggggcg

SEQ ID NO: 130120 - RNA, 22 nt, Homo sapiens
ugugcaugacagcauacaaacg

SEQ ID NO: 130121 - RNA, 22 nt, Homo sapiens
ugugccuaguaauguguccaga

SEQ ID NO: 130122 - RNA, 22 nt, Homo sapiens
ugugcguguaagagaucuaggu

SEQ ID NO: 130123 - RNA, 22 nt, Homo sapiens
ugugcuaaaaugggacuucuaa

SEQ ID NO: 130124 - RNA, 22 nt, Homo sapiens
ugugcuugaauuuaguagcuua

SEQ ID NO: 130125 - RNA, 22 nt, Homo sapiens
uguggcacuguguccagagaaa

SEQ ID NO: 130126 - RNA, 22 nt, Homo sapiens
uguggcagugcuuuaugaaacc

SEQ ID NO: 130127 - RNA, 22 nt, Homo sapiens
uguggcauuuucagaaaggaug

SEQ ID NO: 130128 - RNA, 22 nt, Homo sapiens
uguggccuuuguuucaguuggg

SEQ ID NO: 130129 - RNA, 17 nt, Homo sapiens
uguggcucuuaugcuga

SEQ ID NO: 130130 - RNA, 22 nt, Homo sapiens
uguggcuuuguaaccauggguc

SEQ ID NO: 130131 - RNA, 22 nt, Homo sapiens
ugugggaggugcuaauguaaau

SEQ ID NO: 130132 - RNA, 22 nt, Homo sapiens
uguguacaucucuacacacaug

SEQ ID NO: 130133 - RNA, 22 nt, Homo sapiens
ugugucacugcacuccagcgug

SEQ ID NO: 130134 - RNA, 22 nt, Homo sapiens
ugugucuacugagaugaucaug

SEQ ID NO: 130135 - RNA, 22 nt, Homo sapiens
ugugucuccugaaaauucacau

SEQ ID NO: 130136 - RNA, 22 nt, Homo sapiens
ugugucuuguuuuuucccaggc

SEQ ID NO: 130137 - RNA, 22 nt, Homo sapiens
uguuaaggcagagauaauacau

SEQ ID NO: 130138 - RNA, 22 nt, Homo sapiens
uguuacagcagaauugauugca

SEQ ID NO: 130139 - RNA, 22 nt, Homo sapiens
uguuacagugacuaauguuuua

SEQ ID NO: 130140 - RNA, 22 nt, Homo sapiens
augagacaguucccuuuaucuu

SEQ ID NO: 130141 - RNA, 22 nt, Homo sapiens
augagagcugacuuuaaggcaa

SEQ ID NO: 130142 - RNA, 22 nt, Homo sapiens
augagauacuacaaaugaguuu

SEQ ID NO: 130143 - RNA, 22 nt, Homo sapiens
augagauauguuaaaaguuaaa

SEQ ID NO: 130144 - RNA, 22 nt, Homo sapiens
augagaugauaggcguucuaac

SEQ ID NO: 130145 - RNA, 22 nt, Homo sapiens
augagauuguuuguacuccaca

SEQ ID NO: 130146 - RNA, 22 nt, Homo sapiens
augagcucauaaagagugauuu

SEQ ID NO: 130147 - RNA, 22 nt, Homo sapiens
augaggaagucaggcccagggg

SEQ ID NO: 130148 - RNA, 22 nt, Homo sapiens
augagggagggguggugccgca

SEQ ID NO: 130149 - RNA, 22 nt, Homo sapiens
augagguaguagaaagucaggu

SEQ ID NO: 130150 - RNA, 22 nt, Homo sapiens
augaggugaggucaguaaggua

SEQ ID NO: 130151 - RNA, 22 nt, Homo sapiens
augaggugaguaaauaaaugaa

SEQ ID NO: 130152 - RNA, 22 nt, Homo sapiens
augaggugggagaaucacuuga

SEQ ID NO: 130153 - RNA, 18 nt, Homo sapiens
augagucauuguggaaau

SEQ ID NO: 130154 - RNA, 19 nt, Homo sapiens
augagucugcaagaaccag

SEQ ID NO: 130155 - RNA, 22 nt, Homo sapiens
augaucuagaguaggaaacaga

SEQ ID NO: 130156 - RNA, 22 nt, Homo sapiens
augaucuguuuggugaucuugu

SEQ ID NO: 130157 - RNA, 22 nt, Homo sapiens
augaugaaguaagugcuuagga

SEQ ID NO: 130158 - RNA, 22 nt, Homo sapiens
augauguccacagggguguuca

SEQ ID NO: 130159 - RNA, 22 nt, Homo sapiens
augauugugaauaugugguuuu

SEQ ID NO: 130160 - RNA, 22 nt, Homo sapiens
augcaauggaaaggacaauuac

SEQ ID NO: 130161 - RNA, 22 nt, Homo sapiens
augcaauucuagauugauagua

SEQ ID NO: 130162 - RNA, 22 nt, Homo sapiens
augcacaguccagcccaugugg

SEQ ID NO: 130163 - RNA, 19 nt, Homo sapiens
augcacgugaaaugcauuu

SEQ ID NO: 130164 - RNA, 22 nt, Homo sapiens
augcagagaaaucuaaaauaug

SEQ ID NO: 130165 - RNA, 22 nt, Homo sapiens
augcauggucugaagucaaccu

SEQ ID NO: 130166 - RNA, 22 nt, Homo sapiens
augccacugcauaagguuuuca

SEQ ID NO: 130167 - RNA, 22 nt, Homo sapiens
augccauugcacuccagccuag

SEQ ID NO: 130168 - RNA, 22 nt, Homo sapiens
augccucugacaauuggauucu

SEQ ID NO: 130169 - RNA, 22 nt, Homo sapiens
augcuauguagaugagggccca

SEQ ID NO: 130170 - RNA, 22 nt, Homo sapiens
augcuguuuugaauucucuaga

SEQ ID NO: 130171 - RNA, 22 nt, Homo sapiens
augcuuguugcagccugagccu

SEQ ID NO: 130172 - RNA, 22 nt, Homo sapiens
auggaacauaacuauuugggga

SEQ ID NO: 130173 - RNA, 22 nt, Homo sapiens
auggaacugaagugcugcccuu

SEQ ID NO: 130174 - RNA, 22 nt, Homo sapiens
auggaagcugauuagauaguac

SEQ ID NO: 130175 - RNA, 22 nt, Homo sapiens
auggaaggagaggaaugaauga

SEQ ID NO: 130176 - RNA, 22 nt, Homo sapiens
auggaauguaaguuauguuugc

SEQ ID NO: 130177 - RNA, 22 nt, Homo sapiens
auggacauuaaagcgauguaga

SEQ ID NO: 130178 - RNA, 21 nt, Homo sapiens
auggacugugugacccugcac

SEQ ID NO: 130179 - RNA, 22 nt, Homo sapiens
auggagaugaacuuggguaaag

SEQ ID NO: 130180 - RNA, 22 nt, Homo sapiens
auggagaugugcgaacugagua

SEQ ID NO: 130181 - RNA, 22 nt, Homo sapiens
auggagcuugacaguuguagag

SEQ ID NO: 130182 - RNA, 22 nt, Homo sapiens
auggagugagaauggagguucc

SEQ ID NO: 130183 - RNA, 22 nt, Homo sapiens
auggaguguaauauugagagcu

SEQ ID NO: 130184 - RNA, 19 nt, Homo sapiens
auggauacauuuucugcua

SEQ ID NO: 130185 - RNA, 22 nt, Homo sapiens
auggaucuuucugcuuuugaau

SEQ ID NO: 130186 - RNA, 22 nt, Homo sapiens
auggauguucuagggaugugau

SEQ ID NO: 130187 - RNA, 22 nt, Homo sapiens
auggauuuguaguacaugguug

SEQ ID NO: 130188 - RNA, 22 nt, Homo sapiens
auggcaaaaaaugcaauuacuu

SEQ ID NO: 130189 - RNA, 22 nt, Homo sapiens
auggcaaaauguuccuaguggu

SEQ ID NO: 130190 - RNA, 22 nt, Homo sapiens
auggcaauaugaugcacuguuu

SEQ ID NO: 130191 - RNA, 22 nt, Homo sapiens
auggcacuacugggaaugucuu

SEQ ID NO: 130192 - RNA, 22 nt, Homo sapiens
auggcacuccagccugggcaac

SEQ ID NO: 130193 - RNA, 22 nt, Homo sapiens
auggcacugaagcguauugaca

SEQ ID NO: 130194 - RNA, 22 nt, Homo sapiens
auggcagagucagaaagucagg

SEQ ID NO: 130195 - RNA, 22 nt, Homo sapiens
auggcagugagucucuaguauu

SEQ ID NO: 130196 - RNA, 22 nt, Homo sapiens
auggccuuuuuaucucaccaag

SEQ ID NO: 130197 - RNA, 22 nt, Homo sapiens
auggcucuguuuuuuaugcucu

SEQ ID NO: 130198 - RNA, 22 nt, Homo sapiens
auggcugugaaaugguaggugg

SEQ ID NO: 130199 - RNA, 22 nt, Homo sapiens
auggcugugagaucgacuuauu

SEQ ID NO: 130200 - RNA, 22 nt, Homo sapiens
auggcuuuuuaaaucauguugu

SEQ ID NO: 130201 - RNA, 21 nt, Homo sapiens
augggguagaagagaaggcuu

SEQ ID NO: 130202 - RNA, 22 nt, Homo sapiens
augggguagguagcucggggaa

SEQ ID NO: 130203 - RNA, 22 nt, Homo sapiens
augggugaguaugaguugacuu

SEQ ID NO: 130204 - RNA, 22 nt, Homo sapiens
augguacuccagagaagcagaa

SEQ ID NO: 130205 - RNA, 22 nt, Homo sapiens
auggucuuuuuguuaugagaga

SEQ ID NO: 130206 - RNA, 22 nt, Homo sapiens
augguuuauuuguaagcagagu

SEQ ID NO: 130207 - RNA, 22 nt, Homo sapiens
auguaaacagaugugcagcuug

SEQ ID NO: 130208 - RNA, 21 nt, Homo sapiens
auguaaugaagaagccacugg

SEQ ID NO: 130209 - RNA, 20 nt, Homo sapiens
auguaauguaugauauguac

SEQ ID NO: 130210 - RNA, 22 nt, Homo sapiens
auguaauguuaaauugcuaauu

SEQ ID NO: 130211 - RNA, 22 nt, Homo sapiens
auguaauugagguuuuugccau

SEQ ID NO: 130212 - RNA, 22 nt, Homo sapiens
auguaguaugaagaagaugcuu

SEQ ID NO: 130213 - RNA, 22 nt, Homo sapiens
auguaguauuaaugagagauaa

SEQ ID NO: 130214 - RNA, 22 nt, Homo sapiens
auguagugugauuuucacuaga

SEQ ID NO: 130215 - RNA, 22 nt, Homo sapiens
augucacagguccuagccaagu

SEQ ID NO: 130216 - RNA, 20 nt, Homo sapiens
augucaggaagggagucagg

SEQ ID NO: 130217 - RNA, 22 nt, Homo sapiens
augucuagagugauacugaagc

SEQ ID NO: 130218 - RNA, 22 nt, Homo sapiens
augucugguagccaccuggagg

SEQ ID NO: 130219 - RNA, 22 nt, Homo sapiens
augucuguuugcugagcccggc

SEQ ID NO: 130220 - RNA, 17 nt, Homo sapiens
augugaauguucaaaua

SEQ ID NO: 130221 - RNA, 22 nt, Homo sapiens
augugacuugugaaaaguucag

SEQ ID NO: 130222 - RNA, 22 nt, Homo sapiens
augugcaaagcacuguucagca

SEQ ID NO: 130223 - RNA, 22 nt, Homo sapiens
augugcaacugcuggaacaguc

SEQ ID NO: 130224 - RNA, 22 nt, Homo sapiens
augugcaagaucauuaaagcuc

SEQ ID NO: 130225 - RNA, 22 nt, Homo sapiens
augugcaauguguacguagccc

SEQ ID NO: 130226 - RNA, 21 nt, Homo sapiens
augugcacuaugucauuuaau

SEQ ID NO: 130227 - RNA, 20 nt, Homo sapiens
augugcaguguggcaaccaa

SEQ ID NO: 130228 - RNA, 22 nt, Homo sapiens
augugcauaugaagcacagaca

SEQ ID NO: 130229 - RNA, 22 nt, Homo sapiens
augugcaugcuguucugccaga

SEQ ID NO: 130230 - RNA, 22 nt, Homo sapiens
cagggcauugucuucuuaguac

SEQ ID NO: 130231 - RNA, 22 nt, Homo sapiens
cagguacauuuuaaagggcuca

SEQ ID NO: 130232 - RNA, 21 nt, Homo sapiens
cagguagugucugaagccaga

SEQ ID NO: 130233 - RNA, 22 nt, Homo sapiens
cagguaguguguagcacagcag

SEQ ID NO: 130234 - RNA, 22 nt, Homo sapiens
cagguauagucacuugcccaag

SEQ ID NO: 130235 - RNA, 22 nt, Homo sapiens
caggucaucugaguuuaguucu

SEQ ID NO: 130236 - RNA, 22 nt, Homo sapiens
caguacaauguugauuagaagu

SEQ ID NO: 130237 - RNA, 22 nt, Homo sapiens
caguaguagccccuuagaugga

SEQ ID NO: 130238 - RNA, 19 nt, Homo sapiens
caguaucauugcacauagu

SEQ ID NO: 130239 - RNA, 22 nt, Homo sapiens
cagucacugggauuauggucau

SEQ ID NO: 130240 - RNA, 22 nt, Homo sapiens
cagugauaggugguuguuggca

SEQ ID NO: 130241 - RNA, 22 nt, Homo sapiens
cagugcaaagccucugcccaga

SEQ ID NO: 130242 - RNA, 22 nt, Homo sapiens
cagugcaaccuccaucucucgg

SEQ ID NO: 130243 - RNA, 23 nt, Homo sapiens
cagugcauuguggcauucagcau

SEQ ID NO: 130244 - RNA, 22 nt, Homo sapiens
caguuacuugacacaaccaauu

SEQ ID NO: 130245 - RNA, 22 nt, Homo sapiens
caguucaugguaggcaccauag

SEQ ID NO: 130246 - RNA, 22 nt, Homo sapiens
cauaaagauggaggaggccagg

SEQ ID NO: 130247 - RNA, 22 nt, Homo sapiens
cauaaaucuuguugaauagcac

SEQ ID NO: 130248 - RNA, 22 nt, Homo sapiens
cauacagcuaguaaguguaaga

SEQ ID NO: 130249 - RNA, 22 nt, Homo sapiens
cauagcacugagcucuacccuc

SEQ ID NO: 130250 - RNA, 22 nt, Homo sapiens
cauauaguaggugcucuguguu

SEQ ID NO: 130251 - RNA, 22 nt, Homo sapiens
cauauucacuuuacagagcugu

SEQ ID NO: 130252 - RNA, 21 nt, Homo sapiens
caucaaauugucauggugggu

SEQ ID NO: 130253 - RNA, 23 nt, Homo sapiens
caucacagagccuuccuugacuc

SEQ ID NO: 130254 - RNA, 22 nt, Homo sapiens
caucacagcaaguagggagugg

SEQ ID NO: 130255 - RNA, 21 nt, Homo sapiens
caucacauuacucaaaguccu

SEQ ID NO: 130256 - RNA, 22 nt, Homo sapiens
caucacauucugagauacugag

SEQ ID NO: 130257 - RNA, 22 nt, Homo sapiens
caucccauucgaggggcacagc

SEQ ID NO: 130258 - RNA, 22 nt, Homo sapiens
cauccccugcaccaaccuuuac

SEQ ID NO: 130259 - RNA, 22 nt, Homo sapiens
caugacacuggcauguuucuuu

SEQ ID NO: 130260 - RNA, 22 nt, Homo sapiens
caugaugcuagguauggaugaa

SEQ ID NO: 130261 - RNA, 22 nt, Homo sapiens
caugcauagccauucauucguu

SEQ ID NO: 130262 - RNA, 22 nt, Homo sapiens
cauggcacauauauaucuaggu

SEQ ID NO: 130263 - RNA, 22 nt, Homo sapiens
cauggcacugagcagguaugca

SEQ ID NO: 130264 - RNA, 22 nt, Homo sapiens
cauggcacuggugggagugucu

SEQ ID NO: 130265 - RNA, 22 nt, Homo sapiens
cauggcccugggcugggcgaac

SEQ ID NO: 130266 - RNA, 22 nt, Homo sapiens
cauggccuuuggaaugugucua

SEQ ID NO: 130267 - RNA, 22 nt, Homo sapiens
cauggcuuuaagcaacaccaag

SEQ ID NO: 130268 - RNA, 22 nt, Homo sapiens
cauggcuuuuauaacaagaaau

SEQ ID NO: 130269 - RNA, 22 nt, Homo sapiens
caugucacuuccucucugaugg

SEQ ID NO: 130270 - RNA, 22 nt, Homo sapiens
caugucuuuuaaacauucaacu

SEQ ID NO: 130271 - RNA, 22 nt, Homo sapiens
caugucuuuuauucugugugau

SEQ ID NO: 130272 - RNA, 22 nt, Homo sapiens
caugugcaugagcacauacgug

SEQ ID NO: 130273 - RNA, 22 nt, Homo sapiens
cauuacacuccagccuggguga

SEQ ID NO: 130274 - RNA, 22 nt, Homo sapiens
cauuaguugaagugcagggaga

SEQ ID NO: 130275 - RNA, 22 nt, Homo sapiens
cauuccacauguaggacaauuu

SEQ ID NO: 130276 - RNA, 22 nt, Homo sapiens
cauugcaacuucugccucccag

SEQ ID NO: 130277 - RNA, 22 nt, Homo sapiens
cauugcacuccaccuuggguaa

SEQ ID NO: 130278 - RNA, 22 nt, Homo sapiens
cauugcacuccagcccuggcaa

SEQ ID NO: 130279 - RNA, 22 nt, Homo sapiens
cauugcacuccagccuagccaa

SEQ ID NO: 130280 - RNA, 22 nt, Homo sapiens
cauugcacuccagccugaggga

SEQ ID NO: 130281 - RNA, 22 nt, Homo sapiens
cauugcacuccagccugaguga

SEQ ID NO: 130282 - RNA, 22 nt, Homo sapiens
cauugcacuccagccugcugac

SEQ ID NO: 130283 - RNA, 22 nt, Homo sapiens
cauugcacuccagccuuggcaa

SEQ ID NO: 130284 - RNA, 20 nt, Homo sapiens
cauugcacuccagcuugggc

SEQ ID NO: 130285 - RNA, 22 nt, Homo sapiens
cauugcacugcagcccgggcaa

SEQ ID NO: 130286 - RNA, 22 nt, Homo sapiens
cauugcaugccagccugggcaa

SEQ ID NO: 130287 - RNA, 22 nt, Homo sapiens
cauugcccuccagccugggcaa

SEQ ID NO: 130288 - RNA, 22 nt, Homo sapiens
cauugguuggacaguucucucu

SEQ ID NO: 130289 - RNA, 22 nt, Homo sapiens
cauugguuuauagauggggaaa

SEQ ID NO: 130290 - RNA, 22 nt, Homo sapiens
cauugguuuuucaggaguauau

SEQ ID NO: 130291 - RNA, 22 nt, Homo sapiens
cauuuuacuuuccagacgugga

SEQ ID NO: 130292 - RNA, 23 nt, Homo sapiens
ccacaaugguugaacuagauuac

SEQ ID NO: 130293 - RNA, 22 nt, Homo sapiens
ccaccuguacuuaagucacuuu

SEQ ID NO: 130294 - RNA, 22 nt, Homo sapiens
ccacugggcaguuuauuaucag

SEQ ID NO: 130295 - RNA, 22 nt, Homo sapiens
ccacuguuuaaauggcugagga

SEQ ID NO: 130296 - RNA, 22 nt, Homo sapiens
ccagauguuuucauucagcaag

SEQ ID NO: 130297 - RNA, 22 nt, Homo sapiens
ccagguuucuagaauaauuccu

SEQ ID NO: 130298 - RNA, 22 nt, Homo sapiens
ccaguuuucucacuguugcagu

SEQ ID NO: 130299 - RNA, 22 nt, Homo sapiens
ccaguuuuucauuuauacuagu

SEQ ID NO: 130300 - RNA, 22 nt, Homo sapiens
ccauggcuauucuguaaggguu

SEQ ID NO: 130301 - RNA, 22 nt, Homo sapiens
cccacaguggccucauauccuu

SEQ ID NO: 130302 - RNA, 22 nt, Homo sapiens
cccagagacagaaugauaaacu

SEQ ID NO: 130303 - RNA, 22 nt, Homo sapiens
cccagcguucggcauggcugag

SEQ ID NO: 130304 - RNA, 22 nt, Homo sapiens
ccccagguuucaauaaagccca

SEQ ID NO: 130305 - RNA, 22 nt, Homo sapiens
ccccagugguugcaacagcaga

SEQ ID NO: 130306 - RNA, 20 nt, Homo sapiens
ccccuggaguggggcugcuu

SEQ ID NO: 130307 - RNA, 17 nt, Homo sapiens
cccuaguagcugggacu

SEQ ID NO: 130308 - RNA, 22 nt, Homo sapiens
cccugagaugugaauuucagag

SEQ ID NO: 130309 - RNA, 22 nt, Homo sapiens
cccuggacacacacuuuuauuc

SEQ ID NO: 130310 - RNA, 19 nt, Homo sapiens
cccuggcacauggaaaaug

SEQ ID NO: 130311 - RNA, 22 nt, Homo sapiens
cccuuagaauuuuguaguuauu

SEQ ID NO: 130312 - RNA, 21 nt, Homo sapiens
ccuccauuuguauucuugccc

SEQ ID NO: 130313 - RNA, 21 nt, Homo sapiens
ccugaugaccucugagaguua

SEQ ID NO: 130314 - RNA, 21 nt, Homo sapiens
ccugauguucacuuggccuuc

SEQ ID NO: 130315 - RNA, 22 nt, Homo sapiens
ccugcauugucaaggccaagcc

SEQ ID NO: 130316 - RNA, 22 nt, Homo sapiens
ccuggcacugggccccguggcu

SEQ ID NO: 130317 - RNA, 22 nt, Homo sapiens
ccuggguuacaggugugagcca

SEQ ID NO: 130318 - RNA, 22 nt, Homo sapiens
ccugguguuuugauggucgggu

SEQ ID NO: 130319 - RNA, 22 nt, Homo sapiens
ccugucuugauuaaauuacuua

SEQ ID NO: 130320 - RNA, 22 nt, Homo sapiens
ccuucacaggcacugguucaga

SEQ ID NO: 130321 - RNA, 22 nt, Homo sapiens
uugaauagaagguuuuuuguuc

SEQ ID NO: 130322 - RNA, 22 nt, Homo sapiens
uugaauaguggugaaaguuuga

SEQ ID NO: 130323 - RNA, 18 nt, Homo sapiens
uugaauaguguccaaucu

SEQ ID NO: 130324 - RNA, 22 nt, Homo sapiens
uugaaugaaaugaugucauuug

SEQ ID NO: 130325 - RNA, 22 nt, Homo sapiens
uugacaguugggcagggaaguu

SEQ ID NO: 130326 - RNA, 22 nt, Homo sapiens
uugacauaguuucugaaauaga

SEQ ID NO: 130327 - RNA, 22 nt, Homo sapiens
uugacauguaaguacucuauag

SEQ ID NO: 130328 - RNA, 21 nt, Homo sapiens
uugagaagaauuagcucuucc

SEQ ID NO: 130329 - RNA, 21 nt, Homo sapiens
uugagacggagucucacucug

SEQ ID NO: 130330 - RNA, 22 nt, Homo sapiens
uugagacggagucucacucugu

SEQ ID NO: 130331 - RNA, 22 nt, Homo sapiens
uugagagagaacauuuguuaca

SEQ ID NO: 130332 - RNA, 22 nt, Homo sapiens
uugagaguggaggcuauaucuu

SEQ ID NO: 130333 - RNA, 20 nt, Homo sapiens
uugagaucuguaucugguuu

SEQ ID NO: 130334 - RNA, 22 nt, Homo sapiens
uugagaugaagucuugcucucu

SEQ ID NO: 130335 - RNA, 22 nt, Homo sapiens
uugagaugaaguuuugcucuuu

SEQ ID NO: 130336 - RNA, 22 nt, Homo sapiens
uugagaugauggauaugcuaau

SEQ ID NO: 130337 - RNA, 22 nt, Homo sapiens
uugagauggagcuucacucuug

SEQ ID NO: 130338 - RNA, 22 nt, Homo sapiens
uugagauggagucucacgcauu

SEQ ID NO: 130339 - RNA, 22 nt, Homo sapiens
uugagauggagucucacucugu

SEQ ID NO: 130340 - RNA, 22 nt, Homo sapiens
uugagauggagucucgcugugu

SEQ ID NO: 130341 - RNA, 22 nt, Homo sapiens
uugagauggagucuugcucugu

SEQ ID NO: 130342 - RNA, 22 nt, Homo sapiens
uugagauggagucuugcucuug

SEQ ID NO: 130343 - RNA, 22 nt, Homo sapiens
uugagauggaguuucaauauug

SEQ ID NO: 130344 - RNA, 22 nt, Homo sapiens
uugagauggaguuucacucugu

SEQ ID NO: 130345 - RNA, 22 nt, Homo sapiens
uugagauggaguuuugcucuug

SEQ ID NO: 130346 - RNA, 22 nt, Homo sapiens
uugagauuauuguguuccuuua

SEQ ID NO: 130347 - RNA, 22 nt, Homo sapiens
uugagcaauccuccugccaugu

SEQ ID NO: 130348 - RNA, 22 nt, Homo sapiens
uugagcaaugaacgauucaggg

SEQ ID NO: 130349 - RNA, 22 nt, Homo sapiens
uugagcacaguagguuguggcu

SEQ ID NO: 130350 - RNA, 22 nt, Homo sapiens
uugagcauugguauagguuuua

SEQ ID NO: 130351 - RNA, 22 nt, Homo sapiens
uugagccaaggauugucuuucc

SEQ ID NO: 130352 - RNA, 22 nt, Homo sapiens
uugagggagcacagauucuuau

SEQ ID NO: 130353 - RNA, 22 nt, Homo sapiens
uugagggagcauuuguuuugag

SEQ ID NO: 130354 - RNA, 22 nt, Homo sapiens
uugaggugaagggcagagcagc

SEQ ID NO: 130355 - RNA, 22 nt, Homo sapiens
uugaggugggaggaucacuuga

SEQ ID NO: 130356 - RNA, 22 nt, Homo sapiens
uugaguaguaagaagaugauag

SEQ ID NO: 130357 - RNA, 22 nt, Homo sapiens
uugauaugaauggcuguuugug

SEQ ID NO: 130358 - RNA, 19 nt, Homo sapiens
ggugagaaauuaugggucu

SEQ ID NO: 130359 - RNA, 22 nt, Homo sapiens
ggugagauguucagacgaacug

SEQ ID NO: 130360 - RNA, 22 nt, Homo sapiens
ggugagguaggaaaaguuagga

SEQ ID NO: 130361 - RNA, 22 nt, Homo sapiens
ggugcagcacaccaacauggca

SEQ ID NO: 130362 - RNA, 22 nt, Homo sapiens
ggugcuugaggaacggaggcug

SEQ ID NO: 130363 - RNA, 22 nt, Homo sapiens
gguggcuuuuugugauggcuga

SEQ ID NO: 130364 - RNA, 22 nt, Homo sapiens
gguguguaaauuacuuaucucu

SEQ ID NO: 130365 - RNA, 22 nt, Homo sapiens
guaaacuuccccucaugaauga

SEQ ID NO: 130366 - RNA, 22 nt, Homo sapiens
guaaagacacaugcacacguau

SEQ ID NO: 130367 - RNA, 22 nt, Homo sapiens
guaaaguaaagcacaucaaggu

SEQ ID NO: 130368 - RNA, 22 nt, Homo sapiens
guaaauguccccugugauauug

SEQ ID NO: 130369 - RNA, 22 nt, Homo sapiens
guaacucugucacuuacuaguu

SEQ ID NO: 130370 - RNA, 22 nt, Homo sapiens
guaacuggccuucaauuucuuc

SEQ ID NO: 130371 - RNA, 22 nt, Homo sapiens
guaagacuuauuuucuuuauca

SEQ ID NO: 130372 - RNA, 22 nt, Homo sapiens
guaaggaguaguguaacagugc

SEQ ID NO: 130373 - RNA, 22 nt, Homo sapiens
guaaggcuucuggucaacagca

SEQ ID NO: 130374 - RNA, 22 nt, Homo sapiens
guaaguauuaggugugagauuc

SEQ ID NO: 130375 - RNA, 22 nt, Homo sapiens
guaagucucaugagaucugaug

SEQ ID NO: 130376 - RNA, 22 nt, Homo sapiens
guaaucucagcuacuugggagc

SEQ ID NO: 130377 - RNA, 22 nt, Homo sapiens
guaaucucagcuacuugggagg

SEQ ID NO: 130378 - RNA, 22 nt, Homo sapiens
guaaugaacuugaaagccuguu

SEQ ID NO: 130379 - RNA, 22 nt, Homo sapiens
guacaagugcaguuucguuaca

SEQ ID NO: 130380 - RNA, 22 nt, Homo sapiens
guacaguuuagugcuuugagaa

SEQ ID NO: 130381 - RNA, 22 nt, Homo sapiens
guacauagucacacauauacau

SEQ ID NO: 130382 - RNA, 22 nt, Homo sapiens
guacaugcauacaugcacaucu

SEQ ID NO: 130383 - RNA, 22 nt, Homo sapiens
guacaugcaugcaugggugugc

SEQ ID NO: 130384 - RNA, 17 nt, Homo sapiens
guacucagugaccaugg

SEQ ID NO: 130385 - RNA, 22 nt, Homo sapiens
guagaagcacaggugaguuggu

SEQ ID NO: 130386 - RNA, 22 nt, Homo sapiens
guagcagaauaucagauaauuu

SEQ ID NO: 130387 - RNA, 22 nt, Homo sapiens
guaggcacuggcucagcuuauc

SEQ ID NO: 130388 - RNA, 22 nt, Homo sapiens
guaguggcaugaucuuggcuca

SEQ ID NO: 130389 - RNA, 22 nt, Homo sapiens
guauaggcuuucaccacgccau

SEQ ID NO: 130390 - RNA, 22 nt, Homo sapiens
guaucaucauguuggccaggcu

SEQ ID NO: 130391 - RNA, 22 nt, Homo sapiens
guaucauugccuaaugcucuca

SEQ ID NO: 130392 - RNA, 22 nt, Homo sapiens
guauccugaaguucucagcacu

SEQ ID NO: 130393 - RNA, 22 nt, Homo sapiens
guaugacacaggaagcuuaacc

SEQ ID NO: 130394 - RNA, 22 nt, Homo sapiens
guauggaagucaguuuguuggc

SEQ ID NO: 130395 - RNA, 22 nt, Homo sapiens
guauggcacuauccucucugau

SEQ ID NO: 130396 - RNA, 22 nt, Homo sapiens
guauggguuuuguuucuucugg

SEQ ID NO: 130397 - RNA, 22 nt, Homo sapiens
guaugucuugucuauggcugcu

SEQ ID NO: 130398 - RNA, 22 nt, Homo sapiens
guauuaguuaucuacugcugug

SEQ ID NO: 130399 - RNA, 18 nt, Homo sapiens
guauuccagccugaguga

SEQ ID NO: 130400 - RNA, 22 nt, Homo sapiens
guauuugguuauugcagccuga

SEQ ID NO: 130401 - RNA, 22 nt, Homo sapiens
gucaaagucuauuggcuaauuc

SEQ ID NO: 130402 - RNA, 22 nt, Homo sapiens
gucaagugaagcagugggagua

SEQ ID NO: 130403 - RNA, 22 nt, Homo sapiens
gucacagaggcuaagaccccac

SEQ ID NO: 130404 - RNA, 22 nt, Homo sapiens
gucacagcacuuuuaguaagug

SEQ ID NO: 130405 - RNA, 22 nt, Homo sapiens
gucacaggaaacuaauaugcgc

SEQ ID NO: 130406 - RNA, 22 nt, Homo sapiens
gucacaguggccagugauguuc

SEQ ID NO: 130407 - RNA, 22 nt, Homo sapiens
uaccacauuguagagggcauuc

SEQ ID NO: 130408 - RNA, 22 nt, Homo sapiens
uaccagcauuucucuuuaagua

SEQ ID NO: 130409 - RNA, 22 nt, Homo sapiens
uaccagugaauuccaggggcua

SEQ ID NO: 130410 - RNA, 22 nt, Homo sapiens
uaccaucauuauacguagaaau

SEQ ID NO: 130411 - RNA, 22 nt, Homo sapiens
uacccuuagcuuacauucuagg

SEQ ID NO: 130412 - RNA, 22 nt, Homo sapiens
uaccuguagacuacagcuucag

SEQ ID NO: 130413 - RNA, 16 nt, Homo sapiens
uacuacugccuauuau

SEQ ID NO: 130414 - RNA, 22 nt, Homo sapiens
uacuacuuucugacaucuuuaa

SEQ ID NO: 130415 - RNA, 22 nt, Homo sapiens
uacuagaaccuuauucagagug

SEQ ID NO: 130416 - RNA, 23 nt, Homo sapiens
uacuaguaagcguguucuuugca

SEQ ID NO: 130417 - RNA, 22 nt, Homo sapiens
uacucaauugcagucaccuggc

SEQ ID NO: 130418 - RNA, 22 nt, Homo sapiens
uacucaguaagugcuggcugcu

SEQ ID NO: 130419 - RNA, 22 nt, Homo sapiens
uacucaguagacacucauaugu

SEQ ID NO: 130420 - RNA, 22 nt, Homo sapiens
uacugagagaggaauauugaaa

SEQ ID NO: 130421 - RNA, 22 nt, Homo sapiens
uacugcacuccacccuggguga

SEQ ID NO: 130422 - RNA, 22 nt, Homo sapiens
uacugcacuccagccuggguga

SEQ ID NO: 130423 - RNA, 22 nt, Homo sapiens
uacugcacuccagccuugccaa

SEQ ID NO: 130424 - RNA, 20 nt, Homo sapiens
uacugcacuccauccugggu

SEQ ID NO: 130425 - RNA, 22 nt, Homo sapiens
uacugcacucuagccuggguga

SEQ ID NO: 130426 - RNA, 18 nt, Homo sapiens
uacugcacucuccagccu

SEQ ID NO: 130427 - RNA, 22 nt, Homo sapiens
uacugcuaccuccagcuucugg

SEQ ID NO: 130428 - RNA, 22 nt, Homo sapiens
uacugcuuaaaagucaauuacu

SEQ ID NO: 130429 - RNA, 20 nt, Homo sapiens
uagaaaguagaguggugguu

SEQ ID NO: 130430 - RNA, 22 nt, Homo sapiens
uagaagcacuaucccuccuagu

SEQ ID NO: 130431 - RNA, 22 nt, Homo sapiens
uagaaguaggcuacgugucugg

SEQ ID NO: 130432 - RNA, 22 nt, Homo sapiens
uagacacugcauauuuuuuuaa

SEQ ID NO: 130433 - RNA, 22 nt, Homo sapiens
uagaccauucuauuuccuaugc

SEQ ID NO: 130434 - RNA, 22 nt, Homo sapiens
uagacugguuuagcacugaaua

SEQ ID NO: 130435 - RNA, 21 nt, Homo sapiens
uagagcaacacacgcccucuc

SEQ ID NO: 130436 - RNA, 22 nt, Homo sapiens
uagagcaaugacucuggaaacc

SEQ ID NO: 130437 - RNA, 22 nt, Homo sapiens
uagagcuagggacucgcaaugu

SEQ ID NO: 130438 - RNA, 22 nt, Homo sapiens
uagagguaggucuucgagucuc

SEQ ID NO: 130439 - RNA, 22 nt, Homo sapiens
uagagguauaccaaaaaggcau

SEQ ID NO: 130440 - RNA, 22 nt, Homo sapiens
uagagguucuaagauucucaga

SEQ ID NO: 130441 - RNA, 22 nt, Homo sapiens
uagaguguaaaccacauaguga

SEQ ID NO: 130442 - RNA, 22 nt, Homo sapiens
uagaguguuuuguuaggcagca

SEQ ID NO: 130443 - RNA, 22 nt, Homo sapiens
uagaucaauuaauuguuacuug

SEQ ID NO: 130444 - RNA, 23 nt, Homo sapiens
uagaucaucaaguuuacugugcu

SEQ ID NO: 130445 - RNA, 22 nt, Homo sapiens
uagaucuuuaaaaggugcuaga

SEQ ID NO: 130446 - RNA, 19 nt, Homo sapiens
uagaugucuuugcauagau

SEQ ID NO: 130447 - RNA, 22 nt, Homo sapiens
uagauuaucccugauuugucca

SEQ ID NO: 130448 - RNA, 22 nt, Homo sapiens
uagauucauuuuagcaaaaguu

SEQ ID NO: 130449 - RNA, 22 nt, Homo sapiens
uagcaaaucaauggaauugaag

SEQ ID NO: 130450 - RNA, 20 nt, Homo sapiens
uagcacacauguagaauagu

SEQ ID NO: 130451 - RNA, 22 nt, Homo sapiens
uagcacagugucauucuaggua

SEQ ID NO: 130452 - RNA, 22 nt, Homo sapiens
uagcacaugucagguaauuugc

SEQ ID NO: 130453 - RNA, 22 nt, Homo sapiens
uagcaccucuuuggccuuucgu

SEQ ID NO: 130454 - RNA, 22 nt, Homo sapiens
uagcaccuuagcauuucuagug

SEQ ID NO: 130455 - RNA, 22 nt, Homo sapiens
uagcagaauauaccucuuacuu

SEQ ID NO: 130456 - RNA, 22 nt, Homo sapiens
uagcagcagugguguauuuaga

SEQ ID NO: 130457 - RNA, 22 nt, Homo sapiens
uagcagcauaaauggacuaaga

SEQ ID NO: 130458 - RNA, 22 nt, Homo sapiens
uagcagguguuccacaaauauu

SEQ ID NO: 130459 - RNA, 22 nt, Homo sapiens
uagcaguaagaaacugacauug

SEQ ID NO: 130460 - RNA, 22 nt, Homo sapiens
uagcaguaccccaguauccugg

SEQ ID NO: 130461 - RNA, 22 nt, Homo sapiens
uagcaguagacagacuuuggcu

SEQ ID NO: 130462 - RNA, 22 nt, Homo sapiens
uagcaguauaugagagcuauug

SEQ ID NO: 130463 - RNA, 22 nt, Homo sapiens
uagcaguaucccaccaucuggu

SEQ ID NO: 130464 - RNA, 22 nt, Homo sapiens
uagcagucucagaaugcauggu

SEQ ID NO: 130465 - RNA, 22 nt, Homo sapiens
uagcccauuuguuuagggaaag

SEQ ID NO: 130466 - RNA, 22 nt, Homo sapiens
uagccucacaaagugcuuaaga

SEQ ID NO: 130467 - RNA, 21 nt, Homo sapiens
uagcuacacugugauucaugg

SEQ ID NO: 130468 - RNA, 22 nt, Homo sapiens
uagcucagcccagcuaagcuca

SEQ ID NO: 130469 - RNA, 18 nt, Homo sapiens
uagcucuuguugguccau

SEQ ID NO: 130470 - RNA, 22 nt, Homo sapiens
uagcugcccagcacgaaguugg

SEQ ID NO: 130471 - RNA, 22 nt, Homo sapiens
uaggaaguuuucuugcugggcc

SEQ ID NO: 130472 - RNA, 22 nt, Homo sapiens
uaggacaaugguacagcagaaa

SEQ ID NO: 130473 - RNA, 22 nt, Homo sapiens
uaggacacagaccuggauggaa

SEQ ID NO: 130474 - RNA, 22 nt, Homo sapiens
uaggacacaggacauauguaga

SEQ ID NO: 130475 - RNA, 22 nt, Homo sapiens
uaggacauugcccuuguggaga

SEQ ID NO: 130476 - RNA, 19 nt, Homo sapiens
uaggacccugguggccccc

SEQ ID NO: 130477 - RNA, 22 nt, Homo sapiens
uaggagugugaacccuaugaac

SEQ ID NO: 130478 - RNA, 22 nt, Homo sapiens
uaggcagccagcuguggauuga

SEQ ID NO: 130479 - RNA, 22 nt, Homo sapiens
uaggcaguuuuccuuucacagu

SEQ ID NO: 130480 - RNA, 22 nt, Homo sapiens
uaggccuuuuucagauggguag

SEQ ID NO: 130481 - RNA, 22 nt, Homo sapiens
uaggcgagauguguguuucaug

SEQ ID NO: 130482 - RNA, 22 nt, Homo sapiens
uagggcaaggaacaguuaaaaa

SEQ ID NO: 130483 - RNA, 19 nt, Homo sapiens
uagggcacgaggcagaguc

SEQ ID NO: 130484 - RNA, 22 nt, Homo sapiens
uagggcaugugggaaguuauaa

SEQ ID NO: 130485 - RNA, 22 nt, Homo sapiens
uagggcuuuccggccugucaga

SEQ ID NO: 130486 - RNA, 22 nt, Homo sapiens
uagggcuuuuccaagcugccac

SEQ ID NO: 130487 - RNA, 22 nt, Homo sapiens
uagguacuuaagaucucagcua

SEQ ID NO: 130488 - RNA, 22 nt, Homo sapiens
uagguaguuagcauacuacaca

SEQ ID NO: 130489 - RNA, 22 nt, Homo sapiens
uaggugaauguaguaagguguu

SEQ ID NO: 130490 - RNA, 19 nt, Homo sapiens
uaggugguuuuccccucac

SEQ ID NO: 130491 - RNA, 23 nt, Homo sapiens
uagguuauuugguaaauauaugu

SEQ ID NO: 130492 - RNA, 22 nt, Homo sapiens
uagguugucuucccagaguuuu

SEQ ID NO: 130493 - RNA, 22 nt, Homo sapiens
uaguagagauggggcacaugcc

SEQ ID NO: 130494 - RNA, 22 nt, Homo sapiens
uaguaggacaggauuucaguua

SEQ ID NO: 130495 - RNA, 22 nt, Homo sapiens
uaguagugucccugacuaucac

SEQ ID NO: 130496 - RNA, 22 nt, Homo sapiens
uaguaucacauggucuuaauua

SEQ ID NO: 130497 - RNA, 21 nt, Homo sapiens
ugagaacaacaggucaagcag

SEQ ID NO: 130498 - RNA, 22 nt, Homo sapiens
ugagaacagauggcuuuauuau

SEQ ID NO: 130499 - RNA, 18 nt, Homo sapiens
ugagaacauguguacaca

SEQ ID NO: 130500 - RNA, 19 nt, Homo sapiens
ugagaaccucuacagaguc

SEQ ID NO: 130501 - RNA, 22 nt, Homo sapiens
ugagaacuuugucuuuuacucu

SEQ ID NO: 130502 - RNA, 22 nt, Homo sapiens
ugagaagcauaccagugucugu

SEQ ID NO: 130503 - RNA, 22 nt, Homo sapiens
ugagaaugcagaaucucgugca

SEQ ID NO: 130504 - RNA, 22 nt, Homo sapiens
ugagacacugaauccggccuga

SEQ ID NO: 130505 - RNA, 22 nt, Homo sapiens
ugagacaugugaauauuuguac

SEQ ID NO: 130506 - RNA, 22 nt, Homo sapiens
ugagaccaacagauuccaguuc

SEQ ID NO: 130507 - RNA, 22 nt, Homo sapiens
ugagacggagucucgcucuguc

SEQ ID NO: 130508 - RNA, 22 nt, Homo sapiens
ugagacggagucucgcucuguu

SEQ ID NO: 130509 - RNA, 22 nt, Homo sapiens
ugagacggagucuugcccuguc

SEQ ID NO: 130510 - RNA, 22 nt, Homo sapiens
ugagacggagucuugcucuguc

SEQ ID NO: 130511 - RNA, 22 nt, Homo sapiens
ugagacugagucuugcucuauu

SEQ ID NO: 130512 - RNA, 22 nt, Homo sapiens
ugagacugaguuuugcucguug

SEQ ID NO: 130513 - RNA, 22 nt, Homo sapiens
ugagacugauaggacauuuucu

SEQ ID NO: 130514 - RNA, 22 nt, Homo sapiens
ugagagacaguuuguuaaaauu

SEQ ID NO: 130515 - RNA, 22 nt, Homo sapiens
ugagaggugauaaagcaagggu

SEQ ID NO: 130516 - RNA, 22 nt, Homo sapiens
ugagagucauacaaauaaaaau

SEQ ID NO: 130517 - RNA, 22 nt, Homo sapiens
ugagauaacuaaaaacauuuug

SEQ ID NO: 130518 - RNA, 22 nt, Homo sapiens
ugagauagaaaacauaggagaa

SEQ ID NO: 130519 - RNA, 22 nt, Homo sapiens
ugagauaggaucuugcucuguu

SEQ ID NO: 130520 - RNA, 22 nt, Homo sapiens
ugagauagggucucacucuguc

SEQ ID NO: 130521 - RNA, 22 nt, Homo sapiens
ugagauaguuguagauguacau

SEQ ID NO: 130522 - RNA, 22 nt, Homo sapiens
ugagauauugggaguaauguca

SEQ ID NO: 130523 - RNA, 22 nt, Homo sapiens
ugagaucacgccacugcacucc

SEQ ID NO: 130524 - RNA, 22 nt, Homo sapiens
ugagaucauguguggaccccag

SEQ ID NO: 130525 - RNA, 20 nt, Homo sapiens
ugagauccacgugaaguaug

SEQ ID NO: 130526 - RNA, 22 nt, Homo sapiens
ugagaucuuaucagaaauggug

SEQ ID NO: 130527 - RNA, 22 nt, Homo sapiens
ugagaucuucgcucuucacaga

SEQ ID NO: 130528 - RNA, 22 nt, Homo sapiens
ugagaucuuugcuguccucacc

SEQ ID NO: 130529 - RNA, 22 nt, Homo sapiens
ugagaugaaagcagaaagacuu

SEQ ID NO: 130530 - RNA, 22 nt, Homo sapiens
ugagaugaagucuugcucuguu

SEQ ID NO: 130531 - RNA, 22 nt, Homo sapiens
ugagauggagucuugucgccua

SEQ ID NO: 130532 - RNA, 22 nt, Homo sapiens
ugagauggaguuucgcuuuugu

SEQ ID NO: 130533 - RNA, 22 nt, Homo sapiens
ugagauggcuuuauugcugaau

SEQ ID NO: 130534 - RNA, 22 nt, Homo sapiens
ugagaugguaaauuuuuguugu

SEQ ID NO: 130535 - RNA, 22 nt, Homo sapiens
ugagaugugaagaucacaugaa

SEQ ID NO: 130536 - RNA, 22 nt, Homo sapiens
ugagaugugaucaccugaaggg

SEQ ID NO: 130537 - RNA, 22 nt, Homo sapiens
ugagaugugugcauucaacuca

SEQ ID NO: 130538 - RNA, 22 nt, Homo sapiens
ugagauguuuagauuguugucu

SEQ ID NO: 130539 - RNA, 22 nt, Homo sapiens
ugagauuauauuucuuaacaga

SEQ ID NO: 130540 - RNA, 19 nt, Homo sapiens
ugagauuguaugaggagau

SEQ ID NO: 130541 - RNA, 23 nt, Homo sapiens
ugagcaauauucuacuauugagu

SEQ ID NO: 130542 - RNA, 22 nt, Homo sapiens
ugagcacagagccugggguggc

SEQ ID NO: 130543 - RNA, 22 nt, Homo sapiens
ugagcacaggugcgcgguuacu

SEQ ID NO: 130544 - RNA, 22 nt, Homo sapiens
ugagcagugagugugcugcagg

SEQ ID NO: 130545 - RNA, 22 nt, Homo sapiens
ugagcagugaguguggugcagg

SEQ ID NO: 130546 - RNA, 22 nt, Homo sapiens
ugagcaucauucacaccuuggu

SEQ ID NO: 130547 - RNA, 22 nt, Homo sapiens
ugagcauuguguuugacuguga

SEQ ID NO: 130548 - RNA, 22 nt, Homo sapiens
ugagcuaggauccugucacugu

SEQ ID NO: 130549 - RNA, 22 nt, Homo sapiens
ugagcucaguauuucauaaaca

SEQ ID NO: 130550 - RNA, 22 nt, Homo sapiens
ugagcugagaaaugcagcagcu

SEQ ID NO: 130551 - RNA, 22 nt, Homo sapiens
ugagcugguacuaauauuauca

SEQ ID NO: 130552 - RNA, 22 nt, Homo sapiens
ugaggaaugaccccgugugguc

SEQ ID NO: 130553 - RNA, 22 nt, Homo sapiens
ugaggaauguguguuaaagaua

SEQ ID NO: 130554 - RNA, 22 nt, Homo sapiens
ugaggacugagaggcacugugg

SEQ ID NO: 130555 - RNA, 22 nt, Homo sapiens
ugaggaguauguucuguagacc

SEQ ID NO: 130556 - RNA, 22 nt, Homo sapiens
ugaggaucucuaggaauuuauc

SEQ ID NO: 130557 - RNA, 22 nt, Homo sapiens
ugagguaacagaagcgagcauu

SEQ ID NO: 130558 - RNA, 22 nt, Homo sapiens
ugagguaauagauaauauuuuu

SEQ ID NO: 130559 - RNA, 22 nt, Homo sapiens
ugagguagguaccauuaucacu

SEQ ID NO: 130560 - RNA, 20 nt, Homo sapiens
ugaggucaggaguuacagac

SEQ ID NO: 130561 - RNA, 22 nt, Homo sapiens
ugaggucauucaugugggcgca

SEQ ID NO: 130562 - RNA, 22 nt, Homo sapiens
ugaggugaaguaauauucuaag

SEQ ID NO: 130563 - RNA, 23 nt, Homo sapiens
ugagguguuaagcagacuugucu

SEQ ID NO: 130564 - RNA, 22 nt, Homo sapiens
ugaguagaagugaagauagugg

SEQ ID NO: 130565 - RNA, 22 nt, Homo sapiens
ugaguagagaauucagcuaagg

SEQ ID NO: 130566 - RNA, 22 nt, Homo sapiens
ugaguauagaucaguucaagug

SEQ ID NO: 130567 - RNA, 22 nt, Homo sapiens
ugagugaaggggcucuguugug

SEQ ID NO: 130568 - RNA, 22 nt, Homo sapiens
ugagugccuggagggcagggac

SEQ ID NO: 130569 - RNA, 22 nt, Homo sapiens
ugaguuagguguuuuaaauaua

SEQ ID NO: 130570 - RNA, 22 nt, Homo sapiens
ugaguuaguguggugcuuggaa

SEQ ID NO: 130571 - RNA, 22 nt, Homo sapiens
ugaguuauuaguagaggcuaug

SEQ ID NO: 130572 - RNA, 22 nt, Homo sapiens
ugaguucaauuguauuuuauua

SEQ ID NO: 130573 - RNA, 22 nt, Homo sapiens
ugaguucuuccaccgggaccag

SEQ ID NO: 130574 - RNA, 22 nt, Homo sapiens
ugaguucuuccuaucucugccu

SEQ ID NO: 130575 - RNA, 22 nt, Homo sapiens
ugauaagugagauagcaaguga

SEQ ID NO: 130576 - RNA, 22 nt, Homo sapiens
ugauaggucacucaacagugag

SEQ ID NO: 130577 - RNA, 22 nt, Homo sapiens
ugauaucucuugccuccaaaug

SEQ ID NO: 130578 - RNA, 21 nt, Homo sapiens
uggaauuaauggagagguguu

SEQ ID NO: 130579 - RNA, 22 nt, Homo sapiens
uggacaagugcccuccaccuca

SEQ ID NO: 130580 - RNA, 22 nt, Homo sapiens
uggacagagagaccggcauuuu

SEQ ID NO: 130581 - RNA, 21 nt, Homo sapiens
uggaccccuacuucucaccau

SEQ ID NO: 130582 - RNA, 22 nt, Homo sapiens
uggagagcaaaaucaauccaaa

SEQ ID NO: 130583 - RNA, 22 nt, Homo sapiens
uggagagcaaagaauuuguuag

SEQ ID NO: 130584 - RNA, 18 nt, Homo sapiens
uggagauaagaagaacuu

SEQ ID NO: 130585 - RNA, 22 nt, Homo sapiens
uggagcccuaguuccucauaac

SEQ ID NO: 130586 - RNA, 23 nt, Homo sapiens
uggaggacaagcauggauaguga

SEQ ID NO: 130587 - RNA, 22 nt, Homo sapiens
uggagguagggccuaggaaucu

SEQ ID NO: 130588 - RNA, 22 nt, Homo sapiens
uggaggucauuggaucaugggg

SEQ ID NO: 130589 - RNA, 22 nt, Homo sapiens
uggagucgugcccuugcauuua

SEQ ID NO: 130590 - RNA, 22 nt, Homo sapiens
uggagugaaaacacacuaaucu

SEQ ID NO: 130591 - RNA, 21 nt, Homo sapiens
uggagugaagaguuuauugac

SEQ ID NO: 130592 - RNA, 20 nt, Homo sapiens
uggagugaagguucuggacc

SEQ ID NO: 130593 - RNA, 22 nt, Homo sapiens
uggagugcaauggcaccaucuu

SEQ ID NO: 130594 - RNA, 22 nt, Homo sapiens
uggagugcgugucugaguuuuu

SEQ ID NO: 130595 - RNA, 20 nt, Homo sapiens
uggagugcuguguugagaag

SEQ ID NO: 130596 - RNA, 22 nt, Homo sapiens
uggaguguguugcagaugaagg

SEQ ID NO: 130597 - RNA, 22 nt, Homo sapiens
uggaguguuggggcaggaucuc

SEQ ID NO: 130598 - RNA, 22 nt, Homo sapiens
uggauagaaauguacuguuuuc

SEQ ID NO: 130599 - RNA, 22 nt, Homo sapiens
uggauagugauaagguagauga

SEQ ID NO: 130600 - RNA, 22 nt, Homo sapiens
uggauugaaagcuuuaauauug

SEQ ID NO: 130601 - RNA, 22 nt, Homo sapiens
uggauugagaagcuguggcuca

SEQ ID NO: 130602 - RNA, 21 nt, Homo sapiens
uggauuguacacccuaucauu

SEQ ID NO: 130603 - RNA, 22 nt, Homo sapiens
uggcaaauauuuuguuuuguaa

SEQ ID NO: 130604 - RNA, 22 nt, Homo sapiens
uggcaaaucagaggcauggaca

SEQ ID NO: 130605 - RNA, 22 nt, Homo sapiens
uggcaaaugaagucagcuguac

SEQ ID NO: 130606 - RNA, 22 nt, Homo sapiens
uggcaacaucuggggacauguu

SEQ ID NO: 130607 - RNA, 22 nt, Homo sapiens
uggcaagaacaacaauuacuuu

SEQ ID NO: 130608 - RNA, 22 nt, Homo sapiens
uggcaagaaggauuuauuccuu

SEQ ID NO: 130609 - RNA, 22 nt, Homo sapiens
uggcaagagauaugugucuaua

SEQ ID NO: 130610 - RNA, 22 nt, Homo sapiens
uggcaauaaaaugcaguuacuu

SEQ ID NO: 130611 - RNA, 19 nt, Homo sapiens
uggcaaugucagcagagau

SEQ ID NO: 130612 - RNA, 19 nt, Homo sapiens
uggcacauguauacuuaug

SEQ ID NO: 130613 - RNA, 22 nt, Homo sapiens
uggcagauaggauacaggacua

SEQ ID NO: 130614 - RNA, 22 nt, Homo sapiens
uggcagaugagccgcgcuccaa

SEQ ID NO: 130615 - RNA, 22 nt, Homo sapiens
uggcagaugcucuuggugccca

SEQ ID NO: 130616 - RNA, 22 nt, Homo sapiens
uggcagaugggugagcuggaga

SEQ ID NO: 130617 - RNA, 22 nt, Homo sapiens
uggcagcgugaauguggcugaa

SEQ ID NO: 130618 - RNA, 20 nt, Homo sapiens
uggcaugaaauuuuccaagc

SEQ ID NO: 130619 - RNA, 22 nt, Homo sapiens
uggcaugauccuagauucaaca

SEQ ID NO: 130620 - RNA, 22 nt, Homo sapiens
uggcaugcauuguggguaauua

SEQ ID NO: 130621 - RNA, 22 nt, Homo sapiens
uggcauggaaagcuuuucauac

SEQ ID NO: 130622 - RNA, 22 nt, Homo sapiens
uggcauggggcagaacauuaca

SEQ ID NO: 130623 - RNA, 22 nt, Homo sapiens
uggcauguagucugggaccugg

SEQ ID NO: 130624 - RNA, 22 nt, Homo sapiens
uggcaugucguuuuucauagga

SEQ ID NO: 130625 - RNA, 22 nt, Homo sapiens
uggcauguguuugaaugaguau

SEQ ID NO: 130626 - RNA, 22 nt, Homo sapiens
uggcauguuggguguugacucc

SEQ ID NO: 130627 - RNA, 20 nt, Homo sapiens
uggcauguugguaugcaccc

SEQ ID NO: 130628 - RNA, 23 nt, Homo sapiens
uggcauuuuaguuagcuucagug

SEQ ID NO: 130629 - RNA, 23 nt, Homo sapiens
uggccagaaacuucuuuucaucc

SEQ ID NO: 130630 - RNA, 22 nt, Homo sapiens
uggccagugucuauugguuucc

SEQ ID NO: 130631 - RNA, 22 nt, Homo sapiens
uggccaguguuuuuccugggcu

SEQ ID NO: 130632 - RNA, 22 nt, Homo sapiens
uggccaguugaagacaaugcuc

SEQ ID NO: 130633 - RNA, 22 nt, Homo sapiens
uggccaguuuuuaauugggucu

SEQ ID NO: 130634 - RNA, 22 nt, Homo sapiens
uggccuguaacgcugucucagc

SEQ ID NO: 130635 - RNA, 22 nt, Homo sapiens
uggcgggaaaguugggagaaga

SEQ ID NO: 130636 - RNA, 22 nt, Homo sapiens
uggcuacagaaaguacuaguga

SEQ ID NO: 130637 - RNA, 19 nt, Homo sapiens
uggcuagaggccaggcguu

SEQ ID NO: 130638 - RNA, 22 nt, Homo sapiens
uggcucauuucuaaacccagcu

SEQ ID NO: 130639 - RNA, 22 nt, Homo sapiens
uggcucuguuuguuaacuagac

SEQ ID NO: 130640 - RNA, 22 nt, Homo sapiens
uggcuguguccucucccaaauc

SEQ ID NO: 130641 - RNA, 22 nt, Homo sapiens
uggcuguuuauuucaccuggau

SEQ ID NO: 130642 - RNA, 22 nt, Homo sapiens
uggcuguuuauuucaccugggu

SEQ ID NO: 130643 - RNA, 22 nt, Homo sapiens
uggcuuucuggggcuucuguuc

SEQ ID NO: 130644 - RNA, 22 nt, Homo sapiens
uggcuuuuccuugaaucugccu

SEQ ID NO: 130645 - RNA, 22 nt, Homo sapiens
ugggaaauguagccuagcugug

SEQ ID NO: 130646 - RNA, 20 nt, Homo sapiens
ugggaacaugugguauaugg

SEQ ID NO: 130647 - RNA, 18 nt, Homo sapiens
ugggaagaaauucuucuc

SEQ ID NO: 130648 - RNA, 22 nt, Homo sapiens
ugggaagcugcugaacuacagu

SEQ ID NO: 130649 - RNA, 22 nt, Homo sapiens
ugggagugugcacaauuucagc

SEQ ID NO: 130650 - RNA, 22 nt, Homo sapiens
ugggaucaugagcaccgcuucc

SEQ ID NO: 130651 - RNA, 22 nt, Homo sapiens
ugggauccaugugguuuaagca

SEQ ID NO: 130652 - RNA, 22 nt, Homo sapiens
ugggaugaugaaaaggcuuucu

SEQ ID NO: 130653 - RNA, 22 nt, Homo sapiens
ugggaugauguuaaacguacuc

SEQ ID NO: 130654 - RNA, 22 nt, Homo sapiens
ugggcaaaacuaagagcugugg

SEQ ID NO: 130655 - RNA, 22 nt, Homo sapiens
ugggcuagaugcuuugggguca

SEQ ID NO: 130656 - RNA, 22 nt, Homo sapiens
uggguaaaucucuguucagggc

SEQ ID NO: 130657 - RNA, 22 nt, Homo sapiens
uggguagauaucauaguugccc

SEQ ID NO: 130658 - RNA, 22 nt, Homo sapiens
uggguaggaccagaaaugcacu

SEQ ID NO: 130659 - RNA, 22 nt, Homo sapiens
uggguaggcccucauuggacag

SEQ ID NO: 130660 - RNA, 23 nt, Homo sapiens
uggguucauucuugaagucagug

SEQ ID NO: 130661 - RNA, 23 nt, Homo sapiens
uggguucccuaagcgcaugcugc

SEQ ID NO: 130662 - RNA, 22 nt, Homo sapiens
ugguacugucucuauuuuguag

SEQ ID NO: 130663 - RNA, 22 nt, Homo sapiens
ugguagguuuauaaagaauuua

SEQ ID NO: 130664 - RNA, 22 nt, Homo sapiens
ugguagugugagucuaaauugg

SEQ ID NO: 130665 - RNA, 22 nt, Homo sapiens
ugguauguaugauuaacaugga

SEQ ID NO: 130666 - RNA, 20 nt, Homo sapiens
uggucaccuucaggagguuc

SEQ ID NO: 130667 - RNA, 22 nt, Homo sapiens
uggucauggggcagcugacacu

SEQ ID NO: 130668 - RNA, 21 nt, Homo sapiens
uggucccauaagauuauaaug

SEQ ID NO: 130669 - RNA, 20 nt, Homo sapiens
ugguccccaccaaaucucau

SEQ ID NO: 130670 - RNA, 20 nt, Homo sapiens
ugguccccugagucuggcuu

SEQ ID NO: 130671 - RNA, 22 nt, Homo sapiens
ucugacuagacaagcaguguac

SEQ ID NO: 130672 - RNA, 22 nt, Homo sapiens
ucugagaugagacuuugaauuu

SEQ ID NO: 130673 - RNA, 22 nt, Homo sapiens
ucugagguuacugcuuuguaga

SEQ ID NO: 130674 - RNA, 22 nt, Homo sapiens
ucugauggaguugccagggaga

SEQ ID NO: 130675 - RNA, 22 nt, Homo sapiens
ucugcauaucaugcagaacuau

SEQ ID NO: 130676 - RNA, 22 nt, Homo sapiens
ucuggcaagagccgagggcagu

SEQ ID NO: 130677 - RNA, 22 nt, Homo sapiens
ucuggcaagauauccauugcuu

SEQ ID NO: 130678 - RNA, 21 nt, Homo sapiens
ucuggccccuccaaaucucau

SEQ ID NO: 130679 - RNA, 20 nt, Homo sapiens
ucuggccccucuaaaucuca

SEQ ID NO: 130680 - RNA, 22 nt, Homo sapiens
ucuggccuacaaguaauuuuau

SEQ ID NO: 130681 - RNA, 22 nt, Homo sapiens
ucuggccuacaucauuuuuccg

SEQ ID NO: 130682 - RNA, 22 nt, Homo sapiens
ucuggcuccaaagucuauuuuu

SEQ ID NO: 130683 - RNA, 16 nt, Homo sapiens
ucuggcucuacaguuc

SEQ ID NO: 130684 - RNA, 18 nt, Homo sapiens
ucuggcuucuuuguucca

SEQ ID NO: 130685 - RNA, 22 nt, Homo sapiens
ucuggcuugugaacugucuucu

SEQ ID NO: 130686 - RNA, 21 nt, Homo sapiens
ucuggcuuucauuccccuucu

SEQ ID NO: 130687 - RNA, 22 nt, Homo sapiens
ucuggguuuuuccauugccggu

SEQ ID NO: 130688 - RNA, 20 nt, Homo sapiens
guucacaggcuuccuuucag

SEQ ID NO: 130689 - RNA, 22 nt, Homo sapiens
guucacagugguugccuuccag

SEQ ID NO: 130690 - RNA, 22 nt, Homo sapiens
guucacaguuaggacaacugcu

SEQ ID NO: 130691 - RNA, 22 nt, Homo sapiens
guucacaguuucuaaucccagc

SEQ ID NO: 130692 - RNA, 22 nt, Homo sapiens
guucaucagggauacuggccug

SEQ ID NO: 130693 - RNA, 22 nt, Homo sapiens
guucaucagggauacuggcuua

SEQ ID NO: 130694 - RNA, 22 nt, Homo sapiens
guucaucagggauauuggccug

SEQ ID NO: 130695 - RNA, 20 nt, Homo sapiens
guucauguaauuaguucagg

SEQ ID NO: 130696 - RNA, 22 nt, Homo sapiens
guucccaguugaaaugauuagu

SEQ ID NO: 130697 - RNA, 20 nt, Homo sapiens
guucccuguaggugugcgga

SEQ ID NO: 130698 - RNA, 22 nt, Homo sapiens
guugaggcaggagaauuacuug

SEQ ID NO: 130699 - RNA, 22 nt, Homo sapiens
guugcucaggccggagugcagu

SEQ ID NO: 130700 - RNA, 22 nt, Homo sapiens
guugcucaggcugaagugcagu

SEQ ID NO: 130701 - RNA, 22 nt, Homo sapiens
guuggcuuuuuaaggaaauugc

SEQ ID NO: 130702 - RNA, 22 nt, Homo sapiens
guuuggcucuuguuucugucaa

SEQ ID NO: 130703 - RNA, 17 nt, Homo sapiens
guuuggguacuggguaa

SEQ ID NO: 130704 - RNA, 22 nt, Homo sapiens
uaaagagcuuuugaggugucau

SEQ ID NO: 130705 - RNA, 22 nt, Homo sapiens
uaaagcauguaauuagguuaga

SEQ ID NO: 130706 - RNA, 22 nt, Homo sapiens
uaaagcuacagagcggaaaauu

SEQ ID NO: 130707 - RNA, 21 nt, Homo sapiens
uaaagcuagaaccuuagcuuu

SEQ ID NO: 130708 - RNA, 22 nt, Homo sapiens
uaaagcuauuauaguuauguuu

SEQ ID NO: 130709 - RNA, 20 nt, Homo sapiens
uaaagcugcucagggggcuc

SEQ ID NO: 130710 - RNA, 21 nt, Homo sapiens
uaaagcuuagcuauaguggcu

SEQ ID NO: 130711 - RNA, 18 nt, Homo sapiens
uaaaggcacuguguuguu

SEQ ID NO: 130712 - RNA, 22 nt, Homo sapiens
uaaagugaggauggcaguaggu

SEQ ID NO: 130713 - RNA, 20 nt, Homo sapiens
uaaaugccucaugcuuuauu

SEQ ID NO: 130714 - RNA, 21 nt, Homo sapiens
uaaaugucauacaaagcaaug

SEQ ID NO: 130715 - RNA, 18 nt, Homo sapiens
uaaauugcuucaccugag

SEQ ID NO: 130716 - RNA, 22 nt, Homo sapiens
uaacaccuuugauagcacuuuu

SEQ ID NO: 130717 - RNA, 21 nt, Homo sapiens
uaacagcuccacuccauucuc

SEQ ID NO: 130718 - RNA, 22 nt, Homo sapiens
uaacaggcaaggucacaccuug

SEQ ID NO: 130719 - RNA, 22 nt, Homo sapiens
uaacaggcuacucuugcauugc

SEQ ID NO: 130720 - RNA, 22 nt, Homo sapiens
uaacagucuccucaagguguug

SEQ ID NO: 130721 - RNA, 22 nt, Homo sapiens
uaacaguguagaggccuauugg

SEQ ID NO: 130722 - RNA, 22 nt, Homo sapiens
uaacauagucauauacuugcuu

SEQ ID NO: 130723 - RNA, 22 nt, Homo sapiens
uaacccuuacaacuacacucgu

SEQ ID NO: 130724 - RNA, 22 nt, Homo sapiens
uaacugcaaccucugccugcug

SEQ ID NO: 130725 - RNA, 22 nt, Homo sapiens
uaacugucucccuugguccuga

SEQ ID NO: 130726 - RNA, 22 nt, Homo sapiens
uaagaauucuguccgguauacu

SEQ ID NO: 130727 - RNA, 23 nt, Homo sapiens
uaagacacuaacuuuaugcuuug

SEQ ID NO: 130728 - RNA, 22 nt, Homo sapiens
uaagacucuggacucuaauguu

SEQ ID NO: 130729 - RNA, 22 nt, Homo sapiens
uaagaugaaggcucaccuagaa

SEQ ID NO: 130730 - RNA, 18 nt, Homo sapiens
uaagaugcagccuauucc

SEQ ID NO: 130731 - RNA, 22 nt, Homo sapiens
uaagcagugcaagaauggaaua

SEQ ID NO: 130732 - RNA, 22 nt, Homo sapiens
uaagccaccgugccuggccuaa

SEQ ID NO: 130733 - RNA, 22 nt, Homo sapiens
uaaggcaaguuuuuaguggaca

SEQ ID NO: 130734 - RNA, 22 nt, Homo sapiens
uaaggcacccuucugaguagag

SEQ ID NO: 130735 - RNA, 18 nt, Homo sapiens
uaaggcacuauaggcauu

SEQ ID NO: 130736 - RNA, 22 nt, Homo sapiens
uaaggcccgugaguuucauauc

SEQ ID NO: 130737 - RNA, 22 nt, Homo sapiens
uaaggcuaggaauucucugaag

SEQ ID NO: 130738 - RNA, 22 nt, Homo sapiens
uaagguccuuaaauguguaacc

SEQ ID NO: 130739 - RNA, 22 nt, Homo sapiens
uaagguuacaaaggacuucaua

SEQ ID NO: 130740 - RNA, 22 nt, Homo sapiens
uaaguaaaugaaagguugauuu

SEQ ID NO: 130741 - RNA, 22 nt, Homo sapiens
uaaguaauugugguuuuugcca

SEQ ID NO: 130742 - RNA, 22 nt, Homo sapiens
uaaguaauuuguauuuuaccca

SEQ ID NO: 130743 - RNA, 22 nt, Homo sapiens
uaagucacuccagguuaaagug

SEQ ID NO: 130744 - RNA, 22 nt, Homo sapiens
uaagucuuuuuggaguuuauaa

SEQ ID NO: 130745 - RNA, 22 nt, Homo sapiens
uaagugaauguuggcuacugaa

SEQ ID NO: 130746 - RNA, 22 nt, Homo sapiens
uugagguaauaaacagccauuc

SEQ ID NO: 130747 - RNA, 22 nt, Homo sapiens
uugagguagcuuugauggaggu

SEQ ID NO: 130748 - RNA, 22 nt, Homo sapiens
uugaggucuucaggaucaggcu

SEQ ID NO: 130749 - RNA, 22 nt, Homo sapiens
uugaggucuuugagcaaacgca

SEQ ID NO: 130750 - RNA, 22 nt, Homo sapiens
uugaggugaauuugcaggaugc

SEQ ID NO: 130751 - RNA, 22 nt, Homo sapiens
uugagguguauuguacagcaca

SEQ ID NO: 130752 - RNA, 20 nt, Homo sapiens
uugaggugugaggggcagag

SEQ ID NO: 130753 - RNA, 22 nt, Homo sapiens
cacauguucaggagcacuuaga

SEQ ID NO: 130754 - RNA, 22 nt, Homo sapiens
caccacuacaccccaggcuggg

SEQ ID NO: 130755 - RNA, 22 nt, Homo sapiens
caccagcuggcauugaauaccu

SEQ ID NO: 130756 - RNA, 22 nt, Homo sapiens
caccaggugcccagcacggcca

SEQ ID NO: 130757 - RNA, 22 nt, Homo sapiens
caccagguuggagugcaguggu

SEQ ID NO: 130758 - RNA, 23 nt, Homo sapiens
caccaguauaauuagcuuuuaaa

SEQ ID NO: 130759 - RNA, 19 nt, Homo sapiens
caccagugcaugcuacuau

SEQ ID NO: 130760 - RNA, 22 nt, Homo sapiens
caccgagguuggagugcagugg

SEQ ID NO: 130761 - RNA, 19 nt, Homo sapiens
caccgccugcccccugcug

SEQ ID NO: 130762 - RNA, 22 nt, Homo sapiens
caccuguagucccagcugaggc

SEQ ID NO: 130763 - RNA, 22 nt, Homo sapiens
cacuaggcuggagugcaguggc

SEQ ID NO: 130764 - RNA, 18 nt, Homo sapiens
cacugagcccuucacucu

SEQ ID NO: 130765 - RNA, 22 nt, Homo sapiens
cacugcacuccaguuucgguaa

SEQ ID NO: 130766 - RNA, 22 nt, Homo sapiens
cacugcacuccaguuuggauga

SEQ ID NO: 130767 - RNA, 22 nt, Homo sapiens
cacugcaguguaauuaagguug

SEQ ID NO: 130768 - RNA, 22 nt, Homo sapiens
cacuggguuagaacaugcuccu

SEQ ID NO: 130769 - RNA, 21 nt, Homo sapiens
cacuggguucaggcuugugga

SEQ ID NO: 130770 - RNA, 22 nt, Homo sapiens
cacuggucucauggcaugagag

SEQ ID NO: 130771 - RNA, 22 nt, Homo sapiens
cacuguggauggaacuauguga

SEQ ID NO: 130772 - RNA, 22 nt, Homo sapiens
cacuuugguucaccugaguuuc

SEQ ID NO: 130773 - RNA, 22 nt, Homo sapiens
cagacagugucccgagucccug

SEQ ID NO: 130774 - RNA, 22 nt, Homo sapiens
cagagguauugcaaaagccuag

SEQ ID NO: 130775 - RNA, 22 nt, Homo sapiens
cagauacucauggaacuggguu

SEQ ID NO: 130776 - RNA, 22 nt, Homo sapiens
cagauaguuguagauaugcagc

SEQ ID NO: 130777 - RNA, 22 nt, Homo sapiens
cagaugguggucccacagccca

SEQ ID NO: 130778 - RNA, 20 nt, Homo sapiens
cagcaaccugcucucuuccu

SEQ ID NO: 130779 - RNA, 22 nt, Homo sapiens
cagcccguaaucccagcacuuu

SEQ ID NO: 130780 - RNA, 22 nt, Homo sapiens
cagccggguggcuccuagggua

SEQ ID NO: 130781 - RNA, 22 nt, Homo sapiens
cagcuaguaauuuauugaagau

SEQ ID NO: 130782 - RNA, 20 nt, Homo sapiens
cagcuagugguaggagucgg

SEQ ID NO: 130783 - RNA, 22 nt, Homo sapiens
cagcugcuuuggaaaauauuuu

SEQ ID NO: 130784 - RNA, 22 nt, Homo sapiens
cagcugguggcaagaagacaga

SEQ ID NO: 130785 - RNA, 22 nt, Homo sapiens
cagcuggugggagcuggguucc

SEQ ID NO: 130786 - RNA, 22 nt, Homo sapiens
cagcuguguuauaaacuaccau

SEQ ID NO: 130787 - RNA, 22 nt, Homo sapiens
cagcuguuguuaugucugcagg

SEQ ID NO: 130788 - RNA, 22 nt, Homo sapiens
cagcuugugguauugcugguug

SEQ ID NO: 130789 - RNA, 22 nt, Homo sapiens
caggcaaggugaaguguacugg

SEQ ID NO: 130790 - RNA, 22 nt, Homo sapiens
caggcacgcuugggagacacac

SEQ ID NO: 130791 - RNA, 22 nt, Homo sapiens
caggcauuguccaugcugaagg

SEQ ID NO: 130792 - RNA, 20 nt, Homo sapiens
cagggcaaugaggagguaaa

SEQ ID NO: 130793 - RNA, 22 nt, Homo sapiens
cagguacuucugggcugagcag

SEQ ID NO: 130794 - RNA, 22 nt, Homo sapiens
cagguaguauuugguuacauaa

SEQ ID NO: 130795 - RNA, 22 nt, Homo sapiens
caguacaauguggaaaaggagu

SEQ ID NO: 130796 - RNA, 22 nt, Homo sapiens
cagugcauccauguucagcagu

SEQ ID NO: 130797 - RNA, 22 nt, Homo sapiens
cagugcaugacuguauauuauc

SEQ ID NO: 130798 - RNA, 22 nt, Homo sapiens
caguguuuuuaacaggugcccg

SEQ ID NO: 130799 - RNA, 22 nt, Homo sapiens
caguuguuuuaugacauaagau

SEQ ID NO: 130800 - RNA, 21 nt, Homo sapiens
cauaaugcuacuuauuuuaug

SEQ ID NO: 130801 - RNA, 19 nt, Homo sapiens
caucacagagucuuccauu

SEQ ID NO: 130802 - RNA, 22 nt, Homo sapiens
caucacaugcuuauuuuccuca

SEQ ID NO: 130803 - RNA, 22 nt, Homo sapiens
caucacuuugccuccgucucua

SEQ ID NO: 130804 - RNA, 22 nt, Homo sapiens
caucagauugagaucaucuaag

SEQ ID NO: 130805 - RNA, 22 nt, Homo sapiens
caucccugucgucaagucucug

SEQ ID NO: 130806 - RNA, 22 nt, Homo sapiens
caugaaagugagaaacuccugg

SEQ ID NO: 130807 - RNA, 23 nt, Homo sapiens
caugaacuaguuugcagccauga

SEQ ID NO: 130808 - RNA, 22 nt, Homo sapiens
caugacacauguuuaccuaugu

SEQ ID NO: 130809 - RNA, 22 nt, Homo sapiens
caugccacugcacgccauccug

SEQ ID NO: 130810 - RNA, 22 nt, Homo sapiens
cauggagcuaggcuugaucccu

SEQ ID NO: 130811 - RNA, 22 nt, Homo sapiens
cauggcacagagaauguguucu

SEQ ID NO: 130812 - RNA, 22 nt, Homo sapiens
cauggcauuugcagaguugaaa

SEQ ID NO: 130813 - RNA, 22 nt, Homo sapiens
caugggcacugacuugcauucg

SEQ ID NO: 130814 - RNA, 22 nt, Homo sapiens
caugguacugccacagaagagu

SEQ ID NO: 130815 - RNA, 19 nt, Homo sapiens
caugugcacuacuggcuuc

SEQ ID NO: 130816 - RNA, 22 nt, Homo sapiens
caugugcaugcuuucuuaugug

SEQ ID NO: 130817 - RNA, 22 nt, Homo sapiens
cauugcaauccagccugggcaa

SEQ ID NO: 130818 - RNA, 22 nt, Homo sapiens
cauugcacuccacuccugaaca

SEQ ID NO: 130819 - RNA, 22 nt, Homo sapiens
cauugcacuccagcccagguga

SEQ ID NO: 130820 - RNA, 22 nt, Homo sapiens
cauugcacuccagccuggccaa

SEQ ID NO: 130821 - RNA, 22 nt, Homo sapiens
cauugcacuccagcucugggcg

SEQ ID NO: 130822 - RNA, 22 nt, Homo sapiens
cauugcacuccagucugggcaa

SEQ ID NO: 130823 - RNA, 22 nt, Homo sapiens
cauugcacuccauccuuggcaa

SEQ ID NO: 130824 - RNA, 22 nt, Homo sapiens
cauugcacuccaucuugggcaa

SEQ ID NO: 130825 - RNA, 16 nt, Homo sapiens
cauugcacucuagccu

SEQ ID NO: 130826 - RNA, 22 nt, Homo sapiens
cauugcacuuagacaacuuuug

SEQ ID NO: 130827 - RNA, 22 nt, Homo sapiens
cauugcauuuucuuuguaccuu

SEQ ID NO: 130828 - RNA, 22 nt, Homo sapiens
cauugguuccaguuuguccuua

SEQ ID NO: 130829 - RNA, 22 nt, Homo sapiens
cauuguacauaaguauggagua

SEQ ID NO: 130830 - RNA, 22 nt, Homo sapiens
cauugucccucaaugucuauga

SEQ ID NO: 130831 - RNA, 22 nt, Homo sapiens
cauuugguggcuacagaguaac

SEQ ID NO: 130832 - RNA, 22 nt, Homo sapiens
ccaaaguauuuucacugauauc

SEQ ID NO: 130833 - RNA, 22 nt, Homo sapiens
ccacaaccuccauauccugggu

SEQ ID NO: 130834 - RNA, 22 nt, Homo sapiens
ccacaguggauuaaaguuacug

SEQ ID NO: 130835 - RNA, 22 nt, Homo sapiens
ccacugcacuccagcccggcaa

SEQ ID NO: 130836 - RNA, 22 nt, Homo sapiens
ccacugggcuagguguuuugga

SEQ ID NO: 130837 - RNA, 22 nt, Homo sapiens
ccacugugguaucugauacugg

SEQ ID NO: 130838 - RNA, 22 nt, Homo sapiens
ccaggguuccacgccuggcugu

SEQ ID NO: 130839 - RNA, 22 nt, Homo sapiens
ccaggguugagacccacugacu

SEQ ID NO: 130840 - RNA, 22 nt, Homo sapiens
ccaggguugcuuuagauucuga

SEQ ID NO: 130841 - RNA, 22 nt, Homo sapiens
ccaguauugaacacaaugaaag

SEQ ID NO: 130842 - RNA, 22 nt, Homo sapiens
ccagugcugugcaguguaugag

SEQ ID NO: 130843 - RNA, 22 nt, Homo sapiens
ccaguucaaugauauggaaacu

SEQ ID NO: 130844 - RNA, 22 nt, Homo sapiens
cuuuggcacuuccuaagugcca

SEQ ID NO: 130845 - RNA, 22 nt, Homo sapiens
cuuuggucaauugcugcgggga

SEQ ID NO: 130846 - RNA, 22 nt, Homo sapiens
cuuuggugagggauaaauuuca

SEQ ID NO: 130847 - RNA, 22 nt, Homo sapiens
cuuugguuaauaggauauggca

SEQ ID NO: 130848 - RNA, 19 nt, Homo sapiens
cuuugguugagcguguugg

SEQ ID NO: 130849 - RNA, 22 nt, Homo sapiens
cuuugguuuacuuggugcuagu

SEQ ID NO: 130850 - RNA, 22 nt, Homo sapiens
cuuuguguaggugccucuggcu

SEQ ID NO: 130851 - RNA, 22 nt, Homo sapiens
cuuuuacacugguggugggaau

SEQ ID NO: 130852 - RNA, 22 nt, Homo sapiens
cuuuuacacuguuggcaggauu

SEQ ID NO: 130853 - RNA, 23 nt, Homo sapiens
cuuuugcaaugugaucuugccac

SEQ ID NO: 130854 - RNA, 21 nt, Homo sapiens
cuuuugcacuccagccugggu

SEQ ID NO: 130855 - RNA, 22 nt, Homo sapiens
cuuuugugauucuucaguuacu

SEQ ID NO: 130856 - RNA, 22 nt, Homo sapiens
gaaaauccauccccagggagua

SEQ ID NO: 130857 - RNA, 22 nt, Homo sapiens
gaaagcuaaugacuuuggguga

SEQ ID NO: 130858 - RNA, 22 nt, Homo sapiens
gaaaguaauuaacgauuguugc

SEQ ID NO: 130859 - RNA, 22 nt, Homo sapiens
gaacugggguuggguugcgaua

SEQ ID NO: 130860 - RNA, 22 nt, Homo sapiens
gaagacauuuacaugggagacc

SEQ ID NO: 130861 - RNA, 22 nt, Homo sapiens
gaagguauauucuguuaaugcu

SEQ ID NO: 130862 - RNA, 22 nt, Homo sapiens
gaaggugcuuggugaaugcauu

SEQ ID NO: 130863 - RNA, 22 nt, Homo sapiens
gaagugcuuuuggacuaacagu

SEQ ID NO: 130864 - RNA, 17 nt, Homo sapiens
gaaguguuucagcagcu

SEQ ID NO: 130865 - RNA, 22 nt, Homo sapiens
gaauacugacuauuucaucugg

SEQ ID NO: 130866 - RNA, 22 nt, Homo sapiens
gaauagugcugcagcaaacaua

SEQ ID NO: 130867 - RNA, 22 nt, Homo sapiens
gaauagugcugcaguaaacaua

SEQ ID NO: 130868 - RNA, 22 nt, Homo sapiens
gaauagugcugcgauaaacaua

SEQ ID NO: 130869 - RNA, 22 nt, Homo sapiens
gaaugguaaacuuccaugacug

SEQ ID NO: 130870 - RNA, 22 nt, Homo sapiens
gaauugcacaaaaacugcuugu

SEQ ID NO: 130871 - RNA, 22 nt, Homo sapiens
gacacagugaagucucuacuug

SEQ ID NO: 130872 - RNA, 22 nt, Homo sapiens
gacaccauuucaguacuagguu

SEQ ID NO: 130873 - RNA, 22 nt, Homo sapiens
gacacugucuucugcucuuaaa

SEQ ID NO: 130874 - RNA, 22 nt, Homo sapiens
gacaguuucucaggcuuccuua

SEQ ID NO: 130875 - RNA, 22 nt, Homo sapiens
gacauguuuucauguauuugga

SEQ ID NO: 130876 - RNA, 21 nt, Homo sapiens
gaccccuagaucuuuuuccag

SEQ ID NO: 130877 - RNA, 22 nt, Homo sapiens
gaccuggugguccacccgccuu

SEQ ID NO: 130878 - RNA, 21 nt, Homo sapiens
gacuacaccaggaugcuaguu

SEQ ID NO: 130879 - RNA, 22 nt, Homo sapiens
gacucagucuuggauuuuuaau

SEQ ID NO: 130880 - RNA, 19 nt, Homo sapiens
gacuccagaguugugugcu

SEQ ID NO: 130881 - RNA, 18 nt, Homo sapiens
gacuccauuucagccaga

SEQ ID NO: 130882 - RNA, 22 nt, Homo sapiens
gacugaggaagcgcucucuccu

SEQ ID NO: 130883 - RNA, 22 nt, Homo sapiens
gacuggagcuguaugugguuac

SEQ ID NO: 130884 - RNA, 22 nt, Homo sapiens
gacuuugguaaacucgguggca

SEQ ID NO: 130885 - RNA, 22 nt, Homo sapiens
gagaacagagauaauuuuacuu

SEQ ID NO: 130886 - RNA, 22 nt, Homo sapiens
gagaacauacggcauuugguuu

SEQ ID NO: 130887 - RNA, 22 nt, Homo sapiens
gagaaccauuuggagaaaaagu

SEQ ID NO: 130888 - RNA, 20 nt, Homo sapiens
gagaacugagaugcguuuga

SEQ ID NO: 130889 - RNA, 22 nt, Homo sapiens
gagaacugagugugcuggcgga

SEQ ID NO: 130890 - RNA, 22 nt, Homo sapiens
gagaaugagaggggaaggccac

SEQ ID NO: 130891 - RNA, 22 nt, Homo sapiens
gagacggagucucgcucugucg

SEQ ID NO: 130892 - RNA, 22 nt, Homo sapiens
gagacggagucuugcucuguug

SEQ ID NO: 130893 - RNA, 22 nt, Homo sapiens
gagacugagucuugcccuguca

SEQ ID NO: 130894 - RNA, 22 nt, Homo sapiens
gagacugagucuugcuuuguca

SEQ ID NO: 130895 - RNA, 22 nt, Homo sapiens
gagagaguacuugauauaauuu

SEQ ID NO: 130896 - RNA, 22 nt, Homo sapiens
gagagcaugugcuggcaucagu

SEQ ID NO: 130897 - RNA, 22 nt, Homo sapiens
gagagguaguuuuuuggucguc

SEQ ID NO: 130898 - RNA, 22 nt, Homo sapiens
gagagugcuuggcaucugcuga

SEQ ID NO: 130899 - RNA, 22 nt, Homo sapiens
gagagugcuuuggguguaggcc

SEQ ID NO: 130900 - RNA, 22 nt, Homo sapiens
gagauagguauuucauuuaccc

SEQ ID NO: 130901 - RNA, 22 nt, Homo sapiens
gagauaguguggguacagcuau

SEQ ID NO: 130902 - RNA, 22 nt, Homo sapiens
gagaucaaguauucuccacuaa

SEQ ID NO: 130903 - RNA, 22 nt, Homo sapiens
gagaucaguuaaugaagugagc

SEQ ID NO: 130904 - RNA, 22 nt, Homo sapiens
gagaucauuaugucagggguca

SEQ ID NO: 130905 - RNA, 22 nt, Homo sapiens
gagaucauucugauccagaguc

SEQ ID NO: 130906 - RNA, 22 nt, Homo sapiens
gagaucauugugggccaagcug

SEQ ID NO: 130907 - RNA, 22 nt, Homo sapiens
gagauggugugcuguuggaagu

SEQ ID NO: 130908 - RNA, 22 nt, Homo sapiens
gagauguagucuugcccuguca

SEQ ID NO: 130909 - RNA, 22 nt, Homo sapiens
gagaugugugugauuauauaau

SEQ ID NO: 130910 - RNA, 22 nt, Homo sapiens
gagauucuucaauauuuauucu

SEQ ID NO: 130911 - RNA, 22 nt, Homo sapiens
gagcaaugagcugccugcugag

SEQ ID NO: 130912 - RNA, 22 nt, Homo sapiens
gagcacauaugacauuuucuuc

SEQ ID NO: 130913 - RNA, 22 nt, Homo sapiens
gagcacauguggagagucuggg

SEQ ID NO: 130914 - RNA, 18 nt, Homo sapiens
gagcaccuuuuuugcaga

SEQ ID NO: 130915 - RNA, 22 nt, Homo sapiens
gagcacugauuuauuuuugucu

SEQ ID NO: 130916 - RNA, 20 nt, Homo sapiens
gagcaucacaggccucugcu

SEQ ID NO: 130917 - RNA, 22 nt, Homo sapiens
gagccauggagaaaacagcuau

SEQ ID NO: 130918 - RNA, 22 nt, Homo sapiens
gagcuagggucaugcuacugca

SEQ ID NO: 130919 - RNA, 22 nt, Homo sapiens
gagcugaauugcugccauuugc

SEQ ID NO: 130920 - RNA, 20 nt, Homo sapiens
gagcugguguacugccgggc

SEQ ID NO: 130921 - RNA, 22 nt, Homo sapiens
gaggaaguagcuacugucuuuc

SEQ ID NO: 130922 - RNA, 22 nt, Homo sapiens
gaggaguauuuugucgaauguc

SEQ ID NO: 130923 - RNA, 22 nt, Homo sapiens
gaggagucagacugugcaaggu

SEQ ID NO: 130924 - RNA, 22 nt, Homo sapiens
gaggcagucugacccuuagcag

SEQ ID NO: 130925 - RNA, 22 nt, Homo sapiens
gagggcacugcuuuccuuucaa

SEQ ID NO: 130926 - RNA, 22 nt, Homo sapiens
gagguaagaaagucaguccuuc

SEQ ID NO: 130927 - RNA, 22 nt, Homo sapiens
gagguaagagaauaaacaguuu

SEQ ID NO: 130928 - RNA, 21 nt, Homo sapiens
gagguaccucauguaagugga

SEQ ID NO: 130929 - RNA, 21 nt, Homo sapiens
gagguagggauuaaagaccuc

SEQ ID NO: 130930 - RNA, 22 nt, Homo sapiens
gagguaggggccuuaaagaugc

SEQ ID NO: 130931 - RNA, 22 nt, Homo sapiens
gagguagguuugguuacaaaag

SEQ ID NO: 130932 - RNA, 22 nt, Homo sapiens
gagguaugauugacauauaaaa

SEQ ID NO: 130933 - RNA, 22 nt, Homo sapiens
gagguauggauaucuggagagg

SEQ ID NO: 130934 - RNA, 22 nt, Homo sapiens
gaggucauucugugguacccag

SEQ ID NO: 130935 - RNA, 22 nt, Homo sapiens
aaagugcugagucuaggcgggg

SEQ ID NO: 130936 - RNA, 22 nt, Homo sapiens
aaagugcugggauuggccgggc

SEQ ID NO: 130937 - RNA, 22 nt, Homo sapiens
aaagugcuuccuuuuugagggu

SEQ ID NO: 130938 - RNA, 22 nt, Homo sapiens
aaagugguuuuucagacuuuga

SEQ ID NO: 130939 - RNA, 22 nt, Homo sapiens
aaaguucuguugauagugcuga

SEQ ID NO: 130940 - RNA, 22 nt, Homo sapiens
aaauaacugucagguucuggaa

SEQ ID NO: 130941 - RNA, 22 nt, Homo sapiens
aaaugacuuuuuaugcagagua

SEQ ID NO: 130942 - RNA, 22 nt, Homo sapiens
aaaugcacaaagauuuugcacu

SEQ ID NO: 130943 - RNA, 22 nt, Homo sapiens
aaaugcaccacucuggugcagg

SEQ ID NO: 130944 - RNA, 22 nt, Homo sapiens
aaaugcaucauuaggugauuuu

SEQ ID NO: 130945 - RNA, 20 nt, Homo sapiens
aaaugcuguaauguuuggga

SEQ ID NO: 130946 - RNA, 22 nt, Homo sapiens
aaaugcuuucuuggaccauuug

SEQ ID NO: 130947 - RNA, 22 nt, Homo sapiens
aaauggauuaaguucacuugcu

SEQ ID NO: 130948 - RNA, 22 nt, Homo sapiens
aaauggcuuugaggguaggaca

SEQ ID NO: 130949 - RNA, 22 nt, Homo sapiens
aaaugggacugggguccuuuga

SEQ ID NO: 130950 - RNA, 22 nt, Homo sapiens
aaaugucauggaguguuucccc

SEQ ID NO: 130951 - RNA, 21 nt, Homo sapiens
aaaugugcuuuaguacccuca

SEQ ID NO: 130952 - RNA, 22 nt, Homo sapiens
aaauucaucaaaugguuuguau

SEQ ID NO: 130953 - RNA, 22 nt, Homo sapiens
aaauugcaaugcgaggcagagg

SEQ ID NO: 130954 - RNA, 22 nt, Homo sapiens
aacaccuugcgugggcgucaau

SEQ ID NO: 130955 - RNA, 22 nt, Homo sapiens
aacagauugcugagccccaccc

SEQ ID NO: 130956 - RNA, 20 nt, Homo sapiens
aacagcacugucugaagcuu

SEQ ID NO: 130957 - RNA, 22 nt, Homo sapiens
aacaggcuccuaggggugcacc

SEQ ID NO: 130958 - RNA, 22 nt, Homo sapiens
aacagucuccaguuguauccau

SEQ ID NO: 130959 - RNA, 22 nt, Homo sapiens
aacauagucaugggguaauguu

SEQ ID NO: 130960 - RNA, 15 nt, Homo sapiens
aaccuggaggagcuu

SEQ ID NO: 130961 - RNA, 22 nt, Homo sapiens
aaccuguggauuuugguaucug

SEQ ID NO: 130962 - RNA, 22 nt, Homo sapiens
aaccuuuagucagcucuuagga

SEQ ID NO: 130963 - RNA, 22 nt, Homo sapiens
aacuaugucaaauaaaaugagg

SEQ ID NO: 130964 - RNA, 22 nt, Homo sapiens
aacugcacuaggacagguuuuu

SEQ ID NO: 130965 - RNA, 22 nt, Homo sapiens
aacuggcacuacaucaagagcu

SEQ ID NO: 130966 - RNA, 22 nt, Homo sapiens
aacuggcauagccagacuucuc

SEQ ID NO: 130967 - RNA, 22 nt, Homo sapiens
aacuggucuuaugcaagcacua

SEQ ID NO: 130968 - RNA, 22 nt, Homo sapiens
aacuggucuuuggaggaggagg

SEQ ID NO: 130969 - RNA, 19 nt, Homo sapiens
aacuggugugagaugauau

SEQ ID NO: 130970 - RNA, 22 nt, Homo sapiens
aacuugcacuugauugagagcu

SEQ ID NO: 130971 - RNA, 21 nt, Homo sapiens
aagaaagcuggacuugccgcu

SEQ ID NO: 130972 - RNA, 22 nt, Homo sapiens
aagagagccagcugguauauuu

SEQ ID NO: 130973 - RNA, 22 nt, Homo sapiens
aagagagcuaugugcauaauua

SEQ ID NO: 130974 - RNA, 22 nt, Homo sapiens
aagagcucauccauaguuguca

SEQ ID NO: 130975 - RNA, 22 nt, Homo sapiens
aagagcucucuguagcauguga

SEQ ID NO: 130976 - RNA, 22 nt, Homo sapiens
aagagguaauaacaaagcuucu

SEQ ID NO: 130977 - RNA, 22 nt, Homo sapiens
aagagguagucugucccuuagc

SEQ ID NO: 130978 - RNA, 22 nt, Homo sapiens
aagagguuguaccuaaaguguu

SEQ ID NO: 130979 - RNA, 22 nt, Homo sapiens
aagaguaguaguggcacucucu

SEQ ID NO: 130980 - RNA, 22 nt, Homo sapiens
aagaucaucauagagggcauga

SEQ ID NO: 130981 - RNA, 22 nt, Homo sapiens
aagaugauguucuuuuucuuag

SEQ ID NO: 130982 - RNA, 22 nt, Homo sapiens
aagaugauguuguguuuucacu

SEQ ID NO: 130983 - RNA, 19 nt, Homo sapiens
aagaugauguuugggcuaa

SEQ ID NO: 130984 - RNA, 22 nt, Homo sapiens
aagaugcagaagcccagauguu

SEQ ID NO: 130985 - RNA, 22 nt, Homo sapiens
aagaugcagucauacuggagua

SEQ ID NO: 130986 - RNA, 22 nt, Homo sapiens
aagcaaacaucagcuugguuaa

SEQ ID NO: 130987 - RNA, 22 nt, Homo sapiens
aagcacccuuugucuggacaug

SEQ ID NO: 130988 - RNA, 22 nt, Homo sapiens
aagcagacauguucauuuugaa

SEQ ID NO: 130989 - RNA, 22 nt, Homo sapiens
aagcaggugucugugucuguaa

SEQ ID NO: 130990 - RNA, 22 nt, Homo sapiens
aagcaucacuggaggcagccau

SEQ ID NO: 130991 - RNA, 21 nt, Homo sapiens
aagcaugguguaucuuuccau

SEQ ID NO: 130992 - RNA, 22 nt, Homo sapiens
aagcccauuguaaguugaggag

SEQ ID NO: 130993 - RNA, 22 nt, Homo sapiens
aagcuggcuuucauugagugcu

SEQ ID NO: 130994 - RNA, 22 nt, Homo sapiens
aagcugugucuugucagcuacc

SEQ ID NO: 130995 - RNA, 22 nt, Homo sapiens
aaggaagcuagcaggaauuggu

SEQ ID NO: 130996 - RNA, 22 nt, Homo sapiens
aaggaaguaauuugguuuauag

SEQ ID NO: 130997 - RNA, 22 nt, Homo sapiens
aaggagcuaagagaucauacau

SEQ ID NO: 130998 - RNA, 22 nt, Homo sapiens
aaggaguagacaacauggcgcc

SEQ ID NO: 130999 - RNA, 22 nt, Homo sapiens
aaggaguaucuguuuucucacc

SEQ ID NO: 131000 - RNA, 22 nt, Homo sapiens
aaggaguauugaaugaccaagu

SEQ ID NO: 131001 - RNA, 22 nt, Homo sapiens
aaggagugugauucuucaguuu

SEQ ID NO: 131002 - RNA, 22 nt, Homo sapiens
aaggauuguaaaguugacaaau

SEQ ID NO: 131003 - RNA, 22 nt, Homo sapiens
aaggauuguaacaccaagguua

SEQ ID NO: 131004 - RNA, 22 nt, Homo sapiens
aaggcaugcaaagaacauuuua

SEQ ID NO: 131005 - RNA, 22 nt, Homo sapiens
aaggcaugcaguacguuucuau

SEQ ID NO: 131006 - RNA, 22 nt, Homo sapiens
aagggaauguuguggcugguug

SEQ ID NO: 131007 - RNA, 22 nt, Homo sapiens
aagggagcugcauaaucuugug

SEQ ID NO: 131008 - RNA, 22 nt, Homo sapiens
aagguggugucagagagcuuau

SEQ ID NO: 131009 - RNA, 22 nt, Homo sapiens
aagguguagucucuggauaagc

SEQ ID NO: 131010 - RNA, 22 nt, Homo sapiens
aaguaaacauugagagacaaga

SEQ ID NO: 131011 - RNA, 22 nt, Homo sapiens
aaguaauggaguuauuuuauga

SEQ ID NO: 131012 - RNA, 22 nt, Homo sapiens
aaguagugcuugugcucaucuc

SEQ ID NO: 131013 - RNA, 22 nt, Homo sapiens
aaguauguaucaagucauacuu

SEQ ID NO: 131014 - RNA, 22 nt, Homo sapiens
aaguauuaagacuaagaggcuu

SEQ ID NO: 131015 - RNA, 22 nt, Homo sapiens
aagucaguuugggagaagcuau

SEQ ID NO: 131016 - RNA, 22 nt, Homo sapiens
aagucaugaagaggaaaggaca

SEQ ID NO: 131017 - RNA, 22 nt, Homo sapiens
aagugaaugugcuggaauagcu

SEQ ID NO: 131018 - RNA, 22 nt, Homo sapiens
aagugaauguuugguagcagug

SEQ ID NO: 131019 - RNA, 22 nt, Homo sapiens
aagugaauucauuguguuauau

SEQ ID NO: 131020 - RNA, 22 nt, Homo sapiens
aagugaccuaacaaugaaggcc

SEQ ID NO: 131021 - RNA, 22 nt, Homo sapiens
aagugacuagacuaugaaaccu

SEQ ID NO: 131022 - RNA, 22 nt, Homo sapiens
aagugaguaauacgucaguugu

SEQ ID NO: 131023 - RNA, 22 nt, Homo sapiens
aagugcaaaucuguggcugaaa

SEQ ID NO: 131024 - RNA, 20 nt, Homo sapiens
aagugcaucguugugucugc

SEQ ID NO: 131025 - RNA, 22 nt, Homo sapiens
aagugcucuugaaacugucuua

SEQ ID NO: 131026 - RNA, 22 nt, Homo sapiens
agcaaccagaggagaugaggcu

SEQ ID NO: 131027 - RNA, 22 nt, Homo sapiens
agcaaccuugaauagcccuuuc

SEQ ID NO: 131028 - RNA, 22 nt, Homo sapiens
agcacagugguuaaguuucuua

SEQ ID NO: 131029 - RNA, 22 nt, Homo sapiens
agcacaguuaaaugaggcuucu

SEQ ID NO: 131030 - RNA, 22 nt, Homo sapiens
agcaccacaauuuccugccuaa

SEQ ID NO: 131031 - RNA, 17 nt, Homo sapiens
agcaccacacucucuug

SEQ ID NO: 131032 - RNA, 22 nt, Homo sapiens
agcacgaaaccaaauucuguga

SEQ ID NO: 131033 - RNA, 22 nt, Homo sapiens
agcagauguuuagugagcgccu

SEQ ID NO: 131034 - RNA, 22 nt, Homo sapiens
agcagcaucgggaaguuggcca

SEQ ID NO: 131035 - RNA, 22 nt, Homo sapiens
agcagcaugcaaauggacuaau

SEQ ID NO: 131036 - RNA, 22 nt, Homo sapiens
agcagcauggguauaaaucucc

SEQ ID NO: 131037 - RNA, 22 nt, Homo sapiens
agcagcauuaugauauaucuua

SEQ ID NO: 131038 - RNA, 22 nt, Homo sapiens
agcagcgacacccuguggugag

SEQ ID NO: 131039 - RNA, 22 nt, Homo sapiens
agcagcucaagacuuaaauuug

SEQ ID NO: 131040 - RNA, 22 nt, Homo sapiens
agcagguauuuaagaaacucag

SEQ ID NO: 131041 - RNA, 22 nt, Homo sapiens
agcaucacaugggcugcuuggg

SEQ ID NO: 131042 - RNA, 16 nt, Homo sapiens
agccaccauuuacuug

SEQ ID NO: 131043 - RNA, 22 nt, Homo sapiens
agccaguauuuuauugaggauu

SEQ ID NO: 131044 - RNA, 22 nt, Homo sapiens
agccaguauuuugaguuggucu

SEQ ID NO: 131045 - RNA, 22 nt, Homo sapiens
agcccuuagauggcuccuucca

SEQ ID NO: 131046 - RNA, 22 nt, Homo sapiens
agccuguagugagcugugauug

SEQ ID NO: 131047 - RNA, 22 nt, Homo sapiens
agccuguguugaauuauagaaa

SEQ ID NO: 131048 - RNA, 22 nt, Homo sapiens
agccuucauucugacaguagga

SEQ ID NO: 131049 - RNA, 21 nt, Homo sapiens
agcuaaauuggaaauuucugu

SEQ ID NO: 131050 - RNA, 22 nt, Homo sapiens
agcuaacauuuuuccucuucca

SEQ ID NO: 131051 - RNA, 23 nt, Homo sapiens
agcuagagaggcuggggauacag

SEQ ID NO: 131052 - RNA, 22 nt, Homo sapiens
agcuauauugaggaugccauuc

SEQ ID NO: 131053 - RNA, 21 nt, Homo sapiens
agcuccacucguucccaaagc

SEQ ID NO: 131054 - RNA, 22 nt, Homo sapiens
agcuccuacuguuacaucauug

SEQ ID NO: 131055 - RNA, 22 nt, Homo sapiens
agcuccuuucugcaggcagguc

SEQ ID NO: 131056 - RNA, 22 nt, Homo sapiens
agcucuuguuaguauuagcagu

SEQ ID NO: 131057 - RNA, 22 nt, Homo sapiens
agcugauuuuaaguccuugucc

SEQ ID NO: 131058 - RNA, 20 nt, Homo sapiens
agcugcagauauaaauccgc

SEQ ID NO: 131059 - RNA, 22 nt, Homo sapiens
agcugcauuuacuuuugcacaa

SEQ ID NO: 131060 - RNA, 22 nt, Homo sapiens
agcuggacuugauaaaugaaua

SEQ ID NO: 131061 - RNA, 22 nt, Homo sapiens
agcuggcuguggagaaaccccu

SEQ ID NO: 131062 - RNA, 22 nt, Homo sapiens
agcugguauuuguuagggaguu

SEQ ID NO: 131063 - RNA, 22 nt, Homo sapiens
agcugguuuauuucuauauccu

SEQ ID NO: 131064 - RNA, 22 nt, Homo sapiens
agcugguuuauuucucacaaca

SEQ ID NO: 131065 - RNA, 22 nt, Homo sapiens
agcuguguugucugaagucaga

SEQ ID NO: 131066 - RNA, 22 nt, Homo sapiens
agcuguuguucucagaggcuuu

SEQ ID NO: 131067 - RNA, 22 nt, Homo sapiens
agcuucauuccaacuuccuucu

SEQ ID NO: 131068 - RNA, 22 nt, Homo sapiens
agcuugucuuauacuacuucau

SEQ ID NO: 131069 - RNA, 22 nt, Homo sapiens
agcuugugcuguaugaagggcc

SEQ ID NO: 131070 - RNA, 22 nt, Homo sapiens
aggaaaucuuagcugaggggau

SEQ ID NO: 131071 - RNA, 22 nt, Homo sapiens
aggaagacugaaauugcuguuc

SEQ ID NO: 131072 - RNA, 16 nt, Homo sapiens
aggaagacuuagagau

SEQ ID NO: 131073 - RNA, 22 nt, Homo sapiens
aggaaguaauaaguuugguucu

SEQ ID NO: 131074 - RNA, 23 nt, Homo sapiens
aggaauggaaaaccaaguaucau

SEQ ID NO: 131075 - RNA, 22 nt, Homo sapiens
aggacacugagcaugggagguu

SEQ ID NO: 131076 - RNA, 22 nt, Homo sapiens
aggagaauugguucuucuugau

SEQ ID NO: 131077 - RNA, 22 nt, Homo sapiens
aggagaucagccucccugcaac

SEQ ID NO: 131078 - RNA, 20 nt, Homo sapiens
aggagcauuuacauuggcuc

SEQ ID NO: 131079 - RNA, 22 nt, Homo sapiens
aggagcuuuggggaaaacagau

SEQ ID NO: 131080 - RNA, 21 nt, Homo sapiens
aggcaaaugaagcagccgcuc

SEQ ID NO: 131081 - RNA, 16 nt, Homo sapiens
aggcaagaauugaggu

SEQ ID NO: 131082 - RNA, 22 nt, Homo sapiens
aggcacggugucucaugccugu

SEQ ID NO: 131083 - RNA, 22 nt, Homo sapiens
aggcagcuguuauauacugagu

SEQ ID NO: 131084 - RNA, 22 nt, Homo sapiens
aggcagucucugccggcugagg

SEQ ID NO: 131085 - RNA, 22 nt, Homo sapiens
aggcaugaguucagaggguaug

SEQ ID NO: 131086 - RNA, 22 nt, Homo sapiens
aggcaugguggcacauacaugu

SEQ ID NO: 131087 - RNA, 22 nt, Homo sapiens
aggcaugugugcagacugucug

SEQ ID NO: 131088 - RNA, 22 nt, Homo sapiens
aggcuuauuaagauucccuuau

SEQ ID NO: 131089 - RNA, 22 nt, Homo sapiens
aggcuuuuggagaacacugcac

SEQ ID NO: 131090 - RNA, 22 nt, Homo sapiens
agggaauguaaguuuuaugaga

SEQ ID NO: 131091 - RNA, 22 nt, Homo sapiens
agggagcaaaguggucuuucuc

SEQ ID NO: 131092 - RNA, 22 nt, Homo sapiens
aggguaguaggcuugggauugg

SEQ ID NO: 131093 - RNA, 22 nt, Homo sapiens
agguaaguauguuauuacuuuu

SEQ ID NO: 131094 - RNA, 22 nt, Homo sapiens
agguaagucucuaauuaugaau

SEQ ID NO: 131095 - RNA, 22 nt, Homo sapiens
agguaauuuuaucauuauguga

SEQ ID NO: 131096 - RNA, 22 nt, Homo sapiens
agguacuugagauucugaacug

SEQ ID NO: 131097 - RNA, 22 nt, Homo sapiens
agguagguugagaugggcauca

SEQ ID NO: 131098 - RNA, 22 nt, Homo sapiens
agguagucuuuuccuauuguca

SEQ ID NO: 131099 - RNA, 22 nt, Homo sapiens
agguaguguuauuugcagcuga

SEQ ID NO: 131100 - RNA, 20 nt, Homo sapiens
agguaguuauacaaaugugu

SEQ ID NO: 131101 - RNA, 22 nt, Homo sapiens
agguauguaugucuguacagcg

SEQ ID NO: 131102 - RNA, 22 nt, Homo sapiens
agguauuuucaacuuagaaugg

SEQ ID NO: 131103 - RNA, 21 nt, Homo sapiens
aggucaugaagauguucuaau

SEQ ID NO: 131104 - RNA, 22 nt, Homo sapiens
aggugaaugcucacauucuaau

SEQ ID NO: 131105 - RNA, 22 nt, Homo sapiens
aggugcacucagaaaacagaua

SEQ ID NO: 131106 - RNA, 22 nt, Homo sapiens
aggugcucuuccuguaggucac

SEQ ID NO: 131107 - RNA, 22 nt, Homo sapiens
aggugcuugaaucuaugagcuc

SEQ ID NO: 131108 - RNA, 22 nt, Homo sapiens
aggugguguuggguuccagccc

SEQ ID NO: 131109 - RNA, 22 nt, Homo sapiens
aggugguuuuaggcagagacau

SEQ ID NO: 131110 - RNA, 22 nt, Homo sapiens
aggugguuuugaugagcaggua

SEQ ID NO: 131111 - RNA, 23 nt, Homo sapiens
agguuaugauuauagagcgagga

SEQ ID NO: 131112 - RNA, 20 nt, Homo sapiens
agguucaaaucccaaucaug

SEQ ID NO: 131113 - RNA, 22 nt, Homo sapiens
aguaaacuucagaguucuuccu

SEQ ID NO: 131114 - RNA, 22 nt, Homo sapiens
aguaaagcaucagcuagaugug

SEQ ID NO: 131115 - RNA, 22 nt, Homo sapiens
aguaacacaccugcauggugug

SEQ ID NO: 131116 - RNA, 22 nt, Homo sapiens
aguacacuguuaaaaagaagug

SEQ ID NO: 131117 - RNA, 20 nt, Homo sapiens
gugagucauuaguaaccaaa

SEQ ID NO: 131118 - RNA, 22 nt, Homo sapiens
gugaguuauuauuuauguaaac

SEQ ID NO: 131119 - RNA, 22 nt, Homo sapiens
gugauaucugagccugccccag

SEQ ID NO: 131120 - RNA, 21 nt, Homo sapiens
gugaucaugucacugcacucc

SEQ ID NO: 131121 - RNA, 22 nt, Homo sapiens
gugaucauuguauugggguuau

SEQ ID NO: 131122 - RNA, 22 nt, Homo sapiens
gugaugcaguacguagaggaga

SEQ ID NO: 131123 - RNA, 22 nt, Homo sapiens
gugauuauuaugcacugcaugc

SEQ ID NO: 131124 - RNA, 22 nt, Homo sapiens
gugcaaaucucugaguaucuuu

SEQ ID NO: 131125 - RNA, 22 nt, Homo sapiens
gugcaaauguuauugagguuuu

SEQ ID NO: 131126 - RNA, 22 nt, Homo sapiens
gugcaaauuccagcucaacucc

SEQ ID NO: 131127 - RNA, 22 nt, Homo sapiens
gugcaacaucccuccauaauuu

SEQ ID NO: 131128 - RNA, 22 nt, Homo sapiens
gugcaaguguaauacagcuagg

SEQ ID NO: 131129 - RNA, 22 nt, Homo sapiens
gugcacaacgugcaaguuuguu

SEQ ID NO: 131130 - RNA, 22 nt, Homo sapiens
gugcacaucgugcagguuuguu

SEQ ID NO: 131131 - RNA, 22 nt, Homo sapiens
gugcacaugcgugcgcacauau

SEQ ID NO: 131132 - RNA, 22 nt, Homo sapiens
gugcacauuguuuaugucuguu

SEQ ID NO: 131133 - RNA, 22 nt, Homo sapiens
gugcauauaaguuguuucuagu

SEQ ID NO: 131134 - RNA, 22 nt, Homo sapiens
gugcauaucugugguuggcuga

SEQ ID NO: 131135 - RNA, 22 nt, Homo sapiens
gugcaugucugugacgacccug

SEQ ID NO: 131136 - RNA, 22 nt, Homo sapiens
gugcuuguauuuaaaucaugug

SEQ ID NO: 131137 - RNA, 22 nt, Homo sapiens
guggaaaucucugugugacuua

SEQ ID NO: 131138 - RNA, 22 nt, Homo sapiens
guggaagaccagacuuuccaac

SEQ ID NO: 131139 - RNA, 20 nt, Homo sapiens
guggaagauaaguagccuga

SEQ ID NO: 131140 - RNA, 22 nt, Homo sapiens
guggaaucuagagaggcaguag

SEQ ID NO: 131141 - RNA, 22 nt, Homo sapiens
guggaaugaaaacucucucaca

SEQ ID NO: 131142 - RNA, 22 nt, Homo sapiens
guggaaugcaguguugauucaa

SEQ ID NO: 131143 - RNA, 22 nt, Homo sapiens
guggaauuauagagacaucuug

SEQ ID NO: 131144 - RNA, 22 nt, Homo sapiens
guggacggagguugcagugagc

SEQ ID NO: 131145 - RNA, 22 nt, Homo sapiens
guggcaaagaugccuucuccaa

SEQ ID NO: 131146 - RNA, 22 nt, Homo sapiens
guggcacgaugaucugggcuca

SEQ ID NO: 131147 - RNA, 22 nt, Homo sapiens
guggcagugugaggauccugcu

SEQ ID NO: 131148 - RNA, 22 nt, Homo sapiens
guggcauuucccaaaguauucu

SEQ ID NO: 131149 - RNA, 23 nt, Homo sapiens
guggccuuuggccaguccgaguc

SEQ ID NO: 131150 - RNA, 22 nt, Homo sapiens
guggcuauucaccuuuaugaaa

SEQ ID NO: 131151 - RNA, 22 nt, Homo sapiens
guggcuauuguucccugguugc

SEQ ID NO: 131152 - RNA, 22 nt, Homo sapiens
gugggaagcuggaacucccucc

SEQ ID NO: 131153 - RNA, 22 nt, Homo sapiens
gugggaugcaaguaaaauuguc

SEQ ID NO: 131154 - RNA, 22 nt, Homo sapiens
gugggauggaaaugggcuucag

SEQ ID NO: 131155 - RNA, 22 nt, Homo sapiens
gugggauggagagaagguauga

SEQ ID NO: 131156 - RNA, 22 nt, Homo sapiens
gugggguaggcaauuccuagug

SEQ ID NO: 131157 - RNA, 22 nt, Homo sapiens
gugggguaggugacuugaugag

SEQ ID NO: 131158 - RNA, 22 nt, Homo sapiens
gugguagaaaguaccaaacuag

SEQ ID NO: 131159 - RNA, 22 nt, Homo sapiens
gugguaucauuuaaccauuaga

SEQ ID NO: 131160 - RNA, 21 nt, Homo sapiens
gugguucuagagaaacagaau

SEQ ID NO: 131161 - RNA, 22 nt, Homo sapiens
gugguucuagagggacagaaug

SEQ ID NO: 131162 - RNA, 22 nt, Homo sapiens
gugguuuuuaaaguaccugugg

SEQ ID NO: 131163 - RNA, 22 nt, Homo sapiens
gugguuuuuuucugccuuauag

SEQ ID NO: 131164 - RNA, 22 nt, Homo sapiens
guguaaaucaaucuguugucuu

SEQ ID NO: 131165 - RNA, 22 nt, Homo sapiens
guguaaaugagugcugaaggag

SEQ ID NO: 131166 - RNA, 22 nt, Homo sapiens
guguagagaaaaguaccauuuu

SEQ ID NO: 131167 - RNA, 22 nt, Homo sapiens
guguauauccuauuaguucugu

SEQ ID NO: 131168 - RNA, 18 nt, Homo sapiens
guguauggauggaggcca

SEQ ID NO: 131169 - RNA, 22 nt, Homo sapiens
gugucaaggaugccugucaggc

SEQ ID NO: 131170 - RNA, 22 nt, Homo sapiens
gugugacuagucaugccugaau

SEQ ID NO: 131171 - RNA, 22 nt, Homo sapiens
gugugcaugucuuuuuaguagg

SEQ ID NO: 131172 - RNA, 22 nt, Homo sapiens
guguggaacucaauacaacgca

SEQ ID NO: 131173 - RNA, 22 nt, Homo sapiens
gugugucuugaccaggaucgga

SEQ ID NO: 131174 - RNA, 22 nt, Homo sapiens
guguucauggaauuugcaauug

SEQ ID NO: 131175 - RNA, 22 nt, Homo sapiens
guuaaagacauccacauaggag

SEQ ID NO: 131176 - RNA, 22 nt, Homo sapiens
guuagcuaguagacaauuuucc

SEQ ID NO: 131177 - RNA, 22 nt, Homo sapiens
guuagugcuuauuaaauaguau

SEQ ID NO: 131178 - RNA, 22 nt, Homo sapiens
guuauccugucuuuacauacaa

SEQ ID NO: 131179 - RNA, 22 nt, Homo sapiens
guuauguaucuugauugggugg

SEQ ID NO: 131180 - RNA, 22 nt, Homo sapiens
guuauguguuuccuuaauugcu

SEQ ID NO: 131181 - RNA, 21 nt, Homo sapiens
guucaagugauccuccugucu

SEQ ID NO: 131182 - RNA, 22 nt, Homo sapiens
guucaagugauucuacugccuc

SEQ ID NO: 131183 - RNA, 22 nt, Homo sapiens
guucacacuugcaaccccagca

SEQ ID NO: 131184 - RNA, 22 nt, Homo sapiens
guucacaguucagccuguaaca

SEQ ID NO: 131185 - RNA, 22 nt, Homo sapiens
guucagcaggggcuucaauggu

SEQ ID NO: 131186 - RNA, 22 nt, Homo sapiens
guucagguauucuggaacagag

SEQ ID NO: 131187 - RNA, 22 nt, Homo sapiens
guucaucaggaauauuggccua

SEQ ID NO: 131188 - RNA, 17 nt, Homo sapiens
guucccaguggcauuug

SEQ ID NO: 131189 - RNA, 22 nt, Homo sapiens
guucucacuggacugugaaaau

SEQ ID NO: 131190 - RNA, 22 nt, Homo sapiens
guugaacaauagauucauauca

SEQ ID NO: 131191 - RNA, 22 nt, Homo sapiens
guugcugagucccaucaccaga

SEQ ID NO: 131192 - RNA, 22 nt, Homo sapiens
guugcuuauuccuguaauccca

SEQ ID NO: 131193 - RNA, 22 nt, Homo sapiens
guugggcccauagacugccagu

SEQ ID NO: 131194 - RNA, 22 nt, Homo sapiens
guuggucaaugugauuaggcca

SEQ ID NO: 131195 - RNA, 22 nt, Homo sapiens
guuggucucguauaaaucaagg

SEQ ID NO: 131196 - RNA, 22 nt, Homo sapiens
guuuacagucgacuugggaaua

SEQ ID NO: 131197 - RNA, 22 nt, Homo sapiens
guuuaggaaugagaauauuuag

SEQ ID NO: 131198 - RNA, 22 nt, Homo sapiens
guuugccuuuuagauaggaaug

SEQ ID NO: 131199 - RNA, 22 nt, Homo sapiens
guuuggcuuucucucuauccug

SEQ ID NO: 131200 - RNA, 22 nt, Homo sapiens
guuugguugcauggaaaauuua

SEQ ID NO: 131201 - RNA, 22 nt, Homo sapiens
guuugugguuaaagccuuucau

SEQ ID NO: 131202 - RNA, 22 nt, Homo sapiens
guuuugguuauauggaucaguu

SEQ ID NO: 131203 - RNA, 21 nt, Homo sapiens
uaaaacuguaacuuuguccug

SEQ ID NO: 131204 - RNA, 22 nt, Homo sapiens
uaaacugcuugaaaugguguca

SEQ ID NO: 131205 - RNA, 22 nt, Homo sapiens
uaaacugucuugcaguuacaug

SEQ ID NO: 131206 - RNA, 22 nt, Homo sapiens
uaaagaugcugggaaggcuagg

SEQ ID NO: 131207 - RNA, 22 nt, Homo sapiens
uaaagcacuuuuuucugcaugg

SEQ ID NO: 131208 - RNA, 23 nt, Homo sapiens
uaugacagaggaagggggagcug

SEQ ID NO: 131209 - RNA, 22 nt, Homo sapiens
uaugacauaguccuuaacccuc

SEQ ID NO: 131210 - RNA, 22 nt, Homo sapiens
uaugaccuuggacaaguuacuu

SEQ ID NO: 131211 - RNA, 22 nt, Homo sapiens
uaugagacugguuaauuuuugu

SEQ ID NO: 131212 - RNA, 22 nt, Homo sapiens
uaugccuuucucacuaagcuua

SEQ ID NO: 131213 - RNA, 22 nt, Homo sapiens
uaugcuuauaaacauuugucag

SEQ ID NO: 131214 - RNA, 22 nt, Homo sapiens
uauggaaaucuuaccuuauggu

SEQ ID NO: 131215 - RNA, 22 nt, Homo sapiens
uauggcauuauuuugauagaca

SEQ ID NO: 131216 - RNA, 22 nt, Homo sapiens
uauggcuucuauaaggaagcuu

SEQ ID NO: 131217 - RNA, 22 nt, Homo sapiens
uauggcuucuuuaaauugaggu

SEQ ID NO: 131218 - RNA, 22 nt, Homo sapiens
uauggcuuucuacuugaguucu

SEQ ID NO: 131219 - RNA, 22 nt, Homo sapiens
uaugggcuuuguuuuguacuag

SEQ ID NO: 131220 - RNA, 21 nt, Homo sapiens
uaugguuucuaauucugcagg

SEQ ID NO: 131221 - RNA, 22 nt, Homo sapiens
uaugucuuuugcuugcaaauag

SEQ ID NO: 131222 - RNA, 22 nt, Homo sapiens
uaugugcaaauuaauugcuaga

SEQ ID NO: 131223 - RNA, 22 nt, Homo sapiens
uaugugcacaugcccuggugac

SEQ ID NO: 131224 - RNA, 22 nt, Homo sapiens
uaugugguuaauaggaauuugu

SEQ ID NO: 131225 - RNA, 22 nt, Homo sapiens
uauuacagaccauaucgccggg

SEQ ID NO: 131226 - RNA, 20 nt, Homo sapiens
uauuacagaguaauggugga

SEQ ID NO: 131227 - RNA, 22 nt, Homo sapiens
uauuacuguuauuccuaucaaa

SEQ ID NO: 131228 - RNA, 22 nt, Homo sapiens
uauuacuugucugugucucaau

SEQ ID NO: 131229 - RNA, 22 nt, Homo sapiens
uauuagugccuaagucuuaggg

SEQ ID NO: 131230 - RNA, 20 nt, Homo sapiens
uauucacucuccagucuugc

SEQ ID NO: 131231 - RNA, 22 nt, Homo sapiens
uauuccacuauuaguccagaug

SEQ ID NO: 131232 - RNA, 22 nt, Homo sapiens
uauugaauuugagcugucucuu

SEQ ID NO: 131233 - RNA, 17 nt, Homo sapiens
uauugaccuuuguaugu

SEQ ID NO: 131234 - RNA, 22 nt, Homo sapiens
uauugacuuuuuuguuaggagg

SEQ ID NO: 131235 - RNA, 22 nt, Homo sapiens
uauugcacaugaggagacauug

SEQ ID NO: 131236 - RNA, 20 nt, Homo sapiens
uauugcacuccagucugggc

SEQ ID NO: 131237 - RNA, 22 nt, Homo sapiens
uauugcagugagauccaucugg

SEQ ID NO: 131238 - RNA, 22 nt, Homo sapiens
uauugcauauuauucuaguggc

SEQ ID NO: 131239 - RNA, 22 nt, Homo sapiens
uauugccuugccuacuuuucca

SEQ ID NO: 131240 - RNA, 22 nt, Homo sapiens
uauugcuggcucugucuucauu

SEQ ID NO: 131241 - RNA, 22 nt, Homo sapiens
uauuucccuuaacuuuccugca

SEQ ID NO: 131242 - RNA, 22 nt, Homo sapiens
uauuuguccccuccaaaaguca

SEQ ID NO: 131243 - RNA, 22 nt, Homo sapiens
ucaaacugcuugaggccauuua

SEQ ID NO: 131244 - RNA, 22 nt, Homo sapiens
ucaaagacacacaaggagaagg

SEQ ID NO: 131245 - RNA, 22 nt, Homo sapiens
ucaaaguauucuucugagaacc

SEQ ID NO: 131246 - RNA, 22 nt, Homo sapiens
ucaaagucuucucaaguaacau

SEQ ID NO: 131247 - RNA, 22 nt, Homo sapiens
ucaaagugagcuccuucucacu

SEQ ID NO: 131248 - RNA, 22 nt, Homo sapiens
ucaaaugcacguagagaaaaua

SEQ ID NO: 131249 - RNA, 22 nt, Homo sapiens
ucaaaugcuguauuguaguaau

SEQ ID NO: 131250 - RNA, 22 nt, Homo sapiens
ucaacacaguuaaauggggaaa

SEQ ID NO: 131251 - RNA, 22 nt, Homo sapiens
ucaacagugauggaaaguuaua

SEQ ID NO: 131252 - RNA, 22 nt, Homo sapiens
ucaagcaauucuccucucagcc

SEQ ID NO: 131253 - RNA, 18 nt, Homo sapiens
ucaagcaauugucaugcc

SEQ ID NO: 131254 - RNA, 20 nt, Homo sapiens
ucaaggcacgaauaaaaguu

SEQ ID NO: 131255 - RNA, 22 nt, Homo sapiens
ucaaggcaguggccuuccuucu

SEQ ID NO: 131256 - RNA, 22 nt, Homo sapiens
ucaagguacguugccucagauu

SEQ ID NO: 131257 - RNA, 22 nt, Homo sapiens
ucaaguaauacucccaucuugg

SEQ ID NO: 131258 - RNA, 22 nt, Homo sapiens
ucaaguacuuauuugauaauua

SEQ ID NO: 131259 - RNA, 22 nt, Homo sapiens
ucaagugauucuugugccuuag

SEQ ID NO: 131260 - RNA, 22 nt, Homo sapiens
ucaaugcaaccuccaccucugg

SEQ ID NO: 131261 - RNA, 22 nt, Homo sapiens
ucaauugcaucaacaguguaca

SEQ ID NO: 131262 - RNA, 22 nt, Homo sapiens
ucacaauucucaauuugugaaa

SEQ ID NO: 131263 - RNA, 22 nt, Homo sapiens
ucacaccauucuucuacuucag

SEQ ID NO: 131264 - RNA, 22 nt, Homo sapiens
ucacagacugagccaaauagag

SEQ ID NO: 131265 - RNA, 22 nt, Homo sapiens
ucacagaugaggcgagaggcag

SEQ ID NO: 131266 - RNA, 18 nt, Homo sapiens
ucacagguaauuaggauu

SEQ ID NO: 131267 - RNA, 22 nt, Homo sapiens
ucacaguaacuuuguugcuuuu

SEQ ID NO: 131268 - RNA, 20 nt, Homo sapiens
ucacagucacacauaauccu

SEQ ID NO: 131269 - RNA, 22 nt, Homo sapiens
ucacagucacugucacguugaa

SEQ ID NO: 131270 - RNA, 22 nt, Homo sapiens
ucacaguccuguuuaggagagg

SEQ ID NO: 131271 - RNA, 22 nt, Homo sapiens
ucacagucuccucuagggaggg

SEQ ID NO: 131272 - RNA, 23 nt, Homo sapiens
ucacaguggcugcuuaauuguga

SEQ ID NO: 131273 - RNA, 22 nt, Homo sapiens
ucacaguguuaaaccuuucuuu

SEQ ID NO: 131274 - RNA, 20 nt, Homo sapiens
ucacauccucucccaacaug

SEQ ID NO: 131275 - RNA, 22 nt, Homo sapiens
ucacaugucagccguggggaag

SEQ ID NO: 131276 - RNA, 22 nt, Homo sapiens
ucacaugugcguuuuggcaugu

SEQ ID NO: 131277 - RNA, 22 nt, Homo sapiens
ucaccaguacuccaaauugagg

SEQ ID NO: 131278 - RNA, 22 nt, Homo sapiens
ucacccacacaggagacaggga

SEQ ID NO: 131279 - RNA, 16 nt, Homo sapiens
ucaccccuagagaucc

SEQ ID NO: 131280 - RNA, 22 nt, Homo sapiens
ucaccuuacuugcuucugaacu

SEQ ID NO: 131281 - RNA, 18 nt, Homo sapiens
ucaccuugaugcuggguc

SEQ ID NO: 131282 - RNA, 22 nt, Homo sapiens
ucaccuugcacaguuguguggg

SEQ ID NO: 131283 - RNA, 19 nt, Homo sapiens
ucacgugcagcagccacac

SEQ ID NO: 131284 - RNA, 23 nt, Homo sapiens
ucacuagaguccuggaguuugag

SEQ ID NO: 131285 - RNA, 22 nt, Homo sapiens
ucacugaaaccacugccuccug

SEQ ID NO: 131286 - RNA, 22 nt, Homo sapiens
ucacugaaaccgccuccaccuc

SEQ ID NO: 131287 - RNA, 22 nt, Homo sapiens
ucacugaaaccuccgccuucug

SEQ ID NO: 131288 - RNA, 22 nt, Homo sapiens
ucacugagcacaggagaugugc

SEQ ID NO: 131289 - RNA, 22 nt, Homo sapiens
ucacugagcuagaucacuugac

SEQ ID NO: 131290 - RNA, 20 nt, Homo sapiens
ucacugagugguccacagua

SEQ ID NO: 131291 - RNA, 22 nt, Homo sapiens
ucacugcacuagguaaugccac

SEQ ID NO: 131292 - RNA, 22 nt, Homo sapiens
ucacugcacuucaggcuuucuc

SEQ ID NO: 131293 - RNA, 19 nt, Homo sapiens
ucacuggacagcacacuca

SEQ ID NO: 131294 - RNA, 22 nt, Homo sapiens
ucacuggagguuccugaaguuc

SEQ ID NO: 131295 - RNA, 22 nt, Homo sapiens
ucacuggcaaauauauccguug

SEQ ID NO: 131296 - RNA, 20 nt, Homo sapiens
ucacuggguucuugaagucu

SEQ ID NO: 131297 - RNA, 22 nt, Homo sapiens
ucacugugugucucuguaucug

SEQ ID NO: 131298 - RNA, 18 nt, Homo sapiens
ucacugugugucuugggu

SEQ ID NO: 131299 - RNA, 22 nt, Homo sapiens
ucacuuugacggccaacuucua

SEQ ID NO: 131300 - RNA, 22 nt, Homo sapiens
ugaauagaaguuuacuccuuuu

SEQ ID NO: 131301 - RNA, 22 nt, Homo sapiens
ugaauagacacuaaagacugua

SEQ ID NO: 131302 - RNA, 22 nt, Homo sapiens
ugaauagagcugcaguggacau

SEQ ID NO: 131303 - RNA, 22 nt, Homo sapiens
ugaauauguuaaauaauguucu

SEQ ID NO: 131304 - RNA, 22 nt, Homo sapiens
ugaauauguuaauuagcaucau

SEQ ID NO: 131305 - RNA, 22 nt, Homo sapiens
ugaauauguuucuaaaagugca

SEQ ID NO: 131306 - RNA, 22 nt, Homo sapiens
ugaauauuugcuacucacucuu

SEQ ID NO: 131307 - RNA, 22 nt, Homo sapiens
ugaaucaugcugcuauaaagac

SEQ ID NO: 131308 - RNA, 22 nt, Homo sapiens
ugaaugcaucauguagggcuca

SEQ ID NO: 131309 - RNA, 22 nt, Homo sapiens
ugaaugccauucuguguuagcu

SEQ ID NO: 131310 - RNA, 22 nt, Homo sapiens
ugaaugcuucaugucugggcug

SEQ ID NO: 131311 - RNA, 22 nt, Homo sapiens
ugaaugguuuuuagagaacaau

SEQ ID NO: 131312 - RNA, 22 nt, Homo sapiens
ugaauguaacuaaaggacuuuu

SEQ ID NO: 131313 - RNA, 20 nt, Homo sapiens
ugaauguaauuacagaugua

SEQ ID NO: 131314 - RNA, 22 nt, Homo sapiens
ugaaugugauggguuucaugug

SEQ ID NO: 131315 - RNA, 22 nt, Homo sapiens
ugaauguuugcagcuuauacca

SEQ ID NO: 131316 - RNA, 22 nt, Homo sapiens
ugaauuguuuacgagaugugag

SEQ ID NO: 131317 - RNA, 23 nt, Homo sapiens
ugacaaccucaugcuuugucaug

SEQ ID NO: 131318 - RNA, 22 nt, Homo sapiens
ugacaagaacuuuccauaguaa

SEQ ID NO: 131319 - RNA, 18 nt, Homo sapiens
ugacaaugcuaguccugg

SEQ ID NO: 131320 - RNA, 19 nt, Homo sapiens
ugacacuguuggugggagg

SEQ ID NO: 131321 - RNA, 22 nt, Homo sapiens
ugacagaggucuuuuaauagcu

SEQ ID NO: 131322 - RNA, 18 nt, Homo sapiens
ugacagcacaugugggga

SEQ ID NO: 131323 - RNA, 22 nt, Homo sapiens
ugacagcaucaggauuggagag

SEQ ID NO: 131324 - RNA, 23 nt, Homo sapiens
ugacagugcuugaaauugcucuu

SEQ ID NO: 131325 - RNA, 22 nt, Homo sapiens
ugacaguguccucauucccaac

SEQ ID NO: 131326 - RNA, 22 nt, Homo sapiens
ugacagugugagacuuugucuc

SEQ ID NO: 131327 - RNA, 22 nt, Homo sapiens
ugacagugugagauccugucuc

SEQ ID NO: 131328 - RNA, 20 nt, Homo sapiens
ugacaucagcaauguaauaa

SEQ ID NO: 131329 - RNA, 22 nt, Homo sapiens
ugacaugagauuugggaggggc

SEQ ID NO: 131330 - RNA, 22 nt, Homo sapiens
ugacauguauaucuuacgcuau

SEQ ID NO: 131331 - RNA, 21 nt, Homo sapiens
ugacauguuggugugcugcac

SEQ ID NO: 131332 - RNA, 22 nt, Homo sapiens
ugacauuacagucacuugcugu

SEQ ID NO: 131333 - RNA, 22 nt, Homo sapiens
ugacauugggagugaagugaag

SEQ ID NO: 131334 - RNA, 22 nt, Homo sapiens
ugaccacagaaagugagggagc

SEQ ID NO: 131335 - RNA, 22 nt, Homo sapiens
ugaccacugucuaagauaggug

SEQ ID NO: 131336 - RNA, 22 nt, Homo sapiens
ugacuacaggucaggaagcugu

SEQ ID NO: 131337 - RNA, 22 nt, Homo sapiens
ugacuagucauaggcauggggg

SEQ ID NO: 131338 - RNA, 22 nt, Homo sapiens
ugacuagugcccuuugcugccu

SEQ ID NO: 131339 - RNA, 22 nt, Homo sapiens
ugacuaguuugaggacauuaua

SEQ ID NO: 131340 - RNA, 22 nt, Homo sapiens
ugacucaguuucucagguagua

SEQ ID NO: 131341 - RNA, 22 nt, Homo sapiens
ugacucgaggcgccuccagucc

SEQ ID NO: 131342 - RNA, 22 nt, Homo sapiens
ugacucuagagcugccuguggc

SEQ ID NO: 131343 - RNA, 22 nt, Homo sapiens
ugacugugcagcuccaucaggg

SEQ ID NO: 131344 - RNA, 22 nt, Homo sapiens
ugacuucauuuuuggccaugag

SEQ ID NO: 131345 - RNA, 22 nt, Homo sapiens
ugacuugaaguuaccauaugca

SEQ ID NO: 131346 - RNA, 22 nt, Homo sapiens
ugacuugaucauuacacauucu

SEQ ID NO: 131347 - RNA, 22 nt, Homo sapiens
ugagaacagcagcuugggacac

SEQ ID NO: 131348 - RNA, 22 nt, Homo sapiens
ugagaacaugcacuugagguug

SEQ ID NO: 131349 - RNA, 19 nt, Homo sapiens
ugagaacaugugguauuug

SEQ ID NO: 131350 - RNA, 20 nt, Homo sapiens
ugagaacaugugguauuugg

SEQ ID NO: 131351 - RNA, 22 nt, Homo sapiens
ugagaacugguagcacuuguga

SEQ ID NO: 131352 - RNA, 22 nt, Homo sapiens
ugagaagacaucagcuuucgga

SEQ ID NO: 131353 - RNA, 22 nt, Homo sapiens
ugagaagugacgcagcaggguu

SEQ ID NO: 131354 - RNA, 22 nt, Homo sapiens
ugagaaugacugggcaugcugc

SEQ ID NO: 131355 - RNA, 22 nt, Homo sapiens
ugagaaugaugauugguaaacc

SEQ ID NO: 131356 - RNA, 22 nt, Homo sapiens
ugagaaugaugauuuccaguuu

SEQ ID NO: 131357 - RNA, 22 nt, Homo sapiens
ugagaauguagggcucucccag

SEQ ID NO: 131358 - RNA, 19 nt, Homo sapiens
ugagaauguuaccaggucc

SEQ ID NO: 131359 - RNA, 22 nt, Homo sapiens
ugagacaaaguuguuggauguu

SEQ ID NO: 131360 - RNA, 22 nt, Homo sapiens
ugagacaaucucaucucaguga

SEQ ID NO: 131361 - RNA, 22 nt, Homo sapiens
ugagacaucucuccugagacag

SEQ ID NO: 131362 - RNA, 22 nt, Homo sapiens
ugagacaugugaacuguaguuc

SEQ ID NO: 131363 - RNA, 23 nt, Homo sapiens
ugagacauuggaaaguuaggcag

SEQ ID NO: 131364 - RNA, 22 nt, Homo sapiens
ugagaccugaucuugguacugc

SEQ ID NO: 131365 - RNA, 22 nt, Homo sapiens
ugagacggagucuggcacuguc

SEQ ID NO: 131366 - RNA, 22 nt, Homo sapiens
ugagacggaguuucacucuugu

SEQ ID NO: 131367 - RNA, 22 nt, Homo sapiens
ugagacugaaauuaggaaacug

SEQ ID NO: 131368 - RNA, 22 nt, Homo sapiens
ugagacugagucucccucuguc

SEQ ID NO: 131369 - RNA, 22 nt, Homo sapiens
ugagacugagucucgcucuauu

SEQ ID NO: 131370 - RNA, 22 nt, Homo sapiens
ugagacugagucucgcucuugu

SEQ ID NO: 131371 - RNA, 22 nt, Homo sapiens
ugagacugaguuucacuuuugu

SEQ ID NO: 131372 - RNA, 22 nt, Homo sapiens
ugagacugaguuuccaucuugu

SEQ ID NO: 131373 - RNA, 22 nt, Homo sapiens
ugagacuguuuuggggaacuuc

SEQ ID NO: 131374 - RNA, 22 nt, Homo sapiens
ugagagaugaacuauucuugaa

SEQ ID NO: 131375 - RNA, 18 nt, Homo sapiens
ugagaucagcaucaaggg

SEQ ID NO: 131376 - RNA, 22 nt, Homo sapiens
ugagaucagugaagaaguguuu

SEQ ID NO: 131377 - RNA, 22 nt, Homo sapiens
ugagaucaguuguuauaauucu

SEQ ID NO: 131378 - RNA, 22 nt, Homo sapiens
ugagaucaugucauuugcacuc

SEQ ID NO: 131379 - RNA, 22 nt, Homo sapiens
ugagauccugugacuacacuga

SEQ ID NO: 131380 - RNA, 22 nt, Homo sapiens
ugagaucucauuaugguuuuaa

SEQ ID NO: 131381 - RNA, 22 nt, Homo sapiens
ugagaucuguaaagucugacau

SEQ ID NO: 131382 - RNA, 22 nt, Homo sapiens
ugagaugagggcugcacucaaa

SEQ ID NO: 131383 - RNA, 22 nt, Homo sapiens
ugagaugaggucucgcucuguc

SEQ ID NO: 131384 - RNA, 22 nt, Homo sapiens
ugagaugaguugcgcucugucg

SEQ ID NO: 131385 - RNA, 22 nt, Homo sapiens
ugagaugauagauauguuaauu

SEQ ID NO: 131386 - RNA, 22 nt, Homo sapiens
ugagaugaucaaaguauaggcu

SEQ ID NO: 131387 - RNA, 22 nt, Homo sapiens
ugagaugaugggauaagagggc

SEQ ID NO: 131388 - RNA, 22 nt, Homo sapiens
ugagaugcuuguaaauucauuu

SEQ ID NO: 131389 - RNA, 22 nt, Homo sapiens
ugagauggaguuucacuuuugu

SEQ ID NO: 131390 - RNA, 22 nt, Homo sapiens
ugagauggaguuucgcccuugu

SEQ ID NO: 131391 - RNA, 22 nt, Homo sapiens
ugucacuuugccuucuggacuu

SEQ ID NO: 131392 - RNA, 18 nt, Homo sapiens
ugucagaguggauuguaa

SEQ ID NO: 131393 - RNA, 22 nt, Homo sapiens
ugucaggaggguccagagaaaa

SEQ ID NO: 131394 - RNA, 22 nt, Homo sapiens
ugucauacaguaacaugguugg

SEQ ID NO: 131395 - RNA, 19 nt, Homo sapiens
ugucaucaucuuuucuugc

SEQ ID NO: 131396 - RNA, 22 nt, Homo sapiens
ugucaugguguuaauuuuccug

SEQ ID NO: 131397 - RNA, 22 nt, Homo sapiens
uguccaaauugaaucaucuggu

SEQ ID NO: 131398 - RNA, 19 nt, Homo sapiens
ugucccagccauagaggca

SEQ ID NO: 131399 - RNA, 22 nt, Homo sapiens
uguccugaagcuuuguuaugua

SEQ ID NO: 131400 - RNA, 21 nt, Homo sapiens
ugucgugcaggaucuguggga

SEQ ID NO: 131401 - RNA, 22 nt, Homo sapiens
ugucuagaucugaauguaauug

SEQ ID NO: 131402 - RNA, 22 nt, Homo sapiens
ugucuaguuuugaaguauagca

SEQ ID NO: 131403 - RNA, 22 nt, Homo sapiens
ugucuggaaggguggccuccug

SEQ ID NO: 131404 - RNA, 21 nt, Homo sapiens
ugucuuggagccagacgccag

SEQ ID NO: 131405 - RNA, 22 nt, Homo sapiens
ugucuuggaugaggauuaacag

SEQ ID NO: 131406 - RNA, 22 nt, Homo sapiens
ugugaaauguuaucccgucgug

SEQ ID NO: 131407 - RNA, 22 nt, Homo sapiens
ugugaagaugagaugacgcccu

SEQ ID NO: 131408 - RNA, 22 nt, Homo sapiens
ugugaauggugcuuccuagaug

SEQ ID NO: 131409 - RNA, 18 nt, Homo sapiens
ugugacauugagcauguc

SEQ ID NO: 131410 - RNA, 22 nt, Homo sapiens
ugugacuaguggugaaugacgc

SEQ ID NO: 131411 - RNA, 22 nt, Homo sapiens
ugugauaguuggcuaaagcagu

SEQ ID NO: 131412 - RNA, 22 nt, Homo sapiens
ugugaucaauuagugaugucug

SEQ ID NO: 131413 - RNA, 22 nt, Homo sapiens
ugugaugcagggccugggccuc

SEQ ID NO: 131414 - RNA, 22 nt, Homo sapiens
ugugaugguuuggaagcuucuu

SEQ ID NO: 131415 - RNA, 22 nt, Homo sapiens
ugugaugugaugagaaguuccu

SEQ ID NO: 131416 - RNA, 22 nt, Homo sapiens
ugugauuauuuauagacaguca

SEQ ID NO: 131417 - RNA, 22 nt, Homo sapiens
ugugcaaaaacaauugcgguuu

SEQ ID NO: 131418 - RNA, 22 nt, Homo sapiens
ugugcaaauguuaaacuaacuu

SEQ ID NO: 131419 - RNA, 22 nt, Homo sapiens
ugugcaaucuuccauuuuuagg

SEQ ID NO: 131420 - RNA, 22 nt, Homo sapiens
ugugcacauugugcagguugau

SEQ ID NO: 131421 - RNA, 23 nt, Homo sapiens
ugugcacauuuacauauauacac

SEQ ID NO: 131422 - RNA, 22 nt, Homo sapiens
ugugcauaugucuuuauaguag

SEQ ID NO: 131423 - RNA, 22 nt, Homo sapiens
ugugccacugcacucugggcaa

SEQ ID NO: 131424 - RNA, 22 nt, Homo sapiens
ugugccacugcacuucagccug

SEQ ID NO: 131425 - RNA, 22 nt, Homo sapiens
uguggaaauggugcuacgaaca

SEQ ID NO: 131426 - RNA, 22 nt, Homo sapiens
uguggaguguaugugacagaga

SEQ ID NO: 131427 - RNA, 22 nt, Homo sapiens
uguggcucuucuguucuccacu

SEQ ID NO: 131428 - RNA, 22 nt, Homo sapiens
uguggcugguggcaccuuuucc

SEQ ID NO: 131429 - RNA, 18 nt, Homo sapiens
uguggcuguuuuccaaua

SEQ ID NO: 131430 - RNA, 22 nt, Homo sapiens
ugugguuuuaguaaaacuaugu

SEQ ID NO: 131431 - RNA, 22 nt, Homo sapiens
ugugguuuuuuucuccaauagg

SEQ ID NO: 131432 - RNA, 22 nt, Homo sapiens
uguguaaauauauacacacgug

SEQ ID NO: 131433 - RNA, 22 nt, Homo sapiens
uguguaaauaugauagaggaau

SEQ ID NO: 131434 - RNA, 22 nt, Homo sapiens
uguguagagaaauauuacuuau

SEQ ID NO: 131435 - RNA, 22 nt, Homo sapiens
uguguauaucacugcaugagug

SEQ ID NO: 131436 - RNA, 22 nt, Homo sapiens
ugugucuugaauuuuguaugua

SEQ ID NO: 131437 - RNA, 22 nt, Homo sapiens
ugugucuuuuaucacacaaugu

SEQ ID NO: 131438 - RNA, 22 nt, Homo sapiens
uguguuuuuauguaaaauggaa

SEQ ID NO: 131439 - RNA, 22 nt, Homo sapiens
uguuaagaugucaauuuuccac

SEQ ID NO: 131440 - RNA, 22 nt, Homo sapiens
uguuacacugugcacuaaauuu

SEQ ID NO: 131441 - RNA, 22 nt, Homo sapiens
uguuacaguguaggccuugggu

SEQ ID NO: 131442 - RNA, 22 nt, Homo sapiens
uguucuggagaguuuagucugg

SEQ ID NO: 131443 - RNA, 22 nt, Homo sapiens
uguugcacuccagccugggcaa

SEQ ID NO: 131444 - RNA, 18 nt, Homo sapiens
uguugguguucacucacu

SEQ ID NO: 131445 - RNA, 22 nt, Homo sapiens
uguuucuacugucucuguagua

SEQ ID NO: 131446 - RNA, 22 nt, Homo sapiens
uguuugguggucucuucacaug

SEQ ID NO: 131447 - RNA, 22 nt, Homo sapiens
uguuuguuugagauggagucuc

SEQ ID NO: 131448 - RNA, 22 nt, Homo sapiens
uguuuguuugugauacgguaca

SEQ ID NO: 131449 - RNA, 22 nt, Homo sapiens
uuaaauacagcaugguguuucu

SEQ ID NO: 131450 - RNA, 22 nt, Homo sapiens
uuaaaugcauagaauguguagu

SEQ ID NO: 131451 - RNA, 22 nt, Homo sapiens
uuaaaugucuguagaugugcug

SEQ ID NO: 131452 - RNA, 22 nt, Homo sapiens
uuaacagugaccccugguggcc

SEQ ID NO: 131453 - RNA, 22 nt, Homo sapiens
uuaagaucagugcaaacuggag

SEQ ID NO: 131454 - RNA, 22 nt, Homo sapiens
uuaagccaggugugguggcaca

SEQ ID NO: 131455 - RNA, 22 nt, Homo sapiens
uuaaggaaggagucuuaaaugg

SEQ ID NO: 131456 - RNA, 22 nt, Homo sapiens
uuaaggcauucuuugucuucau

SEQ ID NO: 131457 - RNA, 22 nt, Homo sapiens
uuaagguaugugggcauuuugu

SEQ ID NO: 131458 - RNA, 22 nt, Homo sapiens
uuaaguacuucccuguuggaca

SEQ ID NO: 131459 - RNA, 22 nt, Homo sapiens
uuaaguagcugggcaugguggu

SEQ ID NO: 131460 - RNA, 22 nt, Homo sapiens
uuaagugaauuaucuaacaugu

SEQ ID NO: 131461 - RNA, 20 nt, Homo sapiens
uuaagugcuuucugcuuaga

SEQ ID NO: 131462 - RNA, 22 nt, Homo sapiens
uuaauagcaaagaguuuagacu

SEQ ID NO: 131463 - RNA, 22 nt, Homo sapiens
uuaauagugacucauuuuccac

SEQ ID NO: 131464 - RNA, 22 nt, Homo sapiens
uuaauuguccauuauucuguuc

SEQ ID NO: 131465 - RNA, 22 nt, Homo sapiens
uuacaaccucagcagugcaaag

SEQ ID NO: 131466 - RNA, 22 nt, Homo sapiens
uuacaaguggcaucucucugga

SEQ ID NO: 131467 - RNA, 22 nt, Homo sapiens
uuacagauggcacacucaaggg

SEQ ID NO: 131468 - RNA, 22 nt, Homo sapiens
uuacagcugcuccccaucacuc

SEQ ID NO: 131469 - RNA, 22 nt, Homo sapiens
uuacagucaaguuacauuucuc

SEQ ID NO: 131470 - RNA, 22 nt, Homo sapiens
uuacaguguuuguucuguuacu

SEQ ID NO: 131471 - RNA, 22 nt, Homo sapiens
uuacaguucugguggagaggua

SEQ ID NO: 131472 - RNA, 22 nt, Homo sapiens
uuacauaguguguggguucggg

SEQ ID NO: 131473 - RNA, 22 nt, Homo sapiens
uuacauguggugugaagaagag

SEQ ID NO: 131474 - RNA, 22 nt, Homo sapiens
uuacauguuguggguuguggcc

SEQ ID NO: 131475 - RNA, 22 nt, Homo sapiens
uuacauguuuauggggguacau

SEQ ID NO: 131476 - RNA, 22 nt, Homo sapiens
uuaccaguggugcuguaaacuu

SEQ ID NO: 131477 - RNA, 22 nt, Homo sapiens
uuacccuuuaacccuuuaaagu

SEQ ID NO: 131478 - RNA, 22 nt, Homo sapiens
uuacuauguuucaaagugucuc

SEQ ID NO: 131479 - RNA, 22 nt, Homo sapiens
uuacugcuuaagugauucaaca

SEQ ID NO: 131480 - RNA, 17 nt, Homo sapiens
uuagacagacauccugc

SEQ ID NO: 131481 - RNA, 22 nt, Homo sapiens
uuagagcacugaucugcucuuu

SEQ ID NO: 131482 - RNA, 22 nt, Homo sapiens
uccaguuguucucgaagcuccu

SEQ ID NO: 131483 - RNA, 22 nt, Homo sapiens
uccaugugaaaaggucgugaua

SEQ ID NO: 131484 - RNA, 22 nt, Homo sapiens
uccauuuguucagcuucaggaa

SEQ ID NO: 131485 - RNA, 19 nt, Homo sapiens
ucccaagaugcucauacau

SEQ ID NO: 131486 - RNA, 22 nt, Homo sapiens
ucccacugucuucucgugcucg

SEQ ID NO: 131487 - RNA, 22 nt, Homo sapiens
ucccaguauucauuuacagaag

SEQ ID NO: 131488 - RNA, 22 nt, Homo sapiens
uggcaguuuugauguggagaga

SEQ ID NO: 131489 - RNA, 22 nt, Homo sapiens
uggcauaugguauuugauaucu

SEQ ID NO: 131490 - RNA, 19 nt, Homo sapiens
uggcaugaaugugaacuaa

SEQ ID NO: 131491 - RNA, 22 nt, Homo sapiens
uggcauguauuuuguguauuaa

SEQ ID NO: 131492 - RNA, 22 nt, Homo sapiens
uggcauuuucucuguucuuaga

SEQ ID NO: 131493 - RNA, 22 nt, Homo sapiens
uggccaagagcacagauauugg

SEQ ID NO: 131494 - RNA, 23 nt, Homo sapiens
uggcuagacguccuuuccugaug

SEQ ID NO: 131495 - RNA, 22 nt, Homo sapiens
uggcuguuguuacuaacaguuc

SEQ ID NO: 131496 - RNA, 22 nt, Homo sapiens
uggcuguuuauuucacaugggu

SEQ ID NO: 131497 - RNA, 22 nt, Homo sapiens
uggcuguuuauuucacgugggu

SEQ ID NO: 131498 - RNA, 22 nt, Homo sapiens
uggcuugauggcacaagguuuc

SEQ ID NO: 131499 - RNA, 22 nt, Homo sapiens
uggcuuuguaagguuucauuuu

SEQ ID NO: 131500 - RNA, 22 nt, Homo sapiens
uggcuuuuauuauguugaggua

SEQ ID NO: 131501 - RNA, 22 nt, Homo sapiens
gagguaaguggauuaugagguc

SEQ ID NO: 131502 - RNA, 22 nt, Homo sapiens
gagguagagacuauguauuaga

SEQ ID NO: 131503 - RNA, 22 nt, Homo sapiens
gagguaucauuauguugcccag

SEQ ID NO: 131504 - RNA, 22 nt, Homo sapiens
gaggucaggacauuuuugcuuu

SEQ ID NO: 131505 - RNA, 22 nt, Homo sapiens
gaggucaugucgggccccagga

SEQ ID NO: 131506 - RNA, 22 nt, Homo sapiens
gaggugguagguucacagcagc

SEQ ID NO: 131507 - RNA, 22 nt, Homo sapiens
gagguggugguggaggcauagc

SEQ ID NO: 131508 - RNA, 22 nt, Homo sapiens
gagguguaaggacaacagagac

SEQ ID NO: 131509 - RNA, 22 nt, Homo sapiens
gagguuuuagugagucccacug

SEQ ID NO: 131510 - RNA, 22 nt, Homo sapiens
gaguaaauguccuagcuucuug

SEQ ID NO: 131511 - RNA, 23 nt, Homo sapiens
gaguacauuaaaagcccagacug

SEQ ID NO: 131512 - RNA, 22 nt, Homo sapiens
gaguagugcugcaguaaacaua

SEQ ID NO: 131513 - RNA, 22 nt, Homo sapiens
gaguauuuuacaucguguaauu

SEQ ID NO: 131514 - RNA, 22 nt, Homo sapiens
gagucagugucuugcucuguca

SEQ ID NO: 131515 - RNA, 22 nt, Homo sapiens
gagugcaagguuuuucugagug

SEQ ID NO: 131516 - RNA, 22 nt, Homo sapiens
gagugcaauggcaagaucuugg

SEQ ID NO: 131517 - RNA, 22 nt, Homo sapiens
gagugcauaugggccuguguca

SEQ ID NO: 131518 - RNA, 22 nt, Homo sapiens
gagugcuguuagcccuggguuu

SEQ ID NO: 131519 - RNA, 22 nt, Homo sapiens
gagugguaguuucuagaggugu

SEQ ID NO: 131520 - RNA, 22 nt, Homo sapiens
gaguggugguucugaaacuuuu

SEQ ID NO: 131521 - RNA, 22 nt, Homo sapiens
gaguucaaaucucagcucuguu

SEQ ID NO: 131522 - RNA, 22 nt, Homo sapiens
gaguucauuuugaaaccuugau

SEQ ID NO: 131523 - RNA, 22 nt, Homo sapiens
gaguuccuuugagccugagagg

SEQ ID NO: 131524 - RNA, 22 nt, Homo sapiens
gaguuguuuuaaggcacugacu

SEQ ID NO: 131525 - RNA, 22 nt, Homo sapiens
gauaaauccagauucugaugua

SEQ ID NO: 131526 - RNA, 22 nt, Homo sapiens
gauaauucuagcagauacaggc

SEQ ID NO: 131527 - RNA, 22 nt, Homo sapiens
gauagugaaccaagggguaauu

SEQ ID NO: 131528 - RNA, 22 nt, Homo sapiens
gauaugugauaagaguuaucuu

SEQ ID NO: 131529 - RNA, 22 nt, Homo sapiens
gauauguucugagaaaugcauu

SEQ ID NO: 131530 - RNA, 22 nt, Homo sapiens
gauauuacuuccaauauugcaa

SEQ ID NO: 131531 - RNA, 17 nt, Homo sapiens
gaucacagucgucuccu

SEQ ID NO: 131532 - RNA, 22 nt, Homo sapiens
gaucaguuucuggagauacgua

SEQ ID NO: 131533 - RNA, 20 nt, Homo sapiens
gaucaguuuggaguaagugc

SEQ ID NO: 131534 - RNA, 22 nt, Homo sapiens
gaucugugugauuggaugcauu

SEQ ID NO: 131535 - RNA, 22 nt, Homo sapiens
gaucuguuuuccuauuguuugu

SEQ ID NO: 131536 - RNA, 22 nt, Homo sapiens
gaugagaucauaaguguggagc

SEQ ID NO: 131537 - RNA, 22 nt, Homo sapiens
gaugagaugagcauuugaauug

SEQ ID NO: 131538 - RNA, 22 nt, Homo sapiens
gaugagguaggccugcuuugaa

SEQ ID NO: 131539 - RNA, 22 nt, Homo sapiens
gaugcaguaagaaugcauagcg

SEQ ID NO: 131540 - RNA, 22 nt, Homo sapiens
gaugccuauugcuaguccuaaa

SEQ ID NO: 131541 - RNA, 22 nt, Homo sapiens
gauggaguaauguaaucuugag

SEQ ID NO: 131542 - RNA, 22 nt, Homo sapiens
gauggauuuuaagugaaugaaa

SEQ ID NO: 131543 - RNA, 22 nt, Homo sapiens
gauggauuuuuuaggcagagcu

SEQ ID NO: 131544 - RNA, 22 nt, Homo sapiens
gauggcagugcagccccuggcu

SEQ ID NO: 131545 - RNA, 22 nt, Homo sapiens
gauggcaucugagaguguuaga

SEQ ID NO: 131546 - RNA, 22 nt, Homo sapiens
gauggcuacugauuaaauauag

SEQ ID NO: 131547 - RNA, 22 nt, Homo sapiens
gauggugucccaggcucaggcu

SEQ ID NO: 131548 - RNA, 22 nt, Homo sapiens
gaugguuuucaccugcaugcuu

SEQ ID NO: 131549 - RNA, 22 nt, Homo sapiens
gaugguuuuucuccgauuuaua

SEQ ID NO: 131550 - RNA, 22 nt, Homo sapiens
gauguagaaagagugggcugga

SEQ ID NO: 131551 - RNA, 22 nt, Homo sapiens
gauguguugggaagauuucaag

SEQ ID NO: 131552 - RNA, 22 nt, Homo sapiens
gauuagcacuucaguuacagua

SEQ ID NO: 131553 - RNA, 22 nt, Homo sapiens
gauugguugaaaguagaauacu

SEQ ID NO: 131554 - RNA, 21 nt, Homo sapiens
gcaaacauccuuugaugccag

SEQ ID NO: 131555 - RNA, 22 nt, Homo sapiens
gcaaaguguuuuccaacuuggu

SEQ ID NO: 131556 - RNA, 22 nt, Homo sapiens
gcaagaaugagaaggauuaauu

SEQ ID NO: 131557 - RNA, 22 nt, Homo sapiens
gcaagaugagagcccgggcagu

SEQ ID NO: 131558 - RNA, 22 nt, Homo sapiens
gcaauacugacagcauuaguuu

SEQ ID NO: 131559 - RNA, 22 nt, Homo sapiens
gcacacuuacacgaaccuagau

SEQ ID NO: 131560 - RNA, 22 nt, Homo sapiens
gcaccaugguagaauaauggua

SEQ ID NO: 131561 - RNA, 22 nt, Homo sapiens
gcaccccuuaccgggcuggguu

SEQ ID NO: 131562 - RNA, 22 nt, Homo sapiens
gcacugagagaagccccaagua

SEQ ID NO: 131563 - RNA, 22 nt, Homo sapiens
gcagcacaugacuguauguaua

SEQ ID NO: 131564 - RNA, 22 nt, Homo sapiens
gcagguaguuucugacuuuuac

SEQ ID NO: 131565 - RNA, 22 nt, Homo sapiens
gcagguauuagagagccugaaa

SEQ ID NO: 131566 - RNA, 22 nt, Homo sapiens
gcagguguuaugcaaacaacug

SEQ ID NO: 131567 - RNA, 22 nt, Homo sapiens
gcaguagugugaucuuggcuca

SEQ ID NO: 131568 - RNA, 23 nt, Homo sapiens
gcagucauuuggaaaagguugaa

SEQ ID NO: 131569 - RNA, 22 nt, Homo sapiens
gcagugcuggagcccccgugug

SEQ ID NO: 131570 - RNA, 22 nt, Homo sapiens
gcagugugaucacagcuuacug

SEQ ID NO: 131571 - RNA, 20 nt, Homo sapiens
gcaguguucugaccugaauc

SEQ ID NO: 131572 - RNA, 22 nt, Homo sapiens
gcaguguuggggccggaggcug

SEQ ID NO: 131573 - RNA, 22 nt, Homo sapiens
gcaguguugugauccaggucuu

SEQ ID NO: 131574 - RNA, 20 nt, Homo sapiens
gcauaugucuuuauagcaga

SEQ ID NO: 131575 - RNA, 20 nt, Homo sapiens
gcauaugucuuuauggcagc

SEQ ID NO: 131576 - RNA, 19 nt, Homo sapiens
gcaucauuaguugcuuuuc

SEQ ID NO: 131577 - RNA, 22 nt, Homo sapiens
gcaugaugaauaauaucacaag

SEQ ID NO: 131578 - RNA, 22 nt, Homo sapiens
gcaugcauuuuccuaacuagaa

SEQ ID NO: 131579 - RNA, 22 nt, Homo sapiens
gcauggagcauacauuucuguu

SEQ ID NO: 131580 - RNA, 22 nt, Homo sapiens
gccaaaaugcugggauuacagg

SEQ ID NO: 131581 - RNA, 22 nt, Homo sapiens
gccaagaagugucuaagcagga

SEQ ID NO: 131582 - RNA, 22 nt, Homo sapiens
gccaagauuuaauucaucaguu

SEQ ID NO: 131583 - RNA, 20 nt, Homo sapiens
gccacaguuaagcuucugcc

SEQ ID NO: 131584 - RNA, 22 nt, Homo sapiens
gccagugugaugugaucauggc

SEQ ID NO: 131585 - RNA, 21 nt, Homo sapiens
gccaguguggcaauuuuucaa

SEQ ID NO: 131586 - RNA, 22 nt, Homo sapiens
gccauugcacuacagccuaggc

SEQ ID NO: 131587 - RNA, 22 nt, Homo sapiens
gccauugcacuccgcccugggc

SEQ ID NO: 131588 - RNA, 22 nt, Homo sapiens
gccauugcacucuagccugagc

SEQ ID NO: 131589 - RNA, 22 nt, Homo sapiens
gcccagauguuuggggucaugg

SEQ ID NO: 131590 - RNA, 22 nt, Homo sapiens
gcccuacuguuuauacauagga

SEQ ID NO: 131591 - RNA, 22 nt, Homo sapiens
uucacugugugacccugggcca

SEQ ID NO: 131592 - RNA, 20 nt, Homo sapiens
uucagcaaaggaaugggagu

SEQ ID NO: 131593 - RNA, 19 nt, Homo sapiens
uucagcagugucugcucuu

SEQ ID NO: 131594 - RNA, 22 nt, Homo sapiens
uucagcuacuuggaaacagcaa

SEQ ID NO: 131595 - RNA, 22 nt, Homo sapiens
uucagguaauuaugguuugucu

SEQ ID NO: 131596 - RNA, 22 nt, Homo sapiens
uucagguucauuugcugcuauu

SEQ ID NO: 131597 - RNA, 22 nt, Homo sapiens
uucaguaguacauucccguguu

SEQ ID NO: 131598 - RNA, 22 nt, Homo sapiens
uucaguauugcaccuggagucc

SEQ ID NO: 131599 - RNA, 18 nt, Homo sapiens
uucagugaauucuuuuga

SEQ ID NO: 131600 - RNA, 22 nt, Homo sapiens
uucaguggagaggcugaguggu

SEQ ID NO: 131601 - RNA, 22 nt, Homo sapiens
uucaguugcaucaguugaccag

SEQ ID NO: 131602 - RNA, 19 nt, Homo sapiens
uucauacagugagagcagc

SEQ ID NO: 131603 - RNA, 22 nt, Homo sapiens
uucauagucacauucgaugucu

SEQ ID NO: 131604 - RNA, 22 nt, Homo sapiens
uucauaguucuuuuagucauua

SEQ ID NO: 131605 - RNA, 22 nt, Homo sapiens
uucaucagggagaaauaauuuc

SEQ ID NO: 131606 - RNA, 23 nt, Homo sapiens
uucaucagggauauuggccugaa

SEQ ID NO: 131607 - RNA, 18 nt, Homo sapiens
uucaucaguccucagcug

SEQ ID NO: 131608 - RNA, 22 nt, Homo sapiens
uucaucaguuauauuggccuga

SEQ ID NO: 131609 - RNA, 22 nt, Homo sapiens
uucaucuggcaauucagagauu

SEQ ID NO: 131610 - RNA, 22 nt, Homo sapiens
uucauggaacaaguggguucaa

SEQ ID NO: 131611 - RNA, 22 nt, Homo sapiens
uucauggaauauugaccauuuu

SEQ ID NO: 131612 - RNA, 22 nt, Homo sapiens
uucauggacucaauaguuucgc

SEQ ID NO: 131613 - RNA, 22 nt, Homo sapiens
uucauguaauauuucacagcuu

SEQ ID NO: 131614 - RNA, 22 nt, Homo sapiens
uucauguagucaucauccugcu

SEQ ID NO: 131615 - RNA, 22 nt, Homo sapiens
uuccacaggguugaacuaguuu

SEQ ID NO: 131616 - RNA, 23 nt, Homo sapiens
uuccaccauugacuaguuacaua

SEQ ID NO: 131617 - RNA, 22 nt, Homo sapiens
uuccagaugggaguucuauucu

SEQ ID NO: 131618 - RNA, 22 nt, Homo sapiens
uuccaguaauagcacagcauug

SEQ ID NO: 131619 - RNA, 22 nt, Homo sapiens
uuccaguguguucauccucaga

SEQ ID NO: 131620 - RNA, 22 nt, Homo sapiens
uuccauagucauagugcugaug

SEQ ID NO: 131621 - RNA, 22 nt, Homo sapiens
uucccagugccaggcacuggga

SEQ ID NO: 131622 - RNA, 22 nt, Homo sapiens
uucccagugguuagcucugguc

SEQ ID NO: 131623 - RNA, 22 nt, Homo sapiens
ugagaauauuugaagauguuag

SEQ ID NO: 131624 - RNA, 22 nt, Homo sapiens
ugagaauauuuuccaugucuca

SEQ ID NO: 131625 - RNA, 21 nt, Homo sapiens
ugagacaauccuggucaauau

SEQ ID NO: 131626 - RNA, 22 nt, Homo sapiens
ugagacauacuuacaggggaug

SEQ ID NO: 131627 - RNA, 22 nt, Homo sapiens
ugagacaucacaaaauccucaa

SEQ ID NO: 131628 - RNA, 22 nt, Homo sapiens
ugagacgaagucucguucugua

SEQ ID NO: 131629 - RNA, 22 nt, Homo sapiens
ugagacgaagucuugcucuguu

SEQ ID NO: 131630 - RNA, 22 nt, Homo sapiens
ugagacggagucucacucuguu

SEQ ID NO: 131631 - RNA, 22 nt, Homo sapiens
ugagacggagucucgcucucua

SEQ ID NO: 131632 - RNA, 22 nt, Homo sapiens
ugagacugagucuugcucuugu

SEQ ID NO: 131633 - RNA, 22 nt, Homo sapiens
ugagacugguaauguguagggc

SEQ ID NO: 131634 - RNA, 22 nt, Homo sapiens
ugagagacagacauuaucuuau

SEQ ID NO: 131635 - RNA, 22 nt, Homo sapiens
ugagagacaguuucgucggagg

SEQ ID NO: 131636 - RNA, 22 nt, Homo sapiens
ugagagaugaacucugauaugu

SEQ ID NO: 131637 - RNA, 22 nt, Homo sapiens
ugagagcugcauucuugaaagc

SEQ ID NO: 131638 - RNA, 22 nt, Homo sapiens
ugagaguauaaauugaugcagc

SEQ ID NO: 131639 - RNA, 22 nt, Homo sapiens
ugagagucacugaccugguaua

SEQ ID NO: 131640 - RNA, 22 nt, Homo sapiens
ugagauaauuuacuuguugagg

SEQ ID NO: 131641 - RNA, 22 nt, Homo sapiens
ugagauauauauauuugagaca

SEQ ID NO: 131642 - RNA, 22 nt, Homo sapiens
ugagaucaaggugggcccuggg

SEQ ID NO: 131643 - RNA, 22 nt, Homo sapiens
ugagaucaagguuaauauaauc

SEQ ID NO: 131644 - RNA, 22 nt, Homo sapiens
ugagaucacuaagagguaaugg

SEQ ID NO: 131645 - RNA, 22 nt, Homo sapiens
ugagaucaugccacugcacuuc

SEQ ID NO: 131646 - RNA, 22 nt, Homo sapiens
ugagauccaugcuauuugggcu

SEQ ID NO: 131647 - RNA, 22 nt, Homo sapiens
ugagaucgagucucgcucuguc

SEQ ID NO: 131648 - RNA, 23 nt, Homo sapiens
ugagaucuacagaucucagaucu

SEQ ID NO: 131649 - RNA, 22 nt, Homo sapiens
ugagaucugucuuuauaguauu

SEQ ID NO: 131650 - RNA, 22 nt, Homo sapiens
ugagaucuuaccuuccugccuu

SEQ ID NO: 131651 - RNA, 22 nt, Homo sapiens
ugagaucuuggaggcuuuguga

SEQ ID NO: 131652 - RNA, 19 nt, Homo sapiens
ugagaucuuuacuggguuu

SEQ ID NO: 131653 - RNA, 22 nt, Homo sapiens
ugagaucuuuuguggcugagaa

SEQ ID NO: 131654 - RNA, 22 nt, Homo sapiens
ugagaugaagucucacucuguc

SEQ ID NO: 131655 - RNA, 22 nt, Homo sapiens
ugagaugagaaucaguucuaau

SEQ ID NO: 131656 - RNA, 22 nt, Homo sapiens
ugagaugaguucucgcucuguc

SEQ ID NO: 131657 - RNA, 22 nt, Homo sapiens
ugagaugaguugcuggcucuga

SEQ ID NO: 131658 - RNA, 22 nt, Homo sapiens
ugagaugcaaaaugagaauugu

SEQ ID NO: 131659 - RNA, 21 nt, Homo sapiens
ugagaugcaaucaccagggag

SEQ ID NO: 131660 - RNA, 22 nt, Homo sapiens
ugagaugcauauucuggcuccu

SEQ ID NO: 131661 - RNA, 22 nt, Homo sapiens
ugagaugcuccucuugcaaagc

SEQ ID NO: 131662 - RNA, 22 nt, Homo sapiens
ugagauggguaauuaaauggug

SEQ ID NO: 131663 - RNA, 22 nt, Homo sapiens
ugagauguagauauggauuaga

SEQ ID NO: 131664 - RNA, 23 nt, Homo sapiens
ugagaugucugauugcgaggguc

SEQ ID NO: 131665 - RNA, 21 nt, Homo sapiens
ugagaugugaccagggcauca

SEQ ID NO: 131666 - RNA, 22 nt, Homo sapiens
ugagauguugcucugaaacaag

SEQ ID NO: 131667 - RNA, 22 nt, Homo sapiens
ugagauguuuguuucagugccu

SEQ ID NO: 131668 - RNA, 22 nt, Homo sapiens
ugagauuacguucggcccacuu

SEQ ID NO: 131669 - RNA, 23 nt, Homo sapiens
ugagauuauaaucuuuuacuucu

SEQ ID NO: 131670 - RNA, 22 nt, Homo sapiens
ugagauuguaucugcaaugugu

SEQ ID NO: 131671 - RNA, 22 nt, Homo sapiens
ugagcaaaauuuuggacauaga

SEQ ID NO: 131672 - RNA, 22 nt, Homo sapiens
ugagcaagaaauagaaacagau

SEQ ID NO: 131673 - RNA, 22 nt, Homo sapiens
ugagcacagcgugugggagagc

SEQ ID NO: 131674 - RNA, 22 nt, Homo sapiens
ugagcagaaguuuugauuggcg

SEQ ID NO: 131675 - RNA, 22 nt, Homo sapiens
ugagcagagggagaaguaaauu

SEQ ID NO: 131676 - RNA, 22 nt, Homo sapiens
ugagcauauuuaagguaugcua

SEQ ID NO: 131677 - RNA, 22 nt, Homo sapiens
ugagccauggcaccuugucuaa

SEQ ID NO: 131678 - RNA, 22 nt, Homo sapiens
ugagcuaagugccaauauuaau

SEQ ID NO: 131679 - RNA, 22 nt, Homo sapiens
ugagcuacuacacccagcuugg

SEQ ID NO: 131680 - RNA, 22 nt, Homo sapiens
ugagcuaggucuugcucuguca

SEQ ID NO: 131681 - RNA, 22 nt, Homo sapiens
ugagcugagaucaugcuauugu

SEQ ID NO: 131682 - RNA, 20 nt, Homo sapiens
ugagcuuguaaacacuguuu

SEQ ID NO: 131683 - RNA, 22 nt, Homo sapiens
ugaggaguguauuucauucgcu

SEQ ID NO: 131684 - RNA, 22 nt, Homo sapiens
ugaggcacucccuagcggggug

SEQ ID NO: 131685 - RNA, 17 nt, Homo sapiens
ugagggaugccugguuc

SEQ ID NO: 131686 - RNA, 22 nt, Homo sapiens
ugagguaaaacaaggauuggau

SEQ ID NO: 131687 - RNA, 22 nt, Homo sapiens
ugagguaacaaacuaugaguua

SEQ ID NO: 131688 - RNA, 22 nt, Homo sapiens
ugagguaagauguucauuuuuc

SEQ ID NO: 131689 - RNA, 22 nt, Homo sapiens
ugagguagaggugaacuugacc

SEQ ID NO: 131690 - RNA, 22 nt, Homo sapiens
ugaggugagauggcuaccccaa

SEQ ID NO: 131691 - RNA, 22 nt, Homo sapiens
ugaggugaggguaucaaaugcu

SEQ ID NO: 131692 - RNA, 22 nt, Homo sapiens
ugaggugcagcaauccucaugu

SEQ ID NO: 131693 - RNA, 22 nt, Homo sapiens
ugagguuauuuguucaagaagu

SEQ ID NO: 131694 - RNA, 22 nt, Homo sapiens
ugagguuggggucagggcuagc

SEQ ID NO: 131695 - RNA, 22 nt, Homo sapiens
ugagguuggguaauuuaugaag

SEQ ID NO: 131696 - RNA, 22 nt, Homo sapiens
ugagguugucagugucauucuu

SEQ ID NO: 131697 - RNA, 22 nt, Homo sapiens
ugagguuguccacuauaaucca

SEQ ID NO: 131698 - RNA, 22 nt, Homo sapiens
ugaguagaacuagucuagagcu

SEQ ID NO: 131699 - RNA, 22 nt, Homo sapiens
ugaguagaacuccuggagaugu

SEQ ID NO: 131700 - RNA, 20 nt, Homo sapiens
ugaguagaggaguucuauca

SEQ ID NO: 131701 - RNA, 22 nt, Homo sapiens
ugaguagcuaagacgauaggca

SEQ ID NO: 131702 - RNA, 22 nt, Homo sapiens
ugaguagcuaauguuuacugag

SEQ ID NO: 131703 - RNA, 22 nt, Homo sapiens
ugaguagucagugggcaggaag

SEQ ID NO: 131704 - RNA, 22 nt, Homo sapiens
ugaguauguuuaaugugacaau

SEQ ID NO: 131705 - RNA, 22 nt, Homo sapiens
ugaguggagaucgcaccauugc

SEQ ID NO: 131706 - RNA, 22 nt, Homo sapiens
ugaguguccaccccuuucacag

SEQ ID NO: 131707 - RNA, 22 nt, Homo sapiens
ugaguuaauuuuuguaucaugu

SEQ ID NO: 131708 - RNA, 22 nt, Homo sapiens
ugaguucaugcuuguaguucua

SEQ ID NO: 131709 - RNA, 18 nt, Homo sapiens
ugaguucauuagacuucc

SEQ ID NO: 131710 - RNA, 22 nt, Homo sapiens
ugaguuccuugugugaccuugc

SEQ ID NO: 131711 - RNA, 22 nt, Homo sapiens
ugaguucuuuuacauuuugaau

SEQ ID NO: 131712 - RNA, 22 nt, Homo sapiens
ugaguuguagcuauaguuucuu

SEQ ID NO: 131713 - RNA, 22 nt, Homo sapiens
acagugcuuggcacacaguaau

SEQ ID NO: 131714 - RNA, 19 nt, Homo sapiens
acagugcuuugucagaagc

SEQ ID NO: 131715 - RNA, 22 nt, Homo sapiens
acagugcuuuuguuccucuccu

SEQ ID NO: 131716 - RNA, 22 nt, Homo sapiens
acaguggaauguaggguuugag

SEQ ID NO: 131717 - RNA, 22 nt, Homo sapiens
acaguggugcgaucucggcuca

SEQ ID NO: 131718 - RNA, 22 nt, Homo sapiens
acaguguacaauagccuuuuaa

SEQ ID NO: 131719 - RNA, 22 nt, Homo sapiens
acaguguagugacugccaacuu

SEQ ID NO: 131720 - RNA, 18 nt, Homo sapiens
acagugucauggcucaau

SEQ ID NO: 131721 - RNA, 17 nt, Homo sapiens
acagugucuaugaaaug

SEQ ID NO: 131722 - RNA, 22 nt, Homo sapiens
acagugucugacacguaggaag

SEQ ID NO: 131723 - RNA, 18 nt, Homo sapiens
acaguguguaaggguucu

SEQ ID NO: 131724 - RNA, 22 nt, Homo sapiens
acauaugaguacaugugccaug

SEQ ID NO: 131725 - RNA, 21 nt, Homo sapiens
acaucagaguugugaagguag

SEQ ID NO: 131726 - RNA, 22 nt, Homo sapiens
acaucaggcuugugaugauuac

SEQ ID NO: 131727 - RNA, 22 nt, Homo sapiens
acauccauuugcuuuauuugcu

SEQ ID NO: 131728 - RNA, 22 nt, Homo sapiens
uuaaugugaaucaggaugcauu

SEQ ID NO: 131729 - RNA, 22 nt, Homo sapiens
uuaauuguaucuauagauguca

SEQ ID NO: 131730 - RNA, 22 nt, Homo sapiens
uuaauuguccaaguucaucucu

SEQ ID NO: 131731 - RNA, 22 nt, Homo sapiens
uuacacaguugguaggggcaga

SEQ ID NO: 131732 - RNA, 22 nt, Homo sapiens
uuacagguggagaaguaaggcu

SEQ ID NO: 131733 - RNA, 22 nt, Homo sapiens
uuacaguggugaccuuguauug

SEQ ID NO: 131734 - RNA, 22 nt, Homo sapiens
uuaccucuguggcucucggacu

SEQ ID NO: 131735 - RNA, 22 nt, Homo sapiens
uuacugcuagcugugugcucuu

SEQ ID NO: 131736 - RNA, 22 nt, Homo sapiens
uuacuguagugucauaucguau

SEQ ID NO: 131737 - RNA, 22 nt, Homo sapiens
uuagaaaguagaaaagcugguu

SEQ ID NO: 131738 - RNA, 22 nt, Homo sapiens
uuagaauggaaaugcgagguua

SEQ ID NO: 131739 - RNA, 19 nt, Homo sapiens
uuagagaucaucugcuuca

SEQ ID NO: 131740 - RNA, 17 nt, Homo sapiens
uuagagguagacucauu

SEQ ID NO: 131741 - RNA, 22 nt, Homo sapiens
uuagagguaggauuucaccaug

SEQ ID NO: 131742 - RNA, 22 nt, Homo sapiens
uuagaguacaggggaaucaagg

SEQ ID NO: 131743 - RNA, 18 nt, Homo sapiens
uuagagugcauuacuuug

SEQ ID NO: 131744 - RNA, 22 nt, Homo sapiens
uuagaugaagucacagaaccca

SEQ ID NO: 131745 - RNA, 18 nt, Homo sapiens
uuagaugguuuuaaaacu

SEQ ID NO: 131746 - RNA, 22 nt, Homo sapiens
uuagcaauagccugcaucugca

SEQ ID NO: 131747 - RNA, 22 nt, Homo sapiens
uuagcaauugauucucauaagc

SEQ ID NO: 131748 - RNA, 22 nt, Homo sapiens
uuagcagcaugaaaauggacug

SEQ ID NO: 131749 - RNA, 20 nt, Homo sapiens
uuagcagcaugauuuauaau

SEQ ID NO: 131750 - RNA, 21 nt, Homo sapiens
uuagcauccauguucaucaac

SEQ ID NO: 131751 - RNA, 19 nt, Homo sapiens
uuagguacuggauaugccc

SEQ ID NO: 131752 - RNA, 22 nt, Homo sapiens
uuagguauuuuguuaugucagc

SEQ ID NO: 131753 - RNA, 22 nt, Homo sapiens
uuaguaguagcugcaugucagu

SEQ ID NO: 131754 - RNA, 22 nt, Homo sapiens
uuagugaaugcaccacuucuga

SEQ ID NO: 131755 - RNA, 22 nt, Homo sapiens
uuagugaaugggugugauuugu

SEQ ID NO: 131756 - RNA, 22 nt, Homo sapiens
uuagugcaaacucuucaaugcu

SEQ ID NO: 131757 - RNA, 22 nt, Homo sapiens
uuagugcugaguggaauguucu

SEQ ID NO: 131758 - RNA, 19 nt, Homo sapiens
uuauacuguauuguuuagg

SEQ ID NO: 131759 - RNA, 22 nt, Homo sapiens
uuauagacacguuguaacaaac

SEQ ID NO: 131760 - RNA, 22 nt, Homo sapiens
uuauagcacuaagaagguaaua

SEQ ID NO: 131761 - RNA, 22 nt, Homo sapiens
uuauagcagugcccaacuccug

SEQ ID NO: 131762 - RNA, 22 nt, Homo sapiens
uuauagcuaacaucugugaaaa

SEQ ID NO: 131763 - RNA, 20 nt, Homo sapiens
uuauagcuacaucuugacug

SEQ ID NO: 131764 - RNA, 21 nt, Homo sapiens
uuauaguggcaugauuuauaa

SEQ ID NO: 131765 - RNA, 22 nt, Homo sapiens
uuaucacauugacugauuugca

SEQ ID NO: 131766 - RNA, 22 nt, Homo sapiens
uuauguaaaucaaucuggaauc

SEQ ID NO: 131767 - RNA, 22 nt, Homo sapiens
uuauuagguuaaccuauagcua

SEQ ID NO: 131768 - RNA, 22 nt, Homo sapiens
uuauuagguuagugcaaaaguu

SEQ ID NO: 131769 - RNA, 22 nt, Homo sapiens
uuauugcacuccagccugggua

SEQ ID NO: 131770 - RNA, 16 nt, Homo sapiens
uuauugcauucuucuc

SEQ ID NO: 131771 - RNA, 22 nt, Homo sapiens
uuauuguccaaguuucccuuug

SEQ ID NO: 131772 - RNA, 22 nt, Homo sapiens
uuauuugguugcugacuuggaa

SEQ ID NO: 131773 - RNA, 22 nt, Homo sapiens
uucaaaguaaaaauguguucac

SEQ ID NO: 131774 - RNA, 22 nt, Homo sapiens
uucaaaguuggaggacaaacug

SEQ ID NO: 131775 - RNA, 22 nt, Homo sapiens
uucaaaucuucguuuugccaua

SEQ ID NO: 131776 - RNA, 22 nt, Homo sapiens
uucaaauguucuuucaccaccc

SEQ ID NO: 131777 - RNA, 22 nt, Homo sapiens
uucaagauggccccagugagcc

SEQ ID NO: 131778 - RNA, 22 nt, Homo sapiens
uucaaggacuaaggauuuuugg

SEQ ID NO: 131779 - RNA, 22 nt, Homo sapiens
uucaagucuuggcuuugccacc

SEQ ID NO: 131780 - RNA, 22 nt, Homo sapiens
uucacagagagaacucaaacca

SEQ ID NO: 131781 - RNA, 22 nt, Homo sapiens
uucacagaguuauuuuuaugcu

SEQ ID NO: 131782 - RNA, 22 nt, Homo sapiens
uucacagcuuaauaaggcucag

SEQ ID NO: 131783 - RNA, 22 nt, Homo sapiens
uucacagucacccuucuccaug

SEQ ID NO: 131784 - RNA, 22 nt, Homo sapiens
uucacaguguguacaccagggg

SEQ ID NO: 131785 - RNA, 22 nt, Homo sapiens
uucacccugguuguagauggac

SEQ ID NO: 131786 - RNA, 22 nt, Homo sapiens
uucacugcacuccagccugagc

SEQ ID NO: 131787 - RNA, 22 nt, Homo sapiens
uucacugcaugaaaaggacagc

SEQ ID NO: 131788 - RNA, 22 nt, Homo sapiens
uucacuguagccucagccucuu

SEQ ID NO: 131789 - RNA, 22 nt, Homo sapiens
uucacuguagcuuggauguuua

SEQ ID NO: 131790 - RNA, 18 nt, Homo sapiens
auguggcuuuugaaggcu

SEQ ID NO: 131791 - RNA, 22 nt, Homo sapiens
augugggaggaauguguuucca

SEQ ID NO: 131792 - RNA, 23 nt, Homo sapiens
augugguuuuagguguugaacug

SEQ ID NO: 131793 - RNA, 22 nt, Homo sapiens
auguuacggaguuuuuauccag

SEQ ID NO: 131794 - RNA, 22 nt, Homo sapiens
auguugcuugaaggcauuuugu

SEQ ID NO: 131795 - RNA, 22 nt, Homo sapiens
auguuguaguaugagucaaaau

SEQ ID NO: 131796 - RNA, 22 nt, Homo sapiens
auguuuagagagggugucaaau

SEQ ID NO: 131797 - RNA, 22 nt, Homo sapiens
auguuugguagugaauauggua

SEQ ID NO: 131798 - RNA, 22 nt, Homo sapiens
auuaaauguuggacguauacau

SEQ ID NO: 131799 - RNA, 22 nt, Homo sapiens
auuaagugcuugcagaagucca

SEQ ID NO: 131800 - RNA, 22 nt, Homo sapiens
auuaaguuaggauuuugagaua

SEQ ID NO: 131801 - RNA, 22 nt, Homo sapiens
auuaaguugugccugaaaacuu

SEQ ID NO: 131802 - RNA, 22 nt, Homo sapiens
auuacacuuucuauucaaugag

SEQ ID NO: 131803 - RNA, 22 nt, Homo sapiens
auuacccuuagacuccagagug

SEQ ID NO: 131804 - RNA, 20 nt, Homo sapiens
auuagacuugccuuauccuu

SEQ ID NO: 131805 - RNA, 22 nt, Homo sapiens
auuagguauuuucuggacaggg

SEQ ID NO: 131806 - RNA, 22 nt, Homo sapiens
auuagguuaggcaaacuucugu

SEQ ID NO: 131807 - RNA, 22 nt, Homo sapiens
auuagguuguugcaaaaguaau

SEQ ID NO: 131808 - RNA, 22 nt, Homo sapiens
auuauaguguauacuugaaauu

SEQ ID NO: 131809 - RNA, 22 nt, Homo sapiens
auuauauguguaugugcauacc

SEQ ID NO: 131810 - RNA, 22 nt, Homo sapiens
auuauguuguauuuccuugcag

SEQ ID NO: 131811 - RNA, 22 nt, Homo sapiens
auuauugacucauagaaaggau

SEQ ID NO: 131812 - RNA, 22 nt, Homo sapiens
auucaaggagucuucgucccaa

SEQ ID NO: 131813 - RNA, 22 nt, Homo sapiens
auucaagucaucucuccgcauu

SEQ ID NO: 131814 - RNA, 20 nt, Homo sapiens
auucauggaggagcaauugg

SEQ ID NO: 131815 - RNA, 22 nt, Homo sapiens
auuccacuuccacuaguuucuc

SEQ ID NO: 131816 - RNA, 22 nt, Homo sapiens
auuccagauggaguugaggguu

SEQ ID NO: 131817 - RNA, 22 nt, Homo sapiens
auuccauaguacagugaugagu

SEQ ID NO: 131818 - RNA, 22 nt, Homo sapiens
auuccauagugucuguggcaga

SEQ ID NO: 131819 - RNA, 22 nt, Homo sapiens
cacagugaacaauauccucugu

SEQ ID NO: 131820 - RNA, 22 nt, Homo sapiens
cacaguguuccagcuauuugaa

SEQ ID NO: 131821 - RNA, 22 nt, Homo sapiens
cacauguuugcuacauuuuucu

SEQ ID NO: 131822 - RNA, 22 nt, Homo sapiens
cacauguuuuagcauggcuguu

SEQ ID NO: 131823 - RNA, 22 nt, Homo sapiens
caccacauuccauugaucaggc

SEQ ID NO: 131824 - RNA, 22 nt, Homo sapiens
caccaguuuuucagugauucaa

SEQ ID NO: 131825 - RNA, 22 nt, Homo sapiens
caccuguacauggcaguguccu

SEQ ID NO: 131826 - RNA, 22 nt, Homo sapiens
cacgugcuuucuuuucauuuag

SEQ ID NO: 131827 - RNA, 22 nt, Homo sapiens
cacugcacuccagccuaagagg

SEQ ID NO: 131828 - RNA, 21 nt, Homo sapiens
cacugcacuugccuucugggu

SEQ ID NO: 131829 - RNA, 22 nt, Homo sapiens
cacugcaguaaauugcgucggu

SEQ ID NO: 131830 - RNA, 22 nt, Homo sapiens
cacugcauggucuagcuggguu

SEQ ID NO: 131831 - RNA, 22 nt, Homo sapiens
cacugcgaccucugccuaccgg

SEQ ID NO: 131832 - RNA, 22 nt, Homo sapiens
cacuggcacuguguuuagaugg

SEQ ID NO: 131833 - RNA, 23 nt, Homo sapiens
cacugggcagcagguguucccag

SEQ ID NO: 131834 - RNA, 22 nt, Homo sapiens
cacugggugccauauguuugcu

SEQ ID NO: 131835 - RNA, 21 nt, Homo sapiens
cacugguguugcuauaucaaa

SEQ ID NO: 131836 - RNA, 22 nt, Homo sapiens
cagagaacauucagagcuguag

SEQ ID NO: 131837 - RNA, 22 nt, Homo sapiens
cagagaacugaguuauuuucuu

SEQ ID NO: 131838 - RNA, 22 nt, Homo sapiens
cagagaaugucuuuuuuaacca

SEQ ID NO: 131839 - RNA, 22 nt, Homo sapiens
cagagcacugauacuggguucu

SEQ ID NO: 131840 - RNA, 22 nt, Homo sapiens
cagagucaagcucuuguuccau

SEQ ID NO: 131841 - RNA, 22 nt, Homo sapiens
cagagugcauguuuagaugagu

SEQ ID NO: 131842 - RNA, 22 nt, Homo sapiens
cagauacuggccuggagcugug

SEQ ID NO: 131843 - RNA, 22 nt, Homo sapiens
cagauguaguauuuuagugaaa

SEQ ID NO: 131844 - RNA, 22 nt, Homo sapiens
cagcacauagcaguugcucagu

SEQ ID NO: 131845 - RNA, 20 nt, Homo sapiens
cagcacgcacaugagacugu

SEQ ID NO: 131846 - RNA, 22 nt, Homo sapiens
cagcagguuuuuaucaguuaag

SEQ ID NO: 131847 - RNA, 22 nt, Homo sapiens
cagccgggugagguggcuuguu

SEQ ID NO: 131848 - RNA, 22 nt, Homo sapiens
cagcgaggucugcgucacauug

SEQ ID NO: 131849 - RNA, 22 nt, Homo sapiens
cagcuaguuuuugguuuacagu

SEQ ID NO: 131850 - RNA, 22 nt, Homo sapiens
cagcugaugucgaaugcacucu

SEQ ID NO: 131851 - RNA, 22 nt, Homo sapiens
caggaccucuugccuggaagcc

SEQ ID NO: 131852 - RNA, 22 nt, Homo sapiens
cagggcauuggcugguaccugg

SEQ ID NO: 131853 - RNA, 22 nt, Homo sapiens
ggcaagugggagggaguguuuc

SEQ ID NO: 131854 - RNA, 22 nt, Homo sapiens
ggcaccacagacgccaggcgug

SEQ ID NO: 131855 - RNA, 19 nt, Homo sapiens
ggcacugugugagugagga

SEQ ID NO: 131856 - RNA, 22 nt, Homo sapiens
ggcacuguugccggccugaauu

SEQ ID NO: 131857 - RNA, 22 nt, Homo sapiens
ggcagaauugcugaggaugcua

SEQ ID NO: 131858 - RNA, 22 nt, Homo sapiens
ggcagcucaggccccgcgcuga

SEQ ID NO: 131859 - RNA, 22 nt, Homo sapiens
ggcaguggaagugccaguuucu

SEQ ID NO: 131860 - RNA, 22 nt, Homo sapiens
ggcaguguauuacuuaggguuc

SEQ ID NO: 131861 - RNA, 22 nt, Homo sapiens
ggcauugaguggguaggaguca

SEQ ID NO: 131862 - RNA, 22 nt, Homo sapiens
ggcccaguugcgggugguaccg

SEQ ID NO: 131863 - RNA, 18 nt, Homo sapiens
ggcggguguuuuauucac

SEQ ID NO: 131864 - RNA, 22 nt, Homo sapiens
ggcuagagaauagugccacuaa

SEQ ID NO: 131865 - RNA, 22 nt, Homo sapiens
ggcuagagagcucagggauaug

SEQ ID NO: 131866 - RNA, 22 nt, Homo sapiens
ggcuauagauaugugaacacuu

SEQ ID NO: 131867 - RNA, 19 nt, Homo sapiens
ggcucagucaacugacugu

SEQ ID NO: 131868 - RNA, 21 nt, Homo sapiens
ggcucuguggucucagguuuc

SEQ ID NO: 131869 - RNA, 18 nt, Homo sapiens
ggcugguguuuuaguaua

SEQ ID NO: 131870 - RNA, 22 nt, Homo sapiens
ggcuguguguuaaaauaggcuu

SEQ ID NO: 131871 - RNA, 22 nt, Homo sapiens
gggaaaaugucuauugaaugaa

SEQ ID NO: 131872 - RNA, 22 nt, Homo sapiens
gggaaauguaaagucauaagau

SEQ ID NO: 131873 - RNA, 22 nt, Homo sapiens
gggaagauauaggcugggcacc

SEQ ID NO: 131874 - RNA, 22 nt, Homo sapiens
gggaaugaagagaaccuuccca

SEQ ID NO: 131875 - RNA, 22 nt, Homo sapiens
gggagguagguauuagcuuuuc

SEQ ID NO: 131876 - RNA, 22 nt, Homo sapiens
gggaggucauuguaaggucuua

SEQ ID NO: 131877 - RNA, 22 nt, Homo sapiens
gggagugugcacacaugguaua

SEQ ID NO: 131878 - RNA, 22 nt, Homo sapiens
gggaugaaguugauguagaaag

SEQ ID NO: 131879 - RNA, 23 nt, Homo sapiens
gggauuguaaaauaugagggcag

SEQ ID NO: 131880 - RNA, 22 nt, Homo sapiens
gggcaagaagucuuguaguuuu

SEQ ID NO: 131881 - RNA, 22 nt, Homo sapiens
gggcagaugucuggacaccuca

SEQ ID NO: 131882 - RNA, 22 nt, Homo sapiens
gggcaugauggugcacacaugu

SEQ ID NO: 131883 - RNA, 22 nt, Homo sapiens
gggcauguggacuuguauguuu

SEQ ID NO: 131884 - RNA, 22 nt, Homo sapiens
gggcauugugggcagagggcag

SEQ ID NO: 131885 - RNA, 22 nt, Homo sapiens
ggggaguguggacaucacccug

SEQ ID NO: 131886 - RNA, 22 nt, Homo sapiens
gggguauguaagugagugagug

SEQ ID NO: 131887 - RNA, 22 nt, Homo sapiens
gggucaguuuugagaaagcgug

SEQ ID NO: 131888 - RNA, 17 nt, Homo sapiens
gguacguuuuguucugu

SEQ ID NO: 131889 - RNA, 22 nt, Homo sapiens
gguauguagcaaaagaggugcu

SEQ ID NO: 131890 - RNA, 22 nt, Homo sapiens
gguauguuuagaccauuuacau

SEQ ID NO: 131891 - RNA, 22 nt, Homo sapiens
ggucaacaucaucaugguaagu

SEQ ID NO: 131892 - RNA, 22 nt, Homo sapiens
ggucauguguccaggagguagc

SEQ ID NO: 131893 - RNA, 22 nt, Homo sapiens
ggucccccuccacucucgcaaa

SEQ ID NO: 131894 - RNA, 22 nt, Homo sapiens
ggugacagugguuaaaauuugu

SEQ ID NO: 131895 - RNA, 22 nt, Homo sapiens
gucaccagcuguguuagccccu

SEQ ID NO: 131896 - RNA, 22 nt, Homo sapiens
gucaccauugagucauuuccuc

SEQ ID NO: 131897 - RNA, 22 nt, Homo sapiens
gucacugacaagagagaagaac

SEQ ID NO: 131898 - RNA, 22 nt, Homo sapiens
gucacugagcaauagaaaguuu

SEQ ID NO: 131899 - RNA, 22 nt, Homo sapiens
gucacugccugaggcugaugca

SEQ ID NO: 131900 - RNA, 22 nt, Homo sapiens
gucacuggcugucuuguaugau

SEQ ID NO: 131901 - RNA, 22 nt, Homo sapiens
gucacuguuuccuauuauauuu

SEQ ID NO: 131902 - RNA, 22 nt, Homo sapiens
gucagggagggauagaugauua

SEQ ID NO: 131903 - RNA, 22 nt, Homo sapiens
gucagguaccugaaagcagcca

SEQ ID NO: 131904 - RNA, 22 nt, Homo sapiens
gucagugucuuaacagagauua

SEQ ID NO: 131905 - RNA, 22 nt, Homo sapiens
gucaguuucacucagcuggaac

SEQ ID NO: 131906 - RNA, 22 nt, Homo sapiens
gucauugagucagggaguaucu

SEQ ID NO: 131907 - RNA, 22 nt, Homo sapiens
guccaaauccaugggauguaca

SEQ ID NO: 131908 - RNA, 20 nt, Homo sapiens
guccauuugcugccauugcu

SEQ ID NO: 131909 - RNA, 18 nt, Homo sapiens
guccauuuguugguacac

SEQ ID NO: 131910 - RNA, 22 nt, Homo sapiens
gucccaguggaaccuccaagcu

SEQ ID NO: 131911 - RNA, 22 nt, Homo sapiens
guccuugaggcuuugacugugg

SEQ ID NO: 131912 - RNA, 22 nt, Homo sapiens
gucuagaacuucugaccuuagg

SEQ ID NO: 131913 - RNA, 22 nt, Homo sapiens
gucucacagcuagcugcuuuau

SEQ ID NO: 131914 - RNA, 22 nt, Homo sapiens
gucucagugcgaaucucaaaga

SEQ ID NO: 131915 - RNA, 22 nt, Homo sapiens
gucucccaaccccugugcccag

SEQ ID NO: 131916 - RNA, 22 nt, Homo sapiens
gucucccagccuacaucuuucu

SEQ ID NO: 131917 - RNA, 22 nt, Homo sapiens
gucuccgagccguguggagccg

SEQ ID NO: 131918 - RNA, 22 nt, Homo sapiens
gucucugagaugucaacaccua

SEQ ID NO: 131919 - RNA, 22 nt, Homo sapiens
gucucuuguuaucauuucugag

SEQ ID NO: 131920 - RNA, 22 nt, Homo sapiens
gucugagcauggggccggcagg

SEQ ID NO: 131921 - RNA, 22 nt, Homo sapiens
gucugcaugucauaugauagua

SEQ ID NO: 131922 - RNA, 22 nt, Homo sapiens
gucuggcuccugucuaaucacu

SEQ ID NO: 131923 - RNA, 22 nt, Homo sapiens
gucugguugacagcauguggcc

SEQ ID NO: 131924 - RNA, 20 nt, Homo sapiens
gucuugcuccguugcccagg

SEQ ID NO: 131925 - RNA, 22 nt, Homo sapiens
gucuuuaguugaaacauguggu

SEQ ID NO: 131926 - RNA, 17 nt, Homo sapiens
gucuuugguugaguuua

SEQ ID NO: 131927 - RNA, 22 nt, Homo sapiens
gucuuuguuuugauuuaccaga

SEQ ID NO: 131928 - RNA, 22 nt, Homo sapiens
gugaaagauuaaaccagugugu

SEQ ID NO: 131929 - RNA, 22 nt, Homo sapiens
gugaaauguguagaggaucugg

SEQ ID NO: 131930 - RNA, 22 nt, Homo sapiens
gugaacuguuugaggaagagaa

SEQ ID NO: 131931 - RNA, 22 nt, Homo sapiens
gugaagaucccuguccuguucc

SEQ ID NO: 131932 - RNA, 20 nt, Homo sapiens
gugaauacauuugguuucau

SEQ ID NO: 131933 - RNA, 22 nt, Homo sapiens
gugaauguaaagucaugugacu

SEQ ID NO: 131934 - RNA, 22 nt, Homo sapiens
gugacacagcaagacuccgucu

SEQ ID NO: 131935 - RNA, 22 nt, Homo sapiens
gugacacuggagcuggcacaau

SEQ ID NO: 131936 - RNA, 22 nt, Homo sapiens
gugacagucaaagacaugacuu

SEQ ID NO: 131937 - RNA, 22 nt, Homo sapiens
gugaccucuguugcugucacua

SEQ ID NO: 131938 - RNA, 22 nt, Homo sapiens
gugacgucauuguuccuggcuc

SEQ ID NO: 131939 - RNA, 22 nt, Homo sapiens
gugacuggacucugaagaaaau

SEQ ID NO: 131940 - RNA, 18 nt, Homo sapiens
gugagaaugacuguucug

SEQ ID NO: 131941 - RNA, 22 nt, Homo sapiens
gugagcagagaucgcgugauug

SEQ ID NO: 131942 - RNA, 22 nt, Homo sapiens
gugagcuccucuucugcugcag

SEQ ID NO: 131943 - RNA, 21 nt, Homo sapiens
gugaggaguuacuggcuuuga

SEQ ID NO: 131944 - RNA, 20 nt, Homo sapiens
gugagguagaggguuaccug

SEQ ID NO: 131945 - RNA, 22 nt, Homo sapiens
gugagguauacugggaucacua

SEQ ID NO: 131946 - RNA, 22 nt, Homo sapiens
gugauacugcuuauuaauuuaa

SEQ ID NO: 131947 - RNA, 22 nt, Homo sapiens
gugaucaugauccugaagcauu

SEQ ID NO: 131948 - RNA, 22 nt, Homo sapiens
gugaugacauucagagaugaag

SEQ ID NO: 131949 - RNA, 22 nt, Homo sapiens
gugauguguuucaacagcuccu

SEQ ID NO: 131950 - RNA, 22 nt, Homo sapiens
gugauuauccacgucuuuguga

SEQ ID NO: 131951 - RNA, 22 nt, Homo sapiens
gugauuguuaaacugccucucu

SEQ ID NO: 131952 - RNA, 22 nt, Homo sapiens
gugcaaccaucaccacugacuc

SEQ ID NO: 131953 - RNA, 21 nt, Homo sapiens
gugcaacucccucucccuaca

SEQ ID NO: 131954 - RNA, 22 nt, Homo sapiens
gugcaagagugacugcaguuuu

SEQ ID NO: 131955 - RNA, 22 nt, Homo sapiens
gugcaagagugauugcaguuuu

SEQ ID NO: 131956 - RNA, 18 nt, Homo sapiens
gugcaaugaauagcagag

SEQ ID NO: 131957 - RNA, 22 nt, Homo sapiens
gugcaaugagaaggggcucugg

SEQ ID NO: 131958 - RNA, 22 nt, Homo sapiens
gugcacaacgugcaggcuuguu

SEQ ID NO: 131959 - RNA, 22 nt, Homo sapiens
gugcacaaucgugcauuccuug

SEQ ID NO: 131960 - RNA, 22 nt, Homo sapiens
gugcacaaugugcagguuuguu

SEQ ID NO: 131961 - RNA, 22 nt, Homo sapiens
gugcacaugguagguauugagu

SEQ ID NO: 131962 - RNA, 22 nt, Homo sapiens
gugcagugugauccuuccguau

SEQ ID NO: 131963 - RNA, 22 nt, Homo sapiens
gugcaguuuacaguuacccagu

SEQ ID NO: 131964 - RNA, 22 nt, Homo sapiens
gugcaguuugaaaguagaaaca

SEQ ID NO: 131965 - RNA, 18 nt, Homo sapiens
gugcauagccauggcagc

SEQ ID NO: 131966 - RNA, 22 nt, Homo sapiens
gugcauaugcaugugcaugcac

SEQ ID NO: 131967 - RNA, 22 nt, Homo sapiens
gugcaugucuaugcgagucuaa

SEQ ID NO: 131968 - RNA, 22 nt, Homo sapiens
gugccacugcaccuggccuaag

SEQ ID NO: 131969 - RNA, 22 nt, Homo sapiens
gugccuucuagcuaugguuggc

SEQ ID NO: 131970 - RNA, 22 nt, Homo sapiens
gugcgggaggcgcgccuaggug

SEQ ID NO: 131971 - RNA, 22 nt, Homo sapiens
gugcuaggugcuaggaagauag

SEQ ID NO: 131972 - RNA, 22 nt, Homo sapiens
gugcuauguuauccagcaagau

SEQ ID NO: 131973 - RNA, 22 nt, Homo sapiens
gugcucauuuagagagaagcac

SEQ ID NO: 131974 - RNA, 22 nt, Homo sapiens
guggaaaacauaugcuuguuga

SEQ ID NO: 131975 - RNA, 22 nt, Homo sapiens
guggaaaaguaguugcgguuuu

SEQ ID NO: 131976 - RNA, 22 nt, Homo sapiens
guggaagauaguguguuaaugu

SEQ ID NO: 131977 - RNA, 22 nt, Homo sapiens
guggaagguaaugcagcuuacu

SEQ ID NO: 131978 - RNA, 22 nt, Homo sapiens
guggaaggucaugaauguucuu

SEQ ID NO: 131979 - RNA, 22 nt, Homo sapiens
guggaauauaaagcaucgugua

SEQ ID NO: 131980 - RNA, 22 nt, Homo sapiens
guggaauggaaugauuguguau

SEQ ID NO: 131981 - RNA, 22 nt, Homo sapiens
guggaggacuggauaaagaaaa

SEQ ID NO: 131982 - RNA, 22 nt, Homo sapiens
guggaggagaaagaagcauuuc

SEQ ID NO: 131983 - RNA, 22 nt, Homo sapiens
guggaguacugagggucacuua

SEQ ID NO: 131984 - RNA, 22 nt, Homo sapiens
guggaucacuugaggucaagag

SEQ ID NO: 131985 - RNA, 22 nt, Homo sapiens
guggcacaauuaaguagcuauu

SEQ ID NO: 131986 - RNA, 22 nt, Homo sapiens
guggcuagaaugaagguagcug

SEQ ID NO: 131987 - RNA, 22 nt, Homo sapiens
guggcuuguaggggucaaggga

SEQ ID NO: 131988 - RNA, 22 nt, Homo sapiens
guggcuuuaaguacgauugagg

SEQ ID NO: 131989 - RNA, 22 nt, Homo sapiens
gugggagugucccguuuuucca

SEQ ID NO: 131990 - RNA, 22 nt, Homo sapiens
uugggcaauaggaagcaggugg

SEQ ID NO: 131991 - RNA, 22 nt, Homo sapiens
uuggggcacggccucuguugcc

SEQ ID NO: 131992 - RNA, 22 nt, Homo sapiens
uugggucaguuccuugacuccu

SEQ ID NO: 131993 - RNA, 22 nt, Homo sapiens
uugguaaugggcugguauaacc

SEQ ID NO: 131994 - RNA, 22 nt, Homo sapiens
uugguacuacacuucuaaucuu

SEQ ID NO: 131995 - RNA, 22 nt, Homo sapiens
uuggucagcuagauuauucccu

SEQ ID NO: 131996 - RNA, 22 nt, Homo sapiens
uuggucaggcuagaguguggug

SEQ ID NO: 131997 - RNA, 21 nt, Homo sapiens
uugguccacaugucauaguua

SEQ ID NO: 131998 - RNA, 22 nt, Homo sapiens
uugguccauuacauugaugaca

SEQ ID NO: 131999 - RNA, 22 nt, Homo sapiens
uugguccccacuccccugccaa

SEQ ID NO: 132000 - RNA, 22 nt, Homo sapiens
uugguccucccaugcucaagag

SEQ ID NO: 132001 - RNA, 23 nt, Homo sapiens
uuggucucccaaaguguugagau

SEQ ID NO: 132002 - RNA, 21 nt, Homo sapiens
uuggucuucucugugauucuu

SEQ ID NO: 132003 - RNA, 22 nt, Homo sapiens
uugguucucuuuauaugcugga

SEQ ID NO: 132004 - RNA, 22 nt, Homo sapiens
uuguaaacaucuguacauugcu

SEQ ID NO: 132005 - RNA, 22 nt, Homo sapiens
uuguaacaugcuuucacuucag

SEQ ID NO: 132006 - RNA, 22 nt, Homo sapiens
uuguaccacagggcaugaagug

SEQ ID NO: 132007 - RNA, 22 nt, Homo sapiens
uuguacuucagacaugccaaag

SEQ ID NO: 132008 - RNA, 22 nt, Homo sapiens
uuguacuuuuaguagagacggg

SEQ ID NO: 132009 - RNA, 22 nt, Homo sapiens
uuguauccaucuuucaggcaac

SEQ ID NO: 132010 - RNA, 22 nt, Homo sapiens
uuguauguuguuugucagagaa

SEQ ID NO: 132011 - RNA, 22 nt, Homo sapiens
uugucaccucuaaaucucauau

SEQ ID NO: 132012 - RNA, 22 nt, Homo sapiens
uugucacugcacuccagucugg

SEQ ID NO: 132013 - RNA, 22 nt, Homo sapiens
uugucaguguucacucaaagcu

SEQ ID NO: 132014 - RNA, 22 nt, Homo sapiens
uuguccacugcuagccucugca

SEQ ID NO: 132015 - RNA, 22 nt, Homo sapiens
uuguccauggacagcaccacag

SEQ ID NO: 132016 - RNA, 22 nt, Homo sapiens
uuguccccacccaaaugucauc

SEQ ID NO: 132017 - RNA, 19 nt, Homo sapiens
uuguccccucuaaaucuca

SEQ ID NO: 132018 - RNA, 22 nt, Homo sapiens
uuguccccuuccaaaucucaug

SEQ ID NO: 132019 - RNA, 22 nt, Homo sapiens
uuguccuggagguucuugcaag

SEQ ID NO: 132020 - RNA, 22 nt, Homo sapiens
uugugaaaucuaggcagagguu

SEQ ID NO: 132021 - RNA, 22 nt, Homo sapiens
uugugaagaugugaagcaagca

SEQ ID NO: 132022 - RNA, 22 nt, Homo sapiens
uugugaauggugccacaauaaa

SEQ ID NO: 132023 - RNA, 22 nt, Homo sapiens
uugugauggugcauacugagcu

SEQ ID NO: 132024 - RNA, 22 nt, Homo sapiens
uugugcaaaguugugguuucug

SEQ ID NO: 132025 - RNA, 20 nt, Homo sapiens
uugugcauugggccauuggg

SEQ ID NO: 132026 - RNA, 21 nt, Homo sapiens
uugugccaaacccuggaggga

SEQ ID NO: 132027 - RNA, 22 nt, Homo sapiens
uugugcuuaaugaguguaaggu

SEQ ID NO: 132028 - RNA, 19 nt, Homo sapiens
uugugggaggacagagggg

SEQ ID NO: 132029 - RNA, 22 nt, Homo sapiens
uugugguaggcauguaagauga

SEQ ID NO: 132030 - RNA, 22 nt, Homo sapiens
uugugguugaugaagacugucu

SEQ ID NO: 132031 - RNA, 22 nt, Homo sapiens
uugugguuuuagcacuguggau

SEQ ID NO: 132032 - RNA, 22 nt, Homo sapiens
uuguguuuuuaguagggaaggg

SEQ ID NO: 132033 - RNA, 22 nt, Homo sapiens
uuguuauguaucucaagauaaa

SEQ ID NO: 132034 - RNA, 22 nt, Homo sapiens
uuguucaggagguuggggaugc

SEQ ID NO: 132035 - RNA, 23 nt, Homo sapiens
uuguucccuuccacucagucucc

SEQ ID NO: 132036 - RNA, 22 nt, Homo sapiens
uuuaaacugucuuggguuugga

SEQ ID NO: 132037 - RNA, 22 nt, Homo sapiens
uuuaaaguuagaaggaaagggc

SEQ ID NO: 132038 - RNA, 22 nt, Homo sapiens
uuuaaggcaugccuguacaugc

SEQ ID NO: 132039 - RNA, 22 nt, Homo sapiens
uuuaagguauguggugaaaauu

SEQ ID NO: 132040 - RNA, 22 nt, Homo sapiens
uuuaauacugcaucuuuacucu

SEQ ID NO: 132041 - RNA, 22 nt, Homo sapiens
uuuaauagcagggacuuccggg

SEQ ID NO: 132042 - RNA, 22 nt, Homo sapiens
uuuaaugcacuaggugguguuc

SEQ ID NO: 132043 - RNA, 22 nt, Homo sapiens
uuuaauguuacaguauugguau

SEQ ID NO: 132044 - RNA, 22 nt, Homo sapiens
uuuacccugaggaaucuauuuu

SEQ ID NO: 132045 - RNA, 22 nt, Homo sapiens
uuuagcaaagcaauuuacacca

SEQ ID NO: 132046 - RNA, 22 nt, Homo sapiens
uuuagcagcaaagagccaugcu

SEQ ID NO: 132047 - RNA, 22 nt, Homo sapiens
uuuagguagucaaagguuaguc

SEQ ID NO: 132048 - RNA, 22 nt, Homo sapiens
uuuaucaggccuuuggaaaaau

SEQ ID NO: 132049 - RNA, 22 nt, Homo sapiens
uuuaucuguuuaaaacuguuca

SEQ ID NO: 132050 - RNA, 22 nt, Homo sapiens
uuuauugcucuaaaguugccau

SEQ ID NO: 132051 - RNA, 22 nt, Homo sapiens
uuucaacuaauuuuuuggugag

SEQ ID NO: 132052 - RNA, 19 nt, Homo sapiens
uuucaauguaaggauggag

SEQ ID NO: 132053 - RNA, 22 nt, Homo sapiens
uuucacagagggcuucuuucua

SEQ ID NO: 132054 - RNA, 17 nt, Homo sapiens
uuucagaguggaagugu

SEQ ID NO: 132055 - RNA, 22 nt, Homo sapiens
uuucaggcaagggugacccuga

SEQ ID NO: 132056 - RNA, 22 nt, Homo sapiens
uuucaggcagggagcuucagug

SEQ ID NO: 132057 - RNA, 18 nt, Homo sapiens
uuucaggguggacaugag

SEQ ID NO: 132058 - RNA, 20 nt, Homo sapiens
uuucaguacuuucuacuggc

SEQ ID NO: 132059 - RNA, 22 nt, Homo sapiens
uuucaguagagacacgguuuug

SEQ ID NO: 132060 - RNA, 22 nt, Homo sapiens
uuucaucaagcacagaguagau

SEQ ID NO: 132061 - RNA, 22 nt, Homo sapiens
uuucauggaauauagucauuuu

SEQ ID NO: 132062 - RNA, 22 nt, Homo sapiens
uuucauggagaaucuucuuacu

SEQ ID NO: 132063 - RNA, 22 nt, Homo sapiens
uuucauguuuuucugugaggca

SEQ ID NO: 132064 - RNA, 22 nt, Homo sapiens
uuuccacauggacuuaccuucg

SEQ ID NO: 132065 - RNA, 22 nt, Homo sapiens
uuuccagguggccaacauuuua

SEQ ID NO: 132066 - RNA, 22 nt, Homo sapiens
uuuccaguuguucuagaaagcu

SEQ ID NO: 132067 - RNA, 22 nt, Homo sapiens
uuucccugaaggcucugaaguc

SEQ ID NO: 132068 - RNA, 22 nt, Homo sapiens
uuucccuuuagcuuagugauuu

SEQ ID NO: 132069 - RNA, 22 nt, Homo sapiens
uuucccuuugcuuugucagcca

SEQ ID NO: 132070 - RNA, 16 nt, Homo sapiens
uuucuauguuuuacua

SEQ ID NO: 132071 - RNA, 17 nt, Homo sapiens
uuucucagcccucuucu

SEQ ID NO: 132072 - RNA, 21 nt, Homo sapiens
uuucugggggagcauggcagg

SEQ ID NO: 132073 - RNA, 22 nt, Homo sapiens
uuugaaaguaauuugguuggug

SEQ ID NO: 132074 - RNA, 22 nt, Homo sapiens
uuugaaguguggcacugaguuu

SEQ ID NO: 132075 - RNA, 22 nt, Homo sapiens
uuugacaaugugugcuuguauu

SEQ ID NO: 132076 - RNA, 22 nt, Homo sapiens
uugaggaaugucauuuguguuu

SEQ ID NO: 132077 - RNA, 22 nt, Homo sapiens
uugaggaaugugauuucaaaua

SEQ ID NO: 132078 - RNA, 22 nt, Homo sapiens
uugaggacugcuaagcauuuga

SEQ ID NO: 132079 - RNA, 22 nt, Homo sapiens
uugaggacugguugaaagcuuu

SEQ ID NO: 132080 - RNA, 22 nt, Homo sapiens
uugaggaggcagucucuccauu

SEQ ID NO: 132081 - RNA, 22 nt, Homo sapiens
uugaggaggcagucuucccauu

SEQ ID NO: 132082 - RNA, 22 nt, Homo sapiens
uugaggaguacugauuagguau

SEQ ID NO: 132083 - RNA, 22 nt, Homo sapiens
uugaggcaaugaggagaagcug

SEQ ID NO: 132084 - RNA, 16 nt, Homo sapiens
uugaggcaugucucag

SEQ ID NO: 132085 - RNA, 22 nt, Homo sapiens
uugaggccugauaacacacuga

SEQ ID NO: 132086 - RNA, 22 nt, Homo sapiens
uugaggcuuuugaccucaugug

SEQ ID NO: 132087 - RNA, 22 nt, Homo sapiens
uugagggaagccagaggucugc

SEQ ID NO: 132088 - RNA, 22 nt, Homo sapiens
uugagguaguacuuauuauugg

SEQ ID NO: 132089 - RNA, 22 nt, Homo sapiens
uugaggucagagguucgagacc

SEQ ID NO: 132090 - RNA, 22 nt, Homo sapiens
uugagguggugucuugcucugu

SEQ ID NO: 132091 - RNA, 22 nt, Homo sapiens
uugaguaguaaggauauuaucu

SEQ ID NO: 132092 - RNA, 22 nt, Homo sapiens
uugauaauguuaacuuugguca

SEQ ID NO: 132093 - RNA, 22 nt, Homo sapiens
uugauaguccuguaucuauuuu

SEQ ID NO: 132094 - RNA, 22 nt, Homo sapiens
uugauaguuuaauuaaugcuag

SEQ ID NO: 132095 - RNA, 22 nt, Homo sapiens
uugauaguuuuaaaauuaaucu

SEQ ID NO: 132096 - RNA, 22 nt, Homo sapiens
uugauauauugcaugggcuacu

SEQ ID NO: 132097 - RNA, 22 nt, Homo sapiens
uugauaugcuugucaguccauu

SEQ ID NO: 132098 - RNA, 22 nt, Homo sapiens
uugauauuaaguacugaagugg

SEQ ID NO: 132099 - RNA, 22 nt, Homo sapiens
uugauauuacucaguaacagau

SEQ ID NO: 132100 - RNA, 22 nt, Homo sapiens
uugaucaauagaauacaacaga

SEQ ID NO: 132101 - RNA, 22 nt, Homo sapiens
uugaucugugucccugcccaau

SEQ ID NO: 132102 - RNA, 22 nt, Homo sapiens
uugauguccaucucuagguaaa

SEQ ID NO: 132103 - RNA, 22 nt, Homo sapiens
uugcaacauuguaaguuuauau

SEQ ID NO: 132104 - RNA, 22 nt, Homo sapiens
uugcaagauguucaugggcugu

SEQ ID NO: 132105 - RNA, 22 nt, Homo sapiens
uugcacaauggaauuuaucuuu

SEQ ID NO: 132106 - RNA, 22 nt, Homo sapiens
uugcacauguugaaccagcaaa

SEQ ID NO: 132107 - RNA, 22 nt, Homo sapiens
uugcacauugauuuuguaucuu

SEQ ID NO: 132108 - RNA, 22 nt, Homo sapiens
uugcacuccagcucgggugaca

SEQ ID NO: 132109 - RNA, 22 nt, Homo sapiens
uugcacucugaagaccuacugu

SEQ ID NO: 132110 - RNA, 22 nt, Homo sapiens
uugcacugagauuuugcuuaca

SEQ ID NO: 132111 - RNA, 22 nt, Homo sapiens
uugcacuguaauuuauuuaugu

SEQ ID NO: 132112 - RNA, 22 nt, Homo sapiens
uugcacuuccgccugggugaca

SEQ ID NO: 132113 - RNA, 22 nt, Homo sapiens
uugcagagccccugcaaggguc

SEQ ID NO: 132114 - RNA, 22 nt, Homo sapiens
uugcagagucaguuauuuugcc

SEQ ID NO: 132115 - RNA, 22 nt, Homo sapiens
uugcagcaaauaggaaugagga

SEQ ID NO: 132116 - RNA, 22 nt, Homo sapiens
uugcagcaacauggaugaaacu

SEQ ID NO: 132117 - RNA, 22 nt, Homo sapiens
uugcaguaguaacuccuuaccu

SEQ ID NO: 132118 - RNA, 22 nt, Homo sapiens
uugcauaagugcauucugugau

SEQ ID NO: 132119 - RNA, 22 nt, Homo sapiens
uugcauagaccgaugucuugga

SEQ ID NO: 132120 - RNA, 19 nt, Homo sapiens
uugcauauguugaaccagc

SEQ ID NO: 132121 - RNA, 22 nt, Homo sapiens
uugcaucagcaggcauaauugg

SEQ ID NO: 132122 - RNA, 22 nt, Homo sapiens
uugcauugacacaugaagcuca

SEQ ID NO: 132123 - RNA, 22 nt, Homo sapiens
uugcauuuucuaggagggcaaa

SEQ ID NO: 132124 - RNA, 22 nt, Homo sapiens
uugccaauauuuuacugagaag

SEQ ID NO: 132125 - RNA, 22 nt, Homo sapiens
uugccacuucucuugccccauu

SEQ ID NO: 132126 - RNA, 22 nt, Homo sapiens
uugccauagugcugccagauau

SEQ ID NO: 132127 - RNA, 22 nt, Homo sapiens
uugccuaggcuggagugcagug

SEQ ID NO: 132128 - RNA, 22 nt, Homo sapiens
uugccuaguuuaggucugugcu

SEQ ID NO: 132129 - RNA, 22 nt, Homo sapiens
uugccuauucacucugaugaua

SEQ ID NO: 132130 - RNA, 22 nt, Homo sapiens
uugcgcuuuuccuauguugccc

SEQ ID NO: 132131 - RNA, 22 nt, Homo sapiens
uugcuacauugauugccucuuu

SEQ ID NO: 132132 - RNA, 22 nt, Homo sapiens
uugcuucuuucgucuggcccca

SEQ ID NO: 132133 - RNA, 22 nt, Homo sapiens
uuggaaauguguuugcauucag

SEQ ID NO: 132134 - RNA, 22 nt, Homo sapiens
uuggaacacauguuuuucuacc

SEQ ID NO: 132135 - RNA, 22 nt, Homo sapiens
uuggaagagaagggagauaaac

SEQ ID NO: 132136 - RNA, 22 nt, Homo sapiens
uuggaaggcugaauggccucuc

SEQ ID NO: 132137 - RNA, 22 nt, Homo sapiens
uuggaagguaaucaaaaguucu

SEQ ID NO: 132138 - RNA, 22 nt, Homo sapiens
uuggaauauaaccuguuucuaa

SEQ ID NO: 132139 - RNA, 22 nt, Homo sapiens
uuggaaugcaacagaaggauaa

SEQ ID NO: 132140 - RNA, 22 nt, Homo sapiens
uuggaauguauggcaucuugcg

SEQ ID NO: 132141 - RNA, 22 nt, Homo sapiens
uuggacuacagauuacuucauc

SEQ ID NO: 132142 - RNA, 22 nt, Homo sapiens
uuggauuauaaacugagauuug

SEQ ID NO: 132143 - RNA, 22 nt, Homo sapiens
uuggauuuugguggcaacucau

SEQ ID NO: 132144 - RNA, 22 nt, Homo sapiens
uuggcaaagaggaaugccacuu

SEQ ID NO: 132145 - RNA, 22 nt, Homo sapiens
uuggcaaagugucuggcauuua

SEQ ID NO: 132146 - RNA, 22 nt, Homo sapiens
uuggcaacauagugagaccccc

SEQ ID NO: 132147 - RNA, 22 nt, Homo sapiens
uuggcaagaauguaugccgauc

SEQ ID NO: 132148 - RNA, 22 nt, Homo sapiens
uuggcaagcuguuaauuauaaa

SEQ ID NO: 132149 - RNA, 22 nt, Homo sapiens
uuggcaaguuucugucagcaaa

SEQ ID NO: 132150 - RNA, 22 nt, Homo sapiens
uuggcacuugauaauauucugg

SEQ ID NO: 132151 - RNA, 22 nt, Homo sapiens
uuggcagaaaaggucggggguu

SEQ ID NO: 132152 - RNA, 22 nt, Homo sapiens
uuggcaguaucuacuacagcua

SEQ ID NO: 132153 - RNA, 22 nt, Homo sapiens
uuggcagugguucugacggacc

SEQ ID NO: 132154 - RNA, 22 nt, Homo sapiens
uuggcauugaguuucaaaucau

SEQ ID NO: 132155 - RNA, 22 nt, Homo sapiens
uuggcauugccaaacugucaac

SEQ ID NO: 132156 - RNA, 22 nt, Homo sapiens
uuggccagugucuuuuuuuccu

SEQ ID NO: 132157 - RNA, 22 nt, Homo sapiens
uuggccauggagcacuuuucua

SEQ ID NO: 132158 - RNA, 22 nt, Homo sapiens
uuggccccucccaaauuucaug

SEQ ID NO: 132159 - RNA, 21 nt, Homo sapiens
uuggccuggaggccugaaugu

SEQ ID NO: 132160 - RNA, 22 nt, Homo sapiens
uuggccuuuucaaugccucuuu

SEQ ID NO: 132161 - RNA, 21 nt, Homo sapiens
uuggcuacugcuucagaggga

SEQ ID NO: 132162 - RNA, 22 nt, Homo sapiens
uuggcuguguuccucaaggagu

SEQ ID NO: 132163 - RNA, 22 nt, Homo sapiens
uuggcuguguuuauaugcugga

SEQ ID NO: 132164 - RNA, 22 nt, Homo sapiens
uuggcuguguuucccuacaaau

SEQ ID NO: 132165 - RNA, 22 nt, Homo sapiens
uuggcuuuuaugcagcuuaggu

SEQ ID NO: 132166 - RNA, 22 nt, Homo sapiens
ucuugguuuauugauggagagg

SEQ ID NO: 132167 - RNA, 22 nt, Homo sapiens
ucuuuagguguuauaguucaag

SEQ ID NO: 132168 - RNA, 19 nt, Homo sapiens
ucuuuagucacauuuuuau

SEQ ID NO: 132169 - RNA, 20 nt, Homo sapiens
ucuuucgguuaccaggcagu

SEQ ID NO: 132170 - RNA, 22 nt, Homo sapiens
ucuuugaguguauacuuagauu

SEQ ID NO: 132171 - RNA, 22 nt, Homo sapiens
ucuuugauguucugaaagaugg

SEQ ID NO: 132172 - RNA, 22 nt, Homo sapiens
ucuuugggauauucugaaaggg

SEQ ID NO: 132173 - RNA, 19 nt, Homo sapiens
ucuuugguacgugcuuuga

SEQ ID NO: 132174 - RNA, 22 nt, Homo sapiens
ucuuugguagaagcuauuuuau

SEQ ID NO: 132175 - RNA, 22 nt, Homo sapiens
ucuuugguaggaguaggaggcc

SEQ ID NO: 132176 - RNA, 22 nt, Homo sapiens
ucuuugguaugugcaugugcuu

SEQ ID NO: 132177 - RNA, 22 nt, Homo sapiens
ucuuugguauugugaauagugu

SEQ ID NO: 132178 - RNA, 22 nt, Homo sapiens
ucuuugguuagguuuaguugau

SEQ ID NO: 132179 - RNA, 22 nt, Homo sapiens
ucuuugguucuguuuauguaau

SEQ ID NO: 132180 - RNA, 22 nt, Homo sapiens
ucuuuguuagaacccucuccuu

SEQ ID NO: 132181 - RNA, 22 nt, Homo sapiens
ucuuuguucaggagccaacucc

SEQ ID NO: 132182 - RNA, 22 nt, Homo sapiens
ucuuuugggccucuugucagac

SEQ ID NO: 132183 - RNA, 22 nt, Homo sapiens
ucuuuugugagucagccucucc

SEQ ID NO: 132184 - RNA, 22 nt, Homo sapiens
ugaaacacacauugcccuuuau

SEQ ID NO: 132185 - RNA, 22 nt, Homo sapiens
ugaaacacaccuccucuccauc

SEQ ID NO: 132186 - RNA, 22 nt, Homo sapiens
ugaaacauacacucugaugggg

SEQ ID NO: 132187 - RNA, 22 nt, Homo sapiens
ugaaagguauagguucuggagg

SEQ ID NO: 132188 - RNA, 22 nt, Homo sapiens
ugaaaguaauugcaguuuuuac

SEQ ID NO: 132189 - RNA, 22 nt, Homo sapiens
ugaaaucauguaguuauugcaa

SEQ ID NO: 132190 - RNA, 22 nt, Homo sapiens
ugaaaugauuauaugguguuug

SEQ ID NO: 132191 - RNA, 22 nt, Homo sapiens
ugaaaugccuuuaaugaauuua

SEQ ID NO: 132192 - RNA, 22 nt, Homo sapiens
ugaaaugcugucuaggggaaau

SEQ ID NO: 132193 - RNA, 22 nt, Homo sapiens
ugaaauggaaagaguguagacu

SEQ ID NO: 132194 - RNA, 22 nt, Homo sapiens
ugaaauggugcggucugcagca

SEQ ID NO: 132195 - RNA, 22 nt, Homo sapiens
ugaaaugguuaugugaggagau

SEQ ID NO: 132196 - RNA, 22 nt, Homo sapiens
ugaaauguuaaacaaguggcuc

SEQ ID NO: 132197 - RNA, 22 nt, Homo sapiens
ugaaauuuuuuauucguuggcu

SEQ ID NO: 132198 - RNA, 22 nt, Homo sapiens
ugaagacauuuuugggugugua

SEQ ID NO: 132199 - RNA, 22 nt, Homo sapiens
ugaagacucaguuugagggaca

SEQ ID NO: 132200 - RNA, 22 nt, Homo sapiens
ugaagacucauacuugaaucag

SEQ ID NO: 132201 - RNA, 22 nt, Homo sapiens
ugaaggacauucuaugguagau

SEQ ID NO: 132202 - RNA, 20 nt, Homo sapiens
ugaaggaggucauuuauacc

SEQ ID NO: 132203 - RNA, 22 nt, Homo sapiens
ugaaggcaggagggagaaaagu

SEQ ID NO: 132204 - RNA, 22 nt, Homo sapiens
ugaagggcauuguuuugccaaa

SEQ ID NO: 132205 - RNA, 22 nt, Homo sapiens
ugaaguguuuuuucaggcaugu

SEQ ID NO: 132206 - RNA, 22 nt, Homo sapiens
ugaauacugugcaaaggauuug

SEQ ID NO: 132207 - RNA, 22 nt, Homo sapiens
ugaauaguaauguguuuggucu

SEQ ID NO: 132208 - RNA, 22 nt, Homo sapiens
ugaauagugucacaauaaacau

SEQ ID NO: 132209 - RNA, 22 nt, Homo sapiens
ugaauauagacagggguagaga

SEQ ID NO: 132210 - RNA, 21 nt, Homo sapiens
ugaaugcuuuaaauauuagaa

SEQ ID NO: 132211 - RNA, 22 nt, Homo sapiens
ugaauguaacuaaaccugugaa

SEQ ID NO: 132212 - RNA, 22 nt, Homo sapiens
ugaauguacuuaacacuggauu

SEQ ID NO: 132213 - RNA, 23 nt, Homo sapiens
ugaauguaucgaaugugggaaag

SEQ ID NO: 132214 - RNA, 22 nt, Homo sapiens
ugaauguauuuauuaccauuca

SEQ ID NO: 132215 - RNA, 22 nt, Homo sapiens
ugaauguccauugauguuuuga

SEQ ID NO: 132216 - RNA, 22 nt, Homo sapiens
ugaauguuguugguugagauau

SEQ ID NO: 132217 - RNA, 22 nt, Homo sapiens
ugaauguuugcuuacuuccaua

SEQ ID NO: 132218 - RNA, 22 nt, Homo sapiens
ugaauucaucucacagaguuaa

SEQ ID NO: 132219 - RNA, 22 nt, Homo sapiens
ugacaagaguagagagggugcc

SEQ ID NO: 132220 - RNA, 22 nt, Homo sapiens
ugacaagcucccucugcaccuu

SEQ ID NO: 132221 - RNA, 22 nt, Homo sapiens
ugacacagcaagauggaaccau

SEQ ID NO: 132222 - RNA, 21 nt, Homo sapiens
ugacagaaaauugaguuugcu

SEQ ID NO: 132223 - RNA, 17 nt, Homo sapiens
ugacagaaacuuguugu

SEQ ID NO: 132224 - RNA, 22 nt, Homo sapiens
ugacagagcaggacuucaucuc

SEQ ID NO: 132225 - RNA, 22 nt, Homo sapiens
ugacagcugaagauguugaacc

SEQ ID NO: 132226 - RNA, 22 nt, Homo sapiens
ugacagcugaggcccagaguac

SEQ ID NO: 132227 - RNA, 22 nt, Homo sapiens
ugacaggagauuaugugauguu

SEQ ID NO: 132228 - RNA, 23 nt, Homo sapiens
ugacagucucccgauggcuaggc

SEQ ID NO: 132229 - RNA, 22 nt, Homo sapiens
ugacagugaauaagucucuuaa

SEQ ID NO: 132230 - RNA, 22 nt, Homo sapiens
ugacauagcuauuaagugaugc

SEQ ID NO: 132231 - RNA, 22 nt, Homo sapiens
ugacauggagagagaagccuuu

SEQ ID NO: 132232 - RNA, 22 nt, Homo sapiens
ugacauggagggugcggcugca

SEQ ID NO: 132233 - RNA, 22 nt, Homo sapiens
ugacauggagguggaggaagau

SEQ ID NO: 132234 - RNA, 23 nt, Homo sapiens
ugacauguaauucaguccagcag

SEQ ID NO: 132235 - RNA, 22 nt, Homo sapiens
ugacauguugcauuauauuucc

SEQ ID NO: 132236 - RNA, 17 nt, Homo sapiens
ugaccacugauucuacu

SEQ ID NO: 132237 - RNA, 22 nt, Homo sapiens
ugaccagaaaacaaauuaguuu

SEQ ID NO: 132238 - RNA, 19 nt, Homo sapiens
ugaccagggacagaaacca

SEQ ID NO: 132239 - RNA, 22 nt, Homo sapiens
ugacccauagaaauguggauaa

SEQ ID NO: 132240 - RNA, 22 nt, Homo sapiens
ugacuacaaccuccaccucccg

SEQ ID NO: 132241 - RNA, 22 nt, Homo sapiens
ugacuagagacagaaacuaaaa

SEQ ID NO: 132242 - RNA, 22 nt, Homo sapiens
ugacuagagcaauuggaaacaa

SEQ ID NO: 132243 - RNA, 22 nt, Homo sapiens
ugacuaggaaauuagaacuuuu

SEQ ID NO: 132244 - RNA, 22 nt, Homo sapiens
ugacuaguuuugcuguuguuau

SEQ ID NO: 132245 - RNA, 22 nt, Homo sapiens
ugacuauaggauaacaugcauu

SEQ ID NO: 132246 - RNA, 22 nt, Homo sapiens
ugacucaagagccugacucauc

SEQ ID NO: 132247 - RNA, 22 nt, Homo sapiens
ugacucaguuguuagucuucau

SEQ ID NO: 132248 - RNA, 23 nt, Homo sapiens
ugacugaguauauguuuggugcu

SEQ ID NO: 132249 - RNA, 22 nt, Homo sapiens
ugacugucuagauagagcuugg

SEQ ID NO: 132250 - RNA, 23 nt, Homo sapiens
ugacuuaggccucaacuaugacu

SEQ ID NO: 132251 - RNA, 22 nt, Homo sapiens
ugacuugaucacccccuaaggg

SEQ ID NO: 132252 - RNA, 20 nt, Homo sapiens
ugagaacauguggcauuugg

SEQ ID NO: 132253 - RNA, 22 nt, Homo sapiens
ugagaacucaugggucugcugg

SEQ ID NO: 132254 - RNA, 22 nt, Homo sapiens
ugagaacugcagggagcugcau

SEQ ID NO: 132255 - RNA, 22 nt, Homo sapiens
ugagaagaugaacuccuugguc

SEQ ID NO: 132256 - RNA, 22 nt, Homo sapiens
aaggcucuuucaacguaaauua

SEQ ID NO: 132257 - RNA, 22 nt, Homo sapiens
aagggaaugcgcugccuguguu

SEQ ID NO: 132258 - RNA, 23 nt, Homo sapiens
aagguaagcuagaaagauguaga

SEQ ID NO: 132259 - RNA, 22 nt, Homo sapiens
aagguaguuuucuuuaaugcug

SEQ ID NO: 132260 - RNA, 22 nt, Homo sapiens
aagguauuuuugucuauaucuu

SEQ ID NO: 132261 - RNA, 22 nt, Homo sapiens
aaggugguuuucucuuggaguc

SEQ ID NO: 132262 - RNA, 22 nt, Homo sapiens
aaguaauugagguuuuugcugu

SEQ ID NO: 132263 - RNA, 22 nt, Homo sapiens
aaguauuagcuaauugugcuua

SEQ ID NO: 132264 - RNA, 22 nt, Homo sapiens
aaguauuaugaguccuuguuuu

SEQ ID NO: 132265 - RNA, 22 nt, Homo sapiens
aagucacugagacuuguggcug

SEQ ID NO: 132266 - RNA, 22 nt, Homo sapiens
aagucauggaggaguaugugag

SEQ ID NO: 132267 - RNA, 22 nt, Homo sapiens
aagugacauugugcccauuuga

SEQ ID NO: 132268 - RNA, 20 nt, Homo sapiens
aagugaguguuaaacugaac

SEQ ID NO: 132269 - RNA, 22 nt, Homo sapiens
aagugcaaauucccaggcucug

SEQ ID NO: 132270 - RNA, 22 nt, Homo sapiens
aagugcauguauuaguguaguc

SEQ ID NO: 132271 - RNA, 22 nt, Homo sapiens
aagugccauguggaugggcccu

SEQ ID NO: 132272 - RNA, 20 nt, Homo sapiens
aagugcuauuucuuuugugg

SEQ ID NO: 132273 - RNA, 22 nt, Homo sapiens
aagugcucuugaaacugccuua

SEQ ID NO: 132274 - RNA, 22 nt, Homo sapiens
aagugcuuacagggaacaugau

SEQ ID NO: 132275 - RNA, 22 nt, Homo sapiens
aagugcuucagaagacaauauu

SEQ ID NO: 132276 - RNA, 22 nt, Homo sapiens
aagugcuucuuuccucgagaag

SEQ ID NO: 132277 - RNA, 22 nt, Homo sapiens
aagugcuuuacacaugcaugau

SEQ ID NO: 132278 - RNA, 17 nt, Homo sapiens
aaguggcuuguucacca

SEQ ID NO: 132279 - RNA, 22 nt, Homo sapiens
aagugguuuuuacaaagacaga

SEQ ID NO: 132280 - RNA, 22 nt, Homo sapiens
aaguguaugaaacaguccaugg

SEQ ID NO: 132281 - RNA, 22 nt, Homo sapiens
aagugucagaguugcuaaugac

SEQ ID NO: 132282 - RNA, 21 nt, Homo sapiens
aauacucuagguuaagagagc

SEQ ID NO: 132283 - RNA, 22 nt, Homo sapiens
aauacugaaaguauuuucaaau

SEQ ID NO: 132284 - RNA, 22 nt, Homo sapiens
aauacugagaugugagguacua

SEQ ID NO: 132285 - RNA, 22 nt, Homo sapiens
aauagugcugcaaaaacauacg

SEQ ID NO: 132286 - RNA, 22 nt, Homo sapiens
aauagugcugugcagugagugg

SEQ ID NO: 132287 - RNA, 22 nt, Homo sapiens
aauaucacaguggguguacacc

SEQ ID NO: 132288 - RNA, 22 nt, Homo sapiens
aauaugguuuuaugaagcaauu

SEQ ID NO: 132289 - RNA, 22 nt, Homo sapiens
aaucaacauuguuuuaagucaa

SEQ ID NO: 132290 - RNA, 22 nt, Homo sapiens
aaucacauugaaucugcuaccu

SEQ ID NO: 132291 - RNA, 22 nt, Homo sapiens
aaucacuuugcuacaaggcagu

SEQ ID NO: 132292 - RNA, 22 nt, Homo sapiens
aaucacuuuggcaccaaccuaa

SEQ ID NO: 132293 - RNA, 17 nt, Homo sapiens
aaucagauuucugagga

SEQ ID NO: 132294 - RNA, 22 nt, Homo sapiens
aaucauauugucugccaagagg

SEQ ID NO: 132295 - RNA, 22 nt, Homo sapiens
aaucccauuucucuguguuuuu

SEQ ID NO: 132296 - RNA, 22 nt, Homo sapiens
aaucccuuuguccagucucuuu

SEQ ID NO: 132297 - RNA, 22 nt, Homo sapiens
aaucucagcauuuugggcugag

SEQ ID NO: 132298 - RNA, 22 nt, Homo sapiens
aaucuguagaaggugcacauuc

SEQ ID NO: 132299 - RNA, 22 nt, Homo sapiens
aaugacagccagauucuucucu

SEQ ID NO: 132300 - RNA, 22 nt, Homo sapiens
aaugacagugcuaaagaacccu

SEQ ID NO: 132301 - RNA, 22 nt, Homo sapiens
aaugacuaagaugguacauuuu

SEQ ID NO: 132302 - RNA, 22 nt, Homo sapiens
aaugcacuccagccugggcgac

SEQ ID NO: 132303 - RNA, 22 nt, Homo sapiens
aaugcauaauuuguaugaggua

SEQ ID NO: 132304 - RNA, 22 nt, Homo sapiens
aauggcacacaccuggucuaac

SEQ ID NO: 132305 - RNA, 22 nt, Homo sapiens
aauggcaucuacguuaaauguc

SEQ ID NO: 132306 - RNA, 22 nt, Homo sapiens
aauggcauugguccuuuuggau

SEQ ID NO: 132307 - RNA, 18 nt, Homo sapiens
aauggcucuggguucuaa

SEQ ID NO: 132308 - RNA, 22 nt, Homo sapiens
aauggcuucuuauugugguuca

SEQ ID NO: 132309 - RNA, 22 nt, Homo sapiens
aaugugcacuauuagggugaua

SEQ ID NO: 132310 - RNA, 22 nt, Homo sapiens
aaugugcacuuggagccuugcu

SEQ ID NO: 132311 - RNA, 22 nt, Homo sapiens
aaugugcuucuggcugugguca

SEQ ID NO: 132312 - RNA, 22 nt, Homo sapiens
aaugugcuuucuuucacacagu

SEQ ID NO: 132313 - RNA, 22 nt, Homo sapiens
aauuaguugucgugagaguggu

SEQ ID NO: 132314 - RNA, 22 nt, Homo sapiens
aauucacuucuuuuaggcaggg

SEQ ID NO: 132315 - RNA, 22 nt, Homo sapiens
aauugcacuggaaguaacugag

SEQ ID NO: 132316 - RNA, 22 nt, Homo sapiens
aauugcauaaaauucaacucug

SEQ ID NO: 132317 - RNA, 22 nt, Homo sapiens
aauugcuucuguauuuuggaca

SEQ ID NO: 132318 - RNA, 22 nt, Homo sapiens
aauuguacucccaucauuccua

SEQ ID NO: 132319 - RNA, 21 nt, Homo sapiens
acaaagcuggagggagacugc

SEQ ID NO: 132320 - RNA, 16 nt, Homo sapiens
acaaagcuggcuaucu

SEQ ID NO: 132321 - RNA, 22 nt, Homo sapiens
acaaaguauggaauguuggugu

SEQ ID NO: 132322 - RNA, 22 nt, Homo sapiens
acaacaguuuuaucaccccaga

SEQ ID NO: 132323 - RNA, 22 nt, Homo sapiens
acaagcacaaaugcauagaugg

SEQ ID NO: 132324 - RNA, 22 nt, Homo sapiens
acacaaugguaaguguuugugu

SEQ ID NO: 132325 - RNA, 23 nt, Homo sapiens
acacaguaaacuaaaagcuagcu

SEQ ID NO: 132326 - RNA, 22 nt, Homo sapiens
acacaguauaugacaaugcuuu

SEQ ID NO: 132327 - RNA, 22 nt, Homo sapiens
acacagugucuguguauuuaaa

SEQ ID NO: 132328 - RNA, 22 nt, Homo sapiens
acacaguguuuauugugguuag

SEQ ID NO: 132329 - RNA, 22 nt, Homo sapiens
acacauacacauaugguguaua

SEQ ID NO: 132330 - RNA, 22 nt, Homo sapiens
acacaugcuccacuguggccuc

SEQ ID NO: 132331 - RNA, 22 nt, Homo sapiens
acaccuguggucccaguaacuu

SEQ ID NO: 132332 - RNA, 22 nt, Homo sapiens
acacgggugccggcaucagcac

SEQ ID NO: 132333 - RNA, 22 nt, Homo sapiens
acacugucucuugcugaccaug

SEQ ID NO: 132334 - RNA, 22 nt, Homo sapiens
acacugucugaugaaaguaguu

SEQ ID NO: 132335 - RNA, 22 nt, Homo sapiens
acacuguuuuaguuauuauagc

SEQ ID NO: 132336 - RNA, 22 nt, Homo sapiens
acagaacugggcuugcuuuugg

SEQ ID NO: 132337 - RNA, 22 nt, Homo sapiens
acaggagugggauuugaguccu

SEQ ID NO: 132338 - RNA, 22 nt, Homo sapiens
acagguacaagggauuaggaug

SEQ ID NO: 132339 - RNA, 22 nt, Homo sapiens
acagguauagaaagcuaaaggg

SEQ ID NO: 132340 - RNA, 22 nt, Homo sapiens
acaguacuguuguuugcugcca

SEQ ID NO: 132341 - RNA, 23 nt, Homo sapiens
acaguauguggauguggcuaagu

SEQ ID NO: 132342 - RNA, 22 nt, Homo sapiens
acagucuggagaaugggugcuc

SEQ ID NO: 132343 - RNA, 18 nt, Homo sapiens
acagugcuggcaugagau

SEQ ID NO: 132344 - RNA, 18 nt, Homo sapiens
acagugcugucacugcuu

SEQ ID NO: 132345 - RNA, 22 nt, Homo sapiens
acagugcuucugauaugaugcc

SEQ ID NO: 132346 - RNA, 22 nt, Homo sapiens
uggcuuuucauccugggacauu

SEQ ID NO: 132347 - RNA, 22 nt, Homo sapiens
uggcuuuuccaggcauuacgau

SEQ ID NO: 132348 - RNA, 22 nt, Homo sapiens
uggcuuuuguuauuuggaagcu

SEQ ID NO: 132349 - RNA, 22 nt, Homo sapiens
ugggaaacauccagcacauacu

SEQ ID NO: 132350 - RNA, 20 nt, Homo sapiens
ugggaaauguccaggacaua

SEQ ID NO: 132351 - RNA, 22 nt, Homo sapiens
ugggaacaugaagguuaaagag

SEQ ID NO: 132352 - RNA, 22 nt, Homo sapiens
ugggaagauucuguguuuuucc

SEQ ID NO: 132353 - RNA, 22 nt, Homo sapiens
ugggaaugaaauuacauagcuu

SEQ ID NO: 132354 - RNA, 19 nt, Homo sapiens
ugggaauguaaauuaguuc

SEQ ID NO: 132355 - RNA, 22 nt, Homo sapiens
ugggaccccuacucuuuccaca

SEQ ID NO: 132356 - RNA, 22 nt, Homo sapiens
ugggagcauugcauuagaagcc

SEQ ID NO: 132357 - RNA, 22 nt, Homo sapiens
ugggaucauuaugcauagugua

SEQ ID NO: 132358 - RNA, 22 nt, Homo sapiens
ugggaucgucaagugaggcucg

SEQ ID NO: 132359 - RNA, 22 nt, Homo sapiens
ugggaugaugcuugagaauauc

SEQ ID NO: 132360 - RNA, 23 nt, Homo sapiens
ugggauguuuuuggaaacuucug

SEQ ID NO: 132361 - RNA, 22 nt, Homo sapiens
ugggcaaauugugagggaggua

SEQ ID NO: 132362 - RNA, 22 nt, Homo sapiens
ugggcaagugacuuggcuucuc

SEQ ID NO: 132363 - RNA, 22 nt, Homo sapiens
ugggcaguauggucauuuucgu

SEQ ID NO: 132364 - RNA, 22 nt, Homo sapiens
ugggcauuguuccuaguuaucu

SEQ ID NO: 132365 - RNA, 22 nt, Homo sapiens
ugggccgcugcaggaugguccc

SEQ ID NO: 132366 - RNA, 22 nt, Homo sapiens
uggguccccuacucuuuccaca

SEQ ID NO: 132367 - RNA, 22 nt, Homo sapiens
uggguucccugucuguccuuga

SEQ ID NO: 132368 - RNA, 22 nt, Homo sapiens
ugguaaaaugucauuuaccaga

SEQ ID NO: 132369 - RNA, 22 nt, Homo sapiens
ugguaagaaaaccauuauuagc

SEQ ID NO: 132370 - RNA, 22 nt, Homo sapiens
ugguauggaguaauuaguaagc

SEQ ID NO: 132371 - RNA, 22 nt, Homo sapiens
ugguaugucuagauggggaagu

SEQ ID NO: 132372 - RNA, 22 nt, Homo sapiens
ugguauguguucuaaaauuaug

SEQ ID NO: 132373 - RNA, 22 nt, Homo sapiens
ugguauuuaauauaugagaguu

SEQ ID NO: 132374 - RNA, 22 nt, Homo sapiens
uggucaaaucugaugugagaaa

SEQ ID NO: 132375 - RNA, 22 nt, Homo sapiens
uggucagaaaauuacuugauau

SEQ ID NO: 132376 - RNA, 22 nt, Homo sapiens
ugguccaguucugugauauugc

SEQ ID NO: 132377 - RNA, 22 nt, Homo sapiens
ugguccccaauacuucuauaga

SEQ ID NO: 132378 - RNA, 22 nt, Homo sapiens
uggucuggagagucccgcccag

SEQ ID NO: 132379 - RNA, 22 nt, Homo sapiens
uggugagaaaagaugucuuugu

SEQ ID NO: 132380 - RNA, 22 nt, Homo sapiens
uggugagaaacuagauauuuuu

SEQ ID NO: 132381 - RNA, 22 nt, Homo sapiens
uggugcuuaaauaaggcuuuca

SEQ ID NO: 132382 - RNA, 22 nt, Homo sapiens
ugguggcuuuucguagguucac

SEQ ID NO: 132383 - RNA, 20 nt, Homo sapiens
uggugguuuuaugugguuua

SEQ ID NO: 132384 - RNA, 22 nt, Homo sapiens
ugguguccugucucugcgcuug

SEQ ID NO: 132385 - RNA, 22 nt, Homo sapiens
ugguuaucacuuuccuuccauc

SEQ ID NO: 132386 - RNA, 22 nt, Homo sapiens
ugguucaguugcacaggcuguu

SEQ ID NO: 132387 - RNA, 22 nt, Homo sapiens
ugguuccauauuaauuuuagga

SEQ ID NO: 132388 - RNA, 22 nt, Homo sapiens
ugguugaucccaucacccaggu

SEQ ID NO: 132389 - RNA, 22 nt, Homo sapiens
uguaaacucaguauguuuuacu

SEQ ID NO: 132390 - RNA, 23 nt, Homo sapiens
uguaaagcuaugaauuauucuuu

SEQ ID NO: 132391 - RNA, 22 nt, Homo sapiens
uguaaaucugguuaauuggaua

SEQ ID NO: 132392 - RNA, 22 nt, Homo sapiens
uguaauaguaggcucacauuug

SEQ ID NO: 132393 - RNA, 20 nt, Homo sapiens
uguacacaguguacccacau

SEQ ID NO: 132394 - RNA, 22 nt, Homo sapiens
uguacaugggacaggaggagag

SEQ ID NO: 132395 - RNA, 19 nt, Homo sapiens
uguaccagcaagucuuuuc

SEQ ID NO: 132396 - RNA, 22 nt, Homo sapiens
uguacuagaaauuaaggcaggg

SEQ ID NO: 132397 - RNA, 22 nt, Homo sapiens
uguagauaucuaucaggucaau

SEQ ID NO: 132398 - RNA, 21 nt, Homo sapiens
uguauauguuuauacacacac

SEQ ID NO: 132399 - RNA, 22 nt, Homo sapiens
uguaugagagacauggcugcuu

SEQ ID NO: 132400 - RNA, 22 nt, Homo sapiens
uguauguugggucaaaguacau

SEQ ID NO: 132401 - RNA, 22 nt, Homo sapiens
uguauguuguaagacuuagacc

SEQ ID NO: 132402 - RNA, 22 nt, Homo sapiens
ugucaaacauuaugaugcucua

SEQ ID NO: 132403 - RNA, 22 nt, Homo sapiens
ugucaaauucuggguuaaaaca

SEQ ID NO: 132404 - RNA, 21 nt, Homo sapiens
ugucaagaugacugcugcggc

SEQ ID NO: 132405 - RNA, 22 nt, Homo sapiens
ugucaaggaaugucauugguuu

SEQ ID NO: 132406 - RNA, 20 nt, Homo sapiens
ugucaaggaauucccaaauc

SEQ ID NO: 132407 - RNA, 21 nt, Homo sapiens
ugucaagugggaaaacaugua

SEQ ID NO: 132408 - RNA, 22 nt, Homo sapiens
ugucaggaugcuccuuuuggcu

SEQ ID NO: 132409 - RNA, 22 nt, Homo sapiens
ugucaguguacuguaagaauua

SEQ ID NO: 132410 - RNA, 22 nt, Homo sapiens
ugucaguguaugagccccggau

SEQ ID NO: 132411 - RNA, 22 nt, Homo sapiens
ugucaguuucaguguuagccuu

SEQ ID NO: 132412 - RNA, 22 nt, Homo sapiens
ugucaguuucccuccucuuccu

SEQ ID NO: 132413 - RNA, 22 nt, Homo sapiens
ugucauauagaauguucuauga

SEQ ID NO: 132414 - RNA, 22 nt, Homo sapiens
ugucaucauuugagagaagaaa

SEQ ID NO: 132415 - RNA, 22 nt, Homo sapiens
ugucaugaaauauguuuuucua

SEQ ID NO: 132416 - RNA, 22 nt, Homo sapiens
ugucaugagucuccuccaucuu

SEQ ID NO: 132417 - RNA, 22 nt, Homo sapiens
ugucauggauucugagucuggg

SEQ ID NO: 132418 - RNA, 22 nt, Homo sapiens
ugucauguagaaauuguccauu

SEQ ID NO: 132419 - RNA, 22 nt, Homo sapiens
ugucauguauauaccacuucca

SEQ ID NO: 132420 - RNA, 22 nt, Homo sapiens
ugucauguggcuaacgauucau

SEQ ID NO: 132421 - RNA, 22 nt, Homo sapiens
uguccaguguuccucagaagaa

SEQ ID NO: 132422 - RNA, 22 nt, Homo sapiens
uguccauuuuuaugcuuauggu

SEQ ID NO: 132423 - RNA, 22 nt, Homo sapiens
uguccuguaggaggcagaacaa

SEQ ID NO: 132424 - RNA, 22 nt, Homo sapiens
ugucuaaagaauggcagacuca

SEQ ID NO: 132425 - RNA, 20 nt, Homo sapiens
ugucuauggggguucucugc

SEQ ID NO: 132426 - RNA, 21 nt, Homo sapiens
ggcauugugcccuugcucuag

SEQ ID NO: 132427 - RNA, 22 nt, Homo sapiens
ggcccugauacaaguaaggucu

SEQ ID NO: 132428 - RNA, 22 nt, Homo sapiens
ggcuagauauucacauauggcu

SEQ ID NO: 132429 - RNA, 22 nt, Homo sapiens
ggcucguguuuucuguccaguu

SEQ ID NO: 132430 - RNA, 22 nt, Homo sapiens
gggaacauggaaauucugcucu

SEQ ID NO: 132431 - RNA, 22 nt, Homo sapiens
gggaagaaggagugguuuacuc

SEQ ID NO: 132432 - RNA, 22 nt, Homo sapiens
gggaagguaaucauuacuugau

SEQ ID NO: 132433 - RNA, 22 nt, Homo sapiens
gggaagugugguuucuuuacag

SEQ ID NO: 132434 - RNA, 18 nt, Homo sapiens
gggaauauggggaguuga

SEQ ID NO: 132435 - RNA, 22 nt, Homo sapiens
cuuuaguugucuccucaagggu

SEQ ID NO: 132436 - RNA, 22 nt, Homo sapiens
cuuucugaggagaauagagaac

SEQ ID NO: 132437 - RNA, 22 nt, Homo sapiens
cuuugcacaucucugcuuuccc

SEQ ID NO: 132438 - RNA, 21 nt, Homo sapiens
cuuugguagaguuuuuagggu

SEQ ID NO: 132439 - RNA, 23 nt, Homo sapiens
cuuugguaggaaauuugaauuau

SEQ ID NO: 132440 - RNA, 21 nt, Homo sapiens
cuuugguuucugacuugcaua

SEQ ID NO: 132441 - RNA, 22 nt, Homo sapiens
cuuuguaugucaugacaacugu

SEQ ID NO: 132442 - RNA, 23 nt, Homo sapiens
cuuuguccccacccaaaucucau

SEQ ID NO: 132443 - RNA, 22 nt, Homo sapiens
cuuuguccuucaagguguguca

SEQ ID NO: 132444 - RNA, 22 nt, Homo sapiens
cuuuguggggucuuuccucaaa

SEQ ID NO: 132445 - RNA, 22 nt, Homo sapiens
cuuugugugggccaagggcugg

SEQ ID NO: 132446 - RNA, 22 nt, Homo sapiens
cuuuuacacuguuggugggaau

SEQ ID NO: 132447 - RNA, 22 nt, Homo sapiens
cuuuuggcuuaagauugucuug

SEQ ID NO: 132448 - RNA, 22 nt, Homo sapiens
cuuuuggcuuagaauugucuug

SEQ ID NO: 132449 - RNA, 20 nt, Homo sapiens
cuuuuugcugugcugggagc

SEQ ID NO: 132450 - RNA, 22 nt, Homo sapiens
gaaagcugguauagauacauua

SEQ ID NO: 132451 - RNA, 22 nt, Homo sapiens
gaaagugcugcaaggccaugca

SEQ ID NO: 132452 - RNA, 22 nt, Homo sapiens
gaaagugcugcuugacugggau

SEQ ID NO: 132453 - RNA, 21 nt, Homo sapiens
gaaauacugccuuaggagcug

SEQ ID NO: 132454 - RNA, 18 nt, Homo sapiens
gaaaugccucuugcuuac

SEQ ID NO: 132455 - RNA, 22 nt, Homo sapiens
gaaauguauuaaugaguugaaa

SEQ ID NO: 132456 - RNA, 22 nt, Homo sapiens
gaacacaucuuugguuagagga

SEQ ID NO: 132457 - RNA, 22 nt, Homo sapiens
gaagaacuaggugagaucuaga

SEQ ID NO: 132458 - RNA, 22 nt, Homo sapiens
gaagagacagguucccacaaaa

SEQ ID NO: 132459 - RNA, 22 nt, Homo sapiens
gaagaucacacuguagaucuau

SEQ ID NO: 132460 - RNA, 23 nt, Homo sapiens
gaaguaauaaauggauucuuaac

SEQ ID NO: 132461 - RNA, 23 nt, Homo sapiens
gaaguauagcaugcacauggaaa

SEQ ID NO: 132462 - RNA, 22 nt, Homo sapiens
gaagugcaguggcacagucaug

SEQ ID NO: 132463 - RNA, 19 nt, Homo sapiens
gaaguguuuguucuccaug

SEQ ID NO: 132464 - RNA, 22 nt, Homo sapiens
gaauaaacuagagaggacugag

SEQ ID NO: 132465 - RNA, 22 nt, Homo sapiens
gaauagugcugcaagaaacaua

SEQ ID NO: 132466 - RNA, 22 nt, Homo sapiens
gaaucacaguuauuagagcagc

SEQ ID NO: 132467 - RNA, 22 nt, Homo sapiens
gaaucacugugguaucccaugc

SEQ ID NO: 132468 - RNA, 22 nt, Homo sapiens
gaaucauuguuucuaaguuugu

SEQ ID NO: 132469 - RNA, 22 nt, Homo sapiens
gaaugaauguuuauccuuagau

SEQ ID NO: 132470 - RNA, 22 nt, Homo sapiens
gaaugcuaccagcaucuagugg

SEQ ID NO: 132471 - RNA, 22 nt, Homo sapiens
gaauggaacugacuauagcuga

SEQ ID NO: 132472 - RNA, 22 nt, Homo sapiens
gaaugguuuacaaguguaaucu

SEQ ID NO: 132473 - RNA, 22 nt, Homo sapiens
gaauucugucgcuuacuagaug

SEQ ID NO: 132474 - RNA, 22 nt, Homo sapiens
gacacuggguguuuguuggcgu

SEQ ID NO: 132475 - RNA, 22 nt, Homo sapiens
gacagacacaauugauccauga

SEQ ID NO: 132476 - RNA, 22 nt, Homo sapiens
gacagguuuucuguuucugaaa

SEQ ID NO: 132477 - RNA, 18 nt, Homo sapiens
gacagugugaagauuccu

SEQ ID NO: 132478 - RNA, 18 nt, Homo sapiens
gacaguguggcgauuccu

SEQ ID NO: 132479 - RNA, 20 nt, Homo sapiens
gacauagagacucucaaaaa

SEQ ID NO: 132480 - RNA, 22 nt, Homo sapiens
gacauagagccuugacuucauu

SEQ ID NO: 132481 - RNA, 20 nt, Homo sapiens
gacauaggcugguaucuggc

SEQ ID NO: 132482 - RNA, 22 nt, Homo sapiens
gacaucauuaugagauuuaaac

SEQ ID NO: 132483 - RNA, 22 nt, Homo sapiens
gacauguuuucaagauuuauaa

SEQ ID NO: 132484 - RNA, 22 nt, Homo sapiens
gacauguuuuuuaagguuuaug

SEQ ID NO: 132485 - RNA, 22 nt, Homo sapiens
gaccaaagaggcaggcauuaga

SEQ ID NO: 132486 - RNA, 22 nt, Homo sapiens
gaccacauuccacacaggcuuu

SEQ ID NO: 132487 - RNA, 22 nt, Homo sapiens
gacccuguugggguuuagggcu

SEQ ID NO: 132488 - RNA, 22 nt, Homo sapiens
gaccuguaguuuaguugccugu

SEQ ID NO: 132489 - RNA, 22 nt, Homo sapiens
gacguagagaaaugugaaaugg

SEQ ID NO: 132490 - RNA, 22 nt, Homo sapiens
gacucagaacuaaggguguuuc

SEQ ID NO: 132491 - RNA, 18 nt, Homo sapiens
gacucaguuucuaaggca

SEQ ID NO: 132492 - RNA, 22 nt, Homo sapiens
gacucuguagacaaucacaucu

SEQ ID NO: 132493 - RNA, 22 nt, Homo sapiens
gacuggauagauaaaguuaguu

SEQ ID NO: 132494 - RNA, 22 nt, Homo sapiens
gacuucaucauacuaugugugg

SEQ ID NO: 132495 - RNA, 20 nt, Homo sapiens
gacuugagagugggagagua

SEQ ID NO: 132496 - RNA, 22 nt, Homo sapiens
gagaacaguguuguauuuuuuc

SEQ ID NO: 132497 - RNA, 22 nt, Homo sapiens
gagacauguuugcuuaucugag

SEQ ID NO: 132498 - RNA, 22 nt, Homo sapiens
gagacggagucucgcucuguca

SEQ ID NO: 132499 - RNA, 22 nt, Homo sapiens
gagacucuuagauuggaaaucu

SEQ ID NO: 132500 - RNA, 22 nt, Homo sapiens
gagauauuuagaaauguguucu

SEQ ID NO: 132501 - RNA, 23 nt, Homo sapiens
gagaucauucuggaauuagagug

SEQ ID NO: 132502 - RNA, 22 nt, Homo sapiens
gagaucuuggccaaguuucuua

SEQ ID NO: 132503 - RNA, 22 nt, Homo sapiens
gagauggagucuuuuucuguca

SEQ ID NO: 132504 - RNA, 22 nt, Homo sapiens
gagaugucuauuucagagaugu

SEQ ID NO: 132505 - RNA, 22 nt, Homo sapiens
gagauuauuagauguucugcuu

SEQ ID NO: 132506 - RNA, 22 nt, Homo sapiens
gagauuuucagcuugacuggga

SEQ ID NO: 132507 - RNA, 22 nt, Homo sapiens
gagcaaaaguauguauugguua

SEQ ID NO: 132508 - RNA, 22 nt, Homo sapiens
gagcaacaguggcagugguggg

SEQ ID NO: 132509 - RNA, 22 nt, Homo sapiens
gagcaccagucccugucagugc

SEQ ID NO: 132510 - RNA, 22 nt, Homo sapiens
gagcacccuuuguugauugcaa

SEQ ID NO: 132511 - RNA, 22 nt, Homo sapiens
auuaaguaaugguuccaauaau

SEQ ID NO: 132512 - RNA, 22 nt, Homo sapiens
auuaagugaaugaaguuguucc

SEQ ID NO: 132513 - RNA, 21 nt, Homo sapiens
auuaaugcucugguuagaggc

SEQ ID NO: 132514 - RNA, 22 nt, Homo sapiens
auuacauagucaaggugucuca

SEQ ID NO: 132515 - RNA, 22 nt, Homo sapiens
auuacaugucuauccaugaaca

SEQ ID NO: 132516 - RNA, 22 nt, Homo sapiens
auuacuuugcaccaaccuaaua

SEQ ID NO: 132517 - RNA, 22 nt, Homo sapiens
auuagaugguuauaggugugag

SEQ ID NO: 132518 - RNA, 22 nt, Homo sapiens
auuauuaguuguugaaugaagu

SEQ ID NO: 132519 - RNA, 22 nt, Homo sapiens
auucacugugcuuggccaaauu

SEQ ID NO: 132520 - RNA, 22 nt, Homo sapiens
auucaucagggauacuggccug

SEQ ID NO: 132521 - RNA, 22 nt, Homo sapiens
auucaucagggauauugguuga

SEQ ID NO: 132522 - RNA, 21 nt, Homo sapiens
auuccacuuuuccuucaggga

SEQ ID NO: 132523 - RNA, 22 nt, Homo sapiens
auuccaguuugugagaagcugu

SEQ ID NO: 132524 - RNA, 22 nt, Homo sapiens
auuccauuuguuaucacacccg

SEQ ID NO: 132525 - RNA, 18 nt, Homo sapiens
auucuacaggccuuuuga

SEQ ID NO: 132526 - RNA, 22 nt, Homo sapiens
auugaacacagaguagcuuucc

SEQ ID NO: 132527 - RNA, 20 nt, Homo sapiens
auugaacucaguauucugaa

SEQ ID NO: 132528 - RNA, 22 nt, Homo sapiens
auugaacuuuugucacugacau

SEQ ID NO: 132529 - RNA, 22 nt, Homo sapiens
auugacacugauuuuucuuuaa

SEQ ID NO: 132530 - RNA, 22 nt, Homo sapiens
auugacuugauauauagcugau

SEQ ID NO: 132531 - RNA, 18 nt, Homo sapiens
auugagcaugacagaccu

SEQ ID NO: 132532 - RNA, 22 nt, Homo sapiens
auugauagaucauaugguaggu

SEQ ID NO: 132533 - RNA, 22 nt, Homo sapiens
auugcacaccagucugggcaaa

SEQ ID NO: 132534 - RNA, 22 nt, Homo sapiens
auugcacuccacccugggcaac

SEQ ID NO: 132535 - RNA, 22 nt, Homo sapiens
auugcacuccagccuagguaac

SEQ ID NO: 132536 - RNA, 22 nt, Homo sapiens
auugcacuccagccugagcaaa

SEQ ID NO: 132537 - RNA, 22 nt, Homo sapiens
auugcacuccagccuggcagca

SEQ ID NO: 132538 - RNA, 22 nt, Homo sapiens
auugcacuccauccugggcaau

SEQ ID NO: 132539 - RNA, 22 nt, Homo sapiens
auugcagcccacccugggugau

SEQ ID NO: 132540 - RNA, 22 nt, Homo sapiens
auugcaguuagaacagaagucu

SEQ ID NO: 132541 - RNA, 22 nt, Homo sapiens
auugcauugugaucuucccaga

SEQ ID NO: 132542 - RNA, 22 nt, Homo sapiens
auugccucaauuccaagacugc

SEQ ID NO: 132543 - RNA, 21 nt, Homo sapiens
auugcgcuccagccuccuggg

SEQ ID NO: 132544 - RNA, 22 nt, Homo sapiens
auugcuauuauuugaccauugu

SEQ ID NO: 132545 - RNA, 22 nt, Homo sapiens
auugcugagacauugcuaaucu

SEQ ID NO: 132546 - RNA, 22 nt, Homo sapiens
auuggcuuuugaaagucugcga

SEQ ID NO: 132547 - RNA, 22 nt, Homo sapiens
auuguaccccaauguacaauau

SEQ ID NO: 132548 - RNA, 22 nt, Homo sapiens
auuguacuccagccugggcaaa

SEQ ID NO: 132549 - RNA, 22 nt, Homo sapiens
auuguacucuagccucugggca

SEQ ID NO: 132550 - RNA, 22 nt, Homo sapiens
auuguaguuugcuauggcaaua

SEQ ID NO: 132551 - RNA, 20 nt, Homo sapiens
auuguccuugauuacacaga

SEQ ID NO: 132552 - RNA, 22 nt, Homo sapiens
auuguguagucuuacugcuugc

SEQ ID NO: 132553 - RNA, 22 nt, Homo sapiens
auuguuccccggucauuuuugu

SEQ ID NO: 132554 - RNA, 22 nt, Homo sapiens
auuuagcaauggagguagugua

SEQ ID NO: 132555 - RNA, 22 nt, Homo sapiens
auuucuacuccuguguccagaa

SEQ ID NO: 132556 - RNA, 22 nt, Homo sapiens
auuugacacugagagccucagu

SEQ ID NO: 132557 - RNA, 19 nt, Homo sapiens
auuugaucaucaggcacag

SEQ ID NO: 132558 - RNA, 20 nt, Homo sapiens
auuugcauuauggagcaccc

SEQ ID NO: 132559 - RNA, 22 nt, Homo sapiens
auuuggcaauuuugaagaugcc

SEQ ID NO: 132560 - RNA, 20 nt, Homo sapiens
auuuggcauaguuuaagcaa

SEQ ID NO: 132561 - RNA, 22 nt, Homo sapiens
auuuggguuuuacaucaggcua

SEQ ID NO: 132562 - RNA, 22 nt, Homo sapiens
auuugguaauauuuaaggacuu

SEQ ID NO: 132563 - RNA, 21 nt, Homo sapiens
auuugguggcugugugacacu

SEQ ID NO: 132564 - RNA, 21 nt, Homo sapiens
auuugguguuagaaauaaauu

SEQ ID NO: 132565 - RNA, 22 nt, Homo sapiens
auuugguguuguuuggagccua

SEQ ID NO: 132566 - RNA, 22 nt, Homo sapiens
auuuuugguuucaccugcacgc

SEQ ID NO: 132567 - RNA, 22 nt, Homo sapiens
caaaggcuguuauaggccagga

SEQ ID NO: 132568 - RNA, 22 nt, Homo sapiens
caaaguaauugcuguuuugcca

SEQ ID NO: 132569 - RNA, 22 nt, Homo sapiens
caaagucuucaguugauucuga

SEQ ID NO: 132570 - RNA, 22 nt, Homo sapiens
caaagugcugaaagaggccagg

SEQ ID NO: 132571 - RNA, 19 nt, Homo sapiens
caaaguguucuucuuugcc

SEQ ID NO: 132572 - RNA, 22 nt, Homo sapiens
caaaugcuucuauggacugucu

SEQ ID NO: 132573 - RNA, 22 nt, Homo sapiens
caaauugcuuguggaggauaau

SEQ ID NO: 132574 - RNA, 20 nt, Homo sapiens
caaauugcuuucuugguuuu

SEQ ID NO: 132575 - RNA, 22 nt, Homo sapiens
caacacuguuuauuggauagcc

SEQ ID NO: 132576 - RNA, 22 nt, Homo sapiens
caacaguaaagcauuuuuaagu

SEQ ID NO: 132577 - RNA, 22 nt, Homo sapiens
cucuuacaguguguggugaaag

SEQ ID NO: 132578 - RNA, 22 nt, Homo sapiens
cucuuggguagauuuugcagag

SEQ ID NO: 132579 - RNA, 22 nt, Homo sapiens
cucuuugaugugaaccgugguu

SEQ ID NO: 132580 - RNA, 22 nt, Homo sapiens
cugaaagagcauuugaaugggu

SEQ ID NO: 132581 - RNA, 22 nt, Homo sapiens
cugaaaguuauucaggggcaag

SEQ ID NO: 132582 - RNA, 22 nt, Homo sapiens
cugaaaucagccaguuaguuuc

SEQ ID NO: 132583 - RNA, 22 nt, Homo sapiens
cugaaaugaauuauuuucuuuc

SEQ ID NO: 132584 - RNA, 22 nt, Homo sapiens
cugaaucauugcauuaucaagg

SEQ ID NO: 132585 - RNA, 20 nt, Homo sapiens
cugaaugucaaggcagaggu

SEQ ID NO: 132586 - RNA, 22 nt, Homo sapiens
cugaauguuucacucugaaaug

SEQ ID NO: 132587 - RNA, 22 nt, Homo sapiens
cugacagucucauugauuugcu

SEQ ID NO: 132588 - RNA, 22 nt, Homo sapiens
cugaccucugucaaagacaccc

SEQ ID NO: 132589 - RNA, 22 nt, Homo sapiens
cugacguguuuuccagaccuuu

SEQ ID NO: 132590 - RNA, 22 nt, Homo sapiens
cugagagaggagcuaaaacugc

SEQ ID NO: 132591 - RNA, 22 nt, Homo sapiens
cugagaucaugggucagguggu

SEQ ID NO: 132592 - RNA, 22 nt, Homo sapiens
cugagcaaaguucuauuuaugg

SEQ ID NO: 132593 - RNA, 22 nt, Homo sapiens
cugagcaauauagugagaucuu

SEQ ID NO: 132594 - RNA, 22 nt, Homo sapiens
cugagcacugagauccucuagc

SEQ ID NO: 132595 - RNA, 22 nt, Homo sapiens
cugagcaugacaucaugugacu

SEQ ID NO: 132596 - RNA, 22 nt, Homo sapiens
cugagcuaugccuggaaaggca

SEQ ID NO: 132597 - RNA, 22 nt, Homo sapiens
cugaggauauucagccucugug

SEQ ID NO: 132598 - RNA, 20 nt, Homo sapiens
cugaggugggagaaucgcuu

SEQ ID NO: 132599 - RNA, 22 nt, Homo sapiens
cugaggugggaggauuacuuga

SEQ ID NO: 132600 - RNA, 22 nt, Homo sapiens
cugaguauuugaggccgaagga

SEQ ID NO: 132601 - RNA, 21 nt, Homo sapiens
cugaucacaggugagcugccu

SEQ ID NO: 132602 - RNA, 22 nt, Homo sapiens
cugauuguagagccccagggcu

SEQ ID NO: 132603 - RNA, 22 nt, Homo sapiens
cugauugucuauuuaguucacu

SEQ ID NO: 132604 - RNA, 22 nt, Homo sapiens
cugcagguaggggcagcuuugg

SEQ ID NO: 132605 - RNA, 18 nt, Homo sapiens
cugccagugugcucuccg

SEQ ID NO: 132606 - RNA, 22 nt, Homo sapiens
cugccuaaagaaaaagacguug

SEQ ID NO: 132607 - RNA, 20 nt, Homo sapiens
cugcuccccuacaaaucuca

SEQ ID NO: 132608 - RNA, 22 nt, Homo sapiens
cugcuguuguuaacuuuuggag

SEQ ID NO: 132609 - RNA, 22 nt, Homo sapiens
cuggaauuacaggguugagcua

SEQ ID NO: 132610 - RNA, 22 nt, Homo sapiens
cuggauagagauugaugaugcu

SEQ ID NO: 132611 - RNA, 19 nt, Homo sapiens
cuggcaaaugcuuuggcca

SEQ ID NO: 132612 - RNA, 22 nt, Homo sapiens
cuggcaguguuucuugugggcu

SEQ ID NO: 132613 - RNA, 22 nt, Homo sapiens
cuggcgagacagcuccaucacu

SEQ ID NO: 132614 - RNA, 22 nt, Homo sapiens
cuggcucauuucauuuagcaua

SEQ ID NO: 132615 - RNA, 22 nt, Homo sapiens
cugggucaguuucugauuauug

SEQ ID NO: 132616 - RNA, 22 nt, Homo sapiens
cugguuguucuggaugggcagg

SEQ ID NO: 132617 - RNA, 22 nt, Homo sapiens
cugguuuguaaaguuccugaga

SEQ ID NO: 132618 - RNA, 22 nt, Homo sapiens
cuguaaagaucacagagcuggu

SEQ ID NO: 132619 - RNA, 22 nt, Homo sapiens
cuguaaaguaagagguaaguua

SEQ ID NO: 132620 - RNA, 22 nt, Homo sapiens
cuguaauguaaugagacuacau

SEQ ID NO: 132621 - RNA, 23 nt, Homo sapiens
cuguacacauauacaucuaagua

SEQ ID NO: 132622 - RNA, 22 nt, Homo sapiens
cugucucagugaauugguuuua

SEQ ID NO: 132623 - RNA, 22 nt, Homo sapiens
cugugcauggauuuuaagauug

SEQ ID NO: 132624 - RNA, 22 nt, Homo sapiens
cugugcauguaugcgugaguuc

SEQ ID NO: 132625 - RNA, 22 nt, Homo sapiens
cugugcuugagagaugacacag

SEQ ID NO: 132626 - RNA, 22 nt, Homo sapiens
cugugguauuauuagaaauauc

SEQ ID NO: 132627 - RNA, 22 nt, Homo sapiens
cugugguuacguucuuugugcu

SEQ ID NO: 132628 - RNA, 22 nt, Homo sapiens
cugugguuuaaggaauuuugac

SEQ ID NO: 132629 - RNA, 22 nt, Homo sapiens
cuguuaacauguuguggauaau

SEQ ID NO: 132630 - RNA, 22 nt, Homo sapiens
cuguuagguuaaggaauggcaa

SEQ ID NO: 132631 - RNA, 22 nt, Homo sapiens
cuguuugaggguuugcuuucag

SEQ ID NO: 132632 - RNA, 22 nt, Homo sapiens
cuuaacagugguauugaugacc

SEQ ID NO: 132633 - RNA, 22 nt, Homo sapiens
cuuaaggccagauaauuucuau

SEQ ID NO: 132634 - RNA, 22 nt, Homo sapiens
cuuagguuaugauaaauuuagu

SEQ ID NO: 132635 - RNA, 20 nt, Homo sapiens
cuuaucaguggcaaguauaa

SEQ ID NO: 132636 - RNA, 17 nt, Homo sapiens
cuucaaauaauuucccc

SEQ ID NO: 132637 - RNA, 22 nt, Homo sapiens
cuucaaguaauucugauggcua

SEQ ID NO: 132638 - RNA, 22 nt, Homo sapiens
cuucaagucuuuggauaauuag

SEQ ID NO: 132639 - RNA, 22 nt, Homo sapiens
cuucaaguguggccaccugacc

SEQ ID NO: 132640 - RNA, 22 nt, Homo sapiens
cuucaccaguuuggcagucuca

SEQ ID NO: 132641 - RNA, 22 nt, Homo sapiens
cuucacggugccuacuuguguc

SEQ ID NO: 132642 - RNA, 22 nt, Homo sapiens
cuucacuggagucccuggauuc

SEQ ID NO: 132643 - RNA, 22 nt, Homo sapiens
cuucagcaauauauccccuggg

SEQ ID NO: 132644 - RNA, 22 nt, Homo sapiens
cuucaguucuguaaggacagca

SEQ ID NO: 132645 - RNA, 22 nt, Homo sapiens
cuucaugagacuuuuggaaggc

SEQ ID NO: 132646 - RNA, 18 nt, Homo sapiens
cuucauugcuguuuugcu

SEQ ID NO: 132647 - RNA, 20 nt, Homo sapiens
cuuccaguggccccaucuuu

SEQ ID NO: 132648 - RNA, 18 nt, Homo sapiens
cuuccuuagucugguuaa

SEQ ID NO: 132649 - RNA, 22 nt, Homo sapiens
cuucucagugcucaucuuauuu

SEQ ID NO: 132650 - RNA, 22 nt, Homo sapiens
cuucuugcuguguccucacaug

SEQ ID NO: 132651 - RNA, 18 nt, Homo sapiens
ugcauauguugaaccagc

SEQ ID NO: 132652 - RNA, 22 nt, Homo sapiens
ugcauauucgaguuauuuuggg

SEQ ID NO: 132653 - RNA, 22 nt, Homo sapiens
ugcauauuuuauaaagauggaa

SEQ ID NO: 132654 - RNA, 22 nt, Homo sapiens
ugcaugaugcugagauuuggga

SEQ ID NO: 132655 - RNA, 22 nt, Homo sapiens
ugcaugcaucuuuuauaguagc

SEQ ID NO: 132656 - RNA, 22 nt, Homo sapiens
ugcauggagauauacaguuuuu

SEQ ID NO: 132657 - RNA, 22 nt, Homo sapiens
ugcauggauguuugaacacacu

SEQ ID NO: 132658 - RNA, 21 nt, Homo sapiens
ugcaugguagucacaugauuc

SEQ ID NO: 132659 - RNA, 22 nt, Homo sapiens
ugcauguucuuacucauacaug

SEQ ID NO: 132660 - RNA, 22 nt, Homo sapiens
ugcauuaucagauguuugcuuu

SEQ ID NO: 132661 - RNA, 22 nt, Homo sapiens
ugcauugcacuugcaugagaua

SEQ ID NO: 132662 - RNA, 22 nt, Homo sapiens
ugcauuguauuguugacucgcc

SEQ ID NO: 132663 - RNA, 21 nt, Homo sapiens
ugcauuguugcugagagcagg

SEQ ID NO: 132664 - RNA, 22 nt, Homo sapiens
ugccaagaacauuuucuguuuu

SEQ ID NO: 132665 - RNA, 20 nt, Homo sapiens
ugccaagaugacuauagcuc

SEQ ID NO: 132666 - RNA, 18 nt, Homo sapiens
ugacaucauuuagaaagg

SEQ ID NO: 132667 - RNA, 22 nt, Homo sapiens
ugacaugaugagcaauaauggc

SEQ ID NO: 132668 - RNA, 22 nt, Homo sapiens
ugacauggugcucuuucaggca

SEQ ID NO: 132669 - RNA, 22 nt, Homo sapiens
ugacauguccaggugguccugu

SEQ ID NO: 132670 - RNA, 21 nt, Homo sapiens
ugacauuauuucaugucagua

SEQ ID NO: 132671 - RNA, 22 nt, Homo sapiens
ugacggaggacaccugcggaau

SEQ ID NO: 132672 - RNA, 22 nt, Homo sapiens
ugacuacaccacacgguuaagg

SEQ ID NO: 132673 - RNA, 22 nt, Homo sapiens
ugacuacauaaguaaucucaaa

SEQ ID NO: 132674 - RNA, 22 nt, Homo sapiens
ugacuauugauuuagacgugcu

SEQ ID NO: 132675 - RNA, 22 nt, Homo sapiens
ugacuccagagacugugcuguc

SEQ ID NO: 132676 - RNA, 22 nt, Homo sapiens
ugacuggaaacaguguuauuug

SEQ ID NO: 132677 - RNA, 22 nt, Homo sapiens
ugacuggaacuuuagugagucu

SEQ ID NO: 132678 - RNA, 22 nt, Homo sapiens
ugacuggagaccucaguagggu

SEQ ID NO: 132679 - RNA, 23 nt, Homo sapiens
ugacuggagacuguugauccuuu

SEQ ID NO: 132680 - RNA, 22 nt, Homo sapiens
ugacuggagucuugcucugucg

SEQ ID NO: 132681 - RNA, 20 nt, Homo sapiens
ugacuggauacccuuuggcu

SEQ ID NO: 132682 - RNA, 18 nt, Homo sapiens
ugacuguccagguggacc

SEQ ID NO: 132683 - RNA, 22 nt, Homo sapiens
ugacuugauccauggggcucca

SEQ ID NO: 132684 - RNA, 22 nt, Homo sapiens
ugagaacaugugauauuuggug

SEQ ID NO: 132685 - RNA, 17 nt, Homo sapiens
ugagaacaugugguauu

SEQ ID NO: 132686 - RNA, 22 nt, Homo sapiens
ugagaacauuccucuuccuggc

SEQ ID NO: 132687 - RNA, 22 nt, Homo sapiens
ugagaaccucugugugcccacu

SEQ ID NO: 132688 - RNA, 22 nt, Homo sapiens
ugagaacugccuguauuuaucu

SEQ ID NO: 132689 - RNA, 22 nt, Homo sapiens
ugagaacuuauggugauuuuuu

SEQ ID NO: 132690 - RNA, 22 nt, Homo sapiens
ugagaagacaucuuugcuuugu

SEQ ID NO: 132691 - RNA, 22 nt, Homo sapiens
ugagaagugauauagaaguuaa

SEQ ID NO: 132692 - RNA, 22 nt, Homo sapiens
ugagacacuucccagaucccuu

SEQ ID NO: 132693 - RNA, 22 nt, Homo sapiens
ugagacauauuauacugcuuuu

SEQ ID NO: 132694 - RNA, 22 nt, Homo sapiens
ugagacaucugagauuuuaagc

SEQ ID NO: 132695 - RNA, 22 nt, Homo sapiens
ugagaccuuucauuucucagug

SEQ ID NO: 132696 - RNA, 22 nt, Homo sapiens
ugagacggagucucgcuguguc

SEQ ID NO: 132697 - RNA, 22 nt, Homo sapiens
ugagacggaguuucgcucuugu

SEQ ID NO: 132698 - RNA, 22 nt, Homo sapiens
ugagacugaguuucgcucuugu

SEQ ID NO: 132699 - RNA, 22 nt, Homo sapiens
ugagacugaguuucucucuugu

SEQ ID NO: 132700 - RNA, 22 nt, Homo sapiens
ugagacugaguuuugccuuugu

SEQ ID NO: 132701 - RNA, 22 nt, Homo sapiens
ugagacugaguuuugcucuugu

SEQ ID NO: 132702 - RNA, 22 nt, Homo sapiens
ugagacugguuaauugauaaag

SEQ ID NO: 132703 - RNA, 22 nt, Homo sapiens
ugagagacauuuguuguagagu

SEQ ID NO: 132704 - RNA, 22 nt, Homo sapiens
ugagagaugauaaaauguuugu

SEQ ID NO: 132705 - RNA, 22 nt, Homo sapiens
ugagagcuuuuuugccugguga

SEQ ID NO: 132706 - RNA, 22 nt, Homo sapiens
ugagaggugaauggcaggcuca

SEQ ID NO: 132707 - RNA, 22 nt, Homo sapiens
ugagauaaggaaauugaggcuc

SEQ ID NO: 132708 - RNA, 22 nt, Homo sapiens
ugagauaaucaugugauuucau

SEQ ID NO: 132709 - RNA, 18 nt, Homo sapiens
ugagauacuagaauaggu

SEQ ID NO: 132710 - RNA, 22 nt, Homo sapiens
ugagauaguacuuuuuuaaagg

SEQ ID NO: 132711 - RNA, 22 nt, Homo sapiens
ugagaucaagauguuagggacu

SEQ ID NO: 132712 - RNA, 22 nt, Homo sapiens
ugagaucagaaggauuucucug

SEQ ID NO: 132713 - RNA, 19 nt, Homo sapiens
ugagauccacugaagauuc

SEQ ID NO: 132714 - RNA, 22 nt, Homo sapiens
ugagauccugagaguugggacu

SEQ ID NO: 132715 - RNA, 22 nt, Homo sapiens
ugagaucugauaggccuggguu

SEQ ID NO: 132716 - RNA, 22 nt, Homo sapiens
ugagaugaacuugauuguuuua

SEQ ID NO: 132717 - RNA, 19 nt, Homo sapiens
ugagaugaagacagggguu

SEQ ID NO: 132718 - RNA, 22 nt, Homo sapiens
ugagaugaagcuagaagaaugg

SEQ ID NO: 132719 - RNA, 22 nt, Homo sapiens
ugagaugaagugauguaaaaca

SEQ ID NO: 132720 - RNA, 22 nt, Homo sapiens
ugagaugacgacacaccucagu

SEQ ID NO: 132721 - RNA, 22 nt, Homo sapiens
ugagaugagagaaugcuugccu

SEQ ID NO: 132722 - RNA, 22 nt, Homo sapiens
ugagaugagggaagccuaggca

SEQ ID NO: 132723 - RNA, 22 nt, Homo sapiens
ugagaugaggucucacucuguu

SEQ ID NO: 132724 - RNA, 22 nt, Homo sapiens
ugagaugagucucgcucuguca

SEQ ID NO: 132725 - RNA, 22 nt, Homo sapiens
ugagaugauaucuuauuguaau

SEQ ID NO: 132726 - RNA, 21 nt, Homo sapiens
ugagaugauccugcaugcaug

SEQ ID NO: 132727 - RNA, 22 nt, Homo sapiens
ugagaugauuuaauggagccca

SEQ ID NO: 132728 - RNA, 20 nt, Homo sapiens
ugagaugcauugggauguuu

SEQ ID NO: 132729 - RNA, 22 nt, Homo sapiens
ugagaugcucgccggccagcau

SEQ ID NO: 132730 - RNA, 22 nt, Homo sapiens
ugagauggaguuucgcucuugu

SEQ ID NO: 132731 - RNA, 22 nt, Homo sapiens
ugagauggguucugguccccug

SEQ ID NO: 132732 - RNA, 22 nt, Homo sapiens
ugagauguguccagaucuaguu

SEQ ID NO: 132733 - RNA, 22 nt, Homo sapiens
ugagauguuccaaugacuauua

SEQ ID NO: 132734 - RNA, 21 nt, Homo sapiens
ugagauuaaguuguuuagaag

SEQ ID NO: 132735 - RNA, 22 nt, Homo sapiens
ugagauuaaucuuuaaguaaga

SEQ ID NO: 132736 - RNA, 22 nt, Homo sapiens
ugagauuaucguaauguaucuc

SEQ ID NO: 132737 - RNA, 22 nt, Homo sapiens
ugagcaagaucuuuauaauuag

SEQ ID NO: 132738 - RNA, 22 nt, Homo sapiens
ugagcacuguacuuuaucaggu

SEQ ID NO: 132739 - RNA, 22 nt, Homo sapiens
aucacagauauggguuuaaauc

SEQ ID NO: 132740 - RNA, 22 nt, Homo sapiens
aucacaguggcucacaagagcc

SEQ ID NO: 132741 - RNA, 22 nt, Homo sapiens
aucacauggccagguaguaauc

SEQ ID NO: 132742 - RNA, 19 nt, Homo sapiens
aucaccagucuuuccacug

SEQ ID NO: 132743 - RNA, 19 nt, Homo sapiens
aucaccauuauuuggaaca

SEQ ID NO: 132744 - RNA, 22 nt, Homo sapiens
aucaccuggaggugaucacuug

SEQ ID NO: 132745 - RNA, 22 nt, Homo sapiens
aucacugggauggaacugcuga

SEQ ID NO: 132746 - RNA, 23 nt, Homo sapiens
aucacuguuaacaauuucuuccu

SEQ ID NO: 132747 - RNA, 22 nt, Homo sapiens
aucacuuugcucuccagugugg

SEQ ID NO: 132748 - RNA, 20 nt, Homo sapiens
aucagagacuaggauugcca

SEQ ID NO: 132749 - RNA, 22 nt, Homo sapiens
aucagcagcaugaaaacggacu

SEQ ID NO: 132750 - RNA, 22 nt, Homo sapiens
aucaggcacacauuggaguuug

SEQ ID NO: 132751 - RNA, 22 nt, Homo sapiens
aucagugagugguuagugaaug

SEQ ID NO: 132752 - RNA, 22 nt, Homo sapiens
aucagugcauguuuguugagcu

SEQ ID NO: 132753 - RNA, 22 nt, Homo sapiens
aucauauccuagauauaacuuc

SEQ ID NO: 132754 - RNA, 22 nt, Homo sapiens
aucaucaugcacuacagccugg

SEQ ID NO: 132755 - RNA, 22 nt, Homo sapiens
aucauugugcaucuucauucca

SEQ ID NO: 132756 - RNA, 22 nt, Homo sapiens
auccacagugucaauguuguga

SEQ ID NO: 132757 - RNA, 22 nt, Homo sapiens
auccagaugggcuuaauguaau

SEQ ID NO: 132758 - RNA, 22 nt, Homo sapiens
auccauugcucaagagaaguca

SEQ ID NO: 132759 - RNA, 22 nt, Homo sapiens
aucccaguucagccucugacac

SEQ ID NO: 132760 - RNA, 22 nt, Homo sapiens
aucccgagacuuugcugaaguu

SEQ ID NO: 132761 - RNA, 22 nt, Homo sapiens
aucccuuucugauacuuucccu

SEQ ID NO: 132762 - RNA, 22 nt, Homo sapiens
auccugaagcuuuacugaauuc

SEQ ID NO: 132763 - RNA, 22 nt, Homo sapiens
auccuguagucucacagcccca

SEQ ID NO: 132764 - RNA, 21 nt, Homo sapiens
auccuucuuuuucaaccugug

SEQ ID NO: 132765 - RNA, 22 nt, Homo sapiens
aucgcgccauuguacuccagcc

SEQ ID NO: 132766 - RNA, 21 nt, Homo sapiens
aucucacuugaauguaaaagc

SEQ ID NO: 132767 - RNA, 22 nt, Homo sapiens
aucucagagaaaauuacuaaga

SEQ ID NO: 132768 - RNA, 22 nt, Homo sapiens
aucucauuccuucugggcugau

SEQ ID NO: 132769 - RNA, 22 nt, Homo sapiens
aucucugagauguucugauuuu

SEQ ID NO: 132770 - RNA, 22 nt, Homo sapiens
aucugauggagagcguguggcu

SEQ ID NO: 132771 - RNA, 22 nt, Homo sapiens
aucugcauuagggugaagaccu

SEQ ID NO: 132772 - RNA, 19 nt, Homo sapiens
aucuggaguuccuggggcu

SEQ ID NO: 132773 - RNA, 22 nt, Homo sapiens
aucugggguuggcaaaguuugg

SEQ ID NO: 132774 - RNA, 22 nt, Homo sapiens
aucugguguuuuucucccucgu

SEQ ID NO: 132775 - RNA, 22 nt, Homo sapiens
aucugugguuguaugcauauua

SEQ ID NO: 132776 - RNA, 22 nt, Homo sapiens
aucuuguccugagguuuuauug

SEQ ID NO: 132777 - RNA, 22 nt, Homo sapiens
aucuuugauuguagguacaaug

SEQ ID NO: 132778 - RNA, 22 nt, Homo sapiens
augaaacuggcuaauuuuugua

SEQ ID NO: 132779 - RNA, 22 nt, Homo sapiens
augaaagguugucuuaagccau

SEQ ID NO: 132780 - RNA, 22 nt, Homo sapiens
augaaauguaugagucuggguu

SEQ ID NO: 132781 - RNA, 22 nt, Homo sapiens
augaacuaugugggauguuuua

SEQ ID NO: 132782 - RNA, 22 nt, Homo sapiens
augaaguauuaggacacauuua

SEQ ID NO: 132783 - RNA, 22 nt, Homo sapiens
augaaguuagcucauuucuuuu

SEQ ID NO: 132784 - RNA, 22 nt, Homo sapiens
augaauacagcuaugcgugcau

SEQ ID NO: 132785 - RNA, 22 nt, Homo sapiens
augaauagaguuaauugaguac

SEQ ID NO: 132786 - RNA, 22 nt, Homo sapiens
augaaugcagcacuguuuuucu

SEQ ID NO: 132787 - RNA, 20 nt, Homo sapiens
augaauguccuugauggcau

SEQ ID NO: 132788 - RNA, 23 nt, Homo sapiens
augacacuguccuugaccauuuc

SEQ ID NO: 132789 - RNA, 22 nt, Homo sapiens
augacagugagugagcucucac

SEQ ID NO: 132790 - RNA, 22 nt, Homo sapiens
augacaguguggauuauuguaa

SEQ ID NO: 132791 - RNA, 22 nt, Homo sapiens
augacauuccacagccguagag

SEQ ID NO: 132792 - RNA, 22 nt, Homo sapiens
augaccuuguccucagugucau

SEQ ID NO: 132793 - RNA, 22 nt, Homo sapiens
augacuaaaggguuuauguuga

SEQ ID NO: 132794 - RNA, 22 nt, Homo sapiens
augacuauugcacuuuccuggu

SEQ ID NO: 132795 - RNA, 22 nt, Homo sapiens
augacuggauaauggacacaca

SEQ ID NO: 132796 - RNA, 22 nt, Homo sapiens
augacugucagggcagucauug

SEQ ID NO: 132797 - RNA, 22 nt, Homo sapiens
augacugucuugcagaggcuau

SEQ ID NO: 132798 - RNA, 22 nt, Homo sapiens
augagaacugucaaugagagcu

SEQ ID NO: 132799 - RNA, 22 nt, Homo sapiens
augagaaucauuucagcuugua

SEQ ID NO: 132800 - RNA, 22 nt, Homo sapiens
augagaaugauucuguuauggu

SEQ ID NO: 132801 - RNA, 22 nt, Homo sapiens
agucauagaguuugcccuucuc

SEQ ID NO: 132802 - RNA, 22 nt, Homo sapiens
agucauaggagagauaucacug

SEQ ID NO: 132803 - RNA, 19 nt, Homo sapiens
agucaugugaggacccuug

SEQ ID NO: 132804 - RNA, 22 nt, Homo sapiens
aguccagguuuuguaauggcaa

SEQ ID NO: 132805 - RNA, 22 nt, Homo sapiens
agucgguguuacugacagaaug

SEQ ID NO: 132806 - RNA, 22 nt, Homo sapiens
agucugguguucucacacuagu

SEQ ID NO: 132807 - RNA, 22 nt, Homo sapiens
agugaaaucugaagaaggucau

SEQ ID NO: 132808 - RNA, 22 nt, Homo sapiens
agugaaaugucaccuuuuagga

SEQ ID NO: 132809 - RNA, 22 nt, Homo sapiens
agugaacaaagaagugcagaua

SEQ ID NO: 132810 - RNA, 22 nt, Homo sapiens
agugcaaagccgagguuucuug

SEQ ID NO: 132811 - RNA, 22 nt, Homo sapiens
agugcaauggugccaucauagc

SEQ ID NO: 132812 - RNA, 22 nt, Homo sapiens
agugcacuccagccugggcaac

SEQ ID NO: 132813 - RNA, 22 nt, Homo sapiens
agugcaguggcauggucauaac

SEQ ID NO: 132814 - RNA, 22 nt, Homo sapiens
agugcagugguuaggagccagg

SEQ ID NO: 132815 - RNA, 22 nt, Homo sapiens
agugccuauugauggaaagaua

SEQ ID NO: 132816 - RNA, 22 nt, Homo sapiens
agugguauaauauuauuuugaa

SEQ ID NO: 132817 - RNA, 23 nt, Homo sapiens
aguggucuccugggcccagcugu

SEQ ID NO: 132818 - RNA, 22 nt, Homo sapiens
aguguuuuuaucaugaaagggu

SEQ ID NO: 132819 - RNA, 22 nt, Homo sapiens
auaaagguaauaauaguugcau

SEQ ID NO: 132820 - RNA, 22 nt, Homo sapiens
auaaaguucugcuggcauauau

SEQ ID NO: 132821 - RNA, 22 nt, Homo sapiens
auaaaugcaaugguauuuuuga

SEQ ID NO: 132822 - RNA, 22 nt, Homo sapiens
auaaaugcauugagaacugcug

SEQ ID NO: 132823 - RNA, 22 nt, Homo sapiens
auaaaugcuuagaucuguauau

SEQ ID NO: 132824 - RNA, 22 nt, Homo sapiens
auaacauccuuucuuaucguug

SEQ ID NO: 132825 - RNA, 22 nt, Homo sapiens
auaacucuguuuuuuucaugca

SEQ ID NO: 132826 - RNA, 22 nt, Homo sapiens
auaaggcagcugcuaaaaggca

SEQ ID NO: 132827 - RNA, 22 nt, Homo sapiens
auaagguuagcucugagaaagu

SEQ ID NO: 132828 - RNA, 22 nt, Homo sapiens
auaaguagaaugauggucaaaa

SEQ ID NO: 132829 - RNA, 22 nt, Homo sapiens
auaagucaauggaacagauuaa

SEQ ID NO: 132830 - RNA, 19 nt, Homo sapiens
auaagugaaucacgggggc

SEQ ID NO: 132831 - RNA, 22 nt, Homo sapiens
auaauagcugaucauuuagaag

SEQ ID NO: 132832 - RNA, 22 nt, Homo sapiens
auaauagguaguaauggauuga

SEQ ID NO: 132833 - RNA, 22 nt, Homo sapiens
auaauguuugauugagcagaua

SEQ ID NO: 132834 - RNA, 19 nt, Homo sapiens
auaauuagcagugaggaca

SEQ ID NO: 132835 - RNA, 19 nt, Homo sapiens
auacacguguauacauaca

SEQ ID NO: 132836 - RNA, 22 nt, Homo sapiens
auacagguauacaaugcauaau

SEQ ID NO: 132837 - RNA, 22 nt, Homo sapiens
auacaguauggagggcccagcu

SEQ ID NO: 132838 - RNA, 22 nt, Homo sapiens
auacaugugccauguugguuug

SEQ ID NO: 132839 - RNA, 22 nt, Homo sapiens
auacccucugggugguuaguug

SEQ ID NO: 132840 - RNA, 22 nt, Homo sapiens
auaccugguagucuugcuacac

SEQ ID NO: 132841 - RNA, 22 nt, Homo sapiens
auacuagucaagaauguaugag

SEQ ID NO: 132842 - RNA, 21 nt, Homo sapiens
auacuugcauccuuggagaga

SEQ ID NO: 132843 - RNA, 20 nt, Homo sapiens
auagaccauugguagguagg

SEQ ID NO: 132844 - RNA, 23 nt, Homo sapiens
auagagcuaggaugcagacagau

SEQ ID NO: 132845 - RNA, 22 nt, Homo sapiens
auagaucauugucauuuuagau

SEQ ID NO: 132846 - RNA, 22 nt, Homo sapiens
auagcaaugccccacuccuugg

SEQ ID NO: 132847 - RNA, 22 nt, Homo sapiens
auagcaaugccccauucccagu

SEQ ID NO: 132848 - RNA, 22 nt, Homo sapiens
auagcacaguguguguacacca

SEQ ID NO: 132849 - RNA, 22 nt, Homo sapiens
auagcacauggcauccucucuu

SEQ ID NO: 132850 - RNA, 22 nt, Homo sapiens
auagcacaugugcaaauggcug

SEQ ID NO: 132851 - RNA, 22 nt, Homo sapiens
auagcagaccaccucucccacu

SEQ ID NO: 132852 - RNA, 22 nt, Homo sapiens
auagcagugugaaaauggacua

SEQ ID NO: 132853 - RNA, 22 nt, Homo sapiens
auagcaucauuucuugaaaaga

SEQ ID NO: 132854 - RNA, 20 nt, Homo sapiens
auagcauugauggacucaaa

SEQ ID NO: 132855 - RNA, 22 nt, Homo sapiens
auagcccuuuucuaacuaugug

SEQ ID NO: 132856 - RNA, 22 nt, Homo sapiens
auaggacuauugugaggauuaa

SEQ ID NO: 132857 - RNA, 22 nt, Homo sapiens
auaggagcacaaacuauuguga

SEQ ID NO: 132858 - RNA, 22 nt, Homo sapiens
auaggagcacgaacucuagugu

SEQ ID NO: 132859 - RNA, 22 nt, Homo sapiens
auaggagugugcacagaguagg

SEQ ID NO: 132860 - RNA, 20 nt, Homo sapiens
uacauaguaaacugagagca

SEQ ID NO: 132861 - RNA, 22 nt, Homo sapiens
uacauccauccugcugggcagu

SEQ ID NO: 132862 - RNA, 22 nt, Homo sapiens
uacaugcaugggcaugugugca

SEQ ID NO: 132863 - RNA, 22 nt, Homo sapiens
uaccaaaguuucggccucuguu

SEQ ID NO: 132864 - RNA, 22 nt, Homo sapiens
uaccaaguauuuucacaugaac

SEQ ID NO: 132865 - RNA, 22 nt, Homo sapiens
uacuauugcaucggugauuagg

SEQ ID NO: 132866 - RNA, 22 nt, Homo sapiens
uacuccccuuguucugugagcu

SEQ ID NO: 132867 - RNA, 22 nt, Homo sapiens
uacucugcagccauaaaacaga

SEQ ID NO: 132868 - RNA, 22 nt, Homo sapiens
uacugcacuccagccucgguga

SEQ ID NO: 132869 - RNA, 22 nt, Homo sapiens
uacugcacuccagccugccaac

SEQ ID NO: 132870 - RNA, 19 nt, Homo sapiens
uacugcacuccagucuggg

SEQ ID NO: 132871 - RNA, 22 nt, Homo sapiens
uacugcagucagacuccugggc

SEQ ID NO: 132872 - RNA, 22 nt, Homo sapiens
uacugcauuucacuguuaaaga

SEQ ID NO: 132873 - RNA, 22 nt, Homo sapiens
uagaaagcaugaccuucagaua

SEQ ID NO: 132874 - RNA, 22 nt, Homo sapiens
uagaacaauugcuggauccgaa

SEQ ID NO: 132875 - RNA, 22 nt, Homo sapiens
uagaacauuccaggugauguug

SEQ ID NO: 132876 - RNA, 22 nt, Homo sapiens
uagaauguaacaguuaaaagca

SEQ ID NO: 132877 - RNA, 22 nt, Homo sapiens
uagacccauuguucagagagug

SEQ ID NO: 132878 - RNA, 22 nt, Homo sapiens
uagagauaucaauuucauggug

SEQ ID NO: 132879 - RNA, 22 nt, Homo sapiens
uagaggaaggauuggaaacgca

SEQ ID NO: 132880 - RNA, 22 nt, Homo sapiens
uagagguagguguaugaacuag

SEQ ID NO: 132881 - RNA, 22 nt, Homo sapiens
uagauaguuaugauuugaugau

SEQ ID NO: 132882 - RNA, 20 nt, Homo sapiens
uagaugcauuuagauucauu

SEQ ID NO: 132883 - RNA, 21 nt, Homo sapiens
uagaugguguucuagagagaa

SEQ ID NO: 132884 - RNA, 22 nt, Homo sapiens
uagauucaucuguuccuuuuga

SEQ ID NO: 132885 - RNA, 21 nt, Homo sapiens
uagcaaauugcuauuaaggca

SEQ ID NO: 132886 - RNA, 23 nt, Homo sapiens
uagcaacaguuggaggugaggua

SEQ ID NO: 132887 - RNA, 22 nt, Homo sapiens
uagcaacauucagcucagguac

SEQ ID NO: 132888 - RNA, 22 nt, Homo sapiens
uagcaagaugaauuugugcaaa

SEQ ID NO: 132889 - RNA, 19 nt, Homo sapiens
uagcacagggucccagacu

SEQ ID NO: 132890 - RNA, 22 nt, Homo sapiens
ugauaugaaagggaaauaagug

SEQ ID NO: 132891 - RNA, 21 nt, Homo sapiens
ugauaugguagaagagagaca

SEQ ID NO: 132892 - RNA, 18 nt, Homo sapiens
ugauaugguuuggcucug

SEQ ID NO: 132893 - RNA, 20 nt, Homo sapiens
ugauaugguuuggcuguguu

SEQ ID NO: 132894 - RNA, 22 nt, Homo sapiens
ugauaugucccucgacaucagg

SEQ ID NO: 132895 - RNA, 22 nt, Homo sapiens
ugauauguuagaaucuugcaag

SEQ ID NO: 132896 - RNA, 20 nt, Homo sapiens
ugauauuucuggaaguggag

SEQ ID NO: 132897 - RNA, 22 nt, Homo sapiens
ugaucacagcuugacuaaagga

SEQ ID NO: 132898 - RNA, 21 nt, Homo sapiens
ugaucacaugaaaaccaugca

SEQ ID NO: 132899 - RNA, 22 nt, Homo sapiens
ugaucucauuagcaccuuuagc

SEQ ID NO: 132900 - RNA, 22 nt, Homo sapiens
ugaucuuuuuaauguccauggg

SEQ ID NO: 132901 - RNA, 20 nt, Homo sapiens
ugaugcaaaucuuuaaaagu

SEQ ID NO: 132902 - RNA, 22 nt, Homo sapiens
ugaugcuacuaccugggcugaa

SEQ ID NO: 132903 - RNA, 22 nt, Homo sapiens
ugaugguguuaccaucuuuacu

SEQ ID NO: 132904 - RNA, 22 nt, Homo sapiens
ugaugguuuuaaaaagaggagu

SEQ ID NO: 132905 - RNA, 22 nt, Homo sapiens
ugauguaggcauuuaagguuau

SEQ ID NO: 132906 - RNA, 22 nt, Homo sapiens
ugaugugucaucugagagagug

SEQ ID NO: 132907 - RNA, 22 nt, Homo sapiens
ugauuagagcccaagcuuugaa

SEQ ID NO: 132908 - RNA, 22 nt, Homo sapiens
ugauucccucaagugccuuaug

SEQ ID NO: 132909 - RNA, 22 nt, Homo sapiens
ugauugacauucuuuggaguau

SEQ ID NO: 132910 - RNA, 18 nt, Homo sapiens
ugauugacuuauuuaggu

SEQ ID NO: 132911 - RNA, 22 nt, Homo sapiens
ugauuuccaugagaacaugccu

SEQ ID NO: 132912 - RNA, 22 nt, Homo sapiens
ugauuuguccauguggcacgug

SEQ ID NO: 132913 - RNA, 19 nt, Homo sapiens
ugcaaagucagugaagggu

SEQ ID NO: 132914 - RNA, 22 nt, Homo sapiens
ugcaaaguccucauucuuaccc

SEQ ID NO: 132915 - RNA, 22 nt, Homo sapiens
ugcaaauguuaggugucauuau

SEQ ID NO: 132916 - RNA, 22 nt, Homo sapiens
ugcaacacauugccccugcucu

SEQ ID NO: 132917 - RNA, 21 nt, Homo sapiens
ugcaagaaucaggaagcugcc

SEQ ID NO: 132918 - RNA, 22 nt, Homo sapiens
ugcaagaggagacuguacucag

SEQ ID NO: 132919 - RNA, 20 nt, Homo sapiens
ugcaaguugccuuuggaggc

SEQ ID NO: 132920 - RNA, 18 nt, Homo sapiens
ugcaauggagaugcagcc

SEQ ID NO: 132921 - RNA, 22 nt, Homo sapiens
ugcaccacugcacuccacccug

SEQ ID NO: 132922 - RNA, 22 nt, Homo sapiens
ugcaccauugucaccuggguga

SEQ ID NO: 132923 - RNA, 22 nt, Homo sapiens
ugcagagaaacauuuuguauuu

SEQ ID NO: 132924 - RNA, 19 nt, Homo sapiens
ugcagcaauguaaaagaca

SEQ ID NO: 132925 - RNA, 17 nt, Homo sapiens
ugcagcacacugauggg

SEQ ID NO: 132926 - RNA, 22 nt, Homo sapiens
ugcagcacuguucacaauagcc

SEQ ID NO: 132927 - RNA, 21 nt, Homo sapiens
ugcagccauucagcccuaugc

SEQ ID NO: 132928 - RNA, 22 nt, Homo sapiens
ugcagcucaaauuccuaacaag

SEQ ID NO: 132929 - RNA, 22 nt, Homo sapiens
ugcagguacuugacaacuuggg

SEQ ID NO: 132930 - RNA, 22 nt, Homo sapiens
ugcaguagugugaucuuggcuc

SEQ ID NO: 132931 - RNA, 22 nt, Homo sapiens
ugcaguuuaggaacugguaaca

SEQ ID NO: 132932 - RNA, 21 nt, Homo sapiens
ugcauacuucucagaugauua

SEQ ID NO: 132933 - RNA, 23 nt, Homo sapiens
ugcauaguacccaauacuuuauc

SEQ ID NO: 132934 - RNA, 22 nt, Homo sapiens
ugcauaugcagcauuuaugauu

SEQ ID NO: 132935 - RNA, 22 nt, Homo sapiens
ugcauauguugagaugcauauu

SEQ ID NO: 132936 - RNA, 22 nt, Homo sapiens
ugcauggaggagcuccccgcag

SEQ ID NO: 132937 - RNA, 21 nt, Homo sapiens
ugcauugucuugaguuuaaau

SEQ ID NO: 132938 - RNA, 22 nt, Homo sapiens
ugcauuguuccgaauguguccu

SEQ ID NO: 132939 - RNA, 22 nt, Homo sapiens
ugccaaaaugggcuuuauaccg

SEQ ID NO: 132940 - RNA, 22 nt, Homo sapiens
ugccaaggagucagucccuaga

SEQ ID NO: 132941 - RNA, 22 nt, Homo sapiens
ugccagagacguagggaauauu

SEQ ID NO: 132942 - RNA, 22 nt, Homo sapiens
ugccaguauuuuauugagcauu

SEQ ID NO: 132943 - RNA, 22 nt, Homo sapiens
ugccauagcaaugguaagcuga

SEQ ID NO: 132944 - RNA, 22 nt, Homo sapiens
ugccaugaagaucccugaaaug

SEQ ID NO: 132945 - RNA, 22 nt, Homo sapiens
ugcccguaauuccagcacuuug

SEQ ID NO: 132946 - RNA, 22 nt, Homo sapiens
ugcccuguaucccacuguuuca

SEQ ID NO: 132947 - RNA, 22 nt, Homo sapiens
ugccuaggcuggaguguagugg

SEQ ID NO: 132948 - RNA, 22 nt, Homo sapiens
ugccuaguagaaggugaacaug

SEQ ID NO: 132949 - RNA, 22 nt, Homo sapiens
ugccuggagagcuccuacauau

SEQ ID NO: 132950 - RNA, 21 nt, Homo sapiens
ugccuuuguaguaggugucuu

SEQ ID NO: 132951 - RNA, 22 nt, Homo sapiens
ugcgauaguuugcugguaaauu

SEQ ID NO: 132952 - RNA, 22 nt, Homo sapiens
ugcuacccuucgucucucuggu

SEQ ID NO: 132953 - RNA, 22 nt, Homo sapiens
ugcuagagaaauauauuugggg

SEQ ID NO: 132954 - RNA, 21 nt, Homo sapiens
ugcuauguuguccaggcuggc

SEQ ID NO: 132955 - RNA, 22 nt, Homo sapiens
ugcucaccugcugcucaccucc

SEQ ID NO: 132956 - RNA, 23 nt, Homo sapiens
ugcuccccucauggaugaauaaa

SEQ ID NO: 132957 - RNA, 22 nt, Homo sapiens
ugcugcacuuauggcucugagg

SEQ ID NO: 132958 - RNA, 22 nt, Homo sapiens
ugcugcauuggggauuaaguuu

SEQ ID NO: 132959 - RNA, 22 nt, Homo sapiens
ugcugcuguuaucauuuuacca

SEQ ID NO: 132960 - RNA, 22 nt, Homo sapiens
ugcugguuuaaaaugcaaauuc

SEQ ID NO: 132961 - RNA, 22 nt, Homo sapiens
ugcuguguugcuggcuuaaaga

SEQ ID NO: 132962 - RNA, 18 nt, Homo sapiens
ugcuuagucauuuucaau

SEQ ID NO: 132963 - RNA, 22 nt, Homo sapiens
ugcuuaguuguauguuccacau

SEQ ID NO: 132964 - RNA, 21 nt, Homo sapiens
ugcuuuggucauacuucuucc

SEQ ID NO: 132965 - RNA, 22 nt, Homo sapiens
uggaaaauuaggggagguuaua

SEQ ID NO: 132966 - RNA, 22 nt, Homo sapiens
uggaaacuuauguucuucugug

SEQ ID NO: 132967 - RNA, 22 nt, Homo sapiens
uggaaauaaaugugccaagauc

SEQ ID NO: 132968 - RNA, 22 nt, Homo sapiens
uggaagacucuagucucuugag

SEQ ID NO: 132969 - RNA, 22 nt, Homo sapiens
uggaagacuuuagaggcuuaua

SEQ ID NO: 132970 - RNA, 22 nt, Homo sapiens
uggaagauggaguuuuaucauu

SEQ ID NO: 132971 - RNA, 20 nt, Homo sapiens
uggaagccuggugcuaucuu

SEQ ID NO: 132972 - RNA, 20 nt, Homo sapiens
uggaaggcaucugcauuauu

SEQ ID NO: 132973 - RNA, 22 nt, Homo sapiens
uggaaguagauagauuguguca

SEQ ID NO: 132974 - RNA, 22 nt, Homo sapiens
uggaaguuaaaugacucuuucu

SEQ ID NO: 132975 - RNA, 20 nt, Homo sapiens
uggaaucuaggcggagguuu

SEQ ID NO: 132976 - RNA, 22 nt, Homo sapiens
uggaaugcuaagcaugugggag

SEQ ID NO: 132977 - RNA, 19 nt, Homo sapiens
uggaauggauuuaaaugug

SEQ ID NO: 132978 - RNA, 22 nt, Homo sapiens
uggaauguagcguugacacgag

SEQ ID NO: 132979 - RNA, 22 nt, Homo sapiens
uggaauguauaucguuuuuugu

SEQ ID NO: 132980 - RNA, 22 nt, Homo sapiens
uggaaugucagcuacaagaggg

SEQ ID NO: 132981 - RNA, 17 nt, Homo sapiens
uggaaugucuaagccug

SEQ ID NO: 132982 - RNA, 22 nt, Homo sapiens
uuccacuuuuuccuugugcucc

SEQ ID NO: 132983 - RNA, 20 nt, Homo sapiens
uuccagcacauuagggaagc

SEQ ID NO: 132984 - RNA, 22 nt, Homo sapiens
uuccagugggacgagaugugga

SEQ ID NO: 132985 - RNA, 22 nt, Homo sapiens
uuccauguaguugagcaguuuu

SEQ ID NO: 132986 - RNA, 22 nt, Homo sapiens
uuccauguugauacgugaaguu

SEQ ID NO: 132987 - RNA, 22 nt, Homo sapiens
uucccagagagggacuucuaau

SEQ ID NO: 132988 - RNA, 22 nt, Homo sapiens
uucccaguuggggaaagcgacc

SEQ ID NO: 132989 - RNA, 22 nt, Homo sapiens
uucccucagaaacacacagccc

SEQ ID NO: 132990 - RNA, 22 nt, Homo sapiens
uucccugaguaucuuaccaugg

SEQ ID NO: 132991 - RNA, 22 nt, Homo sapiens
uucccuguaucuucugccaugu

SEQ ID NO: 132992 - RNA, 22 nt, Homo sapiens
uucccuuucugaaaaucucauu

SEQ ID NO: 132993 - RNA, 22 nt, Homo sapiens
uucccuuugaaacuaaacuugc

SEQ ID NO: 132994 - RNA, 22 nt, Homo sapiens
uuccguguaguugagcaguuuu

SEQ ID NO: 132995 - RNA, 22 nt, Homo sapiens
uuccugcacuugcuugccuaug

SEQ ID NO: 132996 - RNA, 22 nt, Homo sapiens
uucgcagcucaguucaacuagg

SEQ ID NO: 132997 - RNA, 22 nt, Homo sapiens
uucuacaggcuguucaagaagc

SEQ ID NO: 132998 - RNA, 21 nt, Homo sapiens
uucuacuccggcguuguuuuu

SEQ ID NO: 132999 - RNA, 23 nt, Homo sapiens
uucuaucaggcccaggagcccug

SEQ ID NO: 133000 - RNA, 22 nt, Homo sapiens
uucuauguuguuagacccacca

SEQ ID NO: 133001 - RNA, 22 nt, Homo sapiens
uucucaaggagccuucguaacu

SEQ ID NO: 133002 - RNA, 22 nt, Homo sapiens
uucucagcccccugacagucag

SEQ ID NO: 133003 - RNA, 19 nt, Homo sapiens
uucucugguuguacuaccc

SEQ ID NO: 133004 - RNA, 22 nt, Homo sapiens
uucucuguggauugggugagag

SEQ ID NO: 133005 - RNA, 22 nt, Homo sapiens
uucugagguuauauucucucaa

SEQ ID NO: 133006 - RNA, 22 nt, Homo sapiens
uucugcacaucgaucacaagau

SEQ ID NO: 133007 - RNA, 22 nt, Homo sapiens
uucuggcuaugggauacuaaau

SEQ ID NO: 133008 - RNA, 22 nt, Homo sapiens
uucuguguuuaggucacggcua

SEQ ID NO: 133009 - RNA, 20 nt, Homo sapiens
uucuugaguuaacaaguuac

SEQ ID NO: 133010 - RNA, 22 nt, Homo sapiens
uucuugcacugaucccauaagc

SEQ ID NO: 133011 - RNA, 22 nt, Homo sapiens
uucuugguguaguaguugaaaa

SEQ ID NO: 133012 - RNA, 22 nt, Homo sapiens
uucuuuggaaacaguacuaauu

SEQ ID NO: 133013 - RNA, 22 nt, Homo sapiens
uucuuuggauaaaguuuuaugc

SEQ ID NO: 133014 - RNA, 19 nt, Homo sapiens
uucuuuguugugggggcug

SEQ ID NO: 133015 - RNA, 23 nt, Homo sapiens
uugaaaagucaguagccucugau

SEQ ID NO: 133016 - RNA, 22 nt, Homo sapiens
uugaaagaaaggagacugaguu

SEQ ID NO: 133017 - RNA, 22 nt, Homo sapiens
uugaaagacagaggggcaaguu

SEQ ID NO: 133018 - RNA, 22 nt, Homo sapiens
uugaaagacaucaccuacugcu

SEQ ID NO: 133019 - RNA, 22 nt, Homo sapiens
uugaaaguaaacaucacaaaga

SEQ ID NO: 133020 - RNA, 22 nt, Homo sapiens
uugaaaguguucacaaugguau

SEQ ID NO: 133021 - RNA, 22 nt, Homo sapiens
uugaacugguaguuggaaaucu

SEQ ID NO: 133022 - RNA, 22 nt, Homo sapiens
uugaaguagguaccguucaauu

SEQ ID NO: 133023 - RNA, 22 nt, Homo sapiens
uugaaguguguauacauugugg

SEQ ID NO: 133024 - RNA, 22 nt, Homo sapiens
uugaauagaaguguugaaagug

SEQ ID NO: 133025 - RNA, 22 nt, Homo sapiens
uugaauagacagccagcuuuaa

SEQ ID NO: 133026 - RNA, 18 nt, Homo sapiens
uugaauagagccaagcac

SEQ ID NO: 133027 - RNA, 22 nt, Homo sapiens
uugaauagcauguuuagugcau

SEQ ID NO: 133028 - RNA, 22 nt, Homo sapiens
uugaauagugacuuugauucug

SEQ ID NO: 133029 - RNA, 17 nt, Homo sapiens
uugaaugcauuacuugg

SEQ ID NO: 133030 - RNA, 22 nt, Homo sapiens
uugaauguacuuguucucacua

SEQ ID NO: 133031 - RNA, 22 nt, Homo sapiens
uugacagaccuuggucauaucc

SEQ ID NO: 133032 - RNA, 20 nt, Homo sapiens
uugacagagggaaaguugcu

SEQ ID NO: 133033 - RNA, 22 nt, Homo sapiens
uugacauguaggcagggaaugg

SEQ ID NO: 133034 - RNA, 22 nt, Homo sapiens
uugaccaaagaagagucauugc

SEQ ID NO: 133035 - RNA, 22 nt, Homo sapiens
uugaccuggagaguacuuugac

SEQ ID NO: 133036 - RNA, 22 nt, Homo sapiens
uugacuuagacauucaguugga

SEQ ID NO: 133037 - RNA, 22 nt, Homo sapiens
uugacuuuuauucacucugcua

SEQ ID NO: 133038 - RNA, 22 nt, Homo sapiens
uugagaagugucuguucauguc

SEQ ID NO: 133039 - RNA, 22 nt, Homo sapiens
uugagaaucuuucgaauguucu

SEQ ID NO: 133040 - RNA, 22 nt, Homo sapiens
uugagacgaagucucacucuug

SEQ ID NO: 133041 - RNA, 22 nt, Homo sapiens
uugagacggagucuugcucuuu

SEQ ID NO: 133042 - RNA, 22 nt, Homo sapiens
uugagacggaguuuugcucuug

SEQ ID NO: 133043 - RNA, 22 nt, Homo sapiens
uugagagaaaaaauuuauuggu

SEQ ID NO: 133044 - RNA, 22 nt, Homo sapiens
uugagagaaaaggccaugccuu

SEQ ID NO: 133045 - RNA, 22 nt, Homo sapiens
uugagagcugaugaaagauaaa

SEQ ID NO: 133046 - RNA, 22 nt, Homo sapiens
uugagauacauaauuaugaaug

SEQ ID NO: 133047 - RNA, 22 nt, Homo sapiens
uugagaucugugcuuuugcguu

SEQ ID NO: 133048 - RNA, 22 nt, Homo sapiens
uugagauggaaucucgcuuugu

SEQ ID NO: 133049 - RNA, 22 nt, Homo sapiens
uugagauggagucucacucugc

SEQ ID NO: 133050 - RNA, 22 nt, Homo sapiens
uugagauggagucucgcucuuu

SEQ ID NO: 133051 - RNA, 22 nt, Homo sapiens
uugagauggagucuugcacugu

SEQ ID NO: 133052 - RNA, 22 nt, Homo sapiens
uugagauggagucuugcucucu

SEQ ID NO: 133053 - RNA, 22 nt, Homo sapiens
uugagauggagucuuguucucu

SEQ ID NO: 133054 - RNA, 22 nt, Homo sapiens
uugagauggagucuuguucuuu

SEQ ID NO: 133055 - RNA, 22 nt, Homo sapiens
uugagauggaguguugcucugu

SEQ ID NO: 133056 - RNA, 22 nt, Homo sapiens
uugagauggaguuucgcucuug

SEQ ID NO: 133057 - RNA, 22 nt, Homo sapiens
uugagauggaguuucgcucuuu

SEQ ID NO: 133058 - RNA, 22 nt, Homo sapiens
uugagauggauagacauagcau

SEQ ID NO: 133059 - RNA, 22 nt, Homo sapiens
uugagauguggcaguuuaugag

SEQ ID NO: 133060 - RNA, 22 nt, Homo sapiens
uugagcaaaacauuaauauuag

SEQ ID NO: 133061 - RNA, 22 nt, Homo sapiens
uugagcaaugucacugaggcuu

SEQ ID NO: 133062 - RNA, 22 nt, Homo sapiens
uugagcacaggaguuugagacc

SEQ ID NO: 133063 - RNA, 22 nt, Homo sapiens
uugagcucaucuucagggguga

SEQ ID NO: 133064 - RNA, 21 nt, Homo sapiens
uugagcuuuuaguacagacag

SEQ ID NO: 133065 - RNA, 22 nt, Homo sapiens
uugaggacugagacagaccaag

SEQ ID NO: 133066 - RNA, 22 nt, Homo sapiens
uugaggacuggaacacaggucu

SEQ ID NO: 133067 - RNA, 22 nt, Homo sapiens
uugagggaggcagggcuugucu

SEQ ID NO: 133068 - RNA, 22 nt, Homo sapiens
uugagggaggccucaguuuaca

SEQ ID NO: 133069 - RNA, 22 nt, Homo sapiens
uugaguagugugaugcaugucu

SEQ ID NO: 133070 - RNA, 22 nt, Homo sapiens
uugaguauuggacugguaucuu

SEQ ID NO: 133071 - RNA, 22 nt, Homo sapiens
uugaguauuugcagucugaaca

SEQ ID NO: 133072 - RNA, 22 nt, Homo sapiens
uugagugaaugaaugauuaaau

SEQ ID NO: 133073 - RNA, 22 nt, Homo sapiens
uugaguuuaucuaaagaccugg

SEQ ID NO: 133074 - RNA, 22 nt, Homo sapiens
uugaguuugaguauucuaaagc

SEQ ID NO: 133075 - RNA, 22 nt, Homo sapiens
uugauacuagagucuuucugac

SEQ ID NO: 133076 - RNA, 22 nt, Homo sapiens
uugauagaucagggauuugauu

SEQ ID NO: 133077 - RNA, 22 nt, Homo sapiens
uugauaugguauaagauuucau

SEQ ID NO: 133078 - RNA, 22 nt, Homo sapiens
uugauauguaguuggacuugau

SEQ ID NO: 133079 - RNA, 22 nt, Homo sapiens
uugauauguggaauauuuaucu

SEQ ID NO: 133080 - RNA, 22 nt, Homo sapiens
uugauauguuguuagauucagu

SEQ ID NO: 133081 - RNA, 22 nt, Homo sapiens
uugauccucugagaaucuaucg

SEQ ID NO: 133082 - RNA, 22 nt, Homo sapiens
uugaucuaugugucuguuuuua

SEQ ID NO: 133083 - RNA, 22 nt, Homo sapiens
uugauuagauccaguugauuga

SEQ ID NO: 133084 - RNA, 22 nt, Homo sapiens
uugcaaaguugccaaggaagga

SEQ ID NO: 133085 - RNA, 22 nt, Homo sapiens
uugcaaaucucuuguguuuggu

SEQ ID NO: 133086 - RNA, 22 nt, Homo sapiens
uugcaacuuagaaaaaucauuu

SEQ ID NO: 133087 - RNA, 22 nt, Homo sapiens
uugcaagauguuaacauuggag

SEQ ID NO: 133088 - RNA, 20 nt, Homo sapiens
uugcacagagaaggaggcag

SEQ ID NO: 133089 - RNA, 22 nt, Homo sapiens
uugcacagugcuuucuuugccc

SEQ ID NO: 133090 - RNA, 22 nt, Homo sapiens
uugcacagugguuuagagccug

SEQ ID NO: 133091 - RNA, 22 nt, Homo sapiens
uugcacaguguguacagcacca

SEQ ID NO: 133092 - RNA, 22 nt, Homo sapiens
uugcacauugauuuuguauccu

SEQ ID NO: 133093 - RNA, 22 nt, Homo sapiens
uugcacauuuuuucuggcagaa

SEQ ID NO: 133094 - RNA, 22 nt, Homo sapiens
uugcacuucauguaggccaaag

SEQ ID NO: 133095 - RNA, 22 nt, Homo sapiens
uugcacuugcugaggagugauu

SEQ ID NO: 133096 - RNA, 22 nt, Homo sapiens
uugcagagaaauuucugguuua

SEQ ID NO: 133097 - RNA, 20 nt, Homo sapiens
uugcagagcccaacccugga

SEQ ID NO: 133098 - RNA, 22 nt, Homo sapiens
uugcagaucccacacucacccu

SEQ ID NO: 133099 - RNA, 22 nt, Homo sapiens
uugcagugguuucacuggcaaa

SEQ ID NO: 133100 - RNA, 22 nt, Homo sapiens
uugcauagacaauauuaaucuu

SEQ ID NO: 133101 - RNA, 22 nt, Homo sapiens
uugcauagaggugaguauagua

SEQ ID NO: 133102 - RNA, 22 nt, Homo sapiens
uugcauagugcugagguucggg

SEQ ID NO: 133103 - RNA, 22 nt, Homo sapiens
uugcaugggagcugggugaagc

SEQ ID NO: 133104 - RNA, 22 nt, Homo sapiens
uugcaugguggaacuuggagcu

SEQ ID NO: 133105 - RNA, 22 nt, Homo sapiens
uugcaugucauaacugauggaa

SEQ ID NO: 133106 - RNA, 23 nt, Homo sapiens
uugcauugcccuccauaguacuc

SEQ ID NO: 133107 - RNA, 22 nt, Homo sapiens
uugcccuuuagguaacuauaua

SEQ ID NO: 133108 - RNA, 22 nt, Homo sapiens
uugccuaggcuggagugcagua

SEQ ID NO: 133109 - RNA, 22 nt, Homo sapiens
uugccuuuguuggaaacaagug

SEQ ID NO: 133110 - RNA, 22 nt, Homo sapiens
uugcucaggcuagaguucagcu

SEQ ID NO: 133111 - RNA, 22 nt, Homo sapiens
uugcucaggcuggaguacaaug

SEQ ID NO: 133112 - RNA, 22 nt, Homo sapiens
uugcuccucugccaggaccugu

SEQ ID NO: 133113 - RNA, 22 nt, Homo sapiens
uugcugguuuucauaugagcag

SEQ ID NO: 133114 - RNA, 22 nt, Homo sapiens
uugcuuuguuacugcaguuucc

SEQ ID NO: 133115 - RNA, 22 nt, Homo sapiens
uuggaaaguuguuguaguuauu

SEQ ID NO: 133116 - RNA, 22 nt, Homo sapiens
uuggaagacauucugucugcua

SEQ ID NO: 133117 - RNA, 22 nt, Homo sapiens
uuggaaggcuccuaaugaaugg

SEQ ID NO: 133118 - RNA, 22 nt, Homo sapiens
uuggaaugugacugauaauauu

SEQ ID NO: 133119 - RNA, 22 nt, Homo sapiens
uuggacaagauugcagagaauu

SEQ ID NO: 133120 - RNA, 22 nt, Homo sapiens
uuggacugagaguuccaccauu

SEQ ID NO: 133121 - RNA, 22 nt, Homo sapiens
uuggacuucuaacugacaugga

SEQ ID NO: 133122 - RNA, 22 nt, Homo sapiens
uuggacuucucaaggcaauaaa

SEQ ID NO: 133123 - RNA, 22 nt, Homo sapiens
uuggacuuuuauucugcaggca

SEQ ID NO: 133124 - RNA, 22 nt, Homo sapiens
uuggagagaaaggcaguuccug

SEQ ID NO: 133125 - RNA, 22 nt, Homo sapiens
uuggagcacuggggcacugaca

SEQ ID NO: 133126 - RNA, 22 nt, Homo sapiens
uuggagugugucuuauuccauu

SEQ ID NO: 133127 - RNA, 22 nt, Homo sapiens
uuggauaguuuaugaaaaaugg

SEQ ID NO: 133128 - RNA, 22 nt, Homo sapiens
uuggauggugauaugguuugga

SEQ ID NO: 133129 - RNA, 22 nt, Homo sapiens
uuggcaagaaccuucuuccaag

SEQ ID NO: 133130 - RNA, 22 nt, Homo sapiens
uuggcaauauuuacugaaguug

SEQ ID NO: 133131 - RNA, 22 nt, Homo sapiens
uuggcaaucaauucugacgucu

SEQ ID NO: 133132 - RNA, 21 nt, Homo sapiens
uuggcacucuucucuccuuau

SEQ ID NO: 133133 - RNA, 22 nt, Homo sapiens
uuggcagaauguuagaaacuua

SEQ ID NO: 133134 - RNA, 22 nt, Homo sapiens
uuggcagaguuaauuuguugag

SEQ ID NO: 133135 - RNA, 22 nt, Homo sapiens
uuggcagcauuccagccaagca

SEQ ID NO: 133136 - RNA, 22 nt, Homo sapiens
uuggcagucugaggcacagacu

SEQ ID NO: 133137 - RNA, 22 nt, Homo sapiens
uuggcagugcccgaugcugggg

SEQ ID NO: 133138 - RNA, 22 nt, Homo sapiens
uuggcauuguggauggaaucau

SEQ ID NO: 133139 - RNA, 22 nt, Homo sapiens
uuggcccugcugaccauucccu

SEQ ID NO: 133140 - RNA, 22 nt, Homo sapiens
uuggcuauagauacauggauua

SEQ ID NO: 133141 - RNA, 22 nt, Homo sapiens
uuggcuuaguugaccacagucu

SEQ ID NO: 133142 - RNA, 22 nt, Homo sapiens
uuggcuucuggacuauugugca

SEQ ID NO: 133143 - RNA, 22 nt, Homo sapiens
uugggagugucucuggacugca

SEQ ID NO: 133144 - RNA, 22 nt, Homo sapiens
uugggccacuuuaguuuccuua

SEQ ID NO: 133145 - RNA, 22 nt, Homo sapiens
uugggguagaauugcaacauau

SEQ ID NO: 133146 - RNA, 22 nt, Homo sapiens
uugggguaggaauauggaauga

SEQ ID NO: 133147 - RNA, 22 nt, Homo sapiens
uugguacuaaaaaguagggugu

SEQ ID NO: 133148 - RNA, 22 nt, Homo sapiens
uuggucaaaucugaugggagaa

SEQ ID NO: 133149 - RNA, 22 nt, Homo sapiens
uugguccacugugaaauuggga

SEQ ID NO: 133150 - RNA, 22 nt, Homo sapiens
uugguccccuucaaccagcugu

SEQ ID NO: 133151 - RNA, 19 nt, Homo sapiens
uuggucccuuuggguucuu

SEQ ID NO: 133152 - RNA, 22 nt, Homo sapiens
ugguccuuuccauuggagacac

SEQ ID NO: 133153 - RNA, 22 nt, Homo sapiens
uggugcaaauguaauugugguu

SEQ ID NO: 133154 - RNA, 19 nt, Homo sapiens
uggugccuuguucuuggau

SEQ ID NO: 133155 - RNA, 15 nt, Homo sapiens
uggugguguugagac

SEQ ID NO: 133156 - RNA, 22 nt, Homo sapiens
uugguuccauuuuaccagcucu

SEQ ID NO: 133157 - RNA, 21 nt, Homo sapiens
uugguucccucugacaggucu

SEQ ID NO: 133158 - RNA, 22 nt, Homo sapiens
uugguuccuuagccuaggacua

SEQ ID NO: 133159 - RNA, 22 nt, Homo sapiens
uugguucucuuagccaucuuaa

SEQ ID NO: 133160 - RNA, 19 nt, Homo sapiens
uugguugguuauuucuuac

SEQ ID NO: 133161 - RNA, 22 nt, Homo sapiens
uugguuuccuuccugcuuaacu

SEQ ID NO: 133162 - RNA, 22 nt, Homo sapiens
uuguaaagaucauaugcuguuc

SEQ ID NO: 133163 - RNA, 22 nt, Homo sapiens
uuguaaaguucuuaggaagcuc

SEQ ID NO: 133164 - RNA, 22 nt, Homo sapiens
uuguaacaguuuauugacucga

SEQ ID NO: 133165 - RNA, 22 nt, Homo sapiens
uuguaacucugaauacauccua

SEQ ID NO: 133166 - RNA, 22 nt, Homo sapiens
uuguaaucaacacaucauuggg

SEQ ID NO: 133167 - RNA, 22 nt, Homo sapiens
uagugaaugucacuggcuguug

SEQ ID NO: 133168 - RNA, 22 nt, Homo sapiens
uagugaauguuggcuauuaaua

SEQ ID NO: 133169 - RNA, 22 nt, Homo sapiens
uagugacauugcugggaaugcu

SEQ ID NO: 133170 - RNA, 18 nt, Homo sapiens
uagugcuguucucaugau

SEQ ID NO: 133171 - RNA, 22 nt, Homo sapiens
uagugguaguagcaguaauauu

SEQ ID NO: 133172 - RNA, 22 nt, Homo sapiens
uaguguuuuucauuggcagagg

SEQ ID NO: 133173 - RNA, 22 nt, Homo sapiens
uaguuguugcagguaggaugua

SEQ ID NO: 133174 - RNA, 22 nt, Homo sapiens
uauacacgugugcauauauaca

SEQ ID NO: 133175 - RNA, 22 nt, Homo sapiens
uauacuguuuucuauaguggcu

SEQ ID NO: 133176 - RNA, 21 nt, Homo sapiens
uauagcagcacgauuuauaau

SEQ ID NO: 133177 - RNA, 21 nt, Homo sapiens
uauagcagcacgauuuauagu

SEQ ID NO: 133178 - RNA, 22 nt, Homo sapiens
uauagcagugaguauugacuaa

SEQ ID NO: 133179 - RNA, 22 nt, Homo sapiens
uauagcagugugagaacagacu

SEQ ID NO: 133180 - RNA, 22 nt, Homo sapiens
uauagcuuaaaguuuagauccu

SEQ ID NO: 133181 - RNA, 22 nt, Homo sapiens
uauauagcuaugucuguccauu

SEQ ID NO: 133182 - RNA, 22 nt, Homo sapiens
uauaugcaacauaguguaugug

SEQ ID NO: 133183 - RNA, 22 nt, Homo sapiens
uaucaaggccacucauuuuaug

SEQ ID NO: 133184 - RNA, 22 nt, Homo sapiens
uaucacaggucaggaaccuugu

SEQ ID NO: 133185 - RNA, 22 nt, Homo sapiens
uaucacaguaaaucugggugca

SEQ ID NO: 133186 - RNA, 22 nt, Homo sapiens
uaucacaguaucuagcacagug

SEQ ID NO: 133187 - RNA, 22 nt, Homo sapiens
uaucacagugcuggaguauucc

SEQ ID NO: 133188 - RNA, 20 nt, Homo sapiens
uaucacaguucaggaacucu

SEQ ID NO: 133189 - RNA, 22 nt, Homo sapiens
uaucacaguugcauauuuaagg

SEQ ID NO: 133190 - RNA, 22 nt, Homo sapiens
uaucacggaguacauguucugu

SEQ ID NO: 133191 - RNA, 22 nt, Homo sapiens
uaucacuauucauccuagcucc

SEQ ID NO: 133192 - RNA, 22 nt, Homo sapiens
uaucacuguuguuuguuuaagg

SEQ ID NO: 133193 - RNA, 22 nt, Homo sapiens
uaucacuuugauaguuuaaaug

SEQ ID NO: 133194 - RNA, 22 nt, Homo sapiens
uaucagauugcugccaucugcu

SEQ ID NO: 133195 - RNA, 22 nt, Homo sapiens
uaucaucauuggcaggugagaa

SEQ ID NO: 133196 - RNA, 21 nt, Homo sapiens
uaucauggugaaacccugucu

SEQ ID NO: 133197 - RNA, 22 nt, Homo sapiens
uaucauugccucaaucuguauu

SEQ ID NO: 133198 - RNA, 21 nt, Homo sapiens
uauccacuugcaacagagaag

SEQ ID NO: 133199 - RNA, 22 nt, Homo sapiens
uaucccaguggauguaccccau

SEQ ID NO: 133200 - RNA, 22 nt, Homo sapiens
uaucucagaguguacaagauua

SEQ ID NO: 133201 - RNA, 22 nt, Homo sapiens
uaucucagaugagacuuguaac

SEQ ID NO: 133202 - RNA, 22 nt, Homo sapiens
uaugaaacucuaagauucacau

SEQ ID NO: 133203 - RNA, 22 nt, Homo sapiens
uaugaaucuggcuacuccaggg

SEQ ID NO: 133204 - RNA, 20 nt, Homo sapiens
uaugaccugucuuuucucuc

SEQ ID NO: 133205 - RNA, 22 nt, Homo sapiens
uaugcacacucucccaggaggg

SEQ ID NO: 133206 - RNA, 22 nt, Homo sapiens
uaugcacuauggaaguagcuca

SEQ ID NO: 133207 - RNA, 23 nt, Homo sapiens
uaugccuguuucaaacaaacuuu

SEQ ID NO: 133208 - RNA, 22 nt, Homo sapiens
uauggcaaugcauaggaaggaa

SEQ ID NO: 133209 - RNA, 22 nt, Homo sapiens
uauggcacuaguacuggaaagc

SEQ ID NO: 133210 - RNA, 22 nt, Homo sapiens
uauggcuacuacgaauaaugcu

SEQ ID NO: 133211 - RNA, 22 nt, Homo sapiens
uauggcuucuuauucuuucccg

SEQ ID NO: 133212 - RNA, 22 nt, Homo sapiens
uauggguuuuucauaaauaggu

SEQ ID NO: 133213 - RNA, 22 nt, Homo sapiens
uaugguuuuaagguuaaggacu

SEQ ID NO: 133214 - RNA, 22 nt, Homo sapiens
uaugguuuucucuuacguguug

SEQ ID NO: 133215 - RNA, 22 nt, Homo sapiens
uaugguuuuggaauccugcaga

SEQ ID NO: 133216 - RNA, 22 nt, Homo sapiens
uauguuaucaaaaagcuaagga

SEQ ID NO: 133217 - RNA, 22 nt, Homo sapiens
uauuagguuggugcaacaguaa

SEQ ID NO: 133218 - RNA, 22 nt, Homo sapiens
uauuagguugguggaaaaguaa

SEQ ID NO: 133219 - RNA, 22 nt, Homo sapiens
uauuauuguccuucuauaccca

SEQ ID NO: 133220 - RNA, 22 nt, Homo sapiens
uauucacaggugugggacaaag

SEQ ID NO: 133221 - RNA, 22 nt, Homo sapiens
uauucacuguaucauugauggg

SEQ ID NO: 133222 - RNA, 22 nt, Homo sapiens
uauuccacaauaugauuuuuaa

SEQ ID NO: 133223 - RNA, 22 nt, Homo sapiens
uauuccacucuguuggagguaa

SEQ ID NO: 133224 - RNA, 22 nt, Homo sapiens
uauuccacuuacaugagguauc

SEQ ID NO: 133225 - RNA, 22 nt, Homo sapiens
uauuccagcccuggugagccag

SEQ ID NO: 133226 - RNA, 22 nt, Homo sapiens
uauugaacuggaucagaaggcc

SEQ ID NO: 133227 - RNA, 22 nt, Homo sapiens
uauugacauuacagugggucuu

SEQ ID NO: 133228 - RNA, 22 nt, Homo sapiens
uauugauuuucaguguucagcu

SEQ ID NO: 133229 - RNA, 22 nt, Homo sapiens
uauugcaacagaagaaagaguc

SEQ ID NO: 133230 - RNA, 22 nt, Homo sapiens
uauugcaauuggcagagugcua

SEQ ID NO: 133231 - RNA, 22 nt, Homo sapiens
guugcacagucuuuccuggacu

SEQ ID NO: 133232 - RNA, 22 nt, Homo sapiens
guuggaauguauugcuacuucu

SEQ ID NO: 133233 - RNA, 22 nt, Homo sapiens
guugguauuacagaaauuaguu

SEQ ID NO: 133234 - RNA, 22 nt, Homo sapiens
guuguggagucuucuguucugg

SEQ ID NO: 133235 - RNA, 22 nt, Homo sapiens
guuguggcuugugauuaagcac

SEQ ID NO: 133236 - RNA, 22 nt, Homo sapiens
guuuaacugguacuucaagucu

SEQ ID NO: 133237 - RNA, 22 nt, Homo sapiens
guuugcacuccuaugagaaucu

SEQ ID NO: 133238 - RNA, 22 nt, Homo sapiens
guuugcagaucaugaagaaccc

SEQ ID NO: 133239 - RNA, 22 nt, Homo sapiens
guuugcauagugcugggagggg

SEQ ID NO: 133240 - RNA, 22 nt, Homo sapiens
guuuuuggggucacuauuaccg

SEQ ID NO: 133241 - RNA, 22 nt, Homo sapiens
uaaaagucaucacaacuggagu

SEQ ID NO: 133242 - RNA, 22 nt, Homo sapiens
uaaacacucacuucauagccau

SEQ ID NO: 133243 - RNA, 22 nt, Homo sapiens
uaaaccacguuuacauuugaga

SEQ ID NO: 133244 - RNA, 22 nt, Homo sapiens
uaaacugucuuuggagcuuugc

SEQ ID NO: 133245 - RNA, 22 nt, Homo sapiens
uaaagauaaggcucgcuuggau

SEQ ID NO: 133246 - RNA, 22 nt, Homo sapiens
uaaagcuagaauuguuccagca

SEQ ID NO: 133247 - RNA, 22 nt, Homo sapiens
uaaagcuaugagaacaccguag

SEQ ID NO: 133248 - RNA, 22 nt, Homo sapiens
uaaagcugaaaugauuaugaca

SEQ ID NO: 133249 - RNA, 22 nt, Homo sapiens
uaaaugcuuaauugaaugugga

SEQ ID NO: 133250 - RNA, 22 nt, Homo sapiens
uaaauggauauugccaucuccu

SEQ ID NO: 133251 - RNA, 22 nt, Homo sapiens
uaacacagagcuccuaaucccu

SEQ ID NO: 133252 - RNA, 22 nt, Homo sapiens
uaacaccuugcucugucaauaa

SEQ ID NO: 133253 - RNA, 22 nt, Homo sapiens
uaacagcucuacagcugcucuu

SEQ ID NO: 133254 - RNA, 22 nt, Homo sapiens
uaacaguggucugugguaucug

SEQ ID NO: 133255 - RNA, 22 nt, Homo sapiens
uaacaguguauuccuuuggaca

SEQ ID NO: 133256 - RNA, 22 nt, Homo sapiens
uaacaguguauuuacuacuucc

SEQ ID NO: 133257 - RNA, 22 nt, Homo sapiens
uaacccagugucugugaugggu

SEQ ID NO: 133258 - RNA, 22 nt, Homo sapiens
uaacuaaagagaagucaauguc

SEQ ID NO: 133259 - RNA, 22 nt, Homo sapiens
uaacuaguggaauuugauuuca

SEQ ID NO: 133260 - RNA, 22 nt, Homo sapiens
uaacuauagagaauguugagua

SEQ ID NO: 133261 - RNA, 22 nt, Homo sapiens
uaagacugccccagacagcaag

SEQ ID NO: 133262 - RNA, 22 nt, Homo sapiens
uaagacuuuuugggaauauaga

SEQ ID NO: 133263 - RNA, 22 nt, Homo sapiens
uaagagcuaggauuuuaaauca

SEQ ID NO: 133264 - RNA, 22 nt, Homo sapiens
uaagcaguaaaugaagucuugc

SEQ ID NO: 133265 - RNA, 20 nt, Homo sapiens
uaagcauaguugucaggguc

SEQ ID NO: 133266 - RNA, 20 nt, Homo sapiens
uaagccacacagucuaaggu

SEQ ID NO: 133267 - RNA, 22 nt, Homo sapiens
uaagcuagcauagggguaaauu

SEQ ID NO: 133268 - RNA, 22 nt, Homo sapiens
uaaggaguagaauaguaaggca

SEQ ID NO: 133269 - RNA, 22 nt, Homo sapiens
uaaggcaaaccuuggcugcagu

SEQ ID NO: 133270 - RNA, 22 nt, Homo sapiens
uaaggcacuacuuuaggcuuuc

SEQ ID NO: 133271 - RNA, 22 nt, Homo sapiens
uaaggcacucuucugugugccu

SEQ ID NO: 133272 - RNA, 22 nt, Homo sapiens
uaaggcuagcaagaugagaaua

SEQ ID NO: 133273 - RNA, 22 nt, Homo sapiens
uaaggcuuugcuggacucaguc

SEQ ID NO: 133274 - RNA, 22 nt, Homo sapiens
uaagggcaugcugcaugagagu

SEQ ID NO: 133275 - RNA, 22 nt, Homo sapiens
uaagguuuuugauaugcugcug

SEQ ID NO: 133276 - RNA, 22 nt, Homo sapiens
uaaguaauuguuaauagggaag

SEQ ID NO: 133277 - RNA, 22 nt, Homo sapiens
uaaguaguauaagguuuuuuga

SEQ ID NO: 133278 - RNA, 22 nt, Homo sapiens
uaaguagugugcauguauguau

SEQ ID NO: 133279 - RNA, 22 nt, Homo sapiens
uaaguaguuuucuuggaggcga

SEQ ID NO: 133280 - RNA, 22 nt, Homo sapiens
uaaguauagguaacagaagcaa

SEQ ID NO: 133281 - RNA, 23 nt, Homo sapiens
uaagucacacagauuaauuuauu

SEQ ID NO: 133282 - RNA, 22 nt, Homo sapiens
uaagucguggaugauucuucgg

SEQ ID NO: 133283 - RNA, 22 nt, Homo sapiens
uaagugaugucuuuuugugugc

SEQ ID NO: 133284 - RNA, 20 nt, Homo sapiens
uaagugcuugagacuucuga

SEQ ID NO: 133285 - RNA, 20 nt, Homo sapiens
uaagugcuuuauauugauua

SEQ ID NO: 133286 - RNA, 22 nt, Homo sapiens
uaaguggugcauuguuaaaugg

SEQ ID NO: 133287 - RNA, 22 nt, Homo sapiens
uaagugguguucauucuuuuga

SEQ ID NO: 133288 - RNA, 22 nt, Homo sapiens
uaaguucauucaugaaacuuag

SEQ ID NO: 133289 - RNA, 22 nt, Homo sapiens
uaauagcaguguuacuaggacu

SEQ ID NO: 133290 - RNA, 22 nt, Homo sapiens
uaauaguguuaaugcuagagcu

SEQ ID NO: 133291 - RNA, 22 nt, Homo sapiens
uaauaguuggcacuggagaaag

SEQ ID NO: 133292 - RNA, 22 nt, Homo sapiens
uaauauguauacagacagauac

SEQ ID NO: 133293 - RNA, 22 nt, Homo sapiens
uaauauguuuugaaaucaggaa

SEQ ID NO: 133294 - RNA, 22 nt, Homo sapiens
uaaugcacucgaaucauggaau

SEQ ID NO: 133295 - RNA, 19 nt, Homo sapiens
uaaugccacugccuggcau

SEQ ID NO: 133296 - RNA, 22 nt, Homo sapiens
uaaugcuccauggguuauuaaa

SEQ ID NO: 133297 - RNA, 21 nt, Homo sapiens
uaauggcaugaucucggcuca

SEQ ID NO: 133298 - RNA, 22 nt, Homo sapiens
uaauucugacaacaguggcguu

SEQ ID NO: 133299 - RNA, 22 nt, Homo sapiens
uaauugaaugcagacaccaggg

SEQ ID NO: 133300 - RNA, 22 nt, Homo sapiens
uacaacacugguucgacaugug

SEQ ID NO: 133301 - RNA, 22 nt, Homo sapiens
uacaaguggguuugugcaggag

SEQ ID NO: 133302 - RNA, 22 nt, Homo sapiens
uacaccaauuuaaucaaaagca

SEQ ID NO: 133303 - RNA, 22 nt, Homo sapiens
uacagaucaguuauuuuguaga

SEQ ID NO: 133304 - RNA, 20 nt, Homo sapiens
uacaggacugagaaucugug

SEQ ID NO: 133305 - RNA, 19 nt, Homo sapiens
uacaggacugagcugaggu

SEQ ID NO: 133306 - RNA, 22 nt, Homo sapiens
uacaggcagguguucccugguu

SEQ ID NO: 133307 - RNA, 22 nt, Homo sapiens
uacagguaugugucuauauaca

SEQ ID NO: 133308 - RNA, 22 nt, Homo sapiens
uacaggugcuuauguggacaua

SEQ ID NO: 133309 - RNA, 22 nt, Homo sapiens
uacagugcuugguaucuaguaa

SEQ ID NO: 133310 - RNA, 22 nt, Homo sapiens
uacaguggaaguuaaccccauu

SEQ ID NO: 133311 - RNA, 22 nt, Homo sapiens
uacauaguaagcaucuccugug

SEQ ID NO: 133312 - RNA, 22 nt, Homo sapiens
uacauaguuacuuccauuucca

SEQ ID NO: 133313 - RNA, 22 nt, Homo sapiens
uacauguauccauuguuuuugg

SEQ ID NO: 133314 - RNA, 22 nt, Homo sapiens
uacauugcacuuuauuagauac

SEQ ID NO: 133315 - RNA, 23 nt, Homo sapiens
uaccacauuccuucuuuccuguu

SEQ ID NO: 133316 - RNA, 22 nt, Homo sapiens
uaccacugccgagaaaacagau

SEQ ID NO: 133317 - RNA, 22 nt, Homo sapiens
uugagcuaugaguuaauaggac

SEQ ID NO: 133318 - RNA, 22 nt, Homo sapiens
uugagcuuuuuacuuguccaau

SEQ ID NO: 133319 - RNA, 22 nt, Homo sapiens
uugaggaagugguuccccagag

SEQ ID NO: 133320 - RNA, 22 nt, Homo sapiens
uaccucuguaaguaaagauuca

SEQ ID NO: 133321 - RNA, 22 nt, Homo sapiens
uaccugagcccucugcugaguu

SEQ ID NO: 133322 - RNA, 22 nt, Homo sapiens
uaccugagucuagagucuagaa

SEQ ID NO: 133323 - RNA, 22 nt, Homo sapiens
uacucaguagucuguugcuguc

SEQ ID NO: 133324 - RNA, 22 nt, Homo sapiens
uacugcacuccaaccugagaga

SEQ ID NO: 133325 - RNA, 22 nt, Homo sapiens
uacugcacuccagcuuaggaga

SEQ ID NO: 133326 - RNA, 23 nt, Homo sapiens
uacugcauccuccgccucuaggg

SEQ ID NO: 133327 - RNA, 22 nt, Homo sapiens
uacugcuuaagggcaugggccc

SEQ ID NO: 133328 - RNA, 21 nt, Homo sapiens
uacuggagauacagucugcaa

SEQ ID NO: 133329 - RNA, 22 nt, Homo sapiens
uacuguacugcaguucugcaaa

SEQ ID NO: 133330 - RNA, 22 nt, Homo sapiens
uacuucauucuugaccuugcau

SEQ ID NO: 133331 - RNA, 22 nt, Homo sapiens
uacuuuguagagugugagaauu

SEQ ID NO: 133332 - RNA, 22 nt, Homo sapiens
uacuuuguagauuguuuccuuu

SEQ ID NO: 133333 - RNA, 22 nt, Homo sapiens
uacuuuguuauagcagcaggaa

SEQ ID NO: 133334 - RNA, 22 nt, Homo sapiens
uagaaaguagggaagguaggau

SEQ ID NO: 133335 - RNA, 18 nt, Homo sapiens
uagaauauaggucauucu

SEQ ID NO: 133336 - RNA, 22 nt, Homo sapiens
uagaauggaaggcauguuugcc

SEQ ID NO: 133337 - RNA, 22 nt, Homo sapiens
uagaauguaacuuccaugucau

SEQ ID NO: 133338 - RNA, 22 nt, Homo sapiens
uagacacuagauaugugacuga

SEQ ID NO: 133339 - RNA, 22 nt, Homo sapiens
uagaccaauuggcauauaguaa

SEQ ID NO: 133340 - RNA, 20 nt, Homo sapiens
uagagagauauggggguucc

SEQ ID NO: 133341 - RNA, 21 nt, Homo sapiens
uagagagcaauaccuccagag

SEQ ID NO: 133342 - RNA, 22 nt, Homo sapiens
uagagcacaagguagauuucua

SEQ ID NO: 133343 - RNA, 22 nt, Homo sapiens
uagagccauugcagauguuuga

SEQ ID NO: 133344 - RNA, 22 nt, Homo sapiens
uagagcuaguuuuuaaucuaac

SEQ ID NO: 133345 - RNA, 22 nt, Homo sapiens
uagagguagagugacuucccca

SEQ ID NO: 133346 - RNA, 22 nt, Homo sapiens
uagagguagccuacuacacacc

SEQ ID NO: 133347 - RNA, 22 nt, Homo sapiens
uagagguauuaacaguagaaga

SEQ ID NO: 133348 - RNA, 22 nt, Homo sapiens
uagaucaacuuugguaagagaa

SEQ ID NO: 133349 - RNA, 22 nt, Homo sapiens
uagaucacucaggcaauaaaag

SEQ ID NO: 133350 - RNA, 22 nt, Homo sapiens
uagaucauauucagugcuuacu

SEQ ID NO: 133351 - RNA, 22 nt, Homo sapiens
uagauuaucucaccacucgagu

SEQ ID NO: 133352 - RNA, 17 nt, Homo sapiens
uagcacagugccuggua

SEQ ID NO: 133353 - RNA, 22 nt, Homo sapiens
uagcaccacaaucaagauacag

SEQ ID NO: 133354 - RNA, 22 nt, Homo sapiens
uagcacuauguuaucacauacu

SEQ ID NO: 133355 - RNA, 18 nt, Homo sapiens
uagcagacaucauugggg

SEQ ID NO: 133356 - RNA, 22 nt, Homo sapiens
uagcagccaggaagggcuggcu

SEQ ID NO: 133357 - RNA, 22 nt, Homo sapiens
uagcaggaaaccuguguugagg

SEQ ID NO: 133358 - RNA, 22 nt, Homo sapiens
uagcauaauuuguagaaaauca

SEQ ID NO: 133359 - RNA, 18 nt, Homo sapiens
uagcaugaugcugagugc

SEQ ID NO: 133360 - RNA, 22 nt, Homo sapiens
uagcuccacagcuauauauaau

SEQ ID NO: 133361 - RNA, 22 nt, Homo sapiens
uagcuccagugggguuacugcu

SEQ ID NO: 133362 - RNA, 17 nt, Homo sapiens
uagcucuauuucuagcc

SEQ ID NO: 133363 - RNA, 22 nt, Homo sapiens
uagcugagacuacaguaggugc

SEQ ID NO: 133364 - RNA, 22 nt, Homo sapiens
uagcugcugcuaggcuaaggau

SEQ ID NO: 133365 - RNA, 22 nt, Homo sapiens
uagcugcuguauguacacggau

SEQ ID NO: 133366 - RNA, 23 nt, Homo sapiens
uagcuucucccagaccugcuccc

SEQ ID NO: 133367 - RNA, 18 nt, Homo sapiens
uaggaacauugauuggag

SEQ ID NO: 133368 - RNA, 22 nt, Homo sapiens
uaggaaguacaucucagaaucu

SEQ ID NO: 133369 - RNA, 22 nt, Homo sapiens
uaggaaguuucuugauuacuua

SEQ ID NO: 133370 - RNA, 20 nt, Homo sapiens
uaggagcaaugagaguagaa

SEQ ID NO: 133371 - RNA, 22 nt, Homo sapiens
uaggagcacaaaccccauugug

SEQ ID NO: 133372 - RNA, 22 nt, Homo sapiens
uaggauaguccuccugagaccu

SEQ ID NO: 133373 - RNA, 22 nt, Homo sapiens
uaggcacuguguuuguaggagu

SEQ ID NO: 133374 - RNA, 22 nt, Homo sapiens
uaggccuuuuuaugucaauauc

SEQ ID NO: 133375 - RNA, 22 nt, Homo sapiens
uaggcuuuuggacccugucucu

SEQ ID NO: 133376 - RNA, 22 nt, Homo sapiens
uagggcauguguggaguguaug

SEQ ID NO: 133377 - RNA, 22 nt, Homo sapiens
uagggcuugugaucagguguag

SEQ ID NO: 133378 - RNA, 22 nt, Homo sapiens
uaggggcacacuucgguuagca

SEQ ID NO: 133379 - RNA, 22 nt, Homo sapiens
uagguaaguaauauacagauga

SEQ ID NO: 133380 - RNA, 22 nt, Homo sapiens
uaggucaguuuuggcuuggcuu

SEQ ID NO: 133381 - RNA, 22 nt, Homo sapiens
uaggucccguuucagacugaga

SEQ ID NO: 133382 - RNA, 22 nt, Homo sapiens
uagguucucaggaaugagcuuc

SEQ ID NO: 133383 - RNA, 22 nt, Homo sapiens
uagguucuccacagguucucca

SEQ ID NO: 133384 - RNA, 20 nt, Homo sapiens
uagguuuucacagaauugcc

SEQ ID NO: 133385 - RNA, 22 nt, Homo sapiens
uaguaaacaccucagguaauuc

SEQ ID NO: 133386 - RNA, 22 nt, Homo sapiens
uaguaaacauaguucuuuugcu

SEQ ID NO: 133387 - RNA, 22 nt, Homo sapiens
uaguaccauucccaaaccaacu

SEQ ID NO: 133388 - RNA, 22 nt, Homo sapiens
uagucaaaucugaaggaaauuu

SEQ ID NO: 133389 - RNA, 22 nt, Homo sapiens
uagugcaguggcuccaucucag

SEQ ID NO: 133390 - RNA, 21 nt, Homo sapiens
uagugcagugggguaugacuu

SEQ ID NO: 133391 - RNA, 22 nt, Homo sapiens
uagugcuguaauucuaaugaaa

SEQ ID NO: 133392 - RNA, 20 nt, Homo sapiens
uaguggcaugcaccuguagc

SEQ ID NO: 133393 - RNA, 22 nt, Homo sapiens
uaguuuaucuucuggauggaca

SEQ ID NO: 133394 - RNA, 23 nt, Homo sapiens
uauaacuuuuaauuuacuggccu

SEQ ID NO: 133395 - RNA, 22 nt, Homo sapiens
uauacaguaggcacucaguggc

SEQ ID NO: 133396 - RNA, 22 nt, Homo sapiens
uauacugucuuuguaugccuag

SEQ ID NO: 133397 - RNA, 22 nt, Homo sapiens
uauagcaaugccccacuccuga

SEQ ID NO: 133398 - RNA, 22 nt, Homo sapiens
uauagcagccugaacaaaguaa

SEQ ID NO: 133399 - RNA, 22 nt, Homo sapiens
uauagcuugaaggaauggucau

SEQ ID NO: 133400 - RNA, 22 nt, Homo sapiens
uauaguguuuucaaaaguaugu

SEQ ID NO: 133401 - RNA, 22 nt, Homo sapiens
uauaucuagagcggaccaggcu

SEQ ID NO: 133402 - RNA, 22 nt, Homo sapiens
uauaugauugguagacccugca

SEQ ID NO: 133403 - RNA, 22 nt, Homo sapiens
uauaugcuaaacaagggguggg

SEQ ID NO: 133404 - RNA, 22 nt, Homo sapiens
uaucaacaggguggccagugua

SEQ ID NO: 133405 - RNA, 22 nt, Homo sapiens
uaucacacgccuugcuucauuu

SEQ ID NO: 133406 - RNA, 22 nt, Homo sapiens
uaucacagguggacugcacacc

SEQ ID NO: 133407 - RNA, 21 nt, Homo sapiens
uaucagagacauugagaggca

SEQ ID NO: 133408 - RNA, 22 nt, Homo sapiens
uucaugugagucuguauuaacu

SEQ ID NO: 133409 - RNA, 22 nt, Homo sapiens
uuccaagugggaaacaaaaaug

SEQ ID NO: 133410 - RNA, 22 nt, Homo sapiens
uuccacaaugguugaacuaauu

SEQ ID NO: 133411 - RNA, 22 nt, Homo sapiens
uuccacaaugguugaacuaguu

SEQ ID NO: 133412 - RNA, 22 nt, Homo sapiens
uuccacagggauuugcauugau

SEQ ID NO: 133413 - RNA, 22 nt, Homo sapiens
ugaguuguugcauucuuggugu

SEQ ID NO: 133414 - RNA, 23 nt, Homo sapiens
ugauaacagcauaugaagauucu

SEQ ID NO: 133415 - RNA, 22 nt, Homo sapiens
ugauaagaaauuguucauguag

SEQ ID NO: 133416 - RNA, 22 nt, Homo sapiens
ugauaauuuugucagguuuugg

SEQ ID NO: 133417 - RNA, 22 nt, Homo sapiens
ugauagaucugggcaaaguaaa

SEQ ID NO: 133418 - RNA, 22 nt, Homo sapiens
ugauaggagauuuucaucugua

SEQ ID NO: 133419 - RNA, 22 nt, Homo sapiens
ugauaggucagaugauauugaa

SEQ ID NO: 133420 - RNA, 22 nt, Homo sapiens
ugauagucauucaauuuagcca

SEQ ID NO: 133421 - RNA, 22 nt, Homo sapiens
ugauagugccuuuuauaucucu

SEQ ID NO: 133422 - RNA, 22 nt, Homo sapiens
ugauaucugaucauccuugaua

SEQ ID NO: 133423 - RNA, 22 nt, Homo sapiens
ugauauuuuugauccuuaaguu

SEQ ID NO: 133424 - RNA, 22 nt, Homo sapiens
ugauccagugcucaguuggagu

SEQ ID NO: 133425 - RNA, 22 nt, Homo sapiens
ugauccuguccuuaugauguua

SEQ ID NO: 133426 - RNA, 22 nt, Homo sapiens
ugaucugucacuuaucacauuu

SEQ ID NO: 133427 - RNA, 22 nt, Homo sapiens
ugaucugucucggguuaucagu

SEQ ID NO: 133428 - RNA, 21 nt, Homo sapiens
ugaugcaauccgcuaggucgc

SEQ ID NO: 133429 - RNA, 22 nt, Homo sapiens
ugaugcugaguggcuauuugaa

SEQ ID NO: 133430 - RNA, 22 nt, Homo sapiens
agagguagaagauaggcuacag

SEQ ID NO: 133431 - RNA, 22 nt, Homo sapiens
agagguaugccugggcuggagc

SEQ ID NO: 133432 - RNA, 22 nt, Homo sapiens
agaguaguuucuauauucuuca

SEQ ID NO: 133433 - RNA, 21 nt, Homo sapiens
agagucaucucuaucuguacc

SEQ ID NO: 133434 - RNA, 20 nt, Homo sapiens
agagugcugucuguccugag

SEQ ID NO: 133435 - RNA, 22 nt, Homo sapiens
agauacauuggauaaugguggg

SEQ ID NO: 133436 - RNA, 22 nt, Homo sapiens
agaucacagucuuugguuuuag

SEQ ID NO: 133437 - RNA, 22 nt, Homo sapiens
agaugauguuuacugagcauca

SEQ ID NO: 133438 - RNA, 23 nt, Homo sapiens
agaugcauucuuguaggauauau

SEQ ID NO: 133439 - RNA, 22 nt, Homo sapiens
agaugcauuuuuauuggaauac

SEQ ID NO: 133440 - RNA, 22 nt, Homo sapiens
agaugccuaugaagagaaauua

SEQ ID NO: 133441 - RNA, 22 nt, Homo sapiens
agaugguauuauagguuucugu

SEQ ID NO: 133442 - RNA, 22 nt, Homo sapiens
agauggucuucauaaguuuuaa

SEQ ID NO: 133443 - RNA, 22 nt, Homo sapiens
agaugguguuggcugaguguau

SEQ ID NO: 133444 - RNA, 22 nt, Homo sapiens
agcaacauuguucauaauagcu

SEQ ID NO: 133445 - RNA, 22 nt, Homo sapiens
agcaagaugaaguugagcuagg

SEQ ID NO: 133446 - RNA, 22 nt, Homo sapiens
agcacagugaaugguuuacuca

SEQ ID NO: 133447 - RNA, 22 nt, Homo sapiens
agcaccacauacuacagagaua

SEQ ID NO: 133448 - RNA, 22 nt, Homo sapiens
agcaccaugggcugaguaagug

SEQ ID NO: 133449 - RNA, 22 nt, Homo sapiens
agcaccauuuauugaaaagaca

SEQ ID NO: 133450 - RNA, 22 nt, Homo sapiens
agcagcaauuuuguaugguuua

SEQ ID NO: 133451 - RNA, 20 nt, Homo sapiens
agcagccacagauuccucag

SEQ ID NO: 133452 - RNA, 22 nt, Homo sapiens
agcagcuuugcauggccugugg

SEQ ID NO: 133453 - RNA, 22 nt, Homo sapiens
agcaggucuuaacuugugaggu

SEQ ID NO: 133454 - RNA, 22 nt, Homo sapiens
agcagguguccacaauguuugc

SEQ ID NO: 133455 - RNA, 22 nt, Homo sapiens
agcaguagaauuccugcaucac

SEQ ID NO: 133456 - RNA, 22 nt, Homo sapiens
agcaguagugaaaguagacuua

SEQ ID NO: 133457 - RNA, 22 nt, Homo sapiens
agcaucagugauuuuguugaag

SEQ ID NO: 133458 - RNA, 22 nt, Homo sapiens
agcaucaugcaguugcuauuca

SEQ ID NO: 133459 - RNA, 22 nt, Homo sapiens
agccaagacucuguuccccuug

SEQ ID NO: 133460 - RNA, 22 nt, Homo sapiens
agccaguauuuccacagagugg

SEQ ID NO: 133461 - RNA, 22 nt, Homo sapiens
agccauacaacguaugcaugua

SEQ ID NO: 133462 - RNA, 22 nt, Homo sapiens
agcccauguggcugaggcuucu

SEQ ID NO: 133463 - RNA, 21 nt, Homo sapiens
agccugugggucauaguugcc

SEQ ID NO: 133464 - RNA, 23 nt, Homo sapiens
agccuguugccuaggcagcucau

SEQ ID NO: 133465 - RNA, 22 nt, Homo sapiens
agcgccauugcacuccagccuu

SEQ ID NO: 133466 - RNA, 22 nt, Homo sapiens
agcuagugugauucuuuggggu

SEQ ID NO: 133467 - RNA, 22 nt, Homo sapiens
agcucauugcuguccuggagga

SEQ ID NO: 133468 - RNA, 22 nt, Homo sapiens
agcugauggucuuguaugaugu

SEQ ID NO: 133469 - RNA, 22 nt, Homo sapiens
agcugcacaaauggaugugagg

SEQ ID NO: 133470 - RNA, 22 nt, Homo sapiens
agcugccagucuuguaaggccu

SEQ ID NO: 133471 - RNA, 22 nt, Homo sapiens
agcuggauguauguuaagugaa

SEQ ID NO: 133472 - RNA, 22 nt, Homo sapiens
agcugguauuuugucgaggacu

SEQ ID NO: 133473 - RNA, 22 nt, Homo sapiens
agcuggucucaggugcccugcu

SEQ ID NO: 133474 - RNA, 22 nt, Homo sapiens
agcuggucugauacuuaccucc

SEQ ID NO: 133475 - RNA, 21 nt, Homo sapiens
agcugguuuccacagugugcu

SEQ ID NO: 133476 - RNA, 20 nt, Homo sapiens
agcuguuguuaaaaaggagg

SEQ ID NO: 133477 - RNA, 20 nt, Homo sapiens
agcuguuguuaugagguuua

SEQ ID NO: 133478 - RNA, 22 nt, Homo sapiens
agcuuguguuugucugccuggg

SEQ ID NO: 133479 - RNA, 22 nt, Homo sapiens
agcuuguguuuuucuaaguauc

SEQ ID NO: 133480 - RNA, 22 nt, Homo sapiens
agcuuguuuuauagaaagucaa

SEQ ID NO: 133481 - RNA, 22 nt, Homo sapiens
aggaaauguuggucccauuucu

SEQ ID NO: 133482 - RNA, 22 nt, Homo sapiens
aggaagacauauagaacuaaaa

SEQ ID NO: 133483 - RNA, 21 nt, Homo sapiens
aggaagacuaugaucaauugg

SEQ ID NO: 133484 - RNA, 22 nt, Homo sapiens
aggaagguaaacuaacuugccu

SEQ ID NO: 133485 - RNA, 18 nt, Homo sapiens
aggaaugguaauacuuca

SEQ ID NO: 133486 - RNA, 22 nt, Homo sapiens
aggacacugauagucuuuggca

SEQ ID NO: 133487 - RNA, 22 nt, Homo sapiens
aggagcacuggccuuggaguca

SEQ ID NO: 133488 - RNA, 21 nt, Homo sapiens
aggagcauucaugacgagguu

SEQ ID NO: 133489 - RNA, 22 nt, Homo sapiens
aggaggauugcuuucaucuuuu

SEQ ID NO: 133490 - RNA, 22 nt, Homo sapiens
aggagguagaacauugccauuu

SEQ ID NO: 133491 - RNA, 22 nt, Homo sapiens
aggagguagggugugaaacagc

SEQ ID NO: 133492 - RNA, 22 nt, Homo sapiens
aggauaguaaugauagagaggc

SEQ ID NO: 133493 - RNA, 22 nt, Homo sapiens
aggaucauugacuauuauaagg

SEQ ID NO: 133494 - RNA, 22 nt, Homo sapiens
aggcaacaugguaaaacccugu

SEQ ID NO: 133495 - RNA, 21 nt, Homo sapiens
aggcaagauuacuuacgagca

SEQ ID NO: 133496 - RNA, 22 nt, Homo sapiens
aggcaagcaucuugcucccuuc

SEQ ID NO: 133497 - RNA, 21 nt, Homo sapiens
aggcaagguguuauuauugaa

SEQ ID NO: 133498 - RNA, 22 nt, Homo sapiens
aggcaagugauagcugcguaau

SEQ ID NO: 133499 - RNA, 22 nt, Homo sapiens
aggcaggugaaagauaguuuua

SEQ ID NO: 133500 - RNA, 22 nt, Homo sapiens
aggcaguuucagugagagguga

SEQ ID NO: 133501 - RNA, 22 nt, Homo sapiens
aggcaugauuguauuuugcucu

SEQ ID NO: 133502 - RNA, 22 nt, Homo sapiens
uggauccaucacgccucuuccc

SEQ ID NO: 133503 - RNA, 22 nt, Homo sapiens
uggaugaagagaugguaguugc

SEQ ID NO: 133504 - RNA, 19 nt, Homo sapiens
uggaugacugucugggucu

SEQ ID NO: 133505 - RNA, 21 nt, Homo sapiens
uggaugccuaggcagaaguuu

SEQ ID NO: 133506 - RNA, 22 nt, Homo sapiens
uggauguacagucaguauuugu

SEQ ID NO: 133507 - RNA, 21 nt, Homo sapiens
uggauugagaaccccaggagg

SEQ ID NO: 133508 - RNA, 22 nt, Homo sapiens
uggcaaaauauuuugguuucug

SEQ ID NO: 133509 - RNA, 21 nt, Homo sapiens
uggcaaaaugggcaguggguu

SEQ ID NO: 133510 - RNA, 22 nt, Homo sapiens
uggcaaaugaaagaaagccagu

SEQ ID NO: 133511 - RNA, 22 nt, Homo sapiens
uggcaaauguaguacccaauag

SEQ ID NO: 133512 - RNA, 22 nt, Homo sapiens
uggcaagaaccacaguuacuuu

SEQ ID NO: 133513 - RNA, 22 nt, Homo sapiens
uggcaagaagagcaugagacca

SEQ ID NO: 133514 - RNA, 23 nt, Homo sapiens
uggcaagaauucuuaccgugugg

SEQ ID NO: 133515 - RNA, 22 nt, Homo sapiens
uggcaagagggaugcaagguuu

SEQ ID NO: 133516 - RNA, 22 nt, Homo sapiens
uggcaagaucacaauuacuuuu

SEQ ID NO: 133517 - RNA, 20 nt, Homo sapiens
uggcaagauggcagaauaga

SEQ ID NO: 133518 - RNA, 22 nt, Homo sapiens
uggcaagauuguuccgguuugg

SEQ ID NO: 133519 - RNA, 19 nt, Homo sapiens
uggcacauguauacauaug

SEQ ID NO: 133520 - RNA, 20 nt, Homo sapiens
uggcaccugacagauagcca

SEQ ID NO: 133521 - RNA, 22 nt, Homo sapiens
uggcaccugacuccgagaugca

SEQ ID NO: 133522 - RNA, 19 nt, Homo sapiens
uggcacuugacguccggau

SEQ ID NO: 133523 - RNA, 22 nt, Homo sapiens
uggcagauagaaaugugguuaa

SEQ ID NO: 133524 - RNA, 22 nt, Homo sapiens
uggcagcugcuucaugggaugc

SEQ ID NO: 133525 - RNA, 22 nt, Homo sapiens
uggcagugggagauauuuuauu

SEQ ID NO: 133526 - RNA, 22 nt, Homo sapiens
uggcauauaaagauguguucaa

SEQ ID NO: 133527 - RNA, 17 nt, Homo sapiens
uggcaugaggguguggg

SEQ ID NO: 133528 - RNA, 22 nt, Homo sapiens
uggcauggaacuacuuugaaac

SEQ ID NO: 133529 - RNA, 22 nt, Homo sapiens
uggcauggucugcccaaguuuc

SEQ ID NO: 133530 - RNA, 23 nt, Homo sapiens
uggccaagauaaucucaguuuuc

SEQ ID NO: 133531 - RNA, 18 nt, Homo sapiens
uggccaauggcaaacaga

SEQ ID NO: 133532 - RNA, 22 nt, Homo sapiens
uggccagagggcaauuagcugu

SEQ ID NO: 133533 - RNA, 22 nt, Homo sapiens
uggcccccucccaaaucucaua

SEQ ID NO: 133534 - RNA, 22 nt, Homo sapiens
uggcuacuguacuugagcuauu

SEQ ID NO: 133535 - RNA, 22 nt, Homo sapiens
uggcuagauauccagaguucug

SEQ ID NO: 133536 - RNA, 22 nt, Homo sapiens
uggcuguuuauuucaccugggc

SEQ ID NO: 133537 - RNA, 22 nt, Homo sapiens
ugggaagagggagcgauuuugg

SEQ ID NO: 133538 - RNA, 22 nt, Homo sapiens
ugggaauaugauacaggucuuu

SEQ ID NO: 133539 - RNA, 22 nt, Homo sapiens
ugggaucagcugggcucucugu

SEQ ID NO: 133540 - RNA, 22 nt, Homo sapiens
ugggaugaaaauagcuucuucc

SEQ ID NO: 133541 - RNA, 22 nt, Homo sapiens
ugggauguagccuucuauuuuc

SEQ ID NO: 133542 - RNA, 22 nt, Homo sapiens
uggggugugagggagaaagaaa

SEQ ID NO: 133543 - RNA, 22 nt, Homo sapiens
uggguagagaaucaggaucuua

SEQ ID NO: 133544 - RNA, 22 nt, Homo sapiens
ugggucaguagcauguaugucu

SEQ ID NO: 133545 - RNA, 23 nt, Homo sapiens
ugggucaguuuuucugacaucau

SEQ ID NO: 133546 - RNA, 22 nt, Homo sapiens
ugggugugaccgcucaaggggg

SEQ ID NO: 133547 - RNA, 22 nt, Homo sapiens
ugguaagaggcccugaguuugu

SEQ ID NO: 133548 - RNA, 22 nt, Homo sapiens
ugguaauguaauuuggagaagg

SEQ ID NO: 133549 - RNA, 22 nt, Homo sapiens
ugguacuucaugcucacagaua

SEQ ID NO: 133550 - RNA, 22 nt, Homo sapiens
uggucaguugugccucaauucc

SEQ ID NO: 133551 - RNA, 21 nt, Homo sapiens
uggucaguuuucucacuagga

SEQ ID NO: 133552 - RNA, 22 nt, Homo sapiens
uggucaugaggugaggcuucuc

SEQ ID NO: 133553 - RNA, 22 nt, Homo sapiens
uggucauggaaauagaaugcac

SEQ ID NO: 133554 - RNA, 21 nt, Homo sapiens
uggucccauaagauuacaaug

SEQ ID NO: 133555 - RNA, 22 nt, Homo sapiens
uggucccaugaacuuuagguca

SEQ ID NO: 133556 - RNA, 19 nt, Homo sapiens
uggucccccgcaaucucau

SEQ ID NO: 133557 - RNA, 22 nt, Homo sapiens
uggucuccuuuguacccugggc

SEQ ID NO: 133558 - RNA, 22 nt, Homo sapiens
uggucuucuggccuccagaacc

SEQ ID NO: 133559 - RNA, 22 nt, Homo sapiens
uggucuuuucaacaaaugguau

SEQ ID NO: 133560 - RNA, 22 nt, Homo sapiens
uggugagaaaugagaugcuuuu

SEQ ID NO: 133561 - RNA, 22 nt, Homo sapiens
ugguuaucauagcuaugcuacu

SEQ ID NO: 133562 - RNA, 21 nt, Homo sapiens
ugguugauccuccuagugccu

SEQ ID NO: 133563 - RNA, 22 nt, Homo sapiens
ugguuguuuuaaaugucgucug

SEQ ID NO: 133564 - RNA, 23 nt, Homo sapiens
ugguuuguaagagauggacugga

SEQ ID NO: 133565 - RNA, 22 nt, Homo sapiens
uguaaaaagcccagccgcugag

SEQ ID NO: 133566 - RNA, 23 nt, Homo sapiens
uguaaaagcauuugucagccugg

SEQ ID NO: 133567 - RNA, 22 nt, Homo sapiens
uguaaaccauauauguauguag

SEQ ID NO: 133568 - RNA, 22 nt, Homo sapiens
uguaaaucuauuuuuaguguuu

SEQ ID NO: 133569 - RNA, 22 nt, Homo sapiens
uguaacugcuuagaagguuuua

SEQ ID NO: 133570 - RNA, 22 nt, Homo sapiens
uguaagcauuauauaauuguug

SEQ ID NO: 133571 - RNA, 22 nt, Homo sapiens
uguaaugaucaaaucagaguaa

SEQ ID NO: 133572 - RNA, 22 nt, Homo sapiens
aggcauggagacuaaaauuaua

SEQ ID NO: 133573 - RNA, 20 nt, Homo sapiens
aggcauguugguuugcgugu

SEQ ID NO: 133574 - RNA, 23 nt, Homo sapiens
aggcauuguacaguaauggaaaa

SEQ ID NO: 133575 - RNA, 22 nt, Homo sapiens
aggcugguauuuacaaaagcuc

SEQ ID NO: 133576 - RNA, 22 nt, Homo sapiens
aggcuuguuuuacuaacuggua

SEQ ID NO: 133577 - RNA, 22 nt, Homo sapiens
aggcuuuauuacagggucucag

SEQ ID NO: 133578 - RNA, 22 nt, Homo sapiens
agggcaagacuuguuaagaaca

SEQ ID NO: 133579 - RNA, 22 nt, Homo sapiens
agggcacuguagguccugccuc

SEQ ID NO: 133580 - RNA, 22 nt, Homo sapiens
agggccuuuguagauguacuca

SEQ ID NO: 133581 - RNA, 22 nt, Homo sapiens
agggcuuguuuaacuaucauua

SEQ ID NO: 133582 - RNA, 22 nt, Homo sapiens
agggguauuauguaaaucugac

SEQ ID NO: 133583 - RNA, 22 nt, Homo sapiens
agguacuuucccaaccauacug

SEQ ID NO: 133584 - RNA, 22 nt, Homo sapiens
agguccauugguauuauagcau

SEQ ID NO: 133585 - RNA, 22 nt, Homo sapiens
aggugguauuucaaaguggcag

SEQ ID NO: 133586 - RNA, 21 nt, Homo sapiens
aggugucuuggguucccuggc

SEQ ID NO: 133587 - RNA, 22 nt, Homo sapiens
agguuaacaucuauuuuggaug

SEQ ID NO: 133588 - RNA, 22 nt, Homo sapiens
agguuaucccgcauuauuuggu

SEQ ID NO: 133589 - RNA, 22 nt, Homo sapiens
agguuaugauuguagagcgagg

SEQ ID NO: 133590 - RNA, 22 nt, Homo sapiens
agguucccuuuuggccugggau

SEQ ID NO: 133591 - RNA, 22 nt, Homo sapiens
aguaacauuucuaguagagagu

SEQ ID NO: 133592 - RNA, 22 nt, Homo sapiens
aguaagucucaagguaggguag

SEQ ID NO: 133593 - RNA, 22 nt, Homo sapiens
aguacaauguugaguagaagug

SEQ ID NO: 133594 - RNA, 22 nt, Homo sapiens
aguaccauuugacaugggaccc

SEQ ID NO: 133595 - RNA, 22 nt, Homo sapiens
aguaucaucuuguuggccaggc

SEQ ID NO: 133596 - RNA, 22 nt, Homo sapiens
agucaagauggcaagguaaggc

SEQ ID NO: 133597 - RNA, 22 nt, Homo sapiens
agucagucuguccugugcugag

SEQ ID NO: 133598 - RNA, 20 nt, Homo sapiens
agucaguuuauuuucucucu

SEQ ID NO: 133599 - RNA, 22 nt, Homo sapiens
agugacaugggaucaaaucuga

SEQ ID NO: 133600 - RNA, 22 nt, Homo sapiens
agugagcuguuuuuacuuucug

SEQ ID NO: 133601 - RNA, 21 nt, Homo sapiens
agugagucauuuggaaagcaa

SEQ ID NO: 133602 - RNA, 22 nt, Homo sapiens
agugaucauuugaauugaugau

SEQ ID NO: 133603 - RNA, 22 nt, Homo sapiens
agugcacucuuuccucucuuac

SEQ ID NO: 133604 - RNA, 22 nt, Homo sapiens
agugccaaaucgagggcucuga

SEQ ID NO: 133605 - RNA, 23 nt, Homo sapiens
agugccuaguauauaggaggcgc

SEQ ID NO: 133606 - RNA, 22 nt, Homo sapiens
agugcuuguacaaaccccgagg

SEQ ID NO: 133607 - RNA, 22 nt, Homo sapiens
aguggaaucuguuauacuaacu

SEQ ID NO: 133608 - RNA, 22 nt, Homo sapiens
aguggaguguaaagcgucuuuu

SEQ ID NO: 133609 - RNA, 22 nt, Homo sapiens
aguggauguuguggccugggag

SEQ ID NO: 133610 - RNA, 22 nt, Homo sapiens
aguggcaaugugauguccugaa

SEQ ID NO: 133611 - RNA, 22 nt, Homo sapiens
agugggccccuagaggugaggu

SEQ ID NO: 133612 - RNA, 22 nt, Homo sapiens
aguggugucugaguggccaggg

SEQ ID NO: 133613 - RNA, 22 nt, Homo sapiens
agugguuuuaaguagagcauac

SEQ ID NO: 133614 - RNA, 20 nt, Homo sapiens
agugguuuucaaauaugucu

SEQ ID NO: 133615 - RNA, 22 nt, Homo sapiens
aguuggccccuacugggaggug

SEQ ID NO: 133616 - RNA, 18 nt, Homo sapiens
auaaacucaucauuuuua

SEQ ID NO: 133617 - RNA, 22 nt, Homo sapiens
auaaagccaggagacguaauug

SEQ ID NO: 133618 - RNA, 22 nt, Homo sapiens
auaaagccaugagcuugagaug

SEQ ID NO: 133619 - RNA, 22 nt, Homo sapiens
auaaaugccuguuguuuuaagc

SEQ ID NO: 133620 - RNA, 20 nt, Homo sapiens
auaaauguauagguguacau

SEQ ID NO: 133621 - RNA, 22 nt, Homo sapiens
auaacagcauuauugcauacgu

SEQ ID NO: 133622 - RNA, 22 nt, Homo sapiens
auaacagcugcaaggcaaaagc

SEQ ID NO: 133623 - RNA, 22 nt, Homo sapiens
auaacaggaaauacagggcuuu

SEQ ID NO: 133624 - RNA, 22 nt, Homo sapiens
auaagaguaguacauaugagac

SEQ ID NO: 133625 - RNA, 22 nt, Homo sapiens
auaagaugaaggaagccauauc

SEQ ID NO: 133626 - RNA, 22 nt, Homo sapiens
auaagcuaagaguuucugggcu

SEQ ID NO: 133627 - RNA, 22 nt, Homo sapiens
auaaggaguaucauauuaaaac

SEQ ID NO: 133628 - RNA, 22 nt, Homo sapiens
auaagugcuuguugaauaauag

SEQ ID NO: 133629 - RNA, 22 nt, Homo sapiens
auaauaucagguugugaugaug

SEQ ID NO: 133630 - RNA, 22 nt, Homo sapiens
auaaucaugucugaaaccuuug

SEQ ID NO: 133631 - RNA, 22 nt, Homo sapiens
auaauguuuauccagaggaguu

SEQ ID NO: 133632 - RNA, 22 nt, Homo sapiens
auacagugaauaucuggggcag

SEQ ID NO: 133633 - RNA, 22 nt, Homo sapiens
auacaguguucugggaagaagu

SEQ ID NO: 133634 - RNA, 22 nt, Homo sapiens
auacaugugcaggucagguuac

SEQ ID NO: 133635 - RNA, 22 nt, Homo sapiens
auacaugugccauggugguuug

SEQ ID NO: 133636 - RNA, 22 nt, Homo sapiens
auacaugugccauguucgugug

SEQ ID NO: 133637 - RNA, 22 nt, Homo sapiens
auacauguucaagggcauauau

SEQ ID NO: 133638 - RNA, 19 nt, Homo sapiens
auacccacuagguuacuua

SEQ ID NO: 133639 - RNA, 22 nt, Homo sapiens
auacuaugagauaauaaagacu

SEQ ID NO: 133640 - RNA, 22 nt, Homo sapiens
auacuccugucucagcugagau

SEQ ID NO: 133641 - RNA, 22 nt, Homo sapiens
auacugccuuuagcaaaacagu

SEQ ID NO: 133642 - RNA, 22 nt, Homo sapiens
auagaagcugccaacguuucag

SEQ ID NO: 133643 - RNA, 22 nt, Homo sapiens
auagacacugaaaucccugcca

SEQ ID NO: 133644 - RNA, 22 nt, Homo sapiens
auagagguagacagaggggaaa

SEQ ID NO: 133645 - RNA, 22 nt, Homo sapiens
auagaguuagaaagaaauguuu

SEQ ID NO: 133646 - RNA, 21 nt, Homo sapiens
auagcacaucagauuuuauua

SEQ ID NO: 133647 - RNA, 22 nt, Homo sapiens
auagcacugguuuuucuugguu

SEQ ID NO: 133648 - RNA, 22 nt, Homo sapiens
auagcagaagaagggacaauuc

SEQ ID NO: 133649 - RNA, 22 nt, Homo sapiens
auagcagaauuuggucaagucu

SEQ ID NO: 133650 - RNA, 20 nt, Homo sapiens
auagcagcaugauuuauagu

SEQ ID NO: 133651 - RNA, 22 nt, Homo sapiens
auagcagcucacuuauuuaugg

SEQ ID NO: 133652 - RNA, 22 nt, Homo sapiens
auagcaggagaauggucauggg

SEQ ID NO: 133653 - RNA, 22 nt, Homo sapiens
auagcagugugaaaauguacua

SEQ ID NO: 133654 - RNA, 22 nt, Homo sapiens
auagcucuugcuuacccacugu

SEQ ID NO: 133655 - RNA, 22 nt, Homo sapiens
auagguauuuuuaaaugacugu

SEQ ID NO: 133656 - RNA, 22 nt, Homo sapiens
auagguuuucacuguagauucu

SEQ ID NO: 133657 - RNA, 22 nt, Homo sapiens
auagugcagugaugaaccuagg

SEQ ID NO: 133658 - RNA, 22 nt, Homo sapiens
auagugcugcaaaaaacauacg

SEQ ID NO: 133659 - RNA, 22 nt, Homo sapiens
auagugcugcaauaaacauaug

SEQ ID NO: 133660 - RNA, 22 nt, Homo sapiens
auagugcugcaaucaacauaca

SEQ ID NO: 133661 - RNA, 22 nt, Homo sapiens
auagugcugccauaaacauacg

SEQ ID NO: 133662 - RNA, 22 nt, Homo sapiens
cuccuugauuagaguauagagu

SEQ ID NO: 133663 - RNA, 22 nt, Homo sapiens
cucucaguguggaggccagaaa

SEQ ID NO: 133664 - RNA, 22 nt, Homo sapiens
cucucugagccccagacaccuu

SEQ ID NO: 133665 - RNA, 17 nt, Homo sapiens
cucucugguuuaaagca

SEQ ID NO: 133666 - RNA, 22 nt, Homo sapiens
cucucuguuugucuguuauugg

SEQ ID NO: 133667 - RNA, 22 nt, Homo sapiens
cucugacagugguuagcacugu

SEQ ID NO: 133668 - RNA, 22 nt, Homo sapiens
cucuuugaggugagcugcccau

SEQ ID NO: 133669 - RNA, 22 nt, Homo sapiens
cucuuugcuucuggcaucauug

SEQ ID NO: 133670 - RNA, 22 nt, Homo sapiens
cucuuuuguuuagcugagaggg

SEQ ID NO: 133671 - RNA, 22 nt, Homo sapiens
cugacugugcaugcccagcccc

SEQ ID NO: 133672 - RNA, 22 nt, Homo sapiens
cugagaauguaaaugaagcuuu

SEQ ID NO: 133673 - RNA, 22 nt, Homo sapiens
cugagacacucuuaucugcaua

SEQ ID NO: 133674 - RNA, 22 nt, Homo sapiens
cugagaguugaugaaauauggu

SEQ ID NO: 133675 - RNA, 22 nt, Homo sapiens
cugagauaggacucugcuggcu

SEQ ID NO: 133676 - RNA, 22 nt, Homo sapiens
cugagauuaagauauugggagu

SEQ ID NO: 133677 - RNA, 22 nt, Homo sapiens
cugagcaaagaagugauaauga

SEQ ID NO: 133678 - RNA, 22 nt, Homo sapiens
cugagcccauucuggggagaag

SEQ ID NO: 133679 - RNA, 22 nt, Homo sapiens
cugaggaaguucuuuaacaguu

SEQ ID NO: 133680 - RNA, 22 nt, Homo sapiens
cugaggacaucagggaagcauc

SEQ ID NO: 133681 - RNA, 22 nt, Homo sapiens
cugaggcacggcgaccuuaagu

SEQ ID NO: 133682 - RNA, 22 nt, Homo sapiens
cugaggguagaaggaucacuug

SEQ ID NO: 133683 - RNA, 22 nt, Homo sapiens
cugagguaauuuuccagauaau

SEQ ID NO: 133684 - RNA, 22 nt, Homo sapiens
cugagguaggugaucagugcuu

SEQ ID NO: 133685 - RNA, 22 nt, Homo sapiens
cugagguauuuaggugaaagaa

SEQ ID NO: 133686 - RNA, 22 nt, Homo sapiens
cugaggugauauauacauauuu

SEQ ID NO: 133687 - RNA, 22 nt, Homo sapiens
cugagugcaagugauccuccca

SEQ ID NO: 133688 - RNA, 22 nt, Homo sapiens
cugauguagguggucugugauc

SEQ ID NO: 133689 - RNA, 22 nt, Homo sapiens
cugcaguaaccacuguaggugu

SEQ ID NO: 133690 - RNA, 22 nt, Homo sapiens
cugcagucaucugaagauuuug

SEQ ID NO: 133691 - RNA, 22 nt, Homo sapiens
cugccugagaaaauggagggca

SEQ ID NO: 133692 - RNA, 22 nt, Homo sapiens
cuggaaagaaucaggcuaaacu

SEQ ID NO: 133693 - RNA, 22 nt, Homo sapiens
cuggaaagcaaguccauugcuc

SEQ ID NO: 133694 - RNA, 22 nt, Homo sapiens
cuggaaaguagacaaucuaaaa

SEQ ID NO: 133695 - RNA, 22 nt, Homo sapiens
cuggaaggaaaaacaaccacag

SEQ ID NO: 133696 - RNA, 22 nt, Homo sapiens
cuggaauauuagcuggucuuaa

SEQ ID NO: 133697 - RNA, 22 nt, Homo sapiens
cuggaaugugagccccaaaaag

SEQ ID NO: 133698 - RNA, 22 nt, Homo sapiens
cuggagcaaaggugacucuugu

SEQ ID NO: 133699 - RNA, 22 nt, Homo sapiens
cuggaguuugaggcugcaguga

SEQ ID NO: 133700 - RNA, 22 nt, Homo sapiens
cuggauauuaacauugaugaaa

SEQ ID NO: 133701 - RNA, 22 nt, Homo sapiens
cuggcaaauaguagagccagga

SEQ ID NO: 133702 - RNA, 22 nt, Homo sapiens
cuggcaagagugaaccagcugu

SEQ ID NO: 133703 - RNA, 22 nt, Homo sapiens
uuuuagcuuuucccaggacucc

SEQ ID NO: 133704 - RNA, 22 nt, Homo sapiens
uuuuaguugcucagguauucuc

SEQ ID NO: 133705 - RNA, 22 nt, Homo sapiens
uuuuauguuuguucccugccaa

SEQ ID NO: 133706 - RNA, 22 nt, Homo sapiens
uuuuccagugggacucccauua

SEQ ID NO: 133707 - RNA, 22 nt, Homo sapiens
uuuugcaccauccuaauaguau

SEQ ID NO: 133708 - RNA, 22 nt, Homo sapiens
uuuugcauuggcugaggagugu

SEQ ID NO: 133709 - RNA, 22 nt, Homo sapiens
uuuugcucuucggaagagcuug

SEQ ID NO: 133710 - RNA, 18 nt, Homo sapiens
uuuugcuuaacugcgcca

SEQ ID NO: 133711 - RNA, 22 nt, Homo sapiens
uuuugcuugugaauagccacau

SEQ ID NO: 133712 - RNA, 17 nt, Homo sapiens
uuuuggauuagaaaucc

SEQ ID NO: 133713 - RNA, 22 nt, Homo sapiens
uuuuggcuagaaauauaccucc

SEQ ID NO: 133714 - RNA, 22 nt, Homo sapiens
uuuuggcucugucuguaucuuu

SEQ ID NO: 133715 - RNA, 22 nt, Homo sapiens
uuuuggcucuugguaggucaga

SEQ ID NO: 133716 - RNA, 22 nt, Homo sapiens
uuuugguauauacggggguccu

SEQ ID NO: 133717 - RNA, 22 nt, Homo sapiens
uuuuggucuccaguuucugcug

SEQ ID NO: 133718 - RNA, 22 nt, Homo sapiens
uuuugguguauuguauaaggua

SEQ ID NO: 133719 - RNA, 22 nt, Homo sapiens
uuuugguuaggauggguggcau

SEQ ID NO: 133720 - RNA, 22 nt, Homo sapiens
uuuuguacgccuguguccauca

SEQ ID NO: 133721 - RNA, 22 nt, Homo sapiens
uuuugugcauggcccaguggua

SEQ ID NO: 133722 - RNA, 21 nt, Homo sapiens
uuuugugcaugugcagccugc

SEQ ID NO: 133723 - RNA, 18 nt, Homo sapiens
uuuuugaggcacagggga

SEQ ID NO: 133724 - RNA, 22 nt, Homo sapiens
uuuuugagguauaguguggcua

SEQ ID NO: 133725 - RNA, 22 nt, Homo sapiens
uuuuugauuaauggguagacca

SEQ ID NO: 133726 - RNA, 21 nt, Homo sapiens
uuuuugggcuuucauaguguu

SEQ ID NO: 133727 - RNA, 22 nt, Homo sapiens
gacauguaaggcucucucuguu

SEQ ID NO: 133728 - RNA, 22 nt, Homo sapiens
gacauguuucucucuguuuacu

SEQ ID NO: 133729 - RNA, 21 nt, Homo sapiens
gaccacagcagggaaugucag

SEQ ID NO: 133730 - RNA, 22 nt, Homo sapiens
gacccauagaagcgagcuugug

SEQ ID NO: 133731 - RNA, 22 nt, Homo sapiens
gacccucuagauggaagcacug

SEQ ID NO: 133732 - RNA, 22 nt, Homo sapiens
gacccuuagaaugugaucuuau

SEQ ID NO: 133733 - RNA, 22 nt, Homo sapiens
gacuauaucaggaauggggauu

SEQ ID NO: 133734 - RNA, 22 nt, Homo sapiens
gacuauguuaccuuacacauca

SEQ ID NO: 133735 - RNA, 22 nt, Homo sapiens
gacugaguaagcagaagcaauu

SEQ ID NO: 133736 - RNA, 22 nt, Homo sapiens
gacugcagugcagcuguuaggc

SEQ ID NO: 133737 - RNA, 22 nt, Homo sapiens
gacuggccauugauacagaggu

SEQ ID NO: 133738 - RNA, 22 nt, Homo sapiens
gacuggccuauaauggcgaauu

SEQ ID NO: 133739 - RNA, 16 nt, Homo sapiens
gacugggcugaggaau

SEQ ID NO: 133740 - RNA, 22 nt, Homo sapiens
gagaacauuuaagccacucagg

SEQ ID NO: 133741 - RNA, 22 nt, Homo sapiens
gagaaugaacagacugccucuu

SEQ ID NO: 133742 - RNA, 22 nt, Homo sapiens
gagaaugagauuaugguuacau

SEQ ID NO: 133743 - RNA, 20 nt, Homo sapiens
gagaccugagauucacucaa

SEQ ID NO: 133744 - RNA, 22 nt, Homo sapiens
gagacggagucacgcccuguca

SEQ ID NO: 133745 - RNA, 22 nt, Homo sapiens
gagacugagucucgcucugccg

SEQ ID NO: 133746 - RNA, 22 nt, Homo sapiens
gagacugagucuugcucuguca

SEQ ID NO: 133747 - RNA, 22 nt, Homo sapiens
gagagugaaguuugcuaccugu

SEQ ID NO: 133748 - RNA, 22 nt, Homo sapiens
gagauaacuacuggauuaaguu

SEQ ID NO: 133749 - RNA, 22 nt, Homo sapiens
gagauacacccagugcagaggc

SEQ ID NO: 133750 - RNA, 22 nt, Homo sapiens
gagauaggauucacuuucaugu

SEQ ID NO: 133751 - RNA, 22 nt, Homo sapiens
gagauauguuggcagcugguau

SEQ ID NO: 133752 - RNA, 22 nt, Homo sapiens
gagaucaucuaaucuggccucu

SEQ ID NO: 133753 - RNA, 22 nt, Homo sapiens
gagaucauguacuagaacaccu

SEQ ID NO: 133754 - RNA, 22 nt, Homo sapiens
gagaucuauuccucacccuucu

SEQ ID NO: 133755 - RNA, 22 nt, Homo sapiens
gagaugaagugucaauaaggau

SEQ ID NO: 133756 - RNA, 22 nt, Homo sapiens
gagaugaaguuaaggaucuuua

SEQ ID NO: 133757 - RNA, 22 nt, Homo sapiens
gagaugaucaugugguuuuguc

SEQ ID NO: 133758 - RNA, 22 nt, Homo sapiens
gagaugguacacauacgauucu

SEQ ID NO: 133759 - RNA, 22 nt, Homo sapiens
gagaugguguuccacugccagu

SEQ ID NO: 133760 - RNA, 22 nt, Homo sapiens
gagaugugguucaaggguguuu

SEQ ID NO: 133761 - RNA, 22 nt, Homo sapiens
gagauuauuuaaaaggugauuu

SEQ ID NO: 133762 - RNA, 22 nt, Homo sapiens
gagauugucaugauuacauugu

SEQ ID NO: 133763 - RNA, 22 nt, Homo sapiens
gagcagacaugaggaccgcugg

SEQ ID NO: 133764 - RNA, 22 nt, Homo sapiens
gagcccauuucacuuguccagc

SEQ ID NO: 133765 - RNA, 22 nt, Homo sapiens
gagcucauuaaaaauguagaau

SEQ ID NO: 133766 - RNA, 22 nt, Homo sapiens
gagcucauuaaaguaggaccua

SEQ ID NO: 133767 - RNA, 22 nt, Homo sapiens
gagcuccuccccuuggcuuuca

SEQ ID NO: 133768 - RNA, 22 nt, Homo sapiens
gagcugguccuuuaaggaugca

SEQ ID NO: 133769 - RNA, 22 nt, Homo sapiens
gaggaaguaauuuuaggccugu

SEQ ID NO: 133770 - RNA, 22 nt, Homo sapiens
gaggaaguuuacaaagcaucug

SEQ ID NO: 133771 - RNA, 22 nt, Homo sapiens
gaggacauuaugcuaaguggaa

SEQ ID NO: 133772 - RNA, 21 nt, Homo sapiens
gaggauauuuuuauguuugga

SEQ ID NO: 133773 - RNA, 22 nt, Homo sapiens
gaggaucucuugagcccagaag

SEQ ID NO: 133774 - RNA, 22 nt, Homo sapiens
gaggcagucugucccuuagcag

SEQ ID NO: 133775 - RNA, 22 nt, Homo sapiens
gaggcaguguguccguucucgg

SEQ ID NO: 133776 - RNA, 22 nt, Homo sapiens
gaggcauugaaauauugcuuau

SEQ ID NO: 133777 - RNA, 22 nt, Homo sapiens
gaggcauugaagauauggaagu

SEQ ID NO: 133778 - RNA, 22 nt, Homo sapiens
gaggcggugugaugucacaugc

SEQ ID NO: 133779 - RNA, 22 nt, Homo sapiens
gagguaguuuaguuuuggggaa

SEQ ID NO: 133780 - RNA, 22 nt, Homo sapiens
gaggucauguggcaggcagcca

SEQ ID NO: 133781 - RNA, 22 nt, Homo sapiens
gaggucuuacauuuuaauauuu

SEQ ID NO: 133782 - RNA, 22 nt, Homo sapiens
gagguguagagauauaccugaa

SEQ ID NO: 133783 - RNA, 22 nt, Homo sapiens
gaguaaaugucacuguugcugu

SEQ ID NO: 133784 - RNA, 22 nt, Homo sapiens
gaguaacagcauaaauuuguga

SEQ ID NO: 133785 - RNA, 22 nt, Homo sapiens
gaguagaacugguuaucuaaua

SEQ ID NO: 133786 - RNA, 21 nt, Homo sapiens
gagugcaaauaaagagagggc

SEQ ID NO: 133787 - RNA, 22 nt, Homo sapiens
gagugcaauggugcuaucucgg

SEQ ID NO: 133788 - RNA, 22 nt, Homo sapiens
gagugcaucguggccauuuuaa

SEQ ID NO: 133789 - RNA, 22 nt, Homo sapiens
gagugcugagcccacuuccuug

SEQ ID NO: 133790 - RNA, 21 nt, Homo sapiens
gaguggcuuuuguuucaccag

SEQ ID NO: 133791 - RNA, 22 nt, Homo sapiens
gauaaaguauuggguacuaugc

SEQ ID NO: 133792 - RNA, 18 nt, Homo sapiens
gauaacaguggacuaugc

SEQ ID NO: 133793 - RNA, 22 nt, Homo sapiens
gauaagagaugauuuugccaug

SEQ ID NO: 133794 - RNA, 22 nt, Homo sapiens
gauacaccauuuucuagcuauu

SEQ ID NO: 133795 - RNA, 22 nt, Homo sapiens
gauagcagccauucuuuuuauu

SEQ ID NO: 133796 - RNA, 22 nt, Homo sapiens
gauauguguuuuagucaggguu

SEQ ID NO: 133797 - RNA, 22 nt, Homo sapiens
gauauguuucuucaauaccuag

SEQ ID NO: 133798 - RNA, 22 nt, Homo sapiens
gaucaauuggcugaagacacgu

SEQ ID NO: 133799 - RNA, 22 nt, Homo sapiens
gaucacauuguuucauacauau

SEQ ID NO: 133800 - RNA, 22 nt, Homo sapiens
gaucagauggcuguuggugugu

SEQ ID NO: 133801 - RNA, 22 nt, Homo sapiens
gaucugagaaagugucauaaca

SEQ ID NO: 133802 - RNA, 22 nt, Homo sapiens
gaugaaacaucuuuggaaacug

SEQ ID NO: 133803 - RNA, 22 nt, Homo sapiens
gaugacagugaguaaccccaac

SEQ ID NO: 133804 - RNA, 22 nt, Homo sapiens
gaugagguagaagacucagcaa

SEQ ID NO: 133805 - RNA, 22 nt, Homo sapiens
gaugaucaugaccuacagaugg

SEQ ID NO: 133806 - RNA, 22 nt, Homo sapiens
gauggaguugucgccugggcug

SEQ ID NO: 133807 - RNA, 22 nt, Homo sapiens
gauggcacuuaagagcaagagc

SEQ ID NO: 133808 - RNA, 22 nt, Homo sapiens
gaugguggucuacccuuucccu

SEQ ID NO: 133809 - RNA, 22 nt, Homo sapiens
gauuagucccauuuuacaggug

SEQ ID NO: 133810 - RNA, 22 nt, Homo sapiens
gauuagugacguugagcacugu

SEQ ID NO: 133811 - RNA, 22 nt, Homo sapiens
gauuguguucauaggcauguua

SEQ ID NO: 133812 - RNA, 22 nt, Homo sapiens
gauuucaucuuuagaggaagga

SEQ ID NO: 133813 - RNA, 22 nt, Homo sapiens
gauuugguguucuggcucaaga

SEQ ID NO: 133814 - RNA, 22 nt, Homo sapiens
gauuuguauuaaaagugugacg

SEQ ID NO: 133815 - RNA, 22 nt, Homo sapiens
gauuuguuggccugugagcuag

SEQ ID NO: 133816 - RNA, 21 nt, Homo sapiens
gcaaaguggcuaccuugcucc

SEQ ID NO: 133817 - RNA, 22 nt, Homo sapiens
gcaaaguguuuuuaggaagucu

SEQ ID NO: 133818 - RNA, 20 nt, Homo sapiens
gcaacauggccagagugaau

SEQ ID NO: 133819 - RNA, 22 nt, Homo sapiens
gcaagaauggaacaggagagcc

SEQ ID NO: 133820 - RNA, 22 nt, Homo sapiens
gcaagacaugucuaagguuuaa

SEQ ID NO: 133821 - RNA, 22 nt, Homo sapiens
gcaagagguaucuuauuuuccc

SEQ ID NO: 133822 - RNA, 22 nt, Homo sapiens
gcaagauguuaccauuagggaa

SEQ ID NO: 133823 - RNA, 22 nt, Homo sapiens
gcaagugucugagguuuuguau

SEQ ID NO: 133824 - RNA, 22 nt, Homo sapiens
gcacagucaacacuuauucacc

SEQ ID NO: 133825 - RNA, 22 nt, Homo sapiens
gcacaguuaaagggucauguga

SEQ ID NO: 133826 - RNA, 22 nt, Homo sapiens
gcacccugucaaaauggaccaa

SEQ ID NO: 133827 - RNA, 22 nt, Homo sapiens
gcacgcauuguccuucuaguca

SEQ ID NO: 133828 - RNA, 22 nt, Homo sapiens
gcacgugcacccacaugcacgu

SEQ ID NO: 133829 - RNA, 22 nt, Homo sapiens
gcacugggccacauuuauuuuc

SEQ ID NO: 133830 - RNA, 19 nt, Homo sapiens
gcagagaugugguagcuug

SEQ ID NO: 133831 - RNA, 22 nt, Homo sapiens
gcagaguauagagggcugggcc

SEQ ID NO: 133832 - RNA, 22 nt, Homo sapiens
gcagaucuucgcgguaaguguu

SEQ ID NO: 133833 - RNA, 22 nt, Homo sapiens
gcagcaucaaaucacacaagau

SEQ ID NO: 133834 - RNA, 22 nt, Homo sapiens
gcaggaaucuugagaaggauuc

SEQ ID NO: 133835 - RNA, 17 nt, Homo sapiens
gcaguacuuaguaagga

SEQ ID NO: 133836 - RNA, 19 nt, Homo sapiens
gcaguauugaaggccaguc

SEQ ID NO: 133837 - RNA, 22 nt, Homo sapiens
gcagugcaugacgguauauaua

SEQ ID NO: 133838 - RNA, 22 nt, Homo sapiens
gcaguguucugggcaggaagaa

SEQ ID NO: 133839 - RNA, 22 nt, Homo sapiens
gcaguucuguaguugaaauuua

SEQ ID NO: 133840 - RNA, 22 nt, Homo sapiens
gcaugauuuuauaucuauguaa

SEQ ID NO: 133841 - RNA, 22 nt, Homo sapiens
gcaugcacuguauuuaaguauc

SEQ ID NO: 133842 - RNA, 22 nt, Homo sapiens
gcauggagaaggggacugauuc

SEQ ID NO: 133843 - RNA, 22 nt, Homo sapiens
gcauggauguugauggcugcug

SEQ ID NO: 133844 - RNA, 22 nt, Homo sapiens
gccaagauugguuuaauauucc

SEQ ID NO: 133845 - RNA, 22 nt, Homo sapiens
gccauagucauagauggcaggg

SEQ ID NO: 133846 - RNA, 22 nt, Homo sapiens
gccauggugucuuauuuuugug

SEQ ID NO: 133847 - RNA, 22 nt, Homo sapiens
gccauugcacuccagcuugggc

SEQ ID NO: 133848 - RNA, 22 nt, Homo sapiens
gcccacuguuaaauuuguuuua

SEQ ID NO: 133849 - RNA, 22 nt, Homo sapiens
gccccgggugaugcagccguca

SEQ ID NO: 133850 - RNA, 22 nt, Homo sapiens
gccccugagacuugccucgggc

SEQ ID NO: 133851 - RNA, 22 nt, Homo sapiens
gcccugagauucuuggauucug

SEQ ID NO: 133852 - RNA, 22 nt, Homo sapiens
gccuagagacuugguaucuugc

SEQ ID NO: 133853 - RNA, 22 nt, Homo sapiens
gccuagagaguuaucaggcugu

SEQ ID NO: 133854 - RNA, 22 nt, Homo sapiens
gccuuuggugacaggcaugugu

SEQ ID NO: 133855 - RNA, 22 nt, Homo sapiens
gcguugcacuccagccugggua

SEQ ID NO: 133856 - RNA, 22 nt, Homo sapiens
gcuaaggcaggagcauugcuug

SEQ ID NO: 133857 - RNA, 22 nt, Homo sapiens
gcuaggagauccacugcucucu

SEQ ID NO: 133858 - RNA, 22 nt, Homo sapiens
gcucaaguaauggcaguuuugc

SEQ ID NO: 133859 - RNA, 22 nt, Homo sapiens
gcucaugggcagugugauuguu

SEQ ID NO: 133860 - RNA, 22 nt, Homo sapiens
gcuccuuugaguagcuucugug

SEQ ID NO: 133861 - RNA, 22 nt, Homo sapiens
gcucugguuacaaaggcaaauu

SEQ ID NO: 133862 - RNA, 16 nt, Homo sapiens
gcucuuguucucuguu

SEQ ID NO: 133863 - RNA, 22 nt, Homo sapiens
ggcugguuuucaguuacugagu

SEQ ID NO: 133864 - RNA, 22 nt, Homo sapiens
ggcuuggaggaaugugagggcu

SEQ ID NO: 133865 - RNA, 22 nt, Homo sapiens
gggaacaugagaaugugaauga

SEQ ID NO: 133866 - RNA, 22 nt, Homo sapiens
gggagcacaagaaauguuucau

SEQ ID NO: 133867 - RNA, 22 nt, Homo sapiens
gggaggucauuguucaaugcug

SEQ ID NO: 133868 - RNA, 22 nt, Homo sapiens
gggagugucuaaccuguuaaca

SEQ ID NO: 133869 - RNA, 22 nt, Homo sapiens
gggaugaagaagaauaguucgu

SEQ ID NO: 133870 - RNA, 22 nt, Homo sapiens
gggcaaauuauguaucucucag

SEQ ID NO: 133871 - RNA, 22 nt, Homo sapiens
gggcaacauugaguacccugaa

SEQ ID NO: 133872 - RNA, 20 nt, Homo sapiens
gggcaaguaugugggaaguc

SEQ ID NO: 133873 - RNA, 22 nt, Homo sapiens
ggggcaaaaugccacgagucuc

SEQ ID NO: 133874 - RNA, 22 nt, Homo sapiens
gggguuuuaccuucguauucuu

SEQ ID NO: 133875 - RNA, 22 nt, Homo sapiens
ggguaggcaagcggaugucaga

SEQ ID NO: 133876 - RNA, 17 nt, Homo sapiens
gggucaccuugcaggua

SEQ ID NO: 133877 - RNA, 22 nt, Homo sapiens
ggguucccugaugagaguuagu

SEQ ID NO: 133878 - RNA, 22 nt, Homo sapiens
gguaaacauaagagagcugacu

SEQ ID NO: 133879 - RNA, 22 nt, Homo sapiens
gguaauguaacugguauucugu

SEQ ID NO: 133880 - RNA, 22 nt, Homo sapiens
gguagacaucgugcucugugau

SEQ ID NO: 133881 - RNA, 22 nt, Homo sapiens
gguaggcacuggugggaagaga

SEQ ID NO: 133882 - RNA, 22 nt, Homo sapiens
gguauuuaaaguaccugucugc

SEQ ID NO: 133883 - RNA, 22 nt, Homo sapiens
ggucauggagcuuuacuuuaug

SEQ ID NO: 133884 - RNA, 22 nt, Homo sapiens
gguccgccugccuuggccuccc

SEQ ID NO: 133885 - RNA, 22 nt, Homo sapiens
ggucuuggagaauuguccuggg

SEQ ID NO: 133886 - RNA, 23 nt, Homo sapiens
ggugaggaguacagagucuucau

SEQ ID NO: 133887 - RNA, 22 nt, Homo sapiens
ggugaguggugcuuaaguucag

SEQ ID NO: 133888 - RNA, 19 nt, Homo sapiens
ggugcuugaauauuccucc

SEQ ID NO: 133889 - RNA, 22 nt, Homo sapiens
gguggcaaaucugaguggcgcu

SEQ ID NO: 133890 - RNA, 22 nt, Homo sapiens
guaaaucucuguuuucauggac

SEQ ID NO: 133891 - RNA, 22 nt, Homo sapiens
guaaauguccugcuacagagug

SEQ ID NO: 133892 - RNA, 22 nt, Homo sapiens
guaacacucuaaagggaugcac

SEQ ID NO: 133893 - RNA, 22 nt, Homo sapiens
guaacagucucaacaguggucu

SEQ ID NO: 133894 - RNA, 22 nt, Homo sapiens
guaagagcauguaguggcucua

SEQ ID NO: 133895 - RNA, 22 nt, Homo sapiens
guaagugguagagcugggcuau

SEQ ID NO: 133896 - RNA, 22 nt, Homo sapiens
guaauagucucaaacuccugga

SEQ ID NO: 133897 - RNA, 22 nt, Homo sapiens
guaaucucagcuacucgggagg

SEQ ID NO: 133898 - RNA, 22 nt, Homo sapiens
guaaugcacucccaaagaucca

SEQ ID NO: 133899 - RNA, 22 nt, Homo sapiens
guacacauacauauaugugugu

SEQ ID NO: 133900 - RNA, 22 nt, Homo sapiens
guacaggcagcaaacaccauaa

SEQ ID NO: 133901 - RNA, 22 nt, Homo sapiens
guacaguauaguaauaggauuu

SEQ ID NO: 133902 - RNA, 22 nt, Homo sapiens
ucccugguguuaguuuguucuu

SEQ ID NO: 133903 - RNA, 22 nt, Homo sapiens
ucccuguagugccuagaucaga

SEQ ID NO: 133904 - RNA, 17 nt, Homo sapiens
ucccuguuuuuucaguc

SEQ ID NO: 133905 - RNA, 19 nt, Homo sapiens
ucccuuuguauggacauac

SEQ ID NO: 133906 - RNA, 22 nt, Homo sapiens
uccuacugucuucggggcacug

SEQ ID NO: 133907 - RNA, 22 nt, Homo sapiens
uccucaguggauuggauggugc

SEQ ID NO: 133908 - RNA, 22 nt, Homo sapiens
uccugagaauagaguugcaugu

SEQ ID NO: 133909 - RNA, 22 nt, Homo sapiens
uccugagucagcauccguuugu

SEQ ID NO: 133910 - RNA, 22 nt, Homo sapiens
uccugcauucugacuugcuuuc

SEQ ID NO: 133911 - RNA, 22 nt, Homo sapiens
uccuuggugacauuucuugucu

SEQ ID NO: 133912 - RNA, 22 nt, Homo sapiens
ucgcaccauugcacuccagcca

SEQ ID NO: 133913 - RNA, 22 nt, Homo sapiens
ucggcucagugcaagcucugcc

SEQ ID NO: 133914 - RNA, 22 nt, Homo sapiens
ucuaaaacuagauugugaugau

SEQ ID NO: 133915 - RNA, 22 nt, Homo sapiens
ucuaaaguacuacuacuguugg

SEQ ID NO: 133916 - RNA, 19 nt, Homo sapiens
ucuaaaucucuugauagac

SEQ ID NO: 133917 - RNA, 22 nt, Homo sapiens
ucuaugguuuauuuccaagugu

SEQ ID NO: 133918 - RNA, 22 nt, Homo sapiens
ucuauuugggguaccuguggua

SEQ ID NO: 133919 - RNA, 22 nt, Homo sapiens
ucucaaguaacugggacaauaa

SEQ ID NO: 133920 - RNA, 18 nt, Homo sapiens
ucucacagcaaucuguca

SEQ ID NO: 133921 - RNA, 22 nt, Homo sapiens
ucucacaggguuauugaggggg

SEQ ID NO: 133922 - RNA, 22 nt, Homo sapiens
ucucagugaauguggaaaaagc

SEQ ID NO: 133923 - RNA, 22 nt, Homo sapiens
ucucaguggcacccccaacacc

SEQ ID NO: 133924 - RNA, 22 nt, Homo sapiens
ucucaguggcuuccucacuuuu

SEQ ID NO: 133925 - RNA, 22 nt, Homo sapiens
cuugcauuuuggagaaugcuga

SEQ ID NO: 133926 - RNA, 22 nt, Homo sapiens
cuuuggcaaugucauuuucaau

SEQ ID NO: 133927 - RNA, 22 nt, Homo sapiens
gaggaaguagcuacugucuuuc

SEQ ID NO: 133928 - RNA, 21 nt, Homo sapiens
gagugcaaauaaagagagggc

SEQ ID NO: 133929 - RNA, 22 nt, Homo sapiens
ggcaaagagacaugcaucgggg

SEQ ID NO: 133930 - RNA, 22 nt, Homo sapiens
ggcaaggauguuuuucuggcaa

SEQ ID NO: 133931 - RNA, 22 nt, Homo sapiens
guauuuggugaugccuccaaac

SEQ ID NO: 133932 - RNA, 22 nt, Homo sapiens
gugaggcacugcugcuuuccag

SEQ ID NO: 133933 - RNA, 22 nt, Homo sapiens
guuauguuauguuauguuaugu

SEQ ID NO: 133934 - RNA, 22 nt, Homo sapiens
uauuuggauagucuggaaaaaa

SEQ ID NO: 133935 - RNA, 22 nt, Homo sapiens
uauuugguagcuauuuugcagu

SEQ ID NO: 133936 - RNA, 22 nt, Homo sapiens
ucaaagugcuauggcucagguu

SEQ ID NO: 133937 - RNA, 22 nt, Homo sapiens
uccuacugucuucggggcacug

SEQ ID NO: 133938 - RNA, 22 nt, Homo sapiens
ucuguuguuguuuuaagagaca

SEQ ID NO: 133939 - RNA, 22 nt, Homo sapiens
ucuuuaguaauuucuguaaggc

SEQ ID NO: 133940 - RNA, 22 nt, Homo sapiens
ugaaggcaggagggagaaaagu

SEQ ID NO: 133941 - RNA, 22 nt, Homo sapiens
ugaggcaaggcugaaugaaggc

SEQ ID NO: 133942 - RNA, 22 nt, Homo sapiens
ugcauguucuuacucauacaug

SEQ ID NO: 133943 - RNA, 22 nt, Homo sapiens
ugccugcugucuaauauauucu

SEQ ID NO: 133944 - RNA, 21 nt, Homo sapiens
ugcuuuggucauacuucuucc

SEQ ID NO: 133945 - RNA, 22 nt, Homo sapiens
uggcaagaacugcaauugcuuu

SEQ ID NO: 133946 - RNA, 22 nt, Homo sapiens
uggcaagagauaugugucuaua

SEQ ID NO: 133947 - RNA, 22 nt, Homo sapiens
ugucuuguagacaauguauagu

SEQ ID NO: 133948 - RNA, 22 nt, Homo sapiens
uuaggucaucgcuguccuucag

SEQ ID NO: 133949 - RNA, 23 nt, Homo sapiens
uucaucagggauauuggccugaa

SEQ ID NO: 133950 - RNA, 21 nt, Homo sapiens
uucucagaggcaggggauaaa

SEQ ID NO: 133951 - RNA, 22 nt, Homo sapiens
uugagagcugaugaaagauaaa

SEQ ID NO: 133952 - RNA, 22 nt, Homo sapiens
uugaggcaaugaggagaagcug

SEQ ID NO: 133953 - RNA, 23 nt, Homo sapiens
uugaggcauguaccaucaauauc

SEQ ID NO: 133954 - RNA, 22 nt, Homo sapiens
uugcauuuucuaggagggcaaa

SEQ ID NO: 133955 - RNA, 22 nt, Homo sapiens
uugcuuuguuacugcaguuucc

SEQ ID NO: 133956 - RNA, 17 nt, Homo sapiens
uuucucagcccucuucu

SEQ ID NO: 133957 - RNA, 22 nt, Homo sapiens
uuuguuugaagucgagacaacu

SEQ ID NO: 133958 - RNA, 22 nt, Homo sapiens
uuuugcuugugaauagccacau

SEQ ID NO: 133959 - RNA, 22 nt, Homo sapiens
aacuggcauagccagacuucuc

SEQ ID NO: 133960 - RNA, 22 nt, Homo sapiens
aaucugucaguuuuguguuaau

SEQ ID NO: 133961 - RNA, 22 nt, Homo sapiens
aaucugucuagacaaggagucu

SEQ ID NO: 133962 - RNA, 22 nt, Homo sapiens
aaucugucuuuuguuauugagg

SEQ ID NO: 133963 - RNA, 22 nt, Homo sapiens
acacaugugaaaaaaauguuac

SEQ ID NO: 133964 - RNA, 22 nt, Homo sapiens
acccaguguucaacauucacau

SEQ ID NO: 133965 - RNA, 22 nt, Homo sapiens
aguggcacaauuuugacucccc

SEQ ID NO: 133966 - RNA, 22 nt, Homo sapiens
auauuugguuaccugugggucu

SEQ ID NO: 133967 - RNA, 22 nt, Homo sapiens
aucacaggucaaaucauuauuu

SEQ ID NO: 133968 - RNA, 22 nt, Homo sapiens
augcaaacaucugaagagacau

SEQ ID NO: 133969 - RNA, 22 nt, Homo sapiens
augguagacucucgggucaugg

SEQ ID NO: 133970 - RNA, 22 nt, Homo sapiens
augucuuucauagagacccaga

SEQ ID NO: 133971 - RNA, 22 nt, Homo sapiens
auguuugguaagaauauuguua

SEQ ID NO: 133972 - RNA, 22 nt, Homo sapiens
auguuugguagugaauauggua

SEQ ID NO: 133973 - RNA, 22 nt, Homo sapiens
auugcauugugaucuucccaga

SEQ ID NO: 133974 - RNA, 22 nt, Homo sapiens
auuuggcaauuuugaagaugcc

SEQ ID NO: 133975 - RNA, 22 nt, Homo sapiens
auuuggguaaugagugcaaggg

SEQ ID NO: 133976 - RNA, 22 nt, Homo sapiens
cacaccuaccucauuauggaca

SEQ ID NO: 133977 - RNA, 22 nt, Homo sapiens
cacaccuacuagggccgugggc

SEQ ID NO: 133978 - RNA, 22 nt, Homo sapiens
cacauguucaggagcacuuaga

SEQ ID NO: 133979 - RNA, 22 nt, Homo sapiens
cacauguuugcuacauuuuucu

SEQ ID NO: 133980 - RNA, 22 nt, Homo sapiens
cugaggcacggcgaccuuaagu

SEQ ID NO: 133981 - RNA, 22 nt, Homo sapiens
cuucucagugcucaucuuauuu

SEQ ID NO: 133982 - RNA, 22 nt, Homo sapiens
ugcuuugguagaaaucuuuggu

SEQ ID NO: 133983 - RNA, 22 nt, Homo sapiens
uggauagaaauguacuguuuuc

SEQ ID NO: 133984 - RNA, 22 nt, Homo sapiens
uggcaaagugugacgugggggu

SEQ ID NO: 133985 - RNA, 22 nt, Homo sapiens
uggcaagaacaacaauuacuuu

SEQ ID NO: 133986 - RNA, 22 nt, Homo sapiens
uggcaagaaccacaguuacuuu

SEQ ID NO: 133987 - RNA, 22 nt, Homo sapiens
ugggcaaaacuaagagcugugg

SEQ ID NO: 133988 - RNA, 22 nt, Homo sapiens
uguggcaaauggucaggaagaa

SEQ ID NO: 133989 - RNA, 22 nt, Homo sapiens
uuauuugguugcugacuuggaa

SEQ ID NO: 133990 - RNA, 22 nt, Homo sapiens
uugcugagucuuucuagguugc

SEQ ID NO: 133991 - RNA, 22 nt, Homo sapiens
uugcuuuguugucuggggaaua

SEQ ID NO: 133992 - RNA, 22 nt, Homo sapiens
uuggaaaguuguuguaguuauu

SEQ ID NO: 133993 - RNA, 22 nt, Homo sapiens
uuuuacacuguugguuggaaug

SEQ ID NO: 133994 - RNA, 22 nt, Homo sapiens
uuuuacacuucgguugugugca

SEQ ID NO: 133995 - RNA, 19 nt, Homo sapiens
uuuuggaaaugugaacagc

SEQ ID NO: 133996 - RNA, 22 nt, Homo sapiens
ucaccuugcacaguuguguggg

SEQ ID NO: 133997 - RNA, 22 nt, Homo sapiens
ucacuugguggcaaaguuuaug

SEQ ID NO: 133998 - RNA, 22 nt, Homo sapiens
ucucagagccuaggguuuuuca

SEQ ID NO: 133999 - RNA, 22 nt, Homo sapiens
ucucuagagagccugguguuca

SEQ ID NO: 134000 - RNA, 22 nt, Homo sapiens
ucuuugguaauggaugucugau

SEQ ID NO: 134001 - RNA, 22 nt, Homo sapiens
ucuuugguaggaguaggaggcc

SEQ ID NO: 134002 - RNA, 22 nt, Homo sapiens
ugagaagugauauagaaguuaa

SEQ ID NO: 134003 - RNA, 22 nt, Homo sapiens
uggcaagaaccacaauuacuuu

SEQ ID NO: 134004 - RNA, 22 nt, Homo sapiens
uggcaagagaacaacaucucuc

SEQ ID NO: 134005 - RNA, 22 nt, Homo sapiens
uggguagauaucauaguugccc

SEQ ID NO: 134006 - RNA, 22 nt, Homo sapiens
ugucucaguuucuguggguuag

SEQ ID NO: 134007 - RNA, 22 nt, Homo sapiens
uuauuugguuauuguaauuggg

SEQ ID NO: 134008 - RNA, 22 nt, Homo sapiens
uucaugucuuggcuguuagagu

SEQ ID NO: 134009 - RNA, 22 nt, Homo sapiens
uucugagguuauauucucucaa

SEQ ID NO: 134010 - RNA, 22 nt, Homo sapiens
uugcuacuuggauguacaugug

SEQ ID NO: 134011 - RNA, 22 nt, Homo sapiens
uuggaaagagguguuuaugacu

SEQ ID NO: 134012 - RNA, 20 nt, Homo sapiens
uuggugaccuacagaugugg

SEQ ID NO: 134013 - RNA, 22 nt, Homo sapiens
uugugcuuaaugaguguaaggu

SEQ ID NO: 134014 - RNA, 22 nt, Homo sapiens
uuucucaguguuucaggguagg

SEQ ID NO: 134015 - RNA, 22 nt, Homo sapiens
uuuggcagaaaacaagaaucug

SEQ ID NO: 134016 - RNA, 22 nt, Homo sapiens
uuuuagcaaagagacugguggc

SEQ ID NO: 134017 - RNA, 22 nt, Homo sapiens
uuuuggcacuuugucugauucu

SEQ ID NO: 134018 - RNA, 22 nt, Homo sapiens
ucacuuggccgcagccuucucu

SEQ ID NO: 134019 - RNA, 22 nt, Homo sapiens
ucacuuggugaacacauuaugu

SEQ ID NO: 134020 - RNA, 22 nt, Homo sapiens
ucacuuuguuuuuggauaaguu

SEQ ID NO: 134021 - RNA, 22 nt, Homo sapiens
ucagguugcuaaguauaauauu

SEQ ID NO: 134022 - RNA, 22 nt, Homo sapiens
ucauucuuucuguggaggggcu

SEQ ID NO: 134023 - RNA, 22 nt, Homo sapiens
ucucauagaggcagagaguaaa

SEQ ID NO: 134024 - RNA, 22 nt, Homo sapiens
ucucuuggcggaaguugcagug

SEQ ID NO: 134025 - RNA, 22 nt, Homo sapiens
ucuuuggucaucaugggaagca

SEQ ID NO: 134026 - RNA, 21 nt, Homo sapiens
ugagacaauccuggucaauau

SEQ ID NO: 134027 - RNA, 22 nt, Homo sapiens
acacagugucuguguauuuaaa

SEQ ID NO: 134028 - RNA, 22 nt, Homo sapiens
aggcaagagugacuacgugaaa

SEQ ID NO: 134029 - RNA, 22 nt, Homo sapiens
auugacacugauuuuucuuuaa

SEQ ID NO: 134030 - RNA, 22 nt, Homo sapiens
auuuggcaguauaaugcuuugg

SEQ ID NO: 134031 - RNA, 22 nt, Homo sapiens
auuuggcauagaguaucauucu

SEQ ID NO: 134032 - RNA, 22 nt, Homo sapiens
caaagcacuuggcuuggaagau

SEQ ID NO: 134033 - RNA, 22 nt, Homo sapiens
cacaaugucuaagauguuucua

SEQ ID NO: 134034 - RNA, 22 nt, Homo sapiens
cauuacacuuguaagguuuuuc

SEQ ID NO: 134035 - RNA, 22 nt, Homo sapiens
ccacaguugaaauuuugacugu

SEQ ID NO: 134036 - RNA, 20 nt, Homo sapiens
ccaguguuauuuauguucua

SEQ ID NO: 134037 - RNA, 22 nt, Homo sapiens
cucagugaagggcaagaggcaa

SEQ ID NO: 134038 - RNA, 22 nt, Homo sapiens
cugcauuugaugacguauggug

SEQ ID NO: 134039 - RNA, 22 nt, Homo sapiens
gacauguuuucaagauuuauaa

SEQ ID NO: 134040 - RNA, 22 nt, Homo sapiens
gagaacagaagcauuccuaauu

SEQ ID NO: 134041 - RNA, 22 nt, Homo sapiens
gaggaaguuuacaaagcaucug

SEQ ID NO: 134042 - RNA, 21 nt, Homo sapiens
gcaaaguggcuaccuugcucc

SEQ ID NO: 134043 - RNA, 22 nt, Homo sapiens
gcacaguguuacuugauauauu

SEQ ID NO: 134044 - RNA, 22 nt, Homo sapiens
ggucagaaagacaggcauucag

SEQ ID NO: 134045 - RNA, 22 nt, Homo sapiens
guauuugguuauugcagccuga

SEQ ID NO: 134046 - RNA, 22 nt, Homo sapiens
guauuuuguuagggugugguau

SEQ ID NO: 134047 - RNA, 22 nt, Homo sapiens
gucauguuuaacuucuugagga

SEQ ID NO: 134048 - RNA, 22 nt, Homo sapiens
uaagugguguucauucuuuuga

SEQ ID NO: 134049 - RNA, 22 nt, Homo sapiens
uacccaguaacaaguauuuugg

SEQ ID NO: 134050 - RNA, 22 nt, Homo sapiens
uaggacacagaccuggauggaa

SEQ ID NO: 134051 - RNA, 22 nt, Homo sapiens
uauuugguuauaugaguaaguu

SEQ ID NO: 134052 - RNA, 22 nt, Homo sapiens
ucaaagugagcuccuucucacu

SEQ ID NO: 134053 - RNA, 22 nt, Homo sapiens
aagcugguuuuauaucugugag

SEQ ID NO: 134054 - RNA, 23 nt, Homo sapiens
aaucugucuuuguuauagggguc

SEQ ID NO: 134055 - RNA, 22 nt, Homo sapiens
acuuuuugcaaccauuuggacc

SEQ ID NO: 134056 - RNA, 22 nt, Homo sapiens
agcucuuguuaguauuagcagu

SEQ ID NO: 134057 - RNA, 22 nt, Homo sapiens
aguugcaagucuugaguaaaga

SEQ ID NO: 134058 - RNA, 22 nt, Homo sapiens
auacccaguaguggaauugcua

SEQ ID NO: 134059 - RNA, 22 nt, Homo sapiens
auuuggcaacguagggaggcau

SEQ ID NO: 134060 - RNA, 20 nt, Homo sapiens
auuuggcauaguuuaagcaa

SEQ ID NO: 134061 - RNA, 22 nt, Homo sapiens
auuuggguuuuacaucaggcua

SEQ ID NO: 134062 - RNA, 22 nt, Homo sapiens
ccaaaucucauguugaaaugug

SEQ ID NO: 134063 - RNA, 22 nt, Homo sapiens
cugaaagguauacgcuuguuau

SEQ ID NO: 134064 - RNA, 22 nt, Homo sapiens
cuugggcagugugcauguguau

SEQ ID NO: 134065 - RNA, 22 nt, Homo sapiens
cuuuacacauccuaaccagugu

SEQ ID NO: 134066 - RNA, 20 nt, Homo sapiens
cuuuggcaaugagaacaggg

SEQ ID NO: 134067 - RNA, 22 nt, Homo sapiens
gacacuggguguuuguuggcgu

SEQ ID NO: 134068 - RNA, 22 nt, Homo sapiens
gagaacagagauaauuuuacuu

SEQ ID NO: 134069 - RNA, 22 nt, Homo sapiens
gcuuuggauaaaugucaguuua

SEQ ID NO: 134070 - RNA, 22 nt, Homo sapiens
ggagggugagaucaauuuggga

SEQ ID NO: 134071 - RNA, 22 nt, Homo sapiens
ggcucuguugcuaccaauuaag

SEQ ID NO: 134072 - RNA, 22 nt, Homo sapiens
gggcauguggacuuguauguuu

SEQ ID NO: 134073 - RNA, 22 nt, Homo sapiens
guacaggugcaggaugggcagg

SEQ ID NO: 134074 - RNA, 22 nt, Homo sapiens
guuauguuaaauuguuguaugc

SEQ ID NO: 134075 - RNA, 22 nt, Homo sapiens
guuguauaggcauggggagaau

SEQ ID NO: 134076 - RNA, 22 nt, Homo sapiens
guuugcacuccuaugagaaucu

SEQ ID NO: 134077 - RNA, 19 nt, Homo sapiens
uaacacaguuguguuugag

SEQ ID NO: 134078 - RNA, 22 nt, Homo sapiens
uaacaccuuugauagcacuuuu

SEQ ID NO: 134079 - RNA, 22 nt, Homo sapiens
uaaggcaaucagucaugguguu

SEQ ID NO: 134080 - RNA, 21 nt, Homo sapiens
ucaccuguagcugcauguucu

SEQ ID NO: 134081 - RNA, 22 nt, Homo sapiens
ucuuugguauugugaauagugu

SEQ ID NO: 134082 - RNA, 22 nt, Homo sapiens
ucuuugguugcacugcaggugu

SEQ ID NO: 134083 - RNA, 22 nt, Homo sapiens
ugagacaaaguuguuggauguu

SEQ ID NO: 134084 - RNA, 22 nt, Homo sapiens
ugagacaaucucaucucaguga

SEQ ID NO: 134085 - RNA, 18 nt, Homo sapiens
ugagaucagcaucaaggg

SEQ ID NO: 134086 - RNA, 22 nt, Homo sapiens
ugaggcaagauacugauuucau

SEQ ID NO: 134087 - RNA, 22 nt, Homo sapiens
uggcaagaccccaucucuacaa

SEQ ID NO: 134088 - RNA, 19 nt, Homo sapiens
uuacacaaccuaguggggc

SEQ ID NO: 134089 - RNA, 22 nt, Homo sapiens
uuauacacugugggaguguaaa

SEQ ID NO: 134090 - RNA, 22 nt, Homo sapiens
uucagguucauuugcugcuauu

SEQ ID NO: 134091 - RNA, 22 nt, Homo sapiens
uucuagagagaagacuuaagcu

SEQ ID NO: 134092 - RNA, 16 nt, Homo sapiens
uugaggcaugucucag

SEQ ID NO: 134093 - RNA, 22 nt, Homo sapiens
uuguauguuuguucuuucagau

SEQ ID NO: 134094 - RNA, 22 nt, Homo sapiens
uuuagguagucaaagguuaguc

SEQ ID NO: 134095 - RNA, 22 nt, Homo sapiens
uuuuacacaucaccgcucgugu

SEQ ID NO: 134096 - RNA, 18 nt, Homo sapiens
uuuugcuuaacugcgcca

SEQ ID NO: 134097 - RNA, 22 nt, Homo sapiens
aaagggcuguuucuugacuugg

SEQ ID NO: 134098 - RNA, 22 nt, Homo sapiens
aaagucuguuuugucagagacu

SEQ ID NO: 134099 - RNA, 22 nt, Homo sapiens
aaaguggacuaagugaauauga

SEQ ID NO: 134100 - RNA, 22 nt, Homo sapiens
aaggcucuuucaacguaaauua

SEQ ID NO: 134101 - RNA, 22 nt, Homo sapiens
aagucaugaagaggaaaggaca

SEQ ID NO: 134102 - RNA, 22 nt, Homo sapiens
agagguaugccugggcuggagc

SEQ ID NO: 134103 - RNA, 23 nt, Homo sapiens
agccugguuucccugcuucuccc

SEQ ID NO: 134104 - RNA, 22 nt, Homo sapiens
augaggcacugcgcccuacuga

SEQ ID NO: 134105 - RNA, 22 nt, Homo sapiens
augaggcaggaaaggcguaucu

SEQ ID NO: 134106 - RNA, 22 nt, Homo sapiens
auucaagugaugcagcuguuuu

SEQ ID NO: 134107 - RNA, 22 nt, Homo sapiens
auugcauuuucagguuggucug

SEQ ID NO: 134108 - RNA, 22 nt, Homo sapiens
auuuggcagugaagggaucaca

SEQ ID NO: 134109 - RNA, 22 nt, Homo sapiens
cacagggcuaacauuuuugccc

SEQ ID NO: 134110 - RNA, 22 nt, Homo sapiens
cuauuugguuggugaaaaaagu

SEQ ID NO: 134111 - RNA, 22 nt, Homo sapiens
cuuccaaguggggcacgugcca

SEQ ID NO: 134112 - RNA, 22 nt, Homo sapiens
cuuuggcacuuccuaagugcca

SEQ ID NO: 134113 - RNA, 22 nt, Homo sapiens
cuuuggcauuagccuguauaga

SEQ ID NO: 134114 - RNA, 21 nt, Homo sapiens
cuuugguagaguuuuuagggu

SEQ ID NO: 134115 - RNA, 22 nt, Homo sapiens
gagaacaguguuguauuuuuuc

SEQ ID NO: 134116 - RNA, 20 nt, Homo sapiens
ggaauguuaaucuccaugau

SEQ ID NO: 134117 - RNA, 22 nt, Homo sapiens
ggcaagaggagauucugcuccc

SEQ ID NO: 134118 - RNA, 17 nt, Homo sapiens
ggcaggauccaggaucc

SEQ ID NO: 134119 - RNA, 22 nt, Homo sapiens
ggcauguuuaguagaauguggu

SEQ ID NO: 134120 - RNA, 21 nt, Homo sapiens
ggcucuguggucucagguuuc

SEQ ID NO: 134121 - RNA, 22 nt, Homo sapiens
ggggcaaaaugccacgagucuc

SEQ ID NO: 134122 - RNA, 19 nt, Homo sapiens
guauuugguaaacucucca

SEQ ID NO: 134123 - RNA, 20 nt, Homo sapiens
uacacguguagcauucucua

SEQ ID NO: 134124 - RNA, 22 nt, Homo sapiens
uacucaguagucuguugcuguc

SEQ ID NO: 134125 - RNA, 22 nt, Homo sapiens
uaggaaguuuucuugcugggcc

SEQ ID NO: 134126 - RNA, 22 nt, Homo sapiens
ugguccucugcuuccagaauuc

SEQ ID NO: 134127 - RNA, 22 nt, Homo sapiens
uggugcaaugaagugaucucaa

SEQ ID NO: 134128 - RNA, 15 nt, Homo sapiens
uggugguguugagac

SEQ ID NO: 134129 - RNA, 21 nt, Homo sapiens
ugguucaguucguuacgugug

SEQ ID NO: 134130 - RNA, 22 nt, Homo sapiens
ugguuguuuuaaaugucgucug

SEQ ID NO: 134131 - RNA, 23 nt, Homo sapiens
ugguuuguaagagauggacugga

SEQ ID NO: 134132 - RNA, 18 nt, Homo sapiens
uguaaacuaccucaaccu

SEQ ID NO: 134133 - RNA, 22 nt, Homo sapiens
uguaacugcuuagaagguuuua

SEQ ID NO: 134134 - RNA, 22 nt, Homo sapiens
uguacuagaaauuaaggcaggg

SEQ ID NO: 134135 - RNA, 22 nt, Homo sapiens
uguagguguacauacaugguua

SEQ ID NO: 134136 - RNA, 22 nt, Homo sapiens
uguauauguuuguacauauguc

SEQ ID NO: 134137 - RNA, 22 nt, Homo sapiens
uguauguugauguuauauucug

SEQ ID NO: 134138 - RNA, 22 nt, Homo sapiens
ugucacagagauuuugguaugu

SEQ ID NO: 134139 - RNA, 22 nt, Homo sapiens
ugucacaguuuguacuuuauag

SEQ ID NO: 134140 - RNA, 18 nt, Homo sapiens
ugucacuggauaaugguc

SEQ ID NO: 134141 - RNA, 22 nt, Homo sapiens
ugucaggagcaaugauaaauuu

SEQ ID NO: 134142 - RNA, 22 nt, Homo sapiens
uguccaaaucagagguaccaaa

SEQ ID NO: 134143 - RNA, 22 nt, Homo sapiens
ugucuggaaggguggccuccug

SEQ ID NO: 134144 - RNA, 22 nt, Homo sapiens
ugugacaguguuacauuucaug

SEQ ID NO: 134145 - RNA, 19 nt, Homo sapiens
ugugagcauuagcauuuag

SEQ ID NO: 134146 - RNA, 22 nt, Homo sapiens
ugugaugguuuggaagcuucuu

SEQ ID NO: 134147 - RNA, 22 nt, Homo sapiens
ugugauuauuuaaauaggacag

SEQ ID NO: 134148 - RNA, 22 nt, Homo sapiens
ugugcacaugauauaucacaua

SEQ ID NO: 134149 - RNA, 22 nt, Homo sapiens
ugugccaaaucccauaauaaau

SEQ ID NO: 134150 - RNA, 22 nt, Homo sapiens
ugugccacuccaaccuggguga

SEQ ID NO: 134151 - RNA, 21 nt, Homo sapiens
uguggcaauggccucacagau

SEQ ID NO: 134152 - RNA, 22 nt, Homo sapiens
uguggcucuucuguucuccacu

SEQ ID NO: 134153 - RNA, 18 nt, Homo sapiens
uguggcuguuuuccaaua

SEQ ID NO: 134154 - RNA, 22 nt, Homo sapiens
uguggcuuuguaaccauggguc

SEQ ID NO: 134155 - RNA, 22 nt, Homo sapiens
ugugggaggugcuaauguaaau

SEQ ID NO: 134156 - RNA, 22 nt, Homo sapiens
ugugguuuuucacauuuagaga

SEQ ID NO: 134157 - RNA, 22 nt, Homo sapiens
uguguaauacucuaaugaugca

SEQ ID NO: 134158 - RNA, 22 nt, Homo sapiens
uguuauuuuguguuagggcaca

SEQ ID NO: 134159 - RNA, 22 nt, Homo sapiens
uguucacaguguuucuuugaga

SEQ ID NO: 134160 - RNA, 22 nt, Homo sapiens
uguuuaguuaagacauagaauu

SEQ ID NO: 134161 - RNA, 22 nt, Homo sapiens
uguuuguuugagauggagucuc

SEQ ID NO: 134162 - RNA, 21 nt, Homo sapiens
uguuuuugcuguguaucucuc

SEQ ID NO: 134163 - RNA, 22 nt, Homo sapiens
uuaaacugcuugaauuggguuu

SEQ ID NO: 134164 - RNA, 20 nt, Homo sapiens
uuaaaucuagugcagacuca

SEQ ID NO: 134165 - RNA, 22 nt, Homo sapiens
uuaaaugucuguagaugugcug

SEQ ID NO: 134166 - RNA, 22 nt, Homo sapiens
uuaaucucaggaguuugggacc

SEQ ID NO: 134167 - RNA, 22 nt, Homo sapiens
uuaauggagaguuucauuggug

SEQ ID NO: 134168 - RNA, 22 nt, Homo sapiens
uuacaagaugucuguccaacac

SEQ ID NO: 134169 - RNA, 22 nt, Homo sapiens
uuacagauggcacacucaaggg

SEQ ID NO: 134170 - RNA, 22 nt, Homo sapiens
uuacagguggagaaguaaggcu

SEQ ID NO: 134171 - RNA, 22 nt, Homo sapiens
uuacaguagaugaggguauaau

SEQ ID NO: 134172 - RNA, 22 nt, Homo sapiens
uuacaguauugcaaggacuagg

SEQ ID NO: 134173 - RNA, 22 nt, Homo sapiens
uuacaguugugagccaccaugc

SEQ ID NO: 134174 - RNA, 22 nt, Homo sapiens
uuaccagagaagacgaggggga

SEQ ID NO: 134175 - RNA, 22 nt, Homo sapiens
uuacugcucuuuugucaugagu

SEQ ID NO: 134176 - RNA, 22 nt, Homo sapiens
uuagcagugugagcacagacua

SEQ ID NO: 134177 - RNA, 21 nt, Homo sapiens
uuagcauccauguucaucaac

SEQ ID NO: 134178 - RNA, 22 nt, Homo sapiens
uuaggacaauguucguuuuuug

SEQ ID NO: 134179 - RNA, 21 nt, Homo sapiens
uuaggcagugucagaggugag

SEQ ID NO: 134180 - RNA, 22 nt, Homo sapiens
uuaggugguacacagccccagu

SEQ ID NO: 134181 - RNA, 22 nt, Homo sapiens
uuaguaguuugauaggaauagc

SEQ ID NO: 134182 - RNA, 22 nt, Homo sapiens
uuagugaaugggugugauuugu

SEQ ID NO: 134183 - RNA, 22 nt, Homo sapiens
uuauauguuucuuagggacaga

SEQ ID NO: 134184 - RNA, 22 nt, Homo sapiens
uuaucagcagugcgaaaacaga

SEQ ID NO: 134185 - RNA, 22 nt, Homo sapiens
uuaucucaguguuuguaaacaa

SEQ ID NO: 134186 - RNA, 22 nt, Homo sapiens
uuaugacuuucagcuaggggau

SEQ ID NO: 134187 - RNA, 23 nt, Homo sapiens
uucaaauguucucugguugucag

SEQ ID NO: 134188 - RNA, 22 nt, Homo sapiens
uucaaggacuaaggauuuuugg

SEQ ID NO: 134189 - RNA, 22 nt, Homo sapiens
uucaagucuuggcuuugccacc

SEQ ID NO: 134190 - RNA, 20 nt, Homo sapiens
uucaagugauucucaugccu

SEQ ID NO: 134191 - RNA, 22 nt, Homo sapiens
uucaauuaauauuauacucuca

SEQ ID NO: 134192 - RNA, 22 nt, Homo sapiens
uucacaaugccuuguugauggu

SEQ ID NO: 134193 - RNA, 22 nt, Homo sapiens
uucacagccgcaccccaucacu

SEQ ID NO: 134194 - RNA, 22 nt, Homo sapiens
uucacaguacucccuggaauua

SEQ ID NO: 134195 - RNA, 22 nt, Homo sapiens
uucacagugugaucuaugggca

SEQ ID NO: 134196 - RNA, 22 nt, Homo sapiens
uucaccuugggucccacuugcu

SEQ ID NO: 134197 - RNA, 22 nt, Homo sapiens
uucagagagggagggauaccua

SEQ ID NO: 134198 - RNA, 19 nt, Homo sapiens
uucagcagugucugcucuu

SEQ ID NO: 134199 - RNA, 22 nt, Homo sapiens
uucagcuacuuggaaacagcaa

SEQ ID NO: 134200 - RNA, 22 nt, Homo sapiens
uucaguaaauguucuuacuaua

SEQ ID NO: 134201 - RNA, 23 nt, Homo sapiens
uucaguauugaaugauggcgcug

SEQ ID NO: 134202 - RNA, 22 nt, Homo sapiens
uucaucagggagaaauaauuuc

SEQ ID NO: 134203 - RNA, 23 nt, Homo sapiens
uucaucagggauauuggccugaa

SEQ ID NO: 134204 - RNA, 18 nt, Homo sapiens
uucaucaguccucagcug

SEQ ID NO: 134205 - RNA, 22 nt, Homo sapiens
uucaucaguuauauuggccuga

SEQ ID NO: 134206 - RNA, 22 nt, Homo sapiens
uucaucaguugagcugguugcu

SEQ ID NO: 134207 - RNA, 22 nt, Homo sapiens
uucauggguuaauuuguucgau

SEQ ID NO: 134208 - RNA, 22 nt, Homo sapiens
uucaugucuuggcuguuagagu

SEQ ID NO: 134209 - RNA, 22 nt, Homo sapiens
uuccacagggauuugcauugau

SEQ ID NO: 134210 - RNA, 22 nt, Homo sapiens
uuccacuuuuuccuugugcucc

SEQ ID NO: 134211 - RNA, 22 nt, Homo sapiens
uuccaguaauagcacagcauug

SEQ ID NO: 134212 - RNA, 22 nt, Homo sapiens
uuccauguugauacgugaaguu

SEQ ID NO: 134213 - RNA, 22 nt, Homo sapiens
uucccugugggaguaggaaagu

SEQ ID NO: 134214 - RNA, 22 nt, Homo sapiens
uucccugugggcuggugcucca

SEQ ID NO: 134215 - RNA, 22 nt, Homo sapiens
uucuaaacaucuuacaaugcau

SEQ ID NO: 134216 - RNA, 20 nt, Homo sapiens
uucuacagucacaggaagau

SEQ ID NO: 134217 - RNA, 22 nt, Homo sapiens
uucucaaggagccuucguaacu

SEQ ID NO: 134218 - RNA, 22 nt, Homo sapiens
uucucacaguacagggagcucu

SEQ ID NO: 134219 - RNA, 23 nt, Homo sapiens
uucugccacugaaaaugccucag

SEQ ID NO: 134220 - RNA, 22 nt, Homo sapiens
uucuggcucaggucaacacuuc

SEQ ID NO: 134221 - RNA, 22 nt, Homo sapiens
uucuggcuuauaaacgugacuu

SEQ ID NO: 134222 - RNA, 22 nt, Homo sapiens
agugccaaaucgagggcucuga

SEQ ID NO: 134223 - RNA, 22 nt, Homo sapiens
aguggauguuguggccugggag

SEQ ID NO: 134224 - RNA, 22 nt, Homo sapiens
aguggcuuuuuaguggcagaug

SEQ ID NO: 134225 - RNA, 22 nt, Homo sapiens
agugguuugaucacagcucacu

SEQ ID NO: 134226 - RNA, 22 nt, Homo sapiens
agugucaggagacagguagcug

SEQ ID NO: 134227 - RNA, 22 nt, Homo sapiens
aguguuuuuacaagcacucugg

SEQ ID NO: 134228 - RNA, 17 nt, Homo sapiens
auaaacucaucauuuuu

SEQ ID NO: 134229 - RNA, 22 nt, Homo sapiens
auaaaugcaaugguauuuuuga

SEQ ID NO: 134230 - RNA, 22 nt, Homo sapiens
auaagguuagcucugagaaagu

SEQ ID NO: 134231 - RNA, 22 nt, Homo sapiens
auaaguagaaugauggucaaaa

SEQ ID NO: 134232 - RNA, 22 nt, Homo sapiens
auaagucaauggaacagauuaa

SEQ ID NO: 134233 - RNA, 22 nt, Homo sapiens
auacaguugccauuucuugugc

SEQ ID NO: 134234 - RNA, 22 nt, Homo sapiens
auacugguuuuugucaugugga

SEQ ID NO: 134235 - RNA, 22 nt, Homo sapiens
auacuguuucugaacuuugauu

SEQ ID NO: 134236 - RNA, 22 nt, Homo sapiens
auagaucauugucauuuuagau

SEQ ID NO: 134237 - RNA, 22 nt, Homo sapiens
auagcaaugccccaauccuugg

SEQ ID NO: 134238 - RNA, 22 nt, Homo sapiens
auagggcacgagaugugagccu

SEQ ID NO: 134239 - RNA, 22 nt, Homo sapiens
auauagcaaugaaagagaugaa

SEQ ID NO: 134240 - RNA, 22 nt, Homo sapiens
auaucacaaacaagucuguacu

SEQ ID NO: 134241 - RNA, 22 nt, Homo sapiens
auaucacagguguuuaccugau

SEQ ID NO: 134242 - RNA, 22 nt, Homo sapiens
auaucacucccaauaucgcagg

SEQ ID NO: 134243 - RNA, 22 nt, Homo sapiens
auauguaguauggaaacauugu

SEQ ID NO: 134244 - RNA, 22 nt, Homo sapiens
auaugucuauuauuagggcagg

SEQ ID NO: 134245 - RNA, 22 nt, Homo sapiens
auauucacuauaugcagaacca

SEQ ID NO: 134246 - RNA, 22 nt, Homo sapiens
auauuggacucugugcuaggaa

SEQ ID NO: 134247 - RNA, 19 nt, Homo sapiens
aucaaacugcucuuugagg

SEQ ID NO: 134248 - RNA, 22 nt, Homo sapiens
aucaaaguaucucaauauggua

SEQ ID NO: 134249 - RNA, 22 nt, Homo sapiens
aucaaaugcuggcagagugccu

SEQ ID NO: 134250 - RNA, 22 nt, Homo sapiens
aucacauggccagguaguaauc

SEQ ID NO: 134251 - RNA, 23 nt, Homo sapiens
aucagauaguuguagguaugugg

SEQ ID NO: 134252 - RNA, 22 nt, Homo sapiens
aucauauccuagauauaacuuc

SEQ ID NO: 134253 - RNA, 22 nt, Homo sapiens
auccacaugcaguuggaaacag

SEQ ID NO: 134254 - RNA, 22 nt, Homo sapiens
auccaucagacggcaggcguug

SEQ ID NO: 134255 - RNA, 22 nt, Homo sapiens
aucccaguaaaaauggcuucua

SEQ ID NO: 134256 - RNA, 22 nt, Homo sapiens
aucccuguaguaauauucuagc

SEQ ID NO: 134257 - RNA, 22 nt, Homo sapiens
auccuguacuaagguuuuccca

SEQ ID NO: 134258 - RNA, 22 nt, Homo sapiens
aucuaaaucucauaugggcaca

SEQ ID NO: 134259 - RNA, 22 nt, Homo sapiens
aucucauggagguagagaguaa

SEQ ID NO: 134260 - RNA, 22 nt, Homo sapiens
aucuccaggugccagcugcgcc

SEQ ID NO: 134261 - RNA, 20 nt, Homo sapiens
aucucugggcaaaggaaaau

SEQ ID NO: 134262 - RNA, 22 nt, Homo sapiens
aucuuuggcgggaauaucacag

SEQ ID NO: 134263 - RNA, 22 nt, Homo sapiens
aucuuuggucaucacagcuaga

SEQ ID NO: 134264 - RNA, 22 nt, Homo sapiens
augaaaagcauaaacgcugaag

SEQ ID NO: 134265 - RNA, 23 nt, Homo sapiens
augaaagcccuugcaaaugcugg

SEQ ID NO: 134266 - RNA, 22 nt, Homo sapiens
augaaagguauguuuucuguga

SEQ ID NO: 134267 - RNA, 22 nt, Homo sapiens
augaaaucuuuccugugaggau

SEQ ID NO: 134268 - RNA, 22 nt, Homo sapiens
augaaaucuuuggcagaucuua

SEQ ID NO: 134269 - RNA, 22 nt, Homo sapiens
augacaagagccuucuuuccuu

SEQ ID NO: 134270 - RNA, 22 nt, Homo sapiens
augacagagauaugugaauuuu

SEQ ID NO: 134271 - RNA, 22 nt, Homo sapiens
augacaguaugacuccaaaagu

SEQ ID NO: 134272 - RNA, 22 nt, Homo sapiens
augaccauuucaauugauaugg

SEQ ID NO: 134273 - RNA, 22 nt, Homo sapiens
augaccuuggggaaccaugucu

SEQ ID NO: 134274 - RNA, 22 nt, Homo sapiens
augacuagaggagggauggcca

SEQ ID NO: 134275 - RNA, 22 nt, Homo sapiens
augacuuuucugaaaaccacca

SEQ ID NO: 134276 - RNA, 22 nt, Homo sapiens
augagauacuacaaaugaguuu

SEQ ID NO: 134277 - RNA, 22 nt, Homo sapiens
augagauauguuaaaaguuaaa

SEQ ID NO: 134278 - RNA, 22 nt, Homo sapiens
augaggcaggaaaggcguaucu

SEQ ID NO: 134279 - RNA, 22 nt, Homo sapiens
augauaaguuauuagaagaaga

SEQ ID NO: 134280 - RNA, 22 nt, Homo sapiens
augauacuggcuucauagaaug

SEQ ID NO: 134281 - RNA, 22 nt, Homo sapiens
augaucacaccacugcacucca

SEQ ID NO: 134282 - RNA, 19 nt, Homo sapiens
augauugucuauggaggaa

SEQ ID NO: 134283 - RNA, 22 nt, Homo sapiens
augauuuuuguaucgccugaug

SEQ ID NO: 134284 - RNA, 20 nt, Homo sapiens
augcaaacccugcuuugugg

SEQ ID NO: 134285 - RNA, 22 nt, Homo sapiens
augcacauggcuaacuuuuuuc

SEQ ID NO: 134286 - RNA, 22 nt, Homo sapiens
augcuacugauaagcaaucauu

SEQ ID NO: 134287 - RNA, 22 nt, Homo sapiens
augcuacuggauuuguauaaau

SEQ ID NO: 134288 - RNA, 21 nt, Homo sapiens
auggaaagacugccucuucaa

SEQ ID NO: 134289 - RNA, 22 nt, Homo sapiens
auggaaggagaggaaugaauga

SEQ ID NO: 134290 - RNA, 22 nt, Homo sapiens
auggaaugccauuuauaaugga

SEQ ID NO: 134291 - RNA, 22 nt, Homo sapiens
auggaaugguugggucauaagg

SEQ ID NO: 134292 - RNA, 22 nt, Homo sapiens
auggagaugugcgaacugagua

SEQ ID NO: 134293 - RNA, 22 nt, Homo sapiens
auggauugucuccuugugccau

SEQ ID NO: 134294 - RNA, 22 nt, Homo sapiens
auggcaaaaaaugcaauuacuu

SEQ ID NO: 134295 - RNA, 22 nt, Homo sapiens
auggcaaugcgaugaugacuga

SEQ ID NO: 134296 - RNA, 22 nt, Homo sapiens
auggcacuuuggacugcuagau

SEQ ID NO: 134297 - RNA, 22 nt, Homo sapiens
auggcaucgucaccuuuucagu

SEQ ID NO: 134298 - RNA, 22 nt, Homo sapiens
auggcauugaagaguugucccu

SEQ ID NO: 134299 - RNA, 22 nt, Homo sapiens
auggcuuuuauuguguugaggu

SEQ ID NO: 134300 - RNA, 22 nt, Homo sapiens
auggcuuuuuaaaucauguugu

SEQ ID NO: 134301 - RNA, 22 nt, Homo sapiens
augggacugggugccguggagc

SEQ ID NO: 134302 - RNA, 22 nt, Homo sapiens
augggagugugguuagagaccu

SEQ ID NO: 134303 - RNA, 22 nt, Homo sapiens
augguacuagaguaagaauugu

SEQ ID NO: 134304 - RNA, 17 nt, Homo sapiens
auguaauccucaucucu

SEQ ID NO: 134305 - RNA, 20 nt, Homo sapiens
auguaauguaugauauguac

SEQ ID NO: 134306 - RNA, 22 nt, Homo sapiens
auguaauguuaaauugcuaauu

SEQ ID NO: 134307 - RNA, 22 nt, Homo sapiens
auguaguagauauuuauggaaa

SEQ ID NO: 134308 - RNA, 22 nt, Homo sapiens
auguccaugagcacauguauca

SEQ ID NO: 134309 - RNA, 22 nt, Homo sapiens
auguccauggaaucuguagcaa

SEQ ID NO: 134310 - RNA, 22 nt, Homo sapiens
augucuuucauagagacccaga

SEQ ID NO: 134311 - RNA, 21 nt, Homo sapiens
augugcacuaugucauuuaau

SEQ ID NO: 134312 - RNA, 22 nt, Homo sapiens
augugcagauguuacaaauugu

SEQ ID NO: 134313 - RNA, 22 nt, Homo sapiens
augugguaguuauagugauaag

SEQ ID NO: 134314 - RNA, 22 nt, Homo sapiens
auuaacaucuagaguuuuggug

SEQ ID NO: 134315 - RNA, 22 nt, Homo sapiens
auuaagugcuugccagugcugg

SEQ ID NO: 134316 - RNA, 22 nt, Homo sapiens
auuagguuguugcaaaaguaau

SEQ ID NO: 134317 - RNA, 22 nt, Homo sapiens
auuauaugucaucacagacacc

SEQ ID NO: 134318 - RNA, 22 nt, Homo sapiens
gauuuuuggggaagccucuuau

SEQ ID NO: 134319 - RNA, 22 nt, Homo sapiens
gcaaaguguuuuccaacuuggu

SEQ ID NO: 134320 - RNA, 23 nt, Homo sapiens
gcaaauaucguagagugucccug

SEQ ID NO: 134321 - RNA, 22 nt, Homo sapiens
gcaagaugagagcccgggcagu

SEQ ID NO: 134322 - RNA, 22 nt, Homo sapiens
gcaccaugguagaauaauggua

SEQ ID NO: 134323 - RNA, 22 nt, Homo sapiens
gcagaauugacucuguuuuuuc

SEQ ID NO: 134324 - RNA, 22 nt, Homo sapiens
gcagaucuucgcgguaaguguu

SEQ ID NO: 134325 - RNA, 23 nt, Homo sapiens
gcagcaaugucacagggguccgg

SEQ ID NO: 134326 - RNA, 22 nt, Homo sapiens
gcagcagugugggcugaaccua

SEQ ID NO: 134327 - RNA, 22 nt, Homo sapiens
gcagugaugugaucauagcuca

SEQ ID NO: 134328 - RNA, 22 nt, Homo sapiens
gcaguguugugauccaggucuu

SEQ ID NO: 134329 - RNA, 22 nt, Homo sapiens
gcauauuuuaaaguguaaccug

SEQ ID NO: 134330 - RNA, 22 nt, Homo sapiens
gcauggagcauacauuucuguu

SEQ ID NO: 134331 - RNA, 22 nt, Homo sapiens
gccagugugaugugaucauggc

SEQ ID NO: 134332 - RNA, 21 nt, Homo sapiens
gccaguguggcaauuuuucaa

SEQ ID NO: 134333 - RNA, 22 nt, Homo sapiens
gccaguguguguuguucuccgc

SEQ ID NO: 134334 - RNA, 22 nt, Homo sapiens
gccccugagacuugccucgggc

SEQ ID NO: 134335 - RNA, 22 nt, Homo sapiens
gcuaggagauccacugcucucu

SEQ ID NO: 134336 - RNA, 22 nt, Homo sapiens
gcugacacugggcuauagaucu

SEQ ID NO: 134337 - RNA, 22 nt, Homo sapiens
gcugagcuaugccauauaugcc

SEQ ID NO: 134338 - RNA, 22 nt, Homo sapiens
gcugcuguuuaguuucuccugg

SEQ ID NO: 134339 - RNA, 22 nt, Homo sapiens
gcuggaauuaacauagaugugc

SEQ ID NO: 134340 - RNA, 22 nt, Homo sapiens
gcuguuugccgccaucgcagac

SEQ ID NO: 134341 - RNA, 22 nt, Homo sapiens
ggaaauguuggugucaugaguu

SEQ ID NO: 134342 - RNA, 22 nt, Homo sapiens
ggaagaauaaugggccuuagag

SEQ ID NO: 134343 - RNA, 22 nt, Homo sapiens
ggagaucuuuguuaucuuuuga

SEQ ID NO: 134344 - RNA, 22 nt, Homo sapiens
ggagcucaucuagcauagaggu

SEQ ID NO: 134345 - RNA, 22 nt, Homo sapiens
ggagguaauaaguuccagugua

SEQ ID NO: 134346 - RNA, 22 nt, Homo sapiens
ggaucacuugagaccaggaguu

SEQ ID NO: 134347 - RNA, 22 nt, Homo sapiens
ggcaacaugaugaaaugccauc

SEQ ID NO: 134348 - RNA, 22 nt, Homo sapiens
ggcaaggugaugaaugucuaca

SEQ ID NO: 134349 - RNA, 22 nt, Homo sapiens
ggcaaguugcuauucuuuaaug

SEQ ID NO: 134350 - RNA, 23 nt, Homo sapiens
ggcacggaauucaaagaggcauu

SEQ ID NO: 134351 - RNA, 22 nt, Homo sapiens
ggcacgguggcucacaccugua

SEQ ID NO: 134352 - RNA, 22 nt, Homo sapiens
ggcacuguggcucaagccugua

SEQ ID NO: 134353 - RNA, 22 nt, Homo sapiens
ggcagcauugccuuugcaguga

SEQ ID NO: 134354 - RNA, 22 nt, Homo sapiens
ggcaugcauuguacuaguaugc

SEQ ID NO: 134355 - RNA, 22 nt, Homo sapiens
gggagcacaagaaauguuucau

SEQ ID NO: 134356 - RNA, 22 nt, Homo sapiens
gggauguaaaagugggcacauu

SEQ ID NO: 134357 - RNA, 22 nt, Homo sapiens
gggguaggcuacacugaguucc

SEQ ID NO: 134358 - RNA, 22 nt, Homo sapiens
gggguauguaagugagugagug

SEQ ID NO: 134359 - RNA, 19 nt, Homo sapiens
gggucaguuugaaugauua

SEQ ID NO: 134360 - RNA, 19 nt, Homo sapiens
ggucagcaaagucuagcug

SEQ ID NO: 134361 - RNA, 22 nt, Homo sapiens
gguccgccugccuuggccuccc

SEQ ID NO: 134362 - RNA, 22 nt, Homo sapiens
ggugaggaaaguugaguuucua

SEQ ID NO: 134363 - RNA, 19 nt, Homo sapiens
ggugcuugaauauuccucc

SEQ ID NO: 134364 - RNA, 22 nt, Homo sapiens
guaaaucucuguuuucauggac

SEQ ID NO: 134365 - RNA, 23 nt, Homo sapiens
guaauacuagucauaguagcagg

SEQ ID NO: 134366 - RNA, 22 nt, Homo sapiens
guaaucucagcuacucgggagg

SEQ ID NO: 134367 - RNA, 22 nt, Homo sapiens
guaaucucagcuacuugggagg

SEQ ID NO: 134368 - RNA, 22 nt, Homo sapiens
guaaucuguaguaaagcaccau

SEQ ID NO: 134369 - RNA, 22 nt, Homo sapiens
guacaugcauaguuuauuucug

SEQ ID NO: 134370 - RNA, 22 nt, Homo sapiens
guagaagcacagggccuguauu

SEQ ID NO: 134371 - RNA, 22 nt, Homo sapiens
guagaggaauggcuccaccaua

SEQ ID NO: 134372 - RNA, 22 nt, Homo sapiens
guauggaagucaguuuguuggc

SEQ ID NO: 134373 - RNA, 19 nt, Homo sapiens
guauuugacuuucuuguuu

SEQ ID NO: 134374 - RNA, 22 nt, Homo sapiens
guauuugguuauugcagccuga

SEQ ID NO: 134375 - RNA, 22 nt, Homo sapiens
guauuuguugcagcagcacuau

SEQ ID NO: 134376 - RNA, 22 nt, Homo sapiens
gucaccagcuguguuagccccu

SEQ ID NO: 134377 - RNA, 22 nt, Homo sapiens
gucacuguggagaagaaagugg

SEQ ID NO: 134378 - RNA, 22 nt, Homo sapiens
gucagaaucucagaugacaacg

SEQ ID NO: 134379 - RNA, 22 nt, Homo sapiens
gucagucugucccugccuggcg

SEQ ID NO: 134380 - RNA, 22 nt, Homo sapiens
gucagugccugucccaggcuuu

SEQ ID NO: 134381 - RNA, 22 nt, Homo sapiens
gucauugcuuaaggguucaugc

SEQ ID NO: 134382 - RNA, 22 nt, Homo sapiens
guccuggagaagcguggaccgg

SEQ ID NO: 134383 - RNA, 22 nt, Homo sapiens
gucugagcauggggccggcagg

SEQ ID NO: 134384 - RNA, 22 nt, Homo sapiens
gucuuugcauguauguucauga

SEQ ID NO: 134385 - RNA, 22 nt, Homo sapiens
gugaacaagcaaaggcaggagg

SEQ ID NO: 134386 - RNA, 22 nt, Homo sapiens
gugaagaugugcaucagaucca

SEQ ID NO: 134387 - RNA, 22 nt, Homo sapiens
gugacaguggagacuuacuuca

SEQ ID NO: 134388 - RNA, 22 nt, Homo sapiens
gugagauuuucuccagguucag

SEQ ID NO: 134389 - RNA, 22 nt, Homo sapiens
gugagcagagaucgcgugauug

SEQ ID NO: 134390 - RNA, 22 nt, Homo sapiens
gugauaucuuacaauucucuuu

SEQ ID NO: 134391 - RNA, 22 nt, Homo sapiens
gugaugcaguacguagaggaga

SEQ ID NO: 134392 - RNA, 22 nt, Homo sapiens
gugaugguaguuuguauuucug

SEQ ID NO: 134393 - RNA, 22 nt, Homo sapiens
gugcaaauguuauugagguuuu

SEQ ID NO: 134394 - RNA, 22 nt, Homo sapiens
gugcacaacaugcagguuuguu

SEQ ID NO: 134395 - RNA, 22 nt, Homo sapiens
gugcacaacgugcaaguuuguu

SEQ ID NO: 134396 - RNA, 22 nt, Homo sapiens
gugcccacugucuguccuguag

SEQ ID NO: 134397 - RNA, 22 nt, Homo sapiens
guggaaaauuauugcuguuuuu

SEQ ID NO: 134398 - RNA, 22 nt, Homo sapiens
guggaaagaacacaaaauuagg

SEQ ID NO: 134399 - RNA, 17 nt, Homo sapiens
guggauagaacaaugaa

SEQ ID NO: 134400 - RNA, 22 nt, Homo sapiens
guggcaaacucagcaugcccca

SEQ ID NO: 134401 - RNA, 22 nt, Homo sapiens
guggcauuucccaaaguauucu

SEQ ID NO: 134402 - RNA, 22 nt, Homo sapiens
gugguaucauuuaaccauuaga

SEQ ID NO: 134403 - RNA, 22 nt, Homo sapiens
gugguuguuggaguggcaauuu

SEQ ID NO: 134404 - RNA, 22 nt, Homo sapiens
gugguuuuaauauucagucuag

SEQ ID NO: 134405 - RNA, 22 nt, Homo sapiens
gugguuuucaacuccaccugca

SEQ ID NO: 134406 - RNA, 22 nt, Homo sapiens
gugguuuuuuucugccuuauag

SEQ ID NO: 134407 - RNA, 22 nt, Homo sapiens
guguaaaucaaucuguugucuu

SEQ ID NO: 134408 - RNA, 22 nt, Homo sapiens
gugucuccugccuucaugcagc

SEQ ID NO: 134409 - RNA, 22 nt, Homo sapiens
guguggcaggugggggcucaga

SEQ ID NO: 134410 - RNA, 22 nt, Homo sapiens
guguuugauugcaaauaaucua

SEQ ID NO: 134411 - RNA, 22 nt, Homo sapiens
guucacaguucagccuguaaca

SEQ ID NO: 134412 - RNA, 22 nt, Homo sapiens
guucucacuggugcugguaagu

SEQ ID NO: 134413 - RNA, 22 nt, Homo sapiens
guugaaaucaucacuuggcaug

SEQ ID NO: 134414 - RNA, 22 nt, Homo sapiens
ugagaagacaucagcuuucgga

SEQ ID NO: 134415 - RNA, 22 nt, Homo sapiens
ugagaagacaucuuugcuuugu

SEQ ID NO: 134416 - RNA, 22 nt, Homo sapiens
ugagaagugauauagaaguuaa

SEQ ID NO: 134417 - RNA, 22 nt, Homo sapiens
ugagaaugacugggcaugcugc

SEQ ID NO: 134418 - RNA, 22 nt, Homo sapiens
ugagacggagucuugcucuguc

SEQ ID NO: 134419 - RNA, 22 nt, Homo sapiens
ugagagacaguuuguuaaaauu

SEQ ID NO: 134420 - RNA, 22 nt, Homo sapiens
ugagagacauuuguuguagagu

SEQ ID NO: 134421 - RNA, 22 nt, Homo sapiens
ugagagaugaacuauucuugaa

SEQ ID NO: 134422 - RNA, 22 nt, Homo sapiens
ugagauaucauuucacacccag

SEQ ID NO: 134423 - RNA, 22 nt, Homo sapiens
ugagaucuucgcucuucacaga

SEQ ID NO: 134424 - RNA, 22 nt, Homo sapiens
ugagaugaagcuagaagaaugg

SEQ ID NO: 134425 - RNA, 22 nt, Homo sapiens
ugagaugagucucgcucuguca

SEQ ID NO: 134426 - RNA, 22 nt, Homo sapiens
ugagaugauaucuuauuguaau

SEQ ID NO: 134427 - RNA, 22 nt, Homo sapiens
ugagauggagucuugucgccua

SEQ ID NO: 134428 - RNA, 22 nt, Homo sapiens
ugagauuauauuucuuaacaga

SEQ ID NO: 134429 - RNA, 22 nt, Homo sapiens
ugagcaucauucacaccuuggu

SEQ ID NO: 134430 - RNA, 23 nt, Homo sapiens
ugagccaugggacuccaagggag

SEQ ID NO: 134431 - RNA, 22 nt, Homo sapiens
ugagcugguacuaauauuauca

SEQ ID NO: 134432 - RNA, 18 nt, Homo sapiens
ugaggaaaggguuugcua

SEQ ID NO: 134433 - RNA, 22 nt, Homo sapiens
ugaggagugaacuauuucugau

SEQ ID NO: 134434 - RNA, 22 nt, Homo sapiens
ugaggcuagucagaucagauga

SEQ ID NO: 134435 - RNA, 22 nt, Homo sapiens
ugagggcguauccuucauuaag

SEQ ID NO: 134436 - RNA, 22 nt, Homo sapiens
ugagguacaacauggacugaag

SEQ ID NO: 134437 - RNA, 22 nt, Homo sapiens
ugagucauguaauaaugcugcu

SEQ ID NO: 134438 - RNA, 22 nt, Homo sapiens
ugagugaacgcugagaccaaau

SEQ ID NO: 134439 - RNA, 22 nt, Homo sapiens
ugaguguguaugugcauacaca

SEQ ID NO: 134440 - RNA, 22 nt, Homo sapiens
ugauagaucugggcaaaguaaa

SEQ ID NO: 134441 - RNA, 22 nt, Homo sapiens
ugauaguugucagugggggacc

SEQ ID NO: 134442 - RNA, 22 nt, Homo sapiens
ugauauguuagaaucuugcaag

SEQ ID NO: 134443 - RNA, 22 nt, Homo sapiens
ugauauuuuugauccuuaaguu

SEQ ID NO: 134444 - RNA, 22 nt, Homo sapiens
ugaugacauugucacagucuga

SEQ ID NO: 134445 - RNA, 22 nt, Homo sapiens
ugauggcacagugaguuccagg

SEQ ID NO: 134446 - RNA, 20 nt, Homo sapiens
ugauugaccagagcaguuuu

SEQ ID NO: 134447 - RNA, 22 nt, Homo sapiens
ugcaaauguuaggugucauuau

SEQ ID NO: 134448 - RNA, 22 nt, Homo sapiens
ugcaagacacuguccugggcau

SEQ ID NO: 134449 - RNA, 22 nt, Homo sapiens
ugcaaugugaaauaagcacauc

SEQ ID NO: 134450 - RNA, 22 nt, Homo sapiens
ugcaccacugcacuucagccug

SEQ ID NO: 134451 - RNA, 22 nt, Homo sapiens
ugcaccauugcauacuuaauua

SEQ ID NO: 134452 - RNA, 16 nt, Homo sapiens
ugcagaguaggugaau

SEQ ID NO: 134453 - RNA, 22 nt, Homo sapiens
ugcagugcaugacuguguuaug

SEQ ID NO: 134454 - RNA, 22 nt, Homo sapiens
ugcauuguggaucuaaaugcau

SEQ ID NO: 134455 - RNA, 22 nt, Homo sapiens
ugcauuguuccgaauguguccu

SEQ ID NO: 134456 - RNA, 22 nt, Homo sapiens
ugccagagacguagggaauauu

SEQ ID NO: 134457 - RNA, 22 nt, Homo sapiens
ugccuaggcccaguccucagaa

SEQ ID NO: 134458 - RNA, 22 nt, Homo sapiens
ugccuaggcuggaaugcaaugg

SEQ ID NO: 134459 - RNA, 22 nt, Homo sapiens
ugccuaggcuggagugcagugg

SEQ ID NO: 134460 - RNA, 22 nt, Homo sapiens
ugccuaggcuggaguguagugg

SEQ ID NO: 134461 - RNA, 22 nt, Homo sapiens
ugcuacccuucgucucucuggu

SEQ ID NO: 134462 - RNA, 21 nt, Homo sapiens
ugcuauguuguccaggcuggc

SEQ ID NO: 134463 - RNA, 22 nt, Homo sapiens
ugcugcaaacaugagaggaagu

SEQ ID NO: 134464 - RNA, 22 nt, Homo sapiens
ugcuggugucaucaaggcuuug

SEQ ID NO: 134465 - RNA, 22 nt, Homo sapiens
ugcugguguggucuagccgcuu

SEQ ID NO: 134466 - RNA, 20 nt, Homo sapiens
uggaaggcaucugcauuauu

SEQ ID NO: 134467 - RNA, 22 nt, Homo sapiens
uggaagguaaguuuugagcauu

SEQ ID NO: 134468 - RNA, 22 nt, Homo sapiens
uggaaguagauagauuguguca

SEQ ID NO: 134469 - RNA, 22 nt, Homo sapiens
uggaaguauagauaauugaaag

SEQ ID NO: 134470 - RNA, 21 nt, Homo sapiens
uggaaucuauuauuccaguuu

SEQ ID NO: 134471 - RNA, 22 nt, Homo sapiens
uggaaugggauuggaaauuuug

SEQ ID NO: 134472 - RNA, 22 nt, Homo sapiens
uggagacugaucccucuuuccu

SEQ ID NO: 134473 - RNA, 22 nt, Homo sapiens
uggagagucauuuauaguauuu

SEQ ID NO: 134474 - RNA, 23 nt, Homo sapiens
uggaggacaagcauggauaguga

SEQ ID NO: 134475 - RNA, 22 nt, Homo sapiens
uggagugcaauggugagaucuu

SEQ ID NO: 134476 - RNA, 22 nt, Homo sapiens
uggaguguuggggcaggaucuc

SEQ ID NO: 134477 - RNA, 22 nt, Homo sapiens
uggaugccuaauaaaugcagac

SEQ ID NO: 134478 - RNA, 22 nt, Homo sapiens
uggauguacagucaguauuugu

SEQ ID NO: 134479 - RNA, 21 nt, Homo sapiens
uggcaaaaugggcaguggguu

SEQ ID NO: 134480 - RNA, 22 nt, Homo sapiens
uggcaaauuccaaaguuaauuc

SEQ ID NO: 134481 - RNA, 22 nt, Homo sapiens
uggcaagaacugcaauugcuuu

SEQ ID NO: 134482 - RNA, 22 nt, Homo sapiens
uggcaagagggaugcaagguuu

SEQ ID NO: 134483 - RNA, 20 nt, Homo sapiens
uggcaagauggcagaauaga

SEQ ID NO: 134484 - RNA, 22 nt, Homo sapiens
uggcaauauccacaauuacuuu

SEQ ID NO: 134485 - RNA, 19 nt, Homo sapiens
uggcaaugucagcagagau

SEQ ID NO: 134486 - RNA, 22 nt, Homo sapiens
uggcacuggagauacauuaaua

SEQ ID NO: 134487 - RNA, 22 nt, Homo sapiens
uggcaggugcacuggcuuugaa

SEQ ID NO: 134488 - RNA, 22 nt, Homo sapiens
uggcaguuucauaugguucaac

SEQ ID NO: 134489 - RNA, 22 nt, Homo sapiens
uggcauauaaagauguguucaa

SEQ ID NO: 134490 - RNA, 20 nt, Homo sapiens
uggcaugaaauuuuccaagc

SEQ ID NO: 134491 - RNA, 22 nt, Homo sapiens
uggcaugaagaccccauccuuu

SEQ ID NO: 134492 - RNA, 22 nt, Homo sapiens
uggcauguaaugcagaaguugc

SEQ ID NO: 134493 - RNA, 22 nt, Homo sapiens
uggccaagagcacagauauugg

SEQ ID NO: 134494 - RNA, 23 nt, Homo sapiens
uggccagaaacuucuuuucaucc

SEQ ID NO: 134495 - RNA, 22 nt, Homo sapiens
uggccagugucggaggccagga

SEQ ID NO: 134496 - RNA, 22 nt, Homo sapiens
uggcggagacauggacuucaga

SEQ ID NO: 134497 - RNA, 22 nt, Homo sapiens
uggcucauuucuaaacccagcu

SEQ ID NO: 134498 - RNA, 22 nt, Homo sapiens
ugggaagaagguuuacuugcca

SEQ ID NO: 134499 - RNA, 22 nt, Homo sapiens
ugggaagagggagcgauuuugg

SEQ ID NO: 134500 - RNA, 19 nt, Homo sapiens
ugggaauguaaauuaguuc

SEQ ID NO: 134501 - RNA, 22 nt, Homo sapiens
ugggcaaauugugagggaggua

SEQ ID NO: 134502 - RNA, 21 nt, Homo sapiens
ugggccccuuccuuacaucau

SEQ ID NO: 134503 - RNA, 22 nt, Homo sapiens
uggggcaaugaacauuuuugca

SEQ ID NO: 134504 - RNA, 22 nt, Homo sapiens
ugggguaggccugguuaugugc

SEQ ID NO: 134505 - RNA, 19 nt, Homo sapiens
uggguaguuuucuggcugg

SEQ ID NO: 134506 - RNA, 22 nt, Homo sapiens
ugguauguguucuaaaauuaug

SEQ ID NO: 134507 - RNA, 22 nt, Homo sapiens
ugguauuuaauauaugagaguu

SEQ ID NO: 134508 - RNA, 22 nt, Homo sapiens
uggucaguugaguccuugccaa

SEQ ID NO: 134509 - RNA, 22 nt, Homo sapiens
ugguccaguucugugauauugc

SEQ ID NO: 134510 - RNA, 19 nt, Homo sapiens
ggcacugugugagugagga

SEQ ID NO: 134511 - RNA, 22 nt, Homo sapiens
ggcagcuguguccuucguaagg

SEQ ID NO: 134512 - RNA, 22 nt, Homo sapiens
ggccagaugaucuaugaaggaa

SEQ ID NO: 134513 - RNA, 22 nt, Homo sapiens
ggcucagugggguccugguucu

SEQ ID NO: 134514 - RNA, 22 nt, Homo sapiens
ggcuguguguuaaaauaggcuu

SEQ ID NO: 134515 - RNA, 22 nt, Homo sapiens
gggaaaaugucuauugaaugaa

SEQ ID NO: 134516 - RNA, 22 nt, Homo sapiens
gggaagguaaucauuacuugau

SEQ ID NO: 134517 - RNA, 22 nt, Homo sapiens
gggcaacauugaguacccugaa

SEQ ID NO: 134518 - RNA, 22 nt, Homo sapiens
gggccagaugcauuuguuauuu

SEQ ID NO: 134519 - RNA, 22 nt, Homo sapiens
ggggcaaaaugccacgagucuc

SEQ ID NO: 134520 - RNA, 22 nt, Homo sapiens
ggguaggcaagcggaugucaga

SEQ ID NO: 134521 - RNA, 22 nt, Homo sapiens
gguaaacauaagagagcugacu

SEQ ID NO: 134522 - RNA, 22 nt, Homo sapiens
gguaaaucuucacuaagacuga

SEQ ID NO: 134523 - RNA, 22 nt, Homo sapiens
gguauuauuugccuuuuacuga

SEQ ID NO: 134524 - RNA, 19 nt, Homo sapiens
ggucacagggguuacaagg

SEQ ID NO: 134525 - RNA, 22 nt, Homo sapiens
ggucaguguuaucaccgaagga

SEQ ID NO: 134526 - RNA, 23 nt, Homo sapiens
ggugaggaguacagagucuucau

SEQ ID NO: 134527 - RNA, 22 nt, Homo sapiens
ggugcagcacaccaacauggca

SEQ ID NO: 134528 - RNA, 22 nt, Homo sapiens
gguggcuuuuugugauggcuga

SEQ ID NO: 134529 - RNA, 22 nt, Homo sapiens
ggugucaguuggccccuacugg

SEQ ID NO: 134530 - RNA, 22 nt, Homo sapiens
guaaguauuaggugugagauuc

SEQ ID NO: 134531 - RNA, 22 nt, Homo sapiens
guaaucucaccuacuugggagg

SEQ ID NO: 134532 - RNA, 22 nt, Homo sapiens
guaaucucagcuucuugggagg

SEQ ID NO: 134533 - RNA, 17 nt, Homo sapiens
guacacuucuucuguga

SEQ ID NO: 134534 - RNA, 22 nt, Homo sapiens
guacaugcaugcaugggugugc

SEQ ID NO: 134535 - RNA, 22 nt, Homo sapiens
guacauggaaugaaauucaaaa

SEQ ID NO: 134536 - RNA, 22 nt, Homo sapiens
guauuugauuauagcaugcuua

SEQ ID NO: 134537 - RNA, 19 nt, Homo sapiens
guauuugguaaacucucca

SEQ ID NO: 134538 - RNA, 22 nt, Homo sapiens
guauuuggugaugccuccaaac

SEQ ID NO: 134539 - RNA, 22 nt, Homo sapiens
gucaaggaauuuauccauuucu

SEQ ID NO: 134540 - RNA, 22 nt, Homo sapiens
gucagcaucaccaugucuauga

SEQ ID NO: 134541 - RNA, 22 nt, Homo sapiens
gucagugcuuuaguucaggaug

SEQ ID NO: 134542 - RNA, 22 nt, Homo sapiens
gucaguggagaaaaggacaugu

SEQ ID NO: 134543 - RNA, 22 nt, Homo sapiens
gucaguggauacugucucuguc

SEQ ID NO: 134544 - RNA, 22 nt, Homo sapiens
gucaguucuugugguugcauuc

SEQ ID NO: 134545 - RNA, 22 nt, Homo sapiens
gucauaugcucggaaaauguua

SEQ ID NO: 134546 - RNA, 22 nt, Homo sapiens
gucaucaggacgggucaucugc

SEQ ID NO: 134547 - RNA, 22 nt, Homo sapiens
gucaugggguacuacacauggg

SEQ ID NO: 134548 - RNA, 22 nt, Homo sapiens
gucaugucuugaaauucaguuu

SEQ ID NO: 134549 - RNA, 22 nt, Homo sapiens
guccaaagugggagaggugggg

SEQ ID NO: 134550 - RNA, 22 nt, Homo sapiens
gucucccaaccccugugcccag

SEQ ID NO: 134551 - RNA, 21 nt, Homo sapiens
gucugguguuuuaaugaggac

SEQ ID NO: 134552 - RNA, 22 nt, Homo sapiens
gucuuugcuuuuaaccagaggu

SEQ ID NO: 134553 - RNA, 22 nt, Homo sapiens
gugaaaagaugagcaccauaca

SEQ ID NO: 134554 - RNA, 22 nt, Homo sapiens
gugaaagacauauaugguuuga

SEQ ID NO: 134555 - RNA, 22 nt, Homo sapiens
gugaaauacauaaucccaagug

SEQ ID NO: 134556 - RNA, 17 nt, Homo sapiens
gugaaaucaucauuuuu

SEQ ID NO: 134557 - RNA, 22 nt, Homo sapiens
gugaaaugaaucuggaaauauu

SEQ ID NO: 134558 - RNA, 22 nt, Homo sapiens
gugaacuguuugaggaagagaa

SEQ ID NO: 134559 - RNA, 22 nt, Homo sapiens
gugaauugagagaacuguguua

SEQ ID NO: 134560 - RNA, 22 nt, Homo sapiens
gugacagaguaagacccuguau

SEQ ID NO: 134561 - RNA, 22 nt, Homo sapiens
gugacuggacucugaagaaaau

SEQ ID NO: 134562 - RNA, 20 nt, Homo sapiens
gugagaacaugugguauuug

SEQ ID NO: 134563 - RNA, 22 nt, Homo sapiens
gugagaagaaaaauauggcugu

SEQ ID NO: 134564 - RNA, 22 nt, Homo sapiens
gugagacugaguuucgcucuug

SEQ ID NO: 134565 - RNA, 22 nt, Homo sapiens
gugagagaaugacuauguguuu

SEQ ID NO: 134566 - RNA, 16 nt, Homo sapiens
gugagagaugacaaac

SEQ ID NO: 134567 - RNA, 22 nt, Homo sapiens
gugagcauauuaguauugcacu

SEQ ID NO: 134568 - RNA, 22 nt, Homo sapiens
gugaggcacugcugcuuuccag

SEQ ID NO: 134569 - RNA, 22 nt, Homo sapiens
gugcaaauuccagcucaacucc

SEQ ID NO: 134570 - RNA, 18 nt, Homo sapiens
gugcaaugaauagcagag

SEQ ID NO: 134571 - RNA, 22 nt, Homo sapiens
gugcacaacgugcagguuuguu

SEQ ID NO: 134572 - RNA, 22 nt, Homo sapiens
uucuuagucauguaauagucca

SEQ ID NO: 134573 - RNA, 20 nt, Homo sapiens
uucuugaguuaacaaguuac

SEQ ID NO: 134574 - RNA, 22 nt, Homo sapiens
uucuuuaguucacuugcuccag

SEQ ID NO: 134575 - RNA, 22 nt, Homo sapiens
uugaaagucauuucuucuaagu

SEQ ID NO: 134576 - RNA, 22 nt, Homo sapiens
uugacuccagagugaguaaaug

SEQ ID NO: 134577 - RNA, 22 nt, Homo sapiens
uugacuuuuauucacucugcua

SEQ ID NO: 134578 - RNA, 22 nt, Homo sapiens
uugagagaaaaggccaugccuu

SEQ ID NO: 134579 - RNA, 20 nt, Homo sapiens
uugagaucuguaucugguuu

SEQ ID NO: 134580 - RNA, 22 nt, Homo sapiens
uugagauguggcaguuuaugag

SEQ ID NO: 134581 - RNA, 22 nt, Homo sapiens
uugagcuagggagaucgagguc

SEQ ID NO: 134582 - RNA, 22 nt, Homo sapiens
uugaggacugguugaaagcuuu

SEQ ID NO: 134583 - RNA, 22 nt, Homo sapiens
uugaggcuuuugaccucaugug

SEQ ID NO: 134584 - RNA, 21 nt, Homo sapiens
uugagguaaaauccuauggga

SEQ ID NO: 134585 - RNA, 22 nt, Homo sapiens
uugaggucuuugagcaaacgca

SEQ ID NO: 134586 - RNA, 20 nt, Homo sapiens
uugaguauugccagggaggc

SEQ ID NO: 134587 - RNA, 22 nt, Homo sapiens
uugaguuuaucuaaagaccugg

SEQ ID NO: 134588 - RNA, 22 nt, Homo sapiens
uugaguuugaguauucuaaagc

SEQ ID NO: 134589 - RNA, 22 nt, Homo sapiens
uuugugucccuacccgaaucuc

SEQ ID NO: 134590 - RNA, 22 nt, Homo sapiens
uuugugucccucuaaaauuuau

SEQ ID NO: 134591 - RNA, 22 nt, Homo sapiens
uuuuaagcuacaagagacauau

SEQ ID NO: 134592 - RNA, 22 nt, Homo sapiens
uuuuaguggacaaagguauuua

SEQ ID NO: 134593 - RNA, 21 nt, Homo sapiens
uuuugcacacuaugcagcuuu

SEQ ID NO: 134594 - RNA, 22 nt, Homo sapiens
uuuugcuugugaauagccacau

SEQ ID NO: 134595 - RNA, 22 nt, Homo sapiens
uuuugguuuuauccagggucuc

SEQ ID NO: 134596 - RNA, 22 nt, Homo sapiens
uuuuucacuuaaguuaggcuca

SEQ ID NO: 134597 - RNA, 22 nt, Homo sapiens
uuuuuugcuguaugcaaacauc

SEQ ID NO: 134598 - RNA, 22 nt, Homo sapiens
uuccugagaucagaauucaaau

SEQ ID NO: 134599 - RNA, 22 nt, Homo sapiens
uuccugugacccccaagcccac

SEQ ID NO: 134600 - RNA, 20 nt, Homo sapiens
uucuaguacuucuguuucca

SEQ ID NO: 134601 - RNA, 22 nt, Homo sapiens
uucucaauggaugugggaccag

SEQ ID NO: 134602 - RNA, 22 nt, Homo sapiens
uucucuguggauugggugagag

SEQ ID NO: 134603 - RNA, 22 nt, Homo sapiens
uucuggcuaugggauacuaaau

SEQ ID NO: 134604 - RNA, 22 nt, Homo sapiens
uucuggcuuuuaaagaaauguu

SEQ ID NO: 134605 - RNA, 22 nt, Homo sapiens
uucugguuaauacuugcaaaaa

SEQ ID NO: 134606 - RNA, 22 nt, Homo sapiens
uucugugguugaaaggagagau

SEQ ID NO: 134607 - RNA, 22 nt, Homo sapiens
uucuugaggcaugccgcuggga

SEQ ID NO: 134608 - RNA, 22 nt, Homo sapiens
uucuugguuggcaaccaacagu

SEQ ID NO: 134609 - RNA, 22 nt, Homo sapiens
uugaaaguaaacaucacaaaga

SEQ ID NO: 134610 - RNA, 22 nt, Homo sapiens
uugaaagucauggcacaggcaa

SEQ ID NO: 134611 - RNA, 22 nt, Homo sapiens
uugaaagucuaggcuuacagua

SEQ ID NO: 134612 - RNA, 22 nt, Homo sapiens
uugaaaucuuccacagcccaag

SEQ ID NO: 134613 - RNA, 22 nt, Homo sapiens
uugaagacuaauuuagauaaug

SEQ ID NO: 134614 - RNA, 19 nt, Homo sapiens
uugaaggccgccuugcaga

SEQ ID NO: 134615 - RNA, 22 nt, Homo sapiens
uugaagguagaaguucucaauu

SEQ ID NO: 134616 - RNA, 22 nt, Homo sapiens
uugaauagaagguuuuuuguuc

SEQ ID NO: 134617 - RNA, 18 nt, Homo sapiens
uugaaugcgucccagaga

SEQ ID NO: 134618 - RNA, 22 nt, Homo sapiens
uugaaugucuauuaaguuguuu

SEQ ID NO: 134619 - RNA, 23 nt, Homo sapiens
uugaauguuuccccucccaaauu

SEQ ID NO: 134620 - RNA, 20 nt, Homo sapiens
uugacaguggguuguuaaag

SEQ ID NO: 134621 - RNA, 23 nt, Homo sapiens
uugacuguggguacaaugugaua

SEQ ID NO: 134622 - RNA, 22 nt, Homo sapiens
uugagagaaaaaauuuauuggu

SEQ ID NO: 134623 - RNA, 22 nt, Homo sapiens
uugagagagaacauuuguuaca

SEQ ID NO: 134624 - RNA, 22 nt, Homo sapiens
uugagauauccauaaaugggaa

SEQ ID NO: 134625 - RNA, 22 nt, Homo sapiens
uugagauguggguuggugacuu

SEQ ID NO: 134626 - RNA, 22 nt, Homo sapiens
uugagcccuggaggcagaggcu

SEQ ID NO: 134627 - RNA, 22 nt, Homo sapiens
uugaggcaaugaggagaagcug

SEQ ID NO: 134628 - RNA, 22 nt, Homo sapiens
uugaggucagagguucgagacc

SEQ ID NO: 134629 - RNA, 22 nt, Homo sapiens
uugauauucuuucuggauccca

SEQ ID NO: 134630 - RNA, 22 nt, Homo sapiens
uugauugacaugucucuguuca

SEQ ID NO: 134631 - RNA, 22 nt, Homo sapiens
uugcaaaucucuuguguuuggu

SEQ ID NO: 134632 - RNA, 22 nt, Homo sapiens
uugcacaauccugugagugagu

SEQ ID NO: 134633 - RNA, 22 nt, Homo sapiens
uugcacauugcaccuuuuguau

SEQ ID NO: 134634 - RNA, 22 nt, Homo sapiens
uugcagcaaagagggaggggca

SEQ ID NO: 134635 - RNA, 22 nt, Homo sapiens
uugcaucagcaggcauaauugg

SEQ ID NO: 134636 - RNA, 22 nt, Homo sapiens
uugcuacauugauugccucuuu

SEQ ID NO: 134637 - RNA, 22 nt, Homo sapiens
uugcucaggcuagaguucagcu

SEQ ID NO: 134638 - RNA, 22 nt, Homo sapiens
uuggaaagagguguuuaugacu

SEQ ID NO: 134639 - RNA, 22 nt, Homo sapiens
uuggaaauguguuugcauucag

SEQ ID NO: 134640 - RNA, 22 nt, Homo sapiens
uuggaacacauguuuuucuacc

SEQ ID NO: 134641 - RNA, 22 nt, Homo sapiens
uuggaauauaaccuguuucuaa

SEQ ID NO: 134642 - RNA, 23 nt, Homo sapiens
uuggaaugagaccuaagaguuuu

SEQ ID NO: 134643 - RNA, 22 nt, Homo sapiens
uuggaauguauggcaucuugcg

SEQ ID NO: 134644 - RNA, 22 nt, Homo sapiens
uuggaauuuauuuggaugggag

SEQ ID NO: 134645 - RNA, 22 nt, Homo sapiens
uuggaauuuuaaaauaggcaac

SEQ ID NO: 134646 - RNA, 22 nt, Homo sapiens
uuggagugugagagcagccugg

SEQ ID NO: 134647 - RNA, 22 nt, Homo sapiens
uuggcaauauuuacugaaguug

SEQ ID NO: 134648 - RNA, 22 nt, Homo sapiens
uuggcaauucagauucuuuuau

SEQ ID NO: 134649 - RNA, 21 nt, Homo sapiens
uuggcacucuucucuccuuau

SEQ ID NO: 134650 - RNA, 22 nt, Homo sapiens
uuggcagcuguggaaucugggc

SEQ ID NO: 134651 - RNA, 22 nt, Homo sapiens
uuggcagugcccgaugcugggg

SEQ ID NO: 134652 - RNA, 22 nt, Homo sapiens
uuggcuauagauacauggauua

SEQ ID NO: 134653 - RNA, 22 nt, Homo sapiens
uuggcuguguuuauaugcugga

SEQ ID NO: 134654 - RNA, 22 nt, Homo sapiens
uugggacuggaaggaguaaggg

SEQ ID NO: 134655 - RNA, 23 nt, Homo sapiens
uugggcaaaucacugagggcaga

SEQ ID NO: 134656 - RNA, 22 nt, Homo sapiens
uugguuccuuagccuaggacua

SEQ ID NO: 134657 - RNA, 19 nt, Homo sapiens
uugguugguuauuucuuac

SEQ ID NO: 134658 - RNA, 22 nt, Homo sapiens
uuguaauggagcaaacagguug

SEQ ID NO: 134659 - RNA, 22 nt, Homo sapiens
uuguagaucuucaguugcuaca

SEQ ID NO: 134660 - RNA, 22 nt, Homo sapiens
uuguaguagucucguucuuuua

SEQ ID NO: 134661 - RNA, 21 nt, Homo sapiens
uuguccccacccaaaucucau

SEQ ID NO: 134662 - RNA, 22 nt, Homo sapiens
uuguccccacccaaaugucauc

SEQ ID NO: 134663 - RNA, 23 nt, Homo sapiens
uuguccccuccaaagcucauguu

SEQ ID NO: 134664 - RNA, 22 nt, Homo sapiens
uugugaauggugccacaauaaa

SEQ ID NO: 134665 - RNA, 22 nt, Homo sapiens
uugugcacauguacccuagaac

SEQ ID NO: 134666 - RNA, 21 nt, Homo sapiens
uugugccaaacccuggaggga

SEQ ID NO: 134667 - RNA, 22 nt, Homo sapiens
uugugguugacuaaauuuguaa

SEQ ID NO: 134668 - RNA, 22 nt, Homo sapiens
uugugguuuuagcacuguggau

SEQ ID NO: 134669 - RNA, 22 nt, Homo sapiens
uuguguaguaccucucacauug

SEQ ID NO: 134670 - RNA, 22 nt, Homo sapiens
uuuaaacugucuuggguuugga

SEQ ID NO: 134671 - RNA, 19 nt, Homo sapiens
uuuagaucuuuuaugcagc

SEQ ID NO: 134672 - RNA, 22 nt, Homo sapiens
uuuagcaauucauuuugugucu

SEQ ID NO: 134673 - RNA, 22 nt, Homo sapiens
uuucaacaggucuggggugguc

SEQ ID NO: 134674 - RNA, 22 nt, Homo sapiens
uuucaagugcugucuuagcugu

SEQ ID NO: 134675 - RNA, 22 nt, Homo sapiens
uuucaucaagcacagaguagau

SEQ ID NO: 134676 - RNA, 19 nt, Homo sapiens
uuuccaguaaucuuaugug

SEQ ID NO: 134677 - RNA, 22 nt, Homo sapiens
uuucccagugguacaguuuaua

SEQ ID NO: 134678 - RNA, 22 nt, Homo sapiens
uuuccuggagaaucuuaacaaa

SEQ ID NO: 134679 - RNA, 21 nt, Homo sapiens
uuucugggggagcauggcagg

SEQ ID NO: 134680 - RNA, 19 nt, Homo sapiens
uuugaauauaaugcagcua

SEQ ID NO: 134681 - RNA, 22 nt, Homo sapiens
uuugaauggaaguuuugugaaa

SEQ ID NO: 134682 - RNA, 22 nt, Homo sapiens
uuugaggaaaggcauaaguagg

SEQ ID NO: 134683 - RNA, 22 nt, Homo sapiens
uuugcacuugaaaacacucuca

SEQ ID NO: 134684 - RNA, 22 nt, Homo sapiens
uuugcaugcuccuuaugagaau

SEQ ID NO: 134685 - RNA, 22 nt, Homo sapiens
uuugccaauauuuuacugagga

SEQ ID NO: 134686 - RNA, 22 nt, Homo sapiens
uuugcuuaguaaauguagaaaa

SEQ ID NO: 134687 - RNA, 22 nt, Homo sapiens
uuugcuuguguaaaaaucugga

SEQ ID NO: 134688 - RNA, 22 nt, Homo sapiens
uuugggccucugauuucuuugg

SEQ ID NO: 134689 - RNA, 22 nt, Homo sapiens
uuugguuauauauauacacucu

SEQ ID NO: 134690 - RNA, 22 nt, Homo sapiens
uuugguuauuugaaacuagcau

SEQ ID NO: 134691 - RNA, 22 nt, Homo sapiens
uuugucacucuuggagguuguu

SEQ ID NO: 134692 - RNA, 23 nt, Homo sapiens
uuuguguccccacccaaaucuca

SEQ ID NO: 134693 - RNA, 22 nt, Homo sapiens
ugagauaaucaugugauuucau

SEQ ID NO: 134694 - RNA, 22 nt, Homo sapiens
ugagauauugggaguaauguca

SEQ ID NO: 134695 - RNA, 22 nt, Homo sapiens
ugagaucugauaggccuggguu

SEQ ID NO: 134696 - RNA, 22 nt, Homo sapiens
ugagauggguucugguccccug

SEQ ID NO: 134697 - RNA, 22 nt, Homo sapiens
ugagaugguaaauuuuuguugu

SEQ ID NO: 134698 - RNA, 22 nt, Homo sapiens
ugagaugugaagaucacaugaa

SEQ ID NO: 134699 - RNA, 22 nt, Homo sapiens
ugagauguuuguuucagugccu

SEQ ID NO: 134700 - RNA, 22 nt, Homo sapiens
ugagauuaaucuuuaaguaaga

SEQ ID NO: 134701 - RNA, 22 nt, Homo sapiens
ugagauuaucuugaucuugaaa

SEQ ID NO: 134702 - RNA, 22 nt, Homo sapiens
ugagcagugagugugcugcagg

SEQ ID NO: 134703 - RNA, 22 nt, Homo sapiens
ugagcagugaguguggugcagg

SEQ ID NO: 134704 - RNA, 22 nt, Homo sapiens
ugagcugagaucgugccauugu

SEQ ID NO: 134705 - RNA, 22 nt, Homo sapiens
ugagcugagaucuuaccacugc

SEQ ID NO: 134706 - RNA, 22 nt, Homo sapiens
ugaggacugagaggcacugugg

SEQ ID NO: 134707 - RNA, 22 nt, Homo sapiens
ugaggaguguauuucauucgcu

SEQ ID NO: 134708 - RNA, 22 nt, Homo sapiens
ugaggauaguguugaaggcagg

SEQ ID NO: 134709 - RNA, 22 nt, Homo sapiens
ugaggugcagcaauccucaugu

SEQ ID NO: 134710 - RNA, 22 nt, Homo sapiens
ugaguagaacuccuggagaugu

SEQ ID NO: 134711 - RNA, 22 nt, Homo sapiens
ugaguagaagugaagauagugg

SEQ ID NO: 134712 - RNA, 23 nt, Homo sapiens
ugaguaggcaguuuuccccucac

SEQ ID NO: 134713 - RNA, 19 nt, Homo sapiens
ugaguauauuguauucauu

SEQ ID NO: 134714 - RNA, 22 nt, Homo sapiens
ugagucaugcuggagucauggc

SEQ ID NO: 134715 - RNA, 22 nt, Homo sapiens
ugagugaaagaagcacuaagga

SEQ ID NO: 134716 - RNA, 22 nt, Homo sapiens
ugagugaaggggcucuguugug

SEQ ID NO: 134717 - RNA, 22 nt, Homo sapiens
ugagugugacuuagcagaagga

SEQ ID NO: 134718 - RNA, 22 nt, Homo sapiens
ugaguucaugcuuguaguucua

SEQ ID NO: 134719 - RNA, 22 nt, Homo sapiens
ugaguucauggucauuugucac

SEQ ID NO: 134720 - RNA, 22 nt, Homo sapiens
ugauagugccuuuuauaucucu

SEQ ID NO: 134721 - RNA, 22 nt, Homo sapiens
ugauaguguccugugccacauu

SEQ ID NO: 134722 - RNA, 18 nt, Homo sapiens
ugauaucaaugauagcca

SEQ ID NO: 134723 - RNA, 22 nt, Homo sapiens
ugaugacacugauuucuucaau

SEQ ID NO: 134724 - RNA, 19 nt, Homo sapiens
ugauuguaagcuuggugag

SEQ ID NO: 134725 - RNA, 22 nt, Homo sapiens
ugcaaaucuuguguaguuguga

SEQ ID NO: 134726 - RNA, 22 nt, Homo sapiens
ugcaaauguuaguaacaccacu

SEQ ID NO: 134727 - RNA, 22 nt, Homo sapiens
ugcaacauguguaccacucugu

SEQ ID NO: 134728 - RNA, 22 nt, Homo sapiens
uugauagguuuuauguauaguu

SEQ ID NO: 134729 - RNA, 22 nt, Homo sapiens
uugauaugguauaagauuucau

SEQ ID NO: 134730 - RNA, 22 nt, Homo sapiens
uugauauguguauagcaugugg

SEQ ID NO: 134731 - RNA, 22 nt, Homo sapiens
uugauauguuguuagauucagu

SEQ ID NO: 134732 - RNA, 22 nt, Homo sapiens
uugauauuaaguacugaagugg

SEQ ID NO: 134733 - RNA, 22 nt, Homo sapiens
uugaugauguuucugccuugcc

SEQ ID NO: 134734 - RNA, 22 nt, Homo sapiens
uugauguugaggacauaaaccu

SEQ ID NO: 134735 - RNA, 21 nt, Homo sapiens
uugcaaaugcugcugccugau

SEQ ID NO: 134736 - RNA, 22 nt, Homo sapiens
uugcaaguggagcuuccagggc

SEQ ID NO: 134737 - RNA, 22 nt, Homo sapiens
uugcacuccagcucuaggugac

SEQ ID NO: 134738 - RNA, 22 nt, Homo sapiens
uugcacucuccagccucggcaa

SEQ ID NO: 134739 - RNA, 19 nt, Homo sapiens
uugcaguauccuauauguu

SEQ ID NO: 134740 - RNA, 22 nt, Homo sapiens
uugcagugugacgacuauauuu

SEQ ID NO: 134741 - RNA, 22 nt, Homo sapiens
uugcaugggagcugggugaggc

SEQ ID NO: 134742 - RNA, 22 nt, Homo sapiens
uugcaugguuuuuaucugaaau

SEQ ID NO: 134743 - RNA, 22 nt, Homo sapiens
uugcauuagugugguacauuug

SEQ ID NO: 134744 - RNA, 18 nt, Homo sapiens
uugccuauucacucugau

SEQ ID NO: 134745 - RNA, 22 nt, Homo sapiens
uugccugagaagccaagaauaa

SEQ ID NO: 134746 - RNA, 22 nt, Homo sapiens
uugcugagucuuucuagguugc

SEQ ID NO: 134747 - RNA, 22 nt, Homo sapiens
uugcuucauucaacauugaggg

SEQ ID NO: 134748 - RNA, 22 nt, Homo sapiens
uuggaaaaauccaccuugaucu

SEQ ID NO: 134749 - RNA, 22 nt, Homo sapiens
uuggaaaguuguuguaguuauu

SEQ ID NO: 134750 - RNA, 22 nt, Homo sapiens
uuggaaaugguaaaggguuaau

SEQ ID NO: 134751 - RNA, 22 nt, Homo sapiens
uuggaagguaaucaaaaguucu

SEQ ID NO: 134752 - RNA, 22 nt, Homo sapiens
uuggaauuaagagauauuuucu

SEQ ID NO: 134753 - RNA, 22 nt, Homo sapiens
uuggagagugauauucagaugc

SEQ ID NO: 134754 - RNA, 22 nt, Homo sapiens
uuggcaaagaggaaugccacuu

SEQ ID NO: 134755 - RNA, 22 nt, Homo sapiens
uuggcaaauagguuuuauugca

SEQ ID NO: 134756 - RNA, 22 nt, Homo sapiens
uuggcaaucaauucugacgucu

SEQ ID NO: 134757 - RNA, 22 nt, Homo sapiens
uuggcaauugcuaugauuugaa

SEQ ID NO: 134758 - RNA, 22 nt, Homo sapiens
uuggcacugagcaagaacaggg

SEQ ID NO: 134759 - RNA, 22 nt, Homo sapiens
uuggcagaauguuagaaacuua

SEQ ID NO: 134760 - RNA, 22 nt, Homo sapiens
uuggcagugguucugacggacc

SEQ ID NO: 134761 - RNA, 23 nt, Homo sapiens
uuggcaucugggacacaagcuga

SEQ ID NO: 134762 - RNA, 22 nt, Homo sapiens
uuggccaauggugauucccggc

SEQ ID NO: 134763 - RNA, 22 nt, Homo sapiens
uuggccccuuucauccacagcu

SEQ ID NO: 134764 - RNA, 21 nt, Homo sapiens
uuggggaauggagagguuuuc

SEQ ID NO: 134765 - RNA, 22 nt, Homo sapiens
uugguccccuucaaccagcugu

SEQ ID NO: 134766 - RNA, 22 nt, Homo sapiens
uugguccguugugaaaaggccu

SEQ ID NO: 134767 - RNA, 22 nt, Homo sapiens
uuggucucaucaagagcagcuu

SEQ ID NO: 134768 - RNA, 22 nt, Homo sapiens
uuguacaggaguguaagcuuca

SEQ ID NO: 134769 - RNA, 20 nt, Homo sapiens
uuguacuccugggcucaagc

SEQ ID NO: 134770 - RNA, 22 nt, Homo sapiens
uuguccauggacagcaccacag

SEQ ID NO: 134771 - RNA, 22 nt, Homo sapiens
uuguccccuuccaaaucucaug

SEQ ID NO: 134772 - RNA, 22 nt, Homo sapiens
uugucuccuagacgaccaggcg

SEQ ID NO: 134773 - RNA, 22 nt, Homo sapiens
uugucuugcagcuuaggcauca

SEQ ID NO: 134774 - RNA, 22 nt, Homo sapiens
uugugaagaaaccagaaaaguu

SEQ ID NO: 134775 - RNA, 22 nt, Homo sapiens
uugugaauggaguagcaggauc

SEQ ID NO: 134776 - RNA, 22 nt, Homo sapiens
uugugaauggugcugcaguaaa

SEQ ID NO: 134777 - RNA, 22 nt, Homo sapiens
uugugaucauugucaaauagug

SEQ ID NO: 134778 - RNA, 22 nt, Homo sapiens
uugugcaugaugcauacauggu

SEQ ID NO: 134779 - RNA, 22 nt, Homo sapiens
uugugucccugcggcugaggag

SEQ ID NO: 134780 - RNA, 22 nt, Homo sapiens
uuuaaagcacggaguuuguggc

SEQ ID NO: 134781 - RNA, 23 nt, Homo sapiens
uuuaagcuucauguccuaacauc

SEQ ID NO: 134782 - RNA, 22 nt, Homo sapiens
uuuaauacugcaucuuuacucu

SEQ ID NO: 134783 - RNA, 22 nt, Homo sapiens
uuuagcaaugcuguggggaagu

SEQ ID NO: 134784 - RNA, 22 nt, Homo sapiens
uuuagcaauggagggugacuuu

SEQ ID NO: 134785 - RNA, 22 nt, Homo sapiens
uuucacagagggcuucuuucua

SEQ ID NO: 134786 - RNA, 22 nt, Homo sapiens
uuucacagcaauugccuauugu

SEQ ID NO: 134787 - RNA, 22 nt, Homo sapiens
uuucacagcugucuuccgucuc

SEQ ID NO: 134788 - RNA, 23 nt, Homo sapiens
uuucacaguagcuggaucagccu

SEQ ID NO: 134789 - RNA, 22 nt, Homo sapiens
uuucacaguguucucccccaga

SEQ ID NO: 134790 - RNA, 22 nt, Homo sapiens
uuucaccguguuggccaggcug

SEQ ID NO: 134791 - RNA, 22 nt, Homo sapiens
uuucauggaauauagucauuuu

SEQ ID NO: 134792 - RNA, 22 nt, Homo sapiens
uuucauggacgcaaugccuuuu

SEQ ID NO: 134793 - RNA, 23 nt, Homo sapiens
uuucauggggauuuacucauucc

SEQ ID NO: 134794 - RNA, 22 nt, Homo sapiens
uuuccacauggacuuaccuucg

SEQ ID NO: 134795 - RNA, 22 nt, Homo sapiens
uuuccaguuggaaagccuguuu

SEQ ID NO: 134796 - RNA, 22 nt, Homo sapiens
uuuccaguuggaagaaggggga

SEQ ID NO: 134797 - RNA, 22 nt, Homo sapiens
uuuccaguuuggaggaugcauu

SEQ ID NO: 134798 - RNA, 22 nt, Homo sapiens
uuucuacagugaacgauuucua

SEQ ID NO: 134799 - RNA, 22 nt, Homo sapiens
uuucugcuugagagaauugcug

SEQ ID NO: 134800 - RNA, 22 nt, Homo sapiens
uuugaagugugaugccuugaug

SEQ ID NO: 134801 - RNA, 20 nt, Homo sapiens
uuugaauguaaagcauguca

SEQ ID NO: 134802 - RNA, 22 nt, Homo sapiens
uuugcacuggagauucaauggg

SEQ ID NO: 134803 - RNA, 23 nt, Homo sapiens
uuugcacuugcuccuucuauggc

SEQ ID NO: 134804 - RNA, 21 nt, Homo sapiens
uuugcacuuugcaaaucccua

SEQ ID NO: 134805 - RNA, 22 nt, Homo sapiens
uuugcuauagugaauagugcug

SEQ ID NO: 134806 - RNA, 22 nt, Homo sapiens
uuuggaagaugccacuguauca

SEQ ID NO: 134807 - RNA, 22 nt, Homo sapiens
uuuggcaauaaacuccccuaac

SEQ ID NO: 134808 - RNA, 20 nt, Homo sapiens
uuuggcaauaggguuuuugu

SEQ ID NO: 134809 - RNA, 22 nt, Homo sapiens
uuuggcaauuugacuguauagg

SEQ ID NO: 134810 - RNA, 22 nt, Homo sapiens
uuuggcauuagagagacuugca

SEQ ID NO: 134811 - RNA, 21 nt, Homo sapiens
uuuggcauuaugucaccagag

SEQ ID NO: 134812 - RNA, 22 nt, Homo sapiens
uuugguuuuuguuaucacucau

SEQ ID NO: 134813 - RNA, 21 nt, Homo sapiens
uuuguguccccacccaaaucu

SEQ ID NO: 134814 - RNA, 22 nt, Homo sapiens
uuuguguccccacccacaucuc

SEQ ID NO: 134815 - RNA, 23 nt, Homo sapiens
uuugugucccucuagaauucaug

SEQ ID NO: 134816 - RNA, 22 nt, Homo sapiens
uuuuacacuucgguugugugca

SEQ ID NO: 134817 - RNA, 22 nt, Homo sapiens
uuuuaguggaauauuuacaguu

SEQ ID NO: 134818 - RNA, 22 nt, Homo sapiens
uuuuccagugggacucccauua

SEQ ID NO: 134819 - RNA, 20 nt, Homo sapiens
uuuugaacuuggcaaccugu

SEQ ID NO: 134820 - RNA, 22 nt, Homo sapiens
uuuugcacauugauuugguauc

SEQ ID NO: 134821 - RNA, 22 nt, Homo sapiens
uuuugcacuguuuuaucugaca

SEQ ID NO: 134822 - RNA, 22 nt, Homo sapiens
uuuugcuccuggcaaacucaua

SEQ ID NO: 134823 - RNA, 22 nt, Homo sapiens
cuccuggugauuggagugugaa

SEQ ID NO: 134824 - RNA, 22 nt, Homo sapiens
cucugagccugagguuccuacu

SEQ ID NO: 134825 - RNA, 22 nt, Homo sapiens
cucuuuaguaagcaguugauga

SEQ ID NO: 134826 - RNA, 22 nt, Homo sapiens
cugaaaguuauucaggggcaag

SEQ ID NO: 134827 - RNA, 22 nt, Homo sapiens
cugagauuaagauauugggagu

SEQ ID NO: 134828 - RNA, 22 nt, Homo sapiens
cugagcuagaccacuuggcucc

SEQ ID NO: 134829 - RNA, 22 nt, Homo sapiens
cugauauuuuaaaauuggcugg

SEQ ID NO: 134830 - RNA, 22 nt, Homo sapiens
cugauauuuuucuggcuugugu

SEQ ID NO: 134831 - RNA, 19 nt, Homo sapiens
cugcaagguaauaggucag

SEQ ID NO: 134832 - RNA, 18 nt, Homo sapiens
cugccagugugcucuccg

SEQ ID NO: 134833 - RNA, 20 nt, Homo sapiens
cugcuccccuacaaaucuca

SEQ ID NO: 134834 - RNA, 22 nt, Homo sapiens
cugcuggucuuuaaggucuagg

SEQ ID NO: 134835 - RNA, 22 nt, Homo sapiens
cuggaaagcaaguccauugcuc

SEQ ID NO: 134836 - RNA, 22 nt, Homo sapiens
cuggaaaguagacaaucuaaaa

SEQ ID NO: 134837 - RNA, 22 nt, Homo sapiens
cuggcaaaaagagggcaauaau

SEQ ID NO: 134838 - RNA, 22 nt, Homo sapiens
cuggcaaauaguagagccagga

SEQ ID NO: 134839 - RNA, 22 nt, Homo sapiens
cugggauggaggagaauuagag

SEQ ID NO: 134840 - RNA, 22 nt, Homo sapiens
cuggguacccuuuaaacaggaa

SEQ ID NO: 134841 - RNA, 22 nt, Homo sapiens
cuguaugugagaaauaauaagu

SEQ ID NO: 134842 - RNA, 22 nt, Homo sapiens
cugucucagugaauugguuuua

SEQ ID NO: 134843 - RNA, 22 nt, Homo sapiens
cugugguauuauuagaaauauc

SEQ ID NO: 134844 - RNA, 22 nt, Homo sapiens
cuguucaggaggcauuuggugg

SEQ ID NO: 134845 - RNA, 22 nt, Homo sapiens
cuguugguguuuaaucacugca

SEQ ID NO: 134846 - RNA, 22 nt, Homo sapiens
cuguuugauuaagugguggaaa

SEQ ID NO: 134847 - RNA, 17 nt, Homo sapiens
cuucaaauaauuucccc

SEQ ID NO: 134848 - RNA, 22 nt, Homo sapiens
cuucaagucuuuggauaauuag

SEQ ID NO: 134849 - RNA, 22 nt, Homo sapiens
cuugaacaaagagauuccauua

SEQ ID NO: 134850 - RNA, 22 nt, Homo sapiens
cuugagcaaacaaaggugguag

SEQ ID NO: 134851 - RNA, 22 nt, Homo sapiens
cuugccuuugucuucaaaggcu

SEQ ID NO: 134852 - RNA, 21 nt, Homo sapiens
cuuuaugcuguguuagaaaag

SEQ ID NO: 134853 - RNA, 22 nt, Homo sapiens
cuuugauuauaaaaggguguuu

SEQ ID NO: 134854 - RNA, 22 nt, Homo sapiens
cuuuggccauagcuaaaugauu

SEQ ID NO: 134855 - RNA, 22 nt, Homo sapiens
cuuugggaccgcgguuuauacu

SEQ ID NO: 134856 - RNA, 19 nt, Homo sapiens
cuuugguugagcguguugg

SEQ ID NO: 134857 - RNA, 22 nt, Homo sapiens
cuuugugugggccaagggcugg

SEQ ID NO: 134858 - RNA, 22 nt, Homo sapiens
cuuuuggcuuaagauugucuug

SEQ ID NO: 134859 - RNA, 22 nt, Homo sapiens
gaaaacugcuucucuggguuuc

SEQ ID NO: 134860 - RNA, 20 nt, Homo sapiens
gaaacaucuauccucuccuu

SEQ ID NO: 134861 - RNA, 22 nt, Homo sapiens
gaaagacuuucugcuguggaua

SEQ ID NO: 134862 - RNA, 19 nt, Homo sapiens
gaaguguuguccuccagua

SEQ ID NO: 134863 - RNA, 22 nt, Homo sapiens
gaauacugacuauuucaucugg

SEQ ID NO: 134864 - RNA, 22 nt, Homo sapiens
gaaucacagauuaugaguaucu

SEQ ID NO: 134865 - RNA, 22 nt, Homo sapiens
gacauguuuucauguauuugga

SEQ ID NO: 134866 - RNA, 22 nt, Homo sapiens
gacauuaucagguuuguuuucu

SEQ ID NO: 134867 - RNA, 21 nt, Homo sapiens
gaccacagcagggaaugucag

SEQ ID NO: 134868 - RNA, 22 nt, Homo sapiens
gacuucaucauacuaugugugg

SEQ ID NO: 134869 - RNA, 21 nt, Homo sapiens
gagaaucaucauggcugcaua

SEQ ID NO: 134870 - RNA, 22 nt, Homo sapiens
gagaaugaacagacugccucuu

SEQ ID NO: 134871 - RNA, 22 nt, Homo sapiens
gagacggagucucgcucuguca

SEQ ID NO: 134872 - RNA, 22 nt, Homo sapiens
gagauagguauuucauuuaccc

SEQ ID NO: 134873 - RNA, 22 nt, Homo sapiens
gagauuaauacacaucaaaugc

SEQ ID NO: 134874 - RNA, 22 nt, Homo sapiens
gagccuguaggaggagaggugg

SEQ ID NO: 134875 - RNA, 21 nt, Homo sapiens
gagcuaggugaggcuguaaug

SEQ ID NO: 134876 - RNA, 20 nt, Homo sapiens
gagcucaucuucuuuaccac

SEQ ID NO: 134877 - RNA, 22 nt, Homo sapiens
gaggcagucugacccuuagcag

SEQ ID NO: 134878 - RNA, 21 nt, Homo sapiens
gaguggcuuuuguuucaccag

SEQ ID NO: 134879 - RNA, 22 nt, Homo sapiens
gaguucaaaucucagcucuguu

SEQ ID NO: 134880 - RNA, 22 nt, Homo sapiens
gaguucauaucuaugagugugc

SEQ ID NO: 134881 - RNA, 22 nt, Homo sapiens
uggguaauggagaaauaaaucu

SEQ ID NO: 134882 - RNA, 22 nt, Homo sapiens
uggguaggcccucauuggacag

SEQ ID NO: 134883 - RNA, 22 nt, Homo sapiens
ugggucaguagcauguaugucu

SEQ ID NO: 134884 - RNA, 22 nt, Homo sapiens
ugguaaacaacaggagaacuug

SEQ ID NO: 134885 - RNA, 22 nt, Homo sapiens
ugguauguaugauuaacaugga

SEQ ID NO: 134886 - RNA, 22 nt, Homo sapiens
uggucaaaucugaugugagaaa

SEQ ID NO: 134887 - RNA, 22 nt, Homo sapiens
uggucagaugcugaguggaucu

SEQ ID NO: 134888 - RNA, 22 nt, Homo sapiens
uggucaguugugccucaauucc

SEQ ID NO: 134889 - RNA, 21 nt, Homo sapiens
uggucaguuuucucacuagga

SEQ ID NO: 134890 - RNA, 21 nt, Homo sapiens
uggucccauaagauuacaaug

SEQ ID NO: 134891 - RNA, 22 nt, Homo sapiens
uggugcccuguccuucuguggc

SEQ ID NO: 134892 - RNA, 19 nt, Homo sapiens
uggugccuuguucuuggau

SEQ ID NO: 134893 - RNA, 22 nt, Homo sapiens
ugguggcuuuucguagguucac

SEQ ID NO: 134894 - RNA, 23 nt, Homo sapiens
uguaaaagcauuugucagccugg

SEQ ID NO: 134895 - RNA, 22 nt, Homo sapiens
uguaaacuaugagcugauuauu

SEQ ID NO: 134896 - RNA, 22 nt, Homo sapiens
uguaaaucugguuaauuggaua

SEQ ID NO: 134897 - RNA, 22 nt, Homo sapiens
uguaauuuaaaugauccuugga

SEQ ID NO: 134898 - RNA, 22 nt, Homo sapiens
uguagauauucuuucaguuuuu

SEQ ID NO: 134899 - RNA, 22 nt, Homo sapiens
uguagcaaaucgauacuauugg

SEQ ID NO: 134900 - RNA, 20 nt, Homo sapiens
uguagguguacaguaaggag

SEQ ID NO: 134901 - RNA, 22 nt, Homo sapiens
uguaguuugaaagcucccucug

SEQ ID NO: 134902 - RNA, 22 nt, Homo sapiens
uguauguuguaagacuuagacc

SEQ ID NO: 134903 - RNA, 22 nt, Homo sapiens
ugucaaauucuggguuaaaaca

SEQ ID NO: 134904 - RNA, 22 nt, Homo sapiens
ugucaauauguaauaacugaau

SEQ ID NO: 134905 - RNA, 22 nt, Homo sapiens
ugucagcacaacucagguuccu

SEQ ID NO: 134906 - RNA, 22 nt, Homo sapiens
ugucaguuucuugagauggaac

SEQ ID NO: 134907 - RNA, 22 nt, Homo sapiens
ugucauggauucugagucuggg

SEQ ID NO: 134908 - RNA, 16 nt, Homo sapiens
uguccaaauaaauaca

SEQ ID NO: 134909 - RNA, 19 nt, Homo sapiens
ugucccagccauagaggca

SEQ ID NO: 134910 - RNA, 22 nt, Homo sapiens
ugugaagauggacuaauauagu

SEQ ID NO: 134911 - RNA, 21 nt, Homo sapiens
ugugaccucugucucugaguc

SEQ ID NO: 134912 - RNA, 17 nt, Homo sapiens
ugugauugaagucaucc

SEQ ID NO: 134913 - RNA, 22 nt, Homo sapiens
ugugauugauuaaugugugcua

SEQ ID NO: 134914 - RNA, 22 nt, Homo sapiens
ugugccacuccagcucuagcuu

SEQ ID NO: 134915 - RNA, 22 nt, Homo sapiens
ugugcugaucgggcacgguguc

SEQ ID NO: 134916 - RNA, 22 nt, Homo sapiens
uguggaaauaaaagaaagguua

SEQ ID NO: 134917 - RNA, 17 nt, Homo sapiens
uguggcucuuaugcuga

SEQ ID NO: 134918 - RNA, 22 nt, Homo sapiens
uguggcuucuuugguucaguau

SEQ ID NO: 134919 - RNA, 21 nt, Homo sapiens
agccugugggucauaguugcc

SEQ ID NO: 134920 - RNA, 22 nt, Homo sapiens
agcucacagccuagcacuguga

SEQ ID NO: 134921 - RNA, 22 nt, Homo sapiens
agcugcaaagggagagaugauu

SEQ ID NO: 134922 - RNA, 22 nt, Homo sapiens
agcugcauucguaucauauugu

SEQ ID NO: 134923 - RNA, 19 nt, Homo sapiens
agcuguguugccugugaga

SEQ ID NO: 134924 - RNA, 22 nt, Homo sapiens
agcuguuguuaauuaacucauu

SEQ ID NO: 134925 - RNA, 22 nt, Homo sapiens
agcuguuguucucagaggcuuu

SEQ ID NO: 134926 - RNA, 22 nt, Homo sapiens
agcuuguauuuguagccuguug

SEQ ID NO: 134927 - RNA, 21 nt, Homo sapiens
agcuuguguguaucacagugu

SEQ ID NO: 134928 - RNA, 22 nt, Homo sapiens
aggaagacugaaauugcuguuc

SEQ ID NO: 134929 - RNA, 22 nt, Homo sapiens
aggaaugucaaugguaguuuaa

SEQ ID NO: 134930 - RNA, 22 nt, Homo sapiens
aggagaauugguucuucuugau

SEQ ID NO: 134931 - RNA, 22 nt, Homo sapiens
aggagcacuggccuuggaguca

SEQ ID NO: 134932 - RNA, 23 nt, Homo sapiens
aggagcuuagaaguugccauugc

SEQ ID NO: 134933 - RNA, 22 nt, Homo sapiens
agguaauuuuaucauuauguga

SEQ ID NO: 134934 - RNA, 22 nt, Homo sapiens
aggugcugagcagagaauccug

SEQ ID NO: 134935 - RNA, 22 nt, Homo sapiens
aggugcuugagggaagaaauua

SEQ ID NO: 134936 - RNA, 22 nt, Homo sapiens
aguaaagccagaccuguuaauu

SEQ ID NO: 134937 - RNA, 22 nt, Homo sapiens
agucacagugaccuugucugac

SEQ ID NO: 134938 - RNA, 22 nt, Homo sapiens
agucaguggaguaaauguaauu

SEQ ID NO: 134939 - RNA, 22 nt, Homo sapiens
agucauuguugagaugguguca

SEQ ID NO: 134940 - RNA, 22 nt, Homo sapiens
aguccauuugaugaugauucca

SEQ ID NO: 134941 - RNA, 23 nt, Homo sapiens
agucuguguuuacaggcucucug

SEQ ID NO: 134942 - RNA, 22 nt, Homo sapiens
agugaacaaagaagugcagaua

SEQ ID NO: 134943 - RNA, 22 nt, Homo sapiens
agugagcuguuuuuacuuucug

SEQ ID NO: 134944 - RNA, 22 nt, Homo sapiens
agugcaaagccgagguuucuug

SEQ ID NO: 134945 - RNA, 22 nt, Homo sapiens
agugcaauggcgugaucuuggc

SEQ ID NO: 134946 - RNA, 19 nt, Homo sapiens
agugcaauugccuuugugc

SEQ ID NO: 134947 - RNA, 22 nt, Homo sapiens
agugcauuugcaucucaauaua

SEQ ID NO: 134948 - RNA, 22 nt, Homo sapiens
aguggcaaugugauguccugaa

SEQ ID NO: 134949 - RNA, 22 nt, Homo sapiens
aguggcacuauucucagaguca

SEQ ID NO: 134950 - RNA, 22 nt, Homo sapiens
aguggguguuccauuggauaaa

SEQ ID NO: 134951 - RNA, 22 nt, Homo sapiens
aguguuuuuaacaagaaagggu

SEQ ID NO: 134952 - RNA, 22 nt, Homo sapiens
aguucaaaucgagccuggccau

SEQ ID NO: 134953 - RNA, 22 nt, Homo sapiens
aguuggugauugauugggucug

SEQ ID NO: 134954 - RNA, 19 nt, Homo sapiens
auaaacuagaacugucccc

SEQ ID NO: 134955 - RNA, 23 nt, Homo sapiens
auaaacugucaaaagccagcccu

SEQ ID NO: 134956 - RNA, 22 nt, Homo sapiens
auaaaugcuuagaucuguauau

SEQ ID NO: 134957 - RNA, 22 nt, Homo sapiens
auaaaugcuuccagucauuaaa

SEQ ID NO: 134958 - RNA, 20 nt, Homo sapiens
auaaauguauagguguacau

SEQ ID NO: 134959 - RNA, 22 nt, Homo sapiens
auaagagugggguguuagggau

SEQ ID NO: 134960 - RNA, 22 nt, Homo sapiens
auacagcuaaaauauuaaguua

SEQ ID NO: 134961 - RNA, 22 nt, Homo sapiens
auacagguauacaaugcauaau

SEQ ID NO: 134962 - RNA, 22 nt, Homo sapiens
auacccauacauauuggugacu

SEQ ID NO: 134963 - RNA, 22 nt, Homo sapiens
auaccuuguagugcuauuugau

SEQ ID NO: 134964 - RNA, 22 nt, Homo sapiens
auagacacugaaaucccugcca

SEQ ID NO: 134965 - RNA, 22 nt, Homo sapiens
auggcucuuauuauuuugaggu

SEQ ID NO: 134966 - RNA, 22 nt, Homo sapiens
auggcuuucaggacguggcgag

SEQ ID NO: 134967 - RNA, 22 nt, Homo sapiens
auggcuuuggucucccagugau

SEQ ID NO: 134968 - RNA, 21 nt, Homo sapiens
augggacuaacugaugggucu

SEQ ID NO: 134969 - RNA, 22 nt, Homo sapiens
augggcacugauguauucugug

SEQ ID NO: 134970 - RNA, 22 nt, Homo sapiens
augguugguuaaaucuguguau

SEQ ID NO: 134971 - RNA, 22 nt, Homo sapiens
auguaguagcagaaaauauuuu

SEQ ID NO: 134972 - RNA, 22 nt, Homo sapiens
augucuagagcaagagaugcug

SEQ ID NO: 134973 - RNA, 17 nt, Homo sapiens
augugaauguucaaaua

SEQ ID NO: 134974 - RNA, 22 nt, Homo sapiens
augugcaaauuuccaaacucuu

SEQ ID NO: 134975 - RNA, 20 nt, Homo sapiens
augugcaguguggcaaccaa

SEQ ID NO: 134976 - RNA, 22 nt, Homo sapiens
auguguaaagcuuuucuuuguu

SEQ ID NO: 134977 - RNA, 22 nt, Homo sapiens
auguuguaguaugagucaaaau

SEQ ID NO: 134978 - RNA, 22 nt, Homo sapiens
auuaauguaauuaguaaaguug

SEQ ID NO: 134979 - RNA, 22 nt, Homo sapiens
auuauauguguaugugcauacc

SEQ ID NO: 134980 - RNA, 22 nt, Homo sapiens
auucaagugaugcagcuguuuu

SEQ ID NO: 134981 - RNA, 22 nt, Homo sapiens
auucaugggagcuacuuuaaaa

SEQ ID NO: 134982 - RNA, 22 nt, Homo sapiens
auuccacaguuaacacagaccg

SEQ ID NO: 134983 - RNA, 22 nt, Homo sapiens
auuccacuuagugacucauuug

SEQ ID NO: 134984 - RNA, 21 nt, Homo sapiens
auuccacuuuuccuucaggga

SEQ ID NO: 134985 - RNA, 22 nt, Homo sapiens
auugaaugaaauggcagacacu

SEQ ID NO: 134986 - RNA, 22 nt, Homo sapiens
auugacaguuggccaguaagug

SEQ ID NO: 134987 - RNA, 22 nt, Homo sapiens
auugcaaagcguagacucuaaa

SEQ ID NO: 134988 - RNA, 22 nt, Homo sapiens
auugcacuccagccugggcagc

SEQ ID NO: 134989 - RNA, 22 nt, Homo sapiens
auugcacuccagucugggcaac

SEQ ID NO: 134990 - RNA, 22 nt, Homo sapiens
auugcacuccauccugggcaau

SEQ ID NO: 134991 - RNA, 22 nt, Homo sapiens
auugcacugcagccugggcaac

SEQ ID NO: 134992 - RNA, 22 nt, Homo sapiens
auugcagaaaugacagagcgcc

SEQ ID NO: 134993 - RNA, 22 nt, Homo sapiens
auugcuuacccuguauuagauc

SEQ ID NO: 134994 - RNA, 22 nt, Homo sapiens
auuggucuugaaaccagagaga

SEQ ID NO: 134995 - RNA, 22 nt, Homo sapiens
auuguacauacaccggugugua

SEQ ID NO: 134996 - RNA, 22 nt, Homo sapiens
auuuggguuuuacaucaggcua

SEQ ID NO: 134997 - RNA, 22 nt, Homo sapiens
auuugucacuuaacagccauua

SEQ ID NO: 134998 - RNA, 22 nt, Homo sapiens
auuuugcauugcuguaaaggaa

SEQ ID NO: 134999 - RNA, 22 nt, Homo sapiens
caaaagugguucuuauccuuuu

SEQ ID NO: 135000 - RNA, 22 nt, Homo sapiens
caaaggugcuuuccagguccaa

SEQ ID NO: 135001 - RNA, 22 nt, Homo sapiens
caaagugcugaaagaggccagg

SEQ ID NO: 135002 - RNA, 22 nt, Homo sapiens
caagaggcuguguauaaagcca

SEQ ID NO: 135003 - RNA, 22 nt, Homo sapiens
caaggugcugagacaggagccc

SEQ ID NO: 135004 - RNA, 22 nt, Homo sapiens
caagugcucuaggauccugagu

SEQ ID NO: 135005 - RNA, 22 nt, Homo sapiens
caagugcuuucuuggggauuua

SEQ ID NO: 135006 - RNA, 22 nt, Homo sapiens
caaguguuuccuuaaauacuug

SEQ ID NO: 135007 - RNA, 19 nt, Homo sapiens
caauacuucuuggcauaca

SEQ ID NO: 135008 - RNA, 22 nt, Homo sapiens
caauggcaaugaaauagugaga

SEQ ID NO: 135009 - RNA, 22 nt, Homo sapiens
cacaaccuccgccuccuggguu

SEQ ID NO: 135010 - RNA, 22 nt, Homo sapiens
cacacugucuucauuacuguag

SEQ ID NO: 135011 - RNA, 22 nt, Homo sapiens
cacacugucuuucagaaugguu

SEQ ID NO: 135012 - RNA, 22 nt, Homo sapiens
cacagcacaggcaugaguguca

SEQ ID NO: 135013 - RNA, 22 nt, Homo sapiens
cacagcgacuuccgccuaccgg

SEQ ID NO: 135014 - RNA, 22 nt, Homo sapiens
caccagcuggcauugaauaccu

SEQ ID NO: 135015 - RNA, 19 nt, Homo sapiens
caccagugcaugcuacuau

SEQ ID NO: 135016 - RNA, 22 nt, Homo sapiens
caccuguacauggcaguguccu

SEQ ID NO: 135017 - RNA, 22 nt, Homo sapiens
cacuaggcuggagugcaguggc

SEQ ID NO: 135018 - RNA, 22 nt, Homo sapiens
cacucaguuugugguacuuugu

SEQ ID NO: 135019 - RNA, 22 nt, Homo sapiens
cacugcacuccagcuuugguga

SEQ ID NO: 135020 - RNA, 22 nt, Homo sapiens
cacugcacuccagucccgucuc

SEQ ID NO: 135021 - RNA, 22 nt, Homo sapiens
cacuggacauguugaagcuuuu

SEQ ID NO: 135022 - RNA, 23 nt, Homo sapiens
cacugggcagcagguguucccag

SEQ ID NO: 135023 - RNA, 22 nt, Homo sapiens
cacuggucucauggcaugagag

SEQ ID NO: 135024 - RNA, 22 nt, Homo sapiens
cagaaguauugguaugcucugu

SEQ ID NO: 135025 - RNA, 22 nt, Homo sapiens
cagagugcauguuuagaugagu

SEQ ID NO: 135026 - RNA, 22 nt, Homo sapiens
cagauacucauggaacuggguu

SEQ ID NO: 135027 - RNA, 22 nt, Homo sapiens
cagcacauagcaguugcucagu

SEQ ID NO: 135028 - RNA, 22 nt, Homo sapiens
cagcuggugcugcaccaguggg

SEQ ID NO: 135029 - RNA, 22 nt, Homo sapiens
cagguaagaugcuuucucuuau

SEQ ID NO: 135030 - RNA, 22 nt, Homo sapiens
caggugaaugccucuccuucug

SEQ ID NO: 135031 - RNA, 22 nt, Homo sapiens
cagugcauccauguucagcagu

SEQ ID NO: 135032 - RNA, 22 nt, Homo sapiens
cagugcaugacuguauauuauc

SEQ ID NO: 135033 - RNA, 22 nt, Homo sapiens
caugacacauguuuaccuaugu

SEQ ID NO: 135034 - RNA, 22 nt, Homo sapiens
cauggcaucuguguggccucca

SEQ ID NO: 135035 - RNA, 22 nt, Homo sapiens
cauguaacaucccgcuguagga

SEQ ID NO: 135036 - RNA, 22 nt, Homo sapiens
cauuccacauguaggacaauuu

SEQ ID NO: 135037 - RNA, 22 nt, Homo sapiens
cauuccacuggauaaacaaggu

SEQ ID NO: 135038 - RNA, 16 nt, Homo sapiens
cuaaaaugucuacuug

SEQ ID NO: 135039 - RNA, 22 nt, Homo sapiens
cuaaagauagugacaugauuug

SEQ ID NO: 135040 - RNA, 22 nt, Homo sapiens
cuaaaguagccaggacugcagg

SEQ ID NO: 135041 - RNA, 22 nt, Homo sapiens
cuaaaugcacugucaaaggaag

SEQ ID NO: 135042 - RNA, 17 nt, Homo sapiens
cuaaggcaagagucugc

SEQ ID NO: 135043 - RNA, 22 nt, Homo sapiens
cuaauacaguuguccaagcugg

SEQ ID NO: 135044 - RNA, 22 nt, Homo sapiens
cuagaagcauauucagaacaga

SEQ ID NO: 135045 - RNA, 22 nt, Homo sapiens
cuagaagguaagagcuggaugc

SEQ ID NO: 135046 - RNA, 22 nt, Homo sapiens
cuaggcuguagagaaguucagu

SEQ ID NO: 135047 - RNA, 22 nt, Homo sapiens
cuagucacauuuucaucaaaua

SEQ ID NO: 135048 - RNA, 22 nt, Homo sapiens
cuaucucauugguuuuugaaag

SEQ ID NO: 135049 - RNA, 22 nt, Homo sapiens
cuauuugguuggugaaaaaagu

SEQ ID NO: 135050 - RNA, 22 nt, Homo sapiens
cucagcuacuugggaagcugag

SEQ ID NO: 135051 - RNA, 21 nt, Homo sapiens
cucugguuugcauuggauuau

SEQ ID NO: 135052 - RNA, 22 nt, Homo sapiens
cugaaagguauacgcuuguuau

SEQ ID NO: 135053 - RNA, 22 nt, Homo sapiens
cugaaauggaaugugugcacag

SEQ ID NO: 135054 - RNA, 22 nt, Homo sapiens
cugaauguccaggcagagguuu

SEQ ID NO: 135055 - RNA, 22 nt, Homo sapiens
cugaauguucuauagaagccgc

SEQ ID NO: 135056 - RNA, 22 nt, Homo sapiens
cugacaugcagccacugcaccu

SEQ ID NO: 135057 - RNA, 22 nt, Homo sapiens
cugacauuguugaucacagcca

SEQ ID NO: 135058 - RNA, 22 nt, Homo sapiens
cugagaauguaaaugaagcuuu

SEQ ID NO: 135059 - RNA, 22 nt, Homo sapiens
cugagagaggagcuaaaacugc

SEQ ID NO: 135060 - RNA, 22 nt, Homo sapiens
cugagauuuuuagauccuggcg

SEQ ID NO: 135061 - RNA, 22 nt, Homo sapiens
cugagcuaguagcauuguguca

SEQ ID NO: 135062 - RNA, 22 nt, Homo sapiens
cugagguaggugaucagugcuu

SEQ ID NO: 135063 - RNA, 22 nt, Homo sapiens
cugaggucugaauccagguauc

SEQ ID NO: 135064 - RNA, 22 nt, Homo sapiens
cugaggugauauauacauauuu

SEQ ID NO: 135065 - RNA, 22 nt, Homo sapiens
cugaucuguagcagccaccaca

SEQ ID NO: 135066 - RNA, 21 nt, Homo sapiens
cugcaaaugcugcugccugau

SEQ ID NO: 135067 - RNA, 22 nt, Homo sapiens
cugcauuggguuaugcauuuuu

SEQ ID NO: 135068 - RNA, 22 nt, Homo sapiens
cugccacugacaccucaaggac

SEQ ID NO: 135069 - RNA, 22 nt, Homo sapiens
cugccuagaucugaaccuggcu

SEQ ID NO: 135070 - RNA, 22 nt, Homo sapiens
cuggaaacaucuuaggaaugca

SEQ ID NO: 135071 - RNA, 22 nt, Homo sapiens
cuggcacccuugcuuaggaaga

SEQ ID NO: 135072 - RNA, 22 nt, Homo sapiens
cuggcucauuucauuuagcaua

SEQ ID NO: 135073 - RNA, 22 nt, Homo sapiens
cuggugauugguuucauucagu

SEQ ID NO: 135074 - RNA, 22 nt, Homo sapiens
cuguaaagaucacagagcuggu

SEQ ID NO: 135075 - RNA, 22 nt, Homo sapiens
cuguaauguaaugagacuacau

SEQ ID NO: 135076 - RNA, 22 nt, Homo sapiens
cugucagugggaguucaggcuu

SEQ ID NO: 135077 - RNA, 22 nt, Homo sapiens
cugugcauaugacuuuauugga

SEQ ID NO: 135078 - RNA, 22 nt, Homo sapiens
cuguguaguacuagauugagca

SEQ ID NO: 135079 - RNA, 22 nt, Homo sapiens
cuguucaaauuguuugugaagu

SEQ ID NO: 135080 - RNA, 20 nt, Homo sapiens
cuucacagaaguggaaucau

SEQ ID NO: 135081 - RNA, 22 nt, Homo sapiens
cuucaucugguuugugaacuuu

SEQ ID NO: 135082 - RNA, 22 nt, Homo sapiens
cuuccagcuggguucagucagu

SEQ ID NO: 135083 - RNA, 22 nt, Homo sapiens
cuugagcauauucuauauuaaa

SEQ ID NO: 135084 - RNA, 22 nt, Homo sapiens
cuugcacauuacagaucugcau

SEQ ID NO: 135085 - RNA, 22 nt, Homo sapiens
cuugcacucagaagauucaguu

SEQ ID NO: 135086 - RNA, 22 nt, Homo sapiens
cuugcagagcccauggauguca

SEQ ID NO: 135087 - RNA, 20 nt, Homo sapiens
cuugcuccccuuguucuaga

SEQ ID NO: 135088 - RNA, 22 nt, Homo sapiens
cuuggcauuguguugauagaag

SEQ ID NO: 135089 - RNA, 22 nt, Homo sapiens
cuuguacacuguuggugggaau

SEQ ID NO: 135090 - RNA, 22 nt, Homo sapiens
cuugugccugaucuuagggggc

SEQ ID NO: 135091 - RNA, 22 nt, Homo sapiens
cuuguucuccuaagaugaaugc

SEQ ID NO: 135092 - RNA, 17 nt, Homo sapiens
cuuguugugguaguuug

SEQ ID NO: 135093 - RNA, 22 nt, Homo sapiens
cuuuacacauccuaaccagugu

SEQ ID NO: 135094 - RNA, 22 nt, Homo sapiens
cuuucucagugagacccgagau

SEQ ID NO: 135095 - RNA, 22 nt, Homo sapiens
cuuuggugauagauaccccaua

SEQ ID NO: 135096 - RNA, 22 nt, Homo sapiens
cuuuugugauuccucaguuacu

SEQ ID NO: 135097 - RNA, 22 nt, Homo sapiens
cuuuuugcaaauacaacucuga

SEQ ID NO: 135098 - RNA, 22 nt, Homo sapiens
gaaagauuuuaacugggagacu

SEQ ID NO: 135099 - RNA, 22 nt, Homo sapiens
gaaaugcucauuuuggauccuu

SEQ ID NO: 135100 - RNA, 23 nt, Homo sapiens
gaaauguaagugaugccccacag

SEQ ID NO: 135101 - RNA, 22 nt, Homo sapiens
gaacccuggaggcggagguugc

SEQ ID NO: 135102 - RNA, 22 nt, Homo sapiens
gaaggugcuuggugaaugcauu

SEQ ID NO: 135103 - RNA, 22 nt, Homo sapiens
gaauggaacugacuauagcuga

SEQ ID NO: 135104 - RNA, 22 nt, Homo sapiens
gaccuguaguuuaguugccugu

SEQ ID NO: 135105 - RNA, 22 nt, Homo sapiens
gacuuagaauuuuugccugcua

SEQ ID NO: 135106 - RNA, 22 nt, Homo sapiens
gacuuugguaaacucgguggca

SEQ ID NO: 135107 - RNA, 22 nt, Homo sapiens
gagaaugagaggggaaggccac

SEQ ID NO: 135108 - RNA, 22 nt, Homo sapiens
gcccagcguucagggaggggcu

SEQ ID NO: 135109 - RNA, 22 nt, Homo sapiens
gccccaguacaggcuccuuaga

SEQ ID NO: 135110 - RNA, 22 nt, Homo sapiens
gcccuguugcccaggcuggagu

SEQ ID NO: 135111 - RNA, 22 nt, Homo sapiens
gcccuuugugucuggcuggggu

SEQ ID NO: 135112 - RNA, 22 nt, Homo sapiens
gccuaguguuaauguguguuca

SEQ ID NO: 135113 - RNA, 19 nt, Homo sapiens
gcucaccuugcugcuccag

SEQ ID NO: 135114 - RNA, 22 nt, Homo sapiens
gcugguguugugaaucaggccg

SEQ ID NO: 135115 - RNA, 22 nt, Homo sapiens
gcuguauugacuuuguaucaua

SEQ ID NO: 135116 - RNA, 22 nt, Homo sapiens
gcugucaugagcaacacaugaa

SEQ ID NO: 135117 - RNA, 22 nt, Homo sapiens
gcuuuguugauggugagucugu

SEQ ID NO: 135118 - RNA, 21 nt, Homo sapiens
gcuuuuucggaagucuuuggc

SEQ ID NO: 135119 - RNA, 22 nt, Homo sapiens
ggaaaucaucauucucgguaua

SEQ ID NO: 135120 - RNA, 22 nt, Homo sapiens
ggaagaauauuaggggauuucg

SEQ ID NO: 135121 - RNA, 22 nt, Homo sapiens
ggaagccugcacucgggcaggg

SEQ ID NO: 135122 - RNA, 23 nt, Homo sapiens
ggaaugaaaccugguuaugauau

SEQ ID NO: 135123 - RNA, 22 nt, Homo sapiens
ggaauguuaaggcgcuguuggu

SEQ ID NO: 135124 - RNA, 21 nt, Homo sapiens
ggaauguugccagcagccaga

SEQ ID NO: 135125 - RNA, 22 nt, Homo sapiens
ggacaagagacugggacacuga

SEQ ID NO: 135126 - RNA, 22 nt, Homo sapiens
ggacuagggacauggggagcug

SEQ ID NO: 135127 - RNA, 22 nt, Homo sapiens
ggagaguaauuagacugaaaga

SEQ ID NO: 135128 - RNA, 22 nt, Homo sapiens
ggagagugacauauuucuaggc

SEQ ID NO: 135129 - RNA, 22 nt, Homo sapiens
ggaguucaucaggugaggggua

SEQ ID NO: 135130 - RNA, 22 nt, Homo sapiens
ggauuuguuggcauuagugaug

SEQ ID NO: 135131 - RNA, 22 nt, Homo sapiens
ggcaagaaaaugcaauuacugu

SEQ ID NO: 135132 - RNA, 22 nt, Homo sapiens
ggcaagaagagaguuuaaacau

SEQ ID NO: 135133 - RNA, 22 nt, Homo sapiens
ggcaccauggaaggacgggagc

SEQ ID NO: 135134 - RNA, 22 nt, Homo sapiens
ggcaccauuuuacuccuucccu

SEQ ID NO: 135135 - RNA, 22 nt, Homo sapiens
ggcagaucauuggccucaguuu

SEQ ID NO: 135136 - RNA, 22 nt, Homo sapiens
ggcagguaaggagugggagccu

SEQ ID NO: 135137 - RNA, 22 nt, Homo sapiens
ggcaguggaagugccaguuucu

SEQ ID NO: 135138 - RNA, 22 nt, Homo sapiens
ggcuacauuguuacaauuagua

SEQ ID NO: 135139 - RNA, 22 nt, Homo sapiens
ggcuauagauaugugaacacuu

SEQ ID NO: 135140 - RNA, 18 nt, Homo sapiens
ggcugguguuuuaguaua

SEQ ID NO: 135141 - RNA, 22 nt, Homo sapiens
ggcuuggaggaaugugagggcu

SEQ ID NO: 135142 - RNA, 22 nt, Homo sapiens
gggaugaagcccuaggguuggu

SEQ ID NO: 135143 - RNA, 22 nt, Homo sapiens
gggaugaauuagguauguuuau

SEQ ID NO: 135144 - RNA, 19 nt, Homo sapiens
gggcaaaucuggaaauuua

SEQ ID NO: 135145 - RNA, 21 nt, Homo sapiens
gggcaaaucuuuauccuaagc

SEQ ID NO: 135146 - RNA, 23 nt, Homo sapiens
gggcuagaugagagcuuccuggg

SEQ ID NO: 135147 - RNA, 22 nt, Homo sapiens
ggguaaaucucuuuucauggcu

SEQ ID NO: 135148 - RNA, 22 nt, Homo sapiens
gggucaguuuugagaaagcgug

SEQ ID NO: 135149 - RNA, 22 nt, Homo sapiens
gguaucuuggagagagaaguga

SEQ ID NO: 135150 - RNA, 22 nt, Homo sapiens
ggucagugcauucuaaaggcaa

SEQ ID NO: 135151 - RNA, 22 nt, Homo sapiens
gguggugguauuucagaaaaug

SEQ ID NO: 135152 - RNA, 22 nt, Homo sapiens
guaacucugucacuuacuaguu

SEQ ID NO: 135153 - RNA, 22 nt, Homo sapiens
guaacuggccuucaauuucuuc

SEQ ID NO: 135154 - RNA, 22 nt, Homo sapiens
guaauacuuuugggauauuaga

SEQ ID NO: 135155 - RNA, 22 nt, Homo sapiens
guaaucucagcuacucgggaga

SEQ ID NO: 135156 - RNA, 22 nt, Homo sapiens
guaaucucagcuacuugggagc

SEQ ID NO: 135157 - RNA, 22 nt, Homo sapiens
guaaucucagcuacuugggagu

SEQ ID NO: 135158 - RNA, 19 nt, Homo sapiens
guaaucucaguacuuuggu

SEQ ID NO: 135159 - RNA, 22 nt, Homo sapiens
guaaugcacucccaaagaucca

SEQ ID NO: 135160 - RNA, 22 nt, Homo sapiens
guacaggugcaggaugggcagg

SEQ ID NO: 135161 - RNA, 22 nt, Homo sapiens
guacauagucacacauauacau

SEQ ID NO: 135162 - RNA, 17 nt, Homo sapiens
guacucagugaccaugg

SEQ ID NO: 135163 - RNA, 22 nt, Homo sapiens
guagaaagcauuucagauuugc

SEQ ID NO: 135164 - RNA, 22 nt, Homo sapiens
guagaaaguuugcugucacaug

SEQ ID NO: 135165 - RNA, 22 nt, Homo sapiens
guaguuuaucagaaagaauagg

SEQ ID NO: 135166 - RNA, 22 nt, Homo sapiens
guauuuuguuagggugugguau

SEQ ID NO: 135167 - RNA, 22 nt, Homo sapiens
gucaacauauuaauuauguucu

SEQ ID NO: 135168 - RNA, 22 nt, Homo sapiens
gucaaguaaauguuaugguuau

SEQ ID NO: 135169 - RNA, 22 nt, Homo sapiens
gucaagugaagaccugacucuu

SEQ ID NO: 135170 - RNA, 22 nt, Homo sapiens
gucaauguaucuagcuguauua

SEQ ID NO: 135171 - RNA, 22 nt, Homo sapiens
gucacaguggccagugauguuc

SEQ ID NO: 135172 - RNA, 22 nt, Homo sapiens
gucacugugaggaggggccagg

SEQ ID NO: 135173 - RNA, 22 nt, Homo sapiens
gucauggugcuagcgggaaugu

SEQ ID NO: 135174 - RNA, 20 nt, Homo sapiens
guccauuugcugccauugcu

SEQ ID NO: 135175 - RNA, 22 nt, Homo sapiens
gucccugugucuuuauguggcc

SEQ ID NO: 135176 - RNA, 22 nt, Homo sapiens
gucucauugcaguuagaccugu

SEQ ID NO: 135177 - RNA, 22 nt, Homo sapiens
uaucacagcgggguguacaccc

SEQ ID NO: 135178 - RNA, 22 nt, Homo sapiens
uaucacagguggacugcacacc

SEQ ID NO: 135179 - RNA, 22 nt, Homo sapiens
uaucucauccuccuugauccca

SEQ ID NO: 135180 - RNA, 21 nt, Homo sapiens
uaugagucugcaagaaccaca

SEQ ID NO: 135181 - RNA, 22 nt, Homo sapiens
uauggauuugccuauucuguau

SEQ ID NO: 135182 - RNA, 22 nt, Homo sapiens
uauggguauuuuauacauaacc

SEQ ID NO: 135183 - RNA, 22 nt, Homo sapiens
uauuacugucaauaucacagaa

SEQ ID NO: 135184 - RNA, 22 nt, Homo sapiens
uauuacuguuauuccuaucaaa

SEQ ID NO: 135185 - RNA, 22 nt, Homo sapiens
uauuagugccuaagucuuaggg

SEQ ID NO: 135186 - RNA, 22 nt, Homo sapiens
uauuccacuggcacugcauuug

SEQ ID NO: 135187 - RNA, 22 nt, Homo sapiens
uauugcauauuauucuaguggc

SEQ ID NO: 135188 - RNA, 22 nt, Homo sapiens
uauugccucagugacuuugggg

SEQ ID NO: 135189 - RNA, 22 nt, Homo sapiens
uauugccucuuuuguaaaagug

SEQ ID NO: 135190 - RNA, 22 nt, Homo sapiens
uauuggcucuguuucucugaag

SEQ ID NO: 135191 - RNA, 22 nt, Homo sapiens
ucaaacauccccaccagggacu

SEQ ID NO: 135192 - RNA, 22 nt, Homo sapiens
ucaaagacacacaaggagaagg

SEQ ID NO: 135193 - RNA, 20 nt, Homo sapiens
ucaaagacauggcugucaga

SEQ ID NO: 135194 - RNA, 20 nt, Homo sapiens
ucaaaguaugcucugcacua

SEQ ID NO: 135195 - RNA, 22 nt, Homo sapiens
ucaaagugacaaaguugcagca

SEQ ID NO: 135196 - RNA, 22 nt, Homo sapiens
ucaaagugagcuccuucucacu

SEQ ID NO: 135197 - RNA, 21 nt, Homo sapiens
ucaaaguguucuuuuguugaa

SEQ ID NO: 135198 - RNA, 22 nt, Homo sapiens
ucaaaugauucagaagccaccu

SEQ ID NO: 135199 - RNA, 22 nt, Homo sapiens
ucaaaugguccacgugaacauu

SEQ ID NO: 135200 - RNA, 22 nt, Homo sapiens
ucaaguacugccuugcucuggc

SEQ ID NO: 135201 - RNA, 22 nt, Homo sapiens
ucaaguacuuauuugauaauua

SEQ ID NO: 135202 - RNA, 22 nt, Homo sapiens
ucaaguacuuugcauagugccg

SEQ ID NO: 135203 - RNA, 22 nt, Homo sapiens
ucaagugcauugauucaguauu

SEQ ID NO: 135204 - RNA, 22 nt, Homo sapiens
ucaauguaucuccaagaauuga

SEQ ID NO: 135205 - RNA, 16 nt, Homo sapiens
ucacaaacucuagcag

SEQ ID NO: 135206 - RNA, 22 nt, Homo sapiens
ucacaauguaaaugaggguugg

SEQ ID NO: 135207 - RNA, 22 nt, Homo sapiens
ucacaccauucuucuacuucag

SEQ ID NO: 135208 - RNA, 22 nt, Homo sapiens
ucacacucucaccaacauuugg

SEQ ID NO: 135209 - RNA, 22 nt, Homo sapiens
ucacaguagggaacugacaaag

SEQ ID NO: 135210 - RNA, 22 nt, Homo sapiens
ucacaguuggccuggccuuuua

SEQ ID NO: 135211 - RNA, 22 nt, Homo sapiens
ucacugaggucugagcuuuaug

SEQ ID NO: 135212 - RNA, 22 nt, Homo sapiens
ucacugcacuucaggcuuucuc

SEQ ID NO: 135213 - RNA, 22 nt, Homo sapiens
ucacuguguauguauaugcagg

SEQ ID NO: 135214 - RNA, 22 nt, Homo sapiens
ucacuuuggguacuauggaaau

SEQ ID NO: 135215 - RNA, 22 nt, Homo sapiens
ucacuuuguuuuuggauaaguu

SEQ ID NO: 135216 - RNA, 22 nt, Homo sapiens
ucagaacugaacaaaccagucu

SEQ ID NO: 135217 - RNA, 22 nt, Homo sapiens
ucagaauguaacuuuaguugga

SEQ ID NO: 135218 - RNA, 22 nt, Homo sapiens
ucagacacugagcaaacgacua

SEQ ID NO: 135219 - RNA, 22 nt, Homo sapiens
ucagagcaaagacacuuuauca

SEQ ID NO: 135220 - RNA, 22 nt, Homo sapiens
ucagauguuucuuuaacgcaug

SEQ ID NO: 135221 - RNA, 21 nt, Homo sapiens
ucagcucaucacugccuggag

SEQ ID NO: 135222 - RNA, 20 nt, Homo sapiens
ucaggcuccgcauuaacuua

SEQ ID NO: 135223 - RNA, 23 nt, Homo sapiens
ucagguaggccuagaguauucuu

SEQ ID NO: 135224 - RNA, 22 nt, Homo sapiens
ucagguaucucuauagcaaugu

SEQ ID NO: 135225 - RNA, 22 nt, Homo sapiens
ucagguaugucuuuaacagcag

SEQ ID NO: 135226 - RNA, 22 nt, Homo sapiens
ucagguauuuuaucacaugaag

SEQ ID NO: 135227 - RNA, 22 nt, Homo sapiens
ucagugauugguuauuuuaggc

SEQ ID NO: 135228 - RNA, 22 nt, Homo sapiens
ucagugucaucuggguuguuug

SEQ ID NO: 135229 - RNA, 21 nt, Homo sapiens
ucaucaagcuguagacaugau

SEQ ID NO: 135230 - RNA, 22 nt, Homo sapiens
ucaucaguggggaugugguuga

SEQ ID NO: 135231 - RNA, 20 nt, Homo sapiens
ucaucaguuggugcucgcug

SEQ ID NO: 135232 - RNA, 22 nt, Homo sapiens
ucaucaguuuuuuauaugugau

SEQ ID NO: 135233 - RNA, 22 nt, Homo sapiens
ucaugggagcccccaucaugag

SEQ ID NO: 135234 - RNA, 22 nt, Homo sapiens
ucauggggugagcuacaggcac

SEQ ID NO: 135235 - RNA, 22 nt, Homo sapiens
ucaugguuuuauaacccucuug

SEQ ID NO: 135236 - RNA, 22 nt, Homo sapiens
uccagugugcaggcaaguuuga

SEQ ID NO: 135237 - RNA, 22 nt, Homo sapiens
uccaguguuauaauaugcgucu

SEQ ID NO: 135238 - RNA, 22 nt, Homo sapiens
uccaguguuucuuccacuauuu

SEQ ID NO: 135239 - RNA, 22 nt, Homo sapiens
ucccaagaugagaugggggcug

SEQ ID NO: 135240 - RNA, 22 nt, Homo sapiens
ucccacugucuucucgugcucg

SEQ ID NO: 135241 - RNA, 22 nt, Homo sapiens
ucccaguggucuugaaacaggg

SEQ ID NO: 135242 - RNA, 22 nt, Homo sapiens
ucccauguagcuaggauuacag

SEQ ID NO: 135243 - RNA, 22 nt, Homo sapiens
ucccuagacuccugccuuucag

SEQ ID NO: 135244 - RNA, 22 nt, Homo sapiens
ucccuagagaagugauuuuuga

SEQ ID NO: 135245 - RNA, 22 nt, Homo sapiens
ucccugaaaaauuggcuuaaca

SEQ ID NO: 135246 - RNA, 22 nt, Homo sapiens
ucccugacagucacagagcuac

SEQ ID NO: 135247 - RNA, 19 nt, Homo sapiens
ucccuguagaccacagugc

SEQ ID NO: 135248 - RNA, 22 nt, Homo sapiens
uccuuugguucuugucacccca

SEQ ID NO: 135249 - RNA, 22 nt, Homo sapiens
ucuaaaguacuacuacuguugg

SEQ ID NO: 135250 - RNA, 18 nt, Homo sapiens
ucuagacacugugucuau

SEQ ID NO: 135251 - RNA, 22 nt, Homo sapiens
ucucaaccuccacacuacaaua

SEQ ID NO: 135252 - RNA, 22 nt, Homo sapiens
ucucaguuuucaagcugucgau

SEQ ID NO: 135253 - RNA, 23 nt, Homo sapiens
ucucauuccuugaaaauaaugac

SEQ ID NO: 135254 - RNA, 17 nt, Homo sapiens
ucucccaucccuuucuc

SEQ ID NO: 135255 - RNA, 22 nt, Homo sapiens
ucucuggauaucuacuuauguu

SEQ ID NO: 135256 - RNA, 22 nt, Homo sapiens
ucugcauauucuagggcaccaa

SEQ ID NO: 135257 - RNA, 22 nt, Homo sapiens
ucugccacugucauugugugau

SEQ ID NO: 135258 - RNA, 22 nt, Homo sapiens
ucuggccuacaaguaauuuuau

SEQ ID NO: 135259 - RNA, 22 nt, Homo sapiens
ucuggcuccaaagucuauuuuu

SEQ ID NO: 135260 - RNA, 22 nt, Homo sapiens
ucuggcuuuuaacaucuauaaa

SEQ ID NO: 135261 - RNA, 22 nt, Homo sapiens
ucugggguuagucaaagguaug

SEQ ID NO: 135262 - RNA, 22 nt, Homo sapiens
ucugggguuuccacuuuuacuu

SEQ ID NO: 135263 - RNA, 22 nt, Homo sapiens
ucuguggucagaguccuuggcc

SEQ ID NO: 135264 - RNA, 22 nt, Homo sapiens
ucuugguugaaaauucauaaua

SEQ ID NO: 135265 - RNA, 22 nt, Homo sapiens
ucuugguuuauugugguaugaa

SEQ ID NO: 135266 - RNA, 22 nt, Homo sapiens
ucuugucacugcauccccagcu

SEQ ID NO: 135267 - RNA, 19 nt, Homo sapiens
ucuuugcuuuucuaagagg

SEQ ID NO: 135268 - RNA, 22 nt, Homo sapiens
ucuuuugugagucagccucucc

SEQ ID NO: 135269 - RNA, 22 nt, Homo sapiens
ugaaagguuuaauucugugaga

SEQ ID NO: 135270 - RNA, 22 nt, Homo sapiens
ugaaaguaauugcaguuuuuac

SEQ ID NO: 135271 - RNA, 22 nt, Homo sapiens
ugaaaucauguaguuauugcaa

SEQ ID NO: 135272 - RNA, 22 nt, Homo sapiens
ugaaaugaucaguuugguuacu

SEQ ID NO: 135273 - RNA, 22 nt, Homo sapiens
ugaaaugccuuuaaugaauuua

SEQ ID NO: 135274 - RNA, 22 nt, Homo sapiens
ugaaaugguuaugugaggagau

SEQ ID NO: 135275 - RNA, 22 nt, Homo sapiens
ugaaauguuaaacaaguggcuc

SEQ ID NO: 135276 - RNA, 22 nt, Homo sapiens
ugaacagucaucucucuuguau

SEQ ID NO: 135277 - RNA, 20 nt, Homo sapiens
ugaaggaggucauuuauacc

SEQ ID NO: 135278 - RNA, 22 nt, Homo sapiens
ugaagggcauuguuuugccaaa

SEQ ID NO: 135279 - RNA, 22 nt, Homo sapiens
ugaagugaagacucacagaagg

SEQ ID NO: 135280 - RNA, 22 nt, Homo sapiens
ugaaguguuuauuuuggccuuc

SEQ ID NO: 135281 - RNA, 22 nt, Homo sapiens
ugaaugcauggggccaagaagg

SEQ ID NO: 135282 - RNA, 22 nt, Homo sapiens
ugacaagaguagagagggugcc

SEQ ID NO: 135283 - RNA, 22 nt, Homo sapiens
ugacagcuguugaggcauuuau

SEQ ID NO: 135284 - RNA, 22 nt, Homo sapiens
ugacagugugagacuuugucuc

SEQ ID NO: 135285 - RNA, 22 nt, Homo sapiens
ugacaugaagucucccucuguu

SEQ ID NO: 135286 - RNA, 22 nt, Homo sapiens
ugacaugauuguauauuuagaa

SEQ ID NO: 135287 - RNA, 22 nt, Homo sapiens
ugacugaguaguauuccacuau

SEQ ID NO: 135288 - RNA, 23 nt, Homo sapiens
ugacuggagacuguugauccuuu

SEQ ID NO: 135289 - RNA, 22 nt, Homo sapiens
ugacuugaaacgugaacagauc

SEQ ID NO: 135290 - RNA, 22 nt, Homo sapiens
ugacuugaacuucuaugucacc

SEQ ID NO: 135291 - RNA, 22 nt, Homo sapiens
ugacuugaaguuaccauaugca

SEQ ID NO: 135292 - RNA, 22 nt, Homo sapiens
ugacuugaguaacuggcucagg

SEQ ID NO: 135293 - RNA, 21 nt, Homo sapiens
ugagaacaacaggucaagcag

SEQ ID NO: 135294 - RNA, 22 nt, Homo sapiens
ugagaacagcagcuugggacac

SEQ ID NO: 135295 - RNA, 22 nt, Homo sapiens
ugagaacaugcacuugagguug

SEQ ID NO: 135296 - RNA, 16 nt, Homo sapiens
ugagaacaugugauau

SEQ ID NO: 135297 - RNA, 20 nt, Homo sapiens
ugagaacauguggcauuugg

SEQ ID NO: 135298 - RNA, 22 nt, Homo sapiens
ugagaacuagagaacaagguga

SEQ ID NO: 135299 - RNA, 22 nt, Homo sapiens
ugagaacugguagcacuuguga

SEQ ID NO: 135300 - RNA, 22 nt, Homo sapiens
ugagaagcauaccagugucugu

SEQ ID NO: 135301 - RNA, 22 nt, Homo sapiens
ugagaaugaugauuuccaguuu

SEQ ID NO: 135302 - RNA, 22 nt, Homo sapiens
ugagaaugcagaaucucgugca

SEQ ID NO: 135303 - RNA, 22 nt, Homo sapiens
ugagacacugaauccggccuga

SEQ ID NO: 135304 - RNA, 22 nt, Homo sapiens
ugagacaucugagauuuuaagc

SEQ ID NO: 135305 - RNA, 22 nt, Homo sapiens
ugagauaguacuuuuuuaaagg

SEQ ID NO: 135306 - RNA, 22 nt, Homo sapiens
ugagaucuuuuguggcugagaa

SEQ ID NO: 135307 - RNA, 22 nt, Homo sapiens
ugagaugaacuugauuguuuua

SEQ ID NO: 135308 - RNA, 22 nt, Homo sapiens
ugagaugaguugcgcucugucg

SEQ ID NO: 135309 - RNA, 22 nt, Homo sapiens
ugagaugauagauauguuaauu

SEQ ID NO: 135310 - RNA, 20 nt, Homo sapiens
ugagaugcauugggauguuu

SEQ ID NO: 135311 - RNA, 23 nt, Homo sapiens
ugagauuacccagaaagaguaua

SEQ ID NO: 135312 - RNA, 22 nt, Homo sapiens
ugagcagaaagcugcaaggucg

SEQ ID NO: 135313 - RNA, 20 nt, Homo sapiens
ugagccccuggacucaagcg

SEQ ID NO: 135314 - RNA, 22 nt, Homo sapiens
ugagcuaggaucacaccugcau

SEQ ID NO: 135315 - RNA, 22 nt, Homo sapiens
ugagcuaggauccugucacugu

SEQ ID NO: 135316 - RNA, 17 nt, Homo sapiens
ugagcuaugauccuguc

SEQ ID NO: 135317 - RNA, 22 nt, Homo sapiens
ugaggaguauguucuguagacc

SEQ ID NO: 135318 - RNA, 22 nt, Homo sapiens
ugaggagugagaaauugguuuc

SEQ ID NO: 135319 - RNA, 17 nt, Homo sapiens
ugagggaugccugguuc

SEQ ID NO: 135320 - RNA, 22 nt, Homo sapiens
ugaguaauguugaucuuugaua

SEQ ID NO: 135321 - RNA, 22 nt, Homo sapiens
ugaguaggauugguauuucuuc

SEQ ID NO: 135322 - RNA, 22 nt, Homo sapiens
ugaguucaauuguauuuuauua

SEQ ID NO: 135323 - RNA, 22 nt, Homo sapiens
ugaguucuuccuaucucugccu

SEQ ID NO: 135324 - RNA, 22 nt, Homo sapiens
ugauaggucagaugauauugaa

SEQ ID NO: 135325 - RNA, 23 nt, Homo sapiens
ugauaugccuaggaguauauuuu

SEQ ID NO: 135326 - RNA, 22 nt, Homo sapiens
ugauaugcuuugaacucucugg

SEQ ID NO: 135327 - RNA, 17 nt, Homo sapiens
ugauauuuucccagaua

SEQ ID NO: 135328 - RNA, 22 nt, Homo sapiens
ugaugaaguauaggaagggcuu

SEQ ID NO: 135329 - RNA, 22 nt, Homo sapiens
ugcaaagaaauuuuggugacca

SEQ ID NO: 135330 - RNA, 19 nt, Homo sapiens
ugcaaauucuaaaaacuga

SEQ ID NO: 135331 - RNA, 17 nt, Homo sapiens
ugcaauuuaagcuagau

SEQ ID NO: 135332 - RNA, 22 nt, Homo sapiens
ugcaccacugcuagccugggua

SEQ ID NO: 135333 - RNA, 22 nt, Homo sapiens
ugcaccauugcacuccagccug

SEQ ID NO: 135334 - RNA, 22 nt, Homo sapiens
ugcagguacuugacaacuuggg

SEQ ID NO: 135335 - RNA, 22 nt, Homo sapiens
ugcagugugaaagagccugaca

SEQ ID NO: 135336 - RNA, 22 nt, Homo sapiens
ugcaguguucuuuagaggaaau

SEQ ID NO: 135337 - RNA, 17 nt, Homo sapiens
ugcauaggcaggcucag

SEQ ID NO: 135338 - RNA, 19 nt, Homo sapiens
ugcauaggguuacauacuc

SEQ ID NO: 135339 - RNA, 21 nt, Homo sapiens
ugcauauuggaacuuucucuc

SEQ ID NO: 135340 - RNA, 21 nt, Homo sapiens
ugcauugucuugaguuuaaau

SEQ ID NO: 135341 - RNA, 22 nt, Homo sapiens
ugccaaaaugggcuuuauaccg

SEQ ID NO: 135342 - RNA, 22 nt, Homo sapiens
ugccaugaagaucccugaaaug

SEQ ID NO: 135343 - RNA, 19 nt, Homo sapiens
ugccauguagcacaugguc

SEQ ID NO: 135344 - RNA, 22 nt, Homo sapiens
ugccuacuuugcaucugucagg

SEQ ID NO: 135345 - RNA, 22 nt, Homo sapiens
ugccuaggcuggaaugcagugg

SEQ ID NO: 135346 - RNA, 22 nt, Homo sapiens
ugccuuuguucuggaaugggaa

SEQ ID NO: 135347 - RNA, 18 nt, Homo sapiens
ugcuaugagauuauuuua

SEQ ID NO: 135348 - RNA, 22 nt, Homo sapiens
ugcuaugucagccaggcugguc

SEQ ID NO: 135349 - RNA, 22 nt, Homo sapiens
ugcugcauuggggauuaaguuu

SEQ ID NO: 135350 - RNA, 22 nt, Homo sapiens
ugcugguaguuuaugacuaauu

SEQ ID NO: 135351 - RNA, 22 nt, Homo sapiens
ugcuguguugcuggcuuaaaga

SEQ ID NO: 135352 - RNA, 20 nt, Homo sapiens
uggaaaguaagucaugauau

SEQ ID NO: 135353 - RNA, 22 nt, Homo sapiens
uggaagcauagcagcgugugug

SEQ ID NO: 135354 - RNA, 20 nt, Homo sapiens
uggaaucugaagaucucagu

SEQ ID NO: 135355 - RNA, 22 nt, Homo sapiens
uggaaugcucuccccacggacu

SEQ ID NO: 135356 - RNA, 22 nt, Homo sapiens
uggaauuaauuaaaauauacug

SEQ ID NO: 135357 - RNA, 22 nt, Homo sapiens
uggacuguaauagagaacagaa

SEQ ID NO: 135358 - RNA, 22 nt, Homo sapiens
uggaggacugcagaacugaggc

SEQ ID NO: 135359 - RNA, 20 nt, Homo sapiens
uggagugaagguucuggacc

SEQ ID NO: 135360 - RNA, 20 nt, Homo sapiens
uggagugcuguguugagaag

SEQ ID NO: 135361 - RNA, 22 nt, Homo sapiens
uggauaguaauaaacauauagg

SEQ ID NO: 135362 - RNA, 22 nt, Homo sapiens
uggaugacauccuuguaugcag

SEQ ID NO: 135363 - RNA, 22 nt, Homo sapiens
uggaugacuguuauaugcauau

SEQ ID NO: 135364 - RNA, 21 nt, Homo sapiens
uggauuguacacccuaucauu

SEQ ID NO: 135365 - RNA, 20 nt, Homo sapiens
uggauugugaugggauuugc

SEQ ID NO: 135366 - RNA, 22 nt, Homo sapiens
uggcaaaugaaagaaagccagu

SEQ ID NO: 135367 - RNA, 22 nt, Homo sapiens
uggcaagaacgaaauguagggu

SEQ ID NO: 135368 - RNA, 22 nt, Homo sapiens
uggcaauguggaaugguccagg

SEQ ID NO: 135369 - RNA, 22 nt, Homo sapiens
uggcaccugacuccgagaugca

SEQ ID NO: 135370 - RNA, 22 nt, Homo sapiens
uggcagcgugaauguggcugaa

SEQ ID NO: 135371 - RNA, 22 nt, Homo sapiens
uggcuuuuauuauguugaggua

SEQ ID NO: 135372 - RNA, 22 nt, Homo sapiens
uggcuuuuguuauuuggaagcu

SEQ ID NO: 135373 - RNA, 22 nt, Homo sapiens
ugggaagaugcugcuucuuccu

SEQ ID NO: 135374 - RNA, 22 nt, Homo sapiens
ugggaagcugcugaacuacagu

SEQ ID NO: 135375 - RNA, 22 nt, Homo sapiens
ugggagcauugcauuagaagcc

SEQ ID NO: 135376 - RNA, 22 nt, Homo sapiens
ugggcaaaacuaagagcugugg

SEQ ID NO: 135377 - RNA, 23 nt, Homo sapiens
uggguucauucuugaagucagug

SEQ ID NO: 135378 - RNA, 22 nt, Homo sapiens
ugguacuucaugcucacagaua

SEQ ID NO: 135379 - RNA, 22 nt, Homo sapiens
uugagauaucuuggccuuugca

SEQ ID NO: 135380 - RNA, 22 nt, Homo sapiens
uugagaugauggauaugcuaau

SEQ ID NO: 135381 - RNA, 22 nt, Homo sapiens
uugagauuauuguguuccuuua

SEQ ID NO: 135382 - RNA, 22 nt, Homo sapiens
uugagcaccaugccuggccaug

SEQ ID NO: 135383 - RNA, 22 nt, Homo sapiens
uugagccaaggauugucuuucc

SEQ ID NO: 135384 - RNA, 22 nt, Homo sapiens
uugagcccuggagguggaggcu

SEQ ID NO: 135385 - RNA, 22 nt, Homo sapiens
uugaggaaugugauuucaaaua

SEQ ID NO: 135386 - RNA, 22 nt, Homo sapiens
uugagggcugaauaccaaucag

SEQ ID NO: 135387 - RNA, 22 nt, Homo sapiens
uugagguaggaggagcuuggau

SEQ ID NO: 135388 - RNA, 20 nt, Homo sapiens
uugaggucaggaguuuggga

SEQ ID NO: 135389 - RNA, 22 nt, Homo sapiens
uugaguagugugaugcaugucu

SEQ ID NO: 135390 - RNA, 22 nt, Homo sapiens
uugauauguggaauauuuaucu

SEQ ID NO: 135391 - RNA, 20 nt, Homo sapiens
uugauucccucuaaacucgc

SEQ ID NO: 135392 - RNA, 22 nt, Homo sapiens
uugcaaacaucuuguuucacau

SEQ ID NO: 135393 - RNA, 18 nt, Homo sapiens
uugcaaauucuucccugu

SEQ ID NO: 135394 - RNA, 22 nt, Homo sapiens
uugcaaggugcucgaagggcuc

SEQ ID NO: 135395 - RNA, 22 nt, Homo sapiens
uugcacagugcuuucuuugccc

SEQ ID NO: 135396 - RNA, 22 nt, Homo sapiens
uugcagagccccacacugggcu

SEQ ID NO: 135397 - RNA, 22 nt, Homo sapiens
uugcaguagucugaaagcaaua

SEQ ID NO: 135398 - RNA, 22 nt, Homo sapiens
uugcaugggagcugggugaagc

SEQ ID NO: 135399 - RNA, 22 nt, Homo sapiens
uugccauggaguagaauugaag

SEQ ID NO: 135400 - RNA, 22 nt, Homo sapiens
uuggaaggcugaauggccucuc

SEQ ID NO: 135401 - RNA, 22 nt, Homo sapiens
uuggaaugugacugauaauauu

SEQ ID NO: 135402 - RNA, 22 nt, Homo sapiens
uuggaauuagacaagugguggu

SEQ ID NO: 135403 - RNA, 22 nt, Homo sapiens
uuggaauuuuacuucuguaaga

SEQ ID NO: 135404 - RNA, 22 nt, Homo sapiens
uuggauggucuuuauauaguau

SEQ ID NO: 135405 - RNA, 22 nt, Homo sapiens
uuggcaaaugucacaaaucagg

SEQ ID NO: 135406 - RNA, 22 nt, Homo sapiens
uuggcaagcuguuaauuauaaa

SEQ ID NO: 135407 - RNA, 22 nt, Homo sapiens
uuggcacuugauaauauucugg

SEQ ID NO: 135408 - RNA, 22 nt, Homo sapiens
uuggcauugccaaacugucaac

SEQ ID NO: 135409 - RNA, 22 nt, Homo sapiens
uuggccuccuggucauauccag

SEQ ID NO: 135410 - RNA, 22 nt, Homo sapiens
uuggcuaugaguccuaugugca

SEQ ID NO: 135411 - RNA, 22 nt, Homo sapiens
uugggagugucucuggacugca

SEQ ID NO: 135412 - RNA, 22 nt, Homo sapiens
uugggcaaguggcaugaccaug

SEQ ID NO: 135413 - RNA, 22 nt, Homo sapiens
uuggggcacggccucuguugcc

SEQ ID NO: 135414 - RNA, 22 nt, Homo sapiens
uugggguagaauugcaacauau

SEQ ID NO: 135415 - RNA, 22 nt, Homo sapiens
uuguaaucaacacaucauuggg

SEQ ID NO: 135416 - RNA, 22 nt, Homo sapiens
uuguaguagcauuauuuauaau

SEQ ID NO: 135417 - RNA, 22 nt, Homo sapiens
uuguaguguuuauucugucaac

SEQ ID NO: 135418 - RNA, 22 nt, Homo sapiens
uuguauguuguuugucagagaa

SEQ ID NO: 135419 - RNA, 22 nt, Homo sapiens
uugucaguguucacucaaagcu

SEQ ID NO: 135420 - RNA, 22 nt, Homo sapiens
uuguccacugcuagccucugca

SEQ ID NO: 135421 - RNA, 19 nt, Homo sapiens
uuguccccucuaaaucuca

SEQ ID NO: 135422 - RNA, 22 nt, Homo sapiens
uugugaaaucuaggcagagguu

SEQ ID NO: 135423 - RNA, 22 nt, Homo sapiens
uugugaaugaugccgcaauaaa

SEQ ID NO: 135424 - RNA, 22 nt, Homo sapiens
uugugaaugaugucgcaauaaa

SEQ ID NO: 135425 - RNA, 22 nt, Homo sapiens
uuguggcuuaucucauuuagcg

SEQ ID NO: 135426 - RNA, 19 nt, Homo sapiens
uugugggaggacagagggg

SEQ ID NO: 135427 - RNA, 22 nt, Homo sapiens
uugugggaggugauuagaucau

SEQ ID NO: 135428 - RNA, 22 nt, Homo sapiens
uuguguuugaugcugacacgca

SEQ ID NO: 135429 - RNA, 22 nt, Homo sapiens
uuguguuuuuaguagggaaggg

SEQ ID NO: 135430 - RNA, 22 nt, Homo sapiens
uuguucaggagguuggggaugc

SEQ ID NO: 135431 - RNA, 22 nt, Homo sapiens
uuuaaagcuaaaauauguuuau

SEQ ID NO: 135432 - RNA, 22 nt, Homo sapiens
agcuggauuguuuaccuggggc

SEQ ID NO: 135433 - RNA, 22 nt, Homo sapiens
agcuggcuguagcugcaagucu

SEQ ID NO: 135434 - RNA, 22 nt, Homo sapiens
agcugugucuucuuaaagauuu

SEQ ID NO: 135435 - RNA, 22 nt, Homo sapiens
agcuucauuccaacuuccuucu

SEQ ID NO: 135436 - RNA, 22 nt, Homo sapiens
agcuuguccuccacccacacug

SEQ ID NO: 135437 - RNA, 22 nt, Homo sapiens
aggaagugugcaauuaauuucu

SEQ ID NO: 135438 - RNA, 21 nt, Homo sapiens
aggagcauuguugugguggag

SEQ ID NO: 135439 - RNA, 22 nt, Homo sapiens
aggagguugguaccaucuguuu

SEQ ID NO: 135440 - RNA, 22 nt, Homo sapiens
aggaguguguauuaaugaaauu

SEQ ID NO: 135441 - RNA, 22 nt, Homo sapiens
aggcaagaaugcuuguuucacc

SEQ ID NO: 135442 - RNA, 22 nt, Homo sapiens
aggcagcuguuauauacugagu

SEQ ID NO: 135443 - RNA, 22 nt, Homo sapiens
aggcaguuucagugagagguga

SEQ ID NO: 135444 - RNA, 22 nt, Homo sapiens
aggcaugguggcacauacaugu

SEQ ID NO: 135445 - RNA, 22 nt, Homo sapiens
aggcuguguggauaauauuggg

SEQ ID NO: 135446 - RNA, 22 nt, Homo sapiens
agggaagugugcuaugcauuua

SEQ ID NO: 135447 - RNA, 22 nt, Homo sapiens
aggugaauggauaaacuguggg

SEQ ID NO: 135448 - RNA, 22 nt, Homo sapiens
aggugguuuugaugagcaggua

SEQ ID NO: 135449 - RNA, 20 nt, Homo sapiens
agguucaaaucccaaucaug

SEQ ID NO: 135450 - RNA, 22 nt, Homo sapiens
aguaaaucacuaauggcuuccg

SEQ ID NO: 135451 - RNA, 22 nt, Homo sapiens
agucacagccuuuuacuuuaga

SEQ ID NO: 135452 - RNA, 22 nt, Homo sapiens
agucaguguguauugauggcac

SEQ ID NO: 135453 - RNA, 22 nt, Homo sapiens
agucauggcagaaggcaccucu

SEQ ID NO: 135454 - RNA, 22 nt, Homo sapiens
agugauuuuaacuuccagcaau

SEQ ID NO: 135455 - RNA, 22 nt, Homo sapiens
agugcaguggcacaaucuuggc

SEQ ID NO: 135456 - RNA, 22 nt, Homo sapiens
agugcagugguuaggagccagg

SEQ ID NO: 135457 - RNA, 22 nt, Homo sapiens
agugcaguugucacgugccuuc

SEQ ID NO: 135458 - RNA, 22 nt, Homo sapiens
aguggaauuaagaaacugaauu

SEQ ID NO: 135459 - RNA, 22 nt, Homo sapiens
aguggcacaauuuugacucccc

SEQ ID NO: 135460 - RNA, 22 nt, Homo sapiens
agugggccccuagaggugaggu

SEQ ID NO: 135461 - RNA, 19 nt, Homo sapiens
agugucauggucauuauuu

SEQ ID NO: 135462 - RNA, 18 nt, Homo sapiens
aguuguuuuauccugccc

SEQ ID NO: 135463 - RNA, 22 nt, Homo sapiens
aguuuuugcugauagcaugcuu

SEQ ID NO: 135464 - RNA, 22 nt, Homo sapiens
auaaacugucaguggagaguaa

SEQ ID NO: 135465 - RNA, 22 nt, Homo sapiens
auaaaugcauugagaacugcug

SEQ ID NO: 135466 - RNA, 22 nt, Homo sapiens
auaaaugccuguuguuuuaagc

SEQ ID NO: 135467 - RNA, 22 nt, Homo sapiens
auaacagcugcaaggcaaaagc

SEQ ID NO: 135468 - RNA, 22 nt, Homo sapiens
auaaucaugucugaaaccuuug

SEQ ID NO: 135469 - RNA, 23 nt, Homo sapiens
auaaugcaaguggugguaaucug

SEQ ID NO: 135470 - RNA, 22 nt, Homo sapiens
auaauugcuaagugaagauggu

SEQ ID NO: 135471 - RNA, 22 nt, Homo sapiens
auacaugcauuugcacgagagu

SEQ ID NO: 135472 - RNA, 22 nt, Homo sapiens
auagaccuggagaguagauaua

SEQ ID NO: 135473 - RNA, 22 nt, Homo sapiens
auagcagugccccaaacuccug

SEQ ID NO: 135474 - RNA, 22 nt, Homo sapiens
auagugcugcaacaaauauacg

SEQ ID NO: 135475 - RNA, 19 nt, Homo sapiens
auauaacauccaggagcag

SEQ ID NO: 135476 - RNA, 22 nt, Homo sapiens
auaucacaggaaaggaagauac

SEQ ID NO: 135477 - RNA, 20 nt, Homo sapiens
auaugcauguguuuucacuu

SEQ ID NO: 135478 - RNA, 22 nt, Homo sapiens
auauggcuaugugagcauacca

SEQ ID NO: 135479 - RNA, 22 nt, Homo sapiens
auaugugacuucaugcaaggcu

SEQ ID NO: 135480 - RNA, 22 nt, Homo sapiens
auauuggacugugcuaguuaga

SEQ ID NO: 135481 - RNA, 22 nt, Homo sapiens
aucaaacugcaaggcagcagca

SEQ ID NO: 135482 - RNA, 22 nt, Homo sapiens
aucaaagugaaauauuaguuau

SEQ ID NO: 135483 - RNA, 22 nt, Homo sapiens
aucaaaucuccagaaccugucu

SEQ ID NO: 135484 - RNA, 22 nt, Homo sapiens
aucaaguacuguacugaaagug

SEQ ID NO: 135485 - RNA, 22 nt, Homo sapiens
aucacaguggcucacaagagcc

SEQ ID NO: 135486 - RNA, 22 nt, Homo sapiens
aucacaguuaagaggugaugaa

SEQ ID NO: 135487 - RNA, 20 nt, Homo sapiens
aucacuggagaaggaaaccu

SEQ ID NO: 135488 - RNA, 22 nt, Homo sapiens
aucacuggccuuuuuaaaugcu

SEQ ID NO: 135489 - RNA, 22 nt, Homo sapiens
aucacugggauggaacugcuga

SEQ ID NO: 135490 - RNA, 22 nt, Homo sapiens
aucacugggcaagauaucauga

SEQ ID NO: 135491 - RNA, 22 nt, Homo sapiens
aucacuuucuauuucugugcca

SEQ ID NO: 135492 - RNA, 22 nt, Homo sapiens
aucagaaucucuagaggacugu

SEQ ID NO: 135493 - RNA, 22 nt, Homo sapiens
aucagcagcaugaaaacggacu

SEQ ID NO: 135494 - RNA, 22 nt, Homo sapiens
aucagcagcaugaaaagcaacu

SEQ ID NO: 135495 - RNA, 22 nt, Homo sapiens
aucccuagaaaaaucagcacau

SEQ ID NO: 135496 - RNA, 22 nt, Homo sapiens
aucccuguaacuagcagccccu

SEQ ID NO: 135497 - RNA, 22 nt, Homo sapiens
aucccugugacgagcaucccua

SEQ ID NO: 135498 - RNA, 22 nt, Homo sapiens
aucuagagacauaguaaagaau

SEQ ID NO: 135499 - RNA, 22 nt, Homo sapiens
aucucaaugcuuuuguaggcca

SEQ ID NO: 135500 - RNA, 22 nt, Homo sapiens
aucuguagauucagcacaagcu

SEQ ID NO: 135501 - RNA, 22 nt, Homo sapiens
augaaacuggagcgccuggagg

SEQ ID NO: 135502 - RNA, 22 nt, Homo sapiens
augaacagagccuugagaaccu

SEQ ID NO: 135503 - RNA, 17 nt, Homo sapiens
augacuucuucagugug

SEQ ID NO: 135504 - RNA, 19 nt, Homo sapiens
augagaacagacuccauuu

SEQ ID NO: 135505 - RNA, 22 nt, Homo sapiens
augagaauguaaguuaaugaaa

SEQ ID NO: 135506 - RNA, 22 nt, Homo sapiens
augagaugauaggcguucuaac

SEQ ID NO: 135507 - RNA, 22 nt, Homo sapiens
ugccaucauuaauauuaggcau

SEQ ID NO: 135508 - RNA, 22 nt, Homo sapiens
ugccaugucauagguuaagccu

SEQ ID NO: 135509 - RNA, 18 nt, Homo sapiens
ugcuccccugggugagca

SEQ ID NO: 135510 - RNA, 22 nt, Homo sapiens
ugcugcuguuguuguuacuagc

SEQ ID NO: 135511 - RNA, 22 nt, Homo sapiens
ugcugguguuuaggaauaagaa

SEQ ID NO: 135512 - RNA, 22 nt, Homo sapiens
ugcugguuuaaaaugcaaauuc

SEQ ID NO: 135513 - RNA, 22 nt, Homo sapiens
ugcuucauuggccaccaggaag

SEQ ID NO: 135514 - RNA, 22 nt, Homo sapiens
uggaaaauuaggggagguuaua

SEQ ID NO: 135515 - RNA, 22 nt, Homo sapiens
uggaaaguaguucuaaucuaag

SEQ ID NO: 135516 - RNA, 22 nt, Homo sapiens
uggaaggcuucauauguaaaga

SEQ ID NO: 135517 - RNA, 22 nt, Homo sapiens
uggaaguaaccaugaauggaau

SEQ ID NO: 135518 - RNA, 22 nt, Homo sapiens
uggaaguuaaauuaguugauga

SEQ ID NO: 135519 - RNA, 22 nt, Homo sapiens
uggaauaucaugagaguuuguu

SEQ ID NO: 135520 - RNA, 21 nt, Homo sapiens
uggaauguucugacuucaggg

SEQ ID NO: 135521 - RNA, 21 nt, Homo sapiens
uggaauuaauggagagguguu

SEQ ID NO: 135522 - RNA, 22 nt, Homo sapiens
uggacaagugcccuccaccuca

SEQ ID NO: 135523 - RNA, 22 nt, Homo sapiens
uggaguaggccuaagaaugaca

SEQ ID NO: 135524 - RNA, 21 nt, Homo sapiens
uggagugaagaguuuauugac

SEQ ID NO: 135525 - RNA, 22 nt, Homo sapiens
uggagugagaacuucaaugaug

SEQ ID NO: 135526 - RNA, 22 nt, Homo sapiens
uggagugauaugguuauauggg

SEQ ID NO: 135527 - RNA, 22 nt, Homo sapiens
uggcaaaauggaauauguuggg

SEQ ID NO: 135528 - RNA, 22 nt, Homo sapiens
uggcaaauguaguacccaauag

SEQ ID NO: 135529 - RNA, 22 nt, Homo sapiens
uggcaagaacaacaauuacuuu

SEQ ID NO: 135530 - RNA, 21 nt, Homo sapiens
uggcacuauucacaauagcaa

SEQ ID NO: 135531 - RNA, 22 nt, Homo sapiens
uggcauauaauauagaagacua

SEQ ID NO: 135532 - RNA, 22 nt, Homo sapiens
uggccagagggcaauuagcugu

SEQ ID NO: 135533 - RNA, 22 nt, Homo sapiens
uggcuacugacugaugauuaua

SEQ ID NO: 135534 - RNA, 22 nt, Homo sapiens
uggcuuucuggggcuucuguuc

SEQ ID NO: 135535 - RNA, 22 nt, Homo sapiens
ugggaagauucuguguuuuucc

SEQ ID NO: 135536 - RNA, 22 nt, Homo sapiens
ugggaauaugauacaggucuuu

SEQ ID NO: 135537 - RNA, 22 nt, Homo sapiens
ugggaucagcugggcucucugu

SEQ ID NO: 135538 - RNA, 22 nt, Homo sapiens
ugggguaggcuguauacucugu

SEQ ID NO: 135539 - RNA, 23 nt, Homo sapiens
ugggucaguuuuucugacaucau

SEQ ID NO: 135540 - RNA, 17 nt, Homo sapiens
ugguagguuuuucuggc

SEQ ID NO: 135541 - RNA, 19 nt, Homo sapiens
uggucaguucugggagcug

SEQ ID NO: 135542 - RNA, 21 nt, Homo sapiens
uggucccauaagauuauaaug

SEQ ID NO: 135543 - RNA, 20 nt, Homo sapiens
ugguccccugagucuggcuu

SEQ ID NO: 135544 - RNA, 20 nt, Homo sapiens
uggugguuuuaugugguuua

SEQ ID NO: 135545 - RNA, 22 nt, Homo sapiens
ugguugaucccaucacccaggu

SEQ ID NO: 135546 - RNA, 22 nt, Homo sapiens
uguaaaaagcccagccgcugag

SEQ ID NO: 135547 - RNA, 21 nt, Homo sapiens
uguaacugcaaaccucagauu

SEQ ID NO: 135548 - RNA, 20 nt, Homo sapiens
uguaaucuaaguuuuaagcc

SEQ ID NO: 135549 - RNA, 22 nt, Homo sapiens
uguacaaauuucugugguggug

SEQ ID NO: 135550 - RNA, 19 nt, Homo sapiens
uguaccagcaagucuuuuc

SEQ ID NO: 135551 - RNA, 22 nt, Homo sapiens
uguauaguugagucaaguuuca

SEQ ID NO: 135552 - RNA, 22 nt, Homo sapiens
uguauuuguuguuaaauggaga

SEQ ID NO: 135553 - RNA, 22 nt, Homo sapiens
ugucaggaguuuuagaaucuua

SEQ ID NO: 135554 - RNA, 22 nt, Homo sapiens
ugucaguggacugugaaaggca

SEQ ID NO: 135555 - RNA, 22 nt, Homo sapiens
ugucaguggucuggaugcagcc

SEQ ID NO: 135556 - RNA, 21 nt, Homo sapiens
ugucaguuuccagaguucaac

SEQ ID NO: 135557 - RNA, 22 nt, Homo sapiens
ugucccguuuucgaggcugcag

SEQ ID NO: 135558 - RNA, 22 nt, Homo sapiens
uguccuguaggaggcagaacaa

SEQ ID NO: 135559 - RNA, 21 nt, Homo sapiens
ugugaaaucuaggcagagguu

SEQ ID NO: 135560 - RNA, 22 nt, Homo sapiens
ugugaacagcuccaaaugugga

SEQ ID NO: 135561 - RNA, 19 nt, Homo sapiens
ugugaacaucacagagugu

SEQ ID NO: 135562 - RNA, 19 nt, Homo sapiens
ugugaagaaaugcugcaag

SEQ ID NO: 135563 - RNA, 22 nt, Homo sapiens
ugugaagauguuucuuaauuga

SEQ ID NO: 135564 - RNA, 22 nt, Homo sapiens
ugugaauguaagaaaauccaac

SEQ ID NO: 135565 - RNA, 22 nt, Homo sapiens
ugugauuauuuauagacaguca

SEQ ID NO: 135566 - RNA, 22 nt, Homo sapiens
ugugccacugcacuccugccug

SEQ ID NO: 135567 - RNA, 22 nt, Homo sapiens
ugugcuuguaaaggccagagca

SEQ ID NO: 135568 - RNA, 22 nt, Homo sapiens
uguggaaauggugcuacgaaca

SEQ ID NO: 135569 - RNA, 22 nt, Homo sapiens
uguggcacuguguccagagaaa

SEQ ID NO: 135570 - RNA, 22 nt, Homo sapiens
uguggcugguggcaccuuuucc

SEQ ID NO: 135571 - RNA, 22 nt, Homo sapiens
ugugguagugcuuaccugcagu

SEQ ID NO: 135572 - RNA, 22 nt, Homo sapiens
uguuaacauggucucagucugu

SEQ ID NO: 135573 - RNA, 22 nt, Homo sapiens
uguuaaggcagagauaauacau

SEQ ID NO: 135574 - RNA, 22 nt, Homo sapiens
uguuacagcagcacaaaaugga

SEQ ID NO: 135575 - RNA, 18 nt, Homo sapiens
uguugguguucacucacu

SEQ ID NO: 135576 - RNA, 22 nt, Homo sapiens
uuaaaccugucuucucacuaau

SEQ ID NO: 135577 - RNA, 22 nt, Homo sapiens
uuaaauacagcaugguguuucu

SEQ ID NO: 135578 - RNA, 22 nt, Homo sapiens
uuaaaugcuagaauuuucuuug

SEQ ID NO: 135579 - RNA, 22 nt, Homo sapiens
uuaagagcauggugccagguug

SEQ ID NO: 135580 - RNA, 22 nt, Homo sapiens
uuaagaugcauuuugaaguuaa

SEQ ID NO: 135581 - RNA, 22 nt, Homo sapiens
uuaaggaaggagucuuaaaugg

SEQ ID NO: 135582 - RNA, 22 nt, Homo sapiens
uuaaguguaaguggugugggac

SEQ ID NO: 135583 - RNA, 22 nt, Homo sapiens
uuaaucacagcugaacucaaac

SEQ ID NO: 135584 - RNA, 22 nt, Homo sapiens
uuaauuguccauuauucuguuc

SEQ ID NO: 135585 - RNA, 22 nt, Homo sapiens
uuacaacugucuuacugguuau

SEQ ID NO: 135586 - RNA, 17 nt, Homo sapiens
uuacaggugcugagagu

SEQ ID NO: 135587 - RNA, 22 nt, Homo sapiens
uuacaugucuugguaagguuag

SEQ ID NO: 135588 - RNA, 22 nt, Homo sapiens
uuagaaaguagaaaagcugguu

SEQ ID NO: 135589 - RNA, 17 nt, Homo sapiens
uuagacagacauccugc

SEQ ID NO: 135590 - RNA, 22 nt, Homo sapiens
uuagacaguggugcacugcacu

SEQ ID NO: 135591 - RNA, 17 nt, Homo sapiens
uuagagguagacucauu

SEQ ID NO: 135592 - RNA, 18 nt, Homo sapiens
uuagagugcauuacuuug

SEQ ID NO: 135593 - RNA, 22 nt, Homo sapiens
uuagauuauugagcauccacug

SEQ ID NO: 135594 - RNA, 22 nt, Homo sapiens
uuagcacuaauucguuggggca

SEQ ID NO: 135595 - RNA, 22 nt, Homo sapiens
uuagggaggcucaggacaagag

SEQ ID NO: 135596 - RNA, 22 nt, Homo sapiens
uuaguaguagugcuguaauuuu

SEQ ID NO: 135597 - RNA, 22 nt, Homo sapiens
uuauaaacaugaagauuugggg

SEQ ID NO: 135598 - RNA, 22 nt, Homo sapiens
uuauacuacuauaaagagguag

SEQ ID NO: 135599 - RNA, 22 nt, Homo sapiens
uuaucccacuuucuguuccugu

SEQ ID NO: 135600 - RNA, 22 nt, Homo sapiens
uuauccugucaguaaauauuuu

SEQ ID NO: 135601 - RNA, 22 nt, Homo sapiens
uuauuagagauauuugguuagg

SEQ ID NO: 135602 - RNA, 22 nt, Homo sapiens
uuauucauuaacagggaccaaa

SEQ ID NO: 135603 - RNA, 22 nt, Homo sapiens
uuauucugucuuuggucucaau

SEQ ID NO: 135604 - RNA, 22 nt, Homo sapiens
uucaaguaagaaagacaucagg

SEQ ID NO: 135605 - RNA, 22 nt, Homo sapiens
uucacagagagaacucaaacca

SEQ ID NO: 135606 - RNA, 22 nt, Homo sapiens
uucacagcuuaauaaggcucag

SEQ ID NO: 135607 - RNA, 22 nt, Homo sapiens
uucacagucacccuucuccaug

SEQ ID NO: 135608 - RNA, 22 nt, Homo sapiens
uucacaugacagggugaagcau

SEQ ID NO: 135609 - RNA, 22 nt, Homo sapiens
uucacccugguuguagauggac

SEQ ID NO: 135610 - RNA, 20 nt, Homo sapiens
uucacugggcucucuguugg

SEQ ID NO: 135611 - RNA, 22 nt, Homo sapiens
uucacuguaaaaugaagagggu

SEQ ID NO: 135612 - RNA, 22 nt, Homo sapiens
uucacuguagccucagccucuu

SEQ ID NO: 135613 - RNA, 22 nt, Homo sapiens
uucaguagucaaaagauaaggg

SEQ ID NO: 135614 - RNA, 22 nt, Homo sapiens
uucauaguaacaguaacuaugg

SEQ ID NO: 135615 - RNA, 21 nt, Homo sapiens
uucaucagccagaaaucaagc

SEQ ID NO: 135616 - RNA, 22 nt, Homo sapiens
uucaucagcuguagaugucaug

SEQ ID NO: 135617 - RNA, 22 nt, Homo sapiens
uucaucaggaauauugaccugu

SEQ ID NO: 135618 - RNA, 20 nt, Homo sapiens
uucaucaggauauuggucua

SEQ ID NO: 135619 - RNA, 22 nt, Homo sapiens
uucauggaauauugaccauuuu

SEQ ID NO: 135620 - RNA, 22 nt, Homo sapiens
uucauggaguugagaaggcuaa

SEQ ID NO: 135621 - RNA, 22 nt, Homo sapiens
uuccacaauggcugaacuaguu

SEQ ID NO: 135622 - RNA, 22 nt, Homo sapiens
uuccacaaugguugaacuaguu

SEQ ID NO: 135623 - RNA, 22 nt, Homo sapiens
uuccagaugggaguucuauucu

SEQ ID NO: 135624 - RNA, 22 nt, Homo sapiens
uuccaggugggcgugggccugg

SEQ ID NO: 135625 - RNA, 22 nt, Homo sapiens
uuccagugggacgagaugugga

SEQ ID NO: 135626 - RNA, 22 nt, Homo sapiens
uuccaguguuugacucaccuuu

SEQ ID NO: 135627 - RNA, 22 nt, Homo sapiens
uuccaguuauuauaccucuuaa

SEQ ID NO: 135628 - RNA, 22 nt, Homo sapiens
uucccuguaucuucugccaugu

SEQ ID NO: 135629 - RNA, 22 nt, Homo sapiens
uucccugugugcagaugggugu

SEQ ID NO: 135630 - RNA, 22 nt, Homo sapiens
uucccuuucugaaaaucucauu

SEQ ID NO: 135631 - RNA, 22 nt, Homo sapiens
uucccuuucuuaaagaguuagg

SEQ ID NO: 135632 - RNA, 22 nt, Homo sapiens
uucccuuuguuaaauuggaaga

SEQ ID NO: 135633 - RNA, 22 nt, Homo sapiens
uuccuggaggggaaguguccaa

SEQ ID NO: 135634 - RNA, 22 nt, Homo sapiens
uuccuugaaacagucaagagaa

SEQ ID NO: 135635 - RNA, 22 nt, Homo sapiens
uucucaauggcaacuuguugcu

SEQ ID NO: 135636 - RNA, 22 nt, Homo sapiens
uucucagcccccugacagucag

SEQ ID NO: 135637 - RNA, 22 nt, Homo sapiens
uucucaguucgguggcagugcu

SEQ ID NO: 135638 - RNA, 22 nt, Homo sapiens
uucugcuugaucuaguguguug

SEQ ID NO: 135639 - RNA, 22 nt, Homo sapiens
uugaaagacagaggggcaaguu

SEQ ID NO: 135640 - RNA, 22 nt, Homo sapiens
uugaagguaauugguuuuauga

SEQ ID NO: 135641 - RNA, 22 nt, Homo sapiens
uugaagugaagaacaauaucac

SEQ ID NO: 135642 - RNA, 22 nt, Homo sapiens
uugaauaggcucaugcuuauca

SEQ ID NO: 135643 - RNA, 22 nt, Homo sapiens
uugaauguguugggaagcccuu

SEQ ID NO: 135644 - RNA, 22 nt, Homo sapiens
uuuagcaaagcaauuuacacca

SEQ ID NO: 135645 - RNA, 22 nt, Homo sapiens
uuuagcacugugauugacaaaa

SEQ ID NO: 135646 - RNA, 22 nt, Homo sapiens
uuuagguaauauuaaguagcug

SEQ ID NO: 135647 - RNA, 22 nt, Homo sapiens
uuuaugcuacauguguuggaaa

SEQ ID NO: 135648 - RNA, 22 nt, Homo sapiens
uuuauggagagauauuuauggu

SEQ ID NO: 135649 - RNA, 22 nt, Homo sapiens
uuucaguagagacacgguuuug

SEQ ID NO: 135650 - RNA, 22 nt, Homo sapiens
uuucauggcaguuuggggccug

SEQ ID NO: 135651 - RNA, 19 nt, Homo sapiens
uuucccugcagaccuacua

SEQ ID NO: 135652 - RNA, 22 nt, Homo sapiens
uuucccuuuagcuuagugauuu

SEQ ID NO: 135653 - RNA, 21 nt, Homo sapiens
uuuccuggagcguauggcuuc

SEQ ID NO: 135654 - RNA, 22 nt, Homo sapiens
uuuccuguagggggcaaggccu

SEQ ID NO: 135655 - RNA, 22 nt, Homo sapiens
uuucuacagggcuugccaggua

SEQ ID NO: 135656 - RNA, 22 nt, Homo sapiens
uuucucaguguuucaggguagg

SEQ ID NO: 135657 - RNA, 22 nt, Homo sapiens
uuucugguuaauuucuaagagc

SEQ ID NO: 135658 - RNA, 22 nt, Homo sapiens
uuugaagacuacugggagugaa

SEQ ID NO: 135659 - RNA, 22 nt, Homo sapiens
uuugacaaugugugcuuguauu

SEQ ID NO: 135660 - RNA, 22 nt, Homo sapiens
uuugagugugauaucgauugga

SEQ ID NO: 135661 - RNA, 22 nt, Homo sapiens
uuugauuguacuaaaauuguac

SEQ ID NO: 135662 - RNA, 22 nt, Homo sapiens
uuugcacuuuaauauaauguga

SEQ ID NO: 135663 - RNA, 22 nt, Homo sapiens
uuugccaaugggaauuuuccua

SEQ ID NO: 135664 - RNA, 22 nt, Homo sapiens
uuuggcaacguuggaucccuca

SEQ ID NO: 135665 - RNA, 22 nt, Homo sapiens
uuuggcaugggcuauuugcuuu

SEQ ID NO: 135666 - RNA, 22 nt, Homo sapiens
uuuggcucugugucccacccaa

SEQ ID NO: 135667 - RNA, 22 nt, Homo sapiens
uuugggaaugguuugucuccca

SEQ ID NO: 135668 - RNA, 22 nt, Homo sapiens
uuuggucagcugcgggucagcu

SEQ ID NO: 135669 - RNA, 22 nt, Homo sapiens
uuuguacacuguuggugguuau

SEQ ID NO: 135670 - RNA, 22 nt, Homo sapiens
uuugugaggugauggauauguc

SEQ ID NO: 135671 - RNA, 22 nt, Homo sapiens
uuuguguccccacccaaaucuc

SEQ ID NO: 135672 - RNA, 22 nt, Homo sapiens
uuuuaacagccaggggacggcc

SEQ ID NO: 135673 - RNA, 22 nt, Homo sapiens
uuuuaugggcuauuugcauuag

SEQ ID NO: 135674 - RNA, 23 nt, Homo sapiens
uuuugcaauaagucacuggaaua

SEQ ID NO: 135675 - RNA, 22 nt, Homo sapiens
uuuugcaauauguuccugaaua

SEQ ID NO: 135676 - RNA, 22 nt, Homo sapiens
uuuuggcacuuugucugauucu

SEQ ID NO: 135677 - RNA, 22 nt, Homo sapiens
uuuugguuaggauggguggcau

SEQ ID NO: 135678 - RNA, 22 nt, Homo sapiens
uuuuuggguaaugauuaucaau

SEQ ID NO: 135679 - RNA, 21 nt, Homo sapiens
uuuuugguggucauggauaga

SEQ ID NO: 135680 - RNA, 22 nt, Homo sapiens
uggucaaaugccaaucuguagu

SEQ ID NO: 135681 - RNA, 22 nt, Homo sapiens
uggucaccuucuugcucugucu

SEQ ID NO: 135682 - RNA, 22 nt, Homo sapiens
uggucuggagagucccgcccag

SEQ ID NO: 135683 - RNA, 22 nt, Homo sapiens
uggucuucuggccuccagaacc

SEQ ID NO: 135684 - RNA, 22 nt, Homo sapiens
uggugcuuaaauaaggcuuuca

SEQ ID NO: 135685 - RNA, 21 nt, Homo sapiens
ugguugauccuccuagugccu

SEQ ID NO: 135686 - RNA, 22 nt, Homo sapiens
uguaaacauguauguguuuaug

SEQ ID NO: 135687 - RNA, 22 nt, Homo sapiens
uguaaacucaguauguuuuacu

SEQ ID NO: 135688 - RNA, 22 nt, Homo sapiens
uguauguugggucaaaguacau

SEQ ID NO: 135689 - RNA, 22 nt, Homo sapiens
uguauguuuaaggccaguggaa

SEQ ID NO: 135690 - RNA, 22 nt, Homo sapiens
ugucaaaugcagugauauuuga

SEQ ID NO: 135691 - RNA, 22 nt, Homo sapiens
ugucacccuuuauccauuuccu

SEQ ID NO: 135692 - RNA, 22 nt, Homo sapiens
ugucaccuugcucauccucgga

SEQ ID NO: 135693 - RNA, 22 nt, Homo sapiens
ugucaggaggguccagagaaaa

SEQ ID NO: 135694 - RNA, 22 nt, Homo sapiens
ugucaguguacuguaagaauua

SEQ ID NO: 135695 - RNA, 22 nt, Homo sapiens
ugucaguguaugagccccggau

SEQ ID NO: 135696 - RNA, 22 nt, Homo sapiens
ugucaguuucccuccucuuccu

SEQ ID NO: 135697 - RNA, 22 nt, Homo sapiens
ugucauucaggaaauucuaagu

SEQ ID NO: 135698 - RNA, 22 nt, Homo sapiens
uguccaaauugaaucaucuggu

SEQ ID NO: 135699 - RNA, 22 nt, Homo sapiens
ugucccaguuggguauugaauu

SEQ ID NO: 135700 - RNA, 22 nt, Homo sapiens
ugucuaaagaauggcagacuca

SEQ ID NO: 135701 - RNA, 22 nt, Homo sapiens
ugugaagaaagucauugguagc

SEQ ID NO: 135702 - RNA, 22 nt, Homo sapiens
augagaugcaagauuagauggg

SEQ ID NO: 135703 - RNA, 22 nt, Homo sapiens
augagauuguuugugugaaaua

SEQ ID NO: 135704 - RNA, 22 nt, Homo sapiens
augaggaaggagccuuugucug

SEQ ID NO: 135705 - RNA, 22 nt, Homo sapiens
augaggcacugcgcccuacuga

SEQ ID NO: 135706 - RNA, 22 nt, Homo sapiens
augauggaggccgugauggacg

SEQ ID NO: 135707 - RNA, 22 nt, Homo sapiens
augauggagguagauuguccau

SEQ ID NO: 135708 - RNA, 22 nt, Homo sapiens
augcaaaucuuaaguaugugug

SEQ ID NO: 135709 - RNA, 22 nt, Homo sapiens
augcacaguccagcccaugugg

SEQ ID NO: 135710 - RNA, 22 nt, Homo sapiens
augcacuguuuucuugaugaga

SEQ ID NO: 135711 - RNA, 22 nt, Homo sapiens
augcagagaaaucuaaaauaug

SEQ ID NO: 135712 - RNA, 22 nt, Homo sapiens
augcagugugcaacagauuaag

SEQ ID NO: 135713 - RNA, 22 nt, Homo sapiens
augccacugcgcucuagccugg

SEQ ID NO: 135714 - RNA, 22 nt, Homo sapiens
augcccauuuguuuucugaaag

SEQ ID NO: 135715 - RNA, 22 nt, Homo sapiens
augccucugacaauuggauucu

SEQ ID NO: 135716 - RNA, 22 nt, Homo sapiens
auggaacuggagaugguuauau

SEQ ID NO: 135717 - RNA, 22 nt, Homo sapiens
auggaagacuccucuuugggua

SEQ ID NO: 135718 - RNA, 22 nt, Homo sapiens
auggaauguauagucauguagg

SEQ ID NO: 135719 - RNA, 22 nt, Homo sapiens
auggauuuguaguacaugguug

SEQ ID NO: 135720 - RNA, 22 nt, Homo sapiens
auggauuuuaggauacaguuga

SEQ ID NO: 135721 - RNA, 22 nt, Homo sapiens
auggauuuugaacuugagaguu

SEQ ID NO: 135722 - RNA, 22 nt, Homo sapiens
auggcaaaauguuccuaguggu

SEQ ID NO: 135723 - RNA, 22 nt, Homo sapiens
auggcuagauuguaugguaguu

SEQ ID NO: 135724 - RNA, 22 nt, Homo sapiens
cugaaaugaauuauuuucuuuc

SEQ ID NO: 135725 - RNA, 22 nt, Homo sapiens
cugaaauguccaucgacugaug

SEQ ID NO: 135726 - RNA, 22 nt, Homo sapiens
cugacagaugacugccacugua

SEQ ID NO: 135727 - RNA, 22 nt, Homo sapiens
cugacauggggauccaccuuag

SEQ ID NO: 135728 - RNA, 22 nt, Homo sapiens
cugagagaugagaccucucacu

SEQ ID NO: 135729 - RNA, 22 nt, Homo sapiens
cugagcccauucuggggagaag

SEQ ID NO: 135730 - RNA, 20 nt, Homo sapiens
cugagguugggguccuuccc

SEQ ID NO: 135731 - RNA, 22 nt, Homo sapiens
cugagguuguucuucucagugg

SEQ ID NO: 135732 - RNA, 18 nt, Homo sapiens
cugagucauuccuggguc

SEQ ID NO: 135733 - RNA, 22 nt, Homo sapiens
cugcaguaaccacuguaggugu

SEQ ID NO: 135734 - RNA, 22 nt, Homo sapiens
cuggaaagaaucaggcuaaacu

SEQ ID NO: 135735 - RNA, 22 nt, Homo sapiens
cuggaaagcaaagggugcauug

SEQ ID NO: 135736 - RNA, 18 nt, Homo sapiens
cuggaaggcuacuacagu

SEQ ID NO: 135737 - RNA, 22 nt, Homo sapiens
cuggacaaaucuggaaagaacc

SEQ ID NO: 135738 - RNA, 22 nt, Homo sapiens
cuggagcauugguggauuuguu

SEQ ID NO: 135739 - RNA, 22 nt, Homo sapiens
cuggaggccugaacauaaaugg

SEQ ID NO: 135740 - RNA, 22 nt, Homo sapiens
cuggaguuugaggcugcaguga

SEQ ID NO: 135741 - RNA, 22 nt, Homo sapiens
cuggcaaauguuuucuguaaag

SEQ ID NO: 135742 - RNA, 22 nt, Homo sapiens
cuggcagugcuuguuauccugg

SEQ ID NO: 135743 - RNA, 22 nt, Homo sapiens
cugggaugugacuguugccccc

SEQ ID NO: 135744 - RNA, 22 nt, Homo sapiens
cuguaguuagcagaugaugaau

SEQ ID NO: 135745 - RNA, 22 nt, Homo sapiens
cuguugguuaaauuccaugcag

SEQ ID NO: 135746 - RNA, 22 nt, Homo sapiens
cuguuugguaaggaugccucag

SEQ ID NO: 135747 - RNA, 22 nt, Homo sapiens
cuucaccaguuuggcagucuca

SEQ ID NO: 135748 - RNA, 22 nt, Homo sapiens
cuucagcaauauauccccuggg

SEQ ID NO: 135749 - RNA, 22 nt, Homo sapiens
cuucaugggagaaccacaggua

SEQ ID NO: 135750 - RNA, 22 nt, Homo sapiens
cuuccugaguccugggcucaca

SEQ ID NO: 135751 - RNA, 22 nt, Homo sapiens
cuugacaucugucaguuccuca

SEQ ID NO: 135752 - RNA, 22 nt, Homo sapiens
cuuggcuuguuguccccugcuc

SEQ ID NO: 135753 - RNA, 22 nt, Homo sapiens
cuugggauauguguuacucugu

SEQ ID NO: 135754 - RNA, 22 nt, Homo sapiens
cuugggccccacccaaaucuua

SEQ ID NO: 135755 - RNA, 18 nt, Homo sapiens
cuugucaaaucuuuccuc

SEQ ID NO: 135756 - RNA, 22 nt, Homo sapiens
cuuuccauuguuggagcauaaa

SEQ ID NO: 135757 - RNA, 22 nt, Homo sapiens
cuuugcaaaacauugagaccuc

SEQ ID NO: 135758 - RNA, 22 nt, Homo sapiens
cuuugcaaauggccuuuccaag

SEQ ID NO: 135759 - RNA, 20 nt, Homo sapiens
cuuuggcaaugagaacaggg

SEQ ID NO: 135760 - RNA, 22 nt, Homo sapiens
cuuuggugagggauaaauuuca

SEQ ID NO: 135761 - RNA, 22 nt, Homo sapiens
cuuugguggagucuuuagguuc

SEQ ID NO: 135762 - RNA, 22 nt, Homo sapiens
cuuugguguauuuucagagacc

SEQ ID NO: 135763 - RNA, 22 nt, Homo sapiens
cuuugguuaauaggauauggca

SEQ ID NO: 135764 - RNA, 22 nt, Homo sapiens
cuuugguuuacuuggugcuagu

SEQ ID NO: 135765 - RNA, 21 nt, Homo sapiens
cuuugguuucugacuugcaua

SEQ ID NO: 135766 - RNA, 20 nt, Homo sapiens
cuuuguccuccugcugugcu

SEQ ID NO: 135767 - RNA, 22 nt, Homo sapiens
cuuuuguggaucuucuguugcu

SEQ ID NO: 135768 - RNA, 22 nt, Homo sapiens
gaaauggaucagagcaagcuuu

SEQ ID NO: 135769 - RNA, 22 nt, Homo sapiens
gaaauguauuaaugaguugaaa

SEQ ID NO: 135770 - RNA, 22 nt, Homo sapiens
gaaauguugauagugggcauug

SEQ ID NO: 135771 - RNA, 22 nt, Homo sapiens
gaaauguuuuucaugugggcaa

SEQ ID NO: 135772 - RNA, 22 nt, Homo sapiens
gaagaacuaggugagaucuaga

SEQ ID NO: 135773 - RNA, 22 nt, Homo sapiens
gaaggagcuuaucugccauuuc

SEQ ID NO: 135774 - RNA, 22 nt, Homo sapiens
gaagugcuuuuggacuaacagu

SEQ ID NO: 135775 - RNA, 22 nt, Homo sapiens
gaauacuguccaagagugaugg

SEQ ID NO: 135776 - RNA, 22 nt, Homo sapiens
gaaucacugugguaucccaugc

SEQ ID NO: 135777 - RNA, 22 nt, Homo sapiens
gaaugaauguuuauccuuagau

SEQ ID NO: 135778 - RNA, 22 nt, Homo sapiens
gaauguuuacuuuguuuaauac

SEQ ID NO: 135779 - RNA, 22 nt, Homo sapiens
gaauuguacugcaaucagggga

SEQ ID NO: 135780 - RNA, 22 nt, Homo sapiens
gacagguuuucuguuucugaaa

SEQ ID NO: 135781 - RNA, 18 nt, Homo sapiens
gacaguguggcaauuccu

SEQ ID NO: 135782 - RNA, 19 nt, Homo sapiens
gacaugagauuuggugggg

SEQ ID NO: 135783 - RNA, 20 nt, Homo sapiens
gacauguugguuugcugcac

SEQ ID NO: 135784 - RNA, 22 nt, Homo sapiens
gacccuguugggguuuagggcu

SEQ ID NO: 135785 - RNA, 21 nt, Homo sapiens
gaccuguaguaagcauucaca

SEQ ID NO: 135786 - RNA, 17 nt, Homo sapiens
gacgaucaucaggaggc

SEQ ID NO: 135787 - RNA, 22 nt, Homo sapiens
gacuaaugaaagagugugauau

SEQ ID NO: 135788 - RNA, 22 nt, Homo sapiens
gacucagucuuggauuuuuaau

SEQ ID NO: 135789 - RNA, 22 nt, Homo sapiens
gacuggccuauaauggcgaauu

SEQ ID NO: 135790 - RNA, 22 nt, Homo sapiens
gagaacagaagcauuccuaauu

SEQ ID NO: 135791 - RNA, 22 nt, Homo sapiens
gagaacauacggcauuugguuu

SEQ ID NO: 135792 - RNA, 22 nt, Homo sapiens
gagacggagucacgcccuguca

SEQ ID NO: 135793 - RNA, 22 nt, Homo sapiens
gagacugagucuugcccuguca

SEQ ID NO: 135794 - RNA, 22 nt, Homo sapiens
gagacugagucuugcucuguca

SEQ ID NO: 135795 - RNA, 22 nt, Homo sapiens
gagauaggauucacuuucaugu

SEQ ID NO: 135796 - RNA, 22 nt, Homo sapiens
gagaugguacacauacgauucu

SEQ ID NO: 135797 - RNA, 22 nt, Homo sapiens
gagaugguguuccacugccagu

SEQ ID NO: 135798 - RNA, 22 nt, Homo sapiens
gagauucaucuagguccagaga

SEQ ID NO: 135799 - RNA, 22 nt, Homo sapiens
gagauugucaugauuacauugu

SEQ ID NO: 135800 - RNA, 22 nt, Homo sapiens
gaggcagucugucccuuagcag

SEQ ID NO: 135801 - RNA, 22 nt, Homo sapiens
gaggcaguguguccguucucgg

SEQ ID NO: 135802 - RNA, 22 nt, Homo sapiens
gaggcuagauggggaugugucc

SEQ ID NO: 135803 - RNA, 22 nt, Homo sapiens
gagguaagaguuuuccauuucu

SEQ ID NO: 135804 - RNA, 22 nt, Homo sapiens
gagguaggaauaaacauuugaa

SEQ ID NO: 135805 - RNA, 17 nt, Homo sapiens
gagguaguuuacuuuca

SEQ ID NO: 135806 - RNA, 22 nt, Homo sapiens
gagucagugucuugcucuguca

SEQ ID NO: 135807 - RNA, 22 nt, Homo sapiens
gagugcaauggcaagaucuugg

SEQ ID NO: 135808 - RNA, 22 nt, Homo sapiens
gagugcaauggcaugaucuugg

SEQ ID NO: 135809 - RNA, 22 nt, Homo sapiens
gaguucaauuuccagcuguucu

SEQ ID NO: 135810 - RNA, 22 nt, Homo sapiens
gauaaaucuuggcuagucuaag

SEQ ID NO: 135811 - RNA, 22 nt, Homo sapiens
gauacaguaugcaugugguauu

SEQ ID NO: 135812 - RNA, 22 nt, Homo sapiens
gauauguaaaaauuauaucuga

SEQ ID NO: 135813 - RNA, 22 nt, Homo sapiens
gaucagagugaaccuuguuaug

SEQ ID NO: 135814 - RNA, 22 nt, Homo sapiens
gaucuggagguuuuccucauga

SEQ ID NO: 135815 - RNA, 22 nt, Homo sapiens
gaugcaguaagaaugcauagcg

SEQ ID NO: 135816 - RNA, 22 nt, Homo sapiens
gauggcucugcaggugagggua

SEQ ID NO: 135817 - RNA, 22 nt, Homo sapiens
gauguguugggaagauuucaag

SEQ ID NO: 135818 - RNA, 22 nt, Homo sapiens
gauuccacuuacuuagcauucc

SEQ ID NO: 135819 - RNA, 22 nt, Homo sapiens
gauuccauuuguggcuauuuac

SEQ ID NO: 135820 - RNA, 22 nt, Homo sapiens
ucacugagcacaggagaugugc

SEQ ID NO: 135821 - RNA, 22 nt, Homo sapiens
ucacugggagcauuugagccuu

SEQ ID NO: 135822 - RNA, 22 nt, Homo sapiens
ucacugugcaugaaggaugcug

SEQ ID NO: 135823 - RNA, 22 nt, Homo sapiens
ucacugugguuggaaggcuuaa

SEQ ID NO: 135824 - RNA, 22 nt, Homo sapiens
ucagacacuguggccuuuggac

SEQ ID NO: 135825 - RNA, 22 nt, Homo sapiens
ucagaguggagucugcagccuu

SEQ ID NO: 135826 - RNA, 22 nt, Homo sapiens
ucagauacuggugacaugaaug

SEQ ID NO: 135827 - RNA, 22 nt, Homo sapiens
ucagauguuuuguuuaucugcu

SEQ ID NO: 135828 - RNA, 20 nt, Homo sapiens
ucagguagaucuuugagguc

SEQ ID NO: 135829 - RNA, 22 nt, Homo sapiens
ucagguagcuagauuaugugag

SEQ ID NO: 135830 - RNA, 22 nt, Homo sapiens
ucagguaucuucauagcaaugc

SEQ ID NO: 135831 - RNA, 19 nt, Homo sapiens
ucaguagugcacauaagcc

SEQ ID NO: 135832 - RNA, 22 nt, Homo sapiens
ucagucauucaauuguugaaug

SEQ ID NO: 135833 - RNA, 22 nt, Homo sapiens
ucaguccccucgcugagucuac

SEQ ID NO: 135834 - RNA, 22 nt, Homo sapiens
ucagugaacgaggaggagggug

SEQ ID NO: 135835 - RNA, 22 nt, Homo sapiens
ucagugaauguuggccacuacu

SEQ ID NO: 135836 - RNA, 22 nt, Homo sapiens
ucagugacuggguauuaaauca

SEQ ID NO: 135837 - RNA, 22 nt, Homo sapiens
ucagugcuuggcacagagagcu

SEQ ID NO: 135838 - RNA, 22 nt, Homo sapiens
ucagugucugugcaccgcugga

SEQ ID NO: 135839 - RNA, 22 nt, Homo sapiens
ucaugacacuggcaggagcuaa

SEQ ID NO: 135840 - RNA, 23 nt, Homo sapiens
ucaugaggccauucaaauccauu

SEQ ID NO: 135841 - RNA, 22 nt, Homo sapiens
ucauggggugcuuugcuagauu

SEQ ID NO: 135842 - RNA, 22 nt, Homo sapiens
ucauucauucauccagcuugag

SEQ ID NO: 135843 - RNA, 22 nt, Homo sapiens
uccacuuuugugcugaauugga

SEQ ID NO: 135844 - RNA, 22 nt, Homo sapiens
uccagguuuugugaguuuaaau

SEQ ID NO: 135845 - RNA, 22 nt, Homo sapiens
uccauggagacacauuuuauau

SEQ ID NO: 135846 - RNA, 22 nt, Homo sapiens
uccauuuguagguagugagaca

SEQ ID NO: 135847 - RNA, 22 nt, Homo sapiens
ucccagugcuaugcaaaagccu

SEQ ID NO: 135848 - RNA, 22 nt, Homo sapiens
uccccugagucaccugcuucuc

SEQ ID NO: 135849 - RNA, 22 nt, Homo sapiens
ucccuugguaauucuguuccuu

SEQ ID NO: 135850 - RNA, 22 nt, Homo sapiens
uccuguaaucccagcuaccaga

SEQ ID NO: 135851 - RNA, 22 nt, Homo sapiens
uccuucaugcaucaauguaucc

SEQ ID NO: 135852 - RNA, 22 nt, Homo sapiens
uccuugagucuuugcucagaug

SEQ ID NO: 135853 - RNA, 19 nt, Homo sapiens
uccuugauugcaccacugc

SEQ ID NO: 135854 - RNA, 22 nt, Homo sapiens
uccuuuggcuaacuuucuaagu

SEQ ID NO: 135855 - RNA, 22 nt, Homo sapiens
uccuuugguuauaggcaccucu

SEQ ID NO: 135856 - RNA, 19 nt, Homo sapiens
ucuaaaucucuugauagac

SEQ ID NO: 135857 - RNA, 22 nt, Homo sapiens
ucuaagaauucauuuauaagcc

SEQ ID NO: 135858 - RNA, 22 nt, Homo sapiens
ucuacagccaguucaggaagaa

SEQ ID NO: 135859 - RNA, 22 nt, Homo sapiens
ucucaaccucccaaguagcugg

SEQ ID NO: 135860 - RNA, 18 nt, Homo sapiens
ucucacagcaaucuguca

SEQ ID NO: 135861 - RNA, 19 nt, Homo sapiens
ucucacagcucuacuaugu

SEQ ID NO: 135862 - RNA, 22 nt, Homo sapiens
ucucacaggguuauugaggggg

SEQ ID NO: 135863 - RNA, 19 nt, Homo sapiens
ucucaguguuggucaggug

SEQ ID NO: 135864 - RNA, 22 nt, Homo sapiens
ucuccggguggcggcgaaggga

SEQ ID NO: 135865 - RNA, 22 nt, Homo sapiens
ucugagacuguuucuaacaagc

SEQ ID NO: 135866 - RNA, 22 nt, Homo sapiens
ucugcaagucuaaacuagccau

SEQ ID NO: 135867 - RNA, 22 nt, Homo sapiens
ucugccuuuucaugugggaugg

SEQ ID NO: 135868 - RNA, 23 nt, Homo sapiens
ucugcggguguggacccuagugc

SEQ ID NO: 135869 - RNA, 22 nt, Homo sapiens
ucuggcuucugacuuaggggac

SEQ ID NO: 135870 - RNA, 22 nt, Homo sapiens
ucuggcuuuagcaugugggaag

SEQ ID NO: 135871 - RNA, 22 nt, Homo sapiens
ucuggcuuucuuuacuuaaugu

SEQ ID NO: 135872 - RNA, 22 nt, Homo sapiens
ucuggguuuuuacaauguuuac

SEQ ID NO: 135873 - RNA, 22 nt, Homo sapiens
ucugugguucaaaccagcaacu

SEQ ID NO: 135874 - RNA, 22 nt, Homo sapiens
ucugugguucaggcuggagugc

SEQ ID NO: 135875 - RNA, 22 nt, Homo sapiens
ucuuaguuuagauuagcaauuc

SEQ ID NO: 135876 - RNA, 22 nt, Homo sapiens
ucuucaugcuugaaauaauagc

SEQ ID NO: 135877 - RNA, 20 nt, Homo sapiens
ucuugggaauguagccuagg

SEQ ID NO: 135878 - RNA, 20 nt, Homo sapiens
ucuugguuggaggucuuuua

SEQ ID NO: 135879 - RNA, 22 nt, Homo sapiens
ucuuuagguguuauaguucaag

SEQ ID NO: 135880 - RNA, 22 nt, Homo sapiens
ucuuugaguuauugugcagacu

SEQ ID NO: 135881 - RNA, 22 nt, Homo sapiens
ucuuugauuuuguuacuaagac

SEQ ID NO: 135882 - RNA, 22 nt, Homo sapiens
ucuuuggguguauuucacagcc

SEQ ID NO: 135883 - RNA, 19 nt, Homo sapiens
ucuuugguacgugcuuuga

SEQ ID NO: 135884 - RNA, 22 nt, Homo sapiens
ucuuuggucagaaagauuacac

SEQ ID NO: 135885 - RNA, 22 nt, Homo sapiens
ucuuuggucaucaugggaagca

SEQ ID NO: 135886 - RNA, 22 nt, Homo sapiens
ugaaaagucuaagauuaagguu

SEQ ID NO: 135887 - RNA, 22 nt, Homo sapiens
ugaaaucuaaaauguuccaaga

SEQ ID NO: 135888 - RNA, 22 nt, Homo sapiens
ugaaaugauuauaugguguuug

SEQ ID NO: 135889 - RNA, 22 nt, Homo sapiens
ugaaaugcagaacuuuaggucu

SEQ ID NO: 135890 - RNA, 22 nt, Homo sapiens
ugaacacagccugccucugcca

SEQ ID NO: 135891 - RNA, 22 nt, Homo sapiens
ugaacagcuaucuugucagugu

SEQ ID NO: 135892 - RNA, 22 nt, Homo sapiens
ugaagagucuaaaucugucuuc

SEQ ID NO: 135893 - RNA, 22 nt, Homo sapiens
ugaaggaguauggauaagucgu

SEQ ID NO: 135894 - RNA, 22 nt, Homo sapiens
ugaaggccgggcaugguggcuc

SEQ ID NO: 135895 - RNA, 22 nt, Homo sapiens
ugaaguaggcauaaguuaagcu

SEQ ID NO: 135896 - RNA, 22 nt, Homo sapiens
ugaauauagacagggguagaga

SEQ ID NO: 135897 - RNA, 22 nt, Homo sapiens
ugaauauguuaauuagcaucau

SEQ ID NO: 135898 - RNA, 22 nt, Homo sapiens
ugaaucauuucuugucuucagu

SEQ ID NO: 135899 - RNA, 22 nt, Homo sapiens
ugaauguaagaugucugcuggu

SEQ ID NO: 135900 - RNA, 23 nt, Homo sapiens
ugaauguaucgaaugugggaaag

SEQ ID NO: 135901 - RNA, 22 nt, Homo sapiens
ugaauguuugcagcuuauacca

SEQ ID NO: 135902 - RNA, 22 nt, Homo sapiens
ugaauucaucucacagaguuaa

SEQ ID NO: 135903 - RNA, 22 nt, Homo sapiens
ugaauugucucucacuggguuc

SEQ ID NO: 135904 - RNA, 22 nt, Homo sapiens
ugacaagggaaaugcaaaaugu

SEQ ID NO: 135905 - RNA, 22 nt, Homo sapiens
ugacacagcaagauggaaccau

SEQ ID NO: 135906 - RNA, 22 nt, Homo sapiens
ugacaggagauuaugugauguu

SEQ ID NO: 135907 - RNA, 22 nt, Homo sapiens
ugacagugaauaagucucuuaa

SEQ ID NO: 135908 - RNA, 22 nt, Homo sapiens
ugacaugaaggcaccucugucc

SEQ ID NO: 135909 - RNA, 22 nt, Homo sapiens
ugacuagggacauucuuccacg

SEQ ID NO: 135910 - RNA, 22 nt, Homo sapiens
ugacuauaguuuucuugacaca

SEQ ID NO: 135911 - RNA, 22 nt, Homo sapiens
ugacuugaucauuacacauucu

SEQ ID NO: 135912 - RNA, 22 nt, Homo sapiens
ugagaacagauggcuuuauuau

SEQ ID NO: 135913 - RNA, 22 nt, Homo sapiens
ugagaacauggagaacccccca

SEQ ID NO: 135914 - RNA, 22 nt, Homo sapiens
ugagaacuaaaaugugguauau

SEQ ID NO: 135915 - RNA, 22 nt, Homo sapiens
ugagaacuguuuugguuugggu

SEQ ID NO: 135916 - RNA, 22 nt, Homo sapiens
uuuuugguugguaggcuauuaa

SEQ ID NO: 135917 - RNA, 22 nt, Homo sapiens
uuuuuuaguuagcugggcauga

SEQ ID NO: 135918 - RNA, 22 nt, Homo sapiens
aaaaguucuuugagccuugaca

SEQ ID NO: 135919 - RNA, 18 nt, Homo sapiens
aaacagugucucuuucug

SEQ ID NO: 135920 - RNA, 22 nt, Homo sapiens
aaaccacagugugcugcugggg

SEQ ID NO: 135921 - RNA, 22 nt, Homo sapiens
aaagaguucagguagauuucaa

SEQ ID NO: 135922 - RNA, 22 nt, Homo sapiens
aaagcacuggagucaucaucua

SEQ ID NO: 135923 - RNA, 22 nt, Homo sapiens
aaaggcacugaucuuauccagu

SEQ ID NO: 135924 - RNA, 22 nt, Homo sapiens
aaagucacuggagaaggaauau

SEQ ID NO: 135925 - RNA, 22 nt, Homo sapiens
aaagucuagaggaucaugugug

SEQ ID NO: 135926 - RNA, 22 nt, Homo sapiens
aaagugauguccaggcuuucag

SEQ ID NO: 135927 - RNA, 22 nt, Homo sapiens
aaagugccugacucauaguuag

SEQ ID NO: 135928 - RNA, 22 nt, Homo sapiens
aaagugcugagucuaggcgggg

SEQ ID NO: 135929 - RNA, 22 nt, Homo sapiens
aaaguucugcguuagggcuaaa

SEQ ID NO: 135930 - RNA, 22 nt, Homo sapiens
aaaugacuuuuuaugcagagua

SEQ ID NO: 135931 - RNA, 21 nt, Homo sapiens
aaaugcacauuacugcuggug

SEQ ID NO: 135932 - RNA, 22 nt, Homo sapiens
aaaugcagucuuuguucugggc

SEQ ID NO: 135933 - RNA, 22 nt, Homo sapiens
aaauggcuuugaggguaggaca

SEQ ID NO: 135934 - RNA, 22 nt, Homo sapiens
aaauucaugucaccucuaggua

SEQ ID NO: 135935 - RNA, 22 nt, Homo sapiens
aaauugcaguuaggaugauggu

SEQ ID NO: 135936 - RNA, 22 nt, Homo sapiens
aacaccuugcgugggcgucaau

SEQ ID NO: 135937 - RNA, 22 nt, Homo sapiens
aacagcuaguaccaauccacua

SEQ ID NO: 135938 - RNA, 20 nt, Homo sapiens
aaccccuauagagaaaccau

SEQ ID NO: 135939 - RNA, 22 nt, Homo sapiens
aaccuguaaccauaugaucagu

SEQ ID NO: 135940 - RNA, 22 nt, Homo sapiens
aacuggcauauucugguugcgg

SEQ ID NO: 135941 - RNA, 22 nt, Homo sapiens
aacuggucuuuggaggaggagg

SEQ ID NO: 135942 - RNA, 21 nt, Homo sapiens
aagaaagcuggacuugccgcu

SEQ ID NO: 135943 - RNA, 18 nt, Homo sapiens
aagagcucagcacagguu

SEQ ID NO: 135944 - RNA, 22 nt, Homo sapiens
aagagguagaagcuugccuucu

SEQ ID NO: 135945 - RNA, 22 nt, Homo sapiens
aagagguaggaaauggucauuu

SEQ ID NO: 135946 - RNA, 22 nt, Homo sapiens
aagaugauguucuuuuucuuag

SEQ ID NO: 135947 - RNA, 22 nt, Homo sapiens
aagaugauguuguguuuucacu

SEQ ID NO: 135948 - RNA, 22 nt, Homo sapiens
aagaugguauuucauuaguuuu

SEQ ID NO: 135949 - RNA, 22 nt, Homo sapiens
aagcaggugucugugucuguaa

SEQ ID NO: 135950 - RNA, 22 nt, Homo sapiens
aagcuggauuuaguguggagca

SEQ ID NO: 135951 - RNA, 22 nt, Homo sapiens
aaggaaguaauuugguuuauag

SEQ ID NO: 135952 - RNA, 22 nt, Homo sapiens
aaggagugugauucuucaguuu

SEQ ID NO: 135953 - RNA, 22 nt, Homo sapiens
aaggcaauuuguugugaggauu

SEQ ID NO: 135954 - RNA, 22 nt, Homo sapiens
aaggcaugcugaguccuaaaag

SEQ ID NO: 135955 - RNA, 22 nt, Homo sapiens
aaggcauucucaaacuaguucu

SEQ ID NO: 135956 - RNA, 22 nt, Homo sapiens
aaggcuguuguguaauaggauu

SEQ ID NO: 135957 - RNA, 22 nt, Homo sapiens
aagguaguuagaaaauauaacu

SEQ ID NO: 135958 - RNA, 22 nt, Homo sapiens
aagguggugucagagagcuuau

SEQ ID NO: 135959 - RNA, 22 nt, Homo sapiens
aagguguagucucuggauaagc

SEQ ID NO: 135960 - RNA, 22 nt, Homo sapiens
aaguaucaggaauaguuauugg

SEQ ID NO: 135961 - RNA, 20 nt, Homo sapiens
aagugcaucguugugucugc

SEQ ID NO: 135962 - RNA, 22 nt, Homo sapiens
aagugccauguggaugggcccu

SEQ ID NO: 135963 - RNA, 22 nt, Homo sapiens
aaguggcauugaggaaaaaaau

SEQ ID NO: 135964 - RNA, 17 nt, Homo sapiens
aaguggcuuguucacca

SEQ ID NO: 135965 - RNA, 22 nt, Homo sapiens
aaguguaugaaacaguccaugg

SEQ ID NO: 135966 - RNA, 20 nt, Homo sapiens
aauaacagccccagggaggu

SEQ ID NO: 135967 - RNA, 22 nt, Homo sapiens
aauaagcugagagaauucuaca

SEQ ID NO: 135968 - RNA, 22 nt, Homo sapiens
aauaauggcaccaaagcacaag

SEQ ID NO: 135969 - RNA, 22 nt, Homo sapiens
aauacugaaaguauuuucaaau

SEQ ID NO: 135970 - RNA, 22 nt, Homo sapiens
aauacuuccaaaucuagucauu

SEQ ID NO: 135971 - RNA, 22 nt, Homo sapiens
aauagcuguccuuagaagugug

SEQ ID NO: 135972 - RNA, 22 nt, Homo sapiens
aauaucuguguauagauggggg

SEQ ID NO: 135973 - RNA, 22 nt, Homo sapiens
aaucgcuuuugguaggcaagga

SEQ ID NO: 135974 - RNA, 22 nt, Homo sapiens
aaugacagccagauucuucucu

SEQ ID NO: 135975 - RNA, 22 nt, Homo sapiens
aauggcauuugccagggcaaag

SEQ ID NO: 135976 - RNA, 18 nt, Homo sapiens
aauggcucuggguucuaa

SEQ ID NO: 135977 - RNA, 22 nt, Homo sapiens
aaugucaugaguccaaccagaa

SEQ ID NO: 135978 - RNA, 22 nt, Homo sapiens
aauguguuuugaaaucaggaag

SEQ ID NO: 135979 - RNA, 22 nt, Homo sapiens
aauugaaucaugugggcagacu

SEQ ID NO: 135980 - RNA, 22 nt, Homo sapiens
aauugcauugaauuuguagcuu

SEQ ID NO: 135981 - RNA, 21 nt, Homo sapiens
acaaagcuggagggagacugc

SEQ ID NO: 135982 - RNA, 22 nt, Homo sapiens
acaaaguaggcagugggcugga

SEQ ID NO: 135983 - RNA, 22 nt, Homo sapiens
acaaagugccuccuuuuagagu

SEQ ID NO: 135984 - RNA, 22 nt, Homo sapiens
acaaaguguuuucugaaggccu

SEQ ID NO: 135985 - RNA, 22 nt, Homo sapiens
acacaguaagcacaguguagau

SEQ ID NO: 135986 - RNA, 22 nt, Homo sapiens
acacagucaaauccacuuggcu

SEQ ID NO: 135987 - RNA, 22 nt, Homo sapiens
acacauuagcaagugcuguuau

SEQ ID NO: 135988 - RNA, 22 nt, Homo sapiens
acacugcugaguaaauaauuuu

SEQ ID NO: 135989 - RNA, 22 nt, Homo sapiens
acacugucugaugaaaguaguu

SEQ ID NO: 135990 - RNA, 22 nt, Homo sapiens
uucuuaguggcaccacuuuuuu

SEQ ID NO: 135991 - RNA, 22 nt, Homo sapiens
uucuuugcaugaucucaaaguc

SEQ ID NO: 135992 - RNA, 23 nt, Homo sapiens
uugaaaagucaguagccucugau

SEQ ID NO: 135993 - RNA, 22 nt, Homo sapiens
uugaaauguuuagaaguuugga

SEQ ID NO: 135994 - RNA, 22 nt, Homo sapiens
uugaagagaaccgcggcuuauu

SEQ ID NO: 135995 - RNA, 22 nt, Homo sapiens
uugaagguaggaugugcuauca

SEQ ID NO: 135996 - RNA, 22 nt, Homo sapiens
uugaaguaggaaaggaggaggu

SEQ ID NO: 135997 - RNA, 22 nt, Homo sapiens
uugaauagcauguuuagugcau

SEQ ID NO: 135998 - RNA, 22 nt, Homo sapiens
uugaauagugacuuugauucug

SEQ ID NO: 135999 - RNA, 22 nt, Homo sapiens
uugaaugaaaugaugucauuug

SEQ ID NO: 136000 - RNA, 22 nt, Homo sapiens
uugaaugaauggaaagaagggu

SEQ ID NO: 136001 - RNA, 22 nt, Homo sapiens
uugacaaggagccauugcaucu

SEQ ID NO: 136002 - RNA, 22 nt, Homo sapiens
uugacagaccuuggucauaucc

SEQ ID NO: 136003 - RNA, 22 nt, Homo sapiens
uugacagagaaaagugugacuu

SEQ ID NO: 136004 - RNA, 22 nt, Homo sapiens
uugacuuagacauucaguugga

SEQ ID NO: 136005 - RNA, 22 nt, Homo sapiens
uugagauguaagauguuaauau

SEQ ID NO: 136006 - RNA, 22 nt, Homo sapiens
uugagcacaggaguuuugagac

SEQ ID NO: 136007 - RNA, 22 nt, Homo sapiens
uugaggacuggaacacaggucu

SEQ ID NO: 136008 - RNA, 22 nt, Homo sapiens
uugaggaggcagucugcccauu

SEQ ID NO: 136009 - RNA, 22 nt, Homo sapiens
uugaggucuucaggaucaggcu

SEQ ID NO: 136010 - RNA, 22 nt, Homo sapiens
uugauaauguuaacuuugguca

SEQ ID NO: 136011 - RNA, 22 nt, Homo sapiens
uugauaguccuguaucuauuuu

SEQ ID NO: 136012 - RNA, 22 nt, Homo sapiens
uugauaugcuugucaguccauu

SEQ ID NO: 136013 - RNA, 22 nt, Homo sapiens
uugauauguuguuggauucacu

SEQ ID NO: 136014 - RNA, 22 nt, Homo sapiens
uugauauuacucaguaacagau

SEQ ID NO: 136015 - RNA, 22 nt, Homo sapiens
uugauauucugagaagcugaag

SEQ ID NO: 136016 - RNA, 22 nt, Homo sapiens
uugcaaagaccucuucacuucc

SEQ ID NO: 136017 - RNA, 22 nt, Homo sapiens
uugcaacauguauucuggugau

SEQ ID NO: 136018 - RNA, 22 nt, Homo sapiens
uugcaccuugaagccaauagca

SEQ ID NO: 136019 - RNA, 22 nt, Homo sapiens
uugcaggcaugagccaccgugc

SEQ ID NO: 136020 - RNA, 23 nt, Homo sapiens
uugcauagacauccucauagauu

SEQ ID NO: 136021 - RNA, 22 nt, Homo sapiens
uugcaugguggaacuuggagcu

SEQ ID NO: 136022 - RNA, 22 nt, Homo sapiens
uugccaauauuuuacugagaag

SEQ ID NO: 136023 - RNA, 22 nt, Homo sapiens
uugcuucuuucgucuggcccca

SEQ ID NO: 136024 - RNA, 22 nt, Homo sapiens
uuggaauuaaccuggugcugga

SEQ ID NO: 136025 - RNA, 19 nt, Homo sapiens
uuggaauuuuagaguuuga

SEQ ID NO: 136026 - RNA, 22 nt, Homo sapiens
uuggacagaugguuacauuuuu

SEQ ID NO: 136027 - RNA, 22 nt, Homo sapiens
uuggacuaagaacuuaaaauaa

SEQ ID NO: 136028 - RNA, 22 nt, Homo sapiens
uuggacuucucaaggcaauaaa

SEQ ID NO: 136029 - RNA, 22 nt, Homo sapiens
uuggacuuuaagauagagaugu

SEQ ID NO: 136030 - RNA, 22 nt, Homo sapiens
uuggcaaagugucuggcauuua

SEQ ID NO: 136031 - RNA, 22 nt, Homo sapiens
uuggcaacauagugagaccccc

SEQ ID NO: 136032 - RNA, 22 nt, Homo sapiens
uuggcacugggaaaaugaccac

SEQ ID NO: 136033 - RNA, 22 nt, Homo sapiens
uuggcagucugaggcacagacu

SEQ ID NO: 136034 - RNA, 22 nt, Homo sapiens
uugggaauguccuaauaucucg

SEQ ID NO: 136035 - RNA, 22 nt, Homo sapiens
uugggcauugggcuaaacuccc

SEQ ID NO: 136036 - RNA, 20 nt, Homo sapiens
uuggugaccuacagaugugg

SEQ ID NO: 136037 - RNA, 22 nt, Homo sapiens
uuguaacucugaauacauccua

SEQ ID NO: 136038 - RNA, 23 nt, Homo sapiens
uuguaacuggagaguaacauucc

SEQ ID NO: 136039 - RNA, 23 nt, Homo sapiens
uuguacacuaagaaucgcagaug

SEQ ID NO: 136040 - RNA, 22 nt, Homo sapiens
uugucaaacucauucuccaucc

SEQ ID NO: 136041 - RNA, 22 nt, Homo sapiens
uuguccccaucugcugccagaa

SEQ ID NO: 136042 - RNA, 22 nt, Homo sapiens
uugugaagaugugaagcaagca

SEQ ID NO: 136043 - RNA, 22 nt, Homo sapiens
uugugaauggugccgcaauaaa

SEQ ID NO: 136044 - RNA, 22 nt, Homo sapiens
uugugccauucuucugccucag

SEQ ID NO: 136045 - RNA, 22 nt, Homo sapiens
uugugguaggaugaagagauga

SEQ ID NO: 136046 - RNA, 22 nt, Homo sapiens
uugugguugauacacguaggaa

SEQ ID NO: 136047 - RNA, 22 nt, Homo sapiens
uuguuaagaugcagauucugga

SEQ ID NO: 136048 - RNA, 22 nt, Homo sapiens
uuguuauguaucucaagauaaa

SEQ ID NO: 136049 - RNA, 22 nt, Homo sapiens
uuguugcacugcuuuccuggcc

SEQ ID NO: 136050 - RNA, 22 nt, Homo sapiens
uuguuuagagacuggaauuaaa

SEQ ID NO: 136051 - RNA, 22 nt, Homo sapiens
uuuaaagcaugacgagaagaag

SEQ ID NO: 136052 - RNA, 22 nt, Homo sapiens
uuuagguauuugguauagcagu

SEQ ID NO: 136053 - RNA, 22 nt, Homo sapiens
uuuaucaggccuuuggaaaaau

SEQ ID NO: 136054 - RNA, 18 nt, Homo sapiens
uuucaagucuuaggugac

SEQ ID NO: 136055 - RNA, 23 nt, Homo sapiens
uuucacagaaggauuguagggcc

SEQ ID NO: 136056 - RNA, 17 nt, Homo sapiens
uuucagaguggaagugu

SEQ ID NO: 136057 - RNA, 22 nt, Homo sapiens
uuucauagaucaugcuuuugga

SEQ ID NO: 136058 - RNA, 22 nt, Homo sapiens
uuucauggagaaucuucuuacu

SEQ ID NO: 136059 - RNA, 22 nt, Homo sapiens
uuucauggaggauuugcuucuu

SEQ ID NO: 136060 - RNA, 22 nt, Homo sapiens
uuucauggaggcauuuuagauu

SEQ ID NO: 136061 - RNA, 22 nt, Homo sapiens
uuucauggcgaggcuucauggg

SEQ ID NO: 136062 - RNA, 22 nt, Homo sapiens
uuuccaguuguucuagaaagcu

SEQ ID NO: 136063 - RNA, 22 nt, Homo sapiens
uuuccauguuggugaaaugagg

SEQ ID NO: 136064 - RNA, 22 nt, Homo sapiens
uuuccuguaggaaggaaauaga

SEQ ID NO: 136065 - RNA, 17 nt, Homo sapiens
uuucucagcccucuucu

SEQ ID NO: 136066 - RNA, 23 nt, Homo sapiens
uuucuugggcaugcuaugucagu

SEQ ID NO: 136067 - RNA, 22 nt, Homo sapiens
uuugacuuuuagaauaugaguu

SEQ ID NO: 136068 - RNA, 22 nt, Homo sapiens
uuugauugguguaccugaaagu

SEQ ID NO: 136069 - RNA, 22 nt, Homo sapiens
uuugcacuuuuguaauaugguu

SEQ ID NO: 136070 - RNA, 22 nt, Homo sapiens
uuuggcaaagaucaacauguua

SEQ ID NO: 136071 - RNA, 22 nt, Homo sapiens
uuuggcacuauagguaaauuug

SEQ ID NO: 136072 - RNA, 22 nt, Homo sapiens
uuuggcauuaagaugcuguauc

SEQ ID NO: 136073 - RNA, 22 nt, Homo sapiens
uuuguaauccuauuccaaagga

SEQ ID NO: 136074 - RNA, 22 nt, Homo sapiens
uuuguacacgugggugaauugu

SEQ ID NO: 136075 - RNA, 22 nt, Homo sapiens
uuuguacacuguugguaggauu

SEQ ID NO: 136076 - RNA, 23 nt, Homo sapiens
uuuguaguagcaugauuuauaau

SEQ ID NO: 136077 - RNA, 22 nt, Homo sapiens
uuugucuccuaagacucugugg

SEQ ID NO: 136078 - RNA, 22 nt, Homo sapiens
uuugugacacaaacacauauau

SEQ ID NO: 136079 - RNA, 22 nt, Homo sapiens
uuugugcuccucucaguaugug

SEQ ID NO: 136080 - RNA, 22 nt, Homo sapiens
uuuguggaaugcccuuauuuau

SEQ ID NO: 136081 - RNA, 22 nt, Homo sapiens
uuuguguccccacccaaacauc

SEQ ID NO: 136082 - RNA, 22 nt, Homo sapiens
uuuuagcagccaugacaaagau

SEQ ID NO: 136083 - RNA, 22 nt, Homo sapiens
uuuugcaccauccuaauaguau

SEQ ID NO: 136084 - RNA, 22 nt, Homo sapiens
uuuugcauuggcugaggagugu

SEQ ID NO: 136085 - RNA, 17 nt, Homo sapiens
uuuuggauuagaaaucc

SEQ ID NO: 136086 - RNA, 23 nt, Homo sapiens
acacuugcugaguaaaucaaaua

SEQ ID NO: 136087 - RNA, 22 nt, Homo sapiens
acaggguuauuguaauaaugua

SEQ ID NO: 136088 - RNA, 22 nt, Homo sapiens
acaggugaaguauuacacuaag

SEQ ID NO: 136089 - RNA, 20 nt, Homo sapiens
acaguagaagggauuucaaa

SEQ ID NO: 136090 - RNA, 22 nt, Homo sapiens
acagugcuuucaauguucagua

SEQ ID NO: 136091 - RNA, 17 nt, Homo sapiens
acagugucuaugaaaug

SEQ ID NO: 136092 - RNA, 22 nt, Homo sapiens
acaguguuccuuuguugugacu

SEQ ID NO: 136093 - RNA, 22 nt, Homo sapiens
acauacacuagggauguggugu

SEQ ID NO: 136094 - RNA, 22 nt, Homo sapiens
acaugcauauguuggaagaaag

SEQ ID NO: 136095 - RNA, 22 nt, Homo sapiens
acauguaauugauuuuguguua

SEQ ID NO: 136096 - RNA, 22 nt, Homo sapiens
acauucagcuguuguuucaaug

SEQ ID NO: 136097 - RNA, 18 nt, Homo sapiens
acauucagcuugaagaua

SEQ ID NO: 136098 - RNA, 22 nt, Homo sapiens
accacaggguaaaguuagauau

SEQ ID NO: 136099 - RNA, 22 nt, Homo sapiens
accacuguuucaagaagcuugu

SEQ ID NO: 136100 - RNA, 19 nt, Homo sapiens
accagauugcauucuugga

SEQ ID NO: 136101 - RNA, 22 nt, Homo sapiens
accaugcaguccaauaugcaca

SEQ ID NO: 136102 - RNA, 22 nt, Homo sapiens
acccagaagucauucaggaaca

SEQ ID NO: 136103 - RNA, 22 nt, Homo sapiens
acccagaguuccuugucuuuca

SEQ ID NO: 136104 - RNA, 22 nt, Homo sapiens
acccaguguugggcagaacugu

SEQ ID NO: 136105 - RNA, 22 nt, Homo sapiens
accuggguguauguucaguuug

SEQ ID NO: 136106 - RNA, 22 nt, Homo sapiens
acggcaguguggugcggucagg

SEQ ID NO: 136107 - RNA, 22 nt, Homo sapiens
acugagccuuuaaaugacuuca

SEQ ID NO: 136108 - RNA, 19 nt, Homo sapiens
acugagcuaccugggggca

SEQ ID NO: 136109 - RNA, 22 nt, Homo sapiens
acugagucauugaggcccucuc

SEQ ID NO: 136110 - RNA, 19 nt, Homo sapiens
acugcacuccaaccuccug

SEQ ID NO: 136111 - RNA, 22 nt, Homo sapiens
acugcacuccagccucggcaau

SEQ ID NO: 136112 - RNA, 22 nt, Homo sapiens
acugcacuccagccuugagagc

SEQ ID NO: 136113 - RNA, 20 nt, Homo sapiens
acugcacuccagucucuggg

SEQ ID NO: 136114 - RNA, 22 nt, Homo sapiens
acugcacugucaaccuccuggg

SEQ ID NO: 136115 - RNA, 22 nt, Homo sapiens
acuguacucuacccugggcaac

SEQ ID NO: 136116 - RNA, 22 nt, Homo sapiens
acuugacacuuauauuacucac

SEQ ID NO: 136117 - RNA, 21 nt, Homo sapiens
acuuucuguggcaguccauuc

SEQ ID NO: 136118 - RNA, 17 nt, Homo sapiens
acuuuuugaggaggcau

SEQ ID NO: 136119 - RNA, 22 nt, Homo sapiens
acuuuuugcaaccauuuggacc

SEQ ID NO: 136120 - RNA, 21 nt, Homo sapiens
agaaaaucuuaugggaaacau

SEQ ID NO: 136121 - RNA, 22 nt, Homo sapiens
agaaauguuuauucaaacccgu

SEQ ID NO: 136122 - RNA, 22 nt, Homo sapiens
agaaugucagcuggauucagcu

SEQ ID NO: 136123 - RNA, 21 nt, Homo sapiens
agacacuuggaagguuuuaga

SEQ ID NO: 136124 - RNA, 22 nt, Homo sapiens
agagauaaagauuuuaauuuug

SEQ ID NO: 136125 - RNA, 22 nt, Homo sapiens
agagaugauuaacauuuuggua

SEQ ID NO: 136126 - RNA, 23 nt, Homo sapiens
agagguuuaaucaggcaguugcu

SEQ ID NO: 136127 - RNA, 22 nt, Homo sapiens
agaucacucagguuucucccug

SEQ ID NO: 136128 - RNA, 22 nt, Homo sapiens
agaucauaugcaguaaugaacu

SEQ ID NO: 136129 - RNA, 18 nt, Homo sapiens
agaugcaugcucacuaca

SEQ ID NO: 136130 - RNA, 22 nt, Homo sapiens
agaugcauugguggcauauuca

SEQ ID NO: 136131 - RNA, 22 nt, Homo sapiens
agauggucuucauaaguuuuaa

SEQ ID NO: 136132 - RNA, 23 nt, Homo sapiens
agcaaaugcucuagcacuccaac

SEQ ID NO: 136133 - RNA, 22 nt, Homo sapiens
agcacagugguuaaguuucuua

SEQ ID NO: 136134 - RNA, 22 nt, Homo sapiens
agcaccacauacuacagagaua

SEQ ID NO: 136135 - RNA, 22 nt, Homo sapiens
agcagcaauuuuguaugguuua

SEQ ID NO: 136136 - RNA, 22 nt, Homo sapiens
agcagcaccaaacagacuaaga

SEQ ID NO: 136137 - RNA, 22 nt, Homo sapiens
agcagcuuugcauggccuguga

SEQ ID NO: 136138 - RNA, 22 nt, Homo sapiens
agcagguauucgggucaugggg

SEQ ID NO: 136139 - RNA, 22 nt, Homo sapiens
agcagguauuuaagaaacucag

SEQ ID NO: 136140 - RNA, 16 nt, Homo sapiens
agcagguguuagguga

SEQ ID NO: 136141 - RNA, 22 nt, Homo sapiens
agcaguagaauuccugcaucac

SEQ ID NO: 136142 - RNA, 16 nt, Homo sapiens
agccaccauuuacuug

SEQ ID NO: 136143 - RNA, 22 nt, Homo sapiens
agcccuuagauggcuccuucca

SEQ ID NO: 136144 - RNA, 22 nt, Homo sapiens
agccuguguugaauuauagaaa

SEQ ID NO: 136145 - RNA, 22 nt, Homo sapiens
agccuucauucugacaguagga

SEQ ID NO: 136146 - RNA, 22 nt, Homo sapiens
agcuaguguucaccagagguca

SEQ ID NO: 136147 - RNA, 22 nt, Homo sapiens
agcugaguguuccaagagcgag

SEQ ID NO: 136148 - RNA, 22 nt, Homo sapiens
agcugccagucuuguaaggccu

SEQ ID NO: 136149 - RNA, 22 nt, Homo sapiens
agcuguguugucugaagucaga

SEQ ID NO: 136150 - RNA, 20 nt, Homo sapiens
agcuugguuuggaugaucac

SEQ ID NO: 136151 - RNA, 22 nt, Homo sapiens
agcuugugauuuagagugagag

SEQ ID NO: 136152 - RNA, 22 nt, Homo sapiens
agcuuguuuuauagaaagucaa

SEQ ID NO: 136153 - RNA, 22 nt, Homo sapiens
agcuuuggauaccugcuguucc

SEQ ID NO: 136154 - RNA, 22 nt, Homo sapiens
agcuuuuugggaggccuuagga

SEQ ID NO: 136155 - RNA, 22 nt, Homo sapiens
aggaacuguaacuaugucucug

SEQ ID NO: 136156 - RNA, 22 nt, Homo sapiens
aggaagcuagcauuuguucagu

SEQ ID NO: 136157 - RNA, 22 nt, Homo sapiens
aggaauguuaguacuucuuagu

SEQ ID NO: 136158 - RNA, 22 nt, Homo sapiens
aggaauuuaauguaugauaaua

SEQ ID NO: 136159 - RNA, 22 nt, Homo sapiens
aggaccauuguguagcagacau

SEQ ID NO: 136160 - RNA, 22 nt, Homo sapiens
aggaggauugcuuucaucuuuu

SEQ ID NO: 136161 - RNA, 22 nt, Homo sapiens
aggaucauugacuauuauaagg

SEQ ID NO: 136162 - RNA, 21 nt, Homo sapiens
aggcaaaugaagcagccgcuc

SEQ ID NO: 136163 - RNA, 22 nt, Homo sapiens
aggcaaugugagaguuuauuca

SEQ ID NO: 136164 - RNA, 22 nt, Homo sapiens
aggcaggugaaagauaguuuua

SEQ ID NO: 136165 - RNA, 22 nt, Homo sapiens
aggcaugauuguauuuugcucu

SEQ ID NO: 136166 - RNA, 22 nt, Homo sapiens
agggcaguguuaggacugucug

SEQ ID NO: 136167 - RNA, 22 nt, Homo sapiens
agggccuuuguagauguacuca

SEQ ID NO: 136168 - RNA, 22 nt, Homo sapiens
agguaauagcacaugauaccuu

SEQ ID NO: 136169 - RNA, 21 nt, Homo sapiens
aggucaguaagaaugcagcac

SEQ ID NO: 136170 - RNA, 22 nt, Homo sapiens
aggugcaauggugguuuugugg

SEQ ID NO: 136171 - RNA, 22 nt, Homo sapiens
aguaaauuucugugcuuucaua

SEQ ID NO: 136172 - RNA, 20 nt, Homo sapiens
aguauucacuuuuuucaugg

SEQ ID NO: 136173 - RNA, 22 nt, Homo sapiens
agucaaggaggccuuucagaug

SEQ ID NO: 136174 - RNA, 22 nt, Homo sapiens
agugaaaugucaccuuuuagga

SEQ ID NO: 136175 - RNA, 22 nt, Homo sapiens
agugaauguuggaaaguuauuu

SEQ ID NO: 136176 - RNA, 22 nt, Homo sapiens
agugaauuguucaacaggagga

SEQ ID NO: 136177 - RNA, 22 nt, Homo sapiens
agugcaaugauccggugcuggg

SEQ ID NO: 136178 - RNA, 22 nt, Homo sapiens
agugcacuccagccugggcaac

SEQ ID NO: 136179 - RNA, 22 nt, Homo sapiens
agugcaguggcauggucauaac

SEQ ID NO: 136180 - RNA, 22 nt, Homo sapiens
agugcaguggugccaucauaac

SEQ ID NO: 136181 - RNA, 22 nt, Homo sapiens
agugcauuuguucugugucagg

SEQ ID NO: 136182 - RNA, 22 nt, Homo sapiens
auucaacuaauuauugaagaug

SEQ ID NO: 136183 - RNA, 20 nt, Homo sapiens
auucauggugguacguuguc

SEQ ID NO: 136184 - RNA, 22 nt, Homo sapiens
auuccacuuacaugaaguaccu

SEQ ID NO: 136185 - RNA, 22 nt, Homo sapiens
auuccauuuguguggaauggcu

SEQ ID NO: 136186 - RNA, 23 nt, Homo sapiens
auugaacacuuucauaugugagg

SEQ ID NO: 136187 - RNA, 22 nt, Homo sapiens
auugaacaugccauauguacca

SEQ ID NO: 136188 - RNA, 22 nt, Homo sapiens
auugagcacugacucugugcca

SEQ ID NO: 136189 - RNA, 22 nt, Homo sapiens
auugauaguuuaauaggaauug

SEQ ID NO: 136190 - RNA, 22 nt, Homo sapiens
auugcaauuaguccauagaguu

SEQ ID NO: 136191 - RNA, 21 nt, Homo sapiens
auugcacuccagccugggcga

SEQ ID NO: 136192 - RNA, 22 nt, Homo sapiens
auugcuuacuaaucaucuucag

SEQ ID NO: 136193 - RNA, 22 nt, Homo sapiens
auugcuucugauuuuaaaugag

SEQ ID NO: 136194 - RNA, 22 nt, Homo sapiens
auugcuuuuacugggagcuuug

SEQ ID NO: 136195 - RNA, 22 nt, Homo sapiens
auuggcaauggcaaagcagagu

SEQ ID NO: 136196 - RNA, 22 nt, Homo sapiens
auuggucuauuaaaccuaaguu

SEQ ID NO: 136197 - RNA, 22 nt, Homo sapiens
auugucauuuucugagaaguaa

SEQ ID NO: 136198 - RNA, 22 nt, Homo sapiens
auugugauugcugcuaggccua

SEQ ID NO: 136199 - RNA, 22 nt, Homo sapiens
auuguucuuacaugcugucauc

SEQ ID NO: 136200 - RNA, 22 nt, Homo sapiens
auuguucuuguguccuuuuccu

SEQ ID NO: 136201 - RNA, 22 nt, Homo sapiens
auuuggguaaugagugcaaggg

SEQ ID NO: 136202 - RNA, 22 nt, Homo sapiens
auuugguugggugcgguggcuu

SEQ ID NO: 136203 - RNA, 22 nt, Homo sapiens
auuuuugguugucagcacuagg

SEQ ID NO: 136204 - RNA, 22 nt, Homo sapiens
caaaguaauugcuguuuugcca

SEQ ID NO: 136205 - RNA, 22 nt, Homo sapiens
caaagugcugggaugggccagg

SEQ ID NO: 136206 - RNA, 22 nt, Homo sapiens
caaauccucaccucaucaugaa

SEQ ID NO: 136207 - RNA, 22 nt, Homo sapiens
caaaugacaucauuucauucaa

SEQ ID NO: 136208 - RNA, 22 nt, Homo sapiens
caagacuguccaacauauuggg

SEQ ID NO: 136209 - RNA, 22 nt, Homo sapiens
caaggaauucucaauagaguua

SEQ ID NO: 136210 - RNA, 22 nt, Homo sapiens
caaguacugggcuauggauauu

SEQ ID NO: 136211 - RNA, 22 nt, Homo sapiens
caauacuguguugaauaagagu

SEQ ID NO: 136212 - RNA, 22 nt, Homo sapiens
caauacuguuaccugaaauagg

SEQ ID NO: 136213 - RNA, 21 nt, Homo sapiens
caaugacacuguagcugugcu

SEQ ID NO: 136214 - RNA, 22 nt, Homo sapiens
caaugcagcuuuuggagagaaa

SEQ ID NO: 136215 - RNA, 22 nt, Homo sapiens
caaugcauuauucucccacuuc

SEQ ID NO: 136216 - RNA, 22 nt, Homo sapiens
cacagcuagucaaugguagaca

SEQ ID NO: 136217 - RNA, 22 nt, Homo sapiens
cacaguugccuaucuccugaag

SEQ ID NO: 136218 - RNA, 22 nt, Homo sapiens
caccacagccauuauugucccc

SEQ ID NO: 136219 - RNA, 22 nt, Homo sapiens
cacugcacuccagccuaagagg

SEQ ID NO: 136220 - RNA, 22 nt, Homo sapiens
cacugcacuccagucugacgac

SEQ ID NO: 136221 - RNA, 22 nt, Homo sapiens
cacugcaguaaauugcgucggu

SEQ ID NO: 136222 - RNA, 22 nt, Homo sapiens
cacugcauccuccaccugccag

SEQ ID NO: 136223 - RNA, 22 nt, Homo sapiens
cacugcauggucuagcuggguu

SEQ ID NO: 136224 - RNA, 17 nt, Homo sapiens
cacugggugcaagagga

SEQ ID NO: 136225 - RNA, 22 nt, Homo sapiens
cagagaaugucuuuuuuaacca

SEQ ID NO: 136226 - RNA, 22 nt, Homo sapiens
cagcaagucucuaagaguucau

SEQ ID NO: 136227 - RNA, 20 nt, Homo sapiens
cagcacgcacaugagacugu

SEQ ID NO: 136228 - RNA, 22 nt, Homo sapiens
cagcagguuuuuaucaguuaag

SEQ ID NO: 136229 - RNA, 22 nt, Homo sapiens
cagcuggugggagcuggguucc

SEQ ID NO: 136230 - RNA, 22 nt, Homo sapiens
cagcuguguuauaaacuaccau

SEQ ID NO: 136231 - RNA, 22 nt, Homo sapiens
cagcuguuguugggguauagga

SEQ ID NO: 136232 - RNA, 22 nt, Homo sapiens
caggugcuuacuuaauagccau

SEQ ID NO: 136233 - RNA, 22 nt, Homo sapiens
caguaaauaucugagcgagguc

SEQ ID NO: 136234 - RNA, 20 nt, Homo sapiens
cagucauagacaucagaguc

SEQ ID NO: 136235 - RNA, 22 nt, Homo sapiens
cagugcuuguuauuguucuauu

SEQ ID NO: 136236 - RNA, 22 nt, Homo sapiens
caucacaucugcaugguaagua

SEQ ID NO: 136237 - RNA, 22 nt, Homo sapiens
caucagcaauguaugaggguuc

SEQ ID NO: 136238 - RNA, 22 nt, Homo sapiens
caugcagcacacaugucugugc

SEQ ID NO: 136239 - RNA, 22 nt, Homo sapiens
caugccacugcacuccaaccug

SEQ ID NO: 136240 - RNA, 23 nt, Homo sapiens
cauggcuguuaacacuguuugag

SEQ ID NO: 136241 - RNA, 22 nt, Homo sapiens
cauugcacuccagccugaggga

SEQ ID NO: 136242 - RNA, 22 nt, Homo sapiens
cauugcacuccagccugccugg

SEQ ID NO: 136243 - RNA, 20 nt, Homo sapiens
cauugcacuccagcuugggc

SEQ ID NO: 136244 - RNA, 22 nt, Homo sapiens
cauugcacuccagcuugggcaa

SEQ ID NO: 136245 - RNA, 22 nt, Homo sapiens
cauugcacuccauccuuggcaa

SEQ ID NO: 136246 - RNA, 22 nt, Homo sapiens
cauugcacuccaucuugggcaa

SEQ ID NO: 136247 - RNA, 22 nt, Homo sapiens
ccaaguguucucauuguucaau

SEQ ID NO: 136248 - RNA, 21 nt, Homo sapiens
ccaugggacggaaugaauaca

SEQ ID NO: 136249 - RNA, 22 nt, Homo sapiens
cccagagacagaaugauaaacu

SEQ ID NO: 136250 - RNA, 22 nt, Homo sapiens
cccaguguuuauuuugagccaa

SEQ ID NO: 136251 - RNA, 22 nt, Homo sapiens
ccccaguguguaaaggccuugc

SEQ ID NO: 136252 - RNA, 19 nt, Homo sapiens
ccccuguggauaccgaggg

SEQ ID NO: 136253 - RNA, 22 nt, Homo sapiens
cccgugucuuggucuagggccu

SEQ ID NO: 136254 - RNA, 22 nt, Homo sapiens
cccuguguuuagcugaagguuu

SEQ ID NO: 136255 - RNA, 22 nt, Homo sapiens
ccuggguuacaggugugagcca

SEQ ID NO: 136256 - RNA, 22 nt, Homo sapiens
ccuucauccuccagcaggcuag

SEQ ID NO: 136257 - RNA, 22 nt, Homo sapiens
ccuuggcacuuugccacagugc

SEQ ID NO: 136258 - RNA, 22 nt, Homo sapiens
cuaaaguauugagugguaaaga

SEQ ID NO: 136259 - RNA, 22 nt, Homo sapiens
cuacacaugcaggcucccugcc

SEQ ID NO: 136260 - RNA, 22 nt, Homo sapiens
cuacagguaugaaagggaguau

SEQ ID NO: 136261 - RNA, 21 nt, Homo sapiens
cuacccuguauuagagaaaga

SEQ ID NO: 136262 - RNA, 22 nt, Homo sapiens
cuauaacagugugguuuggaga

SEQ ID NO: 136263 - RNA, 18 nt, Homo sapiens
cucacacccuaaucagga

SEQ ID NO: 136264 - RNA, 18 nt, Homo sapiens
cucacaguaacuuuuaag

SEQ ID NO: 136265 - RNA, 20 nt, Homo sapiens
cucaccagguguaggcugag

SEQ ID NO: 136266 - RNA, 22 nt, Homo sapiens
cucacggcccugcgcacuggca

SEQ ID NO: 136267 - RNA, 22 nt, Homo sapiens
cucacugugguguccuuaggua

SEQ ID NO: 136268 - RNA, 22 nt, Homo sapiens
cucagcuacuugagaggcuuag

SEQ ID NO: 136269 - RNA, 21 nt, Homo sapiens
cucauauugcuuuuccauggu

SEQ ID NO: 136270 - RNA, 22 nt, Homo sapiens
cuccaggugucauccaccuccu

SEQ ID NO: 136271 - RNA, 22 nt, Homo sapiens
cuccagugcaaagucaugauca

SEQ ID NO: 136272 - RNA, 22 nt, Homo sapiens
cucccuuugcugaauguuuuuc

SEQ ID NO: 136273 - RNA, 22 nt, Homo sapiens
cuccuguagccccaucaucuuu

SEQ ID NO: 136274 - RNA, 22 nt, Homo sapiens
cucucaagaugcugggauuaca

SEQ ID NO: 136275 - RNA, 17 nt, Homo sapiens
cucucugguuuaaagca

SEQ ID NO: 136276 - RNA, 20 nt, Homo sapiens
cucugguugugaauugucuu

SEQ ID NO: 136277 - RNA, 22 nt, Homo sapiens
cucuuggguagauuuugcagag

SEQ ID NO: 136278 - RNA, 22 nt, Homo sapiens
guuggaauguauugcuacuucu

SEQ ID NO: 136279 - RNA, 22 nt, Homo sapiens
guugguauuacagaaauuaguu

SEQ ID NO: 136280 - RNA, 22 nt, Homo sapiens
guuuaacugguacuucaagucu

SEQ ID NO: 136281 - RNA, 22 nt, Homo sapiens
uaaacugcuugaaaugguguca

SEQ ID NO: 136282 - RNA, 22 nt, Homo sapiens
uaaagcauguaauuagguuaga

SEQ ID NO: 136283 - RNA, 22 nt, Homo sapiens
uaaauggauaaaugaauaccua

SEQ ID NO: 136284 - RNA, 22 nt, Homo sapiens
uaacaguguauuccuuuggaca

SEQ ID NO: 136285 - RNA, 18 nt, Homo sapiens
uaacuggugugagauggu

SEQ ID NO: 136286 - RNA, 22 nt, Homo sapiens
uaaggcaaguuuuuaguggaca

SEQ ID NO: 136287 - RNA, 22 nt, Homo sapiens
uaagggacauguguugccuaag

SEQ ID NO: 136288 - RNA, 22 nt, Homo sapiens
uaagguauuuacauuucuguuu

SEQ ID NO: 136289 - RNA, 22 nt, Homo sapiens
uaaguaauugugguuucugcca

SEQ ID NO: 136290 - RNA, 23 nt, Homo sapiens
uaagucacacagauuaauuuauu

SEQ ID NO: 136291 - RNA, 22 nt, Homo sapiens
uaagucacuccagguuaaagug

SEQ ID NO: 136292 - RNA, 22 nt, Homo sapiens
uaagugcaacauaaguguuaaa

SEQ ID NO: 136293 - RNA, 22 nt, Homo sapiens
uaagugcuugacuuugauguuu

SEQ ID NO: 136294 - RNA, 20 nt, Homo sapiens
uaagugcuuuauauugauua

SEQ ID NO: 136295 - RNA, 21 nt, Homo sapiens
uaauaaugucucagacaccua

SEQ ID NO: 136296 - RNA, 22 nt, Homo sapiens
uaauacuagugaauagcaggau

SEQ ID NO: 136297 - RNA, 22 nt, Homo sapiens
uaauacugcugugcuugaguug

SEQ ID NO: 136298 - RNA, 22 nt, Homo sapiens
uaauacuugucauaaaggcauu

SEQ ID NO: 136299 - RNA, 22 nt, Homo sapiens
uaauauguauacagacagauac

SEQ ID NO: 136300 - RNA, 22 nt, Homo sapiens
uaaugcaucaugguuggcaaac

SEQ ID NO: 136301 - RNA, 22 nt, Homo sapiens
uacaccauuugauucuuuaagc

SEQ ID NO: 136302 - RNA, 22 nt, Homo sapiens
uacagaauugcagguguggcag

SEQ ID NO: 136303 - RNA, 23 nt, Homo sapiens
uacagcacacugaugggucuuga

SEQ ID NO: 136304 - RNA, 22 nt, Homo sapiens
uacaggacuucucagaguuauu

SEQ ID NO: 136305 - RNA, 22 nt, Homo sapiens
uacagucauaaugccuagugac

SEQ ID NO: 136306 - RNA, 22 nt, Homo sapiens
uacaugugcaggucuguggggg

SEQ ID NO: 136307 - RNA, 19 nt, Homo sapiens
uacugcacuccagucuggg

SEQ ID NO: 136308 - RNA, 18 nt, Homo sapiens
uacugcacucuccagccu

SEQ ID NO: 136309 - RNA, 22 nt, Homo sapiens
uacugcagucagacuccugggc

SEQ ID NO: 136310 - RNA, 22 nt, Homo sapiens
uagaaugucagcuucuugaggg

SEQ ID NO: 136311 - RNA, 23 nt, Homo sapiens
uagaauguuuuuccauguuucuu

SEQ ID NO: 136312 - RNA, 20 nt, Homo sapiens
uagacagcuagauuagauag

SEQ ID NO: 136313 - RNA, 22 nt, Homo sapiens
uagaggaaggauuggaaacgca

SEQ ID NO: 136314 - RNA, 22 nt, Homo sapiens
uagaucacucaggcaauaaaag

SEQ ID NO: 136315 - RNA, 22 nt, Homo sapiens
uagauuaucccugauuugucca

SEQ ID NO: 136316 - RNA, 21 nt, Homo sapiens
uagcaaauugcuauuaaggca

SEQ ID NO: 136317 - RNA, 20 nt, Homo sapiens
uagcacacauguagaauagu

SEQ ID NO: 136318 - RNA, 17 nt, Homo sapiens
uagcacagugccuggua

SEQ ID NO: 136319 - RNA, 23 nt, Homo sapiens
uagcacuuuuuacauauggacau

SEQ ID NO: 136320 - RNA, 22 nt, Homo sapiens
uagcaggaaaggggucagaucu

SEQ ID NO: 136321 - RNA, 22 nt, Homo sapiens
uagccuguggugaauguuucug

SEQ ID NO: 136322 - RNA, 21 nt, Homo sapiens
uagcuacacugugauucaugg

SEQ ID NO: 136323 - RNA, 22 nt, Homo sapiens
uagcucagcccagcuaagcuca

SEQ ID NO: 136324 - RNA, 22 nt, Homo sapiens
uaggcaauggagauagaggaug

SEQ ID NO: 136325 - RNA, 22 nt, Homo sapiens
uaggcgagauguguguuucaug

SEQ ID NO: 136326 - RNA, 22 nt, Homo sapiens
uagguugucaucagucuccacu

SEQ ID NO: 136327 - RNA, 22 nt, Homo sapiens
uaguaaacauuuuucuaucauu

SEQ ID NO: 136328 - RNA, 22 nt, Homo sapiens
uagucccauaugauuuagugaa

SEQ ID NO: 136329 - RNA, 22 nt, Homo sapiens
uagugaauguuggcuauuaaua

SEQ ID NO: 136330 - RNA, 22 nt, Homo sapiens
uauacaugugggcaucaggaga

SEQ ID NO: 136331 - RNA, 22 nt, Homo sapiens
uauaccacugauuuuauucuga

SEQ ID NO: 136332 - RNA, 21 nt, Homo sapiens
uauagcagcacgauuuauagu

SEQ ID NO: 136333 - RNA, 22 nt, Homo sapiens
uauaucacaugcacucauuuuc

SEQ ID NO: 136334 - RNA, 22 nt, Homo sapiens
uauauguuuucauaaggcuaga

SEQ ID NO: 136335 - RNA, 22 nt, Homo sapiens
uaucacagcauugucuauaaua

SEQ ID NO: 136336 - RNA, 22 nt, Homo sapiens
uaucaguauggauucauggauu

SEQ ID NO: 136337 - RNA, 22 nt, Homo sapiens
uaucauuguguuauuucuucca

SEQ ID NO: 136338 - RNA, 22 nt, Homo sapiens
uauccugaagcuuuauuuaagu

SEQ ID NO: 136339 - RNA, 22 nt, Homo sapiens
uaucuacauguagguauguaug

SEQ ID NO: 136340 - RNA, 22 nt, Homo sapiens
uaugaagccaggauuuauuauu

SEQ ID NO: 136341 - RNA, 20 nt, Homo sapiens
uaugacacugucauaaaaau

SEQ ID NO: 136342 - RNA, 22 nt, Homo sapiens
uaugacauaguccuuaacccuc

SEQ ID NO: 136343 - RNA, 22 nt, Homo sapiens
uaugcacacguguccaugugca

SEQ ID NO: 136344 - RNA, 19 nt, Homo sapiens
uaugggauuuuuagggugu

SEQ ID NO: 136345 - RNA, 22 nt, Homo sapiens
uauuacagaccauaucgccggg

SEQ ID NO: 136346 - RNA, 22 nt, Homo sapiens
uauuccuuuugcauuuccacau

SEQ ID NO: 136347 - RNA, 22 nt, Homo sapiens
uauuguuaaagauguuaaugau

SEQ ID NO: 136348 - RNA, 22 nt, Homo sapiens
ucaaaguaaagccucaggaugg

SEQ ID NO: 136349 - RNA, 22 nt, Homo sapiens
ucaaaucaucuuuuccaaagcu

SEQ ID NO: 136350 - RNA, 22 nt, Homo sapiens
ucaaaugaucugcccgccuugg

SEQ ID NO: 136351 - RNA, 22 nt, Homo sapiens
ucaaaugauucacccaccuuug

SEQ ID NO: 136352 - RNA, 22 nt, Homo sapiens
ucaaaugcacguagagaaaaua

SEQ ID NO: 136353 - RNA, 22 nt, Homo sapiens
ucaaauuccaagucuagguagg

SEQ ID NO: 136354 - RNA, 22 nt, Homo sapiens
ucaagugauucuugugccuuag

SEQ ID NO: 136355 - RNA, 22 nt, Homo sapiens
ucacaagugagaggaauuagau

SEQ ID NO: 136356 - RNA, 22 nt, Homo sapiens
ucacaaguguauagacaugucc

SEQ ID NO: 136357 - RNA, 22 nt, Homo sapiens
ucacacugaauuugaagcaaug

SEQ ID NO: 136358 - RNA, 22 nt, Homo sapiens
ucacagauaaauaaagaugauu

SEQ ID NO: 136359 - RNA, 22 nt, Homo sapiens
ucacagcuaaaaugaaaguagu

SEQ ID NO: 136360 - RNA, 18 nt, Homo sapiens
ucacagguaauuaggauu

SEQ ID NO: 136361 - RNA, 20 nt, Homo sapiens
ucacagucacacauaauccu

SEQ ID NO: 136362 - RNA, 22 nt, Homo sapiens
ucacaguccuguuuaggagagg

SEQ ID NO: 136363 - RNA, 22 nt, Homo sapiens
ucacagucuccucuagggaggg

SEQ ID NO: 136364 - RNA, 23 nt, Homo sapiens
ucacaguuacuuuugcaucaacc

SEQ ID NO: 136365 - RNA, 22 nt, Homo sapiens
ucacauggcagagaagaagcuc

SEQ ID NO: 136366 - RNA, 22 nt, Homo sapiens
ucacaugugacauauauauuug

SEQ ID NO: 136367 - RNA, 22 nt, Homo sapiens
ucacaugugcguuuuggcaugu

SEQ ID NO: 136368 - RNA, 22 nt, Homo sapiens
ucacccacacaggagacaggga

SEQ ID NO: 136369 - RNA, 22 nt, Homo sapiens
ucaccggcagacguggccugau

SEQ ID NO: 136370 - RNA, 21 nt, Homo sapiens
ucaccuguugcgaugaagcug

SEQ ID NO: 136371 - RNA, 23 nt, Homo sapiens
ucacuagaguccuggaguuugag

SEQ ID NO: 136372 - RNA, 22 nt, Homo sapiens
ucacucagaccuggugauaugc

SEQ ID NO: 136373 - RNA, 22 nt, Homo sapiens
ucacugagaaugauguuucuga

SEQ ID NO: 136374 - RNA, 22 nt, Homo sapiens
gucuuugaugucuaugugcuuc

SEQ ID NO: 136375 - RNA, 22 nt, Homo sapiens
gucuuuguuauuaugaaucaac

SEQ ID NO: 136376 - RNA, 22 nt, Homo sapiens
gugaaugaaugggugaauacau

SEQ ID NO: 136377 - RNA, 22 nt, Homo sapiens
gugacacagcaagacuccgucu

SEQ ID NO: 136378 - RNA, 22 nt, Homo sapiens
gugacauuuuuacugaugagag

SEQ ID NO: 136379 - RNA, 22 nt, Homo sapiens
gugaccauuugacauauccuug

SEQ ID NO: 136380 - RNA, 22 nt, Homo sapiens
gugaccucauuacggggccugc

SEQ ID NO: 136381 - RNA, 22 nt, Homo sapiens
gugacugggaguggugaagaua

SEQ ID NO: 136382 - RNA, 22 nt, Homo sapiens
gugagcaaacuuaccuaagguu

SEQ ID NO: 136383 - RNA, 22 nt, Homo sapiens
gugagcauucaaggaaggagcu

SEQ ID NO: 136384 - RNA, 22 nt, Homo sapiens
gugagguguuaaccaaccugug

SEQ ID NO: 136385 - RNA, 22 nt, Homo sapiens
gugauaucacuguaucacucca

SEQ ID NO: 136386 - RNA, 21 nt, Homo sapiens
gugaucaugucacugcacucc

SEQ ID NO: 136387 - RNA, 22 nt, Homo sapiens
gugaucucauuuggaauuagag

SEQ ID NO: 136388 - RNA, 22 nt, Homo sapiens
gugaucuguccuucauagccug

SEQ ID NO: 136389 - RNA, 22 nt, Homo sapiens
gugauugcauuaugaauauuau

SEQ ID NO: 136390 - RNA, 21 nt, Homo sapiens
gugcagaugccacagucacuc

SEQ ID NO: 136391 - RNA, 22 nt, Homo sapiens
gugcaguuuuaagugaguuucu

SEQ ID NO: 136392 - RNA, 22 nt, Homo sapiens
gugccacaguguuaagggauuc

SEQ ID NO: 136393 - RNA, 22 nt, Homo sapiens
guggaaaucucugugugacuua

SEQ ID NO: 136394 - RNA, 22 nt, Homo sapiens
guggaagucuuugguauuggua

SEQ ID NO: 136395 - RNA, 22 nt, Homo sapiens
guggaaugauaucucauugugg

SEQ ID NO: 136396 - RNA, 22 nt, Homo sapiens
guggcaaagaugccuucuccaa

SEQ ID NO: 136397 - RNA, 22 nt, Homo sapiens
guggcaagaauguacaaaaggu

SEQ ID NO: 136398 - RNA, 22 nt, Homo sapiens
guggcaaggaaaugcugcucac

SEQ ID NO: 136399 - RNA, 22 nt, Homo sapiens
guggcagugugaggauccugcu

SEQ ID NO: 136400 - RNA, 22 nt, Homo sapiens
gugucaguggggagugaucuuc

SEQ ID NO: 136401 - RNA, 22 nt, Homo sapiens
gugugauggcgcacacagggug

SEQ ID NO: 136402 - RNA, 21 nt, Homo sapiens
gugugcuugaauucagcuguc

SEQ ID NO: 136403 - RNA, 22 nt, Homo sapiens
guguucaaacccaggucugucu

SEQ ID NO: 136404 - RNA, 22 nt, Homo sapiens
ucacaucucagguuucuugaca

SEQ ID NO: 136405 - RNA, 22 nt, Homo sapiens
ucacaugggugcaauauaauca

SEQ ID NO: 136406 - RNA, 22 nt, Homo sapiens
ucacauguguaaauugguguaa

SEQ ID NO: 136407 - RNA, 22 nt, Homo sapiens
ucacauguguaugagcuuugau

SEQ ID NO: 136408 - RNA, 22 nt, Homo sapiens
ucaccuguagcuaagaccuaau

SEQ ID NO: 136409 - RNA, 22 nt, Homo sapiens
ucaccuugcacaguuguguggg

SEQ ID NO: 136410 - RNA, 19 nt, Homo sapiens
ucaccuugcccugcacaca

SEQ ID NO: 136411 - RNA, 22 nt, Homo sapiens
ucacgugcucuuguguguucug

SEQ ID NO: 136412 - RNA, 22 nt, Homo sapiens
ucacuaggcuggagugcagugg

SEQ ID NO: 136413 - RNA, 22 nt, Homo sapiens
ucacugaaaccuccgccuucug

SEQ ID NO: 136414 - RNA, 22 nt, Homo sapiens
ucacugaaacuguccuggguua

SEQ ID NO: 136415 - RNA, 22 nt, Homo sapiens
ucacugcgaccuccaccucccg

SEQ ID NO: 136416 - RNA, 22 nt, Homo sapiens
ucacugcgaccuccaccuccug

SEQ ID NO: 136417 - RNA, 19 nt, Homo sapiens
ucacuggacagcacacuca

SEQ ID NO: 136418 - RNA, 22 nt, Homo sapiens
ucacuggccaaauucuggguga

SEQ ID NO: 136419 - RNA, 20 nt, Homo sapiens
ucacuggguucuugaagucu

SEQ ID NO: 136420 - RNA, 18 nt, Homo sapiens
ucacugugugucuugggu

SEQ ID NO: 136421 - RNA, 22 nt, Homo sapiens
ucacuuugacggccaacuucua

SEQ ID NO: 136422 - RNA, 22 nt, Homo sapiens
ucacuuuguauagcgacuggcu

SEQ ID NO: 136423 - RNA, 18 nt, Homo sapiens
ucagagugcagacuauac

SEQ ID NO: 136424 - RNA, 22 nt, Homo sapiens
ucagauugaugcauacuuaaau

SEQ ID NO: 136425 - RNA, 22 nt, Homo sapiens
ucaggcaccuuccucuuaucug

SEQ ID NO: 136426 - RNA, 22 nt, Homo sapiens
ucaggcuuuucccagagugaug

SEQ ID NO: 136427 - RNA, 22 nt, Homo sapiens
ucagguaaucuauuugucuuuu

SEQ ID NO: 136428 - RNA, 22 nt, Homo sapiens
ucagguagugccaugauugauu

SEQ ID NO: 136429 - RNA, 22 nt, Homo sapiens
ucagucuuuuaccauuaaguau

SEQ ID NO: 136430 - RNA, 22 nt, Homo sapiens
ucagugguuaaaagauucuaga

SEQ ID NO: 136431 - RNA, 22 nt, Homo sapiens
ucagugucugcauucuuauugu

SEQ ID NO: 136432 - RNA, 23 nt, Homo sapiens
ucagugucuggauccugcucagu

SEQ ID NO: 136433 - RNA, 22 nt, Homo sapiens
ucaguuuagguguaacggccac

SEQ ID NO: 136434 - RNA, 22 nt, Homo sapiens
ucauaguagucacuuaauaaau

SEQ ID NO: 136435 - RNA, 22 nt, Homo sapiens
ucauaucauuagaucuacugua

SEQ ID NO: 136436 - RNA, 22 nt, Homo sapiens
ucauauguaugugcaauuuugu

SEQ ID NO: 136437 - RNA, 21 nt, Homo sapiens
ucaucagucaaagacaauggu

SEQ ID NO: 136438 - RNA, 22 nt, Homo sapiens
ucaucagugcuugcaaauuauu

SEQ ID NO: 136439 - RNA, 22 nt, Homo sapiens
ucaucucaguuucuugccguac

SEQ ID NO: 136440 - RNA, 19 nt, Homo sapiens
ucaugugcauacauuuggg

SEQ ID NO: 136441 - RNA, 22 nt, Homo sapiens
uccagaguggugaugcuggggc

SEQ ID NO: 136442 - RNA, 22 nt, Homo sapiens
uccagguuucaugcucuuuauu

SEQ ID NO: 136443 - RNA, 22 nt, Homo sapiens
uccaguguuccucagucacccc

SEQ ID NO: 136444 - RNA, 19 nt, Homo sapiens
ucccaagaugcucauacau

SEQ ID NO: 136445 - RNA, 23 nt, Homo sapiens
ucccaagauggaccagaccaagg

SEQ ID NO: 136446 - RNA, 22 nt, Homo sapiens
uccccgaggcuggagugcagug

SEQ ID NO: 136447 - RNA, 22 nt, Homo sapiens
uccccugagaccccucagcacu

SEQ ID NO: 136448 - RNA, 22 nt, Homo sapiens
ucccugaagcugcagcaacaca

SEQ ID NO: 136449 - RNA, 22 nt, Homo sapiens
ucccugaaucucagguucugua

SEQ ID NO: 136450 - RNA, 22 nt, Homo sapiens
uccuuuggguagcuguucagau

SEQ ID NO: 136451 - RNA, 22 nt, Homo sapiens
ucgugccacugcacuccagccu

SEQ ID NO: 136452 - RNA, 22 nt, Homo sapiens
ucuaauguaaccugcaaauauu

SEQ ID NO: 136453 - RNA, 22 nt, Homo sapiens
ucucacacugaauguguguggg

SEQ ID NO: 136454 - RNA, 22 nt, Homo sapiens
ucucacagaguugaacuuucuu

SEQ ID NO: 136455 - RNA, 22 nt, Homo sapiens
ucucacagaguugaauguuucu

SEQ ID NO: 136456 - RNA, 22 nt, Homo sapiens
ucucccauccaugaacuucugu

SEQ ID NO: 136457 - RNA, 22 nt, Homo sapiens
ucucccauccguacacggauug

SEQ ID NO: 136458 - RNA, 22 nt, Homo sapiens
ucugagcaauaaacaacauauu

SEQ ID NO: 136459 - RNA, 22 nt, Homo sapiens
ucugagcaauagauguggauau

SEQ ID NO: 136460 - RNA, 18 nt, Homo sapiens
ucuggcuucuuuguucca

SEQ ID NO: 136461 - RNA, 21 nt, Homo sapiens
ucuggcuuucauuccccuucu

SEQ ID NO: 136462 - RNA, 23 nt, Homo sapiens
ucuggcuuugggaugcucaaggg

SEQ ID NO: 136463 - RNA, 22 nt, Homo sapiens
ucuggcuuugugaguugccaga

SEQ ID NO: 136464 - RNA, 22 nt, Homo sapiens
ucugguggugaugagagacagu

SEQ ID NO: 136465 - RNA, 22 nt, Homo sapiens
ucugguuccugcauucauucaa

SEQ ID NO: 136466 - RNA, 22 nt, Homo sapiens
ucugugaaugugaccuuauuug

SEQ ID NO: 136467 - RNA, 22 nt, Homo sapiens
ucuguuguuguuuuaagagaca

SEQ ID NO: 136468 - RNA, 22 nt, Homo sapiens
ucuugaacuucauaggucuaga

SEQ ID NO: 136469 - RNA, 22 nt, Homo sapiens
ucuugguuuauugauggagagg

SEQ ID NO: 136470 - RNA, 22 nt, Homo sapiens
ucuuugagugcccugagucccu

SEQ ID NO: 136471 - RNA, 22 nt, Homo sapiens
ucuuugaguggagcgaggcaga

SEQ ID NO: 136472 - RNA, 22 nt, Homo sapiens
ucuuugauguucugaaagaugg

SEQ ID NO: 136473 - RNA, 22 nt, Homo sapiens
ucuuugauuaugcagauggguu

SEQ ID NO: 136474 - RNA, 22 nt, Homo sapiens
ugaaaaguuguugaaggcuuca

SEQ ID NO: 136475 - RNA, 22 nt, Homo sapiens
ugaaacugcagugggcuuggca

SEQ ID NO: 136476 - RNA, 22 nt, Homo sapiens
ugaaaguuauauugugaaauuc

SEQ ID NO: 136477 - RNA, 22 nt, Homo sapiens
ugaaauggaaagaguguagacu

SEQ ID NO: 136478 - RNA, 21 nt, Homo sapiens
ugaaccccugcucucaagaaa

SEQ ID NO: 136479 - RNA, 22 nt, Homo sapiens
ugaagugggaaaugaguauuaa

SEQ ID NO: 136480 - RNA, 22 nt, Homo sapiens
ugaaugcaucauguagggcuca

SEQ ID NO: 136481 - RNA, 22 nt, Homo sapiens
ugaauggauccaauucuuagua

SEQ ID NO: 136482 - RNA, 20 nt, Homo sapiens
ugaauguaauuacagaugua

SEQ ID NO: 136483 - RNA, 22 nt, Homo sapiens
ugaauucuguccaaaauaacug

SEQ ID NO: 136484 - RNA, 23 nt, Homo sapiens
ugacaaccucaugcuuugucaug

SEQ ID NO: 136485 - RNA, 20 nt, Homo sapiens
ugacaaggugcaaagaauca

SEQ ID NO: 136486 - RNA, 22 nt, Homo sapiens
ugacaggucuaauuuacugaca

SEQ ID NO: 136487 - RNA, 23 nt, Homo sapiens
ugacagugcuugaaauugcucuu

SEQ ID NO: 136488 - RNA, 22 nt, Homo sapiens
ugacaguguccuccuccugaga

SEQ ID NO: 136489 - RNA, 22 nt, Homo sapiens
ugacagugugagauccugucuc

SEQ ID NO: 136490 - RNA, 22 nt, Homo sapiens
ugacccauagaaauguggauaa

SEQ ID NO: 136491 - RNA, 22 nt, Homo sapiens
ugacuacacacaauuugucaag

SEQ ID NO: 136492 - RNA, 22 nt, Homo sapiens
ugacuucauuuuuggccaugag

SEQ ID NO: 136493 - RNA, 16 nt, Homo sapiens
ugagaacaugcagcau

SEQ ID NO: 136494 - RNA, 16 nt, Homo sapiens
ugagaacaugggguau

SEQ ID NO: 136495 - RNA, 17 nt, Homo sapiens
ugagaacaugugguauu

SEQ ID NO: 136496 - RNA, 22 nt, Homo sapiens
ugagaagaugaacuccuugguc

SEQ ID NO: 136497 - RNA, 19 nt, Homo sapiens
ugagaauguuaccaggucc

SEQ ID NO: 136498 - RNA, 22 nt, Homo sapiens
ugagacugagucucgcucuauu

SEQ ID NO: 136499 - RNA, 22 nt, Homo sapiens
ugagagacagacauuaucuuau

SEQ ID NO: 136500 - RNA, 18 nt, Homo sapiens
ugugacauugagcauguc

SEQ ID NO: 136501 - RNA, 22 nt, Homo sapiens
ugugacucuggcacauggugag

SEQ ID NO: 136502 - RNA, 22 nt, Homo sapiens
ugugauaguuggcuaaagcagu

SEQ ID NO: 136503 - RNA, 18 nt, Homo sapiens
ugugauggauauguuaau

SEQ ID NO: 136504 - RNA, 22 nt, Homo sapiens
ugugauugauauauuuacagaa

SEQ ID NO: 136505 - RNA, 22 nt, Homo sapiens
ugugcaaucagcuucauuacau

SEQ ID NO: 136506 - RNA, 22 nt, Homo sapiens
ugugcaccucuucacacaggga

SEQ ID NO: 136507 - RNA, 22 nt, Homo sapiens
ugugcaguuuugagugaauuuc

SEQ ID NO: 136508 - RNA, 22 nt, Homo sapiens
ugugcuaauacauacagugcua

SEQ ID NO: 136509 - RNA, 20 nt, Homo sapiens
uguggcacuguaucucucag

SEQ ID NO: 136510 - RNA, 22 nt, Homo sapiens
uguggcagugcuuuaugaaacc

SEQ ID NO: 136511 - RNA, 22 nt, Homo sapiens
uguguaaagcuuguuccagaaa

SEQ ID NO: 136512 - RNA, 22 nt, Homo sapiens
uguguacaucucuacacacaug

SEQ ID NO: 136513 - RNA, 22 nt, Homo sapiens
uguuaucauuacguucuuaguu

SEQ ID NO: 136514 - RNA, 19 nt, Homo sapiens
uguugcacuccagcuuggg

SEQ ID NO: 136515 - RNA, 22 nt, Homo sapiens
uguugcuuaagccacccagucu

SEQ ID NO: 136516 - RNA, 22 nt, Homo sapiens
uguuggcauugcugcugacccu

SEQ ID NO: 136517 - RNA, 22 nt, Homo sapiens
uguuugcuguguggaguagcag

SEQ ID NO: 136518 - RNA, 22 nt, Homo sapiens
uuaaagcuggcguuacaguuug

SEQ ID NO: 136519 - RNA, 22 nt, Homo sapiens
uuaaaguguuuucaaaauguca

SEQ ID NO: 136520 - RNA, 22 nt, Homo sapiens
uuaaaugcacauacuugagaaa

SEQ ID NO: 136521 - RNA, 21 nt, Homo sapiens
uuaacagacaagugucuuccc

SEQ ID NO: 136522 - RNA, 23 nt, Homo sapiens
uuaagcaacggcugcuuuucaga

SEQ ID NO: 136523 - RNA, 22 nt, Homo sapiens
uuaaguuguagcuacaaauaca

SEQ ID NO: 136524 - RNA, 22 nt, Homo sapiens
uuaauacucuucuaaguagucc

SEQ ID NO: 136525 - RNA, 22 nt, Homo sapiens
uuaauguaucuaucacaucaca

SEQ ID NO: 136526 - RNA, 22 nt, Homo sapiens
uuacaaccucagcagugcaaag

SEQ ID NO: 136527 - RNA, 22 nt, Homo sapiens
uuacaaguggcaucucucugga

SEQ ID NO: 136528 - RNA, 22 nt, Homo sapiens
uuacacaguugguaggggcaga

SEQ ID NO: 136529 - RNA, 22 nt, Homo sapiens
uuacacguaauaucacggugug

SEQ ID NO: 136530 - RNA, 22 nt, Homo sapiens
uuaccagucugauaaacagaaa

SEQ ID NO: 136531 - RNA, 22 nt, Homo sapiens
uuacccauuagagaauuuaaga

SEQ ID NO: 136532 - RNA, 22 nt, Homo sapiens
uuagacacacauacauuuaucu

SEQ ID NO: 136533 - RNA, 22 nt, Homo sapiens
uuagcacaucuuucuauguaag

SEQ ID NO: 136534 - RNA, 22 nt, Homo sapiens
uuagcacugucuacucuggauu

SEQ ID NO: 136535 - RNA, 22 nt, Homo sapiens
uuaggcaguuuauugauuuuca

SEQ ID NO: 136536 - RNA, 22 nt, Homo sapiens
uuaggcuuuucagacacuucau

SEQ ID NO: 136537 - RNA, 22 nt, Homo sapiens
uuagguauuuuguuaugucagc

SEQ ID NO: 136538 - RNA, 22 nt, Homo sapiens
uuagugaaugcaccacuucuga

SEQ ID NO: 136539 - RNA, 22 nt, Homo sapiens
uuauauguuagacauggugggu

SEQ ID NO: 136540 - RNA, 22 nt, Homo sapiens
uuauuagguuagugcaaaaguu

SEQ ID NO: 136541 - RNA, 22 nt, Homo sapiens
uuauuagguugguggaaaagua

SEQ ID NO: 136542 - RNA, 22 nt, Homo sapiens
uuauucauuaauugcuaagguu

SEQ ID NO: 136543 - RNA, 22 nt, Homo sapiens
uucaaaguaaaaauguguucac

SEQ ID NO: 136544 - RNA, 22 nt, Homo sapiens
uucaaaguguugguuuugggcu

SEQ ID NO: 136545 - RNA, 22 nt, Homo sapiens
uucaaaguuggaggacaaacug

SEQ ID NO: 136546 - RNA, 22 nt, Homo sapiens
uucaaaucuucguuuugccaua

SEQ ID NO: 136547 - RNA, 22 nt, Homo sapiens
uucacaugguugccuuuugauc

SEQ ID NO: 136548 - RNA, 22 nt, Homo sapiens
uucacugggugugguggcucac

SEQ ID NO: 136549 - RNA, 22 nt, Homo sapiens
uucacugugaacucauauucag

SEQ ID NO: 136550 - RNA, 22 nt, Homo sapiens
uucacugugugacccugggcca

SEQ ID NO: 136551 - RNA, 22 nt, Homo sapiens
uucacuguuaagcaguuaaacu

SEQ ID NO: 136552 - RNA, 22 nt, Homo sapiens
uucagaugcacacuguagucua

SEQ ID NO: 136553 - RNA, 22 nt, Homo sapiens
uucaguauugcaccuggagucc

SEQ ID NO: 136554 - RNA, 22 nt, Homo sapiens
uucaguccauuuccuuggucac

SEQ ID NO: 136555 - RNA, 18 nt, Homo sapiens
uucauaguagcaugauuu

SEQ ID NO: 136556 - RNA, 22 nt, Homo sapiens
uucauaguauuuuucuccaaau

SEQ ID NO: 136557 - RNA, 22 nt, Homo sapiens
uucauagucuaugcaaguaaga

SEQ ID NO: 136558 - RNA, 22 nt, Homo sapiens
uucauagugaaaaauucaaagu

SEQ ID NO: 136559 - RNA, 22 nt, Homo sapiens
uucauaguucuuuuagucauua

SEQ ID NO: 136560 - RNA, 22 nt, Homo sapiens
uucauaguuuauacugauauuu

SEQ ID NO: 136561 - RNA, 20 nt, Homo sapiens
uucaugggagcaaagaggcc

SEQ ID NO: 136562 - RNA, 22 nt, Homo sapiens
uuccaagugggaaacaaaaaug

SEQ ID NO: 136563 - RNA, 22 nt, Homo sapiens
uuccacaaugguugaacuagcu

SEQ ID NO: 136564 - RNA, 23 nt, Homo sapiens
uuccaccauugacuaguuacaua

SEQ ID NO: 136565 - RNA, 20 nt, Homo sapiens
uuccagcacauuagggaagc

SEQ ID NO: 136566 - RNA, 22 nt, Homo sapiens
uuccaguauuugggcaagcgca

SEQ ID NO: 136567 - RNA, 22 nt, Homo sapiens
uuccaguggacuacuucauccu

SEQ ID NO: 136568 - RNA, 22 nt, Homo sapiens
uuccaguguguucauccucaga

SEQ ID NO: 136569 - RNA, 22 nt, Homo sapiens
uuccaugagaugcaucaaagcu

SEQ ID NO: 136570 - RNA, 22 nt, Homo sapiens
uuccauguaguugagcaguuuu

SEQ ID NO: 136571 - RNA, 22 nt, Homo sapiens
uucccagugccaggcacuggga

SEQ ID NO: 136572 - RNA, 22 nt, Homo sapiens
uucccuagaacacauggaggga

SEQ ID NO: 136573 - RNA, 22 nt, Homo sapiens
uuccguguaguugagcaguuuu

SEQ ID NO: 136574 - RNA, 22 nt, Homo sapiens
uuccuguagcgauuuuaguaau

SEQ ID NO: 136575 - RNA, 22 nt, Homo sapiens
uuccuuguuuauuuacaggagg

SEQ ID NO: 136576 - RNA, 22 nt, Homo sapiens
uucugcacaucgaucacaagau

SEQ ID NO: 136577 - RNA, 22 nt, Homo sapiens
uucuggcucgauucucugaccg

SEQ ID NO: 136578 - RNA, 22 nt, Homo sapiens
auugcacuccacccugggcaac

SEQ ID NO: 136579 - RNA, 22 nt, Homo sapiens
auugccucaauuccaagacugc

SEQ ID NO: 136580 - RNA, 22 nt, Homo sapiens
auugcugagacauugcuaaucu

SEQ ID NO: 136581 - RNA, 22 nt, Homo sapiens
auugcuuaagucccuguauuag

SEQ ID NO: 136582 - RNA, 22 nt, Homo sapiens
auuggcaauagcuuucuuacua

SEQ ID NO: 136583 - RNA, 22 nt, Homo sapiens
auuggcaauguacauaucuugc

SEQ ID NO: 136584 - RNA, 22 nt, Homo sapiens
auuuaugguuaauauaggaagu

SEQ ID NO: 136585 - RNA, 19 nt, Homo sapiens
auuuccuggagcuggucuc

SEQ ID NO: 136586 - RNA, 22 nt, Homo sapiens
auuuccuguaggggcuugcgaa

SEQ ID NO: 136587 - RNA, 22 nt, Homo sapiens
auuuggccuuuguaugcaguau

SEQ ID NO: 136588 - RNA, 22 nt, Homo sapiens
auuugguuauucaguuguucag

SEQ ID NO: 136589 - RNA, 22 nt, Homo sapiens
auuuuugguugguaggcuauua

SEQ ID NO: 136590 - RNA, 22 nt, Homo sapiens
caagggguggaaaugguagugu

SEQ ID NO: 136591 - RNA, 23 nt, Homo sapiens
caauacugaccucacguuaauag

SEQ ID NO: 136592 - RNA, 21 nt, Homo sapiens
caauggcacaaucucugcuca

SEQ ID NO: 136593 - RNA, 22 nt, Homo sapiens
cacagucugggcuuguuuguac

SEQ ID NO: 136594 - RNA, 21 nt, Homo sapiens
cacauggaggcagagagugua

SEQ ID NO: 136595 - RNA, 22 nt, Homo sapiens
caccuagacuggagugcagugg

SEQ ID NO: 136596 - RNA, 22 nt, Homo sapiens
caccuguagucccagcugaggc

SEQ ID NO: 136597 - RNA, 22 nt, Homo sapiens
cacuagagaauagguaguucug

SEQ ID NO: 136598 - RNA, 22 nt, Homo sapiens
cacugcaauuacuuuugcacca

SEQ ID NO: 136599 - RNA, 22 nt, Homo sapiens
cacugcacuccagucuggcgac

SEQ ID NO: 136600 - RNA, 22 nt, Homo sapiens
cacugcacuccaguuucgguaa

SEQ ID NO: 136601 - RNA, 21 nt, Homo sapiens
cacugcacuugccuucugggu

SEQ ID NO: 136602 - RNA, 22 nt, Homo sapiens
cacugcauccuccaccuccugg

SEQ ID NO: 136603 - RNA, 22 nt, Homo sapiens
cacugcauccuugaccuucugg

SEQ ID NO: 136604 - RNA, 22 nt, Homo sapiens
cacugcauggccacccauguua

SEQ ID NO: 136605 - RNA, 22 nt, Homo sapiens
cacugcgaccuccaccucccgg

SEQ ID NO: 136606 - RNA, 22 nt, Homo sapiens
cacugggccaucacuuaauauu

SEQ ID NO: 136607 - RNA, 22 nt, Homo sapiens
cagcccguaaucccagcacuuu

SEQ ID NO: 136608 - RNA, 22 nt, Homo sapiens
cagcuguuguuaugucugcagg

SEQ ID NO: 136609 - RNA, 23 nt, Homo sapiens
cagcuucauugaacauaacuccu

SEQ ID NO: 136610 - RNA, 22 nt, Homo sapiens
caggaaugugaggguucccugc

SEQ ID NO: 136611 - RNA, 22 nt, Homo sapiens
caggcagugggagacaaaacug

SEQ ID NO: 136612 - RNA, 22 nt, Homo sapiens
cagggcauuggcugguaccugg

SEQ ID NO: 136613 - RNA, 22 nt, Homo sapiens
cagucacagugacaggaugugg

SEQ ID NO: 136614 - RNA, 22 nt, Homo sapiens
caguuguuuuaugacauaagau

SEQ ID NO: 136615 - RNA, 22 nt, Homo sapiens
cauaaagauggaggaggccagg

SEQ ID NO: 136616 - RNA, 22 nt, Homo sapiens
cauacagcuaguaaguguaaga

SEQ ID NO: 136617 - RNA, 22 nt, Homo sapiens
cauacaguaggcacuauuugua

SEQ ID NO: 136618 - RNA, 22 nt, Homo sapiens
cauagguugggcguuugauuuu

SEQ ID NO: 136619 - RNA, 22 nt, Homo sapiens
cauauucacuuuacagagcugu

SEQ ID NO: 136620 - RNA, 22 nt, Homo sapiens
caucacagcaaguagggagugg

SEQ ID NO: 136621 - RNA, 22 nt, Homo sapiens
cauccccugcaccaaccuuuac

SEQ ID NO: 136622 - RNA, 22 nt, Homo sapiens
caucucauugaauugcugagca

SEQ ID NO: 136623 - RNA, 22 nt, Homo sapiens
caugccacugcacgccauccug

SEQ ID NO: 136624 - RNA, 22 nt, Homo sapiens
cauggcccugggcugggcgaac

SEQ ID NO: 136625 - RNA, 22 nt, Homo sapiens
caugggacugucuuggcuauac

SEQ ID NO: 136626 - RNA, 19 nt, Homo sapiens
cauugcacuccacccuggg

SEQ ID NO: 136627 - RNA, 22 nt, Homo sapiens
cauugcacuccagccuaggcaa

SEQ ID NO: 136628 - RNA, 22 nt, Homo sapiens
cauugguuaguuaacuuuaaga

SEQ ID NO: 136629 - RNA, 22 nt, Homo sapiens
ccaaauccauccaaaucauaga

SEQ ID NO: 136630 - RNA, 22 nt, Homo sapiens
ccacauuaccuugcuugcucca

SEQ ID NO: 136631 - RNA, 22 nt, Homo sapiens
ccaccuguacuuaagucacuuu

SEQ ID NO: 136632 - RNA, 22 nt, Homo sapiens
ccagauguuuucauucagcaag

SEQ ID NO: 136633 - RNA, 22 nt, Homo sapiens
ccagugauggcugccucauuug

SEQ ID NO: 136634 - RNA, 19 nt, Homo sapiens
ccaguguugccagagcuga

SEQ ID NO: 136635 - RNA, 22 nt, Homo sapiens
ccaguucaaugauauggaaacu

SEQ ID NO: 136636 - RNA, 19 nt, Homo sapiens
ccauggcaaugaucugaug

SEQ ID NO: 136637 - RNA, 22 nt, Homo sapiens
cccacaguggccucauauccuu

SEQ ID NO: 136638 - RNA, 22 nt, Homo sapiens
cccagcguucggcauggcugag

SEQ ID NO: 136639 - RNA, 19 nt, Homo sapiens
cccagugucagagaagggu

SEQ ID NO: 136640 - RNA, 22 nt, Homo sapiens
cccagugugcugggugacagcu

SEQ ID NO: 136641 - RNA, 20 nt, Homo sapiens
ccccuggaguggggcugcuu

SEQ ID NO: 136642 - RNA, 22 nt, Homo sapiens
ccccuguaucucagcgucuuca

SEQ ID NO: 136643 - RNA, 22 nt, Homo sapiens
ccggcuguguggagaggccccu

SEQ ID NO: 136644 - RNA, 21 nt, Homo sapiens
ccugaagaagugaccucugag

SEQ ID NO: 136645 - RNA, 22 nt, Homo sapiens
ccuguagcauccaagaagcugc

SEQ ID NO: 136646 - RNA, 22 nt, Homo sapiens
ccugucuugauuaaauuacuua

SEQ ID NO: 136647 - RNA, 22 nt, Homo sapiens
ccuucauugcaucuuuaagaga

SEQ ID NO: 136648 - RNA, 22 nt, Homo sapiens
ccuuuguuuaguugaauuguau

SEQ ID NO: 136649 - RNA, 22 nt, Homo sapiens
cgcccuguagcuagcuagaggu

SEQ ID NO: 136650 - RNA, 22 nt, Homo sapiens
cuagacacugacguuccuccga

SEQ ID NO: 136651 - RNA, 22 nt, Homo sapiens
cuagacuagacccaaauugaag

SEQ ID NO: 136652 - RNA, 22 nt, Homo sapiens
cuagccuggagugcaguggugc

SEQ ID NO: 136653 - RNA, 22 nt, Homo sapiens
cuagguuauacucugaaauggu

SEQ ID NO: 136654 - RNA, 22 nt, Homo sapiens
cuauauacugccugcugauuag

SEQ ID NO: 136655 - RNA, 18 nt, Homo sapiens
cuaugccacuuuauauca

SEQ ID NO: 136656 - RNA, 22 nt, Homo sapiens
cuauuacuuuuauugaacucag

SEQ ID NO: 136657 - RNA, 21 nt, Homo sapiens
cucaaaguacugauauuacag

SEQ ID NO: 136658 - RNA, 22 nt, Homo sapiens
cucaaagugcugggauuggcca

SEQ ID NO: 136659 - RNA, 22 nt, Homo sapiens
cucaaguacaugggauuacagg

SEQ ID NO: 136660 - RNA, 22 nt, Homo sapiens
cucacagucagaagggacuugc

SEQ ID NO: 136661 - RNA, 22 nt, Homo sapiens
cucacagucucucccuaauuuu

SEQ ID NO: 136662 - RNA, 22 nt, Homo sapiens
cucacaguucuaaaggcaagaa

SEQ ID NO: 136663 - RNA, 22 nt, Homo sapiens
cucaccuugugauccacccacc

SEQ ID NO: 136664 - RNA, 22 nt, Homo sapiens
cucacggugcaggcuucuggga

SEQ ID NO: 136665 - RNA, 17 nt, Homo sapiens
cucacugagaacagcua

SEQ ID NO: 136666 - RNA, 22 nt, Homo sapiens
cucagucuaugauacuuugcua

SEQ ID NO: 136667 - RNA, 22 nt, Homo sapiens
cucagugucuggcacacagaaa

SEQ ID NO: 136668 - RNA, 22 nt, Homo sapiens
cucaguguuucagcugcucaga

SEQ ID NO: 136669 - RNA, 22 nt, Homo sapiens
cucauggaauacuucacagcca

SEQ ID NO: 136670 - RNA, 19 nt, Homo sapiens
cucauggagaaggagaaua

SEQ ID NO: 136671 - RNA, 22 nt, Homo sapiens
cuccauuuaguccuuuuagaag

SEQ ID NO: 136672 - RNA, 22 nt, Homo sapiens
cucccauugcaaacaacagaag

SEQ ID NO: 136673 - RNA, 23 nt, Homo sapiens
auagagcuaggaugcagacagau

SEQ ID NO: 136674 - RNA, 22 nt, Homo sapiens
auagaggacugaggugaucuuu

SEQ ID NO: 136675 - RNA, 22 nt, Homo sapiens
auagcaaugccccauucccagu

SEQ ID NO: 136676 - RNA, 20 nt, Homo sapiens
auagcaccagacagcccuag

SEQ ID NO: 136677 - RNA, 22 nt, Homo sapiens
auagugcuggaauaaauauacg

SEQ ID NO: 136678 - RNA, 22 nt, Homo sapiens
auauaugcacacgugugcauau

SEQ ID NO: 136679 - RNA, 22 nt, Homo sapiens
auauaugcuaagugcuaauaaa

SEQ ID NO: 136680 - RNA, 22 nt, Homo sapiens
auauauguuuucugggaagaaa

SEQ ID NO: 136681 - RNA, 22 nt, Homo sapiens
auaucaaggccauuuucuaaau

SEQ ID NO: 136682 - RNA, 22 nt, Homo sapiens
auaucccagugaugauugauag

SEQ ID NO: 136683 - RNA, 21 nt, Homo sapiens
auauggaacuggugacguguu

SEQ ID NO: 136684 - RNA, 22 nt, Homo sapiens
auauuagcacuaaugucacgau

SEQ ID NO: 136685 - RNA, 22 nt, Homo sapiens
auauucaagugaggauggcuaa

SEQ ID NO: 136686 - RNA, 22 nt, Homo sapiens
auauugcuugaggccaggaggu

SEQ ID NO: 136687 - RNA, 22 nt, Homo sapiens
auauuggccuaaaauucucuuu

SEQ ID NO: 136688 - RNA, 22 nt, Homo sapiens
aucaaaguaggcauauguuuuu

SEQ ID NO: 136689 - RNA, 22 nt, Homo sapiens
aucaaagugaauuaaugagaau

SEQ ID NO: 136690 - RNA, 22 nt, Homo sapiens
aucaaguaaucugaguaagagu

SEQ ID NO: 136691 - RNA, 22 nt, Homo sapiens
aucacagugaaaacagucaauu

SEQ ID NO: 136692 - RNA, 22 nt, Homo sapiens
aucacugggagcagccauuaau

SEQ ID NO: 136693 - RNA, 22 nt, Homo sapiens
aucacuuugcucuccagugugg

SEQ ID NO: 136694 - RNA, 22 nt, Homo sapiens
aucagaaucucuugagaguguu

SEQ ID NO: 136695 - RNA, 22 nt, Homo sapiens
aucagcagcaugaaaacaggcu

SEQ ID NO: 136696 - RNA, 22 nt, Homo sapiens
aucagcaguguaaaaacggacu

SEQ ID NO: 136697 - RNA, 22 nt, Homo sapiens
aucaucacaguuguguguaaug

SEQ ID NO: 136698 - RNA, 22 nt, Homo sapiens
aucauggaguauuugcaagucu

SEQ ID NO: 136699 - RNA, 22 nt, Homo sapiens
auccccugcacggggugucauu

SEQ ID NO: 136700 - RNA, 22 nt, Homo sapiens
aucccugugauccaaucacuuc

SEQ ID NO: 136701 - RNA, 22 nt, Homo sapiens
auccuguagagaugagggugga

SEQ ID NO: 136702 - RNA, 22 nt, Homo sapiens
auccuguaggcuaguagacagu

SEQ ID NO: 136703 - RNA, 22 nt, Homo sapiens
auccuguagucucacagcccca

SEQ ID NO: 136704 - RNA, 22 nt, Homo sapiens
aucucagcaacuaaagauccuu

SEQ ID NO: 136705 - RNA, 22 nt, Homo sapiens
aucucauuccuucugggcugau

SEQ ID NO: 136706 - RNA, 22 nt, Homo sapiens
aucugggguuggcaaaguuugg

SEQ ID NO: 136707 - RNA, 22 nt, Homo sapiens
aucuggguccguucugcuucuc

SEQ ID NO: 136708 - RNA, 22 nt, Homo sapiens
aucuguguuuaaggucccagaa

SEQ ID NO: 136709 - RNA, 22 nt, Homo sapiens
aucuucucuugaagggugggga

SEQ ID NO: 136710 - RNA, 22 nt, Homo sapiens
aucuuuggauacuugauauagu

SEQ ID NO: 136711 - RNA, 22 nt, Homo sapiens
aucuuuggugcaugauacuuug

SEQ ID NO: 136712 - RNA, 22 nt, Homo sapiens
augaaguauuaggacacauuua

SEQ ID NO: 136713 - RNA, 22 nt, Homo sapiens
augacaaugaaucccuguuuca

SEQ ID NO: 136714 - RNA, 22 nt, Homo sapiens
augacaguguggauuauuguaa

SEQ ID NO: 136715 - RNA, 22 nt, Homo sapiens
augagaaugauucuguuauggu

SEQ ID NO: 136716 - RNA, 22 nt, Homo sapiens
augagacaguucccuuuaucuu

SEQ ID NO: 136717 - RNA, 22 nt, Homo sapiens
augagacuguucuuccucauug

SEQ ID NO: 136718 - RNA, 22 nt, Homo sapiens
augagcuccucaaggucagaga

SEQ ID NO: 136719 - RNA, 22 nt, Homo sapiens
augaggcuauaauuuuuaugua

SEQ ID NO: 136720 - RNA, 22 nt, Homo sapiens
augagggagggguggugccgca

SEQ ID NO: 136721 - RNA, 22 nt, Homo sapiens
augagggcggacgcccuggaga

SEQ ID NO: 136722 - RNA, 22 nt, Homo sapiens
augaguauguucuguauuuuca

SEQ ID NO: 136723 - RNA, 22 nt, Homo sapiens
augaguuccuuccuugccuagg

SEQ ID NO: 136724 - RNA, 22 nt, Homo sapiens
uguggcuuuacagcaugguuca

SEQ ID NO: 136725 - RNA, 22 nt, Homo sapiens
uguguaaauacaagugcuugaa

SEQ ID NO: 136726 - RNA, 22 nt, Homo sapiens
ugugucuuuuaucacacaaugu

SEQ ID NO: 136727 - RNA, 21 nt, Homo sapiens
uguuaacaugcagauuacugg

SEQ ID NO: 136728 - RNA, 22 nt, Homo sapiens
uguuacagcagaauugauugca

SEQ ID NO: 136729 - RNA, 22 nt, Homo sapiens
uguugcacugguaauguacuga

SEQ ID NO: 136730 - RNA, 22 nt, Homo sapiens
uguuugcuuaacguggagccag

SEQ ID NO: 136731 - RNA, 22 nt, Homo sapiens
uguuuguuugugauacgguaca

SEQ ID NO: 136732 - RNA, 22 nt, Homo sapiens
uuaaaaguauaggccuggcaua

SEQ ID NO: 136733 - RNA, 22 nt, Homo sapiens
uuaacacugccauugauacugu

SEQ ID NO: 136734 - RNA, 19 nt, Homo sapiens
uuaagugugauaucucagu

SEQ ID NO: 136735 - RNA, 22 nt, Homo sapiens
uuaauacugcuuaacuuuagga

SEQ ID NO: 136736 - RNA, 22 nt, Homo sapiens
uuaaugaacuuuauuuuguaga

SEQ ID NO: 136737 - RNA, 22 nt, Homo sapiens
uuaaugacaucauaggugaagu

SEQ ID NO: 136738 - RNA, 21 nt, Homo sapiens
uuaaugcuaugcagaaaaucu

SEQ ID NO: 136739 - RNA, 22 nt, Homo sapiens
uuaauguaauugauugauugac

SEQ ID NO: 136740 - RNA, 22 nt, Homo sapiens
uuacaccuguaauccagcacuu

SEQ ID NO: 136741 - RNA, 22 nt, Homo sapiens
uuacaguaugaguaagaguucu

SEQ ID NO: 136742 - RNA, 22 nt, Homo sapiens
uuacagucuuaggcagugcuuu

SEQ ID NO: 136743 - RNA, 22 nt, Homo sapiens
uuaccaguggugcuguaaacuu

SEQ ID NO: 136744 - RNA, 22 nt, Homo sapiens
uuacuguagugucauaucguau

SEQ ID NO: 136745 - RNA, 22 nt, Homo sapiens
uuagcagugugaaaaaagacua

SEQ ID NO: 136746 - RNA, 22 nt, Homo sapiens
uuaggacacuguggguggguca

SEQ ID NO: 136747 - RNA, 23 nt, Homo sapiens
uuaguaaacucaaugacaccaca

SEQ ID NO: 136748 - RNA, 22 nt, Homo sapiens
uuaguaguaguuugcauuuacc

SEQ ID NO: 136749 - RNA, 22 nt, Homo sapiens
uuauacucgucugaaugauucu

SEQ ID NO: 136750 - RNA, 22 nt, Homo sapiens
uuauauguuacucccucuagca

SEQ ID NO: 136751 - RNA, 22 nt, Homo sapiens
uuaucauagugcaguuuucuga

SEQ ID NO: 136752 - RNA, 22 nt, Homo sapiens
uuaugccuauugugccuuggau

SEQ ID NO: 136753 - RNA, 22 nt, Homo sapiens
uuaugguuuuucugugagaugg

SEQ ID NO: 136754 - RNA, 22 nt, Homo sapiens
uuauuagguuaaccuauagcua

SEQ ID NO: 136755 - RNA, 22 nt, Homo sapiens
uucaaaguaaagggauggagac

SEQ ID NO: 136756 - RNA, 22 nt, Homo sapiens
uucaaaucuuuggcucccacua

SEQ ID NO: 136757 - RNA, 22 nt, Homo sapiens
uucaaauguucuuucaccaccc

SEQ ID NO: 136758 - RNA, 22 nt, Homo sapiens
uucaagucaauuuuugaaugac

SEQ ID NO: 136759 - RNA, 22 nt, Homo sapiens
uucaaguguucaggagcuacag

SEQ ID NO: 136760 - RNA, 22 nt, Homo sapiens
uucacacugggccuacucugug

SEQ ID NO: 136761 - RNA, 22 nt, Homo sapiens
uucacaguggugggagacguca

SEQ ID NO: 136762 - RNA, 21 nt, Homo sapiens
uucaccauggcuccacacucu

SEQ ID NO: 136763 - RNA, 23 nt, Homo sapiens
uucaccguguuggccaggcuggu

SEQ ID NO: 136764 - RNA, 22 nt, Homo sapiens
uucaccuggguuggccaucauu

SEQ ID NO: 136765 - RNA, 22 nt, Homo sapiens
uucaccuguagcaugcccuugg

SEQ ID NO: 136766 - RNA, 22 nt, Homo sapiens
uucaccuugcccacagcagucu

SEQ ID NO: 136767 - RNA, 22 nt, Homo sapiens
uucacuggagcccaggaguugg

SEQ ID NO: 136768 - RNA, 22 nt, Homo sapiens
uucacuguagcuuggauguuua

SEQ ID NO: 136769 - RNA, 22 nt, Homo sapiens
uucacugugcuuaaauucugcu

SEQ ID NO: 136770 - RNA, 22 nt, Homo sapiens
uucagaguggacagaaauuaag

SEQ ID NO: 136771 - RNA, 22 nt, Homo sapiens
uucagcuaccugggaugcugaa

SEQ ID NO: 136772 - RNA, 22 nt, Homo sapiens
uucagcuacuugggaggcugaa

SEQ ID NO: 136773 - RNA, 22 nt, Homo sapiens
uucaggcuuuuauuuacugaua

SEQ ID NO: 136774 - RNA, 22 nt, Homo sapiens
uucagggcauuggaguuucuga

SEQ ID NO: 136775 - RNA, 22 nt, Homo sapiens
uucaggguggagaguaugaggu

SEQ ID NO: 136776 - RNA, 22 nt, Homo sapiens
uucaucagggguauuggccaau

SEQ ID NO: 136777 - RNA, 22 nt, Homo sapiens
uucauggugguacaaaagcaau

SEQ ID NO: 136778 - RNA, 22 nt, Homo sapiens
uuccaauguuccguguugcagu

SEQ ID NO: 136779 - RNA, 22 nt, Homo sapiens
uucccagugguuagcucugguc

SEQ ID NO: 136780 - RNA, 22 nt, Homo sapiens
uucccugugguauagaagccgu

SEQ ID NO: 136781 - RNA, 17 nt, Homo sapiens
guuuggguacuggguaa

SEQ ID NO: 136782 - RNA, 22 nt, Homo sapiens
uaaaccuagcauuuugcauaug

SEQ ID NO: 136783 - RNA, 22 nt, Homo sapiens
uaaagcacaaguaaagaauacu

SEQ ID NO: 136784 - RNA, 22 nt, Homo sapiens
uaaagccauugucaaguuugua

SEQ ID NO: 136785 - RNA, 22 nt, Homo sapiens
uaaagcugaaaugauuaugaca

SEQ ID NO: 136786 - RNA, 22 nt, Homo sapiens
uaaagcuuggauuuaggcuaau

SEQ ID NO: 136787 - RNA, 21 nt, Homo sapiens
uaaaggcuccaauuauacccc

SEQ ID NO: 136788 - RNA, 22 nt, Homo sapiens
uaaaugcucuuuaaaagugcuu

SEQ ID NO: 136789 - RNA, 22 nt, Homo sapiens
uaaaugcuuaauugaaugugga

SEQ ID NO: 136790 - RNA, 22 nt, Homo sapiens
uaacaguauaugugguaucuau

SEQ ID NO: 136791 - RNA, 22 nt, Homo sapiens
uaacaguguauuuacuacuucc

SEQ ID NO: 136792 - RNA, 22 nt, Homo sapiens
uaacucugccuagugacauggu

SEQ ID NO: 136793 - RNA, 22 nt, Homo sapiens
uaacugucucccuugguccuga

SEQ ID NO: 136794 - RNA, 22 nt, Homo sapiens
uaagcuaauguguuuucucuua

SEQ ID NO: 136795 - RNA, 22 nt, Homo sapiens
uaagcuguguggacuaugccuc

SEQ ID NO: 136796 - RNA, 22 nt, Homo sapiens
uaaggauuuuggugauuacacu

SEQ ID NO: 136797 - RNA, 22 nt, Homo sapiens
uaagugaauguuggcuacugaa

SEQ ID NO: 136798 - RNA, 22 nt, Homo sapiens
uaagugcaugauuacaugcaua

SEQ ID NO: 136799 - RNA, 22 nt, Homo sapiens
uaaguguaaugucugaaguuug

SEQ ID NO: 136800 - RNA, 22 nt, Homo sapiens
uaauccuagcacuuuggaagac

SEQ ID NO: 136801 - RNA, 22 nt, Homo sapiens
uaaucucagcuacucaggaggc

SEQ ID NO: 136802 - RNA, 22 nt, Homo sapiens
uaaucucagcugagcugagauu

SEQ ID NO: 136803 - RNA, 21 nt, Homo sapiens
uaauggcaugaucucggcuca

SEQ ID NO: 136804 - RNA, 22 nt, Homo sapiens
uacaaagcuuugaugugucuuu

SEQ ID NO: 136805 - RNA, 22 nt, Homo sapiens
uacaggaaugucagguugcugu

SEQ ID NO: 136806 - RNA, 22 nt, Homo sapiens
uacaggugcuuauguggacaua

SEQ ID NO: 136807 - RNA, 22 nt, Homo sapiens
uacaucagccugaaagagcucg

SEQ ID NO: 136808 - RNA, 22 nt, Homo sapiens
uacauguauccauuguuuuugg

SEQ ID NO: 136809 - RNA, 22 nt, Homo sapiens
uacaugugcacaacgugcaggu

SEQ ID NO: 136810 - RNA, 22 nt, Homo sapiens
uacaugugccauguugguuugc

SEQ ID NO: 136811 - RNA, 22 nt, Homo sapiens
uaccaugcagguguauguuugu

SEQ ID NO: 136812 - RNA, 22 nt, Homo sapiens
uaccuguagacuacagcuucag

SEQ ID NO: 136813 - RNA, 22 nt, Homo sapiens
uaccuguagcucuucuaggcug

SEQ ID NO: 136814 - RNA, 22 nt, Homo sapiens
uacugcacuccaggcucaccug

SEQ ID NO: 136815 - RNA, 22 nt, Homo sapiens
uacugcuuaaaagucaauuacu

SEQ ID NO: 136816 - RNA, 22 nt, Homo sapiens
uagaagcacuaucccuccuagu

SEQ ID NO: 136817 - RNA, 22 nt, Homo sapiens
uagagcucaucuucuuuaaacu

SEQ ID NO: 136818 - RNA, 22 nt, Homo sapiens
uagauuaucuaugaggcuucca

SEQ ID NO: 136819 - RNA, 22 nt, Homo sapiens
uagcacaugucagguaauuugc

SEQ ID NO: 136820 - RNA, 22 nt, Homo sapiens
uagcagcaucucuggcuucuac

SEQ ID NO: 136821 - RNA, 22 nt, Homo sapiens
uagcugcacuuacaagugagaa

SEQ ID NO: 136822 - RNA, 22 nt, Homo sapiens
uagcuggaguuuuuguuauagg

SEQ ID NO: 136823 - RNA, 22 nt, Homo sapiens
uaggagcacagcagcauguggg

SEQ ID NO: 136824 - RNA, 22 nt, Homo sapiens
uaggcaguguucucacuuguaa

SEQ ID NO: 136825 - RNA, 22 nt, Homo sapiens
uagguagugugugcaugagagg

SEQ ID NO: 136826 - RNA, 22 nt, Homo sapiens
uaggucaguuuuggcuuggcuu

SEQ ID NO: 136827 - RNA, 22 nt, Homo sapiens
uaguaacacauugaacgaucgc

SEQ ID NO: 136828 - RNA, 22 nt, Homo sapiens
uaguagcauaccuaaguauacu

SEQ ID NO: 136829 - RNA, 22 nt, Homo sapiens
uaguauguuuauagcauugagu

SEQ ID NO: 136830 - RNA, 22 nt, Homo sapiens
uagugcaguggcuccaucucag

SEQ ID NO: 136831 - RNA, 20 nt, Homo sapiens
uaguggcaugcaccuguagc

SEQ ID NO: 136832 - RNA, 22 nt, Homo sapiens
uaguucauuauguguugcucag

SEQ ID NO: 136833 - RNA, 22 nt, Homo sapiens
uaguucauuuuucuugcuuaga

SEQ ID NO: 136834 - RNA, 22 nt, Homo sapiens
uauaaccauuucuucucucuuc

SEQ ID NO: 136835 - RNA, 22 nt, Homo sapiens
uauacaguaggcacucaguggc

SEQ ID NO: 136836 - RNA, 21 nt, Homo sapiens
uauagcagcacgauuuauaau

SEQ ID NO: 136837 - RNA, 21 nt, Homo sapiens
uauaugacuuacuauugccuc

SEQ ID NO: 136838 - RNA, 22 nt, Homo sapiens
uauaugcuaaacaagggguggg

SEQ ID NO: 136839 - RNA, 23 nt, Homo sapiens
uauaugugucuaggagcuauggu

SEQ ID NO: 136840 - RNA, 22 nt, Homo sapiens
uauauguucugugucccuuucg

SEQ ID NO: 136841 - RNA, 22 nt, Homo sapiens
uaucaaguuggaagagaaguaa

SEQ ID NO: 136842 - RNA, 22 nt, Homo sapiens
uaucacuguuguuuguuuaagg

SEQ ID NO: 136843 - RNA, 22 nt, Homo sapiens
uaucagcagagucauacuucaa

SEQ ID NO: 136844 - RNA, 22 nt, Homo sapiens
uaucccaauguaauaucacaaa

SEQ ID NO: 136845 - RNA, 20 nt, Homo sapiens
uaugacaaagccuagugagu

SEQ ID NO: 136846 - RNA, 22 nt, Homo sapiens
uauggacuuuaggauagcuuuu

SEQ ID NO: 136847 - RNA, 22 nt, Homo sapiens
uauggauuuucagauucuuauc

SEQ ID NO: 136848 - RNA, 22 nt, Homo sapiens
uauucaagccaaauucaagcca

SEQ ID NO: 136849 - RNA, 22 nt, Homo sapiens
uauucaucuuaagcuuuggcuu

SEQ ID NO: 136850 - RNA, 18 nt, Homo sapiens
uauuccucuuccucuauc

SEQ ID NO: 136851 - RNA, 22 nt, Homo sapiens
uauugcacuccucaugcauuug

SEQ ID NO: 136852 - RNA, 22 nt, Homo sapiens
uauugccugucuccaaaaauca

SEQ ID NO: 136853 - RNA, 22 nt, Homo sapiens
uauuguacauguuauagauuuu

SEQ ID NO: 136854 - RNA, 22 nt, Homo sapiens
uauuucaguugugcagguaguu

SEQ ID NO: 136855 - RNA, 22 nt, Homo sapiens
uauuugguagcuauuuugcagu

SEQ ID NO: 136856 - RNA, 22 nt, Homo sapiens
ucaaagugcuauggcucagguu

SEQ ID NO: 136857 - RNA, 22 nt, Homo sapiens
ucaaauguucccuguacuggcc

SEQ ID NO: 136858 - RNA, 22 nt, Homo sapiens
ucaagaccucacauagaggaga

SEQ ID NO: 136859 - RNA, 22 nt, Homo sapiens
ucaaguaauacucccaucuugg

SEQ ID NO: 136860 - RNA, 22 nt, Homo sapiens
ucaauugcaucaacaguguaca

SEQ ID NO: 136861 - RNA, 22 nt, Homo sapiens
ucacagacauugaggggaccuu

SEQ ID NO: 136862 - RNA, 22 nt, Homo sapiens
ucacagacugagccaaauagag

SEQ ID NO: 136863 - RNA, 19 nt, Homo sapiens
ucacaggguugacuugagg

SEQ ID NO: 136864 - RNA, 22 nt, Homo sapiens
ucacauggaaaaguccaguaaa

SEQ ID NO: 136865 - RNA, 22 nt, Homo sapiens
ucacauggaggugauaguugaa

SEQ ID NO: 136866 - RNA, 21 nt, Homo sapiens
ucacauggccagaguaggaac

SEQ ID NO: 136867 - RNA, 22 nt, Homo sapiens
ucacauggggaagggacuagcu

SEQ ID NO: 136868 - RNA, 22 nt, Homo sapiens
ucacauuguauauguaccuauc

SEQ ID NO: 136869 - RNA, 19 nt, Homo sapiens
ucaccaguacacaauacaa

SEQ ID NO: 136870 - RNA, 21 nt, Homo sapiens
ucaccuguagcugcauguucu

SEQ ID NO: 136871 - RNA, 22 nt, Homo sapiens
ucacuagaucaagggagagaaa

SEQ ID NO: 136872 - RNA, 22 nt, Homo sapiens
ucacugaaaccuccaccucucg

SEQ ID NO: 136873 - RNA, 22 nt, Homo sapiens
ucacugagcuagaucacuugac

SEQ ID NO: 136874 - RNA, 22 nt, Homo sapiens
ucacugcacuagguaaugccac

SEQ ID NO: 136875 - RNA, 22 nt, Homo sapiens
ucacugcacucuccgccuugcg

SEQ ID NO: 136876 - RNA, 22 nt, Homo sapiens
ucacugggagaccaaagccauc

SEQ ID NO: 136877 - RNA, 22 nt, Homo sapiens
ucacugugcacauaugauaggu

SEQ ID NO: 136878 - RNA, 22 nt, Homo sapiens
ucacugugguuuugaugugcau

SEQ ID NO: 136879 - RNA, 22 nt, Homo sapiens
ucagaguagaaacacuuccaua

SEQ ID NO: 136880 - RNA, 22 nt, Homo sapiens
ucagaugaugucccuguucuaa

SEQ ID NO: 136881 - RNA, 22 nt, Homo sapiens
ucagcagugugaaaauggacua

SEQ ID NO: 136882 - RNA, 22 nt, Homo sapiens
ucaggcacucagcuuagagucu

SEQ ID NO: 136883 - RNA, 22 nt, Homo sapiens
ucaggugcagagaagaaauggg

SEQ ID NO: 136884 - RNA, 23 nt, Homo sapiens
ucaguacuccacuuucaauagug

SEQ ID NO: 136885 - RNA, 23 nt, Homo sapiens
ucaguagucauugggaaagugug

SEQ ID NO: 136886 - RNA, 22 nt, Homo sapiens
ucagugucugugauggagaggu

SEQ ID NO: 136887 - RNA, 22 nt, Homo sapiens
ucaguuaaugcugccugcugga

SEQ ID NO: 136888 - RNA, 22 nt, Homo sapiens
ucauaaaguuguuuuaauggga

SEQ ID NO: 136889 - RNA, 22 nt, Homo sapiens
ucauaugucauaguaugaucuu

SEQ ID NO: 136890 - RNA, 22 nt, Homo sapiens
ucauauugguuaaaauaguggg

SEQ ID NO: 136891 - RNA, 22 nt, Homo sapiens
ucaucagaaucccuuagggaug

SEQ ID NO: 136892 - RNA, 22 nt, Homo sapiens
ucaucagaguuuacaagcucag

SEQ ID NO: 136893 - RNA, 22 nt, Homo sapiens
ucaugacacagcauacugacuu

SEQ ID NO: 136894 - RNA, 22 nt, Homo sapiens
ucaugagacacacuggaaagga

SEQ ID NO: 136895 - RNA, 22 nt, Homo sapiens
ucauggcacugaugagaguuuc

SEQ ID NO: 136896 - RNA, 22 nt, Homo sapiens
ucauggguuuugguccaagcaa

SEQ ID NO: 136897 - RNA, 22 nt, Homo sapiens
ucauugcauguuaauuaaacag

SEQ ID NO: 136898 - RNA, 22 nt, Homo sapiens
uccaagaugcuggcagcuacag

SEQ ID NO: 136899 - RNA, 22 nt, Homo sapiens
uccacaauggcugaacuagauu

SEQ ID NO: 136900 - RNA, 22 nt, Homo sapiens
uccacaguaaggacccugccuu

SEQ ID NO: 136901 - RNA, 22 nt, Homo sapiens
uccagguuuggcuuuauaacuu

SEQ ID NO: 136902 - RNA, 22 nt, Homo sapiens
uccaguggacagacauaccaug

SEQ ID NO: 136903 - RNA, 22 nt, Homo sapiens
uccaguuguuauuuuuauaaag

SEQ ID NO: 136904 - RNA, 22 nt, Homo sapiens
ucccuguagugccuagaucaga

SEQ ID NO: 136905 - RNA, 22 nt, Homo sapiens
ucccuuagccaaauccccagcc

SEQ ID NO: 136906 - RNA, 22 nt, Homo sapiens
uccuucauuugucaacucuagu

SEQ ID NO: 136907 - RNA, 22 nt, Homo sapiens
uccuugagccucccagacucag

SEQ ID NO: 136908 - RNA, 22 nt, Homo sapiens
gcugcuguuucucuuucagcau

SEQ ID NO: 136909 - RNA, 22 nt, Homo sapiens
gcuggguucagagugggcugcg

SEQ ID NO: 136910 - RNA, 22 nt, Homo sapiens
gcuguauuguugaaggaaaugu

SEQ ID NO: 136911 - RNA, 22 nt, Homo sapiens
gcuguguguuaucagaaauugc

SEQ ID NO: 136912 - RNA, 19 nt, Homo sapiens
gcuuuguggggaaggagcc

SEQ ID NO: 136913 - RNA, 22 nt, Homo sapiens
gcuuuguuguugaugggaaauc

SEQ ID NO: 136914 - RNA, 23 nt, Homo sapiens
ggaaacauccagucuuucaccau

SEQ ID NO: 136915 - RNA, 22 nt, Homo sapiens
ggaagacaguguggugauuccu

SEQ ID NO: 136916 - RNA, 22 nt, Homo sapiens
ggaagguaauugucagcucaua

SEQ ID NO: 136917 - RNA, 22 nt, Homo sapiens
ggaaugggauuugaagucuggc

SEQ ID NO: 136918 - RNA, 22 nt, Homo sapiens
ggacagugaaugccacuccucc

SEQ ID NO: 136919 - RNA, 22 nt, Homo sapiens
ggagguagguuugugauuugua

SEQ ID NO: 136920 - RNA, 20 nt, Homo sapiens
ggagguuguauaaguacauc

SEQ ID NO: 136921 - RNA, 23 nt, Homo sapiens
ggauggaaaguuuugagggccac

SEQ ID NO: 136922 - RNA, 22 nt, Homo sapiens
ggauugugauaauuguugcaaa

SEQ ID NO: 136923 - RNA, 19 nt, Homo sapiens
ggcaccuuuuccaaaaaug

SEQ ID NO: 136924 - RNA, 22 nt, Homo sapiens
ggcacugugaugugagggggua

SEQ ID NO: 136925 - RNA, 22 nt, Homo sapiens
ggcagaauugcugaggaugcua

SEQ ID NO: 136926 - RNA, 22 nt, Homo sapiens
ggcagcgugcacuuucgccacu

SEQ ID NO: 136927 - RNA, 22 nt, Homo sapiens
ggccggguggccauggcugccc

SEQ ID NO: 136928 - RNA, 22 nt, Homo sapiens
ggcuagagaauagugccacuaa

SEQ ID NO: 136929 - RNA, 22 nt, Homo sapiens
ggcucguguuuucuguccaguu

SEQ ID NO: 136930 - RNA, 21 nt, Homo sapiens
ggcucuguggucucagguuuc

SEQ ID NO: 136931 - RNA, 22 nt, Homo sapiens
gggaagaaggagugguuuacuc

SEQ ID NO: 136932 - RNA, 22 nt, Homo sapiens
gggaagauauaggcugggcacc

SEQ ID NO: 136933 - RNA, 20 nt, Homo sapiens
gggaaugcaaauucucaucc

SEQ ID NO: 136934 - RNA, 19 nt, Homo sapiens
gggaggaugcgucuucagg

SEQ ID NO: 136935 - RNA, 22 nt, Homo sapiens
gggaggucauuguaaggucuua

SEQ ID NO: 136936 - RNA, 22 nt, Homo sapiens
gggcaaauuauguaucucucag

SEQ ID NO: 136937 - RNA, 22 nt, Homo sapiens
gggcaugauggugcacacaugu

SEQ ID NO: 136938 - RNA, 19 nt, Homo sapiens
ggucauggagguuguguga

SEQ ID NO: 136939 - RNA, 22 nt, Homo sapiens
ggugccuacugugugucaggca

SEQ ID NO: 136940 - RNA, 22 nt, Homo sapiens
guaaaguaaagcacaucaaggu

SEQ ID NO: 136941 - RNA, 22 nt, Homo sapiens
guaagagaauggguuacuuucc

SEQ ID NO: 136942 - RNA, 22 nt, Homo sapiens
guaauagucucaaacuccugga

SEQ ID NO: 136943 - RNA, 22 nt, Homo sapiens
guaaucucagcuacucaggagg

SEQ ID NO: 136944 - RNA, 19 nt, Homo sapiens
guaaugugcuucaguagca

SEQ ID NO: 136945 - RNA, 22 nt, Homo sapiens
guacacaacaugcagguuuguu

SEQ ID NO: 136946 - RNA, 22 nt, Homo sapiens
guacacauacauauaugugugu

SEQ ID NO: 136947 - RNA, 22 nt, Homo sapiens
guagaagcacaggugaguuggu

SEQ ID NO: 136948 - RNA, 22 nt, Homo sapiens
guaggcacuggcucagcuuauc

SEQ ID NO: 136949 - RNA, 22 nt, Homo sapiens
guaucauugccuaaugcucuca

SEQ ID NO: 136950 - RNA, 22 nt, Homo sapiens
guauggaauuugugaccuuaua

SEQ ID NO: 136951 - RNA, 22 nt, Homo sapiens
guauugcuugagcccaggaguu

SEQ ID NO: 136952 - RNA, 22 nt, Homo sapiens
gucacaggaaacuaauaugcgc

SEQ ID NO: 136953 - RNA, 22 nt, Homo sapiens
gucacugugacggcaguuacau

SEQ ID NO: 136954 - RNA, 22 nt, Homo sapiens
gucagcaaaguucuccugcaga

SEQ ID NO: 136955 - RNA, 22 nt, Homo sapiens
gucaggugcuuacgcggagauc

SEQ ID NO: 136956 - RNA, 21 nt, Homo sapiens
gucauaugucucugauuagug

SEQ ID NO: 136957 - RNA, 22 nt, Homo sapiens
gucauggguuaaagguggauac

SEQ ID NO: 136958 - RNA, 22 nt, Homo sapiens
gucauguuuaacuucuugagga

SEQ ID NO: 136959 - RNA, 21 nt, Homo sapiens
guccaaaacaguguccaaugc

SEQ ID NO: 136960 - RNA, 22 nt, Homo sapiens
gucguggagcucacagugugcc

SEQ ID NO: 136961 - RNA, 22 nt, Homo sapiens
gucucccagccuacauauuucu

SEQ ID NO: 136962 - RNA, 22 nt, Homo sapiens
gucucccagccuacaucuuucu

SEQ ID NO: 136963 - RNA, 22 nt, Homo sapiens
gucugcaugucauaugauagua

SEQ ID NO: 136964 - RNA, 22 nt, Homo sapiens
gucuggcuccugucuaaucacu

SEQ ID NO: 136965 - RNA, 22 nt, Homo sapiens
gucuguuuggggaccuguggcc

SEQ ID NO: 136966 - RNA, 22 nt, Homo sapiens
gucuuccagccuccaucuuucu

SEQ ID NO: 136967 - RNA, 20 nt, Homo sapiens
gugaauacauuugguuucau

SEQ ID NO: 136968 - RNA, 22 nt, Homo sapiens
gugacacuggagcuggcacaau

SEQ ID NO: 136969 - RNA, 22 nt, Homo sapiens
gugacauuauuucagcuacaug

SEQ ID NO: 136970 - RNA, 22 nt, Homo sapiens
gugaccagaugggcaggggugu

SEQ ID NO: 136971 - RNA, 22 nt, Homo sapiens
gugaccucuguugcugucacua

SEQ ID NO: 136972 - RNA, 22 nt, Homo sapiens
gugagcauaggaggcuucuguu

SEQ ID NO: 136973 - RNA, 22 nt, Homo sapiens
gugaggcugguccugccuccca

SEQ ID NO: 136974 - RNA, 22 nt, Homo sapiens
gugaggcuuuuccuguuagacu

SEQ ID NO: 136975 - RNA, 22 nt, Homo sapiens
gugaggucagggcuguggacag

SEQ ID NO: 136976 - RNA, 22 nt, Homo sapiens
gugaggucguagucauaggcaa

SEQ ID NO: 136977 - RNA, 22 nt, Homo sapiens
gugauuuaguagaugcuaguua

SEQ ID NO: 136978 - RNA, 22 nt, Homo sapiens
gugcaaaucucugaguaucuuu

SEQ ID NO: 136979 - RNA, 22 nt, Homo sapiens
gugcacaaaucuuaaauguaca

SEQ ID NO: 136980 - RNA, 22 nt, Homo sapiens
gugcacaacgugcagguuaguu

SEQ ID NO: 136981 - RNA, 22 nt, Homo sapiens
gugccuucuagcuaugguuggc

SEQ ID NO: 136982 - RNA, 22 nt, Homo sapiens
guggaagaccagacuuuccaac

SEQ ID NO: 136983 - RNA, 22 nt, Homo sapiens
guggaagauaguguguuaaugu

SEQ ID NO: 136984 - RNA, 22 nt, Homo sapiens
guggacggagguugcagugagc

SEQ ID NO: 136985 - RNA, 18 nt, Homo sapiens
guggagugucuuccugga

SEQ ID NO: 136986 - RNA, 22 nt, Homo sapiens
guggcaaguguuccaagaggcg

SEQ ID NO: 136987 - RNA, 22 nt, Homo sapiens
guggcaugaaagcaucugugau

SEQ ID NO: 136988 - RNA, 22 nt, Homo sapiens
guggcuaaagauuuggaaucug

SEQ ID NO: 136989 - RNA, 22 nt, Homo sapiens
gugggagugucccguuuuucca

SEQ ID NO: 136990 - RNA, 20 nt, Homo sapiens
gugggcaaauccuuuccucu

SEQ ID NO: 136991 - RNA, 22 nt, Homo sapiens
gugguuuuaucccagaaauuaa

SEQ ID NO: 136992 - RNA, 22 nt, Homo sapiens
gugguuuuuagauuucuacagu

SEQ ID NO: 136993 - RNA, 22 nt, Homo sapiens
guguaaaacaauuagaggauuu

SEQ ID NO: 136994 - RNA, 22 nt, Homo sapiens
gugucuccuguggagcuaugua

SEQ ID NO: 136995 - RNA, 22 nt, Homo sapiens
gugugauuauuucaauugaugc

SEQ ID NO: 136996 - RNA, 23 nt, Homo sapiens
gugugguaggcuauaccaucuag

SEQ ID NO: 136997 - RNA, 22 nt, Homo sapiens
guguugcacauucuguggaugu

SEQ ID NO: 136998 - RNA, 22 nt, Homo sapiens
guucaagcaauucugcugccuc

SEQ ID NO: 136999 - RNA, 22 nt, Homo sapiens
guucaguuugcugaugcguuga

SEQ ID NO: 137000 - RNA, 17 nt, Homo sapiens
guucccaguggcauuug

SEQ ID NO: 137001 - RNA, 22 nt, Homo sapiens
guugaguuugaccugaacucug

SEQ ID NO: 137002 - RNA, 22 nt, Homo sapiens
guuggaguuaagcaguaaugaa

SEQ ID NO: 137003 - RNA, 22 nt, Homo sapiens
cuuuguguaggugccucuggcu

SEQ ID NO: 137004 - RNA, 22 nt, Homo sapiens
cuuuuggcuuagaauugucuug

SEQ ID NO: 137005 - RNA, 22 nt, Homo sapiens
cuuuugugauucuucaguuacu

SEQ ID NO: 137006 - RNA, 22 nt, Homo sapiens
cuuuuugcugcagcaauacugg

SEQ ID NO: 137007 - RNA, 22 nt, Homo sapiens
cuuuuugguagagcaggugugc

SEQ ID NO: 137008 - RNA, 22 nt, Homo sapiens
gaaaguaauuaacgauuguugc

SEQ ID NO: 137009 - RNA, 22 nt, Homo sapiens
gaaaguguugagauuacaggca

SEQ ID NO: 137010 - RNA, 22 nt, Homo sapiens
gaacuguuucuggugaaagagu

SEQ ID NO: 137011 - RNA, 22 nt, Homo sapiens
gaagacauuugcugcacguccu

SEQ ID NO: 137012 - RNA, 22 nt, Homo sapiens
gaaucaauugaucuaugugucu

SEQ ID NO: 137013 - RNA, 22 nt, Homo sapiens
gaaugauacuguuaacgaaaga

SEQ ID NO: 137014 - RNA, 22 nt, Homo sapiens
gaaugcagcagugacagggcug

SEQ ID NO: 137015 - RNA, 22 nt, Homo sapiens
gaaugucuuauugcucguugua

SEQ ID NO: 137016 - RNA, 22 nt, Homo sapiens
gaauucugucgcuuacuagaug

SEQ ID NO: 137017 - RNA, 22 nt, Homo sapiens
gaauugcacaaaaacugcuugu

SEQ ID NO: 137018 - RNA, 22 nt, Homo sapiens
gacagugugauacuuagucuca

SEQ ID NO: 137019 - RNA, 18 nt, Homo sapiens
gacaguguggcgauuccu

SEQ ID NO: 137020 - RNA, 18 nt, Homo sapiens
gacaguguggugauuccu

SEQ ID NO: 137021 - RNA, 22 nt, Homo sapiens
gaccaaagaggcaggcauuaga

SEQ ID NO: 137022 - RNA, 22 nt, Homo sapiens
gaccuuguagaaucucaugauu

SEQ ID NO: 137023 - RNA, 22 nt, Homo sapiens
gacuuugguagaggaaaaaucu

SEQ ID NO: 137024 - RNA, 22 nt, Homo sapiens
gagaaccauuuggagaaaaagu

SEQ ID NO: 137025 - RNA, 22 nt, Homo sapiens
gagaaccuccagcaagguagua

SEQ ID NO: 137026 - RNA, 22 nt, Homo sapiens
gagaacuaaugguuugauaagg

SEQ ID NO: 137027 - RNA, 22 nt, Homo sapiens
gagaaugagauuaugguuacau

SEQ ID NO: 137028 - RNA, 22 nt, Homo sapiens
gagauaacuacuggauuaaguu

SEQ ID NO: 137029 - RNA, 22 nt, Homo sapiens
gagaugucuauuucagagaugu

SEQ ID NO: 137030 - RNA, 22 nt, Homo sapiens
gagauuaacauuugaggagcug

SEQ ID NO: 137031 - RNA, 22 nt, Homo sapiens
gagauucuucaauauuuauucu

SEQ ID NO: 137032 - RNA, 22 nt, Homo sapiens
gagcucauuaaaguaggaccua

SEQ ID NO: 137033 - RNA, 22 nt, Homo sapiens
gagcugaauugcugccauuugc

SEQ ID NO: 137034 - RNA, 22 nt, Homo sapiens
gaggaguauuuugucgaauguc

SEQ ID NO: 137035 - RNA, 22 nt, Homo sapiens
gaggcaaguggccaccgagucu

SEQ ID NO: 137036 - RNA, 22 nt, Homo sapiens
gaggcggugugaugucacaugc

SEQ ID NO: 137037 - RNA, 22 nt, Homo sapiens
gagguagaauguuuuucagcug

SEQ ID NO: 137038 - RNA, 22 nt, Homo sapiens
gagguaguuaaugcauucacua

SEQ ID NO: 137039 - RNA, 22 nt, Homo sapiens
gaggucaggacauuuuugcuuu

SEQ ID NO: 137040 - RNA, 22 nt, Homo sapiens
gaguaaauguccuagcuucuug

SEQ ID NO: 137041 - RNA, 22 nt, Homo sapiens
gaguauguauaugagugugucu

SEQ ID NO: 137042 - RNA, 22 nt, Homo sapiens
gaguuuguacuaauuuguugua

SEQ ID NO: 137043 - RNA, 22 nt, Homo sapiens
gauaaauccagauucugaugua

SEQ ID NO: 137044 - RNA, 21 nt, Homo sapiens
gauaucuuuauucccaagagc

SEQ ID NO: 137045 - RNA, 22 nt, Homo sapiens
gaucacaguuccucacgggcau

SEQ ID NO: 137046 - RNA, 22 nt, Homo sapiens
gaugacagcugacucccuugcu

SEQ ID NO: 137047 - RNA, 22 nt, Homo sapiens
gauggcagugcagccccuggcu

SEQ ID NO: 137048 - RNA, 22 nt, Homo sapiens
gaugugaaaucauaguuucuag

SEQ ID NO: 137049 - RNA, 22 nt, Homo sapiens
gauguguuuuaggaucucagca

SEQ ID NO: 137050 - RNA, 22 nt, Homo sapiens
gauuagaacagaagucagauua

SEQ ID NO: 137051 - RNA, 22 nt, Homo sapiens
gauuuugguuagggaaggauac

SEQ ID NO: 137052 - RNA, 22 nt, Homo sapiens
gcaaaauugagaagggaauaua

SEQ ID NO: 137053 - RNA, 21 nt, Homo sapiens
gcaaguacuaucaucauuauc

SEQ ID NO: 137054 - RNA, 22 nt, Homo sapiens
gcaauguuacugaauguguuuu

SEQ ID NO: 137055 - RNA, 22 nt, Homo sapiens
gcacacuuacacgaaccuagau

SEQ ID NO: 137056 - RNA, 22 nt, Homo sapiens
gcacaguggcucccgucuauaa

SEQ ID NO: 137057 - RNA, 22 nt, Homo sapiens
gcacaguguuacuugauauauu

SEQ ID NO: 137058 - RNA, 22 nt, Homo sapiens
gcacauuacaaguauuagcuca

SEQ ID NO: 137059 - RNA, 22 nt, Homo sapiens
gcagaauugguuucuucuaagg

SEQ ID NO: 137060 - RNA, 22 nt, Homo sapiens
gcagugcaugacgguauauaua

SEQ ID NO: 137061 - RNA, 22 nt, Homo sapiens
gcaguguucugggcaggaagaa

SEQ ID NO: 137062 - RNA, 22 nt, Homo sapiens
gcauggaaggcgcuuugugacu

SEQ ID NO: 137063 - RNA, 22 nt, Homo sapiens
gcauggaguggaaauucuuggg

SEQ ID NO: 137064 - RNA, 22 nt, Homo sapiens
gccaguguuuuauugagaauuu

SEQ ID NO: 137065 - RNA, 22 nt, Homo sapiens
gccauggaggauuuauagaggc

SEQ ID NO: 137066 - RNA, 22 nt, Homo sapiens
gcccuguaguauaguuugaagu

SEQ ID NO: 137067 - RNA, 22 nt, Homo sapiens
gccuguagaagaguagaugacc

SEQ ID NO: 137068 - RNA, 22 nt, Homo sapiens
gccuuuggugacaggcaugugu

SEQ ID NO: 137069 - RNA, 19 nt, Homo sapiens
gcggcacuggagacacagc

SEQ ID NO: 137070 - RNA, 22 nt, Homo sapiens
gcuaguguuugccagcguagcc

SEQ ID NO: 137071 - RNA, 22 nt, Homo sapiens
gcucaguuuccucagcugcaaa

SEQ ID NO: 137072 - RNA, 16 nt, Homo sapiens
gcucuuguucucuguu

SEQ ID NO: 137073 - RNA, 22 nt, Homo sapiens
gcugaaauguuuaauuugggag

SEQ ID NO: 137074 - RNA, 17 nt, Homo sapiens
gcugcauucauguagaa

SEQ ID NO: 137075 - RNA, 22 nt, Homo sapiens
aaaagcauucagagugcugggc

SEQ ID NO: 137076 - RNA, 22 nt, Homo sapiens
aaaagcuuagaugggcuuguau

SEQ ID NO: 137077 - RNA, 18 nt, Homo sapiens
aaacugcuuccuuggccu

SEQ ID NO: 137078 - RNA, 22 nt, Homo sapiens
aaacugcuuuccaugguggcug

SEQ ID NO: 137079 - RNA, 22 nt, Homo sapiens
aaacuugucuaauuauaagcau

SEQ ID NO: 137080 - RNA, 22 nt, Homo sapiens
aaagagcugagaccugguggag

SEQ ID NO: 137081 - RNA, 22 nt, Homo sapiens
aaaguaauugcaguuuuugcaa

SEQ ID NO: 137082 - RNA, 18 nt, Homo sapiens
aaagugaugucauucuuu

SEQ ID NO: 137083 - RNA, 22 nt, Homo sapiens
aaagugcuaggauuaccugggg

SEQ ID NO: 137084 - RNA, 22 nt, Homo sapiens
aaagugcugagauuguaggcau

SEQ ID NO: 137085 - RNA, 22 nt, Homo sapiens
aaagugcugggaucacacugaa

SEQ ID NO: 137086 - RNA, 22 nt, Homo sapiens
aaagugcugggauuggcugggc

SEQ ID NO: 137087 - RNA, 22 nt, Homo sapiens
aaagugcuguagacugggcgca

SEQ ID NO: 137088 - RNA, 22 nt, Homo sapiens
aaagugucuguuccuagcauga

SEQ ID NO: 137089 - RNA, 22 nt, Homo sapiens
aaauccauuuguucagcuaugc

SEQ ID NO: 137090 - RNA, 22 nt, Homo sapiens
aaaugcagauucugcuuagguu

SEQ ID NO: 137091 - RNA, 22 nt, Homo sapiens
aaaugcagcacucaagugggaa

SEQ ID NO: 137092 - RNA, 22 nt, Homo sapiens
aaaugcauaucaagauugcccu

SEQ ID NO: 137093 - RNA, 22 nt, Homo sapiens
aaaugcaugaggugggaagaaa

SEQ ID NO: 137094 - RNA, 22 nt, Homo sapiens
aacacuaucugccuuacaggga

SEQ ID NO: 137095 - RNA, 22 nt, Homo sapiens
aacaucaaccaugaggguugga

SEQ ID NO: 137096 - RNA, 22 nt, Homo sapiens
aacuacaucucuuugaggcagg

SEQ ID NO: 137097 - RNA, 22 nt, Homo sapiens
aacuggucuuaugcaagcacua

SEQ ID NO: 137098 - RNA, 22 nt, Homo sapiens
aagagguagucugucccuuagc

SEQ ID NO: 137099 - RNA, 22 nt, Homo sapiens
aagcuccauuucugccaugaga

SEQ ID NO: 137100 - RNA, 22 nt, Homo sapiens
aagcugccaggcaugguggcug

SEQ ID NO: 137101 - RNA, 22 nt, Homo sapiens
aagcuguauuguguugcuauaa

SEQ ID NO: 137102 - RNA, 22 nt, Homo sapiens
aaggaagcuagcaggaauuggu

SEQ ID NO: 137103 - RNA, 23 nt, Homo sapiens
aaggacacugaacacuucccagc

SEQ ID NO: 137104 - RNA, 22 nt, Homo sapiens
aaggauuguaaaguugacaaau

SEQ ID NO: 137105 - RNA, 22 nt, Homo sapiens
aaggauuguaacaccaagguua

SEQ ID NO: 137106 - RNA, 22 nt, Homo sapiens
aaggcagucacuaaauagugag

SEQ ID NO: 137107 - RNA, 22 nt, Homo sapiens
aaggugguuuucucuuggaguc

SEQ ID NO: 137108 - RNA, 22 nt, Homo sapiens
aaguauuagcuaauugugcuua

SEQ ID NO: 137109 - RNA, 22 nt, Homo sapiens
aagucaguuugggagaagcuau

SEQ ID NO: 137110 - RNA, 22 nt, Homo sapiens
aagugagaugcaguggaguucc

SEQ ID NO: 137111 - RNA, 22 nt, Homo sapiens
aagugcuuuacacaugcaugau

SEQ ID NO: 137112 - RNA, 22 nt, Homo sapiens
aauaaagucugaagugugcuua

SEQ ID NO: 137113 - RNA, 22 nt, Homo sapiens
aauacugagaugugagguacua

SEQ ID NO: 137114 - RNA, 22 nt, Homo sapiens
aauagcuguuuuuaauuccugc

SEQ ID NO: 137115 - RNA, 23 nt, Homo sapiens
aauaucacaguggguguacaccc

SEQ ID NO: 137116 - RNA, 22 nt, Homo sapiens
aauaugucugcuaauuguuucu

SEQ ID NO: 137117 - RNA, 22 nt, Homo sapiens
aaucacuuugcuacaaggcagu

SEQ ID NO: 137118 - RNA, 22 nt, Homo sapiens
aaucauauugucugccaagagg

SEQ ID NO: 137119 - RNA, 22 nt, Homo sapiens
aaucccugagcuagacacaaag

SEQ ID NO: 137120 - RNA, 22 nt, Homo sapiens
aaucccuggacuuucggaggcu

SEQ ID NO: 137121 - RNA, 22 nt, Homo sapiens
aaugacacugagcaucuuucau

SEQ ID NO: 137122 - RNA, 17 nt, Homo sapiens
aaugagacauuucugcu

SEQ ID NO: 137123 - RNA, 22 nt, Homo sapiens
aaugauacuguguacaagggca

SEQ ID NO: 137124 - RNA, 22 nt, Homo sapiens
aaugcuaucuggaacauuguug

SEQ ID NO: 137125 - RNA, 22 nt, Homo sapiens
aauggcagaugaaauugucauu

SEQ ID NO: 137126 - RNA, 22 nt, Homo sapiens
aauggcaguagauggaugggua

SEQ ID NO: 137127 - RNA, 22 nt, Homo sapiens
aauggcucuguuggcccaagac

SEQ ID NO: 137128 - RNA, 22 nt, Homo sapiens
aaugugcuuucuuucacacagu

SEQ ID NO: 137129 - RNA, 22 nt, Homo sapiens
aaugugcuuugaaaagagcuga

SEQ ID NO: 137130 - RNA, 22 nt, Homo sapiens
aauugaaugauaugggacauuu

SEQ ID NO: 137131 - RNA, 22 nt, Homo sapiens
aauugaccuaaucugauuacug

SEQ ID NO: 137132 - RNA, 22 nt, Homo sapiens
aauugcauaaaauucaacucug

SEQ ID NO: 137133 - RNA, 16 nt, Homo sapiens
acaaagcuggcuaucu

SEQ ID NO: 137134 - RNA, 22 nt, Homo sapiens
acaaaguauggaauguuggugu

SEQ ID NO: 137135 - RNA, 22 nt, Homo sapiens
acaagcacaaaugcauagaugg

SEQ ID NO: 137136 - RNA, 22 nt, Homo sapiens
acaagugaauacaggauucucu

SEQ ID NO: 137137 - RNA, 22 nt, Homo sapiens
acaauguauauuuuacuguagg

SEQ ID NO: 137138 - RNA, 22 nt, Homo sapiens
acacauacacauaugguguaua

SEQ ID NO: 137139 - RNA, 22 nt, Homo sapiens
acaccaguacuuuauacaagca

SEQ ID NO: 137140 - RNA, 22 nt, Homo sapiens
acacuggaguuaaaggugauuu

SEQ ID NO: 137141 - RNA, 22 nt, Homo sapiens
acagaacugggcuugcuuuugg

SEQ ID NO: 137142 - RNA, 22 nt, Homo sapiens
acaggagugggauuugaguccu

SEQ ID NO: 137143 - RNA, 22 nt, Homo sapiens
acaguagaaaacaauggauuug

SEQ ID NO: 137144 - RNA, 22 nt, Homo sapiens
acagucuggagaaugggugcuc

SEQ ID NO: 137145 - RNA, 23 nt, Homo sapiens
acaguggugugaucuuggcucag

SEQ ID NO: 137146 - RNA, 22 nt, Homo sapiens
acagugucaugucguguucccc

SEQ ID NO: 137147 - RNA, 22 nt, Homo sapiens
acaucccuuucccacccuucac

SEQ ID NO: 137148 - RNA, 17 nt, Homo sapiens
acaugagacuggauucu

SEQ ID NO: 137149 - RNA, 17 nt, Homo sapiens
accagugcaugugcuuu

SEQ ID NO: 137150 - RNA, 22 nt, Homo sapiens
accaguguuuaccaaguagcau

SEQ ID NO: 137151 - RNA, 22 nt, Homo sapiens
acccaguguucaacauucacau

SEQ ID NO: 137152 - RNA, 22 nt, Homo sapiens
acccgcccagguguggccggga

SEQ ID NO: 137153 - RNA, 22 nt, Homo sapiens
acccuguaggacuauucuaauc

SEQ ID NO: 137154 - RNA, 22 nt, Homo sapiens
acccuguaguuagaaacuuuca

SEQ ID NO: 137155 - RNA, 22 nt, Homo sapiens
accgaguuagccaggauggucu

SEQ ID NO: 137156 - RNA, 22 nt, Homo sapiens
accuuguagcaaaccuaacaua

SEQ ID NO: 137157 - RNA, 22 nt, Homo sapiens
acucagagauuagcacauguuu

SEQ ID NO: 137158 - RNA, 22 nt, Homo sapiens
acugagaucuuuaaauaaauaa

SEQ ID NO: 137159 - RNA, 22 nt, Homo sapiens
acugcaaugucgaauagagaug

SEQ ID NO: 137160 - RNA, 23 nt, Homo sapiens
acugcaauuacguuugcaccaac

SEQ ID NO: 137161 - RNA, 22 nt, Homo sapiens
acugcacuccaccuugggcaac

SEQ ID NO: 137162 - RNA, 22 nt, Homo sapiens
acugcacuccaguuugggcagc

SEQ ID NO: 137163 - RNA, 22 nt, Homo sapiens
acugcauuugguaaagucaaga

SEQ ID NO: 137164 - RNA, 22 nt, Homo sapiens
acugcauuugucugucucaauu

SEQ ID NO: 137165 - RNA, 22 nt, Homo sapiens
acuggaguuuguucaagaaaua

SEQ ID NO: 137166 - RNA, 22 nt, Homo sapiens
acuggcaauggcagaaauaguu

SEQ ID NO: 137167 - RNA, 22 nt, Homo sapiens
acuggcuuauuucacuuagcau

SEQ ID NO: 137168 - RNA, 22 nt, Homo sapiens
acuguacuccagccugggcaac

SEQ ID NO: 137169 - RNA, 22 nt, Homo sapiens
acuguguguuugucuagcacag

SEQ ID NO: 137170 - RNA, 22 nt, Homo sapiens
acuuugguuaucauacuuucag

SEQ ID NO: 137171 - RNA, 23 nt, Homo sapiens
agaaaugucuauucagggucccu

SEQ ID NO: 137172 - RNA, 22 nt, Homo sapiens
agaagugcuggguucaggcugg

SEQ ID NO: 137173 - RNA, 22 nt, Homo sapiens
agaauaauguccccccaaggga

SEQ ID NO: 137174 - RNA, 22 nt, Homo sapiens
agacuuagagagucuauucuau

SEQ ID NO: 137175 - RNA, 22 nt, Homo sapiens
agagauaguuuccaacucauac

SEQ ID NO: 137176 - RNA, 22 nt, Homo sapiens
agagaucacugaaucacggggg

SEQ ID NO: 137177 - RNA, 22 nt, Homo sapiens
agagguuuugcacugguucuuu

SEQ ID NO: 137178 - RNA, 22 nt, Homo sapiens
agauauguuuaguuucaaaaug

SEQ ID NO: 137179 - RNA, 22 nt, Homo sapiens
agaugcauuuuuauuggaauac

SEQ ID NO: 137180 - RNA, 22 nt, Homo sapiens
agcaauaugacauugcuacauc

SEQ ID NO: 137181 - RNA, 22 nt, Homo sapiens
agcacauauauuucccaaaaca

SEQ ID NO: 137182 - RNA, 22 nt, Homo sapiens
agcagcauuaugauauaucuua

SEQ ID NO: 137183 - RNA, 20 nt, Homo sapiens
agcagccacagauuccucag

SEQ ID NO: 137184 - RNA, 21 nt, Homo sapiens
agcagcuuugguugaagcaga

SEQ ID NO: 137185 - RNA, 22 nt, Homo sapiens
agcagguguggcuuauccugaa

SEQ ID NO: 137186 - RNA, 22 nt, Homo sapiens
agcaguagugaaaguagacuua

SEQ ID NO: 137187 - RNA, 22 nt, Homo sapiens
agcaucagugauuuuguugaag

SEQ ID NO: 137188 - RNA, 22 nt, Homo sapiens
agcuacuguuagucuaguuagg

SEQ ID NO: 137189 - RNA, 20 nt, Homo sapiens
agcugcagauauaaauccgc

SEQ ID NO: 137190 - RNA, 22 nt, Homo sapiens
cagcaaaucauccuauuugagc

SEQ ID NO: 137191 - RNA, 22 nt, Homo sapiens
cagccgggugagguggcuuguu

SEQ ID NO: 137192 - RNA, 22 nt, Homo sapiens
cagcgaggucugcgucacauug

SEQ ID NO: 137193 - RNA, 22 nt, Homo sapiens
cagcuaaauuguuaaauccaag

SEQ ID NO: 137194 - RNA, 23 nt, Homo sapiens
cagcuggugauuuuaaguugaag

SEQ ID NO: 137195 - RNA, 22 nt, Homo sapiens
caggcagucuggcucccaagug

SEQ ID NO: 137196 - RNA, 22 nt, Homo sapiens
caggguccccuaccuuuugaug

SEQ ID NO: 137197 - RNA, 19 nt, Homo sapiens
caguaucauugcacauagu

SEQ ID NO: 137198 - RNA, 22 nt, Homo sapiens
cagugcauaggaucuaaaauuu

SEQ ID NO: 137199 - RNA, 23 nt, Homo sapiens
cagugcauuguggcauucagcau

SEQ ID NO: 137200 - RNA, 22 nt, Homo sapiens
caguguuuuuaacaggugcccg

SEQ ID NO: 137201 - RNA, 22 nt, Homo sapiens
cauaaaucuuguugaauagcac

SEQ ID NO: 137202 - RNA, 22 nt, Homo sapiens
cauacaugugcuugucuuaugc

SEQ ID NO: 137203 - RNA, 22 nt, Homo sapiens
caucaaaguggagggaaggacc

SEQ ID NO: 137204 - RNA, 22 nt, Homo sapiens
caucacuguugguacaaguaau

SEQ ID NO: 137205 - RNA, 21 nt, Homo sapiens
cauccccugccauuguggucu

SEQ ID NO: 137206 - RNA, 22 nt, Homo sapiens
caugacacuggcauguuucuuu

SEQ ID NO: 137207 - RNA, 22 nt, Homo sapiens
caugcauuggucuauuauguga

SEQ ID NO: 137208 - RNA, 22 nt, Homo sapiens
caugccacuguggacaaagaca

SEQ ID NO: 137209 - RNA, 22 nt, Homo sapiens
cauugcacuccagccuuggcaa

SEQ ID NO: 137210 - RNA, 22 nt, Homo sapiens
cauugcacuuagacaacuuuug

SEQ ID NO: 137211 - RNA, 22 nt, Homo sapiens
cauuuugcaguuucugucucca

SEQ ID NO: 137212 - RNA, 22 nt, Homo sapiens
ccaaggaauacccucccuuuuu

SEQ ID NO: 137213 - RNA, 22 nt, Homo sapiens
ccaaguguuuucauuguuccau

SEQ ID NO: 137214 - RNA, 22 nt, Homo sapiens
ccacagucuaugcaacaagguc

SEQ ID NO: 137215 - RNA, 22 nt, Homo sapiens
ccaccgggucccagcucugcuc

SEQ ID NO: 137216 - RNA, 21 nt, Homo sapiens
cccagguucucugaggguaga

SEQ ID NO: 137217 - RNA, 22 nt, Homo sapiens
cccucgagaaaccaucugcuga

SEQ ID NO: 137218 - RNA, 22 nt, Homo sapiens
cccugaagaaagccuaggacau

SEQ ID NO: 137219 - RNA, 21 nt, Homo sapiens
cccugguguuuggaguuugag

SEQ ID NO: 137220 - RNA, 22 nt, Homo sapiens
ccucauggagaacaucugcuag

SEQ ID NO: 137221 - RNA, 22 nt, Homo sapiens
ccugucuugaagagauccuccu

SEQ ID NO: 137222 - RNA, 22 nt, Homo sapiens
ccuugguggccacaagacauug

SEQ ID NO: 137223 - RNA, 22 nt, Homo sapiens
ccuugucacugaguggaaugaa

SEQ ID NO: 137224 - RNA, 22 nt, Homo sapiens
cgugaggaaaacagaggguguu

SEQ ID NO: 137225 - RNA, 22 nt, Homo sapiens
cuaaaugucucuacuaaguuua

SEQ ID NO: 137226 - RNA, 22 nt, Homo sapiens
cuaaucugugcauagaagaggc

SEQ ID NO: 137227 - RNA, 22 nt, Homo sapiens
cuacaguucucaggaguuggcc

SEQ ID NO: 137228 - RNA, 23 nt, Homo sapiens
cuacuagucaagucuuuuccagu

SEQ ID NO: 137229 - RNA, 22 nt, Homo sapiens
cuauguaccuggaacuguauua

SEQ ID NO: 137230 - RNA, 22 nt, Homo sapiens
cuauucacaggcaauauguaca

SEQ ID NO: 137231 - RNA, 22 nt, Homo sapiens
cuauuugcauucagaggcaugu

SEQ ID NO: 137232 - RNA, 22 nt, Homo sapiens
cucaaagucaagggaaagcagg

SEQ ID NO: 137233 - RNA, 22 nt, Homo sapiens
cucaaagugcuaagauuaggcu

SEQ ID NO: 137234 - RNA, 22 nt, Homo sapiens
cucaaagugcugggacuggcug

SEQ ID NO: 137235 - RNA, 22 nt, Homo sapiens
cucaccuugugauccacccgcc

SEQ ID NO: 137236 - RNA, 22 nt, Homo sapiens
cucaccuugugauccuccugcc

SEQ ID NO: 137237 - RNA, 20 nt, Homo sapiens
cucagguauuugaggcugca

SEQ ID NO: 137238 - RNA, 22 nt, Homo sapiens
cucaguacuugcacagaagaac

SEQ ID NO: 137239 - RNA, 20 nt, Homo sapiens
cucagugcacccccauaaaa

SEQ ID NO: 137240 - RNA, 22 nt, Homo sapiens
cucauugcaaucuccaccuccc

SEQ ID NO: 137241 - RNA, 22 nt, Homo sapiens
cuccaggugagguuaagggacu

SEQ ID NO: 137242 - RNA, 22 nt, Homo sapiens
cucucugagccauggcugcccu

SEQ ID NO: 137243 - RNA, 21 nt, Homo sapiens
cucucugcuuaugaauaguga

SEQ ID NO: 137244 - RNA, 22 nt, Homo sapiens
cucugguuaaggcugaacuaua

SEQ ID NO: 137245 - RNA, 22 nt, Homo sapiens
cucugguucugcagugcacccu

SEQ ID NO: 137246 - RNA, 22 nt, Homo sapiens
cugaaaagcaucugcauagcug

SEQ ID NO: 137247 - RNA, 22 nt, Homo sapiens
cugaaaucagccaguuaguuuc

SEQ ID NO: 137248 - RNA, 22 nt, Homo sapiens
cugaaucauugguuaugaguac

SEQ ID NO: 137249 - RNA, 22 nt, Homo sapiens
cugacagucucauugauuugcu

SEQ ID NO: 137250 - RNA, 22 nt, Homo sapiens
cugaccucugucaaagacaccc

SEQ ID NO: 137251 - RNA, 22 nt, Homo sapiens
cugacuuuagaacccaaaaagu

SEQ ID NO: 137252 - RNA, 22 nt, Homo sapiens
cugagaagaaacagguaaggac

SEQ ID NO: 137253 - RNA, 22 nt, Homo sapiens
cugagaucugaaccaggagugu

SEQ ID NO: 137254 - RNA, 22 nt, Homo sapiens
cugaggaaguucuuuaacaguu

SEQ ID NO: 137255 - RNA, 22 nt, Homo sapiens
cugaggguagaaggaucacuug

SEQ ID NO: 137256 - RNA, 22 nt, Homo sapiens
cugaggugggagaaucacauaa

SEQ ID NO: 137257 - RNA, 22 nt, Homo sapiens
cugagguuaggaguuugagacc

SEQ ID NO: 137258 - RNA, 22 nt, Homo sapiens
cugcagaucuuggggcuugcca

SEQ ID NO: 137259 - RNA, 22 nt, Homo sapiens
cuggaaagaaacccuuaauucu

SEQ ID NO: 137260 - RNA, 22 nt, Homo sapiens
cuggaauguuccuaaagauuca

SEQ ID NO: 137261 - RNA, 19 nt, Homo sapiens
cuggcaaaugcuuuggcca

SEQ ID NO: 137262 - RNA, 22 nt, Homo sapiens
cuggcaagagugaaccagcugu

SEQ ID NO: 137263 - RNA, 22 nt, Homo sapiens
cuggcagucugccucuucacug

SEQ ID NO: 137264 - RNA, 22 nt, Homo sapiens
cuggcucuguuagaagaaccag

SEQ ID NO: 137265 - RNA, 22 nt, Homo sapiens
aucaccuggaggugaucacuug

SEQ ID NO: 137266 - RNA, 22 nt, Homo sapiens
aucacuggucaugagagaagua

SEQ ID NO: 137267 - RNA, 22 nt, Homo sapiens
aucacugugauuucuacugugc

SEQ ID NO: 137268 - RNA, 22 nt, Homo sapiens
aucagaaucucuagugggacca

SEQ ID NO: 137269 - RNA, 22 nt, Homo sapiens
aucagauaccuguugggaaaug

SEQ ID NO: 137270 - RNA, 22 nt, Homo sapiens
aucaggaaccuuuuuggugugu

SEQ ID NO: 137271 - RNA, 22 nt, Homo sapiens
aucccugaggaauuucugcacu

SEQ ID NO: 137272 - RNA, 22 nt, Homo sapiens
aucccuguguccagcaccugug

SEQ ID NO: 137273 - RNA, 21 nt, Homo sapiens
auccuucuuuuucaaccugug

SEQ ID NO: 137274 - RNA, 21 nt, Homo sapiens
aucucacuugaauguaaaagc

SEQ ID NO: 137275 - RNA, 22 nt, Homo sapiens
augaaacuggcuaauuuuugua

SEQ ID NO: 137276 - RNA, 22 nt, Homo sapiens
augaaaugcauguuaaguccgu

SEQ ID NO: 137277 - RNA, 22 nt, Homo sapiens
augaaauugcuaucgcaguacu

SEQ ID NO: 137278 - RNA, 22 nt, Homo sapiens
augaagaucaugaagacggcuu

SEQ ID NO: 137279 - RNA, 22 nt, Homo sapiens
augacagugagugagcucucac

SEQ ID NO: 137280 - RNA, 22 nt, Homo sapiens
augacauguauuuccaggauuu

SEQ ID NO: 137281 - RNA, 22 nt, Homo sapiens
augagaacugucaaugagagcu

SEQ ID NO: 137282 - RNA, 22 nt, Homo sapiens
aaaaggcuagcuaguaacagaa

SEQ ID NO: 137283 - RNA, 22 nt, Homo sapiens
aaaaugcugauauugggcccca

SEQ ID NO: 137284 - RNA, 22 nt, Homo sapiens
aaagcacugaauaaauuugcuu

SEQ ID NO: 137285 - RNA, 22 nt, Homo sapiens
aaagcugucaaggcaggaggcu

SEQ ID NO: 137286 - RNA, 22 nt, Homo sapiens
aaaggauucuaauggaaaugcu

SEQ ID NO: 137287 - RNA, 20 nt, Homo sapiens
aaaggcugugagaacgagau

SEQ ID NO: 137288 - RNA, 22 nt, Homo sapiens
aaagguaguacuucuagaaggg

SEQ ID NO: 137289 - RNA, 22 nt, Homo sapiens
aaaguacucaguucaguuccgu

SEQ ID NO: 137290 - RNA, 22 nt, Homo sapiens
aaagugaauguaucccguaagu

SEQ ID NO: 137291 - RNA, 22 nt, Homo sapiens
aaagugacuuagugccccauuu

SEQ ID NO: 137292 - RNA, 22 nt, Homo sapiens
aaagugcugagacagacuggga

SEQ ID NO: 137293 - RNA, 22 nt, Homo sapiens
aaagugcugagaguucuaacuu

SEQ ID NO: 137294 - RNA, 22 nt, Homo sapiens
aaagugcugggauuaggccagg

SEQ ID NO: 137295 - RNA, 22 nt, Homo sapiens
aaagugcugggauuggccgggc

SEQ ID NO: 137296 - RNA, 22 nt, Homo sapiens
aaagugcugggauuuuaggcau

SEQ ID NO: 137297 - RNA, 22 nt, Homo sapiens
aaagugcuuacuaaguugccaa

SEQ ID NO: 137298 - RNA, 22 nt, Homo sapiens
aaagugcuuccuuuuugagggu

SEQ ID NO: 137299 - RNA, 22 nt, Homo sapiens
aaagugcuucucuuuggugggu

SEQ ID NO: 137300 - RNA, 22 nt, Homo sapiens
aaaguggacuaagugaauauga

SEQ ID NO: 137301 - RNA, 19 nt, Homo sapiens
aaaguucuucccuuuggag

SEQ ID NO: 137302 - RNA, 22 nt, Homo sapiens
aaaugcaguugguggggauaug

SEQ ID NO: 137303 - RNA, 22 nt, Homo sapiens
aaaugcaucauuaggugauuuu

SEQ ID NO: 137304 - RNA, 22 nt, Homo sapiens
aaaugcaugaauaagcucgugu

SEQ ID NO: 137305 - RNA, 22 nt, Homo sapiens
aaaugguguuaguagaucuuua

SEQ ID NO: 137306 - RNA, 22 nt, Homo sapiens
aacagacugucacauaaaauug

SEQ ID NO: 137307 - RNA, 22 nt, Homo sapiens
aacagauugcugagccccaccc

SEQ ID NO: 137308 - RNA, 22 nt, Homo sapiens
aacaggguggugccugguccau

SEQ ID NO: 137309 - RNA, 22 nt, Homo sapiens
aacaguguuuuggguuuucugg

SEQ ID NO: 137310 - RNA, 22 nt, Homo sapiens
aaccuucauuccuuucccugcc

SEQ ID NO: 137311 - RNA, 22 nt, Homo sapiens
aacugcuguuuggguacuggug

SEQ ID NO: 137312 - RNA, 22 nt, Homo sapiens
aacugguauuucccaugaauuu

SEQ ID NO: 137313 - RNA, 22 nt, Homo sapiens
aagagcucauccauaguuguca

SEQ ID NO: 137314 - RNA, 21 nt, Homo sapiens
aagcacauugaguguguguga

SEQ ID NO: 137315 - RNA, 22 nt, Homo sapiens
aagcaccaauaggagauuuguc

SEQ ID NO: 137316 - RNA, 22 nt, Homo sapiens
aagcugcauuuucuagaugcuu

SEQ ID NO: 137317 - RNA, 22 nt, Homo sapiens
aagcuguguguaagcucucaca

SEQ ID NO: 137318 - RNA, 22 nt, Homo sapiens
aaggagcaguggacggguccua

SEQ ID NO: 137319 - RNA, 22 nt, Homo sapiens
aaggaguguggugaucuugggc

SEQ ID NO: 137320 - RNA, 22 nt, Homo sapiens
aaggcaguggcagaagauguca

SEQ ID NO: 137321 - RNA, 22 nt, Homo sapiens
aaggcauggugacuauuuaggc

SEQ ID NO: 137322 - RNA, 22 nt, Homo sapiens
aaggcuauuugagaaugugugu

SEQ ID NO: 137323 - RNA, 22 nt, Homo sapiens
aaggucauugugguuuuugcca

SEQ ID NO: 137324 - RNA, 21 nt, Homo sapiens
aagguuuuuagugcuugacuu

SEQ ID NO: 137325 - RNA, 22 nt, Homo sapiens
aaguaaauauccgguaguccca

SEQ ID NO: 137326 - RNA, 22 nt, Homo sapiens
aagugcaaauucccaggcucug

SEQ ID NO: 137327 - RNA, 22 nt, Homo sapiens
aagugcucuugaaacugccuua

SEQ ID NO: 137328 - RNA, 22 nt, Homo sapiens
aagugcuucagaagacaauauu

SEQ ID NO: 137329 - RNA, 22 nt, Homo sapiens
aaguggaauguuuguggcacaa

SEQ ID NO: 137330 - RNA, 22 nt, Homo sapiens
aaguggccuagagcgaccauuu

SEQ ID NO: 137331 - RNA, 22 nt, Homo sapiens
aagugucagaguugcuaaugac

SEQ ID NO: 137332 - RNA, 22 nt, Homo sapiens
aauaaagcagcuuuuugggacu

SEQ ID NO: 137333 - RNA, 22 nt, Homo sapiens
aauaaagccugucucuuuagag

SEQ ID NO: 137334 - RNA, 22 nt, Homo sapiens
aauaagaaguggaagggaccgg

SEQ ID NO: 137335 - RNA, 19 nt, Homo sapiens
aauaaugccagaugucugu

SEQ ID NO: 137336 - RNA, 22 nt, Homo sapiens
aauaugguuuuaugaagcaauu

SEQ ID NO: 137337 - RNA, 22 nt, Homo sapiens
aauauguccuugaaauggugcu

SEQ ID NO: 137338 - RNA, 22 nt, Homo sapiens
aaucagcacacugugcuuucca

SEQ ID NO: 137339 - RNA, 22 nt, Homo sapiens
aaucucagcauuuugggcugag

SEQ ID NO: 137340 - RNA, 22 nt, Homo sapiens
aaugacuaagaugguacauuuu

SEQ ID NO: 137341 - RNA, 22 nt, Homo sapiens
aaugcaagauguuaauuauagg

SEQ ID NO: 137342 - RNA, 22 nt, Homo sapiens
aaugcacauaaaauccuccagg

SEQ ID NO: 137343 - RNA, 22 nt, Homo sapiens
aaugcuguucuuugcuuaaguu

SEQ ID NO: 137344 - RNA, 22 nt, Homo sapiens
aauggcacaagaguaaacuguu

SEQ ID NO: 137345 - RNA, 22 nt, Homo sapiens
aauggccacugaccuguguuga

SEQ ID NO: 137346 - RNA, 22 nt, Homo sapiens
aauggcuauuucaugugguagg

SEQ ID NO: 137347 - RNA, 22 nt, Homo sapiens
aauuacauggcaauugggaaau

SEQ ID NO: 137348 - RNA, 22 nt, Homo sapiens
aauucacuucuuuuaggcaggg

SEQ ID NO: 137349 - RNA, 23 nt, Homo sapiens
aauugcuuuugaggacuuaguug

SEQ ID NO: 137350 - RNA, 22 nt, Homo sapiens
acacaguaaauauugucuccuc

SEQ ID NO: 137351 - RNA, 22 nt, Homo sapiens
uccuuuggucaguauucuuuug

SEQ ID NO: 137352 - RNA, 22 nt, Homo sapiens
uccuuugguggagucuuuaggg

SEQ ID NO: 137353 - RNA, 22 nt, Homo sapiens
ucucagugacugcugggucccc

SEQ ID NO: 137354 - RNA, 22 nt, Homo sapiens
ucucaguuuucuggggaagaaa

SEQ ID NO: 137355 - RNA, 22 nt, Homo sapiens
ucuccauuguccagaugaggaa

SEQ ID NO: 137356 - RNA, 20 nt, Homo sapiens
ucucccaaacagcaggcccu

SEQ ID NO: 137357 - RNA, 22 nt, Homo sapiens
ucucuguuuagagccagcaauu

SEQ ID NO: 137358 - RNA, 22 nt, Homo sapiens
ucugagguuacugcuuuguaga

SEQ ID NO: 137359 - RNA, 22 nt, Homo sapiens
ucuggcaagagccgagggcagu

SEQ ID NO: 137360 - RNA, 22 nt, Homo sapiens
ucuggccuacaucauuuuuccg

SEQ ID NO: 137361 - RNA, 22 nt, Homo sapiens
ucuggcuuauuucacuuagcau

SEQ ID NO: 137362 - RNA, 22 nt, Homo sapiens
ucuggcuugugaacugucuucu

SEQ ID NO: 137363 - RNA, 17 nt, Homo sapiens
ucuggcuuucacaccug

SEQ ID NO: 137364 - RNA, 22 nt, Homo sapiens
ucugguguuacugagccuccca

SEQ ID NO: 137365 - RNA, 22 nt, Homo sapiens
ucuguugguucuuugaggagga

SEQ ID NO: 137366 - RNA, 22 nt, Homo sapiens
ucuugcuuuugcagagcuucuc

SEQ ID NO: 137367 - RNA, 22 nt, Homo sapiens
ucuuugguagaagcuauuuuau

SEQ ID NO: 137368 - RNA, 22 nt, Homo sapiens
ucuuuguguucaggagccacgu

SEQ ID NO: 137369 - RNA, 22 nt, Homo sapiens
ucuuuguuagaacccucuccuu

SEQ ID NO: 137370 - RNA, 22 nt, Homo sapiens
ucuuuguuggaguccaaggaua

SEQ ID NO: 137371 - RNA, 22 nt, Homo sapiens
ugaaaugucuuuaggaggcuuc

SEQ ID NO: 137372 - RNA, 22 nt, Homo sapiens
ugaaauuauucuuaccaaggug

SEQ ID NO: 137373 - RNA, 22 nt, Homo sapiens
ugaaauuguuugcaaggauagg

SEQ ID NO: 137374 - RNA, 22 nt, Homo sapiens
ugaacagcaccuccuagaguug

SEQ ID NO: 137375 - RNA, 20 nt, Homo sapiens
ugaacugguuacuuucuguc

SEQ ID NO: 137376 - RNA, 22 nt, Homo sapiens
ugaagacauuuuugggugugua

SEQ ID NO: 137377 - RNA, 22 nt, Homo sapiens
ugaagugaaugguaaguaugcc

SEQ ID NO: 137378 - RNA, 21 nt, Homo sapiens
ugaaguguaaccgugcagggc

SEQ ID NO: 137379 - RNA, 22 nt, Homo sapiens
ugaauacuucaaaaaaauagcu

SEQ ID NO: 137380 - RNA, 22 nt, Homo sapiens
ugaauacuucguucaaagauaa

SEQ ID NO: 137381 - RNA, 22 nt, Homo sapiens
ugaauaguaauguguuuggucu

SEQ ID NO: 137382 - RNA, 19 nt, Homo sapiens
ugaaugacaucuaaagucc

SEQ ID NO: 137383 - RNA, 22 nt, Homo sapiens
ugaaugcaucuagaaauuuauu

SEQ ID NO: 137384 - RNA, 22 nt, Homo sapiens
ugaauguaacuaaaccugugaa

SEQ ID NO: 137385 - RNA, 22 nt, Homo sapiens
ugaauguuugcuuacuuccaua

SEQ ID NO: 137386 - RNA, 22 nt, Homo sapiens
ugaauuguuuacgagaugugag

SEQ ID NO: 137387 - RNA, 22 nt, Homo sapiens
ugaauuguuucauucuuuacau

SEQ ID NO: 137388 - RNA, 22 nt, Homo sapiens
ugacaagacuacauaucccauu

SEQ ID NO: 137389 - RNA, 22 nt, Homo sapiens
ugacacagugggggauccuuuu

SEQ ID NO: 137390 - RNA, 19 nt, Homo sapiens
ugacacuguuggugggagg

SEQ ID NO: 137391 - RNA, 22 nt, Homo sapiens
ugacagagaagcauugaguuca

SEQ ID NO: 137392 - RNA, 22 nt, Homo sapiens
ugacagagcaggacuucaucuc

SEQ ID NO: 137393 - RNA, 22 nt, Homo sapiens
ugacagaggucuuuuaauagcu

SEQ ID NO: 137394 - RNA, 18 nt, Homo sapiens
ugacagcacaugugggga

SEQ ID NO: 137395 - RNA, 22 nt, Homo sapiens
ugacaggauggagaucgguauu

SEQ ID NO: 137396 - RNA, 22 nt, Homo sapiens
ugacagugaacagguuaccacu

SEQ ID NO: 137397 - RNA, 22 nt, Homo sapiens
ugacaguguccucauucccaac

SEQ ID NO: 137398 - RNA, 22 nt, Homo sapiens
ugacaugauguuccuacacugu

SEQ ID NO: 137399 - RNA, 22 nt, Homo sapiens
ugacauugggagugaagugaag

SEQ ID NO: 137400 - RNA, 23 nt, Homo sapiens
ugacuuaggccucaacuaugacu

SEQ ID NO: 137401 - RNA, 22 nt, Homo sapiens
ugacuucagacugaaaugauuc

SEQ ID NO: 137402 - RNA, 22 nt, Homo sapiens
ugacuugaggcucgcacaaguu

SEQ ID NO: 137403 - RNA, 16 nt, Homo sapiens
ugagaacaugugacau

SEQ ID NO: 137404 - RNA, 22 nt, Homo sapiens
ugagaacaugugauauuuggug

SEQ ID NO: 137405 - RNA, 19 nt, Homo sapiens
ugagaacaugugguauuug

SEQ ID NO: 137406 - RNA, 20 nt, Homo sapiens
ugagaacaugugguauuugg

SEQ ID NO: 137407 - RNA, 18 nt, Homo sapiens
ugagaacauguguacaca

SEQ ID NO: 137408 - RNA, 22 nt, Homo sapiens
ugagaacauuccucuuccuggc

SEQ ID NO: 137409 - RNA, 22 nt, Homo sapiens
ugagaauauuugaagauguuag

SEQ ID NO: 137410 - RNA, 22 nt, Homo sapiens
ugagaaugaugauugguaaacc

SEQ ID NO: 137411 - RNA, 22 nt, Homo sapiens
ugagaauguagggcucucccag

SEQ ID NO: 137412 - RNA, 22 nt, Homo sapiens
ugagacugaaauuaggaaacug

SEQ ID NO: 137413 - RNA, 22 nt, Homo sapiens
ugagauaaagcauguacugugu

SEQ ID NO: 137414 - RNA, 22 nt, Homo sapiens
gaugacagugaguaaccccaac

SEQ ID NO: 137415 - RNA, 22 nt, Homo sapiens
gaugaucaugaccuacagaugg

SEQ ID NO: 137416 - RNA, 22 nt, Homo sapiens
gauggaauuaaaaucagaauca

SEQ ID NO: 137417 - RNA, 22 nt, Homo sapiens
gauguguuuguuucuggaggag

SEQ ID NO: 137418 - RNA, 22 nt, Homo sapiens
gauuucaucuuuagaggaagga

SEQ ID NO: 137419 - RNA, 21 nt, Homo sapiens
gcaaacauccuuugaugccag

SEQ ID NO: 137420 - RNA, 22 nt, Homo sapiens
gcaaaguguuuuuaggaagucu

SEQ ID NO: 137421 - RNA, 20 nt, Homo sapiens
gcaaauggaucccacaagcc

SEQ ID NO: 137422 - RNA, 22 nt, Homo sapiens
gcaaggacucccugggucauuc

SEQ ID NO: 137423 - RNA, 22 nt, Homo sapiens
gcaagugucugagguuuuguau

SEQ ID NO: 137424 - RNA, 22 nt, Homo sapiens
gcaccguggaguauggggagga

SEQ ID NO: 137425 - RNA, 22 nt, Homo sapiens
gcagaguauagagggcugggcc

SEQ ID NO: 137426 - RNA, 22 nt, Homo sapiens
gcaggaauuucucugcagaccc

SEQ ID NO: 137427 - RNA, 19 nt, Homo sapiens
gcaguauugaaggccaguc

SEQ ID NO: 137428 - RNA, 22 nt, Homo sapiens
gcagugcaguggcgcgaucucg

SEQ ID NO: 137429 - RNA, 22 nt, Homo sapiens
gcaugcauuuuccuaacuagaa

SEQ ID NO: 137430 - RNA, 22 nt, Homo sapiens
gcccacuguuaaauuuguuuua

SEQ ID NO: 137431 - RNA, 17 nt, Homo sapiens
gcccuuugugccucuuc

SEQ ID NO: 137432 - RNA, 22 nt, Homo sapiens
gcgguagcauagacugcaggac

SEQ ID NO: 137433 - RNA, 22 nt, Homo sapiens
gcuaggagaucugcugcucucu

SEQ ID NO: 137434 - RNA, 22 nt, Homo sapiens
gcucaugagacaagcaggagua

SEQ ID NO: 137435 - RNA, 22 nt, Homo sapiens
gcugauggugcaguucuagccu

SEQ ID NO: 137436 - RNA, 22 nt, Homo sapiens
gcugauguuggccucugggcuu

SEQ ID NO: 137437 - RNA, 22 nt, Homo sapiens
gcugcuuuugaugacaaaaaca

SEQ ID NO: 137438 - RNA, 22 nt, Homo sapiens
gcuggcuuucuccugaucucag

SEQ ID NO: 137439 - RNA, 19 nt, Homo sapiens
gcugguuguccacucucuc

SEQ ID NO: 137440 - RNA, 22 nt, Homo sapiens
gcuguugcuauuauuccgagaa

SEQ ID NO: 137441 - RNA, 22 nt, Homo sapiens
gcuuuguuaaaacacagccaca

SEQ ID NO: 137442 - RNA, 22 nt, Homo sapiens
ggaaagacuauuguaaaggaug

SEQ ID NO: 137443 - RNA, 22 nt, Homo sapiens
ggaaauguaaacaauggggcua

SEQ ID NO: 137444 - RNA, 22 nt, Homo sapiens
ggaagguaauuggcuaaugaga

SEQ ID NO: 137445 - RNA, 19 nt, Homo sapiens
ggaaugcuauucaaccuuu

SEQ ID NO: 137446 - RNA, 20 nt, Homo sapiens
ggaauguuaaucuccaugau

SEQ ID NO: 137447 - RNA, 22 nt, Homo sapiens
ggagaauguaauugguauuuug

SEQ ID NO: 137448 - RNA, 22 nt, Homo sapiens
ggaguaggcuguccggcaccca

SEQ ID NO: 137449 - RNA, 22 nt, Homo sapiens
ggagugucagaaacaguguccu

SEQ ID NO: 137450 - RNA, 22 nt, Homo sapiens
ggcaaaugaagauggagaggcu

SEQ ID NO: 137451 - RNA, 22 nt, Homo sapiens
ugcaagaaucagccuaucauua

SEQ ID NO: 137452 - RNA, 22 nt, Homo sapiens
ugcaagauaggcaguuugcacu

SEQ ID NO: 137453 - RNA, 22 nt, Homo sapiens
ugcaagaugagauuuuggaugg

SEQ ID NO: 137454 - RNA, 22 nt, Homo sapiens
ugcaccacugcacugccugggu

SEQ ID NO: 137455 - RNA, 22 nt, Homo sapiens
ugcaccaucuugcuucuguggu

SEQ ID NO: 137456 - RNA, 22 nt, Homo sapiens
ugcaccauggcacuccaggcug

SEQ ID NO: 137457 - RNA, 22 nt, Homo sapiens
ugcaccauugcauuccagccug

SEQ ID NO: 137458 - RNA, 22 nt, Homo sapiens
ugcagagucuguccugccugcc

SEQ ID NO: 137459 - RNA, 23 nt, Homo sapiens
ugcagcacacugaugggucuuga

SEQ ID NO: 137460 - RNA, 22 nt, Homo sapiens
ugcagguaggcaguaucauuua

SEQ ID NO: 137461 - RNA, 22 nt, Homo sapiens
ugcaguuuaggaacugguaaca

SEQ ID NO: 137462 - RNA, 22 nt, Homo sapiens
ugcauauucgaguuauuuuggg

SEQ ID NO: 137463 - RNA, 22 nt, Homo sapiens
ugcaugcaucuuuuauaguagc

SEQ ID NO: 137464 - RNA, 22 nt, Homo sapiens
ugcauggagcucucuuuggacu

SEQ ID NO: 137465 - RNA, 21 nt, Homo sapiens
ugcaugguagucacaugauuc

SEQ ID NO: 137466 - RNA, 22 nt, Homo sapiens
ugcauggucauacauggcaccc

SEQ ID NO: 137467 - RNA, 22 nt, Homo sapiens
ugcauuguauuguugacucgcc

SEQ ID NO: 137468 - RNA, 21 nt, Homo sapiens
ugcauuguugcugagagcagg

SEQ ID NO: 137469 - RNA, 19 nt, Homo sapiens
ugccauguaacaggaaaau

SEQ ID NO: 137470 - RNA, 22 nt, Homo sapiens
ugccauugcacuccagccuggg

SEQ ID NO: 137471 - RNA, 22 nt, Homo sapiens
ugcgauuauuaugucacuuccu

SEQ ID NO: 137472 - RNA, 22 nt, Homo sapiens
ugcucaccugcugcucaccucc

SEQ ID NO: 137473 - RNA, 21 nt, Homo sapiens
ugcucaugaguaaugcaguga

SEQ ID NO: 137474 - RNA, 22 nt, Homo sapiens
ugcugcuguuaucauuuuacca

SEQ ID NO: 137475 - RNA, 22 nt, Homo sapiens
uggaaaucuaaguuuggauuga

SEQ ID NO: 137476 - RNA, 20 nt, Homo sapiens
uggaaauuaaccuuucaggu

SEQ ID NO: 137477 - RNA, 22 nt, Homo sapiens
uggaagucuucauuauguauag

SEQ ID NO: 137478 - RNA, 22 nt, Homo sapiens
uggaauaugagacgggguuguc

SEQ ID NO: 137479 - RNA, 22 nt, Homo sapiens
uggaaugucuauguuuuugauu

SEQ ID NO: 137480 - RNA, 22 nt, Homo sapiens
uggaauguggacucuuaugggg

SEQ ID NO: 137481 - RNA, 22 nt, Homo sapiens
uggacagagagaccggcauuuu

SEQ ID NO: 137482 - RNA, 20 nt, Homo sapiens
uggaccagagagguggggac

SEQ ID NO: 137483 - RNA, 22 nt, Homo sapiens
uggacuguaaauuggggacucu

SEQ ID NO: 137484 - RNA, 22 nt, Homo sapiens
uggacuguaagugccuugagua

SEQ ID NO: 137485 - RNA, 22 nt, Homo sapiens
uggacuguaauuuuauaggcau

SEQ ID NO: 137486 - RNA, 22 nt, Homo sapiens
uggagagugagggccuccuuaa

SEQ ID NO: 137487 - RNA, 20 nt, Homo sapiens
uggaguuguggcaguuugga

SEQ ID NO: 137488 - RNA, 18 nt, Homo sapiens
uggauaugaaauucugga

SEQ ID NO: 137489 - RNA, 22 nt, Homo sapiens
uggauggagaggcuugugaugc

SEQ ID NO: 137490 - RNA, 22 nt, Homo sapiens
uggauggugauuggaucaugga

SEQ ID NO: 137491 - RNA, 22 nt, Homo sapiens
uggcaaaugugagaugagaacu

SEQ ID NO: 137492 - RNA, 22 nt, Homo sapiens
uggcaagaaccacaauuacuuu

SEQ ID NO: 137493 - RNA, 22 nt, Homo sapiens
uggcaagaccccaucucuacaa

SEQ ID NO: 137494 - RNA, 20 nt, Homo sapiens
uggcaccugacagauagcca

SEQ ID NO: 137495 - RNA, 22 nt, Homo sapiens
uggcagcgugaaagacuuuuuc

SEQ ID NO: 137496 - RNA, 22 nt, Homo sapiens
uggcagcugcuucaugggaugc

SEQ ID NO: 137497 - RNA, 22 nt, Homo sapiens
uggcaguuuuaugugguucaac

SEQ ID NO: 137498 - RNA, 17 nt, Homo sapiens
uggcaugaggguguggg

SEQ ID NO: 137499 - RNA, 22 nt, Homo sapiens
uggcauggaguggauggcccca

SEQ ID NO: 137500 - RNA, 22 nt, Homo sapiens
uggcaugucguuuuucauagga

SEQ ID NO: 137501 - RNA, 23 nt, Homo sapiens
uggccaagauaaucucaguuuuc

SEQ ID NO: 137502 - RNA, 22 nt, Homo sapiens
uggccuguaacgcugucucagc

SEQ ID NO: 137503 - RNA, 22 nt, Homo sapiens
uggcuacagaaaguacuaguga

SEQ ID NO: 137504 - RNA, 22 nt, Homo sapiens
uggcuguguccucucccaaauc

SEQ ID NO: 137505 - RNA, 22 nt, Homo sapiens
uggcuuuuaucuacucucaacu

SEQ ID NO: 137506 - RNA, 22 nt, Homo sapiens
ugggaacaugaagguuaaagag

SEQ ID NO: 137507 - RNA, 18 nt, Homo sapiens
ugggaagaaauucuucuc

SEQ ID NO: 137508 - RNA, 22 nt, Homo sapiens
ugggagugugcacaauuucagc

SEQ ID NO: 137509 - RNA, 22 nt, Homo sapiens
ugggaugaugcuugagaauauc

SEQ ID NO: 137510 - RNA, 22 nt, Homo sapiens
ugggguagaauagaauugauau

SEQ ID NO: 137511 - RNA, 22 nt, Homo sapiens
augauacuguucuaagauuuuu

SEQ ID NO: 137512 - RNA, 22 nt, Homo sapiens
augauaucuuguuuuucaugca

SEQ ID NO: 137513 - RNA, 22 nt, Homo sapiens
augaucauggaaguuuuccugu

SEQ ID NO: 137514 - RNA, 22 nt, Homo sapiens
augauugugaauaugugguuuu

SEQ ID NO: 137515 - RNA, 22 nt, Homo sapiens
augcaaacaucauagaguguac

SEQ ID NO: 137516 - RNA, 22 nt, Homo sapiens
augcaaacaucugaagagacau

SEQ ID NO: 137517 - RNA, 22 nt, Homo sapiens
augcauggucugaagucaaccu

SEQ ID NO: 137518 - RNA, 22 nt, Homo sapiens
augccacuguacucuagccuag

SEQ ID NO: 137519 - RNA, 22 nt, Homo sapiens
augccagggagaauuguucaag

SEQ ID NO: 137520 - RNA, 22 nt, Homo sapiens
auggaauguaaguuauguuugc

SEQ ID NO: 137521 - RNA, 22 nt, Homo sapiens
auggacagacacuggccuucug

SEQ ID NO: 137522 - RNA, 22 nt, Homo sapiens
auggaguguaauauugagagcu

SEQ ID NO: 137523 - RNA, 22 nt, Homo sapiens
auggauauuuuuugaacauaga

SEQ ID NO: 137524 - RNA, 22 nt, Homo sapiens
auggcaauaugaugcacuguuu

SEQ ID NO: 137525 - RNA, 22 nt, Homo sapiens
auggcaaugcgauggugacuga

SEQ ID NO: 137526 - RNA, 22 nt, Homo sapiens
auggcacucaaucaaguugaga

SEQ ID NO: 137527 - RNA, 22 nt, Homo sapiens
auggcacugccuggcuucaugg

SEQ ID NO: 137528 - RNA, 22 nt, Homo sapiens
auggcccuguguggagcugcug

SEQ ID NO: 137529 - RNA, 22 nt, Homo sapiens
auggcuauuccauaggcagagc

SEQ ID NO: 137530 - RNA, 22 nt, Homo sapiens
auggcucaguguguaucuauca

SEQ ID NO: 137531 - RNA, 22 nt, Homo sapiens
auggcuugugacccaugcuuca

SEQ ID NO: 137532 - RNA, 22 nt, Homo sapiens
auggucuuuuuguuaugagaga

SEQ ID NO: 137533 - RNA, 22 nt, Homo sapiens
augguuuuacugcaaaauggga

SEQ ID NO: 137534 - RNA, 22 nt, Homo sapiens
auguaaacauuuggucuaaauu

SEQ ID NO: 137535 - RNA, 22 nt, Homo sapiens
auguaguaugaagaagaugcuu

SEQ ID NO: 137536 - RNA, 22 nt, Homo sapiens
auguaguauuaaugagagauaa

SEQ ID NO: 137537 - RNA, 22 nt, Homo sapiens
augucauagaagccugugaacc

SEQ ID NO: 137538 - RNA, 22 nt, Homo sapiens
augugaacaucauagaaugcac

SEQ ID NO: 137539 - RNA, 22 nt, Homo sapiens
augugcaaaguuaagaucccag

SEQ ID NO: 137540 - RNA, 22 nt, Homo sapiens
augugcaauguguacguagccc

SEQ ID NO: 137541 - RNA, 22 nt, Homo sapiens
augugcaugcuguucugccaga

SEQ ID NO: 137542 - RNA, 22 nt, Homo sapiens
augugcuuuuggugagagauuu

SEQ ID NO: 137543 - RNA, 22 nt, Homo sapiens
augugggaggacuuggcuguug

SEQ ID NO: 137544 - RNA, 22 nt, Homo sapiens
auguuagcaucaauauucauca

SEQ ID NO: 137545 - RNA, 22 nt, Homo sapiens
auuacuuugcaccaaccuaaua

SEQ ID NO: 137546 - RNA, 20 nt, Homo sapiens
auucauggaggagcaauugg

SEQ ID NO: 137547 - RNA, 22 nt, Homo sapiens
auuccacuuauaugagguaucu

SEQ ID NO: 137548 - RNA, 20 nt, Homo sapiens
auuccacuuauaugaggucc

SEQ ID NO: 137549 - RNA, 22 nt, Homo sapiens
auuccacuuccacuaguuucuc

SEQ ID NO: 137550 - RNA, 22 nt, Homo sapiens
auucuauaguccuaggauuggg

SEQ ID NO: 137551 - RNA, 22 nt, Homo sapiens
auugaacacagaguagcuuucc

SEQ ID NO: 137552 - RNA, 20 nt, Homo sapiens
auugaagacuccggggcaga

SEQ ID NO: 137553 - RNA, 16 nt, Homo sapiens
auugacaguggguguu

SEQ ID NO: 137554 - RNA, 22 nt, Homo sapiens
auugacuugauauauagcugau

SEQ ID NO: 137555 - RNA, 22 nt, Homo sapiens
acaccaucuccuuauuucucuu

SEQ ID NO: 137556 - RNA, 22 nt, Homo sapiens
acagaauucucagaacugggag

SEQ ID NO: 137557 - RNA, 22 nt, Homo sapiens
acagugcuuggcacacaguaau

SEQ ID NO: 137558 - RNA, 22 nt, Homo sapiens
acaguggugcgaucucggcuca

SEQ ID NO: 137559 - RNA, 22 nt, Homo sapiens
acagugucugacacguaggaag

SEQ ID NO: 137560 - RNA, 18 nt, Homo sapiens
acagugucuuacaccugu

SEQ ID NO: 137561 - RNA, 22 nt, Homo sapiens
acaguguuacuugauaguguau

SEQ ID NO: 137562 - RNA, 22 nt, Homo sapiens
acaugcauccaugugaagagac

SEQ ID NO: 137563 - RNA, 22 nt, Homo sapiens
accagucucagguaugucuuua

SEQ ID NO: 137564 - RNA, 22 nt, Homo sapiens
acccaguagucauucaggagca

SEQ ID NO: 137565 - RNA, 21 nt, Homo sapiens
acccccacaccuccuuaguuc

SEQ ID NO: 137566 - RNA, 17 nt, Homo sapiens
accccuaccucagaagc

SEQ ID NO: 137567 - RNA, 22 nt, Homo sapiens
acccugacacgauucuucacuu

SEQ ID NO: 137568 - RNA, 22 nt, Homo sapiens
acccuguaacauacaagugguu

SEQ ID NO: 137569 - RNA, 22 nt, Homo sapiens
acccuguaggugcuggcagaga

SEQ ID NO: 137570 - RNA, 23 nt, Homo sapiens
accugauguuucuguggggagcc

SEQ ID NO: 137571 - RNA, 22 nt, Homo sapiens
accuucauuguugccaugucca

SEQ ID NO: 137572 - RNA, 22 nt, Homo sapiens
acuaugcuuuucuuagaauuaa

SEQ ID NO: 137573 - RNA, 22 nt, Homo sapiens
acucacagcaaccuccgccucc

SEQ ID NO: 137574 - RNA, 22 nt, Homo sapiens
acugcacuccacccuuggcagc

SEQ ID NO: 137575 - RNA, 22 nt, Homo sapiens
acugcacuccagccuccugggu

SEQ ID NO: 137576 - RNA, 22 nt, Homo sapiens
acugcacuccggccuggcaaca

SEQ ID NO: 137577 - RNA, 22 nt, Homo sapiens
acugcacugcagccuggccaac

SEQ ID NO: 137578 - RNA, 20 nt, Homo sapiens
acugcauuuaguccucagga

SEQ ID NO: 137579 - RNA, 22 nt, Homo sapiens
acugcauuugucccuuuugaac

SEQ ID NO: 137580 - RNA, 22 nt, Homo sapiens
acuggcuuaaggaugggccacu

SEQ ID NO: 137581 - RNA, 22 nt, Homo sapiens
acuuugcuuagagggcauuaaa

SEQ ID NO: 137582 - RNA, 19 nt, Homo sapiens
acuuuggugauuagaggga

SEQ ID NO: 137583 - RNA, 22 nt, Homo sapiens
acuuugguuuauagaauuuagg

SEQ ID NO: 137584 - RNA, 22 nt, Homo sapiens
acuuuuugauggggagaacauu

SEQ ID NO: 137585 - RNA, 19 nt, Homo sapiens
agaagugcauggucuagag

SEQ ID NO: 137586 - RNA, 22 nt, Homo sapiens
agaauguauauucuguaguugu

SEQ ID NO: 137587 - RNA, 22 nt, Homo sapiens
agaaugugaacaucuugaaagu

SEQ ID NO: 137588 - RNA, 22 nt, Homo sapiens
agaauucugucauguuuauauu

SEQ ID NO: 137589 - RNA, 22 nt, Homo sapiens
agacagcugggaaauggagugu

SEQ ID NO: 137590 - RNA, 22 nt, Homo sapiens
agagauaauuagguuaaaugag

SEQ ID NO: 137591 - RNA, 22 nt, Homo sapiens
agagaucaauaugaaggaaaug

SEQ ID NO: 137592 - RNA, 22 nt, Homo sapiens
agagcaaugacaugcuaugugg

SEQ ID NO: 137593 - RNA, 22 nt, Homo sapiens
agagcaaugggugaauauuaaa

SEQ ID NO: 137594 - RNA, 22 nt, Homo sapiens
agagcaauguuaucagucucug

SEQ ID NO: 137595 - RNA, 22 nt, Homo sapiens
agaguacugacguuugcaaauu

SEQ ID NO: 137596 - RNA, 22 nt, Homo sapiens
agaugcuguuaucaacuguagc

SEQ ID NO: 137597 - RNA, 18 nt, Homo sapiens
agaugguguugcuucugu

SEQ ID NO: 137598 - RNA, 22 nt, Homo sapiens
agcaacauugagacugcaguug

SEQ ID NO: 137599 - RNA, 22 nt, Homo sapiens
agcacagugaaugguuuacuca

SEQ ID NO: 137600 - RNA, 22 nt, Homo sapiens
agcaccaugggcugaguaagug

SEQ ID NO: 137601 - RNA, 22 nt, Homo sapiens
agcagcaugaggggacuucugc

SEQ ID NO: 137602 - RNA, 17 nt, Homo sapiens
agcagcccauaucccca

SEQ ID NO: 137603 - RNA, 22 nt, Homo sapiens
agcagcuuugcauggccugugg

SEQ ID NO: 137604 - RNA, 21 nt, Homo sapiens
agccaguguuccuuguggcuc

SEQ ID NO: 137605 - RNA, 23 nt, Homo sapiens
agcccugugacucgaacgaggag

SEQ ID NO: 137606 - RNA, 23 nt, Homo sapiens
agccugguuucccugcuucuccc

SEQ ID NO: 137607 - RNA, 22 nt, Homo sapiens
agcuccuuugcuuuuuccagga

SEQ ID NO: 137608 - RNA, 22 nt, Homo sapiens
agcuggauguggaugacccugu

SEQ ID NO: 137609 - RNA, 22 nt, Homo sapiens
agcuggucuacguguguaugag

SEQ ID NO: 137610 - RNA, 22 nt, Homo sapiens
agcuggucuuggggaagaguag

SEQ ID NO: 137611 - RNA, 22 nt, Homo sapiens
agcuuguggugaauacugcuag

SEQ ID NO: 137612 - RNA, 22 nt, Homo sapiens
agcuuuuugggcagcuauugac

SEQ ID NO: 137613 - RNA, 22 nt, Homo sapiens
aggaagacauauagaacuaaaa

SEQ ID NO: 137614 - RNA, 22 nt, Homo sapiens
aggaccaugguauugcuuuggg

SEQ ID NO: 137615 - RNA, 22 nt, Homo sapiens
aggagcacaggacuuugauuau

SEQ ID NO: 137616 - RNA, 22 nt, Homo sapiens
aggcaagcaucuugcucccuuc

SEQ ID NO: 137617 - RNA, 22 nt, Homo sapiens
aggcaugauggcuccagaucau

SEQ ID NO: 137618 - RNA, 22 nt, Homo sapiens
aggcugguauuuacaaaagcuc

SEQ ID NO: 137619 - RNA, 22 nt, Homo sapiens
agggagcaaaguggucuuucuc

SEQ ID NO: 137620 - RNA, 22 nt, Homo sapiens
aggucccauguccucccugacc

SEQ ID NO: 137621 - RNA, 22 nt, Homo sapiens
aggugcugacaggauagguuuc

SEQ ID NO: 137622 - RNA, 22 nt, Homo sapiens
aguaacauuucuaguagagagu

SEQ ID NO: 137623 - RNA, 22 nt, Homo sapiens
aguaccauuccguuggagcugg

SEQ ID NO: 137624 - RNA, 21 nt, Homo sapiens
aguagcacugugucuuacaaa

SEQ ID NO: 137625 - RNA, 16 nt, Homo sapiens
aguaguuuuacagauu

SEQ ID NO: 137626 - RNA, 22 nt, Homo sapiens
aguauuuguuggaauaccuguu

SEQ ID NO: 137627 - RNA, 22 nt, Homo sapiens
agucagugcauaagaaugaagu

SEQ ID NO: 137628 - RNA, 22 nt, Homo sapiens
agucagugucuguaaggagaac

SEQ ID NO: 137629 - RNA, 22 nt, Homo sapiens
agugcauugagacuugugaguu

SEQ ID NO: 137630 - RNA, 22 nt, Homo sapiens
agugcauugcaucucugcuuca

SEQ ID NO: 137631 - RNA, 22 nt, Homo sapiens
agugguguugccuguugaccua

SEQ ID NO: 137632 - RNA, 22 nt, Homo sapiens
aguguuuuuaucaugaaagggu

SEQ ID NO: 137633 - RNA, 22 nt, Homo sapiens
auaaagacacuuggcaugauuu

SEQ ID NO: 137634 - RNA, 22 nt, Homo sapiens
auaaagcuauuccucucuuuuu

SEQ ID NO: 137635 - RNA, 22 nt, Homo sapiens
auaaaguagaggugaggugcau

SEQ ID NO: 137636 - RNA, 22 nt, Homo sapiens
auaaauaguaguugugguggcc

SEQ ID NO: 137637 - RNA, 22 nt, Homo sapiens
auaaguauuuggacuuuacugu

SEQ ID NO: 137638 - RNA, 22 nt, Homo sapiens
auaauacugggaagaugagcau

SEQ ID NO: 137639 - RNA, 22 nt, Homo sapiens
auagcaaugccccacuccuugg

SEQ ID NO: 137640 - RNA, 22 nt, Homo sapiens
auagcaauuugggaaucagacu

SEQ ID NO: 137641 - RNA, 22 nt, Homo sapiens
auagugcagugaugaaccuagg

SEQ ID NO: 137642 - RNA, 21 nt, Homo sapiens
auaugugcuguggaagucagc

SEQ ID NO: 137643 - RNA, 22 nt, Homo sapiens
auauguucucauucauaugugg

SEQ ID NO: 137644 - RNA, 22 nt, Homo sapiens
auauugguuaaauauuauguga

SEQ ID NO: 137645 - RNA, 22 nt, Homo sapiens
auauuguacugcuacugguucu

SEQ ID NO: 137646 - RNA, 20 nt, Homo sapiens
aucaaagacuuagaggggga

SEQ ID NO: 137647 - RNA, 22 nt, Homo sapiens
aucaaagccaugcucaguuuuc

SEQ ID NO: 137648 - RNA, 22 nt, Homo sapiens
aucaaguaguuauacguaaagg

SEQ ID NO: 137649 - RNA, 22 nt, Homo sapiens
aucacagauauggguuuaaauc

SEQ ID NO: 137650 - RNA, 22 nt, Homo sapiens
cauugcacuccacuccugaaca

SEQ ID NO: 137651 - RNA, 20 nt, Homo sapiens
cauugcacuccagccugcug

SEQ ID NO: 137652 - RNA, 22 nt, Homo sapiens
cauugcacuccagcuugggcga

SEQ ID NO: 137653 - RNA, 22 nt, Homo sapiens
cauugcuaaaagucauauauaa

SEQ ID NO: 137654 - RNA, 22 nt, Homo sapiens
ccacugcacuccagcccggcaa

SEQ ID NO: 137655 - RNA, 22 nt, Homo sapiens
ccacugugguaucugauacugg

SEQ ID NO: 137656 - RNA, 22 nt, Homo sapiens
ccagaauucucauuggaaggaa

SEQ ID NO: 137657 - RNA, 22 nt, Homo sapiens
ccagccgggugcaguggcucac

SEQ ID NO: 137658 - RNA, 22 nt, Homo sapiens
ccagugucugacagacacggcg

SEQ ID NO: 137659 - RNA, 22 nt, Homo sapiens
ccaguguuuggauuagggaugc

SEQ ID NO: 137660 - RNA, 22 nt, Homo sapiens
ccaugaacuagaauagaacaug

SEQ ID NO: 137661 - RNA, 22 nt, Homo sapiens
ccauggcuucugcauucuguca

SEQ ID NO: 137662 - RNA, 22 nt, Homo sapiens
cccagugugaacuuggcauuuu

SEQ ID NO: 137663 - RNA, 22 nt, Homo sapiens
cccaguguguuguggauauuua

SEQ ID NO: 137664 - RNA, 22 nt, Homo sapiens
cccaguguuacgugacagccug

SEQ ID NO: 137665 - RNA, 22 nt, Homo sapiens
ccccuguaaacuggcuucccug

SEQ ID NO: 137666 - RNA, 17 nt, Homo sapiens
cccuaguagcugggacu

SEQ ID NO: 137667 - RNA, 22 nt, Homo sapiens
cccuugcacuucagagcugcau

SEQ ID NO: 137668 - RNA, 19 nt, Homo sapiens
ccucaaguacuaauauguu

SEQ ID NO: 137669 - RNA, 19 nt, Homo sapiens
ccugcuguucuuuugcacc

SEQ ID NO: 137670 - RNA, 22 nt, Homo sapiens
ccuucauucauuaauuuagccc

SEQ ID NO: 137671 - RNA, 22 nt, Homo sapiens
ccuucuuuuguaaggcugaaua

SEQ ID NO: 137672 - RNA, 22 nt, Homo sapiens
ccuuggcacuacugacauugua

SEQ ID NO: 137673 - RNA, 22 nt, Homo sapiens
cgcaguguuugugucccugggu

SEQ ID NO: 137674 - RNA, 21 nt, Homo sapiens
cgucauggagauguguuguac

SEQ ID NO: 137675 - RNA, 23 nt, Homo sapiens
gagaccagcuucagaaagcacga

SEQ ID NO: 137676 - RNA, 22 nt, Homo sapiens
gagacggagucucgcucugucg

SEQ ID NO: 137677 - RNA, 22 nt, Homo sapiens
gagacggagucuugcucuguug

SEQ ID NO: 137678 - RNA, 22 nt, Homo sapiens
gagacugagucucacucuguca

SEQ ID NO: 137679 - RNA, 22 nt, Homo sapiens
gagacugagucucgcucugccg

SEQ ID NO: 137680 - RNA, 22 nt, Homo sapiens
gagacugagucuugcucugucg

SEQ ID NO: 137681 - RNA, 22 nt, Homo sapiens
gagacugaguuuugcucuuguu

SEQ ID NO: 137682 - RNA, 22 nt, Homo sapiens
gagaugaagugucaauaaggau

SEQ ID NO: 137683 - RNA, 22 nt, Homo sapiens
gagauuuucagcuugacuggga

SEQ ID NO: 137684 - RNA, 22 nt, Homo sapiens
gaggcacucuguacaaaucugc

SEQ ID NO: 137685 - RNA, 22 nt, Homo sapiens
gaguauuuuacaucguguaauu

SEQ ID NO: 137686 - RNA, 22 nt, Homo sapiens
gauaaagauagcaauagggaca

SEQ ID NO: 137687 - RNA, 22 nt, Homo sapiens
gauauguucugagaaaugcauu

SEQ ID NO: 137688 - RNA, 22 nt, Homo sapiens
gaucucaguggauacugugaug

SEQ ID NO: 137689 - RNA, 22 nt, Homo sapiens
gauggaguaauguaaucuugag

SEQ ID NO: 137690 - RNA, 22 nt, Homo sapiens
gauuguguucauaggcauguua

SEQ ID NO: 137691 - RNA, 22 nt, Homo sapiens
gauuuuccaguggcccugauca

SEQ ID NO: 137692 - RNA, 22 nt, Homo sapiens
gcaaaguaauuguuguuuuugc

SEQ ID NO: 137693 - RNA, 21 nt, Homo sapiens
gcaaaguggcuaccuugcucc

SEQ ID NO: 137694 - RNA, 22 nt, Homo sapiens
gcaagaguauuucaaggaagau

SEQ ID NO: 137695 - RNA, 22 nt, Homo sapiens
gcacugggccacauuuauuuuc

SEQ ID NO: 137696 - RNA, 22 nt, Homo sapiens
gcaggaaucuugagaaggauuc

SEQ ID NO: 137697 - RNA, 23 nt, Homo sapiens
gcagucauuuggaaaagguugaa

SEQ ID NO: 137698 - RNA, 22 nt, Homo sapiens
gcaguguggguagagggcaaga

SEQ ID NO: 137699 - RNA, 20 nt, Homo sapiens
gcauaugucuuuauggcagc

SEQ ID NO: 137700 - RNA, 22 nt, Homo sapiens
gcaugcacuguauuuaaguauc

SEQ ID NO: 137701 - RNA, 19 nt, Homo sapiens
uuuugcucuuuauaccuau

SEQ ID NO: 137702 - RNA, 22 nt, Homo sapiens
uuuugguucaauuaauuugcua

SEQ ID NO: 137703 - RNA, 22 nt, Homo sapiens
uuuugguuguuggguaagagua

SEQ ID NO: 137704 - RNA, 22 nt, Homo sapiens
uuuugugacuauuguaaauggg

SEQ ID NO: 137705 - RNA, 16 nt, Homo sapiens
uuuuugcagaaaugac

SEQ ID NO: 137706 - RNA, 22 nt, Homo sapiens
uuuuuggauaaugguacaugua

SEQ ID NO: 137707 - RNA, 22 nt, Homo sapiens
gugcacaacguguagguuuguu

SEQ ID NO: 137708 - RNA, 22 nt, Homo sapiens
gugcacaaugugcagguuuguu

SEQ ID NO: 137709 - RNA, 23 nt, Homo sapiens
gugcaguggcgagauuucggcuc

SEQ ID NO: 137710 - RNA, 22 nt, Homo sapiens
gugcaguuuugagugaguuucu

SEQ ID NO: 137711 - RNA, 23 nt, Homo sapiens
gugcaugagucuuuauaguagca

SEQ ID NO: 137712 - RNA, 22 nt, Homo sapiens
gugccacugcacuccggccugg

SEQ ID NO: 137713 - RNA, 21 nt, Homo sapiens
gugcuuguagccucacuucug

SEQ ID NO: 137714 - RNA, 22 nt, Homo sapiens
guggaaaacauaugcuuguuga

SEQ ID NO: 137715 - RNA, 21 nt, Homo sapiens
guggaaauggaauuuacuaau

SEQ ID NO: 137716 - RNA, 17 nt, Homo sapiens
guggaaugucaugucaa

SEQ ID NO: 137717 - RNA, 22 nt, Homo sapiens
guggaauuauagagacaucuug

SEQ ID NO: 137718 - RNA, 22 nt, Homo sapiens
guggaucacuugaggucaagag

SEQ ID NO: 137719 - RNA, 22 nt, Homo sapiens
guggcaagaugacuacucacug

SEQ ID NO: 137720 - RNA, 22 nt, Homo sapiens
guggcaguuuuaaauaugaaaa

SEQ ID NO: 137721 - RNA, 22 nt, Homo sapiens
guggcaugaaagcagauaccac

SEQ ID NO: 137722 - RNA, 21 nt, Homo sapiens
guggccuuuggagcaugucag

SEQ ID NO: 137723 - RNA, 22 nt, Homo sapiens
guggcuuuauuuagaagcaggg

SEQ ID NO: 137724 - RNA, 22 nt, Homo sapiens
gugguuuuacaaagagaaagau

SEQ ID NO: 137725 - RNA, 22 nt, Homo sapiens
gugguuuuuaaaguaccugugg

SEQ ID NO: 137726 - RNA, 22 nt, Homo sapiens
guguaaaucugcugugaacauu

SEQ ID NO: 137727 - RNA, 22 nt, Homo sapiens
guguaaaugagugcugaaggag

SEQ ID NO: 137728 - RNA, 22 nt, Homo sapiens
gugucaaggaugccugucaggc

SEQ ID NO: 137729 - RNA, 21 nt, Homo sapiens
gugucacagacaugacagaug

SEQ ID NO: 137730 - RNA, 22 nt, Homo sapiens
guguguaaauggcagugagcuc

SEQ ID NO: 137731 - RNA, 22 nt, Homo sapiens
guguuauugagaaauagggugu

SEQ ID NO: 137732 - RNA, 22 nt, Homo sapiens
guucaaggaauguuggcuucuc

SEQ ID NO: 137733 - RNA, 21 nt, Homo sapiens
guucaagugauccuccugucu

SEQ ID NO: 137734 - RNA, 22 nt, Homo sapiens
guucacaguuaggacaacugcu

SEQ ID NO: 137735 - RNA, 22 nt, Homo sapiens
guucagguauucuggaacagag

SEQ ID NO: 137736 - RNA, 22 nt, Homo sapiens
guucaguuuugaaauguuaauu

SEQ ID NO: 137737 - RNA, 22 nt, Homo sapiens
guucccaguugaaaugauuagu

SEQ ID NO: 137738 - RNA, 22 nt, Homo sapiens
guugagcaagcuuuggagccua

SEQ ID NO: 137739 - RNA, 22 nt, Homo sapiens
guugcaaaguaauugugguuuu

SEQ ID NO: 137740 - RNA, 22 nt, Homo sapiens
ugagagaugaacucugauaugu

SEQ ID NO: 137741 - RNA, 22 nt, Homo sapiens
ugagagaugauaaaauguuugu

SEQ ID NO: 137742 - RNA, 22 nt, Homo sapiens
ugagagcugguuguuuaaagga

SEQ ID NO: 137743 - RNA, 18 nt, Homo sapiens
ugagauacuagaauaggu

SEQ ID NO: 137744 - RNA, 22 nt, Homo sapiens
ugagaucaagguuaauauaauc

SEQ ID NO: 137745 - RNA, 22 nt, Homo sapiens
ugagaugagaaucaguucuaau

SEQ ID NO: 137746 - RNA, 22 nt, Homo sapiens
ugagaugaucaaaguauaggcu

SEQ ID NO: 137747 - RNA, 21 nt, Homo sapiens
ugagaugauccugcaugcaug

SEQ ID NO: 137748 - RNA, 21 nt, Homo sapiens
ugagaugcaaucaccagggag

SEQ ID NO: 137749 - RNA, 22 nt, Homo sapiens
ugagauuguaucugcaaugugu

SEQ ID NO: 137750 - RNA, 22 nt, Homo sapiens
ugagcaaaauuuuggacauaga

SEQ ID NO: 137751 - RNA, 22 nt, Homo sapiens
ugagcacagcgugugggagagc

SEQ ID NO: 137752 - RNA, 22 nt, Homo sapiens
ugagcacauuuacaucaguucc

SEQ ID NO: 137753 - RNA, 22 nt, Homo sapiens
ugagcagagaagugcccugcgc

SEQ ID NO: 137754 - RNA, 22 nt, Homo sapiens
ugagccaugguuagcuucucau

SEQ ID NO: 137755 - RNA, 22 nt, Homo sapiens
ugagcuauguucuucuuguuuu

SEQ ID NO: 137756 - RNA, 22 nt, Homo sapiens
ugagcucagcuaguugaggugu

SEQ ID NO: 137757 - RNA, 22 nt, Homo sapiens
ugagcucaugcauucuugagga

SEQ ID NO: 137758 - RNA, 22 nt, Homo sapiens
ugagcuccuucauaaaaaggca

SEQ ID NO: 137759 - RNA, 22 nt, Homo sapiens
ugaggucuuuauuuagugcuca

SEQ ID NO: 137760 - RNA, 23 nt, Homo sapiens
ugagguguuaagcagacuugucu

SEQ ID NO: 137761 - RNA, 22 nt, Homo sapiens
ugaguagcuaauguuuacugag

SEQ ID NO: 137762 - RNA, 23 nt, Homo sapiens
ugaguaggugguuuuccccucac

SEQ ID NO: 137763 - RNA, 22 nt, Homo sapiens
ugaguauagaucaguucaagug

SEQ ID NO: 137764 - RNA, 22 nt, Homo sapiens
ugagucaauggaggcucagagc

SEQ ID NO: 137765 - RNA, 22 nt, Homo sapiens
ugagucaauucuaacaauggca

SEQ ID NO: 137766 - RNA, 22 nt, Homo sapiens
ugagucuguuccaaagaaauaa

SEQ ID NO: 137767 - RNA, 22 nt, Homo sapiens
ugagugccuggagggcagggac

SEQ ID NO: 137768 - RNA, 22 nt, Homo sapiens
ugaguuguaggggucaccuggc

SEQ ID NO: 137769 - RNA, 23 nt, Homo sapiens
ugauaacagcauaugaagauucu

SEQ ID NO: 137770 - RNA, 22 nt, Homo sapiens
ugaucacagcuugacuaaagga

SEQ ID NO: 137771 - RNA, 21 nt, Homo sapiens
ugaucacaugaaaaccaugca

SEQ ID NO: 137772 - RNA, 22 nt, Homo sapiens
ugauggcauuuggaguugggac

SEQ ID NO: 137773 - RNA, 22 nt, Homo sapiens
ugaugguguuaccaucuuuacu

SEQ ID NO: 137774 - RNA, 22 nt, Homo sapiens
ugauuggagaugaauuucguuu

SEQ ID NO: 137775 - RNA, 22 nt, Homo sapiens
ugauuguucuguccccaggggc

SEQ ID NO: 137776 - RNA, 22 nt, Homo sapiens
ugauuuccaugagaacaugccu

SEQ ID NO: 137777 - RNA, 22 nt, Homo sapiens
ugcaaagucgaaacugcaguuu

SEQ ID NO: 137778 - RNA, 22 nt, Homo sapiens
ugcaagaaacauauuccacaag

SEQ ID NO: 137779 - RNA, 21 nt, Homo sapiens
ugcaagaaucaggaagcugcc

SEQ ID NO: 137780 - RNA, 22 nt, Homo sapiens
ugcaauauccucuacuauaggu

SEQ ID NO: 137781 - RNA, 22 nt, Homo sapiens
ugcaaugucuucugaggggagc

SEQ ID NO: 137782 - RNA, 23 nt, Homo sapiens
ugcaccacuacacacucuugggu

SEQ ID NO: 137783 - RNA, 22 nt, Homo sapiens
ugcaccacuacacuccaggcug

SEQ ID NO: 137784 - RNA, 22 nt, Homo sapiens
ugcaccacugcaccccagucug

SEQ ID NO: 137785 - RNA, 22 nt, Homo sapiens
ugcaccacugcacuccagcuug

SEQ ID NO: 137786 - RNA, 22 nt, Homo sapiens
ugcaccacugcacuccaggcug

SEQ ID NO: 137787 - RNA, 22 nt, Homo sapiens
ugcaccauuacacuccaggcug

SEQ ID NO: 137788 - RNA, 22 nt, Homo sapiens
ugcaccauugucaccuggguga

SEQ ID NO: 137789 - RNA, 17 nt, Homo sapiens
ugcaccauuugauuuuu

SEQ ID NO: 137790 - RNA, 22 nt, Homo sapiens
ugcacuguggucugagagacag

SEQ ID NO: 137791 - RNA, 19 nt, Homo sapiens
ugcagcaauguaaaagaca

SEQ ID NO: 137792 - RNA, 22 nt, Homo sapiens
ugcagcacuguucacaauagcc

SEQ ID NO: 137793 - RNA, 21 nt, Homo sapiens
ugcagccauucagcccuaugc

SEQ ID NO: 137794 - RNA, 22 nt, Homo sapiens
ugcagugugauuuucuggcuga

SEQ ID NO: 137795 - RNA, 22 nt, Homo sapiens
ugcaguguggcucacgccugua

SEQ ID NO: 137796 - RNA, 21 nt, Homo sapiens
ugcagugugguugcccugcug

SEQ ID NO: 137797 - RNA, 22 nt, Homo sapiens
ugcauggaagggagggaaagag

SEQ ID NO: 137798 - RNA, 22 nt, Homo sapiens
ugcauggaggagcuccccgcag

SEQ ID NO: 137799 - RNA, 22 nt, Homo sapiens
ugcauguucuuacucauacaug

SEQ ID NO: 137800 - RNA, 22 nt, Homo sapiens
guguucaaagcugauugagauu

SEQ ID NO: 137801 - RNA, 22 nt, Homo sapiens
guguucaaauucugacagagag

SEQ ID NO: 137802 - RNA, 22 nt, Homo sapiens
guucaguaguucauucauuuau

SEQ ID NO: 137803 - RNA, 22 nt, Homo sapiens
guugauguugcagucuugagga

SEQ ID NO: 137804 - RNA, 22 nt, Homo sapiens
guugcaauugauguaugucuga

SEQ ID NO: 137805 - RNA, 22 nt, Homo sapiens
guugcucaggcuggagugcagu

SEQ ID NO: 137806 - RNA, 22 nt, Homo sapiens
guuggguaauggggcgcaccgu

SEQ ID NO: 137807 - RNA, 22 nt, Homo sapiens
guugguuuccuguaacuggaca

SEQ ID NO: 137808 - RNA, 22 nt, Homo sapiens
uaaaagucaucacaacuggagu

SEQ ID NO: 137809 - RNA, 22 nt, Homo sapiens
uaaacugucuugcaguuacaug

SEQ ID NO: 137810 - RNA, 17 nt, Homo sapiens
uaaagccagucaaguca

SEQ ID NO: 137811 - RNA, 22 nt, Homo sapiens
uaaaugcuugagaugauggaua

SEQ ID NO: 137812 - RNA, 22 nt, Homo sapiens
uaaauggauauugccaucuccu

SEQ ID NO: 137813 - RNA, 22 nt, Homo sapiens
uaacaccuuugauagcacuuuu

SEQ ID NO: 137814 - RNA, 22 nt, Homo sapiens
uaacugcaaccuccgccucccg

SEQ ID NO: 137815 - RNA, 22 nt, Homo sapiens
uaacugcaaccucugccugcug

SEQ ID NO: 137816 - RNA, 22 nt, Homo sapiens
uaagacuguguaauuuaugaag

SEQ ID NO: 137817 - RNA, 22 nt, Homo sapiens
uaagcucauuccagccaugucc

SEQ ID NO: 137818 - RNA, 22 nt, Homo sapiens
uaaguacuuuacagacauuauc

SEQ ID NO: 137819 - RNA, 22 nt, Homo sapiens
uaaguauuaugugcugcauuuu

SEQ ID NO: 137820 - RNA, 22 nt, Homo sapiens
uaauacauucaaggugguaguu

SEQ ID NO: 137821 - RNA, 22 nt, Homo sapiens
uaauacuguaauggugguuccg

SEQ ID NO: 137822 - RNA, 19 nt, Homo sapiens
uaaugccacugccuggcau

SEQ ID NO: 137823 - RNA, 22 nt, Homo sapiens
uaaugcuugguuguuuggaaaa

SEQ ID NO: 137824 - RNA, 22 nt, Homo sapiens
uacaaaguaacaguuccuguau

SEQ ID NO: 137825 - RNA, 16 nt, Homo sapiens
uacaacagugaguaug

SEQ ID NO: 137826 - RNA, 22 nt, Homo sapiens
uacaagcuaaaauggaagauca

SEQ ID NO: 137827 - RNA, 21 nt, Homo sapiens
uacaagcuguagcacaugcca

SEQ ID NO: 137828 - RNA, 22 nt, Homo sapiens
uacaaguaauaagggaagaauu

SEQ ID NO: 137829 - RNA, 16 nt, Homo sapiens
uacaauguagaaaaca

SEQ ID NO: 137830 - RNA, 22 nt, Homo sapiens
uacagaauauuucugcccugag

SEQ ID NO: 137831 - RNA, 22 nt, Homo sapiens
uacagccacauaauguaugauu

SEQ ID NO: 137832 - RNA, 22 nt, Homo sapiens
uacagguaugugucuauauaca

SEQ ID NO: 137833 - RNA, 22 nt, Homo sapiens
uacaggugcucuacagacagga

SEQ ID NO: 137834 - RNA, 22 nt, Homo sapiens
uacagucuggaggccuguguug

SEQ ID NO: 137835 - RNA, 22 nt, Homo sapiens
uacagugcauagaggcaugaua

SEQ ID NO: 137836 - RNA, 22 nt, Homo sapiens
uacauacuucacagacuuuaaa

SEQ ID NO: 137837 - RNA, 22 nt, Homo sapiens
uacauguauguguuuauggcug

SEQ ID NO: 137838 - RNA, 22 nt, Homo sapiens
uaccucaguucaauaacagaua

SEQ ID NO: 137839 - RNA, 19 nt, Homo sapiens
uacuggcucgggaauuuuc

SEQ ID NO: 137840 - RNA, 22 nt, Homo sapiens
uacuguacugcaguucugcaaa

SEQ ID NO: 137841 - RNA, 22 nt, Homo sapiens
uagaaagcaugaccuucagaua

SEQ ID NO: 137842 - RNA, 22 nt, Homo sapiens
uagaaguaggcuacgugucugg

SEQ ID NO: 137843 - RNA, 22 nt, Homo sapiens
uagacacugcauauuuuuuuaa

SEQ ID NO: 137844 - RNA, 22 nt, Homo sapiens
uagaccaauuggcauauaguaa

SEQ ID NO: 137845 - RNA, 22 nt, Homo sapiens
uagagagcuguuugaaagcagg

SEQ ID NO: 137846 - RNA, 22 nt, Homo sapiens
uagagauaucaauuucauggug

SEQ ID NO: 137847 - RNA, 22 nt, Homo sapiens
uagagcuaguugcucacugcuu

SEQ ID NO: 137848 - RNA, 21 nt, Homo sapiens
uagaugguguucuagagagaa

SEQ ID NO: 137849 - RNA, 19 nt, Homo sapiens
uagcacagggucccagacu

SEQ ID NO: 137850 - RNA, 21 nt, Homo sapiens
uagcucagugguguugccaua

SEQ ID NO: 137851 - RNA, 22 nt, Homo sapiens
uaggacaaugguacagcagaaa

SEQ ID NO: 137852 - RNA, 22 nt, Homo sapiens
uaggcagccagcuguggauuga

SEQ ID NO: 137853 - RNA, 22 nt, Homo sapiens
uaggcuguguggccguggggcu

SEQ ID NO: 137854 - RNA, 19 nt, Homo sapiens
uagggcacgaggcagaguc

SEQ ID NO: 137855 - RNA, 22 nt, Homo sapiens
uaggugauugaagguggaaugu

SEQ ID NO: 137856 - RNA, 22 nt, Homo sapiens
uagucacacacucaacuuuuca

SEQ ID NO: 137857 - RNA, 22 nt, Homo sapiens
uagugcugagauugagaagccc

SEQ ID NO: 137858 - RNA, 22 nt, Homo sapiens
uauaacaaugcaagaauggccu

SEQ ID NO: 137859 - RNA, 20 nt, Homo sapiens
uauaacaguuuggacccagu

SEQ ID NO: 137860 - RNA, 22 nt, Homo sapiens
uauacaugugccauguuggugu

SEQ ID NO: 137861 - RNA, 22 nt, Homo sapiens
uauagcuaugggauguauuugc

SEQ ID NO: 137862 - RNA, 21 nt, Homo sapiens
uauaguaguaugauuuacaau

SEQ ID NO: 137863 - RNA, 22 nt, Homo sapiens
uauaugucuucuuguaauuggc

SEQ ID NO: 137864 - RNA, 22 nt, Homo sapiens
uaucaagauggauaaggauaga

SEQ ID NO: 137865 - RNA, 22 nt, Homo sapiens
aaacugaucugaaggccaggcu

SEQ ID NO: 137866 - RNA, 19 nt, Homo sapiens
aaagguaguaaccucugau

SEQ ID NO: 137867 - RNA, 22 nt, Homo sapiens
aaaguguuucugcaguagguuu

SEQ ID NO: 137868 - RNA, 19 nt, Homo sapiens
aaaguguuuuaaagaggau

SEQ ID NO: 137869 - RNA, 22 nt, Homo sapiens
aaaguucuguugauagugcuga

SEQ ID NO: 137870 - RNA, 22 nt, Homo sapiens
aaaguucuugcugaaggauuau

SEQ ID NO: 137871 - RNA, 22 nt, Homo sapiens
aaaugcacaaagauuuugcacu

SEQ ID NO: 137872 - RNA, 22 nt, Homo sapiens
aaaugcagauuccuaggcccca

SEQ ID NO: 137873 - RNA, 22 nt, Homo sapiens
aaaugcauugagggaaaaggca

SEQ ID NO: 137874 - RNA, 22 nt, Homo sapiens
aaaugcuucuauguggcauguu

SEQ ID NO: 137875 - RNA, 22 nt, Homo sapiens
aaaugcuuucuuggaccauuug

SEQ ID NO: 137876 - RNA, 22 nt, Homo sapiens
aaauggcuuuuugggcaaggug

SEQ ID NO: 137877 - RNA, 22 nt, Homo sapiens
aaaugucauggaguguuucccc

SEQ ID NO: 137878 - RNA, 22 nt, Homo sapiens
aaauugcacaaguggugauuug

SEQ ID NO: 137879 - RNA, 22 nt, Homo sapiens
aacaccauuuuucugcagccuu

SEQ ID NO: 137880 - RNA, 22 nt, Homo sapiens
aacaccuugcagggauuaugac

SEQ ID NO: 137881 - RNA, 22 nt, Homo sapiens
aacagcacacccgcugcuucca

SEQ ID NO: 137882 - RNA, 22 nt, Homo sapiens
aaccuauaguauugaaaucaag

SEQ ID NO: 137883 - RNA, 22 nt, Homo sapiens
aaccuuuagucagcucuuagga

SEQ ID NO: 137884 - RNA, 22 nt, Homo sapiens
aacucugucuccuucaaguuca

SEQ ID NO: 137885 - RNA, 19 nt, Homo sapiens
aacuggugugagaugguau

SEQ ID NO: 137886 - RNA, 21 nt, Homo sapiens
aacuggugugagaugguaugu

SEQ ID NO: 137887 - RNA, 22 nt, Homo sapiens
aagaggcuguaggauaaugccu

SEQ ID NO: 137888 - RNA, 22 nt, Homo sapiens
aagagguuauagaguguauacu

SEQ ID NO: 137889 - RNA, 22 nt, Homo sapiens
aagcuggagugcaguggugcaa

SEQ ID NO: 137890 - RNA, 22 nt, Homo sapiens
aagcuggagugcaguggugcga

SEQ ID NO: 137891 - RNA, 22 nt, Homo sapiens
aagcugugucuugucagcuacc

SEQ ID NO: 137892 - RNA, 22 nt, Homo sapiens
aaggagcagagagcccuguuuc

SEQ ID NO: 137893 - RNA, 22 nt, Homo sapiens
aagguagcugagugaagugguu

SEQ ID NO: 137894 - RNA, 22 nt, Homo sapiens
aaggugcucucuuauguagaaa

SEQ ID NO: 137895 - RNA, 22 nt, Homo sapiens
aaguaaacauugagagacaaga

SEQ ID NO: 137896 - RNA, 22 nt, Homo sapiens
aaguaaaucuuaugucagggag

SEQ ID NO: 137897 - RNA, 22 nt, Homo sapiens
aaguacuguuuaaauugcagaa

SEQ ID NO: 137898 - RNA, 19 nt, Homo sapiens
aaguacuugucuuuugaag

SEQ ID NO: 137899 - RNA, 22 nt, Homo sapiens
aaguagcagaggcaagacuuga

SEQ ID NO: 137900 - RNA, 22 nt, Homo sapiens
aaguagcuggaugcaguggcac

SEQ ID NO: 137901 - RNA, 22 nt, Homo sapiens
aaguauguaucaagucauacuu

SEQ ID NO: 137902 - RNA, 22 nt, Homo sapiens
aagugaaugugcuggaauagcu

SEQ ID NO: 137903 - RNA, 22 nt, Homo sapiens
aagugacauugugcccauuuga

SEQ ID NO: 137904 - RNA, 22 nt, Homo sapiens
aagugcucuugugggaagagag

SEQ ID NO: 137905 - RNA, 22 nt, Homo sapiens
aauaaaguaggaggugaggaaa

SEQ ID NO: 137906 - RNA, 22 nt, Homo sapiens
aauaaugucacaggggguuagc

SEQ ID NO: 137907 - RNA, 19 nt, Homo sapiens
aauauugacaguggugucu

SEQ ID NO: 137908 - RNA, 22 nt, Homo sapiens
aaucacaggucuuggcugcaug

SEQ ID NO: 137909 - RNA, 22 nt, Homo sapiens
aaucacaguguucuugugaggg

SEQ ID NO: 137910 - RNA, 22 nt, Homo sapiens
aauccaugugcuuuaccauuuu

SEQ ID NO: 137911 - RNA, 22 nt, Homo sapiens
aauccugucuugccauccaaua

SEQ ID NO: 137912 - RNA, 22 nt, Homo sapiens
aaucucaacacuuugggaggcu

SEQ ID NO: 137913 - RNA, 22 nt, Homo sapiens
aaucuguagaaggugcacauuc

SEQ ID NO: 137914 - RNA, 22 nt, Homo sapiens
aaugaaguuagauguugagaag

SEQ ID NO: 137915 - RNA, 22 nt, Homo sapiens
aaugacugugauauuuuucuuc

SEQ ID NO: 137916 - RNA, 22 nt, Homo sapiens
aaugcacauauauuuccuuauu

SEQ ID NO: 137917 - RNA, 22 nt, Homo sapiens
aaugccaucagagaaaacucuu

SEQ ID NO: 137918 - RNA, 22 nt, Homo sapiens
aauggcaaauguuuucuguuga

SEQ ID NO: 137919 - RNA, 22 nt, Homo sapiens
aauggcaagagccacagaggcg

SEQ ID NO: 137920 - RNA, 22 nt, Homo sapiens
aauggcucuuuaggcaauagau

SEQ ID NO: 137921 - RNA, 22 nt, Homo sapiens
aaugugcacuuggagccuugcu

SEQ ID NO: 137922 - RNA, 22 nt, Homo sapiens
aauuacuucuacaccaaccuaa

SEQ ID NO: 137923 - RNA, 22 nt, Homo sapiens
aauugcaucuguucuuugccag

SEQ ID NO: 137924 - RNA, 22 nt, Homo sapiens
acaaagcuagggaauccaucuu

SEQ ID NO: 137925 - RNA, 20 nt, Homo sapiens
acaaaugcauucugugacau

SEQ ID NO: 137926 - RNA, 22 nt, Homo sapiens
acaagacuucuuguauucuagu

SEQ ID NO: 137927 - RNA, 22 nt, Homo sapiens
acacaugcuccacuguggccuc

SEQ ID NO: 137928 - RNA, 22 nt, Homo sapiens
acaccuguggucccaguaacuu

SEQ ID NO: 137929 - RNA, 22 nt, Homo sapiens
acagaccuauuucaaucauuua

SEQ ID NO: 137930 - RNA, 22 nt, Homo sapiens
acagcacugccaagugacccau

SEQ ID NO: 137931 - RNA, 20 nt, Homo sapiens
acagcacugguuucaagcaa

SEQ ID NO: 137932 - RNA, 22 nt, Homo sapiens
acagguacacagaauauccaga

SEQ ID NO: 137933 - RNA, 22 nt, Homo sapiens
acaguacaugauaaauaaggua

SEQ ID NO: 137934 - RNA, 22 nt, Homo sapiens
acagugcuguuguguuuucacg

SEQ ID NO: 137935 - RNA, 18 nt, Homo sapiens
acagugucauggcucaau

SEQ ID NO: 137936 - RNA, 19 nt, Homo sapiens
acagugucucuauaaugau

SEQ ID NO: 137937 - RNA, 22 nt, Homo sapiens
acauauaaggagacuagggcau

SEQ ID NO: 137938 - RNA, 22 nt, Homo sapiens
acccagaauucagucuuaggcc

SEQ ID NO: 137939 - RNA, 22 nt, Homo sapiens
accccugugacggguauuugag

SEQ ID NO: 137940 - RNA, 22 nt, Homo sapiens
acccugcuaaacagcccccugc

SEQ ID NO: 137941 - RNA, 22 nt, Homo sapiens
accugagacuaggcauuuuaua

SEQ ID NO: 137942 - RNA, 22 nt, Homo sapiens
accugggugcugaugggcuuua

SEQ ID NO: 137943 - RNA, 22 nt, Homo sapiens
acucuguugucuggccuuccug

SEQ ID NO: 137944 - RNA, 22 nt, Homo sapiens
acugaauguaaacacggagugu

SEQ ID NO: 137945 - RNA, 22 nt, Homo sapiens
acugcacuccagccuuggcaac

SEQ ID NO: 137946 - RNA, 22 nt, Homo sapiens
acugcacucuagccuuggcaac

SEQ ID NO: 137947 - RNA, 22 nt, Homo sapiens
acugcacuucagccuuggcuac

SEQ ID NO: 137948 - RNA, 22 nt, Homo sapiens
acuggauguuagggauuuuauu

SEQ ID NO: 137949 - RNA, 22 nt, Homo sapiens
acuggcuguuaggaauuaccuc

SEQ ID NO: 137950 - RNA, 22 nt, Homo sapiens
acuggcuuuugagaaaaacacu

SEQ ID NO: 137951 - RNA, 22 nt, Homo sapiens
acuuggcaaaguuuuaaacagc

SEQ ID NO: 137952 - RNA, 21 nt, Homo sapiens
acuuuguugggggcugaggca

SEQ ID NO: 137953 - RNA, 20 nt, Homo sapiens
acuuuuugaugaggucguuu

SEQ ID NO: 137954 - RNA, 22 nt, Homo sapiens
agaaauguuuacucacccccuu

SEQ ID NO: 137955 - RNA, 22 nt, Homo sapiens
agaacuguccauucagcaugaa

SEQ ID NO: 137956 - RNA, 20 nt, Homo sapiens
agaagcauugcucucuucag

SEQ ID NO: 137957 - RNA, 22 nt, Homo sapiens
agaaugugaccuuauuuggaga

SEQ ID NO: 137958 - RNA, 20 nt, Homo sapiens
agacaguguggagauuccuu

SEQ ID NO: 137959 - RNA, 22 nt, Homo sapiens
agagaucauuuuguuucaaauc

SEQ ID NO: 137960 - RNA, 22 nt, Homo sapiens
agagccacacucuccuaacuca

SEQ ID NO: 137961 - RNA, 22 nt, Homo sapiens
agauaugucugcuauuugcugu

SEQ ID NO: 137962 - RNA, 22 nt, Homo sapiens
agauggugugcuaggaaaugua

SEQ ID NO: 137963 - RNA, 22 nt, Homo sapiens
agcaacaucagcagcaggaaaa

SEQ ID NO: 137964 - RNA, 22 nt, Homo sapiens
agcacacuggguggcuuaaaca

SEQ ID NO: 137965 - RNA, 22 nt, Homo sapiens
agcacauuaguaucuaagaaca

SEQ ID NO: 137966 - RNA, 22 nt, Homo sapiens
agcagagcauauucauucgggg

SEQ ID NO: 137967 - RNA, 22 nt, Homo sapiens
agcagcaugcaaauggacuaau

SEQ ID NO: 137968 - RNA, 22 nt, Homo sapiens
agcaggacaauaugggaucagg

SEQ ID NO: 137969 - RNA, 22 nt, Homo sapiens
agcagguguccacaauguuugc

SEQ ID NO: 137970 - RNA, 22 nt, Homo sapiens
agcccauguggcugaggcuucu

SEQ ID NO: 137971 - RNA, 22 nt, Homo sapiens
guugcacagucuuuccuggacu

SEQ ID NO: 137972 - RNA, 22 nt, Homo sapiens
guugcucaggccggagugcagu

SEQ ID NO: 137973 - RNA, 22 nt, Homo sapiens
guugcugagucccaucaccaga

SEQ ID NO: 137974 - RNA, 22 nt, Homo sapiens
guuggugaccugaagagaguaa

SEQ ID NO: 137975 - RNA, 22 nt, Homo sapiens
guuugguugcauggaaaauuua

SEQ ID NO: 137976 - RNA, 22 nt, Homo sapiens
uaaagagcuuuugaggugucau

SEQ ID NO: 137977 - RNA, 22 nt, Homo sapiens
uaaagauaaggcucgcuuggau

SEQ ID NO: 137978 - RNA, 22 nt, Homo sapiens
uaaagccagugauuaugucucu

SEQ ID NO: 137979 - RNA, 22 nt, Homo sapiens
uaaaugacugucaguagaugaa

SEQ ID NO: 137980 - RNA, 22 nt, Homo sapiens
uaacaacauucuaacugacggc

SEQ ID NO: 137981 - RNA, 22 nt, Homo sapiens
uaacacagagcuccuaaucccu

SEQ ID NO: 137982 - RNA, 19 nt, Homo sapiens
uaacacaguuguguuugag

SEQ ID NO: 137983 - RNA, 22 nt, Homo sapiens
uaacuauagagaauguugagua

SEQ ID NO: 137984 - RNA, 22 nt, Homo sapiens
uaagccaccgugccuggccuaa

SEQ ID NO: 137985 - RNA, 22 nt, Homo sapiens
uaaggcaaaccuuggcugcagu

SEQ ID NO: 137986 - RNA, 22 nt, Homo sapiens
uaaggcaaucagucaugguguu

SEQ ID NO: 137987 - RNA, 22 nt, Homo sapiens
uaagggacgcccccuucucucu

SEQ ID NO: 137988 - RNA, 22 nt, Homo sapiens
uaagggcacuaaucccauuuau

SEQ ID NO: 137989 - RNA, 22 nt, Homo sapiens
uaaguacaugcuagauggaaug

SEQ ID NO: 137990 - RNA, 22 nt, Homo sapiens
uaagugaauauggacaguuagc

SEQ ID NO: 137991 - RNA, 22 nt, Homo sapiens
uaagugaauuucacuacugagu

SEQ ID NO: 137992 - RNA, 20 nt, Homo sapiens
uaagugcuugaugaaugaac

SEQ ID NO: 137993 - RNA, 22 nt, Homo sapiens
uaauaauguuaggcuuacucaa

SEQ ID NO: 137994 - RNA, 22 nt, Homo sapiens
uaauagagucauuauuauuguu

SEQ ID NO: 137995 - RNA, 22 nt, Homo sapiens
uaauagcaguguuacuaggacu

SEQ ID NO: 137996 - RNA, 22 nt, Homo sapiens
uaauaguguuaaugcuagagcu

SEQ ID NO: 137997 - RNA, 22 nt, Homo sapiens
uaauauguuuugaaaucaggaa

SEQ ID NO: 137998 - RNA, 22 nt, Homo sapiens
uaauccugucuugaccaucagg

SEQ ID NO: 137999 - RNA, 22 nt, Homo sapiens
uaaugcaucagugguaguucuu

SEQ ID NO: 138000 - RNA, 22 nt, Homo sapiens
uaauucacauaaagcacuuaga

SEQ ID NO: 138001 - RNA, 22 nt, Homo sapiens
uacaaagcuacucgagggcagg

SEQ ID NO: 138002 - RNA, 22 nt, Homo sapiens
uacaaagcuuucugcaaaucau

SEQ ID NO: 138003 - RNA, 22 nt, Homo sapiens
uacagaauucugucccuugagu

SEQ ID NO: 138004 - RNA, 22 nt, Homo sapiens
uacagaucaguuauuuuguaga

SEQ ID NO: 138005 - RNA, 22 nt, Homo sapiens
uacagguauagauguguguucu

SEQ ID NO: 138006 - RNA, 22 nt, Homo sapiens
uacaguaauguuaaucuuugug

SEQ ID NO: 138007 - RNA, 22 nt, Homo sapiens
uacaguggaaguuaaccccauu

SEQ ID NO: 138008 - RNA, 22 nt, Homo sapiens
uacaguggugugaucucagcuc

SEQ ID NO: 138009 - RNA, 22 nt, Homo sapiens
uacauacuguaugguucuguuu

SEQ ID NO: 138010 - RNA, 23 nt, Homo sapiens
uaccacauuccuucuuuccuguu

SEQ ID NO: 138011 - RNA, 22 nt, Homo sapiens
uacugcacauaugaagguuccc

SEQ ID NO: 138012 - RNA, 22 nt, Homo sapiens
uacugcuuaagggcaugggccc

SEQ ID NO: 138013 - RNA, 22 nt, Homo sapiens
uagaaugaaacaagcugugccu

SEQ ID NO: 138014 - RNA, 22 nt, Homo sapiens
uagagcacagugauuagaccua

SEQ ID NO: 138015 - RNA, 22 nt, Homo sapiens
uagagcuacagcccucacuguc

SEQ ID NO: 138016 - RNA, 22 nt, Homo sapiens
uagaggaaugaauuuggccaga

SEQ ID NO: 138017 - RNA, 19 nt, Homo sapiens
uagaugucuuugcauagau

SEQ ID NO: 138018 - RNA, 22 nt, Homo sapiens
uagcaggaaaccuguguugagg

SEQ ID NO: 138019 - RNA, 21 nt, Homo sapiens
uagcugcacccaggccuccuu

SEQ ID NO: 138020 - RNA, 22 nt, Homo sapiens
uagcugcauccugugcacucaa

SEQ ID NO: 138021 - RNA, 22 nt, Homo sapiens
uagcuggaauuacuugcaccug

SEQ ID NO: 138022 - RNA, 22 nt, Homo sapiens
uagguagaacccagaaaucuga

SEQ ID NO: 138023 - RNA, 22 nt, Homo sapiens
uagguaguaaauugauagagga

SEQ ID NO: 138024 - RNA, 21 nt, Homo sapiens
uagugcagugggguaugacuu

SEQ ID NO: 138025 - RNA, 22 nt, Homo sapiens
uaucaagaugacaaacuuugcu

SEQ ID NO: 138026 - RNA, 21 nt, Homo sapiens
uaucacaguagaauaggaucu

SEQ ID NO: 138027 - RNA, 22 nt, Homo sapiens
uaucaccuugguagucuugggg

SEQ ID NO: 138028 - RNA, 22 nt, Homo sapiens
uaucagcacaguggguucaugg

SEQ ID NO: 138029 - RNA, 22 nt, Homo sapiens
uaucucacauauucaguagguu

SEQ ID NO: 138030 - RNA, 18 nt, Homo sapiens
uaucucauuucuuagguc

SEQ ID NO: 138031 - RNA, 22 nt, Homo sapiens
uaugcacacacguguuuaugug

SEQ ID NO: 138032 - RNA, 22 nt, Homo sapiens
uaugcagacauuguuccaacca

SEQ ID NO: 138033 - RNA, 22 nt, Homo sapiens
uauggaaaucuuaccuuauggu

SEQ ID NO: 138034 - RNA, 22 nt, Homo sapiens
uauggcuacuacgaauaaugcu

SEQ ID NO: 138035 - RNA, 22 nt, Homo sapiens
uauggcucuauuuccuugucua

SEQ ID NO: 138036 - RNA, 22 nt, Homo sapiens
uaugugcaaauuaauugcuaga

SEQ ID NO: 138037 - RNA, 20 nt, Homo sapiens
uauuacagaguaauggugga

SEQ ID NO: 138038 - RNA, 22 nt, Homo sapiens
uauuacauccauaggcucugcu

SEQ ID NO: 138039 - RNA, 22 nt, Homo sapiens
uauugcuuuacucucuuauccu

SEQ ID NO: 138040 - RNA, 22 nt, Homo sapiens
uauugcuuuuaacccaaucucu

SEQ ID NO: 138041 - RNA, 22 nt, Homo sapiens
ucaaaaucucuuagcugugucu

SEQ ID NO: 138042 - RNA, 22 nt, Homo sapiens
ucaaaguagaaaaggggcaauu

SEQ ID NO: 138043 - RNA, 22 nt, Homo sapiens
ucaaaguauucuucugagaacc

SEQ ID NO: 138044 - RNA, 22 nt, Homo sapiens
ucaaaugcuguauuguaguaau

SEQ ID NO: 138045 - RNA, 22 nt, Homo sapiens
ucaaauguuuguuuaaggcuua

SEQ ID NO: 138046 - RNA, 22 nt, Homo sapiens
ucaacugcuugagaucacaaau

SEQ ID NO: 138047 - RNA, 18 nt, Homo sapiens
ucaauguggauguucuuu

SEQ ID NO: 138048 - RNA, 19 nt, Homo sapiens
ucaauucugucaauggcuu

SEQ ID NO: 138049 - RNA, 22 nt, Homo sapiens
ucacaagcuccugccuuugcuu

SEQ ID NO: 138050 - RNA, 22 nt, Homo sapiens
ucacaaggcaggaaugaaaggg

SEQ ID NO: 138051 - RNA, 22 nt, Homo sapiens
ucacaauucucaauuugugaaa

SEQ ID NO: 138052 - RNA, 19 nt, Homo sapiens
ucacacuguggcuucuuua

SEQ ID NO: 138053 - RNA, 22 nt, Homo sapiens
ucacagaugaggcgagaggcag

SEQ ID NO: 138054 - RNA, 22 nt, Homo sapiens
ucacaguaaauccagaagaaau

SEQ ID NO: 138055 - RNA, 22 nt, Homo sapiens
ucacaguagagcuucuuucaga

SEQ ID NO: 138056 - RNA, 22 nt, Homo sapiens
ucacagucaaaguaaucauaga

SEQ ID NO: 138057 - RNA, 22 nt, Homo sapiens
ucacauagcauaaugucugcaa

SEQ ID NO: 138058 - RNA, 18 nt, Homo sapiens
ucacauggccgagagaga

SEQ ID NO: 138059 - RNA, 22 nt, Homo sapiens
ucacauuaagcuguuauuucuu

SEQ ID NO: 138060 - RNA, 20 nt, Homo sapiens
ucacccugacaucugcccag

SEQ ID NO: 138061 - RNA, 18 nt, Homo sapiens
ucaccuugcuuuuagaac

SEQ ID NO: 138062 - RNA, 23 nt, Homo sapiens
ucacggagaccugcaagaccaau

SEQ ID NO: 138063 - RNA, 22 nt, Homo sapiens
ucacgugguucauaaggcagaa

SEQ ID NO: 138064 - RNA, 22 nt, Homo sapiens
ucacugaaaccacugccuccug

SEQ ID NO: 138065 - RNA, 22 nt, Homo sapiens
ucacugaaaccgccuccaccuc

SEQ ID NO: 138066 - RNA, 22 nt, Homo sapiens
cugggaugauguaaauaggcua

SEQ ID NO: 138067 - RNA, 22 nt, Homo sapiens
cugguuguuacaaagagccugg

SEQ ID NO: 138068 - RNA, 22 nt, Homo sapiens
cugguuguuacaugcuugccag

SEQ ID NO: 138069 - RNA, 22 nt, Homo sapiens
cugguuguucuggaugggcagg

SEQ ID NO: 138070 - RNA, 22 nt, Homo sapiens
cugucucagccucuccaguagc

SEQ ID NO: 138071 - RNA, 22 nt, Homo sapiens
cugugaucuuuuuucauguggu

SEQ ID NO: 138072 - RNA, 22 nt, Homo sapiens
cuuagcaaugucguguacucac

SEQ ID NO: 138073 - RNA, 22 nt, Homo sapiens
cuucaaaguuggcuaggagaca

SEQ ID NO: 138074 - RNA, 20 nt, Homo sapiens
cuugaagacuaugcugcuga

SEQ ID NO: 138075 - RNA, 22 nt, Homo sapiens
cuugauagugguaaucauuuuu

SEQ ID NO: 138076 - RNA, 22 nt, Homo sapiens
cuuggcacgugauagguguuga

SEQ ID NO: 138077 - RNA, 22 nt, Homo sapiens
cuuggcacugcucacccuccuu

SEQ ID NO: 138078 - RNA, 22 nt, Homo sapiens
cuugggcagugugcauguguau

SEQ ID NO: 138079 - RNA, 22 nt, Homo sapiens
cuuggguaagucauuaaaauua

SEQ ID NO: 138080 - RNA, 22 nt, Homo sapiens
cuuggguugauugauaaugcca

SEQ ID NO: 138081 - RNA, 22 nt, Homo sapiens
cuuguggugcuuuuacgugggc

SEQ ID NO: 138082 - RNA, 22 nt, Homo sapiens
cuuucacacuguuggugggaau

SEQ ID NO: 138083 - RNA, 22 nt, Homo sapiens
cuuuggcaaugucauuuucaau

SEQ ID NO: 138084 - RNA, 22 nt, Homo sapiens
cuuuggcacuuccuaagugcca

SEQ ID NO: 138085 - RNA, 22 nt, Homo sapiens
cuuuggguauucucccuugggg

SEQ ID NO: 138086 - RNA, 20 nt, Homo sapiens
cuuuggugagucaacuccuu

SEQ ID NO: 138087 - RNA, 22 nt, Homo sapiens
cuuugguucuguuuauaugcug

SEQ ID NO: 138088 - RNA, 22 nt, Homo sapiens
cuuugguugugcucuccacuuu

SEQ ID NO: 138089 - RNA, 22 nt, Homo sapiens
caaauacuuucauguugucuug

SEQ ID NO: 138090 - RNA, 22 nt, Homo sapiens
caacugcucacuccuggguuca

SEQ ID NO: 138091 - RNA, 22 nt, Homo sapiens
caagguacuuuuacaauuuccc

SEQ ID NO: 138092 - RNA, 22 nt, Homo sapiens
caaguguuggcuuguauacaaa

SEQ ID NO: 138093 - RNA, 22 nt, Homo sapiens
cacagugaaugucaucauugcc

SEQ ID NO: 138094 - RNA, 22 nt, Homo sapiens
cacaguguuacugguaugaagu

SEQ ID NO: 138095 - RNA, 22 nt, Homo sapiens
caccccuaccugagucaggagu

SEQ ID NO: 138096 - RNA, 22 nt, Homo sapiens
caccgagguuggagugcagugg

SEQ ID NO: 138097 - RNA, 22 nt, Homo sapiens
cacugcacuccagcuugugggc

SEQ ID NO: 138098 - RNA, 22 nt, Homo sapiens
cacugcacuccaguuuggauga

SEQ ID NO: 138099 - RNA, 22 nt, Homo sapiens
cacugcacucuucuucugggca

SEQ ID NO: 138100 - RNA, 21 nt, Homo sapiens
cacugcaucacaggacagcau

SEQ ID NO: 138101 - RNA, 22 nt, Homo sapiens
cacugcauccucugccuggcgg

SEQ ID NO: 138102 - RNA, 22 nt, Homo sapiens
cacugcauucuccaccucccag

SEQ ID NO: 138103 - RNA, 22 nt, Homo sapiens
cacugcgaccucugccuaccgg

SEQ ID NO: 138104 - RNA, 22 nt, Homo sapiens
cacugcgacguccgccucccgg

SEQ ID NO: 138105 - RNA, 22 nt, Homo sapiens
cacuuugguucaccugaguuuc

SEQ ID NO: 138106 - RNA, 22 nt, Homo sapiens
cagacaugucuuguggccgugg

SEQ ID NO: 138107 - RNA, 22 nt, Homo sapiens
cagagagcuugcccuuguauau

SEQ ID NO: 138108 - RNA, 22 nt, Homo sapiens
cagagcacuaaagguaaaaggc

SEQ ID NO: 138109 - RNA, 22 nt, Homo sapiens
augagaaucauuucagcuugua

SEQ ID NO: 138110 - RNA, 22 nt, Homo sapiens
augagacuagaagagaauaaua

SEQ ID NO: 138111 - RNA, 22 nt, Homo sapiens
augagagcaacaccuucacuug

SEQ ID NO: 138112 - RNA, 22 nt, Homo sapiens
augagauuauguaaagagacca

SEQ ID NO: 138113 - RNA, 22 nt, Homo sapiens
augagcuaauauggguaaguug

SEQ ID NO: 138114 - RNA, 22 nt, Homo sapiens
augagcuaguguaggguacuga

SEQ ID NO: 138115 - RNA, 21 nt, Homo sapiens
augagguguacuguggugaaa

SEQ ID NO: 138116 - RNA, 22 nt, Homo sapiens
augagugugaccugccaagaga

SEQ ID NO: 138117 - RNA, 22 nt, Homo sapiens
augauagguuuagguuuagaca

SEQ ID NO: 138118 - RNA, 22 nt, Homo sapiens
augaucuguuuggugaucuugu

SEQ ID NO: 138119 - RNA, 22 nt, Homo sapiens
augauucugaucuagagcuugg

SEQ ID NO: 138120 - RNA, 22 nt, Homo sapiens
augcacuuggcaggaugauucc

SEQ ID NO: 138121 - RNA, 22 nt, Homo sapiens
augcagauauuuuugugguugc

SEQ ID NO: 138122 - RNA, 22 nt, Homo sapiens
augcagaucacauuuuucuguc

SEQ ID NO: 138123 - RNA, 22 nt, Homo sapiens
augcauggagucuuucacaagu

SEQ ID NO: 138124 - RNA, 22 nt, Homo sapiens
augcauggcagagucaggguac

SEQ ID NO: 138125 - RNA, 22 nt, Homo sapiens
augccacugcacucuagccugg

SEQ ID NO: 138126 - RNA, 22 nt, Homo sapiens
augccacugcacuucagcuugg

SEQ ID NO: 138127 - RNA, 22 nt, Homo sapiens
augccacuguuuaugucacuua

SEQ ID NO: 138128 - RNA, 22 nt, Homo sapiens
augcuacauucuacaauuaggc

SEQ ID NO: 138129 - RNA, 22 nt, Homo sapiens
augcuacugaccccuacuuaca

SEQ ID NO: 138130 - RNA, 22 nt, Homo sapiens
augcuacuggacaauggugacu

SEQ ID NO: 138131 - RNA, 22 nt, Homo sapiens
augcuguuuugaauucucuaga

SEQ ID NO: 138132 - RNA, 22 nt, Homo sapiens
augcuguuuuguagcucccucu

SEQ ID NO: 138133 - RNA, 22 nt, Homo sapiens
auggaaagcuguuccuacacaa

SEQ ID NO: 138134 - RNA, 22 nt, Homo sapiens
auggaagucucuguuaaguuuc

SEQ ID NO: 138135 - RNA, 22 nt, Homo sapiens
auggacuuuuuguucagugucu

SEQ ID NO: 138136 - RNA, 22 nt, Homo sapiens
auggagaugaauaucaucuguu

SEQ ID NO: 138137 - RNA, 22 nt, Homo sapiens
auggaggacaaugucaccuuca

SEQ ID NO: 138138 - RNA, 22 nt, Homo sapiens
auggaguguucugaauccuuug

SEQ ID NO: 138139 - RNA, 19 nt, Homo sapiens
auggauacauuuucugcua

SEQ ID NO: 138140 - RNA, 22 nt, Homo sapiens
auggauguucuagggaugugau

SEQ ID NO: 138141 - RNA, 22 nt, Homo sapiens
auggcaauaauagcuaccauuu

SEQ ID NO: 138142 - RNA, 22 nt, Homo sapiens
auggcacagaguagaugcucaa

SEQ ID NO: 138143 - RNA, 22 nt, Homo sapiens
auggcccugggaaaggaggcau

SEQ ID NO: 138144 - RNA, 22 nt, Homo sapiens
auggccugaugcaccuguccca

SEQ ID NO: 138145 - RNA, 22 nt, Homo sapiens
auggcuauucuucuuuugucag

SEQ ID NO: 138146 - RNA, 22 nt, Homo sapiens
auggcucaauucuuucccugaa

SEQ ID NO: 138147 - RNA, 22 nt, Homo sapiens
auggcucuuauuauuugaggua

SEQ ID NO: 138148 - RNA, 22 nt, Homo sapiens
auggcuguuuaagaguuucauu

SEQ ID NO: 138149 - RNA, 22 nt, Homo sapiens
auggcuuuugaccugguaggau

SEQ ID NO: 138150 - RNA, 22 nt, Homo sapiens
auggcuuuugcccuaaauggau

SEQ ID NO: 138151 - RNA, 22 nt, Homo sapiens
auguaauugagguuuuugccau

SEQ ID NO: 138152 - RNA, 22 nt, Homo sapiens
auguagugugauuuucacuaga

SEQ ID NO: 138153 - RNA, 22 nt, Homo sapiens
augucaaggugggugauaguuu

SEQ ID NO: 138154 - RNA, 20 nt, Homo sapiens
augucagaguguggguacgg

SEQ ID NO: 138155 - RNA, 22 nt, Homo sapiens
augugacugauguaaucagaca

SEQ ID NO: 138156 - RNA, 22 nt, Homo sapiens
augugcaauggugucaccacau

SEQ ID NO: 138157 - RNA, 18 nt, Homo sapiens
augugcaauuuuguauuu

SEQ ID NO: 138158 - RNA, 22 nt, Homo sapiens
augugugaaucccagaaccugu

SEQ ID NO: 138159 - RNA, 22 nt, Homo sapiens
auguguucaucacagcacaauu

SEQ ID NO: 138160 - RNA, 20 nt, Homo sapiens
auguucuggaggacagaagc

SEQ ID NO: 138161 - RNA, 22 nt, Homo sapiens
auguugcuugaaggcauuuugu

SEQ ID NO: 138162 - RNA, 22 nt, Homo sapiens
auuacaugucuauccaugaaca

SEQ ID NO: 138163 - RNA, 22 nt, Homo sapiens
auuagguuagugcaaaaguaau

SEQ ID NO: 138164 - RNA, 22 nt, Homo sapiens
auuagguuggugcaaaaguaau

SEQ ID NO: 138165 - RNA, 22 nt, Homo sapiens
auuagugaaugugaugucuuga

SEQ ID NO: 138166 - RNA, 22 nt, Homo sapiens
auuauguuguauuuccuugcag

SEQ ID NO: 138167 - RNA, 22 nt, Homo sapiens
auuauugacucauagaaaggau

SEQ ID NO: 138168 - RNA, 22 nt, Homo sapiens
auucacagggggagaaggguau

SEQ ID NO: 138169 - RNA, 22 nt, Homo sapiens
auucacuguggguccuuuggau

SEQ ID NO: 138170 - RNA, 22 nt, Homo sapiens
auuccacagccgauaccaugac

SEQ ID NO: 138171 - RNA, 20 nt, Homo sapiens
auuccacuuguuugagguac

SEQ ID NO: 138172 - RNA, 22 nt, Homo sapiens
auugaacacuucugugugccag

SEQ ID NO: 138173 - RNA, 22 nt, Homo sapiens
auugaaucuaaaaugagucucu

SEQ ID NO: 138174 - RNA, 22 nt, Homo sapiens
auugaauuugguuugcuaagaa

SEQ ID NO: 138175 - RNA, 22 nt, Homo sapiens
auugagcaauuccuaugugcuu

SEQ ID NO: 138176 - RNA, 22 nt, Homo sapiens
auugcacuccagccuggcaaua

SEQ ID NO: 138177 - RNA, 22 nt, Homo sapiens
auugcacuccagccugggcaac

SEQ ID NO: 138178 - RNA, 21 nt, Homo sapiens
auugcgcuccagccuccuggg

SEQ ID NO: 138179 - RNA, 22 nt, Homo sapiens
auugcuauuauuugaccauugu

SEQ ID NO: 138180 - RNA, 22 nt, Homo sapiens
auuggcaagauagcauaugagg

SEQ ID NO: 138181 - RNA, 22 nt, Homo sapiens
auuggugaccugcggcaguaug

SEQ ID NO: 138182 - RNA, 22 nt, Homo sapiens
auuugguuauggucauggacac

SEQ ID NO: 138183 - RNA, 21 nt, Homo sapiens
auuuuugcagagcugguagug

SEQ ID NO: 138184 - RNA, 22 nt, Homo sapiens
caaaguaauuacgguuuuggcc

SEQ ID NO: 138185 - RNA, 22 nt, Homo sapiens
caaaguaauugugguuuugcca

SEQ ID NO: 138186 - RNA, 22 nt, Homo sapiens
caaagucuucucauuaugucuu

SEQ ID NO: 138187 - RNA, 22 nt, Homo sapiens
aucagaguggguuuuaaaagug

SEQ ID NO: 138188 - RNA, 22 nt, Homo sapiens
aucauauccuagauauaacuuc

SEQ ID NO: 138189 - RNA, 22 nt, Homo sapiens
augaccuuguccucagugucau

SEQ ID NO: 138190 - RNA, 22 nt, Homo sapiens
augagauacuacaaaugaguuu

SEQ ID NO: 138191 - RNA, 22 nt, Homo sapiens
augagggaagcucacgugucca

SEQ ID NO: 138192 - RNA, 22 nt, Homo sapiens
augagggagggguggugccgca

SEQ ID NO: 138193 - RNA, 22 nt, Homo sapiens
augauggagguagauuguccau

SEQ ID NO: 138194 - RNA, 22 nt, Homo sapiens
augccuagagucaguggaggug

SEQ ID NO: 138195 - RNA, 22 nt, Homo sapiens
auggaggacaaugucaccuuca

SEQ ID NO: 138196 - RNA, 22 nt, Homo sapiens
augucaaggugaagaaagauca

SEQ ID NO: 138197 - RNA, 20 nt, Homo sapiens
augucaggaagggagucagg

SEQ ID NO: 138198 - RNA, 22 nt, Homo sapiens
augugcacaugcuuacauguga

SEQ ID NO: 138199 - RNA, 22 nt, Homo sapiens
augugcagauguuacaaauugu

SEQ ID NO: 138200 - RNA, 22 nt, Homo sapiens
auguugcaguuuaauuauccua

SEQ ID NO: 138201 - RNA, 22 nt, Homo sapiens
auuaaguuaggauuuugagaua

SEQ ID NO: 138202 - RNA, 22 nt, Homo sapiens
auugcacuccagccuuggggau

SEQ ID NO: 138203 - RNA, 22 nt, Homo sapiens
auugcucaaaucaguacuugag

SEQ ID NO: 138204 - RNA, 22 nt, Homo sapiens
caaauacuuucauguugucuug

SEQ ID NO: 138205 - RNA, 22 nt, Homo sapiens
caaaugacaucauuucauucaa

SEQ ID NO: 138206 - RNA, 22 nt, Homo sapiens
caacagucagcccauccacaga

SEQ ID NO: 138207 - RNA, 22 nt, Homo sapiens
cacacugucuuucagaaugguu

SEQ ID NO: 138208 - RNA, 22 nt, Homo sapiens
cacaguguuccagcuauuugaa

SEQ ID NO: 138209 - RNA, 19 nt, Homo sapiens
caugugcacuacuggcuuc

SEQ ID NO: 138210 - RNA, 22 nt, Homo sapiens
cauugcaguaagagugggcucu

SEQ ID NO: 138211 - RNA, 22 nt, Homo sapiens
cuacacaugcaggcucccugcc

SEQ ID NO: 138212 - RNA, 22 nt, Homo sapiens
cucauggagauagagaauagaa

SEQ ID NO: 138213 - RNA, 22 nt, Homo sapiens
cugaaaguuauucaggggcaag

SEQ ID NO: 138214 - RNA, 22 nt, Homo sapiens
cugaggacaucagggaagcauc

SEQ ID NO: 138215 - RNA, 22 nt, Homo sapiens
cuggcaauaggcagugucccaa

SEQ ID NO: 138216 - RNA, 22 nt, Homo sapiens
cuguagcuuuuauaugcuuagc

SEQ ID NO: 138217 - RNA, 22 nt, Homo sapiens
cuguaugugagaaauaauaagu

SEQ ID NO: 138218 - RNA, 22 nt, Homo sapiens
cuuaaagcgaauauugguggua

SEQ ID NO: 138219 - RNA, 22 nt, Homo sapiens
cuucucagugcucaucuuauuu

SEQ ID NO: 138220 - RNA, 22 nt, Homo sapiens
gaaagacuuucugcuguggaua

SEQ ID NO: 138221 - RNA, 22 nt, Homo sapiens
gaagcgaggugauuagcagaca

SEQ ID NO: 138222 - RNA, 22 nt, Homo sapiens
gaaugcuaagcaugugggaauu

SEQ ID NO: 138223 - RNA, 22 nt, Homo sapiens
gacacugucuucugcucuuaaa

SEQ ID NO: 138224 - RNA, 20 nt, Homo sapiens
gacauagagacucucaaaaa

SEQ ID NO: 138225 - RNA, 22 nt, Homo sapiens
gagagcuaggccacuggggcuu

SEQ ID NO: 138226 - RNA, 22 nt, Homo sapiens
gaggagucagacugugcaaggu

SEQ ID NO: 138227 - RNA, 22 nt, Homo sapiens
gaggcuagauggggaugugucc

SEQ ID NO: 138228 - RNA, 22 nt, Homo sapiens
gaggugauaucucauugugguu

SEQ ID NO: 138229 - RNA, 22 nt, Homo sapiens
gaguaacagcauaaauuuguga

SEQ ID NO: 138230 - RNA, 22 nt, Homo sapiens
gcaagacaugucuaagguuuaa

SEQ ID NO: 138231 - RNA, 22 nt, Homo sapiens
gcagaauugguuucuucuaagg

SEQ ID NO: 138232 - RNA, 22 nt, Homo sapiens
gcuuuguugauggugagucugu

SEQ ID NO: 138233 - RNA, 22 nt, Homo sapiens
ggcaaugaggcggaccagcagg

SEQ ID NO: 138234 - RNA, 19 nt, Homo sapiens
ggucacagggguuacaagg

SEQ ID NO: 138235 - RNA, 22 nt, Homo sapiens
guaaacuuccccucaugaauga

SEQ ID NO: 138236 - RNA, 20 nt, Homo sapiens
guaacagcacuuucccaaag

SEQ ID NO: 138237 - RNA, 22 nt, Homo sapiens
guauaguaguacaaaaguuuuu

SEQ ID NO: 138238 - RNA, 22 nt, Homo sapiens
guaugcacauauguguauguau

SEQ ID NO: 138239 - RNA, 22 nt, Homo sapiens
gugacauuauuucagcuacaug

SEQ ID NO: 138240 - RNA, 22 nt, Homo sapiens
gugacugggaguggugaagaua

SEQ ID NO: 138241 - RNA, 17 nt, Homo sapiens
gugagguggguaguauc

SEQ ID NO: 138242 - RNA, 22 nt, Homo sapiens
gugauauguuaggaucuaaguc

SEQ ID NO: 138243 - RNA, 22 nt, Homo sapiens
gugcacaacaugcaguuuuguu

SEQ ID NO: 138244 - RNA, 22 nt, Homo sapiens
gugcacaacgugcagguuaguu

SEQ ID NO: 138245 - RNA, 22 nt, Homo sapiens
gugcacaacguguagguuuguu

SEQ ID NO: 138246 - RNA, 22 nt, Homo sapiens
guguauguuucucccugucccu

SEQ ID NO: 138247 - RNA, 22 nt, Homo sapiens
guuauguaucuugauugggugg

SEQ ID NO: 138248 - RNA, 22 nt, Homo sapiens
uaaagugaggauggcaguaggu

SEQ ID NO: 138249 - RNA, 22 nt, Homo sapiens
uaacauagucauauacuugcuu

SEQ ID NO: 138250 - RNA, 22 nt, Homo sapiens
uaagugaauguuggcuacugaa

SEQ ID NO: 138251 - RNA, 22 nt, Homo sapiens
uaauagcaguguuacuaggacu

SEQ ID NO: 138252 - RNA, 22 nt, Homo sapiens
uaaugcuaucugggccaggggu

SEQ ID NO: 138253 - RNA, 22 nt, Homo sapiens
uaccaaguauuuucacaugaac

SEQ ID NO: 138254 - RNA, 19 nt, Homo sapiens
uacuggcucgggaauuuuc

SEQ ID NO: 138255 - RNA, 18 nt, Homo sapiens
uagaauauaggucauucu

SEQ ID NO: 138256 - RNA, 22 nt, Homo sapiens
uagcaagaugaauuugugcaaa

SEQ ID NO: 138257 - RNA, 19 nt, Homo sapiens
uagggcacgaggcagaguc

SEQ ID NO: 138258 - RNA, 20 nt, Homo sapiens
uauaacaguuuggacccagu

SEQ ID NO: 138259 - RNA, 22 nt, Homo sapiens
uauagcagugaguauugacuaa

SEQ ID NO: 138260 - RNA, 22 nt, Homo sapiens
uauagcuaugggauguauuugc

SEQ ID NO: 138261 - RNA, 22 nt, Homo sapiens
uauauguuuucauaaggcuaga

SEQ ID NO: 138262 - RNA, 22 nt, Homo sapiens
uaugcacacacguguuuaugug

SEQ ID NO: 138263 - RNA, 22 nt, Homo sapiens
uaugcacacguguccaugugca

SEQ ID NO: 138264 - RNA, 22 nt, Homo sapiens
uaugcacacucucccaggaggg

SEQ ID NO: 138265 - RNA, 22 nt, Homo sapiens
uaugcacaugcaugcuugaaua

SEQ ID NO: 138266 - RNA, 22 nt, Homo sapiens
uaugcacaugugccugggugug

SEQ ID NO: 138267 - RNA, 22 nt, Homo sapiens
uaugccuuuuggcucaagaaac

SEQ ID NO: 138268 - RNA, 18 nt, Homo sapiens
uauuccucuuccucuauc

SEQ ID NO: 138269 - RNA, 22 nt, Homo sapiens
uauugcagaaugugaguuggca

SEQ ID NO: 138270 - RNA, 22 nt, Homo sapiens
uauugccuugccuacuuuucca

SEQ ID NO: 138271 - RNA, 22 nt, Homo sapiens
ucaaaguaaagccucaggaugg

SEQ ID NO: 138272 - RNA, 22 nt, Homo sapiens
ucaacagugggcacuguaaaug

SEQ ID NO: 138273 - RNA, 19 nt, Homo sapiens
ucacacuguggcuucuuua

SEQ ID NO: 138274 - RNA, 22 nt, Homo sapiens
ucacacuguuuugauuauuaua

SEQ ID NO: 138275 - RNA, 23 nt, Homo sapiens
ucacaguggcugcuuaauuguga

SEQ ID NO: 138276 - RNA, 22 nt, Homo sapiens
ucacauuguuauguaaauguuu

SEQ ID NO: 138277 - RNA, 20 nt, Homo sapiens
ucacuggagcucauuugauu

SEQ ID NO: 138278 - RNA, 18 nt, Homo sapiens
ucacugugugucuugggu

SEQ ID NO: 138279 - RNA, 22 nt, Homo sapiens
ucagaguagagcgacuucuccu

SEQ ID NO: 138280 - RNA, 22 nt, Homo sapiens
ucauggcacugaugagaguuuc

SEQ ID NO: 138281 - RNA, 22 nt, Homo sapiens
ucauuggaugucugaaaugauu

SEQ ID NO: 138282 - RNA, 22 nt, Homo sapiens
ucugugcauuacacuuuucuca

SEQ ID NO: 138283 - RNA, 19 nt, Homo sapiens
ucuuugcuuuucuaagagg

SEQ ID NO: 138284 - RNA, 22 nt, Homo sapiens
ugaaacauacacucugaugggg

SEQ ID NO: 138285 - RNA, 22 nt, Homo sapiens
ugaaagacugaaagcuuuucuu

SEQ ID NO: 138286 - RNA, 22 nt, Homo sapiens
ugaaagcuacaggaaaguauuu

SEQ ID NO: 138287 - RNA, 22 nt, Homo sapiens
ugaauagacacuaaagacugua

SEQ ID NO: 138288 - RNA, 22 nt, Homo sapiens
ugacaacugauuaacuccuuua

SEQ ID NO: 138289 - RNA, 22 nt, Homo sapiens
ugagaacuaaaaugugguauau

SEQ ID NO: 138290 - RNA, 22 nt, Homo sapiens
ugagaggugaauggcaggcuca

SEQ ID NO: 138291 - RNA, 22 nt, Homo sapiens
ugagaucaaggugggcccuggg

SEQ ID NO: 138292 - RNA, 21 nt, Homo sapiens
ugauaugguuuggauaugugu

SEQ ID NO: 138293 - RNA, 22 nt, Homo sapiens
ugauggcacagugaguuccagg

SEQ ID NO: 138294 - RNA, 22 nt, Homo sapiens
ugcugcaaacaugagaggaagu

SEQ ID NO: 138295 - RNA, 22 nt, Homo sapiens
cuaaagugcuuaaaaucucauu

SEQ ID NO: 138296 - RNA, 21 nt, Homo sapiens
cuaaggaaagcuaugaacccu

SEQ ID NO: 138297 - RNA, 22 nt, Homo sapiens
cuacaguagagaggauguagaa

SEQ ID NO: 138298 - RNA, 22 nt, Homo sapiens
cuagcagacacuuccagagagu

SEQ ID NO: 138299 - RNA, 22 nt, Homo sapiens
cuagcagacaugggcugaacca

SEQ ID NO: 138300 - RNA, 22 nt, Homo sapiens
cuagcuuuugauguaaagugag

SEQ ID NO: 138301 - RNA, 21 nt, Homo sapiens
cuaucucaguguuuacauuug

SEQ ID NO: 138302 - RNA, 21 nt, Homo sapiens
cucaaaguacugauauuacag

SEQ ID NO: 138303 - RNA, 22 nt, Homo sapiens
cuucaaaguuggcuaggagaca

SEQ ID NO: 138304 - RNA, 22 nt, Homo sapiens
cuuuaguugucuccucaagggu

SEQ ID NO: 138305 - RNA, 20 nt, Homo sapiens
cuuuggcaaugagaacaggg

SEQ ID NO: 138306 - RNA, 22 nt, Homo sapiens
gaaagguaggaacagggugcag

SEQ ID NO: 138307 - RNA, 22 nt, Homo sapiens
gaaucauuguuucuaaguuugu

SEQ ID NO: 138308 - RNA, 22 nt, Homo sapiens
gaauucugucgcuuacuagaug

SEQ ID NO: 138309 - RNA, 22 nt, Homo sapiens
gacaccugguguggaacuggag

SEQ ID NO: 138310 - RNA, 22 nt, Homo sapiens
gagauggugugcuguuggaagu

SEQ ID NO: 138311 - RNA, 22 nt, Homo sapiens
gauagcagccauucuuuuuauu

SEQ ID NO: 138312 - RNA, 22 nt, Homo sapiens
gaugagguagaagacucagcaa

SEQ ID NO: 138313 - RNA, 22 nt, Homo sapiens
gcaaaugcuaugccauuuuaua

SEQ ID NO: 138314 - RNA, 22 nt, Homo sapiens
gcaccacugcacucucagcuug

SEQ ID NO: 138315 - RNA, 22 nt, Homo sapiens
ggaaagacaccuuacuauguua

SEQ ID NO: 138316 - RNA, 22 nt, Homo sapiens
ggaaagauguaauauuaucuaa

SEQ ID NO: 138317 - RNA, 22 nt, Homo sapiens
ggagcucaucuagcauagaggu

SEQ ID NO: 138318 - RNA, 22 nt, Homo sapiens
ggcuuggaggaaugugagggcu

SEQ ID NO: 138319 - RNA, 22 nt, Homo sapiens
guagcagaacauguuccuugua

SEQ ID NO: 138320 - RNA, 22 nt, Homo sapiens
gucucacagcuagcugcuuuau

SEQ ID NO: 138321 - RNA, 22 nt, Homo sapiens
gugaaguuuuuugcugagaguc

SEQ ID NO: 138322 - RNA, 22 nt, Homo sapiens
gugacauuuuuacugaugagag

SEQ ID NO: 138323 - RNA, 22 nt, Homo sapiens
gugcacaaaucuuaaauguaca

SEQ ID NO: 138324 - RNA, 22 nt, Homo sapiens
gugcacaacaugcagguuuguu

SEQ ID NO: 138325 - RNA, 22 nt, Homo sapiens
gugcacaaucgugcauuccuug

SEQ ID NO: 138326 - RNA, 22 nt, Homo sapiens
gugcuaggugcuaggaagauag

SEQ ID NO: 138327 - RNA, 22 nt, Homo sapiens
guuugccuuuuagauaggaaug

SEQ ID NO: 138328 - RNA, 22 nt, Homo sapiens
uaaagcuaucacauuggugauu

SEQ ID NO: 138329 - RNA, 22 nt, Homo sapiens
uaaaugcuuaauugaaugugga

SEQ ID NO: 138330 - RNA, 22 nt, Homo sapiens
uaacaguguauuccuuuggaca

SEQ ID NO: 138331 - RNA, 22 nt, Homo sapiens
uaacauucacaugcugcaaaaa

SEQ ID NO: 138332 - RNA, 22 nt, Homo sapiens
uaaugcacuuuccuccaaggcu

SEQ ID NO: 138333 - RNA, 22 nt, Homo sapiens
uacugagagaggaauauugaaa

SEQ ID NO: 138334 - RNA, 22 nt, Homo sapiens
uagagcucaucuucuuuaaacu

SEQ ID NO: 138335 - RNA, 22 nt, Homo sapiens
uauaacaaugcaagaauggccu

SEQ ID NO: 138336 - RNA, 22 nt, Homo sapiens
uaucacaaacuuagcaguuuaa

SEQ ID NO: 138337 - RNA, 22 nt, Homo sapiens
uauugcagauacccaggaaguu

SEQ ID NO: 138338 - RNA, 22 nt, Homo sapiens
ucaaagugacaaaguugcagca

SEQ ID NO: 138339 - RNA, 17 nt, Homo sapiens
ucaaaugcucccaguga

SEQ ID NO: 138340 - RNA, 22 nt, Homo sapiens
ucaacauugcugucaggcaucu

SEQ ID NO: 138341 - RNA, 22 nt, Homo sapiens
ucacaaguguauagacaugucc

SEQ ID NO: 138342 - RNA, 22 nt, Homo sapiens
ucagggacuuacaaaccagaag

SEQ ID NO: 138343 - RNA, 22 nt, Homo sapiens
ucagugcuuuuuguugucauca

SEQ ID NO: 138344 - RNA, 19 nt, Homo sapiens
ucuaaaucucuugauagac

SEQ ID NO: 138345 - RNA, 17 nt, Homo sapiens
ucuaauaauaugcauuu

SEQ ID NO: 138346 - RNA, 22 nt, Homo sapiens
ucucacaccccucucauauacc

SEQ ID NO: 138347 - RNA, 22 nt, Homo sapiens
aaagugaauguaucccguaagu

SEQ ID NO: 138348 - RNA, 22 nt, Homo sapiens
aaaguggugugaguauguaucu

SEQ ID NO: 138349 - RNA, 22 nt, Homo sapiens
aaaguucuugcugaaggauuau

SEQ ID NO: 138350 - RNA, 22 nt, Homo sapiens
aaauaguagcugaaugagggaa

SEQ ID NO: 138351 - RNA, 22 nt, Homo sapiens
aaaugcuucuauguggcauguu

SEQ ID NO: 138352 - RNA, 20 nt, Homo sapiens
aacaguguguaaguuuccuu

SEQ ID NO: 138353 - RNA, 22 nt, Homo sapiens
aagcuggagugcaguggugcaa

SEQ ID NO: 138354 - RNA, 22 nt, Homo sapiens
aagcuggagugcaguggugcga

SEQ ID NO: 138355 - RNA, 22 nt, Homo sapiens
aaucugucuuuuguuauugagg

SEQ ID NO: 138356 - RNA, 22 nt, Homo sapiens
aauggcaagagccacagaggcg

SEQ ID NO: 138357 - RNA, 22 nt, Homo sapiens
aaugugcacuauuagggugaua

SEQ ID NO: 138358 - RNA, 22 nt, Homo sapiens
aauuacauggcaauugggaaau

SEQ ID NO: 138359 - RNA, 22 nt, Homo sapiens
acaagugaauacaggauucucu

SEQ ID NO: 138360 - RNA, 23 nt, Homo sapiens
acacaguaaacuaaaagcuagcu

SEQ ID NO: 138361 - RNA, 22 nt, Homo sapiens
acauaguagacacugaaaauau

SEQ ID NO: 138362 - RNA, 22 nt, Homo sapiens
acauaugaguacaugugccaug

SEQ ID NO: 138363 - RNA, 22 nt, Homo sapiens
acaucuguacaguggguguggu

SEQ ID NO: 138364 - RNA, 22 nt, Homo sapiens
accaguuuuuuauacaucuucu

SEQ ID NO: 138365 - RNA, 22 nt, Homo sapiens
acugacaugaucaggcauguuc

SEQ ID NO: 138366 - RNA, 22 nt, Homo sapiens
agaaacauucucuugccuccuu

SEQ ID NO: 138367 - RNA, 19 nt, Homo sapiens
agagacucauuguagcauu

SEQ ID NO: 138368 - RNA, 22 nt, Homo sapiens
agaggucuuaucaaacaugcuu

SEQ ID NO: 138369 - RNA, 22 nt, Homo sapiens
agagguuuuggggcugagagcu

SEQ ID NO: 138370 - RNA, 22 nt, Homo sapiens
agagugcuauagauuagauuuc

SEQ ID NO: 138371 - RNA, 22 nt, Homo sapiens
agcaggucuuaacuugugaggu

SEQ ID NO: 138372 - RNA, 19 nt, Homo sapiens
agcaguguggagauuucuc

SEQ ID NO: 138373 - RNA, 22 nt, Homo sapiens
agccaguauuuccacagagugg

SEQ ID NO: 138374 - RNA, 22 nt, Homo sapiens
agcuauauugaggaugccauuc

SEQ ID NO: 138375 - RNA, 22 nt, Homo sapiens
aggaauguuaguacuucuuagu

SEQ ID NO: 138376 - RNA, 22 nt, Homo sapiens
agugcauuuguucugugucagg

SEQ ID NO: 138377 - RNA, 22 nt, Homo sapiens
agugguuuuaaguagagcauac

SEQ ID NO: 138378 - RNA, 22 nt, Homo sapiens
auaaagcaagucucuggccuca

SEQ ID NO: 138379 - RNA, 22 nt, Homo sapiens
auaaaugcaaugguauuuuuga

SEQ ID NO: 138380 - RNA, 22 nt, Homo sapiens
auaauagcugaucauuuagaag

SEQ ID NO: 138381 - RNA, 22 nt, Homo sapiens
auacaguaaugucuuaggcugu

SEQ ID NO: 138382 - RNA, 22 nt, Homo sapiens
auagcagaauuuggucaagucu

SEQ ID NO: 138383 - RNA, 22 nt, Homo sapiens
auagcaggagaauggucauggg

SEQ ID NO: 138384 - RNA, 21 nt, Homo sapiens
auagggcuuguugauaguuaa

SEQ ID NO: 138385 - RNA, 22 nt, Homo sapiens
auaugcauacccucaccaacua

SEQ ID NO: 138386 - RNA, 22 nt, Homo sapiens
aucaggaaccuuuuuggugugu

SEQ ID NO: 138387 - RNA, 22 nt, Homo sapiens
aucucaguuaauuccaucuuuc

SEQ ID NO: 138388 - RNA, 22 nt, Homo sapiens
augaaagguauguuuucuguga

SEQ ID NO: 138389 - RNA, 22 nt, Homo sapiens
augaaaguguguggaaacuuga

SEQ ID NO: 138390 - RNA, 22 nt, Homo sapiens
augacauugaugcucuggcugg

SEQ ID NO: 138391 - RNA, 22 nt, Homo sapiens
augagcuaauauggguaaguug

SEQ ID NO: 138392 - RNA, 22 nt, Homo sapiens
augagcuaguguaggguacuga

SEQ ID NO: 138393 - RNA, 22 nt, Homo sapiens
auggcaauaauagcuaccauuu

SEQ ID NO: 138394 - RNA, 22 nt, Homo sapiens
auggcaauguaagucagaaaaa

SEQ ID NO: 138395 - RNA, 22 nt, Homo sapiens
augugcaaagcacuguucagca

SEQ ID NO: 138396 - RNA, 22 nt, Homo sapiens
augugcaaauuuccaaacucuu

SEQ ID NO: 138397 - RNA, 18 nt, Homo sapiens
augugcaauuuuguauuu

SEQ ID NO: 138398 - RNA, 22 nt, Homo sapiens
auuacauagucaaggugucuca

SEQ ID NO: 138399 - RNA, 22 nt, Homo sapiens
caacacuguuuauuggauagcc

SEQ ID NO: 138400 - RNA, 22 nt, Homo sapiens
cacacugucuucauuacuguag

SEQ ID NO: 138401 - RNA, 22 nt, Homo sapiens
cauugcagauccuucaaaugac

SEQ ID NO: 138402 - RNA, 22 nt, Homo sapiens
cauugcaguggaguggggaaga

SEQ ID NO: 138403 - RNA, 22 nt, Homo sapiens
ccaucacaggccucagugggaa

SEQ ID NO: 138404 - RNA, 20 nt, Homo sapiens
ccccaguuuuucuauuagcu

SEQ ID NO: 138405 - RNA, 22 nt, Homo sapiens
cuaacacagggcaagucaggcu

SEQ ID NO: 138406 - RNA, 22 nt, Homo sapiens
cuaaggaaggacugaaaggaca

SEQ ID NO: 138407 - RNA, 22 nt, Homo sapiens
cuacaguaugaaaccuuuacuc

SEQ ID NO: 138408 - RNA, 22 nt, Homo sapiens
cucaguggauuagauaaugcac

SEQ ID NO: 138409 - RNA, 22 nt, Homo sapiens
cucauggaauacuucacagcca

SEQ ID NO: 138410 - RNA, 19 nt, Homo sapiens
cucauggagaaggagaaua

SEQ ID NO: 138411 - RNA, 22 nt, Homo sapiens
cugaaagguauacgcuuguuau

SEQ ID NO: 138412 - RNA, 22 nt, Homo sapiens
cugacauuguugaucacagcca

SEQ ID NO: 138413 - RNA, 22 nt, Homo sapiens
cugugcauggauuuuaagauug

SEQ ID NO: 138414 - RNA, 17 nt, Homo sapiens
cuucaaauaauuucccc

SEQ ID NO: 138415 - RNA, 21 nt, Homo sapiens
gaaauacugccuuaggagcug

SEQ ID NO: 138416 - RNA, 22 nt, Homo sapiens
gaaucacagauuaugaguaucu

SEQ ID NO: 138417 - RNA, 22 nt, Homo sapiens
gaaucacaguuauuagagcagc

SEQ ID NO: 138418 - RNA, 22 nt, Homo sapiens
gaaugcuaccagcaucuagugg

SEQ ID NO: 138419 - RNA, 22 nt, Homo sapiens
gagaacauuaauaguuaauuuu

SEQ ID NO: 138420 - RNA, 21 nt, Homo sapiens
gagguaccucauguaagugga

SEQ ID NO: 138421 - RNA, 21 nt, Homo sapiens
gauaucuuuauucccaagagc

SEQ ID NO: 138422 - RNA, 22 nt, Homo sapiens
gauaucuuuuguauggugagcu

SEQ ID NO: 138423 - RNA, 19 nt, Homo sapiens
gauauguugagcacccuuu

SEQ ID NO: 138424 - RNA, 20 nt, Homo sapiens
gcauaugucuuuauagcaga

SEQ ID NO: 138425 - RNA, 22 nt, Homo sapiens
gccaagaagugucuaagcagga

SEQ ID NO: 138426 - RNA, 23 nt, Homo sapiens
ggaaacauccagucuuucaccau

SEQ ID NO: 138427 - RNA, 22 nt, Homo sapiens
ggagucugauuuuuauguugcu

SEQ ID NO: 138428 - RNA, 22 nt, Homo sapiens
ggaguguguaggagaaagguaa

SEQ ID NO: 138429 - RNA, 22 nt, Homo sapiens
gggaggucauuguucaaugcug

SEQ ID NO: 138430 - RNA, 22 nt, Homo sapiens
ggugagguaggaaaaguuagga

SEQ ID NO: 138431 - RNA, 22 nt, Homo sapiens
guaacacaugcugcucucuggu

SEQ ID NO: 138432 - RNA, 22 nt, Homo sapiens
guacaagugcaguuucguuaca

SEQ ID NO: 138433 - RNA, 22 nt, Homo sapiens
guacaguaguaaaagugaauga

SEQ ID NO: 138434 - RNA, 22 nt, Homo sapiens
guacaguauaguaauaggauuu

SEQ ID NO: 138435 - RNA, 22 nt, Homo sapiens
gucuuuguuuggucuguaucag

SEQ ID NO: 138436 - RNA, 22 nt, Homo sapiens
gugaggucguagucauaggcaa

SEQ ID NO: 138437 - RNA, 22 nt, Homo sapiens
gugauuauccacgucuuuguga

SEQ ID NO: 138438 - RNA, 22 nt, Homo sapiens
gugcacaacgugcagguuuguu

SEQ ID NO: 138439 - RNA, 22 nt, Homo sapiens
guucacagugguugccuuccag

SEQ ID NO: 138440 - RNA, 22 nt, Homo sapiens
uaaagccauugucaaguuugua

SEQ ID NO: 138441 - RNA, 22 nt, Homo sapiens
uaaauugcauaaguacaaauga

SEQ ID NO: 138442 - RNA, 22 nt, Homo sapiens
uaacuagaaaggagacaguugc

SEQ ID NO: 138443 - RNA, 22 nt, Homo sapiens
uaagugaauauggacaguuagc

SEQ ID NO: 138444 - RNA, 22 nt, Homo sapiens
uaauacuguaauggugguuccg

SEQ ID NO: 138445 - RNA, 22 nt, Homo sapiens
uaaugcacauuuauuuuaccuu

SEQ ID NO: 138446 - RNA, 22 nt, Homo sapiens
uacaguagaaugucuuucaaaa

SEQ ID NO: 138447 - RNA, 22 nt, Homo sapiens
uacauugucauauucucucucu

SEQ ID NO: 138448 - RNA, 22 nt, Homo sapiens
uacugguuuuauauauuucucc

SEQ ID NO: 138449 - RNA, 22 nt, Homo sapiens
uagaacauuccaggugauguug

SEQ ID NO: 138450 - RNA, 22 nt, Homo sapiens
uagaauguaaauuccaagggca

SEQ ID NO: 138451 - RNA, 21 nt, Homo sapiens
uagagagcaauaccuccagag

SEQ ID NO: 138452 - RNA, 21 nt, Homo sapiens
uagcaaauugcuauuaaggca

SEQ ID NO: 138453 - RNA, 22 nt, Homo sapiens
uaguaaacauaguucuuuugcu

SEQ ID NO: 138454 - RNA, 21 nt, Homo sapiens
uauagcagcacgauuuauaau

SEQ ID NO: 138455 - RNA, 21 nt, Homo sapiens
uauagcagcacgauuuauagu

SEQ ID NO: 138456 - RNA, 22 nt, Homo sapiens
uauagcaguguaagaaucgagu

SEQ ID NO: 138457 - RNA, 22 nt, Homo sapiens
uaucauggggacugcagccuag

SEQ ID NO: 138458 - RNA, 22 nt, Homo sapiens
uaugaaagcuacuucucacaau

SEQ ID NO: 138459 - RNA, 22 nt, Homo sapiens
uaugcuuauaaacauuugucag

SEQ ID NO: 138460 - RNA, 22 nt, Homo sapiens
uauugaacgugggauauugaag

SEQ ID NO: 138461 - RNA, 20 nt, Homo sapiens
uauugcacuccagucugggc

SEQ ID NO: 138462 - RNA, 22 nt, Homo sapiens
uauugcagugagauccaucugg

SEQ ID NO: 138463 - RNA, 22 nt, Homo sapiens
ucaaaugcucuuugcagagagg

SEQ ID NO: 138464 - RNA, 22 nt, Homo sapiens
ucaaaugcuguauuguaguaau

SEQ ID NO: 138465 - RNA, 22 nt, Homo sapiens
ucacagugcaggaucaguuaau

SEQ ID NO: 138466 - RNA, 22 nt, Homo sapiens
ucacaugaagauuuuaguauac

SEQ ID NO: 138467 - RNA, 22 nt, Homo sapiens
ucacaugugcguuuuggcaugu

SEQ ID NO: 138468 - RNA, 22 nt, Homo sapiens
ucacauuguacaaacagguaag

SEQ ID NO: 138469 - RNA, 22 nt, Homo sapiens
ucagauacuggugacaugaaug

SEQ ID NO: 138470 - RNA, 22 nt, Homo sapiens
ucaggcacuaguaagaaaaagg

SEQ ID NO: 138471 - RNA, 22 nt, Homo sapiens
ucagggacgcuugacacaagcc

SEQ ID NO: 138472 - RNA, 22 nt, Homo sapiens
uccaguuguuauuuuuauaaag

SEQ ID NO: 138473 - RNA, 22 nt, Homo sapiens
ucucaguggcuuccucacuuuu

SEQ ID NO: 138474 - RNA, 22 nt, Homo sapiens
ucucaguguuaucuaucugccu

SEQ ID NO: 138475 - RNA, 22 nt, Homo sapiens
ucugguggugaugagagacagu

SEQ ID NO: 138476 - RNA, 22 nt, Homo sapiens
ugaaagacugaagaauaggcau

SEQ ID NO: 138477 - RNA, 22 nt, Homo sapiens
ugaaggacauucuaugguagau

SEQ ID NO: 138478 - RNA, 22 nt, Homo sapiens
ugaauaguuugacagaacucuu

SEQ ID NO: 138479 - RNA, 18 nt, Homo sapiens
ugacaucauuuagaaagg

SEQ ID NO: 138480 - RNA, 22 nt, Homo sapiens
ugagaagcauaccagugucugu

SEQ ID NO: 138481 - RNA, 22 nt, Homo sapiens
ugagaucaacugagucagagca

SEQ ID NO: 138482 - RNA, 22 nt, Homo sapiens
ugagauggguaauuaaauggug

SEQ ID NO: 138483 - RNA, 22 nt, Homo sapiens
ugagcacauuuacaucaguucc

SEQ ID NO: 138484 - RNA, 22 nt, Homo sapiens
ugagcagagggagaaguaaauu

SEQ ID NO: 138485 - RNA, 22 nt, Homo sapiens
ugaggagugaacuauuucugau

SEQ ID NO: 138486 - RNA, 22 nt, Homo sapiens
ugauaggucuguuuugaaaagg

SEQ ID NO: 138487 - RNA, 22 nt, Homo sapiens
ugaugcuaccuaaagcaaccau

SEQ ID NO: 138488 - RNA, 22 nt, Homo sapiens
ugcauauguugagaugcauauu

SEQ ID NO: 138489 - RNA, 22 nt, Homo sapiens
ugcauguucuuacucauacaug

SEQ ID NO: 138490 - RNA, 22 nt, Homo sapiens
ugcauuguuuagaaacacuggg

SEQ ID NO: 138491 - RNA, 22 nt, Homo sapiens
ugcugcaaacaggcaucugugg

SEQ ID NO: 138492 - RNA, 22 nt, Homo sapiens
uggaagguaaguuuugagcauu

SEQ ID NO: 138493 - RNA, 22 nt, Homo sapiens
uggagagugauaaguaaaugga

SEQ ID NO: 138494 - RNA, 22 nt, Homo sapiens
uggcaguuuacaaaugccauga

SEQ ID NO: 138495 - RNA, 22 nt, Homo sapiens
uggcauauaauauagaagacua

SEQ ID NO: 138496 - RNA, 22 nt, Homo sapiens
uguaaaucugguuaauuggaua

SEQ ID NO: 138497 - RNA, 22 nt, Homo sapiens
ugugcaaucagcuucauuacau

SEQ ID NO: 138498 - RNA, 22 nt, Homo sapiens
uguugcacuccagccuggguga

SEQ ID NO: 138499 - RNA, 22 nt, Homo sapiens
uuaaaugcauagaauguguagu

SEQ ID NO: 138500 - RNA, 22 nt, Homo sapiens
uuaaggaaggagucuuaaaugg

SEQ ID NO: 138501 - RNA, 22 nt, Homo sapiens
uuaaggcuuuaaguaaacacag

SEQ ID NO: 138502 - RNA, 22 nt, Homo sapiens
uuacaguagaugaggguauaau

SEQ ID NO: 138503 - RNA, 22 nt, Homo sapiens
uuacaguauugcaaggacuagg

SEQ ID NO: 138504 - RNA, 22 nt, Homo sapiens
uuacaucaucacauuaguuugc

SEQ ID NO: 138505 - RNA, 22 nt, Homo sapiens
uuacuguauagaaucaucuuga

SEQ ID NO: 138506 - RNA, 22 nt, Homo sapiens
uuagaacaguguuugccucgcu

SEQ ID NO: 138507 - RNA, 22 nt, Homo sapiens
uuagcaauagccugcaucugca

SEQ ID NO: 138508 - RNA, 20 nt, Homo sapiens
uuauagcuacaucuugacug

SEQ ID NO: 138509 - RNA, 22 nt, Homo sapiens
uucaaaguaaaaauguguucac

SEQ ID NO: 138510 - RNA, 22 nt, Homo sapiens
uucacagucacccuucuccaug

SEQ ID NO: 138511 - RNA, 22 nt, Homo sapiens
uuccauguaguugagcaguuuu

SEQ ID NO: 138512 - RNA, 22 nt, Homo sapiens
uucuaaacaucuuacaaugcau

SEQ ID NO: 138513 - RNA, 22 nt, Homo sapiens
uugaaagacagaggggcaaguu

SEQ ID NO: 138514 - RNA, 22 nt, Homo sapiens
uugaaagcuaucucaaaucgcu

SEQ ID NO: 138515 - RNA, 22 nt, Homo sapiens
uugaacuagaaccugcaaauuu

SEQ ID NO: 138516 - RNA, 22 nt, Homo sapiens
uugaccuaugggaguuugacua

SEQ ID NO: 138517 - RNA, 22 nt, Homo sapiens
uugcgcuuuuccuauguugccc

SEQ ID NO: 138518 - RNA, 22 nt, Homo sapiens
uuggagagaaaggcaguuccug

SEQ ID NO: 138519 - RNA, 22 nt, Homo sapiens
uuggagagucacuaguuagugc

SEQ ID NO: 138520 - RNA, 22 nt, Homo sapiens
uuggcaauucagauucuuuuau

SEQ ID NO: 138521 - RNA, 22 nt, Homo sapiens
uuggcaauugcuaugauuugaa

SEQ ID NO: 138522 - RNA, 22 nt, Homo sapiens
uuguauaggcucaguaagaauc

SEQ ID NO: 138523 - RNA, 22 nt, Homo sapiens
uugugaaaaaccucucguggaa

SEQ ID NO: 138524 - RNA, 22 nt, Homo sapiens
uuuaacauuggaugagaucguc

SEQ ID NO: 138525 - RNA, 22 nt, Homo sapiens
uuuacagucuuuugugugaguc

SEQ ID NO: 138526 - RNA, 22 nt, Homo sapiens
uuuagguuacauauaauccaaa

SEQ ID NO: 138527 - RNA, 22 nt, Homo sapiens
uuucuauguugaccagucuaga

SEQ ID NO: 138528 - RNA, 23 nt, Homo sapiens
uuucuugggcaugcuaugucagu

SEQ ID NO: 138529 - RNA, 22 nt, Homo sapiens
uuugauguugagacuauaaagc

SEQ ID NO: 138530 - RNA, 22 nt, Homo sapiens
uuugauguugauacuaccuuca

SEQ ID NO: 138531 - RNA, 22 nt, Homo sapiens
uuugccuuugugauauggucua

SEQ ID NO: 138532 - RNA, 17 nt, Homo sapiens
uuuuggauuagaaaucc

SEQ ID NO: 138533 - RNA, 21 nt, Homo sapiens
uggcaacauggauggauucug

SEQ ID NO: 138534 - RNA, 19 nt, Homo sapiens
uggcuagagcagauauccu

SEQ ID NO: 138535 - RNA, 21 nt, Homo sapiens
uggcuauuucuguggcauaca

SEQ ID NO: 138536 - RNA, 22 nt, Homo sapiens
uguauguagugaccagggccag

SEQ ID NO: 138537 - RNA, 22 nt, Homo sapiens
ugugaagauggacuaauauagu

SEQ ID NO: 138538 - RNA, 22 nt, Homo sapiens
uuaaagugaucauaaggauagu

SEQ ID NO: 138539 - RNA, 20 nt, Homo sapiens
uuaaaucuagugcagacuca

SEQ ID NO: 138540 - RNA, 22 nt, Homo sapiens
uuaaaugcacauacuugagaaa

SEQ ID NO: 138541 - RNA, 22 nt, Homo sapiens
uuaaaugcuagaauuuucuuug

SEQ ID NO: 138542 - RNA, 22 nt, Homo sapiens
uuaacagcacaugcugucccuu

SEQ ID NO: 138543 - RNA, 22 nt, Homo sapiens
uuccaugagaugcaucaaagcu

SEQ ID NO: 138544 - RNA, 22 nt, Homo sapiens
uuggaagagaagggagauaaac

SEQ ID NO: 138545 - RNA, 22 nt, Homo sapiens
uuggccauaugacuugcuuugg

SEQ ID NO: 138546 - RNA, 22 nt, Homo sapiens
uugugaaaucuaggcagagguu

SEQ ID NO: 138547 - RNA, 22 nt, Homo sapiens
uugugcaugaugcauacauggu

SEQ ID NO: 138548 - RNA, 22 nt, Homo sapiens
uuuaaagcuaaaauauguuuau

SEQ ID NO: 138549 - RNA, 22 nt, Homo sapiens
uuucauggaauauagucauuuu

SEQ ID NO: 138550 - RNA, 22 nt, Homo sapiens
uuuccuguaggaaggaaauaga

SEQ ID NO: 138551 - RNA, 22 nt, Homo sapiens
uuuccuguagggggcaaggccu

SEQ ID NO: 138552 - RNA, 22 nt, Homo sapiens
uuuggcuuugagaagcagugga

SEQ ID NO: 138553 - RNA, 22 nt, Homo sapiens
ugaaacacaccuccucuccauc

SEQ ID NO: 138554 - RNA, 22 nt, Homo sapiens
ugaaaguuauauugugaaauuc

SEQ ID NO: 138555 - RNA, 22 nt, Homo sapiens
ugaaauacuuaauuucuccaug

SEQ ID NO: 138556 - RNA, 22 nt, Homo sapiens
ugaaauguuaaacaaguggcuc

SEQ ID NO: 138557 - RNA, 22 nt, Homo sapiens
ugaagacauuuuugggugugua

SEQ ID NO: 138558 - RNA, 22 nt, Homo sapiens
ugacagcugaagauguugaacc

SEQ ID NO: 138559 - RNA, 22 nt, Homo sapiens
ugagaggugauaaagcaagggu

SEQ ID NO: 138560 - RNA, 22 nt, Homo sapiens
ugauagaucugggcaaaguaaa

SEQ ID NO: 138561 - RNA, 22 nt, Homo sapiens
ugcugcaaucucggcacuuugg

SEQ ID NO: 138562 - RNA, 22 nt, Homo sapiens
uggagaacauucauuugcaaga

SEQ ID NO: 138563 - RNA, 22 nt, Homo sapiens
uggaguguaaauuaguucagcc

SEQ ID NO: 138564 - RNA, 18 nt, Homo sapiens
uggcaagugccauacggu

SEQ ID NO: 138565 - RNA, 18 nt, Homo sapiens
uggcaauaugguucuacc

SEQ ID NO: 138566 - RNA, 22 nt, Homo sapiens
uggcaauguggaaugguccagg

SEQ ID NO: 138567 - RNA, 22 nt, Homo sapiens
ugugaagauguuucuuaauuga

SEQ ID NO: 138568 - RNA, 22 nt, Homo sapiens
ugugcaugacagcauacaaacg

SEQ ID NO: 138569 - RNA, 22 nt, Homo sapiens
uguugcacuccagccuagguga

SEQ ID NO: 138570 - RNA, 22 nt, Homo sapiens
uguugcacuccauccugggcga

SEQ ID NO: 138571 - RNA, 22 nt, Homo sapiens
uguugcacucuagccugggcaa

SEQ ID NO: 138572 - RNA, 22 nt, Homo sapiens
uuaaaaguauaggccuggcaua

SEQ ID NO: 138573 - RNA, 22 nt, Homo sapiens
uuaaaguguuugcagacaggug

SEQ ID NO: 138574 - RNA, 22 nt, Homo sapiens
uuaucauagugcaguuuucuga

SEQ ID NO: 138575 - RNA, 22 nt, Homo sapiens
uucaaaguaaagggauggagac

SEQ ID NO: 138576 - RNA, 22 nt, Homo sapiens
uucagagugaggcucucggaac

SEQ ID NO: 138577 - RNA, 22 nt, Homo sapiens
uucaucuggcaauucagagauu

SEQ ID NO: 138578 - RNA, 22 nt, Homo sapiens
uucuuagucauguaauagucca

SEQ ID NO: 138579 - RNA, 22 nt, Homo sapiens
uugaaagucuaggcuuacagua

SEQ ID NO: 138580 - RNA, 22 nt, Homo sapiens
uugacauaguuucugaaauaga

SEQ ID NO: 138581 - RNA, 22 nt, Homo sapiens
uugacauugcuguaguguccag

SEQ ID NO: 138582 - RNA, 22 nt, Homo sapiens
uugacuucagagcugauucaag

SEQ ID NO: 138583 - RNA, 22 nt, Homo sapiens
uugagagaaaaaauuuauuggu

SEQ ID NO: 138584 - RNA, 22 nt, Homo sapiens
uugcacaauggaauuuaucuuu

SEQ ID NO: 138585 - RNA, 22 nt, Homo sapiens
uuggagagagaggacucccggc

SEQ ID NO: 138586 - RNA, 22 nt, Homo sapiens
uuuaaagcaugacgagaagaag

SEQ ID NO: 138587 - RNA, 22 nt, Homo sapiens
uuuaaggcaugccuguacaugc

SEQ ID NO: 138588 - RNA, 22 nt, Homo sapiens
uuugacuuuuagaauaugaguu

SEQ ID NO: 138589 - RNA, 18 nt, Homo sapiens
aaaaagugcucaggccua

SEQ ID NO: 138590 - RNA, 22 nt, Homo sapiens
aaaccaccauuacuuuugcacc

SEQ ID NO: 138591 - RNA, 20 nt, Homo sapiens
aaacucugucuucuuuauca

SEQ ID NO: 138592 - RNA, 21 nt, Homo sapiens
aaaugcacauuacugcuggug

SEQ ID NO: 138593 - RNA, 22 nt, Homo sapiens
aaaugcacgcuacccagcuaga

SEQ ID NO: 138594 - RNA, 20 nt, Homo sapiens
aagugcaucguugugucugc

SEQ ID NO: 138595 - RNA, 20 nt, Homo sapiens
aauaacagccccagggaggu

SEQ ID NO: 138596 - RNA, 22 nt, Homo sapiens
aaucacaggucuuggcugcaug

SEQ ID NO: 138597 - RNA, 21 nt, Homo sapiens
aaucacaguuguucugccuuc

SEQ ID NO: 138598 - RNA, 22 nt, Homo sapiens
aaugacuaagaugguacauuuu

SEQ ID NO: 138599 - RNA, 22 nt, Homo sapiens
aaugguguuuccguuaagcuga

SEQ ID NO: 138600 - RNA, 22 nt, Homo sapiens
acaguguguguguucaccuaga

SEQ ID NO: 138601 - RNA, 22 nt, Homo sapiens
acauaaagaagcaggacauugu

SEQ ID NO: 138602 - RNA, 22 nt, Homo sapiens
acauauaaggagacuagggcau

SEQ ID NO: 138603 - RNA, 22 nt, Homo sapiens
acauggcacugcgggcuucuug

SEQ ID NO: 138604 - RNA, 22 nt, Homo sapiens
accugagauuacaggugcuggc

SEQ ID NO: 138605 - RNA, 23 nt, Homo sapiens
accuucauucauucagcugaagu

SEQ ID NO: 138606 - RNA, 22 nt, Homo sapiens
agaauguauauucuguaguugu

SEQ ID NO: 138607 - RNA, 22 nt, Homo sapiens
aggaauuuaauguaugauaaua

SEQ ID NO: 138608 - RNA, 22 nt, Homo sapiens
auaaaguucugcuggcauauau

SEQ ID NO: 138609 - RNA, 22 nt, Homo sapiens
auacaguauggagggcccagcu

SEQ ID NO: 138610 - RNA, 23 nt, Homo sapiens
auagagcuaggaugcagacagau

SEQ ID NO: 138611 - RNA, 22 nt, Homo sapiens
auagcagaagaagggacaauuc

SEQ ID NO: 138612 - RNA, 22 nt, Homo sapiens
auagcagugugaaaacagacua

SEQ ID NO: 138613 - RNA, 22 nt, Homo sapiens
auagcagugugagaaugaacua

SEQ ID NO: 138614 - RNA, 22 nt, Homo sapiens
auagcauagucagcuucgcuga

SEQ ID NO: 138615 - RNA, 17 nt, Homo sapiens
auaugaauuuuggagau

SEQ ID NO: 138616 - RNA, 22 nt, Homo sapiens
auauucacagguaucagagauu

SEQ ID NO: 138617 - RNA, 22 nt, Homo sapiens
aucaaaguuucccagaaguugu

SEQ ID NO: 138618 - RNA, 22 nt, Homo sapiens
aucaaaugcuggcagagugccu

SEQ ID NO: 138619 - RNA, 22 nt, Homo sapiens
aucugggguuggcaaaguuugg

SEQ ID NO: 138620 - RNA, 22 nt, Homo sapiens
augaaaacaugauuugccuguu

SEQ ID NO: 138621 - RNA, 22 nt, Homo sapiens
augaaaucuuuggcagaucuua

SEQ ID NO: 138622 - RNA, 22 nt, Homo sapiens
augacauuccacagccguagag

SEQ ID NO: 138623 - RNA, 19 nt, Homo sapiens
augacauuuggggguggac

SEQ ID NO: 138624 - RNA, 22 nt, Homo sapiens
augagauauuuuauaagaucau

SEQ ID NO: 138625 - RNA, 22 nt, Homo sapiens
augauacuggcuucauagaaug

SEQ ID NO: 138626 - RNA, 22 nt, Homo sapiens
auggagagaauuauucucucag

SEQ ID NO: 138627 - RNA, 22 nt, Homo sapiens
auggcacugccuggcuucaugg

SEQ ID NO: 138628 - RNA, 22 nt, Homo sapiens
auuaaguugugccugaaaacuu

SEQ ID NO: 138629 - RNA, 22 nt, Homo sapiens
auuaaucaggcaaugcuugcua

SEQ ID NO: 138630 - RNA, 22 nt, Homo sapiens
auucuauaguccuaggauuggg

SEQ ID NO: 138631 - RNA, 22 nt, Homo sapiens
auugaacaugccauauguacca

SEQ ID NO: 138632 - RNA, 22 nt, Homo sapiens
auugaacuuuugucacugacau

SEQ ID NO: 138633 - RNA, 22 nt, Homo sapiens
auuguacuccagccuuggggac

SEQ ID NO: 138634 - RNA, 22 nt, Homo sapiens
caaaagugguucuuauccuuuu

SEQ ID NO: 138635 - RNA, 22 nt, Homo sapiens
caagugaauaguugcucucaga

SEQ ID NO: 138636 - RNA, 19 nt, Homo sapiens
caauacuucuuggcauaca

SEQ ID NO: 138637 - RNA, 22 nt, Homo sapiens
cacacugucuucaauggguggu

SEQ ID NO: 138638 - RNA, 22 nt, Homo sapiens
cacacuguuuuccauggggguu

SEQ ID NO: 138639 - RNA, 22 nt, Homo sapiens
cagagaacauucagagcuguag

SEQ ID NO: 138640 - RNA, 19 nt, Homo sapiens
caguaucauugcacauagu

SEQ ID NO: 138641 - RNA, 22 nt, Homo sapiens
cagugcauaggaucuaaaauuu

SEQ ID NO: 138642 - RNA, 22 nt, Homo sapiens
ccauggcaauggucagucuauu

SEQ ID NO: 138643 - RNA, 22 nt, Homo sapiens
ccauugaacaugaaggaaugug

SEQ ID NO: 138644 - RNA, 22 nt, Homo sapiens
ccauuucacucuuccugaagga

SEQ ID NO: 138645 - RNA, 22 nt, Homo sapiens
ccucacaaccuuuauugaagag

SEQ ID NO: 138646 - RNA, 22 nt, Homo sapiens
cuaaaacuuucugagugcagca

SEQ ID NO: 138647 - RNA, 22 nt, Homo sapiens
cuagcagaacaauacaauucgg

SEQ ID NO: 138648 - RNA, 22 nt, Homo sapiens
cuauucacaggcaauauguaca

SEQ ID NO: 138649 - RNA, 22 nt, Homo sapiens
cucaaagucaagggaaagcagg

SEQ ID NO: 138650 - RNA, 22 nt, Homo sapiens
cucacugucaacauguauuugg

SEQ ID NO: 138651 - RNA, 22 nt, Homo sapiens
cucauuggcuacugaggcuugu

SEQ ID NO: 138652 - RNA, 22 nt, Homo sapiens
cuggcaauaaauuuuuguguug

SEQ ID NO: 138653 - RNA, 19 nt, Homo sapiens
cugugcauuucuguggaag

SEQ ID NO: 138654 - RNA, 18 nt, Homo sapiens
cuuaacauugggaugaua

SEQ ID NO: 138655 - RNA, 20 nt, Homo sapiens
cuucacagaaguggaaucau

SEQ ID NO: 138656 - RNA, 22 nt, Homo sapiens
gaaugaauguuuauccuuagau

SEQ ID NO: 138657 - RNA, 22 nt, Homo sapiens
gaauuguacugcaaucagggga

SEQ ID NO: 138658 - RNA, 22 nt, Homo sapiens
gacagugagaugucaugugaaa

SEQ ID NO: 138659 - RNA, 22 nt, Homo sapiens
gagaacauacggcauuugguuu

SEQ ID NO: 138660 - RNA, 22 nt, Homo sapiens
gagaacauuuaagccacucagg

SEQ ID NO: 138661 - RNA, 22 nt, Homo sapiens
gagauacacccagugcagaggc

SEQ ID NO: 138662 - RNA, 22 nt, Homo sapiens
gagguaaguggauuaugagguc

SEQ ID NO: 138663 - RNA, 22 nt, Homo sapiens
gagguauggauaucuggagagg

SEQ ID NO: 138664 - RNA, 22 nt, Homo sapiens
gauaaaguauuggguacuaugc

SEQ ID NO: 138665 - RNA, 22 nt, Homo sapiens
gauaacagauaaugucaguuau

SEQ ID NO: 138666 - RNA, 18 nt, Homo sapiens
gauaacaguggacuaugc

SEQ ID NO: 138667 - RNA, 22 nt, Homo sapiens
gaucugugugauuggaugcauu

SEQ ID NO: 138668 - RNA, 22 nt, Homo sapiens
gcaaaugcuacaccauuuugua

SEQ ID NO: 138669 - RNA, 22 nt, Homo sapiens
gcauggagaaggggacugauuc

SEQ ID NO: 138670 - RNA, 22 nt, Homo sapiens
ggaaagcuagguguggguguac

SEQ ID NO: 138671 - RNA, 22 nt, Homo sapiens
ggaaggucaaagggaaagcaga

SEQ ID NO: 138672 - RNA, 22 nt, Homo sapiens
ggacuguacuccuggccagugu

SEQ ID NO: 138673 - RNA, 22 nt, Homo sapiens
guaaaucucuguuuucauggac

SEQ ID NO: 138674 - RNA, 22 nt, Homo sapiens
guacaguacugaaugaauguau

SEQ ID NO: 138675 - RNA, 22 nt, Homo sapiens
guacaguuuucaguguucacug

SEQ ID NO: 138676 - RNA, 22 nt, Homo sapiens
guagagguagacuuccuugucu

SEQ ID NO: 138677 - RNA, 22 nt, Homo sapiens
guagcagaauaucagauaauuu

SEQ ID NO: 138678 - RNA, 22 nt, Homo sapiens
guaugucuugucuauggcugcu

SEQ ID NO: 138679 - RNA, 22 nt, Homo sapiens
gugaaagacagcauuaauggcu

SEQ ID NO: 138680 - RNA, 22 nt, Homo sapiens
gugaaagacauauaugguuuga

SEQ ID NO: 138681 - RNA, 22 nt, Homo sapiens
gugaaagauuaaaccagugugu

SEQ ID NO: 138682 - RNA, 22 nt, Homo sapiens
gugaaguuuuugugaggccuaa

SEQ ID NO: 138683 - RNA, 22 nt, Homo sapiens
gugacagucaaagacaugacuu

SEQ ID NO: 138684 - RNA, 16 nt, Homo sapiens
gugagagaugacaaac

SEQ ID NO: 138685 - RNA, 22 nt, Homo sapiens
gugaggaaggaaaccugcuagc

SEQ ID NO: 138686 - RNA, 22 nt, Homo sapiens
gugauuauuaugcacugcaugc

SEQ ID NO: 138687 - RNA, 22 nt, Homo sapiens
gugcacaacgugcaaguuuguu

SEQ ID NO: 138688 - RNA, 22 nt, Homo sapiens
gugcacaacgugcaggcuuguu

SEQ ID NO: 138689 - RNA, 22 nt, Homo sapiens
gugcacaaugugcagguuuguu

SEQ ID NO: 138690 - RNA, 22 nt, Homo sapiens
gugcauaugcaugugcaugcac

SEQ ID NO: 138691 - RNA, 22 nt, Homo sapiens
uaaagcgaggucuccuacaaga

SEQ ID NO: 138692 - RNA, 22 nt, Homo sapiens
aaagguaguacuucuagaaggg

SEQ ID NO: 138693 - RNA, 22 nt, Homo sapiens
aaaugcacaaagauuuugcacu

SEQ ID NO: 138694 - RNA, 22 nt, Homo sapiens
aaaugcaccacucuggugcagg

SEQ ID NO: 138695 - RNA, 22 nt, Homo sapiens
aacacuguuuccagucaugauc

SEQ ID NO: 138696 - RNA, 22 nt, Homo sapiens
aacagaauccucuuuuccuggg

SEQ ID NO: 138697 - RNA, 22 nt, Homo sapiens
aagagguaauaacaaagcuucu

SEQ ID NO: 138698 - RNA, 21 nt, Homo sapiens
aagcaugguguaucuuuccau

SEQ ID NO: 138699 - RNA, 22 nt, Homo sapiens
aaggaauucaaauuuucucugg

SEQ ID NO: 138700 - RNA, 22 nt, Homo sapiens
aaggaguagaauagaugcaccu

SEQ ID NO: 138701 - RNA, 22 nt, Homo sapiens
aagugaaugaugugaaguguaa

SEQ ID NO: 138702 - RNA, 19 nt, Homo sapiens
aagugaaugcuuuguucac

SEQ ID NO: 138703 - RNA, 22 nt, Homo sapiens
aagugaaugugcuggaauagcu

SEQ ID NO: 138704 - RNA, 20 nt, Homo sapiens
aagugaguguuaaacugaac

SEQ ID NO: 138705 - RNA, 22 nt, Homo sapiens
aauaaagucugaagugugcuua

SEQ ID NO: 138706 - RNA, 22 nt, Homo sapiens
aauagcauugaaucuaccaauu

SEQ ID NO: 138707 - RNA, 22 nt, Homo sapiens
aauggcaaauguuuucuguuga

SEQ ID NO: 138708 - RNA, 22 nt, Homo sapiens
accagucucagguaugucuuua

SEQ ID NO: 138709 - RNA, 22 nt, Homo sapiens
agaaccaaucccacauggauac

SEQ ID NO: 138710 - RNA, 22 nt, Homo sapiens
agagagguggguggagccccca

SEQ ID NO: 138711 - RNA, 22 nt, Homo sapiens
agagauuauccuggcuucucug

SEQ ID NO: 138712 - RNA, 22 nt, Homo sapiens
agagguauuggaaggaguguca

SEQ ID NO: 138713 - RNA, 22 nt, Homo sapiens
agagugaagcuuuuuauauucu

SEQ ID NO: 138714 - RNA, 22 nt, Homo sapiens
agcaauaugacauugcuacauc

SEQ ID NO: 138715 - RNA, 22 nt, Homo sapiens
agcugcaaagggagagaugauu

SEQ ID NO: 138716 - RNA, 22 nt, Homo sapiens
agcugcaauguuuaguauaaua

SEQ ID NO: 138717 - RNA, 22 nt, Homo sapiens
aggagguaggaauugugcuagg

SEQ ID NO: 138718 - RNA, 22 nt, Homo sapiens
aguaucacaggcaaaacagaau

SEQ ID NO: 138719 - RNA, 22 nt, Homo sapiens
auaacagcauuauugcauacgu

SEQ ID NO: 138720 - RNA, 22 nt, Homo sapiens
auacacauuccugggccucacc

SEQ ID NO: 138721 - RNA, 19 nt, Homo sapiens
auacacguguauacauaca

SEQ ID NO: 138722 - RNA, 22 nt, Homo sapiens
auacaguaucuucuggcaagca

SEQ ID NO: 138723 - RNA, 22 nt, Homo sapiens
auagaaucaucugugcacuagu

SEQ ID NO: 138724 - RNA, 22 nt, Homo sapiens
auagcaaugcaagaauggcuua

SEQ ID NO: 138725 - RNA, 22 nt, Homo sapiens
auagcagaccaccucucccacu

SEQ ID NO: 138726 - RNA, 22 nt, Homo sapiens
aucaaagugaauuaaugagaau

SEQ ID NO: 138727 - RNA, 22 nt, Homo sapiens
aucacauuuauaguggcacgca

SEQ ID NO: 138728 - RNA, 22 nt, Homo sapiens
aucauggaguauuugcaagucu

SEQ ID NO: 138729 - RNA, 22 nt, Homo sapiens
aucucaguucaggcuggccaca

SEQ ID NO: 138730 - RNA, 22 nt, Homo sapiens
aucuuuaguggcuguuuucaga

SEQ ID NO: 138731 - RNA, 22 nt, Homo sapiens
augaaacuggcuaauuuuugua

SEQ ID NO: 138732 - RNA, 22 nt, Homo sapiens
augaaagguugucuuaagccau

SEQ ID NO: 138733 - RNA, 22 nt, Homo sapiens
augaagacaucgucugggauua

SEQ ID NO: 138734 - RNA, 22 nt, Homo sapiens
augaauacugcugcaaugaaca

SEQ ID NO: 138735 - RNA, 22 nt, Homo sapiens
augacauugaaaagcaagugga

SEQ ID NO: 138736 - RNA, 22 nt, Homo sapiens
augaugucauuuuaauuucuaa

SEQ ID NO: 138737 - RNA, 22 nt, Homo sapiens
auggaaggagaggaaugaauga

SEQ ID NO: 138738 - RNA, 22 nt, Homo sapiens
auggagguguggggagugaguu

SEQ ID NO: 138739 - RNA, 22 nt, Homo sapiens
auggcaauaugaugcacuguuu

SEQ ID NO: 138740 - RNA, 22 nt, Homo sapiens
auggcaaugcgaugaugacuga

SEQ ID NO: 138741 - RNA, 22 nt, Homo sapiens
auggcaaugcgauggugacuga

SEQ ID NO: 138742 - RNA, 22 nt, Homo sapiens
augugaaugugaucggauaguc

SEQ ID NO: 138743 - RNA, 22 nt, Homo sapiens
auguggcacuugacuuucucgc

SEQ ID NO: 138744 - RNA, 22 nt, Homo sapiens
auuaacaucuagaguuuuggug

SEQ ID NO: 138745 - RNA, 22 nt, Homo sapiens
auuacaugucuauccaugaaca

SEQ ID NO: 138746 - RNA, 23 nt, Homo sapiens
auugaacacuuucauaugugagg

SEQ ID NO: 138747 - RNA, 22 nt, Homo sapiens
caaaagugauugcgguuuuugc

SEQ ID NO: 138748 - RNA, 22 nt, Homo sapiens
caauggcaaugaaauagugaga

SEQ ID NO: 138749 - RNA, 22 nt, Homo sapiens
cacagugaaugucaucauugcc

SEQ ID NO: 138750 - RNA, 22 nt, Homo sapiens
cagagguauugcaaaagccuag

SEQ ID NO: 138751 - RNA, 20 nt, Homo sapiens
cagcaaccugcucucuuccu

SEQ ID NO: 138752 - RNA, 22 nt, Homo sapiens
cagggaauguuauuuaauagca

SEQ ID NO: 138753 - RNA, 22 nt, Homo sapiens
cauugcaguuuuugguguaucu

SEQ ID NO: 138754 - RNA, 22 nt, Homo sapiens
cauuugcacugagacucagcuu

SEQ ID NO: 138755 - RNA, 23 nt, Homo sapiens
cccaguuaauccuuaaucuccac

SEQ ID NO: 138756 - RNA, 22 nt, Homo sapiens
cuaaagauagugacaugauuug

SEQ ID NO: 138757 - RNA, 22 nt, Homo sapiens
aaagugauguccaggcuuucag

SEQ ID NO: 138758 - RNA, 22 nt, Homo sapiens
aaaugcacagaaaggaugugga

SEQ ID NO: 138759 - RNA, 22 nt, Homo sapiens
aaauugcaguuaggaugauggu

SEQ ID NO: 138760 - RNA, 22 nt, Homo sapiens
aagauauguuaguuauaaacuc

SEQ ID NO: 138761 - RNA, 22 nt, Homo sapiens
aagccagugugacaggaaacuu

SEQ ID NO: 138762 - RNA, 22 nt, Homo sapiens
aagcuggauuuaguguggagca

SEQ ID NO: 138763 - RNA, 22 nt, Homo sapiens
aaggaguagaggaauagcaaug

SEQ ID NO: 138764 - RNA, 22 nt, Homo sapiens
aaguaaauauccgguaguccca

SEQ ID NO: 138765 - RNA, 22 nt, Homo sapiens
aagucaguuugggagaagcuau

SEQ ID NO: 138766 - RNA, 22 nt, Homo sapiens
aauaaagcugaauccuuccuga

SEQ ID NO: 138767 - RNA, 22 nt, Homo sapiens
aaugcacauaaaauccuccagg

SEQ ID NO: 138768 - RNA, 22 nt, Homo sapiens
aaugcacauauauuuccuuauu

SEQ ID NO: 138769 - RNA, 22 nt, Homo sapiens
acaaagcgcuucucuuuagagu

SEQ ID NO: 138770 - RNA, 20 nt, Homo sapiens
acaaaugcauucugugacau

SEQ ID NO: 138771 - RNA, 20 nt, Homo sapiens
acacuggcuuugagauuuag

SEQ ID NO: 138772 - RNA, 22 nt, Homo sapiens
acagugcuucugauaugaugcc

SEQ ID NO: 138773 - RNA, 19 nt, Homo sapiens
acauggauuuugugcaaac

SEQ ID NO: 138774 - RNA, 21 nt, Homo sapiens
acccucuaguuuucaacaggc

SEQ ID NO: 138775 - RNA, 22 nt, Homo sapiens
acuauacugaagcaaauuaaca

SEQ ID NO: 138776 - RNA, 21 nt, Homo sapiens
agagaacugaaacaugugacu

SEQ ID NO: 138777 - RNA, 22 nt, Homo sapiens
agagguaagcaguggcaagugc

SEQ ID NO: 138778 - RNA, 22 nt, Homo sapiens
agagguuuugcccucgagauaa

SEQ ID NO: 138779 - RNA, 21 nt, Homo sapiens
agagucaucucuaucuguacc

SEQ ID NO: 138780 - RNA, 22 nt, Homo sapiens
agcauggucacuuugggcccca

SEQ ID NO: 138781 - RNA, 22 nt, Homo sapiens
aggugguuuugaugagcaggua

SEQ ID NO: 138782 - RNA, 22 nt, Homo sapiens
aguaaaucacuaauggcuuccg

SEQ ID NO: 138783 - RNA, 22 nt, Homo sapiens
agucaaaugcuuauguauaaag

SEQ ID NO: 138784 - RNA, 22 nt, Homo sapiens
agugcauugcaucucugcuuca

SEQ ID NO: 138785 - RNA, 22 nt, Homo sapiens
auaaauaguaguugugguggcc

SEQ ID NO: 138786 - RNA, 22 nt, Homo sapiens
auaacagcugcaaggcaaaagc

SEQ ID NO: 138787 - RNA, 22 nt, Homo sapiens
auacuagucaagaauguaugag

SEQ ID NO: 138788 - RNA, 22 nt, Homo sapiens
auagacacugaaaucccugcca

SEQ ID NO: 138789 - RNA, 22 nt, Homo sapiens
auagcagugugaaaacagacug

SEQ ID NO: 138790 - RNA, 22 nt, Homo sapiens
auagcagugugaggacagacua

SEQ ID NO: 138791 - RNA, 22 nt, Homo sapiens
auagcauaucccacaugucaga

SEQ ID NO: 138792 - RNA, 22 nt, Homo sapiens
auaugcacgugcauacacacuu

SEQ ID NO: 138793 - RNA, 18 nt, Homo sapiens
auauugccuucagacuag

SEQ ID NO: 138794 - RNA, 22 nt, Homo sapiens
uaacuaaagagaagucaauguc

SEQ ID NO: 138795 - RNA, 21 nt, Homo sapiens
uaagcuaaacauucaguuaac

SEQ ID NO: 138796 - RNA, 22 nt, Homo sapiens
uaagugaaggaaguguguuuac

SEQ ID NO: 138797 - RNA, 22 nt, Homo sapiens
uaagugaauuucacuacugagu

SEQ ID NO: 138798 - RNA, 22 nt, Homo sapiens
uaaucacagagguuuggccuca

SEQ ID NO: 138799 - RNA, 22 nt, Homo sapiens
uaaugcacucgaaucauggaau

SEQ ID NO: 138800 - RNA, 22 nt, Homo sapiens
uacaaguggguuugugcaggag

SEQ ID NO: 138801 - RNA, 22 nt, Homo sapiens
uacaauagugacaaaucagcau

SEQ ID NO: 138802 - RNA, 22 nt, Homo sapiens
uacacagucaaaaauuuccagg

SEQ ID NO: 138803 - RNA, 22 nt, Homo sapiens
uagagcacauuaucauuuccaa

SEQ ID NO: 138804 - RNA, 22 nt, Homo sapiens
uagcaguaucccaccaucuggu

SEQ ID NO: 138805 - RNA, 22 nt, Homo sapiens
uaguucauuuuucuugcuuaga

SEQ ID NO: 138806 - RNA, 22 nt, Homo sapiens
uauagcagccugaacaaaguaa

SEQ ID NO: 138807 - RNA, 22 nt, Homo sapiens
uaucacagguggacugcacacc

SEQ ID NO: 138808 - RNA, 23 nt, Homo sapiens
uaucucaaugcacagagaggaaa

SEQ ID NO: 138809 - RNA, 22 nt, Homo sapiens
uaugcuuauugucucauccacu

SEQ ID NO: 138810 - RNA, 22 nt, Homo sapiens
uauggcaaugcauaggaaggaa

SEQ ID NO: 138811 - RNA, 22 nt, Homo sapiens
uaugugcacaugcccuggugac

SEQ ID NO: 138812 - RNA, 22 nt, Homo sapiens
ucaaaugcacguagagaaaaua

SEQ ID NO: 138813 - RNA, 20 nt, Homo sapiens
ucacaagccaagaucacguc

SEQ ID NO: 138814 - RNA, 21 nt, Homo sapiens
ucacaaugaacagcagcagaa

SEQ ID NO: 138815 - RNA, 22 nt, Homo sapiens
ucacaguucagcauggcugagg

SEQ ID NO: 138816 - RNA, 20 nt, Homo sapiens
ucacugugaacuucuugagg

SEQ ID NO: 138817 - RNA, 22 nt, Homo sapiens
ucacugugagaguuuauccugu

SEQ ID NO: 138818 - RNA, 22 nt, Homo sapiens
ucagaccauuucauuacagacu

SEQ ID NO: 138819 - RNA, 22 nt, Homo sapiens
ucccaguuuuucugaauaguca

SEQ ID NO: 138820 - RNA, 22 nt, Homo sapiens
ucccugaguaucuaauguguuu

SEQ ID NO: 138821 - RNA, 22 nt, Homo sapiens
ugaaagcuacagucuccuagga

SEQ ID NO: 138822 - RNA, 22 nt, Homo sapiens
ugaagcuaacuugauugugaug

SEQ ID NO: 138823 - RNA, 22 nt, Homo sapiens
ugaaggacauaaggcagaguga

SEQ ID NO: 138824 - RNA, 22 nt, Homo sapiens
ugaaguaauguuuuauucuauu

SEQ ID NO: 138825 - RNA, 22 nt, Homo sapiens
ugaagugaagacucacagaagg

SEQ ID NO: 138826 - RNA, 22 nt, Homo sapiens
ugacauagcuauuaagugaugc

SEQ ID NO: 138827 - RNA, 22 nt, Homo sapiens
ugacuagagcaauuggaaacaa

SEQ ID NO: 138828 - RNA, 22 nt, Homo sapiens
ugagaacuuauggugauuuuuu

SEQ ID NO: 138829 - RNA, 22 nt, Homo sapiens
ugaggucauguucugucagguu

SEQ ID NO: 138830 - RNA, 22 nt, Homo sapiens
ugauaacauuucuucugguaca

SEQ ID NO: 138831 - RNA, 22 nt, Homo sapiens
ugauauguaacuacuccuuaua

SEQ ID NO: 138832 - RNA, 22 nt, Homo sapiens
ugcauacacaagcauacaugua

SEQ ID NO: 138833 - RNA, 23 nt, Homo sapiens
uggaggacaagcauggauaguga

SEQ ID NO: 138834 - RNA, 22 nt, Homo sapiens
uggcaauaaaaugcaguuacuu

SEQ ID NO: 138835 - RNA, 19 nt, Homo sapiens
uggcaaugucagcagagau

SEQ ID NO: 138836 - RNA, 22 nt, Homo sapiens
uggcagauaggauacaggacua

SEQ ID NO: 138837 - RNA, 22 nt, Homo sapiens
uggcagaugagccgcgcuccaa

SEQ ID NO: 138838 - RNA, 23 nt, Homo sapiens
uggcauuuuaguuagcuucagug

SEQ ID NO: 138839 - RNA, 22 nt, Homo sapiens
uggcgagaugcucgugugcaga

SEQ ID NO: 138840 - RNA, 22 nt, Homo sapiens
uggcuagaugagauguacugca

SEQ ID NO: 138841 - RNA, 22 nt, Homo sapiens
ugucauguaaagaguaaauggu

SEQ ID NO: 138842 - RNA, 22 nt, Homo sapiens
ugucuuguagacaauguauagu

SEQ ID NO: 138843 - RNA, 22 nt, Homo sapiens
ugugaaaucagauagccuuuuu

SEQ ID NO: 138844 - RNA, 22 nt, Homo sapiens
ugugaacauuuuguauauauua

SEQ ID NO: 138845 - RNA, 22 nt, Homo sapiens
uguugcacuccagccugggcaa

SEQ ID NO: 138846 - RNA, 22 nt, Homo sapiens
uuaaagcuggcguuacaguuug

SEQ ID NO: 138847 - RNA, 22 nt, Homo sapiens
uuaaauacagcaugguguuucu

SEQ ID NO: 138848 - RNA, 22 nt, Homo sapiens
uuaaaugcucacauaaagguag

SEQ ID NO: 138849 - RNA, 22 nt, Homo sapiens
uuaacagcacuacguggggauc

SEQ ID NO: 138850 - RNA, 22 nt, Homo sapiens
uuaaggaaagcauuuaauucag

SEQ ID NO: 138851 - RNA, 22 nt, Homo sapiens
uuaagugcucaguuacucaguu

SEQ ID NO: 138852 - RNA, 22 nt, Homo sapiens
uuaaugaacuuuauuuuguaga

SEQ ID NO: 138853 - RNA, 22 nt, Homo sapiens
uuacaguaugaguaagaguucu

SEQ ID NO: 138854 - RNA, 22 nt, Homo sapiens
uuagaucaacauggaacucuau

SEQ ID NO: 138855 - RNA, 22 nt, Homo sapiens
uucaaaguuggaggacaaacug

SEQ ID NO: 138856 - RNA, 22 nt, Homo sapiens
uucaagucaaggaaagaggucu

SEQ ID NO: 138857 - RNA, 22 nt, Homo sapiens
uucaauacuguugauccuuaug

SEQ ID NO: 138858 - RNA, 22 nt, Homo sapiens
uucacagugugaucuaugggca

SEQ ID NO: 138859 - RNA, 20 nt, Homo sapiens
uucagcaaaggaaugggagu

SEQ ID NO: 138860 - RNA, 22 nt, Homo sapiens
uucaguagucaaaagauaaggg

SEQ ID NO: 138861 - RNA, 22 nt, Homo sapiens
uugaaggaggugcucacucucg

SEQ ID NO: 138862 - RNA, 22 nt, Homo sapiens
uugacagaccuuggucauaucc

SEQ ID NO: 138863 - RNA, 22 nt, Homo sapiens
uugcaacuuagaaaaaucauuu

SEQ ID NO: 138864 - RNA, 22 nt, Homo sapiens
uugcacaauccugugagugagu

SEQ ID NO: 138865 - RNA, 20 nt, Homo sapiens
uugcagagcccaacccugga

SEQ ID NO: 138866 - RNA, 23 nt, Homo sapiens
uugcauagacauccucauagauu

SEQ ID NO: 138867 - RNA, 22 nt, Homo sapiens
uuggagagugauauucagaugc

SEQ ID NO: 138868 - RNA, 22 nt, Homo sapiens
uuggcaauauuuacugaaguug

SEQ ID NO: 138869 - RNA, 22 nt, Homo sapiens
uuggcaaucaauucugacgucu

SEQ ID NO: 138870 - RNA, 22 nt, Homo sapiens
uuuaaagcacggaguuuguggc

SEQ ID NO: 138871 - RNA, 22 nt, Homo sapiens
uuuaaagcuccaagcaugucug

SEQ ID NO: 138872 - RNA, 22 nt, Homo sapiens
uuuaaugcaucccaaaauguag

SEQ ID NO: 138873 - RNA, 22 nt, Homo sapiens
uuuccaagaugcuuacuuucuc

SEQ ID NO: 138874 - RNA, 22 nt, Homo sapiens
uuuggcuuaagauugacugcaa

SEQ ID NO: 138875 - RNA, 21 nt, Homo sapiens
uuuggcuucucugcugcagcc

SEQ ID NO: 138876 - RNA, 22 nt, Homo sapiens
aaagagaucuaugggcacuaug

SEQ ID NO: 138877 - RNA, 22 nt, Homo sapiens
aaaugcccuaaaauggagcauc

SEQ ID NO: 138878 - RNA, 22 nt, Homo sapiens
aaaugcucuguggguaguaaug

SEQ ID NO: 138879 - RNA, 22 nt, Homo sapiens
aacacuguuuccagucaugauc

SEQ ID NO: 138880 - RNA, 22 nt, Homo sapiens
aacagauugcugagccccaccc

SEQ ID NO: 138881 - RNA, 22 nt, Homo sapiens
aacaguaucuaacgagugauga

SEQ ID NO: 138882 - RNA, 22 nt, Homo sapiens
aacugcacauauuuguaugggu

SEQ ID NO: 138883 - RNA, 22 nt, Homo sapiens
aagagagccagcugguauauuu

SEQ ID NO: 138884 - RNA, 23 nt, Homo sapiens
aagagguaugacuaugaagugga

SEQ ID NO: 138885 - RNA, 22 nt, Homo sapiens
aaggcaagauacugguugcuga

SEQ ID NO: 138886 - RNA, 23 nt, Homo sapiens
aagguaagcuagaaagauguaga

SEQ ID NO: 138887 - RNA, 22 nt, Homo sapiens
aaguaaauauccgguaguccca

SEQ ID NO: 138888 - RNA, 22 nt, Homo sapiens
aaguaaaucuuaugucagggag

SEQ ID NO: 138889 - RNA, 20 nt, Homo sapiens
aagugcaucguugugucugc

SEQ ID NO: 138890 - RNA, 22 nt, Homo sapiens
aagugcuuacagggaacaugau

SEQ ID NO: 138891 - RNA, 22 nt, Homo sapiens
aagugcuuaggauagugugugg

SEQ ID NO: 138892 - RNA, 22 nt, Homo sapiens
aauaagcugagagaauucuaca

SEQ ID NO: 138893 - RNA, 22 nt, Homo sapiens
aaugugcacuuggagccuugcu

SEQ ID NO: 138894 - RNA, 22 nt, Homo sapiens
aauguguuuugaaaucaggaag

SEQ ID NO: 138895 - RNA, 22 nt, Homo sapiens
acaagacuucuuguauucuagu

SEQ ID NO: 138896 - RNA, 22 nt, Homo sapiens
acaagcacaaaugcauagaugg

SEQ ID NO: 138897 - RNA, 22 nt, Homo sapiens
acacaguaagcacaguguagau

SEQ ID NO: 138898 - RNA, 22 nt, Homo sapiens
acacaugugaaaaaaauguuac

SEQ ID NO: 138899 - RNA, 22 nt, Homo sapiens
acacauuagcaagugcuguuau

SEQ ID NO: 138900 - RNA, 22 nt, Homo sapiens
cugucuguuucaaaagugguua

SEQ ID NO: 138901 - RNA, 22 nt, Homo sapiens
cuuugguucuguuuauaugcug

SEQ ID NO: 138902 - RNA, 22 nt, Homo sapiens
cuuuuacacuguuagugggaau

SEQ ID NO: 138903 - RNA, 22 nt, Homo sapiens
cuuuuugcugcagcaauacugg

SEQ ID NO: 138904 - RNA, 22 nt, Homo sapiens
gaaagauuuccugagcuagaaa

SEQ ID NO: 138905 - RNA, 22 nt, Homo sapiens
gaaaguguugagauuacaggca

SEQ ID NO: 138906 - RNA, 22 nt, Homo sapiens
gaagaacuaggugagaucuaga

SEQ ID NO: 138907 - RNA, 22 nt, Homo sapiens
gaagacauuuacaugggagacc

SEQ ID NO: 138908 - RNA, 22 nt, Homo sapiens
gaagacauuugcugcacguccu

SEQ ID NO: 138909 - RNA, 22 nt, Homo sapiens
gaagagacagguucccacaaaa

SEQ ID NO: 138910 - RNA, 22 nt, Homo sapiens
gaaugauacuguuaacgaaaga

SEQ ID NO: 138911 - RNA, 22 nt, Homo sapiens
gacacuggguguuuguuggcgu

SEQ ID NO: 138912 - RNA, 18 nt, Homo sapiens
gacaguguggcaauuccu

SEQ ID NO: 138913 - RNA, 22 nt, Homo sapiens
gacauagagccuugacuucauu

SEQ ID NO: 138914 - RNA, 22 nt, Homo sapiens
gagcucaccuuaccucuggagc

SEQ ID NO: 138915 - RNA, 22 nt, Homo sapiens
gaguaaauguccuagcuucuug

SEQ ID NO: 138916 - RNA, 22 nt, Homo sapiens
gaguauauuugcacuguuaugu

SEQ ID NO: 138917 - RNA, 21 nt, Homo sapiens
gaguggcuuuuguuucaccag

SEQ ID NO: 138918 - RNA, 22 nt, Homo sapiens
gauauguguuuuagucaggguu

SEQ ID NO: 138919 - RNA, 22 nt, Homo sapiens
gaugacagcugacucccuugcu

SEQ ID NO: 138920 - RNA, 22 nt, Homo sapiens
gcauaugucuuuauagcagcau

SEQ ID NO: 138921 - RNA, 22 nt, Homo sapiens
gccauagucauagauggcaggg

SEQ ID NO: 138922 - RNA, 22 nt, Homo sapiens
gccucaguuguggccagggauu

SEQ ID NO: 138923 - RNA, 22 nt, Homo sapiens
gcuggguucagagugggcugcg

SEQ ID NO: 138924 - RNA, 19 nt, Homo sapiens
gcuuuguggggaaggagcc

SEQ ID NO: 138925 - RNA, 22 nt, Homo sapiens
ggaaagaucagcuaaauguaag

SEQ ID NO: 138926 - RNA, 22 nt, Homo sapiens
ggagcucaucuagcauagaggu

SEQ ID NO: 138927 - RNA, 22 nt, Homo sapiens
ggcuuggaggaaugugagggcu

SEQ ID NO: 138928 - RNA, 22 nt, Homo sapiens
gggcaaaacuguacugccaagg

SEQ ID NO: 138929 - RNA, 22 nt, Homo sapiens
ggucacauuggacuaucaaguu

SEQ ID NO: 138930 - RNA, 22 nt, Homo sapiens
ggucuuggagaauuguccuggg

SEQ ID NO: 138931 - RNA, 22 nt, Homo sapiens
ggugacugguuuaucuggcagu

SEQ ID NO: 138932 - RNA, 22 nt, Homo sapiens
guacaugcaugcaugggugugc

SEQ ID NO: 138933 - RNA, 22 nt, Homo sapiens
guagaauguauacaguauacag

SEQ ID NO: 138934 - RNA, 22 nt, Homo sapiens
guaucauugccuaaugcucuca

SEQ ID NO: 138935 - RNA, 22 nt, Homo sapiens
guauuuguugcagcagcacuau

SEQ ID NO: 138936 - RNA, 22 nt, Homo sapiens
gucagggagucucuaucagugg

SEQ ID NO: 138937 - RNA, 22 nt, Homo sapiens
gucaggugcuuacgcggagauc

SEQ ID NO: 138938 - RNA, 22 nt, Homo sapiens
gucagugucuuugcagcucaga

SEQ ID NO: 138939 - RNA, 22 nt, Homo sapiens
gucccugcgauugugggauccu

SEQ ID NO: 138940 - RNA, 22 nt, Homo sapiens
gucuuggagacauugccauuga

SEQ ID NO: 138941 - RNA, 22 nt, Homo sapiens
gucuuugagauaggguuauuuu

SEQ ID NO: 138942 - RNA, 22 nt, Homo sapiens
gugaaaagaugagcaccauaca

SEQ ID NO: 138943 - RNA, 17 nt, Homo sapiens
gugaaaucaucauuuuu

SEQ ID NO: 138944 - RNA, 22 nt, Homo sapiens
gugaggaaggaaaccugcuagc

SEQ ID NO: 138945 - RNA, 22 nt, Homo sapiens
gugcaaaucucugaguaucuuu

SEQ ID NO: 138946 - RNA, 22 nt, Homo sapiens
gugcaagagugauugcaguuuu

SEQ ID NO: 138947 - RNA, 22 nt, Homo sapiens
guguauacauagaauuguguau

SEQ ID NO: 138948 - RNA, 19 nt, Homo sapiens
gugugcauaucacagagca

SEQ ID NO: 138949 - RNA, 21 nt, Homo sapiens
uaaaacuguaacuuuguccug

SEQ ID NO: 138950 - RNA, 22 nt, Homo sapiens
uaacaguauaugugguaucuau

SEQ ID NO: 138951 - RNA, 22 nt, Homo sapiens
uaagaauucuguccgguauacu

SEQ ID NO: 138952 - RNA, 22 nt, Homo sapiens
uaagccaccgugccuggccuaa

SEQ ID NO: 138953 - RNA, 22 nt, Homo sapiens
uaaguauuaugugcugcauuuu

SEQ ID NO: 138954 - RNA, 22 nt, Homo sapiens
uaaguguaaugucugaaguuug

SEQ ID NO: 138955 - RNA, 22 nt, Homo sapiens
uaauagcucggauaaacaugau

SEQ ID NO: 138956 - RNA, 22 nt, Homo sapiens
uacacgugcacaacgugcacgu

SEQ ID NO: 138957 - RNA, 22 nt, Homo sapiens
uacagucauaaugccuagugac

SEQ ID NO: 138958 - RNA, 22 nt, Homo sapiens
uacaugugcacaacgugcaggu

SEQ ID NO: 138959 - RNA, 22 nt, Homo sapiens
uacaugugcaggucuguggggg

SEQ ID NO: 138960 - RNA, 22 nt, Homo sapiens
uacuccccuuguucugugagcu

SEQ ID NO: 138961 - RNA, 22 nt, Homo sapiens
uacuuuguagagugugagaauu

SEQ ID NO: 138962 - RNA, 22 nt, Homo sapiens
uagcacuauguuaucacauacu

SEQ ID NO: 138963 - RNA, 22 nt, Homo sapiens
uagcagcaccccacucuacugg

SEQ ID NO: 138964 - RNA, 20 nt, Homo sapiens
uagcagcagacagagggagg

SEQ ID NO: 138965 - RNA, 22 nt, Homo sapiens
uagcagcaucucuggcuucuac

SEQ ID NO: 138966 - RNA, 22 nt, Homo sapiens
uaggcaauguggcgaaacucug

SEQ ID NO: 138967 - RNA, 22 nt, Homo sapiens
uauaaccauuucuucucucuuc

SEQ ID NO: 138968 - RNA, 22 nt, Homo sapiens
uauacaguaggcacucaguggc

SEQ ID NO: 138969 - RNA, 23 nt, Homo sapiens
uauaugugucuaggagcuauggu

SEQ ID NO: 138970 - RNA, 21 nt, Homo sapiens
uaucacauuggugauuaaguu

SEQ ID NO: 138971 - RNA, 22 nt, Homo sapiens
uauggcauuauuuugauagaca

SEQ ID NO: 138972 - RNA, 22 nt, Homo sapiens
uaugugcacaugcccuggugac

SEQ ID NO: 138973 - RNA, 18 nt, Homo sapiens
ucaagcaauugucaugcc

SEQ ID NO: 138974 - RNA, 22 nt, Homo sapiens
ucacaagugagaggaauuagau

SEQ ID NO: 138975 - RNA, 22 nt, Homo sapiens
ucacaguagagcuucuuucaga

SEQ ID NO: 138976 - RNA, 22 nt, Homo sapiens
ucacaguaucaugggggacaga

SEQ ID NO: 138977 - RNA, 22 nt, Homo sapiens
ucacaguauucaugaacaugga

SEQ ID NO: 138978 - RNA, 22 nt, Homo sapiens
ucacagucggugacuucuugcu

SEQ ID NO: 138979 - RNA, 22 nt, Homo sapiens
ucaccuggagccuucacauucu

SEQ ID NO: 138980 - RNA, 22 nt, Homo sapiens
ucacugggagcauuugagccuu

SEQ ID NO: 138981 - RNA, 20 nt, Homo sapiens
ucacugugaacuucuugagg

SEQ ID NO: 138982 - RNA, 22 nt, Homo sapiens
ucaggcuuuucccagagugaug

SEQ ID NO: 138983 - RNA, 22 nt, Homo sapiens
ucagugccucaguuuuuaaaga

SEQ ID NO: 138984 - RNA, 21 nt, Homo sapiens
ucagugcugugggcaaggugc

SEQ ID NO: 138985 - RNA, 19 nt, Homo sapiens
uccccgggucuagugcagc

SEQ ID NO: 138986 - RNA, 22 nt, Homo sapiens
uccccuuuguaagauggaaacg

SEQ ID NO: 138987 - RNA, 22 nt, Homo sapiens
uccuucacucuacaucuuuguu

SEQ ID NO: 138988 - RNA, 22 nt, Homo sapiens
uccuugagccuuaaauuauaaa

SEQ ID NO: 138989 - RNA, 22 nt, Homo sapiens
uccuugguugauccugugcaga

SEQ ID NO: 138990 - RNA, 22 nt, Homo sapiens
uccuuugguuauaggcaccucu

SEQ ID NO: 138991 - RNA, 22 nt, Homo sapiens
uccuuugguucuugucacccca

SEQ ID NO: 138992 - RNA, 22 nt, Homo sapiens
ucucauggcucacccugcauag

SEQ ID NO: 138993 - RNA, 21 nt, Homo sapiens
ucucucaaccaggaagugggc

SEQ ID NO: 138994 - RNA, 22 nt, Homo sapiens
ucucuugguugaacaguuugga

SEQ ID NO: 138995 - RNA, 23 nt, Homo sapiens
ucuggaucauucguagugccagc

SEQ ID NO: 138996 - RNA, 22 nt, Homo sapiens
ucuggguuuuguaccgugcucg

SEQ ID NO: 138997 - RNA, 22 nt, Homo sapiens
ucuggguuuuuccauugccggu

SEQ ID NO: 138998 - RNA, 19 nt, Homo sapiens
ucugucacuggggguauuc

SEQ ID NO: 138999 - RNA, 22 nt, Homo sapiens
ucuuaggugaugauugauguga

SEQ ID NO: 139000 - RNA, 22 nt, Homo sapiens
ucuuaguuuagauuagcaauuc

SEQ ID NO: 139001 - RNA, 22 nt, Homo sapiens
ucuugcuuguuguucccuucau

SEQ ID NO: 139002 - RNA, 22 nt, Homo sapiens
ucuuggguuuguccuucuccua

SEQ ID NO: 139003 - RNA, 22 nt, Homo sapiens
ucuugguugaaaauucauaaua

SEQ ID NO: 139004 - RNA, 22 nt, Homo sapiens
ucuuuaguuaagggacauuuua

SEQ ID NO: 139005 - RNA, 22 nt, Homo sapiens
ucuuugaguguauacuuagauu

SEQ ID NO: 139006 - RNA, 22 nt, Homo sapiens
ucuuuguugcauaggcuuguuc

SEQ ID NO: 139007 - RNA, 22 nt, Homo sapiens
ugaaacauacacucugaugggg

SEQ ID NO: 139008 - RNA, 22 nt, Homo sapiens
ugaaaucauguaguuauugcaa

SEQ ID NO: 139009 - RNA, 22 nt, Homo sapiens
uucauguagucaucauccugcu

SEQ ID NO: 139010 - RNA, 22 nt, Homo sapiens
uucccagagagggacuucuaau

SEQ ID NO: 139011 - RNA, 22 nt, Homo sapiens
uucccaguggaacauguaguca

SEQ ID NO: 139012 - RNA, 22 nt, Homo sapiens
uuccuugagaaaggcacaaguu

SEQ ID NO: 139013 - RNA, 22 nt, Homo sapiens
uucuccugguggacccuaaacg

SEQ ID NO: 139014 - RNA, 22 nt, Homo sapiens
uucugcacaucgaucacaagau

SEQ ID NO: 139015 - RNA, 22 nt, Homo sapiens
uucuggcucaggucaacacuuc

SEQ ID NO: 139016 - RNA, 22 nt, Homo sapiens
uucuuuggauaaaguuuuaugc

SEQ ID NO: 139017 - RNA, 22 nt, Homo sapiens
uugaaguguguauacauugugg

SEQ ID NO: 139018 - RNA, 22 nt, Homo sapiens
uugaggucuucaggaucaggcu

SEQ ID NO: 139019 - RNA, 22 nt, Homo sapiens
uugaggugaagggcagagcagc

SEQ ID NO: 139020 - RNA, 20 nt, Homo sapiens
uugaggugugaggggcagag

SEQ ID NO: 139021 - RNA, 22 nt, Homo sapiens
uugauauguuguuagauucagu

SEQ ID NO: 139022 - RNA, 22 nt, Homo sapiens
uugauauuacucaguaacagau

SEQ ID NO: 139023 - RNA, 22 nt, Homo sapiens
uugcacuguaauuuauuuaugu

SEQ ID NO: 139024 - RNA, 20 nt, Homo sapiens
uugcagagcccaacccugga

SEQ ID NO: 139025 - RNA, 22 nt, Homo sapiens
uuggcaaagaggaaugccacuu

SEQ ID NO: 139026 - RNA, 22 nt, Homo sapiens
uuggucucuuaaucacacuuuu

SEQ ID NO: 139027 - RNA, 22 nt, Homo sapiens
uugucacugcacuccagucugg

SEQ ID NO: 139028 - RNA, 22 nt, Homo sapiens
uugugaagaaaccagaaaaguu

SEQ ID NO: 139029 - RNA, 22 nt, Homo sapiens
uugugaagaugugaagcaagca

SEQ ID NO: 139030 - RNA, 22 nt, Homo sapiens
uugugcacauguacccuagaac

SEQ ID NO: 139031 - RNA, 20 nt, Homo sapiens
uugugcauugggccauuggg

SEQ ID NO: 139032 - RNA, 22 nt, Homo sapiens
uuuaaguguuuguuccugaaaa

SEQ ID NO: 139033 - RNA, 22 nt, Homo sapiens
uuuaugcuacauguguuggaaa

SEQ ID NO: 139034 - RNA, 22 nt, Homo sapiens
uuucuacagggcuugccaggua

SEQ ID NO: 139035 - RNA, 22 nt, Homo sapiens
uuugcaucuuuugcuuccugga

SEQ ID NO: 139036 - RNA, 22 nt, Homo sapiens
uuugggccaugcuucccgguca

SEQ ID NO: 139037 - RNA, 22 nt, Homo sapiens
uuugggccucugauuucuuugg

SEQ ID NO: 139038 - RNA, 22 nt, Homo sapiens
uuugugacuugcuucucagaau

SEQ ID NO: 139039 - RNA, 22 nt, Homo sapiens
uuuuagcuuuucccaggacucc

SEQ ID NO: 139040 - RNA, 19 nt, Homo sapiens
gauagacaucacagugcca

SEQ ID NO: 139041 - RNA, 22 nt, Homo sapiens
gauagcagccauucuuuuuauu

SEQ ID NO: 139042 - RNA, 22 nt, Homo sapiens
gaugcagcuaggauuugugaca

SEQ ID NO: 139043 - RNA, 22 nt, Homo sapiens
gcacaguguuacuugauauauu

SEQ ID NO: 139044 - RNA, 17 nt, Homo sapiens
gcauaugucgaaccagc

SEQ ID NO: 139045 - RNA, 20 nt, Homo sapiens
gcauaugucuuuauagcaga

SEQ ID NO: 139046 - RNA, 17 nt, Homo sapiens
gcauauguugaaccagu

SEQ ID NO: 139047 - RNA, 20 nt, Homo sapiens
gccacaguuaagcuucugcc

SEQ ID NO: 139048 - RNA, 22 nt, Homo sapiens
gccccgggugaugcagccguca

SEQ ID NO: 139049 - RNA, 19 nt, Homo sapiens
gcucaccuugcugcuccag

SEQ ID NO: 139050 - RNA, 22 nt, Homo sapiens
gcuggguugccagguuacuuaa

SEQ ID NO: 139051 - RNA, 22 nt, Homo sapiens
ggcaaaauggccagugggucac

SEQ ID NO: 139052 - RNA, 17 nt, Homo sapiens
ggcaggaauuaauguca

SEQ ID NO: 139053 - RNA, 21 nt, Homo sapiens
ggcaugaauggaaaagugaga

SEQ ID NO: 139054 - RNA, 22 nt, Homo sapiens
ggcucguguuuucuguccaguu

SEQ ID NO: 139055 - RNA, 22 nt, Homo sapiens
guaaagacacaugcacacguau

SEQ ID NO: 139056 - RNA, 22 nt, Homo sapiens
guaacagucucaacaguggucu

SEQ ID NO: 139057 - RNA, 22 nt, Homo sapiens
guaaggcuucuggucaacagca

SEQ ID NO: 139058 - RNA, 22 nt, Homo sapiens
guacauguaugcaugcaugcau

SEQ ID NO: 139059 - RNA, 22 nt, Homo sapiens
guagcagcuacuaaguugcugu

SEQ ID NO: 139060 - RNA, 22 nt, Homo sapiens
guauccugaaguucucagcacu

SEQ ID NO: 139061 - RNA, 22 nt, Homo sapiens
gucacaguggccagugauguuc

SEQ ID NO: 139062 - RNA, 22 nt, Homo sapiens
gucauugagucagggaguaucu

SEQ ID NO: 139063 - RNA, 22 nt, Homo sapiens
gucucauugcaguuagaccugu

SEQ ID NO: 139064 - RNA, 22 nt, Homo sapiens
gucuuugaugucuaugugcuuc

SEQ ID NO: 139065 - RNA, 22 nt, Homo sapiens
gugaccaaagauagcucaaguu

SEQ ID NO: 139066 - RNA, 22 nt, Homo sapiens
gugagacugaguuucgcucuug

SEQ ID NO: 139067 - RNA, 22 nt, Homo sapiens
gugagauggagucuugcuuugu

SEQ ID NO: 139068 - RNA, 22 nt, Homo sapiens
gugagaugguaucucauugugg

SEQ ID NO: 139069 - RNA, 22 nt, Homo sapiens
gugcacuguagaacccuuuguu

SEQ ID NO: 139070 - RNA, 22 nt, Homo sapiens
gugcauaucugugguuggcuga

SEQ ID NO: 139071 - RNA, 23 nt, Homo sapiens
gugcaugagucuuuauaguagca

SEQ ID NO: 139072 - RNA, 22 nt, Homo sapiens
gugcuauguuauccagcaagau

SEQ ID NO: 139073 - RNA, 18 nt, Homo sapiens
guggagugucuuccugga

SEQ ID NO: 139074 - RNA, 22 nt, Homo sapiens
guggaucacuugaggucaagag

SEQ ID NO: 139075 - RNA, 22 nt, Homo sapiens
guguucauggaauuugcaauug

SEQ ID NO: 139076 - RNA, 22 nt, Homo sapiens
guguuugguugauagagccacu

SEQ ID NO: 139077 - RNA, 22 nt, Homo sapiens
uaaagcuuagauccaugguggc

SEQ ID NO: 139078 - RNA, 21 nt, Homo sapiens
uaaagcuuagcuauaguggcu

SEQ ID NO: 139079 - RNA, 22 nt, Homo sapiens
uaaaugacugucaguagaugaa

SEQ ID NO: 139080 - RNA, 22 nt, Homo sapiens
uaaauggauaaaugaauaccua

SEQ ID NO: 139081 - RNA, 23 nt, Homo sapiens
uaagacacuaacuuuaugcuuug

SEQ ID NO: 139082 - RNA, 22 nt, Homo sapiens
uaagacuuuuugggaauauaga

SEQ ID NO: 139083 - RNA, 22 nt, Homo sapiens
uaaguaauugcagcaauuugcc

SEQ ID NO: 139084 - RNA, 22 nt, Homo sapiens
uaaguagcugggaguacaggca

SEQ ID NO: 139085 - RNA, 22 nt, Homo sapiens
uaagugaauauggacaguuagc

SEQ ID NO: 139086 - RNA, 22 nt, Homo sapiens
uaagugcaugauuacaugcaua

SEQ ID NO: 139087 - RNA, 22 nt, Homo sapiens
uaauugaaugcagacaccaggg

SEQ ID NO: 139088 - RNA, 22 nt, Homo sapiens
uacaagcacaggcagcaggcug

SEQ ID NO: 139089 - RNA, 22 nt, Homo sapiens
uacagcacaggugcagguguug

SEQ ID NO: 139090 - RNA, 22 nt, Homo sapiens
uacaggacuucucagaguuauu

SEQ ID NO: 139091 - RNA, 22 nt, Homo sapiens
uacuagaaccuuauucagagug

SEQ ID NO: 139092 - RNA, 22 nt, Homo sapiens
uagcagcaaagcaggaucugcu

SEQ ID NO: 139093 - RNA, 22 nt, Homo sapiens
uagcagcauaaauggacuaaga

SEQ ID NO: 139094 - RNA, 19 nt, Homo sapiens
uagcagcaugauuuauaau

SEQ ID NO: 139095 - RNA, 22 nt, Homo sapiens
uagcugagacuacaguaggugc

SEQ ID NO: 139096 - RNA, 23 nt, Homo sapiens
uagcuucucccagaccugcuccc

SEQ ID NO: 139097 - RNA, 22 nt, Homo sapiens
uaggcaguuuuccuuucacagu

SEQ ID NO: 139098 - RNA, 22 nt, Homo sapiens
uagucacacacucaacuuuuca

SEQ ID NO: 139099 - RNA, 20 nt, Homo sapiens
uaucacaggucagaaacccu

SEQ ID NO: 139100 - RNA, 22 nt, Homo sapiens
uaugugcaaauuaauugcuaga

SEQ ID NO: 139101 - RNA, 22 nt, Homo sapiens
uauuagugucuuuugguuagaa

SEQ ID NO: 139102 - RNA, 22 nt, Homo sapiens
uauuguacauguuauagauuuu

SEQ ID NO: 139103 - RNA, 22 nt, Homo sapiens
uauuugauugacuuuagcagga

SEQ ID NO: 139104 - RNA, 22 nt, Homo sapiens
ucaaagugacaaaguugcagca

SEQ ID NO: 139105 - RNA, 22 nt, Homo sapiens
ucaagcaauucuccugccucag

SEQ ID NO: 139106 - RNA, 22 nt, Homo sapiens
ucacaguaacuuuguugcuuuu

SEQ ID NO: 139107 - RNA, 22 nt, Homo sapiens
ucacaguauggggggugguuau

SEQ ID NO: 139108 - RNA, 22 nt, Homo sapiens
ucacauguguaaauugguguaa

SEQ ID NO: 139109 - RNA, 22 nt, Homo sapiens
ucaccuggagaagauggaucau

SEQ ID NO: 139110 - RNA, 21 nt, Homo sapiens
ucacuaguaaaaggugaacug

SEQ ID NO: 139111 - RNA, 22 nt, Homo sapiens
ucacuggucuaaguggaggggg

SEQ ID NO: 139112 - RNA, 22 nt, Homo sapiens
ucacugugagaguuuauccugu

SEQ ID NO: 139113 - RNA, 22 nt, Homo sapiens
ucaguaaauguuaggacauuuc

SEQ ID NO: 139114 - RNA, 23 nt, Homo sapiens
ucagugucuggauccugcucagu

SEQ ID NO: 139115 - RNA, 22 nt, Homo sapiens
ucagugucugugauggagaggu

SEQ ID NO: 139116 - RNA, 22 nt, Homo sapiens
ucauucacucccuugaaguuag

SEQ ID NO: 139117 - RNA, 22 nt, Homo sapiens
uccacagugguggaauuguuca

SEQ ID NO: 139118 - RNA, 22 nt, Homo sapiens
uccaugugaaaaggucgugaua

SEQ ID NO: 139119 - RNA, 22 nt, Homo sapiens
uccaugugaaaucuaugaggac

SEQ ID NO: 139120 - RNA, 22 nt, Homo sapiens
ucccagaaacgcauauguucau

SEQ ID NO: 139121 - RNA, 22 nt, Homo sapiens
uccucaguggauuggauggugc

SEQ ID NO: 139122 - RNA, 22 nt, Homo sapiens
uccugcauucauccugguguug

SEQ ID NO: 139123 - RNA, 22 nt, Homo sapiens
uccuugaaacaggaagaauuca

SEQ ID NO: 139124 - RNA, 22 nt, Homo sapiens
uccuuuaguuaauaaagacaag

SEQ ID NO: 139125 - RNA, 19 nt, Homo sapiens
ucuaaaucucuugauagac

SEQ ID NO: 139126 - RNA, 22 nt, Homo sapiens
ucucaauggguuguagacaaag

SEQ ID NO: 139127 - RNA, 22 nt, Homo sapiens
ucucagugaauugguuuugucu

SEQ ID NO: 139128 - RNA, 22 nt, Homo sapiens
ucucagugacugcugggucccc

SEQ ID NO: 139129 - RNA, 22 nt, Homo sapiens
ucugccacugucauugugugau

SEQ ID NO: 139130 - RNA, 22 nt, Homo sapiens
ucuggccuccuaugagaaucga

SEQ ID NO: 139131 - RNA, 20 nt, Homo sapiens
ucuggguuuuggccacgccc

SEQ ID NO: 139132 - RNA, 22 nt, Homo sapiens
ucugucacugguggacgaucac

SEQ ID NO: 139133 - RNA, 22 nt, Homo sapiens
ucugucuuugccuaaguuuguc

SEQ ID NO: 139134 - RNA, 22 nt, Homo sapiens
ucuugcuuuugcagagcuucuc

SEQ ID NO: 139135 - RNA, 21 nt, Homo sapiens
ucuuggguugaauucucccag

SEQ ID NO: 139136 - RNA, 22 nt, Homo sapiens
ucuuggguuguuggcuucuccu

SEQ ID NO: 139137 - RNA, 22 nt, Homo sapiens
ucuuggguuugccuugcugcug

SEQ ID NO: 139138 - RNA, 22 nt, Homo sapiens
ucuugucacugcauccccagcu

SEQ ID NO: 139139 - RNA, 19 nt, Homo sapiens
ucuuuagucacauuuuuau

SEQ ID NO: 139140 - RNA, 22 nt, Homo sapiens
ucuuucacuuagcaugauguuu

SEQ ID NO: 139141 - RNA, 22 nt, Homo sapiens
ucuuuguguucaggagccacgu

SEQ ID NO: 139142 - RNA, 22 nt, Homo sapiens
ucuuuguucaggagccaacucc

SEQ ID NO: 139143 - RNA, 22 nt, Homo sapiens
ucuuuguuuucugauccugaag

SEQ ID NO: 139144 - RNA, 22 nt, Homo sapiens
ugaaaugaucaguuugguuacu

SEQ ID NO: 139145 - RNA, 22 nt, Homo sapiens
ugaauagacacuaaagacugua

SEQ ID NO: 139146 - RNA, 22 nt, Homo sapiens
ugaaugauuuuaaaagccucuc

SEQ ID NO: 139147 - RNA, 22 nt, Homo sapiens
ugacaguaucuacagcuucuua

SEQ ID NO: 139148 - RNA, 22 nt, Homo sapiens
ugacuucagacugaaaugauuc

SEQ ID NO: 139149 - RNA, 22 nt, Homo sapiens
acugcacuccagccuccugaca

SEQ ID NO: 139150 - RNA, 22 nt, Homo sapiens
acugcacuccagccucgcaaca

SEQ ID NO: 139151 - RNA, 22 nt, Homo sapiens
acugcacuccagccucggggac

SEQ ID NO: 139152 - RNA, 22 nt, Homo sapiens
acugcacuccagccucggugac

SEQ ID NO: 139153 - RNA, 22 nt, Homo sapiens
acugcacuccagccugaugaaa

SEQ ID NO: 139154 - RNA, 22 nt, Homo sapiens
acugcacuccagccugccgaca

SEQ ID NO: 139155 - RNA, 22 nt, Homo sapiens
acugcacuccagccugcuggau

SEQ ID NO: 139156 - RNA, 22 nt, Homo sapiens
acugcacuccagccugcugggu

SEQ ID NO: 139157 - RNA, 22 nt, Homo sapiens
acugcacuccagccuuagugac

SEQ ID NO: 139158 - RNA, 22 nt, Homo sapiens
acugcacuccagccuuggcaac

SEQ ID NO: 139159 - RNA, 22 nt, Homo sapiens
acugcacuccagccuuggccac

SEQ ID NO: 139160 - RNA, 22 nt, Homo sapiens
acugcacuccagcuugggugac

SEQ ID NO: 139161 - RNA, 22 nt, Homo sapiens
acugcacuccggccucgugaca

SEQ ID NO: 139162 - RNA, 19 nt, Homo sapiens
acugcacuccuccuugggu

SEQ ID NO: 139163 - RNA, 22 nt, Homo sapiens
acugcacucuagcauggguaau

SEQ ID NO: 139164 - RNA, 22 nt, Homo sapiens
acugcacugucaaccuccuggg

SEQ ID NO: 139165 - RNA, 22 nt, Homo sapiens
acugcacuguccuagaguccuc

SEQ ID NO: 139166 - RNA, 20 nt, Homo sapiens
acugcacuucagccugcugg

SEQ ID NO: 139167 - RNA, 22 nt, Homo sapiens
acuggguuaauuugaagguuga

SEQ ID NO: 139168 - RNA, 22 nt, Homo sapiens
acuuggcaaaguuuuaaacagc

SEQ ID NO: 139169 - RNA, 22 nt, Homo sapiens
agagugcaauggcaccaucucg

SEQ ID NO: 139170 - RNA, 22 nt, Homo sapiens
agcaacauuguucauaauagcu

SEQ ID NO: 139171 - RNA, 22 nt, Homo sapiens
agcaagaugaaguugagcuagg

SEQ ID NO: 139172 - RNA, 22 nt, Homo sapiens
agcacagccuuguguuuucuug

SEQ ID NO: 139173 - RNA, 22 nt, Homo sapiens
agcagcacaucccuuucuggcc

SEQ ID NO: 139174 - RNA, 23 nt, Homo sapiens
agccugguuucccugcuucuccc

SEQ ID NO: 139175 - RNA, 22 nt, Homo sapiens
agcuucauucugaauagguuga

SEQ ID NO: 139176 - RNA, 22 nt, Homo sapiens
agucacagugaccuugucugac

SEQ ID NO: 139177 - RNA, 22 nt, Homo sapiens
agucagugucuguaaggagaac

SEQ ID NO: 139178 - RNA, 22 nt, Homo sapiens
agugauguggaguuuggaugga

SEQ ID NO: 139179 - RNA, 22 nt, Homo sapiens
agugcauaugucuuuuuggaag

SEQ ID NO: 139180 - RNA, 22 nt, Homo sapiens
aguggauguuguggccugggag

SEQ ID NO: 139181 - RNA, 22 nt, Homo sapiens
auaaaguguuuaguauaggcaa

SEQ ID NO: 139182 - RNA, 22 nt, Homo sapiens
auaaaugcuuagaucuguauau

SEQ ID NO: 139183 - RNA, 19 nt, Homo sapiens
auaagugaaucacgggggc

SEQ ID NO: 139184 - RNA, 22 nt, Homo sapiens
auagaauguauuaguaaauuug

SEQ ID NO: 139185 - RNA, 22 nt, Homo sapiens
auauguucucauucauaugugg

SEQ ID NO: 139186 - RNA, 22 nt, Homo sapiens
aucaaagugaaauauuaguuau

SEQ ID NO: 139187 - RNA, 22 nt, Homo sapiens
aucaaaugcuggcagagugccu

SEQ ID NO: 139188 - RNA, 22 nt, Homo sapiens
aucacaguuaagaggugaugaa

SEQ ID NO: 139189 - RNA, 22 nt, Homo sapiens
aucaccugagcaguauacacug

SEQ ID NO: 139190 - RNA, 22 nt, Homo sapiens
aucacuguccacucaucuuucu

SEQ ID NO: 139191 - RNA, 22 nt, Homo sapiens
aucauccugucaggagcuguga

SEQ ID NO: 139192 - RNA, 22 nt, Homo sapiens
aucccuuccuagcacuuggugu

SEQ ID NO: 139193 - RNA, 22 nt, Homo sapiens
aucucugagauguucugauuuu

SEQ ID NO: 139194 - RNA, 22 nt, Homo sapiens
aucuggcuucuuuuaguccaca

SEQ ID NO: 139195 - RNA, 22 nt, Homo sapiens
augaaaagcauaaacgcugaag

SEQ ID NO: 139196 - RNA, 22 nt, Homo sapiens
augaaaucuuuggcagaucuua

SEQ ID NO: 139197 - RNA, 22 nt, Homo sapiens
augaggugggcggcuuggaaga

SEQ ID NO: 139198 - RNA, 22 nt, Homo sapiens
augcagagaaaucuaaaauaug

SEQ ID NO: 139199 - RNA, 22 nt, Homo sapiens
augcauaugucuuuauaguggc

SEQ ID NO: 139200 - RNA, 22 nt, Homo sapiens
augccacagaaauaaccaaaau

SEQ ID NO: 139201 - RNA, 22 nt, Homo sapiens
augcuacauucuacaauuaggc

SEQ ID NO: 139202 - RNA, 22 nt, Homo sapiens
auggcguguggcuuggaggcug

SEQ ID NO: 139203 - RNA, 22 nt, Homo sapiens
augggugaguaugaguugacuu

SEQ ID NO: 139204 - RNA, 21 nt, Homo sapiens
auguaaugaagaagccacugg

SEQ ID NO: 139205 - RNA, 22 nt, Homo sapiens
auguccuggacccagacaaagc

SEQ ID NO: 139206 - RNA, 22 nt, Homo sapiens
augugcagauguuacaaauugu

SEQ ID NO: 139207 - RNA, 20 nt, Homo sapiens
augugcaguguggcaaccaa

SEQ ID NO: 139208 - RNA, 22 nt, Homo sapiens
augugcaugcuguucugccaga

SEQ ID NO: 139209 - RNA, 22 nt, Homo sapiens
auuaacaucuagaguuuuggug

SEQ ID NO: 139210 - RNA, 20 nt, Homo sapiens
auuagagcuacauggcuaca

SEQ ID NO: 139211 - RNA, 22 nt, Homo sapiens
auucacugugcuuggccaaauu

SEQ ID NO: 139212 - RNA, 22 nt, Homo sapiens
caaauugcuugucuguagugga

SEQ ID NO: 139213 - RNA, 22 nt, Homo sapiens
cacagugaacugguggguuuuu

SEQ ID NO: 139214 - RNA, 22 nt, Homo sapiens
cacccaguaagcaugaggcccu

SEQ ID NO: 139215 - RNA, 22 nt, Homo sapiens
cagacagugucccgagucccug

SEQ ID NO: 139216 - RNA, 22 nt, Homo sapiens
cagugcaaccuccaucucucgg

SEQ ID NO: 139217 - RNA, 22 nt, Homo sapiens
cagugucugcauuuggaacuca

SEQ ID NO: 139218 - RNA, 22 nt, Homo sapiens
caucccugucgucaagucucug

SEQ ID NO: 139219 - RNA, 22 nt, Homo sapiens
caugacacauguuuaccuaugu

SEQ ID NO: 139220 - RNA, 22 nt, Homo sapiens
cauggcacuguaugaaaugugc

SEQ ID NO: 139221 - RNA, 22 nt, Homo sapiens
ccaaaguauuuucacugauauc

SEQ ID NO: 139222 - RNA, 22 nt, Homo sapiens
ccacaguagucuugggaugggc

SEQ ID NO: 139223 - RNA, 22 nt, Homo sapiens
ccuggguuacaggugugagcca

SEQ ID NO: 139224 - RNA, 22 nt, Homo sapiens
ccuucauccuccagcaggcuag

SEQ ID NO: 139225 - RNA, 22 nt, Homo sapiens
cuagucacauuuucaucaaaua

SEQ ID NO: 139226 - RNA, 18 nt, Homo sapiens
cucacaguaacuuuuaag

SEQ ID NO: 139227 - RNA, 22 nt, Homo sapiens
cucacagucagaagggacuugc

SEQ ID NO: 139228 - RNA, 22 nt, Homo sapiens
cucacaguucuaaaggcaagaa

SEQ ID NO: 139229 - RNA, 22 nt, Homo sapiens
cucucuguuugucuguuauugg

SEQ ID NO: 139230 - RNA, 22 nt, Homo sapiens
cucugacagugguuagcacugu

SEQ ID NO: 139231 - RNA, 22 nt, Homo sapiens
cucuuggguagauuuugcagag

SEQ ID NO: 139232 - RNA, 22 nt, Homo sapiens
cugaaaagcaucugcauagcug

SEQ ID NO: 139233 - RNA, 22 nt, Homo sapiens
cugaggaaguucuuuaacaguu

SEQ ID NO: 139234 - RNA, 22 nt, Homo sapiens
cugagguauuuaggugaaagaa

SEQ ID NO: 139235 - RNA, 20 nt, Homo sapiens
cugaggugggagaaucgcuu

SEQ ID NO: 139236 - RNA, 22 nt, Homo sapiens
cugaucuguagcagccaccaca

SEQ ID NO: 139237 - RNA, 22 nt, Homo sapiens
cugcacugagacccucuuugcu

SEQ ID NO: 139238 - RNA, 22 nt, Homo sapiens
cuggaaagaaacccuuaauucu

SEQ ID NO: 139239 - RNA, 22 nt, Homo sapiens
cuggaaugugagccccaaaaag

SEQ ID NO: 139240 - RNA, 20 nt, Homo sapiens
cuggaugucgaggcagaggu

SEQ ID NO: 139241 - RNA, 21 nt, Homo sapiens
cugguguuagcacuucuuccc

SEQ ID NO: 139242 - RNA, 19 nt, Homo sapiens
cugucacugaggaagacug

SEQ ID NO: 139243 - RNA, 21 nt, Homo sapiens
cuuugguuucugacuugcaua

SEQ ID NO: 139244 - RNA, 22 nt, Homo sapiens
cuuugugcccuucugcccauca

SEQ ID NO: 139245 - RNA, 22 nt, Homo sapiens
gaaaacugcuucucuggguuuc

SEQ ID NO: 139246 - RNA, 22 nt, Homo sapiens
gacagacacaauugauccauga

SEQ ID NO: 139247 - RNA, 22 nt, Homo sapiens
gacauguaaggcucucucuguu

SEQ ID NO: 139248 - RNA, 22 nt, Homo sapiens
gagauucuucaauauuuauucu

SEQ ID NO: 139249 - RNA, 22 nt, Homo sapiens
gagcuuggguuaaaguugccuu

SEQ ID NO: 139250 - RNA, 22 nt, Homo sapiens
gagguaaguaagaauggcaagc

SEQ ID NO: 139251 - RNA, 22 nt, Homo sapiens
gaguaaaugucaaguacuuagg

SEQ ID NO: 139252 - RNA, 22 nt, Homo sapiens
gaguucauuuugaaaccuugau

SEQ ID NO: 139253 - RNA, 18 nt, Homo sapiens
gauaacaguggacuaugc

SEQ ID NO: 139254 - RNA, 22 nt, Homo sapiens
ugacuucauuugguaauugggu

SEQ ID NO: 139255 - RNA, 22 nt, Homo sapiens
ugagacugagucucccucuguc

SEQ ID NO: 139256 - RNA, 22 nt, Homo sapiens
ugagacugagucucgcucuauu

SEQ ID NO: 139257 - RNA, 22 nt, Homo sapiens
ugagacugaguuucacuuuugu

SEQ ID NO: 139258 - RNA, 22 nt, Homo sapiens
ugagacugaguuuugccuuugu

SEQ ID NO: 139259 - RNA, 22 nt, Homo sapiens
uaaggcuuugucuuaggacuuu

SEQ ID NO: 139260 - RNA, 22 nt, Homo sapiens
uaaggcuuuuguucagcguggg

SEQ ID NO: 139261 - RNA, 22 nt, Homo sapiens
uacaguaauguuaaucuuugug

SEQ ID NO: 139262 - RNA, 22 nt, Homo sapiens
uacccuuuaguauaaaaucaga

SEQ ID NO: 139263 - RNA, 22 nt, Homo sapiens
uagcagcauuuuuguagaguau

SEQ ID NO: 139264 - RNA, 22 nt, Homo sapiens
uagcaguagacagacuuuggcu

SEQ ID NO: 139265 - RNA, 22 nt, Homo sapiens
uagcagucucagaaugcauggu

SEQ ID NO: 139266 - RNA, 22 nt, Homo sapiens
uaguagcauaccuaaguauacu

SEQ ID NO: 139267 - RNA, 22 nt, Homo sapiens
uagugcaguggcuccaucucag

SEQ ID NO: 139268 - RNA, 22 nt, Homo sapiens
uaugcacacguguccaugugca

SEQ ID NO: 139269 - RNA, 22 nt, Homo sapiens
uauuacugucaauaucacagaa

SEQ ID NO: 139270 - RNA, 22 nt, Homo sapiens
uauuuggugaaugaaugcaugu

SEQ ID NO: 139271 - RNA, 22 nt, Homo sapiens
uauuugguuacuugaauagcua

SEQ ID NO: 139272 - RNA, 22 nt, Homo sapiens
uauuugguuauaugaguaaguu

SEQ ID NO: 139273 - RNA, 22 nt, Homo sapiens
uauuugguuggugcaaaaguaa

SEQ ID NO: 139274 - RNA, 22 nt, Homo sapiens
uauuuguccccuccaaaaguca

SEQ ID NO: 139275 - RNA, 22 nt, Homo sapiens
ucaagcaauucgccugucucag

SEQ ID NO: 139276 - RNA, 22 nt, Homo sapiens
ucaagcaauucuccucucagcc

SEQ ID NO: 139277 - RNA, 22 nt, Homo sapiens
ucacaaagcuuggccugcuucu

SEQ ID NO: 139278 - RNA, 22 nt, Homo sapiens
ucacaguaaauccagaagaaau

SEQ ID NO: 139279 - RNA, 22 nt, Homo sapiens
ucacaguagcaaauguuagaaa

SEQ ID NO: 139280 - RNA, 22 nt, Homo sapiens
ucacaguagggaacugacaaag

SEQ ID NO: 139281 - RNA, 22 nt, Homo sapiens
ucacaugugacauauauauuug

SEQ ID NO: 139282 - RNA, 22 nt, Homo sapiens
ucacaugugcguuuuggcaugu

SEQ ID NO: 139283 - RNA, 22 nt, Homo sapiens
ucacauuaagcuguuauuucuu

SEQ ID NO: 139284 - RNA, 22 nt, Homo sapiens
ucaguaaaugcuguucucuuuu

SEQ ID NO: 139285 - RNA, 22 nt, Homo sapiens
ucagugccauugccauaugagu

SEQ ID NO: 139286 - RNA, 22 nt, Homo sapiens
ucagugucugugcaccgcugga

SEQ ID NO: 139287 - RNA, 21 nt, Homo sapiens
ucauauguaucuuugugccuc

SEQ ID NO: 139288 - RNA, 22 nt, Homo sapiens
ucauauguaugugcaauuuugu

SEQ ID NO: 139289 - RNA, 22 nt, Homo sapiens
ucauaugucauaguaugaucuu

SEQ ID NO: 139290 - RNA, 22 nt, Homo sapiens
ucauguaauuuugugucuauga

SEQ ID NO: 139291 - RNA, 19 nt, Homo sapiens
ucaugugcauacauuuggg

SEQ ID NO: 139292 - RNA, 22 nt, Homo sapiens
uccacaguggugaggugcagca

SEQ ID NO: 139293 - RNA, 22 nt, Homo sapiens
uccacguggucuaucuguccuu

SEQ ID NO: 139294 - RNA, 22 nt, Homo sapiens
uccagugugcaggcaaguuuga

SEQ ID NO: 139295 - RNA, 18 nt, Homo sapiens
ucccuuuguagaugaccc

SEQ ID NO: 139296 - RNA, 19 nt, Homo sapiens
ucccuuuguauggacauac

SEQ ID NO: 139297 - RNA, 22 nt, Homo sapiens
uccuggcuccacuguuuauucc

SEQ ID NO: 139298 - RNA, 22 nt, Homo sapiens
uccuugagaggacagagccaua

SEQ ID NO: 139299 - RNA, 22 nt, Homo sapiens
ucucccuaccugagccgagcca

SEQ ID NO: 139300 - RNA, 22 nt, Homo sapiens
ucugucaaaucuuauguuguag

SEQ ID NO: 139301 - RNA, 22 nt, Homo sapiens
ucugucacugaaucccugucac

SEQ ID NO: 139302 - RNA, 22 nt, Homo sapiens
ucuugggugaguuugugaauaa

SEQ ID NO: 139303 - RNA, 22 nt, Homo sapiens
ucuuuggucuacuuucauaugu

SEQ ID NO: 139304 - RNA, 22 nt, Homo sapiens
ucuuuguguaggucaaucuggc

SEQ ID NO: 139305 - RNA, 22 nt, Homo sapiens
ugaaaagucuaagauuaagguu

SEQ ID NO: 139306 - RNA, 22 nt, Homo sapiens
ugaaauguaaguugucuagucu

SEQ ID NO: 139307 - RNA, 22 nt, Homo sapiens
ugacaagaacuuuccauaguaa

SEQ ID NO: 139308 - RNA, 23 nt, Homo sapiens
ugacagucucccgauggcuaggc

SEQ ID NO: 139309 - RNA, 22 nt, Homo sapiens
ugacuggaacuuuagugagucu

SEQ ID NO: 139310 - RNA, 22 nt, Homo sapiens
aaaugacuuuuuaugcagagua

SEQ ID NO: 139311 - RNA, 22 nt, Homo sapiens
aaguaagcauccaauaaauguu

SEQ ID NO: 139312 - RNA, 22 nt, Homo sapiens
aaguccaugaagucuugugggu

SEQ ID NO: 139313 - RNA, 22 nt, Homo sapiens
aagugcuuuuuagauaugguuu

SEQ ID NO: 139314 - RNA, 17 nt, Homo sapiens
aaguggcuuguucacca

SEQ ID NO: 139315 - RNA, 22 nt, Homo sapiens
aauaaagcugaauccuuccuga

SEQ ID NO: 139316 - RNA, 22 nt, Homo sapiens
aauccugucuugccauccaaua

SEQ ID NO: 139317 - RNA, 22 nt, Homo sapiens
aaucugucaguuuuguguuaau

SEQ ID NO: 139318 - RNA, 22 nt, Homo sapiens
aauggcucuuccuggaguugug

SEQ ID NO: 139319 - RNA, 22 nt, Homo sapiens
aauuaguuggcugccuaugauu

SEQ ID NO: 139320 - RNA, 22 nt, Homo sapiens
acacaguaaauauguauugaau

SEQ ID NO: 139321 - RNA, 22 nt, Homo sapiens
acaguagaaaacaauggauuug

SEQ ID NO: 139322 - RNA, 18 nt, Homo sapiens
acagugucuuacaccugu

SEQ ID NO: 139323 - RNA, 21 nt, Homo sapiens
acauguacacauguaugcaca

SEQ ID NO: 139324 - RNA, 22 nt, Homo sapiens
accaccauugcacugaacuuuc

SEQ ID NO: 139325 - RNA, 22 nt, Homo sapiens
acccucagaccaguuucccugg

SEQ ID NO: 139326 - RNA, 22 nt, Homo sapiens
accuggguguauguucaguuug

SEQ ID NO: 139327 - RNA, 22 nt, Homo sapiens
uucagggacuuuagacaagaga

SEQ ID NO: 139328 - RNA, 18 nt, Homo sapiens
uucauauguugaaccaga

SEQ ID NO: 139329 - RNA, 22 nt, Homo sapiens
uucauguaauuccauaagguaa

SEQ ID NO: 139330 - RNA, 22 nt, Homo sapiens
uucaugugagucuguauuaacu

SEQ ID NO: 139331 - RNA, 22 nt, Homo sapiens
uuccuaguccugagucucugcg

SEQ ID NO: 139332 - RNA, 22 nt, Homo sapiens
uuccugcacuugcuugccuaug

SEQ ID NO: 139333 - RNA, 22 nt, Homo sapiens
uucuggcuaugggauacuaaau

SEQ ID NO: 139334 - RNA, 20 nt, Homo sapiens
uucuugaguuaacaaguuac

SEQ ID NO: 139335 - RNA, 22 nt, Homo sapiens
uugaacugguaguuggaaaucu

SEQ ID NO: 139336 - RNA, 20 nt, Homo sapiens
uugaggucaggaguuuggga

SEQ ID NO: 139337 - RNA, 22 nt, Homo sapiens
uugcaaagaccucuucacuucc

SEQ ID NO: 139338 - RNA, 22 nt, Homo sapiens
uugcacaguguguacagcacca

SEQ ID NO: 139339 - RNA, 22 nt, Homo sapiens
uugcacugagauuuugcuuaca

SEQ ID NO: 139340 - RNA, 22 nt, Homo sapiens
uugcagagccccacacugggcu

SEQ ID NO: 139341 - RNA, 22 nt, Homo sapiens
uugcagagucaguuauuuugcc

SEQ ID NO: 139342 - RNA, 22 nt, Homo sapiens
uuggcaaaugucacaaaucagg

SEQ ID NO: 139343 - RNA, 22 nt, Homo sapiens
uugguuaccuucagaaaugagu

SEQ ID NO: 139344 - RNA, 22 nt, Homo sapiens
uuguacaggaguguaagcuuca

SEQ ID NO: 139345 - RNA, 22 nt, Homo sapiens
uuguccuggagguucuugcaag

SEQ ID NO: 139346 - RNA, 22 nt, Homo sapiens
uugugucccuacccaaaucuca

SEQ ID NO: 139347 - RNA, 21 nt, Homo sapiens
uuucacugugaguuuuucugu

SEQ ID NO: 139348 - RNA, 22 nt, Homo sapiens
uuuguacuugaaacccagggcc

SEQ ID NO: 139349 - RNA, 22 nt, Homo sapiens
uuuguacuugaagaaucuuuau

SEQ ID NO: 139350 - RNA, 22 nt, Homo sapiens
uuugugagguggauagauugca

SEQ ID NO: 139351 - RNA, 22 nt, Homo sapiens
uuugugauugcacacucaagau

SEQ ID NO: 139352 - RNA, 22 nt, Homo sapiens
uuuguuugaagucgagacaacu

SEQ ID NO: 139353 - RNA, 22 nt, Homo sapiens
uuuuaguggacaaagguauuua

SEQ ID NO: 139354 - RNA, 19 nt, Homo sapiens
uuuuggaaaugugaacagc

SEQ ID NO: 139355 - RNA, 22 nt, Homo sapiens
uagcagcagugguguauuuaga

SEQ ID NO: 139356 - RNA, 17 nt, Homo sapiens
uagcuucacauuaggaa

SEQ ID NO: 139357 - RNA, 22 nt, Homo sapiens
uagcuucuccauagcuccaugu

SEQ ID NO: 139358 - RNA, 22 nt, Homo sapiens
uauaugcauugugggguacuga

SEQ ID NO: 139359 - RNA, 20 nt, Homo sapiens
uaucacauggggagaaaccu

SEQ ID NO: 139360 - RNA, 22 nt, Homo sapiens
uaugagcacauauguaucuaug

SEQ ID NO: 139361 - RNA, 22 nt, Homo sapiens
uauggcuuuucacuuaaguccu

SEQ ID NO: 139362 - RNA, 22 nt, Homo sapiens
uauugaacgugggauauugaag

SEQ ID NO: 139363 - RNA, 22 nt, Homo sapiens
ucaagcaauucugcugccucag

SEQ ID NO: 139364 - RNA, 22 nt, Homo sapiens
ucaaggcacauuugacauuuuc

SEQ ID NO: 139365 - RNA, 22 nt, Homo sapiens
ucacagcuaaaaugaaaguagu

SEQ ID NO: 139366 - RNA, 22 nt, Homo sapiens
ucacaguagccccucccaucau

SEQ ID NO: 139367 - RNA, 22 nt, Homo sapiens
ucacaugucagccguggggaag

SEQ ID NO: 139368 - RNA, 22 nt, Homo sapiens
ucacaugugaagauugggagua

SEQ ID NO: 139369 - RNA, 22 nt, Homo sapiens
ucacauguguaugagcuuugau

SEQ ID NO: 139370 - RNA, 22 nt, Homo sapiens
ucaccuggagacaugaagacug

SEQ ID NO: 139371 - RNA, 22 nt, Homo sapiens
ucaccuggagagcuugcuaaua

SEQ ID NO: 139372 - RNA, 22 nt, Homo sapiens
ucaccuggggaucuuguuuaca

SEQ ID NO: 139373 - RNA, 22 nt, Homo sapiens
ucaccuggggcacagcugaaga

SEQ ID NO: 139374 - RNA, 22 nt, Homo sapiens
ucagagucuagaucacucacug

SEQ ID NO: 139375 - RNA, 22 nt, Homo sapiens
ucaggugcaguggcucugaccu

SEQ ID NO: 139376 - RNA, 22 nt, Homo sapiens
ucauuguccaacuucuuucagu

SEQ ID NO: 139377 - RNA, 22 nt, Homo sapiens
uccacaguaaggacccugccuu

SEQ ID NO: 139378 - RNA, 19 nt, Homo sapiens
uccacagugguugaacuag

SEQ ID NO: 139379 - RNA, 22 nt, Homo sapiens
uccacagugguugaacuaguaa

SEQ ID NO: 139380 - RNA, 22 nt, Homo sapiens
uccacagugguugaacuaguuu

SEQ ID NO: 139381 - RNA, 18 nt, Homo sapiens
uccacgugcuuuccagau

SEQ ID NO: 139382 - RNA, 22 nt, Homo sapiens
uccaguguuccucagucacccc

SEQ ID NO: 139383 - RNA, 18 nt, Homo sapiens
ucccucagaauuauagaa

SEQ ID NO: 139384 - RNA, 22 nt, Homo sapiens
ucccuggagcaagagaagaagg

SEQ ID NO: 139385 - RNA, 22 nt, Homo sapiens
uccuuggugacauuucuugucu

SEQ ID NO: 139386 - RNA, 22 nt, Homo sapiens
ucugagguaggugcauggauac

SEQ ID NO: 139387 - RNA, 22 nt, Homo sapiens
ucugccuacugguuggaggaac

SEQ ID NO: 139388 - RNA, 22 nt, Homo sapiens
ucuggcuuugugaguugccaga

SEQ ID NO: 139389 - RNA, 22 nt, Homo sapiens
ucuggguuuuuacaauguuuac

SEQ ID NO: 139390 - RNA, 22 nt, Homo sapiens
ucugugaaugaacacuugaaaa

SEQ ID NO: 139391 - RNA, 22 nt, Homo sapiens
ucugugguuguugcauggaaug

SEQ ID NO: 139392 - RNA, 22 nt, Homo sapiens
ucuuaggauacugaagucgguu

SEQ ID NO: 139393 - RNA, 22 nt, Homo sapiens
ucuuggcauggcugaagauucc

SEQ ID NO: 139394 - RNA, 22 nt, Homo sapiens
ucuuggguggauucauucuuuc

SEQ ID NO: 139395 - RNA, 22 nt, Homo sapiens
ucuuugguucuguuuauguaau

SEQ ID NO: 139396 - RNA, 22 nt, Homo sapiens
ugaaaguaauugcaguuuuuac

SEQ ID NO: 139397 - RNA, 22 nt, Homo sapiens
ugaaaugauuauaugguguuug

SEQ ID NO: 139398 - RNA, 22 nt, Homo sapiens
ugaagugaagacucacagaagg

SEQ ID NO: 139399 - RNA, 22 nt, Homo sapiens
ugaauguucuuaaaacccuugu

SEQ ID NO: 139400 - RNA, 22 nt, Homo sapiens
ugacagguugauaggugcagca

SEQ ID NO: 139401 - RNA, 22 nt, Homo sapiens
ugaccuguuugaaauugccaau

SEQ ID NO: 139402 - RNA, 18 nt, Homo sapiens
ugagaacauguguacaca

SEQ ID NO: 139403 - RNA, 22 nt, Homo sapiens
ugagacugagucucgcucuugu

SEQ ID NO: 139404 - RNA, 22 nt, Homo sapiens
ugagacugagucuugcucuugu

SEQ ID NO: 139405 - RNA, 22 nt, Homo sapiens
ugagacugaguuuugcucguug

SEQ ID NO: 139406 - RNA, 22 nt, Homo sapiens
aaacugccuuccuuguaggugc

SEQ ID NO: 139407 - RNA, 22 nt, Homo sapiens
aaagaguucagguagauuucaa

SEQ ID NO: 139408 - RNA, 22 nt, Homo sapiens
aaauugcaaugcgaggcagagg

SEQ ID NO: 139409 - RNA, 22 nt, Homo sapiens
aaauugcacaaguggugauuug

SEQ ID NO: 139410 - RNA, 20 nt, Homo sapiens
aagacacuguccccacugga

SEQ ID NO: 139411 - RNA, 22 nt, Homo sapiens
aagagagcuaugugcauaauua

SEQ ID NO: 139412 - RNA, 22 nt, Homo sapiens
aaggaagcuagcaggaauuggu

SEQ ID NO: 139413 - RNA, 22 nt, Homo sapiens
aaguaauggaguuauuuuauga

SEQ ID NO: 139414 - RNA, 22 nt, Homo sapiens
aaguauuaagacuaagaggcuu

SEQ ID NO: 139415 - RNA, 22 nt, Homo sapiens
aagucaugaagaggaaaggaca

SEQ ID NO: 139416 - RNA, 23 nt, Homo sapiens
aagucauggaaucaaaugaggug

SEQ ID NO: 139417 - RNA, 22 nt, Homo sapiens
aagugcauguauuaguguaguc

SEQ ID NO: 139418 - RNA, 22 nt, Homo sapiens
aagugccauguggaugggcccu

SEQ ID NO: 139419 - RNA, 23 nt, Homo sapiens
aaguucaugcucaucuguuacac

SEQ ID NO: 139420 - RNA, 17 nt, Homo sapiens
aaugagacauuucugcu

SEQ ID NO: 139421 - RNA, 22 nt, Homo sapiens
aaugauauguuauguuuagguu

SEQ ID NO: 139422 - RNA, 22 nt, Homo sapiens
aaugugcacuauuagggugaua

SEQ ID NO: 139423 - RNA, 22 nt, Homo sapiens
aauuacuucuacaccaaccuaa

SEQ ID NO: 139424 - RNA, 22 nt, Homo sapiens
aauucuguauuguuuagggacu

SEQ ID NO: 139425 - RNA, 22 nt, Homo sapiens
aauucugugagauggugcagau

SEQ ID NO: 139426 - RNA, 22 nt, Homo sapiens
aauugcaauggacaaugcagca

SEQ ID NO: 139427 - RNA, 22 nt, Homo sapiens
acaauguauauuuuacuguagg

SEQ ID NO: 139428 - RNA, 22 nt, Homo sapiens
acacaguaaauauugucuccuc

SEQ ID NO: 139429 - RNA, 22 nt, Homo sapiens
acacaguauaugacaaugcuuu

SEQ ID NO: 139430 - RNA, 22 nt, Homo sapiens
acacucucucauuacuuguuug

SEQ ID NO: 139431 - RNA, 20 nt, Homo sapiens
acacuggaguaucaaggccc

SEQ ID NO: 139432 - RNA, 22 nt, Homo sapiens
acacuggaguuaaaggugauuu

SEQ ID NO: 139433 - RNA, 22 nt, Homo sapiens
acaguauaaugcuguagggaga

SEQ ID NO: 139434 - RNA, 22 nt, Homo sapiens
acagugacagaaagcugauuau

SEQ ID NO: 139435 - RNA, 22 nt, Homo sapiens
acagugcuuggcacacaguaau

SEQ ID NO: 139436 - RNA, 22 nt, Homo sapiens
acauaguagacacugaaaauau

SEQ ID NO: 139437 - RNA, 22 nt, Homo sapiens
accacagugcuuccugcucacg

SEQ ID NO: 139438 - RNA, 22 nt, Homo sapiens
accccuuacaucagcucuggua

SEQ ID NO: 139439 - RNA, 22 nt, Homo sapiens
acccuggagagugcuguaguaa

SEQ ID NO: 139440 - RNA, 22 nt, Homo sapiens
accugcacagccgaacauagac

SEQ ID NO: 139441 - RNA, 22 nt, Homo sapiens
acugcacuccaaccuguugggc

SEQ ID NO: 139442 - RNA, 22 nt, Homo sapiens
ugagacugaguuuugcucuugu

SEQ ID NO: 139443 - RNA, 22 nt, Homo sapiens
ugagaguauaaauugaugcagc

SEQ ID NO: 139444 - RNA, 22 nt, Homo sapiens
ugagccauggcaccuugucuaa

SEQ ID NO: 139445 - RNA, 22 nt, Homo sapiens
ugaggucacuuguuuuaugcuu

SEQ ID NO: 139446 - RNA, 22 nt, Homo sapiens
ugaggugcagcaauccucaugu

SEQ ID NO: 139447 - RNA, 22 nt, Homo sapiens
ugagugaaagaagcacuaagga

SEQ ID NO: 139448 - RNA, 22 nt, Homo sapiens
ugauaacauugggggaagcuga

SEQ ID NO: 139449 - RNA, 20 nt, Homo sapiens
ugauauuuucugagcaggaa

SEQ ID NO: 139450 - RNA, 22 nt, Homo sapiens
ugcagagucuguccugccugcc

SEQ ID NO: 139451 - RNA, 20 nt, Homo sapiens
ugcagcacgggcccuuucca

SEQ ID NO: 139452 - RNA, 22 nt, Homo sapiens
ugcagcucagcugcggaguuuu

SEQ ID NO: 139453 - RNA, 22 nt, Homo sapiens
ugcauauguugaaccaggcuug

SEQ ID NO: 139454 - RNA, 22 nt, Homo sapiens
ugcauauuuuauaaagauggaa

SEQ ID NO: 139455 - RNA, 22 nt, Homo sapiens
ugcauggauguuugaacacacu

SEQ ID NO: 139456 - RNA, 23 nt, Homo sapiens
ugcugagaccuagauccuaaaga

SEQ ID NO: 139457 - RNA, 22 nt, Homo sapiens
uggaaaguccaagccaaccggg

SEQ ID NO: 139458 - RNA, 22 nt, Homo sapiens
uggaaauaaaugugccaagauc

SEQ ID NO: 139459 - RNA, 20 nt, Homo sapiens
uggaccagagagguggggac

SEQ ID NO: 139460 - RNA, 22 nt, Homo sapiens
uggcaaaaaaccgcaguugccu

SEQ ID NO: 139461 - RNA, 22 nt, Homo sapiens
uggcaaaaaucacaaguaccuu

SEQ ID NO: 139462 - RNA, 22 nt, Homo sapiens
uggcaagagcugcauucaucug

SEQ ID NO: 139463 - RNA, 22 nt, Homo sapiens
uggccaagagcacagauauugg

SEQ ID NO: 139464 - RNA, 23 nt, Homo sapiens
uggccaagauaaucucaguuuuc

SEQ ID NO: 139465 - RNA, 22 nt, Homo sapiens
ugggauccaugugguuuaagca

SEQ ID NO: 139466 - RNA, 22 nt, Homo sapiens
ugggaugaauacaaugggauca

SEQ ID NO: 139467 - RNA, 22 nt, Homo sapiens
ugggaugaugcuugagaauauc

SEQ ID NO: 139468 - RNA, 19 nt, Homo sapiens
uggucaguucugggagcug

SEQ ID NO: 139469 - RNA, 22 nt, Homo sapiens
uggucuucuggccuccagaacc

SEQ ID NO: 139470 - RNA, 22 nt, Homo sapiens
uguaaaucuauuuuuaguguuu

SEQ ID NO: 139471 - RNA, 22 nt, Homo sapiens
ugucaacauuuaucaaguuauu

SEQ ID NO: 139472 - RNA, 22 nt, Homo sapiens
ugucccugagccuggauuccug

SEQ ID NO: 139473 - RNA, 22 nt, Homo sapiens
ugugaacagaauuagucaccua

SEQ ID NO: 139474 - RNA, 20 nt, Homo sapiens
ugugaacuguagauagucuu

SEQ ID NO: 139475 - RNA, 22 nt, Homo sapiens
ugugcaaauuagcacaacccga

SEQ ID NO: 139476 - RNA, 22 nt, Homo sapiens
ugugcacaauguacagguuagu

SEQ ID NO: 139477 - RNA, 22 nt, Homo sapiens
uguggaaauggugcuacgaaca

SEQ ID NO: 139478 - RNA, 22 nt, Homo sapiens
uguggaaauuguuguauuuaau

SEQ ID NO: 139479 - RNA, 22 nt, Homo sapiens
uguuuaguuaagacauagaauu

SEQ ID NO: 139480 - RNA, 22 nt, Homo sapiens
uguuugcuguuuucuccaauga

SEQ ID NO: 139481 - RNA, 22 nt, Homo sapiens
uguuugcuuaacguggagccag

SEQ ID NO: 139482 - RNA, 22 nt, Homo sapiens
uuaagaagugauuuuccucauu

SEQ ID NO: 139483 - RNA, 22 nt, Homo sapiens
uuaagcaaagguaacaugagaa

SEQ ID NO: 139484 - RNA, 22 nt, Homo sapiens
uuaagcaguaguuaaggagagg

SEQ ID NO: 139485 - RNA, 22 nt, Homo sapiens
uuaauguaucuaucacaucaca

SEQ ID NO: 139486 - RNA, 22 nt, Homo sapiens
uuaauuguaucuauagauguca

SEQ ID NO: 139487 - RNA, 22 nt, Homo sapiens
uuacuauguuucaaagugucuc

SEQ ID NO: 139488 - RNA, 22 nt, Homo sapiens
uuauggcuauugaugacaauug

SEQ ID NO: 139489 - RNA, 22 nt, Homo sapiens
uuauucauuaauugcuaagguu

SEQ ID NO: 139490 - RNA, 22 nt, Homo sapiens
uucacaguguguacaccagggg

SEQ ID NO: 139491 - RNA, 22 nt, Homo sapiens
uucacugugaauaaaggcuccc

SEQ ID NO: 139492 - RNA, 22 nt, Homo sapiens
uucagcacaguguggaucauuc

SEQ ID NO: 139493 - RNA, 21 nt, Homo sapiens
uucaucuggccguauuccagg

SEQ ID NO: 139494 - RNA, 22 nt, Homo sapiens
uuccaguaauagcacagcauug

SEQ ID NO: 139495 - RNA, 22 nt, Homo sapiens
uucccgggguggaaugcaguga

SEQ ID NO: 139496 - RNA, 22 nt, Homo sapiens
uucccuuugugcauaggauuug

SEQ ID NO: 139497 - RNA, 22 nt, Homo sapiens
uuccuugagaaaguacaaggcu

SEQ ID NO: 139498 - RNA, 22 nt, Homo sapiens
uucuggcucgauucucugaccg

SEQ ID NO: 139499 - RNA, 22 nt, Homo sapiens
uucuggcuuauaaacgugacuu

SEQ ID NO: 139500 - RNA, 22 nt, Homo sapiens
uucuggcuuuuaaagaaauguu

SEQ ID NO: 139501 - RNA, 22 nt, Homo sapiens
uucuuagucaaguuguauuuca

SEQ ID NO: 139502 - RNA, 22 nt, Homo sapiens
uucuugaggcaugccgcuggga

SEQ ID NO: 139503 - RNA, 22 nt, Homo sapiens
uugaaaguguucacaaugguau

SEQ ID NO: 139504 - RNA, 22 nt, Homo sapiens
uugagauacauaauuaugaaug

SEQ ID NO: 139505 - RNA, 22 nt, Homo sapiens
uugaggcaaugaggagaagcug

SEQ ID NO: 139506 - RNA, 22 nt, Homo sapiens
uugauuagauccaguugauuga

SEQ ID NO: 139507 - RNA, 22 nt, Homo sapiens
uugcagagaaauuucugguuua

SEQ ID NO: 139508 - RNA, 22 nt, Homo sapiens
uugcuucauucaacauugaggg

SEQ ID NO: 139509 - RNA, 22 nt, Homo sapiens
uuggaaaguuguuguaguuauu

SEQ ID NO: 139510 - RNA, 22 nt, Homo sapiens
uuggaccacuugauuucugguc

SEQ ID NO: 139511 - RNA, 21 nt, Homo sapiens
uugguucccucugacaggucu

SEQ ID NO: 139512 - RNA, 23 nt, Homo sapiens
uuguacacuaagaaucgcagaug

SEQ ID NO: 139513 - RNA, 22 nt, Homo sapiens
uuguagcaaauguguaaacaaa

SEQ ID NO: 139514 - RNA, 21 nt, Homo sapiens
uuguagcagcauaaucccaga

SEQ ID NO: 139515 - RNA, 22 nt, Homo sapiens
uugugaaaucuaggcagagguu

SEQ ID NO: 139516 - RNA, 22 nt, Homo sapiens
uuguguccccacccaaaucuca

SEQ ID NO: 139517 - RNA, 22 nt, Homo sapiens
uugugucccugcccaaaucuca

SEQ ID NO: 139518 - RNA, 22 nt, Homo sapiens
uuuagguauuugguauagcagu

SEQ ID NO: 139519 - RNA, 22 nt, Homo sapiens
uuucacagcaauugccuauugu

SEQ ID NO: 139520 - RNA, 22 nt, Homo sapiens
uuucacuagccagcccuuuauu

SEQ ID NO: 139521 - RNA, 22 nt, Homo sapiens
uuugaguuugaggugcugauga

SEQ ID NO: 139522 - RNA, 22 nt, Homo sapiens
uuugcaucuuagaaaguucucc

SEQ ID NO: 139523 - RNA, 22 nt, Homo sapiens
uuugcuuguguaaaaaucugga

SEQ ID NO: 139524 - RNA, 22 nt, Homo sapiens
uuuggcuuaagauugacugcaa

SEQ ID NO: 139525 - RNA, 22 nt, Homo sapiens
uuuugguauaugcaggggucuu

SEQ ID NO: 139526 - RNA, 22 nt, Homo sapiens
uuuugugacuauuguaaauggg

SEQ ID NO: 139527 - RNA, 22 nt, Homo sapiens
uuuuuuaguuagcugggcauga

SEQ ID NO: 139528 - RNA, 22 nt, Homo sapiens
acacaugugcguagacucuuua

SEQ ID NO: 139529 - RNA, 20 nt, Homo sapiens
acagcauagccuuuuaaagc

SEQ ID NO: 139530 - RNA, 22 nt, Homo sapiens
acccuggaggucuacagugcag

SEQ ID NO: 139531 - RNA, 22 nt, Homo sapiens
acucagagauuagcacauguuu

SEQ ID NO: 139532 - RNA, 21 nt, Homo sapiens
acugcacuccaaccucaacag

SEQ ID NO: 139533 - RNA, 22 nt, Homo sapiens
acugcacuccaaccuuggugac

SEQ ID NO: 139534 - RNA, 22 nt, Homo sapiens
acacugcugaguaaauaauuuu

SEQ ID NO: 139535 - RNA, 22 nt, Homo sapiens
acaguacaugauaaauaaggua

SEQ ID NO: 139536 - RNA, 22 nt, Homo sapiens
acaguguacaauagccuuuuaa

SEQ ID NO: 139537 - RNA, 22 nt, Homo sapiens
acauaaagaagcaggacauugu

SEQ ID NO: 139538 - RNA, 22 nt, Homo sapiens
acaucacuguuugauugauuga

SEQ ID NO: 139539 - RNA, 22 nt, Homo sapiens
accugggugcugaugggcuuua

SEQ ID NO: 139540 - RNA, 22 nt, Homo sapiens
acugaauguaaacacggagugu

SEQ ID NO: 139541 - RNA, 22 nt, Homo sapiens
acugcacuccagcccgggugac

SEQ ID NO: 139542 - RNA, 22 nt, Homo sapiens
acugcacuccagccuaggcgac

SEQ ID NO: 139543 - RNA, 22 nt, Homo sapiens
acugcacuccagccucccgucu

SEQ ID NO: 139544 - RNA, 22 nt, Homo sapiens
acugcacuccagccucgugaca

SEQ ID NO: 139545 - RNA, 22 nt, Homo sapiens
acugcacuccagccucguggac

SEQ ID NO: 139546 - RNA, 22 nt, Homo sapiens
acugcacuccagccugagccug

SEQ ID NO: 139547 - RNA, 22 nt, Homo sapiens
acugcacuccagccugcuggca

SEQ ID NO: 139548 - RNA, 22 nt, Homo sapiens
acugcacuccagccuggacgac

SEQ ID NO: 139549 - RNA, 22 nt, Homo sapiens
acugcacuccagccuggcggac

SEQ ID NO: 139550 - RNA, 22 nt, Homo sapiens
acugcacuccagccugugagac

SEQ ID NO: 139551 - RNA, 22 nt, Homo sapiens
acugcacuccagccuucaggac

SEQ ID NO: 139552 - RNA, 22 nt, Homo sapiens
acugcacuccagccuucgugac

SEQ ID NO: 139553 - RNA, 22 nt, Homo sapiens
acugcacuccagccuugauggc

SEQ ID NO: 139554 - RNA, 22 nt, Homo sapiens
acugcacuccagccuuggagac

SEQ ID NO: 139555 - RNA, 22 nt, Homo sapiens
acugcacuccagccuugugaca

SEQ ID NO: 139556 - RNA, 22 nt, Homo sapiens
acugcacuccaguuccgggcaa

SEQ ID NO: 139557 - RNA, 18 nt, Homo sapiens
acugcacuccauccuagg

SEQ ID NO: 139558 - RNA, 22 nt, Homo sapiens
acugcacuccggccuggcaaca

SEQ ID NO: 139559 - RNA, 22 nt, Homo sapiens
acugcacuuauccuccaauguu

SEQ ID NO: 139560 - RNA, 22 nt, Homo sapiens
acugcacuucagccuugggaaa

SEQ ID NO: 139561 - RNA, 22 nt, Homo sapiens
acugcacuucagccuuggggac

SEQ ID NO: 139562 - RNA, 22 nt, Homo sapiens
acugcacuucagccuugugaca

SEQ ID NO: 139563 - RNA, 22 nt, Homo sapiens
agauauguuuaguuucaaaaug

SEQ ID NO: 139564 - RNA, 22 nt, Homo sapiens
agcagcaugcaaauggacuaau

SEQ ID NO: 139565 - RNA, 22 nt, Homo sapiens
agcaucacaugggcugcuuggg

SEQ ID NO: 139566 - RNA, 20 nt, Homo sapiens
agcuccauuccugaaggcug

SEQ ID NO: 139567 - RNA, 22 nt, Homo sapiens
agcuggaauuuaagguagauag

SEQ ID NO: 139568 - RNA, 22 nt, Homo sapiens
aggaagugucuucuuuuaggca

SEQ ID NO: 139569 - RNA, 22 nt, Homo sapiens
aggcaggugaaagauaguuuua

SEQ ID NO: 139570 - RNA, 22 nt, Homo sapiens
aggcaugugugcagacugucug

SEQ ID NO: 139571 - RNA, 21 nt, Homo sapiens
aggucaguaagaaugcagcac

SEQ ID NO: 139572 - RNA, 22 nt, Homo sapiens
aggugacugguuuaucuggcag

SEQ ID NO: 139573 - RNA, 22 nt, Homo sapiens
aggugcaugcuucacuggauau

SEQ ID NO: 139574 - RNA, 22 nt, Homo sapiens
aguacaauguugaguagaagug

SEQ ID NO: 139575 - RNA, 22 nt, Homo sapiens
agugaauguuggaaaguuauuu

SEQ ID NO: 139576 - RNA, 22 nt, Homo sapiens
agugagcugcagucuggggucc

SEQ ID NO: 139577 - RNA, 22 nt, Homo sapiens
agugccacugcacucuagccug

SEQ ID NO: 139578 - RNA, 23 nt, Homo sapiens
agugccuaguauauaggaggcgc

SEQ ID NO: 139579 - RNA, 19 nt, Homo sapiens
aguggguguuuucuguuug

SEQ ID NO: 139580 - RNA, 22 nt, Homo sapiens
aguuggcacugagcugugauug

SEQ ID NO: 139581 - RNA, 22 nt, Homo sapiens
auaaaccuacauuuucacuucu

SEQ ID NO: 139582 - RNA, 22 nt, Homo sapiens
auaagaagugaaccagacgucu

SEQ ID NO: 139583 - RNA, 20 nt, Homo sapiens
auaugcagacacauacauac

SEQ ID NO: 139584 - RNA, 22 nt, Homo sapiens
aucacaguuauaacauccuuuu

SEQ ID NO: 139585 - RNA, 22 nt, Homo sapiens
aucaccuggaggugaucacuug

SEQ ID NO: 139586 - RNA, 20 nt, Homo sapiens
aucacuggagaaggaaaccu

SEQ ID NO: 139587 - RNA, 22 nt, Homo sapiens
augaaagguugucuuaagccau

SEQ ID NO: 139588 - RNA, 19 nt, Homo sapiens
augaacucaucauuucuca

SEQ ID NO: 139589 - RNA, 22 nt, Homo sapiens
augagcuguuuggaagacacuu

SEQ ID NO: 139590 - RNA, 21 nt, Homo sapiens
augagguguacuguggugaaa

SEQ ID NO: 139591 - RNA, 22 nt, Homo sapiens
augauguguguuuaagaugucu

SEQ ID NO: 139592 - RNA, 22 nt, Homo sapiens
augcacaguccagcccaugugg

SEQ ID NO: 139593 - RNA, 22 nt, Homo sapiens
augcacuguauaggaucuugcg

SEQ ID NO: 139594 - RNA, 22 nt, Homo sapiens
augcacuguuuucuugaugaga

SEQ ID NO: 139595 - RNA, 18 nt, Homo sapiens
augcauauuuuaaguugu

SEQ ID NO: 139596 - RNA, 22 nt, Homo sapiens
augcccauuuguuuucugaaag

SEQ ID NO: 139597 - RNA, 21 nt, Homo sapiens
auggaaagacugccucuucaa

SEQ ID NO: 139598 - RNA, 22 nt, Homo sapiens
auggauuuuaggauacaguuga

SEQ ID NO: 139599 - RNA, 22 nt, Homo sapiens
auggcaaugcgaugaugacuga

SEQ ID NO: 139600 - RNA, 22 nt, Homo sapiens
augguacuagaguaagaauugu

SEQ ID NO: 139601 - RNA, 22 nt, Homo sapiens
augucuagagugauacugaagc

SEQ ID NO: 139602 - RNA, 22 nt, Homo sapiens
augugcaaagcacuguucagca

SEQ ID NO: 139603 - RNA, 22 nt, Homo sapiens
augugccaauuaggauuccaag

SEQ ID NO: 139604 - RNA, 22 nt, Homo sapiens
auuauaugucaucacagacacc

SEQ ID NO: 139605 - RNA, 22 nt, Homo sapiens
auucacuguggcuuucucugau

SEQ ID NO: 139606 - RNA, 22 nt, Homo sapiens
auugcacaucugcacuacagcc

SEQ ID NO: 139607 - RNA, 22 nt, Homo sapiens
auugcccaggcuggagugcagu

SEQ ID NO: 139608 - RNA, 22 nt, Homo sapiens
auuucacuucgcaugguguccg

SEQ ID NO: 139609 - RNA, 22 nt, Homo sapiens
auuugggaaugugcauuauacu

SEQ ID NO: 139610 - RNA, 22 nt, Homo sapiens
caaagucuucucauuaugucuu

SEQ ID NO: 139611 - RNA, 22 nt, Homo sapiens
caaaugaucugcuggccucagc

SEQ ID NO: 139612 - RNA, 22 nt, Homo sapiens
caagagaccugagugucauucu

SEQ ID NO: 139613 - RNA, 22 nt, Homo sapiens
caagugaauaguugcucucaga

SEQ ID NO: 139614 - RNA, 22 nt, Homo sapiens
cacauguuuuagcauggcuguu

SEQ ID NO: 139615 - RNA, 21 nt, Homo sapiens
cacugcacuugccuucugggu

SEQ ID NO: 139616 - RNA, 21 nt, Homo sapiens
cacugguguugcuauaucaaa

SEQ ID NO: 139617 - RNA, 22 nt, Homo sapiens
cagagagcuugcccuuguauau

SEQ ID NO: 139618 - RNA, 22 nt, Homo sapiens
caggcacgcuugggagacacac

SEQ ID NO: 139619 - RNA, 22 nt, Homo sapiens
caguacaauguggaaaaggagu

SEQ ID NO: 139620 - RNA, 22 nt, Homo sapiens
cagucacagugacaggaugugg

SEQ ID NO: 139621 - RNA, 22 nt, Homo sapiens
cauaguacuugcauaguacuau

SEQ ID NO: 139622 - RNA, 22 nt, Homo sapiens
cauauaguaggugcucuguguu

SEQ ID NO: 139623 - RNA, 22 nt, Homo sapiens
ccacagucuaugcaacaagguc

SEQ ID NO: 139624 - RNA, 22 nt, Homo sapiens
ccuggaagaaaggugcuaaaua

SEQ ID NO: 139625 - RNA, 22 nt, Homo sapiens
ccugucuugauuaaauuacuua

SEQ ID NO: 139626 - RNA, 22 nt, Homo sapiens
cuaagugaacugucacugagaa

SEQ ID NO: 139627 - RNA, 22 nt, Homo sapiens
cuacagcacugagcugugugca

SEQ ID NO: 139628 - RNA, 21 nt, Homo sapiens
cuacccuguauuagagaaaga

SEQ ID NO: 139629 - RNA, 22 nt, Homo sapiens
cuagaacuagaacugcuggggu

SEQ ID NO: 139630 - RNA, 22 nt, Homo sapiens
cuaggcuguagagaaguucagu

SEQ ID NO: 139631 - RNA, 22 nt, Homo sapiens
cucacagucucucccuaauuuu

SEQ ID NO: 139632 - RNA, 22 nt, Homo sapiens
cucagucuaugauacuuugcua

SEQ ID NO: 139633 - RNA, 22 nt, Homo sapiens
cuccuugauuagaguauagagu

SEQ ID NO: 139634 - RNA, 22 nt, Homo sapiens
cugaauguucuauagaagccgc

SEQ ID NO: 139635 - RNA, 22 nt, Homo sapiens
cugaauguucuggauggaagag

SEQ ID NO: 139636 - RNA, 22 nt, Homo sapiens
cugauauuuuaaaauuggcugg

SEQ ID NO: 139637 - RNA, 22 nt, Homo sapiens
cugcccuuucuauaugauguaa

SEQ ID NO: 139638 - RNA, 22 nt, Homo sapiens
cuggaaaguagacaaucuaaaa

SEQ ID NO: 139639 - RNA, 22 nt, Homo sapiens
cuggaauguuccuaaagauuca

SEQ ID NO: 139640 - RNA, 22 nt, Homo sapiens
cuggcaaauaguagagccagga

SEQ ID NO: 139641 - RNA, 22 nt, Homo sapiens
cuguaaagaucacagagcuggu

SEQ ID NO: 139642 - RNA, 22 nt, Homo sapiens
cuguccugcagagucagaauga

SEQ ID NO: 139643 - RNA, 22 nt, Homo sapiens
ugaaaugucuuuaggaggcuuc

SEQ ID NO: 139644 - RNA, 22 nt, Homo sapiens
ugaagugaagcaguaguguggg

SEQ ID NO: 139645 - RNA, 22 nt, Homo sapiens
ugaauagaaguggcaggaguag

SEQ ID NO: 139646 - RNA, 18 nt, Homo sapiens
ugacaguuucuuuauauu

SEQ ID NO: 139647 - RNA, 22 nt, Homo sapiens
ugacauggugcucuuucaggca

SEQ ID NO: 139648 - RNA, 22 nt, Homo sapiens
ugacauguauuagcucagugcu

SEQ ID NO: 139649 - RNA, 22 nt, Homo sapiens
ugacauuacagucacuugcugu

SEQ ID NO: 139650 - RNA, 22 nt, Homo sapiens
ugacccuguggcagcgucuaag

SEQ ID NO: 139651 - RNA, 22 nt, Homo sapiens
ugacuggagaccucaguagggu

SEQ ID NO: 139652 - RNA, 22 nt, Homo sapiens
ugagaacugcagggagcugcau

SEQ ID NO: 139653 - RNA, 22 nt, Homo sapiens
ugagagcuuuuuugccugguga

SEQ ID NO: 139654 - RNA, 22 nt, Homo sapiens
ugagaugauuuaauggagccca

SEQ ID NO: 139655 - RNA, 22 nt, Homo sapiens
ugagugaacgcugagaccaaau

SEQ ID NO: 139656 - RNA, 22 nt, Homo sapiens
ugagugaaggggcucuguugug

SEQ ID NO: 139657 - RNA, 22 nt, Homo sapiens
ugagugccuggagggcagggac

SEQ ID NO: 139658 - RNA, 22 nt, Homo sapiens
ugaguggagacuguguguagag

SEQ ID NO: 139659 - RNA, 23 nt, Homo sapiens
ugauaacagcauaugaagauucu

SEQ ID NO: 139660 - RNA, 22 nt, Homo sapiens
ugauaugcuuugaacucucugg

SEQ ID NO: 139661 - RNA, 20 nt, Homo sapiens
ugauauuucuggaaguggag

SEQ ID NO: 139662 - RNA, 17 nt, Homo sapiens
ugauauuuucccagaua

SEQ ID NO: 139663 - RNA, 21 nt, Homo sapiens
ugaugcuuuucuuaaccuugc

SEQ ID NO: 139664 - RNA, 22 nt, Homo sapiens
ugauuugucugcaggaauagug

SEQ ID NO: 139665 - RNA, 22 nt, Homo sapiens
ugcaaagucgaaacugcaguuu

SEQ ID NO: 139666 - RNA, 22 nt, Homo sapiens
ugcaccacugcacugccugggu

SEQ ID NO: 139667 - RNA, 21 nt, Homo sapiens
ugcauacuucucagaugauua

SEQ ID NO: 139668 - RNA, 22 nt, Homo sapiens
ugcauaugucuuuauagcagca

SEQ ID NO: 139669 - RNA, 22 nt, Homo sapiens
ugcauccauucuagacucaucu

SEQ ID NO: 139670 - RNA, 20 nt, Homo sapiens
ugcugcacuuaagcaugggc

SEQ ID NO: 139671 - RNA, 22 nt, Homo sapiens
ugcuuaguuguauguuccacau

SEQ ID NO: 139672 - RNA, 22 nt, Homo sapiens
uggaagguaaguuuugagcauu

SEQ ID NO: 139673 - RNA, 22 nt, Homo sapiens
uggacaagugcccuccaccuca

SEQ ID NO: 139674 - RNA, 22 nt, Homo sapiens
uggagaacauucauuugcaaga

SEQ ID NO: 139675 - RNA, 22 nt, Homo sapiens
uggaggucauuggaucaugggg

SEQ ID NO: 139676 - RNA, 22 nt, Homo sapiens
uggaugccuaauaaaugcagac

SEQ ID NO: 139677 - RNA, 22 nt, Homo sapiens
uggcaaaaaaacgcaauuacgu

SEQ ID NO: 139678 - RNA, 22 nt, Homo sapiens
uggcaaaauauuuugguuucug

SEQ ID NO: 139679 - RNA, 22 nt, Homo sapiens
uggcaaaauggaauauguuggg

SEQ ID NO: 139680 - RNA, 22 nt, Homo sapiens
uggcaagaaggauuuauuccuu

SEQ ID NO: 139681 - RNA, 22 nt, Homo sapiens
uggcuccguuguacaggcugga

SEQ ID NO: 139682 - RNA, 16 nt, Homo sapiens
uguaaauguuuugcau

SEQ ID NO: 139683 - RNA, 22 nt, Homo sapiens
uguauauguuuguacauauguc

SEQ ID NO: 139684 - RNA, 16 nt, Homo sapiens
ugucuguuugggcaca

SEQ ID NO: 139685 - RNA, 22 nt, Homo sapiens
ugucuugagagaggacaugacu

SEQ ID NO: 139686 - RNA, 22 nt, Homo sapiens
ugugaaacacgaaagucuaaaa

SEQ ID NO: 139687 - RNA, 22 nt, Homo sapiens
ugugaagaugagaugacgcccu

SEQ ID NO: 139688 - RNA, 22 nt, Homo sapiens
ugugaagauggacuaauauagu

SEQ ID NO: 139689 - RNA, 22 nt, Homo sapiens
ugugagaaaugcagaaucucag

SEQ ID NO: 139690 - RNA, 22 nt, Homo sapiens
ugugcauagugugugcggggcg

SEQ ID NO: 139691 - RNA, 22 nt, Homo sapiens
uguguaaauaugauagaggaau

SEQ ID NO: 139692 - RNA, 22 nt, Homo sapiens
uguguacaucucuacacacaug

SEQ ID NO: 139693 - RNA, 22 nt, Homo sapiens
uguuaugaagaugccugguaca

SEQ ID NO: 139694 - RNA, 22 nt, Homo sapiens
uguuauuuuguguuagggcaca

SEQ ID NO: 139695 - RNA, 22 nt, Homo sapiens
uuaaaaguauaggccuggcaua

SEQ ID NO: 139696 - RNA, 22 nt, Homo sapiens
uuaaguagaugaaugugaaugu

SEQ ID NO: 139697 - RNA, 22 nt, Homo sapiens
uuaaugaacuuuauuuuguaga

SEQ ID NO: 139698 - RNA, 21 nt, Homo sapiens
uuacaauggcuccuugaaggu

SEQ ID NO: 139699 - RNA, 22 nt, Homo sapiens
uuacaguguuuguucuguuacu

SEQ ID NO: 139700 - RNA, 22 nt, Homo sapiens
uuagcaugucuacuaauuugcu

SEQ ID NO: 139701 - RNA, 20 nt, Homo sapiens
uuauagcuacaucuugacug

SEQ ID NO: 139702 - RNA, 22 nt, Homo sapiens
uuaugucuuugagcaaugcugu

SEQ ID NO: 139703 - RNA, 22 nt, Homo sapiens
uucacagucacccuucuccaug

SEQ ID NO: 139704 - RNA, 22 nt, Homo sapiens
uucacaguguuucucacgguua

SEQ ID NO: 139705 - RNA, 23 nt, Homo sapiens
uucaccugguuauuaauagccuc

SEQ ID NO: 139706 - RNA, 22 nt, Homo sapiens
uucaccuguagcaugcccuugg

SEQ ID NO: 139707 - RNA, 22 nt, Homo sapiens
uucacuguagccucagccucuu

SEQ ID NO: 139708 - RNA, 22 nt, Homo sapiens
uucacuguagcuuggauguuua

SEQ ID NO: 139709 - RNA, 22 nt, Homo sapiens
uucacugugaacucauauucag

SEQ ID NO: 139710 - RNA, 22 nt, Homo sapiens
uucacuguuaagcaguuaaacu

SEQ ID NO: 139711 - RNA, 22 nt, Homo sapiens
uucagugucauuaacacaguag

SEQ ID NO: 139712 - RNA, 22 nt, Homo sapiens
uuccuugaaacagucaagagaa

SEQ ID NO: 139713 - RNA, 22 nt, Homo sapiens
uuccuugagagcuugauaucac

SEQ ID NO: 139714 - RNA, 22 nt, Homo sapiens
uucuauugguaauauuuucugu

SEQ ID NO: 139715 - RNA, 22 nt, Homo sapiens
uucuugcugaauugugcccuuc

SEQ ID NO: 139716 - RNA, 23 nt, Homo sapiens
uugaaaagucaguagccucugau

SEQ ID NO: 139717 - RNA, 22 nt, Homo sapiens
uugaaaguaaacaucacaaaga

SEQ ID NO: 139718 - RNA, 22 nt, Homo sapiens
uugaaaucuuccacagcccaag

SEQ ID NO: 139719 - RNA, 22 nt, Homo sapiens
uugacaaugcacugugcuaagu

SEQ ID NO: 139720 - RNA, 22 nt, Homo sapiens
uugagaagugucuguucauguc

SEQ ID NO: 139721 - RNA, 22 nt, Homo sapiens
uugagaguggcagagguggaac

SEQ ID NO: 139722 - RNA, 22 nt, Homo sapiens
uugaggaagugguuccccagag

SEQ ID NO: 139723 - RNA, 22 nt, Homo sapiens
uugaggaaugucauuuguguuu

SEQ ID NO: 139724 - RNA, 22 nt, Homo sapiens
uugaggaaugugauuucaaaua

SEQ ID NO: 139725 - RNA, 23 nt, Homo sapiens
uugaggcauguaccaucaauauc

SEQ ID NO: 139726 - RNA, 22 nt, Homo sapiens
uugauaauguuaacuuugguca

SEQ ID NO: 139727 - RNA, 22 nt, Homo sapiens
uugauauguguauagcaugugg

SEQ ID NO: 139728 - RNA, 22 nt, Homo sapiens
uugcaccuugaagccaauagca

SEQ ID NO: 139729 - RNA, 22 nt, Homo sapiens
uugcagagccccugcaaggguc

SEQ ID NO: 139730 - RNA, 22 nt, Homo sapiens
uuggaaagagguguuuaugacu

SEQ ID NO: 139731 - RNA, 22 nt, Homo sapiens
uuggcaaagugucuggcauuua

SEQ ID NO: 139732 - RNA, 22 nt, Homo sapiens
uuggcaaauagguuuuauugca

SEQ ID NO: 139733 - RNA, 22 nt, Homo sapiens
uuggcuucuggacuauugugca

SEQ ID NO: 139734 - RNA, 21 nt, Homo sapiens
uuguaugguugaacuugauac

SEQ ID NO: 139735 - RNA, 22 nt, Homo sapiens
uuguccccaucugcugccagaa

SEQ ID NO: 139736 - RNA, 22 nt, Homo sapiens
uugugaaaaaccucucguggaa

SEQ ID NO: 139737 - RNA, 22 nt, Homo sapiens
uugugcauguauauuaguucac

SEQ ID NO: 139738 - RNA, 22 nt, Homo sapiens
uuguuuagagacuggaauuaaa

SEQ ID NO: 139739 - RNA, 22 nt, Homo sapiens
uuuacugugggguuucuuagag

SEQ ID NO: 139740 - RNA, 23 nt, Homo sapiens
uuucacagaaggauuguagggcc

SEQ ID NO: 139741 - RNA, 18 nt, Homo sapiens
uuucauugagugugauau

SEQ ID NO: 139742 - RNA, 23 nt, Homo sapiens
uuucuugggcaugcuaugucagu

SEQ ID NO: 139743 - RNA, 22 nt, Homo sapiens
uuugagcaagaggugacauuau

SEQ ID NO: 139744 - RNA, 22 nt, Homo sapiens
uuugcuugaggucuagcuaccc

SEQ ID NO: 139745 - RNA, 22 nt, Homo sapiens
uuugggccauggcuuuuccacg

SEQ ID NO: 139746 - RNA, 22 nt, Homo sapiens
uuugggccaugguuuguguaua

SEQ ID NO: 139747 - RNA, 22 nt, Homo sapiens
uuugguuauuugaaacuagcau

SEQ ID NO: 139748 - RNA, 22 nt, Homo sapiens
uuugugaaugucauaagcucca

SEQ ID NO: 139749 - RNA, 22 nt, Homo sapiens
aaacauugaccucauccuggca

SEQ ID NO: 139750 - RNA, 22 nt, Homo sapiens
aaaugccucccauucuacugac

SEQ ID NO: 139751 - RNA, 22 nt, Homo sapiens
aaauucaucaaaugguuuguau

SEQ ID NO: 139752 - RNA, 22 nt, Homo sapiens
aacaccauucucuguaacaaga

SEQ ID NO: 139753 - RNA, 22 nt, Homo sapiens
aagaggccuaggaaucuguauu

SEQ ID NO: 139754 - RNA, 22 nt, Homo sapiens
aagcuuucaacuguuugccauu

SEQ ID NO: 139755 - RNA, 23 nt, Homo sapiens
aaggacacugaacacuucccagc

SEQ ID NO: 139756 - RNA, 20 nt, Homo sapiens
aaggcuuucgaguuccaggg

SEQ ID NO: 139757 - RNA, 22 nt, Homo sapiens
aaguaauugagguuuuugcugu

SEQ ID NO: 139758 - RNA, 22 nt, Homo sapiens
aauugcauugaauuuguagcuu

SEQ ID NO: 139759 - RNA, 23 nt, Homo sapiens
acacaguaaacuaaaagcuagcu

SEQ ID NO: 139760 - RNA, 19 nt, Homo sapiens
cuggcaaaugcuuuggcca

SEQ ID NO: 139761 - RNA, 22 nt, Homo sapiens
cuggcaccauacacuguuguug

SEQ ID NO: 139762 - RNA, 22 nt, Homo sapiens
cugggaugugacuguugccccc

SEQ ID NO: 139763 - RNA, 22 nt, Homo sapiens
cuuagcaugucagcaccggguu

SEQ ID NO: 139764 - RNA, 22 nt, Homo sapiens
cuucagcaauauauccccuggg

SEQ ID NO: 139765 - RNA, 22 nt, Homo sapiens
cuugaauguaaauaauguacag

SEQ ID NO: 139766 - RNA, 22 nt, Homo sapiens
cuugcacucagaagauucaguu

SEQ ID NO: 139767 - RNA, 22 nt, Homo sapiens
cuugcagagcccauggauguca

SEQ ID NO: 139768 - RNA, 22 nt, Homo sapiens
cuuguacacuguuggugggaau

SEQ ID NO: 139769 - RNA, 22 nt, Homo sapiens
cuuuaguugucuccucaagggu

SEQ ID NO: 139770 - RNA, 18 nt, Homo sapiens
gacagugugaagauuccu

SEQ ID NO: 139771 - RNA, 18 nt, Homo sapiens
gacaguguggcgauuccu

SEQ ID NO: 139772 - RNA, 22 nt, Homo sapiens
gacucuguagacaaucacaucu

SEQ ID NO: 139773 - RNA, 20 nt, Homo sapiens
gacuucagaagcuucagagu

SEQ ID NO: 139774 - RNA, 22 nt, Homo sapiens
gaguucauaucuaugagugugc

SEQ ID NO: 139775 - RNA, 22 nt, Homo sapiens
gauauguguaucuauguacaug

SEQ ID NO: 139776 - RNA, 22 nt, Homo sapiens
gaucacaugggagaaugagagu

SEQ ID NO: 139777 - RNA, 22 nt, Homo sapiens
gaugauauuugagucauuagaa

SEQ ID NO: 139778 - RNA, 22 nt, Homo sapiens
gaugaucucuggugguaaagac

SEQ ID NO: 139779 - RNA, 22 nt, Homo sapiens
gcaagacaugucuaagguuuaa

SEQ ID NO: 139780 - RNA, 22 nt, Homo sapiens
gcacaguaggugguaggacuuu

SEQ ID NO: 139781 - RNA, 22 nt, Homo sapiens
gcaguguucugggcaggaagaa

SEQ ID NO: 139782 - RNA, 22 nt, Homo sapiens
gcauaaagcuaauaagacgaag

SEQ ID NO: 139783 - RNA, 17 nt, Homo sapiens
gcauauguugaaccagc

SEQ ID NO: 139784 - RNA, 22 nt, Homo sapiens
gcauggagaaggggacugauuc

SEQ ID NO: 139785 - RNA, 22 nt, Homo sapiens
gccaaaaugcugggauuacagg

SEQ ID NO: 139786 - RNA, 22 nt, Homo sapiens
gccaguguguguuguucuccgc

SEQ ID NO: 139787 - RNA, 22 nt, Homo sapiens
gcugcacuuuaaggcauccccu

SEQ ID NO: 139788 - RNA, 22 nt, Homo sapiens
gcugcguguagaguucucacug

SEQ ID NO: 139789 - RNA, 22 nt, Homo sapiens
ggacauguauauauaugugugu

SEQ ID NO: 139790 - RNA, 22 nt, Homo sapiens
ggaugcauuuuugguugucaca

SEQ ID NO: 139791 - RNA, 21 nt, Homo sapiens
ggcaagaaacacaaucaagua

SEQ ID NO: 139792 - RNA, 22 nt, Homo sapiens
ggcagagucuugcaucuuuaga

SEQ ID NO: 139793 - RNA, 22 nt, Homo sapiens
ggcucagugaucuguuucugua

SEQ ID NO: 139794 - RNA, 22 nt, Homo sapiens
ggugagcacagaaugcccugag

SEQ ID NO: 139795 - RNA, 22 nt, Homo sapiens
guaagugauagaauuaggauuc

SEQ ID NO: 139796 - RNA, 22 nt, Homo sapiens
guacaguauaguaauaggauuu

SEQ ID NO: 139797 - RNA, 22 nt, Homo sapiens
guacaugugcacagugugcagg

SEQ ID NO: 139798 - RNA, 22 nt, Homo sapiens
gucaaaugcacagaaccauuaa

SEQ ID NO: 139799 - RNA, 22 nt, Homo sapiens
gucagugugauaucugcagggg

SEQ ID NO: 139800 - RNA, 22 nt, Homo sapiens
gucauucauucagcaagcacug

SEQ ID NO: 139801 - RNA, 22 nt, Homo sapiens
gucuggcuccugucuaaucacu

SEQ ID NO: 139802 - RNA, 22 nt, Homo sapiens
gucuuuaguugaaacauguggu

SEQ ID NO: 139803 - RNA, 22 nt, Homo sapiens
gugaaagauuaaaccagugugu

SEQ ID NO: 139804 - RNA, 22 nt, Homo sapiens
gugacgucauuguuccuggcuc

SEQ ID NO: 139805 - RNA, 20 nt, Homo sapiens
gugauuggucacugguuguu

SEQ ID NO: 139806 - RNA, 22 nt, Homo sapiens
gugcaagagugacugcaguuuu

SEQ ID NO: 139807 - RNA, 22 nt, Homo sapiens
gugcaauucacuguuaugucug

SEQ ID NO: 139808 - RNA, 21 nt, Homo sapiens
gugcagacacacauauaggcu

SEQ ID NO: 139809 - RNA, 19 nt, Homo sapiens
gugcauaguuauuaaagag

SEQ ID NO: 139810 - RNA, 22 nt, Homo sapiens
gugcauaugcaugugcaugcac

SEQ ID NO: 139811 - RNA, 22 nt, Homo sapiens
guggcaaacucagcaugcccca

SEQ ID NO: 139812 - RNA, 22 nt, Homo sapiens
guggcaugaaagcaucugugau

SEQ ID NO: 139813 - RNA, 22 nt, Homo sapiens
guuaagaaguguaacuuaaguu

SEQ ID NO: 139814 - RNA, 22 nt, Homo sapiens
guuaugcagcaauugauaaucu

SEQ ID NO: 139815 - RNA, 22 nt, Homo sapiens
guugcugagucccaucaccaga

SEQ ID NO: 139816 - RNA, 20 nt, Homo sapiens
uaagccacacagucuaaggu

SEQ ID NO: 139817 - RNA, 22 nt, Homo sapiens
uaaggcuuaugguaaaguccug

SEQ ID NO: 139818 - RNA, 22 nt, Homo sapiens
uaaggcuucuuggaauacugca

SEQ ID NO: 139819 - RNA, 22 nt, Homo sapiens
ugacuggagucuugcucugucg

SEQ ID NO: 139820 - RNA, 22 nt, Homo sapiens
ugagacugagucuugcucuauu

SEQ ID NO: 139821 - RNA, 22 nt, Homo sapiens
ugagacugaguuuccaucuugu

SEQ ID NO: 139822 - RNA, 22 nt, Homo sapiens
ugagacugaguuucgcucuugu

SEQ ID NO: 139823 - RNA, 22 nt, Homo sapiens
ugagacugaguuucucucuugu

SEQ ID NO: 139824 - RNA, 22 nt, Homo sapiens
ugagaugaagugauguaaaaca

SEQ ID NO: 139825 - RNA, 22 nt, Homo sapiens
ugagaugacgacacaccucagu

SEQ ID NO: 139826 - RNA, 22 nt, Homo sapiens
ugagaugagggaagccuaggca

SEQ ID NO: 139827 - RNA, 22 nt, Homo sapiens
ugagcugagauuaagcugcugc

SEQ ID NO: 139828 - RNA, 22 nt, Homo sapiens
ugagguaaaacaaggauuggau

SEQ ID NO: 139829 - RNA, 22 nt, Homo sapiens
ugagguaacaaacuaugaguua

SEQ ID NO: 139830 - RNA, 22 nt, Homo sapiens
ugaggugagggguuaggugcua

SEQ ID NO: 139831 - RNA, 22 nt, Homo sapiens
ugaguagaaauaaacgcaaacu

SEQ ID NO: 139832 - RNA, 22 nt, Homo sapiens
ugaguucaauguuaaugaagca

SEQ ID NO: 139833 - RNA, 18 nt, Homo sapiens
ugaguucauuagacuucc

SEQ ID NO: 139834 - RNA, 22 nt, Homo sapiens
ugauaacauuucuucugguaca

SEQ ID NO: 139835 - RNA, 22 nt, Homo sapiens
ugauaagaaauuguucauguag

SEQ ID NO: 139836 - RNA, 22 nt, Homo sapiens
ugauauuuuugauccuuaaguu

SEQ ID NO: 139837 - RNA, 22 nt, Homo sapiens
ugaugacacugauuucuucaau

SEQ ID NO: 139838 - RNA, 22 nt, Homo sapiens
ugcaccacugcuagccugggua

SEQ ID NO: 139839 - RNA, 16 nt, Homo sapiens
ugcagaguaggugaau

SEQ ID NO: 139840 - RNA, 17 nt, Homo sapiens
ugcagcacacugauggg

SEQ ID NO: 139841 - RNA, 18 nt, Homo sapiens
ugcagcuuugugauuggc

SEQ ID NO: 139842 - RNA, 22 nt, Homo sapiens
ugcauaggcuaaaauccuggcc

SEQ ID NO: 139843 - RNA, 22 nt, Homo sapiens
ugcauauguauacaugugccau

SEQ ID NO: 139844 - RNA, 18 nt, Homo sapiens
ugcauauguugaaccagc

SEQ ID NO: 139845 - RNA, 21 nt, Homo sapiens
ugcauggagaacacugagggu

SEQ ID NO: 139846 - RNA, 22 nt, Homo sapiens
ugccuaguagaaggugaacaug

SEQ ID NO: 139847 - RNA, 22 nt, Homo sapiens
uggacagagagaccggcauuuu

SEQ ID NO: 139848 - RNA, 22 nt, Homo sapiens
uggcuguuuauuucacgugggu

SEQ ID NO: 139849 - RNA, 20 nt, Homo sapiens
uggcuucuuaauugcaggca

SEQ ID NO: 139850 - RNA, 20 nt, Homo sapiens
ugguguuugaacagugaaug

SEQ ID NO: 139851 - RNA, 22 nt, Homo sapiens
uguacuagaaauuaaggcaggg

SEQ ID NO: 139852 - RNA, 22 nt, Homo sapiens
uguagcagccauaaacacagug

SEQ ID NO: 139853 - RNA, 22 nt, Homo sapiens
uguauuuguuguuaaauggaga

SEQ ID NO: 139854 - RNA, 22 nt, Homo sapiens
ugucuguuugcgaaauugcuuc

SEQ ID NO: 139855 - RNA, 22 nt, Homo sapiens
ugucuuguagacaauguauagu

SEQ ID NO: 139856 - RNA, 22 nt, Homo sapiens
ugugcauaugucuuuauaguag

SEQ ID NO: 139857 - RNA, 22 nt, Homo sapiens
ugugccacuccaaccuggguga

SEQ ID NO: 139858 - RNA, 22 nt, Homo sapiens
ugugccacugcacuccugggug

SEQ ID NO: 139859 - RNA, 22 nt, Homo sapiens
ugugccuacugauagagccaag

SEQ ID NO: 139860 - RNA, 17 nt, Homo sapiens
uguggcucuuaugcuga

SEQ ID NO: 139861 - RNA, 22 nt, Homo sapiens
ugugggaggugcuaauguaaau

SEQ ID NO: 139862 - RNA, 19 nt, Homo sapiens
uguggucauccugggacga

SEQ ID NO: 139863 - RNA, 22 nt, Homo sapiens
uuaacagucacuuagcucauuu

SEQ ID NO: 139864 - RNA, 22 nt, Homo sapiens
uuaagcaguggauuagaauuuu

SEQ ID NO: 139865 - RNA, 22 nt, Homo sapiens
uuaaguuaggcuucagcagucu

SEQ ID NO: 139866 - RNA, 22 nt, Homo sapiens
uuaauguaauugauugauugac

SEQ ID NO: 139867 - RNA, 19 nt, Homo sapiens
uuacagugugcccuuuuag

SEQ ID NO: 139868 - RNA, 22 nt, Homo sapiens
uuauuagcacccuaccaugugg

SEQ ID NO: 139869 - RNA, 22 nt, Homo sapiens
uucacaguggugggagacguca

SEQ ID NO: 139870 - RNA, 22 nt, Homo sapiens
uucaccuggaguucaggauaag

SEQ ID NO: 139871 - RNA, 22 nt, Homo sapiens
uucaccuggguuggccaucauu

SEQ ID NO: 139872 - RNA, 21 nt, Homo sapiens
uucacuggucuauuucccuuu

SEQ ID NO: 139873 - RNA, 22 nt, Homo sapiens
uucacuguaaaaugaagagggu

SEQ ID NO: 139874 - RNA, 22 nt, Homo sapiens
uucacugugcuuaaauucugcu

SEQ ID NO: 139875 - RNA, 22 nt, Homo sapiens
uucacugugugacccugggcca

SEQ ID NO: 139876 - RNA, 22 nt, Homo sapiens
uucagcacugaaaauaugucau

SEQ ID NO: 139877 - RNA, 22 nt, Homo sapiens
uucauagucuaauuuuuuccac

SEQ ID NO: 139878 - RNA, 22 nt, Homo sapiens
uucauguaauauauuucaggcc

SEQ ID NO: 139879 - RNA, 22 nt, Homo sapiens
acgugcaugcacacacaugcgc

SEQ ID NO: 139880 - RNA, 19 nt, Homo sapiens
acugcacuccaaccuccug

SEQ ID NO: 139881 - RNA, 18 nt, Homo sapiens
acugcacuccaccuuggg

SEQ ID NO: 139882 - RNA, 22 nt, Homo sapiens
acugcacuccaccuugggcaac

SEQ ID NO: 139883 - RNA, 22 nt, Homo sapiens
acugcacuccagacucugucuc

SEQ ID NO: 139884 - RNA, 22 nt, Homo sapiens
acugcacuccagcccaggugac

SEQ ID NO: 139885 - RNA, 22 nt, Homo sapiens
acugcacuccagccuccugggu

SEQ ID NO: 139886 - RNA, 22 nt, Homo sapiens
acugcacuccagccucggcaau

SEQ ID NO: 139887 - RNA, 22 nt, Homo sapiens
acugcacuccagccugcccaac

SEQ ID NO: 139888 - RNA, 22 nt, Homo sapiens
acugcacuccagccugcugaca

SEQ ID NO: 139889 - RNA, 22 nt, Homo sapiens
acugcacuccagccuggaccac

SEQ ID NO: 139890 - RNA, 22 nt, Homo sapiens
acugcacuccagccugugcgua

SEQ ID NO: 139891 - RNA, 22 nt, Homo sapiens
acugcacuccagccuucggaca

SEQ ID NO: 139892 - RNA, 22 nt, Homo sapiens
acugcacuccagccuugcgaca

SEQ ID NO: 139893 - RNA, 22 nt, Homo sapiens
acugcacuccagccuuggcggc

SEQ ID NO: 139894 - RNA, 22 nt, Homo sapiens
acugcacuccagcuuuggguga

SEQ ID NO: 139895 - RNA, 22 nt, Homo sapiens
acugcacuccagcuuuggugac

SEQ ID NO: 139896 - RNA, 20 nt, Homo sapiens
acugcacuccaggcugccca

SEQ ID NO: 139897 - RNA, 22 nt, Homo sapiens
acugcacucccgcccgggugac

SEQ ID NO: 139898 - RNA, 22 nt, Homo sapiens
acugcacucuagccccugcgac

SEQ ID NO: 139899 - RNA, 22 nt, Homo sapiens
acugcacucuagccuuggcaac

SEQ ID NO: 139900 - RNA, 22 nt, Homo sapiens
acugcacucuagcuugggugac

SEQ ID NO: 139901 - RNA, 22 nt, Homo sapiens
acugcacugcagccuggccaac

SEQ ID NO: 139902 - RNA, 22 nt, Homo sapiens
acugcacuucagccuguugaca

SEQ ID NO: 139903 - RNA, 22 nt, Homo sapiens
acuggcuguuaggaauuaccuc

SEQ ID NO: 139904 - RNA, 18 nt, Homo sapiens
agagcuaugaacauaugc

SEQ ID NO: 139905 - RNA, 21 nt, Homo sapiens
agcagaguggcagcucuuuug

SEQ ID NO: 139906 - RNA, 22 nt, Homo sapiens
agcuuuuugggaggccuuagga

SEQ ID NO: 139907 - RNA, 21 nt, Homo sapiens
aggugucuuggguucccuggc

SEQ ID NO: 139908 - RNA, 22 nt, Homo sapiens
agucacaugcauuuucuucaau

SEQ ID NO: 139909 - RNA, 22 nt, Homo sapiens
agucagugcauaagaaugaagu

SEQ ID NO: 139910 - RNA, 22 nt, Homo sapiens
agugcaguugucacgugccuuc

SEQ ID NO: 139911 - RNA, 22 nt, Homo sapiens
aguggauuuuagacugagauuu

SEQ ID NO: 139912 - RNA, 18 nt, Homo sapiens
auaaacucaucauuuuua

SEQ ID NO: 139913 - RNA, 22 nt, Homo sapiens
auaaagcuauuccucucuuuuu

SEQ ID NO: 139914 - RNA, 22 nt, Homo sapiens
auaaauucauuuaagcuccuua

SEQ ID NO: 139915 - RNA, 22 nt, Homo sapiens
auaagucaauggaacagauuaa

SEQ ID NO: 139916 - RNA, 22 nt, Homo sapiens
auaagugcuuguugaauaauag

SEQ ID NO: 139917 - RNA, 22 nt, Homo sapiens
auacaguguauguauaguacau

SEQ ID NO: 139918 - RNA, 22 nt, Homo sapiens
auagugcagugaugaaccuagg

SEQ ID NO: 139919 - RNA, 22 nt, Homo sapiens
aucaaaguaggcauauguuuuu

SEQ ID NO: 139920 - RNA, 22 nt, Homo sapiens
aucacagugaaaacagucaauu

SEQ ID NO: 139921 - RNA, 22 nt, Homo sapiens
aucacagugagcauaugucuau

SEQ ID NO: 139922 - RNA, 22 nt, Homo sapiens
aucacaguggcucacaagagcc

SEQ ID NO: 139923 - RNA, 22 nt, Homo sapiens
aucacaguggucagguauagau

SEQ ID NO: 139924 - RNA, 22 nt, Homo sapiens
aucacaguuuuaccauuuggua

SEQ ID NO: 139925 - RNA, 22 nt, Homo sapiens
aucagucuguuggaauaucgcu

SEQ ID NO: 139926 - RNA, 22 nt, Homo sapiens
aucccaguucagccucugacac

SEQ ID NO: 139927 - RNA, 22 nt, Homo sapiens
aucuggcuccuuuugacaaugc

SEQ ID NO: 139928 - RNA, 22 nt, Homo sapiens
aucuucucuugaagggugggga

SEQ ID NO: 139929 - RNA, 22 nt, Homo sapiens
augaaaucacugugaugcccua

SEQ ID NO: 139930 - RNA, 17 nt, Homo sapiens
augaacucaucguucuu

SEQ ID NO: 139931 - RNA, 22 nt, Homo sapiens
augacuggaacagcaauuuaca

SEQ ID NO: 139932 - RNA, 22 nt, Homo sapiens
augaggaaggagccuuugucug

SEQ ID NO: 139933 - RNA, 22 nt, Homo sapiens
augaggagguaugauuuucuga

SEQ ID NO: 139934 - RNA, 22 nt, Homo sapiens
augauauuauucuagcccagag

SEQ ID NO: 139935 - RNA, 22 nt, Homo sapiens
augcaauucuagauugauagua

SEQ ID NO: 139936 - RNA, 22 nt, Homo sapiens
augcacuguuguuauuggauaa

SEQ ID NO: 139937 - RNA, 22 nt, Homo sapiens
augccagggagaauuguucaag

SEQ ID NO: 139938 - RNA, 22 nt, Homo sapiens
auggcaaaaaaugcaauuacuu

SEQ ID NO: 139939 - RNA, 22 nt, Homo sapiens
auguaacuaucugagccauggg

SEQ ID NO: 139940 - RNA, 22 nt, Homo sapiens
augugcacaugcuuacauguga

SEQ ID NO: 139941 - RNA, 22 nt, Homo sapiens
augugccauucucauggcgcuu

SEQ ID NO: 139942 - RNA, 20 nt, Homo sapiens
augugcuaauauuaauaugu

SEQ ID NO: 139943 - RNA, 22 nt, Homo sapiens
augugucaaaucuaggccaaag

SEQ ID NO: 139944 - RNA, 22 nt, Homo sapiens
augugugaaucccagaaccugu

SEQ ID NO: 139945 - RNA, 22 nt, Homo sapiens
auguuagcaucuggcacuaugg

SEQ ID NO: 139946 - RNA, 22 nt, Homo sapiens
auguuauguucuucucuguaua

SEQ ID NO: 139947 - RNA, 22 nt, Homo sapiens
auuaagugcuugcagaagucca

SEQ ID NO: 139948 - RNA, 22 nt, Homo sapiens
auuacaugucuauccaugaaca

SEQ ID NO: 139949 - RNA, 22 nt, Homo sapiens
auuauauguguaugugcauacc

SEQ ID NO: 139950 - RNA, 22 nt, Homo sapiens
auuauugacucauagaaaggau

SEQ ID NO: 139951 - RNA, 22 nt, Homo sapiens
auucacuguggguccuuuggau

SEQ ID NO: 139952 - RNA, 21 nt, Homo sapiens
auugcacaauauacccaugua

SEQ ID NO: 139953 - RNA, 22 nt, Homo sapiens
auugcucagucagggagcucgg

SEQ ID NO: 139954 - RNA, 15 nt, Homo sapiens
auuucacuuagcaug

SEQ ID NO: 139955 - RNA, 22 nt, Homo sapiens
auuuggccuuuguaugcaguau

SEQ ID NO: 139956 - RNA, 21 nt, Homo sapiens
auuugguguuagaaauaaauu

SEQ ID NO: 139957 - RNA, 22 nt, Homo sapiens
caacacuguuuauuggauagcc

SEQ ID NO: 139958 - RNA, 22 nt, Homo sapiens
caagugacugagccgccucggc

SEQ ID NO: 139959 - RNA, 22 nt, Homo sapiens
caaugguacuagauaucuucag

SEQ ID NO: 139960 - RNA, 22 nt, Homo sapiens
caaugugcuuggggcacaugag

SEQ ID NO: 139961 - RNA, 22 nt, Homo sapiens
cacacugucuucaauggguggu

SEQ ID NO: 139962 - RNA, 19 nt, Homo sapiens
caccagugcaugcuacuau

SEQ ID NO: 139963 - RNA, 22 nt, Homo sapiens
cacuggguuagaacaugcuccu

SEQ ID NO: 139964 - RNA, 22 nt, Homo sapiens
caguaaauaucugagcgagguc

SEQ ID NO: 139965 - RNA, 22 nt, Homo sapiens
cauaaagauggaggaggccagg

SEQ ID NO: 139966 - RNA, 22 nt, Homo sapiens
cauggcacuggugggagugucu

SEQ ID NO: 139967 - RNA, 22 nt, Homo sapiens
caugugcaugagcacauacgug

SEQ ID NO: 139968 - RNA, 22 nt, Homo sapiens
ccaaauccauccaaaucauaga

SEQ ID NO: 139969 - RNA, 22 nt, Homo sapiens
ccauuucacucuuccugaagga

SEQ ID NO: 139970 - RNA, 22 nt, Homo sapiens
cccacaguggccucauauccuu

SEQ ID NO: 139971 - RNA, 18 nt, Homo sapiens
cccgggugggcuguuccc

SEQ ID NO: 139972 - RNA, 22 nt, Homo sapiens
cccugaagaaagccuaggacau

SEQ ID NO: 139973 - RNA, 22 nt, Homo sapiens
ccuggaucauugucauucccaa

SEQ ID NO: 139974 - RNA, 19 nt, Homo sapiens
ccuuugguuuccaugacau

SEQ ID NO: 139975 - RNA, 22 nt, Homo sapiens
ccuuuguggggcgguggguaau

SEQ ID NO: 139976 - RNA, 22 nt, Homo sapiens
cgcccuguagcuagcuagaggu

SEQ ID NO: 139977 - RNA, 22 nt, Homo sapiens
cuagcacauaguuauucacuca

SEQ ID NO: 139978 - RNA, 22 nt, Homo sapiens
cuagucacaggaguugaaggau

SEQ ID NO: 139979 - RNA, 18 nt, Homo sapiens
cucaaccucaugcagggc

SEQ ID NO: 139980 - RNA, 22 nt, Homo sapiens
cucaauuuggaauugucaguaa

SEQ ID NO: 139981 - RNA, 22 nt, Homo sapiens
cucacagugacacgaaccccca

SEQ ID NO: 139982 - RNA, 22 nt, Homo sapiens
cuccuggugauuggagugugaa

SEQ ID NO: 139983 - RNA, 22 nt, Homo sapiens
cugaggugggagaaucacauaa

SEQ ID NO: 139984 - RNA, 22 nt, Homo sapiens
cugcaagaaucguaguauuuga

SEQ ID NO: 139985 - RNA, 19 nt, Homo sapiens
cugcacugagaaaaggagg

SEQ ID NO: 139986 - RNA, 22 nt, Homo sapiens
cugccaguuugauucgggccac

SEQ ID NO: 139987 - RNA, 22 nt, Homo sapiens
cuggaaagcaaagggugcauug

SEQ ID NO: 139988 - RNA, 22 nt, Homo sapiens
cuggaggccugaacauaaaugg

SEQ ID NO: 139989 - RNA, 22 nt, Homo sapiens
ugagaugagggcugcacucaaa

SEQ ID NO: 139990 - RNA, 22 nt, Homo sapiens
ugagcugagaaaugcagcagcu

SEQ ID NO: 139991 - RNA, 22 nt, Homo sapiens
ugaguagaacaucaagucauac

SEQ ID NO: 139992 - RNA, 22 nt, Homo sapiens
ugaguagaacuccuggagaugu

SEQ ID NO: 139993 - RNA, 22 nt, Homo sapiens
ugaguaugaguucaggaaaggc

SEQ ID NO: 139994 - RNA, 22 nt, Homo sapiens
ugaguauguuuagaaguaaagg

SEQ ID NO: 139995 - RNA, 22 nt, Homo sapiens
ugaguucaauuguauuuuauua

SEQ ID NO: 139996 - RNA, 22 nt, Homo sapiens
ugauaauuuugucagguuuugg

SEQ ID NO: 139997 - RNA, 22 nt, Homo sapiens
ugaucacagcuugacuaaagga

SEQ ID NO: 139998 - RNA, 22 nt, Homo sapiens
ugcaaauguuaguaacaccacu

SEQ ID NO: 139999 - RNA, 20 nt, Homo sapiens
ugcagauucaaccaacugug

SEQ ID NO: 140000 - RNA, 19 nt, Homo sapiens
ugcauaggguuacauacuc

SEQ ID NO: 140001 - RNA, 22 nt, Homo sapiens
ugcauaugucuuuauaguagca

SEQ ID NO: 140002 - RNA, 22 nt, Homo sapiens
ugcauauguugagaugcauauu

SEQ ID NO: 140003 - RNA, 21 nt, Homo sapiens
ugcaugguagucacaugauuc

SEQ ID NO: 140004 - RNA, 22 nt, Homo sapiens
ugccaaaaugggcuuuauaccg

SEQ ID NO: 140005 - RNA, 22 nt, Homo sapiens
ugccaaggagucagucccuaga

SEQ ID NO: 140006 - RNA, 22 nt, Homo sapiens
ugccaggaugaggucaauguuu

SEQ ID NO: 140007 - RNA, 20 nt, Homo sapiens
uggaaauuaaccuuucaggu

SEQ ID NO: 140008 - RNA, 23 nt, Homo sapiens
uggaggacaagcauggauaguga

SEQ ID NO: 140009 - RNA, 21 nt, Homo sapiens
uggcaaaaugggcaguggguu

SEQ ID NO: 140010 - RNA, 22 nt, Homo sapiens
uggcaaaugugagaugagaacu

SEQ ID NO: 140011 - RNA, 22 nt, Homo sapiens
uggugcccuguccuucuguggc

SEQ ID NO: 140012 - RNA, 22 nt, Homo sapiens
ugguguuugagaagcugauguc

SEQ ID NO: 140013 - RNA, 22 nt, Homo sapiens
uguacaugggacaggaggagag

SEQ ID NO: 140014 - RNA, 21 nt, Homo sapiens
uguagcagcaugauucauagu

SEQ ID NO: 140015 - RNA, 22 nt, Homo sapiens
uguagguguacauacaugguua

SEQ ID NO: 140016 - RNA, 22 nt, Homo sapiens
ugucaaagagacaucugcacuc

SEQ ID NO: 140017 - RNA, 22 nt, Homo sapiens
ugucaauauguaauaacugaau

SEQ ID NO: 140018 - RNA, 22 nt, Homo sapiens
ugucaguuucaguguuagccuu

SEQ ID NO: 140019 - RNA, 22 nt, Homo sapiens
uguccuggugaugcccaaauuc

SEQ ID NO: 140020 - RNA, 22 nt, Homo sapiens
ugucuagaucugaauguaauug

SEQ ID NO: 140021 - RNA, 22 nt, Homo sapiens
ugucucaguuucuguggguuag

SEQ ID NO: 140022 - RNA, 22 nt, Homo sapiens
ugucuuggagaauccuggguuu

SEQ ID NO: 140023 - RNA, 22 nt, Homo sapiens
ugugcaaggcucucaaccugug

SEQ ID NO: 140024 - RNA, 22 nt, Homo sapiens
ugugcauauaaguguguauaua

SEQ ID NO: 140025 - RNA, 22 nt, Homo sapiens
ugugccuaguaauguguccaga

SEQ ID NO: 140026 - RNA, 22 nt, Homo sapiens
uguggcucuucuguucuccacu

SEQ ID NO: 140027 - RNA, 22 nt, Homo sapiens
ugugguuuuuuucuccaauagg

SEQ ID NO: 140028 - RNA, 22 nt, Homo sapiens
uguguaaagcuuguuccagaaa

SEQ ID NO: 140029 - RNA, 21 nt, Homo sapiens
uguuaacaugcagauuacugg

SEQ ID NO: 140030 - RNA, 22 nt, Homo sapiens
uguuaacauggucucagucugu

SEQ ID NO: 140031 - RNA, 22 nt, Homo sapiens
uguuacacugugcacuaaauuu

SEQ ID NO: 140032 - RNA, 22 nt, Homo sapiens
uuaaggaaggagucuuaaaugg

SEQ ID NO: 140033 - RNA, 22 nt, Homo sapiens
uuaagugaauuaucuaacaugu

SEQ ID NO: 140034 - RNA, 22 nt, Homo sapiens
uuacagauggcacacucaaggg

SEQ ID NO: 140035 - RNA, 22 nt, Homo sapiens
uuacagucucaagagugcugca

SEQ ID NO: 140036 - RNA, 22 nt, Homo sapiens
uuacagucuuaggcagugcuuu

SEQ ID NO: 140037 - RNA, 22 nt, Homo sapiens
uuacauguuguggguuguggcc

SEQ ID NO: 140038 - RNA, 22 nt, Homo sapiens
uuacccauuagagaauuuaaga

SEQ ID NO: 140039 - RNA, 23 nt, Homo sapiens
uuauggcuuuuauuauguugagg

SEQ ID NO: 140040 - RNA, 22 nt, Homo sapiens
uuauuagagauauuugguuagg

SEQ ID NO: 140041 - RNA, 22 nt, Homo sapiens
uuauuauguuggugcaaaggua

SEQ ID NO: 140042 - RNA, 22 nt, Homo sapiens
uucaaaucuuuggcucccacua

SEQ ID NO: 140043 - RNA, 22 nt, Homo sapiens
uucacaguacucccuggaauua

SEQ ID NO: 140044 - RNA, 22 nt, Homo sapiens
uucacagugugaucuaugggca

SEQ ID NO: 140045 - RNA, 22 nt, Homo sapiens
uucacuggagcccaggaguugg

SEQ ID NO: 140046 - RNA, 20 nt, Homo sapiens
uucacugggcucucuguugg

SEQ ID NO: 140047 - RNA, 22 nt, Homo sapiens
uucacugggugugguggcucac

SEQ ID NO: 140048 - RNA, 22 nt, Homo sapiens
gagauuaacauuugaggagcug

SEQ ID NO: 140049 - RNA, 22 nt, Homo sapiens
gagauuaauacacaucaaaugc

SEQ ID NO: 140050 - RNA, 22 nt, Homo sapiens
gaguaaaugucacuguugcugu

SEQ ID NO: 140051 - RNA, 22 nt, Homo sapiens
gauaaagauagcaauagggaca

SEQ ID NO: 140052 - RNA, 22 nt, Homo sapiens
gauaugugauaagaguuaucuu

SEQ ID NO: 140053 - RNA, 22 nt, Homo sapiens
gaucacauguguacucaaugug

SEQ ID NO: 140054 - RNA, 22 nt, Homo sapiens
gauuagaacagaagucagauua

SEQ ID NO: 140055 - RNA, 22 nt, Homo sapiens
gcacauuacaaguauuagcuca

SEQ ID NO: 140056 - RNA, 22 nt, Homo sapiens
gcaguagugcgaucucagcuca

SEQ ID NO: 140057 - RNA, 20 nt, Homo sapiens
gcauaugucuuuauggcagc

SEQ ID NO: 140058 - RNA, 22 nt, Homo sapiens
gcauauguuuggguguguauau

SEQ ID NO: 140059 - RNA, 22 nt, Homo sapiens
gcaucacagcuccugugcuggc

SEQ ID NO: 140060 - RNA, 22 nt, Homo sapiens
gccaacauggcgcuccauucuu

SEQ ID NO: 140061 - RNA, 22 nt, Homo sapiens
ggagagcuaggcagagguuugu

SEQ ID NO: 140062 - RNA, 16 nt, Homo sapiens
ggaggucaucugggaa

SEQ ID NO: 140063 - RNA, 22 nt, Homo sapiens
ggcaaaauauugucugguauag

SEQ ID NO: 140064 - RNA, 22 nt, Homo sapiens
ggcaaaaucgcaauuacuuuug

SEQ ID NO: 140065 - RNA, 22 nt, Homo sapiens
ggcagaguggacauuuaaaugu

SEQ ID NO: 140066 - RNA, 22 nt, Homo sapiens
ggcucaguugcaaaucaguuca

SEQ ID NO: 140067 - RNA, 22 nt, Homo sapiens
gggcgagaaucggcugcucagc

SEQ ID NO: 140068 - RNA, 22 nt, Homo sapiens
ggucaggagaaugguaacugag

SEQ ID NO: 140069 - RNA, 22 nt, Homo sapiens
ggucugguguugaaauucuuca

SEQ ID NO: 140070 - RNA, 22 nt, Homo sapiens
guaaauguccccugugauauug

SEQ ID NO: 140071 - RNA, 22 nt, Homo sapiens
guacauagucacacauauacau

SEQ ID NO: 140072 - RNA, 22 nt, Homo sapiens
guagaauguauguauaacgcaa

SEQ ID NO: 140073 - RNA, 22 nt, Homo sapiens
gucaagugaagaccugacucuu

SEQ ID NO: 140074 - RNA, 22 nt, Homo sapiens
gucaaguguuuucaaggcuucc

SEQ ID NO: 140075 - RNA, 22 nt, Homo sapiens
gucacaguguuuguucauccca

SEQ ID NO: 140076 - RNA, 22 nt, Homo sapiens
gucacugggugcugcgccuguc

SEQ ID NO: 140077 - RNA, 22 nt, Homo sapiens
gucagcaaagaggaauaguuug

SEQ ID NO: 140078 - RNA, 22 nt, Homo sapiens
gucagucugucccugccuggcg

SEQ ID NO: 140079 - RNA, 22 nt, Homo sapiens
gucagugucuuaacagagauua

SEQ ID NO: 140080 - RNA, 22 nt, Homo sapiens
gucccagagauauugugucuuu

SEQ ID NO: 140081 - RNA, 22 nt, Homo sapiens
gucuggcuccuucuacuacaug

SEQ ID NO: 140082 - RNA, 22 nt, Homo sapiens
gucuggcuuaucucacuuacca

SEQ ID NO: 140083 - RNA, 22 nt, Homo sapiens
gugaaagacagcauuaauggcu

SEQ ID NO: 140084 - RNA, 22 nt, Homo sapiens
gugaaaugaaucuggaaauauu

SEQ ID NO: 140085 - RNA, 22 nt, Homo sapiens
gugaaugaaugggugaauacau

SEQ ID NO: 140086 - RNA, 18 nt, Homo sapiens
gugcauagccauggcagc

SEQ ID NO: 140087 - RNA, 22 nt, Homo sapiens
gugcauauaaguuguuucuagu

SEQ ID NO: 140088 - RNA, 22 nt, Homo sapiens
gugccacugcacuccggccugg

SEQ ID NO: 140089 - RNA, 22 nt, Homo sapiens
guggagcuguguggccuugggc

SEQ ID NO: 140090 - RNA, 22 nt, Homo sapiens
guggcaaagaugccuucuccaa

SEQ ID NO: 140091 - RNA, 21 nt, Homo sapiens
gugucacagacaugacagaug

SEQ ID NO: 140092 - RNA, 22 nt, Homo sapiens
gugucacuguugagaaguccac

SEQ ID NO: 140093 - RNA, 22 nt, Homo sapiens
guucuggagauaaagccaaggu

SEQ ID NO: 140094 - RNA, 20 nt, Homo sapiens
uaagacaugguccacaugcc

SEQ ID NO: 140095 - RNA, 22 nt, Homo sapiens
uaagugaauuugacagguaaug

SEQ ID NO: 140096 - RNA, 18 nt, Homo sapiens
uaauaacugugaccuuga

SEQ ID NO: 140097 - RNA, 21 nt, Homo sapiens
uaauaaugucucagacaccua

SEQ ID NO: 140098 - RNA, 22 nt, Homo sapiens
uaauaauguuaggcuuacucaa

SEQ ID NO: 140099 - RNA, 22 nt, Homo sapiens
uacaccauuugauucuuuaagc

SEQ ID NO: 140100 - RNA, 19 nt, Homo sapiens
uacaggacugagcugaggu

SEQ ID NO: 140101 - RNA, 22 nt, Homo sapiens
uacauccauccugcugggcagu

SEQ ID NO: 140102 - RNA, 22 nt, Homo sapiens
uacaugugccauguugguuugc

SEQ ID NO: 140103 - RNA, 19 nt, Homo sapiens
uacugcacuccagucuggg

SEQ ID NO: 140104 - RNA, 22 nt, Homo sapiens
uacugcagucagacuccugggc

SEQ ID NO: 140105 - RNA, 22 nt, Homo sapiens
uacugcaguugcagcuugagga

SEQ ID NO: 140106 - RNA, 22 nt, Homo sapiens
uagauaguaaagccauuagcuu

SEQ ID NO: 140107 - RNA, 20 nt, Homo sapiens
acugcacuccaaccuuugug

SEQ ID NO: 140108 - RNA, 22 nt, Homo sapiens
acugcacuccacccuuggcagc

SEQ ID NO: 140109 - RNA, 22 nt, Homo sapiens
acugcacuccagccucaugaca

SEQ ID NO: 140110 - RNA, 22 nt, Homo sapiens
acugcacuccagccuggacgaa

SEQ ID NO: 140111 - RNA, 22 nt, Homo sapiens
acugcacuccagccuguugaca

SEQ ID NO: 140112 - RNA, 20 nt, Homo sapiens
acugcacuccagccuuccag

SEQ ID NO: 140113 - RNA, 22 nt, Homo sapiens
acugcacuccagccuugagagc

SEQ ID NO: 140114 - RNA, 22 nt, Homo sapiens
acugcacuccagccuuugcgau

SEQ ID NO: 140115 - RNA, 22 nt, Homo sapiens
acugcacuccagcuccagggug

SEQ ID NO: 140116 - RNA, 20 nt, Homo sapiens
acugcacuccagucucuggg

SEQ ID NO: 140117 - RNA, 22 nt, Homo sapiens
acugcacuccaguuugggcagc

SEQ ID NO: 140118 - RNA, 22 nt, Homo sapiens
acugcacuccaucuuagguggc

SEQ ID NO: 140119 - RNA, 22 nt, Homo sapiens
acugcacuccuccuugggugac

SEQ ID NO: 140120 - RNA, 22 nt, Homo sapiens
acugcacuucaaccucauugac

SEQ ID NO: 140121 - RNA, 22 nt, Homo sapiens
acugcacuucagccuuggcuac

SEQ ID NO: 140122 - RNA, 22 nt, Homo sapiens
acuuuguguuacccagcaagga

SEQ ID NO: 140123 - RNA, 19 nt, Homo sapiens
agaaucuaaauuauuucug

SEQ ID NO: 140124 - RNA, 22 nt, Homo sapiens
agacuagagggaaaugaguugg

SEQ ID NO: 140125 - RNA, 22 nt, Homo sapiens
agagcaauguuaucagucucug

SEQ ID NO: 140126 - RNA, 22 nt, Homo sapiens
agaguauagcaacuuaguaaaa

SEQ ID NO: 140127 - RNA, 18 nt, Homo sapiens
agcaucacugaucauccu

SEQ ID NO: 140128 - RNA, 22 nt, Homo sapiens
agcauuaguugugaagccuuua

SEQ ID NO: 140129 - RNA, 22 nt, Homo sapiens
agcuccuuugcuuuuuccagga

SEQ ID NO: 140130 - RNA, 22 nt, Homo sapiens
agcuucauuguuaugaauguca

SEQ ID NO: 140131 - RNA, 22 nt, Homo sapiens
aggaagcuagcauuuguucagu

SEQ ID NO: 140132 - RNA, 22 nt, Homo sapiens
aggcaagaaugcuuguuucacc

SEQ ID NO: 140133 - RNA, 22 nt, Homo sapiens
agugcacuccagccugggcaac

SEQ ID NO: 140134 - RNA, 22 nt, Homo sapiens
auaagugagugauucaguguua

SEQ ID NO: 140135 - RNA, 22 nt, Homo sapiens
auaaucaugucugaaaccuuug

SEQ ID NO: 140136 - RNA, 22 nt, Homo sapiens
auacaagugccauguuggugug

SEQ ID NO: 140137 - RNA, 22 nt, Homo sapiens
auacauguucaagggcauauau

SEQ ID NO: 140138 - RNA, 22 nt, Homo sapiens
auagagugcuucaucaguagua

SEQ ID NO: 140139 - RNA, 22 nt, Homo sapiens
auagggcacgagaugugagccu

SEQ ID NO: 140140 - RNA, 21 nt, Homo sapiens
auaugugcuguggaagucagc

SEQ ID NO: 140141 - RNA, 22 nt, Homo sapiens
aucacauggccuagccuaaccu

SEQ ID NO: 140142 - RNA, 22 nt, Homo sapiens
aucaccuggaguagcccguccc

SEQ ID NO: 140143 - RNA, 22 nt, Homo sapiens
aucacuagaucauagguaaaca

SEQ ID NO: 140144 - RNA, 22 nt, Homo sapiens
aucagcagcaugaaaacaggcu

SEQ ID NO: 140145 - RNA, 22 nt, Homo sapiens
auccccugcacggggugucauu

SEQ ID NO: 140146 - RNA, 22 nt, Homo sapiens
auccuugagaaaauaaaugacc

SEQ ID NO: 140147 - RNA, 22 nt, Homo sapiens
aucuuuggugaguucuuugguc

SEQ ID NO: 140148 - RNA, 22 nt, Homo sapiens
augaaaguguguggaaacuuga

SEQ ID NO: 140149 - RNA, 22 nt, Homo sapiens
augaaaucuuuccugugaggau

SEQ ID NO: 140150 - RNA, 22 nt, Homo sapiens
augaggaagucaggcccagggg

SEQ ID NO: 140151 - RNA, 22 nt, Homo sapiens
augaggugauuucuguucgggu

SEQ ID NO: 140152 - RNA, 20 nt, Homo sapiens
augagguguaugacacugaa

SEQ ID NO: 140153 - RNA, 22 nt, Homo sapiens
augcagagucccagccccuagc

SEQ ID NO: 140154 - RNA, 22 nt, Homo sapiens
augcauagcaucugcaaauguu

SEQ ID NO: 140155 - RNA, 22 nt, Homo sapiens
augccaagaugagcacgcgucu

SEQ ID NO: 140156 - RNA, 22 nt, Homo sapiens
auggagugagaauggagguucc

SEQ ID NO: 140157 - RNA, 22 nt, Homo sapiens
auggcaaaauguuccuaguggu

SEQ ID NO: 140158 - RNA, 22 nt, Homo sapiens
auggcacuccagccugggcaac

SEQ ID NO: 140159 - RNA, 22 nt, Homo sapiens
auguaaacuacagauuuugggu

SEQ ID NO: 140160 - RNA, 22 nt, Homo sapiens
augucuuucauagagacccaga

SEQ ID NO: 140161 - RNA, 22 nt, Homo sapiens
augugcaaaguuaagaucccag

SEQ ID NO: 140162 - RNA, 22 nt, Homo sapiens
augugcaauguguacguagccc

SEQ ID NO: 140163 - RNA, 22 nt, Homo sapiens
auguuuagagagggugucaaau

SEQ ID NO: 140164 - RNA, 22 nt, Homo sapiens
auuaagugcuugccagugcugg

SEQ ID NO: 140165 - RNA, 22 nt, Homo sapiens
auuagugaaugugaugucuuga

SEQ ID NO: 140166 - RNA, 22 nt, Homo sapiens
auugaacacuucugugugccag

SEQ ID NO: 140167 - RNA, 22 nt, Homo sapiens
auugaaucuaaaaugagucucu

SEQ ID NO: 140168 - RNA, 22 nt, Homo sapiens
auuguacauacaccggugugua

SEQ ID NO: 140169 - RNA, 22 nt, Homo sapiens
auuucacugagacaugugccca

SEQ ID NO: 140170 - RNA, 19 nt, Homo sapiens
caaaguguucuucuuugcc

SEQ ID NO: 140171 - RNA, 22 nt, Homo sapiens
caauacuguuaccugaaauagg

SEQ ID NO: 140172 - RNA, 22 nt, Homo sapiens
cacaaugucuaagauguuucua

SEQ ID NO: 140173 - RNA, 22 nt, Homo sapiens
cacaggaagaggcacggucccu

SEQ ID NO: 140174 - RNA, 22 nt, Homo sapiens
cacaguguucauagccaucagg

SEQ ID NO: 140175 - RNA, 22 nt, Homo sapiens
cacaguguuccagcuauuugaa

SEQ ID NO: 140176 - RNA, 22 nt, Homo sapiens
cacugcacuccagccuaagagg

SEQ ID NO: 140177 - RNA, 22 nt, Homo sapiens
cacugcacuccagucuggcgac

SEQ ID NO: 140178 - RNA, 22 nt, Homo sapiens
cacugcaguaaauugcgucggu

SEQ ID NO: 140179 - RNA, 22 nt, Homo sapiens
cagagguauugcaaaagccuag

SEQ ID NO: 140180 - RNA, 22 nt, Homo sapiens
cagcugcuuuggaaaauauuuu

SEQ ID NO: 140181 - RNA, 22 nt, Homo sapiens
caggucaucugaguuuaguucu

SEQ ID NO: 140182 - RNA, 20 nt, Homo sapiens
cagugcacuuucccacuggu

SEQ ID NO: 140183 - RNA, 22 nt, Homo sapiens
caguucaugguaggcaccauag

SEQ ID NO: 140184 - RNA, 22 nt, Homo sapiens
cauggcacugagcagguaugca

SEQ ID NO: 140185 - RNA, 19 nt, Homo sapiens
caugugcacuacuggcuuc

SEQ ID NO: 140186 - RNA, 22 nt, Homo sapiens
caugugcaugcuuucuuaugug

SEQ ID NO: 140187 - RNA, 22 nt, Homo sapiens
cauugcaugcauauggcuuggu

SEQ ID NO: 140188 - RNA, 22 nt, Homo sapiens
ccacauuaccuugcuugcucca

SEQ ID NO: 140189 - RNA, 22 nt, Homo sapiens
ccagucuuggugucuguagcac

SEQ ID NO: 140190 - RNA, 17 nt, Homo sapiens
ccccugagcgaugcagu

SEQ ID NO: 140191 - RNA, 22 nt, Homo sapiens
cccuguguuguucaaggaucug

SEQ ID NO: 140192 - RNA, 22 nt, Homo sapiens
ccugguguuuugauggucgggu

SEQ ID NO: 140193 - RNA, 22 nt, Homo sapiens
cuaagugaguauaauuuuaaga

SEQ ID NO: 140194 - RNA, 22 nt, Homo sapiens
cuacagugggucuguaguccuu

SEQ ID NO: 140195 - RNA, 22 nt, Homo sapiens
cuauuugguuggugaaaaaagu

SEQ ID NO: 140196 - RNA, 21 nt, Homo sapiens
cucaaaguacugauauuacag

SEQ ID NO: 140197 - RNA, 22 nt, Homo sapiens
cucacggcccugcgcacuggca

SEQ ID NO: 140198 - RNA, 22 nt, Homo sapiens
cucacugggaccacucugaagu

SEQ ID NO: 140199 - RNA, 22 nt, Homo sapiens
cuccagugcaaagucaugauca

SEQ ID NO: 140200 - RNA, 22 nt, Homo sapiens
cucugguuuuucuuccauuaag

SEQ ID NO: 140201 - RNA, 22 nt, Homo sapiens
cugaaagagcauguaacacagu

SEQ ID NO: 140202 - RNA, 22 nt, Homo sapiens
cugacaagugaucacagcagca

SEQ ID NO: 140203 - RNA, 18 nt, Homo sapiens
cugccagugugcucuccg

SEQ ID NO: 140204 - RNA, 22 nt, Homo sapiens
cuggcaaaaagagggcaauaau

SEQ ID NO: 140205 - RNA, 22 nt, Homo sapiens
cuggcaaauguuuucuguaaag

SEQ ID NO: 140206 - RNA, 22 nt, Homo sapiens
cuggccagagacauucauuaaa

SEQ ID NO: 140207 - RNA, 23 nt, Homo sapiens
cuguacacauauacaucuaagua

SEQ ID NO: 140208 - RNA, 22 nt, Homo sapiens
cuuuguggggucuuuccucaaa

SEQ ID NO: 140209 - RNA, 22 nt, Homo sapiens
cuuuuugcaaauacaacucuga

SEQ ID NO: 140210 - RNA, 22 nt, Homo sapiens
gaaagauuuuaacugggagacu

SEQ ID NO: 140211 - RNA, 22 nt, Homo sapiens
gaacuguaaagaaauucuaagg

SEQ ID NO: 140212 - RNA, 22 nt, Homo sapiens
gaaguaggugcuguuauuaucu

SEQ ID NO: 140213 - RNA, 22 nt, Homo sapiens
gacauuaucagguuuguuuucu

SEQ ID NO: 140214 - RNA, 22 nt, Homo sapiens
gaccacagacuggaaagagggc

SEQ ID NO: 140215 - RNA, 18 nt, Homo sapiens
gacuccauuucagccaga

SEQ ID NO: 140216 - RNA, 22 nt, Homo sapiens
gagagcuaggccacuggggcuu

SEQ ID NO: 140217 - RNA, 22 nt, Homo sapiens
uuuuacacaucaccgcucgugu

SEQ ID NO: 140218 - RNA, 19 nt, Homo sapiens
uuuuccccuuucuuaagac

SEQ ID NO: 140219 - RNA, 22 nt, Homo sapiens
uuuugcuugugaauagccacau

SEQ ID NO: 140220 - RNA, 22 nt, Homo sapiens
uuuuugaguaaauauaaauugu

SEQ ID NO: 140221 - RNA, 22 nt, Homo sapiens
gcaucacagggagacaggccuc

SEQ ID NO: 140222 - RNA, 22 nt, Homo sapiens
gcauugcacuuggcauagacug

SEQ ID NO: 140223 - RNA, 22 nt, Homo sapiens
gccaagaagugucuaagcagga

SEQ ID NO: 140224 - RNA, 22 nt, Homo sapiens
gccugagaggauaugauccccu

SEQ ID NO: 140225 - RNA, 22 nt, Homo sapiens
gcucaugggcagugugauuguu

SEQ ID NO: 140226 - RNA, 22 nt, Homo sapiens
gcugguguagagugcagaaagg

SEQ ID NO: 140227 - RNA, 22 nt, Homo sapiens
gcuguauugacuuuguaucaua

SEQ ID NO: 140228 - RNA, 22 nt, Homo sapiens
gcuguauuguugaaggaaaugu

SEQ ID NO: 140229 - RNA, 22 nt, Homo sapiens
ggagaugauuaugaaucacuua

SEQ ID NO: 140230 - RNA, 20 nt, Homo sapiens
ggagguuguauaaguacauc

SEQ ID NO: 140231 - RNA, 22 nt, Homo sapiens
ggcaacaaagacauuucaacau

SEQ ID NO: 140232 - RNA, 22 nt, Homo sapiens
ggcaguggaagugccaguuucu

SEQ ID NO: 140233 - RNA, 22 nt, Homo sapiens
gggaugaaguugauguagaaag

SEQ ID NO: 140234 - RNA, 22 nt, Homo sapiens
gggcaaaacuguacugccaagg

SEQ ID NO: 140235 - RNA, 22 nt, Homo sapiens
ggggcauugugucuggguuccu

SEQ ID NO: 140236 - RNA, 22 nt, Homo sapiens
gggguauguaagugagugagug

SEQ ID NO: 140237 - RNA, 22 nt, Homo sapiens
ggggucauuaaauuccgcuggu

SEQ ID NO: 140238 - RNA, 22 nt, Homo sapiens
ggguaaaucucuuuucauggcu

SEQ ID NO: 140239 - RNA, 19 nt, Homo sapiens
ggucauggagguuguguga

SEQ ID NO: 140240 - RNA, 21 nt, Homo sapiens
ggugagaaaggagacauagac

SEQ ID NO: 140241 - RNA, 22 nt, Homo sapiens
guaacacaugcugcucucuggu

SEQ ID NO: 140242 - RNA, 22 nt, Homo sapiens
guacaguuuucaguguucacug

SEQ ID NO: 140243 - RNA, 22 nt, Homo sapiens
guagaagcacaggugaguuggu

SEQ ID NO: 140244 - RNA, 22 nt, Homo sapiens
guauacaugucaaaacucacau

SEQ ID NO: 140245 - RNA, 22 nt, Homo sapiens
guauaguaguacaaaaguuuuu

SEQ ID NO: 140246 - RNA, 22 nt, Homo sapiens
guaugcacauauguguauguau

SEQ ID NO: 140247 - RNA, 22 nt, Homo sapiens
guauggaagucaguuuguuggc

SEQ ID NO: 140248 - RNA, 22 nt, Homo sapiens
gucacauugaugcccauggugg

SEQ ID NO: 140249 - RNA, 22 nt, Homo sapiens
gucaccagcuguguuagccccu

SEQ ID NO: 140250 - RNA, 22 nt, Homo sapiens
gucagggagggauagaugauua

SEQ ID NO: 140251 - RNA, 22 nt, Homo sapiens
gucagugugauaucugcagggg

SEQ ID NO: 140252 - RNA, 22 nt, Homo sapiens
gucaugcaggguucgccagccc

SEQ ID NO: 140253 - RNA, 22 nt, Homo sapiens
gucauucauucagcaagcacug

SEQ ID NO: 140254 - RNA, 22 nt, Homo sapiens
guccaagacuaggaguuggcag

SEQ ID NO: 140255 - RNA, 22 nt, Homo sapiens
guccauuuguuuccagagcacu

SEQ ID NO: 140256 - RNA, 22 nt, Homo sapiens
gucucacagcuagcugcuuuau

SEQ ID NO: 140257 - RNA, 21 nt, Homo sapiens
gucugguguuuuaaugaggac

SEQ ID NO: 140258 - RNA, 20 nt, Homo sapiens
gucuugcuccguugcccagg

SEQ ID NO: 140259 - RNA, 22 nt, Homo sapiens
gugaacagaaccugggaucgaa

SEQ ID NO: 140260 - RNA, 22 nt, Homo sapiens
gugaaguuuuuugcugagaguc

SEQ ID NO: 140261 - RNA, 22 nt, Homo sapiens
gugacacagcaagacuccgucu

SEQ ID NO: 140262 - RNA, 19 nt, Homo sapiens
gugagcacagacaauacaa

SEQ ID NO: 140263 - RNA, 22 nt, Homo sapiens
gugagcauaggaggcuucuguu

SEQ ID NO: 140264 - RNA, 22 nt, Homo sapiens
gugagcuccucuucugcugcag

SEQ ID NO: 140265 - RNA, 21 nt, Homo sapiens
gugaggucauugggcuuucug

SEQ ID NO: 140266 - RNA, 20 nt, Homo sapiens
gugagucauuaguaaccaaa

SEQ ID NO: 140267 - RNA, 22 nt, Homo sapiens
gugaugguaguuuguauuucug

SEQ ID NO: 140268 - RNA, 22 nt, Homo sapiens
gugauuauuaugcacugcaugc

SEQ ID NO: 140269 - RNA, 22 nt, Homo sapiens
gugcacaacguguagguuuguu

SEQ ID NO: 140270 - RNA, 22 nt, Homo sapiens
gugcacaaucgugcauuccuug

SEQ ID NO: 140271 - RNA, 22 nt, Homo sapiens
gugcacuguagaacccuuuguu

SEQ ID NO: 140272 - RNA, 23 nt, Homo sapiens
gugcaguggcgagauuucggcuc

SEQ ID NO: 140273 - RNA, 22 nt, Homo sapiens
gugcauguccacuaguccauau

SEQ ID NO: 140274 - RNA, 22 nt, Homo sapiens
guggaagguaaugcagcuuacu

SEQ ID NO: 140275 - RNA, 22 nt, Homo sapiens
guggaucacuugaggucaagag

SEQ ID NO: 140276 - RNA, 22 nt, Homo sapiens
guggcagcacauauagguuguu

SEQ ID NO: 140277 - RNA, 22 nt, Homo sapiens
gugggcaaagcuaguguguaga

SEQ ID NO: 140278 - RNA, 22 nt, Homo sapiens
guggguaaaucucuguucgagg

SEQ ID NO: 140279 - RNA, 22 nt, Homo sapiens
gugguuuuaauauucagucuag

SEQ ID NO: 140280 - RNA, 22 nt, Homo sapiens
gugguuuuaucccagaaauuaa

SEQ ID NO: 140281 - RNA, 18 nt, Homo sapiens
acagugucauggcucaau

SEQ ID NO: 140282 - RNA, 22 nt, Homo sapiens
acagugucaugucguguucccc

SEQ ID NO: 140283 - RNA, 22 nt, Homo sapiens
accauugcacuccagccugggc

SEQ ID NO: 140284 - RNA, 22 nt, Homo sapiens
acccuggauucguggccuugaa

SEQ ID NO: 140285 - RNA, 19 nt, Homo sapiens
acccuguccccaccuuuac

SEQ ID NO: 140286 - RNA, 22 nt, Homo sapiens
accugagacuaggcauuuuaua

SEQ ID NO: 140287 - RNA, 22 nt, Homo sapiens
accugagauuacaggugcuggc

SEQ ID NO: 140288 - RNA, 19 nt, Homo sapiens
accuguagaaaguacaaca

SEQ ID NO: 140289 - RNA, 21 nt, Homo sapiens
acugagagaucuggggcacau

SEQ ID NO: 140290 - RNA, 22 nt, Homo sapiens
acugcacuccagccuucaggac

SEQ ID NO: 140291 - RNA, 22 nt, Homo sapiens
agaaacauucucuugccuccuu

SEQ ID NO: 140292 - RNA, 22 nt, Homo sapiens
agaauucugucauguuuauauu

SEQ ID NO: 140293 - RNA, 22 nt, Homo sapiens
agacaucauuugauggugggag

SEQ ID NO: 140294 - RNA, 22 nt, Homo sapiens
agagguaagcaguggcaagugc

SEQ ID NO: 140295 - RNA, 21 nt, Homo sapiens
agagucaucucuaucuguacc

SEQ ID NO: 140296 - RNA, 22 nt, Homo sapiens
agagugcaauggcaccaucucg

SEQ ID NO: 140297 - RNA, 22 nt, Homo sapiens
agagugcuauagauuagauuuc

SEQ ID NO: 140298 - RNA, 20 nt, Homo sapiens
agagugcugucuguccugag

SEQ ID NO: 140299 - RNA, 22 nt, Homo sapiens
agauauguuauugauguuaaug

SEQ ID NO: 140300 - RNA, 19 nt, Homo sapiens
agcagaacaaauguguggg

SEQ ID NO: 140301 - RNA, 22 nt, Homo sapiens
agcagagcauauucauucgggg

SEQ ID NO: 140302 - RNA, 22 nt, Homo sapiens
agcagcauggguauaaaucucc

SEQ ID NO: 140303 - RNA, 21 nt, Homo sapiens
agcagcuuugguugaagcaga

SEQ ID NO: 140304 - RNA, 22 nt, Homo sapiens
agcagguguggcuuauccugaa

SEQ ID NO: 140305 - RNA, 22 nt, Homo sapiens
agccauacaacguaugcaugua

SEQ ID NO: 140306 - RNA, 22 nt, Homo sapiens
agcuaguguucaccagagguca

SEQ ID NO: 140307 - RNA, 22 nt, Homo sapiens
agcucauugcuguccuggagga

SEQ ID NO: 140308 - RNA, 20 nt, Homo sapiens
agcuguuguuaaaaaggagg

SEQ ID NO: 140309 - RNA, 22 nt, Homo sapiens
agcuugugauucuccaucaugu

SEQ ID NO: 140310 - RNA, 22 nt, Homo sapiens
aggcuagacuuugagaauuuuu

SEQ ID NO: 140311 - RNA, 22 nt, Homo sapiens
agggcuuuugagcugagauggu

SEQ ID NO: 140312 - RNA, 22 nt, Homo sapiens
aggguaguaggcuugggauugg

SEQ ID NO: 140313 - RNA, 22 nt, Homo sapiens
agguagaguguuuuguucuucu

SEQ ID NO: 140314 - RNA, 21 nt, Homo sapiens
agguaguuuuccuuuuggagu

SEQ ID NO: 140315 - RNA, 22 nt, Homo sapiens
aguaaaucacuaauggcuuccg

SEQ ID NO: 140316 - RNA, 22 nt, Homo sapiens
agucacagccuuuuacuuuaga

SEQ ID NO: 140317 - RNA, 22 nt, Homo sapiens
agugaauuguucaacaggagga

SEQ ID NO: 140318 - RNA, 22 nt, Homo sapiens
agugcacucuuuccucucuuac

SEQ ID NO: 140319 - RNA, 17 nt, Homo sapiens
auaaacucaucauuuuu

SEQ ID NO: 140320 - RNA, 22 nt, Homo sapiens
auaagucaauggaacagauuaa

SEQ ID NO: 140321 - RNA, 21 nt, Homo sapiens
auagcacuucacuugguuaga

SEQ ID NO: 140322 - RNA, 22 nt, Homo sapiens
auagcagcaccucacucuacug

SEQ ID NO: 140323 - RNA, 22 nt, Homo sapiens
auaugcacgugcauacacacuu

SEQ ID NO: 140324 - RNA, 22 nt, Homo sapiens
aucaaaguaggcauauguuuuu

SEQ ID NO: 140325 - RNA, 22 nt, Homo sapiens
aucacagaacuuugagcagaga

SEQ ID NO: 140326 - RNA, 22 nt, Homo sapiens
aucauaucauuggugaacagug

SEQ ID NO: 140327 - RNA, 22 nt, Homo sapiens
aucgcaccauugcacuccagca

SEQ ID NO: 140328 - RNA, 17 nt, Homo sapiens
augaacucaucauuuuu

SEQ ID NO: 140329 - RNA, 22 nt, Homo sapiens
augaagcuagcugauugcugau

SEQ ID NO: 140330 - RNA, 22 nt, Homo sapiens
augaauccauuccugccacaga

SEQ ID NO: 140331 - RNA, 22 nt, Homo sapiens
augaccaugauccuugccgacc

SEQ ID NO: 140332 - RNA, 22 nt, Homo sapiens
augaccuuguccucagugucau

SEQ ID NO: 140333 - RNA, 22 nt, Homo sapiens
augagagugagagcagccccuu

SEQ ID NO: 140334 - RNA, 22 nt, Homo sapiens
auggaaggagaggaaugaauga

SEQ ID NO: 140335 - RNA, 22 nt, Homo sapiens
cugucuguuucaaaagugguua

SEQ ID NO: 140336 - RNA, 19 nt, Homo sapiens
cugugcauuucuguggaag

SEQ ID NO: 140337 - RNA, 22 nt, Homo sapiens
cuucaaguguggccaccugacc

SEQ ID NO: 140338 - RNA, 18 nt, Homo sapiens
cuucauugcuguuuugcu

SEQ ID NO: 140339 - RNA, 22 nt, Homo sapiens
cuuccauaguuacacccaggga

SEQ ID NO: 140340 - RNA, 22 nt, Homo sapiens
cuucuugcuguguccucacaug

SEQ ID NO: 140341 - RNA, 19 nt, Homo sapiens
cuugccccauucauccucu

SEQ ID NO: 140342 - RNA, 22 nt, Homo sapiens
cuugccuaaucugcaugauuuu

SEQ ID NO: 140343 - RNA, 22 nt, Homo sapiens
cuuucacacuguuggugggaau

SEQ ID NO: 140344 - RNA, 22 nt, Homo sapiens
cuuuccauuguuggagcauaaa

SEQ ID NO: 140345 - RNA, 22 nt, Homo sapiens
cuuugggaccgcgguuuauacu

SEQ ID NO: 140346 - RNA, 22 nt, Homo sapiens
cuuugguugugcucuccacuuu

SEQ ID NO: 140347 - RNA, 22 nt, Homo sapiens
cuuuugcugggucagcgguggu

SEQ ID NO: 140348 - RNA, 22 nt, Homo sapiens
gaauagugcugcaagaaacaua

SEQ ID NO: 140349 - RNA, 20 nt, Homo sapiens
gaaugguuucgggguucuug

SEQ ID NO: 140350 - RNA, 22 nt, Homo sapiens
gacaccugguguggaacuggag

SEQ ID NO: 140351 - RNA, 22 nt, Homo sapiens
gacaguguggcgauuccucaag

SEQ ID NO: 140352 - RNA, 22 nt, Homo sapiens
gagaacuaaugguuugauaagg

SEQ ID NO: 140353 - RNA, 22 nt, Homo sapiens
gagaaugagaggggaaggccac

SEQ ID NO: 140354 - RNA, 22 nt, Homo sapiens
gagacugagucucacucuguca

SEQ ID NO: 140355 - RNA, 21 nt, Homo sapiens
gagaggauucgccagccucuu

SEQ ID NO: 140356 - RNA, 22 nt, Homo sapiens
gagagugcuuggcaucugcuga

SEQ ID NO: 140357 - RNA, 22 nt, Homo sapiens
gagauucaucuagguccagaga

SEQ ID NO: 140358 - RNA, 22 nt, Homo sapiens
gagcaucaguggccucaucuca

SEQ ID NO: 140359 - RNA, 22 nt, Homo sapiens
gagguaaguggauuaugagguc

SEQ ID NO: 140360 - RNA, 17 nt, Homo sapiens
gagguaguuuacuuuca

SEQ ID NO: 140361 - RNA, 22 nt, Homo sapiens
gaguaacagcauaaauuuguga

SEQ ID NO: 140362 - RNA, 22 nt, Homo sapiens
gaguuguuuuaaggcacugacu

SEQ ID NO: 140363 - RNA, 22 nt, Homo sapiens
gauaaaguauuggguacuaugc

SEQ ID NO: 140364 - RNA, 20 nt, Homo sapiens
gaucaguuuggaguaagugc

SEQ ID NO: 140365 - RNA, 22 nt, Homo sapiens
gauuggcauugcugcaccugag

SEQ ID NO: 140366 - RNA, 22 nt, Homo sapiens
gcaaaguguuuuuaggaagucu

SEQ ID NO: 140367 - RNA, 22 nt, Homo sapiens
gcaaaugcuacaccauuuugua

SEQ ID NO: 140368 - RNA, 22 nt, Homo sapiens
gcaacugguuucaguuuuucag

SEQ ID NO: 140369 - RNA, 22 nt, Homo sapiens
gcacaggguuacauucuaaggu

SEQ ID NO: 140370 - RNA, 22 nt, Homo sapiens
gcaccacugcacucucagcuug

SEQ ID NO: 140371 - RNA, 22 nt, Homo sapiens
gcacugagagaagccccaagua

SEQ ID NO: 140372 - RNA, 22 nt, Homo sapiens
gcagagaaacaggucuaaggag

SEQ ID NO: 140373 - RNA, 22 nt, Homo sapiens
gcaguagugugaucuuggcuca

SEQ ID NO: 140374 - RNA, 20 nt, Homo sapiens
gcauaugucuuuauagcaga

SEQ ID NO: 140375 - RNA, 22 nt, Homo sapiens
acaguguuacuugauaguguau

SEQ ID NO: 140376 - RNA, 22 nt, Homo sapiens
acauggcacugcgggcuucuug

SEQ ID NO: 140377 - RNA, 22 nt, Homo sapiens
acccuggaguaguaggaaucug

SEQ ID NO: 140378 - RNA, 22 nt, Homo sapiens
accugcacagccgaacauagac

SEQ ID NO: 140379 - RNA, 22 nt, Homo sapiens
acuagagaugcauuuguaguuu

SEQ ID NO: 140380 - RNA, 22 nt, Homo sapiens
acucauugcucauaccuuaucu

SEQ ID NO: 140381 - RNA, 19 nt, Homo sapiens
acugagcuaccugggggca

SEQ ID NO: 140382 - RNA, 22 nt, Homo sapiens
acugcaaugucgaauagagaug

SEQ ID NO: 140383 - RNA, 22 nt, Homo sapiens
acugcacuccagcccaggugac

SEQ ID NO: 140384 - RNA, 18 nt, Homo sapiens
acuggaauuaaacuuuuu

SEQ ID NO: 140385 - RNA, 22 nt, Homo sapiens
agaaagugcuucccuuugguga

SEQ ID NO: 140386 - RNA, 22 nt, Homo sapiens
agaauguaaacagaauagagga

SEQ ID NO: 140387 - RNA, 22 nt, Homo sapiens
agaauguauauucuguaguugu

SEQ ID NO: 140388 - RNA, 21 nt, Homo sapiens
agacacuuggaagguuuuaga

SEQ ID NO: 140389 - RNA, 22 nt, Homo sapiens
agacuagacagaugaacagcac

SEQ ID NO: 140390 - RNA, 20 nt, Homo sapiens
agacuagggagcagaaagcc

SEQ ID NO: 140391 - RNA, 22 nt, Homo sapiens
agagcuguguuuuaacuuuuua

SEQ ID NO: 140392 - RNA, 23 nt, Homo sapiens
agagugcaauggugccaucucgg

SEQ ID NO: 140393 - RNA, 22 nt, Homo sapiens
agcagcuuugcauggccugugg

SEQ ID NO: 140394 - RNA, 22 nt, Homo sapiens
agcagugucauuuucuggugag

SEQ ID NO: 140395 - RNA, 19 nt, Homo sapiens
agcaguguggagauuucuc

SEQ ID NO: 140396 - RNA, 19 nt, Homo sapiens
agcaucauuauuguuuugg

SEQ ID NO: 140397 - RNA, 17 nt, Homo sapiens
agccccauuagcuaguu

SEQ ID NO: 140398 - RNA, 23 nt, Homo sapiens
agccugguuucccugcuucuccc

SEQ ID NO: 140399 - RNA, 22 nt, Homo sapiens
agccuucauucugacaguagga

SEQ ID NO: 140400 - RNA, 22 nt, Homo sapiens
agcucauugcaaccuccgccuc

SEQ ID NO: 140401 - RNA, 22 nt, Homo sapiens
agcuggaauuuaagguagauag

SEQ ID NO: 140402 - RNA, 22 nt, Homo sapiens
agcuggcuguggagaaaccccu

SEQ ID NO: 140403 - RNA, 19 nt, Homo sapiens
agcuguguugccugugaga

SEQ ID NO: 140404 - RNA, 22 nt, Homo sapiens
agcuuaugcuuggaagagauga

SEQ ID NO: 140405 - RNA, 22 nt, Homo sapiens
agcuucacaaugcagagggcag

SEQ ID NO: 140406 - RNA, 22 nt, Homo sapiens
agcuucauuguuaugaauguca

SEQ ID NO: 140407 - RNA, 22 nt, Homo sapiens
agcuugugauuuagagugagag

SEQ ID NO: 140408 - RNA, 21 nt, Homo sapiens
agcuuguguguaucacagugu

SEQ ID NO: 140409 - RNA, 19 nt, Homo sapiens
agcuuuggcuaacuuucuc

SEQ ID NO: 140410 - RNA, 22 nt, Homo sapiens
aggcagcuguuauauacugagu

SEQ ID NO: 140411 - RNA, 22 nt, Homo sapiens
aggugcucuuccuguaggucac

SEQ ID NO: 140412 - RNA, 20 nt, Homo sapiens
agguuauuauaauuagaaga

SEQ ID NO: 140413 - RNA, 22 nt, Homo sapiens
auacaguaaugucuuaggcugu

SEQ ID NO: 140414 - RNA, 22 nt, Homo sapiens
auacaguauggagggcccagcu

SEQ ID NO: 140415 - RNA, 22 nt, Homo sapiens
auacaugugugagcgaagaugu

SEQ ID NO: 140416 - RNA, 22 nt, Homo sapiens
auacauguucaagggcauauau

SEQ ID NO: 140417 - RNA, 22 nt, Homo sapiens
auacguacauaugcacauaugg

SEQ ID NO: 140418 - RNA, 22 nt, Homo sapiens
auaguacuauugcaguguuaua

SEQ ID NO: 140419 - RNA, 22 nt, Homo sapiens
auagugcuuuugaaucuuguug

SEQ ID NO: 140420 - RNA, 22 nt, Homo sapiens
auaucaaggccauuuucuaaau

SEQ ID NO: 140421 - RNA, 22 nt, Homo sapiens
aucaaauugucauuuuaaggau

SEQ ID NO: 140422 - RNA, 22 nt, Homo sapiens
aucagcaugcagaagucggggg

SEQ ID NO: 140423 - RNA, 22 nt, Homo sapiens
auccucugagaucuaggcagag

SEQ ID NO: 140424 - RNA, 22 nt, Homo sapiens
auccuguacuaagguuuuccca

SEQ ID NO: 140425 - RNA, 22 nt, Homo sapiens
aucucuugccagucagaauggu

SEQ ID NO: 140426 - RNA, 22 nt, Homo sapiens
aucugguguauuggugcugggu

SEQ ID NO: 140427 - RNA, 22 nt, Homo sapiens
augaaaacaugauuugccuguu

SEQ ID NO: 140428 - RNA, 22 nt, Homo sapiens
augaaaucuuuggcagaucuua

SEQ ID NO: 140429 - RNA, 21 nt, Homo sapiens
caucaaauugucauggugggu

SEQ ID NO: 140430 - RNA, 22 nt, Homo sapiens
cauggcacauauauaucuaggu

SEQ ID NO: 140431 - RNA, 22 nt, Homo sapiens
cauggcacaucuuuucugacua

SEQ ID NO: 140432 - RNA, 22 nt, Homo sapiens
caugguguuaggcacugggaau

SEQ ID NO: 140433 - RNA, 22 nt, Homo sapiens
cauuugguggcuacagaguaac

SEQ ID NO: 140434 - RNA, 22 nt, Homo sapiens
ccacccuggagaauuugagguc

SEQ ID NO: 140435 - RNA, 22 nt, Homo sapiens
ccagugcauggaucccaggggg

SEQ ID NO: 140436 - RNA, 19 nt, Homo sapiens
ccauggcaaugaucugaug

SEQ ID NO: 140437 - RNA, 22 nt, Homo sapiens
ccauggcaauggucagucuauu

SEQ ID NO: 140438 - RNA, 22 nt, Homo sapiens
cccagcguucggcauggcugag

SEQ ID NO: 140439 - RNA, 22 nt, Homo sapiens
cccugagaaaacuuuguccuua

SEQ ID NO: 140440 - RNA, 22 nt, Homo sapiens
cccugagagcagggucuuucuc

SEQ ID NO: 140441 - RNA, 22 nt, Homo sapiens
ccucuguaguccugcaagagga

SEQ ID NO: 140442 - RNA, 22 nt, Homo sapiens
ccugucuugaagagauccuccu

SEQ ID NO: 140443 - RNA, 22 nt, Homo sapiens
ccuuggcacuacugacauugua

SEQ ID NO: 140444 - RNA, 22 nt, Homo sapiens
ccuuuuuguaguggaaguagga

SEQ ID NO: 140445 - RNA, 22 nt, Homo sapiens
cuacucuggagagugacaauca

SEQ ID NO: 140446 - RNA, 22 nt, Homo sapiens
cuagcagaacaauacaauucgg

SEQ ID NO: 140447 - RNA, 22 nt, Homo sapiens
cuagccuggagugcaguggugc

SEQ ID NO: 140448 - RNA, 22 nt, Homo sapiens
cuauucacaggcaauauguaca

SEQ ID NO: 140449 - RNA, 18 nt, Homo sapiens
cucacacccuaaucagga

SEQ ID NO: 140450 - RNA, 20 nt, Homo sapiens
cucacagacagcuucuuucu

SEQ ID NO: 140451 - RNA, 22 nt, Homo sapiens
cucacuggguguaaaacaugua

SEQ ID NO: 140452 - RNA, 22 nt, Homo sapiens
cucaugcugucuucugggguaa

SEQ ID NO: 140453 - RNA, 22 nt, Homo sapiens
cucauggagauagagaauagaa

SEQ ID NO: 140454 - RNA, 22 nt, Homo sapiens
cucauugcaaucucugccuccc

SEQ ID NO: 140455 - RNA, 22 nt, Homo sapiens
cuccagugcaaagucaugauca

SEQ ID NO: 140456 - RNA, 22 nt, Homo sapiens
cucccuuugcugaauguuuuuc

SEQ ID NO: 140457 - RNA, 22 nt, Homo sapiens
cucuuuuguuuagcugagaggg

SEQ ID NO: 140458 - RNA, 22 nt, Homo sapiens
cugagauacacuaauagucucu

SEQ ID NO: 140459 - RNA, 22 nt, Homo sapiens
cugagauggagucucgcauugu

SEQ ID NO: 140460 - RNA, 22 nt, Homo sapiens
cugaggugggaguuuuucucau

SEQ ID NO: 140461 - RNA, 22 nt, Homo sapiens
cugccuagauguuguagggggu

SEQ ID NO: 140462 - RNA, 22 nt, Homo sapiens
cuggaaagcaaagggugcauug

SEQ ID NO: 140463 - RNA, 18 nt, Homo sapiens
cuggaaggcuacuacagu

SEQ ID NO: 140464 - RNA, 22 nt, Homo sapiens
cuggaguaugaaccauguauca

SEQ ID NO: 140465 - RNA, 22 nt, Homo sapiens
cuggcagucugccucuucacug

SEQ ID NO: 140466 - RNA, 22 nt, Homo sapiens
cuggcccaguucugcguuuugc

SEQ ID NO: 140467 - RNA, 22 nt, Homo sapiens
cugggcaaugcggcuggauaga

SEQ ID NO: 140468 - RNA, 22 nt, Homo sapiens
cugugcacaucuggcggcccga

SEQ ID NO: 140469 - RNA, 23 nt, Homo sapiens
cuguggugaggcccuagaaucug

SEQ ID NO: 140470 - RNA, 22 nt, Homo sapiens
cugugguguaacucuuggggcg

SEQ ID NO: 140471 - RNA, 21 nt, Homo sapiens
cuucuuggggcagggcagggu

SEQ ID NO: 140472 - RNA, 22 nt, Homo sapiens
cuuuggccauagcuaaaugauu

SEQ ID NO: 140473 - RNA, 22 nt, Homo sapiens
cuuuguggggucuuuccucaaa

SEQ ID NO: 140474 - RNA, 22 nt, Homo sapiens
cuuuguguggacauuucaggca

SEQ ID NO: 140475 - RNA, 22 nt, Homo sapiens
cuuuuugcaaauacaacucuga

SEQ ID NO: 140476 - RNA, 20 nt, Homo sapiens
gaaacaucuauccucuccuu

SEQ ID NO: 140477 - RNA, 22 nt, Homo sapiens
gaacuguaaagaaauucuaagg

SEQ ID NO: 140478 - RNA, 22 nt, Homo sapiens
gaaucacagauuaugaguaucu

SEQ ID NO: 140479 - RNA, 22 nt, Homo sapiens
gaaucacaguuauuagagcagc

SEQ ID NO: 140480 - RNA, 22 nt, Homo sapiens
gacagugugauacuuagucuca

SEQ ID NO: 140481 - RNA, 22 nt, Homo sapiens
gacauagcuagauaaccucaug

SEQ ID NO: 140482 - RNA, 20 nt, Homo sapiens
gacuugagagugggagagua

SEQ ID NO: 140483 - RNA, 22 nt, Homo sapiens
gagaacaguguuguauuuuuuc

SEQ ID NO: 140484 - RNA, 22 nt, Homo sapiens
gagauacacccagugcagaggc

SEQ ID NO: 140485 - RNA, 20 nt, Homo sapiens
gagauguugaucagggcuau

SEQ ID NO: 140486 - RNA, 20 nt, Homo sapiens
ucaaggcacgaauaaaaguu

SEQ ID NO: 140487 - RNA, 22 nt, Homo sapiens
ucaaguacugccuugcucuggc

SEQ ID NO: 140488 - RNA, 22 nt, Homo sapiens
ucacacgugaacucaucacaga

SEQ ID NO: 140489 - RNA, 22 nt, Homo sapiens
ucacacugaauuugaagcaaug

SEQ ID NO: 140490 - RNA, 22 nt, Homo sapiens
ucacacugcaucuguuggaauu

SEQ ID NO: 140491 - RNA, 22 nt, Homo sapiens
ucacacugucuugguuacucuu

SEQ ID NO: 140492 - RNA, 22 nt, Homo sapiens
ucacacuguuuugauuauuaua

SEQ ID NO: 140493 - RNA, 22 nt, Homo sapiens
ucacagugcaggaucaguuaau

SEQ ID NO: 140494 - RNA, 22 nt, Homo sapiens
ucacauggauuaacucauuuau

SEQ ID NO: 140495 - RNA, 22 nt, Homo sapiens
ucacaugugcguuuuggcaugu

SEQ ID NO: 140496 - RNA, 22 nt, Homo sapiens
ucacauuguacaaacagguaag

SEQ ID NO: 140497 - RNA, 22 nt, Homo sapiens
ucacauuguuauguaaauguuu

SEQ ID NO: 140498 - RNA, 22 nt, Homo sapiens
ucaccuggagccuucacauucu

SEQ ID NO: 140499 - RNA, 22 nt, Homo sapiens
ucaccuggggcacagcugaaga

SEQ ID NO: 140500 - RNA, 22 nt, Homo sapiens
ucacuaggcuggagugcagugg

SEQ ID NO: 140501 - RNA, 22 nt, Homo sapiens
ucacugaaaccacugccuccug

SEQ ID NO: 140502 - RNA, 22 nt, Homo sapiens
ucacugaaaccuccaccucucg

SEQ ID NO: 140503 - RNA, 22 nt, Homo sapiens
ucagaguaguuccuggcagaaa

SEQ ID NO: 140504 - RNA, 22 nt, Homo sapiens
ucagcagugugaaaacaaacua

SEQ ID NO: 140505 - RNA, 22 nt, Homo sapiens
ucaucagaaucccuuagggaug

SEQ ID NO: 140506 - RNA, 22 nt, Homo sapiens
ucaucuggcgaaugugaagagu

SEQ ID NO: 140507 - RNA, 22 nt, Homo sapiens
ucauuguccaacuucuuucagu

SEQ ID NO: 140508 - RNA, 22 nt, Homo sapiens
uccaugaggcuacaguaaucuc

SEQ ID NO: 140509 - RNA, 22 nt, Homo sapiens
uccauguagaagacaggggaga

SEQ ID NO: 140510 - RNA, 22 nt, Homo sapiens
uccauuuguucagcuucaggaa

SEQ ID NO: 140511 - RNA, 22 nt, Homo sapiens
ucccuguguuccuuuugaauug

SEQ ID NO: 140512 - RNA, 21 nt, Homo sapiens
uccugagagaggaguaacucu

SEQ ID NO: 140513 - RNA, 22 nt, Homo sapiens
uccugagagcagacccucuaua

SEQ ID NO: 140514 - RNA, 19 nt, Homo sapiens
uccuugauugcaccacugc

SEQ ID NO: 140515 - RNA, 22 nt, Homo sapiens
uccuuuggucaguauucuuuug

SEQ ID NO: 140516 - RNA, 22 nt, Homo sapiens
uccuuuguuacaguuggcucug

SEQ ID NO: 140517 - RNA, 22 nt, Homo sapiens
ucuauggaguuugaaugagaaa

SEQ ID NO: 140518 - RNA, 22 nt, Homo sapiens
ucucccauccaugaacuucugu

SEQ ID NO: 140519 - RNA, 17 nt, Homo sapiens
ucucccaucccuuucuc

SEQ ID NO: 140520 - RNA, 22 nt, Homo sapiens
ucucccauccguacacggauug

SEQ ID NO: 140521 - RNA, 19 nt, Homo sapiens
ucucugguguuggagggga

SEQ ID NO: 140522 - RNA, 22 nt, Homo sapiens
ucugagguuaaauuuuauaguu

SEQ ID NO: 140523 - RNA, 22 nt, Homo sapiens
ucuggccuacaucauuuuuccg

SEQ ID NO: 140524 - RNA, 22 nt, Homo sapiens
ucuggccuagaacaauuaauua

SEQ ID NO: 140525 - RNA, 22 nt, Homo sapiens
ucuggccuccuaugagaaucga

SEQ ID NO: 140526 - RNA, 22 nt, Homo sapiens
ucugucacugaaucccugucac

SEQ ID NO: 140527 - RNA, 19 nt, Homo sapiens
ucugucacuggggguauuc

SEQ ID NO: 140528 - RNA, 22 nt, Homo sapiens
ucugucuuguccucacccuaga

SEQ ID NO: 140529 - RNA, 22 nt, Homo sapiens
ucuugguuuauugugguaugaa

SEQ ID NO: 140530 - RNA, 22 nt, Homo sapiens
ucuuuagugacaguugugcaag

SEQ ID NO: 140531 - RNA, 23 nt, Homo sapiens
ucuuuggcucuaauauaccuugu

SEQ ID NO: 140532 - RNA, 22 nt, Homo sapiens
ucuuuguuagaacccucuccuu

SEQ ID NO: 140533 - RNA, 22 nt, Homo sapiens
ucuuuguuuucugauccugaag

SEQ ID NO: 140534 - RNA, 22 nt, Homo sapiens
ucuuuugugagucagccucucc

SEQ ID NO: 140535 - RNA, 22 nt, Homo sapiens
ugaagugaaugguaaguaugcc

SEQ ID NO: 140536 - RNA, 22 nt, Homo sapiens
ugaauguauuuauuaccauuca

SEQ ID NO: 140537 - RNA, 22 nt, Homo sapiens
ugacaucugcuugugcccagga

SEQ ID NO: 140538 - RNA, 22 nt, Homo sapiens
ugacuaaaacugaguuucauua

SEQ ID NO: 140539 - RNA, 17 nt, Homo sapiens
ugagaacaugugguauu

SEQ ID NO: 140540 - RNA, 22 nt, Homo sapiens
ugagauaucauuucacacccag

SEQ ID NO: 140541 - RNA, 22 nt, Homo sapiens
ugagcagugagugugcugcagg

SEQ ID NO: 140542 - RNA, 22 nt, Homo sapiens
ugaggaucucuaggaauuuauc

SEQ ID NO: 140543 - RNA, 17 nt, Homo sapiens
ugagggaugccugguuc

SEQ ID NO: 140544 - RNA, 22 nt, Homo sapiens
ugagguuggggucagggcuagc

SEQ ID NO: 140545 - RNA, 22 nt, Homo sapiens
ugagucaugcuggagucauggc

SEQ ID NO: 140546 - RNA, 22 nt, Homo sapiens
ugagugugacuuagcagaagga

SEQ ID NO: 140547 - RNA, 22 nt, Homo sapiens
ugaguucaugcuuguaguucua

SEQ ID NO: 140548 - RNA, 22 nt, Homo sapiens
ugauggcacagugaguuccagg

SEQ ID NO: 140549 - RNA, 22 nt, Homo sapiens
ugauuuccaugagaacaugccu

SEQ ID NO: 140550 - RNA, 22 nt, Homo sapiens
cacugcacuccagcuugugggc

SEQ ID NO: 140551 - RNA, 22 nt, Homo sapiens
cacugcacuccaguuucgguaa

SEQ ID NO: 140552 - RNA, 21 nt, Homo sapiens
cacugcacuugccuucugggu

SEQ ID NO: 140553 - RNA, 22 nt, Homo sapiens
cacugcgaccuccaccucccgg

SEQ ID NO: 140554 - RNA, 22 nt, Homo sapiens
uuggcaacauagugagaccccc

SEQ ID NO: 140555 - RNA, 22 nt, Homo sapiens
uuggcagcauuccagccaagca

SEQ ID NO: 140556 - RNA, 22 nt, Homo sapiens
uuggcagcuguggaaucugggc

SEQ ID NO: 140557 - RNA, 22 nt, Homo sapiens
uuggcauagaggcucucaagcu

SEQ ID NO: 140558 - RNA, 22 nt, Homo sapiens
uuggggcacggccucuguugcc

SEQ ID NO: 140559 - RNA, 22 nt, Homo sapiens
uuguauguuguuugucagagaa

SEQ ID NO: 140560 - RNA, 22 nt, Homo sapiens
uugucccauggggucuuccuuu

SEQ ID NO: 140561 - RNA, 22 nt, Homo sapiens
uugugaagaaaccagaaaaguu

SEQ ID NO: 140562 - RNA, 22 nt, Homo sapiens
uugugaucuucagaaaguggcu

SEQ ID NO: 140563 - RNA, 22 nt, Homo sapiens
uugugguuuuagcacuguggau

SEQ ID NO: 140564 - RNA, 22 nt, Homo sapiens
uuuauagucaggaacuugagga

SEQ ID NO: 140565 - RNA, 22 nt, Homo sapiens
uuucccuuugcuuugucagcca

SEQ ID NO: 140566 - RNA, 22 nt, Homo sapiens
uuuccuguagggggcaaggccu

SEQ ID NO: 140567 - RNA, 20 nt, Homo sapiens
uuucuccccuauaaaucuca

SEQ ID NO: 140568 - RNA, 22 nt, Homo sapiens
uuugcuucacuguuuggcaaaa

SEQ ID NO: 140569 - RNA, 22 nt, Homo sapiens
uuuggcccugagggauggcaua

SEQ ID NO: 140570 - RNA, 22 nt, Homo sapiens
uuugucuccuaagacucugugg

SEQ ID NO: 140571 - RNA, 22 nt, Homo sapiens
uuugugcuccucucaguaugug

SEQ ID NO: 140572 - RNA, 22 nt, Homo sapiens
uuuuccagugggacucccauua

SEQ ID NO: 140573 - RNA, 20 nt, Homo sapiens
uuuugaacuuggcaaccugu

SEQ ID NO: 140574 - RNA, 19 nt, Homo sapiens
uuuugcucuuuauaccuau

SEQ ID NO: 140575 - RNA, 17 nt, Homo sapiens
uuuuggauuagaaaucc

SEQ ID NO: 140576 - RNA, 22 nt, Homo sapiens
uuuuggcuuuuccucagcaagc

SEQ ID NO: 140577 - RNA, 22 nt, Homo sapiens
gugagguugaaaauaauggaaa

SEQ ID NO: 140578 - RNA, 22 nt, Homo sapiens
gugauaucacuguaucacucca

SEQ ID NO: 140579 - RNA, 21 nt, Homo sapiens
gugaucaugucacugcacucc

SEQ ID NO: 140580 - RNA, 22 nt, Homo sapiens
gugcacaacgugcaggcuuguu

SEQ ID NO: 140581 - RNA, 22 nt, Homo sapiens
gugcacaacgugcagguuaguu

SEQ ID NO: 140582 - RNA, 22 nt, Homo sapiens
gugcacaaugugcagguuuguu

SEQ ID NO: 140583 - RNA, 22 nt, Homo sapiens
aaacauugaccucauccuggca

SEQ ID NO: 140584 - RNA, 20 nt, Homo sapiens
aaacucugucuucuuuauca

SEQ ID NO: 140585 - RNA, 22 nt, Homo sapiens
aaacugaucugaaggccaggcu

SEQ ID NO: 140586 - RNA, 22 nt, Homo sapiens
auggcacagaguagaugcucaa

SEQ ID NO: 140587 - RNA, 22 nt, Homo sapiens
auggcacugccuggcuucaugg

SEQ ID NO: 140588 - RNA, 22 nt, Homo sapiens
auggcagcaccccacucuacug

SEQ ID NO: 140589 - RNA, 22 nt, Homo sapiens
auggcuucuuacucuucugcau

SEQ ID NO: 140590 - RNA, 21 nt, Homo sapiens
augguacugucucuggagaua

SEQ ID NO: 140591 - RNA, 21 nt, Homo sapiens
auguaacugggaaugugagag

SEQ ID NO: 140592 - RNA, 22 nt, Homo sapiens
augucaaggugggugauaguuu

SEQ ID NO: 140593 - RNA, 22 nt, Homo sapiens
auguccauggaaucuguagcaa

SEQ ID NO: 140594 - RNA, 17 nt, Homo sapiens
augugaauguucaaaua

SEQ ID NO: 140595 - RNA, 21 nt, Homo sapiens
augugcacuaugucauuuaau

SEQ ID NO: 140596 - RNA, 22 nt, Homo sapiens
augugcauaugaagcacagaca

SEQ ID NO: 140597 - RNA, 22 nt, Homo sapiens
augugugcuugugacacagccu

SEQ ID NO: 140598 - RNA, 22 nt, Homo sapiens
auuaaguuaggauuuugagaua

SEQ ID NO: 140599 - RNA, 22 nt, Homo sapiens
auuaaguugugccugaaaacuu

SEQ ID NO: 140600 - RNA, 22 nt, Homo sapiens
auugcucagucagggagcucgg

SEQ ID NO: 140601 - RNA, 22 nt, Homo sapiens
auuggaguuguacgcacgcuca

SEQ ID NO: 140602 - RNA, 22 nt, Homo sapiens
auugugcuaaaguaauaaguca

SEQ ID NO: 140603 - RNA, 22 nt, Homo sapiens
caaaguaauugcuguuuugcca

SEQ ID NO: 140604 - RNA, 22 nt, Homo sapiens
caaaugacaucauuucauucaa

SEQ ID NO: 140605 - RNA, 22 nt, Homo sapiens
caacagucagcccauccacaga

SEQ ID NO: 140606 - RNA, 22 nt, Homo sapiens
cacagagugagacccugucucu

SEQ ID NO: 140607 - RNA, 22 nt, Homo sapiens
caccgagguuggagugcagugg

SEQ ID NO: 140608 - RNA, 22 nt, Homo sapiens
cacugaaugugagguuggggag

SEQ ID NO: 140609 - RNA, 22 nt, Homo sapiens
cacugcacuccagucugacgac

SEQ ID NO: 140610 - RNA, 22 nt, Homo sapiens
cacugcacucuucuucugggca

SEQ ID NO: 140611 - RNA, 22 nt, Homo sapiens
cacugcauggucuagcuggguu

SEQ ID NO: 140612 - RNA, 22 nt, Homo sapiens
cacugcauucuccaccucccag

SEQ ID NO: 140613 - RNA, 22 nt, Homo sapiens
cacuggucagugaaacaguauu

SEQ ID NO: 140614 - RNA, 22 nt, Homo sapiens
cagcaucauucaucugggguaa

SEQ ID NO: 140615 - RNA, 22 nt, Homo sapiens
cagcuguuguuaugucugcagg

SEQ ID NO: 140616 - RNA, 22 nt, Homo sapiens
caguagcaugccucagaaugag

SEQ ID NO: 140617 - RNA, 19 nt, Homo sapiens
caguaucauugcacauagu

SEQ ID NO: 140618 - RNA, 22 nt, Homo sapiens
cagugcauaggaucuaaaauuu

SEQ ID NO: 140619 - RNA, 22 nt, Homo sapiens
caucacaucugcaugguaagua

SEQ ID NO: 140620 - RNA, 22 nt, Homo sapiens
cauccccugcaccaaccuuuac

SEQ ID NO: 140621 - RNA, 19 nt, Homo sapiens
caugccacugcacuugagu

SEQ ID NO: 140622 - RNA, 22 nt, Homo sapiens
cauggcacugagcagguaugca

SEQ ID NO: 140623 - RNA, 23 nt, Homo sapiens
cauggcuguuaacacuguuugag

SEQ ID NO: 140624 - RNA, 22 nt, Homo sapiens
ccaagccucaguuucccucugu

SEQ ID NO: 140625 - RNA, 22 nt, Homo sapiens
ccaaguguucucauuguucaau

SEQ ID NO: 140626 - RNA, 22 nt, Homo sapiens
ccacacugucuuggugggaaac

SEQ ID NO: 140627 - RNA, 17 nt, Homo sapiens
ccccugagcgaugcagu

SEQ ID NO: 140628 - RNA, 22 nt, Homo sapiens
cccugagaugcuguuaaucugu

SEQ ID NO: 140629 - RNA, 22 nt, Homo sapiens
ccucauggagaacuucugcuag

SEQ ID NO: 140630 - RNA, 22 nt, Homo sapiens
ccucuuuguugagacuucacca

SEQ ID NO: 140631 - RNA, 22 nt, Homo sapiens
ccugagaucauacuguuaguaa

SEQ ID NO: 140632 - RNA, 22 nt, Homo sapiens
ccugucuugauuaaauuacuua

SEQ ID NO: 140633 - RNA, 22 nt, Homo sapiens
ccuucauugcaucuuuaagaga

SEQ ID NO: 140634 - RNA, 22 nt, Homo sapiens
cuacaguaugaaaccuuuacuc

SEQ ID NO: 140635 - RNA, 22 nt, Homo sapiens
cuauucacaauagccaagauuu

SEQ ID NO: 140636 - RNA, 22 nt, Homo sapiens
cucaaguaauccucccgccuug

SEQ ID NO: 140637 - RNA, 22 nt, Homo sapiens
cucaccuugugauccacccacc

SEQ ID NO: 140638 - RNA, 22 nt, Homo sapiens
cucacugggaccacucugaagu

SEQ ID NO: 140639 - RNA, 19 nt, Homo sapiens
cucauggagaaggagaaua

SEQ ID NO: 140640 - RNA, 22 nt, Homo sapiens
cucauuaguuguuuuaagauga

SEQ ID NO: 140641 - RNA, 22 nt, Homo sapiens
cucauugcaaucuccaccuccc

SEQ ID NO: 140642 - RNA, 22 nt, Homo sapiens
cucccacccucauuuuuaggca

SEQ ID NO: 140643 - RNA, 21 nt, Homo sapiens
cucucugcuuaugaauaguga

SEQ ID NO: 140644 - RNA, 22 nt, Homo sapiens
cucugagccugagguuccuacu

SEQ ID NO: 140645 - RNA, 22 nt, Homo sapiens
cugagaacaucauucagauauu

SEQ ID NO: 140646 - RNA, 22 nt, Homo sapiens
cugagauaauuucuagguguca

SEQ ID NO: 140647 - RNA, 22 nt, Homo sapiens
cugagauaggacucugcuggcu

SEQ ID NO: 140648 - RNA, 22 nt, Homo sapiens
cugagaucguggggcugcuguc

SEQ ID NO: 140649 - RNA, 22 nt, Homo sapiens
cugagguaggcccugagaauau

SEQ ID NO: 140650 - RNA, 22 nt, Homo sapiens
cugaggugauauauacauauuu

SEQ ID NO: 140651 - RNA, 22 nt, Homo sapiens
cugaggugggagaaucacauaa

SEQ ID NO: 140652 - RNA, 22 nt, Homo sapiens
cuggauagagauugaugaugcu

SEQ ID NO: 140653 - RNA, 22 nt, Homo sapiens
cuggcucugggcuaaagaaaua

SEQ ID NO: 140654 - RNA, 22 nt, Homo sapiens
cuguaugugagaaauaauaagu

SEQ ID NO: 140655 - RNA, 17 nt, Homo sapiens
cugugaugaucuugucu

SEQ ID NO: 140656 - RNA, 22 nt, Homo sapiens
cugugcuuggagucccccuagg

SEQ ID NO: 140657 - RNA, 22 nt, Homo sapiens
cuucaccaguuuggcagucuca

SEQ ID NO: 140658 - RNA, 20 nt, Homo sapiens
cuuccaguggccccaucuuu

SEQ ID NO: 140659 - RNA, 22 nt, Homo sapiens
cuugacaaugcuucaggcugaa

SEQ ID NO: 140660 - RNA, 22 nt, Homo sapiens
cuugucacuguuggcuuuagaa

SEQ ID NO: 140661 - RNA, 22 nt, Homo sapiens
cuuguuguggaggggagugcag

SEQ ID NO: 140662 - RNA, 22 nt, Homo sapiens
cuuuaugagguuggauggaucu

SEQ ID NO: 140663 - RNA, 22 nt, Homo sapiens
cuuuuggugguucugaugcagg

SEQ ID NO: 140664 - RNA, 22 nt, Homo sapiens
gaaagauuuccugagcuagaaa

SEQ ID NO: 140665 - RNA, 22 nt, Homo sapiens
gaaguaguaaaauuuauugcag

SEQ ID NO: 140666 - RNA, 22 nt, Homo sapiens
gacucuguagacaaucacaucu

SEQ ID NO: 140667 - RNA, 22 nt, Homo sapiens
gagagcauuaagccaucaucau

SEQ ID NO: 140668 - RNA, 22 nt, Homo sapiens
gagagugugucagaggcugcga

SEQ ID NO: 140669 - RNA, 22 nt, Homo sapiens
gagauuaauacacaucaaaugc

SEQ ID NO: 140670 - RNA, 22 nt, Homo sapiens
gagcacauguggagagucuggg

SEQ ID NO: 140671 - RNA, 21 nt, Homo sapiens
gagcacauuguccucuaacgc

SEQ ID NO: 140672 - RNA, 18 nt, Homo sapiens
gagcaccuuuuuugcaga

SEQ ID NO: 140673 - RNA, 22 nt, Homo sapiens
gagcucauuaaaaauguagaau

SEQ ID NO: 140674 - RNA, 22 nt, Homo sapiens
gagcucauuguugcuaaagaga

SEQ ID NO: 140675 - RNA, 22 nt, Homo sapiens
gagcugaauugcugccauuugc

SEQ ID NO: 140676 - RNA, 22 nt, Homo sapiens
gagguaagagaauaaacaguuu

SEQ ID NO: 140677 - RNA, 22 nt, Homo sapiens
gagguugggaugagggauacag

SEQ ID NO: 140678 - RNA, 22 nt, Homo sapiens
gaugauguugaauguucucacc

SEQ ID NO: 140679 - RNA, 22 nt, Homo sapiens
gaugcaguaagaaugcauagcg

SEQ ID NO: 140680 - RNA, 22 nt, Homo sapiens
gcaaaugcuaugccauuuuaua

SEQ ID NO: 140681 - RNA, 22 nt, Homo sapiens
gcaagaaugagaaggauuaauu

SEQ ID NO: 140682 - RNA, 22 nt, Homo sapiens
gcacugggccacauuuauuuuc

SEQ ID NO: 140683 - RNA, 22 nt, Homo sapiens
ucacaccauucuucuacuucag

SEQ ID NO: 140684 - RNA, 22 nt, Homo sapiens
ucacagccuaguuuuauacauu

SEQ ID NO: 140685 - RNA, 22 nt, Homo sapiens
ucacaggguguuauuagaauua

SEQ ID NO: 140686 - RNA, 22 nt, Homo sapiens
ucacauagcugaguaaaaugga

SEQ ID NO: 140687 - RNA, 22 nt, Homo sapiens
ucacaugaauugucuuguucca

SEQ ID NO: 140688 - RNA, 18 nt, Homo sapiens
ucacauggccgagagaga

SEQ ID NO: 140689 - RNA, 22 nt, Homo sapiens
ucacauuguauauguaccuauc

SEQ ID NO: 140690 - RNA, 22 nt, Homo sapiens
ucaccuggagaagauggaucau

SEQ ID NO: 140691 - RNA, 22 nt, Homo sapiens
ucacugaaaccuccgccuucug

SEQ ID NO: 140692 - RNA, 22 nt, Homo sapiens
ucacugaaacuguccuggguua

SEQ ID NO: 140693 - RNA, 22 nt, Homo sapiens
ucacugggagaccaaagccauc

SEQ ID NO: 140694 - RNA, 22 nt, Homo sapiens
ucagcaaugcugcacucuacug

SEQ ID NO: 140695 - RNA, 22 nt, Homo sapiens
ucagugacuggguauuaaauca

SEQ ID NO: 140696 - RNA, 22 nt, Homo sapiens
ucagugcuuuuuguugucauca

SEQ ID NO: 140697 - RNA, 22 nt, Homo sapiens
ucagugggcuauguaauuaacu

SEQ ID NO: 140698 - RNA, 22 nt, Homo sapiens
ucaguguugauggcugcugacu

SEQ ID NO: 140699 - RNA, 22 nt, Homo sapiens
ucaugggagcccccaucaugag

SEQ ID NO: 140700 - RNA, 22 nt, Homo sapiens
ucauggggugagcuacaggcac

SEQ ID NO: 140701 - RNA, 22 nt, Homo sapiens
ucauucacucccuugaaguuag

SEQ ID NO: 140702 - RNA, 22 nt, Homo sapiens
ucauucauuugcucacuccaca

SEQ ID NO: 140703 - RNA, 21 nt, Homo sapiens
ucauugggugcagcccacccu

SEQ ID NO: 140704 - RNA, 22 nt, Homo sapiens
uccaaaucucuggcacugggau

SEQ ID NO: 140705 - RNA, 22 nt, Homo sapiens
uccagguuuugugaguuuaaau

SEQ ID NO: 140706 - RNA, 22 nt, Homo sapiens
uccauguagaugcuauguuguc

SEQ ID NO: 140707 - RNA, 22 nt, Homo sapiens
uccauguaguugagcggcuuug

SEQ ID NO: 140708 - RNA, 22 nt, Homo sapiens
uccccugagaacuugcuagaaa

SEQ ID NO: 140709 - RNA, 22 nt, Homo sapiens
uccccugagucaccugcuucuc

SEQ ID NO: 140710 - RNA, 22 nt, Homo sapiens
ucccuggacagccuugccuggg

SEQ ID NO: 140711 - RNA, 22 nt, Homo sapiens
ucccuugguaauucuguuccuu

SEQ ID NO: 140712 - RNA, 22 nt, Homo sapiens
uccuacaugcaguacauucaaa

SEQ ID NO: 140713 - RNA, 22 nt, Homo sapiens
uccugagacucacaggcucccc

SEQ ID NO: 140714 - RNA, 20 nt, Homo sapiens
uccugagauucccaguucuc

SEQ ID NO: 140715 - RNA, 22 nt, Homo sapiens
uccuucaguccaguggguuuug

SEQ ID NO: 140716 - RNA, 22 nt, Homo sapiens
ucgcaguuaauaaugaugugcg

SEQ ID NO: 140717 - RNA, 22 nt, Homo sapiens
ucucaaccuccacacuacaaua

SEQ ID NO: 140718 - RNA, 22 nt, Homo sapiens
ucucagugaauugguuuugucu

SEQ ID NO: 140719 - RNA, 22 nt, Homo sapiens
ucucauggcucacccugcauag

SEQ ID NO: 140720 - RNA, 20 nt, Homo sapiens
ucucccaaacagcaggcccu

SEQ ID NO: 140721 - RNA, 22 nt, Homo sapiens
ucucuagagagccugguguuca

SEQ ID NO: 140722 - RNA, 23 nt, Homo sapiens
ucuggcuuugggaugcucaaggg

SEQ ID NO: 140723 - RNA, 22 nt, Homo sapiens
ucugucuuugucaggaccagag

SEQ ID NO: 140724 - RNA, 22 nt, Homo sapiens
ucuuugauuuuguuacuaagac

SEQ ID NO: 140725 - RNA, 22 nt, Homo sapiens
ucuuuguguaggucaaucuggc

SEQ ID NO: 140726 - RNA, 20 nt, Homo sapiens
ugaaggaggucauuuauacc

SEQ ID NO: 140727 - RNA, 22 nt, Homo sapiens
ugaauucaucucacagaguuaa

SEQ ID NO: 140728 - RNA, 17 nt, Homo sapiens
ugacagaaacuuguugu

SEQ ID NO: 140729 - RNA, 23 nt, Homo sapiens
ugacagucucccgauggcuaggc

SEQ ID NO: 140730 - RNA, 22 nt, Homo sapiens
ugagaacucaugaaucuuucca

SEQ ID NO: 140731 - RNA, 22 nt, Homo sapiens
ugagaacuuauggugauuuuuu

SEQ ID NO: 140732 - RNA, 22 nt, Homo sapiens
ugagacggagucucacucuguu

SEQ ID NO: 140733 - RNA, 22 nt, Homo sapiens
ugagagucauacaaauaaaaau

SEQ ID NO: 140734 - RNA, 22 nt, Homo sapiens
ugagaugauaucuuauuguaau

SEQ ID NO: 140735 - RNA, 22 nt, Homo sapiens
ugagaugcaaaaugagaauugu

SEQ ID NO: 140736 - RNA, 22 nt, Homo sapiens
ugagcacagagccugggguggc

SEQ ID NO: 140737 - RNA, 22 nt, Homo sapiens
ugagcuguuugaagaagcauuu

SEQ ID NO: 140738 - RNA, 22 nt, Homo sapiens
ugaggagugaacuauuucugau

SEQ ID NO: 140739 - RNA, 22 nt, Homo sapiens
ugaggucauguucugucagguu

SEQ ID NO: 140740 - RNA, 22 nt, Homo sapiens
ugauaacauuucuucugguaca

SEQ ID NO: 140741 - RNA, 22 nt, Homo sapiens
ugcaguaggcccagcgggaggc

SEQ ID NO: 140742 - RNA, 20 nt, Homo sapiens
ugcaguguccucacuuguca

SEQ ID NO: 140743 - RNA, 22 nt, Homo sapiens
ugcauauguauacaugugccau

SEQ ID NO: 140744 - RNA, 22 nt, Homo sapiens
ugcauggauguuugaacacacu

SEQ ID NO: 140745 - RNA, 22 nt, Homo sapiens
ugcugcacaguucuuaagauua

SEQ ID NO: 140746 - RNA, 22 nt, Homo sapiens
ugcuuuguugaaaaucauuugg

SEQ ID NO: 140747 - RNA, 22 nt, Homo sapiens
uggaagugaacaaccaaggcag

SEQ ID NO: 140748 - RNA, 22 nt, Homo sapiens
uggagagugauaaguaaaugga

SEQ ID NO: 140749 - RNA, 22 nt, Homo sapiens
uggagcccuaaacuucuaauau

SEQ ID NO: 140750 - RNA, 22 nt, Homo sapiens
uggagcccuaguuccucauaac

SEQ ID NO: 140751 - RNA, 22 nt, Homo sapiens
uggagggcuagucauuucuuuu

SEQ ID NO: 140752 - RNA, 21 nt, Homo sapiens
uggcaacauggauggauucug

SEQ ID NO: 140753 - RNA, 22 nt, Homo sapiens
ugggaugaugcuugagaauauc

SEQ ID NO: 140754 - RNA, 22 nt, Homo sapiens
ugggcaaaacuaagagcugugg

SEQ ID NO: 140755 - RNA, 21 nt, Homo sapiens
ugggccccuuccuuacaucau

SEQ ID NO: 140756 - RNA, 22 nt, Homo sapiens
uguauguagugaccagggccag

SEQ ID NO: 140757 - RNA, 22 nt, Homo sapiens
ugucaaggaaugucauugguuu

SEQ ID NO: 140758 - RNA, 22 nt, Homo sapiens
ugucagcacaacucagguuccu

SEQ ID NO: 140759 - RNA, 22 nt, Homo sapiens
ugucaguggucuggaugcagcc

SEQ ID NO: 140760 - RNA, 22 nt, Homo sapiens
ugucucaguucccuucucugga

SEQ ID NO: 140761 - RNA, 22 nt, Homo sapiens
ugucuggaaggguggccuccug

SEQ ID NO: 140762 - RNA, 22 nt, Homo sapiens
ugugaacagcuccaaaugugga

SEQ ID NO: 140763 - RNA, 22 nt, Homo sapiens
ugugacacugaauggcagaacu

SEQ ID NO: 140764 - RNA, 19 nt, Homo sapiens
ugugacugggccagccuag

SEQ ID NO: 140765 - RNA, 22 nt, Homo sapiens
ugugauggaguuucauggacug

SEQ ID NO: 140766 - RNA, 22 nt, Homo sapiens
ugugcauaugucuuuauaguag

SEQ ID NO: 140767 - RNA, 22 nt, Homo sapiens
ugugcuugaaauucaguuuuga

SEQ ID NO: 140768 - RNA, 22 nt, Homo sapiens
uguggcuuuguaaccauggguc

SEQ ID NO: 140769 - RNA, 22 nt, Homo sapiens
uguguacaucucuacacacaug

SEQ ID NO: 140770 - RNA, 22 nt, Homo sapiens
uguuacacugugcacuaaauuu

SEQ ID NO: 140771 - RNA, 22 nt, Homo sapiens
uguuauugagguuacuuauaag

SEQ ID NO: 140772 - RNA, 22 nt, Homo sapiens
uguuauuuuguguuagggcaca

SEQ ID NO: 140773 - RNA, 22 nt, Homo sapiens
uguucuugaguugggaguacaa

SEQ ID NO: 140774 - RNA, 18 nt, Homo sapiens
uguugguguucacucacu

SEQ ID NO: 140775 - RNA, 22 nt, Homo sapiens
uguuuuggagguccucacuaga

SEQ ID NO: 140776 - RNA, 22 nt, Homo sapiens
uuaacagugucaaucuguagua

SEQ ID NO: 140777 - RNA, 22 nt, Homo sapiens
uuacaguauugcaaggacuagg

SEQ ID NO: 140778 - RNA, 22 nt, Homo sapiens
uuauaacagagacuccugugcu

SEQ ID NO: 140779 - RNA, 22 nt, Homo sapiens
uuauggcuauugaugacaauug

SEQ ID NO: 140780 - RNA, 22 nt, Homo sapiens
aaaagucuguagugaaagguga

SEQ ID NO: 140781 - RNA, 15 nt, Homo sapiens
aaacccugucucaag

SEQ ID NO: 140782 - RNA, 22 nt, Homo sapiens
aaagaagucagccuguccuuug

SEQ ID NO: 140783 - RNA, 22 nt, Homo sapiens
aaagagaucuaugggcacuaug

SEQ ID NO: 140784 - RNA, 22 nt, Homo sapiens
aaagcacuggagucaucaucua

SEQ ID NO: 140785 - RNA, 22 nt, Homo sapiens
aaagggcacugugcuuuggcaa

SEQ ID NO: 140786 - RNA, 22 nt, Homo sapiens
aaagguaguacuucuagaaggg

SEQ ID NO: 140787 - RNA, 21 nt, Homo sapiens
aaaugcacauuacugcuggug

SEQ ID NO: 140788 - RNA, 22 nt, Homo sapiens
aaaugcagcacucaagugggaa

SEQ ID NO: 140789 - RNA, 22 nt, Homo sapiens
aaaugcuuucuuggaccauuug

SEQ ID NO: 140790 - RNA, 23 nt, Homo sapiens
aaauuugccuauuauuccuaugg

SEQ ID NO: 140791 - RNA, 22 nt, Homo sapiens
aacacuggcugcucgaguucuc

SEQ ID NO: 140792 - RNA, 22 nt, Homo sapiens
aacagacugucacauaaaauug

SEQ ID NO: 140793 - RNA, 22 nt, Homo sapiens
aacaucaaccaugaggguugga

SEQ ID NO: 140794 - RNA, 23 nt, Homo sapiens
aagagguaugacuaugaagugga

SEQ ID NO: 140795 - RNA, 22 nt, Homo sapiens
aagaugauguuguguuuucacu

SEQ ID NO: 140796 - RNA, 20 nt, Homo sapiens
aagcaagcauuugcaaucau

SEQ ID NO: 140797 - RNA, 22 nt, Homo sapiens
aagcuggcauucauucguucuu

SEQ ID NO: 140798 - RNA, 22 nt, Homo sapiens
aagcugugucuugucagcuacc

SEQ ID NO: 140799 - RNA, 22 nt, Homo sapiens
uuaagucacacuagacaacuga

SEQ ID NO: 140800 - RNA, 22 nt, Homo sapiens
uuaauccugccuuauuucagua

SEQ ID NO: 140801 - RNA, 23 nt, Homo sapiens
uuacaguggcaugaucucugcuc

SEQ ID NO: 140802 - RNA, 22 nt, Homo sapiens
uuacaugagacugucgcuaguu

SEQ ID NO: 140803 - RNA, 22 nt, Homo sapiens
uuacccuuuaacccuuuaaagu

SEQ ID NO: 140804 - RNA, 22 nt, Homo sapiens
uuagaacagugcucaccacaaa

SEQ ID NO: 140805 - RNA, 22 nt, Homo sapiens
uuagcaccacacacuuuagagg

SEQ ID NO: 140806 - RNA, 22 nt, Homo sapiens
uuaggaucacagaaaauccucu

SEQ ID NO: 140807 - RNA, 22 nt, Homo sapiens
uuauccucuagacauagguuua

SEQ ID NO: 140808 - RNA, 22 nt, Homo sapiens
uucaagauggcaccagugagug

SEQ ID NO: 140809 - RNA, 22 nt, Homo sapiens
uucaaguaagaaagacaucagg

SEQ ID NO: 140810 - RNA, 22 nt, Homo sapiens
uucaccuugcccacagcagucu

SEQ ID NO: 140811 - RNA, 22 nt, Homo sapiens
uucauggaacaaguggguucaa

SEQ ID NO: 140812 - RNA, 22 nt, Homo sapiens
uucccuuugaauuggaaaggug

SEQ ID NO: 140813 - RNA, 22 nt, Homo sapiens
uucccuuugugcauaggauuug

SEQ ID NO: 140814 - RNA, 22 nt, Homo sapiens
uuccguguaguugagcaguuuu

SEQ ID NO: 140815 - RNA, 19 nt, Homo sapiens
uuccuagugguugggaagu

SEQ ID NO: 140816 - RNA, 22 nt, Homo sapiens
uuccuggaggggaaguguccaa

SEQ ID NO: 140817 - RNA, 22 nt, Homo sapiens
uucuaaacaucuuacaaugcau

SEQ ID NO: 140818 - RNA, 22 nt, Homo sapiens
uucucugggacauaggucgggu

SEQ ID NO: 140819 - RNA, 22 nt, Homo sapiens
uucucuggucagaggggagguu

SEQ ID NO: 140820 - RNA, 22 nt, Homo sapiens
uucuuccagccuugaggggccc

SEQ ID NO: 140821 - RNA, 22 nt, Homo sapiens
uugaaaucuuccacagcccaag

SEQ ID NO: 140822 - RNA, 22 nt, Homo sapiens
uugacaguggcuuaaauugguu

SEQ ID NO: 140823 - RNA, 22 nt, Homo sapiens
uugagauaggaacucacuaugc

SEQ ID NO: 140824 - RNA, 22 nt, Homo sapiens
uugaguauuggacugguaucuu

SEQ ID NO: 140825 - RNA, 22 nt, Homo sapiens
uugauguguuuccaggauuugu

SEQ ID NO: 140826 - RNA, 22 nt, Homo sapiens
uugcacaauccugugagugagu

SEQ ID NO: 140827 - RNA, 22 nt, Homo sapiens
uugcacaauggaauuuaucuuu

SEQ ID NO: 140828 - RNA, 22 nt, Homo sapiens
uuggaaguguguauguauagcu

SEQ ID NO: 140829 - RNA, 22 nt, Homo sapiens
uuggcagcacgcaguccagagg

SEQ ID NO: 140830 - RNA, 22 nt, Homo sapiens
uuggccuccuggucauauccag

SEQ ID NO: 140831 - RNA, 23 nt, Homo sapiens
uuggccuccuugugucuagggcu

SEQ ID NO: 140832 - RNA, 22 nt, Homo sapiens
uuggcuguguuucccuacaaau

SEQ ID NO: 140833 - RNA, 22 nt, Homo sapiens
aaaagcauucagagugcugggc

SEQ ID NO: 140834 - RNA, 22 nt, Homo sapiens
aaaccaccauuacuuuugcacc

SEQ ID NO: 140835 - RNA, 22 nt, Homo sapiens
aaagcuacaggaccugcucauu

SEQ ID NO: 140836 - RNA, 22 nt, Homo sapiens
aaagucuguuuugucagagacu

SEQ ID NO: 140837 - RNA, 22 nt, Homo sapiens
aaaguggugugaguauguaucu

SEQ ID NO: 140838 - RNA, 22 nt, Homo sapiens
aacagagcuggugacuccaggu

SEQ ID NO: 140839 - RNA, 22 nt, Homo sapiens
aacucugucuccuucaaguuca

SEQ ID NO: 140840 - RNA, 22 nt, Homo sapiens
aagagguaauaacaaagcuucu

SEQ ID NO: 140841 - RNA, 22 nt, Homo sapiens
aagagguuauagaguguauacu

SEQ ID NO: 140842 - RNA, 22 nt, Homo sapiens
aagcuggauuuaguguggagca

SEQ ID NO: 140843 - RNA, 22 nt, Homo sapiens
aagcuggauuucgcauccuguu

SEQ ID NO: 140844 - RNA, 22 nt, Homo sapiens
aaggugcucucuuauguagaaa

SEQ ID NO: 140845 - RNA, 17 nt, Homo sapiens
aaggugcuucgaccucc

SEQ ID NO: 140846 - RNA, 22 nt, Homo sapiens
aaucuguagaaggugcacauuc

SEQ ID NO: 140847 - RNA, 22 nt, Homo sapiens
aaugcacauaaaauccuccagg

SEQ ID NO: 140848 - RNA, 22 nt, Homo sapiens
aaugcacauauauuuccuuauu

SEQ ID NO: 140849 - RNA, 22 nt, Homo sapiens
aaugccuagugugugacaggug

SEQ ID NO: 140850 - RNA, 21 nt, Homo sapiens
acaaagcuggagggagacugc

SEQ ID NO: 140851 - RNA, 22 nt, Homo sapiens
acacaugugcguagacucuuua

SEQ ID NO: 140852 - RNA, 23 nt, Homo sapiens
acacuugcugaguaaaucaaaua

SEQ ID NO: 140853 - RNA, 22 nt, Homo sapiens
auggcaaaaaaugcaauuacuu

SEQ ID NO: 140854 - RNA, 22 nt, Homo sapiens
auggcacagacucuuggucaag

SEQ ID NO: 140855 - RNA, 22 nt, Homo sapiens
auggcacuacugggaaugucuu

SEQ ID NO: 140856 - RNA, 22 nt, Homo sapiens
auggcagcccucuuuauccaug

SEQ ID NO: 140857 - RNA, 22 nt, Homo sapiens
augggagugugguuagagaccu

SEQ ID NO: 140858 - RNA, 22 nt, Homo sapiens
augguuuuacugcaaaauggga

SEQ ID NO: 140859 - RNA, 22 nt, Homo sapiens
auguaguauuaaugagagauaa

SEQ ID NO: 140860 - RNA, 22 nt, Homo sapiens
augucauagaagccugugaacc

SEQ ID NO: 140861 - RNA, 22 nt, Homo sapiens
augugacuggaucauggggacg

SEQ ID NO: 140862 - RNA, 22 nt, Homo sapiens
augugcacaugcuuacauguga

SEQ ID NO: 140863 - RNA, 22 nt, Homo sapiens
augugcacauucugguaaauau

SEQ ID NO: 140864 - RNA, 22 nt, Homo sapiens
augugcuuauagguguauguuu

SEQ ID NO: 140865 - RNA, 22 nt, Homo sapiens
auguugcuugaaggcauuuugu

SEQ ID NO: 140866 - RNA, 22 nt, Homo sapiens
auuccacaguuaacacagaccg

SEQ ID NO: 140867 - RNA, 22 nt, Homo sapiens
auucuugcuugaacuuggugca

SEQ ID NO: 140868 - RNA, 22 nt, Homo sapiens
auugcuauuauuugaccauugu

SEQ ID NO: 140869 - RNA, 22 nt, Homo sapiens
auugcuuaagucccuguauuag

SEQ ID NO: 140870 - RNA, 22 nt, Homo sapiens
auuggauagucuuuaucuguug

SEQ ID NO: 140871 - RNA, 18 nt, Homo sapiens
auuguaagauguauggga

SEQ ID NO: 140872 - RNA, 22 nt, Homo sapiens
auugucacccgggcaguaagca

SEQ ID NO: 140873 - RNA, 22 nt, Homo sapiens
auuucuacuccuguguccagaa

SEQ ID NO: 140874 - RNA, 22 nt, Homo sapiens
caaaguaauuacgguuuuggcc

SEQ ID NO: 140875 - RNA, 22 nt, Homo sapiens
caaaguaauugugguuuugcca

SEQ ID NO: 140876 - RNA, 22 nt, Homo sapiens
caaagugcugggaugggccagg

SEQ ID NO: 140877 - RNA, 22 nt, Homo sapiens
caaaugcuucuauggacugucu

SEQ ID NO: 140878 - RNA, 22 nt, Homo sapiens
caacucuguaggauccaggugg

SEQ ID NO: 140879 - RNA, 22 nt, Homo sapiens
caaguguuggcuuguauacaaa

SEQ ID NO: 140880 - RNA, 22 nt, Homo sapiens
caauggcaaugaaauagugaga

SEQ ID NO: 140881 - RNA, 22 nt, Homo sapiens
cacacugucuuucagaaugguu

SEQ ID NO: 140882 - RNA, 22 nt, Homo sapiens
cacagggcuaacauuuuugccc

SEQ ID NO: 140883 - RNA, 22 nt, Homo sapiens
cacauguuuuagcauggcuguu

SEQ ID NO: 140884 - RNA, 22 nt, Homo sapiens
caccagcuggcauugaauaccu

SEQ ID NO: 140885 - RNA, 22 nt, Homo sapiens
caccaggugcccagcacggcca

SEQ ID NO: 140886 - RNA, 19 nt, Homo sapiens
caccgccugcccccugcug

SEQ ID NO: 140887 - RNA, 22 nt, Homo sapiens
caccuagacuggagugcagugg

SEQ ID NO: 140888 - RNA, 22 nt, Homo sapiens
caccuguagucccagcugaggc

SEQ ID NO: 140889 - RNA, 22 nt, Homo sapiens
cacugcaauuacuuuugcacca

SEQ ID NO: 140890 - RNA, 22 nt, Homo sapiens
cacugcacuccagcuuugguga

SEQ ID NO: 140891 - RNA, 22 nt, Homo sapiens
cacugcacuccagucuggcgac

SEQ ID NO: 140892 - RNA, 22 nt, Homo sapiens
cacugcacuccaguuuggauga

SEQ ID NO: 140893 - RNA, 22 nt, Homo sapiens
cacugcaguaaauugcgucggu

SEQ ID NO: 140894 - RNA, 17 nt, Homo sapiens
cacugggugcaagagga

SEQ ID NO: 140895 - RNA, 22 nt, Homo sapiens
cacuggucucauggcaugagag

SEQ ID NO: 140896 - RNA, 22 nt, Homo sapiens
cacuguggauggaacuauguga

SEQ ID NO: 140897 - RNA, 22 nt, Homo sapiens
cagagguauugcaaaagccuag

SEQ ID NO: 140898 - RNA, 22 nt, Homo sapiens
cagauacuggaguccugaaguu

SEQ ID NO: 140899 - RNA, 22 nt, Homo sapiens
cagcucauugcagucucgaccu

SEQ ID NO: 140900 - RNA, 22 nt, Homo sapiens
cagggcaugugggucuauuggc

SEQ ID NO: 140901 - RNA, 18 nt, Homo sapiens
cagugcaauacaggagag

SEQ ID NO: 140902 - RNA, 23 nt, Homo sapiens
cagugguguuagagaaaucuuuu

SEQ ID NO: 140903 - RNA, 22 nt, Homo sapiens
cagugguuuuuagcuugcuggg

SEQ ID NO: 140904 - RNA, 22 nt, Homo sapiens
caugacacuggcauguuucuuu

SEQ ID NO: 140905 - RNA, 22 nt, Homo sapiens
caugcagcacacaugucugugc

SEQ ID NO: 140906 - RNA, 22 nt, Homo sapiens
cauggcauuugcagaguugaaa

SEQ ID NO: 140907 - RNA, 22 nt, Homo sapiens
cauggguuuucucaaguaguca

SEQ ID NO: 140908 - RNA, 22 nt, Homo sapiens
cauggucaccuuccaaguuauu

SEQ ID NO: 140909 - RNA, 19 nt, Homo sapiens
caugugcacuacuggcuuc

SEQ ID NO: 140910 - RNA, 22 nt, Homo sapiens
cauugcauuuucuuuguaccuu

SEQ ID NO: 140911 - RNA, 22 nt, Homo sapiens
cauuuugcaguuucugucucca

SEQ ID NO: 140912 - RNA, 22 nt, Homo sapiens
ccaaguguuuucauuguuccau

SEQ ID NO: 140913 - RNA, 23 nt, Homo sapiens
ccacacuguuuagaauggcauca

SEQ ID NO: 140914 - RNA, 22 nt, Homo sapiens
ccagccgggugcaguggcucac

SEQ ID NO: 140915 - RNA, 22 nt, Homo sapiens
ccaucacaggccucagugggaa

SEQ ID NO: 140916 - RNA, 21 nt, Homo sapiens
cccagguucucugaggguaga

SEQ ID NO: 140917 - RNA, 23 nt, Homo sapiens
cccaguuaauccuuaaucuccac

SEQ ID NO: 140918 - RNA, 20 nt, Homo sapiens
cccuaagccagaugcugggg

SEQ ID NO: 140919 - RNA, 22 nt, Homo sapiens
cccucgagaaaccaucugcuga

SEQ ID NO: 140920 - RNA, 22 nt, Homo sapiens
ccucauggagaacaucugcuag

SEQ ID NO: 140921 - RNA, 21 nt, Homo sapiens
ccucuuugagggaagaaaggg

SEQ ID NO: 140922 - RNA, 19 nt, Homo sapiens
ccugcuguucuuuugcacc

SEQ ID NO: 140923 - RNA, 22 nt, Homo sapiens
ccuggaagaaaggugcuaaaua

SEQ ID NO: 140924 - RNA, 22 nt, Homo sapiens
ccugugguuaaccagcuagaug

SEQ ID NO: 140925 - RNA, 22 nt, Homo sapiens
ccuguguuaugguuucuaaugu

SEQ ID NO: 140926 - RNA, 22 nt, Homo sapiens
ccuuggcacuuugccacagugc

SEQ ID NO: 140927 - RNA, 22 nt, Homo sapiens
cgccugagcugaggaagcugca

SEQ ID NO: 140928 - RNA, 22 nt, Homo sapiens
cuaagauugucuuaguguguug

SEQ ID NO: 140929 - RNA, 22 nt, Homo sapiens
cuacaguagagaggauguagaa

SEQ ID NO: 140930 - RNA, 22 nt, Homo sapiens
cuagcagacaugggcugaacca

SEQ ID NO: 140931 - RNA, 22 nt, Homo sapiens
cuagcccagugcuccuggauca

SEQ ID NO: 140932 - RNA, 22 nt, Homo sapiens
cucaaguacaugggauuacagg

SEQ ID NO: 140933 - RNA, 22 nt, Homo sapiens
cucagcuacuugggaagcugag

SEQ ID NO: 140934 - RNA, 22 nt, Homo sapiens
cucgagagaaaaugcuucacug

SEQ ID NO: 140935 - RNA, 22 nt, Homo sapiens
cucucugagccauggcugcccu

SEQ ID NO: 140936 - RNA, 22 nt, Homo sapiens
cucugacagugguuagcacugu

SEQ ID NO: 140937 - RNA, 22 nt, Homo sapiens
cugaauagagcacacugauggg

SEQ ID NO: 140938 - RNA, 22 nt, Homo sapiens
cugaauguccaggcagagguuu

SEQ ID NO: 140939 - RNA, 22 nt, Homo sapiens
cugagacacucuuaucugcaua

SEQ ID NO: 140940 - RNA, 22 nt, Homo sapiens
cugagauuuuuagauccuggcg

SEQ ID NO: 140941 - RNA, 22 nt, Homo sapiens
cugaggacaucagggaagcauc

SEQ ID NO: 140942 - RNA, 22 nt, Homo sapiens
cugaggguagaaggaucacuug

SEQ ID NO: 140943 - RNA, 20 nt, Homo sapiens
cugaggugggagaaucgcuu

SEQ ID NO: 140944 - RNA, 22 nt, Homo sapiens
cugaggugggaggauuacuuga

SEQ ID NO: 140945 - RNA, 22 nt, Homo sapiens
cuggaaggaaaaacaaccacag

SEQ ID NO: 140946 - RNA, 22 nt, Homo sapiens
cuggaauucaaaaucugaauuu

SEQ ID NO: 140947 - RNA, 22 nt, Homo sapiens
cuguaaggcacuaagcauaugu

SEQ ID NO: 140948 - RNA, 22 nt, Homo sapiens
cuguaguuagcagaugaugaau

SEQ ID NO: 140949 - RNA, 22 nt, Homo sapiens
cuguauguuucuaugaauguga

SEQ ID NO: 140950 - RNA, 22 nt, Homo sapiens
cugucacugggaggggcagcag

SEQ ID NO: 140951 - RNA, 22 nt, Homo sapiens
gugguuuuuuucugccuuauag

SEQ ID NO: 140952 - RNA, 22 nt, Homo sapiens
gugucacagcuuccaucucggu

SEQ ID NO: 140953 - RNA, 22 nt, Homo sapiens
gugucaguggggagugaucuuc

SEQ ID NO: 140954 - RNA, 22 nt, Homo sapiens
gugugacagcuauagacaugau

SEQ ID NO: 140955 - RNA, 22 nt, Homo sapiens
guucacaguuucuaaucccagc

SEQ ID NO: 140956 - RNA, 22 nt, Homo sapiens
guucaucagggauauuggccug

SEQ ID NO: 140957 - RNA, 22 nt, Homo sapiens
uaacaccuuugauagcacuuuu

SEQ ID NO: 140958 - RNA, 22 nt, Homo sapiens
uaagaauucuguccgguauacu

SEQ ID NO: 140959 - RNA, 22 nt, Homo sapiens
uaaggcacuacuuuaggcuuuc

SEQ ID NO: 140960 - RNA, 22 nt, Homo sapiens
uaaggcuagcaagaugagaaua

SEQ ID NO: 140961 - RNA, 22 nt, Homo sapiens
uaauacuguaauggugguuccg

SEQ ID NO: 140962 - RNA, 22 nt, Homo sapiens
uaaugcacauuuauuuuaccuu

SEQ ID NO: 140963 - RNA, 22 nt, Homo sapiens
uaaugcacucgaaucauggaau

SEQ ID NO: 140964 - RNA, 22 nt, Homo sapiens
uacaaaguaacaguuccuguau

SEQ ID NO: 140965 - RNA, 22 nt, Homo sapiens
uacaguagaaugucuuucaaaa

SEQ ID NO: 140966 - RNA, 22 nt, Homo sapiens
uacaguagagaucagcaaacua

SEQ ID NO: 140967 - RNA, 22 nt, Homo sapiens
uacaguguuuugguauuccaca

SEQ ID NO: 140968 - RNA, 22 nt, Homo sapiens
uacuacuuucugacaucuuuaa

SEQ ID NO: 140969 - RNA, 22 nt, Homo sapiens
uacuagaggaaaacuugaagac

SEQ ID NO: 140970 - RNA, 19 nt, Homo sapiens
uacuggcucgggaauuuuc

SEQ ID NO: 140971 - RNA, 22 nt, Homo sapiens
uagaagcuacucuucuuguggc

SEQ ID NO: 140972 - RNA, 22 nt, Homo sapiens
uagaccaauuggcauauaguaa

SEQ ID NO: 140973 - RNA, 22 nt, Homo sapiens
uagcaaaucaauggaauugaag

SEQ ID NO: 140974 - RNA, 21 nt, Homo sapiens
uagcaaauugcuauuaaggca

SEQ ID NO: 140975 - RNA, 22 nt, Homo sapiens
uagcaagaugaauuugugcaaa

SEQ ID NO: 140976 - RNA, 22 nt, Homo sapiens
uagcagcuuuauugagguaaau

SEQ ID NO: 140977 - RNA, 22 nt, Homo sapiens
uagcugcugcuaggcuaaggau

SEQ ID NO: 140978 - RNA, 22 nt, Homo sapiens
uaguaaacauaguucuuuugcu

SEQ ID NO: 140979 - RNA, 22 nt, Homo sapiens
uagucaaaucugaaggaaauuu

SEQ ID NO: 140980 - RNA, 22 nt, Homo sapiens
uauagcuaugggauguauuugc

SEQ ID NO: 140981 - RNA, 22 nt, Homo sapiens
uaucauaguuuggacuuucauu

SEQ ID NO: 140982 - RNA, 22 nt, Homo sapiens
uaucaucauguuuuugcugugu

SEQ ID NO: 140983 - RNA, 22 nt, Homo sapiens
uaucucagagaaucagauuuac

SEQ ID NO: 140984 - RNA, 22 nt, Homo sapiens
uauuagugucuuuugguuagaa

SEQ ID NO: 140985 - RNA, 22 nt, Homo sapiens
ucaaaugcacguagagaaaaua

SEQ ID NO: 140986 - RNA, 22 nt, Homo sapiens
ucaaaugcucuuugcagagagg

SEQ ID NO: 140987 - RNA, 22 nt, Homo sapiens
uggucagaugcugaguggaucu

SEQ ID NO: 140988 - RNA, 20 nt, Homo sapiens
ugguccccaccaaaucucau

SEQ ID NO: 140989 - RNA, 20 nt, Homo sapiens
ugguguuugaacagugaaug

SEQ ID NO: 140990 - RNA, 22 nt, Homo sapiens
uguauguugauguuauauucug

SEQ ID NO: 140991 - RNA, 22 nt, Homo sapiens
ugucauguauauaccacuucca

SEQ ID NO: 140992 - RNA, 22 nt, Homo sapiens
ugucauguggcuaacgauucau

SEQ ID NO: 140993 - RNA, 19 nt, Homo sapiens
ugugaagaaaugcugcaag

SEQ ID NO: 140994 - RNA, 18 nt, Homo sapiens
ugugacauugagcauguc

SEQ ID NO: 140995 - RNA, 22 nt, Homo sapiens
ugugcaugacagcauacaaacg

SEQ ID NO: 140996 - RNA, 22 nt, Homo sapiens
uguggcagugcuuuaugaaacc

SEQ ID NO: 140997 - RNA, 22 nt, Homo sapiens
uguggcuuuuucuuggcugagg

SEQ ID NO: 140998 - RNA, 22 nt, Homo sapiens
ugugucacugcacuccagcgug

SEQ ID NO: 140999 - RNA, 22 nt, Homo sapiens
uuaaaccugucuucucacuaau

SEQ ID NO: 141000 - RNA, 22 nt, Homo sapiens
uuaaggcagugcaucuggaguu

SEQ ID NO: 141001 - RNA, 22 nt, Homo sapiens
uuaaggcagugucuaugccagu

SEQ ID NO: 141002 - RNA, 22 nt, Homo sapiens
uuaaguaaucagagaagagaac

SEQ ID NO: 141003 - RNA, 22 nt, Homo sapiens
uuaaguuguagcuacaaauaca

SEQ ID NO: 141004 - RNA, 22 nt, Homo sapiens
uuacuguauagaaucaucuuga

SEQ ID NO: 141005 - RNA, 22 nt, Homo sapiens
uuagaaaguagaaaagcugguu

SEQ ID NO: 141006 - RNA, 18 nt, Homo sapiens
uuagaugguuuuaaaacu

SEQ ID NO: 141007 - RNA, 22 nt, Homo sapiens
uuauguaaaucaaucuggaauc

SEQ ID NO: 141008 - RNA, 22 nt, Homo sapiens
uucaaauguucuuucaccaccc

SEQ ID NO: 141009 - RNA, 22 nt, Homo sapiens
uucaagucaaggaaagaggucu

SEQ ID NO: 141010 - RNA, 22 nt, Homo sapiens
uucagcaaugacagccuauaua

SEQ ID NO: 141011 - RNA, 22 nt, Homo sapiens
uucagcaggccaggcccugacu

SEQ ID NO: 141012 - RNA, 22 nt, Homo sapiens
uucauguagucaucauccugcu

SEQ ID NO: 141013 - RNA, 22 nt, Homo sapiens
uuccaagugggaaacaaaaaug

SEQ ID NO: 141014 - RNA, 22 nt, Homo sapiens
uuccaugugggcuugucaagua

SEQ ID NO: 141015 - RNA, 22 nt, Homo sapiens
uuccauuuguucggugucgcca

SEQ ID NO: 141016 - RNA, 22 nt, Homo sapiens
uuccuugguucagggaaggucc

SEQ ID NO: 141017 - RNA, 22 nt, Homo sapiens
uuccuuguagcaaaugcgauga

SEQ ID NO: 141018 - RNA, 22 nt, Homo sapiens
uucuggccccucccaaucucau

SEQ ID NO: 141019 - RNA, 20 nt, Homo sapiens
uucuugaguuaacaaguuac

SEQ ID NO: 141020 - RNA, 22 nt, Homo sapiens
uugaaagacagaggggcaaguu

SEQ ID NO: 141021 - RNA, 22 nt, Homo sapiens
uugaaagacaucaccuacugcu

SEQ ID NO: 141022 - RNA, 21 nt, Homo sapiens
uugagacggagucucacucug

SEQ ID NO: 141023 - RNA, 22 nt, Homo sapiens
uugagacggagucucacucugu

SEQ ID NO: 141024 - RNA, 22 nt, Homo sapiens
uugagauggagucucacugugu

SEQ ID NO: 141025 - RNA, 22 nt, Homo sapiens
uugagauggagucucgcugugu

SEQ ID NO: 141026 - RNA, 22 nt, Homo sapiens
uugagcaaugucacugaggcuu

SEQ ID NO: 141027 - RNA, 22 nt, Homo sapiens
uugaggugaagggcagagcagc

SEQ ID NO: 141028 - RNA, 22 nt, Homo sapiens
uugaggugaauuugcaggaugc

SEQ ID NO: 141029 - RNA, 22 nt, Homo sapiens
uugcaaggugcucgaagggcuc

SEQ ID NO: 141030 - RNA, 22 nt, Homo sapiens
uugcacauuuuuucuggcagaa

SEQ ID NO: 141031 - RNA, 23 nt, Homo sapiens
uugcauagacauccucauagauu

SEQ ID NO: 141032 - RNA, 22 nt, Homo sapiens
uugcuauguugcccagucugga

SEQ ID NO: 141033 - RNA, 22 nt, Homo sapiens
uugcuccccaggaaaggaagca

SEQ ID NO: 141034 - RNA, 20 nt, Homo sapiens
uugcugguguuagaggaggc

SEQ ID NO: 141035 - RNA, 22 nt, Homo sapiens
uuggaccacuugauuucugguc

SEQ ID NO: 141036 - RNA, 22 nt, Homo sapiens
uuggcuguguuccucaaggagu

SEQ ID NO: 141037 - RNA, 23 nt, Homo sapiens
uuggucucccaaaguguugagau

SEQ ID NO: 141038 - RNA, 22 nt, Homo sapiens
uugguucucuuagccaucuuaa

SEQ ID NO: 141039 - RNA, 22 nt, Homo sapiens
uuguauguaaccauuuggcaaa

SEQ ID NO: 141040 - RNA, 22 nt, Homo sapiens
uuguaugucuucauuugaaaaa

SEQ ID NO: 141041 - RNA, 21 nt, Homo sapiens
uugugccaaacccuggaggga

SEQ ID NO: 141042 - RNA, 19 nt, Homo sapiens
uuguguccccacaaaauuc

SEQ ID NO: 141043 - RNA, 20 nt, Homo sapiens
uuuaagacaugcugaauuga

SEQ ID NO: 141044 - RNA, 17 nt, Homo sapiens
uuucagaguggaagugu

SEQ ID NO: 141045 - RNA, 22 nt, Homo sapiens
uuucauggaauauagucauuuu

SEQ ID NO: 141046 - RNA, 22 nt, Homo sapiens
uuugcugagucauuccaugcug

SEQ ID NO: 141047 - RNA, 22 nt, Homo sapiens
uuugcugagucugacuucaugg

SEQ ID NO: 141048 - RNA, 22 nt, Homo sapiens
uuuggcauuuaaauaugcaugg

SEQ ID NO: 141049 - RNA, 22 nt, Homo sapiens
uuuggucuuuuguaaguuaucu

SEQ ID NO: 141050 - RNA, 22 nt, Homo sapiens
uuugguuuuuguuaucacucau

SEQ ID NO: 141051 - RNA, 21 nt, Homo sapiens
uuuguccaccuguguucacca

SEQ ID NO: 141052 - RNA, 22 nt, Homo sapiens
uuugugcuauguuauauauucu

SEQ ID NO: 141053 - RNA, 22 nt, Homo sapiens
ugcaagaaucagccuaucauua

SEQ ID NO: 141054 - RNA, 22 nt, Homo sapiens
ugcaagaaucuuucaggcuagc

SEQ ID NO: 141055 - RNA, 22 nt, Homo sapiens
ugcaccaucuugcuucuguggu

SEQ ID NO: 141056 - RNA, 20 nt, Homo sapiens
ugcagcacugggaaugcagu

SEQ ID NO: 141057 - RNA, 21 nt, Homo sapiens
ugcagccauucagcccuaugc

SEQ ID NO: 141058 - RNA, 22 nt, Homo sapiens
ugcauguucuuacucauacaug

SEQ ID NO: 141059 - RNA, 21 nt, Homo sapiens
ugcccaguggcuuggggucag

SEQ ID NO: 141060 - RNA, 22 nt, Homo sapiens
ugcuaugucagccaggcugguc

SEQ ID NO: 141061 - RNA, 18 nt, Homo sapiens
ugcuccccugggugagca

SEQ ID NO: 141062 - RNA, 22 nt, Homo sapiens
ugcuguuguuugaugaaguaau

SEQ ID NO: 141063 - RNA, 22 nt, Homo sapiens
uggaaauaaaauagaguuugcc

SEQ ID NO: 141064 - RNA, 22 nt, Homo sapiens
uggaaauaaaugugccaagauc

SEQ ID NO: 141065 - RNA, 22 nt, Homo sapiens
uggaaguaaccaugaauggaau

SEQ ID NO: 141066 - RNA, 22 nt, Homo sapiens
uggacugagauuucagcugcca

SEQ ID NO: 141067 - RNA, 22 nt, Homo sapiens
uggacuguaagugccuugagua

SEQ ID NO: 141068 - RNA, 22 nt, Homo sapiens
uggacuguaauagagaacagaa

SEQ ID NO: 141069 - RNA, 22 nt, Homo sapiens
uggaguaggccuaagaaugaca

SEQ ID NO: 141070 - RNA, 22 nt, Homo sapiens
uggagugcaauggcaccaucuu

SEQ ID NO: 141071 - RNA, 22 nt, Homo sapiens
uggaugaagagaugguaguugc

SEQ ID NO: 141072 - RNA, 22 nt, Homo sapiens
uggauuuuaauuauucugucau

SEQ ID NO: 141073 - RNA, 22 nt, Homo sapiens
uggcaaaauggaauauguuggg

SEQ ID NO: 141074 - RNA, 22 nt, Homo sapiens
uggcaagaccccaucucuacaa

SEQ ID NO: 141075 - RNA, 22 nt, Homo sapiens
uggcauauaaagauguguucaa

SEQ ID NO: 141076 - RNA, 22 nt, Homo sapiens
uggcaugauccuagauucaaca

SEQ ID NO: 141077 - RNA, 22 nt, Homo sapiens
uggccaguugaagacaaugcuc

SEQ ID NO: 141078 - RNA, 22 nt, Homo sapiens
uggccuguaacgcugucucagc

SEQ ID NO: 141079 - RNA, 22 nt, Homo sapiens
uggcuuuuauuauguugaggua

SEQ ID NO: 141080 - RNA, 22 nt, Homo sapiens
ugggaagauucuguguuuuucc

SEQ ID NO: 141081 - RNA, 22 nt, Homo sapiens
ugggaucauucaaugacgaaau

SEQ ID NO: 141082 - RNA, 22 nt, Homo sapiens
uggggcuuuuucuuguauucuc

SEQ ID NO: 141083 - RNA, 22 nt, Homo sapiens
uggguaguguaaagcacuccag

SEQ ID NO: 141084 - RNA, 22 nt, Homo sapiens
ugguaucauuuuaucugcucua

SEQ ID NO: 141085 - RNA, 22 nt, Homo sapiens
aaggugcuguaagcauccaugu

SEQ ID NO: 141086 - RNA, 22 nt, Homo sapiens
aaguauuaugaguccuuguuuu

SEQ ID NO: 141087 - RNA, 20 nt, Homo sapiens
aagugcaucguugugucugc

SEQ ID NO: 141088 - RNA, 22 nt, Homo sapiens
aauaaagucugaagugugcuua

SEQ ID NO: 141089 - RNA, 22 nt, Homo sapiens
aauacuuccaaaucuagucauu

SEQ ID NO: 141090 - RNA, 22 nt, Homo sapiens
aaucacaguguucuugugaggg

SEQ ID NO: 141091 - RNA, 20 nt, Homo sapiens
acaaaugcauucugugacau

SEQ ID NO: 141092 - RNA, 22 nt, Homo sapiens
acacucuaguguucuuaaucag

SEQ ID NO: 141093 - RNA, 20 nt, Homo sapiens
acacuggaguaucaaggccc

SEQ ID NO: 141094 - RNA, 22 nt, Homo sapiens
acacugucaugucucacaggca

SEQ ID NO: 141095 - RNA, 22 nt, Homo sapiens
acaguacuuuuggauuugugaa

SEQ ID NO: 141096 - RNA, 22 nt, Homo sapiens
acaguauaaugcuguagggaga

SEQ ID NO: 141097 - RNA, 22 nt, Homo sapiens
acagugcuuuuguuccucuccu

SEQ ID NO: 141098 - RNA, 23 nt, Homo sapiens
acaguggugugaucuuggcucag

SEQ ID NO: 141099 - RNA, 22 nt, Homo sapiens
acauagaguagcuaccuguaga

SEQ ID NO: 141100 - RNA, 22 nt, Homo sapiens
acaugacauugggguggggaua

SEQ ID NO: 141101 - RNA, 22 nt, Homo sapiens
acccugcuaaacagcccccugc

SEQ ID NO: 141102 - RNA, 22 nt, Homo sapiens
acccugucauccacauggugcu

SEQ ID NO: 141103 - RNA, 22 nt, Homo sapiens
acucugucuaguuguaaaauuu

SEQ ID NO: 141104 - RNA, 22 nt, Homo sapiens
acugcacuccaccuugggcaac

SEQ ID NO: 141105 - RNA, 22 nt, Homo sapiens
acuguguguuugucuagcacag

SEQ ID NO: 141106 - RNA, 22 nt, Homo sapiens
agagagguggguggagccccca

SEQ ID NO: 141107 - RNA, 22 nt, Homo sapiens
agaguaguaggaugaauggacu

SEQ ID NO: 141108 - RNA, 19 nt, Homo sapiens
agaguauuguuacuucucu

SEQ ID NO: 141109 - RNA, 20 nt, Homo sapiens
agagugcuggacugaggagc

SEQ ID NO: 141110 - RNA, 22 nt, Homo sapiens
agauggugauaaaugugguacc

SEQ ID NO: 141111 - RNA, 22 nt, Homo sapiens
agaugguguuuucucaccagau

SEQ ID NO: 141112 - RNA, 22 nt, Homo sapiens
agcagagcaguggauuuuguga

SEQ ID NO: 141113 - RNA, 22 nt, Homo sapiens
agcagcuuugcauggccuguga

SEQ ID NO: 141114 - RNA, 22 nt, Homo sapiens
agcagguguccacaauguuugc

SEQ ID NO: 141115 - RNA, 16 nt, Homo sapiens
agcagguguuagguga

SEQ ID NO: 141116 - RNA, 22 nt, Homo sapiens
agcaucaugcaguugcuauuca

SEQ ID NO: 141117 - RNA, 20 nt, Homo sapiens
agcaucauugcaauuuguca

SEQ ID NO: 141118 - RNA, 20 nt, Homo sapiens
agcugcagauauaaauccgc

SEQ ID NO: 141119 - RNA, 20 nt, Homo sapiens
agcuguuguuaugagguuua

SEQ ID NO: 141120 - RNA, 22 nt, Homo sapiens
aggcaugaguucagaggguaug

SEQ ID NO: 141121 - RNA, 22 nt, Homo sapiens
aggcauguggcucuguucugac

SEQ ID NO: 141122 - RNA, 22 nt, Homo sapiens
aguaccauuugacaugggaccc

SEQ ID NO: 141123 - RNA, 22 nt, Homo sapiens
aguauuuguuggaauaccuguu

SEQ ID NO: 141124 - RNA, 22 nt, Homo sapiens
agucaaaugcuuauguauaaag

SEQ ID NO: 141125 - RNA, 22 nt, Homo sapiens
agucaguguguauugauggcac

SEQ ID NO: 141126 - RNA, 22 nt, Homo sapiens
aguccauuugaugaugauucca

SEQ ID NO: 141127 - RNA, 22 nt, Homo sapiens
agugcagugguuaggagccagg

SEQ ID NO: 141128 - RNA, 22 nt, Homo sapiens
agugcauugcaucucugcuuca

SEQ ID NO: 141129 - RNA, 22 nt, Homo sapiens
agugccacugcacucuagccug

SEQ ID NO: 141130 - RNA, 19 nt, Homo sapiens
agugggcuagaaaucaggg

SEQ ID NO: 141131 - RNA, 19 nt, Homo sapiens
aguggguguuuucuguuug

SEQ ID NO: 141132 - RNA, 22 nt, Homo sapiens
agugguuuuggaauggaauuca

SEQ ID NO: 141133 - RNA, 22 nt, Homo sapiens
aguuggccccuacugggaggug

SEQ ID NO: 141134 - RNA, 18 nt, Homo sapiens
aguuguuuuauccugccc

SEQ ID NO: 141135 - RNA, 22 nt, Homo sapiens
auaaaguucugcuggcauauau

SEQ ID NO: 141136 - RNA, 22 nt, Homo sapiens
auaaaugccuguuguuuuaagc

SEQ ID NO: 141137 - RNA, 22 nt, Homo sapiens
auacccucugggugguuaguug

SEQ ID NO: 141138 - RNA, 22 nt, Homo sapiens
auagaucuauuuauguaucccu

SEQ ID NO: 141139 - RNA, 22 nt, Homo sapiens
auagcacaguguguguacacca

SEQ ID NO: 141140 - RNA, 22 nt, Homo sapiens
auagugcugcaauaaccauggg

SEQ ID NO: 141141 - RNA, 22 nt, Homo sapiens
auaugucuguuuagucuguaau

SEQ ID NO: 141142 - RNA, 22 nt, Homo sapiens
auauucaagugaggauggcuaa

SEQ ID NO: 141143 - RNA, 22 nt, Homo sapiens
auauucacuauaugcagaacca

SEQ ID NO: 141144 - RNA, 20 nt, Homo sapiens
aucacuggagaaggaaaccu

SEQ ID NO: 141145 - RNA, 22 nt, Homo sapiens
aucaggaaccuuuuuggugugu

SEQ ID NO: 141146 - RNA, 22 nt, Homo sapiens
aucauccugucaggagcuguga

SEQ ID NO: 141147 - RNA, 22 nt, Homo sapiens
auccccugcacggggugucauu

SEQ ID NO: 141148 - RNA, 22 nt, Homo sapiens
aucugcaaagcugggcugagac

SEQ ID NO: 141149 - RNA, 22 nt, Homo sapiens
augaagaucucugccuuguguc

SEQ ID NO: 141150 - RNA, 22 nt, Homo sapiens
augaguaugagaauacauuaag

SEQ ID NO: 141151 - RNA, 22 nt, Homo sapiens
augcagugugcaacagauuaag

SEQ ID NO: 141152 - RNA, 22 nt, Homo sapiens
auggaaggagaauggucuuuga

SEQ ID NO: 141153 - RNA, 22 nt, Homo sapiens
auggcacugaagcguauugaca

SEQ ID NO: 141154 - RNA, 22 nt, Homo sapiens
auggcagcugguuuuacccuag

SEQ ID NO: 141155 - RNA, 22 nt, Homo sapiens
auggccugaugcaccuguccca

SEQ ID NO: 141156 - RNA, 22 nt, Homo sapiens
augguacuccagagaagcagaa

SEQ ID NO: 141157 - RNA, 22 nt, Homo sapiens
augguacuggguaaaagugggg

SEQ ID NO: 141158 - RNA, 20 nt, Homo sapiens
augucagaguguggguacgg

SEQ ID NO: 141159 - RNA, 22 nt, Homo sapiens
augucuguuugcugagcccggc

SEQ ID NO: 141160 - RNA, 22 nt, Homo sapiens
auuacaugucuauccaugaaca

SEQ ID NO: 141161 - RNA, 22 nt, Homo sapiens
auucaccauggaccaggggccu

SEQ ID NO: 141162 - RNA, 22 nt, Homo sapiens
auugagcaaggucuccuaguau

SEQ ID NO: 141163 - RNA, 22 nt, Homo sapiens
auugcagaaaugacagagcgcc

SEQ ID NO: 141164 - RNA, 22 nt, Homo sapiens
auugcaguuagaacagaagucu

SEQ ID NO: 141165 - RNA, 22 nt, Homo sapiens
auugcugagacauugcuaaucu

SEQ ID NO: 141166 - RNA, 22 nt, Homo sapiens
auuggcaagauagcauaugagg

SEQ ID NO: 141167 - RNA, 22 nt, Homo sapiens
auuggcaauggcaaagcagagu

SEQ ID NO: 141168 - RNA, 22 nt, Homo sapiens
auuuaugguuaauauaggaagu

SEQ ID NO: 141169 - RNA, 19 nt, Homo sapiens
auuugaucaucaggcacag

SEQ ID NO: 141170 - RNA, 22 nt, Homo sapiens
auuuuugguugucagcacuagg

SEQ ID NO: 141171 - RNA, 22 nt, Homo sapiens
auuuuugguuucaccugcacgc

SEQ ID NO: 141172 - RNA, 22 nt, Homo sapiens
caaagucuucaguugauucuga

SEQ ID NO: 141173 - RNA, 22 nt, Homo sapiens
caaagugcuggccgggcgcagu

SEQ ID NO: 141174 - RNA, 22 nt, Homo sapiens
caauggcacuauuggaaaaggu

SEQ ID NO: 141175 - RNA, 22 nt, Homo sapiens
cacaaugucuaagauguuucua

SEQ ID NO: 141176 - RNA, 22 nt, Homo sapiens
cacacugucuucaauggguggu

SEQ ID NO: 141177 - RNA, 22 nt, Homo sapiens
cacagcacaggcaugaguguca

SEQ ID NO: 141178 - RNA, 22 nt, Homo sapiens
cacaguguuccagcuauuugaa

SEQ ID NO: 141179 - RNA, 22 nt, Homo sapiens
cacauagcuagucaguagugaa

SEQ ID NO: 141180 - RNA, 22 nt, Homo sapiens
cacauugcaggaaaguucauua

SEQ ID NO: 141181 - RNA, 22 nt, Homo sapiens
gugcagugugauccuuccguau

SEQ ID NO: 141182 - RNA, 22 nt, Homo sapiens
gugcauaugcaugugcaugcac

SEQ ID NO: 141183 - RNA, 22 nt, Homo sapiens
gugcaugucuaugcgagucuaa

SEQ ID NO: 141184 - RNA, 22 nt, Homo sapiens
gugcccacugucuguccuguag

SEQ ID NO: 141185 - RNA, 20 nt, Homo sapiens
guggaaguagaaacauaugu

SEQ ID NO: 141186 - RNA, 22 nt, Homo sapiens
guggcagagucagagggaaaug

SEQ ID NO: 141187 - RNA, 22 nt, Homo sapiens
gugugaacaucauagaguguau

SEQ ID NO: 141188 - RNA, 22 nt, Homo sapiens
gugugacuagucaugccugaau

SEQ ID NO: 141189 - RNA, 22 nt, Homo sapiens
gugugacugcucuauuagggcg

SEQ ID NO: 141190 - RNA, 22 nt, Homo sapiens
gugugguauuauaacuagguau

SEQ ID NO: 141191 - RNA, 22 nt, Homo sapiens
guucacacuugcaaccccagca

SEQ ID NO: 141192 - RNA, 22 nt, Homo sapiens
guucacucuggagaauauugac

SEQ ID NO: 141193 - RNA, 22 nt, Homo sapiens
guucaucaggaauauuggccua

SEQ ID NO: 141194 - RNA, 22 nt, Homo sapiens
guugcacagucuuuccuggacu

SEQ ID NO: 141195 - RNA, 22 nt, Homo sapiens
guugcugagucccaucaccaga

SEQ ID NO: 141196 - RNA, 22 nt, Homo sapiens
uaaaguuauugccccucaguua

SEQ ID NO: 141197 - RNA, 22 nt, Homo sapiens
uaaaugcucuuuaaaagugcuu

SEQ ID NO: 141198 - RNA, 22 nt, Homo sapiens
uaacccagugucugugaugggu

SEQ ID NO: 141199 - RNA, 22 nt, Homo sapiens
uaagcaguaaaugaagucuugc

SEQ ID NO: 141200 - RNA, 22 nt, Homo sapiens
uaagucuuuuuggaguuuauaa

SEQ ID NO: 141201 - RNA, 18 nt, Homo sapiens
uaauaacugugaccuuga

SEQ ID NO: 141202 - RNA, 19 nt, Homo sapiens
uacaggacugagcugaggu

SEQ ID NO: 141203 - RNA, 22 nt, Homo sapiens
uacaguggaaguuaaccccauu

SEQ ID NO: 141204 - RNA, 22 nt, Homo sapiens
uacagugggcacuggcgcccug

SEQ ID NO: 141205 - RNA, 22 nt, Homo sapiens
uacauacuucacagacuuuaaa

SEQ ID NO: 141206 - RNA, 22 nt, Homo sapiens
uacauugucauauucucucucu

SEQ ID NO: 141207 - RNA, 22 nt, Homo sapiens
uagaaguaggcuacgugucugg

SEQ ID NO: 141208 - RNA, 22 nt, Homo sapiens
uagagaucuuauauuuuaugac

SEQ ID NO: 141209 - RNA, 21 nt, Homo sapiens
uagauaguugguucugaaucu

SEQ ID NO: 141210 - RNA, 22 nt, Homo sapiens
uagcaccucuuuggccuuucgu

SEQ ID NO: 141211 - RNA, 20 nt, Homo sapiens
uagccggguguugugucaug

SEQ ID NO: 141212 - RNA, 22 nt, Homo sapiens
uagccucacaaagugcuuaaga

SEQ ID NO: 141213 - RNA, 22 nt, Homo sapiens
uaggggcacacuucgguuagca

SEQ ID NO: 141214 - RNA, 22 nt, Homo sapiens
uaguccauuuucaugcugcuau

SEQ ID NO: 141215 - RNA, 22 nt, Homo sapiens
uaucaagaugacaaacuuugcu

SEQ ID NO: 141216 - RNA, 22 nt, Homo sapiens
uaucaaguuggaagagaaguaa

SEQ ID NO: 141217 - RNA, 22 nt, Homo sapiens
uaucacaaacuuagcaguuuaa

SEQ ID NO: 141218 - RNA, 22 nt, Homo sapiens
uaucccaguggauguaccccau

SEQ ID NO: 141219 - RNA, 22 nt, Homo sapiens
uaucucaguguacaggaugaua

SEQ ID NO: 141220 - RNA, 22 nt, Homo sapiens
uaugcacacucucccaggaggg

SEQ ID NO: 141221 - RNA, 22 nt, Homo sapiens
uaugcacaugugccugggugug

SEQ ID NO: 141222 - RNA, 21 nt, Homo sapiens
ucaacccuugcgucaccaagc

SEQ ID NO: 141223 - RNA, 22 nt, Homo sapiens
ucaauguaucuccaagaauuga

SEQ ID NO: 141224 - RNA, 19 nt, Homo sapiens
ucacacuguggcuucuuua

SEQ ID NO: 141225 - RNA, 23 nt, Homo sapiens
ucacacuuaagagaaaugcagcu

SEQ ID NO: 141226 - RNA, 22 nt, Homo sapiens
ucacagaugcuugacccauuuc

SEQ ID NO: 141227 - RNA, 19 nt, Homo sapiens
ucacaggguugacuugagg

SEQ ID NO: 141228 - RNA, 22 nt, Homo sapiens
ucacauagcauaaugucugcaa

SEQ ID NO: 141229 - RNA, 21 nt, Homo sapiens
ucacauggccagaguaggaac

SEQ ID NO: 141230 - RNA, 22 nt, Homo sapiens
ucacauguguaugagcuuugau

SEQ ID NO: 141231 - RNA, 22 nt, Homo sapiens
ucacauuguguagccugcucac

SEQ ID NO: 141232 - RNA, 22 nt, Homo sapiens
ucaccuggagacaugaagacug

SEQ ID NO: 141233 - RNA, 22 nt, Homo sapiens
ucacugaaaccgccuccaccuc

SEQ ID NO: 141234 - RNA, 22 nt, Homo sapiens
ucacuuuguuuuuggauaaguu

SEQ ID NO: 141235 - RNA, 22 nt, Homo sapiens
ucagaguagcugucugaggugc

SEQ ID NO: 141236 - RNA, 22 nt, Homo sapiens
ucagcaaugaccuaagcaaaua

SEQ ID NO: 141237 - RNA, 22 nt, Homo sapiens
ucagcacauucaaggccugccu

SEQ ID NO: 141238 - RNA, 22 nt, Homo sapiens
ucaggcaccuuccucuuaucug

SEQ ID NO: 141239 - RNA, 22 nt, Homo sapiens
ucaggcacucagcuuagagucu

SEQ ID NO: 141240 - RNA, 22 nt, Homo sapiens
ucagggacgcuugacacaagcc

SEQ ID NO: 141241 - RNA, 22 nt, Homo sapiens
ucagggacuuacaaaccagaag

SEQ ID NO: 141242 - RNA, 22 nt, Homo sapiens
ucagguauuuauagcaaugcaa

SEQ ID NO: 141243 - RNA, 23 nt, Homo sapiens
ucaguacuccacuuucaauagug

SEQ ID NO: 141244 - RNA, 18 nt, Homo sapiens
ucagucacugccuggcuu

SEQ ID NO: 141245 - RNA, 22 nt, Homo sapiens
uccacugagcuagaccacuugg

SEQ ID NO: 141246 - RNA, 21 nt, Homo sapiens
uccagcuuugagaguuguggu

SEQ ID NO: 141247 - RNA, 22 nt, Homo sapiens
uccagguuuggcuuuauaacuu

SEQ ID NO: 141248 - RNA, 22 nt, Homo sapiens
uccauugucuagauguaacaca

SEQ ID NO: 141249 - RNA, 22 nt, Homo sapiens
uccccgucacacgcaggcuuac

SEQ ID NO: 141250 - RNA, 18 nt, Homo sapiens
ucccucagaauuauagaa

SEQ ID NO: 141251 - RNA, 22 nt, Homo sapiens
ucccugaguaucuaauguguuu

SEQ ID NO: 141252 - RNA, 22 nt, Homo sapiens
uccucaguggauuggauggugc

SEQ ID NO: 141253 - RNA, 22 nt, Homo sapiens
uccugagaauagaguugcaugu

SEQ ID NO: 141254 - RNA, 22 nt, Homo sapiens
uccugagacugaggagcuuugg

SEQ ID NO: 141255 - RNA, 22 nt, Homo sapiens
ucuaagaauucauuuauaagcc

SEQ ID NO: 141256 - RNA, 22 nt, Homo sapiens
ucucacauuucacagggauggg

SEQ ID NO: 141257 - RNA, 22 nt, Homo sapiens
ucucaguggcuuccucacuuuu

SEQ ID NO: 141258 - RNA, 20 nt, Homo sapiens
ucucauagagguagagaaua

SEQ ID NO: 141259 - RNA, 20 nt, Homo sapiens
ucucauggagggaaagagca

SEQ ID NO: 141260 - RNA, 20 nt, Homo sapiens
ucucauggagguagagaaua

SEQ ID NO: 141261 - RNA, 22 nt, Homo sapiens
ucucauggagucaggagcagaa

SEQ ID NO: 141262 - RNA, 22 nt, Homo sapiens
ucucugguuuucaaagcaguau

SEQ ID NO: 141263 - RNA, 22 nt, Homo sapiens
ucugguggugaugagagacagu

SEQ ID NO: 141264 - RNA, 22 nt, Homo sapiens
ucugucuuugccuaaguuuguc

SEQ ID NO: 141265 - RNA, 22 nt, Homo sapiens
ucuuuguucaggagccaacucc

SEQ ID NO: 141266 - RNA, 20 nt, Homo sapiens
ucuuuuuguggccccagagu

SEQ ID NO: 141267 - RNA, 22 nt, Homo sapiens
ugaacacagccugccucugcca

SEQ ID NO: 141268 - RNA, 22 nt, Homo sapiens
ugaaggaguauggauaagucgu

SEQ ID NO: 141269 - RNA, 22 nt, Homo sapiens
ugacacauguagacaucuggug

SEQ ID NO: 141270 - RNA, 21 nt, Homo sapiens
ugacagaaaauugaguuugcu

SEQ ID NO: 141271 - RNA, 20 nt, Homo sapiens
cagagcaaagcaguccuggc

SEQ ID NO: 141272 - RNA, 22 nt, Homo sapiens
cagccgggugagguggcuuguu

SEQ ID NO: 141273 - RNA, 23 nt, Homo sapiens
cagcucauuuggguccccuuguc

SEQ ID NO: 141274 - RNA, 23 nt, Homo sapiens
cagcuucauugaacauaacuccu

SEQ ID NO: 141275 - RNA, 22 nt, Homo sapiens
cagugcuuuaucaaguccucca

SEQ ID NO: 141276 - RNA, 22 nt, Homo sapiens
caucaaaguggagggaaggacc

SEQ ID NO: 141277 - RNA, 23 nt, Homo sapiens
caugaacuaguuugcagccauga

SEQ ID NO: 141278 - RNA, 22 nt, Homo sapiens
cauguaacaucccgcuguagga

SEQ ID NO: 141279 - RNA, 22 nt, Homo sapiens
caugucacuuccucucugaugg

SEQ ID NO: 141280 - RNA, 22 nt, Homo sapiens
caugucuuuuauucugugugau

SEQ ID NO: 141281 - RNA, 22 nt, Homo sapiens
caugugcaugcuuucuuaugug

SEQ ID NO: 141282 - RNA, 22 nt, Homo sapiens
ccacugcacuccagcccggcaa

SEQ ID NO: 141283 - RNA, 22 nt, Homo sapiens
ccaucacacugugauuauuauc

SEQ ID NO: 141284 - RNA, 22 nt, Homo sapiens
cccagaguucuuaaauacugag

SEQ ID NO: 141285 - RNA, 22 nt, Homo sapiens
cccugagaugugaauuucagag

SEQ ID NO: 141286 - RNA, 19 nt, Homo sapiens
cccuggcacauggaaaaug

SEQ ID NO: 141287 - RNA, 22 nt, Homo sapiens
ccucauggagaaccucugcuag

SEQ ID NO: 141288 - RNA, 22 nt, Homo sapiens
ccugagacuugagggggcuucu

SEQ ID NO: 141289 - RNA, 22 nt, Homo sapiens
ccuuggcaauggcuggggcuga

SEQ ID NO: 141290 - RNA, 22 nt, Homo sapiens
cgcuggugucuaagcgacagcu

SEQ ID NO: 141291 - RNA, 22 nt, Homo sapiens
cuaaaugcacugucaaaggaag

SEQ ID NO: 141292 - RNA, 22 nt, Homo sapiens
cuaacacagggcaagucaggcu

SEQ ID NO: 141293 - RNA, 22 nt, Homo sapiens
cuacaguguauuuauggagggu

SEQ ID NO: 141294 - RNA, 22 nt, Homo sapiens
cuagguuauacucugaaauggu

SEQ ID NO: 141295 - RNA, 20 nt, Homo sapiens
cucaccagguguaggcugag

SEQ ID NO: 141296 - RNA, 22 nt, Homo sapiens
cucacugugguguccuuaggua

SEQ ID NO: 141297 - RNA, 22 nt, Homo sapiens
cucaguuuugccuuguuuaagg

SEQ ID NO: 141298 - RNA, 22 nt, Homo sapiens
cucauggauggucuggcagcca

SEQ ID NO: 141299 - RNA, 22 nt, Homo sapiens
cuccauguggcuaacuuuuaaa

SEQ ID NO: 141300 - RNA, 22 nt, Homo sapiens
cuccauuuggaacagauguccu

SEQ ID NO: 141301 - RNA, 22 nt, Homo sapiens
cucugcuuaaugucccacuuga

SEQ ID NO: 141302 - RNA, 22 nt, Homo sapiens
cugaauagucaacgauggacug

SEQ ID NO: 141303 - RNA, 22 nt, Homo sapiens
cugacauuguugaucacagcca

SEQ ID NO: 141304 - RNA, 22 nt, Homo sapiens
cugaggugggaggauuggcuug

SEQ ID NO: 141305 - RNA, 22 nt, Homo sapiens
cugagguuaggaguuugagacc

SEQ ID NO: 141306 - RNA, 22 nt, Homo sapiens
cugcaagaaucguaguauuuga

SEQ ID NO: 141307 - RNA, 22 nt, Homo sapiens
cugcaguaaccacuguaggugu

SEQ ID NO: 141308 - RNA, 22 nt, Homo sapiens
cuguagcuuuuauaugcuuagc

SEQ ID NO: 141309 - RNA, 22 nt, Homo sapiens
cuguccugcagagucagaauga

SEQ ID NO: 141310 - RNA, 22 nt, Homo sapiens
cugugcauaugacuuuauugga

SEQ ID NO: 141311 - RNA, 22 nt, Homo sapiens
cugugcauggauuuuaagauug

SEQ ID NO: 141312 - RNA, 17 nt, Homo sapiens
cuuguugugguaguuug

SEQ ID NO: 141313 - RNA, 20 nt, Homo sapiens
cuuuggcaaugagaacaggg

SEQ ID NO: 141314 - RNA, 22 nt, Homo sapiens
gaaagguaggaacagggugcag

SEQ ID NO: 141315 - RNA, 22 nt, Homo sapiens
gaaggugcuuggugaaugcauu

SEQ ID NO: 141316 - RNA, 16 nt, Homo sapiens
gacugggcugaggaau

SEQ ID NO: 141317 - RNA, 22 nt, Homo sapiens
gagaacuggcugauucaaggac

SEQ ID NO: 141318 - RNA, 22 nt, Homo sapiens
gagacugagucucgcucugccg

SEQ ID NO: 141319 - RNA, 22 nt, Homo sapiens
gagagcaugugcuggcaucagu

SEQ ID NO: 141320 - RNA, 22 nt, Homo sapiens
gagaucauucugauccagaguc

SEQ ID NO: 141321 - RNA, 22 nt, Homo sapiens
gagcucaccuuaccucuggagc

SEQ ID NO: 141322 - RNA, 22 nt, Homo sapiens
gagcugaaguuuccauuuguac

SEQ ID NO: 141323 - RNA, 22 nt, Homo sapiens
gagugcaauggcaagaucuugg

SEQ ID NO: 141324 - RNA, 22 nt, Homo sapiens
gagugcaucguggccauuuuaa

SEQ ID NO: 141325 - RNA, 22 nt, Homo sapiens
gaucacuuugaugccaggaacu

SEQ ID NO: 141326 - RNA, 22 nt, Homo sapiens
gaucaguuucuggagauacgua

SEQ ID NO: 141327 - RNA, 22 nt, Homo sapiens
gauuccauuuguggcuauuuac

SEQ ID NO: 141328 - RNA, 20 nt, Homo sapiens
gcaaauggaucccacaagcc

SEQ ID NO: 141329 - RNA, 22 nt, Homo sapiens
gcaagaauggaacaggagagcc

SEQ ID NO: 141330 - RNA, 22 nt, Homo sapiens
gcaagaguauuucaaggaagau

SEQ ID NO: 141331 - RNA, 23 nt, Homo sapiens
gcagcaaugucacagggguccgg

SEQ ID NO: 141332 - RNA, 22 nt, Homo sapiens
gcagguguuaugcaaacaacug

SEQ ID NO: 141333 - RNA, 20 nt, Homo sapiens
gcaguguucacuguauuccu

SEQ ID NO: 141334 - RNA, 22 nt, Homo sapiens
gcauggaguggaaauucuuggg

SEQ ID NO: 141335 - RNA, 22 nt, Homo sapiens
gccaagauuuaauucaucaguu

SEQ ID NO: 141336 - RNA, 22 nt, Homo sapiens
gcucuuuugggguaauucugag

SEQ ID NO: 141337 - RNA, 22 nt, Homo sapiens
gcuggugacuuuaaguugaagc

SEQ ID NO: 141338 - RNA, 22 nt, Homo sapiens
gcuguguguuaucagaaauugc

SEQ ID NO: 141339 - RNA, 19 nt, Homo sapiens
gcuucuugaggacgaugac

SEQ ID NO: 141340 - RNA, 21 nt, Homo sapiens
gcuuuuucggaagucuuuggc

SEQ ID NO: 141341 - RNA, 22 nt, Homo sapiens
ggagguagguuugugauuugua

SEQ ID NO: 141342 - RNA, 21 nt, Homo sapiens
ggcaagagaauacaacauaaa

SEQ ID NO: 141343 - RNA, 22 nt, Homo sapiens
ggcaagugucagcagcaacacc

SEQ ID NO: 141344 - RNA, 22 nt, Homo sapiens
ggcaugaaguagcccacaggca

SEQ ID NO: 141345 - RNA, 22 nt, Homo sapiens
ggcaugguggugugugccuaua

SEQ ID NO: 141346 - RNA, 22 nt, Homo sapiens
gggaagaaggagugguuuacuc

SEQ ID NO: 141347 - RNA, 22 nt, Homo sapiens
gggugguuuuauuaucagugac

SEQ ID NO: 141348 - RNA, 22 nt, Homo sapiens
ggucaacaucaucaugguaagu

SEQ ID NO: 141349 - RNA, 19 nt, Homo sapiens
ggucacagggguuacaagg

SEQ ID NO: 141350 - RNA, 22 nt, Homo sapiens
ggugagauguucagacgaacug

SEQ ID NO: 141351 - RNA, 22 nt, Homo sapiens
ggugaguggugcuuaaguucag

SEQ ID NO: 141352 - RNA, 22 nt, Homo sapiens
guacaguacugaaugaauguau

SEQ ID NO: 141353 - RNA, 19 nt, Homo sapiens
guauuugacuuucuuguuu

SEQ ID NO: 141354 - RNA, 22 nt, Homo sapiens
gucuaugguucaggguggagug

SEQ ID NO: 141355 - RNA, 22 nt, Homo sapiens
gucucuuguuaucauuucugag

SEQ ID NO: 141356 - RNA, 22 nt, Homo sapiens
gucugcaugucauaugauagua

SEQ ID NO: 141357 - RNA, 20 nt, Homo sapiens
gucuuguagcucaaguuauu

SEQ ID NO: 141358 - RNA, 22 nt, Homo sapiens
gucuuuggaaagacaaaguuca

SEQ ID NO: 141359 - RNA, 22 nt, Homo sapiens
gugaaaagaugagcaccauaca

SEQ ID NO: 141360 - RNA, 22 nt, Homo sapiens
gugaccucuguugcugucacua

SEQ ID NO: 141361 - RNA, 22 nt, Homo sapiens
gugagcauauuaguauugcacu

SEQ ID NO: 141362 - RNA, 22 nt, Homo sapiens
gugagggaugugaaaaagguca

SEQ ID NO: 141363 - RNA, 23 nt, Homo sapiens
ugacagaccuucuggaagaaguc

SEQ ID NO: 141364 - RNA, 22 nt, Homo sapiens
ugacugucuagauagagcuugg

SEQ ID NO: 141365 - RNA, 16 nt, Homo sapiens
ugagaacaugcagcau

SEQ ID NO: 141366 - RNA, 22 nt, Homo sapiens
ugagacaucugagauuuuaagc

SEQ ID NO: 141367 - RNA, 21 nt, Homo sapiens
ugagaguaguguauuauucuc

SEQ ID NO: 141368 - RNA, 22 nt, Homo sapiens
ugagauagggucucacucuguc

SEQ ID NO: 141369 - RNA, 18 nt, Homo sapiens
ugagaucagcaucaaggg

SEQ ID NO: 141370 - RNA, 19 nt, Homo sapiens
ugagaucuuuacuggguuu

SEQ ID NO: 141371 - RNA, 22 nt, Homo sapiens
ugagaugaaagcagaaagacuu

SEQ ID NO: 141372 - RNA, 22 nt, Homo sapiens
ugagaugaucaaaguauaggcu

SEQ ID NO: 141373 - RNA, 21 nt, Homo sapiens
ugagaugcaaucaccagggag

SEQ ID NO: 141374 - RNA, 22 nt, Homo sapiens
ugagcuauguucuucuuguuuu

SEQ ID NO: 141375 - RNA, 22 nt, Homo sapiens
ugagcugagauuaagcugcugc

SEQ ID NO: 141376 - RNA, 23 nt, Homo sapiens
ugagguguuaagcagacuugucu

SEQ ID NO: 141377 - RNA, 22 nt, Homo sapiens
ugaguucaauguuaaugaagca

SEQ ID NO: 141378 - RNA, 22 nt, Homo sapiens
ugaucucauuagcaccuuuagc

SEQ ID NO: 141379 - RNA, 22 nt, Homo sapiens
ugaucuguccaccucagcuucc

SEQ ID NO: 141380 - RNA, 22 nt, Homo sapiens
ugaugaaguauaggaagggcuu

SEQ ID NO: 141381 - RNA, 22 nt, Homo sapiens
ugaugcugaugccugccagaag

SEQ ID NO: 141382 - RNA, 22 nt, Homo sapiens
ugauggcaauggcauucauuuu

SEQ ID NO: 141383 - RNA, 22 nt, Homo sapiens
ugauguugacuguaggcagaga

SEQ ID NO: 141384 - RNA, 22 nt, Homo sapiens
ugcaaauguuaguaacaccacu

SEQ ID NO: 141385 - RNA, 22 nt, Homo sapiens
ugcagcauguaggcacguuauu

SEQ ID NO: 141386 - RNA, 22 nt, Homo sapiens
ugcagugugauuuucuggcuga

SEQ ID NO: 141387 - RNA, 22 nt, Homo sapiens
ugcauuaguaaguaauuuuaau

SEQ ID NO: 141388 - RNA, 22 nt, Homo sapiens
ugcauuagucuguucucacacu

SEQ ID NO: 141389 - RNA, 22 nt, Homo sapiens
ugcauugcacuugcaugagaua

SEQ ID NO: 141390 - RNA, 22 nt, Homo sapiens
ugccauugcacuccagccuggg

SEQ ID NO: 141391 - RNA, 22 nt, Homo sapiens
ugccugagccagguuuuaggag

SEQ ID NO: 141392 - RNA, 22 nt, Homo sapiens
ugccugagcccagcccuguagu

SEQ ID NO: 141393 - RNA, 22 nt, Homo sapiens
ugccugauacccucugucucuc

SEQ ID NO: 141394 - RNA, 22 nt, Homo sapiens
ugcuagaagaucacacacauca

SEQ ID NO: 141395 - RNA, 22 nt, Homo sapiens
ugcucaccugcugcucaccucc

SEQ ID NO: 141396 - RNA, 22 nt, Homo sapiens
ugcucaguuuaaaacuuuugag

SEQ ID NO: 141397 - RNA, 21 nt, Homo sapiens
ugcugcacuucuuuugcugug

SEQ ID NO: 141398 - RNA, 22 nt, Homo sapiens
ugcuugagacacauaugaauuu

SEQ ID NO: 141399 - RNA, 22 nt, Homo sapiens
uggaaaacaugcacauuggauu

SEQ ID NO: 141400 - RNA, 22 nt, Homo sapiens
uggaagacacauaccugauaac

SEQ ID NO: 141401 - RNA, 22 nt, Homo sapiens
uggaggacugcagaacugaggc

SEQ ID NO: 141402 - RNA, 22 nt, Homo sapiens
uggcaacaucuggggacauguu

SEQ ID NO: 141403 - RNA, 22 nt, Homo sapiens
uggcagaugagccgcgcuccaa

SEQ ID NO: 141404 - RNA, 22 nt, Homo sapiens
uggcagcugcuucaugggaugc

SEQ ID NO: 141405 - RNA, 22 nt, Homo sapiens
uggcaggugcacuggcuuugaa

SEQ ID NO: 141406 - RNA, 17 nt, Homo sapiens
uggcaugaggguguggg

SEQ ID NO: 141407 - RNA, 22 nt, Homo sapiens
ugggaucauuaugcauagugua

SEQ ID NO: 141408 - RNA, 22 nt, Homo sapiens
uggggugugagggagaaagaaa

SEQ ID NO: 141409 - RNA, 22 nt, Homo sapiens
uggguagagaaucaggaucuua

SEQ ID NO: 141410 - RNA, 20 nt, Homo sapiens
ugguccccugagucuggcuu

SEQ ID NO: 141411 - RNA, 22 nt, Homo sapiens
uggugcuuaaauaaggcuuuca

SEQ ID NO: 141412 - RNA, 20 nt, Homo sapiens
uguaacacauggagaacucu

SEQ ID NO: 141413 - RNA, 22 nt, Homo sapiens
uguaagcagcagagacuauccu

SEQ ID NO: 141414 - RNA, 22 nt, Homo sapiens
uguacuucaagauuaugguuua

SEQ ID NO: 141415 - RNA, 22 nt, Homo sapiens
uguauguaaagacaggauaaca

SEQ ID NO: 141416 - RNA, 22 nt, Homo sapiens
uguauguaauugaaguuaaguu

SEQ ID NO: 141417 - RNA, 22 nt, Homo sapiens
uguaugucugcucuuuggaacu

SEQ ID NO: 141418 - RNA, 22 nt, Homo sapiens
ugucaaaugcagugauauuuga

SEQ ID NO: 141419 - RNA, 22 nt, Homo sapiens
ugucagaaucuagaggcugcua

SEQ ID NO: 141420 - RNA, 22 nt, Homo sapiens
ugucauguaaagaguaaauggu

SEQ ID NO: 141421 - RNA, 22 nt, Homo sapiens
ugugagaaaugcagaaucucag

SEQ ID NO: 141422 - RNA, 22 nt, Homo sapiens
ugugcaguuuugagugaauuuc

SEQ ID NO: 141423 - RNA, 22 nt, Homo sapiens
ugugcauauaaguguguauaua

SEQ ID NO: 141424 - RNA, 22 nt, Homo sapiens
ugugccacugcacuccugccug

SEQ ID NO: 141425 - RNA, 22 nt, Homo sapiens
ugugguuuuuuucuccaauagg

SEQ ID NO: 141426 - RNA, 22 nt, Homo sapiens
ugugucacugaggguuagugua

SEQ ID NO: 141427 - RNA, 21 nt, Homo sapiens
uguuaacaugcagauuacugg

SEQ ID NO: 141428 - RNA, 22 nt, Homo sapiens
uguucuugagccuuuagaccua

SEQ ID NO: 141429 - RNA, 22 nt, Homo sapiens
uuacaccuguaauccagcacuu

SEQ ID NO: 141430 - RNA, 22 nt, Homo sapiens
uuacaguagaugaggguauaau

SEQ ID NO: 141431 - RNA, 22 nt, Homo sapiens
uuacaguaugaguaagaguucu

SEQ ID NO: 141432 - RNA, 18 nt, Homo sapiens
uuagguaggucuuugugu

SEQ ID NO: 141433 - RNA, 21 nt, Homo sapiens
uuauaguggcaugauuuauaa

SEQ ID NO: 141434 - RNA, 22 nt, Homo sapiens
uuaucucaguguuuguaaacaa

SEQ ID NO: 141435 - RNA, 22 nt, Homo sapiens
uucaagauggccccagugagcc

SEQ ID NO: 141436 - RNA, 22 nt, Homo sapiens
uucaagcugggcaaauaagggg

SEQ ID NO: 141437 - RNA, 22 nt, Homo sapiens
uucacacugggccuacucugug

SEQ ID NO: 141438 - RNA, 22 nt, Homo sapiens
uucauacaguggcugcacucca

SEQ ID NO: 141439 - RNA, 22 nt, Homo sapiens
uuccauguaguugaacgguuuu

SEQ ID NO: 141440 - RNA, 22 nt, Homo sapiens
uuccauguugauacgugaaguu

SEQ ID NO: 141441 - RNA, 22 nt, Homo sapiens
uucccuguaucuucugccaugu

SEQ ID NO: 141442 - RNA, 20 nt, Homo sapiens
uuccuuaggcauuggaagaa

SEQ ID NO: 141443 - RNA, 22 nt, Homo sapiens
uuccuugagagcuugauaucac

SEQ ID NO: 141444 - RNA, 21 nt, Homo sapiens
uucuacuccggcguuguuuuu

SEQ ID NO: 141445 - RNA, 22 nt, Homo sapiens
uucuagcaauggcagagugucu

SEQ ID NO: 141446 - RNA, 22 nt, Homo sapiens
uucuugcacuuaacugacauuc

SEQ ID NO: 141447 - RNA, 22 nt, Homo sapiens
uucuugcuguauccucacaugg

SEQ ID NO: 141448 - RNA, 22 nt, Homo sapiens
uugaagacuaccuaccauacuu

SEQ ID NO: 141449 - RNA, 22 nt, Homo sapiens
uugaauggaauguuggaacuau

SEQ ID NO: 141450 - RNA, 21 nt, Homo sapiens
uugagaagaauuagcucuucc

SEQ ID NO: 141451 - RNA, 22 nt, Homo sapiens
uugagacgaagucucacucuug

SEQ ID NO: 141452 - RNA, 21 nt, Homo sapiens
uugaguugaagcaaggaggga

SEQ ID NO: 141453 - RNA, 22 nt, Homo sapiens
uugauaguuuaauuaaugcuag

SEQ ID NO: 141454 - RNA, 22 nt, Homo sapiens
uugcagagaaauuucugguuua

SEQ ID NO: 141455 - RNA, 22 nt, Homo sapiens
uugcagugguuucacuggcaaa

SEQ ID NO: 141456 - RNA, 22 nt, Homo sapiens
uugcauguacguacagagagag

SEQ ID NO: 141457 - RNA, 22 nt, Homo sapiens
uuggaagacaaugcugauucuc

SEQ ID NO: 141458 - RNA, 22 nt, Homo sapiens
uuggagcccuaacucucaguac

SEQ ID NO: 141459 - RNA, 22 nt, Homo sapiens
aaggagugugauucuucaguuu

SEQ ID NO: 141460 - RNA, 22 nt, Homo sapiens
aaggaguguggugaucuugggc

SEQ ID NO: 141461 - RNA, 22 nt, Homo sapiens
gagcacauaugacauuuucuuc

SEQ ID NO: 141462 - RNA, 20 nt, Homo sapiens
gagcucaucuucuuuaccac

SEQ ID NO: 141463 - RNA, 22 nt, Homo sapiens
gagcugccuugccuaugcaaga

SEQ ID NO: 141464 - RNA, 22 nt, Homo sapiens
gagggcacugcuuuccuuucaa

SEQ ID NO: 141465 - RNA, 22 nt, Homo sapiens
gagguagugagcagcugaacua

SEQ ID NO: 141466 - RNA, 18 nt, Homo sapiens
gagguuagguucugacag

SEQ ID NO: 141467 - RNA, 22 nt, Homo sapiens
gagugcuguuagcccuggguuu

SEQ ID NO: 141468 - RNA, 22 nt, Homo sapiens
gauguaggugcauuugcacgug

SEQ ID NO: 141469 - RNA, 22 nt, Homo sapiens
gcaagaaucugggaguaaaauu

SEQ ID NO: 141470 - RNA, 22 nt, Homo sapiens
gcacccugucaaaauggaccaa

SEQ ID NO: 141471 - RNA, 22 nt, Homo sapiens
gcaggcaugacauuucacucuu

SEQ ID NO: 141472 - RNA, 22 nt, Homo sapiens
gcagugcaugacgguauauaua

SEQ ID NO: 141473 - RNA, 22 nt, Homo sapiens
gcuaaaugcaugaggcgaugug

SEQ ID NO: 141474 - RNA, 22 nt, Homo sapiens
gcugagguucaagaagguuaaa

SEQ ID NO: 141475 - RNA, 20 nt, Homo sapiens
gcugugcuuaauacacuuuc

SEQ ID NO: 141476 - RNA, 22 nt, Homo sapiens
gcuguugugaacuauacaucua

SEQ ID NO: 141477 - RNA, 22 nt, Homo sapiens
gcuuuggcauguagauguaugg

SEQ ID NO: 141478 - RNA, 22 nt, Homo sapiens
ggaaagaucagcuaaauguaag

SEQ ID NO: 141479 - RNA, 22 nt, Homo sapiens
ggaaagauguaauauuaucuaa

SEQ ID NO: 141480 - RNA, 17 nt, Homo sapiens
ggaaugaauuccagccc

SEQ ID NO: 141481 - RNA, 22 nt, Homo sapiens
ggagcucaucuagcauagaggu

SEQ ID NO: 141482 - RNA, 22 nt, Homo sapiens
ggagcugugauuugaguccaga

SEQ ID NO: 141483 - RNA, 22 nt, Homo sapiens
ggagugucccaaucucagcuca

SEQ ID NO: 141484 - RNA, 21 nt, Homo sapiens
ggcaagaaacacaaucaagua

SEQ ID NO: 141485 - RNA, 22 nt, Homo sapiens
ggccggguggccauggcugccc

SEQ ID NO: 141486 - RNA, 22 nt, Homo sapiens
ggccuguaaacuagagacccug

SEQ ID NO: 141487 - RNA, 22 nt, Homo sapiens
gggaugaagaagaauaguucgu

SEQ ID NO: 141488 - RNA, 22 nt, Homo sapiens
gggguaguuacuguuguucuuu

SEQ ID NO: 141489 - RNA, 22 nt, Homo sapiens
ggucugguguugaaauucuuca

SEQ ID NO: 141490 - RNA, 22 nt, Homo sapiens
ggugagguaguaagguacaaua

SEQ ID NO: 141491 - RNA, 22 nt, Homo sapiens
ggugaucauugucucuaguaug

SEQ ID NO: 141492 - RNA, 22 nt, Homo sapiens
guaagagcauguaguggcucua

SEQ ID NO: 141493 - RNA, 22 nt, Homo sapiens
guacaguaguaaaagugaauga

SEQ ID NO: 141494 - RNA, 22 nt, Homo sapiens
guacagugcucacaaugagagc

SEQ ID NO: 141495 - RNA, 22 nt, Homo sapiens
guagcagccacacuugauaacu

SEQ ID NO: 141496 - RNA, 22 nt, Homo sapiens
guagcagcuacuaaguugcugu

SEQ ID NO: 141497 - RNA, 22 nt, Homo sapiens
guauuugauuauagcaugcuua

SEQ ID NO: 141498 - RNA, 22 nt, Homo sapiens
gucaagauuuguaggacagaga

SEQ ID NO: 141499 - RNA, 22 nt, Homo sapiens
gucacaguggccagugauguuc

SEQ ID NO: 141500 - RNA, 22 nt, Homo sapiens
gucagauaauuugcauccaucu

SEQ ID NO: 141501 - RNA, 22 nt, Homo sapiens
gucagugucuuaacagagauua

SEQ ID NO: 141502 - RNA, 22 nt, Homo sapiens
gucauuguguggacauggagaa

SEQ ID NO: 141503 - RNA, 22 nt, Homo sapiens
gucucccaaccccugugcccag

SEQ ID NO: 141504 - RNA, 22 nt, Homo sapiens
gucucccagccuacaucuuucu

SEQ ID NO: 141505 - RNA, 22 nt, Homo sapiens
gucugguugacagcauguggcc

SEQ ID NO: 141506 - RNA, 22 nt, Homo sapiens
gucuuccagccuccaucuuucu

SEQ ID NO: 141507 - RNA, 22 nt, Homo sapiens
gugaaguuuuugugaggccuaa

SEQ ID NO: 141508 - RNA, 22 nt, Homo sapiens
gugaauugagagaacuguguua

SEQ ID NO: 141509 - RNA, 22 nt, Homo sapiens
gugacagaguaagacccuguau

SEQ ID NO: 141510 - RNA, 22 nt, Homo sapiens
gugacaguggagacuuacuuca

SEQ ID NO: 141511 - RNA, 22 nt, Homo sapiens
gugacuacaggccacaguuugg

SEQ ID NO: 141512 - RNA, 22 nt, Homo sapiens
gugagaccaauguacuaccuuc

SEQ ID NO: 141513 - RNA, 22 nt, Homo sapiens
gugcacaacgugcaaguuuguu

SEQ ID NO: 141514 - RNA, 22 nt, Homo sapiens
gugcacaacgugcagguuuguu

SEQ ID NO: 141515 - RNA, 22 nt, Homo sapiens
gugcaguguuugcauggaauca

SEQ ID NO: 141516 - RNA, 22 nt, Homo sapiens
gugcuuguguuaauauguagcu

SEQ ID NO: 141517 - RNA, 22 nt, Homo sapiens
guggcagugugaggauccugcu

SEQ ID NO: 141518 - RNA, 22 nt, Homo sapiens
guggguaaaucucuggggcucu

SEQ ID NO: 141519 - RNA, 22 nt, Homo sapiens
guggguaaaucucuguuugagg

SEQ ID NO: 141520 - RNA, 22 nt, Homo sapiens
gugguuuuuaaaguaccugugg

SEQ ID NO: 141521 - RNA, 22 nt, Homo sapiens
gugguuuuuagauuucuacagu

SEQ ID NO: 141522 - RNA, 22 nt, Homo sapiens
guguauguuguccauggaugcg

SEQ ID NO: 141523 - RNA, 22 nt, Homo sapiens
guguccucgaguacacaucagg

SEQ ID NO: 141524 - RNA, 18 nt, Homo sapiens
gugucugguuaugggagu

SEQ ID NO: 141525 - RNA, 19 nt, Homo sapiens
gugugcauaucacagagca

SEQ ID NO: 141526 - RNA, 22 nt, Homo sapiens
gugugcauaugucuuuauagua

SEQ ID NO: 141527 - RNA, 22 nt, Homo sapiens
guguguaaauggcagugagcuc

SEQ ID NO: 141528 - RNA, 22 nt, Homo sapiens
guuauuguccauuuauuuagca

SEQ ID NO: 141529 - RNA, 22 nt, Homo sapiens
guucaucagggauauuggcuua

SEQ ID NO: 141530 - RNA, 22 nt, Homo sapiens
uaacaguguauuccuuuggaca

SEQ ID NO: 141531 - RNA, 20 nt, Homo sapiens
uaaggcacugugcuuuuagg

SEQ ID NO: 141532 - RNA, 22 nt, Homo sapiens
uaagggacgcccccuucucucu

SEQ ID NO: 141533 - RNA, 22 nt, Homo sapiens
uaaugugaauagugcuguaaug

SEQ ID NO: 141534 - RNA, 22 nt, Homo sapiens
uaauugcaguucuguguuauau

SEQ ID NO: 141535 - RNA, 22 nt, Homo sapiens
uacacaugugaguucuuuucua

SEQ ID NO: 141536 - RNA, 23 nt, Homo sapiens
uacagcugcagaaucaggcuaag

SEQ ID NO: 141537 - RNA, 22 nt, Homo sapiens
uaccuuugucaguuacucaccu

SEQ ID NO: 141538 - RNA, 22 nt, Homo sapiens
uacuauugcaucggugauuagg

SEQ ID NO: 141539 - RNA, 22 nt, Homo sapiens
uacugguuuuauauauuucucc

SEQ ID NO: 141540 - RNA, 22 nt, Homo sapiens
uagaaucuaacucgcaugaaaa

SEQ ID NO: 141541 - RNA, 21 nt, Homo sapiens
uagagagcaauaccuccagag

SEQ ID NO: 141542 - RNA, 22 nt, Homo sapiens
uagagcaugugccauacguaca

SEQ ID NO: 141543 - RNA, 21 nt, Homo sapiens
uagagcuuggcacagaguaga

SEQ ID NO: 141544 - RNA, 22 nt, Homo sapiens
uagaucauauacuugccaugac

SEQ ID NO: 141545 - RNA, 22 nt, Homo sapiens
uagccgggugugguggaacucc

SEQ ID NO: 141546 - RNA, 22 nt, Homo sapiens
uagucccauaugauuuagugaa

SEQ ID NO: 141547 - RNA, 22 nt, Homo sapiens
uauaacaaugcaagaauggccu

SEQ ID NO: 141548 - RNA, 22 nt, Homo sapiens
uaucacacgccuugcuucauuu

SEQ ID NO: 141549 - RNA, 21 nt, Homo sapiens
uaucacauuggugauuaaguu

SEQ ID NO: 141550 - RNA, 21 nt, Homo sapiens
uaucauggccauccucuucuc

SEQ ID NO: 141551 - RNA, 21 nt, Homo sapiens
uaucccagucacaucuaccca

SEQ ID NO: 141552 - RNA, 22 nt, Homo sapiens
uaucucauccuccuugauccca

SEQ ID NO: 141553 - RNA, 22 nt, Homo sapiens
uaugcacaugcaugcuugaaua

SEQ ID NO: 141554 - RNA, 22 nt, Homo sapiens
uauuugauuaacaagagccuaa

SEQ ID NO: 141555 - RNA, 22 nt, Homo sapiens
ucaaaugauucuccugccucag

SEQ ID NO: 141556 - RNA, 17 nt, Homo sapiens
ucaaaugcucccaguga

SEQ ID NO: 141557 - RNA, 22 nt, Homo sapiens
ucaagugauucuugugccuuag

SEQ ID NO: 141558 - RNA, 22 nt, Homo sapiens
ucacacugaaacuaggguguga

SEQ ID NO: 141559 - RNA, 22 nt, Homo sapiens
ucacauaguuuucgggaccuug

SEQ ID NO: 141560 - RNA, 22 nt, Homo sapiens
ucacauguguaaauugguguaa

SEQ ID NO: 141561 - RNA, 19 nt, Homo sapiens
ucaccaguacacaauacaa

SEQ ID NO: 141562 - RNA, 22 nt, Homo sapiens
ucacugaggucugagcuuuaug

SEQ ID NO: 141563 - RNA, 22 nt, Homo sapiens
ucacugcacuccagccuuuaug

SEQ ID NO: 141564 - RNA, 22 nt, Homo sapiens
ucacugcacucuccgccuugcg

SEQ ID NO: 141565 - RNA, 22 nt, Homo sapiens
ucagauacuggugacaugaaug

SEQ ID NO: 141566 - RNA, 22 nt, Homo sapiens
ucaguguuuggaaucucaauuu

SEQ ID NO: 141567 - RNA, 21 nt, Homo sapiens
ucaucaagcuguagacaugau

SEQ ID NO: 141568 - RNA, 22 nt, Homo sapiens
ucauccauacaguuagcaaagg

SEQ ID NO: 141569 - RNA, 22 nt, Homo sapiens
ucauggggugcuuugcuagauu

SEQ ID NO: 141570 - RNA, 22 nt, Homo sapiens
ucauguguugcacugaggaccu

SEQ ID NO: 141571 - RNA, 22 nt, Homo sapiens
uccaguacaggucucucauuuc

SEQ ID NO: 141572 - RNA, 22 nt, Homo sapiens
uccaguuguuauuuuuauaaag

SEQ ID NO: 141573 - RNA, 22 nt, Homo sapiens
ucccuuucuggaguuucccaag

SEQ ID NO: 141574 - RNA, 22 nt, Homo sapiens
uccuucacucuacaucuuuguu

SEQ ID NO: 141575 - RNA, 22 nt, Homo sapiens
uccuuuggguagcuguucagau

SEQ ID NO: 141576 - RNA, 22 nt, Homo sapiens
ucgcaccauugcacuccagcca

SEQ ID NO: 141577 - RNA, 22 nt, Homo sapiens
ucucauggagguagagaguaaa

SEQ ID NO: 141578 - RNA, 22 nt, Homo sapiens
ucugagcaauagauguggauau

SEQ ID NO: 141579 - RNA, 22 nt, Homo sapiens
ucugcauaucaugcagaacuau

SEQ ID NO: 141580 - RNA, 22 nt, Homo sapiens
ucuggccuacaaguaauuuuau

SEQ ID NO: 141581 - RNA, 22 nt, Homo sapiens
ucuguaacauccaccuucuggg

SEQ ID NO: 141582 - RNA, 22 nt, Homo sapiens
ucugucacugguggacgaucac

SEQ ID NO: 141583 - RNA, 22 nt, Homo sapiens
ucugucuugugguuugagugcc

SEQ ID NO: 141584 - RNA, 22 nt, Homo sapiens
ucugugcauuacacuuuucuca

SEQ ID NO: 141585 - RNA, 22 nt, Homo sapiens
ucuguggucagaguccuuggcc

SEQ ID NO: 141586 - RNA, 22 nt, Homo sapiens
ucuuggccaugaauggcaaggc

SEQ ID NO: 141587 - RNA, 22 nt, Homo sapiens
ucuuugauguucugaaagaugg

SEQ ID NO: 141588 - RNA, 22 nt, Homo sapiens
ucuuuguuggaguccaaggaua

SEQ ID NO: 141589 - RNA, 22 nt, Homo sapiens
ugaaaaguuguugaaggcuuca

SEQ ID NO: 141590 - RNA, 22 nt, Homo sapiens
ugaaaguuauauugugaaauuc

SEQ ID NO: 141591 - RNA, 22 nt, Homo sapiens
ugaagagucuaaaucugucuuc

SEQ ID NO: 141592 - RNA, 22 nt, Homo sapiens
ugaagcuaacuugauugugaug

SEQ ID NO: 141593 - RNA, 18 nt, Homo sapiens
ugacagcacaugugggga

SEQ ID NO: 141594 - RNA, 22 nt, Homo sapiens
ugacuucauuuuuggccaugag

SEQ ID NO: 141595 - RNA, 22 nt, Homo sapiens
ugagaacugccuguauuuaucu

SEQ ID NO: 141596 - RNA, 22 nt, Homo sapiens
ugagaacuuugucuuuuacucu

SEQ ID NO: 141597 - RNA, 22 nt, Homo sapiens
ugagaggugaauggcaggcuca

SEQ ID NO: 141598 - RNA, 22 nt, Homo sapiens
ugagaguagggguugggauugg

SEQ ID NO: 141599 - RNA, 22 nt, Homo sapiens
ugagcacagcgugugggagagc

SEQ ID NO: 141600 - RNA, 22 nt, Homo sapiens
ugaggcuaggauaggcugauuc

SEQ ID NO: 141601 - RNA, 22 nt, Homo sapiens
ugagguaucauugcccaggcug

SEQ ID NO: 141602 - RNA, 22 nt, Homo sapiens
ugagguguuauccagaguucuu

SEQ ID NO: 141603 - RNA, 22 nt, Homo sapiens
ugagguugaaggacauuuuuau

SEQ ID NO: 141604 - RNA, 22 nt, Homo sapiens
ugagucauuuccuuaugcuacu

SEQ ID NO: 141605 - RNA, 22 nt, Homo sapiens
ugagugaggcugggcagucccu

SEQ ID NO: 141606 - RNA, 22 nt, Homo sapiens
ugaguuguugcauucuuggugu

SEQ ID NO: 141607 - RNA, 22 nt, Homo sapiens
ugaucucagcucacugguugaa

SEQ ID NO: 141608 - RNA, 22 nt, Homo sapiens
ugauggcauuucauguuuguaa

SEQ ID NO: 141609 - RNA, 22 nt, Homo sapiens
ugauggcauuuggaguugggac

SEQ ID NO: 141610 - RNA, 22 nt, Homo sapiens
ugaugucuugcaggcacgagau

SEQ ID NO: 141611 - RNA, 19 nt, Homo sapiens
ugcaaagucuuuuccuauu

SEQ ID NO: 141612 - RNA, 22 nt, Homo sapiens
ugcaagacacuguccugggcau

SEQ ID NO: 141613 - RNA, 22 nt, Homo sapiens
ugcaaucauuuggaggagaaga

SEQ ID NO: 141614 - RNA, 18 nt, Homo sapiens
ugcagcuuugugauuggc

SEQ ID NO: 141615 - RNA, 22 nt, Homo sapiens
ugcauauguugagaugcauauu

SEQ ID NO: 141616 - RNA, 22 nt, Homo sapiens
ugcauuguuccgaauguguccu

SEQ ID NO: 141617 - RNA, 22 nt, Homo sapiens
ugcauuguuuagaaacacuggg

SEQ ID NO: 141618 - RNA, 22 nt, Homo sapiens
ugccaacaugccuggcuguuuu

SEQ ID NO: 141619 - RNA, 22 nt, Homo sapiens
ugccuggagagcuccuacauau

SEQ ID NO: 141620 - RNA, 21 nt, Homo sapiens
ugcuauguuguccaggcuggc

SEQ ID NO: 141621 - RNA, 22 nt, Homo sapiens
ugcuggugucaucaaggcuuug

SEQ ID NO: 141622 - RNA, 22 nt, Homo sapiens
uggacuguaaauuggggacucu

SEQ ID NO: 141623 - RNA, 22 nt, Homo sapiens
uggacuguaauuuuauaggcau

SEQ ID NO: 141624 - RNA, 22 nt, Homo sapiens
uggcagauaggauacaggacua

SEQ ID NO: 141625 - RNA, 22 nt, Homo sapiens
uggcaguuucacauggcucaac

SEQ ID NO: 141626 - RNA, 20 nt, Homo sapiens
uggcaugaaauuuuccaagc

SEQ ID NO: 141627 - RNA, 20 nt, Homo sapiens
uggcuucuuaauugcaggca

SEQ ID NO: 141628 - RNA, 22 nt, Homo sapiens
ugggaugaauacaaugggauca

SEQ ID NO: 141629 - RNA, 23 nt, Homo sapiens
uggguucauucuugaagucagug

SEQ ID NO: 141630 - RNA, 22 nt, Homo sapiens
uggucaccugaauuaugcaugu

SEQ ID NO: 141631 - RNA, 20 nt, Homo sapiens
uggucaccuucaggagguuc

SEQ ID NO: 141632 - RNA, 22 nt, Homo sapiens
uggucaccuucuugcucugucu

SEQ ID NO: 141633 - RNA, 22 nt, Homo sapiens
ugguccccaauacuucuauaga

SEQ ID NO: 141634 - RNA, 19 nt, Homo sapiens
uggucccccgcaaucucau

SEQ ID NO: 141635 - RNA, 22 nt, Homo sapiens
uggugcccuguccuucuguggc

SEQ ID NO: 141636 - RNA, 22 nt, Homo sapiens
ugguuguuuuaaaugucgucug

SEQ ID NO: 141637 - RNA, 22 nt, Homo sapiens
uguaagcauugggcaugcaguc

SEQ ID NO: 141638 - RNA, 22 nt, Homo sapiens
uguaugaguuguuuauaaauuu

SEQ ID NO: 141639 - RNA, 22 nt, Homo sapiens
uguauguuguaagacuuagacc

SEQ ID NO: 141640 - RNA, 22 nt, Homo sapiens
ugucaccuugcucauccucgga

SEQ ID NO: 141641 - RNA, 22 nt, Homo sapiens
uguccuguaggaggcagaacaa

SEQ ID NO: 141642 - RNA, 22 nt, Homo sapiens
ugucuuguagacaauguauagu

SEQ ID NO: 141643 - RNA, 22 nt, Homo sapiens
ugugagacugacagggcagggu

SEQ ID NO: 141644 - RNA, 22 nt, Homo sapiens
ugugagacugguucugaaccca

SEQ ID NO: 141645 - RNA, 20 nt, Homo sapiens
ugugagacugguuuugaacu

SEQ ID NO: 141646 - RNA, 19 nt, Homo sapiens
ugugagcauuagcauuuag

SEQ ID NO: 141647 - RNA, 22 nt, Homo sapiens
ugugcacaauguacagguuagu

SEQ ID NO: 141648 - RNA, 22 nt, Homo sapiens
ugugcaguuuuagcguauuuua

SEQ ID NO: 141649 - RNA, 22 nt, Homo sapiens
ugugccacugcacucuggccug

SEQ ID NO: 141650 - RNA, 22 nt, Homo sapiens
ugugccacuguucuguaaagug

SEQ ID NO: 141651 - RNA, 22 nt, Homo sapiens
ugugcuauguuauucacauggg

SEQ ID NO: 141652 - RNA, 22 nt, Homo sapiens
uguggcuuuacagcaugguuca

SEQ ID NO: 141653 - RNA, 22 nt, Homo sapiens
ugugguuuuaguaaaacuaugu

SEQ ID NO: 141654 - RNA, 22 nt, Homo sapiens
ugugguuuuucacauuuagaga

SEQ ID NO: 141655 - RNA, 22 nt, Homo sapiens
ugugucacugcacuccagccug

SEQ ID NO: 141656 - RNA, 22 nt, Homo sapiens
ugugucuugaauuuuguaugua

SEQ ID NO: 141657 - RNA, 21 nt, Homo sapiens
uuaaguaauuacccaacucuc

SEQ ID NO: 141658 - RNA, 22 nt, Homo sapiens
aaaguggacuaagugaauauga

SEQ ID NO: 141659 - RNA, 22 nt, Homo sapiens
aaaugcaccacucuggugcagg

SEQ ID NO: 141660 - RNA, 22 nt, Homo sapiens
aaaugguguuaguagaucuuua

SEQ ID NO: 141661 - RNA, 22 nt, Homo sapiens
aacaggguguuugcaguuucuu

SEQ ID NO: 141662 - RNA, 22 nt, Homo sapiens
aacagugccugucauuuaguag

SEQ ID NO: 141663 - RNA, 22 nt, Homo sapiens
aacuggcauaugaacuuguucu

SEQ ID NO: 141664 - RNA, 22 nt, Homo sapiens
aagcuggagugcaguggugcga

SEQ ID NO: 141665 - RNA, 22 nt, Homo sapiens
aagucaaggagagaagcuucag

SEQ ID NO: 141666 - RNA, 22 nt, Homo sapiens
aauacuggcacugaagaccaug

SEQ ID NO: 141667 - RNA, 22 nt, Homo sapiens
aaucacuuuggcaccaaccuaa

SEQ ID NO: 141668 - RNA, 22 nt, Homo sapiens
aauugcauugaauuuguagcuu

SEQ ID NO: 141669 - RNA, 22 nt, Homo sapiens
acaaagcgcuucucuuuagagu

SEQ ID NO: 141670 - RNA, 20 nt, Homo sapiens
acacuggcuuugagauuuag

SEQ ID NO: 141671 - RNA, 22 nt, Homo sapiens
acaguacuguuguuugcugcca

SEQ ID NO: 141672 - RNA, 22 nt, Homo sapiens
acaguagcgcaaucucggcuca

SEQ ID NO: 141673 - RNA, 22 nt, Homo sapiens
acagugacagaaagcugauuau

SEQ ID NO: 141674 - RNA, 22 nt, Homo sapiens
acaguggugcgaucucggcuca

SEQ ID NO: 141675 - RNA, 22 nt, Homo sapiens
augaagugcaugauaguugguu

SEQ ID NO: 141676 - RNA, 22 nt, Homo sapiens
augaggugggagaaucacuuga

SEQ ID NO: 141677 - RNA, 20 nt, Homo sapiens
augagguguaugacacugaa

SEQ ID NO: 141678 - RNA, 22 nt, Homo sapiens
auggcagcugacacuuccgucu

SEQ ID NO: 141679 - RNA, 22 nt, Homo sapiens
auggcuguuucugcaaugucua

SEQ ID NO: 141680 - RNA, 22 nt, Homo sapiens
augggaaaaucagaaggccugg

SEQ ID NO: 141681 - RNA, 22 nt, Homo sapiens
auggucccuguuccaugcuccu

SEQ ID NO: 141682 - RNA, 21 nt, Homo sapiens
auggugagaaaguagugucaa

SEQ ID NO: 141683 - RNA, 22 nt, Homo sapiens
auguccaugagcacauguauca

SEQ ID NO: 141684 - RNA, 22 nt, Homo sapiens
augugcacaacgugcagguuug

SEQ ID NO: 141685 - RNA, 22 nt, Homo sapiens
auguggugguagccaggacagg

SEQ ID NO: 141686 - RNA, 22 nt, Homo sapiens
augugugaaucccagaaccugu

SEQ ID NO: 141687 - RNA, 18 nt, Homo sapiens
auguuauguuuguagaag

SEQ ID NO: 141688 - RNA, 22 nt, Homo sapiens
auuaaauguuggacguauacau

SEQ ID NO: 141689 - RNA, 20 nt, Homo sapiens
auucauggaggagcaauugg

SEQ ID NO: 141690 - RNA, 22 nt, Homo sapiens
auuccaguuguaagguuuuuca

SEQ ID NO: 141691 - RNA, 22 nt, Homo sapiens
auucccuuagcugccucagccu

SEQ ID NO: 141692 - RNA, 22 nt, Homo sapiens
auuccuuaggcccuuugguuag

SEQ ID NO: 141693 - RNA, 22 nt, Homo sapiens
auugcacaucugcacuacagcc

SEQ ID NO: 141694 - RNA, 22 nt, Homo sapiens
auugcucaaaucaguacuugag

SEQ ID NO: 141695 - RNA, 22 nt, Homo sapiens
auuguguuugaaugaggcucca

SEQ ID NO: 141696 - RNA, 22 nt, Homo sapiens
auuguucuuacaugcugucauc

SEQ ID NO: 141697 - RNA, 22 nt, Homo sapiens
auuuggccuuuguaugcaguau

SEQ ID NO: 141698 - RNA, 22 nt, Homo sapiens
auuuuuggauauagggaaggau

SEQ ID NO: 141699 - RNA, 22 nt, Homo sapiens
caaaggugcuuuccagguccaa

SEQ ID NO: 141700 - RNA, 22 nt, Homo sapiens
caaagucuauucuacccuuacc

SEQ ID NO: 141701 - RNA, 22 nt, Homo sapiens
caaagucuucucauuaugucuu

SEQ ID NO: 141702 - RNA, 22 nt, Homo sapiens
caaauugcuuguggaggauaau

SEQ ID NO: 141703 - RNA, 22 nt, Homo sapiens
caaugugcuuggggcacaugag

SEQ ID NO: 141704 - RNA, 22 nt, Homo sapiens
cacaaaguagauuagucuucca

SEQ ID NO: 141705 - RNA, 22 nt, Homo sapiens
caccugagcgggaugcucgccu

SEQ ID NO: 141706 - RNA, 22 nt, Homo sapiens
caccuguacauggcaguguccu

SEQ ID NO: 141707 - RNA, 22 nt, Homo sapiens
cacuaggcuggagugcaguggc

SEQ ID NO: 141708 - RNA, 22 nt, Homo sapiens
cacugcacuccagccuaagagg

SEQ ID NO: 141709 - RNA, 22 nt, Homo sapiens
cacugcacuccagucccgucuc

SEQ ID NO: 141710 - RNA, 22 nt, Homo sapiens
cacugcauccuccauauccugg

SEQ ID NO: 141711 - RNA, 22 nt, Homo sapiens
cacuuugguucaccugaguuuc

SEQ ID NO: 141712 - RNA, 22 nt, Homo sapiens
cagaaguauugguaugcucugu

SEQ ID NO: 141713 - RNA, 22 nt, Homo sapiens
cagagaacugaguuauuuucuu

SEQ ID NO: 141714 - RNA, 22 nt, Homo sapiens
cagccggguggcuccuagggua

SEQ ID NO: 141715 - RNA, 22 nt, Homo sapiens
caguaguagccccuuagaugga

SEQ ID NO: 141716 - RNA, 22 nt, Homo sapiens
cagugguuuucaacccugguug

SEQ ID NO: 141717 - RNA, 22 nt, Homo sapiens
uuguagcaaauauauuuuggaa

SEQ ID NO: 141718 - RNA, 22 nt, Homo sapiens
uuguccuggagguucuugcaag

SEQ ID NO: 141719 - RNA, 22 nt, Homo sapiens
uugugaucauugucaaauagug

SEQ ID NO: 141720 - RNA, 22 nt, Homo sapiens
uugugauugagugauccuuguu

SEQ ID NO: 141721 - RNA, 22 nt, Homo sapiens
uugugcacauguacccuagaac

SEQ ID NO: 141722 - RNA, 22 nt, Homo sapiens
uugugcaugaugcauacauggu

SEQ ID NO: 141723 - RNA, 22 nt, Homo sapiens
uugugcuuaaugaguguaaggu

SEQ ID NO: 141724 - RNA, 22 nt, Homo sapiens
uuguguccccacucaaauuaca

SEQ ID NO: 141725 - RNA, 22 nt, Homo sapiens
uuuagguuacauauaauccaaa

SEQ ID NO: 141726 - RNA, 19 nt, Homo sapiens
uuucacacucgccuacuuc

SEQ ID NO: 141727 - RNA, 22 nt, Homo sapiens
uuucaucagccagggucagucu

SEQ ID NO: 141728 - RNA, 22 nt, Homo sapiens
uuucgugucuggucugugaugg

SEQ ID NO: 141729 - RNA, 17 nt, Homo sapiens
uuucucagcccucuucu

SEQ ID NO: 141730 - RNA, 22 nt, Homo sapiens
uuucugugguccucuugaaggu

SEQ ID NO: 141731 - RNA, 22 nt, Homo sapiens
uuuggaagaugccacuguauca

SEQ ID NO: 141732 - RNA, 20 nt, Homo sapiens
uuuggcacugagugguauaa

SEQ ID NO: 141733 - RNA, 22 nt, Homo sapiens
uuugugacuugcuucucagaau

SEQ ID NO: 141734 - RNA, 18 nt, Homo sapiens
uuugugcuccacaaagga

SEQ ID NO: 141735 - RNA, 23 nt, Homo sapiens
uuuugcaauaagucacuggaaua

SEQ ID NO: 141736 - RNA, 22 nt, Homo sapiens
uuuuugugguauauugcaacaa

SEQ ID NO: 141737 - RNA, 22 nt, Homo sapiens
aaagugcacuuggaagagggcc

SEQ ID NO: 141738 - RNA, 19 nt, Homo sapiens
aaaguguuuuaaagaggau

SEQ ID NO: 141739 - RNA, 22 nt, Homo sapiens
aaaugcacaaagauuuugcacu

SEQ ID NO: 141740 - RNA, 22 nt, Homo sapiens
aaaugcacagaaaggaugugga

SEQ ID NO: 141741 - RNA, 22 nt, Homo sapiens
aaaugcacgcuacccagcuaga

SEQ ID NO: 141742 - RNA, 20 nt, Homo sapiens
aacaguguguaaguuuccuu

SEQ ID NO: 141743 - RNA, 22 nt, Homo sapiens
aacaguguuuuggguuuucugg

SEQ ID NO: 141744 - RNA, 22 nt, Homo sapiens
aacugggcaagcauuacauggu

SEQ ID NO: 141745 - RNA, 22 nt, Homo sapiens
aagagcauuauuuaguaauuuc

SEQ ID NO: 141746 - RNA, 22 nt, Homo sapiens
aagagcauuggauggggagauu

SEQ ID NO: 141747 - RNA, 22 nt, Homo sapiens
aagcaggugucugugucuguaa

SEQ ID NO: 141748 - RNA, 22 nt, Homo sapiens
aagccagugugacaggaaacuu

SEQ ID NO: 141749 - RNA, 22 nt, Homo sapiens
aagcucauugagaucuauggcu

SEQ ID NO: 141750 - RNA, 22 nt, Homo sapiens
aagcucuuguugaaucuuguca

SEQ ID NO: 141751 - RNA, 22 nt, Homo sapiens
aagcugcauuuucuagaugcuu

SEQ ID NO: 141752 - RNA, 22 nt, Homo sapiens
aagcugccuugugaaggcauuc

SEQ ID NO: 141753 - RNA, 22 nt, Homo sapiens
aagcuggagugcaguggugcaa

SEQ ID NO: 141754 - RNA, 22 nt, Homo sapiens
aagcuguguguaagcucucaca

SEQ ID NO: 141755 - RNA, 19 nt, Homo sapiens
aaguacuugucuuuugaag

SEQ ID NO: 141756 - RNA, 22 nt, Homo sapiens
aagugagaugcaguggaguucc

SEQ ID NO: 141757 - RNA, 19 nt, Homo sapiens
aagugguuuaaacuuguau

SEQ ID NO: 141758 - RNA, 22 nt, Homo sapiens
aagugguuuuaaucuggugagu

SEQ ID NO: 141759 - RNA, 22 nt, Homo sapiens
aaguugcuuuagguaagucaau

SEQ ID NO: 141760 - RNA, 22 nt, Homo sapiens
aauacugugauaucgagcgauu

SEQ ID NO: 141761 - RNA, 22 nt, Homo sapiens
aauccaugugcuuuaccauuuu

SEQ ID NO: 141762 - RNA, 22 nt, Homo sapiens
aauccugucuugccauccaaua

SEQ ID NO: 141763 - RNA, 22 nt, Homo sapiens
aaugacuaagaugguacauuuu

SEQ ID NO: 141764 - RNA, 22 nt, Homo sapiens
aaugguguuuccguuaagcuga

SEQ ID NO: 141765 - RNA, 22 nt, Homo sapiens
acaccuguggucccaguaacuu

SEQ ID NO: 141766 - RNA, 22 nt, Homo sapiens
acacuggaggagagcuguugcu

SEQ ID NO: 141767 - RNA, 22 nt, Homo sapiens
acacugucugaugaaaguaguu

SEQ ID NO: 141768 - RNA, 18 nt, Homo sapiens
acagugcugucacugcuu

SEQ ID NO: 141769 - RNA, 22 nt, Homo sapiens
acagugcuguuguguuuucacg

SEQ ID NO: 141770 - RNA, 22 nt, Homo sapiens
acaucauugggggcuacaggug

SEQ ID NO: 141771 - RNA, 18 nt, Homo sapiens
acaucccaugcuggggug

SEQ ID NO: 141772 - RNA, 22 nt, Homo sapiens
accagucucagguaugucuuua

SEQ ID NO: 141773 - RNA, 21 nt, Homo sapiens
acccccacaccuccuuaguuc

SEQ ID NO: 141774 - RNA, 22 nt, Homo sapiens
acccuggagagugcuguaguaa

SEQ ID NO: 141775 - RNA, 22 nt, Homo sapiens
acccugucacucccaucaauuu

SEQ ID NO: 141776 - RNA, 22 nt, Homo sapiens
acccugucagcuggccugggca

SEQ ID NO: 141777 - RNA, 22 nt, Homo sapiens
acgugcaugcacacacaugcgc

SEQ ID NO: 141778 - RNA, 22 nt, Homo sapiens
acugcacuccaguuugggcagc

SEQ ID NO: 141779 - RNA, 22 nt, Homo sapiens
acuggaguuuguucaagaaaua

SEQ ID NO: 141780 - RNA, 22 nt, Homo sapiens
agacccuguauguguuuaguuu

SEQ ID NO: 141781 - RNA, 22 nt, Homo sapiens
agaguaguuuauuaugcuaagg

SEQ ID NO: 141782 - RNA, 22 nt, Homo sapiens
agaguaguuucuauauucuuca

SEQ ID NO: 141783 - RNA, 22 nt, Homo sapiens
agagugcaaagguuggggcugg

SEQ ID NO: 141784 - RNA, 22 nt, Homo sapiens
agaucacagucuuugguuuuag

SEQ ID NO: 141785 - RNA, 22 nt, Homo sapiens
agaugguguuggcugaguguau

SEQ ID NO: 141786 - RNA, 22 nt, Homo sapiens
agcagcauauuuuuauaaugua

SEQ ID NO: 141787 - RNA, 22 nt, Homo sapiens
agcagcauuaguggaaucuugu

SEQ ID NO: 141788 - RNA, 22 nt, Homo sapiens
agcagcauuaugauauaucuua

SEQ ID NO: 141789 - RNA, 22 nt, Homo sapiens
agcagcuuugaucugaaugauu

SEQ ID NO: 141790 - RNA, 22 nt, Homo sapiens
agccccauuuguugaaaagacg

SEQ ID NO: 141791 - RNA, 22 nt, Homo sapiens
agcugccagucuuguaaggccu

SEQ ID NO: 141792 - RNA, 22 nt, Homo sapiens
agcugugucuucuuaaagauuu

SEQ ID NO: 141793 - RNA, 22 nt, Homo sapiens
agcuguguugucugaagucaga

SEQ ID NO: 141794 - RNA, 22 nt, Homo sapiens
agcuugugcuguaugaagggcc

SEQ ID NO: 141795 - RNA, 21 nt, Homo sapiens
aggagcauucaugacgagguu

SEQ ID NO: 141796 - RNA, 22 nt, Homo sapiens
aggcaggugaaagauaguuuua

SEQ ID NO: 141797 - RNA, 22 nt, Homo sapiens
aggucaccucaggaaauacuga

SEQ ID NO: 141798 - RNA, 21 nt, Homo sapiens
aggugucuuggguucccuggc

SEQ ID NO: 141799 - RNA, 22 nt, Homo sapiens
aguaaacuucagaguucuuccu

SEQ ID NO: 141800 - RNA, 22 nt, Homo sapiens
aguaacauuucuaguagagagu

SEQ ID NO: 141801 - RNA, 22 nt, Homo sapiens
aguacugucugguuaccugaca

SEQ ID NO: 141802 - RNA, 22 nt, Homo sapiens
agucacaugcauuuucuucaau

SEQ ID NO: 141803 - RNA, 22 nt, Homo sapiens
agucacaugccagcacacccag

SEQ ID NO: 141804 - RNA, 22 nt, Homo sapiens
agucugguguucucacacuagu

SEQ ID NO: 141805 - RNA, 19 nt, Homo sapiens
agugagccaagauccuacc

SEQ ID NO: 141806 - RNA, 22 nt, Homo sapiens
agugcaguggcacaaucuuggc

SEQ ID NO: 141807 - RNA, 22 nt, Homo sapiens
agugcauuuguucugugucagg

SEQ ID NO: 141808 - RNA, 23 nt, Homo sapiens
aguggucuccugggcccagcugu

SEQ ID NO: 141809 - RNA, 22 nt, Homo sapiens
aguguuuuuaucaugaaagggu

SEQ ID NO: 141810 - RNA, 21 nt, Homo sapiens
aguucacauggcuccuguguu

SEQ ID NO: 141811 - RNA, 22 nt, Homo sapiens
auaaaguguuuaguauaggcaa

SEQ ID NO: 141812 - RNA, 22 nt, Homo sapiens
auaacauggaguuugucauuua

SEQ ID NO: 141813 - RNA, 22 nt, Homo sapiens
auacaguaucuucuggcaagca

SEQ ID NO: 141814 - RNA, 22 nt, Homo sapiens
auagaggacugaggugaucuuu

SEQ ID NO: 141815 - RNA, 22 nt, Homo sapiens
auagcagcagcuaguagugaua

SEQ ID NO: 141816 - RNA, 22 nt, Homo sapiens
auaggacuauugugaggauuaa

SEQ ID NO: 141817 - RNA, 22 nt, Homo sapiens
aucaaaguuucccagaaguugu

SEQ ID NO: 141818 - RNA, 22 nt, Homo sapiens
aucaaaugcuggcagagugccu

SEQ ID NO: 141819 - RNA, 22 nt, Homo sapiens
aucacagguacuauggcugaca

SEQ ID NO: 141820 - RNA, 22 nt, Homo sapiens
aucacauuuauaguggcacgca

SEQ ID NO: 141821 - RNA, 22 nt, Homo sapiens
aucaccugagcaguauacacug

SEQ ID NO: 141822 - RNA, 22 nt, Homo sapiens
aucacuuucuauuucugugcca

SEQ ID NO: 141823 - RNA, 22 nt, Homo sapiens
aucauuaguuguggaauucuug

SEQ ID NO: 141824 - RNA, 22 nt, Homo sapiens
auccauguggauaaauguguau

SEQ ID NO: 141825 - RNA, 22 nt, Homo sapiens
auccucugagagaguuucauaa

SEQ ID NO: 141826 - RNA, 22 nt, Homo sapiens
aucuacagccagucugguuugu

SEQ ID NO: 141827 - RNA, 22 nt, Homo sapiens
aucugcaaauaaugaagauugg

SEQ ID NO: 141828 - RNA, 22 nt, Homo sapiens
augaagucguuacuaccaauug

SEQ ID NO: 141829 - RNA, 22 nt, Homo sapiens
augauagguuuagguuuagaca

SEQ ID NO: 141830 - RNA, 22 nt, Homo sapiens
augcacuuggcaggaugauucc

SEQ ID NO: 141831 - RNA, 19 nt, Homo sapiens
augcugguguugcucaaac

SEQ ID NO: 141832 - RNA, 21 nt, Homo sapiens
auggaaagacugccucuucaa

SEQ ID NO: 141833 - RNA, 22 nt, Homo sapiens
auggagagaauuauucucucag

SEQ ID NO: 141834 - RNA, 22 nt, Homo sapiens
gcagugugauguuuuaaucuau

SEQ ID NO: 141835 - RNA, 22 nt, Homo sapiens
gcagugugugaggaauuugggu

SEQ ID NO: 141836 - RNA, 22 nt, Homo sapiens
gcccugagauucuuggauucug

SEQ ID NO: 141837 - RNA, 22 nt, Homo sapiens
gccuagagaguuaucaggcugu

SEQ ID NO: 141838 - RNA, 22 nt, Homo sapiens
gccuguagaagaguagaugacc

SEQ ID NO: 141839 - RNA, 22 nt, Homo sapiens
gcugagcuaugccauauaugcc

SEQ ID NO: 141840 - RNA, 22 nt, Homo sapiens
gcugucaugagcaacacaugaa

SEQ ID NO: 141841 - RNA, 22 nt, Homo sapiens
gcuuguguuuacuguaguuacu

SEQ ID NO: 141842 - RNA, 22 nt, Homo sapiens
ggaaaguaacccauucucuuac

SEQ ID NO: 141843 - RNA, 22 nt, Homo sapiens
ggaaugagaaauauuacacaau

SEQ ID NO: 141844 - RNA, 22 nt, Homo sapiens
ggacagugaaugccacuccucc

SEQ ID NO: 141845 - RNA, 23 nt, Homo sapiens
ggacuguaagggauauaaagguu

SEQ ID NO: 141846 - RNA, 22 nt, Homo sapiens
ggaucacuugagaccaggaguu

SEQ ID NO: 141847 - RNA, 22 nt, Homo sapiens
ggcaacauggugaaacucuguc

SEQ ID NO: 141848 - RNA, 22 nt, Homo sapiens
ggcaagaaaaugcaauuacugu

SEQ ID NO: 141849 - RNA, 21 nt, Homo sapiens
ggcaagugugagguuuggggu

SEQ ID NO: 141850 - RNA, 22 nt, Homo sapiens
ggcagcacaauuuucugaugga

SEQ ID NO: 141851 - RNA, 22 nt, Homo sapiens
ggcuagaauagggauagaccuu

SEQ ID NO: 141852 - RNA, 18 nt, Homo sapiens
ggcugguguuuuaguaua

SEQ ID NO: 141853 - RNA, 22 nt, Homo sapiens
gggagcaaaaaugaugcccaag

SEQ ID NO: 141854 - RNA, 22 nt, Homo sapiens
gggaugaagcccuaggguuggu

SEQ ID NO: 141855 - RNA, 22 nt, Homo sapiens
gggaugaauuagguauguuuau

SEQ ID NO: 141856 - RNA, 22 nt, Homo sapiens
gggcaacauugaguacccugaa

SEQ ID NO: 141857 - RNA, 22 nt, Homo sapiens
gggcaugauggugcacacaugu

SEQ ID NO: 141858 - RNA, 17 nt, Homo sapiens
gggucaccuugcaggua

SEQ ID NO: 141859 - RNA, 22 nt, Homo sapiens
ggucacccugaugcuggugguc

SEQ ID NO: 141860 - RNA, 22 nt, Homo sapiens
ggucagaaagacaggcauucag

SEQ ID NO: 141861 - RNA, 23 nt, Homo sapiens
ggugaggaguacagagucuucau

SEQ ID NO: 141862 - RNA, 22 nt, Homo sapiens
gguggcuuuuugugauggcuga

SEQ ID NO: 141863 - RNA, 22 nt, Homo sapiens
guaaaguaaagcacaucaaggu

SEQ ID NO: 141864 - RNA, 22 nt, Homo sapiens
guacaguauaguaauaggauuu

SEQ ID NO: 141865 - RNA, 22 nt, Homo sapiens
guacaguucucuuuguugucag

SEQ ID NO: 141866 - RNA, 22 nt, Homo sapiens
guagaagcacagggccuguauu

SEQ ID NO: 141867 - RNA, 22 nt, Homo sapiens
guagcagaauaucagauaauuu

SEQ ID NO: 141868 - RNA, 22 nt, Homo sapiens
guaguaccauuaggauauuucu

SEQ ID NO: 141869 - RNA, 22 nt, Homo sapiens
guaugucuugucuauggcugcu

SEQ ID NO: 141870 - RNA, 22 nt, Homo sapiens
gucacaguguuuguucauccca

SEQ ID NO: 141871 - RNA, 22 nt, Homo sapiens
guccaaagugggagaggugggg

SEQ ID NO: 141872 - RNA, 22 nt, Homo sapiens
gucucccagccuacauauuucu

SEQ ID NO: 141873 - RNA, 21 nt, Homo sapiens
gucuuacagccagaugccucu

SEQ ID NO: 141874 - RNA, 22 nt, Homo sapiens
gucuuuguuuggucuguaucag

SEQ ID NO: 141875 - RNA, 22 nt, Homo sapiens
gugaaagacauauaugguuuga

SEQ ID NO: 141876 - RNA, 22 nt, Homo sapiens
gugaaugcauuaagaaggggga

SEQ ID NO: 141877 - RNA, 22 nt, Homo sapiens
gugagggagcuggaauauuuau

SEQ ID NO: 141878 - RNA, 22 nt, Homo sapiens
gugagucaugucccaucugauu

SEQ ID NO: 141879 - RNA, 22 nt, Homo sapiens
gugcacaaaucuuaaauguaca

SEQ ID NO: 141880 - RNA, 22 nt, Homo sapiens
gugcacaacaugcagguuuguu

SEQ ID NO: 141881 - RNA, 22 nt, Homo sapiens
gugcacaacaugcaguuuuguu

SEQ ID NO: 141882 - RNA, 22 nt, Homo sapiens
guggaaggucaugaauguucuu

SEQ ID NO: 141883 - RNA, 22 nt, Homo sapiens
guggaggacuggauaaagaaaa

SEQ ID NO: 141884 - RNA, 22 nt, Homo sapiens
guggcagaaaagagaagcaaug

SEQ ID NO: 141885 - RNA, 22 nt, Homo sapiens
gugggaugaucacaguucacug

SEQ ID NO: 141886 - RNA, 22 nt, Homo sapiens
gugggauggaaaugggcuucag

SEQ ID NO: 141887 - RNA, 22 nt, Homo sapiens
gugggauggagagaagguauga

SEQ ID NO: 141888 - RNA, 22 nt, Homo sapiens
gugguuuuacaaagagaaagau

SEQ ID NO: 141889 - RNA, 22 nt, Homo sapiens
gugguuuucaacuccaccugca

SEQ ID NO: 141890 - RNA, 21 nt, Homo sapiens
gugucacagacaugacagaug

SEQ ID NO: 141891 - RNA, 22 nt, Homo sapiens
gugucccagugugcauacaggu

SEQ ID NO: 141892 - RNA, 22 nt, Homo sapiens
gugucucagcccagaccuauuu

SEQ ID NO: 141893 - RNA, 22 nt, Homo sapiens
gugugcacaaucuggcaugugc

SEQ ID NO: 141894 - RNA, 22 nt, Homo sapiens
guuauguaucuugauugggugg

SEQ ID NO: 141895 - RNA, 22 nt, Homo sapiens
uaacuagaaaggagacaguugc

SEQ ID NO: 141896 - RNA, 22 nt, Homo sapiens
uaacuguggaaaugacuuuaaa

SEQ ID NO: 141897 - RNA, 22 nt, Homo sapiens
uaagacuuuuugggaauauaga

SEQ ID NO: 141898 - RNA, 22 nt, Homo sapiens
uaagcagugcaagaauggaaua

SEQ ID NO: 141899 - RNA, 18 nt, Homo sapiens
uaaggcacuauaggcauu

SEQ ID NO: 141900 - RNA, 22 nt, Homo sapiens
uaagggacauguguugccuaag

SEQ ID NO: 141901 - RNA, 22 nt, Homo sapiens
uaauagagucauuauuauuguu

SEQ ID NO: 141902 - RNA, 22 nt, Homo sapiens
uaaucacagagguuuggccuca

SEQ ID NO: 141903 - RNA, 22 nt, Homo sapiens
uaaugcacuuuccuccaaggcu

SEQ ID NO: 141904 - RNA, 22 nt, Homo sapiens
uaaugcuaucugggccaggggu

SEQ ID NO: 141905 - RNA, 22 nt, Homo sapiens
uaccuguagacuacagcuucag

SEQ ID NO: 141906 - RNA, 22 nt, Homo sapiens
uacuguguaguuagaccucaga

SEQ ID NO: 141907 - RNA, 22 nt, Homo sapiens
uagagguucuaagauucucaga

SEQ ID NO: 141908 - RNA, 22 nt, Homo sapiens
uagaucauauucagugcuuacu

SEQ ID NO: 141909 - RNA, 18 nt, Homo sapiens
uagcucuuguugguccau

SEQ ID NO: 141910 - RNA, 22 nt, Homo sapiens
uagcugcacuuacaagugagaa

SEQ ID NO: 141911 - RNA, 17 nt, Homo sapiens
uagcuucacauuaggaa

SEQ ID NO: 141912 - RNA, 21 nt, Homo sapiens
uagugcagugggguaugacuu

SEQ ID NO: 141913 - RNA, 22 nt, Homo sapiens
uauaguguuuucaaaaguaugu

SEQ ID NO: 141914 - RNA, 23 nt, Homo sapiens
uaucacacuuucucugugccaca

SEQ ID NO: 141915 - RNA, 22 nt, Homo sapiens
uaucauagucacuuccaguuug

SEQ ID NO: 141916 - RNA, 22 nt, Homo sapiens
uaucauggaaagauguugaaau

SEQ ID NO: 141917 - RNA, 22 nt, Homo sapiens
uaugaaucugagagaucuggaa

SEQ ID NO: 141918 - RNA, 22 nt, Homo sapiens
uaugaaucuggcuacuccaggg

SEQ ID NO: 141919 - RNA, 23 nt, Homo sapiens
uaugacagaggaagggggagcug

SEQ ID NO: 141920 - RNA, 22 nt, Homo sapiens
uaugcacacacguguuuaugug

SEQ ID NO: 141921 - RNA, 22 nt, Homo sapiens
uaugcacacguguccaugugca

SEQ ID NO: 141922 - RNA, 22 nt, Homo sapiens
uauggcugcuuucacacuacaa

SEQ ID NO: 141923 - RNA, 22 nt, Homo sapiens
uaugugcacaugcccuggugac

SEQ ID NO: 141924 - RNA, 22 nt, Homo sapiens
uauuguccacuuugcacugugu

SEQ ID NO: 141925 - RNA, 22 nt, Homo sapiens
ucaaaguagaaaaggggcaauu

SEQ ID NO: 141926 - RNA, 22 nt, Homo sapiens
ucaaagucuucucaaguaacau

SEQ ID NO: 141927 - RNA, 22 nt, Homo sapiens
ucaaaugcuguauuguaguaau

SEQ ID NO: 141928 - RNA, 22 nt, Homo sapiens
ucaaaugguccacgugaacauu

SEQ ID NO: 141929 - RNA, 18 nt, Homo sapiens
ucaagcaauugucaugcc

SEQ ID NO: 141930 - RNA, 18 nt, Homo sapiens
ucacaaccacagugcugu

SEQ ID NO: 141931 - RNA, 22 nt, Homo sapiens
uuauucagcaccugcuguguuc

SEQ ID NO: 141932 - RNA, 22 nt, Homo sapiens
uucaagaauuaaaguggcuuuu

SEQ ID NO: 141933 - RNA, 22 nt, Homo sapiens
uucaauuaauauuauacucuca

SEQ ID NO: 141934 - RNA, 20 nt, Homo sapiens
uucagcaaaggaaugggagu

SEQ ID NO: 141935 - RNA, 22 nt, Homo sapiens
uucagcacaguguggaucauuc

SEQ ID NO: 141936 - RNA, 22 nt, Homo sapiens
uucagcaguggccaguggaaau

SEQ ID NO: 141937 - RNA, 22 nt, Homo sapiens
uucaucaggaauauugaccugu

SEQ ID NO: 141938 - RNA, 22 nt, Homo sapiens
uucauggacucaauaguuucgc

SEQ ID NO: 141939 - RNA, 22 nt, Homo sapiens
uuccauguaguugagcaguuuu

SEQ ID NO: 141940 - RNA, 22 nt, Homo sapiens
uuccauugugucaucuuggugg

SEQ ID NO: 141941 - RNA, 22 nt, Homo sapiens
uucccuagaacacauggaggga

SEQ ID NO: 141942 - RNA, 22 nt, Homo sapiens
uucccugugggcuggugcucca

SEQ ID NO: 141943 - RNA, 22 nt, Homo sapiens
uucucacaguacagggagcucu

SEQ ID NO: 141944 - RNA, 22 nt, Homo sapiens
uucucauggaacaucuguacug

SEQ ID NO: 141945 - RNA, 22 nt, Homo sapiens
uucucauggugauggcaaaauc

SEQ ID NO: 141946 - RNA, 22 nt, Homo sapiens
uucuugcugaauugugcccuuc

SEQ ID NO: 141947 - RNA, 22 nt, Homo sapiens
uucuugguguaguaguugaaaa

SEQ ID NO: 141948 - RNA, 22 nt, Homo sapiens
uugagcaccaugccuggccaug

SEQ ID NO: 141949 - RNA, 22 nt, Homo sapiens
uugaggugggaggaucacuuga

SEQ ID NO: 141950 - RNA, 22 nt, Homo sapiens
uugauguugaggacauaaaccu

SEQ ID NO: 141951 - RNA, 22 nt, Homo sapiens
uugcagagccccacacugggcu

SEQ ID NO: 141952 - RNA, 22 nt, Homo sapiens
uugcaggugguuuaugcaagac

SEQ ID NO: 141953 - RNA, 22 nt, Homo sapiens
uugcagugugacgacuauauuu

SEQ ID NO: 141954 - RNA, 22 nt, Homo sapiens
uugcauaagugcauucugugau

SEQ ID NO: 141955 - RNA, 22 nt, Homo sapiens
uugcucaccugagaagaauaga

SEQ ID NO: 141956 - RNA, 22 nt, Homo sapiens
uuggaaauguguuugcauucag

SEQ ID NO: 141957 - RNA, 22 nt, Homo sapiens
uuggaagauuacuuaguuuucu

SEQ ID NO: 141958 - RNA, 22 nt, Homo sapiens
uuggaaggcuccuaaugaaugg

SEQ ID NO: 141959 - RNA, 22 nt, Homo sapiens
uuggaaggcugaauggccucuc

SEQ ID NO: 141960 - RNA, 22 nt, Homo sapiens
uuggaagguaaucaaaaguucu

SEQ ID NO: 141961 - RNA, 21 nt, Homo sapiens
uuggccuggaggccugaaugu

SEQ ID NO: 141962 - RNA, 21 nt, Homo sapiens
uugguccacaugucauaguua

SEQ ID NO: 141963 - RNA, 22 nt, Homo sapiens
uuguauguuuguucuuucagau

SEQ ID NO: 141964 - RNA, 22 nt, Homo sapiens
uugucaguguucacucaaagcu

SEQ ID NO: 141965 - RNA, 22 nt, Homo sapiens
uugucucacuggaguuuaguaa

SEQ ID NO: 141966 - RNA, 22 nt, Homo sapiens
uugugcuugauuugccuagcug

SEQ ID NO: 141967 - RNA, 22 nt, Homo sapiens
uugugcuuguaacuacauucag

SEQ ID NO: 141968 - RNA, 22 nt, Homo sapiens
uugugguugauacacguaggaa

SEQ ID NO: 141969 - RNA, 22 nt, Homo sapiens
uuuaaugcaucccaaaauguag

SEQ ID NO: 141970 - RNA, 22 nt, Homo sapiens
uuuagcaaugcuguggggaagu

SEQ ID NO: 141971 - RNA, 22 nt, Homo sapiens
uuucacaguguucucccccaga

SEQ ID NO: 141972 - RNA, 22 nt, Homo sapiens
uuuccuguaggaaggaaauaga

SEQ ID NO: 141973 - RNA, 22 nt, Homo sapiens
uuucuacagugaacgauuucua

SEQ ID NO: 141974 - RNA, 22 nt, Homo sapiens
uuugauguugagacuauaaagc

SEQ ID NO: 141975 - RNA, 22 nt, Homo sapiens
uuuggccauguuggucaggcug

SEQ ID NO: 141976 - RNA, 19 nt, Homo sapiens
uuuguauguuuccaguaau

SEQ ID NO: 141977 - RNA, 22 nt, Homo sapiens
uuugugcaugaagagggggugc

SEQ ID NO: 141978 - RNA, 22 nt, Homo sapiens
uuugugcuaaugcuagauuacu

SEQ ID NO: 141979 - RNA, 22 nt, Homo sapiens
uuuguucuucguuccugagcca

SEQ ID NO: 141980 - RNA, 22 nt, Homo sapiens
uuuguuugaagucgagacaacu

SEQ ID NO: 141981 - RNA, 22 nt, Homo sapiens
uuuuaguggaauauuuacaguu

SEQ ID NO: 141982 - RNA, 22 nt, Homo sapiens
uuuuaguggacaaagguauuua

SEQ ID NO: 141983 - RNA, 22 nt, Homo sapiens
uuuugcaguuacagagagugag

SEQ ID NO: 141984 - RNA, 22 nt, Homo sapiens
uuuugcucuugguaaugaaaga

SEQ ID NO: 141985 - RNA, 22 nt, Homo sapiens
uuuugcuuuuccucggucccac

SEQ ID NO: 141986 - RNA, 22 nt, Homo sapiens
uuuuggcuuaaagagaauguau

SEQ ID NO: 141987 - RNA, 22 nt, Homo sapiens
uuuuugagaauuggugaaacac

SEQ ID NO: 141988 - RNA, 18 nt, Homo sapiens
uuuuugaggcacagggga

SEQ ID NO: 141989 - RNA, 22 nt, Homo sapiens
uuuuuggguaaugauuaucaau

SEQ ID NO: 141990 - RNA, 22 nt, Homo sapiens
aaaagcuuagaugggcuuguau

SEQ ID NO: 141991 - RNA, 22 nt, Homo sapiens
aaagcacugaauaaauuugcuu

SEQ ID NO: 141992 - RNA, 19 nt, Homo sapiens
aaagguaguaaccucugau

SEQ ID NO: 141993 - RNA, 22 nt, Homo sapiens
aaagugaauguaucccguaagu

SEQ ID NO: 141994 - RNA, 22 nt, Homo sapiens
aaagugauugcgguuuuugcca

SEQ ID NO: 141995 - RNA, 22 nt, Homo sapiens
aaaucccuugcucucucagacc

SEQ ID NO: 141996 - RNA, 22 nt, Homo sapiens
aaaugacuuuuuaugcagagua

SEQ ID NO: 141997 - RNA, 22 nt, Homo sapiens
aaaugcacaaagauuuugcacu

SEQ ID NO: 141998 - RNA, 22 nt, Homo sapiens
aaaugcauggacagcuggucuu

SEQ ID NO: 141999 - RNA, 22 nt, Homo sapiens
aaaugccucccauucuacugac

SEQ ID NO: 142000 - RNA, 18 nt, Homo sapiens
aaaugcucuucuggaaua

SEQ ID NO: 142001 - RNA, 22 nt, Homo sapiens
aaauugcaaugcgaggcagagg

SEQ ID NO: 142002 - RNA, 22 nt, Homo sapiens
aacagaauccucuuuuccuggg

SEQ ID NO: 142003 - RNA, 22 nt, Homo sapiens
aacagucuccaguuguauccau

SEQ ID NO: 142004 - RNA, 22 nt, Homo sapiens
aaccuguaaccauaugaucagu

SEQ ID NO: 142005 - RNA, 22 nt, Homo sapiens
aacucugucuccuucaaguuca

SEQ ID NO: 142006 - RNA, 22 nt, Homo sapiens
aacugguauuucccaugaauuu

SEQ ID NO: 142007 - RNA, 22 nt, Homo sapiens
aacuggucuuaugcaagcacua

SEQ ID NO: 142008 - RNA, 22 nt, Homo sapiens
aagagaugaagguccugacugu

SEQ ID NO: 142009 - RNA, 22 nt, Homo sapiens
aagagguaggaaauggucauuu

SEQ ID NO: 142010 - RNA, 22 nt, Homo sapiens
aagaugguauuucauuaguuuu

SEQ ID NO: 142011 - RNA, 22 nt, Homo sapiens
aagcagacauguucauuuugaa

SEQ ID NO: 142012 - RNA, 22 nt, Homo sapiens
aaggaacuggaauauuuugaac

SEQ ID NO: 142013 - RNA, 23 nt, Homo sapiens
aaggacacugaacacuucccagc

SEQ ID NO: 142014 - RNA, 22 nt, Homo sapiens
aaggaguguggugaucuugggc

SEQ ID NO: 142015 - RNA, 22 nt, Homo sapiens
aaggcuagagaagaagggcauc

SEQ ID NO: 142016 - RNA, 22 nt, Homo sapiens
aaggcucuuucaacguaaauua

SEQ ID NO: 142017 - RNA, 22 nt, Homo sapiens
aaggcuguuguguaauaggauu

SEQ ID NO: 142018 - RNA, 22 nt, Homo sapiens
aagguuguauuuaauauacugu

SEQ ID NO: 142019 - RNA, 22 nt, Homo sapiens
aaguagcuggaugcaguggcac

SEQ ID NO: 142020 - RNA, 22 nt, Homo sapiens
aaguagugcuugugcucaucuc

SEQ ID NO: 142021 - RNA, 22 nt, Homo sapiens
aaguauuaugaguccuuguuuu

SEQ ID NO: 142022 - RNA, 22 nt, Homo sapiens
aagugcuggccuacucaaucga

SEQ ID NO: 142023 - RNA, 22 nt, Homo sapiens
aagugcuuacagggaacaugau

SEQ ID NO: 142024 - RNA, 22 nt, Homo sapiens
aggcaagagugacuacgugaaa

SEQ ID NO: 142025 - RNA, 22 nt, Homo sapiens
aggcagcuguuauauacugagu

SEQ ID NO: 142026 - RNA, 22 nt, Homo sapiens
aggcaugguggcacauacaugu

SEQ ID NO: 142027 - RNA, 20 nt, Homo sapiens
aggcauguugguuugcgugu

SEQ ID NO: 142028 - RNA, 22 nt, Homo sapiens
aggcuguguggauaauauuggg

SEQ ID NO: 142029 - RNA, 22 nt, Homo sapiens
aggcuuuuggagaacacugcac

SEQ ID NO: 142030 - RNA, 22 nt, Homo sapiens
agggaauguaaguuuuaugaga

SEQ ID NO: 142031 - RNA, 22 nt, Homo sapiens
agggccuuuguagauguacuca

SEQ ID NO: 142032 - RNA, 22 nt, Homo sapiens
agggcuuuugagcugagauggu

SEQ ID NO: 142033 - RNA, 22 nt, Homo sapiens
agguaagucucuaauuaugaau

SEQ ID NO: 142034 - RNA, 22 nt, Homo sapiens
aggucaccucaggaaauacuga

SEQ ID NO: 142035 - RNA, 22 nt, Homo sapiens
aguaaauuucugugcuuucaua

SEQ ID NO: 142036 - RNA, 23 nt, Homo sapiens
agucaguaugcuccuuggauccc

SEQ ID NO: 142037 - RNA, 22 nt, Homo sapiens
agucagugucuguaaggagaac

SEQ ID NO: 142038 - RNA, 22 nt, Homo sapiens
agucaugggagagaugugaucg

SEQ ID NO: 142039 - RNA, 22 nt, Homo sapiens
aguccagguuuuguaauggcaa

SEQ ID NO: 142040 - RNA, 22 nt, Homo sapiens
agucugguguucucacacuagu

SEQ ID NO: 142041 - RNA, 22 nt, Homo sapiens
agugacaugggaucaaaucuga

SEQ ID NO: 142042 - RNA, 19 nt, Homo sapiens
agugggcuagaaaucaggg

SEQ ID NO: 142043 - RNA, 23 nt, Homo sapiens
aguggucuccugggcccagcugu

SEQ ID NO: 142044 - RNA, 19 nt, Homo sapiens
agugucauggucauuauuu

SEQ ID NO: 142045 - RNA, 22 nt, Homo sapiens
aguucaaaucgagccuggccau

SEQ ID NO: 142046 - RNA, 22 nt, Homo sapiens
auaagugcuuguugaauaauag

SEQ ID NO: 142047 - RNA, 22 nt, Homo sapiens
auaauagguaguaauggauuga

SEQ ID NO: 142048 - RNA, 22 nt, Homo sapiens
auacagacacagucagaggggu

SEQ ID NO: 142049 - RNA, 22 nt, Homo sapiens
auacagugaauacuuacagugu

SEQ ID NO: 142050 - RNA, 22 nt, Homo sapiens
auacaucugccauguuggugug

SEQ ID NO: 142051 - RNA, 22 nt, Homo sapiens
auacaugugccauguugguuug

SEQ ID NO: 142052 - RNA, 22 nt, Homo sapiens
auagcacacuauagcuucaaac

SEQ ID NO: 142053 - RNA, 20 nt, Homo sapiens
auagcagcaugauuuauaau

SEQ ID NO: 142054 - RNA, 22 nt, Homo sapiens
auagugcugcauuaaacauacg

SEQ ID NO: 142055 - RNA, 22 nt, Homo sapiens
auagugcuggaauaaauauacg

SEQ ID NO: 142056 - RNA, 22 nt, Homo sapiens
auaucacagguguuuaccugau

SEQ ID NO: 142057 - RNA, 22 nt, Homo sapiens
auaugcacuauacacacguaua

SEQ ID NO: 142058 - RNA, 22 nt, Homo sapiens
auaugcuuauuagcaagaaaua

SEQ ID NO: 142059 - RNA, 22 nt, Homo sapiens
auauggcauucagaacuguaua

SEQ ID NO: 142060 - RNA, 22 nt, Homo sapiens
auaugguuuuuggaagcauauc

SEQ ID NO: 142061 - RNA, 17 nt, Homo sapiens
auaugucugcuggggga

SEQ ID NO: 142062 - RNA, 22 nt, Homo sapiens
auauuacagagaggaccuggga

SEQ ID NO: 142063 - RNA, 22 nt, Homo sapiens
auauuacuggcuauaucgcaag

SEQ ID NO: 142064 - RNA, 22 nt, Homo sapiens
auauucaagugaggauggcuaa

SEQ ID NO: 142065 - RNA, 22 nt, Homo sapiens
auauugacuuucucuuagauca

SEQ ID NO: 142066 - RNA, 22 nt, Homo sapiens
auauugcuugaggccaggaggu

SEQ ID NO: 142067 - RNA, 22 nt, Homo sapiens
auauuggucuucaagaccugug

SEQ ID NO: 142068 - RNA, 20 nt, Homo sapiens
aucaaagacuuagaggggga

SEQ ID NO: 142069 - RNA, 22 nt, Homo sapiens
aucaaagcagcauggcccaguc

SEQ ID NO: 142070 - RNA, 22 nt, Homo sapiens
aucaaagugaauuaaugagaau

SEQ ID NO: 142071 - RNA, 22 nt, Homo sapiens
aucaaauugucauuuuaaggau

SEQ ID NO: 142072 - RNA, 22 nt, Homo sapiens
aucacauggccagguaguaauc

SEQ ID NO: 142073 - RNA, 22 nt, Homo sapiens
aucaccgugggagauccugccu

SEQ ID NO: 142074 - RNA, 22 nt, Homo sapiens
aucacuggucaugagagaagua

SEQ ID NO: 142075 - RNA, 22 nt, Homo sapiens
aucacuguccacucaucuuucu

SEQ ID NO: 142076 - RNA, 23 nt, Homo sapiens
aucacuguuaacaauuucuuccu

SEQ ID NO: 142077 - RNA, 22 nt, Homo sapiens
aucacuuucuauuucugugcca

SEQ ID NO: 142078 - RNA, 22 nt, Homo sapiens
aucagaaucucuagaggacugu

SEQ ID NO: 142079 - RNA, 18 nt, Homo sapiens
aucagggugaagagagga

SEQ ID NO: 142080 - RNA, 22 nt, Homo sapiens
aucagugaaagugaaaucuccg

SEQ ID NO: 142081 - RNA, 22 nt, Homo sapiens
aucauauccuagauauaacuuc

SEQ ID NO: 142082 - RNA, 22 nt, Homo sapiens
aucauugugugaguugauggga

SEQ ID NO: 142083 - RNA, 22 nt, Homo sapiens
aucccuguguccagcaccugug

SEQ ID NO: 142084 - RNA, 22 nt, Homo sapiens
aucccuuucugauacuuucccu

SEQ ID NO: 142085 - RNA, 22 nt, Homo sapiens
auccugagacuuuucugaaguu

SEQ ID NO: 142086 - RNA, 22 nt, Homo sapiens
aucgcgccauuguacuccagcc

SEQ ID NO: 142087 - RNA, 22 nt, Homo sapiens
aucuacagccagucugguuugu

SEQ ID NO: 142088 - RNA, 22 nt, Homo sapiens
aucucagagaaaauuacuaaga

SEQ ID NO: 142089 - RNA, 22 nt, Homo sapiens
aucucauggagguagagaguaa

SEQ ID NO: 142090 - RNA, 22 nt, Homo sapiens
aucucugagauguucugauuuu

SEQ ID NO: 142091 - RNA, 19 nt, Homo sapiens
aucuggaguuccuggggcu

SEQ ID NO: 142092 - RNA, 22 nt, Homo sapiens
aucuugcauuugcuaaaaugca

SEQ ID NO: 142093 - RNA, 22 nt, Homo sapiens
aucuuugauuguagguacaaug

SEQ ID NO: 142094 - RNA, 22 nt, Homo sapiens
augaaagugauaaaugucucua

SEQ ID NO: 142095 - RNA, 22 nt, Homo sapiens
augaaauguaugagucuggguu

SEQ ID NO: 142096 - RNA, 17 nt, Homo sapiens
augaagucaucauuuuu

SEQ ID NO: 142097 - RNA, 22 nt, Homo sapiens
augaauagaguuaauugaguac

SEQ ID NO: 142098 - RNA, 22 nt, Homo sapiens
augaccauuucaauugauaugg

SEQ ID NO: 142099 - RNA, 22 nt, Homo sapiens
augacuaaaggguuuauguuga

SEQ ID NO: 142100 - RNA, 20 nt, Homo sapiens
augacuagaggacaugguaa

SEQ ID NO: 142101 - RNA, 22 nt, Homo sapiens
augacugagacuaacuuacuuu

SEQ ID NO: 142102 - RNA, 22 nt, Homo sapiens
augagaugauaggcguucuaac

SEQ ID NO: 142103 - RNA, 20 nt, Homo sapiens
augagcucaucuugaaaacc

SEQ ID NO: 142104 - RNA, 22 nt, Homo sapiens
augaggagauauuaaauaccau

SEQ ID NO: 142105 - RNA, 22 nt, Homo sapiens
augagggaagcucacgugucca

SEQ ID NO: 142106 - RNA, 22 nt, Homo sapiens
augagggagggguggugccgca

SEQ ID NO: 142107 - RNA, 21 nt, Homo sapiens
augagguguacuguggugaaa

SEQ ID NO: 142108 - RNA, 20 nt, Homo sapiens
augagguguaugacacugaa

SEQ ID NO: 142109 - RNA, 22 nt, Homo sapiens
augauagucuugagaagcauuu

SEQ ID NO: 142110 - RNA, 22 nt, Homo sapiens
augaucacuguggaaauucagc

SEQ ID NO: 142111 - RNA, 22 nt, Homo sapiens
cagugcacugggauuauaagug

SEQ ID NO: 142112 - RNA, 22 nt, Homo sapiens
caguggacuaaauggggaauau

SEQ ID NO: 142113 - RNA, 22 nt, Homo sapiens
cauaaaucuuguugaauagcac

SEQ ID NO: 142114 - RNA, 22 nt, Homo sapiens
caucacagcaaguagggagugg

SEQ ID NO: 142115 - RNA, 22 nt, Homo sapiens
caucacuguugguacaaguaau

SEQ ID NO: 142116 - RNA, 22 nt, Homo sapiens
caucagauugagaucaucuaag

SEQ ID NO: 142117 - RNA, 22 nt, Homo sapiens
caucagcaauguaugaggguuc

SEQ ID NO: 142118 - RNA, 22 nt, Homo sapiens
cauggauuuuuuugaauggcag

SEQ ID NO: 142119 - RNA, 22 nt, Homo sapiens
cauggcauuugcagaguugaaa

SEQ ID NO: 142120 - RNA, 22 nt, Homo sapiens
cauggcuacugcagauguaggg

SEQ ID NO: 142121 - RNA, 22 nt, Homo sapiens
cauuccacuggauaaacaaggu

SEQ ID NO: 142122 - RNA, 22 nt, Homo sapiens
cauugcaugcauauggcuuggu

SEQ ID NO: 142123 - RNA, 20 nt, Homo sapiens
cauugcccuccagccugggc

SEQ ID NO: 142124 - RNA, 22 nt, Homo sapiens
ccacugugguaucugauacugg

SEQ ID NO: 142125 - RNA, 20 nt, Homo sapiens
ccagcaucauuagauucugg

SEQ ID NO: 142126 - RNA, 22 nt, Homo sapiens
ccagguuucuagaauaauuccu

SEQ ID NO: 142127 - RNA, 22 nt, Homo sapiens
ccaguauugaacacaaugaaag

SEQ ID NO: 142128 - RNA, 22 nt, Homo sapiens
ccaguguauuuuugggaccugc

SEQ ID NO: 142129 - RNA, 22 nt, Homo sapiens
ccagugucugacagacacggcg

SEQ ID NO: 142130 - RNA, 19 nt, Homo sapiens
ccauggcaaugaucugaug

SEQ ID NO: 142131 - RNA, 18 nt, Homo sapiens
cccagugacuuauggccu

SEQ ID NO: 142132 - RNA, 22 nt, Homo sapiens
cccagugguuacauaaggagua

SEQ ID NO: 142133 - RNA, 22 nt, Homo sapiens
cccagugugaacuuggcauuuu

SEQ ID NO: 142134 - RNA, 22 nt, Homo sapiens
cccaguguguuguggauauuua

SEQ ID NO: 142135 - RNA, 22 nt, Homo sapiens
cccaguuuugccacuuacuagc

SEQ ID NO: 142136 - RNA, 22 nt, Homo sapiens
ccccaguguguaaaggccuugc

SEQ ID NO: 142137 - RNA, 20 nt, Homo sapiens
ccccuggaguggggcugcuu

SEQ ID NO: 142138 - RNA, 22 nt, Homo sapiens
cccgugucuuggucuagggccu

SEQ ID NO: 142139 - RNA, 22 nt, Homo sapiens
cccugagagcagggucuuucuc

SEQ ID NO: 142140 - RNA, 23 nt, Homo sapiens
ccgugagagaguucauagaaagc

SEQ ID NO: 142141 - RNA, 22 nt, Homo sapiens
ccucuuuguugagacuucacca

SEQ ID NO: 142142 - RNA, 22 nt, Homo sapiens
ccugagacgaauggagugaaca

SEQ ID NO: 142143 - RNA, 22 nt, Homo sapiens
ccugucuugauuaaauuacuua

SEQ ID NO: 142144 - RNA, 22 nt, Homo sapiens
ccuugucacugaguggaaugaa

SEQ ID NO: 142145 - RNA, 19 nt, Homo sapiens
ccuuugguuuccaugacau

SEQ ID NO: 142146 - RNA, 22 nt, Homo sapiens
ccuuuuugaguugccagaguuc

SEQ ID NO: 142147 - RNA, 22 nt, Homo sapiens
cgcuggugucuaagcgacagcu

SEQ ID NO: 142148 - RNA, 22 nt, Homo sapiens
cuaagugaguauaauuuuaaga

SEQ ID NO: 142149 - RNA, 22 nt, Homo sapiens
cuaauccugugguagcacucaa

SEQ ID NO: 142150 - RNA, 22 nt, Homo sapiens
cuacagguaugaaagggaguau

SEQ ID NO: 142151 - RNA, 23 nt, Homo sapiens
cuacagugccugucucuuuggcc

SEQ ID NO: 142152 - RNA, 22 nt, Homo sapiens
cuagcagacacuuccagagagu

SEQ ID NO: 142153 - RNA, 22 nt, Homo sapiens
cuaggugauccacugcucucuu

SEQ ID NO: 142154 - RNA, 19 nt, Homo sapiens
cuaugaccaugugauuuuu

SEQ ID NO: 142155 - RNA, 22 nt, Homo sapiens
cuauuugguuggugaaaaaagu

SEQ ID NO: 142156 - RNA, 22 nt, Homo sapiens
cucaaagucaagggaaagcagg

SEQ ID NO: 142157 - RNA, 22 nt, Homo sapiens
cucaaagugcuaagauuaggcu

SEQ ID NO: 142158 - RNA, 22 nt, Homo sapiens
cucaaagugcugggacuggcug

SEQ ID NO: 142159 - RNA, 19 nt, Homo sapiens
cucaaagugguauuuggag

SEQ ID NO: 142160 - RNA, 22 nt, Homo sapiens
cucaauuuggaauugucaguaa

SEQ ID NO: 142161 - RNA, 22 nt, Homo sapiens
cucacaugcucaccugguguuc

SEQ ID NO: 142162 - RNA, 20 nt, Homo sapiens
cucagauuauucugaagcaa

SEQ ID NO: 142163 - RNA, 20 nt, Homo sapiens
cucagguauuugaggcugca

SEQ ID NO: 142164 - RNA, 22 nt, Homo sapiens
cucagugucuggcacacagaaa

SEQ ID NO: 142165 - RNA, 22 nt, Homo sapiens
cucaguguuucagcugcucaga

SEQ ID NO: 142166 - RNA, 22 nt, Homo sapiens
cuccauagucuucgaagaauga

SEQ ID NO: 142167 - RNA, 22 nt, Homo sapiens
cucccacccucauuuuuaggca

SEQ ID NO: 142168 - RNA, 22 nt, Homo sapiens
cucucaagaugcugggauuaca

SEQ ID NO: 142169 - RNA, 22 nt, Homo sapiens
cucugcuuaaugucccacuuga

SEQ ID NO: 142170 - RNA, 22 nt, Homo sapiens
cucugguuuuucuuccauuaag

SEQ ID NO: 142171 - RNA, 22 nt, Homo sapiens
cucuuacaguguguggugaaag

SEQ ID NO: 142172 - RNA, 19 nt, Homo sapiens
cucuuuggugucucuucuu

SEQ ID NO: 142173 - RNA, 22 nt, Homo sapiens
cucuuuuguuuagcugagaggg

SEQ ID NO: 142174 - RNA, 22 nt, Homo sapiens
cugaaaguuauucaggggcaag

SEQ ID NO: 142175 - RNA, 22 nt, Homo sapiens
cugaaggcagguagaauagaga

SEQ ID NO: 142176 - RNA, 22 nt, Homo sapiens
cugaagugugaaagucuuuuuu

SEQ ID NO: 142177 - RNA, 22 nt, Homo sapiens
cugacauuguugaucacagcca

SEQ ID NO: 142178 - RNA, 22 nt, Homo sapiens
cugacugaggaucaguucauca

SEQ ID NO: 142179 - RNA, 22 nt, Homo sapiens
cugagaagaaacagguaaggac

SEQ ID NO: 142180 - RNA, 22 nt, Homo sapiens
cugagauaggacucugcuggcu

SEQ ID NO: 142181 - RNA, 22 nt, Homo sapiens
cugagaucaugggucagguggu

SEQ ID NO: 142182 - RNA, 22 nt, Homo sapiens
cugagaucguggggcugcuguc

SEQ ID NO: 142183 - RNA, 22 nt, Homo sapiens
cugagaucugaaccaggagugu

SEQ ID NO: 142184 - RNA, 22 nt, Homo sapiens
cugagauggagucucgcauugu

SEQ ID NO: 142185 - RNA, 22 nt, Homo sapiens
cugaggauauucagccucugug

SEQ ID NO: 142186 - RNA, 22 nt, Homo sapiens
cugagguagcucaggguauugc

SEQ ID NO: 142187 - RNA, 22 nt, Homo sapiens
cugaggugggaggauuggcuug

SEQ ID NO: 142188 - RNA, 22 nt, Homo sapiens
cugaucuaugaacacaggauau

SEQ ID NO: 142189 - RNA, 22 nt, Homo sapiens
cugauugugcagagguguaauu

SEQ ID NO: 142190 - RNA, 22 nt, Homo sapiens
cugcaauggagaaagugagacu

SEQ ID NO: 142191 - RNA, 20 nt, Homo sapiens
cugcacauccacucuacuuc

SEQ ID NO: 142192 - RNA, 22 nt, Homo sapiens
cugcuauauugguucaggcuug

SEQ ID NO: 142193 - RNA, 22 nt, Homo sapiens
cuggacaaaucuggaaagaacc

SEQ ID NO: 142194 - RNA, 22 nt, Homo sapiens
cuggagaucuugacauugaagu

SEQ ID NO: 142195 - RNA, 22 nt, Homo sapiens
cuggagucugacugacacaagg

SEQ ID NO: 142196 - RNA, 22 nt, Homo sapiens
cuggcaaauguuuucuguaaag

SEQ ID NO: 142197 - RNA, 22 nt, Homo sapiens
cuggcccaguucugcguuuugc

SEQ ID NO: 142198 - RNA, 22 nt, Homo sapiens
aaaaugcugauauugggcccca

SEQ ID NO: 142199 - RNA, 22 nt, Homo sapiens
aaacuugucuaauuauaagcau

SEQ ID NO: 142200 - RNA, 22 nt, Homo sapiens
aaaggcaucugcucggcucccu

SEQ ID NO: 142201 - RNA, 22 nt, Homo sapiens
aaaggcuucggaucagaaggua

SEQ ID NO: 142202 - RNA, 22 nt, Homo sapiens
aaagugcaguauuugggcagaa

SEQ ID NO: 142203 - RNA, 22 nt, Homo sapiens
aaagugcaguauuugggcagga

SEQ ID NO: 142204 - RNA, 22 nt, Homo sapiens
aaagugcuaggauuaccugggg

SEQ ID NO: 142205 - RNA, 22 nt, Homo sapiens
aaagugcugggauuuuaggcau

SEQ ID NO: 142206 - RNA, 22 nt, Homo sapiens
aaaguucuguugauagugcuga

SEQ ID NO: 142207 - RNA, 22 nt, Homo sapiens
aaaugcaucauuaggugauuuu

SEQ ID NO: 142208 - RNA, 22 nt, Homo sapiens
aaaugcaugaauaagcucgugu

SEQ ID NO: 142209 - RNA, 22 nt, Homo sapiens
aaaugcucuuuaugaaguugga

SEQ ID NO: 142210 - RNA, 22 nt, Homo sapiens
aaauggauuaaguucacuugcu

SEQ ID NO: 142211 - RNA, 22 nt, Homo sapiens
aaaugucauggaguguuucccc

SEQ ID NO: 142212 - RNA, 22 nt, Homo sapiens
aacagauugcugagccccaccc

SEQ ID NO: 142213 - RNA, 22 nt, Homo sapiens
aacagugcuucauucacacauu

SEQ ID NO: 142214 - RNA, 22 nt, Homo sapiens
aacauagucaugggguaauguu

SEQ ID NO: 142215 - RNA, 22 nt, Homo sapiens
aacccugacacaagcagaauuu

SEQ ID NO: 142216 - RNA, 22 nt, Homo sapiens
aacccugagucaugagucuaga

SEQ ID NO: 142217 - RNA, 22 nt, Homo sapiens
aagacuguaauccaucuugagu

SEQ ID NO: 142218 - RNA, 18 nt, Homo sapiens
aagagcucagcacagguu

SEQ ID NO: 142219 - RNA, 22 nt, Homo sapiens
aagagguuuaacugacucacag

SEQ ID NO: 142220 - RNA, 22 nt, Homo sapiens
aagaucaucauagagggcauga

SEQ ID NO: 142221 - RNA, 22 nt, Homo sapiens
aagaucauucagggaaggcuga

SEQ ID NO: 142222 - RNA, 21 nt, Homo sapiens
aagcacauugaguguguguga

SEQ ID NO: 142223 - RNA, 22 nt, Homo sapiens
aagcucuuguugaaucuuguca

SEQ ID NO: 142224 - RNA, 22 nt, Homo sapiens
aagcuguuguucauccugaauu

SEQ ID NO: 142225 - RNA, 22 nt, Homo sapiens
aaggaagcuagcaggaauuggu

SEQ ID NO: 142226 - RNA, 22 nt, Homo sapiens
aaggaaguaauuugguuuauag

SEQ ID NO: 142227 - RNA, 22 nt, Homo sapiens
aaggagcuaagagaucauacau

SEQ ID NO: 142228 - RNA, 22 nt, Homo sapiens
aaguagcagaggcaagacuuga

SEQ ID NO: 142229 - RNA, 19 nt, Homo sapiens
aaguaguugugacagaugc

SEQ ID NO: 142230 - RNA, 22 nt, Homo sapiens
aagugaauguuugguagcagug

SEQ ID NO: 142231 - RNA, 22 nt, Homo sapiens
aagugagugacaaaaacugggc

SEQ ID NO: 142232 - RNA, 22 nt, Homo sapiens
aagugcacuguaagugcaggau

SEQ ID NO: 142233 - RNA, 21 nt, Homo sapiens
aagugcucugggacucuaaau

SEQ ID NO: 142234 - RNA, 22 nt, Homo sapiens
aagugcucuugaaacugucuua

SEQ ID NO: 142235 - RNA, 22 nt, Homo sapiens
aagugcuuuacacaugcaugau

SEQ ID NO: 142236 - RNA, 22 nt, Homo sapiens
aagugguucuaugaguuugcaa

SEQ ID NO: 142237 - RNA, 22 nt, Homo sapiens
aauaaagcaggguccuugcacu

SEQ ID NO: 142238 - RNA, 22 nt, Homo sapiens
cuuuggccauagcuaaaugauu

SEQ ID NO: 142239 - RNA, 22 nt, Homo sapiens
cuuuguguggacauuucaggca

SEQ ID NO: 142240 - RNA, 23 nt, Homo sapiens
cuuuugcaaugugaucuugccac

SEQ ID NO: 142241 - RNA, 21 nt, Homo sapiens
cuuuugcacuccagccugggu

SEQ ID NO: 142242 - RNA, 22 nt, Homo sapiens
cuuuuugcugcagcaauacugg

SEQ ID NO: 142243 - RNA, 22 nt, Homo sapiens
gaaaauccauccccagggagua

SEQ ID NO: 142244 - RNA, 22 nt, Homo sapiens
gaaagugcugcuugacugggau

SEQ ID NO: 142245 - RNA, 22 nt, Homo sapiens
gaacuuguguugcuucacaugu

SEQ ID NO: 142246 - RNA, 22 nt, Homo sapiens
gaagaacuaggugagaucuaga

SEQ ID NO: 142247 - RNA, 22 nt, Homo sapiens
gaagcauugauccacaggcgug

SEQ ID NO: 142248 - RNA, 22 nt, Homo sapiens
gaagguacgcuuaggaaaugau

SEQ ID NO: 142249 - RNA, 19 nt, Homo sapiens
gaaguguuguccuccagua

SEQ ID NO: 142250 - RNA, 22 nt, Homo sapiens
gaaucaauugaucuaugugucu

SEQ ID NO: 142251 - RNA, 22 nt, Homo sapiens
gaaugcuaaguuuccucccugu

SEQ ID NO: 142252 - RNA, 20 nt, Homo sapiens
gacaugacuaggagauagcc

SEQ ID NO: 142253 - RNA, 22 nt, Homo sapiens
gagaacaguguuguauuuuuuc

SEQ ID NO: 142254 - RNA, 22 nt, Homo sapiens
gagacggagucucgcucuguca

SEQ ID NO: 142255 - RNA, 22 nt, Homo sapiens
gagacugagucuugcucuguca

SEQ ID NO: 142256 - RNA, 22 nt, Homo sapiens
gagacugagucuugcuuuguca

SEQ ID NO: 142257 - RNA, 22 nt, Homo sapiens
gagaucaucuaaucuggccucu

SEQ ID NO: 142258 - RNA, 22 nt, Homo sapiens
gagaugaagugucaauaaggau

SEQ ID NO: 142259 - RNA, 20 nt, Homo sapiens
acaguagaagggauuucaaa

SEQ ID NO: 142260 - RNA, 22 nt, Homo sapiens
acauauaaggagacuagggcau

SEQ ID NO: 142261 - RNA, 22 nt, Homo sapiens
acaucacuguuugauugauuga

SEQ ID NO: 142262 - RNA, 22 nt, Homo sapiens
acaucccuuucccacccuucac

SEQ ID NO: 142263 - RNA, 22 nt, Homo sapiens
acaugcauccaugugaagagac

SEQ ID NO: 142264 - RNA, 22 nt, Homo sapiens
acaugguacugauuuacgaaau

SEQ ID NO: 142265 - RNA, 23 nt, Homo sapiens
acauguauagacuuuuuuuccuu

SEQ ID NO: 142266 - RNA, 22 nt, Homo sapiens
acauguauauaaugcauagcga

SEQ ID NO: 142267 - RNA, 22 nt, Homo sapiens
accacaggguaaaguuagauau

SEQ ID NO: 142268 - RNA, 22 nt, Homo sapiens
accagucucagguaugucuuua

SEQ ID NO: 142269 - RNA, 21 nt, Homo sapiens
acccccacaccuccuuaguuc

SEQ ID NO: 142270 - RNA, 17 nt, Homo sapiens
accccuaccucagaagc

SEQ ID NO: 142271 - RNA, 22 nt, Homo sapiens
acccgcccagguguggccggga

SEQ ID NO: 142272 - RNA, 22 nt, Homo sapiens
acccgugcugaauauguaggug

SEQ ID NO: 142273 - RNA, 22 nt, Homo sapiens
acccuggagagugcuguaguaa

SEQ ID NO: 142274 - RNA, 22 nt, Homo sapiens
acccuggaggucuacagugcag

SEQ ID NO: 142275 - RNA, 22 nt, Homo sapiens
acccuguugguggaucagauug

SEQ ID NO: 142276 - RNA, 22 nt, Homo sapiens
acccuguugucagaauguggau

SEQ ID NO: 142277 - RNA, 22 nt, Homo sapiens
accucagcccggggaaguugag

SEQ ID NO: 142278 - RNA, 22 nt, Homo sapiens
accuggcacuuagcaaaucuga

SEQ ID NO: 142279 - RNA, 19 nt, Homo sapiens
accuguagaaaguacaaca

SEQ ID NO: 142280 - RNA, 20 nt, Homo sapiens
acuaaaucucauuuuaugca

SEQ ID NO: 142281 - RNA, 22 nt, Homo sapiens
acuacauaugacaucuucuuua

SEQ ID NO: 142282 - RNA, 22 nt, Homo sapiens
acugagucauugaggcccucuc

SEQ ID NO: 142283 - RNA, 22 nt, Homo sapiens
acugcacuccagccuaggcgac

SEQ ID NO: 142284 - RNA, 22 nt, Homo sapiens
acugcacuccuccuugggugac

SEQ ID NO: 142285 - RNA, 22 nt, Homo sapiens
acugcacuucagccuugugaca

SEQ ID NO: 142286 - RNA, 22 nt, Homo sapiens
acuggauguuagggauuuuauu

SEQ ID NO: 142287 - RNA, 22 nt, Homo sapiens
acuggcauagggcgggcacagu

SEQ ID NO: 142288 - RNA, 22 nt, Homo sapiens
acugggauauuauugguaauau

SEQ ID NO: 142289 - RNA, 21 nt, Homo sapiens
acuuucuguggcaguccauuc

SEQ ID NO: 142290 - RNA, 22 nt, Homo sapiens
acuuugguuaucauacuuucag

SEQ ID NO: 142291 - RNA, 22 nt, Homo sapiens
agaaacacagguggaauugcuu

SEQ ID NO: 142292 - RNA, 22 nt, Homo sapiens
agaaagugcuucccuuugguga

SEQ ID NO: 142293 - RNA, 23 nt, Homo sapiens
agaaaugucuauucagggucccu

SEQ ID NO: 142294 - RNA, 22 nt, Homo sapiens
agaaauguuuauucaaacccgu

SEQ ID NO: 142295 - RNA, 22 nt, Homo sapiens
agaaugauccuucucagaggca

SEQ ID NO: 142296 - RNA, 22 nt, Homo sapiens
agaaugucaguauuggcuaaaa

SEQ ID NO: 142297 - RNA, 22 nt, Homo sapiens
agacaucauuugauggugggag

SEQ ID NO: 142298 - RNA, 22 nt, Homo sapiens
agaccacuuuagagauuguuca

SEQ ID NO: 142299 - RNA, 22 nt, Homo sapiens
agagaacugauucagggaaaau

SEQ ID NO: 142300 - RNA, 22 nt, Homo sapiens
agagcacuguggguccaaauau

SEQ ID NO: 142301 - RNA, 22 nt, Homo sapiens
agagguuuugcacugguucuuu

SEQ ID NO: 142302 - RNA, 22 nt, Homo sapiens
agaguauagcaacuuaguaaaa

SEQ ID NO: 142303 - RNA, 23 nt, Homo sapiens
agaugcaucuggcugcgaggcaa

SEQ ID NO: 142304 - RNA, 22 nt, Homo sapiens
agauggucuucauaaguuuuaa

SEQ ID NO: 142305 - RNA, 22 nt, Homo sapiens
agauucauccaaguuguugcau

SEQ ID NO: 142306 - RNA, 22 nt, Homo sapiens
agcaacauuuuugaccuuucuu

SEQ ID NO: 142307 - RNA, 22 nt, Homo sapiens
agcacagugguuaaguuucuua

SEQ ID NO: 142308 - RNA, 22 nt, Homo sapiens
agcaccguucaaacccagguua

SEQ ID NO: 142309 - RNA, 22 nt, Homo sapiens
agcagagcaguggauuuuguga

SEQ ID NO: 142310 - RNA, 20 nt, Homo sapiens
agcagccacagauuccucag

SEQ ID NO: 142311 - RNA, 22 nt, Homo sapiens
agcaucauuugauguucccgag

SEQ ID NO: 142312 - RNA, 22 nt, Homo sapiens
agccaagacucuguuccccuug

SEQ ID NO: 142313 - RNA, 22 nt, Homo sapiens
agccauacaacguaugcaugua

SEQ ID NO: 142314 - RNA, 22 nt, Homo sapiens
agcccauguggcugaggcuucu

SEQ ID NO: 142315 - RNA, 22 nt, Homo sapiens
agccccauuuguugaaaagacg

SEQ ID NO: 142316 - RNA, 22 nt, Homo sapiens
agcccugugauuacuuuuauaa

SEQ ID NO: 142317 - RNA, 22 nt, Homo sapiens
agcuauauugaggaugccauuc

SEQ ID NO: 142318 - RNA, 22 nt, Homo sapiens
agcuccuuugcuuuuuccagga

SEQ ID NO: 142319 - RNA, 16 nt, Homo sapiens
agcuggaauuacaggc

SEQ ID NO: 142320 - RNA, 22 nt, Homo sapiens
agugcauuuguucugugucagg

SEQ ID NO: 142321 - RNA, 22 nt, Homo sapiens
agugccuauugauggaaagaua

SEQ ID NO: 142322 - RNA, 22 nt, Homo sapiens
agugguauaauauuauuuugaa

SEQ ID NO: 142323 - RNA, 22 nt, Homo sapiens
auaaaagcaggucuaggucagg

SEQ ID NO: 142324 - RNA, 22 nt, Homo sapiens
auaaaccuacauuuucacuucu

SEQ ID NO: 142325 - RNA, 22 nt, Homo sapiens
auaaaguguuuaguauaggcaa

SEQ ID NO: 142326 - RNA, 22 nt, Homo sapiens
auaaaguucugcuggcauauau

SEQ ID NO: 142327 - RNA, 22 nt, Homo sapiens
auaaaugcuuagaucuguauau

SEQ ID NO: 142328 - RNA, 22 nt, Homo sapiens
auaaauucauuuaagcuccuua

SEQ ID NO: 142329 - RNA, 22 nt, Homo sapiens
auaagucaauggaacagauuaa

SEQ ID NO: 142330 - RNA, 22 nt, Homo sapiens
auaaugcuuuucuagguugcau

SEQ ID NO: 142331 - RNA, 19 nt, Homo sapiens
auacacguguauacauaca

SEQ ID NO: 142332 - RNA, 22 nt, Homo sapiens
auacaugugcaggucagguuac

SEQ ID NO: 142333 - RNA, 22 nt, Homo sapiens
auacaugugccauguucgugug

SEQ ID NO: 142334 - RNA, 22 nt, Homo sapiens
auacaugugucauguugguuug

SEQ ID NO: 142335 - RNA, 22 nt, Homo sapiens
auacuguuucugaacuuugauu

SEQ ID NO: 142336 - RNA, 22 nt, Homo sapiens
auagaaucaucugugcacuagu

SEQ ID NO: 142337 - RNA, 22 nt, Homo sapiens
auagcagcaccucacucuacug

SEQ ID NO: 142338 - RNA, 20 nt, Homo sapiens
auagcagcaugauuuauagu

SEQ ID NO: 142339 - RNA, 22 nt, Homo sapiens
auagugcugcaauaaacauaca

SEQ ID NO: 142340 - RNA, 22 nt, Homo sapiens
auagugcugcacuaaacauaca

SEQ ID NO: 142341 - RNA, 22 nt, Homo sapiens
auagugcugccauaaacauacg

SEQ ID NO: 142342 - RNA, 22 nt, Homo sapiens
auaucccagugaugauugauag

SEQ ID NO: 142343 - RNA, 22 nt, Homo sapiens
auaucccaguguguaaacacug

SEQ ID NO: 142344 - RNA, 22 nt, Homo sapiens
auaucugcauugccauuuaugu

SEQ ID NO: 142345 - RNA, 17 nt, Homo sapiens
auaugaauuuuggagau

SEQ ID NO: 142346 - RNA, 22 nt, Homo sapiens
auauggguuuuauauuaggcuc

SEQ ID NO: 142347 - RNA, 22 nt, Homo sapiens
auauguaguauggaaacauugu

SEQ ID NO: 142348 - RNA, 22 nt, Homo sapiens
auauguauuuuaacguguaagg

SEQ ID NO: 142349 - RNA, 21 nt, Homo sapiens
auauuacuguuagaggacugc

SEQ ID NO: 142350 - RNA, 22 nt, Homo sapiens
auauuagcacuaaugucacgau

SEQ ID NO: 142351 - RNA, 22 nt, Homo sapiens
aucaaaguuucccagaaguugu

SEQ ID NO: 142352 - RNA, 22 nt, Homo sapiens
aucaagcugcuuguuugaaucu

SEQ ID NO: 142353 - RNA, 22 nt, Homo sapiens
aucaagcuugacuccuuaaagg

SEQ ID NO: 142354 - RNA, 22 nt, Homo sapiens
aucacacucaccuucuguccuu

SEQ ID NO: 142355 - RNA, 22 nt, Homo sapiens
aucacagaacuuugagcagaga

SEQ ID NO: 142356 - RNA, 22 nt, Homo sapiens
aucacagagucacgggcaacuu

SEQ ID NO: 142357 - RNA, 22 nt, Homo sapiens
aucacagaguuaaaacuuucuu

SEQ ID NO: 142358 - RNA, 22 nt, Homo sapiens
aucaccuuucccuuucugaauc

SEQ ID NO: 142359 - RNA, 22 nt, Homo sapiens
aucacuaugcaggugucucggg

SEQ ID NO: 142360 - RNA, 22 nt, Homo sapiens
aucacuuugcucuccagugugg

SEQ ID NO: 142361 - RNA, 22 nt, Homo sapiens
aucagaaucucuagugggacca

SEQ ID NO: 142362 - RNA, 22 nt, Homo sapiens
aucagugagugguuagugaaug

SEQ ID NO: 142363 - RNA, 22 nt, Homo sapiens
aucagugcauaguauuuaauga

SEQ ID NO: 142364 - RNA, 22 nt, Homo sapiens
aucauugugcaucuucauucca

SEQ ID NO: 142365 - RNA, 22 nt, Homo sapiens
auccauguggauaaauguguau

SEQ ID NO: 142366 - RNA, 22 nt, Homo sapiens
aucccuuucucuggcuaggggg

SEQ ID NO: 142367 - RNA, 22 nt, Homo sapiens
auccucaguggcuuaaguauag

SEQ ID NO: 142368 - RNA, 22 nt, Homo sapiens
auccugaagcuuuacugaauuc

SEQ ID NO: 142369 - RNA, 21 nt, Homo sapiens
auccuucuuuuucaaccugug

SEQ ID NO: 142370 - RNA, 22 nt, Homo sapiens
auccuuuagacuguccaguuga

SEQ ID NO: 142371 - RNA, 20 nt, Homo sapiens
aucucugggcaaaggaaaau

SEQ ID NO: 142372 - RNA, 22 nt, Homo sapiens
aucugugguuguaugcauauua

SEQ ID NO: 142373 - RNA, 22 nt, Homo sapiens
aucuguguuuaaggucccagaa

SEQ ID NO: 142374 - RNA, 22 nt, Homo sapiens
aucuuugauugaagggacccug

SEQ ID NO: 142375 - RNA, 22 nt, Homo sapiens
aucuuuggcgggaauaucacag

SEQ ID NO: 142376 - RNA, 22 nt, Homo sapiens
aucuuuggucaucacagcuaga

SEQ ID NO: 142377 - RNA, 22 nt, Homo sapiens
augaaaguguguggaaacuuga

SEQ ID NO: 142378 - RNA, 22 nt, Homo sapiens
augaaaugcauguuaaguccgu

SEQ ID NO: 142379 - RNA, 22 nt, Homo sapiens
augaagacaucgucugggauua

SEQ ID NO: 142380 - RNA, 18 nt, Homo sapiens
augaagucaucacuuuua

SEQ ID NO: 142381 - RNA, 20 nt, Homo sapiens
augaauguccuugauggcau

SEQ ID NO: 142382 - RNA, 22 nt, Homo sapiens
augacagagauaugugaauuuu

SEQ ID NO: 142383 - RNA, 22 nt, Homo sapiens
uauucacaggugugggacaaag

SEQ ID NO: 142384 - RNA, 20 nt, Homo sapiens
uauucacucuccagucuugc

SEQ ID NO: 142385 - RNA, 22 nt, Homo sapiens
uauugacuuuuuuguuaggagg

SEQ ID NO: 142386 - RNA, 22 nt, Homo sapiens
uauugauuaauugugauuaggc

SEQ ID NO: 142387 - RNA, 22 nt, Homo sapiens
uauugcagugagauccaucugg

SEQ ID NO: 142388 - RNA, 22 nt, Homo sapiens
uauugucacuaaaggaagcugg

SEQ ID NO: 142389 - RNA, 22 nt, Homo sapiens
uauuguccaauaggauguuccu

SEQ ID NO: 142390 - RNA, 22 nt, Homo sapiens
uauuugauugacuuuagcagga

SEQ ID NO: 142391 - RNA, 22 nt, Homo sapiens
ucaaacauccccaccagggacu

SEQ ID NO: 142392 - RNA, 20 nt, Homo sapiens
ucaaaguaugcucugcacua

SEQ ID NO: 142393 - RNA, 22 nt, Homo sapiens
ucaaaugauucacccaccuuug

SEQ ID NO: 142394 - RNA, 22 nt, Homo sapiens
ucaaaugauucuccugccucag

SEQ ID NO: 142395 - RNA, 22 nt, Homo sapiens
ucaaaugguccacgugaacauu

SEQ ID NO: 142396 - RNA, 22 nt, Homo sapiens
ucaaauuccaagucuagguagg

SEQ ID NO: 142397 - RNA, 22 nt, Homo sapiens
ucaaugggcuacacauugagug

SEQ ID NO: 142398 - RNA, 22 nt, Homo sapiens
ucacagaggagaagaccuuuaa

SEQ ID NO: 142399 - RNA, 22 nt, Homo sapiens
ucacagaugaggcgagaggcag

SEQ ID NO: 142400 - RNA, 22 nt, Homo sapiens
ucacaggguguuauuagaauua

SEQ ID NO: 142401 - RNA, 19 nt, Homo sapiens
ucacaggguugacuugagg

SEQ ID NO: 142402 - RNA, 22 nt, Homo sapiens
ucacaguauucaugaacaugga

SEQ ID NO: 142403 - RNA, 22 nt, Homo sapiens
ucacagucaaaguaaucauaga

SEQ ID NO: 142404 - RNA, 22 nt, Homo sapiens
ucacaguugauugaaacacagc

SEQ ID NO: 142405 - RNA, 22 nt, Homo sapiens
ucacaugaagauuuuaguauac

SEQ ID NO: 142406 - RNA, 21 nt, Homo sapiens
ucacauggccagaguaggaac

SEQ ID NO: 142407 - RNA, 22 nt, Homo sapiens
ucacaugugacauauauauuug

SEQ ID NO: 142408 - RNA, 22 nt, Homo sapiens
ucacauucaauuguaauccccg

SEQ ID NO: 142409 - RNA, 22 nt, Homo sapiens
ucacauuguguagccugcucac

SEQ ID NO: 142410 - RNA, 22 nt, Homo sapiens
ucaccaguacuccaaauugagg

SEQ ID NO: 142411 - RNA, 22 nt, Homo sapiens
ucaccuggagccuucacauucu

SEQ ID NO: 142412 - RNA, 22 nt, Homo sapiens
ucaccuugcacaguuguguggg

SEQ ID NO: 142413 - RNA, 22 nt, Homo sapiens
ucacugagaaugauguuucuga

SEQ ID NO: 142414 - RNA, 22 nt, Homo sapiens
ucacugcgaccuccaccucccg

SEQ ID NO: 142415 - RNA, 22 nt, Homo sapiens
ucacugcgaccucugccucccg

SEQ ID NO: 142416 - RNA, 22 nt, Homo sapiens
ucacugggagaccaaagccauc

SEQ ID NO: 142417 - RNA, 22 nt, Homo sapiens
ucacugugcacauaugauaggu

SEQ ID NO: 142418 - RNA, 22 nt, Homo sapiens
ucacuguggaacucaaaaagcu

SEQ ID NO: 142419 - RNA, 22 nt, Homo sapiens
ucacugugguuggaaggcuuaa

SEQ ID NO: 142420 - RNA, 22 nt, Homo sapiens
ucacuuggccgcagccuucucu

SEQ ID NO: 142421 - RNA, 22 nt, Homo sapiens
ucagaaccuccuagcaguguuc

SEQ ID NO: 142422 - RNA, 22 nt, Homo sapiens
ucagaauguaacuuuaguugga

SEQ ID NO: 142423 - RNA, 22 nt, Homo sapiens
ucagaguagaaacacuuccaua

SEQ ID NO: 142424 - RNA, 22 nt, Homo sapiens
ucagagucuagaucacucacug

SEQ ID NO: 142425 - RNA, 22 nt, Homo sapiens
ucagaucauauucuucgcugcu

SEQ ID NO: 142426 - RNA, 22 nt, Homo sapiens
ucagaucuucagcaggggcccc

SEQ ID NO: 142427 - RNA, 22 nt, Homo sapiens
ucagggacgcuugacacaagcc

SEQ ID NO: 142428 - RNA, 23 nt, Homo sapiens
ucagguaggccuagaguauucuu

SEQ ID NO: 142429 - RNA, 22 nt, Homo sapiens
ucagguccuuacugugcucccu

SEQ ID NO: 142430 - RNA, 19 nt, Homo sapiens
ucaguagugcacauaagcc

SEQ ID NO: 142431 - RNA, 22 nt, Homo sapiens
ucaguccccucgcugagucuac

SEQ ID NO: 142432 - RNA, 23 nt, Homo sapiens
ucagugaaggaacaacuaaauag

SEQ ID NO: 142433 - RNA, 22 nt, Homo sapiens
ucagugaauauauaacagcgau

SEQ ID NO: 142434 - RNA, 22 nt, Homo sapiens
ucagugaauguuggccacuacu

SEQ ID NO: 142435 - RNA, 23 nt, Homo sapiens
ucagugucuggauccugcucagu

SEQ ID NO: 142436 - RNA, 21 nt, Homo sapiens
ucaucaagcuguagacaugau

SEQ ID NO: 142437 - RNA, 23 nt, Homo sapiens
ucaucacagcauuuccugguauu

SEQ ID NO: 142438 - RNA, 22 nt, Homo sapiens
ucaucuggcgaaugugaagagu

SEQ ID NO: 142439 - RNA, 22 nt, Homo sapiens
ucaugaccaugguauagaccac

SEQ ID NO: 142440 - RNA, 22 nt, Homo sapiens
ucauggcacugaugagaguuuc

SEQ ID NO: 142441 - RNA, 19 nt, Homo sapiens
ucauggcuuuuucagcugu

SEQ ID NO: 142442 - RNA, 22 nt, Homo sapiens
ucauggggugagcuacaggcac

SEQ ID NO: 142443 - RNA, 22 nt, Homo sapiens
ucauguaauuuugugucuauga

SEQ ID NO: 142444 - RNA, 22 nt, Homo sapiens
ucaugugaggauaacaauagug

SEQ ID NO: 142445 - RNA, 22 nt, Homo sapiens
ucauugcacuucuuuaguugca

SEQ ID NO: 142446 - RNA, 22 nt, Homo sapiens
uccacugagcuagaccacuugg

SEQ ID NO: 142447 - RNA, 22 nt, Homo sapiens
uccagguuucaugcucuuuauu

SEQ ID NO: 142448 - RNA, 18 nt, Homo sapiens
uccaguuuucccagcauc

SEQ ID NO: 142449 - RNA, 22 nt, Homo sapiens
uccaguuuuguuaacauauggu

SEQ ID NO: 142450 - RNA, 22 nt, Homo sapiens
uccauaguugcacucuggagcc

SEQ ID NO: 142451 - RNA, 22 nt, Homo sapiens
uccaugaggcuacaguaaucuc

SEQ ID NO: 142452 - RNA, 22 nt, Homo sapiens
ucccaguguguagcuugucucu

SEQ ID NO: 142453 - RNA, 19 nt, Homo sapiens
uccccaguuuuccguucag

SEQ ID NO: 142454 - RNA, 19 nt, Homo sapiens
uccccuguggauaccaaga

SEQ ID NO: 142455 - RNA, 22 nt, Homo sapiens
ucccugaacacauguugagaag

SEQ ID NO: 142456 - RNA, 22 nt, Homo sapiens
ucccuguuaggcacagauuuau

SEQ ID NO: 142457 - RNA, 22 nt, Homo sapiens
uccugagacucacaggcucccc

SEQ ID NO: 142458 - RNA, 22 nt, Homo sapiens
uccugagucagcauccguuugu

SEQ ID NO: 142459 - RNA, 22 nt, Homo sapiens
ucgcugggaaccagagguaaag

SEQ ID NO: 142460 - RNA, 22 nt, Homo sapiens
ucuaaaguacuacuacuguugg

SEQ ID NO: 142461 - RNA, 17 nt, Homo sapiens
ucuaauaauaugcauuu

SEQ ID NO: 142462 - RNA, 22 nt, Homo sapiens
ucucaaguaacugggacaauaa

SEQ ID NO: 142463 - RNA, 22 nt, Homo sapiens
ucucacagaguugaauguuucu

SEQ ID NO: 142464 - RNA, 22 nt, Homo sapiens
ucucagagccuaggguuuuuca

SEQ ID NO: 142465 - RNA, 19 nt, Homo sapiens
ucucaguguuggucaggug

SEQ ID NO: 142466 - RNA, 21 nt, Homo sapiens
ucucauagaguuucacuuucu

SEQ ID NO: 142467 - RNA, 22 nt, Homo sapiens
ucucauggagucaggagcagaa

SEQ ID NO: 142468 - RNA, 22 nt, Homo sapiens
ucuccggguggcggcgaaggga

SEQ ID NO: 142469 - RNA, 22 nt, Homo sapiens
guugacuaggagcuacuacuac

SEQ ID NO: 142470 - RNA, 18 nt, Homo sapiens
guugagcuuuuccuuuag

SEQ ID NO: 142471 - RNA, 22 nt, Homo sapiens
guugaucuauguugcuggcagu

SEQ ID NO: 142472 - RNA, 22 nt, Homo sapiens
guugcucaggcugaagugcagu

SEQ ID NO: 142473 - RNA, 22 nt, Homo sapiens
guugcugagucccaucaccaga

SEQ ID NO: 142474 - RNA, 22 nt, Homo sapiens
guuuggcucuuguuucugucaa

SEQ ID NO: 142475 - RNA, 22 nt, Homo sapiens
uaaaagucaucacaacuggagu

SEQ ID NO: 142476 - RNA, 22 nt, Homo sapiens
uaaaccuagcauuuugcauaug

SEQ ID NO: 142477 - RNA, 22 nt, Homo sapiens
uaaagugcugagaugaggcugg

SEQ ID NO: 142478 - RNA, 22 nt, Homo sapiens
uaaaguuauugccccucaguua

SEQ ID NO: 142479 - RNA, 22 nt, Homo sapiens
uaaaugcuuaauugaaugugga

SEQ ID NO: 142480 - RNA, 22 nt, Homo sapiens
uaaaugcuugagaugauggaua

SEQ ID NO: 142481 - RNA, 22 nt, Homo sapiens
uaacaacauucuaacugacggc

SEQ ID NO: 142482 - RNA, 22 nt, Homo sapiens
uaacaaugucuuaugggcuuaa

SEQ ID NO: 142483 - RNA, 22 nt, Homo sapiens
uaacaccuugcucugucaauaa

SEQ ID NO: 142484 - RNA, 22 nt, Homo sapiens
uaacaguauaugugguaucuau

SEQ ID NO: 142485 - RNA, 22 nt, Homo sapiens
uaacuaguggaauuugauuuca

SEQ ID NO: 142486 - RNA, 18 nt, Homo sapiens
uaacugugggaacuaacu

SEQ ID NO: 142487 - RNA, 18 nt, Homo sapiens
uaaggcacuauaggcauu

SEQ ID NO: 142488 - RNA, 20 nt, Homo sapiens
uaagugcauaggauauuucu

SEQ ID NO: 142489 - RNA, 20 nt, Homo sapiens
uaagugcuugagacuucuga

SEQ ID NO: 142490 - RNA, 22 nt, Homo sapiens
uaauacuugucauaaaggcauu

SEQ ID NO: 142491 - RNA, 22 nt, Homo sapiens
uaauagagucauuauuauuguu

SEQ ID NO: 142492 - RNA, 22 nt, Homo sapiens
uaauagcaguguuacuaggacu

SEQ ID NO: 142493 - RNA, 22 nt, Homo sapiens
uaauaguuggcacuggagaaag

SEQ ID NO: 142494 - RNA, 22 nt, Homo sapiens
uaauaguuucagaaguuguuuu

SEQ ID NO: 142495 - RNA, 22 nt, Homo sapiens
gaggcaauaugagggaggcuuc

SEQ ID NO: 142496 - RNA, 22 nt, Homo sapiens
gaggcagucugacccuuagcag

SEQ ID NO: 142497 - RNA, 22 nt, Homo sapiens
gaggcagucugucccuuagcag

SEQ ID NO: 142498 - RNA, 22 nt, Homo sapiens
gagguaggaggauugcuuaagg

SEQ ID NO: 142499 - RNA, 22 nt, Homo sapiens
gagguaggggccuuaaagaugc

SEQ ID NO: 142500 - RNA, 22 nt, Homo sapiens
gagguagguacaauugccacca

SEQ ID NO: 142501 - RNA, 17 nt, Homo sapiens
gagguaguuuacuuuca

SEQ ID NO: 142502 - RNA, 22 nt, Homo sapiens
gagguauaauugacaagcaaaa

SEQ ID NO: 142503 - RNA, 22 nt, Homo sapiens
gaggugaaggucucaauaaaua

SEQ ID NO: 142504 - RNA, 22 nt, Homo sapiens
gaguaaaugucaaguacuuagg

SEQ ID NO: 142505 - RNA, 22 nt, Homo sapiens
gaguagaacugguuaucuaaua

SEQ ID NO: 142506 - RNA, 22 nt, Homo sapiens
gagugcugagcccacuuccuug

SEQ ID NO: 142507 - RNA, 22 nt, Homo sapiens
gagugcuguuagcccuggguuu

SEQ ID NO: 142508 - RNA, 22 nt, Homo sapiens
gagugguucuauauguaauugg

SEQ ID NO: 142509 - RNA, 22 nt, Homo sapiens
gaguuacauuguaauugccgag

SEQ ID NO: 142510 - RNA, 22 nt, Homo sapiens
gaguuaggaucucacuguguca

SEQ ID NO: 142511 - RNA, 22 nt, Homo sapiens
gaguucauaucuaugagugugc

SEQ ID NO: 142512 - RNA, 22 nt, Homo sapiens
gauauuacuuccaauauugcaa

SEQ ID NO: 142513 - RNA, 22 nt, Homo sapiens
gaucuggagguuuuccucauga

SEQ ID NO: 142514 - RNA, 19 nt, Homo sapiens
gaucuguugaucaaugugu

SEQ ID NO: 142515 - RNA, 22 nt, Homo sapiens
gauggcauuucuggaucugaca

SEQ ID NO: 142516 - RNA, 22 nt, Homo sapiens
gauggguuuuuugaagacagca

SEQ ID NO: 142517 - RNA, 22 nt, Homo sapiens
gaugguuuucaccugcaugcuu

SEQ ID NO: 142518 - RNA, 22 nt, Homo sapiens
gauuuuccaguggcccugauca

SEQ ID NO: 142519 - RNA, 21 nt, Homo sapiens
gcaaacauccuuugaugccag

SEQ ID NO: 142520 - RNA, 21 nt, Homo sapiens
gcaaaggaauugccuaagcuu

SEQ ID NO: 142521 - RNA, 22 nt, Homo sapiens
gcaaaugcuaugccauuuuaua

SEQ ID NO: 142522 - RNA, 22 nt, Homo sapiens
gcaauggaaucccuugaucaau

SEQ ID NO: 142523 - RNA, 22 nt, Homo sapiens
gcacacguagaagcaugcauca

SEQ ID NO: 142524 - RNA, 22 nt, Homo sapiens
gcacaguuaaagggucauguga

SEQ ID NO: 142525 - RNA, 22 nt, Homo sapiens
gcacauauguaaauagcugccu

SEQ ID NO: 142526 - RNA, 22 nt, Homo sapiens
gcaccauugacaagaaauaggu

SEQ ID NO: 142527 - RNA, 22 nt, Homo sapiens
gcacugggccacauuuauuuuc

SEQ ID NO: 142528 - RNA, 20 nt, Homo sapiens
gcagcaccauauuucuaaga

SEQ ID NO: 142529 - RNA, 22 nt, Homo sapiens
gcagcaucaaaucacacaagau

SEQ ID NO: 142530 - RNA, 22 nt, Homo sapiens
gcaggauuggagccucucugaa

SEQ ID NO: 142531 - RNA, 20 nt, Homo sapiens
gcaguguucugaccugaauc

SEQ ID NO: 142532 - RNA, 22 nt, Homo sapiens
gcaucacagcuccugugcuggc

SEQ ID NO: 142533 - RNA, 22 nt, Homo sapiens
gcauggagaaggggacugauuc

SEQ ID NO: 142534 - RNA, 22 nt, Homo sapiens
gcauggagcauacauuucuguu

SEQ ID NO: 142535 - RNA, 22 nt, Homo sapiens
gcauggaguggaaauucuuggg

SEQ ID NO: 142536 - RNA, 22 nt, Homo sapiens
gccaguguguguuguucuccgc

SEQ ID NO: 142537 - RNA, 22 nt, Homo sapiens
gccccaguacaggcuccuuaga

SEQ ID NO: 142538 - RNA, 22 nt, Homo sapiens
gcccuuugugucuggcuggggu

SEQ ID NO: 142539 - RNA, 22 nt, Homo sapiens
gcucguuuuugccucugguugc

SEQ ID NO: 142540 - RNA, 22 nt, Homo sapiens
gcugagaucucuugccugaacu

SEQ ID NO: 142541 - RNA, 22 nt, Homo sapiens
gcugauguugaccuugaucacc

SEQ ID NO: 142542 - RNA, 22 nt, Homo sapiens
gcugauguuggccucugggcuu

SEQ ID NO: 142543 - RNA, 22 nt, Homo sapiens
gcuggaauuaacauagaugugc

SEQ ID NO: 142544 - RNA, 22 nt, Homo sapiens
gcuggauguuucaauacaaaua

SEQ ID NO: 142545 - RNA, 22 nt, Homo sapiens
gcuggcaaguggccuacuuugu

SEQ ID NO: 142546 - RNA, 22 nt, Homo sapiens
gcuugguccccacccaaaucgc

SEQ ID NO: 142547 - RNA, 22 nt, Homo sapiens
gcuuuggauaaaugucaguuua

SEQ ID NO: 142548 - RNA, 23 nt, Homo sapiens
ggaaacauccagucuuucaccau

SEQ ID NO: 142549 - RNA, 22 nt, Homo sapiens
ggaaagauguaauauuaucuaa

SEQ ID NO: 142550 - RNA, 22 nt, Homo sapiens
ggaaauguaaacaauggggcua

SEQ ID NO: 142551 - RNA, 22 nt, Homo sapiens
ggaaauguuuagcauccacuuu

SEQ ID NO: 142552 - RNA, 18 nt, Homo sapiens
ggaagccuauuuaguaac

SEQ ID NO: 142553 - RNA, 22 nt, Homo sapiens
ggaauaguauaaauaccacaaa

SEQ ID NO: 142554 - RNA, 21 nt, Homo sapiens
ggaauguugccagcagccaga

SEQ ID NO: 142555 - RNA, 22 nt, Homo sapiens
ggacugagaggacuacagugua

SEQ ID NO: 142556 - RNA, 19 nt, Homo sapiens
ggacugucauggaguaguu

SEQ ID NO: 142557 - RNA, 22 nt, Homo sapiens
ggagcugugauuugaguccaga

SEQ ID NO: 142558 - RNA, 16 nt, Homo sapiens
ggaggucaucugggaa

SEQ ID NO: 142559 - RNA, 22 nt, Homo sapiens
ggagucugauguucuaaggcag

SEQ ID NO: 142560 - RNA, 22 nt, Homo sapiens
ggauuuguuggcauuagugaug

SEQ ID NO: 142561 - RNA, 22 nt, Homo sapiens
ggcaagaucuuggcucacugaa

SEQ ID NO: 142562 - RNA, 22 nt, Homo sapiens
ggcaaugaggcggaccagcagg

SEQ ID NO: 142563 - RNA, 22 nt, Homo sapiens
ggcacaguuaagugcuaccuaa

SEQ ID NO: 142564 - RNA, 22 nt, Homo sapiens
ggcaccacagacgccaggcgug

SEQ ID NO: 142565 - RNA, 22 nt, Homo sapiens
ggcagcaugggugccuuuguga

SEQ ID NO: 142566 - RNA, 22 nt, Homo sapiens
ggcagcgugcacuuucgccacu

SEQ ID NO: 142567 - RNA, 22 nt, Homo sapiens
ggcuagauauucacauauggcu

SEQ ID NO: 142568 - RNA, 22 nt, Homo sapiens
ggcucguguuuucuguccaguu

SEQ ID NO: 142569 - RNA, 22 nt, Homo sapiens
ggcugguuuucaguuacugagu

SEQ ID NO: 142570 - RNA, 22 nt, Homo sapiens
gggagcacaagaaauguuucau

SEQ ID NO: 142571 - RNA, 22 nt, Homo sapiens
gggaggucauuguucaaugcug

SEQ ID NO: 142572 - RNA, 22 nt, Homo sapiens
gggaugaagaagaauaguucgu

SEQ ID NO: 142573 - RNA, 23 nt, Homo sapiens
gggauuguaaaauaugagggcag

SEQ ID NO: 142574 - RNA, 22 nt, Homo sapiens
gggcaugaugucuuaugccuau

SEQ ID NO: 142575 - RNA, 22 nt, Homo sapiens
ggggaguguggacaucacccug

SEQ ID NO: 142576 - RNA, 22 nt, Homo sapiens
gggguaggcuacacugaguucc

SEQ ID NO: 142577 - RNA, 22 nt, Homo sapiens
gguaaacauacugcugucuucu

SEQ ID NO: 142578 - RNA, 22 nt, Homo sapiens
gguaucuuggagagagaaguga

SEQ ID NO: 142579 - RNA, 22 nt, Homo sapiens
gguauguaggucuacgguacaa

SEQ ID NO: 142580 - RNA, 22 nt, Homo sapiens
ggucacccugaugcuggugguc

SEQ ID NO: 142581 - RNA, 21 nt, Homo sapiens
ggugagaaaggagacauagac

SEQ ID NO: 142582 - RNA, 22 nt, Homo sapiens
guaaaucucuguuuucauggac

SEQ ID NO: 142583 - RNA, 22 nt, Homo sapiens
guaaaugcagaugcaugaccuu

SEQ ID NO: 142584 - RNA, 22 nt, Homo sapiens
guacaaguaagaaaauugccca

SEQ ID NO: 142585 - RNA, 22 nt, Homo sapiens
guacaagugcaguuucguuaca

SEQ ID NO: 142586 - RNA, 22 nt, Homo sapiens
guacacaacaugcagguuuguu

SEQ ID NO: 142587 - RNA, 22 nt, Homo sapiens
guacaggugcaggaugggcagg

SEQ ID NO: 142588 - RNA, 22 nt, Homo sapiens
guacaguaguaaaagugaauga

SEQ ID NO: 142589 - RNA, 22 nt, Homo sapiens
guagaaagcauuucagauuugc

SEQ ID NO: 142590 - RNA, 22 nt, Homo sapiens
guagaaaguuugcugucacaug

SEQ ID NO: 142591 - RNA, 22 nt, Homo sapiens
guagaauguauacaguauacag

SEQ ID NO: 142592 - RNA, 22 nt, Homo sapiens
guagcagucacauagcagauug

SEQ ID NO: 142593 - RNA, 22 nt, Homo sapiens
guagcaucauuugcaauuucau

SEQ ID NO: 142594 - RNA, 22 nt, Homo sapiens
guauacaguugacccuugaacc

SEQ ID NO: 142595 - RNA, 22 nt, Homo sapiens
guaucccuugcuaucugaaucu

SEQ ID NO: 142596 - RNA, 22 nt, Homo sapiens
guaugaaaaucggagauugggu

SEQ ID NO: 142597 - RNA, 22 nt, Homo sapiens
guaugcacauauguguauguau

SEQ ID NO: 142598 - RNA, 22 nt, Homo sapiens
guauggaagucaguuuguuggc

SEQ ID NO: 142599 - RNA, 22 nt, Homo sapiens
guauugacuaucaaucaugugc

SEQ ID NO: 142600 - RNA, 19 nt, Homo sapiens
guauuugacuuucuuguuu

SEQ ID NO: 142601 - RNA, 22 nt, Homo sapiens
gucacugagauugguauuaaug

SEQ ID NO: 142602 - RNA, 22 nt, Homo sapiens
gucacugucuacuguaauagcc

SEQ ID NO: 142603 - RNA, 22 nt, Homo sapiens
gucacugugacggcaguuacau

SEQ ID NO: 142604 - RNA, 22 nt, Homo sapiens
gucacugugaggaggggccagg

SEQ ID NO: 142605 - RNA, 22 nt, Homo sapiens
gucagauaauuugcauccaucu

SEQ ID NO: 142606 - RNA, 22 nt, Homo sapiens
gucagcaaagaggaauaguuug

SEQ ID NO: 142607 - RNA, 22 nt, Homo sapiens
gucagugcuuuaguucaggaug

SEQ ID NO: 142608 - RNA, 22 nt, Homo sapiens
gucauugucaauugacaauugu

SEQ ID NO: 142609 - RNA, 22 nt, Homo sapiens
guccaguguuggagguuuuacc

SEQ ID NO: 142610 - RNA, 18 nt, Homo sapiens
guccauuuguugguacac

SEQ ID NO: 142611 - RNA, 22 nt, Homo sapiens
gucuaugagucccugaauuuaa

SEQ ID NO: 142612 - RNA, 21 nt, Homo sapiens
gucugguguuuuaaugaggac

SEQ ID NO: 142613 - RNA, 22 nt, Homo sapiens
gucugucuuuugucuuugaaau

SEQ ID NO: 142614 - RNA, 22 nt, Homo sapiens
gucuugaaggcugaguaccugu

SEQ ID NO: 142615 - RNA, 22 nt, Homo sapiens
gucuuugagauaggguuauuuu

SEQ ID NO: 142616 - RNA, 22 nt, Homo sapiens
gugaaauauuuaacguccaggu

SEQ ID NO: 142617 - RNA, 22 nt, Homo sapiens
gugaaauguguagaggaucugg

SEQ ID NO: 142618 - RNA, 22 nt, Homo sapiens
gugaaugcauuaagaaggggga

SEQ ID NO: 142619 - RNA, 22 nt, Homo sapiens
gugaccucauuacggggccugc

SEQ ID NO: 142620 - RNA, 22 nt, Homo sapiens
gugagaugaggucucacucugu

SEQ ID NO: 142621 - RNA, 22 nt, Homo sapiens
gugagcaauugauacuugaagu

SEQ ID NO: 142622 - RNA, 22 nt, Homo sapiens
gugagccaugauuuuaccacug

SEQ ID NO: 142623 - RNA, 22 nt, Homo sapiens
gugagcuccucuucugcugcag

SEQ ID NO: 142624 - RNA, 22 nt, Homo sapiens
gugaggcugguccugccuccca

SEQ ID NO: 142625 - RNA, 22 nt, Homo sapiens
gugagguaauuagcucccuuag

SEQ ID NO: 142626 - RNA, 22 nt, Homo sapiens
gugagguagagcaugugaaaga

SEQ ID NO: 142627 - RNA, 22 nt, Homo sapiens
gugaggucagggcuguggacag

SEQ ID NO: 142628 - RNA, 22 nt, Homo sapiens
gugcaaccaucaccacugacuc

SEQ ID NO: 142629 - RNA, 22 nt, Homo sapiens
gugcacaugguagguauugagu

SEQ ID NO: 142630 - RNA, 22 nt, Homo sapiens
gugcaguuuugagugaguuucu

SEQ ID NO: 142631 - RNA, 18 nt, Homo sapiens
gugcauagccauggcagc

SEQ ID NO: 142632 - RNA, 23 nt, Homo sapiens
gugccuucugagccuagucucca

SEQ ID NO: 142633 - RNA, 22 nt, Homo sapiens
guggaagcacaggccuccugga

SEQ ID NO: 142634 - RNA, 22 nt, Homo sapiens
guggcaaacucagcaugcccca

SEQ ID NO: 142635 - RNA, 22 nt, Homo sapiens
guggcaaagaugccuucuccaa

SEQ ID NO: 142636 - RNA, 21 nt, Homo sapiens
guggccuuuggagcaugucag

SEQ ID NO: 142637 - RNA, 19 nt, Homo sapiens
gugguauuaccuuuugauu

SEQ ID NO: 142638 - RNA, 22 nt, Homo sapiens
gugguucuaaaccuuuuuuggu

SEQ ID NO: 142639 - RNA, 22 nt, Homo sapiens
gugguucuagagggacagaaug

SEQ ID NO: 142640 - RNA, 22 nt, Homo sapiens
guguaaaucaaucuguugucuu

SEQ ID NO: 142641 - RNA, 22 nt, Homo sapiens
guguauguuguccauggaugcg

SEQ ID NO: 142642 - RNA, 22 nt, Homo sapiens
gugugcaacuuucauuaauauu

SEQ ID NO: 142643 - RNA, 22 nt, Homo sapiens
gugugcacaaucuggcaugugc

SEQ ID NO: 142644 - RNA, 22 nt, Homo sapiens
gugugcauggagggggcaguga

SEQ ID NO: 142645 - RNA, 22 nt, Homo sapiens
guuauguuaaauuguuguaugc

SEQ ID NO: 142646 - RNA, 21 nt, Homo sapiens
guucaagugauccuccugucu

SEQ ID NO: 142647 - RNA, 22 nt, Homo sapiens
guugcucaggccggagugcagu

SEQ ID NO: 142648 - RNA, 22 nt, Homo sapiens
guuggugaccugaagagaguaa

SEQ ID NO: 142649 - RNA, 22 nt, Homo sapiens
guugugcuuaagccuauugauu

SEQ ID NO: 142650 - RNA, 22 nt, Homo sapiens
guuuacagucgacuugggaaua

SEQ ID NO: 142651 - RNA, 22 nt, Homo sapiens
uaaacugcuugaaaugguguca

SEQ ID NO: 142652 - RNA, 22 nt, Homo sapiens
uaaauugcauaaguacaaauga

SEQ ID NO: 142653 - RNA, 22 nt, Homo sapiens
uaacaggcuacucuugcauugc

SEQ ID NO: 142654 - RNA, 22 nt, Homo sapiens
uaacagucuccucaagguguug

SEQ ID NO: 142655 - RNA, 22 nt, Homo sapiens
uaacucugccuagugacauggu

SEQ ID NO: 142656 - RNA, 22 nt, Homo sapiens
uaacugcaaccuccgccucccg

SEQ ID NO: 142657 - RNA, 22 nt, Homo sapiens
cucccagagccaguuauaggcu

SEQ ID NO: 142658 - RNA, 22 nt, Homo sapiens
cucccauugcaaacaacagaag

SEQ ID NO: 142659 - RNA, 20 nt, Homo sapiens
cucccugacaaauguggaaa

SEQ ID NO: 142660 - RNA, 20 nt, Homo sapiens
cucuaguaauaaaguuuccc

SEQ ID NO: 142661 - RNA, 22 nt, Homo sapiens
cucugagccugagguuccuacu

SEQ ID NO: 142662 - RNA, 22 nt, Homo sapiens
cucuggauauuccugucuaaaa

SEQ ID NO: 142663 - RNA, 22 nt, Homo sapiens
cucuuugaggugagcugcccau

SEQ ID NO: 142664 - RNA, 22 nt, Homo sapiens
cucuuugaguuccuccuggugu

SEQ ID NO: 142665 - RNA, 22 nt, Homo sapiens
cucuuuggaugccuuaggguua

SEQ ID NO: 142666 - RNA, 22 nt, Homo sapiens
cugaaaagcaucugcauagcug

SEQ ID NO: 142667 - RNA, 19 nt, Homo sapiens
cugaaacacagagagggcu

SEQ ID NO: 142668 - RNA, 22 nt, Homo sapiens
cugaaagagcauguaacacagu

SEQ ID NO: 142669 - RNA, 22 nt, Homo sapiens
cugaaagguauacgcuuguuau

SEQ ID NO: 142670 - RNA, 22 nt, Homo sapiens
cugaaucauugcauuaucaagg

SEQ ID NO: 142671 - RNA, 22 nt, Homo sapiens
cugacagaugacugccacugua

SEQ ID NO: 142672 - RNA, 22 nt, Homo sapiens
cugagaauguaaaugaagcuuu

SEQ ID NO: 142673 - RNA, 22 nt, Homo sapiens
cugagauuuuuagauccuggcg

SEQ ID NO: 142674 - RNA, 22 nt, Homo sapiens
cugagcaaaguucuauuuaugg

SEQ ID NO: 142675 - RNA, 22 nt, Homo sapiens
cugagcaagucauuuuguuaaa

SEQ ID NO: 142676 - RNA, 22 nt, Homo sapiens
cugagcaauauagugagaucuu

SEQ ID NO: 142677 - RNA, 22 nt, Homo sapiens
cugagguaauuuguugccagua

SEQ ID NO: 142678 - RNA, 22 nt, Homo sapiens
cugagguacccacuucaucuca

SEQ ID NO: 142679 - RNA, 20 nt, Homo sapiens
cugagguacgaggguuaaau

SEQ ID NO: 142680 - RNA, 22 nt, Homo sapiens
cugagguaggcccugagaauau

SEQ ID NO: 142681 - RNA, 22 nt, Homo sapiens
cugagguaggugaucagugcuu

SEQ ID NO: 142682 - RNA, 22 nt, Homo sapiens
cugaggugggaguuuuucucau

SEQ ID NO: 142683 - RNA, 22 nt, Homo sapiens
cugauauuuuucuggcuugugu

SEQ ID NO: 142684 - RNA, 21 nt, Homo sapiens
cugaucacaggugagcugccu

SEQ ID NO: 142685 - RNA, 22 nt, Homo sapiens
cugcaauguuugaaauggcaaa

SEQ ID NO: 142686 - RNA, 22 nt, Homo sapiens
cugcagguaggggcagcuuugg

SEQ ID NO: 142687 - RNA, 22 nt, Homo sapiens
cugccacugacaccucaaggac

SEQ ID NO: 142688 - RNA, 22 nt, Homo sapiens
cuggaaacaucuuaggaaugca

SEQ ID NO: 142689 - RNA, 22 nt, Homo sapiens
cuggagauauuggaagaaagaa

SEQ ID NO: 142690 - RNA, 22 nt, Homo sapiens
cuggagcaaaggugacucuugu

SEQ ID NO: 142691 - RNA, 19 nt, Homo sapiens
cuggcaaaugcuuuggcca

SEQ ID NO: 142692 - RNA, 22 nt, Homo sapiens
cuggcacagugucagaaacaca

SEQ ID NO: 142693 - RNA, 22 nt, Homo sapiens
cuggcucugagguguuuagggc

SEQ ID NO: 142694 - RNA, 22 nt, Homo sapiens
cuggcucugggcuaaagaaaua

SEQ ID NO: 142695 - RNA, 22 nt, Homo sapiens
cuggcucuguuagaagaaccag

SEQ ID NO: 142696 - RNA, 22 nt, Homo sapiens
cuguagacauuaggccugcacu

SEQ ID NO: 142697 - RNA, 22 nt, Homo sapiens
cugucagugggaguucaggcuu

SEQ ID NO: 142698 - RNA, 22 nt, Homo sapiens
cugugaacaugggagaaauggc

SEQ ID NO: 142699 - RNA, 22 nt, Homo sapiens
cuguucaggaggcauuuggugg

SEQ ID NO: 142700 - RNA, 18 nt, Homo sapiens
cuuagguagcucauucca

SEQ ID NO: 142701 - RNA, 22 nt, Homo sapiens
cuuagguuaugauaaauuuagu

SEQ ID NO: 142702 - RNA, 22 nt, Homo sapiens
cuucaaguguggccaccugacc

SEQ ID NO: 142703 - RNA, 20 nt, Homo sapiens
cuucacagaaguggaaucau

SEQ ID NO: 142704 - RNA, 22 nt, Homo sapiens
cuucaugagacuuuuggaaggc

SEQ ID NO: 142705 - RNA, 19 nt, Homo sapiens
cuugccccauucauccucu

SEQ ID NO: 142706 - RNA, 22 nt, Homo sapiens
cuuggacaccucaugcccaccu

SEQ ID NO: 142707 - RNA, 22 nt, Homo sapiens
cuuguuguggaggggagugcag

SEQ ID NO: 142708 - RNA, 22 nt, Homo sapiens
cuuucugaggagaauagagaac

SEQ ID NO: 142709 - RNA, 22 nt, Homo sapiens
cuuugcacaucucugcuuuccc

SEQ ID NO: 142710 - RNA, 18 nt, Homo sapiens
cuuugcagcuuccagagg

SEQ ID NO: 142711 - RNA, 22 nt, Homo sapiens
cuuugguguauuuucagagacc

SEQ ID NO: 142712 - RNA, 20 nt, Homo sapiens
cuuuguccuccugcugugcu

SEQ ID NO: 142713 - RNA, 22 nt, Homo sapiens
cuuuuacacugguggugggaau

SEQ ID NO: 142714 - RNA, 22 nt, Homo sapiens
cuuuuggugguucugaugcagg

SEQ ID NO: 142715 - RNA, 22 nt, Homo sapiens
cuuuugugauucuucaguugcu

SEQ ID NO: 142716 - RNA, 22 nt, Homo sapiens
gaaagugcugcaaggccaugca

SEQ ID NO: 142717 - RNA, 21 nt, Homo sapiens
gaaauacugccuuaggagcug

SEQ ID NO: 142718 - RNA, 18 nt, Homo sapiens
gaaaugccucuugcuuac

SEQ ID NO: 142719 - RNA, 22 nt, Homo sapiens
gaacugggguuggguugcgaua

SEQ ID NO: 142720 - RNA, 22 nt, Homo sapiens
gaacuguaaagaaauucuaagg

SEQ ID NO: 142721 - RNA, 22 nt, Homo sapiens
gaagaaguacaagacaaauuuu

SEQ ID NO: 142722 - RNA, 22 nt, Homo sapiens
gaauacugacuauuucaucugg

SEQ ID NO: 142723 - RNA, 22 nt, Homo sapiens
gaaugaauguuuauccuuagau

SEQ ID NO: 142724 - RNA, 22 nt, Homo sapiens
gaaugcuaaguuuccucccuau

SEQ ID NO: 142725 - RNA, 17 nt, Homo sapiens
gacauaggaaaaggaga

SEQ ID NO: 142726 - RNA, 22 nt, Homo sapiens
gacauguuucucucuguuuacu

SEQ ID NO: 142727 - RNA, 22 nt, Homo sapiens
gacuagauauuguucuauguca

SEQ ID NO: 142728 - RNA, 22 nt, Homo sapiens
gacuuugguagaggaaaaaucu

SEQ ID NO: 142729 - RNA, 22 nt, Homo sapiens
gagaacuggcgugaacugcacg

SEQ ID NO: 142730 - RNA, 22 nt, Homo sapiens
gagacauguuugccaauaauuu

SEQ ID NO: 142731 - RNA, 22 nt, Homo sapiens
gagacggagucucgcucugucg

SEQ ID NO: 142732 - RNA, 22 nt, Homo sapiens
gagacggagucuugcucuguug

SEQ ID NO: 142733 - RNA, 22 nt, Homo sapiens
gagauauguuggcagcugguau

SEQ ID NO: 142734 - RNA, 22 nt, Homo sapiens
gagauauuuagaaauguguucu

SEQ ID NO: 142735 - RNA, 22 nt, Homo sapiens
gagaucauucugauccagaguc

SEQ ID NO: 142736 - RNA, 22 nt, Homo sapiens
gagaucauugugggccaagcug

SEQ ID NO: 142737 - RNA, 22 nt, Homo sapiens
gagauggagucuuuuucuguca

SEQ ID NO: 142738 - RNA, 22 nt, Homo sapiens
gagcccauuucacuuguccagc

SEQ ID NO: 142739 - RNA, 20 nt, Homo sapiens
gagcucaucuucuuuaccac

SEQ ID NO: 142740 - RNA, 22 nt, Homo sapiens
gagcucauuaaaguaggaccua

SEQ ID NO: 142741 - RNA, 22 nt, Homo sapiens
gagcuguugguuugaaagaauu

SEQ ID NO: 142742 - RNA, 22 nt, Homo sapiens
gaggaucucuugagcccagaag

SEQ ID NO: 142743 - RNA, 22 nt, Homo sapiens
cuagcacauaguuauucacuca

SEQ ID NO: 142744 - RNA, 21 nt, Homo sapiens
cuaggaccaguucuguaauuc

SEQ ID NO: 142745 - RNA, 22 nt, Homo sapiens
cuaggugcaugagccguacagu

SEQ ID NO: 142746 - RNA, 22 nt, Homo sapiens
cuauacuguacacugaaugagg

SEQ ID NO: 142747 - RNA, 22 nt, Homo sapiens
cuaugcauuuuggaggagggaa

SEQ ID NO: 142748 - RNA, 22 nt, Homo sapiens
cuauggauuuacuguauagggu

SEQ ID NO: 142749 - RNA, 22 nt, Homo sapiens
cuauggcucugucuuuuaaguu

SEQ ID NO: 142750 - RNA, 22 nt, Homo sapiens
cuaugguuucuccauaucauca

SEQ ID NO: 142751 - RNA, 22 nt, Homo sapiens
cuauuacuuuuauugaacucag

SEQ ID NO: 142752 - RNA, 22 nt, Homo sapiens
cuauucacaauggugaagauau

SEQ ID NO: 142753 - RNA, 21 nt, Homo sapiens
cucaaaguacugauauuacag

SEQ ID NO: 142754 - RNA, 22 nt, Homo sapiens
cucaaagugcugggauuggcca

SEQ ID NO: 142755 - RNA, 22 nt, Homo sapiens
cucaaaguguggucuguggguu

SEQ ID NO: 142756 - RNA, 18 nt, Homo sapiens
cucaaccucaugcagggc

SEQ ID NO: 142757 - RNA, 22 nt, Homo sapiens
cucacugugguguccuuaggua

SEQ ID NO: 142758 - RNA, 22 nt, Homo sapiens
cuccacugagcaggugggaggc

SEQ ID NO: 142759 - RNA, 22 nt, Homo sapiens
cuccauuuaguccuuuuagaag

SEQ ID NO: 142760 - RNA, 22 nt, Homo sapiens
cuccauuuaucugaaauuuuau

SEQ ID NO: 142761 - RNA, 22 nt, Homo sapiens
ugauuugucugcaggaauagug

SEQ ID NO: 142762 - RNA, 22 nt, Homo sapiens
ugcaccaucuugcuucuguggu

SEQ ID NO: 142763 - RNA, 22 nt, Homo sapiens
ugcaccauugucaccuggguga

SEQ ID NO: 142764 - RNA, 22 nt, Homo sapiens
ugcagcauugcacuccagccug

SEQ ID NO: 142765 - RNA, 22 nt, Homo sapiens
ugcagcucagcugcggaguuuu

SEQ ID NO: 142766 - RNA, 22 nt, Homo sapiens
ugcagugugauuuucuggcuga

SEQ ID NO: 142767 - RNA, 22 nt, Homo sapiens
ugcaguuuaggaacugguaaca

SEQ ID NO: 142768 - RNA, 22 nt, Homo sapiens
ugcauagaauguucuguaaaua

SEQ ID NO: 142769 - RNA, 19 nt, Homo sapiens
ugcauaggguuacauacuc

SEQ ID NO: 142770 - RNA, 22 nt, Homo sapiens
ugcauauguucaaaguauucug

SEQ ID NO: 142771 - RNA, 22 nt, Homo sapiens
ugcauuguggaucuaaaugcau

SEQ ID NO: 142772 - RNA, 22 nt, Homo sapiens
ugcauuguuccgaauguguccu

SEQ ID NO: 142773 - RNA, 19 nt, Homo sapiens
ugccaagaaagucagcuua

SEQ ID NO: 142774 - RNA, 20 nt, Homo sapiens
ugccaagaugacuauagcuc

SEQ ID NO: 142775 - RNA, 22 nt, Homo sapiens
ugccaaggagucagucccuaga

SEQ ID NO: 142776 - RNA, 22 nt, Homo sapiens
ugccaggaugaggucaauguuu

SEQ ID NO: 142777 - RNA, 22 nt, Homo sapiens
ugcccaguggacagaaagucau

SEQ ID NO: 142778 - RNA, 21 nt, Homo sapiens
ugcccaguggcuuggggucag

SEQ ID NO: 142779 - RNA, 22 nt, Homo sapiens
ugccuaggcccaguccucagaa

SEQ ID NO: 142780 - RNA, 22 nt, Homo sapiens
ugccuaggcuggaaugcaaugg

SEQ ID NO: 142781 - RNA, 22 nt, Homo sapiens
ugccuaguggccuuaugaguau

SEQ ID NO: 142782 - RNA, 22 nt, Homo sapiens
ugccuaguguguugagaguuuu

SEQ ID NO: 142783 - RNA, 22 nt, Homo sapiens
ugcgccauugcacuccagccug

SEQ ID NO: 142784 - RNA, 22 nt, Homo sapiens
ugcuauguccccacccaaaucu

SEQ ID NO: 142785 - RNA, 21 nt, Homo sapiens
ugcuauguuguccaggcuggc

SEQ ID NO: 142786 - RNA, 22 nt, Homo sapiens
ugcucaccugcugcucaccucc

SEQ ID NO: 142787 - RNA, 23 nt, Homo sapiens
ugcugagaccuagauccuaaaga

SEQ ID NO: 142788 - RNA, 19 nt, Homo sapiens
ugcugcauugugaccuugc

SEQ ID NO: 142789 - RNA, 22 nt, Homo sapiens
ugcugguauuuggaccagccug

SEQ ID NO: 142790 - RNA, 22 nt, Homo sapiens
uggaaacuuauguucuucugug

SEQ ID NO: 142791 - RNA, 22 nt, Homo sapiens
uggaacugauauugauggaaaa

SEQ ID NO: 142792 - RNA, 22 nt, Homo sapiens
uggaagguaaguuuugagcauu

SEQ ID NO: 142793 - RNA, 22 nt, Homo sapiens
uggaaguauagauaauugaaag

SEQ ID NO: 142794 - RNA, 22 nt, Homo sapiens
uggaaugcuaagcaugugggag

SEQ ID NO: 142795 - RNA, 22 nt, Homo sapiens
uggaauggagagagggugcacg

SEQ ID NO: 142796 - RNA, 22 nt, Homo sapiens
uggacaagugcccuccaccuca

SEQ ID NO: 142797 - RNA, 22 nt, Homo sapiens
uggacauguacauauguguaug

SEQ ID NO: 142798 - RNA, 22 nt, Homo sapiens
ccuucacaggcacugguucaga

SEQ ID NO: 142799 - RNA, 22 nt, Homo sapiens
ccuuuuuguaguggaaguagga

SEQ ID NO: 142800 - RNA, 22 nt, Homo sapiens
cgcaguguuugugucccugggu

SEQ ID NO: 142801 - RNA, 22 nt, Homo sapiens
cgcccuguagcuagcuagaggu

SEQ ID NO: 142802 - RNA, 22 nt, Homo sapiens
cuaaaguucuucugagagaaca

SEQ ID NO: 142803 - RNA, 18 nt, Homo sapiens
cuaagacacuuggcagag

SEQ ID NO: 142804 - RNA, 22 nt, Homo sapiens
cuaaggaaggacugaaaggaca

SEQ ID NO: 142805 - RNA, 22 nt, Homo sapiens
cuaauacaguuguccaagcugg

SEQ ID NO: 142806 - RNA, 22 nt, Homo sapiens
cuagcacauuuaucuuuauaca

SEQ ID NO: 142807 - RNA, 22 nt, Homo sapiens
cuagcccagugcuccuggauca

SEQ ID NO: 142808 - RNA, 18 nt, Homo sapiens
cuaugccacuuuauauca

SEQ ID NO: 142809 - RNA, 22 nt, Homo sapiens
cuaugcuucuuaaauuaguuau

SEQ ID NO: 142810 - RNA, 22 nt, Homo sapiens
cucaccuugugauccacccgcc

SEQ ID NO: 142811 - RNA, 22 nt, Homo sapiens
cucacuaguaaggcuguuuagu

SEQ ID NO: 142812 - RNA, 17 nt, Homo sapiens
cucacugagaacagcua

SEQ ID NO: 142813 - RNA, 22 nt, Homo sapiens
cucacugcauuucaguuuuguu

SEQ ID NO: 142814 - RNA, 22 nt, Homo sapiens
cucacugucaacauguauuugg

SEQ ID NO: 142815 - RNA, 22 nt, Homo sapiens
cucagagcacaguuuaugacag

SEQ ID NO: 142816 - RNA, 22 nt, Homo sapiens
cucaguuuugccuuguuuaagg

SEQ ID NO: 142817 - RNA, 22 nt, Homo sapiens
ugacauggaagauguucaugau

SEQ ID NO: 142818 - RNA, 22 nt, Homo sapiens
ugacauggagagagaagccuuu

SEQ ID NO: 142819 - RNA, 22 nt, Homo sapiens
ugacauggagggugcggcugca

SEQ ID NO: 142820 - RNA, 22 nt, Homo sapiens
ugacauggagguggaggaagau

SEQ ID NO: 142821 - RNA, 22 nt, Homo sapiens
ugacauguagagaacuucucau

SEQ ID NO: 142822 - RNA, 22 nt, Homo sapiens
ugaccacagaaagugagggagc

SEQ ID NO: 142823 - RNA, 22 nt, Homo sapiens
ugacucaagagccugacucauc

SEQ ID NO: 142824 - RNA, 23 nt, Homo sapiens
ugacugaguauauguuuggugcu

SEQ ID NO: 142825 - RNA, 22 nt, Homo sapiens
ugacuugaggcucgcacaaguu

SEQ ID NO: 142826 - RNA, 23 nt, Homo sapiens
ugacuuguccagugauaguucgu

SEQ ID NO: 142827 - RNA, 20 nt, Homo sapiens
ugagaacauguggcauuugg

SEQ ID NO: 142828 - RNA, 20 nt, Homo sapiens
ugagaacaugugguauuugg

SEQ ID NO: 142829 - RNA, 21 nt, Homo sapiens
ugagacaauccuggucaauau

SEQ ID NO: 142830 - RNA, 22 nt, Homo sapiens
ugagacggagucuugcuaaguu

SEQ ID NO: 142831 - RNA, 22 nt, Homo sapiens
ugagagaugaacuauucuugaa

SEQ ID NO: 142832 - RNA, 22 nt, Homo sapiens
ugagagucacugaccugguaua

SEQ ID NO: 142833 - RNA, 22 nt, Homo sapiens
ugagauaggaucuugcucuguu

SEQ ID NO: 142834 - RNA, 22 nt, Homo sapiens
ugagauauauauauuugagaca

SEQ ID NO: 142835 - RNA, 22 nt, Homo sapiens
ugagauccugugacuacacuga

SEQ ID NO: 142836 - RNA, 22 nt, Homo sapiens
ugagaugaacuugauuguuuua

SEQ ID NO: 142837 - RNA, 19 nt, Homo sapiens
ugagaugaagacagggguu

SEQ ID NO: 142838 - RNA, 22 nt, Homo sapiens
ugagaugagucucgcucuguca

SEQ ID NO: 142839 - RNA, 22 nt, Homo sapiens
ugagaugauaucuuauuguaau

SEQ ID NO: 142840 - RNA, 22 nt, Homo sapiens
ugagauggaguuucgcccuugu

SEQ ID NO: 142841 - RNA, 22 nt, Homo sapiens
ugagauggaguuucgcuuuugu

SEQ ID NO: 142842 - RNA, 22 nt, Homo sapiens
ugagauggcugaauucagaaua

SEQ ID NO: 142843 - RNA, 22 nt, Homo sapiens
ugagauguguccagaucuaguu

SEQ ID NO: 142844 - RNA, 22 nt, Homo sapiens
ugagauuacguucggcccacuu

SEQ ID NO: 142845 - RNA, 21 nt, Homo sapiens
ugagauuauauuaacauggua

SEQ ID NO: 142846 - RNA, 22 nt, Homo sapiens
ugagcagagaagugcccugcgc

SEQ ID NO: 142847 - RNA, 22 nt, Homo sapiens
ugagcauuguuuggacuuggau

SEQ ID NO: 142848 - RNA, 22 nt, Homo sapiens
ugagccaugguuagcuucucau

SEQ ID NO: 142849 - RNA, 22 nt, Homo sapiens
ugagcucaguauuucauaaaca

SEQ ID NO: 142850 - RNA, 22 nt, Homo sapiens
ugagcugagaaaugcagcagcu

SEQ ID NO: 142851 - RNA, 22 nt, Homo sapiens
ugaggagugaacuauuucugau

SEQ ID NO: 142852 - RNA, 22 nt, Homo sapiens
ugaggaguguauuucauucgcu

SEQ ID NO: 142853 - RNA, 22 nt, Homo sapiens
ugaggcuagucagaucagauga

SEQ ID NO: 142854 - RNA, 22 nt, Homo sapiens
ugagguagaaugauucuaauau

SEQ ID NO: 142855 - RNA, 20 nt, Homo sapiens
ugaggucaggaguuacagac

SEQ ID NO: 142856 - RNA, 22 nt, Homo sapiens
ugaggucauguucugucagguu

SEQ ID NO: 142857 - RNA, 20 nt, Homo sapiens
ugaggucugagaaagaauga

SEQ ID NO: 142858 - RNA, 22 nt, Homo sapiens
ugagguguuugugcaccaucug

SEQ ID NO: 142859 - RNA, 22 nt, Homo sapiens
ugagguuauuuguucaagaagu

SEQ ID NO: 142860 - RNA, 22 nt, Homo sapiens
ugagugaacgcugagaccaaau

SEQ ID NO: 142861 - RNA, 21 nt, Homo sapiens
ugagugcugagugaggguuga

SEQ ID NO: 142862 - RNA, 22 nt, Homo sapiens
ugaguucuuuguagauucugug

SEQ ID NO: 142863 - RNA, 22 nt, Homo sapiens
ugaguuguaggggucaccuggc

SEQ ID NO: 142864 - RNA, 22 nt, Homo sapiens
ugaguuuaucuaaagaccuggg

SEQ ID NO: 142865 - RNA, 22 nt, Homo sapiens
ugauaugaaagggaaauaagug

SEQ ID NO: 142866 - RNA, 22 nt, Homo sapiens
ugauauguaugugaccuagaaa

SEQ ID NO: 142867 - RNA, 22 nt, Homo sapiens
ugaucugucucggguuaucagu

SEQ ID NO: 142868 - RNA, 22 nt, Homo sapiens
ugauguugaauuguucagcguc

SEQ ID NO: 142869 - RNA, 22 nt, Homo sapiens
agaugguguuuucucaccagau

SEQ ID NO: 142870 - RNA, 22 nt, Homo sapiens
agauguuguucaucugauuguu

SEQ ID NO: 142871 - RNA, 22 nt, Homo sapiens
agcacaguuaaaugaggcuucu

SEQ ID NO: 142872 - RNA, 22 nt, Homo sapiens
agcacauuaguaucuaagaaca

SEQ ID NO: 142873 - RNA, 22 nt, Homo sapiens
agcagcgacacccuguggugag

SEQ ID NO: 142874 - RNA, 22 nt, Homo sapiens
agcagcuuugcauggccuguga

SEQ ID NO: 142875 - RNA, 22 nt, Homo sapiens
agcaggacaauaugggaucagg

SEQ ID NO: 142876 - RNA, 20 nt, Homo sapiens
agcaucguuguguuauagcc

SEQ ID NO: 142877 - RNA, 22 nt, Homo sapiens
agcaugacauauuguagagaaa

SEQ ID NO: 142878 - RNA, 20 nt, Homo sapiens
agcauugguuagaacaguag

SEQ ID NO: 142879 - RNA, 16 nt, Homo sapiens
agccaccauuuacuug

SEQ ID NO: 142880 - RNA, 22 nt, Homo sapiens
agcccagagacuguguaaauuu

SEQ ID NO: 142881 - RNA, 21 nt, Homo sapiens
agcuaaauuggaaauuucugu

SEQ ID NO: 142882 - RNA, 22 nt, Homo sapiens
agcucacagccuagcacuguga

SEQ ID NO: 142883 - RNA, 22 nt, Homo sapiens
agcuccauuguaaucaccuggu

SEQ ID NO: 142884 - RNA, 22 nt, Homo sapiens
agcucuuguuaguauuagcagu

SEQ ID NO: 142885 - RNA, 22 nt, Homo sapiens
agcuggaauuuaagguagauag

SEQ ID NO: 142886 - RNA, 22 nt, Homo sapiens
agcuggacuugauaaaugaaua

SEQ ID NO: 142887 - RNA, 22 nt, Homo sapiens
agcugguuuauuucuauauccu

SEQ ID NO: 142888 - RNA, 22 nt, Homo sapiens
agcugguuuauuucucacaaca

SEQ ID NO: 142889 - RNA, 21 nt, Homo sapiens
agcugguuucuucuuacuccu

SEQ ID NO: 142890 - RNA, 22 nt, Homo sapiens
agcuguaguuuauucauguuaa

SEQ ID NO: 142891 - RNA, 22 nt, Homo sapiens
agcuucauuguuaugaauguca

SEQ ID NO: 142892 - RNA, 22 nt, Homo sapiens
aggaaaucuuagcugaggggau

SEQ ID NO: 142893 - RNA, 22 nt, Homo sapiens
aggaacuguaacuaugucucug

SEQ ID NO: 142894 - RNA, 22 nt, Homo sapiens
aggaagcuagcauuuguucagu

SEQ ID NO: 142895 - RNA, 22 nt, Homo sapiens
aggaagguaaacuaacuugccu

SEQ ID NO: 142896 - RNA, 22 nt, Homo sapiens
aggaccccucaucagcaccagu

SEQ ID NO: 142897 - RNA, 22 nt, Homo sapiens
aggagaucagccucccugcaac

SEQ ID NO: 142898 - RNA, 20 nt, Homo sapiens
aggagcauuuacauuggcuc

SEQ ID NO: 142899 - RNA, 22 nt, Homo sapiens
aggagguagucugucccuuagc

SEQ ID NO: 142900 - RNA, 22 nt, Homo sapiens
aggcaagaaugcuuguuucacc

SEQ ID NO: 142901 - RNA, 22 nt, Homo sapiens
aggcauguggcucuguucugac

SEQ ID NO: 142902 - RNA, 22 nt, Homo sapiens
agggaagugugcuaugcauuua

SEQ ID NO: 142903 - RNA, 22 nt, Homo sapiens
agguaaguauguuauuacuuuu

SEQ ID NO: 142904 - RNA, 22 nt, Homo sapiens
agguccacuuacuacuccuguu

SEQ ID NO: 142905 - RNA, 22 nt, Homo sapiens
agguccauuauuuucauucaug

SEQ ID NO: 142906 - RNA, 22 nt, Homo sapiens
aggugcucuuccuguaggucac

SEQ ID NO: 142907 - RNA, 22 nt, Homo sapiens
agguucccuuuuggccugggau

SEQ ID NO: 142908 - RNA, 22 nt, Homo sapiens
aguaacauuucuaguagagagu

SEQ ID NO: 142909 - RNA, 22 nt, Homo sapiens
aguaccauuacucacuuauuuu

SEQ ID NO: 142910 - RNA, 22 nt, Homo sapiens
agucaaaugcuuauguauaaag

SEQ ID NO: 142911 - RNA, 22 nt, Homo sapiens
agucgguguuacugacagaaug

SEQ ID NO: 142912 - RNA, 22 nt, Homo sapiens
agugaauuguucaacaggagga

SEQ ID NO: 142913 - RNA, 22 nt, Homo sapiens
agugagcugcagucuggggucc

SEQ ID NO: 142914 - RNA, 22 nt, Homo sapiens
agugcaauggcgugaucuuggc

SEQ ID NO: 142915 - RNA, 22 nt, Homo sapiens
agugccauggcugcuagauggc

SEQ ID NO: 142916 - RNA, 22 nt, Homo sapiens
aguggugucugaguggccaggg

SEQ ID NO: 142917 - RNA, 20 nt, Homo sapiens
agugguuuucaaauaugucu

SEQ ID NO: 142918 - RNA, 22 nt, Homo sapiens
aguguuuuuacaagcacucugg

SEQ ID NO: 142919 - RNA, 22 nt, Homo sapiens
aguuggcacugagcugugauug

SEQ ID NO: 142920 - RNA, 22 nt, Homo sapiens
aguuuuugcugauagcaugcuu

SEQ ID NO: 142921 - RNA, 18 nt, Homo sapiens
auaaacucaucauuuuua

SEQ ID NO: 142922 - RNA, 22 nt, Homo sapiens
auaacauggaguuugucauuua

SEQ ID NO: 142923 - RNA, 22 nt, Homo sapiens
auaaggcuaaggacuugaguua

SEQ ID NO: 142924 - RNA, 22 nt, Homo sapiens
auacaaguuauuugaacugcgg

SEQ ID NO: 142925 - RNA, 22 nt, Homo sapiens
auacuagucaagaauguaugag

SEQ ID NO: 142926 - RNA, 22 nt, Homo sapiens
auagcacaugugcaaauggcug

SEQ ID NO: 142927 - RNA, 22 nt, Homo sapiens
auagcagaacagugucucacug

SEQ ID NO: 142928 - RNA, 22 nt, Homo sapiens
auagcagacauuucaaggcagg

SEQ ID NO: 142929 - RNA, 22 nt, Homo sapiens
auagcagcaccccacuaccuca

SEQ ID NO: 142930 - RNA, 22 nt, Homo sapiens
auagggcacgagaugugagccu

SEQ ID NO: 142931 - RNA, 21 nt, Homo sapiens
auagugcuagagaguagcagg

SEQ ID NO: 142932 - RNA, 22 nt, Homo sapiens
auagugcugcaauaaacauacg

SEQ ID NO: 142933 - RNA, 22 nt, Homo sapiens
auagugcugcaauaaacauaug

SEQ ID NO: 142934 - RNA, 22 nt, Homo sapiens
auagugcuguauuaaacauacg

SEQ ID NO: 142935 - RNA, 22 nt, Homo sapiens
auaucaacaugguaggguuggu

SEQ ID NO: 142936 - RNA, 22 nt, Homo sapiens
auaucacaaacaagucuguacu

SEQ ID NO: 142937 - RNA, 22 nt, Homo sapiens
auaucacucccaauaucgcagg

SEQ ID NO: 142938 - RNA, 20 nt, Homo sapiens
auaugguugugagugauuuu

SEQ ID NO: 142939 - RNA, 18 nt, Homo sapiens
auauugcauuggauggau

SEQ ID NO: 142940 - RNA, 22 nt, Homo sapiens
auauuggccuaaaauucucuuu

SEQ ID NO: 142941 - RNA, 22 nt, Homo sapiens
aucacagguacuauggcugaca

SEQ ID NO: 142942 - RNA, 22 nt, Homo sapiens
aucaccauguguacauuagacc

SEQ ID NO: 142943 - RNA, 22 nt, Homo sapiens
aucacuguaaguuuacacuuug

SEQ ID NO: 142944 - RNA, 22 nt, Homo sapiens
aucacugugauuucuacugugc

SEQ ID NO: 142945 - RNA, 22 nt, Homo sapiens
aucacuguuuugaugcucggac

SEQ ID NO: 142946 - RNA, 22 nt, Homo sapiens
aucagcauucccaaaugaugug

SEQ ID NO: 142947 - RNA, 22 nt, Homo sapiens
aucauacuguuuugauuacugu

SEQ ID NO: 142948 - RNA, 18 nt, Homo sapiens
aucauugcacugucuugc

SEQ ID NO: 142949 - RNA, 22 nt, Homo sapiens
auccaguuuuaggagauuucua

SEQ ID NO: 142950 - RNA, 22 nt, Homo sapiens
auccucugagaucuaggcagag

SEQ ID NO: 142951 - RNA, 22 nt, Homo sapiens
auccugagacuuugcugaaguu

SEQ ID NO: 142952 - RNA, 22 nt, Homo sapiens
aucgcaccauugcacuccagca

SEQ ID NO: 142953 - RNA, 22 nt, Homo sapiens
aucucuugccagucagaauggu

SEQ ID NO: 142954 - RNA, 22 nt, Homo sapiens
aucugggguuggcaaaguuugg

SEQ ID NO: 142955 - RNA, 22 nt, Homo sapiens
aagcaccguugccuccccugca

SEQ ID NO: 142956 - RNA, 22 nt, Homo sapiens
aagcugcauuuucuagaugcuu

SEQ ID NO: 142957 - RNA, 22 nt, Homo sapiens
aagcuguauuguguugcuauaa

SEQ ID NO: 142958 - RNA, 22 nt, Homo sapiens
aaggaauucaaauuuucucugg

SEQ ID NO: 142959 - RNA, 22 nt, Homo sapiens
aaggaguaucuguuuucucacc

SEQ ID NO: 142960 - RNA, 22 nt, Homo sapiens
aaggauuguaacaccaagguua

SEQ ID NO: 142961 - RNA, 22 nt, Homo sapiens
aaggcaauuuguugugaggauu

SEQ ID NO: 142962 - RNA, 22 nt, Homo sapiens
aaguaauggaguuauuuuauga

SEQ ID NO: 142963 - RNA, 22 nt, Homo sapiens
aaguaauugagguuuuugcugu

SEQ ID NO: 142964 - RNA, 22 nt, Homo sapiens
aaguacuguuuaaauugcagaa

SEQ ID NO: 142965 - RNA, 19 nt, Homo sapiens
aaguacuugucuuuugaag

SEQ ID NO: 142966 - RNA, 22 nt, Homo sapiens
aaguauagcuaugauaaacauu

SEQ ID NO: 142967 - RNA, 22 nt, Homo sapiens
aaguccaugaagucuugugggu

SEQ ID NO: 142968 - RNA, 22 nt, Homo sapiens
aagugaguaauacgucaguugu

SEQ ID NO: 142969 - RNA, 22 nt, Homo sapiens
aagugcuguccuaccuuuggga

SEQ ID NO: 142970 - RNA, 22 nt, Homo sapiens
aagugcuucagaagacaauauu

SEQ ID NO: 142971 - RNA, 22 nt, Homo sapiens
aaguggaauguuuguggcacaa

SEQ ID NO: 142972 - RNA, 23 nt, Homo sapiens
aaguucaugcucaucuguuacac

SEQ ID NO: 142973 - RNA, 22 nt, Homo sapiens
aaguuguuggaguuccauuguu

SEQ ID NO: 142974 - RNA, 22 nt, Homo sapiens
aauaaaguaggaggugaggaaa

SEQ ID NO: 142975 - RNA, 22 nt, Homo sapiens
aauaucacaggguguacacuca

SEQ ID NO: 142976 - RNA, 22 nt, Homo sapiens
aaucacauugaaucugcuaccu

SEQ ID NO: 142977 - RNA, 21 nt, Homo sapiens
aaucacugucuguuuccccuu

SEQ ID NO: 142978 - RNA, 22 nt, Homo sapiens
aaucugggguuguuuggggagu

SEQ ID NO: 142979 - RNA, 22 nt, Homo sapiens
aaugccacugugccugccaagg

SEQ ID NO: 142980 - RNA, 22 nt, Homo sapiens
aaugcuguguuauuucaugacc

SEQ ID NO: 142981 - RNA, 22 nt, Homo sapiens
aaugugcuguucagaggagucc

SEQ ID NO: 142982 - RNA, 22 nt, Homo sapiens
aauuacuucuacaccaaccuaa

SEQ ID NO: 142983 - RNA, 22 nt, Homo sapiens
aauuaggcuagaauguuauuaa

SEQ ID NO: 142984 - RNA, 22 nt, Homo sapiens
aauugaaugauaugggacauuu

SEQ ID NO: 142985 - RNA, 22 nt, Homo sapiens
aauugcuuuuauuuagggccag

SEQ ID NO: 142986 - RNA, 23 nt, Homo sapiens
aauugcuuuugaggacuuaguug

SEQ ID NO: 142987 - RNA, 22 nt, Homo sapiens
acacaguauaugacaaugcuuu

SEQ ID NO: 142988 - RNA, 22 nt, Homo sapiens
acacaugugaaaaaaauguuac

SEQ ID NO: 142989 - RNA, 22 nt, Homo sapiens
acacaugugcguagacucuuua

SEQ ID NO: 142990 - RNA, 22 nt, Homo sapiens
acacugucucuugcugaccaug

SEQ ID NO: 142991 - RNA, 22 nt, Homo sapiens
acacuguuuuguggagaaugua

SEQ ID NO: 142992 - RNA, 22 nt, Homo sapiens
acagaaccauucacuccccugg

SEQ ID NO: 142993 - RNA, 20 nt, Homo sapiens
acagcacugguuucaagcaa

SEQ ID NO: 142994 - RNA, 22 nt, Homo sapiens
acagcagugccccacucuacug

SEQ ID NO: 142995 - RNA, 22 nt, Homo sapiens
acaggguuauuguaauaaugua

SEQ ID NO: 142996 - RNA, 22 nt, Homo sapiens
acagguacaagggauuaggaug

SEQ ID NO: 142997 - RNA, 22 nt, Homo sapiens
acaguacucugcucuuuugauu

SEQ ID NO: 142998 - RNA, 22 nt, Homo sapiens
acaguacuguuguuugcugcca

SEQ ID NO: 142999 - RNA, 23 nt, Homo sapiens
acaguauguggauguggcuaagu

SEQ ID NO: 143000 - RNA, 22 nt, Homo sapiens
acagucauagcagccuuuguua

SEQ ID NO: 143001 - RNA, 19 nt, Homo sapiens
acagugucucuauaaugau

SEQ ID NO: 143002 - RNA, 22 nt, Homo sapiens
acagugucugacacguaggaag

SEQ ID NO: 143003 - RNA, 22 nt, Homo sapiens
acauacacuagggauguggugu

SEQ ID NO: 143004 - RNA, 22 nt, Homo sapiens
acauaugaguacaugugccaug

SEQ ID NO: 143005 - RNA, 22 nt, Homo sapiens
acaucaggcuugugaugauuac

SEQ ID NO: 143006 - RNA, 22 nt, Homo sapiens
acaucauugggggcuacaggug

SEQ ID NO: 143007 - RNA, 22 nt, Homo sapiens
acaucccuugcucggggccccu

SEQ ID NO: 143008 - RNA, 22 nt, Homo sapiens
acaugccucccugguccgcugu

SEQ ID NO: 143009 - RNA, 22 nt, Homo sapiens
acauggcacugcgggcuucuug

SEQ ID NO: 143010 - RNA, 22 nt, Homo sapiens
acauguaauugauuuuguguua

SEQ ID NO: 143011 - RNA, 22 nt, Homo sapiens
accaguuuuuuauacaucuucu

SEQ ID NO: 143012 - RNA, 22 nt, Homo sapiens
acccaguguucagacuaccugu

SEQ ID NO: 143013 - RNA, 22 nt, Homo sapiens
accugcacagccgaacauagac

SEQ ID NO: 143014 - RNA, 22 nt, Homo sapiens
accugugguuacagucugucuc

SEQ ID NO: 143015 - RNA, 22 nt, Homo sapiens
acugagacugagaauguuucuu

SEQ ID NO: 143016 - RNA, 22 nt, Homo sapiens
acugagaucuuuaaauaaauaa

SEQ ID NO: 143017 - RNA, 23 nt, Homo sapiens
acugagcaauguuuacauacuug

SEQ ID NO: 143018 - RNA, 22 nt, Homo sapiens
acugagucauugggugcccaga

SEQ ID NO: 143019 - RNA, 22 nt, Homo sapiens
acugcacuccagccuggacgaa

SEQ ID NO: 143020 - RNA, 22 nt, Homo sapiens
acugcacuccagccuggacgac

SEQ ID NO: 143021 - RNA, 22 nt, Homo sapiens
acugcacuccagcuuuggguga

SEQ ID NO: 143022 - RNA, 18 nt, Homo sapiens
acuggauguaaagggucc

SEQ ID NO: 143023 - RNA, 22 nt, Homo sapiens
acuucauucucuggaucagaau

SEQ ID NO: 143024 - RNA, 19 nt, Homo sapiens
acuuuggugauuagaggga

SEQ ID NO: 143025 - RNA, 17 nt, Homo sapiens
acuuuuugaggaggcau

SEQ ID NO: 143026 - RNA, 22 nt, Homo sapiens
acuuuuugaugaggucguuugu

SEQ ID NO: 143027 - RNA, 22 nt, Homo sapiens
acuuuuugcaaccauuuggacc

SEQ ID NO: 143028 - RNA, 22 nt, Homo sapiens
agaaaugcagcaugaggcggca

SEQ ID NO: 143029 - RNA, 22 nt, Homo sapiens
agaaauguuuacucacccccuu

SEQ ID NO: 143030 - RNA, 22 nt, Homo sapiens
agaagaacauagggugacugaa

SEQ ID NO: 143031 - RNA, 22 nt, Homo sapiens
agaauguaaacagaauagagga

SEQ ID NO: 143032 - RNA, 19 nt, Homo sapiens
agagacucauuguagcauu

SEQ ID NO: 143033 - RNA, 22 nt, Homo sapiens
agagauaauuagguuaaaugag

SEQ ID NO: 143034 - RNA, 22 nt, Homo sapiens
agagaugauuaacauuuuggua

SEQ ID NO: 143035 - RNA, 22 nt, Homo sapiens
agagauuauccuggcuucucug

SEQ ID NO: 143036 - RNA, 22 nt, Homo sapiens
agagcaaugacaugcuaugugg

SEQ ID NO: 143037 - RNA, 18 nt, Homo sapiens
agagcuaugaacauaugc

SEQ ID NO: 143038 - RNA, 22 nt, Homo sapiens
agagguauuggaaggaguguca

SEQ ID NO: 143039 - RNA, 22 nt, Homo sapiens
agaguacugacguuugcaaauu

SEQ ID NO: 143040 - RNA, 23 nt, Homo sapiens
agaugcauucuuguaggauauau

SEQ ID NO: 143041 - RNA, 22 nt, Homo sapiens
uaauccuagcacuuuggaagac

SEQ ID NO: 143042 - RNA, 22 nt, Homo sapiens
uaauuggaucucaaaaaagugu

SEQ ID NO: 143043 - RNA, 22 nt, Homo sapiens
uacaaguauuuuuauuagugcc

SEQ ID NO: 143044 - RNA, 16 nt, Homo sapiens
uacaauguagaaaaca

SEQ ID NO: 143045 - RNA, 22 nt, Homo sapiens
uacacagucaaaaauuuccagg

SEQ ID NO: 143046 - RNA, 22 nt, Homo sapiens
uacaguaauguuaaucuuugug

SEQ ID NO: 143047 - RNA, 22 nt, Homo sapiens
uacauaguaagcacuaugccaa

SEQ ID NO: 143048 - RNA, 22 nt, Homo sapiens
uacauccauccugcugggcagu

SEQ ID NO: 143049 - RNA, 16 nt, Homo sapiens
uacauuuguuacaugg

SEQ ID NO: 143050 - RNA, 22 nt, Homo sapiens
uaccacugccgagaaaacagau

SEQ ID NO: 143051 - RNA, 22 nt, Homo sapiens
uacugcacuccaggcucaccug

SEQ ID NO: 143052 - RNA, 22 nt, Homo sapiens
uacugcagucagacuccugggc

SEQ ID NO: 143053 - RNA, 22 nt, Homo sapiens
uacugcuuaagggcaugggccc

SEQ ID NO: 143054 - RNA, 22 nt, Homo sapiens
uacuggguguucugagaaaaua

SEQ ID NO: 143055 - RNA, 22 nt, Homo sapiens
uacugguuuuauauauuucucc

SEQ ID NO: 143056 - RNA, 20 nt, Homo sapiens
uagaaaguagaguggugguu

SEQ ID NO: 143057 - RNA, 22 nt, Homo sapiens
uagacccauuguucagagagug

SEQ ID NO: 143058 - RNA, 20 nt, Homo sapiens
uagagagauauggggguucc

SEQ ID NO: 143059 - RNA, 22 nt, Homo sapiens
uagagcacauuaucauuuccaa

SEQ ID NO: 143060 - RNA, 22 nt, Homo sapiens
uagagccauugcagauguuuga

SEQ ID NO: 143061 - RNA, 22 nt, Homo sapiens
uagagguauuaacaguagaaga

SEQ ID NO: 143062 - RNA, 22 nt, Homo sapiens
uagaguguuuuguuaggcagca

SEQ ID NO: 143063 - RNA, 22 nt, Homo sapiens
uagcacagugucauucuaggua

SEQ ID NO: 143064 - RNA, 20 nt, Homo sapiens
uagcacaucuggcuguagag

SEQ ID NO: 143065 - RNA, 22 nt, Homo sapiens
uagcccagugagguugauuugg

SEQ ID NO: 143066 - RNA, 22 nt, Homo sapiens
uagcuaguauuuugcugaggau

SEQ ID NO: 143067 - RNA, 22 nt, Homo sapiens
uagcuggaguuuuuguuauagg

SEQ ID NO: 143068 - RNA, 22 nt, Homo sapiens
uagcugguucuccaggagcuag

SEQ ID NO: 143069 - RNA, 23 nt, Homo sapiens
uagcuucucccagaccugcuccc

SEQ ID NO: 143070 - RNA, 22 nt, Homo sapiens
uaggcaaguugcccaaucucuc

SEQ ID NO: 143071 - RNA, 22 nt, Homo sapiens
uagggcuugugaucagguguag

SEQ ID NO: 143072 - RNA, 22 nt, Homo sapiens
uagguagaacuuuagacccugu

SEQ ID NO: 143073 - RNA, 22 nt, Homo sapiens
uagguugucucuucacucugau

SEQ ID NO: 143074 - RNA, 22 nt, Homo sapiens
uaguaucauugaaacggcuugu

SEQ ID NO: 143075 - RNA, 22 nt, Homo sapiens
uaguugcaucuuaggucuguga

SEQ ID NO: 143076 - RNA, 22 nt, Homo sapiens
uaguugcauuggcugcuaugcu

SEQ ID NO: 143077 - RNA, 22 nt, Homo sapiens
uauaaugcacauucccaaaucu

SEQ ID NO: 143078 - RNA, 22 nt, Homo sapiens
uauagcacugaaagaggugauu

SEQ ID NO: 143079 - RNA, 22 nt, Homo sapiens
uauagcagccugaacaaaguaa

SEQ ID NO: 143080 - RNA, 22 nt, Homo sapiens
uaucacagcauugucuauaaua

SEQ ID NO: 143081 - RNA, 22 nt, Homo sapiens
uaucacuguuguuuguuuaagg

SEQ ID NO: 143082 - RNA, 22 nt, Homo sapiens
uaucagaguuacacugaagacu

SEQ ID NO: 143083 - RNA, 22 nt, Homo sapiens
uaucccuguggacuucccaaca

SEQ ID NO: 143084 - RNA, 22 nt, Homo sapiens
uaucugcacuucugucuagguc

SEQ ID NO: 143085 - RNA, 22 nt, Homo sapiens
uaucuuggaguuugacaaccaa

SEQ ID NO: 143086 - RNA, 20 nt, Homo sapiens
uaugacaaagccuagugagu

SEQ ID NO: 143087 - RNA, 22 nt, Homo sapiens
uaugcuuauaaacauuugucag

SEQ ID NO: 143088 - RNA, 22 nt, Homo sapiens
uauggcauuguuggugaugaua

SEQ ID NO: 143089 - RNA, 22 nt, Homo sapiens
uaugucuggaguuacugagcug

SEQ ID NO: 143090 - RNA, 22 nt, Homo sapiens
uauucaagccaaauucaagcca

SEQ ID NO: 143091 - RNA, 22 nt, Homo sapiens
uauugaauuuuuaagcccuuug

SEQ ID NO: 143092 - RNA, 22 nt, Homo sapiens
uauugacuugaugagggagggu

SEQ ID NO: 143093 - RNA, 22 nt, Homo sapiens
uauugcacuuuuccauaggagu

SEQ ID NO: 143094 - RNA, 20 nt, Homo sapiens
uauugccuaaauaccagaau

SEQ ID NO: 143095 - RNA, 22 nt, Homo sapiens
uauugcuaaauucuuuuccuag

SEQ ID NO: 143096 - RNA, 22 nt, Homo sapiens
uauugcugaugcugaagggaag

SEQ ID NO: 143097 - RNA, 18 nt, Homo sapiens
uauugcuugguuuggaga

SEQ ID NO: 143098 - RNA, 22 nt, Homo sapiens
uauugcuuuacucucuuauccu

SEQ ID NO: 143099 - RNA, 22 nt, Homo sapiens
uauugcuuuugauucaaggcag

SEQ ID NO: 143100 - RNA, 22 nt, Homo sapiens
uauuguuuuucccaggagucua

SEQ ID NO: 143101 - RNA, 22 nt, Homo sapiens
uauuugauuaacaagagccuaa

SEQ ID NO: 143102 - RNA, 22 nt, Homo sapiens
uauuuggugaaugaaugcaugu

SEQ ID NO: 143103 - RNA, 22 nt, Homo sapiens
ucaaagacacacaaggagaagg

SEQ ID NO: 143104 - RNA, 22 nt, Homo sapiens
ucaaaguauucuucugagaacc

SEQ ID NO: 143105 - RNA, 21 nt, Homo sapiens
ucaaaguguucuuuuguugaa

SEQ ID NO: 143106 - RNA, 22 nt, Homo sapiens
ucaaauguucccuguacuggcc

SEQ ID NO: 143107 - RNA, 22 nt, Homo sapiens
ucaacagugauggaaaguuaua

SEQ ID NO: 143108 - RNA, 19 nt, Homo sapiens
ucaagcuauucuccugccu

SEQ ID NO: 143109 - RNA, 22 nt, Homo sapiens
ucaaguaauacucccaucuugg

SEQ ID NO: 143110 - RNA, 22 nt, Homo sapiens
ucaaugaaugaugguugguaug

SEQ ID NO: 143111 - RNA, 22 nt, Homo sapiens
ucacaguagggaacugacaaag

SEQ ID NO: 143112 - RNA, 22 nt, Homo sapiens
ucacaguaucaugggggacaga

SEQ ID NO: 143113 - RNA, 22 nt, Homo sapiens
ucacagucggugacuucuugcu

SEQ ID NO: 143114 - RNA, 22 nt, Homo sapiens
ucacagugaguggaguggggug

SEQ ID NO: 143115 - RNA, 22 nt, Homo sapiens
ucacaguucagcauggcugagg

SEQ ID NO: 143116 - RNA, 22 nt, Homo sapiens
ucacauuguauauguaccuauc

SEQ ID NO: 143117 - RNA, 22 nt, Homo sapiens
ucaccaguaauaaagagccugc

SEQ ID NO: 143118 - RNA, 16 nt, Homo sapiens
ucaccccuagagaucc

SEQ ID NO: 143119 - RNA, 23 nt, Homo sapiens
ucacuagaguccuggaguuugag

SEQ ID NO: 143120 - RNA, 22 nt, Homo sapiens
ucacugagcacaggagaugugc

SEQ ID NO: 143121 - RNA, 21 nt, Homo sapiens
ucacugagcaucaugguuuca

SEQ ID NO: 143122 - RNA, 22 nt, Homo sapiens
ucacugagcuagaucacuugac

SEQ ID NO: 143123 - RNA, 22 nt, Homo sapiens
ucacugaggucugagcuuuaug

SEQ ID NO: 143124 - RNA, 22 nt, Homo sapiens
ucacugcgaccuccgccucccg

SEQ ID NO: 143125 - RNA, 22 nt, Homo sapiens
ucacuggacagaaauaaaggug

SEQ ID NO: 143126 - RNA, 22 nt, Homo sapiens
ucacugggagcauuugagccuu

SEQ ID NO: 143127 - RNA, 20 nt, Homo sapiens
ucacuggguucuugaagucu

SEQ ID NO: 143128 - RNA, 22 nt, Homo sapiens
ugccaugaagagaggaagcagu

SEQ ID NO: 143129 - RNA, 19 nt, Homo sapiens
ugccauguagcacaugguc

SEQ ID NO: 143130 - RNA, 22 nt, Homo sapiens
ugcccuuugucagaugaguagg

SEQ ID NO: 143131 - RNA, 22 nt, Homo sapiens
ugccuaggcuggagugcagugg

SEQ ID NO: 143132 - RNA, 22 nt, Homo sapiens
ugcucaguuuaaaacuuuugag

SEQ ID NO: 143133 - RNA, 22 nt, Homo sapiens
ugcuggugauucagauucaaau

SEQ ID NO: 143134 - RNA, 22 nt, Homo sapiens
ugcuguuguuugaugaaguaau

SEQ ID NO: 143135 - RNA, 22 nt, Homo sapiens
ugcuuugguagaaaucuuuggu

SEQ ID NO: 143136 - RNA, 22 nt, Homo sapiens
uggaaaguacuugaguuuguau

SEQ ID NO: 143137 - RNA, 22 nt, Homo sapiens
uggaagacaggcuguauuuuaa

SEQ ID NO: 143138 - RNA, 22 nt, Homo sapiens
uggaagacucuagucucuugag

SEQ ID NO: 143139 - RNA, 22 nt, Homo sapiens
uggaagcaugcaaucugugggg

SEQ ID NO: 143140 - RNA, 22 nt, Homo sapiens
uggaaucuacuaaagcaaaauc

SEQ ID NO: 143141 - RNA, 21 nt, Homo sapiens
uggaauguucugacuucaggg

SEQ ID NO: 143142 - RNA, 22 nt, Homo sapiens
uggacaugaagggcacaggagg

SEQ ID NO: 143143 - RNA, 22 nt, Homo sapiens
uggagcaaaguugaggccaagc

SEQ ID NO: 143144 - RNA, 22 nt, Homo sapiens
uggagguagagaugggaucucc

SEQ ID NO: 143145 - RNA, 22 nt, Homo sapiens
uggagucgugcccuugcauuua

SEQ ID NO: 143146 - RNA, 22 nt, Homo sapiens
uggaguguaaauuaguucagcc

SEQ ID NO: 143147 - RNA, 22 nt, Homo sapiens
uggauagaaauguacuguuuuc

SEQ ID NO: 143148 - RNA, 22 nt, Homo sapiens
uggauagaacuaagugcuuaga

SEQ ID NO: 143149 - RNA, 18 nt, Homo sapiens
uggauaugaaauucugga

SEQ ID NO: 143150 - RNA, 22 nt, Homo sapiens
uggaugacauccuuguaugcag

SEQ ID NO: 143151 - RNA, 22 nt, Homo sapiens
uggaugacuguuauaugcauau

SEQ ID NO: 143152 - RNA, 22 nt, Homo sapiens
uggcaagaccccaucucuacaa

SEQ ID NO: 143153 - RNA, 22 nt, Homo sapiens
uggcaauguggaaugguccagg

SEQ ID NO: 143154 - RNA, 19 nt, Homo sapiens
uggcacauguauacuuaug

SEQ ID NO: 143155 - RNA, 22 nt, Homo sapiens
uggcagcgugaauguggcugaa

SEQ ID NO: 143156 - RNA, 22 nt, Homo sapiens
uggcaugauauauauucguuug

SEQ ID NO: 143157 - RNA, 22 nt, Homo sapiens
uggcauggaaagcuuuucauac

SEQ ID NO: 143158 - RNA, 22 nt, Homo sapiens
uggcauguguuugaaugaguau

SEQ ID NO: 143159 - RNA, 23 nt, Homo sapiens
uggcauuuuaguuagcuucagug

SEQ ID NO: 143160 - RNA, 22 nt, Homo sapiens
uggcauuuugugugaauuagaa

SEQ ID NO: 143161 - RNA, 23 nt, Homo sapiens
uggcuagacguccuuuccugaug

SEQ ID NO: 143162 - RNA, 22 nt, Homo sapiens
uggcucuguuuguuaacuagac

SEQ ID NO: 143163 - RNA, 21 nt, Homo sapiens
uggcuguuuucaugcuagaac

SEQ ID NO: 143164 - RNA, 18 nt, Homo sapiens
ugggaagaaauucuucuc

SEQ ID NO: 143165 - RNA, 22 nt, Homo sapiens
ugggaucagcugggcucucugu

SEQ ID NO: 143166 - RNA, 22 nt, Homo sapiens
ugggaugaauacaaugggauca

SEQ ID NO: 143167 - RNA, 22 nt, Homo sapiens
ugggaugaugaaaaggcuuucu

SEQ ID NO: 143168 - RNA, 22 nt, Homo sapiens
ugggaugaugcuugagaauauc

SEQ ID NO: 143169 - RNA, 22 nt, Homo sapiens
ugggcggagacgugcagccgcc

SEQ ID NO: 143170 - RNA, 22 nt, Homo sapiens
ugggguaggccugguuaugugc

SEQ ID NO: 143171 - RNA, 22 nt, Homo sapiens
uggguaggcccucauuggacag

SEQ ID NO: 143172 - RNA, 22 nt, Homo sapiens
uggucaugaggugaggcuucuc

SEQ ID NO: 143173 - RNA, 22 nt, Homo sapiens
uggucuccuuuguacccugggc

SEQ ID NO: 143174 - RNA, 22 nt, Homo sapiens
uggucuucuggccuccagaacc

SEQ ID NO: 143175 - RNA, 20 nt, Homo sapiens
ugguguuugaacagugaaug

SEQ ID NO: 143176 - RNA, 22 nt, Homo sapiens
uguaaaaagcccagccgcugag

SEQ ID NO: 143177 - RNA, 20 nt, Homo sapiens
uguaacaaucuggauguugc

SEQ ID NO: 143178 - RNA, 22 nt, Homo sapiens
uguaaugaucaaaucagaguaa

SEQ ID NO: 143179 - RNA, 22 nt, Homo sapiens
uguacaugggacaggaggagag

SEQ ID NO: 143180 - RNA, 22 nt, Homo sapiens
uguagauauucuuucaguuuuu

SEQ ID NO: 143181 - RNA, 22 nt, Homo sapiens
uguagcaaauaaaagucuggau

SEQ ID NO: 143182 - RNA, 22 nt, Homo sapiens
uguagcagccauaaacacagug

SEQ ID NO: 143183 - RNA, 22 nt, Homo sapiens
uguagucauuugaaggaugucc

SEQ ID NO: 143184 - RNA, 23 nt, Homo sapiens
uguauacacccugugcaucuggg

SEQ ID NO: 143185 - RNA, 21 nt, Homo sapiens
uguauacauggaagaaugguc

SEQ ID NO: 143186 - RNA, 22 nt, Homo sapiens
uguaugagagugaaagcauuuc

SEQ ID NO: 143187 - RNA, 16 nt, Homo sapiens
uguauugcuaaaaaga

SEQ ID NO: 143188 - RNA, 22 nt, Homo sapiens
ugucacagagauuuugguaugu

SEQ ID NO: 143189 - RNA, 22 nt, Homo sapiens
ugucaccauuuguaggugagga

SEQ ID NO: 143190 - RNA, 22 nt, Homo sapiens
ugucaggaguuuuagaaucuua

SEQ ID NO: 143191 - RNA, 22 nt, Homo sapiens
ugucccaguuggguauugaauu

SEQ ID NO: 143192 - RNA, 16 nt, Homo sapiens
ugucuguuugggcaca

SEQ ID NO: 143193 - RNA, 22 nt, Homo sapiens
ugucuuguagacugaaggcuuc

SEQ ID NO: 143194 - RNA, 22 nt, Homo sapiens
ugugacagcacgguucaacugc

SEQ ID NO: 143195 - RNA, 22 nt, Homo sapiens
ugugacagguauccuguguucu

SEQ ID NO: 143196 - RNA, 18 nt, Homo sapiens
ugugacauugagcauguc

SEQ ID NO: 143197 - RNA, 22 nt, Homo sapiens
ugugacucugcauuuuggguuc

SEQ ID NO: 143198 - RNA, 22 nt, Homo sapiens
ugugagaaaugcagaaucucag

SEQ ID NO: 143199 - RNA, 22 nt, Homo sapiens
ugugauggaguuucauggacug

SEQ ID NO: 143200 - RNA, 22 nt, Homo sapiens
ugugccuaguaauguguccaga

SEQ ID NO: 143201 - RNA, 22 nt, Homo sapiens
uguguauaucacugcaugagug

SEQ ID NO: 143202 - RNA, 21 nt, Homo sapiens
uguuaacaugcagauuacugg

SEQ ID NO: 143203 - RNA, 22 nt, Homo sapiens
uguuaacauggucucagucugu

SEQ ID NO: 143204 - RNA, 22 nt, Homo sapiens
uguucauggauccaguggcuuc

SEQ ID NO: 143205 - RNA, 22 nt, Homo sapiens
uguucuugaguugggaguacaa

SEQ ID NO: 143206 - RNA, 22 nt, Homo sapiens
uguugcaccugccuugcuuuag

SEQ ID NO: 143207 - RNA, 22 nt, Homo sapiens
uguuuguuugugauacgguaca

SEQ ID NO: 143208 - RNA, 20 nt, Homo sapiens
uuaaaucuagugcagacuca

SEQ ID NO: 143209 - RNA, 22 nt, Homo sapiens
uuaagcaaagguaacaugagaa

SEQ ID NO: 143210 - RNA, 22 nt, Homo sapiens
uuaagcaguggauuagaauuuu

SEQ ID NO: 143211 - RNA, 22 nt, Homo sapiens
uuaaggcagugcaucuggaguu

SEQ ID NO: 143212 - RNA, 22 nt, Homo sapiens
uuaaggcuuguacuuguuuucu

SEQ ID NO: 143213 - RNA, 21 nt, Homo sapiens
uuaaguaauuacccaacucuc

SEQ ID NO: 143214 - RNA, 22 nt, Homo sapiens
uuaaugaacuuuauuuuguaga

SEQ ID NO: 143215 - RNA, 22 nt, Homo sapiens
ugugcaaaaacaauugcgguuu

SEQ ID NO: 143216 - RNA, 22 nt, Homo sapiens
ugugcaaaaguaauugcgguuu

SEQ ID NO: 143217 - RNA, 22 nt, Homo sapiens
ugugcacaugauauaucacaua

SEQ ID NO: 143218 - RNA, 22 nt, Homo sapiens
ugugcacauugugcagguugau

SEQ ID NO: 143219 - RNA, 22 nt, Homo sapiens
ugugccacugcacuccugccug

SEQ ID NO: 143220 - RNA, 22 nt, Homo sapiens
ugugccugagguuaacauuguu

SEQ ID NO: 143221 - RNA, 22 nt, Homo sapiens
uguggcacuguguccagagaaa

SEQ ID NO: 143222 - RNA, 22 nt, Homo sapiens
uguggcagugcuuuaugaaacc

SEQ ID NO: 143223 - RNA, 23 nt, Homo sapiens
ugugguauuauuccauuuauagg

SEQ ID NO: 143224 - RNA, 22 nt, Homo sapiens
ugugguuuuaguaaaacuaugu

SEQ ID NO: 143225 - RNA, 22 nt, Homo sapiens
uguguaaauaugauagaggaau

SEQ ID NO: 143226 - RNA, 22 nt, Homo sapiens
uguuacagcagaauugauugca

SEQ ID NO: 143227 - RNA, 22 nt, Homo sapiens
uguucaugaguucucauuuuua

SEQ ID NO: 143228 - RNA, 19 nt, Homo sapiens
uguugcacauaucaauaug

SEQ ID NO: 143229 - RNA, 22 nt, Homo sapiens
uguugcauuugucaaggucaag

SEQ ID NO: 143230 - RNA, 22 nt, Homo sapiens
uguuggacuuacuuggcagauu

SEQ ID NO: 143231 - RNA, 22 nt, Homo sapiens
uguuuugguugucccuggccag

SEQ ID NO: 143232 - RNA, 23 nt, Homo sapiens
uuaagcaacggcugcuuuucaga

SEQ ID NO: 143233 - RNA, 22 nt, Homo sapiens
uuaaggaaagcauuuaauucag

SEQ ID NO: 143234 - RNA, 22 nt, Homo sapiens
uuaaucugucuaugauuuuggu

SEQ ID NO: 143235 - RNA, 22 nt, Homo sapiens
uuaaugcuuuugggauauuucu

SEQ ID NO: 143236 - RNA, 22 nt, Homo sapiens
uuacaguugugagccaccaugc

SEQ ID NO: 143237 - RNA, 22 nt, Homo sapiens
uuaccugagaaggugacauuug

SEQ ID NO: 143238 - RNA, 22 nt, Homo sapiens
uuagcacuaauucguuggggca

SEQ ID NO: 143239 - RNA, 22 nt, Homo sapiens
uuagcaguggauggguggagaa

SEQ ID NO: 143240 - RNA, 22 nt, Homo sapiens
uuagugaaugcaccacuucuga

SEQ ID NO: 143241 - RNA, 22 nt, Homo sapiens
uuauauguuuguacuuaggccu

SEQ ID NO: 143242 - RNA, 17 nt, Homo sapiens
uuaugagacuucuuagc

SEQ ID NO: 143243 - RNA, 22 nt, Homo sapiens
uuaugcagcaaagugcuugaaa

SEQ ID NO: 143244 - RNA, 22 nt, Homo sapiens
uuaugcuuauugguguacggua

SEQ ID NO: 143245 - RNA, 22 nt, Homo sapiens
uuaugcuugugugaauuuuccc

SEQ ID NO: 143246 - RNA, 22 nt, Homo sapiens
uuauugcacuccagccugggua

SEQ ID NO: 143247 - RNA, 22 nt, Homo sapiens
uucaaaguguugguuuugggcu

SEQ ID NO: 143248 - RNA, 22 nt, Homo sapiens
uucaaguaagaaagacaucagg

SEQ ID NO: 143249 - RNA, 22 nt, Homo sapiens
uucaauacuguugauccuuaug

SEQ ID NO: 143250 - RNA, 22 nt, Homo sapiens
uucacaugguugccuuuugauc

SEQ ID NO: 143251 - RNA, 21 nt, Homo sapiens
uucaccauggcuccacacucu

SEQ ID NO: 143252 - RNA, 23 nt, Homo sapiens
uucaccguguuggccaggcuggu

SEQ ID NO: 143253 - RNA, 22 nt, Homo sapiens
uucacugagccagacuaagaca

SEQ ID NO: 143254 - RNA, 22 nt, Homo sapiens
uucacugugaacucauauucag

SEQ ID NO: 143255 - RNA, 22 nt, Homo sapiens
uucacugugugacccugggcca

SEQ ID NO: 143256 - RNA, 22 nt, Homo sapiens
uucagcaaugacagccuauaua

SEQ ID NO: 143257 - RNA, 22 nt, Homo sapiens
uucagcaggccaggcccugacu

SEQ ID NO: 143258 - RNA, 22 nt, Homo sapiens
uucaguagucaaaagauaaggg

SEQ ID NO: 143259 - RNA, 18 nt, Homo sapiens
uucaguuuguaucugggg

SEQ ID NO: 143260 - RNA, 22 nt, Homo sapiens
uucauagucuaugcaaguaaga

SEQ ID NO: 143261 - RNA, 22 nt, Homo sapiens
uucauaguucuuuuagucauua

SEQ ID NO: 143262 - RNA, 21 nt, Homo sapiens
uucaucagccagaaaucaagc

SEQ ID NO: 143263 - RNA, 22 nt, Homo sapiens
uucaucuggcaauucagagauu

SEQ ID NO: 143264 - RNA, 22 nt, Homo sapiens
uucauugaaugauuuuuagaag

SEQ ID NO: 143265 - RNA, 22 nt, Homo sapiens
uuccacaaugguugaacuagcu

SEQ ID NO: 143266 - RNA, 22 nt, Homo sapiens
uuccacaaugguugaacuaguu

SEQ ID NO: 143267 - RNA, 22 nt, Homo sapiens
uuccacuuuuuccuugugcucc

SEQ ID NO: 143268 - RNA, 22 nt, Homo sapiens
uuccaguaauagcacagcauug

SEQ ID NO: 143269 - RNA, 21 nt, Homo sapiens
uuccagugagccuagaugccu

SEQ ID NO: 143270 - RNA, 22 nt, Homo sapiens
uuccaguuuuauggguauagag

SEQ ID NO: 143271 - RNA, 22 nt, Homo sapiens
uucccagugguuagcucugguc

SEQ ID NO: 143272 - RNA, 22 nt, Homo sapiens
uucccuagaacacauggaggga

SEQ ID NO: 143273 - RNA, 22 nt, Homo sapiens
uucccugugggaguaggaaagu

SEQ ID NO: 143274 - RNA, 22 nt, Homo sapiens
uucccugugugcagaugggugu

SEQ ID NO: 143275 - RNA, 23 nt, Homo sapiens
uucccuuagaagaaggggagaaa

SEQ ID NO: 143276 - RNA, 22 nt, Homo sapiens
uucccuuucuuaaagaguuagg

SEQ ID NO: 143277 - RNA, 22 nt, Homo sapiens
uucccuuugaauuggaaaggug

SEQ ID NO: 143278 - RNA, 22 nt, Homo sapiens
uucccuuugugcauaggauuug

SEQ ID NO: 143279 - RNA, 22 nt, Homo sapiens
uuccugagagggcugggugcag

SEQ ID NO: 143280 - RNA, 22 nt, Homo sapiens
uuccuugguucagggaaggucc

SEQ ID NO: 143281 - RNA, 22 nt, Homo sapiens
uucguuuguaauccuuacagca

SEQ ID NO: 143282 - RNA, 20 nt, Homo sapiens
uucuacagucacaggaagau

SEQ ID NO: 143283 - RNA, 21 nt, Homo sapiens
uucuacuccggcguuguuuuu

SEQ ID NO: 143284 - RNA, 22 nt, Homo sapiens
uucuaugguuuaauaguuuggg

SEQ ID NO: 143285 - RNA, 22 nt, Homo sapiens
uucucaaggagccuucguaacu

SEQ ID NO: 143286 - RNA, 22 nt, Homo sapiens
uucucagugcuaucuuuuaugc

SEQ ID NO: 143287 - RNA, 22 nt, Homo sapiens
uucugagguuauauucucucaa

SEQ ID NO: 143288 - RNA, 22 nt, Homo sapiens
uucugcuagucugucagaucuu

SEQ ID NO: 143289 - RNA, 22 nt, Homo sapiens
uucugcuugaucuaguguguug

SEQ ID NO: 143290 - RNA, 22 nt, Homo sapiens
uucuggccccucccaaucucau

SEQ ID NO: 143291 - RNA, 22 nt, Homo sapiens
uucuggcuuuuaaagaaauguu

SEQ ID NO: 143292 - RNA, 19 nt, Homo sapiens
uucugguguuuuaagccaa

SEQ ID NO: 143293 - RNA, 22 nt, Homo sapiens
uucugugguagaaaucucaaau

SEQ ID NO: 143294 - RNA, 22 nt, Homo sapiens
uucugugguugaaaggagagau

SEQ ID NO: 143295 - RNA, 22 nt, Homo sapiens
uucuuagucaaguuguauuuca

SEQ ID NO: 143296 - RNA, 22 nt, Homo sapiens
uugaaagaugaacuggauugga

SEQ ID NO: 143297 - RNA, 22 nt, Homo sapiens
uugaaaguaaacaucacaaaga

SEQ ID NO: 143298 - RNA, 22 nt, Homo sapiens
uugaaaguguucacaaugguau

SEQ ID NO: 143299 - RNA, 22 nt, Homo sapiens
uugaacuagaaccugcaaauuu

SEQ ID NO: 143300 - RNA, 22 nt, Homo sapiens
uugaaggaggugcucacucucg

SEQ ID NO: 143301 - RNA, 22 nt, Homo sapiens
ugaaaugaucaguuugguuacu

SEQ ID NO: 143302 - RNA, 22 nt, Homo sapiens
ugaaaugccuugagauuuugac

SEQ ID NO: 143303 - RNA, 22 nt, Homo sapiens
ugaaaugccuuuaaugaauuua

SEQ ID NO: 143304 - RNA, 22 nt, Homo sapiens
uggagcccuaguuccucauaac

SEQ ID NO: 143305 - RNA, 22 nt, Homo sapiens
uggaguaggccuaagaaugaca

SEQ ID NO: 143306 - RNA, 19 nt, Homo sapiens
uggagucaucaugcugcua

SEQ ID NO: 143307 - RNA, 22 nt, Homo sapiens
uggagugucaguuuccagaguu

SEQ ID NO: 143308 - RNA, 22 nt, Homo sapiens
uggaucaugcgaggccuccccu

SEQ ID NO: 143309 - RNA, 22 nt, Homo sapiens
uggaucuguucuauuuaucuga

SEQ ID NO: 143310 - RNA, 22 nt, Homo sapiens
uggcaaauagcaauaggagggu

SEQ ID NO: 143311 - RNA, 22 nt, Homo sapiens
uggcaagugggaccuaguuaaa

SEQ ID NO: 143312 - RNA, 18 nt, Homo sapiens
uggcaauaugguucuacc

SEQ ID NO: 143313 - RNA, 22 nt, Homo sapiens
uggcaugaaguguguuuuaucu

SEQ ID NO: 143314 - RNA, 17 nt, Homo sapiens
uggcaugaggguguggg

SEQ ID NO: 143315 - RNA, 22 nt, Homo sapiens
uggcaugauguguucauugaaa

SEQ ID NO: 143316 - RNA, 22 nt, Homo sapiens
uggcccccucccaaaucucaua

SEQ ID NO: 143317 - RNA, 22 nt, Homo sapiens
uggcgagaaaccauaugcuuuc

SEQ ID NO: 143318 - RNA, 22 nt, Homo sapiens
uggcgagaugcucgugugcaga

SEQ ID NO: 143319 - RNA, 22 nt, Homo sapiens
uggcgggaaaguugggagaaga

SEQ ID NO: 143320 - RNA, 22 nt, Homo sapiens
ugggaauaugauacaggucuuu

SEQ ID NO: 143321 - RNA, 22 nt, Homo sapiens
ugggguagaauagaauugauau

SEQ ID NO: 143322 - RNA, 22 nt, Homo sapiens
uggguaggaccagaaaugcacu

SEQ ID NO: 143323 - RNA, 22 nt, Homo sapiens
uggucaccugaauuaugcaugu

SEQ ID NO: 143324 - RNA, 22 nt, Homo sapiens
uggucaccuucuugcucugucu

SEQ ID NO: 143325 - RNA, 22 nt, Homo sapiens
ugguccaguucugugauauugc

SEQ ID NO: 143326 - RNA, 22 nt, Homo sapiens
ugguccccaauacuucuauaga

SEQ ID NO: 143327 - RNA, 22 nt, Homo sapiens
uggucuggagagucccgcccag

SEQ ID NO: 143328 - RNA, 22 nt, Homo sapiens
uggugagaaacuagauauuuuu

SEQ ID NO: 143329 - RNA, 22 nt, Homo sapiens
uggugcuugaugaggguggagc

SEQ ID NO: 143330 - RNA, 20 nt, Homo sapiens
uggugucuuggaaagagcuc

SEQ ID NO: 143331 - RNA, 22 nt, Homo sapiens
uguaauguuucaucauuauuaa

SEQ ID NO: 143332 - RNA, 22 nt, Homo sapiens
uguaauuuaaaugauccuugga

SEQ ID NO: 143333 - RNA, 22 nt, Homo sapiens
uguacaaaacaagaugggggua

SEQ ID NO: 143334 - RNA, 22 nt, Homo sapiens
uguagacaccaaagacagcaua

SEQ ID NO: 143335 - RNA, 22 nt, Homo sapiens
uguagauaucauuagugcugug

SEQ ID NO: 143336 - RNA, 22 nt, Homo sapiens
uguauauguuuguacauauguc

SEQ ID NO: 143337 - RNA, 22 nt, Homo sapiens
uguaugcuuuugagagauauuu

SEQ ID NO: 143338 - RNA, 22 nt, Homo sapiens
uguauuuguuguuaaauggaga

SEQ ID NO: 143339 - RNA, 22 nt, Homo sapiens
ugucaaguugugguucaauuuu

SEQ ID NO: 143340 - RNA, 22 nt, Homo sapiens
ugucagcacaacucagguuccu

SEQ ID NO: 143341 - RNA, 22 nt, Homo sapiens
ugucauauagaauguucuauga

SEQ ID NO: 143342 - RNA, 22 nt, Homo sapiens
uguccugcagagguguuugccu

SEQ ID NO: 143343 - RNA, 22 nt, Homo sapiens
uguccuggugaugcccaaauuc

SEQ ID NO: 143344 - RNA, 22 nt, Homo sapiens
ugucuggaaggguggccuccug

SEQ ID NO: 143345 - RNA, 22 nt, Homo sapiens
ugucuuggacuugaaucucauu

SEQ ID NO: 143346 - RNA, 21 nt, Homo sapiens
ugucuuggagccagacgccag

SEQ ID NO: 143347 - RNA, 21 nt, Homo sapiens
ugugaaaucuaggcagagguu

SEQ ID NO: 143348 - RNA, 22 nt, Homo sapiens
ugugaauggugcugcaaugaac

SEQ ID NO: 143349 - RNA, 22 nt, Homo sapiens
ugugacaaauuuaguggacugu

SEQ ID NO: 143350 - RNA, 22 nt, Homo sapiens
ugugacaguguuacauuucaug

SEQ ID NO: 143351 - RNA, 20 nt, Homo sapiens
ugugauuauuuaguugcaug

SEQ ID NO: 143352 - RNA, 22 nt, Homo sapiens
ugugauuauuuauagacaguca

SEQ ID NO: 143353 - RNA, 22 nt, Homo sapiens
uguggcaaauggucaggaagaa

SEQ ID NO: 143354 - RNA, 22 nt, Homo sapiens
ugugguauuagguguaguaucu

SEQ ID NO: 143355 - RNA, 22 nt, Homo sapiens
uguuacagcagcacaaaaugga

SEQ ID NO: 143356 - RNA, 22 nt, Homo sapiens
uguuacagugacuaauguuuua

SEQ ID NO: 143357 - RNA, 22 nt, Homo sapiens
uguuagguuggugcaaaaguga

SEQ ID NO: 143358 - RNA, 22 nt, Homo sapiens
uguucaauucccaccuaugagu

SEQ ID NO: 143359 - RNA, 22 nt, Homo sapiens
uguuugguggucucuucacaug

SEQ ID NO: 143360 - RNA, 22 nt, Homo sapiens
uguuuuggaggccagaagucca

SEQ ID NO: 143361 - RNA, 22 nt, Homo sapiens
uguuuuggaguggacuuugcau

SEQ ID NO: 143362 - RNA, 22 nt, Homo sapiens
uuaaaagcuaucuccaagguca

SEQ ID NO: 143363 - RNA, 22 nt, Homo sapiens
uuaaaguguuuucaaaauguca

SEQ ID NO: 143364 - RNA, 22 nt, Homo sapiens
uuaaaugucuguagaugugcug

SEQ ID NO: 143365 - RNA, 22 nt, Homo sapiens
uuaacacugccauugauacugu

SEQ ID NO: 143366 - RNA, 22 nt, Homo sapiens
uuaagaagugauuuuccucauu

SEQ ID NO: 143367 - RNA, 21 nt, Homo sapiens
uuaagugcuuuguaugcacua

SEQ ID NO: 143368 - RNA, 22 nt, Homo sapiens
uuaauacugcuuaacuuuagga

SEQ ID NO: 143369 - RNA, 21 nt, Homo sapiens
uuacaauggcuccuugaaggu

SEQ ID NO: 143370 - RNA, 22 nt, Homo sapiens
uuacagauggauggcagcuggc

SEQ ID NO: 143371 - RNA, 22 nt, Homo sapiens
uuacagauggcacacucaaggg

SEQ ID NO: 143372 - RNA, 22 nt, Homo sapiens
uuacaguaugaguaagaguucu

SEQ ID NO: 143373 - RNA, 22 nt, Homo sapiens
uuacagucaccugggggacaua

SEQ ID NO: 143374 - RNA, 19 nt, Homo sapiens
uuacagugugcccuuuuag

SEQ ID NO: 143375 - RNA, 22 nt, Homo sapiens
uuacaugucuugguaagguuag

SEQ ID NO: 143376 - RNA, 22 nt, Homo sapiens
uuaccacagugccugucuaaug

SEQ ID NO: 143377 - RNA, 22 nt, Homo sapiens
uuaccagucugauuccuguuag

SEQ ID NO: 143378 - RNA, 22 nt, Homo sapiens
uuacccauuagagaauuuaaga

SEQ ID NO: 143379 - RNA, 22 nt, Homo sapiens
uuacccuuuaacccuuuaaagu

SEQ ID NO: 143380 - RNA, 20 nt, Homo sapiens
uuacuccuuaaugagguuuu

SEQ ID NO: 143381 - RNA, 22 nt, Homo sapiens
uuacuguauagaaucaucuuga

SEQ ID NO: 143382 - RNA, 22 nt, Homo sapiens
uuagccccuuugagccucaacu

SEQ ID NO: 143383 - RNA, 22 nt, Homo sapiens
uuagguauuuuguuaugucagc

SEQ ID NO: 143384 - RNA, 22 nt, Homo sapiens
uuagugaaugggugugauuugu

SEQ ID NO: 143385 - RNA, 22 nt, Homo sapiens
uuagugcuuacgaugagcuaag

SEQ ID NO: 143386 - RNA, 22 nt, Homo sapiens
uuaucagcagcaugaaacugga

SEQ ID NO: 143387 - RNA, 22 nt, Homo sapiens
uuaugcuguuuucuggagauuu

SEQ ID NO: 143388 - RNA, 22 nt, Homo sapiens
uucaaaaccucugcuuaagccc

SEQ ID NO: 143389 - RNA, 22 nt, Homo sapiens
uucaaaguaaagggauggagac

SEQ ID NO: 143390 - RNA, 20 nt, Homo sapiens
uucaagugauucucaugccu

SEQ ID NO: 143391 - RNA, 22 nt, Homo sapiens
uucaauuaauauuauacucuca

SEQ ID NO: 143392 - RNA, 22 nt, Homo sapiens
uucacaguguguacaccagggg

SEQ ID NO: 143393 - RNA, 22 nt, Homo sapiens
uucacaugacagggugaagcau

SEQ ID NO: 143394 - RNA, 22 nt, Homo sapiens
uucacccugguuguagauggac

SEQ ID NO: 143395 - RNA, 22 nt, Homo sapiens
uucaccuggguuggccaucauu

SEQ ID NO: 143396 - RNA, 22 nt, Homo sapiens
uucacugcaugaaaaggacagc

SEQ ID NO: 143397 - RNA, 20 nt, Homo sapiens
uucacugggcucucuguugg

SEQ ID NO: 143398 - RNA, 22 nt, Homo sapiens
uucacuguagcuuggauguuua

SEQ ID NO: 143399 - RNA, 22 nt, Homo sapiens
uucacugugaauaaaggcuccc

SEQ ID NO: 143400 - RNA, 22 nt, Homo sapiens
uucacugugcuuaaauucugcu

SEQ ID NO: 143401 - RNA, 22 nt, Homo sapiens
uucacuguuaagcaguuaaacu

SEQ ID NO: 143402 - RNA, 22 nt, Homo sapiens
uucagacugggugaagagggua

SEQ ID NO: 143403 - RNA, 22 nt, Homo sapiens
uucagcacaguguggaucauuc

SEQ ID NO: 143404 - RNA, 22 nt, Homo sapiens
uucaggcuuuuauuuacugaua

SEQ ID NO: 143405 - RNA, 22 nt, Homo sapiens
uucagguaauuaugguuugucu

SEQ ID NO: 143406 - RNA, 22 nt, Homo sapiens
uucaguucugcacugaucuuag

SEQ ID NO: 143407 - RNA, 18 nt, Homo sapiens
uucauaguagcaugauuu

SEQ ID NO: 143408 - RNA, 22 nt, Homo sapiens
uucauaguguaccugaaggcac

SEQ ID NO: 143409 - RNA, 22 nt, Homo sapiens
uucauuggacuuguguucuuga

SEQ ID NO: 143410 - RNA, 22 nt, Homo sapiens
uuccacagggauuugcauugau

SEQ ID NO: 143411 - RNA, 22 nt, Homo sapiens
uuccagugggacgagaugugga

SEQ ID NO: 143412 - RNA, 22 nt, Homo sapiens
uucccagucaaacgaaggacuu

SEQ ID NO: 143413 - RNA, 22 nt, Homo sapiens
uucccauuguuggccagcaugu

SEQ ID NO: 143414 - RNA, 22 nt, Homo sapiens
uucccuuucugaaaaucucauu

SEQ ID NO: 143415 - RNA, 22 nt, Homo sapiens
uucccuuucugccuugaaucuu

SEQ ID NO: 143416 - RNA, 22 nt, Homo sapiens
uucuaaguaauuuugcaugccu

SEQ ID NO: 143417 - RNA, 22 nt, Homo sapiens
uucuacaggcuguucaagaagc

SEQ ID NO: 143418 - RNA, 22 nt, Homo sapiens
uucucagcccccugacagucag

SEQ ID NO: 143419 - RNA, 17 nt, Homo sapiens
uucucaguucugaucuc

SEQ ID NO: 143420 - RNA, 19 nt, Homo sapiens
uucucugguuguacuaccc

SEQ ID NO: 143421 - RNA, 22 nt, Homo sapiens
uucucuguggauugggugagag

SEQ ID NO: 143422 - RNA, 22 nt, Homo sapiens
uucugccaaucaacccacaucc

SEQ ID NO: 143423 - RNA, 22 nt, Homo sapiens
uucuggcucgauucucugaccg

SEQ ID NO: 143424 - RNA, 22 nt, Homo sapiens
uucugugguuucauuuaccugu

SEQ ID NO: 143425 - RNA, 22 nt, Homo sapiens
uucuugcacuuggcccucauua

SEQ ID NO: 143426 - RNA, 22 nt, Homo sapiens
uucuugcuguauccucacaugg

SEQ ID NO: 143427 - RNA, 22 nt, Homo sapiens
uucuuugcaugaucucaaaguc

SEQ ID NO: 143428 - RNA, 22 nt, Homo sapiens
uucuuuggauaaaguuuuaugc

SEQ ID NO: 143429 - RNA, 22 nt, Homo sapiens
uugaaagaaaggagacugaguu

SEQ ID NO: 143430 - RNA, 22 nt, Homo sapiens
uugaagacuaaguuaucaggau

SEQ ID NO: 143431 - RNA, 22 nt, Homo sapiens
uugaagacuaauuuagauaaug

SEQ ID NO: 143432 - RNA, 22 nt, Homo sapiens
uugaauaggcucaugcuuauca

SEQ ID NO: 143433 - RNA, 22 nt, Homo sapiens
uugacauaguuucugaaauaga

SEQ ID NO: 143434 - RNA, 22 nt, Homo sapiens
uugacuuuuauucacucugcua

SEQ ID NO: 143435 - RNA, 22 nt, Homo sapiens
uugagauaucuuggccuuugca

SEQ ID NO: 143436 - RNA, 22 nt, Homo sapiens
uugagaugaagucuugcucucu

SEQ ID NO: 143437 - RNA, 22 nt, Homo sapiens
uugagaugaaguuuugcucuuu

SEQ ID NO: 143438 - RNA, 22 nt, Homo sapiens
uugagauggagucucgcucugu

SEQ ID NO: 143439 - RNA, 22 nt, Homo sapiens
ugcccuguaucccacuguuuca

SEQ ID NO: 143440 - RNA, 20 nt, Homo sapiens
ugccugacacucuuugcuuc

SEQ ID NO: 143441 - RNA, 22 nt, Homo sapiens
ugcgauuauuaugucacuuccu

SEQ ID NO: 143442 - RNA, 22 nt, Homo sapiens
ugcugguuuaaaaugcaaauuc

SEQ ID NO: 143443 - RNA, 22 nt, Homo sapiens
ugcugguuuucaucaucagugg

SEQ ID NO: 143444 - RNA, 21 nt, Homo sapiens
ugcuuacugaauguuaauuuc

SEQ ID NO: 143445 - RNA, 19 nt, Homo sapiens
uggaacugauucaguucug

SEQ ID NO: 143446 - RNA, 23 nt, Homo sapiens
uggaagacuccucucuuggcugc

SEQ ID NO: 143447 - RNA, 22 nt, Homo sapiens
uggaagcauagcagcgugugug

SEQ ID NO: 143448 - RNA, 22 nt, Homo sapiens
uggaaggucauuguucauuuga

SEQ ID NO: 143449 - RNA, 22 nt, Homo sapiens
uggaagugaacaaccaaggcag

SEQ ID NO: 143450 - RNA, 22 nt, Homo sapiens
uggaaugugaauaacuuccuuc

SEQ ID NO: 143451 - RNA, 22 nt, Homo sapiens
uggaggucauuggaucaugggg

SEQ ID NO: 143452 - RNA, 22 nt, Homo sapiens
uggagucuugcucuguugccca

SEQ ID NO: 143453 - RNA, 22 nt, Homo sapiens
uggauaguaaagucagauuccc

SEQ ID NO: 143454 - RNA, 22 nt, Homo sapiens
uggauaguucuucuacuagagu

SEQ ID NO: 143455 - RNA, 22 nt, Homo sapiens
uggauauguuuauuacccugaa

SEQ ID NO: 143456 - RNA, 22 nt, Homo sapiens
uggcaaaauggaauauguuggg

SEQ ID NO: 143457 - RNA, 22 nt, Homo sapiens
uggcaaaugugagaugagaacu

SEQ ID NO: 143458 - RNA, 22 nt, Homo sapiens
uggcaaauuccaaaguuaauuc

SEQ ID NO: 143459 - RNA, 19 nt, Homo sapiens
uggcaaugucagcagagau

SEQ ID NO: 143460 - RNA, 19 nt, Homo sapiens
uggcacauguauacauaug

SEQ ID NO: 143461 - RNA, 20 nt, Homo sapiens
uggcaugaaauuuuccaagc

SEQ ID NO: 143462 - RNA, 22 nt, Homo sapiens
uggcaugaagaccccauccuuu

SEQ ID NO: 143463 - RNA, 22 nt, Homo sapiens
uggcauggaguggauggcccca

SEQ ID NO: 143464 - RNA, 22 nt, Homo sapiens
uggcauggggcagaacauuaca

SEQ ID NO: 143465 - RNA, 22 nt, Homo sapiens
uggcaugggguaguagcgcugg

SEQ ID NO: 143466 - RNA, 22 nt, Homo sapiens
uggcauguauuuuguguauuaa

SEQ ID NO: 143467 - RNA, 22 nt, Homo sapiens
uggcauguuggguguugacucc

SEQ ID NO: 143468 - RNA, 20 nt, Homo sapiens
uggcauguugguaugcaccc

SEQ ID NO: 143469 - RNA, 22 nt, Homo sapiens
uggcauuuuguuuuagaauuag

SEQ ID NO: 143470 - RNA, 22 nt, Homo sapiens
uggccaagagcacagauauugg

SEQ ID NO: 143471 - RNA, 22 nt, Homo sapiens
uggccaguguuuuuccugggcu

SEQ ID NO: 143472 - RNA, 22 nt, Homo sapiens
uggcuacagaaaguacuaguga

SEQ ID NO: 143473 - RNA, 22 nt, Homo sapiens
ugggaaacauccagcacauacu

SEQ ID NO: 143474 - RNA, 22 nt, Homo sapiens
ugggaaauguagccuagcugug

SEQ ID NO: 143475 - RNA, 22 nt, Homo sapiens
ugggaagaagguuuacuugcca

SEQ ID NO: 143476 - RNA, 22 nt, Homo sapiens
ugggaagagggagcgauuuugg

SEQ ID NO: 143477 - RNA, 22 nt, Homo sapiens
ugggaucauuaugcauagugua

SEQ ID NO: 143478 - RNA, 22 nt, Homo sapiens
ugggaucgucaagugaggcucg

SEQ ID NO: 143479 - RNA, 22 nt, Homo sapiens
ugggaugauguuaaacguacuc

SEQ ID NO: 143480 - RNA, 22 nt, Homo sapiens
ugggcaaauugugagggaggua

SEQ ID NO: 143481 - RNA, 21 nt, Homo sapiens
ugggccccuuccuuacaucau

SEQ ID NO: 143482 - RNA, 22 nt, Homo sapiens
uggguaguguaaagcacuccag

SEQ ID NO: 143483 - RNA, 23 nt, Homo sapiens
uggguucauucuugaagucagug

SEQ ID NO: 143484 - RNA, 22 nt, Homo sapiens
ugguaagaucugugagccaggc

SEQ ID NO: 143485 - RNA, 22 nt, Homo sapiens
ugguaauguaauuuggagaagg

SEQ ID NO: 143486 - RNA, 22 nt, Homo sapiens
uggucagaugcugaguggaucu

SEQ ID NO: 143487 - RNA, 20 nt, Homo sapiens
ugguccccaccaaaucucau

SEQ ID NO: 143488 - RNA, 22 nt, Homo sapiens
uggucuuuucaacaaaugguau

SEQ ID NO: 143489 - RNA, 22 nt, Homo sapiens
uggugagaaaugagaugcuuuu

SEQ ID NO: 143490 - RNA, 17 nt, Homo sapiens
uggugcuugaaaguugc

SEQ ID NO: 143491 - RNA, 23 nt, Homo sapiens
ugguuuguaagagauggacugga

SEQ ID NO: 143492 - RNA, 22 nt, Homo sapiens
uguaaacauguauguguuuaug

SEQ ID NO: 143493 - RNA, 22 nt, Homo sapiens
uguacaaauuucugugguggug

SEQ ID NO: 143494 - RNA, 19 nt, Homo sapiens
uguacacuguaaaccugug

SEQ ID NO: 143495 - RNA, 22 nt, Homo sapiens
uguauaacucacauugaaguuu

SEQ ID NO: 143496 - RNA, 22 nt, Homo sapiens
uguauacauauguauguuuugu

SEQ ID NO: 143497 - RNA, 22 nt, Homo sapiens
uguauacugucuaauauguugu

SEQ ID NO: 143498 - RNA, 22 nt, Homo sapiens
uguauagaucugauucaucucc

SEQ ID NO: 143499 - RNA, 22 nt, Homo sapiens
uguauugcuugaagagugaauu

SEQ ID NO: 143500 - RNA, 22 nt, Homo sapiens
ugucaaagagacaucugcacuc

SEQ ID NO: 143501 - RNA, 19 nt, Homo sapiens
ugucaaaugucuccugggg

SEQ ID NO: 143502 - RNA, 22 nt, Homo sapiens
ugucaaauucuggguuaaaaca

SEQ ID NO: 143503 - RNA, 22 nt, Homo sapiens
ugucacugugaguuugacugcu

SEQ ID NO: 143504 - RNA, 22 nt, Homo sapiens
ugucaggaugcuccuuuuggcu

SEQ ID NO: 143505 - RNA, 22 nt, Homo sapiens
ugucauacaguaacaugguugg

SEQ ID NO: 143506 - RNA, 23 nt, Homo sapiens
ugucaucaagaugaggucacacu

SEQ ID NO: 143507 - RNA, 22 nt, Homo sapiens
ugucaucauuugagagaagaaa

SEQ ID NO: 143508 - RNA, 22 nt, Homo sapiens
ugucaugagucuccuccaucuu

SEQ ID NO: 143509 - RNA, 22 nt, Homo sapiens
ugucauguuucuacugaccaaa

SEQ ID NO: 143510 - RNA, 16 nt, Homo sapiens
uguccaaauaaauaca

SEQ ID NO: 143511 - RNA, 19 nt, Homo sapiens
ugucccagccauagaggca

SEQ ID NO: 143512 - RNA, 22 nt, Homo sapiens
ugucuuggaugaggauuaacag

SEQ ID NO: 143513 - RNA, 22 nt, Homo sapiens
ugucuuugguucaggcaaggag

SEQ ID NO: 143514 - RNA, 22 nt, Homo sapiens
ugugacaguuaguuugguguua

SEQ ID NO: 143515 - RNA, 22 nt, Homo sapiens
ugugaucaugcuccaggcgaga

SEQ ID NO: 143516 - RNA, 22 nt, Homo sapiens
ugugcaaauuagcacaacccga

SEQ ID NO: 143517 - RNA, 18 nt, Homo sapiens
ugugcaauauuaaccacc

SEQ ID NO: 143518 - RNA, 22 nt, Homo sapiens
ugugcaauucgauggagcucau

SEQ ID NO: 143519 - RNA, 22 nt, Homo sapiens
ugugcaguuuuagcguauuuua

SEQ ID NO: 143520 - RNA, 22 nt, Homo sapiens
ugugcaugacagcauacaaacg

SEQ ID NO: 143521 - RNA, 22 nt, Homo sapiens
ugugccaaucauagggcuuggu

SEQ ID NO: 143522 - RNA, 22 nt, Homo sapiens
ugugccacugcacuccugggug

SEQ ID NO: 143523 - RNA, 22 nt, Homo sapiens
ugugcuauguuauucacauggg

SEQ ID NO: 143524 - RNA, 22 nt, Homo sapiens
ugaacucagcauccagggccaa

SEQ ID NO: 143525 - RNA, 22 nt, Homo sapiens
ugaauauguuucuaaaagugca

SEQ ID NO: 143526 - RNA, 21 nt, Homo sapiens
ugaauauuuggguugugucca

SEQ ID NO: 143527 - RNA, 22 nt, Homo sapiens
ugaaugguaaagaaaagcacug

SEQ ID NO: 143528 - RNA, 23 nt, Homo sapiens
ugaauguuuauucucggugcaga

SEQ ID NO: 143529 - RNA, 22 nt, Homo sapiens
ugacacauguagacaucuggug

SEQ ID NO: 143530 - RNA, 22 nt, Homo sapiens
ugacaggagauuaugugauguu

SEQ ID NO: 143531 - RNA, 22 nt, Homo sapiens
ugacaguaucuacagcuucuua

SEQ ID NO: 143532 - RNA, 22 nt, Homo sapiens
ugacagucaccaggacccacag

SEQ ID NO: 143533 - RNA, 23 nt, Homo sapiens
ugacagucucccgauggcuaggc

SEQ ID NO: 143534 - RNA, 22 nt, Homo sapiens
ugacaguuuccagggcugucuc

SEQ ID NO: 143535 - RNA, 22 nt, Homo sapiens
ugacaugaagaaaaacagauuu

SEQ ID NO: 143536 - RNA, 22 nt, Homo sapiens
ugacauggaaguagguauacau

SEQ ID NO: 143537 - RNA, 22 nt, Homo sapiens
ugacauguugcauuauauuucc

SEQ ID NO: 143538 - RNA, 21 nt, Homo sapiens
ugacauuauuucaugucagua

SEQ ID NO: 143539 - RNA, 19 nt, Homo sapiens
ugaccagggacagaaacca

SEQ ID NO: 143540 - RNA, 22 nt, Homo sapiens
ugacucaguuguuagucuucau

SEQ ID NO: 143541 - RNA, 22 nt, Homo sapiens
ugacuugaaacgugaacagauc

SEQ ID NO: 143542 - RNA, 22 nt, Homo sapiens
ugagaacuguuuugguuugggu

SEQ ID NO: 143543 - RNA, 22 nt, Homo sapiens
ugagaagacaucuuugcuuugu

SEQ ID NO: 143544 - RNA, 22 nt, Homo sapiens
ugagaauauuuuccaugucuca

SEQ ID NO: 143545 - RNA, 22 nt, Homo sapiens
ugagacauauuauacugcuuuu

SEQ ID NO: 143546 - RNA, 22 nt, Homo sapiens
ugagaccaacagauuccaguuc

SEQ ID NO: 143547 - RNA, 22 nt, Homo sapiens
ugagacggagucucacucuguu

SEQ ID NO: 143548 - RNA, 22 nt, Homo sapiens
ugagacggagucucgcucucua

SEQ ID NO: 143549 - RNA, 22 nt, Homo sapiens
ugagacggagucucgcucuguc

SEQ ID NO: 143550 - RNA, 22 nt, Homo sapiens
ugagacggaguuucgcucuugu

SEQ ID NO: 143551 - RNA, 22 nt, Homo sapiens
ugagacugagucucgcucuauu

SEQ ID NO: 143552 - RNA, 22 nt, Homo sapiens
ugagacugaguuucucucuugu

SEQ ID NO: 143553 - RNA, 22 nt, Homo sapiens
ugagacugguaauguguagggc

SEQ ID NO: 143554 - RNA, 22 nt, Homo sapiens
ugagagacauuuguuguagagu

SEQ ID NO: 143555 - RNA, 22 nt, Homo sapiens
ugagagaugaacucugauaugu

SEQ ID NO: 143556 - RNA, 22 nt, Homo sapiens
ugagaucaagguuaauauaauc

SEQ ID NO: 143557 - RNA, 22 nt, Homo sapiens
ugagaucuuugcuguccucacc

SEQ ID NO: 143558 - RNA, 22 nt, Homo sapiens
ugagaugaagucucacucuguc

SEQ ID NO: 143559 - RNA, 22 nt, Homo sapiens
ugagaugacgacacaccucagu

SEQ ID NO: 143560 - RNA, 22 nt, Homo sapiens
ugagaugagaaucaguucuaau

SEQ ID NO: 143561 - RNA, 22 nt, Homo sapiens
ugagaugaguucucgcucuguc

SEQ ID NO: 143562 - RNA, 22 nt, Homo sapiens
ugagaugaguugcgcucugucg

SEQ ID NO: 143563 - RNA, 22 nt, Homo sapiens
ugagaugaguugcuggcucuga

SEQ ID NO: 143564 - RNA, 22 nt, Homo sapiens
ugagaugauagauauguuaauu

SEQ ID NO: 143565 - RNA, 22 nt, Homo sapiens
ugagaugaucaaaguauaggcu

SEQ ID NO: 143566 - RNA, 22 nt, Homo sapiens
ugagaugcauauucuggcuccu

SEQ ID NO: 143567 - RNA, 22 nt, Homo sapiens
ugagauguugcucugaaacaag

SEQ ID NO: 143568 - RNA, 23 nt, Homo sapiens
ugagcaauauucuacuauugagu

SEQ ID NO: 143569 - RNA, 22 nt, Homo sapiens
ugagcccauuguccugguuuau

SEQ ID NO: 143570 - RNA, 20 nt, Homo sapiens
ugagccccuggacucaagcg

SEQ ID NO: 143571 - RNA, 22 nt, Homo sapiens
ugagcucaugcauucuugagga

SEQ ID NO: 143572 - RNA, 22 nt, Homo sapiens
ugaggaacuagcuacccuaaua

SEQ ID NO: 143573 - RNA, 22 nt, Homo sapiens
ugaggcaaggcugaaugaaggc

SEQ ID NO: 143574 - RNA, 22 nt, Homo sapiens
ugaggcuaggauaggcugauuc

SEQ ID NO: 143575 - RNA, 22 nt, Homo sapiens
ugagggaugccugguuuguuuu

SEQ ID NO: 143576 - RNA, 22 nt, Homo sapiens
ugagggaugcguacccuaugcc

SEQ ID NO: 143577 - RNA, 22 nt, Homo sapiens
ugagguaauagauaauauuuuu

SEQ ID NO: 143578 - RNA, 22 nt, Homo sapiens
ugagguagaggugaacuugacc

SEQ ID NO: 143579 - RNA, 22 nt, Homo sapiens
ugagguagguaccauuaucacu

SEQ ID NO: 143580 - RNA, 22 nt, Homo sapiens
ugaggucuuuauuuagugcuca

SEQ ID NO: 143581 - RNA, 22 nt, Homo sapiens
ugagguugaaggacauuuuuau

SEQ ID NO: 143582 - RNA, 22 nt, Homo sapiens
ugagguuggggucagggcuagc

SEQ ID NO: 143583 - RNA, 22 nt, Homo sapiens
ugagguugucagugucauucuu

SEQ ID NO: 143584 - RNA, 22 nt, Homo sapiens
ugaguagugccacaauaagcau

SEQ ID NO: 143585 - RNA, 22 nt, Homo sapiens
ugagucauguaauaaugcugcu

SEQ ID NO: 143586 - RNA, 22 nt, Homo sapiens
ugagugaggcugggcagucccu

SEQ ID NO: 143587 - RNA, 22 nt, Homo sapiens
ugagugagguucuacucuguga

SEQ ID NO: 143588 - RNA, 22 nt, Homo sapiens
ugaguuaauuuuuguaucaugu

SEQ ID NO: 143589 - RNA, 22 nt, Homo sapiens
ugaguucauggucauuugucac

SEQ ID NO: 143590 - RNA, 22 nt, Homo sapiens
ugaguuccuugugugaccuugc

SEQ ID NO: 143591 - RNA, 20 nt, Homo sapiens
ugauauuucuggaaguggag

SEQ ID NO: 143592 - RNA, 21 nt, Homo sapiens
ugaugcuuuucuuaaccuugc

SEQ ID NO: 143593 - RNA, 21 nt, Homo sapiens
ugauguugaccuaaguaguga

SEQ ID NO: 143594 - RNA, 22 nt, Homo sapiens
ugauguugacuguaggcagaga

SEQ ID NO: 143595 - RNA, 22 nt, Homo sapiens
ugauuuccaugagaacaugccu

SEQ ID NO: 143596 - RNA, 22 nt, Homo sapiens
ugcaaacuuccuugggcagcau

SEQ ID NO: 143597 - RNA, 22 nt, Homo sapiens
ugcaacacauugccccugcucu

SEQ ID NO: 143598 - RNA, 22 nt, Homo sapiens
ugcaaucauuuggaggagaaga

SEQ ID NO: 143599 - RNA, 17 nt, Homo sapiens
ugcaauuuaagcuagau

SEQ ID NO: 143600 - RNA, 22 nt, Homo sapiens
ugcacacucuguaugagaaucu

SEQ ID NO: 143601 - RNA, 18 nt, Homo sapiens
ugcaccaguuuacacuuc

SEQ ID NO: 143602 - RNA, 21 nt, Homo sapiens
ugcagccauucagcccuaugc

SEQ ID NO: 143603 - RNA, 22 nt, Homo sapiens
ugcagcucaaauuccuaacaag

SEQ ID NO: 143604 - RNA, 22 nt, Homo sapiens
ugcaggguccauugucccaagu

SEQ ID NO: 143605 - RNA, 22 nt, Homo sapiens
ugcauaugcagcauuuaugauu

SEQ ID NO: 143606 - RNA, 22 nt, Homo sapiens
ugcauauucgaguuauuuuggg

SEQ ID NO: 143607 - RNA, 22 nt, Homo sapiens
aucuguagauucagcacaagcu

SEQ ID NO: 143608 - RNA, 22 nt, Homo sapiens
aucuuuggauacuugauauagu

SEQ ID NO: 143609 - RNA, 22 nt, Homo sapiens
aucuuuggugcaugauacuuug

SEQ ID NO: 143610 - RNA, 22 nt, Homo sapiens
augaaaagcauaaacgcugaag

SEQ ID NO: 143611 - RNA, 22 nt, Homo sapiens
augaaacuggcuaauuuuugua

SEQ ID NO: 143612 - RNA, 22 nt, Homo sapiens
augaaagguugucuuaagccau

SEQ ID NO: 143613 - RNA, 22 nt, Homo sapiens
augaaugcagcacuguuuuucu

SEQ ID NO: 143614 - RNA, 22 nt, Homo sapiens
augaaugcuuuuggauguaucu

SEQ ID NO: 143615 - RNA, 22 nt, Homo sapiens
augacaaugaaucccuguuuca

SEQ ID NO: 143616 - RNA, 23 nt, Homo sapiens
augacacuguccuugaccauuuc

SEQ ID NO: 143617 - RNA, 22 nt, Homo sapiens
augacauagaagcaauccccua

SEQ ID NO: 143618 - RNA, 19 nt, Homo sapiens
augacauuuggggguggac

SEQ ID NO: 143619 - RNA, 22 nt, Homo sapiens
augaccagagagugcgcagggu

SEQ ID NO: 143620 - RNA, 22 nt, Homo sapiens
augacucagaucuguuccuggu

SEQ ID NO: 143621 - RNA, 22 nt, Homo sapiens
augagagcaacaccuucacuug

SEQ ID NO: 143622 - RNA, 22 nt, Homo sapiens
augagaugaggaauggcccucc

SEQ ID NO: 143623 - RNA, 22 nt, Homo sapiens
augagcugauuuccuuaccaua

SEQ ID NO: 143624 - RNA, 22 nt, Homo sapiens
augaggcuauaauuuuuaugua

SEQ ID NO: 143625 - RNA, 22 nt, Homo sapiens
augagguguuuauuguauccug

SEQ ID NO: 143626 - RNA, 22 nt, Homo sapiens
augaugucauuuuaauuucuaa

SEQ ID NO: 143627 - RNA, 22 nt, Homo sapiens
augauguccacagggguguuca

SEQ ID NO: 143628 - RNA, 22 nt, Homo sapiens
augauguguguuuaagaugucu

SEQ ID NO: 143629 - RNA, 22 nt, Homo sapiens
augcacaguccagcccaugugg

SEQ ID NO: 143630 - RNA, 22 nt, Homo sapiens
augcacauauguacugcccuau

SEQ ID NO: 143631 - RNA, 22 nt, Homo sapiens
augcacaucagcuccagggacc

SEQ ID NO: 143632 - RNA, 22 nt, Homo sapiens
augcagauauuuuugugguugc

SEQ ID NO: 143633 - RNA, 22 nt, Homo sapiens
augccacagaaauaaccaaaau

SEQ ID NO: 143634 - RNA, 22 nt, Homo sapiens
augccacugcacuucagccugc

SEQ ID NO: 143635 - RNA, 22 nt, Homo sapiens
augccacugcacuucagcuugg

SEQ ID NO: 143636 - RNA, 22 nt, Homo sapiens
augcuggugguucacaugcgca

SEQ ID NO: 143637 - RNA, 22 nt, Homo sapiens
augcuuguguuggggcagugga

SEQ ID NO: 143638 - RNA, 22 nt, Homo sapiens
auggacguagauucucaaggau

SEQ ID NO: 143639 - RNA, 19 nt, Homo sapiens
auggauacauuuucugcua

SEQ ID NO: 143640 - RNA, 22 nt, Homo sapiens
auggauuuuaggauacaguuga

SEQ ID NO: 143641 - RNA, 22 nt, Homo sapiens
auggcaauaugaugcacuguuu

SEQ ID NO: 143642 - RNA, 22 nt, Homo sapiens
auggcagagucagaaagucagg

SEQ ID NO: 143643 - RNA, 22 nt, Homo sapiens
auggcccugggaaaggaggcau

SEQ ID NO: 143644 - RNA, 22 nt, Homo sapiens
auggcccuguguggagcugcug

SEQ ID NO: 143645 - RNA, 22 nt, Homo sapiens
auggcucuuauuauuugaggua

SEQ ID NO: 143646 - RNA, 22 nt, Homo sapiens
auggcuugugacccaugcuuca

SEQ ID NO: 143647 - RNA, 21 nt, Homo sapiens
augguacugucucuggagaua

SEQ ID NO: 143648 - RNA, 22 nt, Homo sapiens
auggucccuguuccaugcuccu

SEQ ID NO: 143649 - RNA, 22 nt, Homo sapiens
auggucuuuguuucuaauucug

SEQ ID NO: 143650 - RNA, 22 nt, Homo sapiens
augguugguuaaaucuguguau

SEQ ID NO: 143651 - RNA, 22 nt, Homo sapiens
auguaaacagaugugcagcuug

SEQ ID NO: 143652 - RNA, 22 nt, Homo sapiens
auguaacacagugcggcugggc

SEQ ID NO: 143653 - RNA, 22 nt, Homo sapiens
auguaacaguauuuggagaugu

SEQ ID NO: 143654 - RNA, 22 nt, Homo sapiens
auguaauguuaaauugcuaauu

SEQ ID NO: 143655 - RNA, 22 nt, Homo sapiens
auguagauaucaagaggcauau

SEQ ID NO: 143656 - RNA, 22 nt, Homo sapiens
augugaacugaauuaauucaca

SEQ ID NO: 143657 - RNA, 22 nt, Homo sapiens
augugcaaagcacuguucagca

SEQ ID NO: 143658 - RNA, 22 nt, Homo sapiens
augugcacaacgugcagguuug

SEQ ID NO: 143659 - RNA, 22 nt, Homo sapiens
augugcaugcuguucugccaga

SEQ ID NO: 143660 - RNA, 20 nt, Homo sapiens
augugcuaauauuaauaugu

SEQ ID NO: 143661 - RNA, 22 nt, Homo sapiens
augugcuuauagguguauguuu

SEQ ID NO: 143662 - RNA, 22 nt, Homo sapiens
auguguauuaccucgauuguga

SEQ ID NO: 143663 - RNA, 22 nt, Homo sapiens
auguuauguucuucucuguaua

SEQ ID NO: 143664 - RNA, 18 nt, Homo sapiens
auguuauguuuguagaag

SEQ ID NO: 143665 - RNA, 22 nt, Homo sapiens
auuaauguaauuaguaaaguug

SEQ ID NO: 143666 - RNA, 22 nt, Homo sapiens
auuauugacucauagaaaggau

SEQ ID NO: 143667 - RNA, 22 nt, Homo sapiens
auucccuuagcugccucagccu

SEQ ID NO: 143668 - RNA, 22 nt, Homo sapiens
auugcacaccagucugggcaaa

SEQ ID NO: 143669 - RNA, 21 nt, Homo sapiens
auugcacuccagccugggcga

SEQ ID NO: 143670 - RNA, 22 nt, Homo sapiens
auugcacuccauccuaggugac

SEQ ID NO: 143671 - RNA, 18 nt, Homo sapiens
auugcccucauggggcuu

SEQ ID NO: 143672 - RNA, 22 nt, Homo sapiens
auugcucaaaucaguacuugag

SEQ ID NO: 143673 - RNA, 22 nt, Homo sapiens
auugcucagucagggagcucgg

SEQ ID NO: 143674 - RNA, 22 nt, Homo sapiens
acacuggguaacauaucuguua

SEQ ID NO: 143675 - RNA, 19 nt, Homo sapiens
acagauagaauguucuaca

SEQ ID NO: 143676 - RNA, 22 nt, Homo sapiens
acagcacugccaagugacccau

SEQ ID NO: 143677 - RNA, 21 nt, Homo sapiens
acaguacuugagaucuuuuga

SEQ ID NO: 143678 - RNA, 22 nt, Homo sapiens
acaguagugggcuacagaauca

SEQ ID NO: 143679 - RNA, 23 nt, Homo sapiens
acagucuaguuugaagucaggua

SEQ ID NO: 143680 - RNA, 17 nt, Homo sapiens
acagugcuuugcuuucc

SEQ ID NO: 143681 - RNA, 18 nt, Homo sapiens
acagugucuuacaccugu

SEQ ID NO: 143682 - RNA, 22 nt, Homo sapiens
acauaguagacacugaaaauau

SEQ ID NO: 143683 - RNA, 22 nt, Homo sapiens
acauugcauauggcacccucuu

SEQ ID NO: 143684 - RNA, 22 nt, Homo sapiens
accaccacucccgcauucuaaa

SEQ ID NO: 143685 - RNA, 22 nt, Homo sapiens
accaugcaguccaauaugcaca

SEQ ID NO: 143686 - RNA, 22 nt, Homo sapiens
acccucagaccaguuucccugg

SEQ ID NO: 143687 - RNA, 22 nt, Homo sapiens
acccuggaguaguaggaaucug

SEQ ID NO: 143688 - RNA, 22 nt, Homo sapiens
acccuggauucguggccuugaa

SEQ ID NO: 143689 - RNA, 22 nt, Homo sapiens
acccuguugagcaacuggccau

SEQ ID NO: 143690 - RNA, 22 nt, Homo sapiens
accugagauuacaggugcuggc

SEQ ID NO: 143691 - RNA, 22 nt, Homo sapiens
accugggugcugaugggcuuua

SEQ ID NO: 143692 - RNA, 23 nt, Homo sapiens
accugugguuauuuuacucuucc

SEQ ID NO: 143693 - RNA, 21 nt, Homo sapiens
acugagagaucuggggcacau

SEQ ID NO: 143694 - RNA, 19 nt, Homo sapiens
acugagcuaccugggggca

SEQ ID NO: 143695 - RNA, 22 nt, Homo sapiens
acugcacuccagccugugcgua

SEQ ID NO: 143696 - RNA, 22 nt, Homo sapiens
acugcacuccagcuugggugac

SEQ ID NO: 143697 - RNA, 22 nt, Homo sapiens
acuggcuuuugagaaaaacacu

SEQ ID NO: 143698 - RNA, 20 nt, Homo sapiens
acugggcuaccgaaguaagg

SEQ ID NO: 143699 - RNA, 22 nt, Homo sapiens
acuuuuguuauacagugugaua

SEQ ID NO: 143700 - RNA, 20 nt, Homo sapiens
acuuuuugaugaggucguuu

SEQ ID NO: 143701 - RNA, 22 nt, Homo sapiens
agaaugugaccuuauuuggaga

SEQ ID NO: 143702 - RNA, 22 nt, Homo sapiens
agacaagauggcuugagguuca

SEQ ID NO: 143703 - RNA, 22 nt, Homo sapiens
agacuagaaaucauuuguugag

SEQ ID NO: 143704 - RNA, 22 nt, Homo sapiens
agagaacugauuggaguugggc

SEQ ID NO: 143705 - RNA, 22 nt, Homo sapiens
agagaucaacugaauuacugga

SEQ ID NO: 143706 - RNA, 22 nt, Homo sapiens
agagcaaugggugaauauuaaa

SEQ ID NO: 143707 - RNA, 22 nt, Homo sapiens
agagcaauguuaucagucucug

SEQ ID NO: 143708 - RNA, 22 nt, Homo sapiens
agagguagaagauaggcuacag

SEQ ID NO: 143709 - RNA, 22 nt, Homo sapiens
agagugaagcuuuuuauauucu

SEQ ID NO: 143710 - RNA, 22 nt, Homo sapiens
agauacaucuaugugucugugu

SEQ ID NO: 143711 - RNA, 22 nt, Homo sapiens
agaucauaugcaguaaugaacu

SEQ ID NO: 143712 - RNA, 22 nt, Homo sapiens
agcagauguuuagugagcgccu

SEQ ID NO: 143713 - RNA, 22 nt, Homo sapiens
agcagcauuaguggaaucuugu

SEQ ID NO: 143714 - RNA, 21 nt, Homo sapiens
agcagcuuugguugaagcaga

SEQ ID NO: 143715 - RNA, 22 nt, Homo sapiens
agccaguauuuccacagagugg

SEQ ID NO: 143716 - RNA, 19 nt, Homo sapiens
agccaguuuucccagcacc

SEQ ID NO: 143717 - RNA, 22 nt, Homo sapiens
agcgccacugcacuccagccug

SEQ ID NO: 143718 - RNA, 18 nt, Homo sapiens
agcucaguguuugcuuac

SEQ ID NO: 143719 - RNA, 22 nt, Homo sapiens
agcucauugcaaccuccgccuc

SEQ ID NO: 143720 - RNA, 22 nt, Homo sapiens
agcuccuuucugcaggcagguc

SEQ ID NO: 143721 - RNA, 22 nt, Homo sapiens
agcuggauguggaugacccugu

SEQ ID NO: 143722 - RNA, 22 nt, Homo sapiens
agcuggcuguagcugcaagucu

SEQ ID NO: 143723 - RNA, 22 nt, Homo sapiens
agcugguucuuugccuuguaga

SEQ ID NO: 143724 - RNA, 21 nt, Homo sapiens
agcugguuuccacagugugcu

SEQ ID NO: 143725 - RNA, 20 nt, Homo sapiens
agcuguuguuaaaaaggagg

SEQ ID NO: 143726 - RNA, 22 nt, Homo sapiens
aggaagacugaaauugcuguuc

SEQ ID NO: 143727 - RNA, 22 nt, Homo sapiens
aggaagugugcaauuaauuucu

SEQ ID NO: 143728 - RNA, 22 nt, Homo sapiens
aggaauggaaacuuuugauggu

SEQ ID NO: 143729 - RNA, 22 nt, Homo sapiens
aggacacugagcaugggagguu

SEQ ID NO: 143730 - RNA, 22 nt, Homo sapiens
aggagcacuggccuuggaguca

SEQ ID NO: 143731 - RNA, 22 nt, Homo sapiens
aggauacugguaugggcugaau

SEQ ID NO: 143732 - RNA, 22 nt, Homo sapiens
aggcacacaacccuggaccuga

SEQ ID NO: 143733 - RNA, 22 nt, Homo sapiens
aggcaggugaaagauaguuuua

SEQ ID NO: 143734 - RNA, 22 nt, Homo sapiens
aggcaugaguucagaggguaug

SEQ ID NO: 143735 - RNA, 22 nt, Homo sapiens
aggcaugauggcuccagaucau

SEQ ID NO: 143736 - RNA, 22 nt, Homo sapiens
aggcuuuuggagguggcuuucu

SEQ ID NO: 143737 - RNA, 22 nt, Homo sapiens
agggcaguguuaggacugucug

SEQ ID NO: 143738 - RNA, 22 nt, Homo sapiens
agguacuugagauucugaacug

SEQ ID NO: 143739 - RNA, 20 nt, Homo sapiens
agguagauagaugauagaua

SEQ ID NO: 143740 - RNA, 22 nt, Homo sapiens
agguauauuggacagauguaaa

SEQ ID NO: 143741 - RNA, 22 nt, Homo sapiens
aggugcuugagggaagaaauua

SEQ ID NO: 143742 - RNA, 22 nt, Homo sapiens
aguaaagcaucagcuagaugug

SEQ ID NO: 143743 - RNA, 22 nt, Homo sapiens
aguacacuguugaacagaagug

SEQ ID NO: 143744 - RNA, 22 nt, Homo sapiens
aguauguagugcaaucagucag

SEQ ID NO: 143745 - RNA, 22 nt, Homo sapiens
aguauuuguuggaauaccuguu

SEQ ID NO: 143746 - RNA, 22 nt, Homo sapiens
agucaacaucaugaaguggaaa

SEQ ID NO: 143747 - RNA, 22 nt, Homo sapiens
agucacaugcauuuucuucaau

SEQ ID NO: 143748 - RNA, 17 nt, Homo sapiens
agugagaucauggcuua

SEQ ID NO: 143749 - RNA, 22 nt, Homo sapiens
agugcaguggcacaaucuuggc

SEQ ID NO: 143750 - RNA, 22 nt, Homo sapiens
agugggccccuagaggugaggu

SEQ ID NO: 143751 - RNA, 22 nt, Homo sapiens
aguggguguuccauuggauaaa

SEQ ID NO: 143752 - RNA, 22 nt, Homo sapiens
aguugcaagucuugaguaaaga

SEQ ID NO: 143753 - RNA, 17 nt, Homo sapiens
auaaacucaucauuuuu

SEQ ID NO: 143754 - RNA, 22 nt, Homo sapiens
auaaaugcaaugguauuuuuga

SEQ ID NO: 143755 - RNA, 20 nt, Homo sapiens
auaaauguauagguguacau

SEQ ID NO: 143756 - RNA, 22 nt, Homo sapiens
auaagaagugaaccagacgucu

SEQ ID NO: 143757 - RNA, 22 nt, Homo sapiens
auaagaguaguacauaugagac

SEQ ID NO: 143758 - RNA, 22 nt, Homo sapiens
auaaggcugguauagacauuca

SEQ ID NO: 143759 - RNA, 22 nt, Homo sapiens
auaauagguugauugacauugc

SEQ ID NO: 143760 - RNA, 22 nt, Homo sapiens
uuuuaguggacaaagguauuua

SEQ ID NO: 143761 - RNA, 22 nt, Homo sapiens
uuuugcaaauuccaguggccau

SEQ ID NO: 143762 - RNA, 22 nt, Homo sapiens
uuuugcacuagaaccagagguu

SEQ ID NO: 143763 - RNA, 22 nt, Homo sapiens
uuuugcaguuacagagagugag

SEQ ID NO: 143764 - RNA, 22 nt, Homo sapiens
uuuugguaaugaacuuaggaag

SEQ ID NO: 143765 - RNA, 22 nt, Homo sapiens
uuuugguauacacaaggguccu

SEQ ID NO: 143766 - RNA, 22 nt, Homo sapiens
uuuugguuguuggguaagagua

SEQ ID NO: 143767 - RNA, 22 nt, Homo sapiens
uuuugugacuauuguaaauggg

SEQ ID NO: 143768 - RNA, 22 nt, Homo sapiens
uuuuuauggccaauccucagaa

SEQ ID NO: 143769 - RNA, 22 nt, Homo sapiens
uuuuugaguaaauauaaauugu

SEQ ID NO: 143770 - RNA, 22 nt, Homo sapiens
uuuuuuaguuagcugggcauga

SEQ ID NO: 143771 - RNA, 22 nt, Homo sapiens
cucaugcugucuucugggguaa

SEQ ID NO: 143772 - RNA, 22 nt, Homo sapiens
cucauugcaaucuccaccuccc

SEQ ID NO: 143773 - RNA, 22 nt, Homo sapiens
cuccacgugaaugccaaguauu

SEQ ID NO: 143774 - RNA, 22 nt, Homo sapiens
cuccuggugauuggagugugaa

SEQ ID NO: 143775 - RNA, 22 nt, Homo sapiens
cucucugagccauggcugcccu

SEQ ID NO: 143776 - RNA, 22 nt, Homo sapiens
cucucugagccccagacaccuu

SEQ ID NO: 143777 - RNA, 21 nt, Homo sapiens
cucucugcuuaugaauaguga

SEQ ID NO: 143778 - RNA, 17 nt, Homo sapiens
cucucugguuuaaagca

SEQ ID NO: 143779 - RNA, 22 nt, Homo sapiens
cucucuguuugucuguuauugg

SEQ ID NO: 143780 - RNA, 22 nt, Homo sapiens
cucugacagugguuagcacugu

SEQ ID NO: 143781 - RNA, 22 nt, Homo sapiens
cucugguggaagcagggggcaa

SEQ ID NO: 143782 - RNA, 21 nt, Homo sapiens
cucugguuugcauuggauuau

SEQ ID NO: 143783 - RNA, 22 nt, Homo sapiens
cucuuggguagauuuugcagag

SEQ ID NO: 143784 - RNA, 22 nt, Homo sapiens
cucuuugaugugaaccgugguu

SEQ ID NO: 143785 - RNA, 22 nt, Homo sapiens
cugacuaguuuuaaugcagauu

SEQ ID NO: 143786 - RNA, 22 nt, Homo sapiens
cugagauacacuaauagucucu

SEQ ID NO: 143787 - RNA, 22 nt, Homo sapiens
cugagcaaagaagugauaauga

SEQ ID NO: 143788 - RNA, 22 nt, Homo sapiens
cugagcacugagauccucuagc

SEQ ID NO: 143789 - RNA, 22 nt, Homo sapiens
cugaggguagaaggaucacuug

SEQ ID NO: 143790 - RNA, 22 nt, Homo sapiens
cugagguaauuuuccagauaau

SEQ ID NO: 143791 - RNA, 22 nt, Homo sapiens
cugagguauaucccauuagaag

SEQ ID NO: 143792 - RNA, 22 nt, Homo sapiens
cugaggugggagaaucacauaa

SEQ ID NO: 143793 - RNA, 22 nt, Homo sapiens
cugaggugggaggauuacuuga

SEQ ID NO: 143794 - RNA, 20 nt, Homo sapiens
cugagguugggguccuuccc

SEQ ID NO: 143795 - RNA, 22 nt, Homo sapiens
cugauugucaucaauauuauua

SEQ ID NO: 143796 - RNA, 20 nt, Homo sapiens
cugcaaaugcugcugcugau

SEQ ID NO: 143797 - RNA, 22 nt, Homo sapiens
cugcaagaugcauaggaauuuu

SEQ ID NO: 143798 - RNA, 19 nt, Homo sapiens
cugcaugagacaguugguu

SEQ ID NO: 143799 - RNA, 22 nt, Homo sapiens
cuggaaaguagacaaucuaaaa

SEQ ID NO: 143800 - RNA, 22 nt, Homo sapiens
cuggaaugcagcuuuaggggcu

SEQ ID NO: 143801 - RNA, 22 nt, Homo sapiens
cuggaggccugaacauaaaugg

SEQ ID NO: 143802 - RNA, 22 nt, Homo sapiens
cuggauauuaacauugaugaaa

SEQ ID NO: 143803 - RNA, 22 nt, Homo sapiens
cuggauggugagauaaagaaaa

SEQ ID NO: 143804 - RNA, 22 nt, Homo sapiens
cuggcaaaaagagggcaauaau

SEQ ID NO: 143805 - RNA, 22 nt, Homo sapiens
cuggcaaauaguagagccagga

SEQ ID NO: 143806 - RNA, 22 nt, Homo sapiens
cuggccagagacauucauuaaa

SEQ ID NO: 143807 - RNA, 22 nt, Homo sapiens
cugggaugugacuguugccccc

SEQ ID NO: 143808 - RNA, 21 nt, Homo sapiens
cugguccccuuuauguaugug

SEQ ID NO: 143809 - RNA, 22 nt, Homo sapiens
cuggugagaugucuuuccucuu

SEQ ID NO: 143810 - RNA, 22 nt, Homo sapiens
cugguuuguaaaguuccugaga

SEQ ID NO: 143811 - RNA, 22 nt, Homo sapiens
cuguagcuuuuauaugcuuagc

SEQ ID NO: 143812 - RNA, 22 nt, Homo sapiens
cugucucagccucuccaguagc

SEQ ID NO: 143813 - RNA, 22 nt, Homo sapiens
cugucuggaguccuucgugugc

SEQ ID NO: 143814 - RNA, 22 nt, Homo sapiens
cugugauagguuagucaugaau

SEQ ID NO: 143815 - RNA, 22 nt, Homo sapiens
cugugcauucuuaaaucaggaa

SEQ ID NO: 143816 - RNA, 22 nt, Homo sapiens
cugugcuugagagaugacacag

SEQ ID NO: 143817 - RNA, 23 nt, Homo sapiens
cuguggauaugaguuguaaaugg

SEQ ID NO: 143818 - RNA, 22 nt, Homo sapiens
cuguuugaggguuugcuuucag

SEQ ID NO: 143819 - RNA, 22 nt, Homo sapiens
cuguuugguaaggaugccucag

SEQ ID NO: 143820 - RNA, 22 nt, Homo sapiens
cuuaaagcgaauauugguggua

SEQ ID NO: 143821 - RNA, 22 nt, Homo sapiens
cuuaaugcuacggcucuguguu

SEQ ID NO: 143822 - RNA, 22 nt, Homo sapiens
cuucaaguuggaagggaccuaa

SEQ ID NO: 143823 - RNA, 22 nt, Homo sapiens
cuuccugaguccugggcucaca

SEQ ID NO: 143824 - RNA, 22 nt, Homo sapiens
cuugaauguaaauaauguacag

SEQ ID NO: 143825 - RNA, 22 nt, Homo sapiens
cuugacacugcaguuuuccugg

SEQ ID NO: 143826 - RNA, 22 nt, Homo sapiens
cuugacacugguuuucugaaua

SEQ ID NO: 143827 - RNA, 22 nt, Homo sapiens
cuugacaucugucaguuccuca

SEQ ID NO: 143828 - RNA, 22 nt, Homo sapiens
cuugcagagucauucuaauuuc

SEQ ID NO: 143829 - RNA, 22 nt, Homo sapiens
cuuggcuagucaaaccuccccg

SEQ ID NO: 143830 - RNA, 22 nt, Homo sapiens
cuuggcuccgacuccccuccaa

SEQ ID NO: 143831 - RNA, 22 nt, Homo sapiens
cuugguuacauuuuccuagaaa

SEQ ID NO: 143832 - RNA, 22 nt, Homo sapiens
cuuguguuacauauuuaagaga

SEQ ID NO: 143833 - RNA, 22 nt, Homo sapiens
cuuuacacauccuaaccagugu

SEQ ID NO: 143834 - RNA, 22 nt, Homo sapiens
cuuuacaguuggacucacgagg

SEQ ID NO: 143835 - RNA, 22 nt, Homo sapiens
cuuucucagugagacccgagau

SEQ ID NO: 143836 - RNA, 22 nt, Homo sapiens
cuuugaugagaaaauacuuugu

SEQ ID NO: 143837 - RNA, 22 nt, Homo sapiens
cuuugcguugaacaaagccaua

SEQ ID NO: 143838 - RNA, 17 nt, Homo sapiens
agcuggaauuacgggag

SEQ ID NO: 143839 - RNA, 22 nt, Homo sapiens
agcuggauuguuuaccuggggc

SEQ ID NO: 143840 - RNA, 20 nt, Homo sapiens
agcugguuuuaugaaucuuu

SEQ ID NO: 143841 - RNA, 22 nt, Homo sapiens
agcuucauucugaauagguuga

SEQ ID NO: 143842 - RNA, 22 nt, Homo sapiens
agcuuguuuucccauaacuaga

SEQ ID NO: 143843 - RNA, 22 nt, Homo sapiens
aggagaugaagcuuuaucuaaa

SEQ ID NO: 143844 - RNA, 22 nt, Homo sapiens
aggagguagggugugaaacagc

SEQ ID NO: 143845 - RNA, 22 nt, Homo sapiens
aggcaguuucagugagagguga

SEQ ID NO: 143846 - RNA, 22 nt, Homo sapiens
aggcaugaaauacaugcauuga

SEQ ID NO: 143847 - RNA, 22 nt, Homo sapiens
aggcaugauuguauuuugcucu

SEQ ID NO: 143848 - RNA, 22 nt, Homo sapiens
aggcauggagacuaaaauuaua

SEQ ID NO: 143849 - RNA, 22 nt, Homo sapiens
aggcuagaaucuuccaucuugg

SEQ ID NO: 143850 - RNA, 22 nt, Homo sapiens
aggcugguauuuacaaaagcuc

SEQ ID NO: 143851 - RNA, 22 nt, Homo sapiens
aggcuuauuaagauucccuuau

SEQ ID NO: 143852 - RNA, 22 nt, Homo sapiens
aggcuuguuuuacuaacuggua

SEQ ID NO: 143853 - RNA, 22 nt, Homo sapiens
agggagcaaaguggucuuucuc

SEQ ID NO: 143854 - RNA, 22 nt, Homo sapiens
agggcuuguuuaacuaucauua

SEQ ID NO: 143855 - RNA, 22 nt, Homo sapiens
aggugcaugcuucacuggauau

SEQ ID NO: 143856 - RNA, 22 nt, Homo sapiens
aggugcugacaggauagguuuc

SEQ ID NO: 143857 - RNA, 22 nt, Homo sapiens
aggugcugagcagagaauccug

SEQ ID NO: 143858 - RNA, 22 nt, Homo sapiens
aguaaucaucugagggcagaaa

SEQ ID NO: 143859 - RNA, 22 nt, Homo sapiens
aguacacuguuaaaaagaagug

SEQ ID NO: 143860 - RNA, 22 nt, Homo sapiens
aguacaucuggcuggauagaua

SEQ ID NO: 143861 - RNA, 22 nt, Homo sapiens
aguaucacaguggguguauacc

SEQ ID NO: 143862 - RNA, 22 nt, Homo sapiens
aguaucaucuuguuggccaggc

SEQ ID NO: 143863 - RNA, 22 nt, Homo sapiens
cauggucaccuuccaaguuauu

SEQ ID NO: 143864 - RNA, 22 nt, Homo sapiens
caugguguuaggcacugggaau

SEQ ID NO: 143865 - RNA, 22 nt, Homo sapiens
cauugcacuuagacaacuuuug

SEQ ID NO: 143866 - RNA, 22 nt, Homo sapiens
cauugcaguaagagugggcucu

SEQ ID NO: 143867 - RNA, 22 nt, Homo sapiens
cauugguuggacaguucucucu

SEQ ID NO: 143868 - RNA, 22 nt, Homo sapiens
cauuuuacuuuccagacgugga

SEQ ID NO: 143869 - RNA, 22 nt, Homo sapiens
ccacccuuccacacccugggua

SEQ ID NO: 143870 - RNA, 22 nt, Homo sapiens
ccagauguuuucauucagcaag

SEQ ID NO: 143871 - RNA, 22 nt, Homo sapiens
ccagcaccauuuauuaaauagg

SEQ ID NO: 143872 - RNA, 22 nt, Homo sapiens
ccaggguugcuuuagauucuga

SEQ ID NO: 143873 - RNA, 22 nt, Homo sapiens
ccaguauuuuauugaggguuuu

SEQ ID NO: 143874 - RNA, 22 nt, Homo sapiens
ccagugauggcugccucauuug

SEQ ID NO: 143875 - RNA, 22 nt, Homo sapiens
ccagugauuguauggugaaggu

SEQ ID NO: 143876 - RNA, 22 nt, Homo sapiens
ccaguguuuggauuagggaugc

SEQ ID NO: 143877 - RNA, 22 nt, Homo sapiens
ccauugcacuccauccugggca

SEQ ID NO: 143878 - RNA, 22 nt, Homo sapiens
cccagugaagagaaccuuacga

SEQ ID NO: 143879 - RNA, 19 nt, Homo sapiens
cccagugucagagaagggu

SEQ ID NO: 143880 - RNA, 22 nt, Homo sapiens
cccagugugcugggugacagcu

SEQ ID NO: 143881 - RNA, 22 nt, Homo sapiens
ccccagugguugcaacagcaga

SEQ ID NO: 143882 - RNA, 22 nt, Homo sapiens
ccccauguucucucugcagcuc

SEQ ID NO: 143883 - RNA, 22 nt, Homo sapiens
ccgugcacggaaaggcauauuu

SEQ ID NO: 143884 - RNA, 22 nt, Homo sapiens
ccucauggagaacaucugcuag

SEQ ID NO: 143885 - RNA, 22 nt, Homo sapiens
ccucuguaguccugcaagagga

SEQ ID NO: 143886 - RNA, 21 nt, Homo sapiens
ccucuuugagggaagaaaggg

SEQ ID NO: 143887 - RNA, 21 nt, Homo sapiens
ccugaagaagugaccucugag

SEQ ID NO: 143888 - RNA, 22 nt, Homo sapiens
ccuggcacugggccccguggcu

SEQ ID NO: 143889 - RNA, 22 nt, Homo sapiens
ccuucuuuuguaaggcugaaua

SEQ ID NO: 143890 - RNA, 22 nt, Homo sapiens
cuaaaacuuucugagugcagca

SEQ ID NO: 143891 - RNA, 16 nt, Homo sapiens
cuaaaaugucuacuug

SEQ ID NO: 143892 - RNA, 21 nt, Homo sapiens
cuaaucucacccuuuucuggg

SEQ ID NO: 143893 - RNA, 22 nt, Homo sapiens
cuagaggcacagccuaggcacu

SEQ ID NO: 143894 - RNA, 22 nt, Homo sapiens
cuagccuggagugcaguggugc

SEQ ID NO: 143895 - RNA, 22 nt, Homo sapiens
cuaugcuuucugggcccugggu

SEQ ID NO: 143896 - RNA, 22 nt, Homo sapiens
cuauggcucugguuauggcugu

SEQ ID NO: 143897 - RNA, 22 nt, Homo sapiens
cucaccuugugauccacccacc

SEQ ID NO: 143898 - RNA, 22 nt, Homo sapiens
cucaccuugugauccuccugcc

SEQ ID NO: 143899 - RNA, 22 nt, Homo sapiens
cucauugcaaucucugccuccc

SEQ ID NO: 143900 - RNA, 22 nt, Homo sapiens
cuccagugcaaagucaugauca

SEQ ID NO: 143901 - RNA, 22 nt, Homo sapiens
cucccuuugcugaauguuuuuc

SEQ ID NO: 143902 - RNA, 22 nt, Homo sapiens
cucugagguuauucguaauauu

SEQ ID NO: 143903 - RNA, 22 nt, Homo sapiens
cucugauggagauauacaagga

SEQ ID NO: 143904 - RNA, 22 nt, Homo sapiens
cucuuuaguaagcaguugauga

SEQ ID NO: 143905 - RNA, 22 nt, Homo sapiens
cucuuuuguuccuaguuugauc

SEQ ID NO: 143906 - RNA, 22 nt, Homo sapiens
cugaagugcuugccacauaaaa

SEQ ID NO: 143907 - RNA, 22 nt, Homo sapiens
cugaauguucuggauggaagag

SEQ ID NO: 143908 - RNA, 22 nt, Homo sapiens
cugagacacucuuaucugcaua

SEQ ID NO: 143909 - RNA, 22 nt, Homo sapiens
cugagagaggagcuaaaacugc

SEQ ID NO: 143910 - RNA, 22 nt, Homo sapiens
cugagagaugagaccucucacu

SEQ ID NO: 143911 - RNA, 22 nt, Homo sapiens
cugagauuaagauauugggagu

SEQ ID NO: 143912 - RNA, 22 nt, Homo sapiens
cugagcaaaaugaagacacgau

SEQ ID NO: 143913 - RNA, 18 nt, Homo sapiens
cugagcacugcuuuauga

SEQ ID NO: 143914 - RNA, 22 nt, Homo sapiens
cugagguacugggggccaggau

SEQ ID NO: 143915 - RNA, 22 nt, Homo sapiens
cugagguauuuaggugaaagaa

SEQ ID NO: 143916 - RNA, 22 nt, Homo sapiens
cugaugaaguauuuguucugga

SEQ ID NO: 143917 - RNA, 22 nt, Homo sapiens
cugauugucuauuuaguucacu

SEQ ID NO: 143918 - RNA, 20 nt, Homo sapiens
cugcuccccuacaaaucuca

SEQ ID NO: 143919 - RNA, 22 nt, Homo sapiens
cuggaauucaaaaucugaauuu

SEQ ID NO: 143920 - RNA, 22 nt, Homo sapiens
cuggauagagauugaugaugcu

SEQ ID NO: 143921 - RNA, 22 nt, Homo sapiens
cuggcucauuucauuuagcaua

SEQ ID NO: 143922 - RNA, 22 nt, Homo sapiens
cuguacucaucccauaugcacu

SEQ ID NO: 143923 - RNA, 22 nt, Homo sapiens
cuguaguuagcagaugaugaau

SEQ ID NO: 143924 - RNA, 22 nt, Homo sapiens
cuguaugugagaaauaauaagu

SEQ ID NO: 143925 - RNA, 22 nt, Homo sapiens
cugucuguuucaaaagugguua

SEQ ID NO: 143926 - RNA, 22 nt, Homo sapiens
cugugcaaguuauaggccaggu

SEQ ID NO: 143927 - RNA, 22 nt, Homo sapiens
cuucaaaguuggcuaggagaca

SEQ ID NO: 143928 - RNA, 22 nt, Homo sapiens
cuucacuggagucccuggauuc

SEQ ID NO: 143929 - RNA, 22 nt, Homo sapiens
cuucuugagggccugcugggaa

SEQ ID NO: 143930 - RNA, 22 nt, Homo sapiens
cuugaccaauauggugaaaccc

SEQ ID NO: 143931 - RNA, 22 nt, Homo sapiens
ggacugucagggcuauuaguca

SEQ ID NO: 143932 - RNA, 22 nt, Homo sapiens
ggagguaauaaguuccagugua

SEQ ID NO: 143933 - RNA, 22 nt, Homo sapiens
ggaguaaaagaguaggaggaau

SEQ ID NO: 143934 - RNA, 22 nt, Homo sapiens
ggauggcauuucuuuagcuuuu

SEQ ID NO: 143935 - RNA, 22 nt, Homo sapiens
ggauugugauaauuguugcaaa

SEQ ID NO: 143936 - RNA, 22 nt, Homo sapiens
ggcaaagaugaccauuacuuuu

SEQ ID NO: 143937 - RNA, 22 nt, Homo sapiens
ggcaagaggagauucugcuccc

SEQ ID NO: 143938 - RNA, 23 nt, Homo sapiens
ggcaagaucucagcucacugcaa

SEQ ID NO: 143939 - RNA, 22 nt, Homo sapiens
ggcaaggugaugaaugucuaca

SEQ ID NO: 143940 - RNA, 22 nt, Homo sapiens
ggcaccauuuuacuccuucccu

SEQ ID NO: 143941 - RNA, 22 nt, Homo sapiens
ggcaugaugcgcacgccuguag

SEQ ID NO: 143942 - RNA, 22 nt, Homo sapiens
ggcuagagaauagugccacuaa

SEQ ID NO: 143943 - RNA, 22 nt, Homo sapiens
gggaagaaggagugguuuacuc

SEQ ID NO: 143944 - RNA, 20 nt, Homo sapiens
gggaaugcaaauucucaucc

SEQ ID NO: 143945 - RNA, 22 nt, Homo sapiens
gggagguagguauuagcuuuuc

SEQ ID NO: 143946 - RNA, 22 nt, Homo sapiens
gggauuauugugauuucauguu

SEQ ID NO: 143947 - RNA, 18 nt, Homo sapiens
gggcaaguugccuggcuu

SEQ ID NO: 143948 - RNA, 22 nt, Homo sapiens
gggcaugugugugcacacacau

SEQ ID NO: 143949 - RNA, 22 nt, Homo sapiens
gggccagaugcauuuguuauuu

SEQ ID NO: 143950 - RNA, 22 nt, Homo sapiens
gggggagugugguacccagcau

SEQ ID NO: 143951 - RNA, 22 nt, Homo sapiens
gggguauguaagugagugagug

SEQ ID NO: 143952 - RNA, 19 nt, Homo sapiens
ggucccucucaagucauuc

SEQ ID NO: 143953 - RNA, 22 nt, Homo sapiens
ggugagaaagggauuccuguuc

SEQ ID NO: 143954 - RNA, 23 nt, Homo sapiens
ggugaggaguacagagucuucau

SEQ ID NO: 143955 - RNA, 22 nt, Homo sapiens
ggugaguggugcuuaaguucag

SEQ ID NO: 143956 - RNA, 22 nt, Homo sapiens
guaaggcuguuaucuucacguc

SEQ ID NO: 143957 - RNA, 22 nt, Homo sapiens
guaauacuuuugggauauuaga

SEQ ID NO: 143958 - RNA, 22 nt, Homo sapiens
guaaucucagcuacucgggagg

SEQ ID NO: 143959 - RNA, 22 nt, Homo sapiens
guauagaucguagaccaauaaa

SEQ ID NO: 143960 - RNA, 22 nt, Homo sapiens
guauccugaaguucucagcacu

SEQ ID NO: 143961 - RNA, 22 nt, Homo sapiens
gucacugagaagguuaguuugu

SEQ ID NO: 143962 - RNA, 22 nt, Homo sapiens
gucacugagcagaaggaagcga

SEQ ID NO: 143963 - RNA, 22 nt, Homo sapiens
gucagggagggauagaugauua

SEQ ID NO: 143964 - RNA, 22 nt, Homo sapiens
gucagugucuuugcagcucaga

SEQ ID NO: 143965 - RNA, 22 nt, Homo sapiens
gucauugcuuaucugcugacgu

SEQ ID NO: 143966 - RNA, 22 nt, Homo sapiens
guccagagaagucauuacuuca

SEQ ID NO: 143967 - RNA, 22 nt, Homo sapiens
gucccagagauauugugucuuu

SEQ ID NO: 143968 - RNA, 22 nt, Homo sapiens
gucccaguggaaccuccaagcu

SEQ ID NO: 143969 - RNA, 22 nt, Homo sapiens
guccugaagaccuuccucugga

SEQ ID NO: 143970 - RNA, 22 nt, Homo sapiens
gucucagugcgaaucucaaaga

SEQ ID NO: 143971 - RNA, 22 nt, Homo sapiens
gucuguuugauccagaucaaaa

SEQ ID NO: 143972 - RNA, 21 nt, Homo sapiens
gucuuacagccagaugccucu

SEQ ID NO: 143973 - RNA, 20 nt, Homo sapiens
gucuugcuccguugcccagg

SEQ ID NO: 143974 - RNA, 22 nt, Homo sapiens
gucuuggcaugugcagcuggga

SEQ ID NO: 143975 - RNA, 22 nt, Homo sapiens
gucuuuggaaaaaaugucuguu

SEQ ID NO: 143976 - RNA, 17 nt, Homo sapiens
gucuuugguugaguuua

SEQ ID NO: 143977 - RNA, 22 nt, Homo sapiens
gugacauuuuuacugaugagag

SEQ ID NO: 143978 - RNA, 22 nt, Homo sapiens
gugaccagaugggcaggggugu

SEQ ID NO: 143979 - RNA, 22 nt, Homo sapiens
gugagaagaaaaauauggcugu

SEQ ID NO: 143980 - RNA, 22 nt, Homo sapiens
gugagaugguaucucauugugg

SEQ ID NO: 143981 - RNA, 19 nt, Homo sapiens
gugagcaaugcauugcacu

SEQ ID NO: 143982 - RNA, 22 nt, Homo sapiens
gugagcacugaaagaaggcaag

SEQ ID NO: 143983 - RNA, 22 nt, Homo sapiens
gugagguaagaguugcuuugcu

SEQ ID NO: 143984 - RNA, 20 nt, Homo sapiens
gugagguagaggguuaccug

SEQ ID NO: 143985 - RNA, 21 nt, Homo sapiens
gugaggucauugggcuuucug

SEQ ID NO: 143986 - RNA, 21 nt, Homo sapiens
gugcaaacaucauagaaugua

SEQ ID NO: 143987 - RNA, 22 nt, Homo sapiens
gugcacauuguuuaugucuguu

SEQ ID NO: 143988 - RNA, 22 nt, Homo sapiens
guggacagagacuaaauguugu

SEQ ID NO: 143989 - RNA, 22 nt, Homo sapiens
gugggaagcuggaacucccucc

SEQ ID NO: 143990 - RNA, 22 nt, Homo sapiens
guggucagaaaucucaguggca

SEQ ID NO: 143991 - RNA, 22 nt, Homo sapiens
gugguguccugcaccuauaguc

SEQ ID NO: 143992 - RNA, 22 nt, Homo sapiens
gugguuuuaauauucagucuag

SEQ ID NO: 143993 - RNA, 22 nt, Homo sapiens
guguauauccuauuaguucugu

SEQ ID NO: 143994 - RNA, 22 nt, Homo sapiens
gugugauuauuucaauugaugc

SEQ ID NO: 143995 - RNA, 19 nt, Homo sapiens
gugugcauaucacagagca

SEQ ID NO: 143996 - RNA, 21 nt, Homo sapiens
gugugcuugaauucagcuguc

SEQ ID NO: 143997 - RNA, 22 nt, Homo sapiens
guguggcaggugggggcucaga

SEQ ID NO: 143998 - RNA, 22 nt, Homo sapiens
guuaagaaguguaacuuaaguu

SEQ ID NO: 143999 - RNA, 22 nt, Homo sapiens
guucaagugauucuacugccuc

SEQ ID NO: 144000 - RNA, 17 nt, Homo sapiens
guucccaguggcauuug

SEQ ID NO: 144001 - RNA, 22 nt, Homo sapiens
guugcaauugauguaugucuga

SEQ ID NO: 144002 - RNA, 22 nt, Homo sapiens
guugcacagucuuuccuggacu

SEQ ID NO: 144003 - RNA, 22 nt, Homo sapiens
guugccuaggcuggagugcagu

SEQ ID NO: 144004 - RNA, 22 nt, Homo sapiens
guugcucaggcuggagugcagu

SEQ ID NO: 144005 - RNA, 22 nt, Homo sapiens
guuuaggaaugagaauauuuag

SEQ ID NO: 144006 - RNA, 22 nt, Homo sapiens
guuuggauuuucuaauuucugu

SEQ ID NO: 144007 - RNA, 21 nt, Homo sapiens
uaaagcuuagcuauaguggcu

SEQ ID NO: 144008 - RNA, 19 nt, Homo sapiens
uaacacaguuguguuugag

SEQ ID NO: 144009 - RNA, 22 nt, Homo sapiens
uaagaugaaggcucaccuagaa

SEQ ID NO: 144010 - RNA, 22 nt, Homo sapiens
uaaggcauuuuuuugaguugca

SEQ ID NO: 144011 - RNA, 22 nt, Homo sapiens
uaaggcccggccuuuccaagca

SEQ ID NO: 144012 - RNA, 22 nt, Homo sapiens
uaaggcuuugucuuaggacuuu

SEQ ID NO: 144013 - RNA, 22 nt, Homo sapiens
uaagguccuuaaauguguaacc

SEQ ID NO: 144014 - RNA, 22 nt, Homo sapiens
uaaguaguuucuggauauucuc

SEQ ID NO: 144015 - RNA, 22 nt, Homo sapiens
uaaguaucaguuuagcuaugau

SEQ ID NO: 144016 - RNA, 22 nt, Homo sapiens
uaauaauguuaggcuuacucaa

SEQ ID NO: 144017 - RNA, 22 nt, Homo sapiens
uaauagcucggauaaacaugau

SEQ ID NO: 144018 - RNA, 21 nt, Homo sapiens
ugaaugcuuuaaauauuagaa

SEQ ID NO: 144019 - RNA, 22 nt, Homo sapiens
ugaauguucuuaaaacccuugu

SEQ ID NO: 144020 - RNA, 22 nt, Homo sapiens
ugaauuguuuacgagaugugag

SEQ ID NO: 144021 - RNA, 22 nt, Homo sapiens
ugacaagauauggucuuaucaa

SEQ ID NO: 144022 - RNA, 20 nt, Homo sapiens
ugacaaggugcaaagaauca

SEQ ID NO: 144023 - RNA, 22 nt, Homo sapiens
ugacagagaagcauugaguuca

SEQ ID NO: 144024 - RNA, 22 nt, Homo sapiens
ugacagaggucuuuuaauagcu

SEQ ID NO: 144025 - RNA, 22 nt, Homo sapiens
ugacaguaaacagucuugauua

SEQ ID NO: 144026 - RNA, 20 nt, Homo sapiens
ugacaucagcaauguaauaa

SEQ ID NO: 144027 - RNA, 18 nt, Homo sapiens
ugacaucauuuagaaagg

SEQ ID NO: 144028 - RNA, 22 nt, Homo sapiens
ugacaugagauuugggaggggc

SEQ ID NO: 144029 - RNA, 22 nt, Homo sapiens
ugacauggugcucuuucaggca

SEQ ID NO: 144030 - RNA, 18 nt, Homo sapiens
ugacauugagcugagaaa

SEQ ID NO: 144031 - RNA, 22 nt, Homo sapiens
ugacauugggagugaagugaag

SEQ ID NO: 144032 - RNA, 22 nt, Homo sapiens
ugaccacugucuaagauaggug

SEQ ID NO: 144033 - RNA, 22 nt, Homo sapiens
ugacggaggacaccugcggaau

SEQ ID NO: 144034 - RNA, 22 nt, Homo sapiens
ugacuacauaaguaaucucaaa

SEQ ID NO: 144035 - RNA, 22 nt, Homo sapiens
ugacuggaaacaguguuauuug

SEQ ID NO: 144036 - RNA, 22 nt, Homo sapiens
ugacugguguuuaaugagucaa

SEQ ID NO: 144037 - RNA, 18 nt, Homo sapiens
ugacuguccagguggacc

SEQ ID NO: 144038 - RNA, 22 nt, Homo sapiens
ugacuugaucauuacacauucu

SEQ ID NO: 144039 - RNA, 22 nt, Homo sapiens
ugagaacagauggcuuuauuau

SEQ ID NO: 144040 - RNA, 22 nt, Homo sapiens
ugagaacugguagcacuuguga

SEQ ID NO: 144041 - RNA, 22 nt, Homo sapiens
ugagacauacuuacaggggaug

SEQ ID NO: 144042 - RNA, 22 nt, Homo sapiens
ugagacaugugaauauuuguac

SEQ ID NO: 144043 - RNA, 22 nt, Homo sapiens
ugagaccuuucauuucucagug

SEQ ID NO: 144044 - RNA, 22 nt, Homo sapiens
ugagacggagucucgcucuguu

SEQ ID NO: 144045 - RNA, 22 nt, Homo sapiens
ugagacggagucuugcucuguc

SEQ ID NO: 144046 - RNA, 22 nt, Homo sapiens
ugagacggaguuucacucuugu

SEQ ID NO: 144047 - RNA, 22 nt, Homo sapiens
ugagacggaguuuugcucuugu

SEQ ID NO: 144048 - RNA, 22 nt, Homo sapiens
ugagagaugauaaaauguuugu

SEQ ID NO: 144049 - RNA, 22 nt, Homo sapiens
ugagaggugaauggcaggcuca

SEQ ID NO: 144050 - RNA, 22 nt, Homo sapiens
ugagauccugagaguugggacu

SEQ ID NO: 144051 - RNA, 22 nt, Homo sapiens
ugagaugaagcuagaagaaugg

SEQ ID NO: 144052 - RNA, 22 nt, Homo sapiens
ugagaugaagucuugcucuguu

SEQ ID NO: 144053 - RNA, 22 nt, Homo sapiens
ugagaugaagugauguaaaaca

SEQ ID NO: 144054 - RNA, 22 nt, Homo sapiens
ugagaugagggaagccuaggca

SEQ ID NO: 144055 - RNA, 22 nt, Homo sapiens
ugagaugaggucucacucuguu

SEQ ID NO: 144056 - RNA, 22 nt, Homo sapiens
ugagaugaugggauaagagggc

SEQ ID NO: 144057 - RNA, 22 nt, Homo sapiens
ugagaugauuuaauggagccca

SEQ ID NO: 144058 - RNA, 22 nt, Homo sapiens
ugagauggaguuucacuuuugu

SEQ ID NO: 144059 - RNA, 22 nt, Homo sapiens
ugagauggaguuucgcucuugu

SEQ ID NO: 144060 - RNA, 22 nt, Homo sapiens
ugagaugugaagaucacaugaa

SEQ ID NO: 144061 - RNA, 22 nt, Homo sapiens
ugagauuaucguaauguaucuc

SEQ ID NO: 144062 - RNA, 22 nt, Homo sapiens
ugagauuaucuugaucuugaaa

SEQ ID NO: 144063 - RNA, 22 nt, Homo sapiens
ugagcaaaauuuuggacauaga

SEQ ID NO: 144064 - RNA, 22 nt, Homo sapiens
ugagcaauaaaguuacacaguu

SEQ ID NO: 144065 - RNA, 22 nt, Homo sapiens
ugagccauggcaccuugucuaa

SEQ ID NO: 144066 - RNA, 22 nt, Homo sapiens
ugagcuguuugaagaagcauuu

SEQ ID NO: 144067 - RNA, 22 nt, Homo sapiens
ugaggauaguguugaaggcagg

SEQ ID NO: 144068 - RNA, 22 nt, Homo sapiens
ugaggguauagccagcccuuag

SEQ ID NO: 144069 - RNA, 22 nt, Homo sapiens
ugagguaggugaagaaugcacg

SEQ ID NO: 144070 - RNA, 22 nt, Homo sapiens
ugagguaugacuuauuauucuu

SEQ ID NO: 144071 - RNA, 22 nt, Homo sapiens
ugagguauuuuguuaugcagcc

SEQ ID NO: 144072 - RNA, 23 nt, Homo sapiens
ugagguguuaagcagacuugucu

SEQ ID NO: 144073 - RNA, 23 nt, Homo sapiens
ugaguagguccacguaugugagu

SEQ ID NO: 144074 - RNA, 20 nt, Homo sapiens
ugaguuccuuguucagaagc

SEQ ID NO: 144075 - RNA, 23 nt, Homo sapiens
ugauaacagcauaugaagauucu

SEQ ID NO: 144076 - RNA, 22 nt, Homo sapiens
ugauaacauugggggaagcuga

SEQ ID NO: 144077 - RNA, 22 nt, Homo sapiens
ugauaauguuaggcuuuauuca

SEQ ID NO: 144078 - RNA, 22 nt, Homo sapiens
ugauaggucuguuuugaaaagg

SEQ ID NO: 144079 - RNA, 22 nt, Homo sapiens
ugauauauugaaugaugaaaca

SEQ ID NO: 144080 - RNA, 22 nt, Homo sapiens
ugauauguguaaacaauguaua

SEQ ID NO: 144081 - RNA, 20 nt, Homo sapiens
ugauauuuucugagcaggaa

SEQ ID NO: 144082 - RNA, 22 nt, Homo sapiens
ugaugcugaugccugccagaag

SEQ ID NO: 144083 - RNA, 22 nt, Homo sapiens
ugauuguucuguccccaggggc

SEQ ID NO: 144084 - RNA, 22 nt, Homo sapiens
ugauuuguuuagugccaaguuu

SEQ ID NO: 144085 - RNA, 22 nt, Homo sapiens
ugauuuguuucaggaguuuucu

SEQ ID NO: 144086 - RNA, 19 nt, Homo sapiens
ugcaaauucuaaaaacuga

SEQ ID NO: 144087 - RNA, 21 nt, Homo sapiens
ugcaagaaucaggaagcugcc

SEQ ID NO: 144088 - RNA, 22 nt, Homo sapiens
ugcaauauccucuacuauaggu

SEQ ID NO: 144089 - RNA, 18 nt, Homo sapiens
ugcaauggagaugcagcc

SEQ ID NO: 144090 - RNA, 22 nt, Homo sapiens
ugcaccacugcacuucagccug

SEQ ID NO: 144091 - RNA, 17 nt, Homo sapiens
ugcaccauuugauuuuu

SEQ ID NO: 144092 - RNA, 16 nt, Homo sapiens
ugcagaguaggugaau

SEQ ID NO: 144093 - RNA, 22 nt, Homo sapiens
ugcagagucuguccugccugcc

SEQ ID NO: 144094 - RNA, 22 nt, Homo sapiens
ugcagauucguuuugaggggua

SEQ ID NO: 144095 - RNA, 22 nt, Homo sapiens
ugcagcacuguucacaauagcc

SEQ ID NO: 144096 - RNA, 18 nt, Homo sapiens
ugcagcaucaguacccag

SEQ ID NO: 144097 - RNA, 22 nt, Homo sapiens
ugcagcauguaggcacguuauu

SEQ ID NO: 144098 - RNA, 22 nt, Homo sapiens
ugcagguacuugacaacuuggg

SEQ ID NO: 144099 - RNA, 23 nt, Homo sapiens
ugcaguagugagaucuaggcuca

SEQ ID NO: 144100 - RNA, 22 nt, Homo sapiens
ugcaguguggcucacgccugua

SEQ ID NO: 144101 - RNA, 22 nt, Homo sapiens
ugcauacugaaauauuuuagag

SEQ ID NO: 144102 - RNA, 22 nt, Homo sapiens
ugcauauguugagaugcauauu

SEQ ID NO: 144103 - RNA, 22 nt, Homo sapiens
ugcauauucuaggauuuuguau

SEQ ID NO: 144104 - RNA, 22 nt, Homo sapiens
ugccaagauuucaggaauuaag

SEQ ID NO: 144105 - RNA, 22 nt, Homo sapiens
uugccuaggcuggagugcagug

SEQ ID NO: 144106 - RNA, 22 nt, Homo sapiens
uugccuaggcuggaguguggug

SEQ ID NO: 144107 - RNA, 22 nt, Homo sapiens
uugcuuaggcuggagugcagug

SEQ ID NO: 144108 - RNA, 22 nt, Homo sapiens
uuggaauguacucuagccuaug

SEQ ID NO: 144109 - RNA, 22 nt, Homo sapiens
uuggaugauaaagaagccuaag

SEQ ID NO: 144110 - RNA, 22 nt, Homo sapiens
uuggauuauaaacugagauuug

SEQ ID NO: 144111 - RNA, 22 nt, Homo sapiens
uuggcaaauagguuuuauugca

SEQ ID NO: 144112 - RNA, 22 nt, Homo sapiens
uuggcaagaaccuucuuccaag

SEQ ID NO: 144113 - RNA, 21 nt, Homo sapiens
uuggcacucuucucuccuuau

SEQ ID NO: 144114 - RNA, 22 nt, Homo sapiens
uuggcauuuauucuaaggucaa

SEQ ID NO: 144115 - RNA, 22 nt, Homo sapiens
uuggccccuuucauccacagcu

SEQ ID NO: 144116 - RNA, 19 nt, Homo sapiens
uuggcccugguucucuucu

SEQ ID NO: 144117 - RNA, 22 nt, Homo sapiens
uuggcucugcgucucgcggacg

SEQ ID NO: 144118 - RNA, 22 nt, Homo sapiens
uugggcuuuuagguccuuaaca

SEQ ID NO: 144119 - RNA, 21 nt, Homo sapiens
uuggggaauggagagguuuuc

SEQ ID NO: 144120 - RNA, 22 nt, Homo sapiens
uuggucaggagccucccucuuu

SEQ ID NO: 144121 - RNA, 22 nt, Homo sapiens
uuggucucaucaagagcagcuu

SEQ ID NO: 144122 - RNA, 22 nt, Homo sapiens
uugguucucuuagccaucuuaa

SEQ ID NO: 144123 - RNA, 23 nt, Homo sapiens
uuguaacuggagaguaacauucc

SEQ ID NO: 144124 - RNA, 22 nt, Homo sapiens
uuguaauguuaccaaauggugu

SEQ ID NO: 144125 - RNA, 22 nt, Homo sapiens
uuguacuagaaaauuauucuuu

SEQ ID NO: 144126 - RNA, 22 nt, Homo sapiens
uuguaguagucucguucuuuua

SEQ ID NO: 144127 - RNA, 22 nt, Homo sapiens
uuguaugucuucauuugaaaaa

SEQ ID NO: 144128 - RNA, 22 nt, Homo sapiens
uugucacccuacauaacaggga

SEQ ID NO: 144129 - RNA, 22 nt, Homo sapiens
uuguccucuccaaaucucaugu

SEQ ID NO: 144130 - RNA, 22 nt, Homo sapiens
uugugaaaucuaggcagagguu

SEQ ID NO: 144131 - RNA, 22 nt, Homo sapiens
uugugcaaaguugugguuucug

SEQ ID NO: 144132 - RNA, 22 nt, Homo sapiens
uugugccacugaagcccuccag

SEQ ID NO: 144133 - RNA, 22 nt, Homo sapiens
uugugccauucuucugccucag

SEQ ID NO: 144134 - RNA, 22 nt, Homo sapiens
uugugcuuaaugaguguaaggu

SEQ ID NO: 144135 - RNA, 22 nt, Homo sapiens
uugugucccugcggcugaggag

SEQ ID NO: 144136 - RNA, 22 nt, Homo sapiens
uuguuuuggagaugagcuaaaa

SEQ ID NO: 144137 - RNA, 22 nt, Homo sapiens
uuuagcacugugauugacaaaa

SEQ ID NO: 144138 - RNA, 22 nt, Homo sapiens
uuuaucaggccuuuggaaaaau

SEQ ID NO: 144139 - RNA, 22 nt, Homo sapiens
uuucaacuaauuuuuuggugag

SEQ ID NO: 144140 - RNA, 18 nt, Homo sapiens
uuucaagucuuaggugac

SEQ ID NO: 144141 - RNA, 22 nt, Homo sapiens
uuucacagcaauugccuauugu

SEQ ID NO: 144142 - RNA, 23 nt, Homo sapiens
uuucacaguagcuggaucagccu

SEQ ID NO: 144143 - RNA, 22 nt, Homo sapiens
uuucagcguggggugcugaaga

SEQ ID NO: 144144 - RNA, 22 nt, Homo sapiens
uuucaguagagacacgguuuug

SEQ ID NO: 144145 - RNA, 22 nt, Homo sapiens
uuucauguuuuucugugaggca

SEQ ID NO: 144146 - RNA, 22 nt, Homo sapiens
uuuccaagaugcuuacuuucuc

SEQ ID NO: 144147 - RNA, 22 nt, Homo sapiens
uuuccaguuuggaggaugcauu

SEQ ID NO: 144148 - RNA, 16 nt, Homo sapiens
uuucccuuugguguuu

SEQ ID NO: 144149 - RNA, 22 nt, Homo sapiens
uuucugagaccaaaacuuguaa

SEQ ID NO: 144150 - RNA, 22 nt, Homo sapiens
uuucugaggccucaccagaagc

SEQ ID NO: 144151 - RNA, 21 nt, Homo sapiens
uuucugggggagcauggcagg

SEQ ID NO: 144152 - RNA, 22 nt, Homo sapiens
uuucugggggugcugauggaaa

SEQ ID NO: 144153 - RNA, 22 nt, Homo sapiens
uuugagcuugacucagcuggag

SEQ ID NO: 144154 - RNA, 22 nt, Homo sapiens
uuugauguugauacuaccuuca

SEQ ID NO: 144155 - RNA, 22 nt, Homo sapiens
uuugauuguacuaaaauuguac

SEQ ID NO: 144156 - RNA, 22 nt, Homo sapiens
uuugcacauauuugggcaaaag

SEQ ID NO: 144157 - RNA, 22 nt, Homo sapiens
uuugcacuggagauucaauggg

SEQ ID NO: 144158 - RNA, 22 nt, Homo sapiens
uuugcacuuuaauauaauguga

SEQ ID NO: 144159 - RNA, 22 nt, Homo sapiens
uuugcacuuuuguaauaugguu

SEQ ID NO: 144160 - RNA, 22 nt, Homo sapiens
uuugcagugucagcuucugugu

SEQ ID NO: 144161 - RNA, 22 nt, Homo sapiens
uuugcuaaucaacacuggccug

SEQ ID NO: 144162 - RNA, 22 nt, Homo sapiens
uuugcugagucugacuucaugg

SEQ ID NO: 144163 - RNA, 22 nt, Homo sapiens
uuugcuuaguaaauguagaaaa

SEQ ID NO: 144164 - RNA, 22 nt, Homo sapiens
uuuggcaacguuggaucccuca

SEQ ID NO: 144165 - RNA, 22 nt, Homo sapiens
uuugggaaaugaaguugguaga

SEQ ID NO: 144166 - RNA, 22 nt, Homo sapiens
uuugggaaugguuugucuccca

SEQ ID NO: 144167 - RNA, 22 nt, Homo sapiens
uuugggccucugauuucuuugg

SEQ ID NO: 144168 - RNA, 22 nt, Homo sapiens
uuuguaagaugcauagauugca

SEQ ID NO: 144169 - RNA, 22 nt, Homo sapiens
uuuguacuugaagaaucuuuau

SEQ ID NO: 144170 - RNA, 22 nt, Homo sapiens
uuugucacccugaauguaagau

SEQ ID NO: 144171 - RNA, 22 nt, Homo sapiens
uuugugauugcacacucaagau

SEQ ID NO: 144172 - RNA, 22 nt, Homo sapiens
uuugugugugauuauaaaaggu

SEQ ID NO: 144173 - RNA, 22 nt, Homo sapiens
uuuuagcagccaugacaaagau

SEQ ID NO: 144174 - RNA, 22 nt, Homo sapiens
uuuucaguuuuccagguagccg

SEQ ID NO: 144175 - RNA, 21 nt, Homo sapiens
uuuuugguggucauggauaga

SEQ ID NO: 144176 - RNA, 22 nt, Homo sapiens
uaauucacauaaagcacuuaga

SEQ ID NO: 144177 - RNA, 22 nt, Homo sapiens
uaauugaaugcagacaccaggg

SEQ ID NO: 144178 - RNA, 22 nt, Homo sapiens
uacaagcacaggcagcaggcug

SEQ ID NO: 144179 - RNA, 22 nt, Homo sapiens
uacaaguggguuugugcaggag

SEQ ID NO: 144180 - RNA, 18 nt, Homo sapiens
uacagaacuggaguagaa

SEQ ID NO: 144181 - RNA, 22 nt, Homo sapiens
uacagcacaggugcagguguug

SEQ ID NO: 144182 - RNA, 22 nt, Homo sapiens
uacagcacugugcauagugguu

SEQ ID NO: 144183 - RNA, 22 nt, Homo sapiens
uacagucuagaggagaaucagg

SEQ ID NO: 144184 - RNA, 22 nt, Homo sapiens
uacagucuggaggccuguguug

SEQ ID NO: 144185 - RNA, 22 nt, Homo sapiens
uacagugcuuuuugguggagaa

SEQ ID NO: 144186 - RNA, 22 nt, Homo sapiens
uacauguauacaggguuuacuu

SEQ ID NO: 144187 - RNA, 22 nt, Homo sapiens
uaccuaguaggugguuuuucag

SEQ ID NO: 144188 - RNA, 23 nt, Homo sapiens
uacuacacuuuucccaagguuuu

SEQ ID NO: 144189 - RNA, 21 nt, Homo sapiens
uacuggagauacagucugcaa

SEQ ID NO: 144190 - RNA, 22 nt, Homo sapiens
uagaagcugagaauguccucag

SEQ ID NO: 144191 - RNA, 22 nt, Homo sapiens
uagaauguaacaguuaaaagca

SEQ ID NO: 144192 - RNA, 22 nt, Homo sapiens
uagacacugcauauuuuuuuaa

SEQ ID NO: 144193 - RNA, 22 nt, Homo sapiens
uagagcaaugacucuggaaacc

SEQ ID NO: 144194 - RNA, 18 nt, Homo sapiens
uagagcacaagcuuuggc

SEQ ID NO: 144195 - RNA, 22 nt, Homo sapiens
uagagguagccuacuacacacc

SEQ ID NO: 144196 - RNA, 22 nt, Homo sapiens
uagagguauguauaguauucuu

SEQ ID NO: 144197 - RNA, 21 nt, Homo sapiens
uagauaguugguucugaaucu

SEQ ID NO: 144198 - RNA, 22 nt, Homo sapiens
uagaucauauacuugccaugac

SEQ ID NO: 144199 - RNA, 22 nt, Homo sapiens
uagauuaucccugauuugucca

SEQ ID NO: 144200 - RNA, 22 nt, Homo sapiens
uagcaaguguuuaagcacuuuu

SEQ ID NO: 144201 - RNA, 22 nt, Homo sapiens
uagcacagggaauugguucucu

SEQ ID NO: 144202 - RNA, 19 nt, Homo sapiens
uagcacagggucccagacu

SEQ ID NO: 144203 - RNA, 17 nt, Homo sapiens
uagcacagugccuggua

SEQ ID NO: 144204 - RNA, 19 nt, Homo sapiens
uagcagcaugauuuauaau

SEQ ID NO: 144205 - RNA, 22 nt, Homo sapiens
uagcaguucauuguugugugaa

SEQ ID NO: 144206 - RNA, 22 nt, Homo sapiens
uagcauaauuuguagaaaauca

SEQ ID NO: 144207 - RNA, 22 nt, Homo sapiens
uagcuccacagcuauauauaau

SEQ ID NO: 144208 - RNA, 22 nt, Homo sapiens
uagcugagacuacaguaggugc

SEQ ID NO: 144209 - RNA, 22 nt, Homo sapiens
uagcuguuggugggaagucaga

SEQ ID NO: 144210 - RNA, 22 nt, Homo sapiens
uagggcuuuaguuugcuugugu

SEQ ID NO: 144211 - RNA, 22 nt, Homo sapiens
uagggcuuuccggccugucaga

SEQ ID NO: 144212 - RNA, 22 nt, Homo sapiens
uaggguaguaauaguuguuuca

SEQ ID NO: 144213 - RNA, 22 nt, Homo sapiens
uagguaguaaauugauagagga

SEQ ID NO: 144214 - RNA, 22 nt, Homo sapiens
uagguugucuguucacucugau

SEQ ID NO: 144215 - RNA, 22 nt, Homo sapiens
uaguagagauggggcacaugcc

SEQ ID NO: 144216 - RNA, 22 nt, Homo sapiens
uaguaucacauggucuuaauua

SEQ ID NO: 144217 - RNA, 22 nt, Homo sapiens
uaguuaguagacucugauuauu

SEQ ID NO: 144218 - RNA, 22 nt, Homo sapiens
uaguuuaucuucuggauggaca

SEQ ID NO: 144219 - RNA, 22 nt, Homo sapiens
uauaagguuaggaaaaauuucu

SEQ ID NO: 144220 - RNA, 22 nt, Homo sapiens
uauaucuagagcggaccaggcu

SEQ ID NO: 144221 - RNA, 23 nt, Homo sapiens
uauaugugucuaggagcuauggu

SEQ ID NO: 144222 - RNA, 22 nt, Homo sapiens
uaucacccuuucauuguucuuc

SEQ ID NO: 144223 - RNA, 22 nt, Homo sapiens
uaucaugggggguguacacucc

SEQ ID NO: 144224 - RNA, 21 nt, Homo sapiens
uauccacuugcaacagagaag

SEQ ID NO: 144225 - RNA, 22 nt, Homo sapiens
uaucccaauguaauaucacaaa

SEQ ID NO: 144226 - RNA, 22 nt, Homo sapiens
uaugaaagcuacuucucacaau

SEQ ID NO: 144227 - RNA, 22 nt, Homo sapiens
uaugacuuuugaauacagaugg

SEQ ID NO: 144228 - RNA, 22 nt, Homo sapiens
uaugagacugguuaauuuuugu

SEQ ID NO: 144229 - RNA, 22 nt, Homo sapiens
uaugagcaaaaugaggguuagu

SEQ ID NO: 144230 - RNA, 22 nt, Homo sapiens
uaugaggaguauaacccgguga

SEQ ID NO: 144231 - RNA, 22 nt, Homo sapiens
uaugcacacacguguuuaugug

SEQ ID NO: 144232 - RNA, 22 nt, Homo sapiens
uaugcacaugcaugcuugaaua

SEQ ID NO: 144233 - RNA, 22 nt, Homo sapiens
uaugcacaugugccugggugug

SEQ ID NO: 144234 - RNA, 19 nt, Homo sapiens
uaugcuauuuauuagaagu

SEQ ID NO: 144235 - RNA, 21 nt, Homo sapiens
uauggcuuagucaguguuucc

SEQ ID NO: 144236 - RNA, 22 nt, Homo sapiens
uauggcuuucuacuugaguucu

SEQ ID NO: 144237 - RNA, 22 nt, Homo sapiens
uaugucaugggguuuuugagau

SEQ ID NO: 144238 - RNA, 22 nt, Homo sapiens
uaugugcaaauuaauugcuaga

SEQ ID NO: 144239 - RNA, 22 nt, Homo sapiens
uauguuaucaaaaagcuaagga

SEQ ID NO: 144240 - RNA, 20 nt, Homo sapiens
uauuacagaguaauggugga

SEQ ID NO: 144241 - RNA, 22 nt, Homo sapiens
uauuacuguuauuccuaucaaa

SEQ ID NO: 144242 - RNA, 22 nt, Homo sapiens
uauuacuugucugugucucaau

SEQ ID NO: 144243 - RNA, 22 nt, Homo sapiens
uauucacuguaucauugauggg

SEQ ID NO: 144244 - RNA, 22 nt, Homo sapiens
uauuccacucuguuggagguaa

SEQ ID NO: 144245 - RNA, 22 nt, Homo sapiens
uauugaacgugggauauugaag

SEQ ID NO: 144246 - RNA, 22 nt, Homo sapiens
uauugaauuugagcugucucuu

SEQ ID NO: 144247 - RNA, 22 nt, Homo sapiens
uauugcaauuggcagagugcua

SEQ ID NO: 144248 - RNA, 22 nt, Homo sapiens
uauugcagauacccaggaaguu

SEQ ID NO: 144249 - RNA, 22 nt, Homo sapiens
uauugccucagugacuuugggg

SEQ ID NO: 144250 - RNA, 22 nt, Homo sapiens
uauugcuggcacauaguagguc

SEQ ID NO: 144251 - RNA, 22 nt, Homo sapiens
uauugcuggcucugucuucauu

SEQ ID NO: 144252 - RNA, 22 nt, Homo sapiens
uauugcuuaugaugcugaauua

SEQ ID NO: 144253 - RNA, 22 nt, Homo sapiens
uauugcuuuuaacccaaucucu

SEQ ID NO: 144254 - RNA, 22 nt, Homo sapiens
uauugucaccaucccuguuuua

SEQ ID NO: 144255 - RNA, 22 nt, Homo sapiens
uauuguuaaagauguuaaugau

SEQ ID NO: 144256 - RNA, 22 nt, Homo sapiens
ucaaacacuccauaucgcgauu

SEQ ID NO: 144257 - RNA, 22 nt, Homo sapiens
uugagauggagucuugcucucu

SEQ ID NO: 144258 - RNA, 22 nt, Homo sapiens
uugagauggagucuuguucuuu

SEQ ID NO: 144259 - RNA, 22 nt, Homo sapiens
uugagauggaguguugcucugu

SEQ ID NO: 144260 - RNA, 22 nt, Homo sapiens
uugagauggaguucauuuuugu

SEQ ID NO: 144261 - RNA, 22 nt, Homo sapiens
uugagauggaguuucaauauug

SEQ ID NO: 144262 - RNA, 22 nt, Homo sapiens
uugagauggaguuucgcucuuu

SEQ ID NO: 144263 - RNA, 22 nt, Homo sapiens
uugagcaaugucacugaggcuu

SEQ ID NO: 144264 - RNA, 22 nt, Homo sapiens
uugagcuccucucaaccuaagg

SEQ ID NO: 144265 - RNA, 22 nt, Homo sapiens
uugaggcaaugaggagaagcug

SEQ ID NO: 144266 - RNA, 22 nt, Homo sapiens
uugagggaggcagggcuugucu

SEQ ID NO: 144267 - RNA, 22 nt, Homo sapiens
uugagguaguacuuauuauugg

SEQ ID NO: 144268 - RNA, 22 nt, Homo sapiens
uugagguauuuugucaacugua

SEQ ID NO: 144269 - RNA, 20 nt, Homo sapiens
uugaggugugaggggcagag

SEQ ID NO: 144270 - RNA, 22 nt, Homo sapiens
uugauaguaccauugggaaauu

SEQ ID NO: 144271 - RNA, 22 nt, Homo sapiens
uugauaguuuaauuaaugcuag

SEQ ID NO: 144272 - RNA, 22 nt, Homo sapiens
uugauauucugagaagcugaag

SEQ ID NO: 144273 - RNA, 22 nt, Homo sapiens
uugauauucuuucuggauccca

SEQ ID NO: 144274 - RNA, 21 nt, Homo sapiens
uugcaaaugcugcugccugau

SEQ ID NO: 144275 - RNA, 22 nt, Homo sapiens
uugcacauggcuggggaggccu

SEQ ID NO: 144276 - RNA, 22 nt, Homo sapiens
uugcacauguugaaccagcaaa

SEQ ID NO: 144277 - RNA, 22 nt, Homo sapiens
uugcacuugcugaggagugauu

SEQ ID NO: 144278 - RNA, 22 nt, Homo sapiens
uugcagugugacgacuauauuu

SEQ ID NO: 144279 - RNA, 22 nt, Homo sapiens
uugccaauauuuuacugagaag

SEQ ID NO: 144280 - RNA, 22 nt, Homo sapiens
uugccuauucacucugaugaua

SEQ ID NO: 144281 - RNA, 22 nt, Homo sapiens
uugcugagucuuucuagguugc

SEQ ID NO: 144282 - RNA, 22 nt, Homo sapiens
uugcuuuguuacugcaguuucc

SEQ ID NO: 144283 - RNA, 22 nt, Homo sapiens
uuggaaaaauccaccuugaucu

SEQ ID NO: 144284 - RNA, 22 nt, Homo sapiens
uuggaaacaccuggugagguua

SEQ ID NO: 144285 - RNA, 22 nt, Homo sapiens
uuggaaacauuuaugguaacag

SEQ ID NO: 144286 - RNA, 22 nt, Homo sapiens
uuggaaugcacacugagccugc

SEQ ID NO: 144287 - RNA, 22 nt, Homo sapiens
uuggacuggaacuauaccauug

SEQ ID NO: 144288 - RNA, 22 nt, Homo sapiens
uuggacugggauggccgaggcu

SEQ ID NO: 144289 - RNA, 22 nt, Homo sapiens
uuggagcacuggggcacugaca

SEQ ID NO: 144290 - RNA, 22 nt, Homo sapiens
uuggcaaaugucacaaaucagg

SEQ ID NO: 144291 - RNA, 22 nt, Homo sapiens
uuggcagcauuccagccaagca

SEQ ID NO: 144292 - RNA, 22 nt, Homo sapiens
uuggcagucugaggcacagacu

SEQ ID NO: 144293 - RNA, 22 nt, Homo sapiens
uuggccaauggugauucccggc

SEQ ID NO: 144294 - RNA, 22 nt, Homo sapiens
uuggccagugucuuuuuuuccu

SEQ ID NO: 144295 - RNA, 22 nt, Homo sapiens
uuggcuguguuuauaugcugga

SEQ ID NO: 144296 - RNA, 19 nt, Homo sapiens
uuggucccuuuggguucuu

SEQ ID NO: 144297 - RNA, 22 nt, Homo sapiens
uugguuccuuagccuaggacua

SEQ ID NO: 144298 - RNA, 22 nt, Homo sapiens
uuguaauggagcaaacagguug

SEQ ID NO: 144299 - RNA, 22 nt, Homo sapiens
uuguagaucuucaguugcuaca

SEQ ID NO: 144300 - RNA, 22 nt, Homo sapiens
uuguagcaaauguguaaacaaa

SEQ ID NO: 144301 - RNA, 22 nt, Homo sapiens
uuguauacucuauuuuagcagu

SEQ ID NO: 144302 - RNA, 22 nt, Homo sapiens
uuguauguugaaugaugguaua

SEQ ID NO: 144303 - RNA, 22 nt, Homo sapiens
uugucaguguucacucaaagcu

SEQ ID NO: 144304 - RNA, 22 nt, Homo sapiens
uugucuagugaauacauuaaug

SEQ ID NO: 144305 - RNA, 22 nt, Homo sapiens
uugugagggagcuaagaugagu

SEQ ID NO: 144306 - RNA, 22 nt, Homo sapiens
uugugauugagugauccuuguu

SEQ ID NO: 144307 - RNA, 22 nt, Homo sapiens
uugugcuuuugagcugagauga

SEQ ID NO: 144308 - RNA, 22 nt, Homo sapiens
uugugguugauacacguaggaa

SEQ ID NO: 144309 - RNA, 22 nt, Homo sapiens
uuguguuugaugcugacacgca

SEQ ID NO: 144310 - RNA, 22 nt, Homo sapiens
uuuaauacugcaucuuuacucu

SEQ ID NO: 144311 - RNA, 22 nt, Homo sapiens
uuuaaugcaucccaaaauguag

SEQ ID NO: 144312 - RNA, 22 nt, Homo sapiens
uuuaaugcgucucugaguuuug

SEQ ID NO: 144313 - RNA, 22 nt, Homo sapiens
uuuacugucuucagucccucug

SEQ ID NO: 144314 - RNA, 22 nt, Homo sapiens
uuuagcagcaaagagccaugcu

SEQ ID NO: 144315 - RNA, 22 nt, Homo sapiens
uuuagcucauucaauuucaguc

SEQ ID NO: 144316 - RNA, 22 nt, Homo sapiens
uuuauagucaggaacuugagga

SEQ ID NO: 144317 - RNA, 22 nt, Homo sapiens
uuuaugagguagagugguuuau

SEQ ID NO: 144318 - RNA, 22 nt, Homo sapiens
uuuaugcuacauguguuggaaa

SEQ ID NO: 144319 - RNA, 22 nt, Homo sapiens
uuucaccguguuggccaggcug

SEQ ID NO: 144320 - RNA, 22 nt, Homo sapiens
uuucacguuggggaguugagug

SEQ ID NO: 144321 - RNA, 22 nt, Homo sapiens
uuucauggcgaggcuucauggg

SEQ ID NO: 144322 - RNA, 19 nt, Homo sapiens
uuuccaguaaucuuaugug

SEQ ID NO: 144323 - RNA, 19 nt, Homo sapiens
uuucccugcagaccuacua

SEQ ID NO: 144324 - RNA, 21 nt, Homo sapiens
uuuccuggagcguauggcuuc

SEQ ID NO: 144325 - RNA, 20 nt, Homo sapiens
uuucuccccuauaaaucuca

SEQ ID NO: 144326 - RNA, 22 nt, Homo sapiens
uuucugcuugagagaauugcug

SEQ ID NO: 144327 - RNA, 22 nt, Homo sapiens
uuugagcuagagucucacucug

SEQ ID NO: 144328 - RNA, 22 nt, Homo sapiens
uuugaggaaaggcauaaguagg

SEQ ID NO: 144329 - RNA, 22 nt, Homo sapiens
uuugcaagaugaaaaaguucua

SEQ ID NO: 144330 - RNA, 22 nt, Homo sapiens
uuugcacuugaaaacacucuca

SEQ ID NO: 144331 - RNA, 23 nt, Homo sapiens
uuugccacuuauuagcugggagg

SEQ ID NO: 144332 - RNA, 19 nt, Homo sapiens
uuugccuaggcacauggcc

SEQ ID NO: 144333 - RNA, 22 nt, Homo sapiens
uuuggcagaaaacaagaaucug

SEQ ID NO: 144334 - RNA, 22 nt, Homo sapiens
uuuggcaugggcuauuugcuuu

SEQ ID NO: 144335 - RNA, 22 nt, Homo sapiens
uuuggcucugugucccacccaa

SEQ ID NO: 144336 - RNA, 22 nt, Homo sapiens
uuugguaauguuucauugcaga

SEQ ID NO: 144337 - RNA, 22 nt, Homo sapiens
uuuggucacugccgccgccagc

SEQ ID NO: 144338 - RNA, 22 nt, Homo sapiens
uuuguacuaugguuuuucacua

SEQ ID NO: 144339 - RNA, 22 nt, Homo sapiens
uuuguacuucauacaauaacuc

SEQ ID NO: 144340 - RNA, 22 nt, Homo sapiens
uuuguagcucacucugagcuga

SEQ ID NO: 144341 - RNA, 21 nt, Homo sapiens
uuuguaguagcaugauuuaua

SEQ ID NO: 144342 - RNA, 22 nt, Homo sapiens
uuugucuccuaagacucugugg

SEQ ID NO: 144343 - RNA, 22 nt, Homo sapiens
uuugugcuccucucaguaugug

SEQ ID NO: 144344 - RNA, 22 nt, Homo sapiens
uuuuacagaggagguugcugau

SEQ ID NO: 144345 - RNA, 22 nt, Homo sapiens
ggaguguuccauuugucacauu

SEQ ID NO: 144346 - RNA, 22 nt, Homo sapiens
ggaguuuaagucuugugcaucu

SEQ ID NO: 144347 - RNA, 22 nt, Homo sapiens
ggaucacuugagaccaggaguu

SEQ ID NO: 144348 - RNA, 23 nt, Homo sapiens
ggauggaaaguuuugagggccac

SEQ ID NO: 144349 - RNA, 23 nt, Homo sapiens
ggcacggaauucaaagaggcauu

SEQ ID NO: 144350 - RNA, 22 nt, Homo sapiens
ggcagguaaggagugggagccu

SEQ ID NO: 144351 - RNA, 22 nt, Homo sapiens
ggcaugauggcugaggcuucug

SEQ ID NO: 144352 - RNA, 22 nt, Homo sapiens
ggcaugguggugugugccuaua

SEQ ID NO: 144353 - RNA, 22 nt, Homo sapiens
ggcauguuuaguagaauguggu

SEQ ID NO: 144354 - RNA, 22 nt, Homo sapiens
ggccuguaggguauugguaggg

SEQ ID NO: 144355 - RNA, 22 nt, Homo sapiens
gggaaaaugucuauugaaugaa

SEQ ID NO: 144356 - RNA, 22 nt, Homo sapiens
gggaagugugcagaguucucuu

SEQ ID NO: 144357 - RNA, 22 nt, Homo sapiens
gggaagugugguuucuuuacag

SEQ ID NO: 144358 - RNA, 22 nt, Homo sapiens
gggagguaggaguuauuauuuu

SEQ ID NO: 144359 - RNA, 22 nt, Homo sapiens
gggcaugauggugcacacaugu

SEQ ID NO: 144360 - RNA, 22 nt, Homo sapiens
gggcauguggacuuguauguuu

SEQ ID NO: 144361 - RNA, 17 nt, Homo sapiens
gggucaccuugcaggua

SEQ ID NO: 144362 - RNA, 22 nt, Homo sapiens
gguagacaucgugcucugugau

SEQ ID NO: 144363 - RNA, 22 nt, Homo sapiens
gguauguagcaaaagaggugcu

SEQ ID NO: 144364 - RNA, 22 nt, Homo sapiens
ggucuuggagaauuguccuggg

SEQ ID NO: 144365 - RNA, 19 nt, Homo sapiens
ggugcuugaauauuccucc

SEQ ID NO: 144366 - RNA, 22 nt, Homo sapiens
guaaagacacaugcacacguau

SEQ ID NO: 144367 - RNA, 22 nt, Homo sapiens
guaagauaguauguuuaaccca

SEQ ID NO: 144368 - RNA, 22 nt, Homo sapiens
auugcuuacccuguauuagauc

SEQ ID NO: 144369 - RNA, 22 nt, Homo sapiens
auuggcaauggcaaagcagagu

SEQ ID NO: 144370 - RNA, 22 nt, Homo sapiens
auuggcuauuuggugagugauu

SEQ ID NO: 144371 - RNA, 22 nt, Homo sapiens
auuggguuaaaggauaugaaca

SEQ ID NO: 144372 - RNA, 22 nt, Homo sapiens
auuggucuugaaaccagagaga

SEQ ID NO: 144373 - RNA, 21 nt, Homo sapiens
auuguauguaaaccaaaugag

SEQ ID NO: 144374 - RNA, 22 nt, Homo sapiens
auuguguagucuuacugcuugc

SEQ ID NO: 144375 - RNA, 15 nt, Homo sapiens
auuucacuuagcaug

SEQ ID NO: 144376 - RNA, 22 nt, Homo sapiens
auuucacuucgcaugguguccg

SEQ ID NO: 144377 - RNA, 22 nt, Homo sapiens
auuucuacuccuguguccagaa

SEQ ID NO: 144378 - RNA, 22 nt, Homo sapiens
auuugucaauacacuucuucca

SEQ ID NO: 144379 - RNA, 22 nt, Homo sapiens
auuuguccugccuuuuccuccu

SEQ ID NO: 144380 - RNA, 22 nt, Homo sapiens
caaagugcuggaauuggccggg

SEQ ID NO: 144381 - RNA, 22 nt, Homo sapiens
caaagugcugggacuggccggg

SEQ ID NO: 144382 - RNA, 22 nt, Homo sapiens
caaagugcugggaugggccagg

SEQ ID NO: 144383 - RNA, 22 nt, Homo sapiens
caacaguaaagcauuuuuaagu

SEQ ID NO: 144384 - RNA, 19 nt, Homo sapiens
caacccugcagagaaagga

SEQ ID NO: 144385 - RNA, 22 nt, Homo sapiens
caagggguggaaaugguagugu

SEQ ID NO: 144386 - RNA, 21 nt, Homo sapiens
caaugacacuguagcugugcu

SEQ ID NO: 144387 - RNA, 22 nt, Homo sapiens
caauggcaaugaaauagugaga

SEQ ID NO: 144388 - RNA, 21 nt, Homo sapiens
caauggcacgaucuuggcuca

SEQ ID NO: 144389 - RNA, 22 nt, Homo sapiens
caaugguacuagauaucuucag

SEQ ID NO: 144390 - RNA, 22 nt, Homo sapiens
cacagcuagucaaugguagaca

SEQ ID NO: 144391 - RNA, 22 nt, Homo sapiens
cacagggcuaacauuuuugccc

SEQ ID NO: 144392 - RNA, 22 nt, Homo sapiens
caccccuaccugagucaggagu

SEQ ID NO: 144393 - RNA, 22 nt, Homo sapiens
cacugcacucuucuucugggca

SEQ ID NO: 144394 - RNA, 22 nt, Homo sapiens
cacugcaguaaauugcgucggu

SEQ ID NO: 144395 - RNA, 22 nt, Homo sapiens
cacugcauccuugaccuucugg

SEQ ID NO: 144396 - RNA, 22 nt, Homo sapiens
cagacaugucuuguggccgugg

SEQ ID NO: 144397 - RNA, 22 nt, Homo sapiens
cagagcaaugcuuuugcuuuga

SEQ ID NO: 144398 - RNA, 22 nt, Homo sapiens
cagagugcauguuuagaugagu

SEQ ID NO: 144399 - RNA, 22 nt, Homo sapiens
cagauacuggaguccugaaguu

SEQ ID NO: 144400 - RNA, 22 nt, Homo sapiens
cagcccguaaucccagcacuuu

SEQ ID NO: 144401 - RNA, 22 nt, Homo sapiens
cagccgggugagguggcuuguu

SEQ ID NO: 144402 - RNA, 22 nt, Homo sapiens
cagcgaggucugcgucacauug

SEQ ID NO: 144403 - RNA, 22 nt, Homo sapiens
cagcucauugcagucucgaccu

SEQ ID NO: 144404 - RNA, 23 nt, Homo sapiens
cagcuucauugaacauaacuccu

SEQ ID NO: 144405 - RNA, 22 nt, Homo sapiens
cagggaauguuauuuaauagca

SEQ ID NO: 144406 - RNA, 19 nt, Homo sapiens
caguaucauugcacauagu

SEQ ID NO: 144407 - RNA, 22 nt, Homo sapiens
cauaaagauggaggaggccagg

SEQ ID NO: 144408 - RNA, 18 nt, Homo sapiens
cauagcacuucagcacau

SEQ ID NO: 144409 - RNA, 21 nt, Homo sapiens
caucaaauugucauggugggu

SEQ ID NO: 144410 - RNA, 19 nt, Homo sapiens
caucacagagucuuccauu

SEQ ID NO: 144411 - RNA, 22 nt, Homo sapiens
caucacaguacuaaucgucaua

SEQ ID NO: 144412 - RNA, 19 nt, Homo sapiens
caugauacugcucccucuc

SEQ ID NO: 144413 - RNA, 22 nt, Homo sapiens
cauggcacauauauaucuaggu

SEQ ID NO: 144414 - RNA, 22 nt, Homo sapiens
cauggcccuggguccauaggaa

SEQ ID NO: 144415 - RNA, 22 nt, Homo sapiens
caugugcaugcuuucuuaugug

SEQ ID NO: 144416 - RNA, 22 nt, Homo sapiens
cauuccacauguaggacaauuu

SEQ ID NO: 144417 - RNA, 22 nt, Homo sapiens
cauugcaacuucugccucccag

SEQ ID NO: 144418 - RNA, 22 nt, Homo sapiens
cauugcacuccagccuugguga

SEQ ID NO: 144419 - RNA, 22 nt, Homo sapiens
cauugcccuccagccugggcaa

SEQ ID NO: 144420 - RNA, 22 nt, Homo sapiens
cauugcuuuuggugguuuagac

SEQ ID NO: 144421 - RNA, 22 nt, Homo sapiens
cauuugcacugagacucagcuu

SEQ ID NO: 144422 - RNA, 22 nt, Homo sapiens
ccaagugcuuaaaauuucauuu

SEQ ID NO: 144423 - RNA, 22 nt, Homo sapiens
ccacagucuaugcaacaagguc

SEQ ID NO: 144424 - RNA, 22 nt, Homo sapiens
ccagaguggagccuuugcgagg

SEQ ID NO: 144425 - RNA, 22 nt, Homo sapiens
ccagcaccauuuguugaauagg

SEQ ID NO: 144426 - RNA, 22 nt, Homo sapiens
ccaggguugagacccacugacu

SEQ ID NO: 144427 - RNA, 22 nt, Homo sapiens
ccagugcauggaucccaggggg

SEQ ID NO: 144428 - RNA, 21 nt, Homo sapiens
ccaguguaaugauagcaggca

SEQ ID NO: 144429 - RNA, 19 nt, Homo sapiens
ccaguguugccagagcuga

SEQ ID NO: 144430 - RNA, 22 nt, Homo sapiens
ccaguuuucaagauaaugguuu

SEQ ID NO: 144431 - RNA, 21 nt, Homo sapiens
ccauggcaaugguaaacugac

SEQ ID NO: 144432 - RNA, 22 nt, Homo sapiens
ccauggcaauggucagucuauu

SEQ ID NO: 144433 - RNA, 23 nt, Homo sapiens
ccauugcacuccagccucaguga

SEQ ID NO: 144434 - RNA, 22 nt, Homo sapiens
ccauuucacucuuccugaagga

SEQ ID NO: 144435 - RNA, 22 nt, Homo sapiens
cccagaguucuuaaauacugag

SEQ ID NO: 144436 - RNA, 22 nt, Homo sapiens
cccagcguucggcauggcugag

SEQ ID NO: 144437 - RNA, 22 nt, Homo sapiens
cccaguguuacgugacagccug

SEQ ID NO: 144438 - RNA, 19 nt, Homo sapiens
ccccuguggauaccgaggg

SEQ ID NO: 144439 - RNA, 22 nt, Homo sapiens
cccugaagaaagccuaggacau

SEQ ID NO: 144440 - RNA, 22 nt, Homo sapiens
cccugaagauacagaguuuggg

SEQ ID NO: 144441 - RNA, 21 nt, Homo sapiens
cccugguguuuggaguuugag

SEQ ID NO: 144442 - RNA, 22 nt, Homo sapiens
cccuugcacuucagagcugcau

SEQ ID NO: 144443 - RNA, 22 nt, Homo sapiens
ccucauugcuaucccaggcuga

SEQ ID NO: 144444 - RNA, 22 nt, Homo sapiens
ccuggguuacaggugugagcca

SEQ ID NO: 144445 - RNA, 22 nt, Homo sapiens
ccugucuugaagagauccuccu

SEQ ID NO: 144446 - RNA, 22 nt, Homo sapiens
ccuucauugcaucuuuaagaga

SEQ ID NO: 144447 - RNA, 22 nt, Homo sapiens
cggcaguggguaagccaagcuu

SEQ ID NO: 144448 - RNA, 22 nt, Homo sapiens
cuaaaguauugagugguaaaga

SEQ ID NO: 144449 - RNA, 22 nt, Homo sapiens
cuaaagucacgauuugugggua

SEQ ID NO: 144450 - RNA, 22 nt, Homo sapiens
cuaacacagagguuuauuucuc

SEQ ID NO: 144451 - RNA, 22 nt, Homo sapiens
cuaagcaccuuaguggggaauc

SEQ ID NO: 144452 - RNA, 22 nt, Homo sapiens
cuaagggaggaagcugugcagg

SEQ ID NO: 144453 - RNA, 22 nt, Homo sapiens
cuacucuggagagugacaauca

SEQ ID NO: 144454 - RNA, 22 nt, Homo sapiens
cuagaagguaagagcuggaugc

SEQ ID NO: 144455 - RNA, 18 nt, Homo sapiens
uaacuggugugagauggu

SEQ ID NO: 144456 - RNA, 22 nt, Homo sapiens
uaagacacauguguucccaggc

SEQ ID NO: 144457 - RNA, 22 nt, Homo sapiens
uaagccaccgugccuggccuaa

SEQ ID NO: 144458 - RNA, 22 nt, Homo sapiens
uaaggcaaaccuuggcugcagu

SEQ ID NO: 144459 - RNA, 22 nt, Homo sapiens
uaaguaaaugaaagguugauuu

SEQ ID NO: 144460 - RNA, 22 nt, Homo sapiens
uaagugaauuucacuacugagu

SEQ ID NO: 144461 - RNA, 22 nt, Homo sapiens
uaagugcaacauaaguguuaaa

SEQ ID NO: 144462 - RNA, 22 nt, Homo sapiens
uaaguuagugugagaauuuugc

SEQ ID NO: 144463 - RNA, 22 nt, Homo sapiens
uaauacucuucucauuuuacag

SEQ ID NO: 144464 - RNA, 19 nt, Homo sapiens
uaaugccacugccuggcau

SEQ ID NO: 144465 - RNA, 22 nt, Homo sapiens
uaauauguauacagacagauac

SEQ ID NO: 144466 - RNA, 22 nt, Homo sapiens
uaaucucagcuacucaggaggc

SEQ ID NO: 144467 - RNA, 22 nt, Homo sapiens
uaaugcuaucugggccaggggu

SEQ ID NO: 144468 - RNA, 22 nt, Homo sapiens
uaaugcuugguuguuuggaaaa

SEQ ID NO: 144469 - RNA, 21 nt, Homo sapiens
uaauggcaugaucucggcuca

SEQ ID NO: 144470 - RNA, 22 nt, Homo sapiens
uaaugugaauagugcuguaaug

SEQ ID NO: 144471 - RNA, 22 nt, Homo sapiens
uacaaaguaacaguuccuguau

SEQ ID NO: 144472 - RNA, 22 nt, Homo sapiens
uacagaauucugucccuugagu

SEQ ID NO: 144473 - RNA, 22 nt, Homo sapiens
uacagaguagaagauuugcaga

SEQ ID NO: 144474 - RNA, 22 nt, Homo sapiens
uacagaguauccauuugaguuc

SEQ ID NO: 144475 - RNA, 22 nt, Homo sapiens
uacagugcuugguaucuaguaa

SEQ ID NO: 144476 - RNA, 19 nt, Homo sapiens
uacauaguauuuaguggca

SEQ ID NO: 144477 - RNA, 22 nt, Homo sapiens
uacaugcaugggcaugugugca

SEQ ID NO: 144478 - RNA, 22 nt, Homo sapiens
uaccagugaauuccaggggcua

SEQ ID NO: 144479 - RNA, 22 nt, Homo sapiens
uacguuaucagguaugcaagag

SEQ ID NO: 144480 - RNA, 22 nt, Homo sapiens
uacugcacuccagcuuaggaga

SEQ ID NO: 144481 - RNA, 22 nt, Homo sapiens
uacuuuguuauagcagcaggaa

SEQ ID NO: 144482 - RNA, 22 nt, Homo sapiens
uagaaaguagggaagguaggau

SEQ ID NO: 144483 - RNA, 22 nt, Homo sapiens
uagaauggaaggcauguuugcc

SEQ ID NO: 144484 - RNA, 22 nt, Homo sapiens
uagaauguauaauauuuuacuu

SEQ ID NO: 144485 - RNA, 22 nt, Homo sapiens
uagagagcuguuugaaagcagg

SEQ ID NO: 144486 - RNA, 22 nt, Homo sapiens
uagagcacaagguagauuucua

SEQ ID NO: 144487 - RNA, 22 nt, Homo sapiens
uagagcacagugauuagaccua

SEQ ID NO: 144488 - RNA, 22 nt, Homo sapiens
uagagguaggucuucgagucuc

SEQ ID NO: 144489 - RNA, 22 nt, Homo sapiens
uagagguagguguaugaacuag

SEQ ID NO: 144490 - RNA, 22 nt, Homo sapiens
uagauaguaaagccauuagcuu

SEQ ID NO: 144491 - RNA, 22 nt, Homo sapiens
uagaucauauucagugcuuacu

SEQ ID NO: 144492 - RNA, 23 nt, Homo sapiens
uagaucaucaaguuuacugugcu

SEQ ID NO: 144493 - RNA, 22 nt, Homo sapiens
uagcacaugucagguaauuugc

SEQ ID NO: 144494 - RNA, 22 nt, Homo sapiens
uagcaccuuagcauuucuagug

SEQ ID NO: 144495 - RNA, 22 nt, Homo sapiens
uagcagccaggaagggcuggcu

SEQ ID NO: 144496 - RNA, 22 nt, Homo sapiens
uagcauccuucucuaaacagga

SEQ ID NO: 144497 - RNA, 22 nt, Homo sapiens
uagcuaaauucagcucuaggua

SEQ ID NO: 144498 - RNA, 22 nt, Homo sapiens
uagcugcugcuaggcuaaggau

SEQ ID NO: 144499 - RNA, 22 nt, Homo sapiens
uagggcuuuuccaagcugccac

SEQ ID NO: 144500 - RNA, 22 nt, Homo sapiens
uaguauguuuauagcauugagu

SEQ ID NO: 144501 - RNA, 22 nt, Homo sapiens
uaguucguguuugaacuagauc

SEQ ID NO: 144502 - RNA, 22 nt, Homo sapiens
uauaacacccacauauagucuu

SEQ ID NO: 144503 - RNA, 22 nt, Homo sapiens
uauagcagugaguauugacuaa

SEQ ID NO: 144504 - RNA, 22 nt, Homo sapiens
uauaucuguccauggcccugcu

SEQ ID NO: 144505 - RNA, 22 nt, Homo sapiens
uauauguuuucauaaggcuaga

SEQ ID NO: 144506 - RNA, 21 nt, Homo sapiens
uaucacauuggugauuaaguu

SEQ ID NO: 144507 - RNA, 22 nt, Homo sapiens
uaucagcacaguggguucaugg

SEQ ID NO: 144508 - RNA, 22 nt, Homo sapiens
uaucaucauuggcaggugagaa

SEQ ID NO: 144509 - RNA, 22 nt, Homo sapiens
uaucccaguggauguaccccau

SEQ ID NO: 144510 - RNA, 22 nt, Homo sapiens
uaucucuuuucauguguaaaug

SEQ ID NO: 144511 - RNA, 22 nt, Homo sapiens
uaugacuuuggaaaaauuacuu

SEQ ID NO: 144512 - RNA, 22 nt, Homo sapiens
uaugagguagguaugacuauca

SEQ ID NO: 144513 - RNA, 22 nt, Homo sapiens
uaugcacacucucccaggaggg

SEQ ID NO: 144514 - RNA, 22 nt, Homo sapiens
uauggcaaugcauaggaaggaa

SEQ ID NO: 144515 - RNA, 22 nt, Homo sapiens
uauggcauuauuuugauagaca

SEQ ID NO: 144516 - RNA, 22 nt, Homo sapiens
uauggccccuacaugugcaaaa

SEQ ID NO: 144517 - RNA, 22 nt, Homo sapiens
uauggucuuugagaggugacug

SEQ ID NO: 144518 - RNA, 21 nt, Homo sapiens
uaugguuucuaauucugcagg

SEQ ID NO: 144519 - RNA, 20 nt, Homo sapiens
uaugguuuuagguauagcau

SEQ ID NO: 144520 - RNA, 22 nt, Homo sapiens
uaugucacagguuuuggugaaa

SEQ ID NO: 144521 - RNA, 22 nt, Homo sapiens
uaugugcacaugcccuggugac

SEQ ID NO: 144522 - RNA, 22 nt, Homo sapiens
uauuaagcuaguugucagugcu

SEQ ID NO: 144523 - RNA, 22 nt, Homo sapiens
uauuacagaccauaucgccggg

SEQ ID NO: 144524 - RNA, 22 nt, Homo sapiens
uauuaguuguaugauucccaag

SEQ ID NO: 144525 - RNA, 22 nt, Homo sapiens
uugaaguaggaaaggaggaggu

SEQ ID NO: 144526 - RNA, 22 nt, Homo sapiens
uugaauagcauguuuagugcau

SEQ ID NO: 144527 - RNA, 22 nt, Homo sapiens
uugaauaguggugaaaguuuga

SEQ ID NO: 144528 - RNA, 22 nt, Homo sapiens
uugacacuuuguaagaaagggg

SEQ ID NO: 144529 - RNA, 20 nt, Homo sapiens
uugacagagggaaaguugcu

SEQ ID NO: 144530 - RNA, 22 nt, Homo sapiens
uugacauugcuguaguguccag

SEQ ID NO: 144531 - RNA, 22 nt, Homo sapiens
uugaccacugggcacaguaagu

SEQ ID NO: 144532 - RNA, 22 nt, Homo sapiens
uugacugggccagacagagauc

SEQ ID NO: 144533 - RNA, 22 nt, Homo sapiens
uugagacggagucuugcucuuu

SEQ ID NO: 144534 - RNA, 22 nt, Homo sapiens
uugagagaaaaggccaugccuu

SEQ ID NO: 144535 - RNA, 22 nt, Homo sapiens
uugagaguggaggcuauaucuu

SEQ ID NO: 144536 - RNA, 22 nt, Homo sapiens
uugagauggagucucgcucuuu

SEQ ID NO: 144537 - RNA, 22 nt, Homo sapiens
uugagauggagucuugcucugu

SEQ ID NO: 144538 - RNA, 22 nt, Homo sapiens
uugagauggagucuuguucucu

SEQ ID NO: 144539 - RNA, 22 nt, Homo sapiens
uugagauggaguuuugcucuug

SEQ ID NO: 144540 - RNA, 22 nt, Homo sapiens
uugagauguauguauauaaugu

SEQ ID NO: 144541 - RNA, 22 nt, Homo sapiens
uugagcaacauagugagacugu

SEQ ID NO: 144542 - RNA, 22 nt, Homo sapiens
uugagccaaggauugucuuucc

SEQ ID NO: 144543 - RNA, 22 nt, Homo sapiens
uugagcucaucuucagggguga

SEQ ID NO: 144544 - RNA, 22 nt, Homo sapiens
uugaggaggcagucucuccauu

SEQ ID NO: 144545 - RNA, 22 nt, Homo sapiens
uugaggaggcagucuucccauu

SEQ ID NO: 144546 - RNA, 22 nt, Homo sapiens
uugaggcuuuugaccucaugug

SEQ ID NO: 144547 - RNA, 22 nt, Homo sapiens
uugagguaauaaacagccauuc

SEQ ID NO: 144548 - RNA, 22 nt, Homo sapiens
uugagguaggaggagcuuggau

SEQ ID NO: 144549 - RNA, 22 nt, Homo sapiens
uugagguauugauaaaacauuu

SEQ ID NO: 144550 - RNA, 22 nt, Homo sapiens
uugaggugaauuugcaggaugc

SEQ ID NO: 144551 - RNA, 22 nt, Homo sapiens
uugagguggugucuugcucugu

SEQ ID NO: 144552 - RNA, 22 nt, Homo sapiens
uugaguuuaucuaaagaccugg

SEQ ID NO: 144553 - RNA, 22 nt, Homo sapiens
uugaguuugaguauucuaaagc

SEQ ID NO: 144554 - RNA, 22 nt, Homo sapiens
uugauaguccuguaucuauuuu

SEQ ID NO: 144555 - RNA, 22 nt, Homo sapiens
uugauaugguauaagauuucau

SEQ ID NO: 144556 - RNA, 22 nt, Homo sapiens
uugauauguuguuagauucagu

SEQ ID NO: 144557 - RNA, 22 nt, Homo sapiens
uugauauuaaguacugaagugg

SEQ ID NO: 144558 - RNA, 20 nt, Homo sapiens
uugauucccucuaaacucgc

SEQ ID NO: 144559 - RNA, 22 nt, Homo sapiens
uugauugacaugucucuguuca

SEQ ID NO: 144560 - RNA, 22 nt, Homo sapiens
uugcaaaguuugccuccuguag

SEQ ID NO: 144561 - RNA, 22 nt, Homo sapiens
uugcacauugauuuuguauccu

SEQ ID NO: 144562 - RNA, 22 nt, Homo sapiens
uugcacauugauuuuguaucuu

SEQ ID NO: 144563 - RNA, 22 nt, Homo sapiens
uugcacauugcaccuuuuguau

SEQ ID NO: 144564 - RNA, 22 nt, Homo sapiens
uugcacauuuuuucuggcagaa

SEQ ID NO: 144565 - RNA, 22 nt, Homo sapiens
uugcaccacugcguuccagccu

SEQ ID NO: 144566 - RNA, 22 nt, Homo sapiens
uugcacuucauguaggccaaag

SEQ ID NO: 144567 - RNA, 22 nt, Homo sapiens
uuuccacauggacuuaccuucg

SEQ ID NO: 144568 - RNA, 22 nt, Homo sapiens
uuucccuuacuuaaacuuacuc

SEQ ID NO: 144569 - RNA, 22 nt, Homo sapiens
uuucuacagugaacgauuucua

SEQ ID NO: 144570 - RNA, 17 nt, Homo sapiens
uuucucagcccucuucu

SEQ ID NO: 144571 - RNA, 22 nt, Homo sapiens
uuugaagacuacugggagugaa

SEQ ID NO: 144572 - RNA, 22 nt, Homo sapiens
uuugaagugugaugccuugaug

SEQ ID NO: 144573 - RNA, 22 nt, Homo sapiens
uuugaaguguggcacugaguuu

SEQ ID NO: 144574 - RNA, 22 nt, Homo sapiens
uuugacuaccaggaauguucuu

SEQ ID NO: 144575 - RNA, 22 nt, Homo sapiens
uuugacuacugaugguguacgc

SEQ ID NO: 144576 - RNA, 22 nt, Homo sapiens
uuugagguguauggcaaguuga

SEQ ID NO: 144577 - RNA, 22 nt, Homo sapiens
uuugauguugagacuauaaagc

SEQ ID NO: 144578 - RNA, 22 nt, Homo sapiens
uuugcaguguaguuggccagca

SEQ ID NO: 144579 - RNA, 22 nt, Homo sapiens
uuugccaaugggaauuuuccua

SEQ ID NO: 144580 - RNA, 22 nt, Homo sapiens
uuuggacuucuagccuccagag

SEQ ID NO: 144581 - RNA, 22 nt, Homo sapiens
uuuggcagaugacccucaaguu

SEQ ID NO: 144582 - RNA, 22 nt, Homo sapiens
uuuggcauuagagagacuugca

SEQ ID NO: 144583 - RNA, 21 nt, Homo sapiens
uuuggcauuaugucaccagag

SEQ ID NO: 144584 - RNA, 22 nt, Homo sapiens
uuuggcuuuugugauacguaau

SEQ ID NO: 144585 - RNA, 22 nt, Homo sapiens
uuugggaaugaguuuaucauuu

SEQ ID NO: 144586 - RNA, 22 nt, Homo sapiens
uuuggucagcugcgggucagcu

SEQ ID NO: 144587 - RNA, 22 nt, Homo sapiens
uuugguugucacaacuggggga

SEQ ID NO: 144588 - RNA, 22 nt, Homo sapiens
uuuguacuucauugguucuacu

SEQ ID NO: 144589 - RNA, 22 nt, Homo sapiens
uuugucauagcagcaggaaugg

SEQ ID NO: 144590 - RNA, 18 nt, Homo sapiens
uuugugcuccacaaagga

SEQ ID NO: 144591 - RNA, 22 nt, Homo sapiens
uuugugcuccuaugagaaucua

SEQ ID NO: 144592 - RNA, 22 nt, Homo sapiens
uuugugcuccugugagaaucua

SEQ ID NO: 144593 - RNA, 22 nt, Homo sapiens
uuuucaguggccauaguggaga

SEQ ID NO: 144594 - RNA, 22 nt, Homo sapiens
uuuugcaggucaggggcagaga

SEQ ID NO: 144595 - RNA, 18 nt, Homo sapiens
uuuugcuuaacugcgcca

SEQ ID NO: 144596 - RNA, 20 nt, Homo sapiens
uuuuggacuaaaggcauccc

SEQ ID NO: 144597 - RNA, 22 nt, Homo sapiens
uuuuggacuugcuccccugucc

SEQ ID NO: 144598 - RNA, 19 nt, Homo sapiens
uuuuguacucugugacuug

SEQ ID NO: 144599 - RNA, 22 nt, Homo sapiens
uuuugucccaugggcuguuccc

SEQ ID NO: 144600 - RNA, 22 nt, Homo sapiens
uuuuucacuuaaguuaggcuca

SEQ ID NO: 144601 - RNA, 18 nt, Homo sapiens
uuuuugaggcacagggga

SEQ ID NO: 144602 - RNA, 16 nt, Homo sapiens
uuuuugcagaaaugac

SEQ ID NO: 144603 - RNA, 22 nt, Homo sapiens
augcagaucacauuuuucuguc

SEQ ID NO: 144604 - RNA, 22 nt, Homo sapiens
augcagguguuuugcacugagu

SEQ ID NO: 144605 - RNA, 22 nt, Homo sapiens
augcccauuuguuuucugaaag

SEQ ID NO: 144606 - RNA, 22 nt, Homo sapiens
auggaauguauagucauguagg

SEQ ID NO: 144607 - RNA, 21 nt, Homo sapiens
auggacaugguuaggcuuugu

SEQ ID NO: 144608 - RNA, 22 nt, Homo sapiens
auggacauuaaagcgauguaga

SEQ ID NO: 144609 - RNA, 21 nt, Homo sapiens
auggacugugugacccugcac

SEQ ID NO: 144610 - RNA, 22 nt, Homo sapiens
auggaggccuacagaauuuugg

SEQ ID NO: 144611 - RNA, 22 nt, Homo sapiens
auggauauugccuaggguagua

SEQ ID NO: 144612 - RNA, 22 nt, Homo sapiens
auggcacuacugggaaugucuu

SEQ ID NO: 144613 - RNA, 22 nt, Homo sapiens
auggcaucgucaccuuuucagu

SEQ ID NO: 144614 - RNA, 22 nt, Homo sapiens
auggccauuacuaagaauguuu

SEQ ID NO: 144615 - RNA, 22 nt, Homo sapiens
auggcccugaguucaauauauu

SEQ ID NO: 144616 - RNA, 22 nt, Homo sapiens
auggccugaugcaccuguccca

SEQ ID NO: 144617 - RNA, 22 nt, Homo sapiens
auggccuuguauaccuggcaaa

SEQ ID NO: 144618 - RNA, 22 nt, Homo sapiens
auggcucuggauagaaugcagg

SEQ ID NO: 144619 - RNA, 22 nt, Homo sapiens
auggcucuguuuuuuaugcucu

SEQ ID NO: 144620 - RNA, 22 nt, Homo sapiens
auggcucuuauuauuuugaggu

SEQ ID NO: 144621 - RNA, 22 nt, Homo sapiens
auggcuuuguguucagagcuga

SEQ ID NO: 144622 - RNA, 22 nt, Homo sapiens
auggcuuuuccugucuugcaug

SEQ ID NO: 144623 - RNA, 22 nt, Homo sapiens
auggcuuuuuaaaucauguugu

SEQ ID NO: 144624 - RNA, 21 nt, Homo sapiens
augggguagaagagaaggcuu

SEQ ID NO: 144625 - RNA, 22 nt, Homo sapiens
augguauggaaggucuggagga

SEQ ID NO: 144626 - RNA, 22 nt, Homo sapiens
auggugugugaauuaaauguua

SEQ ID NO: 144627 - RNA, 22 nt, Homo sapiens
auguccuggacccagacaaagc

SEQ ID NO: 144628 - RNA, 22 nt, Homo sapiens
augugcaaaguuaagaucccag

SEQ ID NO: 144629 - RNA, 22 nt, Homo sapiens
augugcuuuuuaaacagaugcu

SEQ ID NO: 144630 - RNA, 22 nt, Homo sapiens
auuaagugaaugaaguuguucc

SEQ ID NO: 144631 - RNA, 22 nt, Homo sapiens
auuacaugucuauccaugaaca

SEQ ID NO: 144632 - RNA, 22 nt, Homo sapiens
auuacuuugcaccaaccuaaua

SEQ ID NO: 144633 - RNA, 22 nt, Homo sapiens
auucaaagugcauguucccacu

SEQ ID NO: 144634 - RNA, 22 nt, Homo sapiens
auucaagggauuucaggaggcu

SEQ ID NO: 144635 - RNA, 22 nt, Homo sapiens
auucacuguggguccuuuggau

SEQ ID NO: 144636 - RNA, 22 nt, Homo sapiens
auucccuguagaauaaggaugg

SEQ ID NO: 144637 - RNA, 22 nt, Homo sapiens
auucccuuggucaacggaugca

SEQ ID NO: 144638 - RNA, 22 nt, Homo sapiens
auugaacuuuugucacugacau

SEQ ID NO: 144639 - RNA, 22 nt, Homo sapiens
auugaauuugguuugcuaagaa

SEQ ID NO: 144640 - RNA, 22 nt, Homo sapiens
auugcaacaguguugagaggug

SEQ ID NO: 144641 - RNA, 22 nt, Homo sapiens
auugcacacagaaucaggguaa

SEQ ID NO: 144642 - RNA, 22 nt, Homo sapiens
auugcauuuucagguuggucug

SEQ ID NO: 144643 - RNA, 22 nt, Homo sapiens
auugcuuaagucccuguauuag

SEQ ID NO: 144644 - RNA, 22 nt, Homo sapiens
auuggcaagauagcauaugagg

SEQ ID NO: 144645 - RNA, 22 nt, Homo sapiens
auuguacuccagccugggcugc

SEQ ID NO: 144646 - RNA, 22 nt, Homo sapiens
auuucacugagacaugugccca

SEQ ID NO: 144647 - RNA, 22 nt, Homo sapiens
auuugacacugagagccucagu

SEQ ID NO: 144648 - RNA, 22 nt, Homo sapiens
auuugucacuauguggcuaaua

SEQ ID NO: 144649 - RNA, 22 nt, Homo sapiens
caaaguaauugugguuuugcca

SEQ ID NO: 144650 - RNA, 22 nt, Homo sapiens
caacugguuuuauacaguuuag

SEQ ID NO: 144651 - RNA, 22 nt, Homo sapiens
caagacuguccaacauauuggg

SEQ ID NO: 144652 - RNA, 22 nt, Homo sapiens
caagaggcuguguauaaagcca

SEQ ID NO: 144653 - RNA, 22 nt, Homo sapiens
caaggcacagccccuacuuccu

SEQ ID NO: 144654 - RNA, 22 nt, Homo sapiens
caaguacugggcuauggauauu

SEQ ID NO: 144655 - RNA, 22 nt, Homo sapiens
caagugcucuaggauccugagu

SEQ ID NO: 144656 - RNA, 22 nt, Homo sapiens
caaguguuggcuuguauacaaa

SEQ ID NO: 144657 - RNA, 21 nt, Homo sapiens
caauggcacaaucucugcuca

SEQ ID NO: 144658 - RNA, 22 nt, Homo sapiens
cacaaugucuaagauguuucua

SEQ ID NO: 144659 - RNA, 22 nt, Homo sapiens
cacagaauucauuggauuaccu

SEQ ID NO: 144660 - RNA, 22 nt, Homo sapiens
cacagucuugcaauauugagau

SEQ ID NO: 144661 - RNA, 22 nt, Homo sapiens
cacagugaaugucaucauugcc

SEQ ID NO: 144662 - RNA, 21 nt, Homo sapiens
cacauggaggcagagagugua

SEQ ID NO: 144663 - RNA, 22 nt, Homo sapiens
caccacuacaccccaggcuggg

SEQ ID NO: 144664 - RNA, 23 nt, Homo sapiens
caccaguauaauuagcuuuuaaa

SEQ ID NO: 144665 - RNA, 19 nt, Homo sapiens
caccagugcaugcuacuau

SEQ ID NO: 144666 - RNA, 22 nt, Homo sapiens
caccugagcgggaugcucgccu

SEQ ID NO: 144667 - RNA, 18 nt, Homo sapiens
cacugagcccuucacucu

SEQ ID NO: 144668 - RNA, 22 nt, Homo sapiens
gaagacauuuacaugggagacc

SEQ ID NO: 144669 - RNA, 22 nt, Homo sapiens
gaaggagcuuaucugccauuuc

SEQ ID NO: 144670 - RNA, 17 nt, Homo sapiens
gaaguguuucuucauga

SEQ ID NO: 144671 - RNA, 22 nt, Homo sapiens
gacacagugaagucucuacuug

SEQ ID NO: 144672 - RNA, 22 nt, Homo sapiens
gacugaggaagcgcucucuccu

SEQ ID NO: 144673 - RNA, 22 nt, Homo sapiens
gagaacagagauaauuuuacuu

SEQ ID NO: 144674 - RNA, 22 nt, Homo sapiens
gagaaccuccagcaagguagua

SEQ ID NO: 144675 - RNA, 22 nt, Homo sapiens
gagaacuaaugauguacuaggc

SEQ ID NO: 144676 - RNA, 22 nt, Homo sapiens
gagacauguuugcuuaucugag

SEQ ID NO: 144677 - RNA, 22 nt, Homo sapiens
gagauaaauaggucacaguucu

SEQ ID NO: 144678 - RNA, 22 nt, Homo sapiens
gagauauucugguuuacuaaau

SEQ ID NO: 144679 - RNA, 23 nt, Homo sapiens
gagaucauucuggaauuagagug

SEQ ID NO: 144680 - RNA, 22 nt, Homo sapiens
gagaugaaguuaaggaucuuua

SEQ ID NO: 144681 - RNA, 22 nt, Homo sapiens
gagaugguacacauacgauucu

SEQ ID NO: 144682 - RNA, 22 nt, Homo sapiens
gagauguagucuugcccuguca

SEQ ID NO: 144683 - RNA, 22 nt, Homo sapiens
gagauguuuuguuaucaaagga

SEQ ID NO: 144684 - RNA, 22 nt, Homo sapiens
gagauucuucaauauuuauucu

SEQ ID NO: 144685 - RNA, 18 nt, Homo sapiens
gagcaccuuuuuugcaga

SEQ ID NO: 144686 - RNA, 22 nt, Homo sapiens
gagcuguuuuucacuagaccaa

SEQ ID NO: 144687 - RNA, 22 nt, Homo sapiens
gaggaaguagcuacugucuuuc

SEQ ID NO: 144688 - RNA, 22 nt, Homo sapiens
gaggagauauucugcuggaugg

SEQ ID NO: 144689 - RNA, 22 nt, Homo sapiens
gaggcauugaaauauugcuuau

SEQ ID NO: 144690 - RNA, 22 nt, Homo sapiens
gagguagggucccacuauguug

SEQ ID NO: 144691 - RNA, 22 nt, Homo sapiens
gagguaugauugacauauaaaa

SEQ ID NO: 144692 - RNA, 22 nt, Homo sapiens
gaggucaggacauuuuugcuuu

SEQ ID NO: 144693 - RNA, 22 nt, Homo sapiens
gagguguagucaugccaagauc

SEQ ID NO: 144694 - RNA, 22 nt, Homo sapiens
gagguugggaugagggauacag

SEQ ID NO: 144695 - RNA, 22 nt, Homo sapiens
gaguaaauguccuagcuucuug

SEQ ID NO: 144696 - RNA, 23 nt, Homo sapiens
gagugcaaugacaugaucucgga

SEQ ID NO: 144697 - RNA, 22 nt, Homo sapiens
gagugcaauggcagaucuccgc

SEQ ID NO: 144698 - RNA, 22 nt, Homo sapiens
gauaaaguauuggguacuaugc

SEQ ID NO: 144699 - RNA, 22 nt, Homo sapiens
gaucugugugauuggaugcauu

SEQ ID NO: 144700 - RNA, 22 nt, Homo sapiens
gaucuguuguuuggaaguauca

SEQ ID NO: 144701 - RNA, 22 nt, Homo sapiens
gaugacacugggucaaaucuca

SEQ ID NO: 144702 - RNA, 22 nt, Homo sapiens
gaugagaucauaaguguggagc

SEQ ID NO: 144703 - RNA, 22 nt, Homo sapiens
gaugaggcuagagacaugugua

SEQ ID NO: 144704 - RNA, 22 nt, Homo sapiens
gaugaugcuagguguuagggcu

SEQ ID NO: 144705 - RNA, 22 nt, Homo sapiens
gauggauuuuaagugaaugaaa

SEQ ID NO: 144706 - RNA, 22 nt, Homo sapiens
gauggcagugcagccccuggcu

SEQ ID NO: 144707 - RNA, 22 nt, Homo sapiens
gauggcucugcaggugagggua

SEQ ID NO: 144708 - RNA, 20 nt, Homo sapiens
gcaaaguuuagcucccacua

SEQ ID NO: 144709 - RNA, 22 nt, Homo sapiens
gcacagucaacacuuauucacc

SEQ ID NO: 144710 - RNA, 22 nt, Homo sapiens
gcaccacugcacucucagcuug

SEQ ID NO: 144711 - RNA, 22 nt, Homo sapiens
gcaccaugguagaauaauggua

SEQ ID NO: 144712 - RNA, 22 nt, Homo sapiens
gcacgugcucauuugaggucuu

SEQ ID NO: 144713 - RNA, 22 nt, Homo sapiens
gcagguaguuucugacuuuuac

SEQ ID NO: 144714 - RNA, 20 nt, Homo sapiens
gcauaugucuuuauggcagc

SEQ ID NO: 144715 - RNA, 22 nt, Homo sapiens
gcauauuuuaaaguguaaccug

SEQ ID NO: 144716 - RNA, 22 nt, Homo sapiens
gccaaaaugcugggauuacagg

SEQ ID NO: 144717 - RNA, 17 nt, Homo sapiens
gcccuuugugccucuuc

SEQ ID NO: 144718 - RNA, 22 nt, Homo sapiens
gccgagagauuuggaaugggga

SEQ ID NO: 144719 - RNA, 22 nt, Homo sapiens
gcgcagugggcugugccaucca

SEQ ID NO: 144720 - RNA, 22 nt, Homo sapiens
gcuagcauucaaaugugcagcc

SEQ ID NO: 144721 - RNA, 22 nt, Homo sapiens
gcucaugggcagugugauuguu

SEQ ID NO: 144722 - RNA, 22 nt, Homo sapiens
gcucuuuugggguaauucugag

SEQ ID NO: 144723 - RNA, 22 nt, Homo sapiens
gcugcguguagaguucucacug

SEQ ID NO: 144724 - RNA, 22 nt, Homo sapiens
gcuggcuuucuccugaucucag

SEQ ID NO: 144725 - RNA, 22 nt, Homo sapiens
gcuggucugccguaguaggugc

SEQ ID NO: 144726 - RNA, 22 nt, Homo sapiens
gcuguguguuaucagaaauugc

SEQ ID NO: 144727 - RNA, 22 nt, Homo sapiens
gcuguugugaacuauacaucua

SEQ ID NO: 144728 - RNA, 22 nt, Homo sapiens
gcuuugguucaaccaggcaauu

SEQ ID NO: 144729 - RNA, 21 nt, Homo sapiens
gcuuuuucggaagucuuuggc

SEQ ID NO: 144730 - RNA, 22 nt, Homo sapiens
ggaaaguccuucuguaggcucc

SEQ ID NO: 144731 - RNA, 17 nt, Homo sapiens
ggaagccuuugguuuaa

SEQ ID NO: 144732 - RNA, 23 nt, Homo sapiens
ggaaugaaaccugguuaugauau

SEQ ID NO: 144733 - RNA, 22 nt, Homo sapiens
ggagaugaaaugagcuacuuaa

SEQ ID NO: 144734 - RNA, 22 nt, Homo sapiens
ggagauuauugaaucaugaggg

SEQ ID NO: 144735 - RNA, 22 nt, Homo sapiens
ggagcucaucuagcauagaggu

SEQ ID NO: 144736 - RNA, 22 nt, Homo sapiens
ggaggcuaguaaaaagguagaa

SEQ ID NO: 144737 - RNA, 22 nt, Homo sapiens
ggagggugagaucaauuuggga

SEQ ID NO: 144738 - RNA, 22 nt, Homo sapiens
ggagguagguuugugauuugua

SEQ ID NO: 144739 - RNA, 22 nt, Homo sapiens
ggagguagucuuucccuuauca

SEQ ID NO: 144740 - RNA, 22 nt, Homo sapiens
ggaguaggcuguccggcaccca

SEQ ID NO: 144741 - RNA, 22 nt, Homo sapiens
ggagucugacuuauaggaaccu

SEQ ID NO: 144742 - RNA, 22 nt, Homo sapiens
ggcaacaauuccuacuucuuuu

SEQ ID NO: 144743 - RNA, 22 nt, Homo sapiens
ggcagcacaauuuucugaugga

SEQ ID NO: 144744 - RNA, 22 nt, Homo sapiens
ggcauguugauagguagaugua

SEQ ID NO: 144745 - RNA, 22 nt, Homo sapiens
ggcuagaauagggauagaccuu

SEQ ID NO: 144746 - RNA, 22 nt, Homo sapiens
gggaacaugagaaugugaauga

SEQ ID NO: 144747 - RNA, 22 nt, Homo sapiens
gggaggucauuguaaggucuua

SEQ ID NO: 144748 - RNA, 22 nt, Homo sapiens
gggaucaacuuauacuaaaauu

SEQ ID NO: 144749 - RNA, 22 nt, Homo sapiens
gggaugaagcccuaggguuggu

SEQ ID NO: 144750 - RNA, 22 nt, Homo sapiens
gggauguaaaagugggcacauu

SEQ ID NO: 144751 - RNA, 22 nt, Homo sapiens
gggauguuuuauacugagccug

SEQ ID NO: 144752 - RNA, 22 nt, Homo sapiens
gggcaaauuauguaucucucag

SEQ ID NO: 144753 - RNA, 16 nt, Homo sapiens
gggcaugugaagccua

SEQ ID NO: 144754 - RNA, 22 nt, Homo sapiens
uugcacagugguuuagagccug

SEQ ID NO: 144755 - RNA, 22 nt, Homo sapiens
uugcacuauuaguauagauguc

SEQ ID NO: 144756 - RNA, 20 nt, Homo sapiens
uugcagagcccaacccugga

SEQ ID NO: 144757 - RNA, 22 nt, Homo sapiens
uugcagagccccacacugggcu

SEQ ID NO: 144758 - RNA, 22 nt, Homo sapiens
uugcagagccccugcaaggguc

SEQ ID NO: 144759 - RNA, 22 nt, Homo sapiens
uugcagagucaguuauuuugcc

SEQ ID NO: 144760 - RNA, 22 nt, Homo sapiens
uugcaggugguuuaugcaagac

SEQ ID NO: 144761 - RNA, 19 nt, Homo sapiens
uugcaguauccuauauguu

SEQ ID NO: 144762 - RNA, 22 nt, Homo sapiens
uugcauagacaauauuaaucuu

SEQ ID NO: 144763 - RNA, 23 nt, Homo sapiens
uugcauagacauccucauagauu

SEQ ID NO: 144764 - RNA, 22 nt, Homo sapiens
uugcauuuucuaggagggcaaa

SEQ ID NO: 144765 - RNA, 22 nt, Homo sapiens
uugccuaggcuggagugcagua

SEQ ID NO: 144766 - RNA, 22 nt, Homo sapiens
uugcucaggcuagaguucagcu

SEQ ID NO: 144767 - RNA, 22 nt, Homo sapiens
uugcucaggcuggaguacaaug

SEQ ID NO: 144768 - RNA, 22 nt, Homo sapiens
uugcuccucugccaggaccugu

SEQ ID NO: 144769 - RNA, 22 nt, Homo sapiens
uuggaaugcaacagaaggauaa

SEQ ID NO: 144770 - RNA, 22 nt, Homo sapiens
uuggaauguauggcaucuugcg

SEQ ID NO: 144771 - RNA, 22 nt, Homo sapiens
uuggacaagauugcagagaauu

SEQ ID NO: 144772 - RNA, 22 nt, Homo sapiens
uuggacucccuccccagcuuca

SEQ ID NO: 144773 - RNA, 22 nt, Homo sapiens
uuggacuuuaagauagagaugu

SEQ ID NO: 144774 - RNA, 22 nt, Homo sapiens
uuggauggucuuuauauaguau

SEQ ID NO: 144775 - RNA, 22 nt, Homo sapiens
uuggauuuuaacaaacuaggug

SEQ ID NO: 144776 - RNA, 22 nt, Homo sapiens
uuggcaaagugucuggcauuua

SEQ ID NO: 144777 - RNA, 22 nt, Homo sapiens
uuggcagaauguuagaaacuua

SEQ ID NO: 144778 - RNA, 22 nt, Homo sapiens
uuggcauuuuuagucaugggaa

SEQ ID NO: 144779 - RNA, 22 nt, Homo sapiens
uuggccccuccaaaucucaugu

SEQ ID NO: 144780 - RNA, 22 nt, Homo sapiens
uuggcuaugaguccuaugugca

SEQ ID NO: 144781 - RNA, 22 nt, Homo sapiens
uuggcucuggcugggcuccagc

SEQ ID NO: 144782 - RNA, 22 nt, Homo sapiens
uugggauggaaauuuguacccc

SEQ ID NO: 144783 - RNA, 22 nt, Homo sapiens
uuggucaggcuagaguguggug

SEQ ID NO: 144784 - RNA, 22 nt, Homo sapiens
uuggucaucucccuccuuuuag

SEQ ID NO: 144785 - RNA, 22 nt, Homo sapiens
uuguaaagucugucucagucag

SEQ ID NO: 144786 - RNA, 22 nt, Homo sapiens
uuguauaggcucaguaagaauc

SEQ ID NO: 144787 - RNA, 22 nt, Homo sapiens
uugucaacaugaaacuguguuu

SEQ ID NO: 144788 - RNA, 22 nt, Homo sapiens
uugucuccuagacgaccaggcg

SEQ ID NO: 144789 - RNA, 22 nt, Homo sapiens
uugucuugcagcuuaggcauca

SEQ ID NO: 144790 - RNA, 19 nt, Homo sapiens
uugugggaggacagagggg

SEQ ID NO: 144791 - RNA, 22 nt, Homo sapiens
uugugguuuuuaaaacuaggug

SEQ ID NO: 144792 - RNA, 22 nt, Homo sapiens
uuguuauguuaaacuacugaaa

SEQ ID NO: 144793 - RNA, 17 nt, Homo sapiens
uuguucccauuaaaaag

SEQ ID NO: 144794 - RNA, 22 nt, Homo sapiens
uuuacagucucauagguggaag

SEQ ID NO: 144795 - RNA, 22 nt, Homo sapiens
uuuaucuguuuaaaacuguuca

SEQ ID NO: 144796 - RNA, 22 nt, Homo sapiens
uuucaagugcugucuuagcugu

SEQ ID NO: 144797 - RNA, 19 nt, Homo sapiens
uuucaauguaaggauggag

SEQ ID NO: 144798 - RNA, 19 nt, Homo sapiens
uuucacacucgccuacuuc

SEQ ID NO: 144799 - RNA, 20 nt, Homo sapiens
uuucaguacuuucuacuggc

SEQ ID NO: 144800 - RNA, 22 nt, Homo sapiens
uuucauagaucaugcuuuugga

SEQ ID NO: 144801 - RNA, 22 nt, Homo sapiens
uuucccagugguacaguuuaua

SEQ ID NO: 144802 - RNA, 22 nt, Homo sapiens
uuucccuuuagcuuagugauuu

SEQ ID NO: 144803 - RNA, 22 nt, Homo sapiens
uuucccuuugcuuugucagcca

SEQ ID NO: 144804 - RNA, 22 nt, Homo sapiens
uuuccuggagaaucuuaacaaa

SEQ ID NO: 144805 - RNA, 22 nt, Homo sapiens
uuuccuguagggggcaaggccu

SEQ ID NO: 144806 - RNA, 22 nt, Homo sapiens
uuucuauguugaccagucuaga

SEQ ID NO: 144807 - RNA, 22 nt, Homo sapiens
uuucugugguccucuugaaggu

SEQ ID NO: 144808 - RNA, 22 nt, Homo sapiens
uuugacuuuuagaauaugaguu

SEQ ID NO: 144809 - RNA, 22 nt, Homo sapiens
uuugauguccaccucagcccac

SEQ ID NO: 144810 - RNA, 18 nt, Homo sapiens
uuugccacuucccagaaa

SEQ ID NO: 144811 - RNA, 22 nt, Homo sapiens
uuugcuuaaaguccuuguggga

SEQ ID NO: 144812 - RNA, 22 nt, Homo sapiens
uuuggauagugugguccuuuua

SEQ ID NO: 144813 - RNA, 22 nt, Homo sapiens
uuuggcauuagauaauugugua

SEQ ID NO: 144814 - RNA, 18 nt, Homo sapiens
uuuggcuguucaugacuc

SEQ ID NO: 144815 - RNA, 22 nt, Homo sapiens
uuugguguauaaaaaugcuagu

SEQ ID NO: 144816 - RNA, 22 nt, Homo sapiens
uuugguugcauucacauauuuc

SEQ ID NO: 144817 - RNA, 23 nt, Homo sapiens
uuuguaguagcaugauuuauaau

SEQ ID NO: 144818 - RNA, 22 nt, Homo sapiens
uuuguggaaugcccuuauuuau

SEQ ID NO: 144819 - RNA, 22 nt, Homo sapiens
uuuguggaaugcucauguguag

SEQ ID NO: 144820 - RNA, 22 nt, Homo sapiens
uuuuaguugcucagguauucuc

SEQ ID NO: 144821 - RNA, 21 nt, Homo sapiens
uuuugcacacuaugcagcuuu

SEQ ID NO: 144822 - RNA, 22 nt, Homo sapiens
uuuugcacauugauuugguauc

SEQ ID NO: 144823 - RNA, 22 nt, Homo sapiens
uuuugcaccauccuaauaguau

SEQ ID NO: 144824 - RNA, 22 nt, Homo sapiens
uuuugcacuguuuuaucugaca

SEQ ID NO: 144825 - RNA, 22 nt, Homo sapiens
uuuugcucuugguaaugaaaga

SEQ ID NO: 144826 - RNA, 22 nt, Homo sapiens
uuuugcuugugaauagccacau

SEQ ID NO: 144827 - RNA, 22 nt, Homo sapiens
uuuuggacuucaauuugacacu

SEQ ID NO: 144828 - RNA, 17 nt, Homo sapiens
uuuuggauuagaaaucc

SEQ ID NO: 144829 - RNA, 22 nt, Homo sapiens
uuuuggcuuaaagagaauguau

SEQ ID NO: 144830 - RNA, 22 nt, Homo sapiens
ugaaagguuuaauucugugaga

SEQ ID NO: 144831 - RNA, 22 nt, Homo sapiens
ugaaauacuuaauuucuccaug

SEQ ID NO: 144832 - RNA, 22 nt, Homo sapiens
ugaaauacuuuggcucuuuguu

SEQ ID NO: 144833 - RNA, 22 nt, Homo sapiens
ugaaaugauuauaugguguuug

SEQ ID NO: 144834 - RNA, 21 nt, Homo sapiens
ugaaaugcaugugcacauuaa

SEQ ID NO: 144835 - RNA, 22 nt, Homo sapiens
ugaaaugucuuuaggaggcuuc

SEQ ID NO: 144836 - RNA, 22 nt, Homo sapiens
ugaaauguuaaacaaguggcuc

SEQ ID NO: 144837 - RNA, 20 nt, Homo sapiens
ugaacugguuacuuucuguc

SEQ ID NO: 144838 - RNA, 22 nt, Homo sapiens
ugaaggaguauggauaagucgu

SEQ ID NO: 144839 - RNA, 22 nt, Homo sapiens
ugaaguaauguuuuauucuauu

SEQ ID NO: 144840 - RNA, 22 nt, Homo sapiens
ugaagugggaaaugaguauuaa

SEQ ID NO: 144841 - RNA, 22 nt, Homo sapiens
ugaaguguuuuuucaggcaugu

SEQ ID NO: 144842 - RNA, 22 nt, Homo sapiens
ugaaugccauucuguguuagcu

SEQ ID NO: 144843 - RNA, 20 nt, Homo sapiens
ugaauguaauuacagaugua

SEQ ID NO: 144844 - RNA, 22 nt, Homo sapiens
ugaauguuugcuuacuuccaua

SEQ ID NO: 144845 - RNA, 22 nt, Homo sapiens
ugacaagaguagagagggugcc

SEQ ID NO: 144846 - RNA, 22 nt, Homo sapiens
ugacaagcucccucugcaccuu

SEQ ID NO: 144847 - RNA, 22 nt, Homo sapiens
ugacaagggaaaugcaaaaugu

SEQ ID NO: 144848 - RNA, 22 nt, Homo sapiens
ugacagcugaagauguugaacc

SEQ ID NO: 144849 - RNA, 22 nt, Homo sapiens
ugacagguuggaauuaugggag

SEQ ID NO: 144850 - RNA, 20 nt, Homo sapiens
ugacaguuaagggauagaag

SEQ ID NO: 144851 - RNA, 22 nt, Homo sapiens
ugacaugaagucucccucuguu

SEQ ID NO: 144852 - RNA, 22 nt, Homo sapiens
ugacaugaugagcaauaauggc

SEQ ID NO: 144853 - RNA, 22 nt, Homo sapiens
ugacauuacagucacuugcugu

SEQ ID NO: 144854 - RNA, 17 nt, Homo sapiens
ugaccacugauucuacu

SEQ ID NO: 144855 - RNA, 22 nt, Homo sapiens
ugacggaggcauuggaagcuug

SEQ ID NO: 144856 - RNA, 21 nt, Homo sapiens
ugacuacuggucucuuggguc

SEQ ID NO: 144857 - RNA, 22 nt, Homo sapiens
ugacuagagcaauuggaaacaa

SEQ ID NO: 144858 - RNA, 22 nt, Homo sapiens
ugacucagauagguguguauuc

SEQ ID NO: 144859 - RNA, 22 nt, Homo sapiens
ugacugaguaguauuccacuau

SEQ ID NO: 144860 - RNA, 22 nt, Homo sapiens
ugacuuaugcaacucugaugug

SEQ ID NO: 144861 - RNA, 22 nt, Homo sapiens
ugacuugaacuucuaugucacc

SEQ ID NO: 144862 - RNA, 22 nt, Homo sapiens
ugagaacauuccucuuccuggc

SEQ ID NO: 144863 - RNA, 22 nt, Homo sapiens
ugagaacuaaugaagaauuuau

SEQ ID NO: 144864 - RNA, 22 nt, Homo sapiens
ugagacaaucucaucucaguga

SEQ ID NO: 144865 - RNA, 22 nt, Homo sapiens
ugagacaugugaacuguaguuc

SEQ ID NO: 144866 - RNA, 22 nt, Homo sapiens
ugagacggagucucgcuguguc

SEQ ID NO: 144867 - RNA, 22 nt, Homo sapiens
ugagagcugcauucuugaaagc

SEQ ID NO: 144868 - RNA, 22 nt, Homo sapiens
ugagagcuuuuuugccugguga

SEQ ID NO: 144869 - RNA, 22 nt, Homo sapiens
ugagaugaaagcagaaagacuu

SEQ ID NO: 144870 - RNA, 22 nt, Homo sapiens
ugagaugagagaaugcuugccu

SEQ ID NO: 144871 - RNA, 22 nt, Homo sapiens
ugagaugagggcugcacucaaa

SEQ ID NO: 144872 - RNA, 22 nt, Homo sapiens
ugagaugaggucucgcucuguc

SEQ ID NO: 144873 - RNA, 21 nt, Homo sapiens
ugagaugauccugcaugcaug

SEQ ID NO: 144874 - RNA, 22 nt, Homo sapiens
ugagauggcuuuauugcugaau

SEQ ID NO: 144875 - RNA, 22 nt, Homo sapiens
ugagauguuccaaugacuauua

SEQ ID NO: 144876 - RNA, 21 nt, Homo sapiens
ugagauuaaguuguuuagaag

SEQ ID NO: 144877 - RNA, 23 nt, Homo sapiens
ugagauuauaaucuuuuacuucu

SEQ ID NO: 144878 - RNA, 22 nt, Homo sapiens
ugagauuauauuucuuaacaga

SEQ ID NO: 144879 - RNA, 22 nt, Homo sapiens
ugagauuaucuguacauaggag

SEQ ID NO: 144880 - RNA, 22 nt, Homo sapiens
ugagauucucugauuguagguc

SEQ ID NO: 144881 - RNA, 22 nt, Homo sapiens
ugagauuguaucugcaaugugu

SEQ ID NO: 144882 - RNA, 22 nt, Homo sapiens
ugaggagugagaaauugguuuc

SEQ ID NO: 144883 - RNA, 19 nt, Homo sapiens
ugagguauuuguugggaga

SEQ ID NO: 144884 - RNA, 22 nt, Homo sapiens
ugagguguuaacuuuacuuuua

SEQ ID NO: 144885 - RNA, 22 nt, Homo sapiens
ugagguugguauuacugucucu

SEQ ID NO: 144886 - RNA, 22 nt, Homo sapiens
ugaguagugcugcaauaaacau

SEQ ID NO: 144887 - RNA, 22 nt, Homo sapiens
ugagucuguuccaaagaaauaa

SEQ ID NO: 144888 - RNA, 22 nt, Homo sapiens
ugagucuguucucacauugcua

SEQ ID NO: 144889 - RNA, 22 nt, Homo sapiens
ugagugaaagaagcacuaagga

SEQ ID NO: 144890 - RNA, 22 nt, Homo sapiens
ugagugaaugugaaggcuaggg

SEQ ID NO: 144891 - RNA, 22 nt, Homo sapiens
ugaguuaaucucuacgauagaa

SEQ ID NO: 144892 - RNA, 22 nt, Homo sapiens
ugaguuccuuucccaguccagu

SEQ ID NO: 144893 - RNA, 22 nt, Homo sapiens
ugaguucuuccuaucucugccu

SEQ ID NO: 144894 - RNA, 22 nt, Homo sapiens
ugauaauuuugucagguuuugg

SEQ ID NO: 144895 - RNA, 22 nt, Homo sapiens
ugaucaaagugcuggaauuaca

SEQ ID NO: 144896 - RNA, 22 nt, Homo sapiens
ugaucuguguaacauaggaguc

SEQ ID NO: 144897 - RNA, 22 nt, Homo sapiens
ugaugaaguauaggaagggcuu

SEQ ID NO: 144898 - RNA, 22 nt, Homo sapiens
ugaugacacugauuucuucaau

SEQ ID NO: 144899 - RNA, 22 nt, Homo sapiens
ugaugacauugucacagucuga

SEQ ID NO: 144900 - RNA, 19 nt, Homo sapiens
ugauuguaagcuuggugag

SEQ ID NO: 144901 - RNA, 22 nt, Homo sapiens
ugauugucucuccugccccauc

SEQ ID NO: 144902 - RNA, 22 nt, Homo sapiens
ugauuugucucucagcccuacu

SEQ ID NO: 144903 - RNA, 19 nt, Homo sapiens
ugcaaagucuuuuccuauu

SEQ ID NO: 144904 - RNA, 22 nt, Homo sapiens
ugcaaauguuaguaacaccacu

SEQ ID NO: 144905 - RNA, 22 nt, Homo sapiens
ugcaaugucuucugaggggagc

SEQ ID NO: 144906 - RNA, 22 nt, Homo sapiens
ugcacaguccagugcccacuga

SEQ ID NO: 144907 - RNA, 22 nt, Homo sapiens
ugcaguacauucagcauccucu

SEQ ID NO: 144908 - RNA, 22 nt, Homo sapiens
ugcaguagugugaucuuggcuc

SEQ ID NO: 144909 - RNA, 22 nt, Homo sapiens
ugcagugcaugacuguguuaug

SEQ ID NO: 144910 - RNA, 20 nt, Homo sapiens
ugcaguguccucacuuguca

SEQ ID NO: 144911 - RNA, 22 nt, Homo sapiens
ugcagugugaaagagccugaca

SEQ ID NO: 144912 - RNA, 18 nt, Homo sapiens
ugcauauguugaaccagc

SEQ ID NO: 144913 - RNA, 21 nt, Homo sapiens
ugcauuguugcugagagcagg

SEQ ID NO: 144914 - RNA, 22 nt, Homo sapiens
auacaagugccauguuggugug

SEQ ID NO: 144915 - RNA, 22 nt, Homo sapiens
auaccugguagucuugcuacac

SEQ ID NO: 144916 - RNA, 22 nt, Homo sapiens
auacugguuuuugucaugugga

SEQ ID NO: 144917 - RNA, 22 nt, Homo sapiens
auacuguuuuacaucauugccu

SEQ ID NO: 144918 - RNA, 21 nt, Homo sapiens
auacuugagacuggguaauuu

SEQ ID NO: 144919 - RNA, 20 nt, Homo sapiens
auagaagacuagugcagcag

SEQ ID NO: 144920 - RNA, 22 nt, Homo sapiens
auagaggacugaggugaucuuu

SEQ ID NO: 144921 - RNA, 21 nt, Homo sapiens
auagcacaucagauuuuauua

SEQ ID NO: 144922 - RNA, 22 nt, Homo sapiens
auagcagaagaagggacaauuc

SEQ ID NO: 144923 - RNA, 22 nt, Homo sapiens
auagcagaauuuggucaagucu

SEQ ID NO: 144924 - RNA, 22 nt, Homo sapiens
auagcuguugaauggaauauuc

SEQ ID NO: 144925 - RNA, 22 nt, Homo sapiens
auagguagcauagcaggaauau

SEQ ID NO: 144926 - RNA, 22 nt, Homo sapiens
auagugcugcaaaaaacauacg

SEQ ID NO: 144927 - RNA, 22 nt, Homo sapiens
auagugcugcaacaaauauacg

SEQ ID NO: 144928 - RNA, 22 nt, Homo sapiens
auagugcugcaagaaacauacg

SEQ ID NO: 144929 - RNA, 19 nt, Homo sapiens
auauaacauccaggagcag

SEQ ID NO: 144930 - RNA, 22 nt, Homo sapiens
auaugcacaguggaguacuauu

SEQ ID NO: 144931 - RNA, 22 nt, Homo sapiens
auauguaguuucagaaguggaa

SEQ ID NO: 144932 - RNA, 22 nt, Homo sapiens
auauuacuggccauaucgcagg

SEQ ID NO: 144933 - RNA, 22 nt, Homo sapiens
auauugcuccuaauaccacggu

SEQ ID NO: 144934 - RNA, 22 nt, Homo sapiens
auauuggacugugcuaguuaga

SEQ ID NO: 144935 - RNA, 22 nt, Homo sapiens
aucaaaguaggcauauguuuuu

SEQ ID NO: 144936 - RNA, 22 nt, Homo sapiens
aucacaggcaaaauuccuucuc

SEQ ID NO: 144937 - RNA, 22 nt, Homo sapiens
aucacaguuauaacauccuuuu

SEQ ID NO: 144938 - RNA, 22 nt, Homo sapiens
aucagaaucucuugagaguguu

SEQ ID NO: 144939 - RNA, 22 nt, Homo sapiens
aucagaguugucagggagcuuu

SEQ ID NO: 144940 - RNA, 22 nt, Homo sapiens
auccucugagagaguuucauaa

SEQ ID NO: 144941 - RNA, 22 nt, Homo sapiens
aucugauggagagcguguggcu

SEQ ID NO: 144942 - RNA, 22 nt, Homo sapiens
aucuugggugggaacugagaau

SEQ ID NO: 144943 - RNA, 22 nt, Homo sapiens
aucuuuggugaguucuuugguc

SEQ ID NO: 144944 - RNA, 22 nt, Homo sapiens
augaaagguauguuuucuguga

SEQ ID NO: 144945 - RNA, 22 nt, Homo sapiens
augaacuaugugggauguuuua

SEQ ID NO: 144946 - RNA, 22 nt, Homo sapiens
augaaguuagcucauuucuuuu

SEQ ID NO: 144947 - RNA, 21 nt, Homo sapiens
augaauguaaagaauguggga

SEQ ID NO: 144948 - RNA, 22 nt, Homo sapiens
augacauuccacagccguagag

SEQ ID NO: 144949 - RNA, 22 nt, Homo sapiens
augagauacuacaaaugaguuu

SEQ ID NO: 144950 - RNA, 22 nt, Homo sapiens
augagaugaauaccgacgaugu

SEQ ID NO: 144951 - RNA, 21 nt, Homo sapiens
augagauguuagacuuuagac

SEQ ID NO: 144952 - RNA, 22 nt, Homo sapiens
augagcaaagagaugagacccu

SEQ ID NO: 144953 - RNA, 22 nt, Homo sapiens
augagcuguuuggaagacacuu

SEQ ID NO: 144954 - RNA, 22 nt, Homo sapiens
augagguaguagaaagucaggu

SEQ ID NO: 144955 - RNA, 22 nt, Homo sapiens
augagguauccaagcccagaaa

SEQ ID NO: 144956 - RNA, 23 nt, Homo sapiens
augagguaucugagcccagaaau

SEQ ID NO: 144957 - RNA, 22 nt, Homo sapiens
augaguaguugcuaaauauuga

SEQ ID NO: 144958 - RNA, 15 nt, Homo sapiens
augaguuuuauggag

SEQ ID NO: 144959 - RNA, 22 nt, Homo sapiens
augaucacaccacugcacucca

SEQ ID NO: 144960 - RNA, 22 nt, Homo sapiens
augauuuuuguaucgccugaug

SEQ ID NO: 144961 - RNA, 22 nt, Homo sapiens
augcaagcacacaagaggaaau

SEQ ID NO: 144962 - RNA, 19 nt, Homo sapiens
augcaaugucacaggcugc

SEQ ID NO: 144963 - RNA, 22 nt, Homo sapiens
augcagagaaaucuaaaauaug

SEQ ID NO: 144964 - RNA, 22 nt, Homo sapiens
augcagagucccagccccuagc

SEQ ID NO: 144965 - RNA, 19 nt, Homo sapiens
augccacagugaggucaga

SEQ ID NO: 144966 - RNA, 22 nt, Homo sapiens
augccacugcacuucagccugg

SEQ ID NO: 144967 - RNA, 22 nt, Homo sapiens
augccacugcauaagguuuuca

SEQ ID NO: 144968 - RNA, 22 nt, Homo sapiens
augccacuucucuaagucaugu

SEQ ID NO: 144969 - RNA, 22 nt, Homo sapiens
augccaguguccagaguggguu

SEQ ID NO: 144970 - RNA, 19 nt, Homo sapiens
augccucaguuuuguacuu

SEQ ID NO: 144971 - RNA, 22 nt, Homo sapiens
augcuacauucuacaauuaggc

SEQ ID NO: 144972 - RNA, 22 nt, Homo sapiens
auggaaacauaagaguauagau

SEQ ID NO: 144973 - RNA, 21 nt, Homo sapiens
auggaaagacugccucuucaa

SEQ ID NO: 144974 - RNA, 22 nt, Homo sapiens
auggaaaugaagggcuggcccu

SEQ ID NO: 144975 - RNA, 22 nt, Homo sapiens
auggaacauuauagauguaaaa

SEQ ID NO: 144976 - RNA, 22 nt, Homo sapiens
auggagaugaacuuggguaaag

SEQ ID NO: 144977 - RNA, 22 nt, Homo sapiens
auggcaaaauguuccuaguggu

SEQ ID NO: 144978 - RNA, 22 nt, Homo sapiens
auggcaaugcgauggugacuga

SEQ ID NO: 144979 - RNA, 18 nt, Homo sapiens
auggcagaacaauuuaca

SEQ ID NO: 144980 - RNA, 22 nt, Homo sapiens
auggcagaaucaagccgacagc

SEQ ID NO: 144981 - RNA, 22 nt, Homo sapiens
auggcaguuucacucugggauu

SEQ ID NO: 144982 - RNA, 22 nt, Homo sapiens
auggcccaguuugcuaucccua

SEQ ID NO: 144983 - RNA, 22 nt, Homo sapiens
auggcccugcuaccacuuuucu

SEQ ID NO: 144984 - RNA, 22 nt, Homo sapiens
auggccuuucuggcacauuucc

SEQ ID NO: 144985 - RNA, 22 nt, Homo sapiens
auggcucuguuccaugugucuu

SEQ ID NO: 144986 - RNA, 22 nt, Homo sapiens
auggcuuugggcugcucugccc

SEQ ID NO: 144987 - RNA, 22 nt, Homo sapiens
auggcuuuucacagaggguucu

SEQ ID NO: 144988 - RNA, 22 nt, Homo sapiens
augggauaguaucaguggaaua

SEQ ID NO: 144989 - RNA, 22 nt, Homo sapiens
augggugaguaugaguugacuu

SEQ ID NO: 144990 - RNA, 22 nt, Homo sapiens
augguuugugcuccuauaagaa

SEQ ID NO: 144991 - RNA, 21 nt, Homo sapiens
auguaacugggaaugugagag

SEQ ID NO: 144992 - RNA, 22 nt, Homo sapiens
auguauacauagauacgugugu

SEQ ID NO: 144993 - RNA, 22 nt, Homo sapiens
auguccauggaaucuguagcaa

SEQ ID NO: 144994 - RNA, 22 nt, Homo sapiens
augucuagagcaagagaugcug

SEQ ID NO: 144995 - RNA, 22 nt, Homo sapiens
augugaacaucauagaaugcac

SEQ ID NO: 144996 - RNA, 22 nt, Homo sapiens
augugacuggaucauggggacg

SEQ ID NO: 144997 - RNA, 23 nt, Homo sapiens
augugugcuuggagagcaggaug

SEQ ID NO: 144998 - RNA, 22 nt, Homo sapiens
auguuauguuaaugauaaugga

SEQ ID NO: 144999 - RNA, 22 nt, Homo sapiens
auguugcuugaaggcauuuugu

SEQ ID NO: 145000 - RNA, 22 nt, Homo sapiens
auuaagagcacauguucugggu

SEQ ID NO: 145001 - RNA, 22 nt, Homo sapiens
auuaagugcuugccagugcugg

SEQ ID NO: 145002 - RNA, 22 nt, Homo sapiens
auuaaguugugccugaaaacuu

SEQ ID NO: 145003 - RNA, 22 nt, Homo sapiens
auuaaucaggcaaugcuugcua

SEQ ID NO: 145004 - RNA, 21 nt, Homo sapiens
auuaaugcucugguuagaggc

SEQ ID NO: 145005 - RNA, 22 nt, Homo sapiens
auuaucacaguuuugcauaugg

SEQ ID NO: 145006 - RNA, 22 nt, Homo sapiens
auucaacuaauuauugaagaug

SEQ ID NO: 145007 - RNA, 22 nt, Homo sapiens
auucaaggacuggauugcggga

SEQ ID NO: 145008 - RNA, 22 nt, Homo sapiens
auucaaggagucuucgucccaa

SEQ ID NO: 145009 - RNA, 22 nt, Homo sapiens
auucaagugaugcagcuguuuu

SEQ ID NO: 145010 - RNA, 22 nt, Homo sapiens
auucacuguggcuuucucugau

SEQ ID NO: 145011 - RNA, 20 nt, Homo sapiens
auucauggaggagcaauugg

SEQ ID NO: 145012 - RNA, 22 nt, Homo sapiens
auuccacaguuaacacagaccg

SEQ ID NO: 145013 - RNA, 22 nt, Homo sapiens
auuccagguggcgccauucaca

SEQ ID NO: 145014 - RNA, 22 nt, Homo sapiens
auuccauuuguguggaauggcu

SEQ ID NO: 145015 - RNA, 22 nt, Homo sapiens
auuccuuaggcccuuugguuag

SEQ ID NO: 145016 - RNA, 23 nt, Homo sapiens
auugaacacuuucauaugugagg

SEQ ID NO: 145017 - RNA, 22 nt, Homo sapiens
auugaacaugccauauguacca

SEQ ID NO: 145018 - RNA, 22 nt, Homo sapiens
auugacaguuggccaguaagug

SEQ ID NO: 145019 - RNA, 22 nt, Homo sapiens
auugagcaauuccuaugugcuu

SEQ ID NO: 145020 - RNA, 21 nt, Homo sapiens
auugagcacaugaaacauggc

SEQ ID NO: 145021 - RNA, 22 nt, Homo sapiens
auugagcuuuuuaaaauauagu

SEQ ID NO: 145022 - RNA, 22 nt, Homo sapiens
auugaggcaggaggaccaucua

SEQ ID NO: 145023 - RNA, 22 nt, Homo sapiens
auugcacuccagccugggcgac

SEQ ID NO: 145024 - RNA, 23 nt, Homo sapiens
auugcagaaucacagagguagug

SEQ ID NO: 145025 - RNA, 22 nt, Homo sapiens
auugcagcccacccugggugau

SEQ ID NO: 145026 - RNA, 22 nt, Homo sapiens
auugcaugucauguuuagugua

SEQ ID NO: 145027 - RNA, 22 nt, Homo sapiens
auuggacagcauuucuagacuu

SEQ ID NO: 145028 - RNA, 22 nt, Homo sapiens
auugucacuuaaaagugcaugu

SEQ ID NO: 145029 - RNA, 22 nt, Homo sapiens
auuguucuuacaugcugucauc

SEQ ID NO: 145030 - RNA, 22 nt, Homo sapiens
auuuaacuggucuaggggccca

SEQ ID NO: 145031 - RNA, 21 nt, Homo sapiens
auuugcacugagcuccugugc

SEQ ID NO: 145032 - RNA, 22 nt, Homo sapiens
auuuugguuacauaguugagcu

SEQ ID NO: 145033 - RNA, 22 nt, Homo sapiens
caaagcuauagcaccagaggga

SEQ ID NO: 145034 - RNA, 22 nt, Homo sapiens
caaaggcuguuauaggccagga

SEQ ID NO: 145035 - RNA, 22 nt, Homo sapiens
caaaguaauugcuguuuugcca

SEQ ID NO: 145036 - RNA, 22 nt, Homo sapiens
caaagugcuggccgggcgcagu

SEQ ID NO: 145037 - RNA, 22 nt, Homo sapiens
caaagugguuuauacaugauug

SEQ ID NO: 145038 - RNA, 22 nt, Homo sapiens
caaauacuuucauguugucuug

SEQ ID NO: 145039 - RNA, 22 nt, Homo sapiens
caaauccucaccucaucaugaa

SEQ ID NO: 145040 - RNA, 22 nt, Homo sapiens
caagugcuugaugaaugaucaa

SEQ ID NO: 145041 - RNA, 22 nt, Homo sapiens
caaguguuuccuuaaauacuug

SEQ ID NO: 145042 - RNA, 19 nt, Homo sapiens
caauacuucuuggcauaca

SEQ ID NO: 145043 - RNA, 22 nt, Homo sapiens
cacagcgacuuccgccuaccgg

SEQ ID NO: 145044 - RNA, 22 nt, Homo sapiens
cacaguagaauagagcacuagg

SEQ ID NO: 145045 - RNA, 22 nt, Homo sapiens
cacagucugggcuuguuuguac

SEQ ID NO: 145046 - RNA, 22 nt, Homo sapiens
cacauguuugcuacauuuuucu

SEQ ID NO: 145047 - RNA, 22 nt, Homo sapiens
caccacagccauuauugucccc

SEQ ID NO: 145048 - RNA, 22 nt, Homo sapiens
caccacauuccauugaucaggc

SEQ ID NO: 145049 - RNA, 22 nt, Homo sapiens
caccggauucauggggaagaag

SEQ ID NO: 145050 - RNA, 22 nt, Homo sapiens
cagagaacugaguuauuuucuu

SEQ ID NO: 145051 - RNA, 20 nt, Homo sapiens
cagcaaccugcucucuuccu

SEQ ID NO: 145052 - RNA, 20 nt, Homo sapiens
cagcacgcacaugagacugu

SEQ ID NO: 145053 - RNA, 22 nt, Homo sapiens
cagcaucauucaucugggguaa

SEQ ID NO: 145054 - RNA, 23 nt, Homo sapiens
cagcuggugauuuuaaguugaag

SEQ ID NO: 145055 - RNA, 22 nt, Homo sapiens
cagcuggugcugcaccaguggg

SEQ ID NO: 145056 - RNA, 22 nt, Homo sapiens
caggcauagucuugaguuuuau

SEQ ID NO: 145057 - RNA, 22 nt, Homo sapiens
cagggcauuggcugguaccugg

SEQ ID NO: 145058 - RNA, 22 nt, Homo sapiens
cagguaguauuugguuacauaa

SEQ ID NO: 145059 - RNA, 22 nt, Homo sapiens
cagguauagucacuugcccaag

SEQ ID NO: 145060 - RNA, 22 nt, Homo sapiens
caggugguauuugguuuucugu

SEQ ID NO: 145061 - RNA, 22 nt, Homo sapiens
cagugcauaggaucuaaaauuu

SEQ ID NO: 145062 - RNA, 22 nt, Homo sapiens
cagugguuuucaacccugguug

SEQ ID NO: 145063 - RNA, 22 nt, Homo sapiens
caguugcacuagccccguuuca

SEQ ID NO: 145064 - RNA, 22 nt, Homo sapiens
cauauucacuuuacagagcugu

SEQ ID NO: 145065 - RNA, 22 nt, Homo sapiens
caugacacauguuuaccuaugu

SEQ ID NO: 145066 - RNA, 22 nt, Homo sapiens
cauggagcuaggcuugaucccu

SEQ ID NO: 145067 - RNA, 22 nt, Homo sapiens
cauggcacuguaugaaaugugc

SEQ ID NO: 145068 - RNA, 22 nt, Homo sapiens
cauggcccugggcugggcgaac

SEQ ID NO: 145069 - RNA, 22 nt, Homo sapiens
cauugcacuccagccugcacga

SEQ ID NO: 145070 - RNA, 20 nt, Homo sapiens
cauugcacuccagccugcug

SEQ ID NO: 145071 - RNA, 22 nt, Homo sapiens
cauugcagauccuucaaaugac

SEQ ID NO: 145072 - RNA, 22 nt, Homo sapiens
cauugguuaguuaacuuuaaga

SEQ ID NO: 145073 - RNA, 22 nt, Homo sapiens
cauugguuccaguuuguccuua

SEQ ID NO: 145074 - RNA, 23 nt, Homo sapiens
ccacacuguuuagaauggcauca

SEQ ID NO: 145075 - RNA, 22 nt, Homo sapiens
ccacauuggaaaggaucccccc

SEQ ID NO: 145076 - RNA, 22 nt, Homo sapiens
ccagaguuucugauucagcagg

SEQ ID NO: 145077 - RNA, 22 nt, Homo sapiens
ccaguuuucccagcaccauuaa

SEQ ID NO: 145078 - RNA, 22 nt, Homo sapiens
ccaguuuucucacuguugcagu

SEQ ID NO: 145079 - RNA, 22 nt, Homo sapiens
ccaucccuuucugagcaguucc

SEQ ID NO: 145080 - RNA, 22 nt, Homo sapiens
ccauggcuucugcauucuguca

SEQ ID NO: 145081 - RNA, 22 nt, Homo sapiens
cccagagacagaaugauaaacu

SEQ ID NO: 145082 - RNA, 22 nt, Homo sapiens
cccaguguuuauuuugagccaa

SEQ ID NO: 145083 - RNA, 22 nt, Homo sapiens
cccaguuuugcuucucaugagg

SEQ ID NO: 145084 - RNA, 23 nt, Homo sapiens
cccucagaagugcagggagagaa

SEQ ID NO: 145085 - RNA, 22 nt, Homo sapiens
ccucccuuuguugcaagggaaa

SEQ ID NO: 145086 - RNA, 22 nt, Homo sapiens
ugugcucaucucagucaacugu

SEQ ID NO: 145087 - RNA, 22 nt, Homo sapiens
ugcauggaagggagggaaagag

SEQ ID NO: 145088 - RNA, 20 nt, Homo sapiens
ugccaagaaaugaggguauu

SEQ ID NO: 145089 - RNA, 20 nt, Homo sapiens
ugccagugugucaauuuaua

SEQ ID NO: 145090 - RNA, 22 nt, Homo sapiens
cugggaugauguaaauaggcua

SEQ ID NO: 145091 - RNA, 22 nt, Homo sapiens
cuggugugugacuuuucauuau

SEQ ID NO: 145092 - RNA, 21 nt, Homo sapiens
cugguguuagcacuucuuccc

SEQ ID NO: 145093 - RNA, 17 nt, Homo sapiens
cugugaugaucuugucu

SEQ ID NO: 145094 - RNA, 22 nt, Homo sapiens
cuucacuuuguuaaacuccaau

SEQ ID NO: 145095 - RNA, 22 nt, Homo sapiens
cuucaucugguuugugaacuuu

SEQ ID NO: 145096 - RNA, 21 nt, Homo sapiens
cuucuuggggcagggcagggu

SEQ ID NO: 145097 - RNA, 20 nt, Homo sapiens
cuugaagacuaugcugcuga

SEQ ID NO: 145098 - RNA, 22 nt, Homo sapiens
cuugagacauuguuuuccaagu

SEQ ID NO: 145099 - RNA, 22 nt, Homo sapiens
cuugagcuugagauccuuucug

SEQ ID NO: 145100 - RNA, 22 nt, Homo sapiens
cuugcacuccacuguucuccug

SEQ ID NO: 145101 - RNA, 22 nt, Homo sapiens
cuugucuugcacacgguugcca

SEQ ID NO: 145102 - RNA, 22 nt, Homo sapiens
cuuuagcaauugauuaugccau

SEQ ID NO: 145103 - RNA, 22 nt, Homo sapiens
cuuugauuauaaaaggguguuu

SEQ ID NO: 145104 - RNA, 18 nt, Homo sapiens
cuuugguccccgcacccu

SEQ ID NO: 145105 - RNA, 20 nt, Homo sapiens
cuuuggugagucaacuccuu

SEQ ID NO: 145106 - RNA, 22 nt, Homo sapiens
cuuuguggggucuuuccucaaa

SEQ ID NO: 145107 - RNA, 22 nt, Homo sapiens
cuuuguguaggugccucuggcu

SEQ ID NO: 145108 - RNA, 22 nt, Homo sapiens
cuuuuacacuguuagugggaau

SEQ ID NO: 145109 - RNA, 22 nt, Homo sapiens
cuuuuggucuaucagagaagca

SEQ ID NO: 145110 - RNA, 22 nt, Homo sapiens
gaaaguaauuaacgauuguugc

SEQ ID NO: 145111 - RNA, 22 nt, Homo sapiens
gacaguguggcgauuccucaag

SEQ ID NO: 145112 - RNA, 21 nt, Homo sapiens
gacauggcgauacuccgucuc

SEQ ID NO: 145113 - RNA, 22 nt, Homo sapiens
gacuucaucauacuaugugugg

SEQ ID NO: 145114 - RNA, 22 nt, Homo sapiens
gacuuugguaaacucgguggca

SEQ ID NO: 145115 - RNA, 22 nt, Homo sapiens
gagaacugagauaagugauauu

SEQ ID NO: 145116 - RNA, 22 nt, Homo sapiens
gagaacugagugugcuggcgga

SEQ ID NO: 145117 - RNA, 22 nt, Homo sapiens
gagaaguaaauuuauuugcaaa

SEQ ID NO: 145118 - RNA, 22 nt, Homo sapiens
gagacugagucuugcucugucg

SEQ ID NO: 145119 - RNA, 22 nt, Homo sapiens
gagagugaaguuugcuaccugu

SEQ ID NO: 145120 - RNA, 22 nt, Homo sapiens
gagauaauuugaaucauggggg

SEQ ID NO: 145121 - RNA, 22 nt, Homo sapiens
gagauauuauuucccuuucaca

SEQ ID NO: 145122 - RNA, 22 nt, Homo sapiens
gagaucaugcugguucucucau

SEQ ID NO: 145123 - RNA, 22 nt, Homo sapiens
gagaucauguacuagaacaccu

SEQ ID NO: 145124 - RNA, 22 nt, Homo sapiens
gagaucauuaugucagggguca

SEQ ID NO: 145125 - RNA, 22 nt, Homo sapiens
gagaugaaaucuugcucuguca

SEQ ID NO: 145126 - RNA, 22 nt, Homo sapiens
gagauuaauacacaucaaaugc

SEQ ID NO: 145127 - RNA, 22 nt, Homo sapiens
gagcaaugagcugccugcugag

SEQ ID NO: 145128 - RNA, 22 nt, Homo sapiens
gagcaaugauugagccacugua

SEQ ID NO: 145129 - RNA, 22 nt, Homo sapiens
gagcacauaugacauuuucuuc

SEQ ID NO: 145130 - RNA, 22 nt, Homo sapiens
gagcucaccuuaccucuggagc

SEQ ID NO: 145131 - RNA, 22 nt, Homo sapiens
gagcucauuguugcuaaagaga

SEQ ID NO: 145132 - RNA, 22 nt, Homo sapiens
gagcuccuccccuuggcuuuca

SEQ ID NO: 145133 - RNA, 22 nt, Homo sapiens
gaggcuagauggggaugugucc

SEQ ID NO: 145134 - RNA, 22 nt, Homo sapiens
gagguaugugggcagacauuua

SEQ ID NO: 145135 - RNA, 22 nt, Homo sapiens
gaggucauguggcaggcagcca

SEQ ID NO: 145136 - RNA, 22 nt, Homo sapiens
gaggucuuacauuuuaauauuu

SEQ ID NO: 145137 - RNA, 22 nt, Homo sapiens
gaguaacauugacaacuucaug

SEQ ID NO: 145138 - RNA, 22 nt, Homo sapiens
gaguauuuuacaucguguaauu

SEQ ID NO: 145139 - RNA, 22 nt, Homo sapiens
gagugcauugguggucaggugu

SEQ ID NO: 145140 - RNA, 22 nt, Homo sapiens
gaguucaaaucucagcucuguu

SEQ ID NO: 145141 - RNA, 22 nt, Homo sapiens
gauaaauccagauucugaugua

SEQ ID NO: 145142 - RNA, 22 nt, Homo sapiens
gauaaaucuuggcuagucuaag

SEQ ID NO: 145143 - RNA, 22 nt, Homo sapiens
gaugauguuggaaacuuggugc

SEQ ID NO: 145144 - RNA, 22 nt, Homo sapiens
gaugauguuugauaaauaauaa

SEQ ID NO: 145145 - RNA, 19 nt, Homo sapiens
gaugcaaugcacugagguc

SEQ ID NO: 145146 - RNA, 22 nt, Homo sapiens
gaugcagcuaggauuugugaca

SEQ ID NO: 145147 - RNA, 22 nt, Homo sapiens
gauggaguaauguaaucuugag

SEQ ID NO: 145148 - RNA, 22 nt, Homo sapiens
gaugguuuuucuccgauuuaua

SEQ ID NO: 145149 - RNA, 22 nt, Homo sapiens
gauguguuuuaggaucucagca

SEQ ID NO: 145150 - RNA, 22 nt, Homo sapiens
gauuagaacagaagucagauua

SEQ ID NO: 145151 - RNA, 22 nt, Homo sapiens
gauuguguucauaggcauguua

SEQ ID NO: 145152 - RNA, 22 nt, Homo sapiens
gauuucaucuuuagaggaagga

SEQ ID NO: 145153 - RNA, 22 nt, Homo sapiens
gcaaaaaguagugcugguuagg

SEQ ID NO: 145154 - RNA, 22 nt, Homo sapiens
gcacaggguuacauucuaaggu

SEQ ID NO: 145155 - RNA, 22 nt, Homo sapiens
gcacauggccacuaggaauaaa

SEQ ID NO: 145156 - RNA, 22 nt, Homo sapiens
gcacauggccccaucgugccga

SEQ ID NO: 145157 - RNA, 22 nt, Homo sapiens
gcacauuacaaguauuagcuca

SEQ ID NO: 145158 - RNA, 22 nt, Homo sapiens
gcaccccuuaccgggcuggguu

SEQ ID NO: 145159 - RNA, 22 nt, Homo sapiens
gcacgugcacccacaugcacgu

SEQ ID NO: 145160 - RNA, 22 nt, Homo sapiens
gcaggcaugacauuucacucuu

SEQ ID NO: 145161 - RNA, 22 nt, Homo sapiens
gcagugcaguggcgcgaucucg

SEQ ID NO: 145162 - RNA, 22 nt, Homo sapiens
gcauaaagcuaauaagacgaag

SEQ ID NO: 145163 - RNA, 22 nt, Homo sapiens
gcaucacagggagacaggccuc

SEQ ID NO: 145164 - RNA, 22 nt, Homo sapiens
gcaugaugaauaauaucacaag

SEQ ID NO: 145165 - RNA, 22 nt, Homo sapiens
gcaugcacuguauuuaaguauc

SEQ ID NO: 145166 - RNA, 22 nt, Homo sapiens
gccagugugaugugaucauggc

SEQ ID NO: 145167 - RNA, 21 nt, Homo sapiens
gccaguguggcaauuuuucaa

SEQ ID NO: 145168 - RNA, 22 nt, Homo sapiens
gccaguguuuuauugagaauuu

SEQ ID NO: 145169 - RNA, 22 nt, Homo sapiens
gcccuguugcccaggcuggagu

SEQ ID NO: 145170 - RNA, 22 nt, Homo sapiens
gcccuguugcccugaauacaua

SEQ ID NO: 145171 - RNA, 22 nt, Homo sapiens
gcucguccccuccugacucugc

SEQ ID NO: 145172 - RNA, 22 nt, Homo sapiens
gcugacagugguuauacuuaga

SEQ ID NO: 145173 - RNA, 22 nt, Homo sapiens
gcugauguuuucagguaauucu

SEQ ID NO: 145174 - RNA, 22 nt, Homo sapiens
gcuggugacuuuaaguugaagc

SEQ ID NO: 145175 - RNA, 22 nt, Homo sapiens
gcuuugcaauggcauugaccau

SEQ ID NO: 145176 - RNA, 22 nt, Homo sapiens
ggaagguaauuggguaaugaga

SEQ ID NO: 145177 - RNA, 22 nt, Homo sapiens
ucacugugugucucuguaucug

SEQ ID NO: 145178 - RNA, 18 nt, Homo sapiens
ucacugugugucuugggu

SEQ ID NO: 145179 - RNA, 22 nt, Homo sapiens
ucagacacuguggccuuuggac

SEQ ID NO: 145180 - RNA, 22 nt, Homo sapiens
ucagauacuggugacaugaaug

SEQ ID NO: 145181 - RNA, 22 nt, Homo sapiens
ucagaugaugucccuguucuaa

SEQ ID NO: 145182 - RNA, 22 nt, Homo sapiens
ucagcaaugcugcacucuacug

SEQ ID NO: 145183 - RNA, 22 nt, Homo sapiens
ucagcacauucaaggccugccu

SEQ ID NO: 145184 - RNA, 20 nt, Homo sapiens
ucagcagucuggagcagagg

SEQ ID NO: 145185 - RNA, 22 nt, Homo sapiens
ucagcaucacaggcagugagug

SEQ ID NO: 145186 - RNA, 21 nt, Homo sapiens
ucagggaccugcuguacugau

SEQ ID NO: 145187 - RNA, 22 nt, Homo sapiens
ucagguagcauuuuggaaacag

SEQ ID NO: 145188 - RNA, 22 nt, Homo sapiens
ucagguagcuagauuaugugag

SEQ ID NO: 145189 - RNA, 22 nt, Homo sapiens
ucaguaaucuuagcugugcaga

SEQ ID NO: 145190 - RNA, 22 nt, Homo sapiens
ucaguacuuuggagcucacaua

SEQ ID NO: 145191 - RNA, 22 nt, Homo sapiens
ucagugucaucuggguuguuug

SEQ ID NO: 145192 - RNA, 22 nt, Homo sapiens
ucagugucugugcaccgcugga

SEQ ID NO: 145193 - RNA, 22 nt, Homo sapiens
ucaguguuuggaaucucaauuu

SEQ ID NO: 145194 - RNA, 22 nt, Homo sapiens
ucaguuuagguguaacggccac

SEQ ID NO: 145195 - RNA, 22 nt, Homo sapiens
ucaucagaaucccuuagggaug

SEQ ID NO: 145196 - RNA, 22 nt, Homo sapiens
ucaucagaguuuacaagcucag

SEQ ID NO: 145197 - RNA, 22 nt, Homo sapiens
ucaucaguuuuuuauaugugau

SEQ ID NO: 145198 - RNA, 22 nt, Homo sapiens
ucaugggagcccccaucaugag

SEQ ID NO: 145199 - RNA, 23 nt, Homo sapiens
ucaugguagcaccaacaauaacu

SEQ ID NO: 145200 - RNA, 22 nt, Homo sapiens
ucauuagagacagggugucacu

SEQ ID NO: 145201 - RNA, 22 nt, Homo sapiens
ucauuggauggaaugcucugua

SEQ ID NO: 145202 - RNA, 22 nt, Homo sapiens
ucauuguccaacuucuuucagu

SEQ ID NO: 145203 - RNA, 22 nt, Homo sapiens
uccacuuuugugcugaauugga

SEQ ID NO: 145204 - RNA, 22 nt, Homo sapiens
uccaguguuauaauaugcgucu

SEQ ID NO: 145205 - RNA, 22 nt, Homo sapiens
uccaguguuccucagucacccc

SEQ ID NO: 145206 - RNA, 22 nt, Homo sapiens
uccaguguuucuuccacuauuu

SEQ ID NO: 145207 - RNA, 19 nt, Homo sapiens
ucccaauguuuccaggcag

SEQ ID NO: 145208 - RNA, 22 nt, Homo sapiens
ucccagugaaaccccaccuuca

SEQ ID NO: 145209 - RNA, 22 nt, Homo sapiens
ucccaguuuuucugaauaguca

SEQ ID NO: 145210 - RNA, 22 nt, Homo sapiens
uccccaguaggcaauuaacacc

SEQ ID NO: 145211 - RNA, 22 nt, Homo sapiens
ucccugaaucucagguucugua

SEQ ID NO: 145212 - RNA, 22 nt, Homo sapiens
ucccuggagcaagagaagaagg

SEQ ID NO: 145213 - RNA, 17 nt, Homo sapiens
ucccuguuuuuucaguc

SEQ ID NO: 145214 - RNA, 22 nt, Homo sapiens
ucccuuaaugaugaacaaugag

SEQ ID NO: 145215 - RNA, 22 nt, Homo sapiens
uccucugaacuccagacccaua

SEQ ID NO: 145216 - RNA, 22 nt, Homo sapiens
uccuucaguccaguggguuuug

SEQ ID NO: 145217 - RNA, 22 nt, Homo sapiens
ucuauggauaaaaugcccucau

SEQ ID NO: 145218 - RNA, 18 nt, Homo sapiens
ucucacagcaaucuguca

SEQ ID NO: 145219 - RNA, 22 nt, Homo sapiens
ucucagugaaauaaauuauuuu

SEQ ID NO: 145220 - RNA, 20 nt, Homo sapiens
ucucauggagguagagaaua

SEQ ID NO: 145221 - RNA, 22 nt, Homo sapiens
ucucuguuuauuuuugguguau

SEQ ID NO: 145222 - RNA, 22 nt, Homo sapiens
ucugacagugagagaaaucuga

SEQ ID NO: 145223 - RNA, 22 nt, Homo sapiens
ucugacagugugaauauugacu

SEQ ID NO: 145224 - RNA, 22 nt, Homo sapiens
ucugagucaucacaaaugaugc

SEQ ID NO: 145225 - RNA, 22 nt, Homo sapiens
ucugauggaguugccagggaga

SEQ ID NO: 145226 - RNA, 22 nt, Homo sapiens
ucugccacugucauugugugau

SEQ ID NO: 145227 - RNA, 22 nt, Homo sapiens
ucuggcaagagccgagggcagu

SEQ ID NO: 145228 - RNA, 22 nt, Homo sapiens
ucuggcuucugacuuaggggac

SEQ ID NO: 145229 - RNA, 22 nt, Homo sapiens
ucugggguuuccacuuuuacuu

SEQ ID NO: 145230 - RNA, 22 nt, Homo sapiens
ucugucaaaucuuauguuguag

SEQ ID NO: 145231 - RNA, 19 nt, Homo sapiens
ucugucacuggggguauuc

SEQ ID NO: 145232 - RNA, 22 nt, Homo sapiens
ucugucuuugccuaaguuuguc

SEQ ID NO: 145233 - RNA, 22 nt, Homo sapiens
ucugugaaugaacacuugaaaa

SEQ ID NO: 145234 - RNA, 22 nt, Homo sapiens
ucuuaguuggaaugggauaagg

SEQ ID NO: 145235 - RNA, 22 nt, Homo sapiens
ucuuaguuugggguggggauag

SEQ ID NO: 145236 - RNA, 22 nt, Homo sapiens
ucuucaugcuugaaauaauagc

SEQ ID NO: 145237 - RNA, 22 nt, Homo sapiens
ucuugcuuguuguucccuucau

SEQ ID NO: 145238 - RNA, 22 nt, Homo sapiens
ucuuggguuguuggcuucuccu

SEQ ID NO: 145239 - RNA, 22 nt, Homo sapiens
ucuuggguuuguccuucuccua

SEQ ID NO: 145240 - RNA, 21 nt, Homo sapiens
ucuugguauguauuuaggagg

SEQ ID NO: 145241 - RNA, 22 nt, Homo sapiens
ucuugucacugcauccccagcu

SEQ ID NO: 145242 - RNA, 22 nt, Homo sapiens
ucuuuagguguuauaguucaag

SEQ ID NO: 145243 - RNA, 22 nt, Homo sapiens
ucuuuaguuaagggacauuuua

SEQ ID NO: 145244 - RNA, 19 nt, Homo sapiens
ucuuugaggcaucgcccuc

SEQ ID NO: 145245 - RNA, 19 nt, Homo sapiens
ucuuugcuuuucuaagagg

SEQ ID NO: 145246 - RNA, 22 nt, Homo sapiens
ucuuugguaugugcaugugcuu

SEQ ID NO: 145247 - RNA, 22 nt, Homo sapiens
ucuuuggucagaaagauuacac

SEQ ID NO: 145248 - RNA, 22 nt, Homo sapiens
ucuuugguucugugcagccuau

SEQ ID NO: 145249 - RNA, 22 nt, Homo sapiens
ucuuugguucuguuuauguaau

SEQ ID NO: 145250 - RNA, 22 nt, Homo sapiens
ucuuuugguuucuagaggccgc

SEQ ID NO: 145251 - RNA, 22 nt, Homo sapiens
ugaaaguuauauugugaaauuc

SEQ ID NO: 145252 - RNA, 22 nt, Homo sapiens
ugaaauguaaguugucuagucu

SEQ ID NO: 145253 - RNA, 22 nt, Homo sapiens
ugaaauguugggugauggaauc

SEQ ID NO: 145254 - RNA, 16 nt, Homo sapiens
ugaacagagaggauuc

SEQ ID NO: 145255 - RNA, 22 nt, Homo sapiens
ugaagcuaacuugauugugaug

SEQ ID NO: 145256 - RNA, 20 nt, Homo sapiens
ugaaggaggucauuuauacc

SEQ ID NO: 145257 - RNA, 22 nt, Homo sapiens
ugaagggcauuguuuugccaaa

SEQ ID NO: 145258 - RNA, 22 nt, Homo sapiens
ugaaguaggcauaaguuaagcu

SEQ ID NO: 145259 - RNA, 22 nt, Homo sapiens
ugaagugaagacucacagaagg

SEQ ID NO: 145260 - RNA, 22 nt, Homo sapiens
ugaauagaaguuuacuccuuuu

SEQ ID NO: 145261 - RNA, 22 nt, Homo sapiens
ugaauagacagucacugccucc

SEQ ID NO: 145262 - RNA, 22 nt, Homo sapiens
ugaauauguuaauuagcaucau

SEQ ID NO: 145263 - RNA, 22 nt, Homo sapiens
ugaaugcauggggccaagaagg

SEQ ID NO: 145264 - RNA, 22 nt, Homo sapiens
uuaaugcuuggggaguaguucu

SEQ ID NO: 145265 - RNA, 22 nt, Homo sapiens
uuacaaguggcaucucucugga

SEQ ID NO: 145266 - RNA, 22 nt, Homo sapiens
uuacagguggagaaguaaggcu

SEQ ID NO: 145267 - RNA, 22 nt, Homo sapiens
uuacaucaucacauuaguuugc

SEQ ID NO: 145268 - RNA, 19 nt, Homo sapiens
uuacauccauugcauuuca

SEQ ID NO: 145269 - RNA, 22 nt, Homo sapiens
uuacauguggugugaagaagag

SEQ ID NO: 145270 - RNA, 22 nt, Homo sapiens
uuacauugcuucaaauucagug

SEQ ID NO: 145271 - RNA, 22 nt, Homo sapiens
uuaccucuguggcucucggacu

SEQ ID NO: 145272 - RNA, 22 nt, Homo sapiens
uuacuauguuucaaagugucuc

SEQ ID NO: 145273 - RNA, 22 nt, Homo sapiens
uuagacaguggugcacugcacu

SEQ ID NO: 145274 - RNA, 22 nt, Homo sapiens
uuagcagcaucccuggccugua

SEQ ID NO: 145275 - RNA, 22 nt, Homo sapiens
uuagcccaucuugaggaaagua

SEQ ID NO: 145276 - RNA, 22 nt, Homo sapiens
uuauaacucugcagccugguau

SEQ ID NO: 145277 - RNA, 22 nt, Homo sapiens
uuauacucgucugaaugauucu

SEQ ID NO: 145278 - RNA, 22 nt, Homo sapiens
uuauccugucaguaaauauuuu

SEQ ID NO: 145279 - RNA, 22 nt, Homo sapiens
uuaugacauugacaguuuuuag

SEQ ID NO: 145280 - RNA, 22 nt, Homo sapiens
uuauuacuccuauuuuguagau

SEQ ID NO: 145281 - RNA, 22 nt, Homo sapiens
uuauuagagauauuugguuagg

SEQ ID NO: 145282 - RNA, 22 nt, Homo sapiens
uuauugcuccagaggcugauuu

SEQ ID NO: 145283 - RNA, 22 nt, Homo sapiens
uuauuguccaaguuucccuuug

SEQ ID NO: 145284 - RNA, 22 nt, Homo sapiens
uucaaaggauuuagauuagcua

SEQ ID NO: 145285 - RNA, 22 nt, Homo sapiens
uucaaaguaaaaauguguucac

SEQ ID NO: 145286 - RNA, 22 nt, Homo sapiens
uucaaguagguaggaccacagg

SEQ ID NO: 145287 - RNA, 22 nt, Homo sapiens
uucaagucaauuuuugaaugac

SEQ ID NO: 145288 - RNA, 21 nt, Homo sapiens
uucacaagggaaguagggggc

SEQ ID NO: 145289 - RNA, 22 nt, Homo sapiens
uucacagcuuaauaaggcucag

SEQ ID NO: 145290 - RNA, 22 nt, Homo sapiens
uucacagucacccuucuccaug

SEQ ID NO: 145291 - RNA, 22 nt, Homo sapiens
uucaccuguagcaugcccuugg

SEQ ID NO: 145292 - RNA, 22 nt, Homo sapiens
uucaccuugggucccacuugcu

SEQ ID NO: 145293 - RNA, 22 nt, Homo sapiens
uucacuguaaaaugaagagggu

SEQ ID NO: 145294 - RNA, 22 nt, Homo sapiens
uucacuguagccucagccucuu

SEQ ID NO: 145295 - RNA, 20 nt, Homo sapiens
uucagcaaaggaaugggagu

SEQ ID NO: 145296 - RNA, 22 nt, Homo sapiens
uucaggcuccgugccagcuccg

SEQ ID NO: 145297 - RNA, 22 nt, Homo sapiens
uucagugucauuaacacaguag

SEQ ID NO: 145298 - RNA, 22 nt, Homo sapiens
uucauacaguggcugcacucca

SEQ ID NO: 145299 - RNA, 23 nt, Homo sapiens
uucaucagggauauuggccugaa

SEQ ID NO: 145300 - RNA, 22 nt, Homo sapiens
uucauguaauauuucacagcuu

SEQ ID NO: 145301 - RNA, 22 nt, Homo sapiens
uuccaauguuccguguugcagu

SEQ ID NO: 145302 - RNA, 22 nt, Homo sapiens
uuccacaauggcugaacuaguu

SEQ ID NO: 145303 - RNA, 22 nt, Homo sapiens
uuccaguggaguaaauggacaa

SEQ ID NO: 145304 - RNA, 22 nt, Homo sapiens
uuccaugagaugcaucaaagcu

SEQ ID NO: 145305 - RNA, 22 nt, Homo sapiens
uucccagagaaaaggguuucuu

SEQ ID NO: 145306 - RNA, 22 nt, Homo sapiens
uucccguugcugugcuccugcc

SEQ ID NO: 145307 - RNA, 22 nt, Homo sapiens
uucccucagaaacacacagccc

SEQ ID NO: 145308 - RNA, 22 nt, Homo sapiens
uucccugaguaucuuaccaugg

SEQ ID NO: 145309 - RNA, 22 nt, Homo sapiens
uucccuugcaggaugaucugga

SEQ ID NO: 145310 - RNA, 20 nt, Homo sapiens
uuccuuaggcauuggaagaa

SEQ ID NO: 145311 - RNA, 22 nt, Homo sapiens
uuccuuguuuauuuacaggagg

SEQ ID NO: 145312 - RNA, 21 nt, Homo sapiens
uucuaaguaaauguuggacau

SEQ ID NO: 145313 - RNA, 22 nt, Homo sapiens
uucuacagugacugcagccaua

SEQ ID NO: 145314 - RNA, 22 nt, Homo sapiens
uucucaguuccuacuuugguga

SEQ ID NO: 145315 - RNA, 22 nt, Homo sapiens
uucuggcucaggucaacacuuc

SEQ ID NO: 145316 - RNA, 22 nt, Homo sapiens
uucuugcacugaucccauaagc

SEQ ID NO: 145317 - RNA, 22 nt, Homo sapiens
uucuugcacuuaacugacauuc

SEQ ID NO: 145318 - RNA, 22 nt, Homo sapiens
uucuuuaguucacuugcuccag

SEQ ID NO: 145319 - RNA, 21 nt, Homo sapiens
uucuuugcucaguguuagagu

SEQ ID NO: 145320 - RNA, 22 nt, Homo sapiens
uucuuugguacaagggccgacc

SEQ ID NO: 145321 - RNA, 22 nt, Homo sapiens
uugaaauguuuagaaguuugga

SEQ ID NO: 145322 - RNA, 22 nt, Homo sapiens
uugaagacuaccuaccauacuu

SEQ ID NO: 145323 - RNA, 22 nt, Homo sapiens
uugaagguaggaugugcuauca

SEQ ID NO: 145324 - RNA, 22 nt, Homo sapiens
uugaaguagcauuucaugucua

SEQ ID NO: 145325 - RNA, 22 nt, Homo sapiens
uugaauagugacuuugauucug

SEQ ID NO: 145326 - RNA, 22 nt, Homo sapiens
uugaaugaaauuggugugggga

SEQ ID NO: 145327 - RNA, 22 nt, Homo sapiens
uugaaugucuauuaaguuguuu

SEQ ID NO: 145328 - RNA, 22 nt, Homo sapiens
uugacagaccuuggucauaucc

SEQ ID NO: 145329 - RNA, 23 nt, Homo sapiens
uugacuguggguacaaugugaua

SEQ ID NO: 145330 - RNA, 22 nt, Homo sapiens
uugagauaggaacucacuaugc

SEQ ID NO: 145331 - RNA, 22 nt, Homo sapiens
uugagauggagucuugcacugu

SEQ ID NO: 145332 - RNA, 22 nt, Homo sapiens
uugagauggugccacuguacuc

SEQ ID NO: 145333 - RNA, 22 nt, Homo sapiens
uugagcaauccuccugccaugu

SEQ ID NO: 145334 - RNA, 22 nt, Homo sapiens
uugagcaaugaacgauucaggg

SEQ ID NO: 145335 - RNA, 22 nt, Homo sapiens
uugaggaggcagucugcccauu

SEQ ID NO: 145336 - RNA, 22 nt, Homo sapiens
uugaguccauucgaugcugauu

SEQ ID NO: 145337 - RNA, 22 nt, Homo sapiens
uugaguccccacacuggguccc

SEQ ID NO: 145338 - RNA, 22 nt, Homo sapiens
uugauaauguuaacuuugguca

SEQ ID NO: 145339 - RNA, 22 nt, Homo sapiens
uugauaugacuaucuuuuaugu

SEQ ID NO: 145340 - RNA, 22 nt, Homo sapiens
uugauauguggaauauuuaucu

SEQ ID NO: 145341 - RNA, 22 nt, Homo sapiens
uugaucugugucccugcccaau

SEQ ID NO: 145342 - RNA, 22 nt, Homo sapiens
uugaucuguguuagaagcuaag

SEQ ID NO: 145343 - RNA, 22 nt, Homo sapiens
uugauguccaucucuagguaaa

SEQ ID NO: 145344 - RNA, 22 nt, Homo sapiens
uugauguugaggacauaaaccu

SEQ ID NO: 145345 - RNA, 22 nt, Homo sapiens
uugcaaagaccucuucacuucc

SEQ ID NO: 145346 - RNA, 20 nt, Homo sapiens
uugcacagagaaggaggcag

SEQ ID NO: 145347 - RNA, 22 nt, Homo sapiens
uugcacauggcaggugcucaau

SEQ ID NO: 145348 - RNA, 22 nt, Homo sapiens
uugcaugucauaacugauggaa

SEQ ID NO: 145349 - RNA, 22 nt, Homo sapiens
uugccauggaguagaauugaag

SEQ ID NO: 145350 - RNA, 22 nt, Homo sapiens
uugcccuuuagguaacuauaua

SEQ ID NO: 145351 - RNA, 19 nt, Homo sapiens
aagugguuuaaacuuguau

SEQ ID NO: 145352 - RNA, 22 nt, Homo sapiens
aaguugcuuuagguaagucaau

SEQ ID NO: 145353 - RNA, 22 nt, Homo sapiens
aaguugguguaugagacagaag

SEQ ID NO: 145354 - RNA, 22 nt, Homo sapiens
aauaaguugagaugaggucaua

SEQ ID NO: 145355 - RNA, 22 nt, Homo sapiens
aauacucaguccuggugaggcu

SEQ ID NO: 145356 - RNA, 21 nt, Homo sapiens
aauacucuagguuaagagagc

SEQ ID NO: 145357 - RNA, 22 nt, Homo sapiens
aauagcacugcuaugguuugaa

SEQ ID NO: 145358 - RNA, 22 nt, Homo sapiens
aauagcuguccuuagaagugug

SEQ ID NO: 145359 - RNA, 22 nt, Homo sapiens
aauauagcuauguacaugucca

SEQ ID NO: 145360 - RNA, 22 nt, Homo sapiens
aauaucacaguuggguguacac

SEQ ID NO: 145361 - RNA, 22 nt, Homo sapiens
aaucagauuccagugguuggaa

SEQ ID NO: 145362 - RNA, 22 nt, Homo sapiens
aaucagcacacugugcuuucca

SEQ ID NO: 145363 - RNA, 22 nt, Homo sapiens
aaugacacugagcaucuuucau

SEQ ID NO: 145364 - RNA, 22 nt, Homo sapiens
aaugacuaagaugguacauuuu

SEQ ID NO: 145365 - RNA, 22 nt, Homo sapiens
aaugcacauaaaauccuccagg

SEQ ID NO: 145366 - RNA, 22 nt, Homo sapiens
aaugcuaucuggaacauuguug

SEQ ID NO: 145367 - RNA, 22 nt, Homo sapiens
aauggcucuguuggcccaagac

SEQ ID NO: 145368 - RNA, 22 nt, Homo sapiens
aaugggacugacgccucccaga

SEQ ID NO: 145369 - RNA, 22 nt, Homo sapiens
aauuaguugaaagucugcuuuu

SEQ ID NO: 145370 - RNA, 22 nt, Homo sapiens
aauuaguuggcugccuaugauu

SEQ ID NO: 145371 - RNA, 22 nt, Homo sapiens
aauugaaugcagaugccaggga

SEQ ID NO: 145372 - RNA, 22 nt, Homo sapiens
acaaaguaggcagugggcugga

SEQ ID NO: 145373 - RNA, 22 nt, Homo sapiens
acaaaguauggaauguuggugu

SEQ ID NO: 145374 - RNA, 22 nt, Homo sapiens
acaauggaauggaguggaaagu

SEQ ID NO: 145375 - RNA, 22 nt, Homo sapiens
acacaguaaauauguauugaau

SEQ ID NO: 145376 - RNA, 22 nt, Homo sapiens
acacagucaaauccacuuggcu

SEQ ID NO: 145377 - RNA, 22 nt, Homo sapiens
acacaguguuuauugugguuag

SEQ ID NO: 145378 - RNA, 22 nt, Homo sapiens
acacucucucauuacuuguuug

SEQ ID NO: 145379 - RNA, 20 nt, Homo sapiens
acacugugcuaaggauuuuc

SEQ ID NO: 145380 - RNA, 22 nt, Homo sapiens
acaguagaaaacaauggauuug

SEQ ID NO: 145381 - RNA, 21 nt, Homo sapiens
acaguaguaauaguguagcca

SEQ ID NO: 145382 - RNA, 22 nt, Homo sapiens
acagucacaauuuguaccuuuu

SEQ ID NO: 145383 - RNA, 18 nt, Homo sapiens
acagugucauggcucaau

SEQ ID NO: 145384 - RNA, 22 nt, Homo sapiens
acagugucaugucguguucccc

SEQ ID NO: 145385 - RNA, 17 nt, Homo sapiens
acagugucuaugaaaug

SEQ ID NO: 145386 - RNA, 22 nt, Homo sapiens
accaguguuuaccaaguagcau

SEQ ID NO: 145387 - RNA, 22 nt, Homo sapiens
acccaguguucaacauucacau

SEQ ID NO: 145388 - RNA, 22 nt, Homo sapiens
acccaguguugggcagaacugu

SEQ ID NO: 145389 - RNA, 22 nt, Homo sapiens
accccauuugcacugagcccuu

SEQ ID NO: 145390 - RNA, 22 nt, Homo sapiens
acccgugcucacugccucugcc

SEQ ID NO: 145391 - RNA, 21 nt, Homo sapiens
acccucuaguuuucaacaggc

SEQ ID NO: 145392 - RNA, 22 nt, Homo sapiens
acccugacacgauucuucacuu

SEQ ID NO: 145393 - RNA, 18 nt, Homo sapiens
acccuucagcacugggcc

SEQ ID NO: 145394 - RNA, 22 nt, Homo sapiens
accgaguuagccaggauggucu

SEQ ID NO: 145395 - RNA, 22 nt, Homo sapiens
acuacaugugaugucaguauau

SEQ ID NO: 145396 - RNA, 22 nt, Homo sapiens
acuaugagacgaaugcaucagu

SEQ ID NO: 145397 - RNA, 22 nt, Homo sapiens
acucuguauaaacauugcugua

SEQ ID NO: 145398 - RNA, 22 nt, Homo sapiens
acugaguguugauuuagauuaa

SEQ ID NO: 145399 - RNA, 22 nt, Homo sapiens
acugcacuccaccuugggcaac

SEQ ID NO: 145400 - RNA, 22 nt, Homo sapiens
acugcacuccagccuuggcggc

SEQ ID NO: 145401 - RNA, 22 nt, Homo sapiens
acugcacuccagccuugugaca

SEQ ID NO: 145402 - RNA, 22 nt, Homo sapiens
acugcacuccagcuuuggugac

SEQ ID NO: 145403 - RNA, 22 nt, Homo sapiens
acugcacuccaguuugggcagc

SEQ ID NO: 145404 - RNA, 22 nt, Homo sapiens
acugcacucuagcuugggugac

SEQ ID NO: 145405 - RNA, 22 nt, Homo sapiens
acuuugguuuauagaauuuagg

SEQ ID NO: 145406 - RNA, 22 nt, Homo sapiens
acuuuuugauggggagaacauu

SEQ ID NO: 145407 - RNA, 22 nt, Homo sapiens
agaaccaaucccacauggauac

SEQ ID NO: 145408 - RNA, 22 nt, Homo sapiens
agaauaauguccccccaaggga

SEQ ID NO: 145409 - RNA, 22 nt, Homo sapiens
agaauguuuuagaccaauacaa

SEQ ID NO: 145410 - RNA, 22 nt, Homo sapiens
agagaacugauuggaugugggc

SEQ ID NO: 145411 - RNA, 22 nt, Homo sapiens
agagagcuugggguguuaaauu

SEQ ID NO: 145412 - RNA, 22 nt, Homo sapiens
agagauccucauuuuauagaca

SEQ ID NO: 145413 - RNA, 22 nt, Homo sapiens
agaggaguacuacuccaagucu

SEQ ID NO: 145414 - RNA, 20 nt, Homo sapiens
agagugcuggacugaggagc

SEQ ID NO: 145415 - RNA, 22 nt, Homo sapiens
agauauguuauugauguuaaug

SEQ ID NO: 145416 - RNA, 22 nt, Homo sapiens
agaugcuguuaucaacuguagc

SEQ ID NO: 145417 - RNA, 22 nt, Homo sapiens
agauggguuuucacauguuggc

SEQ ID NO: 145418 - RNA, 22 nt, Homo sapiens
agcaagacauggcuuccaaaug

SEQ ID NO: 145419 - RNA, 22 nt, Homo sapiens
agcaagauuguucccauuuucu

SEQ ID NO: 145420 - RNA, 22 nt, Homo sapiens
agcacagugaaugguuuacuca

SEQ ID NO: 145421 - RNA, 22 nt, Homo sapiens
agcaccacauacuacagagaua

SEQ ID NO: 145422 - RNA, 22 nt, Homo sapiens
agcacgaaaccaaauucuguga

SEQ ID NO: 145423 - RNA, 22 nt, Homo sapiens
agcagcuuugcauggccugugg

SEQ ID NO: 145424 - RNA, 20 nt, Homo sapiens
agcaucauugcaauuuguca

SEQ ID NO: 145425 - RNA, 23 nt, Homo sapiens
agcccugugacucgaacgaggag

SEQ ID NO: 145426 - RNA, 23 nt, Homo sapiens
agccugguuucccugcuucuccc

SEQ ID NO: 145427 - RNA, 23 nt, Homo sapiens
agcuagagaggcuggggauacag

SEQ ID NO: 145428 - RNA, 22 nt, Homo sapiens
agcuccuuucugcagguagguu

SEQ ID NO: 145429 - RNA, 20 nt, Homo sapiens
agcugcagauauaaauccgc

SEQ ID NO: 145430 - RNA, 22 nt, Homo sapiens
agcuggauguauguuaagugaa

SEQ ID NO: 145431 - RNA, 22 nt, Homo sapiens
agcugguaguuuucuaguguuu

SEQ ID NO: 145432 - RNA, 22 nt, Homo sapiens
agcugguuuaauaugcugucug

SEQ ID NO: 145433 - RNA, 22 nt, Homo sapiens
agcuguuguuaauuaacucauu

SEQ ID NO: 145434 - RNA, 22 nt, Homo sapiens
agcuguuguucucagaggcuuu

SEQ ID NO: 145435 - RNA, 20 nt, Homo sapiens
agcuugguuuggaugaucac

SEQ ID NO: 145436 - RNA, 22 nt, Homo sapiens
agcuuuuugggaggccuuagga

SEQ ID NO: 145437 - RNA, 21 nt, Homo sapiens
aggcaagacuuuuagguuugu

SEQ ID NO: 145438 - RNA, 22 nt, Homo sapiens
augcaaggaugguuagauauau

SEQ ID NO: 145439 - RNA, 22 nt, Homo sapiens
augcacaugcgaaaacuugugu

SEQ ID NO: 145440 - RNA, 22 nt, Homo sapiens
augcacuuggcaggaugauucc

SEQ ID NO: 145441 - RNA, 22 nt, Homo sapiens
augcauaugucuuuauaguggc

SEQ ID NO: 145442 - RNA, 18 nt, Homo sapiens
augcauauuuuaaguugu

SEQ ID NO: 145443 - RNA, 22 nt, Homo sapiens
augcaugucaaauuuguagguu

SEQ ID NO: 145444 - RNA, 22 nt, Homo sapiens
augccucugacaauuggauucu

SEQ ID NO: 145445 - RNA, 22 nt, Homo sapiens
auggaagcugauuagauaguac

SEQ ID NO: 145446 - RNA, 22 nt, Homo sapiens
auggauaugcuuccaacugccu

SEQ ID NO: 145447 - RNA, 22 nt, Homo sapiens
auggcaaaaaaugcaauuacuu

SEQ ID NO: 145448 - RNA, 22 nt, Homo sapiens
auggcaauaauagcuaccauuu

SEQ ID NO: 145449 - RNA, 22 nt, Homo sapiens
auggcaaugcgaugaugacuga

SEQ ID NO: 145450 - RNA, 22 nt, Homo sapiens
auggcacagacucuuggucaag

SEQ ID NO: 145451 - RNA, 22 nt, Homo sapiens
auggcacugauggaaguaccuu

SEQ ID NO: 145452 - RNA, 22 nt, Homo sapiens
auggcauugaagaguugucccu

SEQ ID NO: 145453 - RNA, 22 nt, Homo sapiens
augguacuagaguaagaauugu

SEQ ID NO: 145454 - RNA, 21 nt, Homo sapiens
auggugagaaaguagugucaa

SEQ ID NO: 145455 - RNA, 22 nt, Homo sapiens
augguuuuacugcaaaauggga

SEQ ID NO: 145456 - RNA, 22 nt, Homo sapiens
auguccaugagcacauguauca

SEQ ID NO: 145457 - RNA, 22 nt, Homo sapiens
augugcauaugaagcacagaca

SEQ ID NO: 145458 - RNA, 22 nt, Homo sapiens
augugcuuaaaaaugcagagaa

SEQ ID NO: 145459 - RNA, 22 nt, Homo sapiens
augugcuuuuggugagagauuu

SEQ ID NO: 145460 - RNA, 22 nt, Homo sapiens
auguugcaguuuaauuauccua

SEQ ID NO: 145461 - RNA, 22 nt, Homo sapiens
auuaaauguuggacguauacau

SEQ ID NO: 145462 - RNA, 22 nt, Homo sapiens
auuaacaucuagaguuuuggug

SEQ ID NO: 145463 - RNA, 22 nt, Homo sapiens
auucacagggggagaaggguau

SEQ ID NO: 145464 - RNA, 20 nt, Homo sapiens
auuccacuuguuugagguac

SEQ ID NO: 145465 - RNA, 22 nt, Homo sapiens
auuccagauggaguugaggguu

SEQ ID NO: 145466 - RNA, 22 nt, Homo sapiens
auugaggcauguaccaaugguc

SEQ ID NO: 145467 - RNA, 22 nt, Homo sapiens
auugcacucuaaccuaggugac

SEQ ID NO: 145468 - RNA, 22 nt, Homo sapiens
auugcagauucgcuuuguguug

SEQ ID NO: 145469 - RNA, 20 nt, Homo sapiens
auugcagcaugauuuauaau

SEQ ID NO: 145470 - RNA, 22 nt, Homo sapiens
auugcagcuugcagggugugua

SEQ ID NO: 145471 - RNA, 22 nt, Homo sapiens
auugcccaggcuggagugcagu

SEQ ID NO: 145472 - RNA, 22 nt, Homo sapiens
auugcuaacugaaauaagacca

SEQ ID NO: 145473 - RNA, 22 nt, Homo sapiens
auugcucuuagaaauauuucuu

SEQ ID NO: 145474 - RNA, 22 nt, Homo sapiens
auugcuuacuaaucaucuucag

SEQ ID NO: 145475 - RNA, 22 nt, Homo sapiens
auuggugaccugcggcaguaug

SEQ ID NO: 145476 - RNA, 22 nt, Homo sapiens
auuguaauuuuagagaaagugg

SEQ ID NO: 145477 - RNA, 22 nt, Homo sapiens
auuguacuagguccuagggcuu

SEQ ID NO: 145478 - RNA, 22 nt, Homo sapiens
auuguacuccagccugggcuaa

SEQ ID NO: 145479 - RNA, 22 nt, Homo sapiens
auuguacuccagccuguggagc

SEQ ID NO: 145480 - RNA, 22 nt, Homo sapiens
auuguacuccagccuuggggac

SEQ ID NO: 145481 - RNA, 22 nt, Homo sapiens
auuguacugccccccuguugcu

SEQ ID NO: 145482 - RNA, 22 nt, Homo sapiens
auuguacuuauugccagaauuu

SEQ ID NO: 145483 - RNA, 22 nt, Homo sapiens
auugugcuaaaguaauaaguca

SEQ ID NO: 145484 - RNA, 22 nt, Homo sapiens
auuuugcauugcuguaaaggaa

SEQ ID NO: 145485 - RNA, 18 nt, Homo sapiens
auuuuugcaguccacaug

SEQ ID NO: 145486 - RNA, 22 nt, Homo sapiens
caaaggcuucugaaacugcaga

SEQ ID NO: 145487 - RNA, 22 nt, Homo sapiens
caaagugcugaaagaggccagg

SEQ ID NO: 145488 - RNA, 22 nt, Homo sapiens
caaaugcuucuauggacugucu

SEQ ID NO: 145489 - RNA, 22 nt, Homo sapiens
caacacagugaaacccgucucu

SEQ ID NO: 145490 - RNA, 22 nt, Homo sapiens
caagugacugagccgccucggc

SEQ ID NO: 145491 - RNA, 22 nt, Homo sapiens
caauacuguguugaauaagagu

SEQ ID NO: 145492 - RNA, 22 nt, Homo sapiens
caauacuguuaccugaaauagg

SEQ ID NO: 145493 - RNA, 22 nt, Homo sapiens
caaucugucuuuuagggggcca

SEQ ID NO: 145494 - RNA, 22 nt, Homo sapiens
caauggcacgaucucgucucac

SEQ ID NO: 145495 - RNA, 22 nt, Homo sapiens
caauggcacuauuggaaaaggu

SEQ ID NO: 145496 - RNA, 22 nt, Homo sapiens
cacaaaguagauuagucuucca

SEQ ID NO: 145497 - RNA, 22 nt, Homo sapiens
cacaaccuccgccuccuggguu

SEQ ID NO: 145498 - RNA, 22 nt, Homo sapiens
cacaggccugucucuuucuaac

SEQ ID NO: 145499 - RNA, 22 nt, Homo sapiens
cacagugaacugguggguuuuu

SEQ ID NO: 145500 - RNA, 22 nt, Homo sapiens
caccagguuggagugcaguggu

SEQ ID NO: 145501 - RNA, 22 nt, Homo sapiens
caccauguguucagaaggauug

SEQ ID NO: 145502 - RNA, 22 nt, Homo sapiens
cacccaguaagcaugaggcccu

SEQ ID NO: 145503 - RNA, 22 nt, Homo sapiens
cacccagucaucuuggguuuuu

SEQ ID NO: 145504 - RNA, 22 nt, Homo sapiens
cacccgugacgcugucugaaau

SEQ ID NO: 145505 - RNA, 22 nt, Homo sapiens
cacccgugcucccuccagcugc

SEQ ID NO: 145506 - RNA, 22 nt, Homo sapiens
cacugcacuccagucccgucuc

SEQ ID NO: 145507 - RNA, 22 nt, Homo sapiens
cacugcaguggaagauuaagaa

SEQ ID NO: 145508 - RNA, 22 nt, Homo sapiens
cagaaguauugguaugcucugu

SEQ ID NO: 145509 - RNA, 22 nt, Homo sapiens
cagacagugucccgagucccug

SEQ ID NO: 145510 - RNA, 22 nt, Homo sapiens
cagagagcuugcccuuguauau

SEQ ID NO: 145511 - RNA, 22 nt, Homo sapiens
cagauacuccuggucucaggag

SEQ ID NO: 145512 - RNA, 22 nt, Homo sapiens
cagaucaucuugagcuuaggaa

SEQ ID NO: 145513 - RNA, 22 nt, Homo sapiens
cagaugcaugaccugggcuugg

SEQ ID NO: 145514 - RNA, 22 nt, Homo sapiens
cagcaaaucauccuauuugagc

SEQ ID NO: 145515 - RNA, 22 nt, Homo sapiens
cagcacauagcaguugcucagu

SEQ ID NO: 145516 - RNA, 22 nt, Homo sapiens
cagcacauuacaaguacuuggu

SEQ ID NO: 145517 - RNA, 23 nt, Homo sapiens
cagcucauuuggguccccuuguc

SEQ ID NO: 145518 - RNA, 22 nt, Homo sapiens
cagcuguuguuaugucugcagg

SEQ ID NO: 145519 - RNA, 22 nt, Homo sapiens
cagcuguuguuccagucuuuua

SEQ ID NO: 145520 - RNA, 22 nt, Homo sapiens
caggaaugugaggguucccugc

SEQ ID NO: 145521 - RNA, 22 nt, Homo sapiens
cagguaagaugcuuucucuuau

SEQ ID NO: 145522 - RNA, 22 nt, Homo sapiens
cagguacauuuuaaagggcuca

SEQ ID NO: 145523 - RNA, 22 nt, Homo sapiens
cagguacuucugggcugagcag

SEQ ID NO: 145524 - RNA, 22 nt, Homo sapiens
cagguaggccaauguuuuccaa

SEQ ID NO: 145525 - RNA, 22 nt, Homo sapiens
aaacaccacgcggucccucgga

SEQ ID NO: 145526 - RNA, 22 nt, Homo sapiens
aaacugccuuccuuguaggugc

SEQ ID NO: 145527 - RNA, 22 nt, Homo sapiens
aaagagcugagaccugguggag

SEQ ID NO: 145528 - RNA, 22 nt, Homo sapiens
aaaggauucuaauggaaaugcu

SEQ ID NO: 145529 - RNA, 20 nt, Homo sapiens
aaaguaggcuaauaccaaaa

SEQ ID NO: 145530 - RNA, 22 nt, Homo sapiens
aaagucacuggagaaggaauau

SEQ ID NO: 145531 - RNA, 18 nt, Homo sapiens
aaagugaugucauucuuu

SEQ ID NO: 145532 - RNA, 22 nt, Homo sapiens
aaagugauuguaguuuuugcca

SEQ ID NO: 145533 - RNA, 22 nt, Homo sapiens
aaagugccugacucauaguuag

SEQ ID NO: 145534 - RNA, 22 nt, Homo sapiens
aaagugguuuuucagacuuuga

SEQ ID NO: 145535 - RNA, 22 nt, Homo sapiens
aaauaguagcugaaugagggaa

SEQ ID NO: 145536 - RNA, 22 nt, Homo sapiens
aaaugcacgcuacccagcuaga

SEQ ID NO: 145537 - RNA, 22 nt, Homo sapiens
aaaugcagauucugcuuagguu

SEQ ID NO: 145538 - RNA, 22 nt, Homo sapiens
aaaugcccuaaaauggagcauc

SEQ ID NO: 145539 - RNA, 19 nt, Homo sapiens
aaaugugcacuguuuucca

SEQ ID NO: 145540 - RNA, 22 nt, Homo sapiens
aaauugcauugagcugcuuauu

SEQ ID NO: 145541 - RNA, 22 nt, Homo sapiens
aacacuaucugccuuacaggga

SEQ ID NO: 145542 - RNA, 22 nt, Homo sapiens
aaccuuuagucagcucuuagga

SEQ ID NO: 145543 - RNA, 22 nt, Homo sapiens
aacugccucugacauaggcagg

SEQ ID NO: 145544 - RNA, 22 nt, Homo sapiens
aagagcauuauuuaguaauuuc

SEQ ID NO: 145545 - RNA, 22 nt, Homo sapiens
aagagcucucuguagcauguga

SEQ ID NO: 145546 - RNA, 22 nt, Homo sapiens
aagcacaauuucaccuucuugu

SEQ ID NO: 145547 - RNA, 22 nt, Homo sapiens
aagcacccagccucacgccugc

SEQ ID NO: 145548 - RNA, 22 nt, Homo sapiens
aagcaucacauaauggaucaug

SEQ ID NO: 145549 - RNA, 22 nt, Homo sapiens
aagcaucacuggaggcagccau

SEQ ID NO: 145550 - RNA, 22 nt, Homo sapiens
aagcccauuguaaguugaggag

SEQ ID NO: 145551 - RNA, 22 nt, Homo sapiens
aagcucauugagaucuauggcu

SEQ ID NO: 145552 - RNA, 22 nt, Homo sapiens
aagcuguguguaagcucucaca

SEQ ID NO: 145553 - RNA, 22 nt, Homo sapiens
aagcuuucaacuguuugccauu

SEQ ID NO: 145554 - RNA, 22 nt, Homo sapiens
aaggaauacuggugguugcuau

SEQ ID NO: 145555 - RNA, 22 nt, Homo sapiens
aaggaguagaggaauagcaaug

SEQ ID NO: 145556 - RNA, 22 nt, Homo sapiens
aaggcuauuugagaaugugugu

SEQ ID NO: 145557 - RNA, 22 nt, Homo sapiens
aagguagguuccaaaauaccua

SEQ ID NO: 145558 - RNA, 22 nt, Homo sapiens
aagguauuuuugucuauaucuu

SEQ ID NO: 145559 - RNA, 22 nt, Homo sapiens
aagguggugucagagagcuuau

SEQ ID NO: 145560 - RNA, 22 nt, Homo sapiens
aaguaucaggaauaguuauugg

SEQ ID NO: 145561 - RNA, 22 nt, Homo sapiens
aagucaugaagaggaaaggaca

SEQ ID NO: 145562 - RNA, 22 nt, Homo sapiens
aagugcaaaucuguggcugaaa

SEQ ID NO: 145563 - RNA, 20 nt, Homo sapiens
aagugcaucguugugucugc

SEQ ID NO: 145564 - RNA, 22 nt, Homo sapiens
aagugcucuugaaacugccuua

SEQ ID NO: 145565 - RNA, 22 nt, Homo sapiens
aaguguaugaaacaguccaugg

SEQ ID NO: 145566 - RNA, 22 nt, Homo sapiens
aauacugugauaucgagcgauu

SEQ ID NO: 145567 - RNA, 22 nt, Homo sapiens
aauagcacuguagauggaggaa

SEQ ID NO: 145568 - RNA, 22 nt, Homo sapiens
aauagcuguuuuuaauuccugc

SEQ ID NO: 145569 - RNA, 22 nt, Homo sapiens
aauagugcugcaaaaacauacg

SEQ ID NO: 145570 - RNA, 22 nt, Homo sapiens
aauaucacaguggguguacacc

SEQ ID NO: 145571 - RNA, 19 nt, Homo sapiens
aauauugacaguggugucu

SEQ ID NO: 145572 - RNA, 22 nt, Homo sapiens
aaugacagccagauucuucucu

SEQ ID NO: 145573 - RNA, 22 nt, Homo sapiens
aaugacucugccuaaauuucac

SEQ ID NO: 145574 - RNA, 22 nt, Homo sapiens
aaugcacauauauuuccuuauu

SEQ ID NO: 145575 - RNA, 22 nt, Homo sapiens
aauggcacaagacaugaagaag

SEQ ID NO: 145576 - RNA, 22 nt, Homo sapiens
aaugguguuuccguuaagcuga

SEQ ID NO: 145577 - RNA, 22 nt, Homo sapiens
aaugugcuucuggcugugguca

SEQ ID NO: 145578 - RNA, 22 nt, Homo sapiens
aaugugcuuucuuucacacagu

SEQ ID NO: 145579 - RNA, 22 nt, Homo sapiens
aaugugcuuugaaaagagcuga

SEQ ID NO: 145580 - RNA, 22 nt, Homo sapiens
aauugcacuggaaguaacugag

SEQ ID NO: 145581 - RNA, 22 nt, Homo sapiens
aauugcuucuguauuuuggaca

SEQ ID NO: 145582 - RNA, 22 nt, Homo sapiens
aauuguacucccauaauucccu

SEQ ID NO: 145583 - RNA, 22 nt, Homo sapiens
acaaaguguuuucugaaggccu

SEQ ID NO: 145584 - RNA, 20 nt, Homo sapiens
acaaaugcauucugugacau

SEQ ID NO: 145585 - RNA, 22 nt, Homo sapiens
acacaaugguaaguguuugugu

SEQ ID NO: 145586 - RNA, 23 nt, Homo sapiens
acacaguaaacuaaaagcuagcu

SEQ ID NO: 145587 - RNA, 22 nt, Homo sapiens
acacaguaagcacaguguagau

SEQ ID NO: 145588 - RNA, 22 nt, Homo sapiens
acacauuggcaauucuggagca

SEQ ID NO: 145589 - RNA, 22 nt, Homo sapiens
acacuauugagguuuguuugca

SEQ ID NO: 145590 - RNA, 22 nt, Homo sapiens
ucaaugcaaccuccaccucugg

SEQ ID NO: 145591 - RNA, 19 nt, Homo sapiens
ucaauucugucaauggcuu

SEQ ID NO: 145592 - RNA, 22 nt, Homo sapiens
ucacagcuaaaaugaaaguagu

SEQ ID NO: 145593 - RNA, 22 nt, Homo sapiens
ucacaguagcaaauguuagaaa

SEQ ID NO: 145594 - RNA, 22 nt, Homo sapiens
ucacaugcacaucucuggaacc

SEQ ID NO: 145595 - RNA, 22 nt, Homo sapiens
ucacauggaggugauaguugaa

SEQ ID NO: 145596 - RNA, 22 nt, Homo sapiens
ucaccaccugcugauuguagag

SEQ ID NO: 145597 - RNA, 22 nt, Homo sapiens
ucacucagaccuggugauaugc

SEQ ID NO: 145598 - RNA, 22 nt, Homo sapiens
ucacugaaacuguccuggguua

SEQ ID NO: 145599 - RNA, 22 nt, Homo sapiens
ucacugcacuucaggcuuucuc

SEQ ID NO: 145600 - RNA, 22 nt, Homo sapiens
ucacuggagauagcaaucuggu

SEQ ID NO: 145601 - RNA, 22 nt, Homo sapiens
ucacugugagaguuuauccugu

SEQ ID NO: 145602 - RNA, 22 nt, Homo sapiens
ucacugugcaugaaggaugcug

SEQ ID NO: 145603 - RNA, 22 nt, Homo sapiens
ucacugugguuugggaaagugc

SEQ ID NO: 145604 - RNA, 22 nt, Homo sapiens
ucacuguguauguauaugcagg

SEQ ID NO: 145605 - RNA, 22 nt, Homo sapiens
ucacuuugacggccaacuucua

SEQ ID NO: 145606 - RNA, 22 nt, Homo sapiens
ucagacacugagcaaacgacua

SEQ ID NO: 145607 - RNA, 18 nt, Homo sapiens
ucagagugcagacuauac

SEQ ID NO: 145608 - RNA, 22 nt, Homo sapiens
ucagaugaucugguaagaacuu

SEQ ID NO: 145609 - RNA, 23 nt, Homo sapiens
ucagguaguuucagaggaccuug

SEQ ID NO: 145610 - RNA, 22 nt, Homo sapiens
ucagguaguuugugggagauga

SEQ ID NO: 145611 - RNA, 22 nt, Homo sapiens
ucaggugcagagaagaaauggg

SEQ ID NO: 145612 - RNA, 22 nt, Homo sapiens
ucaggugcaguggcucaugcuu

SEQ ID NO: 145613 - RNA, 22 nt, Homo sapiens
ucaguaaaugcuguucucuuuu

SEQ ID NO: 145614 - RNA, 22 nt, Homo sapiens
ucaguaguaaauggauuuggaa

SEQ ID NO: 145615 - RNA, 22 nt, Homo sapiens
ucaguaguuccaguggguauuu

SEQ ID NO: 145616 - RNA, 22 nt, Homo sapiens
ucaguaguuuuuuuacuaggug

SEQ ID NO: 145617 - RNA, 22 nt, Homo sapiens
ucagucauguuuaccagacgua

SEQ ID NO: 145618 - RNA, 22 nt, Homo sapiens
ucagucuuuuuuuggcaagcau

SEQ ID NO: 145619 - RNA, 22 nt, Homo sapiens
ucagugccucaguuuuuaaaga

SEQ ID NO: 145620 - RNA, 22 nt, Homo sapiens
ucagugucugcauucuuauugu

SEQ ID NO: 145621 - RNA, 22 nt, Homo sapiens
ucauacuguugugaaacaaaac

SEQ ID NO: 145622 - RNA, 22 nt, Homo sapiens
ucauauguaugugcaauuuugu

SEQ ID NO: 145623 - RNA, 22 nt, Homo sapiens
ucaugugagcacagagcaagau

SEQ ID NO: 145624 - RNA, 22 nt, Homo sapiens
ucauugcaaucucugccucccg

SEQ ID NO: 145625 - RNA, 21 nt, Homo sapiens
ucauugggugcagcccacccu

SEQ ID NO: 145626 - RNA, 22 nt, Homo sapiens
uccagguacucagggggcugag

SEQ ID NO: 145627 - RNA, 22 nt, Homo sapiens
uccagugugcaggcaaguuuga

SEQ ID NO: 145628 - RNA, 22 nt, Homo sapiens
uccaguuuggaggcuugaugug

SEQ ID NO: 145629 - RNA, 22 nt, Homo sapiens
uccaguuuucuuuccuagggcu

SEQ ID NO: 145630 - RNA, 22 nt, Homo sapiens
ucccaagaugagaugggggcug

SEQ ID NO: 145631 - RNA, 19 nt, Homo sapiens
ucccaagaugcucauacau

SEQ ID NO: 145632 - RNA, 22 nt, Homo sapiens
ucccaguggucuugaaacaggg

SEQ ID NO: 145633 - RNA, 22 nt, Homo sapiens
uccccgaggcuggagugcagug

SEQ ID NO: 145634 - RNA, 22 nt, Homo sapiens
ucccuacuggggcacugccuag

SEQ ID NO: 145635 - RNA, 22 nt, Homo sapiens
ucccuacugggguacugccuag

SEQ ID NO: 145636 - RNA, 22 nt, Homo sapiens
ucccugaaaauuagcauuuuaa

SEQ ID NO: 145637 - RNA, 22 nt, Homo sapiens
ucccugguguuaguuuguucuu

SEQ ID NO: 145638 - RNA, 22 nt, Homo sapiens
ucccuguuguuucauaauuuua

SEQ ID NO: 145639 - RNA, 22 nt, Homo sapiens
ucccuuucuggaguuucccaag

SEQ ID NO: 145640 - RNA, 22 nt, Homo sapiens
ucccuuuguccaacggauccac

SEQ ID NO: 145641 - RNA, 22 nt, Homo sapiens
uccuuugguuauaggcaccucu

SEQ ID NO: 145642 - RNA, 22 nt, Homo sapiens
ucgcugggaagacugaaguguc

SEQ ID NO: 145643 - RNA, 22 nt, Homo sapiens
ucuaagaauucauuuauaagcc

SEQ ID NO: 145644 - RNA, 22 nt, Homo sapiens
ucuaaggcaccuagagucauca

SEQ ID NO: 145645 - RNA, 22 nt, Homo sapiens
ucucacacugaauguguguggg

SEQ ID NO: 145646 - RNA, 22 nt, Homo sapiens
ucucaguggcuuccucacuuuu

SEQ ID NO: 145647 - RNA, 20 nt, Homo sapiens
ucucauggagggaaagagca

SEQ ID NO: 145648 - RNA, 22 nt, Homo sapiens
ucucugaaacucuugacauccu

SEQ ID NO: 145649 - RNA, 22 nt, Homo sapiens
ucucugagaccacuccaaacuc

SEQ ID NO: 145650 - RNA, 19 nt, Homo sapiens
ucucugguguuggagggga

SEQ ID NO: 145651 - RNA, 22 nt, Homo sapiens
ucugagaugagacuuugaauuu

SEQ ID NO: 145652 - RNA, 22 nt, Homo sapiens
ucugagcaauaaacaacauauu

SEQ ID NO: 145653 - RNA, 22 nt, Homo sapiens
ucugagcaugcaucuugccugg

SEQ ID NO: 145654 - RNA, 22 nt, Homo sapiens
ucugagguuaaauuuuauaguu

SEQ ID NO: 145655 - RNA, 21 nt, Homo sapiens
ucugagucauucaguggccug

SEQ ID NO: 145656 - RNA, 22 nt, Homo sapiens
ucugucacugaaucccugucac

SEQ ID NO: 145657 - RNA, 22 nt, Homo sapiens
ucugugcugagaguugaaaguu

SEQ ID NO: 145658 - RNA, 18 nt, Homo sapiens
ucugugguguaaauacgu

SEQ ID NO: 145659 - RNA, 22 nt, Homo sapiens
ucugugguuguugcauggaaug

SEQ ID NO: 145660 - RNA, 22 nt, Homo sapiens
ucuguugguucuuugaggagga

SEQ ID NO: 145661 - RNA, 22 nt, Homo sapiens
ucuuugauguucugaaagaugg

SEQ ID NO: 145662 - RNA, 22 nt, Homo sapiens
ucuuuggagacaaccccagucu

SEQ ID NO: 145663 - RNA, 22 nt, Homo sapiens
ucuuuggaggcgaucuguuuga

SEQ ID NO: 145664 - RNA, 22 nt, Homo sapiens
ucuuugguauugugaauagugu

SEQ ID NO: 145665 - RNA, 22 nt, Homo sapiens
ucuuugguuagguuuaguugau

SEQ ID NO: 145666 - RNA, 22 nt, Homo sapiens
ucuuugguuucugucucuguaa

SEQ ID NO: 145667 - RNA, 22 nt, Homo sapiens
ucuuuguuagaacccucuccuu

SEQ ID NO: 145668 - RNA, 22 nt, Homo sapiens
ucuuuugggccucuugucagac

SEQ ID NO: 145669 - RNA, 22 nt, Homo sapiens
ucuuuuggguauggagccauca

SEQ ID NO: 145670 - RNA, 22 nt, Homo sapiens
ucuuuuugagucaguuucggua

SEQ ID NO: 145671 - RNA, 22 nt, Homo sapiens
ugaaaaguuguugaaggcuuca

SEQ ID NO: 145672 - RNA, 22 nt, Homo sapiens
ugaaagacugaagaauaggcau

SEQ ID NO: 145673 - RNA, 22 nt, Homo sapiens
guaauaacuguggaaaaagguu

SEQ ID NO: 145674 - RNA, 22 nt, Homo sapiens
guaaucucagcuacucgggaga

SEQ ID NO: 145675 - RNA, 22 nt, Homo sapiens
guacaugcauacaugcacaucu

SEQ ID NO: 145676 - RNA, 22 nt, Homo sapiens
guaccugggugacaggauuauu

SEQ ID NO: 145677 - RNA, 23 nt, Homo sapiens
guaguuugaugcaauccacuugu

SEQ ID NO: 145678 - RNA, 22 nt, Homo sapiens
guauggaauuugugaccuuaua

SEQ ID NO: 145679 - RNA, 22 nt, Homo sapiens
guauugcuugagcccaggaguu

SEQ ID NO: 145680 - RNA, 22 nt, Homo sapiens
gucaagagaacuuucuaucacu

SEQ ID NO: 145681 - RNA, 22 nt, Homo sapiens
gucaccauugagucauuuccuc

SEQ ID NO: 145682 - RNA, 22 nt, Homo sapiens
gucacuguuuccuauuauauuu

SEQ ID NO: 145683 - RNA, 22 nt, Homo sapiens
gucagcaaaguucuccugcaga

SEQ ID NO: 145684 - RNA, 22 nt, Homo sapiens
gucagugcauguaaacauaaaa

SEQ ID NO: 145685 - RNA, 22 nt, Homo sapiens
gucaucaucaguccucugugca

SEQ ID NO: 145686 - RNA, 22 nt, Homo sapiens
gucauugagucagggaguaucu

SEQ ID NO: 145687 - RNA, 22 nt, Homo sapiens
gucauuguguggacauggagaa

SEQ ID NO: 145688 - RNA, 22 nt, Homo sapiens
guccuguuuuuaagguucauag

SEQ ID NO: 145689 - RNA, 22 nt, Homo sapiens
gucuggagacuugggucaucaa

SEQ ID NO: 145690 - RNA, 22 nt, Homo sapiens
gucuggcaauggcagacuggca

SEQ ID NO: 145691 - RNA, 22 nt, Homo sapiens
gucugguuccugggagauuucu

SEQ ID NO: 145692 - RNA, 22 nt, Homo sapiens
gucugugguuccuaugucaccu

SEQ ID NO: 145693 - RNA, 22 nt, Homo sapiens
gucuuggagaacucagcuuggc

SEQ ID NO: 145694 - RNA, 22 nt, Homo sapiens
gucuuugaugucuaugugcuuc

SEQ ID NO: 145695 - RNA, 22 nt, Homo sapiens
gucuuuguuuggucuguaucag

SEQ ID NO: 145696 - RNA, 22 nt, Homo sapiens
gugaaagacauauaugguuuga

SEQ ID NO: 145697 - RNA, 22 nt, Homo sapiens
gugaacaagcaaaggcaggagg

SEQ ID NO: 145698 - RNA, 22 nt, Homo sapiens
gugacagaguaagacccuguau

SEQ ID NO: 145699 - RNA, 22 nt, Homo sapiens
gugacauuauuucagcuacaug

SEQ ID NO: 145700 - RNA, 22 nt, Homo sapiens
gugaccucuguugcugucacua

SEQ ID NO: 145701 - RNA, 22 nt, Homo sapiens
gugacugcauccauccaggcuu

SEQ ID NO: 145702 - RNA, 22 nt, Homo sapiens
gugagaacugcuggggccacag

SEQ ID NO: 145703 - RNA, 22 nt, Homo sapiens
gugagaggaggcagcuuuuaca

SEQ ID NO: 145704 - RNA, 22 nt, Homo sapiens
gugagaugauggguauguuaau

SEQ ID NO: 145705 - RNA, 22 nt, Homo sapiens
gugagaugugacuucugccucu

SEQ ID NO: 145706 - RNA, 22 nt, Homo sapiens
gugagcaaacuuaccuaagguu

SEQ ID NO: 145707 - RNA, 22 nt, Homo sapiens
gugagcauucaaggaaggagcu

SEQ ID NO: 145708 - RNA, 22 nt, Homo sapiens
gugaggcacugcugcuuuccag

SEQ ID NO: 145709 - RNA, 22 nt, Homo sapiens
gugaggcuuuuccuguuagacu

SEQ ID NO: 145710 - RNA, 22 nt, Homo sapiens
gugagggaugugaaaaagguca

SEQ ID NO: 145711 - RNA, 22 nt, Homo sapiens
gugagguacgugucaagaacca

SEQ ID NO: 145712 - RNA, 22 nt, Homo sapiens
gugagguauacugggaucacua

SEQ ID NO: 145713 - RNA, 22 nt, Homo sapiens
gugaugcaguacguagaggaga

SEQ ID NO: 145714 - RNA, 22 nt, Homo sapiens
gugcaaugucaggagaugcagc

SEQ ID NO: 145715 - RNA, 22 nt, Homo sapiens
gugcacauauggugcauaagug

SEQ ID NO: 145716 - RNA, 22 nt, Homo sapiens
gugcacaucuguguuccagcua

SEQ ID NO: 145717 - RNA, 22 nt, Homo sapiens
gugcaguuuuaagugaguuucu

SEQ ID NO: 145718 - RNA, 22 nt, Homo sapiens
gugcuauguuauccagcaagau

SEQ ID NO: 145719 - RNA, 22 nt, Homo sapiens
gugcuuguguuaauauguagcu

SEQ ID NO: 145720 - RNA, 22 nt, Homo sapiens
guggaaagaacacaaaauuagg

SEQ ID NO: 145721 - RNA, 22 nt, Homo sapiens
guggaagauaguguguuaaugu

SEQ ID NO: 145722 - RNA, 22 nt, Homo sapiens
guggcaugaaagcagauaccac

SEQ ID NO: 145723 - RNA, 22 nt, Homo sapiens
guggcauuucccaaaguauucu

SEQ ID NO: 145724 - RNA, 22 nt, Homo sapiens
gugggaugaucgcuugagccca

SEQ ID NO: 145725 - RNA, 22 nt, Homo sapiens
gugguucuagaauugaguaucc

SEQ ID NO: 145726 - RNA, 22 nt, Homo sapiens
gugguuuuuagauuucuacagu

SEQ ID NO: 145727 - RNA, 22 nt, Homo sapiens
guguaauacacacauauaugca

SEQ ID NO: 145728 - RNA, 22 nt, Homo sapiens
gugucaaggaugccugucaggc

SEQ ID NO: 145729 - RNA, 22 nt, Homo sapiens
guguccucgaguacacaucagg

SEQ ID NO: 145730 - RNA, 22 nt, Homo sapiens
gugucuccugccuucaugcagc

SEQ ID NO: 145731 - RNA, 18 nt, Homo sapiens
gugucugguuaugggagu

SEQ ID NO: 145732 - RNA, 20 nt, Homo sapiens
gugugcauuucagauuuugg

SEQ ID NO: 145733 - RNA, 22 nt, Homo sapiens
guuauccugucuuuacauacaa

SEQ ID NO: 145734 - RNA, 22 nt, Homo sapiens
guuaugcagcaauugauaaucu

SEQ ID NO: 145735 - RNA, 22 nt, Homo sapiens
guuccuuguagaugcuggauau

SEQ ID NO: 145736 - RNA, 22 nt, Homo sapiens
gagaugcaccuugucacguuuc

SEQ ID NO: 145737 - RNA, 22 nt, Homo sapiens
gagauggagacuuggccuuaaa

SEQ ID NO: 145738 - RNA, 22 nt, Homo sapiens
gagauggaguuucacuucgcuc

SEQ ID NO: 145739 - RNA, 22 nt, Homo sapiens
gagaugugugugauuauauaau

SEQ ID NO: 145740 - RNA, 22 nt, Homo sapiens
gagcacauguggagagucuggg

SEQ ID NO: 145741 - RNA, 22 nt, Homo sapiens
gagcucauuaaaaauguagaau

SEQ ID NO: 145742 - RNA, 22 nt, Homo sapiens
gaggaaguuuacaaagcaucug

SEQ ID NO: 145743 - RNA, 22 nt, Homo sapiens
gaggacauuaugcuaaguggaa

SEQ ID NO: 145744 - RNA, 22 nt, Homo sapiens
gagguaagagaauaaacaguuu

SEQ ID NO: 145745 - RNA, 22 nt, Homo sapiens
gagguagguuugguuacaaaag

SEQ ID NO: 145746 - RNA, 18 nt, Homo sapiens
gagguuagguucugacag

SEQ ID NO: 145747 - RNA, 22 nt, Homo sapiens
gagguuuuagugagucccacug

SEQ ID NO: 145748 - RNA, 22 nt, Homo sapiens
gaguaaaugucacuguugcugu

SEQ ID NO: 145749 - RNA, 22 nt, Homo sapiens
gagugcaauggugccaucucgg

SEQ ID NO: 145750 - RNA, 23 nt, Homo sapiens
gaguggagacucauugauuuccu

SEQ ID NO: 145751 - RNA, 22 nt, Homo sapiens
gaguuuguaaacuauucacuaa

SEQ ID NO: 145752 - RNA, 22 nt, Homo sapiens
gaguuuguacuaauuuguugua

SEQ ID NO: 145753 - RNA, 22 nt, Homo sapiens
gauacuggcuuuauagaaugau

SEQ ID NO: 145754 - RNA, 19 nt, Homo sapiens
gauaucuagggggagguuc

SEQ ID NO: 145755 - RNA, 22 nt, Homo sapiens
gaucacauggccauuucuagcu

SEQ ID NO: 145756 - RNA, 22 nt, Homo sapiens
gaucugagaaagugucauaaca

SEQ ID NO: 145757 - RNA, 22 nt, Homo sapiens
gaugcaaauuaagcuugggaca

SEQ ID NO: 145758 - RNA, 22 nt, Homo sapiens
gaugcaguaagaaugcauagcg

SEQ ID NO: 145759 - RNA, 22 nt, Homo sapiens
gauguguuuaucacccaguccu

SEQ ID NO: 145760 - RNA, 22 nt, Homo sapiens
gauguuguuuagccuuugaugu

SEQ ID NO: 145761 - RNA, 22 nt, Homo sapiens
gauuuguauuaaaagugugacg

SEQ ID NO: 145762 - RNA, 22 nt, Homo sapiens
gcacaguaggugguaggacuuu

SEQ ID NO: 145763 - RNA, 22 nt, Homo sapiens
gcagaucuucgcgguaaguguu

SEQ ID NO: 145764 - RNA, 22 nt, Homo sapiens
gcagcauuaccaagacauggca

SEQ ID NO: 145765 - RNA, 20 nt, Homo sapiens
gcaguacuuuuaguucuaag

SEQ ID NO: 145766 - RNA, 19 nt, Homo sapiens
gcaucauuaguugcuuuuc

SEQ ID NO: 145767 - RNA, 20 nt, Homo sapiens
gcaugagucuuuauaguaga

SEQ ID NO: 145768 - RNA, 22 nt, Homo sapiens
gcauggauguugauggcugcug

SEQ ID NO: 145769 - RNA, 22 nt, Homo sapiens
gcauggccuuuaaaugucacag

SEQ ID NO: 145770 - RNA, 22 nt, Homo sapiens
gcaugugaauguguaagaaaau

SEQ ID NO: 145771 - RNA, 20 nt, Homo sapiens
gccacaguuaagcuucugcc

SEQ ID NO: 145772 - RNA, 22 nt, Homo sapiens
gcccagauguuuggggucaugg

SEQ ID NO: 145773 - RNA, 22 nt, Homo sapiens
gcccagcguucagggaggggcu

SEQ ID NO: 145774 - RNA, 22 nt, Homo sapiens
gccuagagaguuaucaggcugu

SEQ ID NO: 145775 - RNA, 22 nt, Homo sapiens
gccucaguuguggccagggauu

SEQ ID NO: 145776 - RNA, 22 nt, Homo sapiens
gcucaguuuccucagcugcaaa

SEQ ID NO: 145777 - RNA, 22 nt, Homo sapiens
gcuccauuuuccauuucucuaa

SEQ ID NO: 145778 - RNA, 22 nt, Homo sapiens
gcugaaauguuuaauuugggag

SEQ ID NO: 145779 - RNA, 22 nt, Homo sapiens
gcugguauuacaggcaugagcc

SEQ ID NO: 145780 - RNA, 18 nt, Homo sapiens
gcuguugucagagcacau

SEQ ID NO: 145781 - RNA, 22 nt, Homo sapiens
gcuucauggaggcugggcgcag

SEQ ID NO: 145782 - RNA, 22 nt, Homo sapiens
ggaaagaucagcuaaauguaag

SEQ ID NO: 145783 - RNA, 22 nt, Homo sapiens
ggaaaguaacccauucucuuac

SEQ ID NO: 145784 - RNA, 19 nt, Homo sapiens
ggaaaugucuauuaagauc

SEQ ID NO: 145785 - RNA, 22 nt, Homo sapiens
ggaaauguuggugucaugaguu

SEQ ID NO: 145786 - RNA, 23 nt, Homo sapiens
ggaaauguuuaagggguugggag

SEQ ID NO: 145787 - RNA, 20 nt, Homo sapiens
ggaauagucuacacucugac

SEQ ID NO: 145788 - RNA, 22 nt, Homo sapiens
ggaauauaaaaagccccagaau

SEQ ID NO: 145789 - RNA, 17 nt, Homo sapiens
ggaaugaauuccagccc

SEQ ID NO: 145790 - RNA, 22 nt, Homo sapiens
ggaaugcagugagcauuagaua

SEQ ID NO: 145791 - RNA, 22 nt, Homo sapiens
ggaauggaacaaagucuugaaa

SEQ ID NO: 145792 - RNA, 22 nt, Homo sapiens
ggaaugggauuugaagucuggc

SEQ ID NO: 145793 - RNA, 20 nt, Homo sapiens
ggaauguuaaucuccaugau

SEQ ID NO: 145794 - RNA, 22 nt, Homo sapiens
ggacagugaaugccacuccucc

SEQ ID NO: 145795 - RNA, 22 nt, Homo sapiens
ggacaucauuaccauggaccca

SEQ ID NO: 145796 - RNA, 22 nt, Homo sapiens
ggagaucacucuuuguagcgug

SEQ ID NO: 145797 - RNA, 22 nt, Homo sapiens
ggagcaaugccucauucucacu

SEQ ID NO: 145798 - RNA, 22 nt, Homo sapiens
ggagucuugcuauguugccaag

SEQ ID NO: 145799 - RNA, 22 nt, Homo sapiens
ggagugcuguuguuacacaagg

SEQ ID NO: 145800 - RNA, 22 nt, Homo sapiens
ggaguguaguggcuccaucucg

SEQ ID NO: 145801 - RNA, 22 nt, Homo sapiens
ucaaagugacaaaguugcagca

SEQ ID NO: 145802 - RNA, 22 nt, Homo sapiens
ucaaaugaucugcccgccuugg

SEQ ID NO: 145803 - RNA, 22 nt, Homo sapiens
ucaaaugcacguagagaaaaua

SEQ ID NO: 145804 - RNA, 22 nt, Homo sapiens
ucaaaugcucuuugcagagagg

SEQ ID NO: 145805 - RNA, 22 nt, Homo sapiens
ucaacagugggcacuguaaaug

SEQ ID NO: 145806 - RNA, 22 nt, Homo sapiens
aauaagcugagagaauucuaca

SEQ ID NO: 145807 - RNA, 22 nt, Homo sapiens
aauaucuguguauagauggggg

SEQ ID NO: 145808 - RNA, 22 nt, Homo sapiens
aaucaacauuguuuuaagucaa

SEQ ID NO: 145809 - RNA, 22 nt, Homo sapiens
aaucacuaugccaugaaguaca

SEQ ID NO: 145810 - RNA, 17 nt, Homo sapiens
aaucagauuucugagga

SEQ ID NO: 145811 - RNA, 22 nt, Homo sapiens
aaucauauugucugccaagagg

SEQ ID NO: 145812 - RNA, 22 nt, Homo sapiens
aaucccuuuguccagucucuuu

SEQ ID NO: 145813 - RNA, 22 nt, Homo sapiens
aaucuguagaaggugcacauuc

SEQ ID NO: 145814 - RNA, 22 nt, Homo sapiens
aaugacagugcuaaagaacccu

SEQ ID NO: 145815 - RNA, 22 nt, Homo sapiens
aaugcaagauguuaauuauagg

SEQ ID NO: 145816 - RNA, 22 nt, Homo sapiens
aaugcacuccagccugggcgac

SEQ ID NO: 145817 - RNA, 22 nt, Homo sapiens
aauggcaaauguuuucuguuga

SEQ ID NO: 145818 - RNA, 22 nt, Homo sapiens
aauggcaucuagaguggugaau

SEQ ID NO: 145819 - RNA, 22 nt, Homo sapiens
aauucacuuguggcagauccuu

SEQ ID NO: 145820 - RNA, 22 nt, Homo sapiens
aauugaaucaugugggcagacu

SEQ ID NO: 145821 - RNA, 22 nt, Homo sapiens
aauugcaccaucuagaucaaga

SEQ ID NO: 145822 - RNA, 22 nt, Homo sapiens
aauugcauugaauuuguagcuu

SEQ ID NO: 145823 - RNA, 22 nt, Homo sapiens
acaaagcuagggaauccaucuu

SEQ ID NO: 145824 - RNA, 21 nt, Homo sapiens
acaaagcuggagggagacugc

SEQ ID NO: 145825 - RNA, 22 nt, Homo sapiens
acaagcacaaauuuaauccugu

SEQ ID NO: 145826 - RNA, 22 nt, Homo sapiens
acaauguauauuuuacuguagg

SEQ ID NO: 145827 - RNA, 22 nt, Homo sapiens
acacucuaguguucuuaaucag

SEQ ID NO: 145828 - RNA, 22 nt, Homo sapiens
acacuguauccuucuguccuuu

SEQ ID NO: 145829 - RNA, 22 nt, Homo sapiens
acacuuucuagacaagggaaua

SEQ ID NO: 145830 - RNA, 22 nt, Homo sapiens
acagauagacauauauagcuca

SEQ ID NO: 145831 - RNA, 20 nt, Homo sapiens
acagcauagccuuuuaaagc

SEQ ID NO: 145832 - RNA, 22 nt, Homo sapiens
acagccauuccagccaaauacu

SEQ ID NO: 145833 - RNA, 22 nt, Homo sapiens
acaguaaugggccccuuuuccu

SEQ ID NO: 145834 - RNA, 22 nt, Homo sapiens
augacauugaaaagcaagugga

SEQ ID NO: 145835 - RNA, 22 nt, Homo sapiens
augacauugaugcucuggcugg

SEQ ID NO: 145836 - RNA, 22 nt, Homo sapiens
augaccagagguaugauguuug

SEQ ID NO: 145837 - RNA, 22 nt, Homo sapiens
augacugucagggcagucauug

SEQ ID NO: 145838 - RNA, 19 nt, Homo sapiens
augagaacagacuccauuu

SEQ ID NO: 145839 - RNA, 22 nt, Homo sapiens
augagacaguucccuuuaucuu

SEQ ID NO: 145840 - RNA, 22 nt, Homo sapiens
augagauauguuaaaaguuaaa

SEQ ID NO: 145841 - RNA, 22 nt, Homo sapiens
augagauauuuuauaagaucau

SEQ ID NO: 145842 - RNA, 22 nt, Homo sapiens
augagaugcaagauuagauggg

SEQ ID NO: 145843 - RNA, 19 nt, Homo sapiens
augagcaauaguuuuaauc

SEQ ID NO: 145844 - RNA, 22 nt, Homo sapiens
augagcacuuguuuugggcaca

SEQ ID NO: 145845 - RNA, 22 nt, Homo sapiens
augagcucauugggugacuggg

SEQ ID NO: 145846 - RNA, 22 nt, Homo sapiens
augaggagguaugauuuucuga

SEQ ID NO: 145847 - RNA, 22 nt, Homo sapiens
augaggcacugcgcccuacuga

SEQ ID NO: 145848 - RNA, 22 nt, Homo sapiens
augaggcaggaaaggcguaucu

SEQ ID NO: 145849 - RNA, 22 nt, Homo sapiens
augagguaauaaguccuuggaa

SEQ ID NO: 145850 - RNA, 22 nt, Homo sapiens
augagguccuagccaacuuuuu

SEQ ID NO: 145851 - RNA, 22 nt, Homo sapiens
augaggugcagaggaaaugagu

SEQ ID NO: 145852 - RNA, 22 nt, Homo sapiens
augauagguuuagguuuagaca

SEQ ID NO: 145853 - RNA, 22 nt, Homo sapiens
augauauggucacccuuaugaa

SEQ ID NO: 145854 - RNA, 22 nt, Homo sapiens
augauccagugaguuucaguuc

SEQ ID NO: 145855 - RNA, 22 nt, Homo sapiens
augcaacugcacuccagccugg

SEQ ID NO: 145856 - RNA, 22 nt, Homo sapiens
augcacauggcuaacuuuuuuc

SEQ ID NO: 145857 - RNA, 22 nt, Homo sapiens
ucucuguuuagagccagcaauu

SEQ ID NO: 145858 - RNA, 22 nt, Homo sapiens
ucucuugguugaacaguuugga

SEQ ID NO: 145859 - RNA, 22 nt, Homo sapiens
ucugacucuggagucucagguu

SEQ ID NO: 145860 - RNA, 22 nt, Homo sapiens
ucugagcaauagauguggauau

SEQ ID NO: 145861 - RNA, 22 nt, Homo sapiens
ucugagguaggugcauggauac

SEQ ID NO: 145862 - RNA, 22 nt, Homo sapiens
ucugaguggcagaaugagcuga

SEQ ID NO: 145863 - RNA, 22 nt, Homo sapiens
ucuguuguuguuuuaagagaca

SEQ ID NO: 145864 - RNA, 22 nt, Homo sapiens
ucuugcaguucccaaauucaca

SEQ ID NO: 145865 - RNA, 20 nt, Homo sapiens
ucuugggaauguagccuagg

SEQ ID NO: 145866 - RNA, 22 nt, Homo sapiens
ucuugguuuauugauggagagg

SEQ ID NO: 145867 - RNA, 22 nt, Homo sapiens
ucuuugagugcccugagucccu

SEQ ID NO: 145868 - RNA, 22 nt, Homo sapiens
ucuuugauaagauccagaagaa

SEQ ID NO: 145869 - RNA, 22 nt, Homo sapiens
ucuuuggcugugaagaauaaug

SEQ ID NO: 145870 - RNA, 19 nt, Homo sapiens
ucuuugguacgugcuuuga

SEQ ID NO: 145871 - RNA, 22 nt, Homo sapiens
ucuuugguagaagcuauuuuau

SEQ ID NO: 145872 - RNA, 22 nt, Homo sapiens
ucuuugguaggaguaggaggcc

SEQ ID NO: 145873 - RNA, 22 nt, Homo sapiens
ucuuugguauuuguggggaauu

SEQ ID NO: 145874 - RNA, 21 nt, Homo sapiens
ucuuuggucaccaguuuucau

SEQ ID NO: 145875 - RNA, 22 nt, Homo sapiens
ucuuuguguucaggagccacgu

SEQ ID NO: 145876 - RNA, 20 nt, Homo sapiens
ucuuuuuguggccccagagu

SEQ ID NO: 145877 - RNA, 22 nt, Homo sapiens
ugaaauguguuaucugggccug

SEQ ID NO: 145878 - RNA, 22 nt, Homo sapiens
ugaacagagaaacacuggccau

SEQ ID NO: 145879 - RNA, 22 nt, Homo sapiens
ugaauaggcaguuaaguuuaug

SEQ ID NO: 145880 - RNA, 22 nt, Homo sapiens
ugaauagugucacaauaaacau

SEQ ID NO: 145881 - RNA, 22 nt, Homo sapiens
ugaauguuguugguugagauau

SEQ ID NO: 145882 - RNA, 22 nt, Homo sapiens
ugaauuguuucauucuuuacau

SEQ ID NO: 145883 - RNA, 22 nt, Homo sapiens
ugacaagaaagcgucuucuuuu

SEQ ID NO: 145884 - RNA, 22 nt, Homo sapiens
ugacacagugggggauccuuuu

SEQ ID NO: 145885 - RNA, 22 nt, Homo sapiens
ugacagagcaggacuucaucuc

SEQ ID NO: 145886 - RNA, 18 nt, Homo sapiens
ugacagcacaugugggga

SEQ ID NO: 145887 - RNA, 22 nt, Homo sapiens
ugacaggauggagaucgguauu

SEQ ID NO: 145888 - RNA, 22 nt, Homo sapiens
ugacaggucuaauuuacugaca

SEQ ID NO: 145889 - RNA, 23 nt, Homo sapiens
ugacagugcuugaaauugcucuu

SEQ ID NO: 145890 - RNA, 22 nt, Homo sapiens
ugacaucugcuugugcccagga

SEQ ID NO: 145891 - RNA, 22 nt, Homo sapiens
uugcagagaaauuucugguuua

SEQ ID NO: 145892 - RNA, 22 nt, Homo sapiens
uugcagcaacauggaugaaacu

SEQ ID NO: 145893 - RNA, 19 nt, Homo sapiens
uugcauagguugaaccagc

SEQ ID NO: 145894 - RNA, 22 nt, Homo sapiens
uugcuacauugauugccucuuu

SEQ ID NO: 145895 - RNA, 22 nt, Homo sapiens
uuggaagacaaugcugauucuc

SEQ ID NO: 145896 - RNA, 22 nt, Homo sapiens
uuggaauacuuguuaaagucca

SEQ ID NO: 145897 - RNA, 22 nt, Homo sapiens
uuggacugagaguuccaccauu

SEQ ID NO: 145898 - RNA, 22 nt, Homo sapiens
uuggagagaaaggcaguuccug

SEQ ID NO: 145899 - RNA, 22 nt, Homo sapiens
uuggauccauccugucuucucu

SEQ ID NO: 145900 - RNA, 22 nt, Homo sapiens
uuggauggugauaugguuugga

SEQ ID NO: 145901 - RNA, 22 nt, Homo sapiens
uuggcaaagaggaaugccacuu

SEQ ID NO: 145902 - RNA, 22 nt, Homo sapiens
uuggcaauugcuaugauuugaa

SEQ ID NO: 145903 - RNA, 22 nt, Homo sapiens
uuggcagcuguggaaucugggc

SEQ ID NO: 145904 - RNA, 22 nt, Homo sapiens
uuggcaguaucuacuacagcua

SEQ ID NO: 145905 - RNA, 23 nt, Homo sapiens
uuggcaucugggacacaagcuga

SEQ ID NO: 145906 - RNA, 22 nt, Homo sapiens
uuggcuuaguugaccacagucu

SEQ ID NO: 145907 - RNA, 22 nt, Homo sapiens
uugggcuugagggugcccaguc

SEQ ID NO: 145908 - RNA, 22 nt, Homo sapiens
uugggguagaauugcaacauau

SEQ ID NO: 145909 - RNA, 22 nt, Homo sapiens
uuggucaggcuaaucucgaacg

SEQ ID NO: 145910 - RNA, 22 nt, Homo sapiens
uugguccccacuccccugccaa

SEQ ID NO: 145911 - RNA, 22 nt, Homo sapiens
uugguccccuucaaccagcugu

SEQ ID NO: 145912 - RNA, 22 nt, Homo sapiens
uuguaguagcauuauuuauaau

SEQ ID NO: 145913 - RNA, 22 nt, Homo sapiens
uugucacucuuccuaggguagg

SEQ ID NO: 145914 - RNA, 22 nt, Homo sapiens
uuguccuccacauuugaucagu

SEQ ID NO: 145915 - RNA, 22 nt, Homo sapiens
uugugaauggugcugcaguaaa

SEQ ID NO: 145916 - RNA, 22 nt, Homo sapiens
uugugacacagcugggccuaua

SEQ ID NO: 145917 - RNA, 22 nt, Homo sapiens
uugugauggugcauacugagcu

SEQ ID NO: 145918 - RNA, 22 nt, Homo sapiens
uugugcuuguaacuacauucag

SEQ ID NO: 145919 - RNA, 22 nt, Homo sapiens
uugugcuuuuuaaauagcuucc

SEQ ID NO: 145920 - RNA, 22 nt, Homo sapiens
uugugguuuucagcuuauauau

SEQ ID NO: 145921 - RNA, 19 nt, Homo sapiens
uuguguccccacaaaauuc

SEQ ID NO: 145922 - RNA, 22 nt, Homo sapiens
uuguguuuuuaguagggaaggg

SEQ ID NO: 145923 - RNA, 22 nt, Homo sapiens
uuguuauguaucucaagauaaa

SEQ ID NO: 145924 - RNA, 22 nt, Homo sapiens
uuguucccuucuggcuuuuaug

SEQ ID NO: 145925 - RNA, 22 nt, Homo sapiens
uuguugcacugcuuuccuggcc

SEQ ID NO: 145926 - RNA, 17 nt, Homo sapiens
uuuaaugcuaggacucu

SEQ ID NO: 145927 - RNA, 22 nt, Homo sapiens
uuuacagucuuuugugugaguc

SEQ ID NO: 145928 - RNA, 21 nt, Homo sapiens
uuuacuguggacccauugcuu

SEQ ID NO: 145929 - RNA, 22 nt, Homo sapiens
uuuauugcucuaaaguugccau

SEQ ID NO: 145930 - RNA, 22 nt, Homo sapiens
uuucacagagggcuucuuucua

SEQ ID NO: 145931 - RNA, 22 nt, Homo sapiens
uuucacagcugucuuccgucuc

SEQ ID NO: 145932 - RNA, 22 nt, Homo sapiens
uuucaggcaagggugacccuga

SEQ ID NO: 145933 - RNA, 23 nt, Homo sapiens
uuucaggcaggugaaagaccagc

SEQ ID NO: 145934 - RNA, 19 nt, Homo sapiens
uuucauguuuuuggugaga

SEQ ID NO: 145935 - RNA, 22 nt, Homo sapiens
cuugcagagcccauggauguca

SEQ ID NO: 145936 - RNA, 22 nt, Homo sapiens
cuuuaugagguuggauggaucu

SEQ ID NO: 145937 - RNA, 22 nt, Homo sapiens
cuuucacacuguuggugggaau

SEQ ID NO: 145938 - RNA, 22 nt, Homo sapiens
cuuuccauuguuggagcauaaa

SEQ ID NO: 145939 - RNA, 21 nt, Homo sapiens
cuuugcacugcuccucagcuc

SEQ ID NO: 145940 - RNA, 22 nt, Homo sapiens
cuuuggcaaugucauuuucaau

SEQ ID NO: 145941 - RNA, 22 nt, Homo sapiens
cuuuguaugucaugacaacugu

SEQ ID NO: 145942 - RNA, 22 nt, Homo sapiens
cuuuuacacugcuggugggaau

SEQ ID NO: 145943 - RNA, 22 nt, Homo sapiens
cuuuuacacuguuggugggaau

SEQ ID NO: 145944 - RNA, 22 nt, Homo sapiens
cuuuuguggaucuucuguugcu

SEQ ID NO: 145945 - RNA, 22 nt, Homo sapiens
cuuuuugcaaauacaacucuga

SEQ ID NO: 145946 - RNA, 22 nt, Homo sapiens
gaaacugcauuucuaacaagcu

SEQ ID NO: 145947 - RNA, 22 nt, Homo sapiens
gaaagguaggaacagggugcag

SEQ ID NO: 145948 - RNA, 23 nt, Homo sapiens
gaaauguaagugaugccccacag

SEQ ID NO: 145949 - RNA, 22 nt, Homo sapiens
gaaauguauuaaugaguugaaa

SEQ ID NO: 145950 - RNA, 22 nt, Homo sapiens
gaaauguugauagugggcauug

SEQ ID NO: 145951 - RNA, 22 nt, Homo sapiens
gaacuggcuuagugaaacuucc

SEQ ID NO: 145952 - RNA, 22 nt, Homo sapiens
gaacuguuucuggugaaagagu

SEQ ID NO: 145953 - RNA, 22 nt, Homo sapiens
cacugcgacguccgccucccgg

SEQ ID NO: 145954 - RNA, 23 nt, Homo sapiens
cacugggcagcagguguucccag

SEQ ID NO: 145955 - RNA, 22 nt, Homo sapiens
cacugggccaucacuuaauauu

SEQ ID NO: 145956 - RNA, 22 nt, Homo sapiens
cagagguaagcaagucagcauu

SEQ ID NO: 145957 - RNA, 22 nt, Homo sapiens
cagagguauugcaaaagccuag

SEQ ID NO: 145958 - RNA, 22 nt, Homo sapiens
cagcccuacacagacugacuca

SEQ ID NO: 145959 - RNA, 22 nt, Homo sapiens
cagcuggugggagcuggguucc

SEQ ID NO: 145960 - RNA, 22 nt, Homo sapiens
cagcugguguuacaaaccagag

SEQ ID NO: 145961 - RNA, 22 nt, Homo sapiens
caggcauuguauuguaaucccc

SEQ ID NO: 145962 - RNA, 22 nt, Homo sapiens
cagucacagugacaggaugugg

SEQ ID NO: 145963 - RNA, 20 nt, Homo sapiens
cagugcaccuggcguguuga

SEQ ID NO: 145964 - RNA, 22 nt, Homo sapiens
caguguuuuuaacaggugcccg

SEQ ID NO: 145965 - RNA, 22 nt, Homo sapiens
caguuguuuuaugacauaagau

SEQ ID NO: 145966 - RNA, 21 nt, Homo sapiens
cauaaugcuacuuauuuuaug

SEQ ID NO: 145967 - RNA, 22 nt, Homo sapiens
cauagcacugagcucuacccuc

SEQ ID NO: 145968 - RNA, 23 nt, Homo sapiens
caucacagagccuuccuugacuc

SEQ ID NO: 145969 - RNA, 22 nt, Homo sapiens
caucccugucgucaagucucug

SEQ ID NO: 145970 - RNA, 19 nt, Homo sapiens
caugccacugcacuugagu

SEQ ID NO: 145971 - RNA, 22 nt, Homo sapiens
caugccacuguggacaaagaca

SEQ ID NO: 145972 - RNA, 22 nt, Homo sapiens
cauggcaucuguguggccucca

SEQ ID NO: 145973 - RNA, 22 nt, Homo sapiens
cauggcucuuguuuacucccag

SEQ ID NO: 145974 - RNA, 22 nt, Homo sapiens
ugccaagaacauuuucuguuuu

SEQ ID NO: 145975 - RNA, 22 nt, Homo sapiens
ugccagaugcuggugugagggg

SEQ ID NO: 145976 - RNA, 22 nt, Homo sapiens
ugccaguguugccuuucacuag

SEQ ID NO: 145977 - RNA, 22 nt, Homo sapiens
ugccuaguagaaggugaacaug

SEQ ID NO: 145978 - RNA, 22 nt, Homo sapiens
ugccugcugucuaauauauucu

SEQ ID NO: 145979 - RNA, 22 nt, Homo sapiens
ugcgccauugcauuccagccug

SEQ ID NO: 145980 - RNA, 22 nt, Homo sapiens
ugcuaucauugauuagugaugu

SEQ ID NO: 145981 - RNA, 22 nt, Homo sapiens
ugcuaugucagccaggcugguc

SEQ ID NO: 145982 - RNA, 22 nt, Homo sapiens
ugcuggugucaucaaggcuuug

SEQ ID NO: 145983 - RNA, 21 nt, Homo sapiens
ugcuuuggucauacuucuucc

SEQ ID NO: 145984 - RNA, 23 nt, Homo sapiens
uggaacugaauuucuuagcauuu

SEQ ID NO: 145985 - RNA, 22 nt, Homo sapiens
uggaagugucugugcccagcuc

SEQ ID NO: 145986 - RNA, 22 nt, Homo sapiens
uggaaguuaaaugacucuuucu

SEQ ID NO: 145987 - RNA, 22 nt, Homo sapiens
uggaaugcucuccccacggacu

SEQ ID NO: 145988 - RNA, 22 nt, Homo sapiens
uggaaugguaucuuguuggggu

SEQ ID NO: 145989 - RNA, 22 nt, Homo sapiens
uggaaugucuauguuuuugauu

SEQ ID NO: 145990 - RNA, 22 nt, Homo sapiens
uggaauguggacucuuaugggg

SEQ ID NO: 145991 - RNA, 22 nt, Homo sapiens
uggaauguuuaucaaaacagua

SEQ ID NO: 145992 - RNA, 20 nt, Homo sapiens
uggaccagagagguggggac

SEQ ID NO: 145993 - RNA, 22 nt, Homo sapiens
uggacugagauuucagcugcca

SEQ ID NO: 145994 - RNA, 22 nt, Homo sapiens
uggagacaaagauagaaaagca

SEQ ID NO: 145995 - RNA, 22 nt, Homo sapiens
uggagcccuaaacuucuaauau

SEQ ID NO: 145996 - RNA, 22 nt, Homo sapiens
uggagggcuagucauuucuuuu

SEQ ID NO: 145997 - RNA, 22 nt, Homo sapiens
uggagguagacauugggaagag

SEQ ID NO: 145998 - RNA, 22 nt, Homo sapiens
uggagugagaacuucaaugaug

SEQ ID NO: 145999 - RNA, 22 nt, Homo sapiens
uggauauguucuuuguguaagg

SEQ ID NO: 146000 - RNA, 22 nt, Homo sapiens
uggauauguuuauauguugucu

SEQ ID NO: 146001 - RNA, 22 nt, Homo sapiens
uggauuuuaauuauucugucau

SEQ ID NO: 146002 - RNA, 22 nt, Homo sapiens
uggcaaaugaaagaaagccagu

SEQ ID NO: 146003 - RNA, 20 nt, Homo sapiens
uggcaagugggaauuguggg

SEQ ID NO: 146004 - RNA, 18 nt, Homo sapiens
uggcaaguuuaguagcac

SEQ ID NO: 146005 - RNA, 22 nt, Homo sapiens
uggcaguuucacauggcucaac

SEQ ID NO: 146006 - RNA, 19 nt, Homo sapiens
uggcaugaaugugaacuaa

SEQ ID NO: 146007 - RNA, 22 nt, Homo sapiens
uggcaugauccuagauucaaca

SEQ ID NO: 146008 - RNA, 22 nt, Homo sapiens
uggcaugucagguuucuggguu

SEQ ID NO: 146009 - RNA, 23 nt, Homo sapiens
uggccaagauaaucucaguuuuc

SEQ ID NO: 146010 - RNA, 22 nt, Homo sapiens
uggcuuuuauuauguugaggua

SEQ ID NO: 146011 - RNA, 22 nt, Homo sapiens
ugggaagcugcugaacuacagu

SEQ ID NO: 146012 - RNA, 22 nt, Homo sapiens
ugggguaggcuguauacucugu

SEQ ID NO: 146013 - RNA, 23 nt, Homo sapiens
ugggucaguuuuucugacaucau

SEQ ID NO: 146014 - RNA, 22 nt, Homo sapiens
ugggugugaccgcucaaggggg

SEQ ID NO: 146015 - RNA, 22 nt, Homo sapiens
ugguacugucucuauuuuguag

SEQ ID NO: 146016 - RNA, 22 nt, Homo sapiens
ugguauguguucuaaaauuaug

SEQ ID NO: 146017 - RNA, 20 nt, Homo sapiens
uggucaccuucaggagguuc

SEQ ID NO: 146018 - RNA, 19 nt, Homo sapiens
uggucaguucugggagcug

SEQ ID NO: 146019 - RNA, 22 nt, Homo sapiens
uggucauggaaauagaaugcac

SEQ ID NO: 146020 - RNA, 22 nt, Homo sapiens
uggucauggggcagcugacacu

SEQ ID NO: 146021 - RNA, 22 nt, Homo sapiens
ugguccacuaacccucaguauc

SEQ ID NO: 146022 - RNA, 20 nt, Homo sapiens
ugguccccugagucuggcuu

SEQ ID NO: 146023 - RNA, 22 nt, Homo sapiens
uggugagaaaagaugucuuugu

SEQ ID NO: 146024 - RNA, 22 nt, Homo sapiens
uguaagcauugggcaugcaguc

SEQ ID NO: 146025 - RNA, 22 nt, Homo sapiens
uguagacagcacguaguugagu

SEQ ID NO: 146026 - RNA, 22 nt, Homo sapiens
uguagcacauuugaagagaagc

SEQ ID NO: 146027 - RNA, 22 nt, Homo sapiens
uguauguaaagacaggauaaca

SEQ ID NO: 146028 - RNA, 22 nt, Homo sapiens
uguauguugggucaaaguacau

SEQ ID NO: 146029 - RNA, 22 nt, Homo sapiens
ugucaaaugcagugauauuuga

SEQ ID NO: 146030 - RNA, 22 nt, Homo sapiens
ugucaggagcaaugauaaauuu

SEQ ID NO: 146031 - RNA, 22 nt, Homo sapiens
ugucaggaggguccagagaaaa

SEQ ID NO: 146032 - RNA, 22 nt, Homo sapiens
ugucaguuucaguguuagccuu

SEQ ID NO: 146033 - RNA, 22 nt, Homo sapiens
ugucaguuucccuccucuuccu

SEQ ID NO: 146034 - RNA, 19 nt, Homo sapiens
ugucaucaucuuuucuugc

SEQ ID NO: 146035 - RNA, 22 nt, Homo sapiens
ugucaugucaacuauggaauuu

SEQ ID NO: 146036 - RNA, 22 nt, Homo sapiens
ugucuacugaugauguaguuaa

SEQ ID NO: 146037 - RNA, 22 nt, Homo sapiens
ugucucaguucccuucucugga

SEQ ID NO: 146038 - RNA, 22 nt, Homo sapiens
ugucuuggagaauccuggguuu

SEQ ID NO: 146039 - RNA, 22 nt, Homo sapiens
ugucuuuguuaguuguccuagu

SEQ ID NO: 146040 - RNA, 22 nt, Homo sapiens
ugugaacagcuccaaaugugga

SEQ ID NO: 146041 - RNA, 22 nt, Homo sapiens
ugugaagauggacuaauauagu

SEQ ID NO: 146042 - RNA, 22 nt, Homo sapiens
ugugacagguagguaauuuuug

SEQ ID NO: 146043 - RNA, 21 nt, Homo sapiens
ugugacuguugcauuugucgu

SEQ ID NO: 146044 - RNA, 22 nt, Homo sapiens
ugugauagagaaugguggagaa

SEQ ID NO: 146045 - RNA, 17 nt, Homo sapiens
ugugaucaucacccuug

SEQ ID NO: 146046 - RNA, 16 nt, Homo sapiens
ugugaucuuuuuucuu

SEQ ID NO: 146047 - RNA, 22 nt, Homo sapiens
ugugccacuccagcucuagcuu

SEQ ID NO: 146048 - RNA, 22 nt, Homo sapiens
uguggcuuuguaaccauggguc

SEQ ID NO: 146049 - RNA, 22 nt, Homo sapiens
uguggcuuuuucuuggcugagg

SEQ ID NO: 146050 - RNA, 22 nt, Homo sapiens
uguuacagcagaauugaaagag

SEQ ID NO: 146051 - RNA, 22 nt, Homo sapiens
uguuauguauggagugauccca

SEQ ID NO: 146052 - RNA, 22 nt, Homo sapiens
uguuauugagguuacuuauaag

SEQ ID NO: 146053 - RNA, 22 nt, Homo sapiens
uguuucuacugucucuguagua

SEQ ID NO: 146054 - RNA, 22 nt, Homo sapiens
uuaaaaguauaggccuggcaua

SEQ ID NO: 146055 - RNA, 22 nt, Homo sapiens
uuaaaugcacauacuugagaaa

SEQ ID NO: 146056 - RNA, 22 nt, Homo sapiens
uuaaaugcauagaauguguagu

SEQ ID NO: 146057 - RNA, 22 nt, Homo sapiens
uuaaaugcuagaauuuucuuug

SEQ ID NO: 146058 - RNA, 22 nt, Homo sapiens
uuaacagugucaaucuguagua

SEQ ID NO: 146059 - RNA, 22 nt, Homo sapiens
uuaagucacacuagacaacuga

SEQ ID NO: 146060 - RNA, 19 nt, Homo sapiens
uuaagugugauaucucagu

SEQ ID NO: 146061 - RNA, 22 nt, Homo sapiens
uuaaguuguagcuacaaauaca

SEQ ID NO: 146062 - RNA, 21 nt, Homo sapiens
uuaaugcuaugcagaaaaucu

SEQ ID NO: 146063 - RNA, 17 nt, Homo sapiens
uuacaggugcugagagu

SEQ ID NO: 146064 - RNA, 20 nt, Homo sapiens
uuacagugggaccuuccuga

SEQ ID NO: 146065 - RNA, 22 nt, Homo sapiens
uuacuugagauggggugucacu

SEQ ID NO: 146066 - RNA, 22 nt, Homo sapiens
uuagaaaguagaaaagcugguu

SEQ ID NO: 146067 - RNA, 17 nt, Homo sapiens
uuagacagacauccugc

SEQ ID NO: 146068 - RNA, 22 nt, Homo sapiens
uuagaugaaugucucuuaaaca

SEQ ID NO: 146069 - RNA, 22 nt, Homo sapiens
uuagcacaguucauucauguua

SEQ ID NO: 146070 - RNA, 22 nt, Homo sapiens
uuagcacaucuuucuauguaag

SEQ ID NO: 146071 - RNA, 22 nt, Homo sapiens
uuaggcaguuuauugauuuuca

SEQ ID NO: 146072 - RNA, 22 nt, Homo sapiens
uuaguucccucauucuugacuu

SEQ ID NO: 146073 - RNA, 18 nt, Homo sapiens
uuauaugcauguguagga

SEQ ID NO: 146074 - RNA, 22 nt, Homo sapiens
uuauauguuacucccucuagca

SEQ ID NO: 146075 - RNA, 22 nt, Homo sapiens
uuauguaaaucaaucuggaauc

SEQ ID NO: 146076 - RNA, 22 nt, Homo sapiens
uuauguguuuaauguuucugaa

SEQ ID NO: 146077 - RNA, 22 nt, Homo sapiens
uuauugcuuuugugcaggugag

SEQ ID NO: 146078 - RNA, 23 nt, Homo sapiens
uucaaaggaugcuuuauggaauu

SEQ ID NO: 146079 - RNA, 22 nt, Homo sapiens
uucaaaguuggaggacaaacug

SEQ ID NO: 146080 - RNA, 22 nt, Homo sapiens
uucaaaucuucguuuugccaua

SEQ ID NO: 146081 - RNA, 22 nt, Homo sapiens
uucacagacaacuggucccuua

SEQ ID NO: 146082 - RNA, 22 nt, Homo sapiens
uucaccuugcccacagcagucu

SEQ ID NO: 146083 - RNA, 22 nt, Homo sapiens
uucacuggagcccaggaguugg

SEQ ID NO: 146084 - RNA, 22 nt, Homo sapiens
uucagguacuauaggcuguugg

SEQ ID NO: 146085 - RNA, 22 nt, Homo sapiens
uucagguaguuuaacuguucca

SEQ ID NO: 146086 - RNA, 22 nt, Homo sapiens
uucaguucugcucugaucuuag

SEQ ID NO: 146087 - RNA, 22 nt, Homo sapiens
uucauaguaacaguaacuaugg

SEQ ID NO: 146088 - RNA, 22 nt, Homo sapiens
uucauagucuaauuuuuuccac

SEQ ID NO: 146089 - RNA, 22 nt, Homo sapiens
uucauagugaaaaauucaaagu

SEQ ID NO: 146090 - RNA, 22 nt, Homo sapiens
uucaucaggaauauugaccugu

SEQ ID NO: 146091 - RNA, 22 nt, Homo sapiens
uucaucagggagaaauaauuuc

SEQ ID NO: 146092 - RNA, 22 nt, Homo sapiens
uucaucaguuauauuggccuga

SEQ ID NO: 146093 - RNA, 22 nt, Homo sapiens
uucaugcaucuguagugguuaa

SEQ ID NO: 146094 - RNA, 20 nt, Homo sapiens
uucaugggagcaaagaggcc

SEQ ID NO: 146095 - RNA, 22 nt, Homo sapiens
uuccacaggguugaacuaguuu

SEQ ID NO: 146096 - RNA, 23 nt, Homo sapiens
uuccaccauugacuaguuacaua

SEQ ID NO: 146097 - RNA, 22 nt, Homo sapiens
uuccaggugggcgugggccugg

SEQ ID NO: 146098 - RNA, 22 nt, Homo sapiens
uucccagagagggacuucuaau

SEQ ID NO: 146099 - RNA, 22 nt, Homo sapiens
uucccagagccugggagugagg

SEQ ID NO: 146100 - RNA, 22 nt, Homo sapiens
uucccaguaaacucuaucccuc

SEQ ID NO: 146101 - RNA, 22 nt, Homo sapiens
uucccagugccaggcacuggga

SEQ ID NO: 146102 - RNA, 22 nt, Homo sapiens
uucccaguggaacauguaguca

SEQ ID NO: 146103 - RNA, 22 nt, Homo sapiens
uucccaguuggggaaagcgacc

SEQ ID NO: 146104 - RNA, 22 nt, Homo sapiens
uucccugugggcuggugcucca

SEQ ID NO: 146105 - RNA, 22 nt, Homo sapiens
uucccuuugaaacuaaacuugc

SEQ ID NO: 146106 - RNA, 22 nt, Homo sapiens
uucccuuuguuaaauuggaaga

SEQ ID NO: 146107 - RNA, 22 nt, Homo sapiens
uucccuuuuuucuaguagguag

SEQ ID NO: 146108 - RNA, 22 nt, Homo sapiens
uuccuguagcgauuuuaguaau

SEQ ID NO: 146109 - RNA, 22 nt, Homo sapiens
uuccuugagucuuuuuccugag

SEQ ID NO: 146110 - RNA, 22 nt, Homo sapiens
uucuaguacucccuggagcugg

SEQ ID NO: 146111 - RNA, 21 nt, Homo sapiens
uucucaggguguguccuaccc

SEQ ID NO: 146112 - RNA, 22 nt, Homo sapiens
uucucugggacauaggucgggu

SEQ ID NO: 146113 - RNA, 22 nt, Homo sapiens
uucucuggucagaggggagguu

SEQ ID NO: 146114 - RNA, 22 nt, Homo sapiens
uucuugcugaauugugcccuuc

SEQ ID NO: 146115 - RNA, 22 nt, Homo sapiens
uucuuuggaaacaguacuaauu

SEQ ID NO: 146116 - RNA, 23 nt, Homo sapiens
uugaaaagucaguagccucugau

SEQ ID NO: 146117 - RNA, 22 nt, Homo sapiens
uugaagacuauaugauucuuca

SEQ ID NO: 146118 - RNA, 22 nt, Homo sapiens
uugaaugaauggaaagaagggu

SEQ ID NO: 146119 - RNA, 22 nt, Homo sapiens
uugacagagaaaagugugacuu

SEQ ID NO: 146120 - RNA, 20 nt, Homo sapiens
uugacaguggguuguuaaag

SEQ ID NO: 146121 - RNA, 22 nt, Homo sapiens
uugacauaaucauuucacagug

SEQ ID NO: 146122 - RNA, 22 nt, Homo sapiens
uugacuuuuaggaggaaaauga

SEQ ID NO: 146123 - RNA, 22 nt, Homo sapiens
uugagacggaguuuugcucuug

SEQ ID NO: 146124 - RNA, 22 nt, Homo sapiens
uugagauauccauaaaugggaa

SEQ ID NO: 146125 - RNA, 22 nt, Homo sapiens
uugagauggagucuugcgcugu

SEQ ID NO: 146126 - RNA, 22 nt, Homo sapiens
uugagauggagucuugcucuug

SEQ ID NO: 146127 - RNA, 22 nt, Homo sapiens
uugagauggaguuucgcucuug

SEQ ID NO: 146128 - RNA, 22 nt, Homo sapiens
uugagauuauuguguuccuuua

SEQ ID NO: 146129 - RNA, 22 nt, Homo sapiens
uugagcaaaacauuaauauuag

SEQ ID NO: 146130 - RNA, 21 nt, Homo sapiens
uugagcaacuaggguuauagg

SEQ ID NO: 146131 - RNA, 22 nt, Homo sapiens
uugaggaggcagucuguccguu

SEQ ID NO: 146132 - RNA, 23 nt, Homo sapiens
uugaggcauguaccaucaauauc

SEQ ID NO: 146133 - RNA, 22 nt, Homo sapiens
uugaggccugauaacacacuga

SEQ ID NO: 146134 - RNA, 22 nt, Homo sapiens
uugaggguggcauauauugauu

SEQ ID NO: 146135 - RNA, 21 nt, Homo sapiens
uugagguaaaauccuauggga

SEQ ID NO: 146136 - RNA, 22 nt, Homo sapiens
uugagguagcuuugauggaggu

SEQ ID NO: 146137 - RNA, 22 nt, Homo sapiens
uugagguauaaagguagguugu

SEQ ID NO: 146138 - RNA, 22 nt, Homo sapiens
uugauaguuuuaaaauuaaucu

SEQ ID NO: 146139 - RNA, 22 nt, Homo sapiens
uugauauuacucaguaacagau

SEQ ID NO: 146140 - RNA, 22 nt, Homo sapiens
uugaucacuguacuaugacuau

SEQ ID NO: 146141 - RNA, 22 nt, Homo sapiens
uugaucuggagagaggcccgug

SEQ ID NO: 146142 - RNA, 22 nt, Homo sapiens
uugauuagugacuggcuacacg

SEQ ID NO: 146143 - RNA, 23 nt, Homo sapiens
uugcaaagccugaaacucuucag

SEQ ID NO: 146144 - RNA, 22 nt, Homo sapiens
uugcaaaucucuuguguuuggu

SEQ ID NO: 146145 - RNA, 18 nt, Homo sapiens
uugcaaauucuucccugu

SEQ ID NO: 146146 - RNA, 22 nt, Homo sapiens
uugcaaggugcucgaagggcuc

SEQ ID NO: 146147 - RNA, 22 nt, Homo sapiens
uugcacaauggaauuuaucuuu

SEQ ID NO: 146148 - RNA, 22 nt, Homo sapiens
ggguucaaaucuuggcucuuac

SEQ ID NO: 146149 - RNA, 22 nt, Homo sapiens
gguaauguaacugguauucugu

SEQ ID NO: 146150 - RNA, 22 nt, Homo sapiens
gguauguuuagaccauuuacau

SEQ ID NO: 146151 - RNA, 19 nt, Homo sapiens
ggucagcaaagucuagcug

SEQ ID NO: 146152 - RNA, 22 nt, Homo sapiens
ggugagaaaaacauagucucag

SEQ ID NO: 146153 - RNA, 19 nt, Homo sapiens
ggugagaaauuaugggucu

SEQ ID NO: 146154 - RNA, 22 nt, Homo sapiens
ggugagcacagaaugcccugag

SEQ ID NO: 146155 - RNA, 22 nt, Homo sapiens
ggugagguaggaaaaguuagga

SEQ ID NO: 146156 - RNA, 22 nt, Homo sapiens
ggugcagcacaccaacauggca

SEQ ID NO: 146157 - RNA, 22 nt, Homo sapiens
gguggucuuccccuggaguucg

SEQ ID NO: 146158 - RNA, 18 nt, Homo sapiens
guaaauguaucuauugcc

SEQ ID NO: 146159 - RNA, 22 nt, Homo sapiens
guaaauguccccugugauauug

SEQ ID NO: 146160 - RNA, 22 nt, Homo sapiens
guaaauguccugcuacagagug

SEQ ID NO: 146161 - RNA, 22 nt, Homo sapiens
guaacagucucaacaguggucu

SEQ ID NO: 146162 - RNA, 22 nt, Homo sapiens
guaaucuguaguaaagcaccau

SEQ ID NO: 146163 - RNA, 22 nt, Homo sapiens
guacugagagacaguuacuguu

SEQ ID NO: 146164 - RNA, 22 nt, Homo sapiens
guauacacccugugauauuauu

SEQ ID NO: 146165 - RNA, 22 nt, Homo sapiens
guauacuucugaaaauagcuau

SEQ ID NO: 146166 - RNA, 22 nt, Homo sapiens
guauaguaguacaaaaguuuuu

SEQ ID NO: 146167 - RNA, 22 nt, Homo sapiens
guaugugcauuguaaauuuuga

SEQ ID NO: 146168 - RNA, 22 nt, Homo sapiens
gucaagugaagcagugggagua

SEQ ID NO: 146169 - RNA, 22 nt, Homo sapiens
gucacuguggagaagaaagugg

SEQ ID NO: 146170 - RNA, 22 nt, Homo sapiens
gucagggagucucuaucagugg

SEQ ID NO: 146171 - RNA, 22 nt, Homo sapiens
gucaggugcuuacgcggagauc

SEQ ID NO: 146172 - RNA, 22 nt, Homo sapiens
gucagugucuuaacagagauua

SEQ ID NO: 146173 - RNA, 22 nt, Homo sapiens
gucaguuucacucagcuggaac

SEQ ID NO: 146174 - RNA, 22 nt, Homo sapiens
gucaguuugguuaaucauucca

SEQ ID NO: 146175 - RNA, 21 nt, Homo sapiens
guccaaaacaguguccaaugc

SEQ ID NO: 146176 - RNA, 22 nt, Homo sapiens
guccaguacucuuuccugaaaa

SEQ ID NO: 146177 - RNA, 22 nt, Homo sapiens
gucuaguuuuaauacauuaaga

SEQ ID NO: 146178 - RNA, 22 nt, Homo sapiens
gucucacagcuagcugcuuuau

SEQ ID NO: 146179 - RNA, 22 nt, Homo sapiens
gucucccaaccccugugcccag

SEQ ID NO: 146180 - RNA, 22 nt, Homo sapiens
gucuccgagccguguggagccg

SEQ ID NO: 146181 - RNA, 22 nt, Homo sapiens
gucucugguugcuuuuguacca

SEQ ID NO: 146182 - RNA, 22 nt, Homo sapiens
gucugcaugucauaugauagua

SEQ ID NO: 146183 - RNA, 22 nt, Homo sapiens
gucugguugacagcauguggcc

SEQ ID NO: 146184 - RNA, 22 nt, Homo sapiens
gucuuuggaaagacaaaguuca

SEQ ID NO: 146185 - RNA, 22 nt, Homo sapiens
gugaaaagaugagcaccauaca

SEQ ID NO: 146186 - RNA, 22 nt, Homo sapiens
gugaaagauuaaaccagugugu

SEQ ID NO: 146187 - RNA, 22 nt, Homo sapiens
gugaaauacauaaucccaagug

SEQ ID NO: 146188 - RNA, 22 nt, Homo sapiens
gugaacuguuugaggaagagaa

SEQ ID NO: 146189 - RNA, 22 nt, Homo sapiens
gugaccauuugacauauccuug

SEQ ID NO: 146190 - RNA, 22 nt, Homo sapiens
gugagauggagucuugcuuugu

SEQ ID NO: 146191 - RNA, 19 nt, Homo sapiens
gugagcacagacaauacaa

SEQ ID NO: 146192 - RNA, 22 nt, Homo sapiens
gugagcauaacaacagaguuua

SEQ ID NO: 146193 - RNA, 21 nt, Homo sapiens
gugaggaguuacuggcuuuga

SEQ ID NO: 146194 - RNA, 22 nt, Homo sapiens
gugagggagcuggaauauuuau

SEQ ID NO: 146195 - RNA, 17 nt, Homo sapiens
gugagguauccucaaaa

SEQ ID NO: 146196 - RNA, 22 nt, Homo sapiens
gugaggucguagucauaggcaa

SEQ ID NO: 146197 - RNA, 18 nt, Homo sapiens
gugcaaugaauagcagag

SEQ ID NO: 146198 - RNA, 22 nt, Homo sapiens
gugcacaucgugcagguuuguu

SEQ ID NO: 146199 - RNA, 22 nt, Homo sapiens
gugcacaugcgugcgcacauau

SEQ ID NO: 146200 - RNA, 23 nt, Homo sapiens
gugcaguggcgagauuucggcuc

SEQ ID NO: 146201 - RNA, 22 nt, Homo sapiens
guggacaugaauuuuggaggca

SEQ ID NO: 146202 - RNA, 18 nt, Homo sapiens
guggagugucuuccugga

SEQ ID NO: 146203 - RNA, 22 nt, Homo sapiens
guggcaugaaagcaucugugau

SEQ ID NO: 146204 - RNA, 22 nt, Homo sapiens
gugggauggaaaugggcuucag

SEQ ID NO: 146205 - RNA, 22 nt, Homo sapiens
gugggguaggaggaguacuucc

SEQ ID NO: 146206 - RNA, 22 nt, Homo sapiens
gugggguaggguaggacucaac

SEQ ID NO: 146207 - RNA, 22 nt, Homo sapiens
guggugucuuuuuugauuagga

SEQ ID NO: 146208 - RNA, 22 nt, Homo sapiens
guguaaaacaauuagaggauuu

SEQ ID NO: 146209 - RNA, 22 nt, Homo sapiens
guguaaaucugcugugaacauu

SEQ ID NO: 146210 - RNA, 22 nt, Homo sapiens
gugucaguggggagugaucuuc

SEQ ID NO: 146211 - RNA, 22 nt, Homo sapiens
guguuauggagccaaacuacua

SEQ ID NO: 146212 - RNA, 22 nt, Homo sapiens
guguuugauugcaaauaaucua

SEQ ID NO: 146213 - RNA, 22 nt, Homo sapiens
guuacagucuuguguaagguua

SEQ ID NO: 146214 - RNA, 22 nt, Homo sapiens
guuauuguccauuuauuuagca

SEQ ID NO: 146215 - RNA, 22 nt, Homo sapiens
guucaaggaauguuggcuucuc

SEQ ID NO: 146216 - RNA, 22 nt, Homo sapiens
guucaguuugcugaugcguuga

SEQ ID NO: 146217 - RNA, 20 nt, Homo sapiens
guucccuguaggugugcgga

SEQ ID NO: 146218 - RNA, 22 nt, Homo sapiens
guugagcaagcuuuggagccua

SEQ ID NO: 146219 - RNA, 22 nt, Homo sapiens
guuggcuguuucccccaaguga

SEQ ID NO: 146220 - RNA, 22 nt, Homo sapiens
guugggcccauagacugccagu

SEQ ID NO: 146221 - RNA, 22 nt, Homo sapiens
uaaagcuuggauuuaggcuaau

SEQ ID NO: 146222 - RNA, 22 nt, Homo sapiens
uaacaguguauuccuuuggaca

SEQ ID NO: 146223 - RNA, 22 nt, Homo sapiens
uaacauuguugauuauacuaag

SEQ ID NO: 146224 - RNA, 22 nt, Homo sapiens
uaacuaguagauggcugacaua

SEQ ID NO: 146225 - RNA, 22 nt, Homo sapiens
uaagagagcuccaucuuuuccu

SEQ ID NO: 146226 - RNA, 20 nt, Homo sapiens
uaagccacacagucuaaggu

SEQ ID NO: 146227 - RNA, 22 nt, Homo sapiens
uaaggcccauucuaugaagcag

SEQ ID NO: 146228 - RNA, 22 nt, Homo sapiens
uaaggcccgugaguuucauauc

SEQ ID NO: 146229 - RNA, 22 nt, Homo sapiens
uaaguaauuuguauuuuaccca

SEQ ID NO: 146230 - RNA, 22 nt, Homo sapiens
uaaguagugugcauguauguau

SEQ ID NO: 146231 - RNA, 22 nt, Homo sapiens
uaagugcaugauuacaugcaua

SEQ ID NO: 146232 - RNA, 21 nt, Homo sapiens
uaauaaugucucagacaccua

SEQ ID NO: 146233 - RNA, 22 nt, Homo sapiens
uaaucucagcugagcugagauu

SEQ ID NO: 146234 - RNA, 22 nt, Homo sapiens
uacaaagugggaaacgaagguu

SEQ ID NO: 146235 - RNA, 22 nt, Homo sapiens
uacaccaauuuaaucaaaagca

SEQ ID NO: 146236 - RNA, 22 nt, Homo sapiens
uacagaauugcagguguggcag

SEQ ID NO: 146237 - RNA, 23 nt, Homo sapiens
uacagcugcagaaucaggcuaag

SEQ ID NO: 146238 - RNA, 22 nt, Homo sapiens
uacaggacuauagaacuuuccc

SEQ ID NO: 146239 - RNA, 22 nt, Homo sapiens
uacagugcauagaggcaugaua

SEQ ID NO: 146240 - RNA, 22 nt, Homo sapiens
uaccaccauuguaguuuggaaa

SEQ ID NO: 146241 - RNA, 22 nt, Homo sapiens
uaccaugcagguguauguuugu

SEQ ID NO: 146242 - RNA, 22 nt, Homo sapiens
uacccuuuaguauaaaaucaga

SEQ ID NO: 146243 - RNA, 22 nt, Homo sapiens
uacuagaggaaaacuugaagac

SEQ ID NO: 146244 - RNA, 22 nt, Homo sapiens
uacugaccugaaggccauggaa

SEQ ID NO: 146245 - RNA, 22 nt, Homo sapiens
uagaacaauugcuggauccgaa

SEQ ID NO: 146246 - RNA, 22 nt, Homo sapiens
uagaagcacuaucccuccuagu

SEQ ID NO: 146247 - RNA, 22 nt, Homo sapiens
uagaauguaacuuccaugucau

SEQ ID NO: 146248 - RNA, 22 nt, Homo sapiens
uagacuguaagauccaggagag

SEQ ID NO: 146249 - RNA, 22 nt, Homo sapiens
uagagcuaguuuuuaaucuaac

SEQ ID NO: 146250 - RNA, 19 nt, Homo sapiens
uagagguuuaagaaaagaa

SEQ ID NO: 146251 - RNA, 22 nt, Homo sapiens
uagauaguuaugauuugaugau

SEQ ID NO: 146252 - RNA, 22 nt, Homo sapiens
uagcaaaucaauggaauugaag

SEQ ID NO: 146253 - RNA, 22 nt, Homo sapiens
uagcacaucccuaaaaugcugu

SEQ ID NO: 146254 - RNA, 22 nt, Homo sapiens
uagcacaucuucuuggccugca

SEQ ID NO: 146255 - RNA, 22 nt, Homo sapiens
uagcagaauaacuugccagccu

SEQ ID NO: 146256 - RNA, 22 nt, Homo sapiens
uagcagacuauuuugugauaau

SEQ ID NO: 146257 - RNA, 22 nt, Homo sapiens
uagcagcagugguguauuuaga

SEQ ID NO: 146258 - RNA, 22 nt, Homo sapiens
uagcaggaaaccuguguugagg

SEQ ID NO: 146259 - RNA, 22 nt, Homo sapiens
uagcagguguuccacaaauauu

SEQ ID NO: 146260 - RNA, 22 nt, Homo sapiens
uagcccauuuguuuagggaaag

SEQ ID NO: 146261 - RNA, 22 nt, Homo sapiens
uagcuccagugggguuacugcu

SEQ ID NO: 146262 - RNA, 17 nt, Homo sapiens
uagcucuauuucuagcc

SEQ ID NO: 146263 - RNA, 22 nt, Homo sapiens
uaggaaguacaucucagaaucu

SEQ ID NO: 146264 - RNA, 22 nt, Homo sapiens
uaggacaaugguacagcagaaa

SEQ ID NO: 146265 - RNA, 20 nt, Homo sapiens
uaggagcaaugagaguagaa

SEQ ID NO: 146266 - RNA, 22 nt, Homo sapiens
uaggcaaaugcaagaguagaac

SEQ ID NO: 146267 - RNA, 19 nt, Homo sapiens
uagggcacgaggcagaguc

SEQ ID NO: 146268 - RNA, 22 nt, Homo sapiens
uaggggcacacuucgguuagca

SEQ ID NO: 146269 - RNA, 22 nt, Homo sapiens
uagguagugugugcaugagagg

SEQ ID NO: 146270 - RNA, 22 nt, Homo sapiens
uaggugauugaagguggaaugu

SEQ ID NO: 146271 - RNA, 22 nt, Homo sapiens
uagguuguucuauuaucuuaca

SEQ ID NO: 146272 - RNA, 18 nt, Homo sapiens
uagugcuguucucaugau

SEQ ID NO: 146273 - RNA, 20 nt, Homo sapiens
uaguuggugauacagugcau

SEQ ID NO: 146274 - RNA, 22 nt, Homo sapiens
uauacaugugggcaucaggaga

SEQ ID NO: 146275 - RNA, 22 nt, Homo sapiens
uauaucacaugcacucauuuuc

SEQ ID NO: 146276 - RNA, 22 nt, Homo sapiens
uaucaaguuggaagagaaguaa

SEQ ID NO: 146277 - RNA, 23 nt, Homo sapiens
uaucacacuuucucugugccaca

SEQ ID NO: 146278 - RNA, 22 nt, Homo sapiens
uaucacagcgggguguacaccc

SEQ ID NO: 146279 - RNA, 22 nt, Homo sapiens
uaucacaguugcauauuuaagg

SEQ ID NO: 146280 - RNA, 22 nt, Homo sapiens
uaucacugucaggcccucauau

SEQ ID NO: 146281 - RNA, 22 nt, Homo sapiens
uaucagauugcugccaucugcu

SEQ ID NO: 146282 - RNA, 21 nt, Homo sapiens
uaucccagucacaucuaccca

SEQ ID NO: 146283 - RNA, 22 nt, Homo sapiens
uaucugcaucccauuuuuauca

SEQ ID NO: 146284 - RNA, 20 nt, Homo sapiens
uaugacacugucauaaaaau

SEQ ID NO: 146285 - RNA, 23 nt, Homo sapiens
uaugacagaggaagggggagcug

SEQ ID NO: 146286 - RNA, 22 nt, Homo sapiens
uaugacauaguccuuaacccuc

SEQ ID NO: 146287 - RNA, 22 nt, Homo sapiens
uaugaugcuguuuagaaucucu

SEQ ID NO: 146288 - RNA, 22 nt, Homo sapiens
uaugcacacguguccaugugca

SEQ ID NO: 146289 - RNA, 22 nt, Homo sapiens
uaugcagacauuguuccaacca

SEQ ID NO: 146290 - RNA, 22 nt, Homo sapiens
uaugcuuguuuauuuaagaaac

SEQ ID NO: 146291 - RNA, 22 nt, Homo sapiens
uauggauguuaagguucacagc

SEQ ID NO: 146292 - RNA, 22 nt, Homo sapiens
uauggauuucauuagacuugag

SEQ ID NO: 146293 - RNA, 22 nt, Homo sapiens
uauggcccuuaaguauugguug

SEQ ID NO: 146294 - RNA, 22 nt, Homo sapiens
uauggcuuuuauuauguuguag

SEQ ID NO: 146295 - RNA, 19 nt, Homo sapiens
uaugggauuuuuagggugu

SEQ ID NO: 146296 - RNA, 22 nt, Homo sapiens
uaugucuucuuuagagaaaugu

SEQ ID NO: 146297 - RNA, 22 nt, Homo sapiens
uaugucuuuugcuugcaaauag

SEQ ID NO: 146298 - RNA, 22 nt, Homo sapiens
uauuacugucaauaucacagaa

SEQ ID NO: 146299 - RNA, 22 nt, Homo sapiens
uauuaguuuucuguggauuaca

SEQ ID NO: 146300 - RNA, 22 nt, Homo sapiens
uauuccacuuacaugagguauc

SEQ ID NO: 146301 - RNA, 18 nt, Homo sapiens
uauuccucuuccucuauc

SEQ ID NO: 146302 - RNA, 22 nt, Homo sapiens
uauuccuuuugcauuuccacau

SEQ ID NO: 146303 - RNA, 22 nt, Homo sapiens
uauugacuugagaagggauuag

SEQ ID NO: 146304 - RNA, 22 nt, Homo sapiens
uauugcacuccagccuuggcaa

SEQ ID NO: 146305 - RNA, 22 nt, Homo sapiens
uauugcauauuauucuaguggc

SEQ ID NO: 146306 - RNA, 22 nt, Homo sapiens
uauugcauuugagguugguuga

SEQ ID NO: 146307 - RNA, 22 nt, Homo sapiens
uauugcucaugcauuuaauuuc

SEQ ID NO: 146308 - RNA, 22 nt, Homo sapiens
uauugcuugaggaaaugguaau

SEQ ID NO: 146309 - RNA, 22 nt, Homo sapiens
uauuggcucuguuucucugaag

SEQ ID NO: 146310 - RNA, 22 nt, Homo sapiens
uauuucaguugugcagguaguu

SEQ ID NO: 146311 - RNA, 22 nt, Homo sapiens
uauuugguuacuugaauagcua

SEQ ID NO: 146312 - RNA, 22 nt, Homo sapiens
ucaaagugagcuccuucucacu

SEQ ID NO: 146313 - RNA, 22 nt, Homo sapiens
ucaaagugcuauggcucagguu

SEQ ID NO: 146314 - RNA, 22 nt, Homo sapiens
ucaaaugauucagaagccaccu

SEQ ID NO: 146315 - RNA, 22 nt, Homo sapiens
ucaaguaguaacuaacugugac

SEQ ID NO: 146316 - RNA, 18 nt, Homo sapiens
ucaauguggauguucuuu

SEQ ID NO: 146317 - RNA, 20 nt, Homo sapiens
ucacaagccaagaucacguc

SEQ ID NO: 146318 - RNA, 22 nt, Homo sapiens
ucacaagcuccugccuuugcuu

SEQ ID NO: 146319 - RNA, 23 nt, Homo sapiens
ucacacuuaagagaaaugcagcu

SEQ ID NO: 146320 - RNA, 22 nt, Homo sapiens
ucacagacugagccaaauagag

SEQ ID NO: 146321 - RNA, 18 nt, Homo sapiens
ucacagguaauuaggauu

SEQ ID NO: 146322 - RNA, 22 nt, Homo sapiens
ucacaguaaauccagaagaaau

SEQ ID NO: 146323 - RNA, 22 nt, Homo sapiens
ucacaucucagguuucuugaca

SEQ ID NO: 146324 - RNA, 18 nt, Homo sapiens
ucacauggccgagagaga

SEQ ID NO: 146325 - RNA, 22 nt, Homo sapiens
ucacauuguacaaacagguaag

SEQ ID NO: 146326 - RNA, 22 nt, Homo sapiens
ucacauuguuauguaaauguuu

SEQ ID NO: 146327 - RNA, 22 nt, Homo sapiens
ucaccaguggcacuccagccug

SEQ ID NO: 146328 - RNA, 22 nt, Homo sapiens
ucacugaaaccuccgccuucug

SEQ ID NO: 146329 - RNA, 20 nt, Homo sapiens
ucacugagugguccacagua

SEQ ID NO: 146330 - RNA, 22 nt, Homo sapiens
ucacugcgaccuccaccuccug

SEQ ID NO: 146331 - RNA, 20 nt, Homo sapiens
ucacugugaacuucuugagg

SEQ ID NO: 146332 - RNA, 22 nt, Homo sapiens
ucacugugguuuugaugugcau

SEQ ID NO: 146333 - RNA, 22 nt, Homo sapiens
ucacuguugaugggcaugcagg

SEQ ID NO: 146334 - RNA, 22 nt, Homo sapiens
ucagaaccucugauuuauacuu

SEQ ID NO: 146335 - RNA, 22 nt, Homo sapiens
ucagacacugcccuccaccugu

SEQ ID NO: 146336 - RNA, 22 nt, Homo sapiens
ucagaucacuggcgcuggcgga

SEQ ID NO: 146337 - RNA, 22 nt, Homo sapiens
ucagaugauucuguuguugugu

SEQ ID NO: 146338 - RNA, 19 nt, Homo sapiens
ucagcaguaaucaacuuca

SEQ ID NO: 146339 - RNA, 22 nt, Homo sapiens
ucagcagugagagaccucaccc

SEQ ID NO: 146340 - RNA, 21 nt, Homo sapiens
ucaggcuuuuugagugccaau

SEQ ID NO: 146341 - RNA, 20 nt, Homo sapiens
ucagguagaucuuugagguc

SEQ ID NO: 146342 - RNA, 20 nt, Homo sapiens
ucagguagggcuucaacauu

SEQ ID NO: 146343 - RNA, 22 nt, Homo sapiens
ucagguagugccaugauugauu

SEQ ID NO: 146344 - RNA, 23 nt, Homo sapiens
ucaguacuccacuuucaauagug

SEQ ID NO: 146345 - RNA, 23 nt, Homo sapiens
ucaguacucuauaagugccagcu

SEQ ID NO: 146346 - RNA, 23 nt, Homo sapiens
ucaguagucauugggaaagugug

SEQ ID NO: 146347 - RNA, 22 nt, Homo sapiens
ucagugaauacauguacucaug

SEQ ID NO: 146348 - RNA, 20 nt, Homo sapiens
ucagugcagauuguccaagu

SEQ ID NO: 146349 - RNA, 22 nt, Homo sapiens
ucagugucugugauggagaggu

SEQ ID NO: 146350 - RNA, 22 nt, Homo sapiens
ucauacaggccaccagggaagu

SEQ ID NO: 146351 - RNA, 21 nt, Homo sapiens
ucaucagucaaagacaauggu

SEQ ID NO: 146352 - RNA, 22 nt, Homo sapiens
ucaugcaaugagucaggaggca

SEQ ID NO: 146353 - RNA, 22 nt, Homo sapiens
ucaugcaaugcaaggggaaauu

SEQ ID NO: 146354 - RNA, 22 nt, Homo sapiens
ucauggcauuguuaaggguuuu

SEQ ID NO: 146355 - RNA, 22 nt, Homo sapiens
ucauugcauguuaauuaaacag

SEQ ID NO: 146356 - RNA, 22 nt, Homo sapiens
uccagcuuuuucuaauucugug

SEQ ID NO: 146357 - RNA, 22 nt, Homo sapiens
ucccagugcuaugcaaaagccu

SEQ ID NO: 146358 - RNA, 22 nt, Homo sapiens
ucccugaagcugcagcaacaca

SEQ ID NO: 146359 - RNA, 22 nt, Homo sapiens
ucccuggacagccuugccuggg

SEQ ID NO: 146360 - RNA, 22 nt, Homo sapiens
uccgaguguuagagagcugugu

SEQ ID NO: 146361 - RNA, 22 nt, Homo sapiens
uccuacaugcaguacauucaaa

SEQ ID NO: 146362 - RNA, 21 nt, Homo sapiens
uccugagagaggaguaacucu

SEQ ID NO: 146363 - RNA, 20 nt, Homo sapiens
uccugagauucccaguucuc

SEQ ID NO: 146364 - RNA, 23 nt, Homo sapiens
ucgcagcauucaauaccaggcag

SEQ ID NO: 146365 - RNA, 23 nt, Homo sapiens
ucgguccccuuggcugcccucgg

SEQ ID NO: 146366 - RNA, 22 nt, Homo sapiens
ucuagaugaaguauaaaguagu

SEQ ID NO: 146367 - RNA, 22 nt, Homo sapiens
ucucaagaugguagaugggaau

SEQ ID NO: 146368 - RNA, 22 nt, Homo sapiens
ucucacagccauuucucccucu

SEQ ID NO: 146369 - RNA, 22 nt, Homo sapiens
ucucagugugguaaaaguuuuu

SEQ ID NO: 146370 - RNA, 23 nt, Homo sapiens
ucucauuccuugaaaauaaugac

SEQ ID NO: 146371 - RNA, 20 nt, Homo sapiens
ucucccaaacagcaggcccu

SEQ ID NO: 146372 - RNA, 22 nt, Homo sapiens
ucucugagaaaaguuucuccca

SEQ ID NO: 146373 - RNA, 22 nt, Homo sapiens
ucucuguuugucuguuacuggu

SEQ ID NO: 146374 - RNA, 22 nt, Homo sapiens
ucucuuggcggaaguugcagug

SEQ ID NO: 146375 - RNA, 22 nt, Homo sapiens
ucucuuggugacuuaaaauguu

SEQ ID NO: 146376 - RNA, 22 nt, Homo sapiens
ucugacaaugaacaaucuauag

SEQ ID NO: 146377 - RNA, 22 nt, Homo sapiens
ucugccaaccacaaaauuuauu

SEQ ID NO: 146378 - RNA, 22 nt, Homo sapiens
ucuggagugugaaguggauaug

SEQ ID NO: 146379 - RNA, 22 nt, Homo sapiens
ucugggguuagucaaagguaug

SEQ ID NO: 146380 - RNA, 22 nt, Homo sapiens
ucugguguuauucauguaguuu

SEQ ID NO: 146381 - RNA, 22 nt, Homo sapiens
ucugucuugugguuugagugcc

SEQ ID NO: 146382 - RNA, 22 nt, Homo sapiens
ucugugguucaggcuggagugc

SEQ ID NO: 146383 - RNA, 22 nt, Homo sapiens
ucuugcauuuuuaaauagugcu

SEQ ID NO: 146384 - RNA, 22 nt, Homo sapiens
ucuuucacuuagcaugauguuu

SEQ ID NO: 146385 - RNA, 20 nt, Homo sapiens
ucuuucgguuaccaggcagu

SEQ ID NO: 146386 - RNA, 22 nt, Homo sapiens
ucuuugauuaugcagauggguu

SEQ ID NO: 146387 - RNA, 22 nt, Homo sapiens
ucuuugauuuuguuacuaagac

SEQ ID NO: 146388 - RNA, 22 nt, Homo sapiens
ucuuuggauggaaauuggaguc

SEQ ID NO: 146389 - RNA, 22 nt, Homo sapiens
ucuuuggguagauauguagcug

SEQ ID NO: 146390 - RNA, 22 nt, Homo sapiens
ucuuuggguguauuucacagcc

SEQ ID NO: 146391 - RNA, 22 nt, Homo sapiens
ucuuugguaauggaugucugau

SEQ ID NO: 146392 - RNA, 22 nt, Homo sapiens
ucuuuggucaucaugggaagca

SEQ ID NO: 146393 - RNA, 22 nt, Homo sapiens
ucuuuggucuacuuucauaugu

SEQ ID NO: 146394 - RNA, 22 nt, Homo sapiens
ucuuuggugaauggucauccag

SEQ ID NO: 146395 - RNA, 22 nt, Homo sapiens
ucuuugguugcacugcaggugu

SEQ ID NO: 146396 - RNA, 22 nt, Homo sapiens
ucuuugguuguuuagggugcau

SEQ ID NO: 146397 - RNA, 22 nt, Homo sapiens
ucuuugucuacauccuguuaaa

SEQ ID NO: 146398 - RNA, 22 nt, Homo sapiens
ucuuuguguaggucaaucuggc

SEQ ID NO: 146399 - RNA, 22 nt, Homo sapiens
ucuuuguugcauaggcuuguuc

SEQ ID NO: 146400 - RNA, 22 nt, Homo sapiens
ucuuuguuuucugauccugaag

SEQ ID NO: 146401 - RNA, 22 nt, Homo sapiens
ugaaaagucuaagauuaagguu

SEQ ID NO: 146402 - RNA, 22 nt, Homo sapiens
ugaaacacacagagaagggaga

SEQ ID NO: 146403 - RNA, 22 nt, Homo sapiens
ugaaacacacauugcccuuuau

SEQ ID NO: 146404 - RNA, 22 nt, Homo sapiens
ugaaacacaccuccucuccauc

SEQ ID NO: 146405 - RNA, 22 nt, Homo sapiens
ugaaagcuacaggaaaguauuu

SEQ ID NO: 146406 - RNA, 22 nt, Homo sapiens
aaacgugcagagaucaauagca

SEQ ID NO: 146407 - RNA, 18 nt, Homo sapiens
aaacugcuuccuuggccu

SEQ ID NO: 146408 - RNA, 22 nt, Homo sapiens
aaagaguucagguagauuucaa

SEQ ID NO: 146409 - RNA, 19 nt, Homo sapiens
aaaguacucugaugccucu

SEQ ID NO: 146410 - RNA, 17 nt, Homo sapiens
aaaguccuuugcuaucu

SEQ ID NO: 146411 - RNA, 22 nt, Homo sapiens
aaagugcaguacuucguauauu

SEQ ID NO: 146412 - RNA, 22 nt, Homo sapiens
aaagugcugagaguucuaacuu

SEQ ID NO: 146413 - RNA, 22 nt, Homo sapiens
aaauaacugucagguucuggaa

SEQ ID NO: 146414 - RNA, 22 nt, Homo sapiens
aaauccauuuguucagcuaugc

SEQ ID NO: 146415 - RNA, 22 nt, Homo sapiens
aaaugcacagaaaggaugugga

SEQ ID NO: 146416 - RNA, 22 nt, Homo sapiens
aaaugcaccacucuggugcagg

SEQ ID NO: 146417 - RNA, 22 nt, Homo sapiens
aaaugcaugaggugggaagaaa

SEQ ID NO: 146418 - RNA, 23 nt, Homo sapiens
aaaugcucucaggugccaguaga

SEQ ID NO: 146419 - RNA, 22 nt, Homo sapiens
aaaugcucuguggguaguaaug

SEQ ID NO: 146420 - RNA, 22 nt, Homo sapiens
aaaugcuuucuuggaccauuug

SEQ ID NO: 146421 - RNA, 21 nt, Homo sapiens
aaaugugcuuuaguacccuca

SEQ ID NO: 146422 - RNA, 22 nt, Homo sapiens
aaauuguccuauugguuuaagc

SEQ ID NO: 146423 - RNA, 22 nt, Homo sapiens
aacaccguagaaacacaaggga

SEQ ID NO: 146424 - RNA, 22 nt, Homo sapiens
aacagcauaguacccgugauaa

SEQ ID NO: 146425 - RNA, 21 nt, Homo sapiens
aacagugcuuaguagauguuc

SEQ ID NO: 146426 - RNA, 22 nt, Homo sapiens
aacaguguuuuggguuuucugg

SEQ ID NO: 146427 - RNA, 20 nt, Homo sapiens
aagagcucaccagaauaucu

SEQ ID NO: 146428 - RNA, 22 nt, Homo sapiens
aagagguuauagaguguauacu

SEQ ID NO: 146429 - RNA, 22 nt, Homo sapiens
aagaugauguucuuuuucuuag

SEQ ID NO: 146430 - RNA, 20 nt, Homo sapiens
auuuggcauaguuuaagcaa

SEQ ID NO: 146431 - RNA, 22 nt, Homo sapiens
auuugguugggugcgguggcuu

SEQ ID NO: 146432 - RNA, 22 nt, Homo sapiens
auuuugcauugcuguaaaggaa

SEQ ID NO: 146433 - RNA, 22 nt, Homo sapiens
auuuuugguuucaccugcacgc

SEQ ID NO: 146434 - RNA, 22 nt, Homo sapiens
caacucuguaggauccaggugg

SEQ ID NO: 146435 - RNA, 23 nt, Homo sapiens
caauacugaccucacguuaauag

SEQ ID NO: 146436 - RNA, 22 nt, Homo sapiens
caauacuguuaccugaaauagg

SEQ ID NO: 146437 - RNA, 22 nt, Homo sapiens
caauggcaaugaaauagugaga

SEQ ID NO: 146438 - RNA, 22 nt, Homo sapiens
cacagggcuaacauuuuugccc

SEQ ID NO: 146439 - RNA, 22 nt, Homo sapiens
cacagugaaugucaucauugcc

SEQ ID NO: 146440 - RNA, 22 nt, Homo sapiens
cacauagucccugcuaaucuuc

SEQ ID NO: 146441 - RNA, 22 nt, Homo sapiens
caccagcuggcauugaauaccu

SEQ ID NO: 146442 - RNA, 22 nt, Homo sapiens
cacccuaucagauguccagaga

SEQ ID NO: 146443 - RNA, 22 nt, Homo sapiens
cacugaaugugagguuggggag

SEQ ID NO: 146444 - RNA, 22 nt, Homo sapiens
cacuggucucauggcaugagag

SEQ ID NO: 146445 - RNA, 22 nt, Homo sapiens
cagagagcuugcccuuguauau

SEQ ID NO: 146446 - RNA, 22 nt, Homo sapiens
cagccggguggcuccuagggua

SEQ ID NO: 146447 - RNA, 22 nt, Homo sapiens
cagggcauugucuucuuaguac

SEQ ID NO: 146448 - RNA, 19 nt, Homo sapiens
caguaucauugcacauagu

SEQ ID NO: 146449 - RNA, 22 nt, Homo sapiens
cagugacacugaaaaguucggg

SEQ ID NO: 146450 - RNA, 18 nt, Homo sapiens
cagugcaauacaggagag

SEQ ID NO: 146451 - RNA, 22 nt, Homo sapiens
cagugguuuucaacccugguug

SEQ ID NO: 146452 - RNA, 20 nt, Homo sapiens
caucaccuggcaggauuugu

SEQ ID NO: 146453 - RNA, 22 nt, Homo sapiens
caugaaagacugaggaauugga

SEQ ID NO: 146454 - RNA, 22 nt, Homo sapiens
cauggucaccuuccaaguuauu

SEQ ID NO: 146455 - RNA, 22 nt, Homo sapiens
caugugcaugcuuucuuaugug

SEQ ID NO: 146456 - RNA, 22 nt, Homo sapiens
cauuacacuuguaagguuuuuc

SEQ ID NO: 146457 - RNA, 19 nt, Homo sapiens
cauuggacuugcuuuugcc

SEQ ID NO: 146458 - RNA, 22 nt, Homo sapiens
cauuuugguuaaauagguagcu

SEQ ID NO: 146459 - RNA, 22 nt, Homo sapiens
ccacaguugaaauuuugacugu

SEQ ID NO: 146460 - RNA, 22 nt, Homo sapiens
ccacauuaccuugcuugcucca

SEQ ID NO: 146461 - RNA, 22 nt, Homo sapiens
ccacccuuccacacccugggua

SEQ ID NO: 146462 - RNA, 23 nt, Homo sapiens
ccaguauuuauguaaggaagugu

SEQ ID NO: 146463 - RNA, 22 nt, Homo sapiens
ccagugcauggaucccaggggg

SEQ ID NO: 146464 - RNA, 22 nt, Homo sapiens
ccagugucugacagacacggcg

SEQ ID NO: 146465 - RNA, 22 nt, Homo sapiens
ccaguuuucccagcaccauuaa

SEQ ID NO: 146466 - RNA, 22 nt, Homo sapiens
ccaguuuucucacuguugcagu

SEQ ID NO: 146467 - RNA, 19 nt, Homo sapiens
ccauggcaaugaucugaug

SEQ ID NO: 146468 - RNA, 19 nt, Homo sapiens
cccagugucagagaagggu

SEQ ID NO: 146469 - RNA, 22 nt, Homo sapiens
cccagugugcugggugacagcu

SEQ ID NO: 146470 - RNA, 22 nt, Homo sapiens
cccaguuuugcuucucaugagg

SEQ ID NO: 146471 - RNA, 19 nt, Homo sapiens
cccuggcacauggaaaaug

SEQ ID NO: 146472 - RNA, 21 nt, Homo sapiens
ccucuuugagggaagaaaggg

SEQ ID NO: 146473 - RNA, 22 nt, Homo sapiens
ccucuuuguugagacuucacca

SEQ ID NO: 146474 - RNA, 22 nt, Homo sapiens
ccugagacugauugacucacaa

SEQ ID NO: 146475 - RNA, 22 nt, Homo sapiens
ccugcauaguucaccgcugaua

SEQ ID NO: 146476 - RNA, 21 nt, Homo sapiens
ccuugagaacaucaauuugcu

SEQ ID NO: 146477 - RNA, 22 nt, Homo sapiens
cuaaagauagugacaugauuug

SEQ ID NO: 146478 - RNA, 22 nt, Homo sapiens
cuagaagguaagagcuggaugc

SEQ ID NO: 146479 - RNA, 22 nt, Homo sapiens
cuagcagacaugggcugaacca

SEQ ID NO: 146480 - RNA, 22 nt, Homo sapiens
cuauacuguacacugaaugagg

SEQ ID NO: 146481 - RNA, 22 nt, Homo sapiens
cuauggcuguaaggauaguaac

SEQ ID NO: 146482 - RNA, 18 nt, Homo sapiens
cucacacccuaaucagga

SEQ ID NO: 146483 - RNA, 22 nt, Homo sapiens
cuccagugcaaagucaugauca

SEQ ID NO: 146484 - RNA, 22 nt, Homo sapiens
cuccaugagauuguugaaguag

SEQ ID NO: 146485 - RNA, 22 nt, Homo sapiens
cuccauuuaguccuuuuagaag

SEQ ID NO: 146486 - RNA, 20 nt, Homo sapiens
cucccugacaaauguggaaa

SEQ ID NO: 146487 - RNA, 22 nt, Homo sapiens
cuccuggugauuggagugugaa

SEQ ID NO: 146488 - RNA, 20 nt, Homo sapiens
cuccuucauuccuuuggacc

SEQ ID NO: 146489 - RNA, 22 nt, Homo sapiens
cugaaagagcauguaacacagu

SEQ ID NO: 146490 - RNA, 22 nt, Homo sapiens
cugaaagagcauuugaaugggu

SEQ ID NO: 146491 - RNA, 22 nt, Homo sapiens
cugaaucauugcauuaucaagg

SEQ ID NO: 146492 - RNA, 22 nt, Homo sapiens
cugaauguucuauagaagccgc

SEQ ID NO: 146493 - RNA, 22 nt, Homo sapiens
cugaauguuucacucugaaaug

SEQ ID NO: 146494 - RNA, 22 nt, Homo sapiens
cugagaucaagucuugcucugu

SEQ ID NO: 146495 - RNA, 22 nt, Homo sapiens
cugagcaauauagugagaucuu

SEQ ID NO: 146496 - RNA, 22 nt, Homo sapiens
cugagcaucauggcagaaucuu

SEQ ID NO: 146497 - RNA, 22 nt, Homo sapiens
cugagcuaguagcauuguguca

SEQ ID NO: 146498 - RNA, 22 nt, Homo sapiens
cugagcucauuucuuuugcuac

SEQ ID NO: 146499 - RNA, 22 nt, Homo sapiens
cugaggauauucagccucugug

SEQ ID NO: 146500 - RNA, 22 nt, Homo sapiens
cugaggguagaaggaucacuug

SEQ ID NO: 146501 - RNA, 22 nt, Homo sapiens
cugagguuguucuucucagugg

SEQ ID NO: 146502 - RNA, 22 nt, Homo sapiens
cugauauuuuaaaauuggcugg

SEQ ID NO: 146503 - RNA, 19 nt, Homo sapiens
cugcaagguaauaggucag

SEQ ID NO: 146504 - RNA, 22 nt, Homo sapiens
cugcaauggagaaagugagacu

SEQ ID NO: 146505 - RNA, 22 nt, Homo sapiens
cuggaaagcaaagggugcauug

SEQ ID NO: 146506 - RNA, 22 nt, Homo sapiens
cuggaaggaaaaacaaccacag

SEQ ID NO: 146507 - RNA, 22 nt, Homo sapiens
cuggagauuaaccaauugccau

SEQ ID NO: 146508 - RNA, 22 nt, Homo sapiens
cuggaggccugaacauaaaugg

SEQ ID NO: 146509 - RNA, 22 nt, Homo sapiens
cuggauauuaacauugaugaaa

SEQ ID NO: 146510 - RNA, 22 nt, Homo sapiens
cuggauggugagauaaagaaaa

SEQ ID NO: 146511 - RNA, 22 nt, Homo sapiens
cuggcaccauuuugaucaaagg

SEQ ID NO: 146512 - RNA, 22 nt, Homo sapiens
cugguaagaaggucuaagucaa

SEQ ID NO: 146513 - RNA, 22 nt, Homo sapiens
cuguaacagaauaaauuuguuu

SEQ ID NO: 146514 - RNA, 22 nt, Homo sapiens
cuguaauguaaugagacuacau

SEQ ID NO: 146515 - RNA, 22 nt, Homo sapiens
cugucaucauuucuaugugcca

SEQ ID NO: 146516 - RNA, 22 nt, Homo sapiens
cugugcauaucuuggacugugu

SEQ ID NO: 146517 - RNA, 22 nt, Homo sapiens
cugugcauggauuuuaagauug

SEQ ID NO: 146518 - RNA, 22 nt, Homo sapiens
cugugcauguuguccaauucuu

SEQ ID NO: 146519 - RNA, 22 nt, Homo sapiens
cugugcauuggaugucucccug

SEQ ID NO: 146520 - RNA, 19 nt, Homo sapiens
cugugcauuucuguggaag

SEQ ID NO: 146521 - RNA, 23 nt, Homo sapiens
cuguggugaggcccuagaaucug

SEQ ID NO: 146522 - RNA, 22 nt, Homo sapiens
cugugguguaacucuuggggcg

SEQ ID NO: 146523 - RNA, 22 nt, Homo sapiens
cuguuugguaaggaugccucag

SEQ ID NO: 146524 - RNA, 22 nt, Homo sapiens
cuucaaguaauucugauggcua

SEQ ID NO: 146525 - RNA, 20 nt, Homo sapiens
cuugccuagcccuuugccuc

SEQ ID NO: 146526 - RNA, 22 nt, Homo sapiens
cuuggcauugccccuggaauuu

SEQ ID NO: 146527 - RNA, 22 nt, Homo sapiens
cuuguuguggaggggagugcag

SEQ ID NO: 146528 - RNA, 17 nt, Homo sapiens
cuuguugugguaguuug

SEQ ID NO: 146529 - RNA, 22 nt, Homo sapiens
cuuucugaggagaauagagaac

SEQ ID NO: 146530 - RNA, 22 nt, Homo sapiens
cuuuggagaaaaguucuugggc

SEQ ID NO: 146531 - RNA, 20 nt, Homo sapiens
cuuuggcaaugagaacaggg

SEQ ID NO: 146532 - RNA, 22 nt, Homo sapiens
cuuuggcacuuccuaagugcca

SEQ ID NO: 146533 - RNA, 22 nt, Homo sapiens
cuuugggaccgcgguuuauacu

SEQ ID NO: 146534 - RNA, 21 nt, Homo sapiens
cuuugguagaguuuuuagggu

SEQ ID NO: 146535 - RNA, 18 nt, Homo sapiens
cuuugguccccgcacccu

SEQ ID NO: 146536 - RNA, 22 nt, Homo sapiens
cuuugguugugcucuccacuuu

SEQ ID NO: 146537 - RNA, 22 nt, Homo sapiens
cuuuguaugucaugacaacugu

SEQ ID NO: 146538 - RNA, 22 nt, Homo sapiens
gaaagauuuccugagcuagaaa

SEQ ID NO: 146539 - RNA, 21 nt, Homo sapiens
gaaauacugccuuaggagcug

SEQ ID NO: 146540 - RNA, 23 nt, Homo sapiens
gaaaugucuuagugaaauugcuu

SEQ ID NO: 146541 - RNA, 22 nt, Homo sapiens
gaauacuguccaagagugaugg

SEQ ID NO: 146542 - RNA, 22 nt, Homo sapiens
gaauagugcugcaagaaacaua

SEQ ID NO: 146543 - RNA, 22 nt, Homo sapiens
gaaugugcuguuggcugggcgu

SEQ ID NO: 146544 - RNA, 22 nt, Homo sapiens
gacaagagaacacugcuauauu

SEQ ID NO: 146545 - RNA, 22 nt, Homo sapiens
gacagguuuucuguuucugaaa

SEQ ID NO: 146546 - RNA, 18 nt, Homo sapiens
gacaguguggugauuccu

SEQ ID NO: 146547 - RNA, 22 nt, Homo sapiens
gaccccuagagauaggaggaac

SEQ ID NO: 146548 - RNA, 18 nt, Homo sapiens
gacuccauuucagccaga

SEQ ID NO: 146549 - RNA, 21 nt, Homo sapiens
gagaaucaucauggcugcaua

SEQ ID NO: 146550 - RNA, 23 nt, Homo sapiens
gagaccagcuucagaaagcacga

SEQ ID NO: 146551 - RNA, 22 nt, Homo sapiens
gagaccauuuacugccuacuua

SEQ ID NO: 146552 - RNA, 22 nt, Homo sapiens
gagagcaugugcuggcaucagu

SEQ ID NO: 146553 - RNA, 22 nt, Homo sapiens
gagauauguuggcagcugguau

SEQ ID NO: 146554 - RNA, 22 nt, Homo sapiens
gagaugugugugauuauauaau

SEQ ID NO: 146555 - RNA, 22 nt, Homo sapiens
gagcugaucuuuucugauucca

SEQ ID NO: 146556 - RNA, 22 nt, Homo sapiens
gaggcacucuguacaaaucugc

SEQ ID NO: 146557 - RNA, 22 nt, Homo sapiens
gaggguguuguguugcuuaaua

SEQ ID NO: 146558 - RNA, 22 nt, Homo sapiens
gagguugggaugagggauacag

SEQ ID NO: 146559 - RNA, 22 nt, Homo sapiens
gagugcaauggcaugaucuggg

SEQ ID NO: 146560 - RNA, 22 nt, Homo sapiens
gagugcaucguggccauuuuaa

SEQ ID NO: 146561 - RNA, 22 nt, Homo sapiens
gauaaagauagcaauagggaca

SEQ ID NO: 146562 - RNA, 22 nt, Homo sapiens
gauagcagccauucuuuuuauu

SEQ ID NO: 146563 - RNA, 21 nt, Homo sapiens
gauaucuuuauucccaagagc

SEQ ID NO: 146564 - RNA, 22 nt, Homo sapiens
gaucuggagguuuuccucauga

SEQ ID NO: 146565 - RNA, 22 nt, Homo sapiens
gaugacuaagaauuuuauaauu

SEQ ID NO: 146566 - RNA, 22 nt, Homo sapiens
gaugccuuuuuguccucaguua

SEQ ID NO: 146567 - RNA, 22 nt, Homo sapiens
gauguguuuuaggaucucagca

SEQ ID NO: 146568 - RNA, 22 nt, Homo sapiens
gauuuugguuagggaaggauac

SEQ ID NO: 146569 - RNA, 20 nt, Homo sapiens
gcaacauggccagagugaau

SEQ ID NO: 146570 - RNA, 22 nt, Homo sapiens
gcaagaguauuucaaggaagau

SEQ ID NO: 146571 - RNA, 21 nt, Homo sapiens
gcaaguacuaucaucauuauc

SEQ ID NO: 146572 - RNA, 22 nt, Homo sapiens
gcacaguguuacuugauauauu

SEQ ID NO: 146573 - RNA, 22 nt, Homo sapiens
gcacauggccccaucgugccga

SEQ ID NO: 146574 - RNA, 22 nt, Homo sapiens
gcaguggugugugccagccuag

SEQ ID NO: 146575 - RNA, 22 nt, Homo sapiens
gcagugugaucacagcuuacug

SEQ ID NO: 146576 - RNA, 22 nt, Homo sapiens
gcaugaugaauaauaucacaag

SEQ ID NO: 146577 - RNA, 22 nt, Homo sapiens
gcauggccuuuaaaugucacag

SEQ ID NO: 146578 - RNA, 22 nt, Homo sapiens
gcaugguacuggaugguaguau

SEQ ID NO: 146579 - RNA, 22 nt, Homo sapiens
gcaugugaauguguaagaaaau

SEQ ID NO: 146580 - RNA, 22 nt, Homo sapiens
gccaacauggcgcuccauucuu

SEQ ID NO: 146581 - RNA, 22 nt, Homo sapiens
gcccuguugcccaggcuggagu

SEQ ID NO: 146582 - RNA, 22 nt, Homo sapiens
gcuaggagauccacugcucucu

SEQ ID NO: 146583 - RNA, 22 nt, Homo sapiens
gcugacacugggcuauagaucu

SEQ ID NO: 146584 - RNA, 22 nt, Homo sapiens
gcugagaucucuugccugaacu

SEQ ID NO: 146585 - RNA, 22 nt, Homo sapiens
gcuggaauuaacauagaugugc

SEQ ID NO: 146586 - RNA, 22 nt, Homo sapiens
gcuggcaaaugguuauaaggcc

SEQ ID NO: 146587 - RNA, 22 nt, Homo sapiens
gcuggcaaguggccuacuuugu

SEQ ID NO: 146588 - RNA, 22 nt, Homo sapiens
gcuguguguuaucagaaauugc

SEQ ID NO: 146589 - RNA, 22 nt, Homo sapiens
ggaaagauguaauauuaucuaa

SEQ ID NO: 146590 - RNA, 22 nt, Homo sapiens
ggacuagaacugagaaucauau

SEQ ID NO: 146591 - RNA, 22 nt, Homo sapiens
ggagaucuuuguuaucuuuuga

SEQ ID NO: 146592 - RNA, 22 nt, Homo sapiens
ggagcugugauuugaguccaga

SEQ ID NO: 146593 - RNA, 22 nt, Homo sapiens
ggagggugagaucaauuuggga

SEQ ID NO: 146594 - RNA, 22 nt, Homo sapiens
ggagugucccaaucucagcuca

SEQ ID NO: 146595 - RNA, 22 nt, Homo sapiens
ggagugugauuguucucuguua

SEQ ID NO: 146596 - RNA, 21 nt, Homo sapiens
ggauucaucccucaugaauuu

SEQ ID NO: 146597 - RNA, 22 nt, Homo sapiens
ggcaaauucuuguaugccuacu

SEQ ID NO: 146598 - RNA, 21 nt, Homo sapiens
ggcaagaaacacaaucaagua

SEQ ID NO: 146599 - RNA, 22 nt, Homo sapiens
ggcaagaaccacaauuacuuuu

SEQ ID NO: 146600 - RNA, 22 nt, Homo sapiens
ggcaagaacuucacucacuuuu

SEQ ID NO: 146601 - RNA, 22 nt, Homo sapiens
ggcaagaagaacuauaacuuuu

SEQ ID NO: 146602 - RNA, 17 nt, Homo sapiens
ggcaagaaguggaacuc

SEQ ID NO: 146603 - RNA, 22 nt, Homo sapiens
ggcauguuuaguagaauguggu

SEQ ID NO: 146604 - RNA, 22 nt, Homo sapiens
gggaagguaaucauuacuugau

SEQ ID NO: 146605 - RNA, 19 nt, Homo sapiens
gggaggaugcgucuucagg

SEQ ID NO: 146606 - RNA, 22 nt, Homo sapiens
gggaggucauuguucaaugcug

SEQ ID NO: 146607 - RNA, 22 nt, Homo sapiens
gggagugugcacacaugguaua

SEQ ID NO: 146608 - RNA, 20 nt, Homo sapiens
gggcaaguaugugggaaguc

SEQ ID NO: 146609 - RNA, 22 nt, Homo sapiens
gggcauguggacuuguauguuu

SEQ ID NO: 146610 - RNA, 22 nt, Homo sapiens
gguaggcacuggugggaagaga

SEQ ID NO: 146611 - RNA, 22 nt, Homo sapiens
ggucacauugcuagcauggguu

SEQ ID NO: 146612 - RNA, 19 nt, Homo sapiens
ggugagaaauuaugggucu

SEQ ID NO: 146613 - RNA, 22 nt, Homo sapiens
ggugcagcacaccaacauggca

SEQ ID NO: 146614 - RNA, 22 nt, Homo sapiens
ggugucuuguuuaauacucauu

SEQ ID NO: 146615 - RNA, 22 nt, Homo sapiens
guaagacuuauuuucuuuauca

SEQ ID NO: 146616 - RNA, 22 nt, Homo sapiens
guaauacuuuugggauauuaga

SEQ ID NO: 146617 - RNA, 22 nt, Homo sapiens
guaaugaacuugaaagccuguu

SEQ ID NO: 146618 - RNA, 22 nt, Homo sapiens
guacaguauaguaauaggauuu

SEQ ID NO: 146619 - RNA, 22 nt, Homo sapiens
guacaguucucuuuguugucag

SEQ ID NO: 146620 - RNA, 22 nt, Homo sapiens
guagcagaacauguuccuugua

SEQ ID NO: 146621 - RNA, 22 nt, Homo sapiens
guaguuuaucagaaagaauagg

SEQ ID NO: 146622 - RNA, 22 nt, Homo sapiens
guaugcaagugauaugacauau

SEQ ID NO: 146623 - RNA, 22 nt, Homo sapiens
guauuuguugcagcagcacuau

SEQ ID NO: 146624 - RNA, 22 nt, Homo sapiens
guauuuuguuagggugugguau

SEQ ID NO: 146625 - RNA, 22 nt, Homo sapiens
gucaagauuuguaggacagaga

SEQ ID NO: 146626 - RNA, 22 nt, Homo sapiens
gucaaguguuuucaaggcuucc

SEQ ID NO: 146627 - RNA, 22 nt, Homo sapiens
gucacaguggccagugauguuc

SEQ ID NO: 146628 - RNA, 22 nt, Homo sapiens
gucaugggguacuacacauggg

SEQ ID NO: 146629 - RNA, 22 nt, Homo sapiens
gucauggguuaaagguggauac

SEQ ID NO: 146630 - RNA, 22 nt, Homo sapiens
gucauguuuaacuucuugagga

SEQ ID NO: 146631 - RNA, 22 nt, Homo sapiens
gucauuguguggacauggagaa

SEQ ID NO: 146632 - RNA, 22 nt, Homo sapiens
guccagagaagucauuacuuca

SEQ ID NO: 146633 - RNA, 22 nt, Homo sapiens
gucucccaaccccugugcccag

SEQ ID NO: 146634 - RNA, 22 nt, Homo sapiens
aguaacaggauccaaagaaugu

SEQ ID NO: 146635 - RNA, 22 nt, Homo sapiens
aguacaucuggcuggauagaua

SEQ ID NO: 146636 - RNA, 22 nt, Homo sapiens
aguagcacaugccacccugucu

SEQ ID NO: 146637 - RNA, 22 nt, Homo sapiens
agugacuagaauaugaauuuua

SEQ ID NO: 146638 - RNA, 22 nt, Homo sapiens
agugauuuuaacuuccagcaau

SEQ ID NO: 146639 - RNA, 22 nt, Homo sapiens
aguggaauuaagaaacugaauu

SEQ ID NO: 146640 - RNA, 19 nt, Homo sapiens
agugggcuagaaaucaggg

SEQ ID NO: 146641 - RNA, 19 nt, Homo sapiens
agugucauggucauuauuu

SEQ ID NO: 146642 - RNA, 22 nt, Homo sapiens
aguucaaugcucuuucuacuau

SEQ ID NO: 146643 - RNA, 17 nt, Homo sapiens
auaaacucaucauuuuu

SEQ ID NO: 146644 - RNA, 22 nt, Homo sapiens
auaaagccaggagacguaauug

SEQ ID NO: 146645 - RNA, 22 nt, Homo sapiens
auaaugcuuuucuagguugcau

SEQ ID NO: 146646 - RNA, 22 nt, Homo sapiens
auacagcuaaaauauuaaguua

SEQ ID NO: 146647 - RNA, 22 nt, Homo sapiens
auacaguguucugggaagaagu

SEQ ID NO: 146648 - RNA, 22 nt, Homo sapiens
auacccaguaguggaauugcua

SEQ ID NO: 146649 - RNA, 22 nt, Homo sapiens
auacuaugagauaauaaagacu

SEQ ID NO: 146650 - RNA, 22 nt, Homo sapiens
auagaaucaucugugcacuagu

SEQ ID NO: 146651 - RNA, 22 nt, Homo sapiens
auagaccuggagaguagauaua

SEQ ID NO: 146652 - RNA, 21 nt, Homo sapiens
auagcacaucagauuuuauua

SEQ ID NO: 146653 - RNA, 21 nt, Homo sapiens
auagcacuucacuugguuaga

SEQ ID NO: 146654 - RNA, 22 nt, Homo sapiens
auagugcuuuugaaucuuguug

SEQ ID NO: 146655 - RNA, 19 nt, Homo sapiens
auauaacauccaggagcag

SEQ ID NO: 146656 - RNA, 22 nt, Homo sapiens
auaucaaggccauuuucuaaau

SEQ ID NO: 146657 - RNA, 22 nt, Homo sapiens
auaugcauacauguaugcagga

SEQ ID NO: 146658 - RNA, 22 nt, Homo sapiens
auauguaguauggaaacauugu

SEQ ID NO: 146659 - RNA, 22 nt, Homo sapiens
auauucacuauaugcagaacca

SEQ ID NO: 146660 - RNA, 22 nt, Homo sapiens
auauuguacugcuacugguucu

SEQ ID NO: 146661 - RNA, 19 nt, Homo sapiens
aucaaacugcucuuugagg

SEQ ID NO: 146662 - RNA, 20 nt, Homo sapiens
aucagagacuaggauugcca

SEQ ID NO: 146663 - RNA, 22 nt, Homo sapiens
aucagauggcuaaaacagaaga

SEQ ID NO: 146664 - RNA, 22 nt, Homo sapiens
aucagauuccacauuuuaucag

SEQ ID NO: 146665 - RNA, 22 nt, Homo sapiens
aucagcacugaucauacagcuu

SEQ ID NO: 146666 - RNA, 22 nt, Homo sapiens
aucagcaugcagaagucggggg

SEQ ID NO: 146667 - RNA, 22 nt, Homo sapiens
aucagugauugauuuaaagacg

SEQ ID NO: 146668 - RNA, 22 nt, Homo sapiens
aucauaucaucugcaaacaaag

SEQ ID NO: 146669 - RNA, 22 nt, Homo sapiens
aucauauccuagauauaacuuc

SEQ ID NO: 146670 - RNA, 22 nt, Homo sapiens
aucauugugcaucuucauucca

SEQ ID NO: 146671 - RNA, 22 nt, Homo sapiens
auccauugucuaaugcuaagau

SEQ ID NO: 146672 - RNA, 22 nt, Homo sapiens
aucgcaccauugcacuccagca

SEQ ID NO: 146673 - RNA, 22 nt, Homo sapiens
augaaagucaauccccaagugu

SEQ ID NO: 146674 - RNA, 22 nt, Homo sapiens
augaaagugauaaaugucucua

SEQ ID NO: 146675 - RNA, 22 nt, Homo sapiens
augaaauguaugagucuggguu

SEQ ID NO: 146676 - RNA, 22 nt, Homo sapiens
augaaugcagcacuguuuuucu

SEQ ID NO: 146677 - RNA, 22 nt, Homo sapiens
augaaugucuuauuuugagaaa

SEQ ID NO: 146678 - RNA, 22 nt, Homo sapiens
augacugucagggcagucauug

SEQ ID NO: 146679 - RNA, 22 nt, Homo sapiens
augagauacuacaaaugaguuu

SEQ ID NO: 146680 - RNA, 22 nt, Homo sapiens
augagaugcaagauuagauggg

SEQ ID NO: 146681 - RNA, 22 nt, Homo sapiens
augagauuguuuguacuccaca

SEQ ID NO: 146682 - RNA, 22 nt, Homo sapiens
augagauuguuugugugaaaua

SEQ ID NO: 146683 - RNA, 22 nt, Homo sapiens
augagggaagcucacgugucca

SEQ ID NO: 146684 - RNA, 22 nt, Homo sapiens
augagggagggcaccugaccuu

SEQ ID NO: 146685 - RNA, 22 nt, Homo sapiens
augaguaugagaauacauuaag

SEQ ID NO: 146686 - RNA, 19 nt, Homo sapiens
augagucugcaagaaccag

SEQ ID NO: 146687 - RNA, 19 nt, Homo sapiens
augauugucuauggaggaa

SEQ ID NO: 146688 - RNA, 22 nt, Homo sapiens
augcacaguccagcccaugugg

SEQ ID NO: 146689 - RNA, 22 nt, Homo sapiens
augcacaugcgaaaacuugugu

SEQ ID NO: 146690 - RNA, 22 nt, Homo sapiens
augcacauggcuaacuuuuuuc

SEQ ID NO: 146691 - RNA, 22 nt, Homo sapiens
augccacuguacucuagccuag

SEQ ID NO: 146692 - RNA, 22 nt, Homo sapiens
augccacuguccuccugccuag

SEQ ID NO: 146693 - RNA, 22 nt, Homo sapiens
augccacuucucuaagucaugu

SEQ ID NO: 146694 - RNA, 22 nt, Homo sapiens
augcuauguagaugagggccca

SEQ ID NO: 146695 - RNA, 22 nt, Homo sapiens
auggaaacauaagaguauagau

SEQ ID NO: 146696 - RNA, 22 nt, Homo sapiens
auggaacauaacuauuugggga

SEQ ID NO: 146697 - RNA, 22 nt, Homo sapiens
auggaacauuauagauguaaaa

SEQ ID NO: 146698 - RNA, 20 nt, Homo sapiens
auggaccuggauuaacagca

SEQ ID NO: 146699 - RNA, 22 nt, Homo sapiens
auggagaugaauaucaucuguu

SEQ ID NO: 146700 - RNA, 22 nt, Homo sapiens
auggauuuguaguacaugguug

SEQ ID NO: 146701 - RNA, 22 nt, Homo sapiens
auggcaaaaaaugcaauuacuu

SEQ ID NO: 146702 - RNA, 22 nt, Homo sapiens
auggcacuaaugggaguuuacu

SEQ ID NO: 146703 - RNA, 22 nt, Homo sapiens
auggcacugauggaaguaccuu

SEQ ID NO: 146704 - RNA, 22 nt, Homo sapiens
auggcacuguguccugggguca

SEQ ID NO: 146705 - RNA, 22 nt, Homo sapiens
auggcacuuuggacugcuagau

SEQ ID NO: 146706 - RNA, 22 nt, Homo sapiens
auggcaguguaugauuauauua

SEQ ID NO: 146707 - RNA, 22 nt, Homo sapiens
augggcacugauguauucugug

SEQ ID NO: 146708 - RNA, 22 nt, Homo sapiens
augguacuagaguaagaauugu

SEQ ID NO: 146709 - RNA, 22 nt, Homo sapiens
auggugugugaauuaaauguua

SEQ ID NO: 146710 - RNA, 22 nt, Homo sapiens
augguuuauuuguaagcagagu

SEQ ID NO: 146711 - RNA, 22 nt, Homo sapiens
augucauagaagccugugaacc

SEQ ID NO: 146712 - RNA, 22 nt, Homo sapiens
auguccaugagcacauguauca

SEQ ID NO: 146713 - RNA, 22 nt, Homo sapiens
augucuguuugcugagcccggc

SEQ ID NO: 146714 - RNA, 22 nt, Homo sapiens
augugcacauucugguaaauau

SEQ ID NO: 146715 - RNA, 22 nt, Homo sapiens
augugcuuaaaaaugcagagaa

SEQ ID NO: 146716 - RNA, 22 nt, Homo sapiens
augugcuuauagguguauguuu

SEQ ID NO: 146717 - RNA, 22 nt, Homo sapiens
augugggaggaauguguuucca

SEQ ID NO: 146718 - RNA, 22 nt, Homo sapiens
auguugcuugaaggcauuuugu

SEQ ID NO: 146719 - RNA, 22 nt, Homo sapiens
auguuguaguaugagucaaaau

SEQ ID NO: 146720 - RNA, 22 nt, Homo sapiens
auuaacaucuagaguuuuggug

SEQ ID NO: 146721 - RNA, 20 nt, Homo sapiens
auucaaguaugccuugagaa

SEQ ID NO: 146722 - RNA, 22 nt, Homo sapiens
auucacagcuuuaaaaggcgug

SEQ ID NO: 146723 - RNA, 22 nt, Homo sapiens
auuccauagugucuguggcaga

SEQ ID NO: 146724 - RNA, 22 nt, Homo sapiens
auugaacaugccauauguacca

SEQ ID NO: 146725 - RNA, 22 nt, Homo sapiens
auugaaugaaauggcagacacu

SEQ ID NO: 146726 - RNA, 22 nt, Homo sapiens
auugcaauuaguccauagaguu

SEQ ID NO: 146727 - RNA, 22 nt, Homo sapiens
auugcacacagaaucaggguaa

SEQ ID NO: 146728 - RNA, 22 nt, Homo sapiens
auugcacaucugcacuacagcc

SEQ ID NO: 146729 - RNA, 22 nt, Homo sapiens
auugcaguuagaacagaagucu

SEQ ID NO: 146730 - RNA, 22 nt, Homo sapiens
auugcauuuucagguuggucug

SEQ ID NO: 146731 - RNA, 22 nt, Homo sapiens
auugcccaggcuggagugcagu

SEQ ID NO: 146732 - RNA, 22 nt, Homo sapiens
auugcuuaagucccuguauuag

SEQ ID NO: 146733 - RNA, 22 nt, Homo sapiens
auuggguuaaaggauaugaaca

SEQ ID NO: 146734 - RNA, 22 nt, Homo sapiens
auuguucuuguguccuuuuccu

SEQ ID NO: 146735 - RNA, 22 nt, Homo sapiens
auuucacugagacaugugccca

SEQ ID NO: 146736 - RNA, 22 nt, Homo sapiens
gugggcaaagcuaguguguaga

SEQ ID NO: 146737 - RNA, 22 nt, Homo sapiens
guggggucaucucauuugugga

SEQ ID NO: 146738 - RNA, 19 nt, Homo sapiens
gugguauuaccuuuugauu

SEQ ID NO: 146739 - RNA, 22 nt, Homo sapiens
gugguguuugagcugccaggga

SEQ ID NO: 146740 - RNA, 22 nt, Homo sapiens
guguauauccuauuaguucugu

SEQ ID NO: 146741 - RNA, 18 nt, Homo sapiens
guguauggauggaggcca

SEQ ID NO: 146742 - RNA, 22 nt, Homo sapiens
gugucuccuguggagcuaugua

SEQ ID NO: 146743 - RNA, 22 nt, Homo sapiens
gugugcaaauguguaccuacau

SEQ ID NO: 146744 - RNA, 22 nt, Homo sapiens
guguuugauugcaaauaaucua

SEQ ID NO: 146745 - RNA, 22 nt, Homo sapiens
guguuugguugauagagccacu

SEQ ID NO: 146746 - RNA, 22 nt, Homo sapiens
guuaugacacucuuuuuaucau

SEQ ID NO: 146747 - RNA, 22 nt, Homo sapiens
guuauugcucucgaagacucuc

SEQ ID NO: 146748 - RNA, 20 nt, Homo sapiens
guucacaggcuuccuuucag

SEQ ID NO: 146749 - RNA, 17 nt, Homo sapiens
guucccaguggcauuug

SEQ ID NO: 146750 - RNA, 22 nt, Homo sapiens
guugcucaggcuggagugcagu

SEQ ID NO: 146751 - RNA, 22 nt, Homo sapiens
guuguauaggcauggggagaau

SEQ ID NO: 146752 - RNA, 22 nt, Homo sapiens
guuugcacuccuaugagaaucu

SEQ ID NO: 146753 - RNA, 22 nt, Homo sapiens
uaaagcuaucacauuggugauu

SEQ ID NO: 146754 - RNA, 22 nt, Homo sapiens
uaaagcuauuauaguuauguuu

SEQ ID NO: 146755 - RNA, 22 nt, Homo sapiens
uaaagcugaaaugauuaugaca

SEQ ID NO: 146756 - RNA, 22 nt, Homo sapiens
uaaagcuuggauuuaggcuaau

SEQ ID NO: 146757 - RNA, 19 nt, Homo sapiens
uaacacaguuguguuugag

SEQ ID NO: 146758 - RNA, 22 nt, Homo sapiens
uaacaggcaaggucacaccuug

SEQ ID NO: 146759 - RNA, 22 nt, Homo sapiens
uaacuagaaaggagacaguugc

SEQ ID NO: 146760 - RNA, 22 nt, Homo sapiens
uaacugcaaccucugccugcug

SEQ ID NO: 146761 - RNA, 22 nt, Homo sapiens
uaagacugccccagacagcaag

SEQ ID NO: 146762 - RNA, 22 nt, Homo sapiens
uaagacuuuuugggaauauaga

SEQ ID NO: 146763 - RNA, 22 nt, Homo sapiens
uaagaugaaggcucaccuagaa

SEQ ID NO: 146764 - RNA, 22 nt, Homo sapiens
uaagcaguaaaugaagucuugc

SEQ ID NO: 146765 - RNA, 22 nt, Homo sapiens
uaaggauuuuggugauuacacu

SEQ ID NO: 146766 - RNA, 22 nt, Homo sapiens
uaaggcaaaccuuggcugcagu

SEQ ID NO: 146767 - RNA, 20 nt, Homo sapiens
uaaggcacugugcuuuuagg

SEQ ID NO: 146768 - RNA, 22 nt, Homo sapiens
uaaguaauuuguauuuuaccca

SEQ ID NO: 146769 - RNA, 22 nt, Homo sapiens
uaaguaguuucuggauauucuc

SEQ ID NO: 146770 - RNA, 22 nt, Homo sapiens
uaaguauuaugugcugcauuuu

SEQ ID NO: 146771 - RNA, 22 nt, Homo sapiens
uaagugaaggaaguguguuuac

SEQ ID NO: 146772 - RNA, 22 nt, Homo sapiens
uaauacuagugaauagcaggau

SEQ ID NO: 146773 - RNA, 22 nt, Homo sapiens
uaaugcacucgaaucauggaau

SEQ ID NO: 146774 - RNA, 22 nt, Homo sapiens
uaaugguuuugcaccaucccuc

SEQ ID NO: 146775 - RNA, 22 nt, Homo sapiens
uacaagcacaggcagcaggcug

SEQ ID NO: 146776 - RNA, 22 nt, Homo sapiens
uacaagcuaaaauggaagauca

SEQ ID NO: 146777 - RNA, 22 nt, Homo sapiens
uacagaauugcagguguggcag

SEQ ID NO: 146778 - RNA, 22 nt, Homo sapiens
uacaggcagguguucccugguu

SEQ ID NO: 146779 - RNA, 22 nt, Homo sapiens
uacaggugcucuacagacagga

SEQ ID NO: 146780 - RNA, 22 nt, Homo sapiens
uacagugcuuuuugguggagaa

SEQ ID NO: 146781 - RNA, 22 nt, Homo sapiens
uacaugugcaggucuguggggg

SEQ ID NO: 146782 - RNA, 22 nt, Homo sapiens
uacuagaaccuuauucagagug

SEQ ID NO: 146783 - RNA, 22 nt, Homo sapiens
uacucaguagucuguugcuguc

SEQ ID NO: 146784 - RNA, 22 nt, Homo sapiens
uacucuuuagcuccuuaaggaa

SEQ ID NO: 146785 - RNA, 22 nt, Homo sapiens
uacugcacuccacccuggguga

SEQ ID NO: 146786 - RNA, 22 nt, Homo sapiens
uacugcacuccagccuggguga

SEQ ID NO: 146787 - RNA, 22 nt, Homo sapiens
uacugcuaccuccagcuucugg

SEQ ID NO: 146788 - RNA, 22 nt, Homo sapiens
uacugguuuuauauauuucucc

SEQ ID NO: 146789 - RNA, 22 nt, Homo sapiens
uagaaaguagggaagguaggau

SEQ ID NO: 146790 - RNA, 22 nt, Homo sapiens
uagaaguaggcuacgugucugg

SEQ ID NO: 146791 - RNA, 22 nt, Homo sapiens
uagagcacaagguagauuucua

SEQ ID NO: 146792 - RNA, 22 nt, Homo sapiens
uagaggaaugaauuuggccaga

SEQ ID NO: 146793 - RNA, 22 nt, Homo sapiens
uagcaaaucaauggaauugaag

SEQ ID NO: 146794 - RNA, 22 nt, Homo sapiens
uagcagccaggaagggcuggcu

SEQ ID NO: 146795 - RNA, 22 nt, Homo sapiens
uagcagguguuccacaaauauu

SEQ ID NO: 146796 - RNA, 22 nt, Homo sapiens
uagcugagacuacaguaggugc

SEQ ID NO: 146797 - RNA, 22 nt, Homo sapiens
uagcugcugcuaggcuaaggau

SEQ ID NO: 146798 - RNA, 17 nt, Homo sapiens
uagcuucacauuaggaa

SEQ ID NO: 146799 - RNA, 22 nt, Homo sapiens
uaggaaguuuucuugcugggcc

SEQ ID NO: 146800 - RNA, 22 nt, Homo sapiens
uaggcacugagaauaugaggau

SEQ ID NO: 146801 - RNA, 22 nt, Homo sapiens
uaggcacuguguuuguaggagu

SEQ ID NO: 146802 - RNA, 22 nt, Homo sapiens
uaggcaguguucucacuuguaa

SEQ ID NO: 146803 - RNA, 22 nt, Homo sapiens
uaggugaaugcuggaagaaaug

SEQ ID NO: 146804 - RNA, 22 nt, Homo sapiens
uagguuaucucaaguguaauuu

SEQ ID NO: 146805 - RNA, 22 nt, Homo sapiens
uagguuauucauucaucauuua

SEQ ID NO: 146806 - RNA, 23 nt, Homo sapiens
uagguuauuugguaaauauaugu

SEQ ID NO: 146807 - RNA, 22 nt, Homo sapiens
uagugaauguuggcuauuaaua

SEQ ID NO: 146808 - RNA, 22 nt, Homo sapiens
uagugcugagauugagaagccc

SEQ ID NO: 146809 - RNA, 22 nt, Homo sapiens
uagugcugugauauuuuuggcc

SEQ ID NO: 146810 - RNA, 22 nt, Homo sapiens
uauacaguaggcacucaguggc

SEQ ID NO: 146811 - RNA, 21 nt, Homo sapiens
uauagcagcacgauuuauaau

SEQ ID NO: 146812 - RNA, 22 nt, Homo sapiens
uauagcuaugggauguauuugc

SEQ ID NO: 146813 - RNA, 22 nt, Homo sapiens
uauaguguuuucaaaaguaugu

SEQ ID NO: 146814 - RNA, 22 nt, Homo sapiens
uauaucuagagcggaccaggcu

SEQ ID NO: 146815 - RNA, 22 nt, Homo sapiens
uaucaagauggauaaggauaga

SEQ ID NO: 146816 - RNA, 22 nt, Homo sapiens
uaucacagaggguauccuagag

SEQ ID NO: 146817 - RNA, 22 nt, Homo sapiens
uaucacaggucaggaaucuugc

SEQ ID NO: 146818 - RNA, 20 nt, Homo sapiens
uaucacauggggagaaaccu

SEQ ID NO: 146819 - RNA, 22 nt, Homo sapiens
uaucauggaaugagguuggaca

SEQ ID NO: 146820 - RNA, 22 nt, Homo sapiens
uaucauggggacugcagccuag

SEQ ID NO: 146821 - RNA, 22 nt, Homo sapiens
uaucucagagaaucagauuuac

SEQ ID NO: 146822 - RNA, 22 nt, Homo sapiens
uaucucaguguacaggaugaua

SEQ ID NO: 146823 - RNA, 22 nt, Homo sapiens
uaugaauuuuauccaggauaua

SEQ ID NO: 146824 - RNA, 22 nt, Homo sapiens
uaugccuuuugguucaagcaac

SEQ ID NO: 146825 - RNA, 22 nt, Homo sapiens
uauggccugaauuagaaaagug

SEQ ID NO: 146826 - RNA, 22 nt, Homo sapiens
uauggguaguacaaaguguaua

SEQ ID NO: 146827 - RNA, 22 nt, Homo sapiens
uaugucauggguaaagugcccu

SEQ ID NO: 146828 - RNA, 22 nt, Homo sapiens
uauuccauuugugaaaggaagu

SEQ ID NO: 146829 - RNA, 22 nt, Homo sapiens
uauugaacuggaucagaaggcc

SEQ ID NO: 146830 - RNA, 22 nt, Homo sapiens
uauugguugcuaauuggcgcca

SEQ ID NO: 146831 - RNA, 22 nt, Homo sapiens
uauuugauuaacaagagccuaa

SEQ ID NO: 146832 - RNA, 22 nt, Homo sapiens
ucaaagugcuauggcucagguu

SEQ ID NO: 146833 - RNA, 21 nt, Homo sapiens
ucaaaguguucuuuuguugaa

SEQ ID NO: 146834 - RNA, 22 nt, Homo sapiens
ucaaaugauucagaagccaccu

SEQ ID NO: 146835 - RNA, 21 nt, Homo sapiens
ucaaauugaaauuaggucauu

SEQ ID NO: 146836 - RNA, 22 nt, Homo sapiens
ucaacagugggcacuguaaaug

SEQ ID NO: 146837 - RNA, 22 nt, Homo sapiens
ucaagcaauucgccugucucag

SEQ ID NO: 146838 - RNA, 18 nt, Homo sapiens
ucaagcaauugucaugcc

SEQ ID NO: 146839 - RNA, 22 nt, Homo sapiens
ucaaguacuuauuugauaauua

SEQ ID NO: 146840 - RNA, 22 nt, Homo sapiens
ucacaccauucuucuacuucag

SEQ ID NO: 146841 - RNA, 22 nt, Homo sapiens
ugagacaaaguuguuggauguu

SEQ ID NO: 146842 - RNA, 22 nt, Homo sapiens
ugagaccaacagauuccaguuc

SEQ ID NO: 146843 - RNA, 22 nt, Homo sapiens
ugagaccugaucuugguacugc

SEQ ID NO: 146844 - RNA, 22 nt, Homo sapiens
ugagaccuuucauuucucagug

SEQ ID NO: 146845 - RNA, 22 nt, Homo sapiens
ugagacugagucuugcucuugu

SEQ ID NO: 146846 - RNA, 22 nt, Homo sapiens
ugagacugguuaauugauaaag

SEQ ID NO: 146847 - RNA, 22 nt, Homo sapiens
ugagauaaugcaugugaagauc

SEQ ID NO: 146848 - RNA, 22 nt, Homo sapiens
ugagauaauuuacuuguugagg

SEQ ID NO: 146849 - RNA, 22 nt, Homo sapiens
ugagauagaaaacauaggagaa

SEQ ID NO: 146850 - RNA, 22 nt, Homo sapiens
ugagaugaaagcagaaagacuu

SEQ ID NO: 146851 - RNA, 22 nt, Homo sapiens
ugagaugaacuugauuguuuua

SEQ ID NO: 146852 - RNA, 19 nt, Homo sapiens
ugagaugaagacagggguu

SEQ ID NO: 146853 - RNA, 22 nt, Homo sapiens
ugagaugagagaaugcuugccu

SEQ ID NO: 146854 - RNA, 22 nt, Homo sapiens
ugagaugaggucucacucuguu

SEQ ID NO: 146855 - RNA, 22 nt, Homo sapiens
ugagaugaggucucgcucuguc

SEQ ID NO: 146856 - RNA, 22 nt, Homo sapiens
ugagaugagucucgcucuguca

SEQ ID NO: 146857 - RNA, 22 nt, Homo sapiens
ugagaugaguugcgcucugucg

SEQ ID NO: 146858 - RNA, 22 nt, Homo sapiens
ugagaugauagauauguuaauu

SEQ ID NO: 146859 - RNA, 22 nt, Homo sapiens
ugagaugaucaaaguauaggcu

SEQ ID NO: 146860 - RNA, 21 nt, Homo sapiens
ugagaugauccugcaugcaug

SEQ ID NO: 146861 - RNA, 22 nt, Homo sapiens
ugagaugauuuaauggagccca

SEQ ID NO: 146862 - RNA, 22 nt, Homo sapiens
ugagauggaguuucacuuuugu

SEQ ID NO: 146863 - RNA, 22 nt, Homo sapiens
ugagauggaguuucgcuuuugu

SEQ ID NO: 146864 - RNA, 22 nt, Homo sapiens
ugagauggcugaauucagaaua

SEQ ID NO: 146865 - RNA, 22 nt, Homo sapiens
ugagauggguaauuaaauggug

SEQ ID NO: 146866 - RNA, 22 nt, Homo sapiens
ugagauguaaucucgcucuguc

SEQ ID NO: 146867 - RNA, 22 nt, Homo sapiens
ugagauguggcuagagagguug

SEQ ID NO: 146868 - RNA, 21 nt, Homo sapiens
ugagauuaaguuguuuagaag

SEQ ID NO: 146869 - RNA, 22 nt, Homo sapiens
ugagcagagggagaaguaaauu

SEQ ID NO: 146870 - RNA, 22 nt, Homo sapiens
ugagcagugagugugcugcagg

SEQ ID NO: 146871 - RNA, 22 nt, Homo sapiens
ugagccaaguucacaccauugc

SEQ ID NO: 146872 - RNA, 22 nt, Homo sapiens
ugagcuacuacacccagcuugg

SEQ ID NO: 146873 - RNA, 22 nt, Homo sapiens
ugagcucagcuuucuuuuucac

SEQ ID NO: 146874 - RNA, 22 nt, Homo sapiens
ugagcucaugcauucuugagga

SEQ ID NO: 146875 - RNA, 22 nt, Homo sapiens
ugagcugagaaaugcagcagcu

SEQ ID NO: 146876 - RNA, 22 nt, Homo sapiens
ugagcugagacaauaaguuuuu

SEQ ID NO: 146877 - RNA, 22 nt, Homo sapiens
ugagcugagauuaagcugcugc

SEQ ID NO: 146878 - RNA, 18 nt, Homo sapiens
ugaggaaaggguuugcua

SEQ ID NO: 146879 - RNA, 22 nt, Homo sapiens
ugagguaggugaagaaugcacg

SEQ ID NO: 146880 - RNA, 22 nt, Homo sapiens
ugagguaugacuuauuauucuu

SEQ ID NO: 146881 - RNA, 23 nt, Homo sapiens
ugagguguuaagcagacuugucu

SEQ ID NO: 146882 - RNA, 22 nt, Homo sapiens
ugagguuggggucagggcuagc

SEQ ID NO: 146883 - RNA, 22 nt, Homo sapiens
ugagguugguauuacugucucu

SEQ ID NO: 146884 - RNA, 22 nt, Homo sapiens
ugaguagaacuccuggagaugu

SEQ ID NO: 146885 - RNA, 22 nt, Homo sapiens
ugagucauguaauaaugcugcu

SEQ ID NO: 146886 - RNA, 22 nt, Homo sapiens
ugagucauuuccuuaugcuacu

SEQ ID NO: 146887 - RNA, 22 nt, Homo sapiens
ugagugaaugugaaggcuaggg

SEQ ID NO: 146888 - RNA, 22 nt, Homo sapiens
ugaguggagaucgcaccauugc

SEQ ID NO: 146889 - RNA, 22 nt, Homo sapiens
ugaguuguaggggucaccuggc

SEQ ID NO: 146890 - RNA, 23 nt, Homo sapiens
ugauaacagcauaugaagauucu

SEQ ID NO: 146891 - RNA, 22 nt, Homo sapiens
ugauauauugaaugaugaaaca

SEQ ID NO: 146892 - RNA, 23 nt, Homo sapiens
ugauaugccuaggaguauauuuu

SEQ ID NO: 146893 - RNA, 22 nt, Homo sapiens
ugaucacagcuugacuaaagga

SEQ ID NO: 146894 - RNA, 22 nt, Homo sapiens
ugaugacauugucacagucuga

SEQ ID NO: 146895 - RNA, 22 nt, Homo sapiens
ugauggcacagugaguuccagg

SEQ ID NO: 146896 - RNA, 22 nt, Homo sapiens
ugaugguaguucagucaaugua

SEQ ID NO: 146897 - RNA, 22 nt, Homo sapiens
ugauuuccaugagaacaugccu

SEQ ID NO: 146898 - RNA, 22 nt, Homo sapiens
ugauuugucugcaggaauagug

SEQ ID NO: 146899 - RNA, 22 nt, Homo sapiens
ugcaaaugcugcuauuucucuu

SEQ ID NO: 146900 - RNA, 20 nt, Homo sapiens
ugcaguguccucacuuguca

SEQ ID NO: 146901 - RNA, 22 nt, Homo sapiens
ugcaguuuaggaacugguaaca

SEQ ID NO: 146902 - RNA, 22 nt, Homo sapiens
ugcaugaugcugagauuuggga

SEQ ID NO: 146903 - RNA, 22 nt, Homo sapiens
ugcauugcacuugcaugagaua

SEQ ID NO: 146904 - RNA, 22 nt, Homo sapiens
ugccuacucucugccaggaaug

SEQ ID NO: 146905 - RNA, 22 nt, Homo sapiens
ugccugcugucuaauauauucu

SEQ ID NO: 146906 - RNA, 22 nt, Homo sapiens
ugccuggagagcuccuacauau

SEQ ID NO: 146907 - RNA, 22 nt, Homo sapiens
ugcugcaaucucggcacuuugg

SEQ ID NO: 146908 - RNA, 22 nt, Homo sapiens
ugcugcuguuguuguuacuagc

SEQ ID NO: 146909 - RNA, 22 nt, Homo sapiens
ugcuguguugcuggcuuaaaga

SEQ ID NO: 146910 - RNA, 22 nt, Homo sapiens
ugcuugagacacauaugaauuu

SEQ ID NO: 146911 - RNA, 22 nt, Homo sapiens
ugcuuuguugaaaaucauuugg

SEQ ID NO: 146912 - RNA, 22 nt, Homo sapiens
uggaaaguacugagguccaccu

SEQ ID NO: 146913 - RNA, 22 nt, Homo sapiens
uggaaaguaguucuaaucuaag

SEQ ID NO: 146914 - RNA, 22 nt, Homo sapiens
uucucuaguuacuuuaauggag

SEQ ID NO: 146915 - RNA, 22 nt, Homo sapiens
uucugagguuauauucucucaa

SEQ ID NO: 146916 - RNA, 22 nt, Homo sapiens
uucugugguagaaaucucaaau

SEQ ID NO: 146917 - RNA, 22 nt, Homo sapiens
uucuuccagccuugaggggccc

SEQ ID NO: 146918 - RNA, 22 nt, Homo sapiens
uucuugcugaauugugcccuuc

SEQ ID NO: 146919 - RNA, 22 nt, Homo sapiens
uucuugcuguauccucacaugg

SEQ ID NO: 146920 - RNA, 22 nt, Homo sapiens
uugaaagucuaggcuuacagua

SEQ ID NO: 146921 - RNA, 22 nt, Homo sapiens
uugaaauguuuagaaguuugga

SEQ ID NO: 146922 - RNA, 22 nt, Homo sapiens
uugaagugaagaacaauaucac

SEQ ID NO: 146923 - RNA, 22 nt, Homo sapiens
uugaaugucuauuaaguuguuu

SEQ ID NO: 146924 - RNA, 22 nt, Homo sapiens
uugaauguguugggaagcccuu

SEQ ID NO: 146925 - RNA, 22 nt, Homo sapiens
uugacauaaucauuucacagug

SEQ ID NO: 146926 - RNA, 22 nt, Homo sapiens
uugagacggagucuugcucuuu

SEQ ID NO: 146927 - RNA, 22 nt, Homo sapiens
uugagacggaguuuugcucuug

SEQ ID NO: 146928 - RNA, 22 nt, Homo sapiens
uugagaugauggauaugcuaau

SEQ ID NO: 146929 - RNA, 22 nt, Homo sapiens
uugagauggagucuugcucuug

SEQ ID NO: 146930 - RNA, 22 nt, Homo sapiens
uugagauggaguuucaauauug

SEQ ID NO: 146931 - RNA, 22 nt, Homo sapiens
uugagauggaguuuugcucuug

SEQ ID NO: 146932 - RNA, 22 nt, Homo sapiens
uugagauggugccacuguacuc

SEQ ID NO: 146933 - RNA, 22 nt, Homo sapiens
uugagauguaagauguuaauau

SEQ ID NO: 146934 - RNA, 22 nt, Homo sapiens
uugagauguauguauauaaugu

SEQ ID NO: 146935 - RNA, 22 nt, Homo sapiens
uugaggaaugugauuucaaaua

SEQ ID NO: 146936 - RNA, 22 nt, Homo sapiens
uugauaagaaaugccaguuugg

SEQ ID NO: 146937 - RNA, 22 nt, Homo sapiens
uugauacuagagucuuucugac

SEQ ID NO: 146938 - RNA, 22 nt, Homo sapiens
uugauauguaguuggacuugau

SEQ ID NO: 146939 - RNA, 22 nt, Homo sapiens
uugauauuacucaguaacagau

SEQ ID NO: 146940 - RNA, 22 nt, Homo sapiens
uugauguugaggacauaaaccu

SEQ ID NO: 146941 - RNA, 20 nt, Homo sapiens
uugauucccucuaaacucgc

SEQ ID NO: 146942 - RNA, 22 nt, Homo sapiens
uugcaaaguugccaaggaagga

SEQ ID NO: 146943 - RNA, 22 nt, Homo sapiens
uugcaacauguauucuggugau

SEQ ID NO: 146944 - RNA, 22 nt, Homo sapiens
uugcaaguggagcuuccagggc

SEQ ID NO: 146945 - RNA, 22 nt, Homo sapiens
uugcacuccagccugggugaca

SEQ ID NO: 146946 - RNA, 22 nt, Homo sapiens
uugcacuccagccuuggggaga

SEQ ID NO: 146947 - RNA, 22 nt, Homo sapiens
uugcacuccauccuggguugac

SEQ ID NO: 146948 - RNA, 18 nt, Homo sapiens
uugcacuccugccugggu

SEQ ID NO: 146949 - RNA, 19 nt, Homo sapiens
uugcauauguugaaccagg

SEQ ID NO: 146950 - RNA, 22 nt, Homo sapiens
uugcauuuucuaggagggcaaa

SEQ ID NO: 146951 - RNA, 21 nt, Homo sapiens
uugccugacacuggaagaaau

SEQ ID NO: 146952 - RNA, 22 nt, Homo sapiens
uugccugagaagccaagaauaa

SEQ ID NO: 146953 - RNA, 22 nt, Homo sapiens
uugcuagaugaaaaugguaccu

SEQ ID NO: 146954 - RNA, 22 nt, Homo sapiens
uugcuccucugccaggaccugu

SEQ ID NO: 146955 - RNA, 22 nt, Homo sapiens
uuggaaaccucugcagguguuu

SEQ ID NO: 146956 - RNA, 22 nt, Homo sapiens
uuggacucccuccccagcuuca

SEQ ID NO: 146957 - RNA, 22 nt, Homo sapiens
uuggagagugauauucagaugc

SEQ ID NO: 146958 - RNA, 22 nt, Homo sapiens
uuggauauucaguuuuuccauc

SEQ ID NO: 146959 - RNA, 22 nt, Homo sapiens
uuggauuauaaacugagauuug

SEQ ID NO: 146960 - RNA, 22 nt, Homo sapiens
uuggccccuuucauccacagcu

SEQ ID NO: 146961 - RNA, 22 nt, Homo sapiens
uugggauggaaauuuguacccc

SEQ ID NO: 146962 - RNA, 22 nt, Homo sapiens
uugguaaaaugaccacagacau

SEQ ID NO: 146963 - RNA, 22 nt, Homo sapiens
uugguaagguggaugaugaaua

SEQ ID NO: 146964 - RNA, 22 nt, Homo sapiens
uuggucaucucccuccuuuuag

SEQ ID NO: 146965 - RNA, 22 nt, Homo sapiens
uugguucucuuagccaucuuaa

SEQ ID NO: 146966 - RNA, 23 nt, Homo sapiens
uuguaacuggagaguaacauucc

SEQ ID NO: 146967 - RNA, 22 nt, Homo sapiens
uuguaauggagcaaacagguug

SEQ ID NO: 146968 - RNA, 23 nt, Homo sapiens
uuguacacuaagaaucgcagaug

SEQ ID NO: 146969 - RNA, 22 nt, Homo sapiens
uuguaguguuuauucugucaac

SEQ ID NO: 146970 - RNA, 22 nt, Homo sapiens
uuguauguuguuugucagagaa

SEQ ID NO: 146971 - RNA, 22 nt, Homo sapiens
uuguccaagucccauuuguuga

SEQ ID NO: 146972 - RNA, 22 nt, Homo sapiens
uuguccuugagauaguuugcug

SEQ ID NO: 146973 - RNA, 22 nt, Homo sapiens
uugucuccuagacgaccaggcg

SEQ ID NO: 146974 - RNA, 22 nt, Homo sapiens
uugugaagaaaccagaaaaguu

SEQ ID NO: 146975 - RNA, 22 nt, Homo sapiens
uugugagggagcuaagaugagu

SEQ ID NO: 146976 - RNA, 22 nt, Homo sapiens
uugugccauucuucugccucag

SEQ ID NO: 146977 - RNA, 22 nt, Homo sapiens
uugugcuccugugagaaucuag

SEQ ID NO: 146978 - RNA, 16 nt, Homo sapiens
uuguggcuuuugcaca

SEQ ID NO: 146979 - RNA, 22 nt, Homo sapiens
uuguguuuuuaguagggaaggg

SEQ ID NO: 146980 - RNA, 22 nt, Homo sapiens
uuuaaagcuaaaauauguuuau

SEQ ID NO: 146981 - RNA, 22 nt, Homo sapiens
uuuaagguauguggugaaaauu

SEQ ID NO: 146982 - RNA, 19 nt, Homo sapiens
uuuagaucuuuuaugcagc

SEQ ID NO: 146983 - RNA, 22 nt, Homo sapiens
uuuauguggagcacuugacaca

SEQ ID NO: 146984 - RNA, 18 nt, Homo sapiens
uuucaagucuuaggugac

SEQ ID NO: 146985 - RNA, 19 nt, Homo sapiens
uuucacacucgccuacuuc

SEQ ID NO: 146986 - RNA, 16 nt, Homo sapiens
uuucaucaguuuuaau

SEQ ID NO: 146987 - RNA, 22 nt, Homo sapiens
uuucauggaauauagucauuuu

SEQ ID NO: 146988 - RNA, 22 nt, Homo sapiens
uuucccauuguucugcucugug

SEQ ID NO: 146989 - RNA, 21 nt, Homo sapiens
uuuccuggagcguauggcuuc

SEQ ID NO: 146990 - RNA, 21 nt, Homo sapiens
uuucugggggagcauggcagg

SEQ ID NO: 146991 - RNA, 22 nt, Homo sapiens
uuugaugcaucucuacuuuguu

SEQ ID NO: 146992 - RNA, 22 nt, Homo sapiens
aagauauguuaguuauaaacuc

SEQ ID NO: 146993 - RNA, 22 nt, Homo sapiens
aagcagauguguugaaaguacu

SEQ ID NO: 146994 - RNA, 22 nt, Homo sapiens
aagcaggugugggaggaaaugg

SEQ ID NO: 146995 - RNA, 22 nt, Homo sapiens
aagcaucauuuggaauuugaga

SEQ ID NO: 146996 - RNA, 22 nt, Homo sapiens
aagccacuguaccugucucuua

SEQ ID NO: 146997 - RNA, 22 nt, Homo sapiens
aagcuacauuuuauuuauguca

SEQ ID NO: 146998 - RNA, 22 nt, Homo sapiens
aagcuacuuuggugguuccuua

SEQ ID NO: 146999 - RNA, 22 nt, Homo sapiens
aagcuggagugcaguggugcaa

SEQ ID NO: 147000 - RNA, 22 nt, Homo sapiens
aagcuggcauucauucguucuu

SEQ ID NO: 147001 - RNA, 22 nt, Homo sapiens
aagcugguuuuauaucugugag

SEQ ID NO: 147002 - RNA, 22 nt, Homo sapiens
aaggaacuggaauauuuugaac

SEQ ID NO: 147003 - RNA, 22 nt, Homo sapiens
aaggcacugaacuuaaauucug

SEQ ID NO: 147004 - RNA, 22 nt, Homo sapiens
aaggcuguucauuuagcacagu

SEQ ID NO: 147005 - RNA, 22 nt, Homo sapiens
aaggcuguuguguaauaggauu

SEQ ID NO: 147006 - RNA, 22 nt, Homo sapiens
aagguauuuuugucuauaucuu

SEQ ID NO: 147007 - RNA, 22 nt, Homo sapiens
aaguauagcuaugauaaacauu

SEQ ID NO: 147008 - RNA, 22 nt, Homo sapiens
aagucaugaagaggaaaggaca

SEQ ID NO: 147009 - RNA, 19 nt, Homo sapiens
aagugaaugcuuuguucac

SEQ ID NO: 147010 - RNA, 20 nt, Homo sapiens
aagugcaucguugugucugc

SEQ ID NO: 147011 - RNA, 22 nt, Homo sapiens
aagugcuuuacacaugcaugau

SEQ ID NO: 147012 - RNA, 22 nt, Homo sapiens
aaguguaugaaacaguccaugg

SEQ ID NO: 147013 - RNA, 22 nt, Homo sapiens
aauacuggcacugaagaccaug

SEQ ID NO: 147014 - RNA, 22 nt, Homo sapiens
aauacuuccaaaucuagucauu

SEQ ID NO: 147015 - RNA, 22 nt, Homo sapiens
aauauguccuugaaauggugcu

SEQ ID NO: 147016 - RNA, 22 nt, Homo sapiens
aaucacauugaaucugcuaccu

SEQ ID NO: 147017 - RNA, 22 nt, Homo sapiens
aaucagcacacugugcuuucca

SEQ ID NO: 147018 - RNA, 22 nt, Homo sapiens
aauccaugugcuuuaccauuuu

SEQ ID NO: 147019 - RNA, 22 nt, Homo sapiens
aaucugucaguuuuguguuaau

SEQ ID NO: 147020 - RNA, 22 nt, Homo sapiens
aaucugucuuuuguuauugagg

SEQ ID NO: 147021 - RNA, 22 nt, Homo sapiens
aauuaguuggcugccuaugauu

SEQ ID NO: 147022 - RNA, 22 nt, Homo sapiens
aauuaguuggcugggugcggug

SEQ ID NO: 147023 - RNA, 22 nt, Homo sapiens
aauugcaauggacaaugcagca

SEQ ID NO: 147024 - RNA, 22 nt, Homo sapiens
aauugguuaagauaagaucaua

SEQ ID NO: 147025 - RNA, 22 nt, Homo sapiens
acaaagcuagggaauccaucuu

SEQ ID NO: 147026 - RNA, 23 nt, Homo sapiens
acacaguaaacuaaaagcuagcu

SEQ ID NO: 147027 - RNA, 22 nt, Homo sapiens
acaccuguggucccaguaacuu

SEQ ID NO: 147028 - RNA, 20 nt, Homo sapiens
acagcauagccuuuuaaagc

SEQ ID NO: 147029 - RNA, 22 nt, Homo sapiens
acaguacaugauaaauaaggua

SEQ ID NO: 147030 - RNA, 22 nt, Homo sapiens
acaguacuuuuggauuugugaa

SEQ ID NO: 147031 - RNA, 22 nt, Homo sapiens
acaguagaaaacaauggauuug

SEQ ID NO: 147032 - RNA, 18 nt, Homo sapiens
acagugcuggcaugagau

SEQ ID NO: 147033 - RNA, 22 nt, Homo sapiens
acagugcuuucaauguucagua

SEQ ID NO: 147034 - RNA, 22 nt, Homo sapiens
acagugcuuuuguuccucuccu

SEQ ID NO: 147035 - RNA, 22 nt, Homo sapiens
acaguguguguguucaccuaga

SEQ ID NO: 147036 - RNA, 22 nt, Homo sapiens
acauaguagacacugaaaauau

SEQ ID NO: 147037 - RNA, 18 nt, Homo sapiens
acaucccaugcuggggug

SEQ ID NO: 147038 - RNA, 17 nt, Homo sapiens
acaugagacuggauucu

SEQ ID NO: 147039 - RNA, 22 nt, Homo sapiens
acaugcauccaugugaagagac

SEQ ID NO: 147040 - RNA, 22 nt, Homo sapiens
acaugguacugauuuacgaaau

SEQ ID NO: 147041 - RNA, 22 nt, Homo sapiens
accacagugcuuccugcucacg

SEQ ID NO: 147042 - RNA, 22 nt, Homo sapiens
acccucagaccaguuucccugg

SEQ ID NO: 147043 - RNA, 22 nt, Homo sapiens
accuguauaacaagugggaaau

SEQ ID NO: 147044 - RNA, 22 nt, Homo sapiens
acuaugcuuuucuuagaauuaa

SEQ ID NO: 147045 - RNA, 22 nt, Homo sapiens
acucagagugggccccuagaua

SEQ ID NO: 147046 - RNA, 22 nt, Homo sapiens
acugcauaaauauguguaauau

SEQ ID NO: 147047 - RNA, 22 nt, Homo sapiens
acugcauuugucccuuuugaac

SEQ ID NO: 147048 - RNA, 22 nt, Homo sapiens
acugugcuguuuuaauuauuga

SEQ ID NO: 147049 - RNA, 22 nt, Homo sapiens
acuugacacuuauauuacucac

SEQ ID NO: 147050 - RNA, 22 nt, Homo sapiens
agaaacacagguggaauugcuu

SEQ ID NO: 147051 - RNA, 22 nt, Homo sapiens
agaacuguccauucagcaugaa

SEQ ID NO: 147052 - RNA, 22 nt, Homo sapiens
agaagugcuggguucaggcugg

SEQ ID NO: 147053 - RNA, 22 nt, Homo sapiens
agagaacugauucagggaaaau

SEQ ID NO: 147054 - RNA, 22 nt, Homo sapiens
agagaacuguuuacacguuaau

SEQ ID NO: 147055 - RNA, 22 nt, Homo sapiens
agaucacaguaccguaaggcug

SEQ ID NO: 147056 - RNA, 22 nt, Homo sapiens
agauggugugcuaggaaaugua

SEQ ID NO: 147057 - RNA, 22 nt, Homo sapiens
agauucauccaaguuguugcau

SEQ ID NO: 147058 - RNA, 23 nt, Homo sapiens
agcaaaugcucuagcacuccaac

SEQ ID NO: 147059 - RNA, 22 nt, Homo sapiens
agcagcucaugccuuugggagg

SEQ ID NO: 147060 - RNA, 22 nt, Homo sapiens
agcagguguccacaauguuugc

SEQ ID NO: 147061 - RNA, 22 nt, Homo sapiens
agcagugugaaaauggacuaau

SEQ ID NO: 147062 - RNA, 22 nt, Homo sapiens
agcagugugagaauggacuaau

SEQ ID NO: 147063 - RNA, 17 nt, Homo sapiens
agcauguguuugagauu

SEQ ID NO: 147064 - RNA, 21 nt, Homo sapiens
agccugugggucauaguugcc

SEQ ID NO: 147065 - RNA, 23 nt, Homo sapiens
agccuguugccuaggcagcucau

SEQ ID NO: 147066 - RNA, 22 nt, Homo sapiens
agccuucauucugacaguagga

SEQ ID NO: 147067 - RNA, 19 nt, Homo sapiens
agcuagugcucagcuguca

SEQ ID NO: 147068 - RNA, 22 nt, Homo sapiens
agcucuauuagaagccgugggu

SEQ ID NO: 147069 - RNA, 20 nt, Homo sapiens
agcuggguguguuggugcau

SEQ ID NO: 147070 - RNA, 19 nt, Homo sapiens
agcuguguugccugugaga

SEQ ID NO: 147071 - RNA, 22 nt, Homo sapiens
agcuuguuuuccugcaacuaga

SEQ ID NO: 147072 - RNA, 22 nt, Homo sapiens
aggaagguaaacuaacuugccu

SEQ ID NO: 147073 - RNA, 18 nt, Homo sapiens
aggaaugguaauacuuca

SEQ ID NO: 147074 - RNA, 22 nt, Homo sapiens
aggaccccucaucagcaccagu

SEQ ID NO: 147075 - RNA, 22 nt, Homo sapiens
aggagaauugguucuucuugau

SEQ ID NO: 147076 - RNA, 22 nt, Homo sapiens
aggagaugaagcuuuaucuaaa

SEQ ID NO: 147077 - RNA, 21 nt, Homo sapiens
aggagcauuguugugguggag

SEQ ID NO: 147078 - RNA, 22 nt, Homo sapiens
aggaggauugcuuucaucuuuu

SEQ ID NO: 147079 - RNA, 21 nt, Homo sapiens
aggcaagauuacuuacgagca

SEQ ID NO: 147080 - RNA, 22 nt, Homo sapiens
aggguaguaggcuugggauugg

SEQ ID NO: 147081 - RNA, 22 nt, Homo sapiens
uucaagugguucagaagucuga

SEQ ID NO: 147082 - RNA, 22 nt, Homo sapiens
uucauaguaacaguaacuaugg

SEQ ID NO: 147083 - RNA, 22 nt, Homo sapiens
uucauagucuaugcaaguaaga

SEQ ID NO: 147084 - RNA, 22 nt, Homo sapiens
uucauaguguaccugaaggcac

SEQ ID NO: 147085 - RNA, 21 nt, Homo sapiens
uucaucuggccguauuccagg

SEQ ID NO: 147086 - RNA, 22 nt, Homo sapiens
uucauggaguuuaaauuguagu

SEQ ID NO: 147087 - RNA, 22 nt, Homo sapiens
uucauggaugcauuugaggggu

SEQ ID NO: 147088 - RNA, 22 nt, Homo sapiens
uucauguagucaucauccugcu

SEQ ID NO: 147089 - RNA, 22 nt, Homo sapiens
uuccagagucaccuuucugucg

SEQ ID NO: 147090 - RNA, 22 nt, Homo sapiens
uuccaguaauagcacagcauug

SEQ ID NO: 147091 - RNA, 22 nt, Homo sapiens
uucccagagagggacuucuaau

SEQ ID NO: 147092 - RNA, 22 nt, Homo sapiens
uucccuguaucuucugccaugu

SEQ ID NO: 147093 - RNA, 22 nt, Homo sapiens
uucccuuugaauuggaaaggug

SEQ ID NO: 147094 - RNA, 22 nt, Homo sapiens
uuccuugguucagggaaggucc

SEQ ID NO: 147095 - RNA, 22 nt, Homo sapiens
uucucaguaauuccagauuuuu

SEQ ID NO: 147096 - RNA, 22 nt, Homo sapiens
uucucagugcuaucuuuuaugc

SEQ ID NO: 147097 - RNA, 22 nt, Homo sapiens
uucuccugguggacccuaaacg

SEQ ID NO: 147098 - RNA, 22 nt, Homo sapiens
uucugugcuuguggaugaagug

SEQ ID NO: 147099 - RNA, 22 nt, Homo sapiens
uucugugguugaaaggagagau

SEQ ID NO: 147100 - RNA, 22 nt, Homo sapiens
uugaaauguguaagcuccgaaa

SEQ ID NO: 147101 - RNA, 22 nt, Homo sapiens
uugaauagacagccagcuuuaa

SEQ ID NO: 147102 - RNA, 22 nt, Homo sapiens
uugaauguacuuguucucacua

SEQ ID NO: 147103 - RNA, 23 nt, Homo sapiens
uugaauguuuccccucccaaauu

SEQ ID NO: 147104 - RNA, 22 nt, Homo sapiens
uugacaaggagugggguugaga

SEQ ID NO: 147105 - RNA, 22 nt, Homo sapiens
uugagaagugucuguucauguc

SEQ ID NO: 147106 - RNA, 22 nt, Homo sapiens
uugagauacauaauuaugaaug

SEQ ID NO: 147107 - RNA, 22 nt, Homo sapiens
uugagauccuuuugcucaucag

SEQ ID NO: 147108 - RNA, 22 nt, Homo sapiens
uugagauggagucuugcacugu

SEQ ID NO: 147109 - RNA, 22 nt, Homo sapiens
uugagauggauagacauagcau

SEQ ID NO: 147110 - RNA, 22 nt, Homo sapiens
uugagauuauuguguuccuuua

SEQ ID NO: 147111 - RNA, 22 nt, Homo sapiens
uugagcuccucucaaccuaagg

SEQ ID NO: 147112 - RNA, 22 nt, Homo sapiens
uugaggaaugucauuuguguuu

SEQ ID NO: 147113 - RNA, 22 nt, Homo sapiens
uugagggaggccucaguuuaca

SEQ ID NO: 147114 - RNA, 22 nt, Homo sapiens
uugaggugggaggaucacuuga

SEQ ID NO: 147115 - RNA, 22 nt, Homo sapiens
uugauaguuuaauuaaugcuag

SEQ ID NO: 147116 - RNA, 22 nt, Homo sapiens
uggggugugagggagaaagaaa

SEQ ID NO: 147117 - RNA, 22 nt, Homo sapiens
uggguagagaaucaggaucuua

SEQ ID NO: 147118 - RNA, 22 nt, Homo sapiens
uggguagauaucauaguugccc

SEQ ID NO: 147119 - RNA, 22 nt, Homo sapiens
uggucaaaugccaaucuguagu

SEQ ID NO: 147120 - RNA, 22 nt, Homo sapiens
uggucagaaaauuacuugauau

SEQ ID NO: 147121 - RNA, 19 nt, Homo sapiens
uggucccccgcaaucucau

SEQ ID NO: 147122 - RNA, 22 nt, Homo sapiens
uggugagaaaagaugucuuugu

SEQ ID NO: 147123 - RNA, 20 nt, Homo sapiens
ugguguuugaacagugaaug

SEQ ID NO: 147124 - RNA, 22 nt, Homo sapiens
ugguuguuuuaaaugucgucug

SEQ ID NO: 147125 - RNA, 22 nt, Homo sapiens
uguaaaucugguuaauuggaua

SEQ ID NO: 147126 - RNA, 20 nt, Homo sapiens
uguaaucuaaguuuuaagcc

SEQ ID NO: 147127 - RNA, 22 nt, Homo sapiens
uguaaugaucaaaucagaguaa

SEQ ID NO: 147128 - RNA, 22 nt, Homo sapiens
uguaauuuaaaugauccuugga

SEQ ID NO: 147129 - RNA, 22 nt, Homo sapiens
uguacacauaugugggguacau

SEQ ID NO: 147130 - RNA, 22 nt, Homo sapiens
uguacaugggacaggaggagag

SEQ ID NO: 147131 - RNA, 22 nt, Homo sapiens
uguagauaucauuagugcugug

SEQ ID NO: 147132 - RNA, 22 nt, Homo sapiens
uguagcacauuugaagagaagc

SEQ ID NO: 147133 - RNA, 22 nt, Homo sapiens
uguagggagagggaguugcacc

SEQ ID NO: 147134 - RNA, 22 nt, Homo sapiens
uguauaguugagucaaguuuca

SEQ ID NO: 147135 - RNA, 22 nt, Homo sapiens
ugucaguggucuggaugcagcc

SEQ ID NO: 147136 - RNA, 22 nt, Homo sapiens
ugucaugaacucacauucuggg

SEQ ID NO: 147137 - RNA, 22 nt, Homo sapiens
ugucauguggcuaacgauucau

SEQ ID NO: 147138 - RNA, 22 nt, Homo sapiens
uguccaaauugaaucaucuggu

SEQ ID NO: 147139 - RNA, 19 nt, Homo sapiens
ugucccagccauagaggca

SEQ ID NO: 147140 - RNA, 22 nt, Homo sapiens
uguccuggugaugcccaaauuc

SEQ ID NO: 147141 - RNA, 22 nt, Homo sapiens
ugucuagaucugaauguaauug

SEQ ID NO: 147142 - RNA, 22 nt, Homo sapiens
ugucuuguagacaauguauagu

SEQ ID NO: 147143 - RNA, 22 nt, Homo sapiens
ugugaagauggacuaauauagu

SEQ ID NO: 147144 - RNA, 22 nt, Homo sapiens
ugugaauggugcugcaaugaac

SEQ ID NO: 147145 - RNA, 22 nt, Homo sapiens
ugugaauggugcuuccuagaug

SEQ ID NO: 147146 - RNA, 22 nt, Homo sapiens
ugugacaaauuuaguggacugu

SEQ ID NO: 147147 - RNA, 22 nt, Homo sapiens
ugugagaaaugcagaaucucag

SEQ ID NO: 147148 - RNA, 22 nt, Homo sapiens
ugugauugauuaaugugugcua

SEQ ID NO: 147149 - RNA, 22 nt, Homo sapiens
ugugcaguuuuagcguauuuua

SEQ ID NO: 147150 - RNA, 22 nt, Homo sapiens
ugugccacugcacucugggcaa

SEQ ID NO: 147151 - RNA, 22 nt, Homo sapiens
ugugccugagguuaacauuguu

SEQ ID NO: 147152 - RNA, 22 nt, Homo sapiens
ugugcuugaaauucaguuuuga

SEQ ID NO: 147153 - RNA, 22 nt, Homo sapiens
uguggcaaagucuugugaauau

SEQ ID NO: 147154 - RNA, 22 nt, Homo sapiens
uguguaaagcuuguuccagaaa

SEQ ID NO: 147155 - RNA, 22 nt, Homo sapiens
uguguaauacucuaaugaugca

SEQ ID NO: 147156 - RNA, 22 nt, Homo sapiens
ugugucuugcuggugccugcau

SEQ ID NO: 147157 - RNA, 16 nt, Homo sapiens
ugugucuugggcccug

SEQ ID NO: 147158 - RNA, 22 nt, Homo sapiens
uguuaacauggucucagucugu

SEQ ID NO: 147159 - RNA, 22 nt, Homo sapiens
uguuacagugacuaauguuuua

SEQ ID NO: 147160 - RNA, 22 nt, Homo sapiens
uguucacaguguuucuuugaga

SEQ ID NO: 147161 - RNA, 22 nt, Homo sapiens
uguugcuuaagccacccagucu

SEQ ID NO: 147162 - RNA, 22 nt, Homo sapiens
uguuuuggaggccagaagucca

SEQ ID NO: 147163 - RNA, 22 nt, Homo sapiens
uuaaagcuggcguuacaguuug

SEQ ID NO: 147164 - RNA, 22 nt, Homo sapiens
uuaaaugcuagaauuuucuuug

SEQ ID NO: 147165 - RNA, 22 nt, Homo sapiens
uuaaaugcucacauaaagguag

SEQ ID NO: 147166 - RNA, 22 nt, Homo sapiens
uuaacacugccauugauacugu

SEQ ID NO: 147167 - RNA, 22 nt, Homo sapiens
uuaagcaguaguuaaggagagg

SEQ ID NO: 147168 - RNA, 22 nt, Homo sapiens
uuaaggcagugucuaugccagu

SEQ ID NO: 147169 - RNA, 22 nt, Homo sapiens
uuaaguaaucagagaagagaac

SEQ ID NO: 147170 - RNA, 22 nt, Homo sapiens
uuaaguuaggcuucagcagucu

SEQ ID NO: 147171 - RNA, 22 nt, Homo sapiens
uuaauacucuucuaaguagucc

SEQ ID NO: 147172 - RNA, 22 nt, Homo sapiens
uuaaugaacuuuauuuuguaga

SEQ ID NO: 147173 - RNA, 22 nt, Homo sapiens
uuaauuguccauuauucuguuc

SEQ ID NO: 147174 - RNA, 22 nt, Homo sapiens
uuacaccuguaauccagcacuu

SEQ ID NO: 147175 - RNA, 22 nt, Homo sapiens
uuacagucuuaggcagugcuuu

SEQ ID NO: 147176 - RNA, 23 nt, Homo sapiens
uuacaguggcaugaucucugcuc

SEQ ID NO: 147177 - RNA, 20 nt, Homo sapiens
uuacagugggaccuuccuga

SEQ ID NO: 147178 - RNA, 19 nt, Homo sapiens
uuacagugugcccuuuuag

SEQ ID NO: 147179 - RNA, 22 nt, Homo sapiens
uuacugcucuuuugucaugagu

SEQ ID NO: 147180 - RNA, 22 nt, Homo sapiens
uuagcacuugggaguauuuauu

SEQ ID NO: 147181 - RNA, 22 nt, Homo sapiens
uuaggcuuuucagacacuucau

SEQ ID NO: 147182 - RNA, 22 nt, Homo sapiens
uuagguuguugccauugaaagu

SEQ ID NO: 147183 - RNA, 22 nt, Homo sapiens
uuagugaaugcaccacuucuga

SEQ ID NO: 147184 - RNA, 22 nt, Homo sapiens
uuaguucccucauucuugacuu

SEQ ID NO: 147185 - RNA, 22 nt, Homo sapiens
uuauaacagagacuccugugcu

SEQ ID NO: 147186 - RNA, 22 nt, Homo sapiens
uuauacacugugggaguguaaa

SEQ ID NO: 147187 - RNA, 22 nt, Homo sapiens
uuauagcuaacaucugugaaaa

SEQ ID NO: 147188 - RNA, 22 nt, Homo sapiens
uuauccagcgcuguuuuggaga

SEQ ID NO: 147189 - RNA, 22 nt, Homo sapiens
uuaucucaguguuuguaaacaa

SEQ ID NO: 147190 - RNA, 22 nt, Homo sapiens
uuauucagcaccugcuguguuc

SEQ ID NO: 147191 - RNA, 18 nt, Homo sapiens
cuggaaggcuacuacagu

SEQ ID NO: 147192 - RNA, 22 nt, Homo sapiens
cuggcuaagugcuugagugugc

SEQ ID NO: 147193 - RNA, 22 nt, Homo sapiens
cuguaaagaucacagagcuggu

SEQ ID NO: 147194 - RNA, 22 nt, Homo sapiens
cuguaaaguucucauuguagcc

SEQ ID NO: 147195 - RNA, 22 nt, Homo sapiens
cuguaaggcacuaagcauaugu

SEQ ID NO: 147196 - RNA, 17 nt, Homo sapiens
cugugaugaucuugucu

SEQ ID NO: 147197 - RNA, 22 nt, Homo sapiens
cugugcaugcgcggagcugaaa

SEQ ID NO: 147198 - RNA, 22 nt, Homo sapiens
cugugcauucuuaaaucaggaa

SEQ ID NO: 147199 - RNA, 22 nt, Homo sapiens
cugugcuugauuauaugagugu

SEQ ID NO: 147200 - RNA, 19 nt, Homo sapiens
cuguggucauuauuuugcu

SEQ ID NO: 147201 - RNA, 22 nt, Homo sapiens
cuguuaacauguuguggauaau

SEQ ID NO: 147202 - RNA, 22 nt, Homo sapiens
cuguucaaauuguuugugaagu

SEQ ID NO: 147203 - RNA, 22 nt, Homo sapiens
cuuagguuaaucaugaaccuuu

SEQ ID NO: 147204 - RNA, 18 nt, Homo sapiens
cuucauugcuguuuugcu

SEQ ID NO: 147205 - RNA, 22 nt, Homo sapiens
cuucucagugcucaucuuauuu

SEQ ID NO: 147206 - RNA, 22 nt, Homo sapiens
cuucugauugaaaauggaguag

SEQ ID NO: 147207 - RNA, 20 nt, Homo sapiens
cuugaagacuaugcugcuga

SEQ ID NO: 147208 - RNA, 22 nt, Homo sapiens
cuugaauguaaauaauguacag

SEQ ID NO: 147209 - RNA, 22 nt, Homo sapiens
cuugacaaugcuucaggcugaa

SEQ ID NO: 147210 - RNA, 22 nt, Homo sapiens
cuugacaucugucaguuccuca

SEQ ID NO: 147211 - RNA, 22 nt, Homo sapiens
cuugcacauuacagaucugcau

SEQ ID NO: 147212 - RNA, 22 nt, Homo sapiens
cuugcauuuuggagaaugcuga

SEQ ID NO: 147213 - RNA, 19 nt, Homo sapiens
cuugccccauucauccucu

SEQ ID NO: 147214 - RNA, 22 nt, Homo sapiens
cuuggcacgugauagguguuga

SEQ ID NO: 147215 - RNA, 22 nt, Homo sapiens
cuugggauauguguuacucugu

SEQ ID NO: 147216 - RNA, 22 nt, Homo sapiens
cuuuacacauccuaaccagugu

SEQ ID NO: 147217 - RNA, 22 nt, Homo sapiens
cuuucacacuguuggugggaau

SEQ ID NO: 147218 - RNA, 22 nt, Homo sapiens
cuuugaugagaaaauacuuugu

SEQ ID NO: 147219 - RNA, 18 nt, Homo sapiens
cuuugcagcuuccagagg

SEQ ID NO: 147220 - RNA, 22 nt, Homo sapiens
cuuuggcauuagccuguauaga

SEQ ID NO: 147221 - RNA, 19 nt, Homo sapiens
cuuugguugagcguguugg

SEQ ID NO: 147222 - RNA, 22 nt, Homo sapiens
cuuugguuuacuuggugcuagu

SEQ ID NO: 147223 - RNA, 21 nt, Homo sapiens
cuuuugcacuccagccugggu

SEQ ID NO: 147224 - RNA, 22 nt, Homo sapiens
cuuuuugcugcagcaauacugg

SEQ ID NO: 147225 - RNA, 22 nt, Homo sapiens
gaagguacgcuuaggaaaugau

SEQ ID NO: 147226 - RNA, 22 nt, Homo sapiens
gaaucaauugaucuaugugucu

SEQ ID NO: 147227 - RNA, 22 nt, Homo sapiens
gaaugcagcagugacagggcug

SEQ ID NO: 147228 - RNA, 22 nt, Homo sapiens
gaauguuuacuuuguuuaauac

SEQ ID NO: 147229 - RNA, 22 nt, Homo sapiens
gacaaguuugauuuauuccaag

SEQ ID NO: 147230 - RNA, 22 nt, Homo sapiens
gacagugugauacuuagucuca

SEQ ID NO: 147231 - RNA, 20 nt, Homo sapiens
gacauggaggaggauuauua

SEQ ID NO: 147232 - RNA, 20 nt, Homo sapiens
gacauguugguuugcugcac

SEQ ID NO: 147233 - RNA, 20 nt, Homo sapiens
augucaggaagggagucagg

SEQ ID NO: 147234 - RNA, 22 nt, Homo sapiens
auguccauggaaucuguagcaa

SEQ ID NO: 147235 - RNA, 22 nt, Homo sapiens
augucuuucauagagacccaga

SEQ ID NO: 147236 - RNA, 22 nt, Homo sapiens
augugcagauguuacaaauugu

SEQ ID NO: 147237 - RNA, 22 nt, Homo sapiens
augugcuuuuggugagagauuu

SEQ ID NO: 147238 - RNA, 19 nt, Homo sapiens
augugguuagcaugacugc

SEQ ID NO: 147239 - RNA, 22 nt, Homo sapiens
auguguauuaccucgauuguga

SEQ ID NO: 147240 - RNA, 22 nt, Homo sapiens
augugucaaaucuaggccaaag

SEQ ID NO: 147241 - RNA, 22 nt, Homo sapiens
auguuaacaucuuaguuuucau

SEQ ID NO: 147242 - RNA, 22 nt, Homo sapiens
auuaaguaaugguuccaauaau

SEQ ID NO: 147243 - RNA, 22 nt, Homo sapiens
auuaagugcuugccagugcugg

SEQ ID NO: 147244 - RNA, 22 nt, Homo sapiens
auuauaguguauacuugaaauu

SEQ ID NO: 147245 - RNA, 22 nt, Homo sapiens
auuccagguggcgccauucaca

SEQ ID NO: 147246 - RNA, 23 nt, Homo sapiens
auuccaguggcaauuggagaaac

SEQ ID NO: 147247 - RNA, 23 nt, Homo sapiens
auugaacacuuucauaugugagg

SEQ ID NO: 147248 - RNA, 19 nt, Homo sapiens
auugacauugggguguuca

SEQ ID NO: 147249 - RNA, 22 nt, Homo sapiens
auugcauaaacacauuucuuau

SEQ ID NO: 147250 - RNA, 22 nt, Homo sapiens
auuggcaauccauauauuuucu

SEQ ID NO: 147251 - RNA, 22 nt, Homo sapiens
auuggugaccugcggcaguaug

SEQ ID NO: 147252 - RNA, 22 nt, Homo sapiens
auuguaauuuuagagaaagugg

SEQ ID NO: 147253 - RNA, 22 nt, Homo sapiens
auugucacccgggcaguaagca

SEQ ID NO: 147254 - RNA, 22 nt, Homo sapiens
auugugcuaaaguaauaaguca

SEQ ID NO: 147255 - RNA, 22 nt, Homo sapiens
auuguucuuacaugcugucauc

SEQ ID NO: 147256 - RNA, 22 nt, Homo sapiens
auuuaacuggucuaggggccca

SEQ ID NO: 147257 - RNA, 22 nt, Homo sapiens
auuuggcauagaguaucauucu

SEQ ID NO: 147258 - RNA, 22 nt, Homo sapiens
auuuggguuuuacaucaggcua

SEQ ID NO: 147259 - RNA, 22 nt, Homo sapiens
caaagcacuuggcuuggaagau

SEQ ID NO: 147260 - RNA, 22 nt, Homo sapiens
caaagcuauagcaccagaggga

SEQ ID NO: 147261 - RNA, 22 nt, Homo sapiens
caaaggcuuccacugcauccuu

SEQ ID NO: 147262 - RNA, 22 nt, Homo sapiens
caagagaccugagugucauucu

SEQ ID NO: 147263 - RNA, 22 nt, Homo sapiens
caagugcuugaugaaugaucaa

SEQ ID NO: 147264 - RNA, 22 nt, Homo sapiens
caauacuguguugaauaagagu

SEQ ID NO: 147265 - RNA, 22 nt, Homo sapiens
cacaaugucuaagauguuucua

SEQ ID NO: 147266 - RNA, 22 nt, Homo sapiens
cacaggccugucucuuucuaac

SEQ ID NO: 147267 - RNA, 22 nt, Homo sapiens
cacaguguucauagccaucagg

SEQ ID NO: 147268 - RNA, 22 nt, Homo sapiens
cacaguugccuaucuccugaag

SEQ ID NO: 147269 - RNA, 22 nt, Homo sapiens
cacauugaauuucugaugacaa

SEQ ID NO: 147270 - RNA, 22 nt, Homo sapiens
caccacagccauuauugucccc

SEQ ID NO: 147271 - RNA, 22 nt, Homo sapiens
caccccuaccugagucaggagu

SEQ ID NO: 147272 - RNA, 22 nt, Homo sapiens
caccuguagucccagcugaggc

SEQ ID NO: 147273 - RNA, 22 nt, Homo sapiens
cacugcauccuccauauccugg

SEQ ID NO: 147274 - RNA, 22 nt, Homo sapiens
cacugcauggucuagcuggguu

SEQ ID NO: 147275 - RNA, 22 nt, Homo sapiens
cacugugcaaccuccaccuccc

SEQ ID NO: 147276 - RNA, 22 nt, Homo sapiens
cagagguaagcaagucagcauu

SEQ ID NO: 147277 - RNA, 22 nt, Homo sapiens
cagauacuggaguccugaaguu

SEQ ID NO: 147278 - RNA, 23 nt, Homo sapiens
aaauuugccuauuauuccuaugg

SEQ ID NO: 147279 - RNA, 22 nt, Homo sapiens
aacaggcuccuaggggugcacc

SEQ ID NO: 147280 - RNA, 22 nt, Homo sapiens
aacagugccugucauuuaguag

SEQ ID NO: 147281 - RNA, 22 nt, Homo sapiens
aaccuguaaccauaugaucagu

SEQ ID NO: 147282 - RNA, 22 nt, Homo sapiens
aagagcauuggauggggagauu

SEQ ID NO: 147283 - RNA, 22 nt, Homo sapiens
aagagguagaagcuugccuucu

SEQ ID NO: 147284 - RNA, 22 nt, Homo sapiens
aagagguaggaaauggucauuu

SEQ ID NO: 147285 - RNA, 22 nt, Homo sapiens
aagcaggugaugagugggugug

SEQ ID NO: 147286 - RNA, 22 nt, Homo sapiens
aagcaugguuuccaggggucac

SEQ ID NO: 147287 - RNA, 22 nt, Homo sapiens
aagcugcauuuucuagaugcuu

SEQ ID NO: 147288 - RNA, 23 nt, Homo sapiens
aagguaagcuagaaagauguaga

SEQ ID NO: 147289 - RNA, 22 nt, Homo sapiens
aaguaaacauuuuguacaauaa

SEQ ID NO: 147290 - RNA, 22 nt, Homo sapiens
aaguaauugagguuuuugcugu

SEQ ID NO: 147291 - RNA, 22 nt, Homo sapiens
aagucaguuugggagaagcuau

SEQ ID NO: 147292 - RNA, 22 nt, Homo sapiens
aagugagaugcaguggaguucc

SEQ ID NO: 147293 - RNA, 22 nt, Homo sapiens
aagugcacuguaagugcaggau

SEQ ID NO: 147294 - RNA, 22 nt, Homo sapiens
aagugcuggccuacucaaucga

SEQ ID NO: 147295 - RNA, 22 nt, Homo sapiens
aagugcuuuuuagauaugguuu

SEQ ID NO: 147296 - RNA, 22 nt, Homo sapiens
aagugguagggucaggauugga

SEQ ID NO: 147297 - RNA, 19 nt, Homo sapiens
aagugguuuaaacuuguau

SEQ ID NO: 147298 - RNA, 22 nt, Homo sapiens
aagugguuuuaaucuggugagu

SEQ ID NO: 147299 - RNA, 22 nt, Homo sapiens
aaguguaaguuaauguuuaggu

SEQ ID NO: 147300 - RNA, 22 nt, Homo sapiens
aauacugaaaguauuuucaaau

SEQ ID NO: 147301 - RNA, 22 nt, Homo sapiens
aauacugcuuugauguaagcua

SEQ ID NO: 147302 - RNA, 22 nt, Homo sapiens
aauaugucugcuaauuguuucu

SEQ ID NO: 147303 - RNA, 22 nt, Homo sapiens
aauaugucuugaaauuggguaa

SEQ ID NO: 147304 - RNA, 19 nt, Homo sapiens
aauauugacaguggugucu

SEQ ID NO: 147305 - RNA, 17 nt, Homo sapiens
aaugagacauuucugcu

SEQ ID NO: 147306 - RNA, 22 nt, Homo sapiens
aaugcacauauauuuccuuauu

SEQ ID NO: 147307 - RNA, 22 nt, Homo sapiens
aaugcuguguuauuucaugacc

SEQ ID NO: 147308 - RNA, 22 nt, Homo sapiens
aaugugcuuugaaaagagcuga

SEQ ID NO: 147309 - RNA, 22 nt, Homo sapiens
aauuaguugucgugagaguggu

SEQ ID NO: 147310 - RNA, 22 nt, Homo sapiens
aauugaaucaugugggcagacu

SEQ ID NO: 147311 - RNA, 22 nt, Homo sapiens
aauugaaugauaugggacauuu

SEQ ID NO: 147312 - RNA, 22 nt, Homo sapiens
acaagugcuuuuccuggagaca

SEQ ID NO: 147313 - RNA, 22 nt, Homo sapiens
acaauggaauggaguggaaagu

SEQ ID NO: 147314 - RNA, 22 nt, Homo sapiens
acacaugugaaaaaaauguuac

SEQ ID NO: 147315 - RNA, 22 nt, Homo sapiens
acacauuagcaagugcuguuau

SEQ ID NO: 147316 - RNA, 22 nt, Homo sapiens
acaccauugcauuccagccugg

SEQ ID NO: 147317 - RNA, 22 nt, Homo sapiens
acacuauugagguuuguuugca

SEQ ID NO: 147318 - RNA, 22 nt, Homo sapiens
acacucuaguguucuuaaucag

SEQ ID NO: 147319 - RNA, 22 nt, Homo sapiens
acagaccuauuucaaucauuua

SEQ ID NO: 147320 - RNA, 22 nt, Homo sapiens
acagauagacauauauagcuca

SEQ ID NO: 147321 - RNA, 22 nt, Homo sapiens
acagccauuccagccaaauacu

SEQ ID NO: 147322 - RNA, 22 nt, Homo sapiens
acaggagugggauuugaguccu

SEQ ID NO: 147323 - RNA, 22 nt, Homo sapiens
acaguauaaugcuguagggaga

SEQ ID NO: 147324 - RNA, 22 nt, Homo sapiens
acagugacagaaagcugauuau

SEQ ID NO: 147325 - RNA, 22 nt, Homo sapiens
acagugcugucugcuuuggcua

SEQ ID NO: 147326 - RNA, 22 nt, Homo sapiens
acuucauucucuggaucagaau

SEQ ID NO: 147327 - RNA, 22 nt, Homo sapiens
acuuuguguuacccagcaagga

SEQ ID NO: 147328 - RNA, 22 nt, Homo sapiens
acuuuuguuauacagugugaua

SEQ ID NO: 147329 - RNA, 22 nt, Homo sapiens
agaauacugucuauucauggua

SEQ ID NO: 147330 - RNA, 22 nt, Homo sapiens
agaaugauccuucucagaggca

SEQ ID NO: 147331 - RNA, 22 nt, Homo sapiens
agaauguaacucuaugaaggca

SEQ ID NO: 147332 - RNA, 22 nt, Homo sapiens
agaaugucagcuggauucagcu

SEQ ID NO: 147333 - RNA, 22 nt, Homo sapiens
agaauguuuuagaccaauacaa

SEQ ID NO: 147334 - RNA, 22 nt, Homo sapiens
agacccuguauguguuuaguuu

SEQ ID NO: 147335 - RNA, 22 nt, Homo sapiens
agagaugauuaacauuuuggua

SEQ ID NO: 147336 - RNA, 19 nt, Homo sapiens
agaguauugaauuugcccu

SEQ ID NO: 147337 - RNA, 22 nt, Homo sapiens
agauacauuggauaaugguggg

SEQ ID NO: 147338 - RNA, 22 nt, Homo sapiens
agcaacaucagcagcaggaaaa

SEQ ID NO: 147339 - RNA, 22 nt, Homo sapiens
agcagcauuaugauauaucuua

SEQ ID NO: 147340 - RNA, 22 nt, Homo sapiens
agcaguagugaaaguagacuua

SEQ ID NO: 147341 - RNA, 22 nt, Homo sapiens
agcauagugccuugaaaacaau

SEQ ID NO: 147342 - RNA, 22 nt, Homo sapiens
agcccauguggcugaggcuucu

SEQ ID NO: 147343 - RNA, 22 nt, Homo sapiens
agccgguguccacgaagaagag

SEQ ID NO: 147344 - RNA, 23 nt, Homo sapiens
agccugguuucccugcuucuccc

SEQ ID NO: 147345 - RNA, 22 nt, Homo sapiens
agcugaguguuccaagagcgag

SEQ ID NO: 147346 - RNA, 22 nt, Homo sapiens
agcuguuuuugugggcauguga

SEQ ID NO: 147347 - RNA, 20 nt, Homo sapiens
agcuugguuuggaugaucac

SEQ ID NO: 147348 - RNA, 22 nt, Homo sapiens
agcuugugauucuccaucaugu

SEQ ID NO: 147349 - RNA, 22 nt, Homo sapiens
agcuuguggugaauacugcuag

SEQ ID NO: 147350 - RNA, 22 nt, Homo sapiens
agcuuguguuugucugccuggg

SEQ ID NO: 147351 - RNA, 22 nt, Homo sapiens
agcuuguuuucccauaacuaga

SEQ ID NO: 147352 - RNA, 22 nt, Homo sapiens
aggaacuguaacuaugucucug

SEQ ID NO: 147353 - RNA, 21 nt, Homo sapiens
aggaagacuaugaucaauugg

SEQ ID NO: 147354 - RNA, 22 nt, Homo sapiens
aggaagacugaaauugcuguuc

SEQ ID NO: 147355 - RNA, 22 nt, Homo sapiens
aggaauguuaguacuucuuagu

SEQ ID NO: 147356 - RNA, 22 nt, Homo sapiens
aggagcacaggacuuugauuau

SEQ ID NO: 147357 - RNA, 20 nt, Homo sapiens
aggagcauuuacauuggcuc

SEQ ID NO: 147358 - RNA, 22 nt, Homo sapiens
aggcaagaaugcuuguuucacc

SEQ ID NO: 147359 - RNA, 22 nt, Homo sapiens
aggcagucugaguuuugaaagg

SEQ ID NO: 147360 - RNA, 23 nt, Homo sapiens
aggccaguuuuuccugcuugcug

SEQ ID NO: 147361 - RNA, 21 nt, Homo sapiens
aggucaugaagauguucuaau

SEQ ID NO: 147362 - RNA, 18 nt, Homo sapiens
agguuauuucccaagacu

SEQ ID NO: 147363 - RNA, 22 nt, Homo sapiens
aguaccauuacucacuuauuuu

SEQ ID NO: 147364 - RNA, 22 nt, Homo sapiens
aguaccauuugacaugggaccc

SEQ ID NO: 147365 - RNA, 22 nt, Homo sapiens
aguauuuguuggaauaccuguu

SEQ ID NO: 147366 - RNA, 22 nt, Homo sapiens
agucacagccuuuuacuuuaga

SEQ ID NO: 147367 - RNA, 22 nt, Homo sapiens
agucacaugcauuuucuucaau

SEQ ID NO: 147368 - RNA, 22 nt, Homo sapiens
agucaguguguauugauggcac

SEQ ID NO: 147369 - RNA, 20 nt, Homo sapiens
agucaguuuauuuucucucu

SEQ ID NO: 147370 - RNA, 22 nt, Homo sapiens
agucauggcagaaggcaccucu

SEQ ID NO: 147371 - RNA, 22 nt, Homo sapiens
agugcacucuuuccucucuuac

SEQ ID NO: 147372 - RNA, 22 nt, Homo sapiens
aguggcaaugugauguccugaa

SEQ ID NO: 147373 - RNA, 22 nt, Homo sapiens
aguguuuuuaacaagaaagggu

SEQ ID NO: 147374 - RNA, 22 nt, Homo sapiens
aguguuuuuacaagcacucugg

SEQ ID NO: 147375 - RNA, 22 nt, Homo sapiens
aguuuuugcugauagcaugcuu

SEQ ID NO: 147376 - RNA, 18 nt, Homo sapiens
auaaccuggugcuuucaa

SEQ ID NO: 147377 - RNA, 22 nt, Homo sapiens
auaaggcugguauagacauuca

SEQ ID NO: 147378 - RNA, 22 nt, Homo sapiens
auaauagcugaucauuuagaag

SEQ ID NO: 147379 - RNA, 22 nt, Homo sapiens
auaauaucagguugugaugaug

SEQ ID NO: 147380 - RNA, 22 nt, Homo sapiens
auaauguuuauccagaggaguu

SEQ ID NO: 147381 - RNA, 22 nt, Homo sapiens
auacagugaauacuuacagugu

SEQ ID NO: 147382 - RNA, 22 nt, Homo sapiens
auacuagucaagaauguaugag

SEQ ID NO: 147383 - RNA, 22 nt, Homo sapiens
auacugccuuuagcaaaacagu

SEQ ID NO: 147384 - RNA, 22 nt, Homo sapiens
auagcagugugaaaauugacug

SEQ ID NO: 147385 - RNA, 22 nt, Homo sapiens
auagcauaucccacaugucaga

SEQ ID NO: 147386 - RNA, 22 nt, Homo sapiens
auagucaguagucucauaauga

SEQ ID NO: 147387 - RNA, 22 nt, Homo sapiens
auaucagugucuuacuguuuuu

SEQ ID NO: 147388 - RNA, 22 nt, Homo sapiens
auaucugcauugccauuuaugu

SEQ ID NO: 147389 - RNA, 20 nt, Homo sapiens
auaugcagacacauacauac

SEQ ID NO: 147390 - RNA, 22 nt, Homo sapiens
aucaagcuggcauauguaguuc

SEQ ID NO: 147391 - RNA, 22 nt, Homo sapiens
aucacagauauggguuuaaauc

SEQ ID NO: 147392 - RNA, 22 nt, Homo sapiens
aucacagugagcauaugucuau

SEQ ID NO: 147393 - RNA, 22 nt, Homo sapiens
aucacuaugcaggugucucggg

SEQ ID NO: 147394 - RNA, 22 nt, Homo sapiens
aucagcagcaugaaaacaggcu

SEQ ID NO: 147395 - RNA, 22 nt, Homo sapiens
aucauggaguauuugcaagucu

SEQ ID NO: 147396 - RNA, 18 nt, Homo sapiens
aucauugcacugucuugc

SEQ ID NO: 147397 - RNA, 22 nt, Homo sapiens
auccacagugucaauguuguga

SEQ ID NO: 147398 - RNA, 22 nt, Homo sapiens
aucccuguaacuagcagccccu

SEQ ID NO: 147399 - RNA, 22 nt, Homo sapiens
auccugaagcuuuacugaauuc

SEQ ID NO: 147400 - RNA, 22 nt, Homo sapiens
aucuaaaucucauaugggcaca

SEQ ID NO: 147401 - RNA, 21 nt, Homo sapiens
aucucacuugaauguaaaagc

SEQ ID NO: 147402 - RNA, 22 nt, Homo sapiens
aucuccaggugccagcugcgcc

SEQ ID NO: 147403 - RNA, 20 nt, Homo sapiens
aucucugggcaaaggaaaau

SEQ ID NO: 147404 - RNA, 22 nt, Homo sapiens
aucugcaaauaaugaagauugg

SEQ ID NO: 147405 - RNA, 22 nt, Homo sapiens
aucuggcuccuuuugacaaugc

SEQ ID NO: 147406 - RNA, 22 nt, Homo sapiens
aucuuugauuguagguacaaug

SEQ ID NO: 147407 - RNA, 22 nt, Homo sapiens
aucuuuggcgggaauaucacag

SEQ ID NO: 147408 - RNA, 22 nt, Homo sapiens
augaacucaucauuuuuauggc

SEQ ID NO: 147409 - RNA, 18 nt, Homo sapiens
augaacucaucauuuuuu

SEQ ID NO: 147410 - RNA, 23 nt, Homo sapiens
augaacucaucauuuuuuauggc

SEQ ID NO: 147411 - RNA, 22 nt, Homo sapiens
augaacucaucauuuuuugugg

SEQ ID NO: 147412 - RNA, 17 nt, Homo sapiens
augaacucaucguucuu

SEQ ID NO: 147413 - RNA, 22 nt, Homo sapiens
augaagacaucgucugggauua

SEQ ID NO: 147414 - RNA, 22 nt, Homo sapiens
augaagauguugccuuuuuaau

SEQ ID NO: 147415 - RNA, 22 nt, Homo sapiens
augaaguauuaggacacauuua

SEQ ID NO: 147416 - RNA, 20 nt, Homo sapiens
augaauguccuugauggcau

SEQ ID NO: 147417 - RNA, 23 nt, Homo sapiens
augacacuguccuugaccauuuc

SEQ ID NO: 147418 - RNA, 22 nt, Homo sapiens
augacagagauaugugaauuuu

SEQ ID NO: 147419 - RNA, 22 nt, Homo sapiens
augacaguaugacuccaaaagu

SEQ ID NO: 147420 - RNA, 22 nt, Homo sapiens
augagaccagcagaaaaccugu

SEQ ID NO: 147421 - RNA, 22 nt, Homo sapiens
augagacuagaagagaauaaua

SEQ ID NO: 147422 - RNA, 22 nt, Homo sapiens
augagacuguucuuccucauug

SEQ ID NO: 147423 - RNA, 22 nt, Homo sapiens
augagaugauaggcguucuaac

SEQ ID NO: 147424 - RNA, 21 nt, Homo sapiens
augagauguuagacuuuagac

SEQ ID NO: 147425 - RNA, 22 nt, Homo sapiens
augagcaucaccagaaucaaua

SEQ ID NO: 147426 - RNA, 22 nt, Homo sapiens
augagcucauugggugacuggg

SEQ ID NO: 147427 - RNA, 22 nt, Homo sapiens
augagcugauuuccuuaccaua

SEQ ID NO: 147428 - RNA, 22 nt, Homo sapiens
augauaacagccaggcacggug

SEQ ID NO: 147429 - RNA, 22 nt, Homo sapiens
augauacugaguugaguucuca

SEQ ID NO: 147430 - RNA, 22 nt, Homo sapiens
augauuuuuguaucgccugaug

SEQ ID NO: 147431 - RNA, 22 nt, Homo sapiens
cuaugguuucuccauaucauca

SEQ ID NO: 147432 - RNA, 22 nt, Homo sapiens
cucacuaguaaggcuguuuagu

SEQ ID NO: 147433 - RNA, 22 nt, Homo sapiens
cucacuggguguaaaacaugua

SEQ ID NO: 147434 - RNA, 22 nt, Homo sapiens
cucagcuacuugagaggcuuag

SEQ ID NO: 147435 - RNA, 22 nt, Homo sapiens
cuccacugagcaggugggaggc

SEQ ID NO: 147436 - RNA, 22 nt, Homo sapiens
cuccaggugucauccaccuccu

SEQ ID NO: 147437 - RNA, 22 nt, Homo sapiens
cucccuuugcugaauguuuuuc

SEQ ID NO: 147438 - RNA, 22 nt, Homo sapiens
cucucugagccauggcugcccu

SEQ ID NO: 147439 - RNA, 22 nt, Homo sapiens
cucuggauauuccugucuaaaa

SEQ ID NO: 147440 - RNA, 22 nt, Homo sapiens
cucugguucugcagugcacccu

SEQ ID NO: 147441 - RNA, 20 nt, Homo sapiens
cucugguugugaauugucuu

SEQ ID NO: 147442 - RNA, 15 nt, Homo sapiens
cucugguuuuucuuc

SEQ ID NO: 147443 - RNA, 22 nt, Homo sapiens
cugaaaugaauuauuuucuuuc

SEQ ID NO: 147444 - RNA, 22 nt, Homo sapiens
cugaauagagcacacugauggg

SEQ ID NO: 147445 - RNA, 20 nt, Homo sapiens
cugaaugucaaggcagaggu

SEQ ID NO: 147446 - RNA, 22 nt, Homo sapiens
cugaauguccaggcagagguuu

SEQ ID NO: 147447 - RNA, 22 nt, Homo sapiens
cugaauguuuucuucuauucug

SEQ ID NO: 147448 - RNA, 22 nt, Homo sapiens
cugacaagauucaucacucagu

SEQ ID NO: 147449 - RNA, 22 nt, Homo sapiens
cugacagaugacugccacugua

SEQ ID NO: 147450 - RNA, 22 nt, Homo sapiens
cugagagaugagaccucucacu

SEQ ID NO: 147451 - RNA, 22 nt, Homo sapiens
cugagaucguggggcugcuguc

SEQ ID NO: 147452 - RNA, 22 nt, Homo sapiens
cugagcuagaccacuuggcucc

SEQ ID NO: 147453 - RNA, 22 nt, Homo sapiens
cugagcuagaccauuuggcucc

SEQ ID NO: 147454 - RNA, 22 nt, Homo sapiens
cugaggaaguucuuuaacaguu

SEQ ID NO: 147455 - RNA, 22 nt, Homo sapiens
cugaggugggaguuuuucucau

SEQ ID NO: 147456 - RNA, 22 nt, Homo sapiens
cugaugaaguauuuguucugga

SEQ ID NO: 147457 - RNA, 19 nt, Homo sapiens
cugcacugagaaaaggagg

SEQ ID NO: 147458 - RNA, 22 nt, Homo sapiens
cugcccuuucuauaugauguaa

SEQ ID NO: 147459 - RNA, 22 nt, Homo sapiens
cuggaaacaucuuaggaaugca

SEQ ID NO: 147460 - RNA, 22 nt, Homo sapiens
cuggaaagcaaguccauugcuc

SEQ ID NO: 147461 - RNA, 22 nt, Homo sapiens
cuggaagcacaacgcauuuauu

SEQ ID NO: 147462 - RNA, 22 nt, Homo sapiens
cuggaaucuauggauaacaucg

SEQ ID NO: 147463 - RNA, 22 nt, Homo sapiens
cuggaauguuccuaaagauuca

SEQ ID NO: 147464 - RNA, 22 nt, Homo sapiens
cuggagaucuugacauugaagu

SEQ ID NO: 147465 - RNA, 22 nt, Homo sapiens
cuggauagucaggagauauaua

SEQ ID NO: 147466 - RNA, 20 nt, Homo sapiens
cuggaucaucaguaaaguua

SEQ ID NO: 147467 - RNA, 22 nt, Homo sapiens
cuggcaaauguuuucuguaaag

SEQ ID NO: 147468 - RNA, 22 nt, Homo sapiens
cugggaucaguucuagucagaa

SEQ ID NO: 147469 - RNA, 22 nt, Homo sapiens
cuggucaugggggcacccucug

SEQ ID NO: 147470 - RNA, 22 nt, Homo sapiens
cugguuuguaaaguuccugaga

SEQ ID NO: 147471 - RNA, 22 nt, Homo sapiens
cugucacuggggcacauguccc

SEQ ID NO: 147472 - RNA, 22 nt, Homo sapiens
cugucuguuucaaaagugguua

SEQ ID NO: 147473 - RNA, 22 nt, Homo sapiens
cugugcauaugacuuuauugga

SEQ ID NO: 147474 - RNA, 22 nt, Homo sapiens
cugugcauguaugcgugaguuc

SEQ ID NO: 147475 - RNA, 22 nt, Homo sapiens
cugugcuugagagaugacacag

SEQ ID NO: 147476 - RNA, 23 nt, Homo sapiens
cuguggauaugaguuguaaaugg

SEQ ID NO: 147477 - RNA, 22 nt, Homo sapiens
cugugguugagcuuugccauga

SEQ ID NO: 147478 - RNA, 22 nt, Homo sapiens
cuguuugaggguuugcuuucag

SEQ ID NO: 147479 - RNA, 17 nt, Homo sapiens
cuucaaauaauuucccc

SEQ ID NO: 147480 - RNA, 22 nt, Homo sapiens
cuucacggugccuacuuguguc

SEQ ID NO: 147481 - RNA, 22 nt, Homo sapiens
cuucacuggagucccuggauuc

SEQ ID NO: 147482 - RNA, 22 nt, Homo sapiens
cuuccauaguauuuuuacaaaa

SEQ ID NO: 147483 - RNA, 22 nt, Homo sapiens
cuuccugaguccugggcucaca

SEQ ID NO: 147484 - RNA, 22 nt, Homo sapiens
cuucuugagacuuaggcuuugg

SEQ ID NO: 147485 - RNA, 22 nt, Homo sapiens
cuuggauuauaauggaauauuu

SEQ ID NO: 147486 - RNA, 22 nt, Homo sapiens
cuuggcacugcucacccuccuu

SEQ ID NO: 147487 - RNA, 22 nt, Homo sapiens
cuuugcaaauggccuuuccaag

SEQ ID NO: 147488 - RNA, 22 nt, Homo sapiens
cuuuggcaaugucauuuucaau

SEQ ID NO: 147489 - RNA, 22 nt, Homo sapiens
cuuuggugagggauaaauuuca

SEQ ID NO: 147490 - RNA, 22 nt, Homo sapiens
cuuugguuaauaggauauggca

SEQ ID NO: 147491 - RNA, 22 nt, Homo sapiens
cuuugguucuguuuauaugcug

SEQ ID NO: 147492 - RNA, 22 nt, Homo sapiens
cuuuugugauucuucaguugcu

SEQ ID NO: 147493 - RNA, 22 nt, Homo sapiens
cuuuuugguagagcaggugugc

SEQ ID NO: 147494 - RNA, 22 nt, Homo sapiens
gaaagauuuuaacugggagacu

SEQ ID NO: 147495 - RNA, 22 nt, Homo sapiens
gaaagguaggaacagggugcag

SEQ ID NO: 147496 - RNA, 22 nt, Homo sapiens
gaaagugcugcuugacugggau

SEQ ID NO: 147497 - RNA, 22 nt, Homo sapiens
gaaaguguugagauuacaggca

SEQ ID NO: 147498 - RNA, 22 nt, Homo sapiens
gaaauggaucagagcaagcuuu

SEQ ID NO: 147499 - RNA, 22 nt, Homo sapiens
gaaauguauuaaugaguugaaa

SEQ ID NO: 147500 - RNA, 22 nt, Homo sapiens
gaacuguuucuggugaaagagu

SEQ ID NO: 147501 - RNA, 22 nt, Homo sapiens
gaagaaguacaagacaaauuuu

SEQ ID NO: 147502 - RNA, 22 nt, Homo sapiens
gaagauucaaccaaaccagaac

SEQ ID NO: 147503 - RNA, 23 nt, Homo sapiens
gaaguauagcaugcacauggaaa

SEQ ID NO: 147504 - RNA, 22 nt, Homo sapiens
gaauacugacuauuucaucugg

SEQ ID NO: 147505 - RNA, 22 nt, Homo sapiens
gaaugguuuacaaguguaaucu

SEQ ID NO: 147506 - RNA, 22 nt, Homo sapiens
gacaguguggcgauuccucaag

SEQ ID NO: 147507 - RNA, 22 nt, Homo sapiens
gacaguuucucaggcuuccuua

SEQ ID NO: 147508 - RNA, 20 nt, Homo sapiens
gacauagagacucucaaaaa

SEQ ID NO: 147509 - RNA, 17 nt, Homo sapiens
gacauaggaaaaggaga

SEQ ID NO: 147510 - RNA, 22 nt, Homo sapiens
gacauguuuucaagauuuauaa

SEQ ID NO: 147511 - RNA, 21 nt, Homo sapiens
gacuacaccaggaugcuaguu

SEQ ID NO: 147512 - RNA, 22 nt, Homo sapiens
gacuugaagaaucuaagggagg

SEQ ID NO: 147513 - RNA, 22 nt, Homo sapiens
gacuuugguaaacucgguggca

SEQ ID NO: 147514 - RNA, 22 nt, Homo sapiens
gagaaccauuuggagaaaaagu

SEQ ID NO: 147515 - RNA, 22 nt, Homo sapiens
gagaacugagauaagugauauu

SEQ ID NO: 147516 - RNA, 22 nt, Homo sapiens
gagaacuggcugauucaaggac

SEQ ID NO: 147517 - RNA, 22 nt, Homo sapiens
gagaagugcgucguuugaugau

SEQ ID NO: 147518 - RNA, 22 nt, Homo sapiens
gagacugagucucacucuguca

SEQ ID NO: 147519 - RNA, 22 nt, Homo sapiens
gagacugagucucgcucugccg

SEQ ID NO: 147520 - RNA, 22 nt, Homo sapiens
gagagcauuaagccaucaucau

SEQ ID NO: 147521 - RNA, 22 nt, Homo sapiens
gagagugcuuuggguguaggcc

SEQ ID NO: 147522 - RNA, 22 nt, Homo sapiens
gagagugugucagaggcugcga

SEQ ID NO: 147523 - RNA, 22 nt, Homo sapiens
aaguaaacauugagagacaaga

SEQ ID NO: 147524 - RNA, 19 nt, Homo sapiens
aaguacuugucuuuugaag

SEQ ID NO: 147525 - RNA, 22 nt, Homo sapiens
aagucaaggagagaagcuucag

SEQ ID NO: 147526 - RNA, 22 nt, Homo sapiens
aagugcugggauuggccgggca

SEQ ID NO: 147527 - RNA, 22 nt, Homo sapiens
aagugcuuaggauagugugugg

SEQ ID NO: 147528 - RNA, 22 nt, Homo sapiens
aauacucuauaagggaagcugu

SEQ ID NO: 147529 - RNA, 22 nt, Homo sapiens
aauacugugauaucgagcgauu

SEQ ID NO: 147530 - RNA, 22 nt, Homo sapiens
aauagcauugaaucuaccaauu

SEQ ID NO: 147531 - RNA, 22 nt, Homo sapiens
aauaucuguguauagauggggg

SEQ ID NO: 147532 - RNA, 22 nt, Homo sapiens
aaucacaguuaguaagggagaa

SEQ ID NO: 147533 - RNA, 22 nt, Homo sapiens
aaucaccaugcacuacagccuu

SEQ ID NO: 147534 - RNA, 17 nt, Homo sapiens
aaucagauuucugagga

SEQ ID NO: 147535 - RNA, 22 nt, Homo sapiens
aaucucagagauaucugugucc

SEQ ID NO: 147536 - RNA, 22 nt, Homo sapiens
aaucucagcauuuugggcugag

SEQ ID NO: 147537 - RNA, 22 nt, Homo sapiens
aaugauacuguguacaagggca

SEQ ID NO: 147538 - RNA, 22 nt, Homo sapiens
aaugaucaauguuugaggugau

SEQ ID NO: 147539 - RNA, 22 nt, Homo sapiens
aaugcuaucuggaacauuguug

SEQ ID NO: 147540 - RNA, 22 nt, Homo sapiens
aauggccacugaccuguguuga

SEQ ID NO: 147541 - RNA, 22 nt, Homo sapiens
aauggcuuuuaauauccauaau

SEQ ID NO: 147542 - RNA, 19 nt, Homo sapiens
aauggcuuuuccuguuccc

SEQ ID NO: 147543 - RNA, 22 nt, Homo sapiens
aaugguuuuaucagcguccaaa

SEQ ID NO: 147544 - RNA, 22 nt, Homo sapiens
aaugugcacuauuagggugaua

SEQ ID NO: 147545 - RNA, 22 nt, Homo sapiens
aaugugcuucuggcugugguca

SEQ ID NO: 147546 - RNA, 22 nt, Homo sapiens
aauuaguugaaagucugcuuuu

SEQ ID NO: 147547 - RNA, 22 nt, Homo sapiens
aauugaaugcagaugccaggga

SEQ ID NO: 147548 - RNA, 22 nt, Homo sapiens
acaagacuucuuguauucuagu

SEQ ID NO: 147549 - RNA, 22 nt, Homo sapiens
acacaguauaugacaaugcuuu

SEQ ID NO: 147550 - RNA, 22 nt, Homo sapiens
acacagugucuguguauuuaaa

SEQ ID NO: 147551 - RNA, 22 nt, Homo sapiens
acacaugcuccacuguggccuc

SEQ ID NO: 147552 - RNA, 22 nt, Homo sapiens
acacaugugcguagacucuuua

SEQ ID NO: 147553 - RNA, 22 nt, Homo sapiens
acacugucaugucucacaggca

SEQ ID NO: 147554 - RNA, 22 nt, Homo sapiens
acagaacugggcuugcuuuugg

SEQ ID NO: 147555 - RNA, 22 nt, Homo sapiens
acagagcaaugagcuacggucu

SEQ ID NO: 147556 - RNA, 20 nt, Homo sapiens
acaguagaagggauuucaaa

SEQ ID NO: 147557 - RNA, 18 nt, Homo sapiens
acagugcugucacugcuu

SEQ ID NO: 147558 - RNA, 22 nt, Homo sapiens
acagugcuucugauaugaugcc

SEQ ID NO: 147559 - RNA, 22 nt, Homo sapiens
acagugcuuggcacacaguaau

SEQ ID NO: 147560 - RNA, 19 nt, Homo sapiens
acagugcuuugucagaagc

SEQ ID NO: 147561 - RNA, 22 nt, Homo sapiens
acaguggugcgaucucggcuca

SEQ ID NO: 147562 - RNA, 18 nt, Homo sapiens
acagugucauggcucaau

SEQ ID NO: 147563 - RNA, 22 nt, Homo sapiens
acaguguuccuuuguugugacu

SEQ ID NO: 147564 - RNA, 22 nt, Homo sapiens
acaugagacuggguuuguaggg

SEQ ID NO: 147565 - RNA, 19 nt, Homo sapiens
acauggauuuugugcaaac

SEQ ID NO: 147566 - RNA, 22 nt, Homo sapiens
acauggcacugcgggcuucuug

SEQ ID NO: 147567 - RNA, 21 nt, Homo sapiens
acauguacacauguaugcaca

SEQ ID NO: 147568 - RNA, 22 nt, Homo sapiens
acauguauauaaugcauagcga

SEQ ID NO: 147569 - RNA, 22 nt, Homo sapiens
accaguuuuuuauacaucuucu

SEQ ID NO: 147570 - RNA, 22 nt, Homo sapiens
acccaguguucaacauucacau

SEQ ID NO: 147571 - RNA, 21 nt, Homo sapiens
acccccacaccuccuuaguuc

SEQ ID NO: 147572 - RNA, 22 nt, Homo sapiens
acccuggagagugcuguaguaa

SEQ ID NO: 147573 - RNA, 22 nt, Homo sapiens
acccugucacucccaucaauuu

SEQ ID NO: 147574 - RNA, 22 nt, Homo sapiens
acccugucauccacauggugcu

SEQ ID NO: 147575 - RNA, 22 nt, Homo sapiens
accuggcacuuagcaaaucuga

SEQ ID NO: 147576 - RNA, 22 nt, Homo sapiens
acucacagcaaccuccgccucc

SEQ ID NO: 147577 - RNA, 22 nt, Homo sapiens
acuccauuucauuuuagcucuu

SEQ ID NO: 147578 - RNA, 22 nt, Homo sapiens
acucuguauaaacauugcugua

SEQ ID NO: 147579 - RNA, 23 nt, Homo sapiens
acugagcaauguuuacauacuug

SEQ ID NO: 147580 - RNA, 20 nt, Homo sapiens
acugauauguuccuguucuc

SEQ ID NO: 147581 - RNA, 20 nt, Homo sapiens
acugcauuuaguccucagga

SEQ ID NO: 147582 - RNA, 22 nt, Homo sapiens
acugcauuugucugucucaauu

SEQ ID NO: 147583 - RNA, 22 nt, Homo sapiens
acuggcaauggcagaaauaguu

SEQ ID NO: 147584 - RNA, 22 nt, Homo sapiens
acuguguguuugucuagcacag

SEQ ID NO: 147585 - RNA, 22 nt, Homo sapiens
acuuugcuuaucccaggcacug

SEQ ID NO: 147586 - RNA, 22 nt, Homo sapiens
agaaauguuuacucacccccuu

SEQ ID NO: 147587 - RNA, 22 nt, Homo sapiens
agagauaauuagguuaaaugag

SEQ ID NO: 147588 - RNA, 22 nt, Homo sapiens
agagaugaagauggggcucccg

SEQ ID NO: 147589 - RNA, 22 nt, Homo sapiens
agagguauuggaaggaguguca

SEQ ID NO: 147590 - RNA, 22 nt, Homo sapiens
agagguuuuggggcugagagcu

SEQ ID NO: 147591 - RNA, 22 nt, Homo sapiens
agauacaucuaugugucugugu

SEQ ID NO: 147592 - RNA, 22 nt, Homo sapiens
agaugauguuuacugagcauca

SEQ ID NO: 147593 - RNA, 22 nt, Homo sapiens
agcaagaaugaacucucccaga

SEQ ID NO: 147594 - RNA, 22 nt, Homo sapiens
agcagagcauauucauucgggg

SEQ ID NO: 147595 - RNA, 22 nt, Homo sapiens
agcagcaugcaaauggacuaau

SEQ ID NO: 147596 - RNA, 20 nt, Homo sapiens
agcagccacagauuccucag

SEQ ID NO: 147597 - RNA, 16 nt, Homo sapiens
agcagguguuagguga

SEQ ID NO: 147598 - RNA, 22 nt, Homo sapiens
agcaucacaugggcugcuuggg

SEQ ID NO: 147599 - RNA, 18 nt, Homo sapiens
agcaucacugaucauccu

SEQ ID NO: 147600 - RNA, 21 nt, Homo sapiens
agccaguguuccuuguggcuc

SEQ ID NO: 147601 - RNA, 22 nt, Homo sapiens
agccuguguugaauuauagaaa

SEQ ID NO: 147602 - RNA, 22 nt, Homo sapiens
agcuguuguacacuuuaccuuu

SEQ ID NO: 147603 - RNA, 20 nt, Homo sapiens
agcuguuguuaugagguuua

SEQ ID NO: 147604 - RNA, 22 nt, Homo sapiens
agcuuuggauaccugcuguucc

SEQ ID NO: 147605 - RNA, 22 nt, Homo sapiens
aggaaauguuggucccauuucu

SEQ ID NO: 147606 - RNA, 22 nt, Homo sapiens
aggaagacauauagaacuaaaa

SEQ ID NO: 147607 - RNA, 16 nt, Homo sapiens
aggaagacuuagagau

SEQ ID NO: 147608 - RNA, 22 nt, Homo sapiens
aggcaaaugccagcaaucacac

SEQ ID NO: 147609 - RNA, 22 nt, Homo sapiens
aggcacacaacccuggaccuga

SEQ ID NO: 147610 - RNA, 22 nt, Homo sapiens
aggcacggugucucaugccugu

SEQ ID NO: 147611 - RNA, 22 nt, Homo sapiens
aggcaugguggcacauacaugu

SEQ ID NO: 147612 - RNA, 22 nt, Homo sapiens
aggcuguguggauaauauuggg

SEQ ID NO: 147613 - RNA, 22 nt, Homo sapiens
agggcacuguagguccugccuc

SEQ ID NO: 147614 - RNA, 21 nt, Homo sapiens
agguaguuuuccuuuuggagu

SEQ ID NO: 147615 - RNA, 22 nt, Homo sapiens
agguccacuuacuacuccuguu

SEQ ID NO: 147616 - RNA, 22 nt, Homo sapiens
aggugcuaucugguuuuauagu

SEQ ID NO: 147617 - RNA, 22 nt, Homo sapiens
aggugcugacaggauagguuuc

SEQ ID NO: 147618 - RNA, 22 nt, Homo sapiens
aggugcugagcagagaauccug

SEQ ID NO: 147619 - RNA, 22 nt, Homo sapiens
aguacacuguuaaaaagaagug

SEQ ID NO: 147620 - RNA, 21 nt, Homo sapiens
aguagcacugugucuuacaaa

SEQ ID NO: 147621 - RNA, 22 nt, Homo sapiens
agucacaugccagcacacccag

SEQ ID NO: 147622 - RNA, 22 nt, Homo sapiens
agugaacaaagaagugcagaua

SEQ ID NO: 147623 - RNA, 19 nt, Homo sapiens
agugagccaagauccuacc

SEQ ID NO: 147624 - RNA, 22 nt, Homo sapiens
agugguuuuggaauggaauuca

SEQ ID NO: 147625 - RNA, 22 nt, Homo sapiens
auugacacugauuuuucuuuaa

SEQ ID NO: 147626 - RNA, 22 nt, Homo sapiens
auugaguaaaaaauagugaugu

SEQ ID NO: 147627 - RNA, 21 nt, Homo sapiens
auugcacaauauacccaugua

SEQ ID NO: 147628 - RNA, 22 nt, Homo sapiens
auugcauugugaucuucccaga

SEQ ID NO: 147629 - RNA, 22 nt, Homo sapiens
auuggaacugaaauaauaacuu

SEQ ID NO: 147630 - RNA, 22 nt, Homo sapiens
auuguguuugaaugaggcucca

SEQ ID NO: 147631 - RNA, 22 nt, Homo sapiens
auuuaugguuaauauaggaagu

SEQ ID NO: 147632 - RNA, 19 nt, Homo sapiens
auuuccuggagcuggucuc

SEQ ID NO: 147633 - RNA, 22 nt, Homo sapiens
auuuccuguaggggcuugcgaa

SEQ ID NO: 147634 - RNA, 22 nt, Homo sapiens
auuuggcaacguagggaggcau

SEQ ID NO: 147635 - RNA, 22 nt, Homo sapiens
auuuggcaauuuugaagaugcc

SEQ ID NO: 147636 - RNA, 22 nt, Homo sapiens
auuuggcaguauaaugcuuugg

SEQ ID NO: 147637 - RNA, 22 nt, Homo sapiens
auuuggcagugaagggaucaca

SEQ ID NO: 147638 - RNA, 22 nt, Homo sapiens
auuuggguaaugagugcaaggg

SEQ ID NO: 147639 - RNA, 18 nt, Homo sapiens
auuuuugcaguccacaug

SEQ ID NO: 147640 - RNA, 22 nt, Homo sapiens
caaagugcugaaagaggccagg

SEQ ID NO: 147641 - RNA, 22 nt, Homo sapiens
caacacagugaaacccgucucu

SEQ ID NO: 147642 - RNA, 22 nt, Homo sapiens
caacauccaccuccuggguuca

SEQ ID NO: 147643 - RNA, 22 nt, Homo sapiens
caaugguuuuuuaguauaagua

SEQ ID NO: 147644 - RNA, 22 nt, Homo sapiens
cacaccuaccucauuauggaca

SEQ ID NO: 147645 - RNA, 22 nt, Homo sapiens
cacaccuacuagggccgugggc

SEQ ID NO: 147646 - RNA, 22 nt, Homo sapiens
cacacugucuuucagaaugguu

SEQ ID NO: 147647 - RNA, 22 nt, Homo sapiens
cacagagugagacccugucucu

SEQ ID NO: 147648 - RNA, 22 nt, Homo sapiens
cacaguagaauagagcacuagg

SEQ ID NO: 147649 - RNA, 21 nt, Homo sapiens
cacauggaggcagagagugua

SEQ ID NO: 147650 - RNA, 22 nt, Homo sapiens
cacauguuugcuacauuuuucu

SEQ ID NO: 147651 - RNA, 22 nt, Homo sapiens
cacauguuuuagcauggcuguu

SEQ ID NO: 147652 - RNA, 22 nt, Homo sapiens
cacccuugcagggacagcuuug

SEQ ID NO: 147653 - RNA, 22 nt, Homo sapiens
cacuggcacuguguuuagaugg

SEQ ID NO: 147654 - RNA, 18 nt, Homo sapiens
cacuuggcuuugccccuc

SEQ ID NO: 147655 - RNA, 22 nt, Homo sapiens
cagagcacuaaagguaaaaggc

SEQ ID NO: 147656 - RNA, 22 nt, Homo sapiens
cagagcacugauacuggguucu

SEQ ID NO: 147657 - RNA, 22 nt, Homo sapiens
cagagguauugcaaaagccuag

SEQ ID NO: 147658 - RNA, 22 nt, Homo sapiens
cagcccguaaucccagcacuuu

SEQ ID NO: 147659 - RNA, 23 nt, Homo sapiens
cagcuucauugaacauaacuccu

SEQ ID NO: 147660 - RNA, 20 nt, Homo sapiens
cagggcaaugaggagguaaa

SEQ ID NO: 147661 - RNA, 22 nt, Homo sapiens
cagggcaugugggucuauuggc

SEQ ID NO: 147662 - RNA, 22 nt, Homo sapiens
caggugcuuacuuaauagccau

SEQ ID NO: 147663 - RNA, 22 nt, Homo sapiens
caguacaauguggaaaaggagu

SEQ ID NO: 147664 - RNA, 22 nt, Homo sapiens
cauacaguaggcacuauuugua

SEQ ID NO: 147665 - RNA, 22 nt, Homo sapiens
caucacagcaaguagggagugg

SEQ ID NO: 147666 - RNA, 22 nt, Homo sapiens
caucacaucugcaugguaagua

SEQ ID NO: 147667 - RNA, 22 nt, Homo sapiens
caucccugaaccccagaaaucu

SEQ ID NO: 147668 - RNA, 22 nt, Homo sapiens
caucucauugaauugcugagca

SEQ ID NO: 147669 - RNA, 22 nt, Homo sapiens
caugaaagugagaaacuccugg

SEQ ID NO: 147670 - RNA, 22 nt, Homo sapiens
caugauauugcagaauguuggu

SEQ ID NO: 147671 - RNA, 22 nt, Homo sapiens
caugaugcuagguauggaugaa

SEQ ID NO: 147672 - RNA, 22 nt, Homo sapiens
caugccacugcacgccauccug

SEQ ID NO: 147673 - RNA, 22 nt, Homo sapiens
caugccacugcacuccaaccug

SEQ ID NO: 147674 - RNA, 22 nt, Homo sapiens
cauggcacugagcagguaugca

SEQ ID NO: 147675 - RNA, 22 nt, Homo sapiens
cauguauagauuccauaguggu

SEQ ID NO: 147676 - RNA, 22 nt, Homo sapiens
cauugcacuccaccuuggguaa

SEQ ID NO: 147677 - RNA, 22 nt, Homo sapiens
cauugcacuccacuccugaaca

SEQ ID NO: 147678 - RNA, 22 nt, Homo sapiens
cauugcacugcuucuugggugu

SEQ ID NO: 147679 - RNA, 22 nt, Homo sapiens
cauugguuaguuaacuuuaaga

SEQ ID NO: 147680 - RNA, 22 nt, Homo sapiens
ccaaaucucauguugaaaugug

SEQ ID NO: 147681 - RNA, 22 nt, Homo sapiens
ccaguucaaugauauggaaacu

SEQ ID NO: 147682 - RNA, 22 nt, Homo sapiens
ccaguuuuuggcaaugaugaau

SEQ ID NO: 147683 - RNA, 22 nt, Homo sapiens
ccaucacgugcaguggccccac

SEQ ID NO: 147684 - RNA, 20 nt, Homo sapiens
ccccuggaguggggcugcuu

SEQ ID NO: 147685 - RNA, 22 nt, Homo sapiens
cccucauucauucauccuaugu

SEQ ID NO: 147686 - RNA, 22 nt, Homo sapiens
cccuugcacuucagagcugcau

SEQ ID NO: 147687 - RNA, 22 nt, Homo sapiens
ccugagacgaauggagugaaca

SEQ ID NO: 147688 - RNA, 22 nt, Homo sapiens
ccuggcaagagacugaagauag

SEQ ID NO: 147689 - RNA, 22 nt, Homo sapiens
ccuggcacugggccccguggcu

SEQ ID NO: 147690 - RNA, 22 nt, Homo sapiens
ccuucauugcaucuuuaagaga

SEQ ID NO: 147691 - RNA, 22 nt, Homo sapiens
ccuucuuuuguaaggcugaaua

SEQ ID NO: 147692 - RNA, 22 nt, Homo sapiens
ccuuggcacuuugccacagugc

SEQ ID NO: 147693 - RNA, 22 nt, Homo sapiens
ccuuuguggggcgguggguaau

SEQ ID NO: 147694 - RNA, 22 nt, Homo sapiens
cgcccuguagcuagcuagaggu

SEQ ID NO: 147695 - RNA, 22 nt, Homo sapiens
cgccgggggaugggcaccagcg

SEQ ID NO: 147696 - RNA, 22 nt, Homo sapiens
cuagauuauccaacuuauuagc

SEQ ID NO: 147697 - RNA, 22 nt, Homo sapiens
cuagcuuuugauguaaagugag

SEQ ID NO: 147698 - RNA, 22 nt, Homo sapiens
cuauuacuuuuauugaacucag

SEQ ID NO: 147699 - RNA, 22 nt, Homo sapiens
cuauuugguuggugaaaaaagu

SEQ ID NO: 147700 - RNA, 20 nt, Homo sapiens
cucacagacagcuucuuucu

SEQ ID NO: 147701 - RNA, 22 nt, Homo sapiens
cucacaugcucaccugguguuc

SEQ ID NO: 147702 - RNA, 22 nt, Homo sapiens
cucagcaguggauuuaccacca

SEQ ID NO: 147703 - RNA, 22 nt, Homo sapiens
cucagugaagggcaagaggcaa

SEQ ID NO: 147704 - RNA, 22 nt, Homo sapiens
cucaguguuaaggccaccucug

SEQ ID NO: 147705 - RNA, 22 nt, Homo sapiens
cucauuaguuguuuuaagauga

SEQ ID NO: 147706 - RNA, 22 nt, Homo sapiens
cuccaggugagguuaagggacu

SEQ ID NO: 147707 - RNA, 22 nt, Homo sapiens
cuccauuuaucugaaauuuuau

SEQ ID NO: 147708 - RNA, 22 nt, Homo sapiens
cuccauuuggaacagauguccu

SEQ ID NO: 147709 - RNA, 22 nt, Homo sapiens
cucccagagccaguuauaggcu

SEQ ID NO: 147710 - RNA, 22 nt, Homo sapiens
cuccccuuuaguuucuuaauaa

SEQ ID NO: 147711 - RNA, 22 nt, Homo sapiens
cucugagccugagguuccuacu

SEQ ID NO: 147712 - RNA, 22 nt, Homo sapiens
cucugguuaaggcugaacuaua

SEQ ID NO: 147713 - RNA, 22 nt, Homo sapiens
cucugguuuuucuuccauuaag

SEQ ID NO: 147714 - RNA, 22 nt, Homo sapiens
cucuuacaguguguggugaaag

SEQ ID NO: 147715 - RNA, 22 nt, Homo sapiens
cucuuuaguaagcaguugauga

SEQ ID NO: 147716 - RNA, 22 nt, Homo sapiens
cucuuugcuucuggcaucauug

SEQ ID NO: 147717 - RNA, 19 nt, Homo sapiens
cugaaacacagagagggcu

SEQ ID NO: 147718 - RNA, 22 nt, Homo sapiens
cugaauguucuggauggaagag

SEQ ID NO: 147719 - RNA, 22 nt, Homo sapiens
cugacaugcagccacugcaccu

SEQ ID NO: 147720 - RNA, 22 nt, Homo sapiens
cugacguguuuuccagaccuuu

SEQ ID NO: 147721 - RNA, 22 nt, Homo sapiens
cugagaucaugggucagguggu

SEQ ID NO: 147722 - RNA, 22 nt, Homo sapiens
cugagcuaugccuggaaaggca

SEQ ID NO: 147723 - RNA, 22 nt, Homo sapiens
cugaggugggagaaucacauaa

SEQ ID NO: 147724 - RNA, 20 nt, Homo sapiens
cugaggugggagaaucgcuu

SEQ ID NO: 147725 - RNA, 20 nt, Homo sapiens
cugcacauccacucuacuuc

SEQ ID NO: 147726 - RNA, 22 nt, Homo sapiens
cugcaguaaccacuguaggugu

SEQ ID NO: 147727 - RNA, 22 nt, Homo sapiens
gcuggcaagaugcugaugcaac

SEQ ID NO: 147728 - RNA, 22 nt, Homo sapiens
gcuuugguucaaccaggcaauu

SEQ ID NO: 147729 - RNA, 19 nt, Homo sapiens
gcuuuguggggaaggagcc

SEQ ID NO: 147730 - RNA, 22 nt, Homo sapiens
ggaaagacaccuuacuauguua

SEQ ID NO: 147731 - RNA, 22 nt, Homo sapiens
ggaaauguuuagcauccacuuu

SEQ ID NO: 147732 - RNA, 22 nt, Homo sapiens
ggaagagugaauuaucuugacu

SEQ ID NO: 147733 - RNA, 22 nt, Homo sapiens
ggaaugggauuugaagucuggc

SEQ ID NO: 147734 - RNA, 20 nt, Homo sapiens
ggaauguuaaucuccaugau

SEQ ID NO: 147735 - RNA, 22 nt, Homo sapiens
ggacaagagacugggacacuga

SEQ ID NO: 147736 - RNA, 22 nt, Homo sapiens
ggacugagaggacuacagugua

SEQ ID NO: 147737 - RNA, 22 nt, Homo sapiens
ggagaucuuguuaaaguacaga

SEQ ID NO: 147738 - RNA, 22 nt, Homo sapiens
ggagaugaaaugagcuacuuaa

SEQ ID NO: 147739 - RNA, 20 nt, Homo sapiens
ggagguuguauaaguacauc

SEQ ID NO: 147740 - RNA, 22 nt, Homo sapiens
ggaguaggcuguccggcaccca

SEQ ID NO: 147741 - RNA, 22 nt, Homo sapiens
ggaguguguuuuccaacuuggu

SEQ ID NO: 147742 - RNA, 22 nt, Homo sapiens
ggaucacagagcuugggaaagg

SEQ ID NO: 147743 - RNA, 22 nt, Homo sapiens
ggaugcauucaacuuccaguuc

SEQ ID NO: 147744 - RNA, 22 nt, Homo sapiens
ggcaaagaugaccauuacuuuu

SEQ ID NO: 147745 - RNA, 22 nt, Homo sapiens
ggcaagaaaaugcaauuacugu

SEQ ID NO: 147746 - RNA, 22 nt, Homo sapiens
ggcaagaaagaaaucaucuguc

SEQ ID NO: 147747 - RNA, 22 nt, Homo sapiens
ggcaaggauguuuuucuggcaa

SEQ ID NO: 147748 - RNA, 22 nt, Homo sapiens
ggcaaggauuagauucuccccu

SEQ ID NO: 147749 - RNA, 22 nt, Homo sapiens
ggcaagugggagggaguguuuc

SEQ ID NO: 147750 - RNA, 22 nt, Homo sapiens
ggcagguaaggagugggagccu

SEQ ID NO: 147751 - RNA, 22 nt, Homo sapiens
ggcaguuuguucuugcuccuuu

SEQ ID NO: 147752 - RNA, 22 nt, Homo sapiens
ggcauguguggguuauuaaaga

SEQ ID NO: 147753 - RNA, 22 nt, Homo sapiens
ggcauguugauagguagaugua

SEQ ID NO: 147754 - RNA, 22 nt, Homo sapiens
ggcgguguugauggcccccaca

SEQ ID NO: 147755 - RNA, 22 nt, Homo sapiens
gggaacauggaaauucugcucu

SEQ ID NO: 147756 - RNA, 22 nt, Homo sapiens
gggagcacaagaaauguuucau

SEQ ID NO: 147757 - RNA, 22 nt, Homo sapiens
gggaugaagaagaauaguucgu

SEQ ID NO: 147758 - RNA, 22 nt, Homo sapiens
gggaugaaguugauguagaaag

SEQ ID NO: 147759 - RNA, 22 nt, Homo sapiens
gggcaacauugaguacccugaa

SEQ ID NO: 147760 - RNA, 22 nt, Homo sapiens
gggcaguauggucauuuucaca

SEQ ID NO: 147761 - RNA, 22 nt, Homo sapiens
gguaacaguggggcuaugcuua

SEQ ID NO: 147762 - RNA, 22 nt, Homo sapiens
ggucacauuggacuaucaaguu

SEQ ID NO: 147763 - RNA, 22 nt, Homo sapiens
ggugucaguuggccccuacugg

SEQ ID NO: 147764 - RNA, 22 nt, Homo sapiens
guaacguaaugucaaaaucuau

SEQ ID NO: 147765 - RNA, 22 nt, Homo sapiens
guaauacuggacaggguaucag

SEQ ID NO: 147766 - RNA, 22 nt, Homo sapiens
guacacaacaugcagguuuguu

SEQ ID NO: 147767 - RNA, 22 nt, Homo sapiens
guacaguacugaaugaauguau

SEQ ID NO: 147768 - RNA, 22 nt, Homo sapiens
guacaguaguaaaagugaauga

SEQ ID NO: 147769 - RNA, 22 nt, Homo sapiens
guacaguuuucaguguucacug

SEQ ID NO: 147770 - RNA, 22 nt, Homo sapiens
guagaucucaacacuggaagua

SEQ ID NO: 147771 - RNA, 22 nt, Homo sapiens
guagcagucacauagcagauug

SEQ ID NO: 147772 - RNA, 22 nt, Homo sapiens
guauacacccugugauauuauu

SEQ ID NO: 147773 - RNA, 22 nt, Homo sapiens
guauacaguugacccuugaacc

SEQ ID NO: 147774 - RNA, 22 nt, Homo sapiens
guauacaugucaaaacucacau

SEQ ID NO: 147775 - RNA, 22 nt, Homo sapiens
guauacuucugaaaauagcuau

SEQ ID NO: 147776 - RNA, 22 nt, Homo sapiens
guaugaaaaucggagauugggu

SEQ ID NO: 147777 - RNA, 22 nt, Homo sapiens
guauggaagucaguuuguuggc

SEQ ID NO: 147778 - RNA, 22 nt, Homo sapiens
guauuugguuauugcagccuga

SEQ ID NO: 147779 - RNA, 22 nt, Homo sapiens
gucaacauauuaauuauguucu

SEQ ID NO: 147780 - RNA, 22 nt, Homo sapiens
gucacagaaaaagauaugccaa

SEQ ID NO: 147781 - RNA, 22 nt, Homo sapiens
gucacagcuggcauugucugca

SEQ ID NO: 147782 - RNA, 22 nt, Homo sapiens
gucacaguguuuguucauccca

SEQ ID NO: 147783 - RNA, 22 nt, Homo sapiens
gucacugugaggaggggccagg

SEQ ID NO: 147784 - RNA, 22 nt, Homo sapiens
gucagauaauuugcauccaucu

SEQ ID NO: 147785 - RNA, 22 nt, Homo sapiens
gucagcaaagaggaauaguuug

SEQ ID NO: 147786 - RNA, 22 nt, Homo sapiens
gucaggcaccgauacaguuuuu

SEQ ID NO: 147787 - RNA, 22 nt, Homo sapiens
gucaugcaggguucgccagccc

SEQ ID NO: 147788 - RNA, 22 nt, Homo sapiens
gucauucauucagcaagcacug

SEQ ID NO: 147789 - RNA, 21 nt, Homo sapiens
guccaaaacaguguccaaugc

SEQ ID NO: 147790 - RNA, 22 nt, Homo sapiens
guccauuuguuuccagagcacu

SEQ ID NO: 147791 - RNA, 22 nt, Homo sapiens
gucccagagauauugugucuuu

SEQ ID NO: 147792 - RNA, 22 nt, Homo sapiens
gucucauugcaguuagaccugu

SEQ ID NO: 147793 - RNA, 22 nt, Homo sapiens
gucucccagccuacauauuucu

SEQ ID NO: 147794 - RNA, 20 nt, Homo sapiens
gucuuguagcucaaguuauu

SEQ ID NO: 147795 - RNA, 22 nt, Homo sapiens
gugaacagcagaugagugagug

SEQ ID NO: 147796 - RNA, 22 nt, Homo sapiens
gugaagaucccuguccuguucc

SEQ ID NO: 147797 - RNA, 22 nt, Homo sapiens
gugagaugaggucucacucugu

SEQ ID NO: 147798 - RNA, 22 nt, Homo sapiens
gugagcagagaucgcgugauug

SEQ ID NO: 147799 - RNA, 22 nt, Homo sapiens
gugagcaguguccuugggggca

SEQ ID NO: 147800 - RNA, 22 nt, Homo sapiens
gugagguaagaguugcuuugcu

SEQ ID NO: 147801 - RNA, 22 nt, Homo sapiens
gugauacugcuuauuaauuuaa

SEQ ID NO: 147802 - RNA, 22 nt, Homo sapiens
gugaugcaguacguagaggaga

SEQ ID NO: 147803 - RNA, 22 nt, Homo sapiens
gugcaaugagaaggggcucugg

SEQ ID NO: 147804 - RNA, 22 nt, Homo sapiens
gugcacaacgugcaggcuuguu

SEQ ID NO: 147805 - RNA, 22 nt, Homo sapiens
gugcacauauggugcauaagug

SEQ ID NO: 147806 - RNA, 22 nt, Homo sapiens
gugcauguccacuaguccauau

SEQ ID NO: 147807 - RNA, 22 nt, Homo sapiens
guggaagcacaggccuccugga

SEQ ID NO: 147808 - RNA, 22 nt, Homo sapiens
guggaggagaaagaagcauuuc

SEQ ID NO: 147809 - RNA, 17 nt, Homo sapiens
guggauagaacaaugaa

SEQ ID NO: 147810 - RNA, 22 nt, Homo sapiens
guggcaugaaagcagauaccac

SEQ ID NO: 147811 - RNA, 22 nt, Homo sapiens
guggcauuucccaaaguauucu

SEQ ID NO: 147812 - RNA, 22 nt, Homo sapiens
gugguuuuaauauucagucuag

SEQ ID NO: 147813 - RNA, 22 nt, Homo sapiens
guguaaaucugcugugaacauu

SEQ ID NO: 147814 - RNA, 22 nt, Homo sapiens
gugucaguggggagugaucuuc

SEQ ID NO: 147815 - RNA, 22 nt, Homo sapiens
gugugacagcuauagacaugau

SEQ ID NO: 147816 - RNA, 22 nt, Homo sapiens
gugugcacaaucuggcaugugc

SEQ ID NO: 147817 - RNA, 22 nt, Homo sapiens
gugugcauaugucuuuauagua

SEQ ID NO: 147818 - RNA, 21 nt, Homo sapiens
gugugcuugaauucagcuguc

SEQ ID NO: 147819 - RNA, 22 nt, Homo sapiens
guguguaaauggcagugagcuc

SEQ ID NO: 147820 - RNA, 22 nt, Homo sapiens
guucacacuugcaaccccagca

SEQ ID NO: 147821 - RNA, 22 nt, Homo sapiens
guucccaguugaaaugauuagu

SEQ ID NO: 147822 - RNA, 22 nt, Homo sapiens
guugaaaucaucacuuggcaug

SEQ ID NO: 147823 - RNA, 22 nt, Homo sapiens
guugguauuacagaaauuaguu

SEQ ID NO: 147824 - RNA, 22 nt, Homo sapiens
guuuaggaaugagaauauuuag

SEQ ID NO: 147825 - RNA, 22 nt, Homo sapiens
guuuuuggggucacuauuaccg

SEQ ID NO: 147826 - RNA, 21 nt, Homo sapiens
uaaagcuagaaccuuagcuuu

SEQ ID NO: 147827 - RNA, 21 nt, Homo sapiens
uaaagcuuagcuauaguggcu

SEQ ID NO: 147828 - RNA, 20 nt, Homo sapiens
uaaaugccucaugcuuuauu

SEQ ID NO: 147829 - RNA, 22 nt, Homo sapiens
gugcaguuuugagugaguuucu

SEQ ID NO: 147830 - RNA, 22 nt, Homo sapiens
gugcaugucuaugcgagucuaa

SEQ ID NO: 147831 - RNA, 22 nt, Homo sapiens
gugcuauguuguuuuggccgaa

SEQ ID NO: 147832 - RNA, 16 nt, Homo sapiens
gugcuguguuguuagg

SEQ ID NO: 147833 - RNA, 21 nt, Homo sapiens
gugcuuguagccucacuucug

SEQ ID NO: 147834 - RNA, 22 nt, Homo sapiens
guggaaugcaguguugauucaa

SEQ ID NO: 147835 - RNA, 22 nt, Homo sapiens
guggacggagguugcagugagc

SEQ ID NO: 147836 - RNA, 22 nt, Homo sapiens
guggaggacuggauaaagaaaa

SEQ ID NO: 147837 - RNA, 22 nt, Homo sapiens
guggcagaaaagagaagcaaug

SEQ ID NO: 147838 - RNA, 20 nt, Homo sapiens
gugggcaaauccuuuccucu

SEQ ID NO: 147839 - RNA, 22 nt, Homo sapiens
gugggguaggguaggacucaac

SEQ ID NO: 147840 - RNA, 22 nt, Homo sapiens
gugguuuucaacuccaccugca

SEQ ID NO: 147841 - RNA, 21 nt, Homo sapiens
gugucacagacaugacagaug

SEQ ID NO: 147842 - RNA, 22 nt, Homo sapiens
gugugacuagucaugccugaau

SEQ ID NO: 147843 - RNA, 19 nt, Homo sapiens
gugugcauaucacagagca

SEQ ID NO: 147844 - RNA, 22 nt, Homo sapiens
gugugcauggagggggcaguga

SEQ ID NO: 147845 - RNA, 21 nt, Homo sapiens
gugugcuugagugaugggauu

SEQ ID NO: 147846 - RNA, 22 nt, Homo sapiens
guuaugcagcuuagaaaaugaa

SEQ ID NO: 147847 - RNA, 22 nt, Homo sapiens
guuauguuaaauuguuguaugc

SEQ ID NO: 147848 - RNA, 22 nt, Homo sapiens
guuauguuauguuauguuaugu

SEQ ID NO: 147849 - RNA, 22 nt, Homo sapiens
guuauuguccauuuauuuagca

SEQ ID NO: 147850 - RNA, 22 nt, Homo sapiens
guucaagcaauucugcugccuc

SEQ ID NO: 147851 - RNA, 22 nt, Homo sapiens
guuugguugcauggaaaauuua

SEQ ID NO: 147852 - RNA, 21 nt, Homo sapiens
uaaaacuguaacuuuguccug

SEQ ID NO: 147853 - RNA, 22 nt, Homo sapiens
uaaacugucuuuggagcuuugc

SEQ ID NO: 147854 - RNA, 17 nt, Homo sapiens
uaaagccagucaaguca

SEQ ID NO: 147855 - RNA, 22 nt, Homo sapiens
uaaauacguccauuugugguau

SEQ ID NO: 147856 - RNA, 22 nt, Homo sapiens
uaacaaugucuuaugggcuuaa

SEQ ID NO: 147857 - RNA, 22 nt, Homo sapiens
uaacaggcuacucuugcauugc

SEQ ID NO: 147858 - RNA, 22 nt, Homo sapiens
uaacuauagagaauguugagua

SEQ ID NO: 147859 - RNA, 22 nt, Homo sapiens
uaagacuguuggcaauuuuugc

SEQ ID NO: 147860 - RNA, 22 nt, Homo sapiens
uaagagagcuccaucuuuuccu

SEQ ID NO: 147861 - RNA, 22 nt, Homo sapiens
uaaggcaaguuuuuaguggaca

SEQ ID NO: 147862 - RNA, 22 nt, Homo sapiens
uaaggcacuacuuuaggcuuuc

SEQ ID NO: 147863 - RNA, 22 nt, Homo sapiens
uaagggacauguguugccuaag

SEQ ID NO: 147864 - RNA, 22 nt, Homo sapiens
uaaguaauugcagcaauuugcc

SEQ ID NO: 147865 - RNA, 22 nt, Homo sapiens
uaagucacuccagguuaaagug

SEQ ID NO: 147866 - RNA, 22 nt, Homo sapiens
uaagugcaugauuacaugcaua

SEQ ID NO: 147867 - RNA, 22 nt, Homo sapiens
uaagugguguucauucuuuuga

SEQ ID NO: 147868 - RNA, 22 nt, Homo sapiens
uaaguuguagaacguuuucuua

SEQ ID NO: 147869 - RNA, 21 nt, Homo sapiens
uaauaaugucucagacaccua

SEQ ID NO: 147870 - RNA, 22 nt, Homo sapiens
uaauacugcugugcuugaguug

SEQ ID NO: 147871 - RNA, 22 nt, Homo sapiens
uaauagcaguguuacuaggacu

SEQ ID NO: 147872 - RNA, 22 nt, Homo sapiens
uaauagcucggauaaacaugau

SEQ ID NO: 147873 - RNA, 22 nt, Homo sapiens
uaauauguauacagacagauac

SEQ ID NO: 147874 - RNA, 22 nt, Homo sapiens
uaauaugugguugcuugggcac

SEQ ID NO: 147875 - RNA, 22 nt, Homo sapiens
uaauauguuuugaaaucaggaa

SEQ ID NO: 147876 - RNA, 22 nt, Homo sapiens
uaaugcuguggucugguuuaaa

SEQ ID NO: 147877 - RNA, 22 nt, Homo sapiens
uaaugugaauagugcuguaaug

SEQ ID NO: 147878 - RNA, 22 nt, Homo sapiens
uaauugaaugcagacaccaggg

SEQ ID NO: 147879 - RNA, 22 nt, Homo sapiens
uacaguguuuugguauuccaca

SEQ ID NO: 147880 - RNA, 22 nt, Homo sapiens
uacauguauccauuguuuuugg

SEQ ID NO: 147881 - RNA, 22 nt, Homo sapiens
uacaugugcacaacgugcaggu

SEQ ID NO: 147882 - RNA, 22 nt, Homo sapiens
uaccaucauuauacguagaaau

SEQ ID NO: 147883 - RNA, 22 nt, Homo sapiens
uaccaugaagguggagagagaa

SEQ ID NO: 147884 - RNA, 22 nt, Homo sapiens
uaccucagccaaugcccagaag

SEQ ID NO: 147885 - RNA, 23 nt, Homo sapiens
uaccugagacuggguaauuaaua

SEQ ID NO: 147886 - RNA, 22 nt, Homo sapiens
uagaccaauuggcauauaguaa

SEQ ID NO: 147887 - RNA, 22 nt, Homo sapiens
uagacccauuguucagagagug

SEQ ID NO: 147888 - RNA, 22 nt, Homo sapiens
uagagcaugugccauacguaca

SEQ ID NO: 147889 - RNA, 22 nt, Homo sapiens
uagagguauguauaguauucuu

SEQ ID NO: 147890 - RNA, 21 nt, Homo sapiens
uagaugguguucuagagagaa

SEQ ID NO: 147891 - RNA, 22 nt, Homo sapiens
uagauuaucauucauacaggga

SEQ ID NO: 147892 - RNA, 22 nt, Homo sapiens
uagauuaucuaugaggcuucca

SEQ ID NO: 147893 - RNA, 20 nt, Homo sapiens
uagcacaucuggcuguagag

SEQ ID NO: 147894 - RNA, 22 nt, Homo sapiens
uagcacuauguuaucacauacu

SEQ ID NO: 147895 - RNA, 22 nt, Homo sapiens
uagcagcaaagcaggaucugcu

SEQ ID NO: 147896 - RNA, 22 nt, Homo sapiens
uagcagcaucucuggcuucuac

SEQ ID NO: 147897 - RNA, 22 nt, Homo sapiens
uagcugaucuuuuaaagaauga

SEQ ID NO: 147898 - RNA, 20 nt, Homo sapiens
uaggagcaaugagaguagaa

SEQ ID NO: 147899 - RNA, 22 nt, Homo sapiens
uaggagugugaacccuguuuug

SEQ ID NO: 147900 - RNA, 22 nt, Homo sapiens
uaguccauuuucaugcugcuau

SEQ ID NO: 147901 - RNA, 22 nt, Homo sapiens
uagucccauaugauuuagugaa

SEQ ID NO: 147902 - RNA, 21 nt, Homo sapiens
uagugcugaggcaguauggga

SEQ ID NO: 147903 - RNA, 22 nt, Homo sapiens
uagugcugugauaaacauauau

SEQ ID NO: 147904 - RNA, 22 nt, Homo sapiens
uaguguuuuucauuggcagagg

SEQ ID NO: 147905 - RNA, 23 nt, Homo sapiens
uauaacuuuuaauuuacuggccu

SEQ ID NO: 147906 - RNA, 22 nt, Homo sapiens
uauacacgugugcauauauaca

SEQ ID NO: 147907 - RNA, 22 nt, Homo sapiens
uauagcagugaguauugacuaa

SEQ ID NO: 147908 - RNA, 22 nt, Homo sapiens
uaucaaacccaaggaggggguu

SEQ ID NO: 147909 - RNA, 22 nt, Homo sapiens
uaucagcagagucauacuucaa

SEQ ID NO: 147910 - RNA, 22 nt, Homo sapiens
uaucucauccuccuugauccca

SEQ ID NO: 147911 - RNA, 22 nt, Homo sapiens
uaugaaucuggcuacuccaggg

SEQ ID NO: 147912 - RNA, 22 nt, Homo sapiens
uaugaccuuggacaaguuacuu

SEQ ID NO: 147913 - RNA, 22 nt, Homo sapiens
uaugacuuuggaaaaauuacuu

SEQ ID NO: 147914 - RNA, 22 nt, Homo sapiens
uaugacuuuugaauacagaugg

SEQ ID NO: 147915 - RNA, 23 nt, Homo sapiens
uaugccuguuucaaacaaacuuu

SEQ ID NO: 147916 - RNA, 22 nt, Homo sapiens
uaugccuuucucacuaagcuua

SEQ ID NO: 147917 - RNA, 22 nt, Homo sapiens
uaugccuuuuggcucaagaaac

SEQ ID NO: 147918 - RNA, 21 nt, Homo sapiens
uaugguuucuaauucugcagg

SEQ ID NO: 147919 - RNA, 22 nt, Homo sapiens
uaugugcuuuguuaaacagaug

SEQ ID NO: 147920 - RNA, 22 nt, Homo sapiens
uauguuaucaaaaagcuaagga

SEQ ID NO: 147921 - RNA, 22 nt, Homo sapiens
uauuacugucaauaucacagaa

SEQ ID NO: 147922 - RNA, 22 nt, Homo sapiens
uauugcaacagaagaaagaguc

SEQ ID NO: 147923 - RNA, 22 nt, Homo sapiens
uauugcaauuggcagagugcua

SEQ ID NO: 147924 - RNA, 22 nt, Homo sapiens
uauugcaauuggggaaacuggg

SEQ ID NO: 147925 - RNA, 20 nt, Homo sapiens
uauugccuaaauaccagaau

SEQ ID NO: 147926 - RNA, 22 nt, Homo sapiens
uauugccucuuuuguaaaagug

SEQ ID NO: 147927 - RNA, 22 nt, Homo sapiens
uauuguuaaagauguuaaugau

SEQ ID NO: 147928 - RNA, 22 nt, Homo sapiens
uauuuggauagucuggaaaaaa

SEQ ID NO: 147929 - RNA, 22 nt, Homo sapiens
uauuugguuggugcaaaaguaa

SEQ ID NO: 147930 - RNA, 22 nt, Homo sapiens
uauuuguccccuccaaaaguca

SEQ ID NO: 147931 - RNA, 22 nt, Homo sapiens
ucaaacugcuugaggccauuua

SEQ ID NO: 147932 - RNA, 22 nt, Homo sapiens
ucaaacugucagguugaccaga

SEQ ID NO: 147933 - RNA, 22 nt, Homo sapiens
ucaaaugcacguagagaaaaua

SEQ ID NO: 147934 - RNA, 22 nt, Homo sapiens
ucaagcaauucugcugccucag

SEQ ID NO: 147935 - RNA, 20 nt, Homo sapiens
ucaaggcacgaauaaaaguu

SEQ ID NO: 147936 - RNA, 22 nt, Homo sapiens
ucaaguacugccuugcucuggc

SEQ ID NO: 147937 - RNA, 22 nt, Homo sapiens
ucacagaggagaagaccuuuaa

SEQ ID NO: 147938 - RNA, 22 nt, Homo sapiens
ucacagcggucgaacuaauuug

SEQ ID NO: 147939 - RNA, 18 nt, Homo sapiens
ucacagguaaaguugaca

SEQ ID NO: 147940 - RNA, 22 nt, Homo sapiens
ucacagugcaggaucaguuaau

SEQ ID NO: 147941 - RNA, 22 nt, Homo sapiens
ucacaugugacauauauauuug

SEQ ID NO: 147942 - RNA, 22 nt, Homo sapiens
ucacaugugcguuuuggcaugu

SEQ ID NO: 147943 - RNA, 22 nt, Homo sapiens
ucacauuguuauguaaauguuu

SEQ ID NO: 147944 - RNA, 22 nt, Homo sapiens
ucacccacacaggagacaggga

SEQ ID NO: 147945 - RNA, 22 nt, Homo sapiens
ucaccuugcacaguuguguggg

SEQ ID NO: 147946 - RNA, 20 nt, Homo sapiens
ucacuggagcucauuugauu

SEQ ID NO: 147947 - RNA, 22 nt, Homo sapiens
ucagaacugaacaaaccagucu

SEQ ID NO: 147948 - RNA, 22 nt, Homo sapiens
ucagaacugauacuagaacuuu

SEQ ID NO: 147949 - RNA, 21 nt, Homo sapiens
ucagaagcucccagggaggac

SEQ ID NO: 147950 - RNA, 22 nt, Homo sapiens
ucagaugaugucccuguucuaa

SEQ ID NO: 147951 - RNA, 22 nt, Homo sapiens
ucagcacauucaaggccugccu

SEQ ID NO: 147952 - RNA, 22 nt, Homo sapiens
ucaggcaccuuccucuuaucug

SEQ ID NO: 147953 - RNA, 22 nt, Homo sapiens
ucaggcaugcagcaaugcagug

SEQ ID NO: 147954 - RNA, 22 nt, Homo sapiens
ucagguaguuugugggagauga

SEQ ID NO: 147955 - RNA, 23 nt, Homo sapiens
ucaguacuccacuuucaauagug

SEQ ID NO: 147956 - RNA, 22 nt, Homo sapiens
ucaguauaugaaucuggggcag

SEQ ID NO: 147957 - RNA, 20 nt, Homo sapiens
ucaguauauuguuuccacag

SEQ ID NO: 147958 - RNA, 22 nt, Homo sapiens
ucagugauugcuuucauggaaa

SEQ ID NO: 147959 - RNA, 19 nt, Homo sapiens
ucagugcuauguaauguag

SEQ ID NO: 147960 - RNA, 22 nt, Homo sapiens
ucaguggauuuaaccugaauca

SEQ ID NO: 147961 - RNA, 22 nt, Homo sapiens
ucauaguagucacuuaauaaau

SEQ ID NO: 147962 - RNA, 22 nt, Homo sapiens
ucaucagugcuugcaaauuauu

SEQ ID NO: 147963 - RNA, 22 nt, Homo sapiens
ucaucaguggggaugugguuga

SEQ ID NO: 147964 - RNA, 22 nt, Homo sapiens
ucaugaaguaguuaacugguug

SEQ ID NO: 147965 - RNA, 22 nt, Homo sapiens
ucaugacacuggcaggagcuaa

SEQ ID NO: 147966 - RNA, 23 nt, Homo sapiens
ucaugguagcaccaacaauaacu

SEQ ID NO: 147967 - RNA, 22 nt, Homo sapiens
ucaugugagcacagagcaagau

SEQ ID NO: 147968 - RNA, 22 nt, Homo sapiens
ucaugugaggauaacaauagug

SEQ ID NO: 147969 - RNA, 22 nt, Homo sapiens
ucauugcauguuaauuaaacag

SEQ ID NO: 147970 - RNA, 22 nt, Homo sapiens
ucauuggaugucugaaaugauu

SEQ ID NO: 147971 - RNA, 22 nt, Homo sapiens
uccagugugcaggcaaguuuga

SEQ ID NO: 147972 - RNA, 23 nt, Homo sapiens
ucccaagauggaccagaccaagg

SEQ ID NO: 147973 - RNA, 22 nt, Homo sapiens
ucccagaaacgcauauguucau

SEQ ID NO: 147974 - RNA, 19 nt, Homo sapiens
uccccaguuuuccguucag

SEQ ID NO: 147975 - RNA, 22 nt, Homo sapiens
uccuuugguuauaggcaccucu

SEQ ID NO: 147976 - RNA, 22 nt, Homo sapiens
ucgcugcgaccuccaccucccg

SEQ ID NO: 147977 - RNA, 22 nt, Homo sapiens
ucuaucacagccccacacucuc

SEQ ID NO: 147978 - RNA, 22 nt, Homo sapiens
ucucaguggcuuccucacuuuu

SEQ ID NO: 147979 - RNA, 22 nt, Homo sapiens
ucucagugugguaaaaguuuuu

SEQ ID NO: 147980 - RNA, 19 nt, Homo sapiens
ucucaguguuggucaggug

SEQ ID NO: 147981 - RNA, 22 nt, Homo sapiens
ucucauagaggcagagaguaaa

SEQ ID NO: 147982 - RNA, 22 nt, Homo sapiens
ucucauggcucacccugcauag

SEQ ID NO: 147983 - RNA, 22 nt, Homo sapiens
ucugacucuggagucucagguu

SEQ ID NO: 147984 - RNA, 22 nt, Homo sapiens
ucuggcaagauauccauugcuu

SEQ ID NO: 147985 - RNA, 21 nt, Homo sapiens
ucuggccccuccaaaucucau

SEQ ID NO: 147986 - RNA, 17 nt, Homo sapiens
ucuggcuuucacaccug

SEQ ID NO: 147987 - RNA, 22 nt, Homo sapiens
ucugucaaaucuuauguuguag

SEQ ID NO: 147988 - RNA, 22 nt, Homo sapiens
ucugucacugguggacgaucac

SEQ ID NO: 147989 - RNA, 22 nt, Homo sapiens
ucugugcauuacacuuuucuca

SEQ ID NO: 147990 - RNA, 22 nt, Homo sapiens
ucugugcauuguaacaacuaaa

SEQ ID NO: 147991 - RNA, 22 nt, Homo sapiens
ucugugcauuguaggauguuua

SEQ ID NO: 147992 - RNA, 17 nt, Homo sapiens
ucuucuguuacuguggc

SEQ ID NO: 147993 - RNA, 22 nt, Homo sapiens
ucuugcacaaauuauuuuaacu

SEQ ID NO: 147994 - RNA, 22 nt, Homo sapiens
ucuugcacacaguaaguguuuu

SEQ ID NO: 147995 - RNA, 19 nt, Homo sapiens
ucuugcacaugugaacuca

SEQ ID NO: 147996 - RNA, 22 nt, Homo sapiens
ucuugcauuuuuaaauagugcu

SEQ ID NO: 147997 - RNA, 23 nt, Homo sapiens
ucuugguuauagaaaaauaguug

SEQ ID NO: 147998 - RNA, 22 nt, Homo sapiens
ucuuucacuuagcaugauguuu

SEQ ID NO: 147999 - RNA, 22 nt, Homo sapiens
ucuuuggguagauauguagcug

SEQ ID NO: 148000 - RNA, 22 nt, Homo sapiens
ucuuugguaggaguaggaggcc

SEQ ID NO: 148001 - RNA, 22 nt, Homo sapiens
ucuuuggucaucaugggaagca

SEQ ID NO: 148002 - RNA, 22 nt, Homo sapiens
ucuuuguucaggagccaacucc

SEQ ID NO: 148003 - RNA, 22 nt, Homo sapiens
ugaaacauacacucugaugggg

SEQ ID NO: 148004 - RNA, 22 nt, Homo sapiens
ugaaaugaucaguuugguuacu

SEQ ID NO: 148005 - RNA, 22 nt, Homo sapiens
ugaaauggaaagaguguagacu

SEQ ID NO: 148006 - RNA, 22 nt, Homo sapiens
ugaaauguguuaucugggccug

SEQ ID NO: 148007 - RNA, 22 nt, Homo sapiens
ugaaauuauucuuaccaaggug

SEQ ID NO: 148008 - RNA, 21 nt, Homo sapiens
ugaauacugcugcucccuuug

SEQ ID NO: 148009 - RNA, 22 nt, Homo sapiens
ugaauacuucaaaaaaauagcu

SEQ ID NO: 148010 - RNA, 22 nt, Homo sapiens
ugaaucaugcugcuauaaagac

SEQ ID NO: 148011 - RNA, 22 nt, Homo sapiens
ugaaugcaucuagaaauuuauu

SEQ ID NO: 148012 - RNA, 22 nt, Homo sapiens
ugaauguauuuauuaccauuca

SEQ ID NO: 148013 - RNA, 22 nt, Homo sapiens
ugacaagaguagagagggugcc

SEQ ID NO: 148014 - RNA, 22 nt, Homo sapiens
ugacaagcucccucugcaccuu

SEQ ID NO: 148015 - RNA, 20 nt, Homo sapiens
ugacaaggugcaaagaauca

SEQ ID NO: 148016 - RNA, 22 nt, Homo sapiens
uauucaagccaaauucaagcca

SEQ ID NO: 148017 - RNA, 22 nt, Homo sapiens
uauugaauuugagcugucucuu

SEQ ID NO: 148018 - RNA, 22 nt, Homo sapiens
uauugaauuuuuaagcccuuug

SEQ ID NO: 148019 - RNA, 22 nt, Homo sapiens
uauuguuuuucccaggagucua

SEQ ID NO: 148020 - RNA, 18 nt, Homo sapiens
ucaaauacuuugggcagu

SEQ ID NO: 148021 - RNA, 22 nt, Homo sapiens
ucaaaugguccacgugaacauu

SEQ ID NO: 148022 - RNA, 22 nt, Homo sapiens
ucaacugcuugagaucacaaau

SEQ ID NO: 148023 - RNA, 22 nt, Homo sapiens
ucaagcaauucuccucucagcc

SEQ ID NO: 148024 - RNA, 18 nt, Homo sapiens
ucaagcuauugucaugcc

SEQ ID NO: 148025 - RNA, 20 nt, Homo sapiens
ucaaggcaggaacuguacau

SEQ ID NO: 148026 - RNA, 22 nt, Homo sapiens
ucaagugauucuugugccuuag

SEQ ID NO: 148027 - RNA, 22 nt, Homo sapiens
ucaauguaucuccaagaauuga

SEQ ID NO: 148028 - RNA, 19 nt, Homo sapiens
ucaauucugucaauggcuu

SEQ ID NO: 148029 - RNA, 16 nt, Homo sapiens
ucacaaacucuagcag

SEQ ID NO: 148030 - RNA, 19 nt, Homo sapiens
ucacaggguugacuugagg

SEQ ID NO: 148031 - RNA, 22 nt, Homo sapiens
ucacaugaauugucuuguucca

SEQ ID NO: 148032 - RNA, 22 nt, Homo sapiens
ucacauguguaaauugguguaa

SEQ ID NO: 148033 - RNA, 22 nt, Homo sapiens
ucacauuaagcuguuauuucuu

SEQ ID NO: 148034 - RNA, 22 nt, Homo sapiens
ucacauuguauauguaccuauc

SEQ ID NO: 148035 - RNA, 22 nt, Homo sapiens
ucaccaccugcugaucauagag

SEQ ID NO: 148036 - RNA, 22 nt, Homo sapiens
ucacccugacaugcggccgaac

SEQ ID NO: 148037 - RNA, 22 nt, Homo sapiens
ucacgcugcugcaaccagccug

SEQ ID NO: 148038 - RNA, 18 nt, Homo sapiens
ucacggggagcagcagcc

SEQ ID NO: 148039 - RNA, 22 nt, Homo sapiens
ucacgugguucauaaggcagaa

SEQ ID NO: 148040 - RNA, 20 nt, Homo sapiens
ucacuggguucuugaagucu

SEQ ID NO: 148041 - RNA, 22 nt, Homo sapiens
ucacuuggugaacacauuaugu

SEQ ID NO: 148042 - RNA, 22 nt, Homo sapiens
ucagagcaaagacacuuuauca

SEQ ID NO: 148043 - RNA, 22 nt, Homo sapiens
ucagaucaugcuuaugauggga

SEQ ID NO: 148044 - RNA, 22 nt, Homo sapiens
ucagaugauucuguuguugugu

SEQ ID NO: 148045 - RNA, 22 nt, Homo sapiens
ucagauguuugagaaguauacu

SEQ ID NO: 148046 - RNA, 20 nt, Homo sapiens
ucagcagucuggagcagagg

SEQ ID NO: 148047 - RNA, 22 nt, Homo sapiens
ucagguccuuacugugcucccu

SEQ ID NO: 148048 - RNA, 22 nt, Homo sapiens
ucagugacuggguauuaaauca

SEQ ID NO: 148049 - RNA, 22 nt, Homo sapiens
ucagugcuuuuuguugucauca

SEQ ID NO: 148050 - RNA, 22 nt, Homo sapiens
ucaguggagcuacaauucuggg

SEQ ID NO: 148051 - RNA, 22 nt, Homo sapiens
ucaguggauuauuaaagucacc

SEQ ID NO: 148052 - RNA, 22 nt, Homo sapiens
ucauagaucaaguaauaagaca

SEQ ID NO: 148053 - RNA, 22 nt, Homo sapiens
ucaucagaaucccuuagggaug

SEQ ID NO: 148054 - RNA, 22 nt, Homo sapiens
ucaucaggaaacuuaugcagug

SEQ ID NO: 148055 - RNA, 20 nt, Homo sapiens
ucaucaguuggugcucgcug

SEQ ID NO: 148056 - RNA, 22 nt, Homo sapiens
ucaugaccaugguauagaccac

SEQ ID NO: 148057 - RNA, 22 nt, Homo sapiens
ucauggggugcuuugcuagauu

SEQ ID NO: 148058 - RNA, 22 nt, Homo sapiens
ucauguauuaucauuagugggu

SEQ ID NO: 148059 - RNA, 22 nt, Homo sapiens
ucauucauucauccagcuugag

SEQ ID NO: 148060 - RNA, 22 nt, Homo sapiens
ucauucauucuucaguggguac

SEQ ID NO: 148061 - RNA, 22 nt, Homo sapiens
uccaaaucucuggcacugggau

SEQ ID NO: 148062 - RNA, 22 nt, Homo sapiens
uccaguacaggucucucauuuc

SEQ ID NO: 148063 - RNA, 22 nt, Homo sapiens
uccaguggacagacauaccaug

SEQ ID NO: 148064 - RNA, 18 nt, Homo sapiens
uccaguuuucccagcauc

SEQ ID NO: 148065 - RNA, 22 nt, Homo sapiens
uccauugucuagauguaacaca

SEQ ID NO: 148066 - RNA, 16 nt, Homo sapiens
ucccaccauugcuugu

SEQ ID NO: 148067 - RNA, 22 nt, Homo sapiens
ucccacugucuucucgugcucg

SEQ ID NO: 148068 - RNA, 22 nt, Homo sapiens
ucccugacagggucugagcuuu

SEQ ID NO: 148069 - RNA, 19 nt, Homo sapiens
ucccuuuguagguaaccug

SEQ ID NO: 148070 - RNA, 22 nt, Homo sapiens
uccucauggagaaccucugcua

SEQ ID NO: 148071 - RNA, 21 nt, Homo sapiens
uccugagagaggaguaacucu

SEQ ID NO: 148072 - RNA, 22 nt, Homo sapiens
uccuucaguccaguggguuuug

SEQ ID NO: 148073 - RNA, 22 nt, Homo sapiens
uccuuuagacugaauccugaga

SEQ ID NO: 148074 - RNA, 22 nt, Homo sapiens
ucgcaguuaauaaugaugugcg

SEQ ID NO: 148075 - RNA, 22 nt, Homo sapiens
ucuaaaacuagauugugaugau

SEQ ID NO: 148076 - RNA, 22 nt, Homo sapiens
ucuaagaauucauuuauaagcc

SEQ ID NO: 148077 - RNA, 22 nt, Homo sapiens
ucuagaugaaguauaaaguagu

SEQ ID NO: 148078 - RNA, 22 nt, Homo sapiens
ucuauuugggguaccuguggua

SEQ ID NO: 148079 - RNA, 22 nt, Homo sapiens
ucucacacugaauguguguggg

SEQ ID NO: 148080 - RNA, 22 nt, Homo sapiens
ucucaguggcacccccaacacc

SEQ ID NO: 148081 - RNA, 21 nt, Homo sapiens
ucucauuacugaugagccaga

SEQ ID NO: 148082 - RNA, 20 nt, Homo sapiens
ucucccaaacagcaggcccu

SEQ ID NO: 148083 - RNA, 22 nt, Homo sapiens
ucucugaaacucuugacauccu

SEQ ID NO: 148084 - RNA, 22 nt, Homo sapiens
aaacaccacgcggucccucgga

SEQ ID NO: 148085 - RNA, 22 nt, Homo sapiens
aaagagaucuaugggcacuaug

SEQ ID NO: 148086 - RNA, 20 nt, Homo sapiens
aaaggcugugagaacgagau

SEQ ID NO: 148087 - RNA, 22 nt, Homo sapiens
aaagggcacugugcuuuggcaa

SEQ ID NO: 148088 - RNA, 22 nt, Homo sapiens
aaagggcuguuucuugacuugg

SEQ ID NO: 148089 - RNA, 22 nt, Homo sapiens
aaaguaauugcaguuuuugcaa

SEQ ID NO: 148090 - RNA, 17 nt, Homo sapiens
aaaguccuuugcuaucu

SEQ ID NO: 148091 - RNA, 22 nt, Homo sapiens
aaagucuguuuugucagagacu

SEQ ID NO: 148092 - RNA, 22 nt, Homo sapiens
aaagugcacuuggaagagggcc

SEQ ID NO: 148093 - RNA, 22 nt, Homo sapiens
aaagugcaguauuugggcagaa

SEQ ID NO: 148094 - RNA, 22 nt, Homo sapiens
aaaguggacuaagugaauauga

SEQ ID NO: 148095 - RNA, 19 nt, Homo sapiens
aaaguguuuuaaagaggau

SEQ ID NO: 148096 - RNA, 22 nt, Homo sapiens
aaauaacugucagguucuggaa

SEQ ID NO: 148097 - RNA, 22 nt, Homo sapiens
aaaugacuuuuuaugcagagua

SEQ ID NO: 148098 - RNA, 22 nt, Homo sapiens
aaaugcagauucugcuuagguu

SEQ ID NO: 148099 - RNA, 22 nt, Homo sapiens
aaaugccucccauucuacugac

SEQ ID NO: 148100 - RNA, 22 nt, Homo sapiens
aaauggauuaaguucacuugcu

SEQ ID NO: 148101 - RNA, 22 nt, Homo sapiens
aacaccuugcagggauuaugac

SEQ ID NO: 148102 - RNA, 20 nt, Homo sapiens
aacaguguguaaguuuccuu

SEQ ID NO: 148103 - RNA, 22 nt, Homo sapiens
aacaucaaccaugaggguugga

SEQ ID NO: 148104 - RNA, 22 nt, Homo sapiens
aacauguuuagcagauaccugu

SEQ ID NO: 148105 - RNA, 22 nt, Homo sapiens
aacauugaacuuggcacaccca

SEQ ID NO: 148106 - RNA, 20 nt, Homo sapiens
aagagcucaccagaauaucu

SEQ ID NO: 148107 - RNA, 22 nt, Homo sapiens
aagagguaauaacaaagcuucu

SEQ ID NO: 148108 - RNA, 22 nt, Homo sapiens
aagagguagcagucacaaaaga

SEQ ID NO: 148109 - RNA, 22 nt, Homo sapiens
uuuugcacuguuuuaucugaca

SEQ ID NO: 148110 - RNA, 22 nt, Homo sapiens
uuuugcuccuggcaaacucaua

SEQ ID NO: 148111 - RNA, 20 nt, Homo sapiens
uuuuggacuaaaggcauccc

SEQ ID NO: 148112 - RNA, 22 nt, Homo sapiens
uuuuggacuucaauuugacacu

SEQ ID NO: 148113 - RNA, 22 nt, Homo sapiens
uuuuggcacuuugucugauucu

SEQ ID NO: 148114 - RNA, 22 nt, Homo sapiens
uuuuggcucugucuguaucuuu

SEQ ID NO: 148115 - RNA, 22 nt, Homo sapiens
uuuugugacuauuguaaauggg

SEQ ID NO: 148116 - RNA, 22 nt, Homo sapiens
uuuuuauggccaauccucagaa

SEQ ID NO: 148117 - RNA, 22 nt, Homo sapiens
uuuuugaguaaauauaaauugu

SEQ ID NO: 148118 - RNA, 16 nt, Homo sapiens
uuuuugcagaaaugac

SEQ ID NO: 148119 - RNA, 22 nt, Homo sapiens
uuugauguugagacuauaaagc

SEQ ID NO: 148120 - RNA, 22 nt, Homo sapiens
uuugauugguguaccugaaagu

SEQ ID NO: 148121 - RNA, 22 nt, Homo sapiens
uuugcagagacuuguuaggaau

SEQ ID NO: 148122 - RNA, 22 nt, Homo sapiens
uuuggcacuguaaauuucucuu

SEQ ID NO: 148123 - RNA, 22 nt, Homo sapiens
uuuggcagaaaacuaaaaggua

SEQ ID NO: 148124 - RNA, 22 nt, Homo sapiens
uuuggcaugggcuauuugcuuu

SEQ ID NO: 148125 - RNA, 22 nt, Homo sapiens
uuuggcauuagauaauugugua

SEQ ID NO: 148126 - RNA, 22 nt, Homo sapiens
uuuggcauuuaaauaugcaugg

SEQ ID NO: 148127 - RNA, 22 nt, Homo sapiens
uuugggaaugaguuuaucauuu

SEQ ID NO: 148128 - RNA, 22 nt, Homo sapiens
uuuguaauaccugaggcugggu

SEQ ID NO: 148129 - RNA, 22 nt, Homo sapiens
uuuguacuaugguuuuucacua

SEQ ID NO: 148130 - RNA, 19 nt, Homo sapiens
uuuguauguuuccaguaau

SEQ ID NO: 148131 - RNA, 22 nt, Homo sapiens
uuugucuccuaagacucugugg

SEQ ID NO: 148132 - RNA, 22 nt, Homo sapiens
uuugugaaugucauaagcucca

SEQ ID NO: 148133 - RNA, 22 nt, Homo sapiens
uuugugagguggauagauugca

SEQ ID NO: 148134 - RNA, 22 nt, Homo sapiens
uuugugcuaaugcuagauuacu

SEQ ID NO: 148135 - RNA, 23 nt, Homo sapiens
uuugugcuaauuuaugggcucuu

SEQ ID NO: 148136 - RNA, 22 nt, Homo sapiens
uuuguggaaugcccuuauuuau

SEQ ID NO: 148137 - RNA, 22 nt, Homo sapiens
uuuguggaaugcucauguguag

SEQ ID NO: 148138 - RNA, 22 nt, Homo sapiens
uuuguucuucguuccugagcca

SEQ ID NO: 148139 - RNA, 22 nt, Homo sapiens
uuuuacacaucaccgcucgugu

SEQ ID NO: 148140 - RNA, 22 nt, Homo sapiens
uuuuagcaaagagacugguggc

SEQ ID NO: 148141 - RNA, 23 nt, Homo sapiens
uuuugcaauaagucacuggaaua

SEQ ID NO: 148142 - RNA, 20 nt, Homo sapiens
uuuugcacuccuacuaaggu

SEQ ID NO: 148143 - RNA, 22 nt, Homo sapiens
aaacugucuggaugcuugugga

SEQ ID NO: 148144 - RNA, 22 nt, Homo sapiens
aaacugucuucugacaguuucc

SEQ ID NO: 148145 - RNA, 22 nt, Homo sapiens
aaacuugucuaauuauaagcau

SEQ ID NO: 148146 - RNA, 22 nt, Homo sapiens
aaagcacuggagucaucaucua

SEQ ID NO: 148147 - RNA, 22 nt, Homo sapiens
aaagcuaccagauucuguugga

SEQ ID NO: 148148 - RNA, 22 nt, Homo sapiens
aaagguaguacuucuagaaggg

SEQ ID NO: 148149 - RNA, 22 nt, Homo sapiens
aaagugcaguauuugggcagga

SEQ ID NO: 148150 - RNA, 22 nt, Homo sapiens
aaagugcuuacuaaguugccaa

SEQ ID NO: 148151 - RNA, 22 nt, Homo sapiens
aaaguguuucugcaguagguuu

SEQ ID NO: 148152 - RNA, 22 nt, Homo sapiens
aaaugcaugaggugggaagaaa

SEQ ID NO: 148153 - RNA, 23 nt, Homo sapiens
aaaugcucucaggugccaguaga

SEQ ID NO: 148154 - RNA, 22 nt, Homo sapiens
ugggaugauguuaaacguacuc

SEQ ID NO: 148155 - RNA, 22 nt, Homo sapiens
ugggcggagacgugcagccgcc

SEQ ID NO: 148156 - RNA, 22 nt, Homo sapiens
ugguacuguccuucuagauucc

SEQ ID NO: 148157 - RNA, 22 nt, Homo sapiens
uggucuuuucaacaaaugguau

SEQ ID NO: 148158 - RNA, 22 nt, Homo sapiens
ugguguccugucucugcgcuug

SEQ ID NO: 148159 - RNA, 23 nt, Homo sapiens
uguaaaagcauuugucagccugg

SEQ ID NO: 148160 - RNA, 22 nt, Homo sapiens
uguaacaggaggaaaaugugaa

SEQ ID NO: 148161 - RNA, 22 nt, Homo sapiens
uguaacaguaguuacuauucuu

SEQ ID NO: 148162 - RNA, 22 nt, Homo sapiens
uguaaccauccagagucccagg

SEQ ID NO: 148163 - RNA, 22 nt, Homo sapiens
uguaagcauuauauaauuguug

SEQ ID NO: 148164 - RNA, 20 nt, Homo sapiens
uguacacaguguacccacau

SEQ ID NO: 148165 - RNA, 22 nt, Homo sapiens
uguacuucaagauuaugguuua

SEQ ID NO: 148166 - RNA, 22 nt, Homo sapiens
uguagauaucuaucaggucaau

SEQ ID NO: 148167 - RNA, 21 nt, Homo sapiens
uguagcagcaugauuuauaau

SEQ ID NO: 148168 - RNA, 22 nt, Homo sapiens
uguauguaauugaaguuaaguu

SEQ ID NO: 148169 - RNA, 22 nt, Homo sapiens
uguauguugauguuauauucug

SEQ ID NO: 148170 - RNA, 22 nt, Homo sapiens
uguauuuguuguuaaauggaga

SEQ ID NO: 148171 - RNA, 22 nt, Homo sapiens
ugucacagagauuuugguaugu

SEQ ID NO: 148172 - RNA, 22 nt, Homo sapiens
ugucagggaggcucggccgcac

SEQ ID NO: 148173 - RNA, 22 nt, Homo sapiens
ugucaguguaugagccccggau

SEQ ID NO: 148174 - RNA, 22 nt, Homo sapiens
ugucauguauauaccacuucca

SEQ ID NO: 148175 - RNA, 22 nt, Homo sapiens
ugucucaguucccuucucugga

SEQ ID NO: 148176 - RNA, 22 nt, Homo sapiens
ugugaaacacgaaagucuaaaa

SEQ ID NO: 148177 - RNA, 22 nt, Homo sapiens
ugugaaaucagauagccuuuuu

SEQ ID NO: 148178 - RNA, 22 nt, Homo sapiens
ugugaacaaaauuuguugcaua

SEQ ID NO: 148179 - RNA, 19 nt, Homo sapiens
ugugaacaucacagagugu

SEQ ID NO: 148180 - RNA, 22 nt, Homo sapiens
ugugaagauguuucuuaauuga

SEQ ID NO: 148181 - RNA, 22 nt, Homo sapiens
ugugaaugaagaaugcuaaccu

SEQ ID NO: 148182 - RNA, 22 nt, Homo sapiens
ugugaauguaaccuuauuugga

SEQ ID NO: 148183 - RNA, 22 nt, Homo sapiens
ugugacagguauccuguguucu

SEQ ID NO: 148184 - RNA, 22 nt, Homo sapiens
ugugagacugacagggcagggu

SEQ ID NO: 148185 - RNA, 22 nt, Homo sapiens
ugugagacugguucugaaccca

SEQ ID NO: 148186 - RNA, 20 nt, Homo sapiens
ugugagacugguuuugaacu

SEQ ID NO: 148187 - RNA, 19 nt, Homo sapiens
ugugagcauuagcauuuag

SEQ ID NO: 148188 - RNA, 22 nt, Homo sapiens
ugugcauaugucuuuauaguag

SEQ ID NO: 148189 - RNA, 22 nt, Homo sapiens
ugugcaugacagcauacaaacg

SEQ ID NO: 148190 - RNA, 22 nt, Homo sapiens
ugugccacuccaggaggcuguu

SEQ ID NO: 148191 - RNA, 22 nt, Homo sapiens
ugugcuugaauuuaguagcuua

SEQ ID NO: 148192 - RNA, 22 nt, Homo sapiens
uguguaauaccuuugacuauau

SEQ ID NO: 148193 - RNA, 22 nt, Homo sapiens
ugugucuugagagucucgagaa

SEQ ID NO: 148194 - RNA, 22 nt, Homo sapiens
uguuacacugugcacuaaauuu

SEQ ID NO: 148195 - RNA, 20 nt, Homo sapiens
uguugcacucuagccugggu

SEQ ID NO: 148196 - RNA, 22 nt, Homo sapiens
uuaaagccauaccugagagagu

SEQ ID NO: 148197 - RNA, 20 nt, Homo sapiens
uuaaaucuagugcagacuca

SEQ ID NO: 148198 - RNA, 22 nt, Homo sapiens
uuaaaugcauagaauguguagu

SEQ ID NO: 148199 - RNA, 22 nt, Homo sapiens
uuaacaguugcaugagacugag

SEQ ID NO: 148200 - RNA, 22 nt, Homo sapiens
uuaaggaaagcauuuaauucag

SEQ ID NO: 148201 - RNA, 18 nt, Homo sapiens
uuaaggcaggacuuuaag

SEQ ID NO: 148202 - RNA, 22 nt, Homo sapiens
uuaaggcagugcaucuggaguu

SEQ ID NO: 148203 - RNA, 22 nt, Homo sapiens
uuaagucacacuagacaacuga

SEQ ID NO: 148204 - RNA, 22 nt, Homo sapiens
uuaaguuguagcuacaaauaca

SEQ ID NO: 148205 - RNA, 21 nt, Homo sapiens
uuaaugcuaugcagaaaaucu

SEQ ID NO: 148206 - RNA, 22 nt, Homo sapiens
uuaaugcuuuugggauauuucu

SEQ ID NO: 148207 - RNA, 22 nt, Homo sapiens
uuaauguaucuaucacaucaca

SEQ ID NO: 148208 - RNA, 22 nt, Homo sapiens
uuacaagaugucuguccaacac

SEQ ID NO: 148209 - RNA, 22 nt, Homo sapiens
uuacagguggagaaguaaggcu

SEQ ID NO: 148210 - RNA, 22 nt, Homo sapiens
uuacuguauagaaucaucuuga

SEQ ID NO: 148211 - RNA, 22 nt, Homo sapiens
uuagacaguggugcacugcacu

SEQ ID NO: 148212 - RNA, 22 nt, Homo sapiens
uuagcauccauaggagauuggu

SEQ ID NO: 148213 - RNA, 22 nt, Homo sapiens
uuagccccuuugagccucaacu

SEQ ID NO: 148214 - RNA, 22 nt, Homo sapiens
uuaggagacuggauaucucuuu

SEQ ID NO: 148215 - RNA, 22 nt, Homo sapiens
uuagggaggcucaggacaagag

SEQ ID NO: 148216 - RNA, 22 nt, Homo sapiens
uuagugcuuacgaugagcuaag

SEQ ID NO: 148217 - RNA, 20 nt, Homo sapiens
uuaguucauuuagaagguuu

SEQ ID NO: 148218 - RNA, 22 nt, Homo sapiens
uuaguuuaucagugguuucuga

SEQ ID NO: 148219 - RNA, 20 nt, Homo sapiens
uuauagcuacaucuugacug

SEQ ID NO: 148220 - RNA, 22 nt, Homo sapiens
uuauccucuagacauagguuua

SEQ ID NO: 148221 - RNA, 22 nt, Homo sapiens
uuauuacuccuauuuuguagau

SEQ ID NO: 148222 - RNA, 22 nt, Homo sapiens
uucaagauggcaccagugagug

SEQ ID NO: 148223 - RNA, 22 nt, Homo sapiens
uucaagugaacaaaaugaggag

SEQ ID NO: 148224 - RNA, 22 nt, Homo sapiens
uugauauuaaguacugaagugg

SEQ ID NO: 148225 - RNA, 22 nt, Homo sapiens
uugaucaucagcuuugucaucu

SEQ ID NO: 148226 - RNA, 22 nt, Homo sapiens
uugcaagaaaugcagauucuca

SEQ ID NO: 148227 - RNA, 22 nt, Homo sapiens
uugcacauugcaccuuuuguau

SEQ ID NO: 148228 - RNA, 22 nt, Homo sapiens
uugcacuccagcucuaggugac

SEQ ID NO: 148229 - RNA, 22 nt, Homo sapiens
uugcacucuagccugggugaca

SEQ ID NO: 148230 - RNA, 22 nt, Homo sapiens
uugcagcauucugguuccuggu

SEQ ID NO: 148231 - RNA, 22 nt, Homo sapiens
uugcaugucauaacugauggaa

SEQ ID NO: 148232 - RNA, 22 nt, Homo sapiens
uugcaugucugcuucuccuccu

SEQ ID NO: 148233 - RNA, 22 nt, Homo sapiens
uugccuaguuuaggucugugcu

SEQ ID NO: 148234 - RNA, 22 nt, Homo sapiens
uugcuagagaugagggaugugu

SEQ ID NO: 148235 - RNA, 22 nt, Homo sapiens
uugcucaggcuggaguacaaug

SEQ ID NO: 148236 - RNA, 22 nt, Homo sapiens
uuggaaacaccuggugagguua

SEQ ID NO: 148237 - RNA, 22 nt, Homo sapiens
uuggaaacgucaccuuuuccuu

SEQ ID NO: 148238 - RNA, 22 nt, Homo sapiens
uuggaaagagguguuuaugacu

SEQ ID NO: 148239 - RNA, 23 nt, Homo sapiens
uuggaaugagaccuaagaguuuu

SEQ ID NO: 148240 - RNA, 22 nt, Homo sapiens
uuggagagucacuaguuagugc

SEQ ID NO: 148241 - RNA, 22 nt, Homo sapiens
uuggauccauccugucuucucu

SEQ ID NO: 148242 - RNA, 22 nt, Homo sapiens
uuggauuuugguggcaacucau

SEQ ID NO: 148243 - RNA, 22 nt, Homo sapiens
uuggcaaauagguuuuauugca

SEQ ID NO: 148244 - RNA, 22 nt, Homo sapiens
uuggcacugagcaagaacaggg

SEQ ID NO: 148245 - RNA, 22 nt, Homo sapiens
uuggcauagaggcucucaagcu

SEQ ID NO: 148246 - RNA, 22 nt, Homo sapiens
uuggcuuggagaguugaaaugu

SEQ ID NO: 148247 - RNA, 22 nt, Homo sapiens
uugggacuggaaggaguaaggg

SEQ ID NO: 148248 - RNA, 22 nt, Homo sapiens
uugggcuugagggugcccaguc

SEQ ID NO: 148249 - RNA, 22 nt, Homo sapiens
uugguauguguuucauacucaa

SEQ ID NO: 148250 - RNA, 20 nt, Homo sapiens
uuggugaccuacagaugugg

SEQ ID NO: 148251 - RNA, 22 nt, Homo sapiens
uugguuaccuucagaaaugagu

SEQ ID NO: 148252 - RNA, 22 nt, Homo sapiens
uugguucucuuuauaugcugga

SEQ ID NO: 148253 - RNA, 22 nt, Homo sapiens
uugguuuccuuccugcuuaacu

SEQ ID NO: 148254 - RNA, 22 nt, Homo sapiens
uuguaaucaacacaucauuggg

SEQ ID NO: 148255 - RNA, 22 nt, Homo sapiens
uugucccauggggucuuccuuu

SEQ ID NO: 148256 - RNA, 22 nt, Homo sapiens
uuguccuugagauaguuugcag

SEQ ID NO: 148257 - RNA, 22 nt, Homo sapiens
uugugcaugaugcauacauggu

SEQ ID NO: 148258 - RNA, 22 nt, Homo sapiens
uugugcauguauauuaguucac

SEQ ID NO: 148259 - RNA, 22 nt, Homo sapiens
uugugcuucaucaccuagcaga

SEQ ID NO: 148260 - RNA, 22 nt, Homo sapiens
uugugcuugauuugccuagcug

SEQ ID NO: 148261 - RNA, 22 nt, Homo sapiens
uugugcuuuacuuacuaccaga

SEQ ID NO: 148262 - RNA, 22 nt, Homo sapiens
uugugguugauacacguaggaa

SEQ ID NO: 148263 - RNA, 22 nt, Homo sapiens
uuguuugguuagaugggcaagu

SEQ ID NO: 148264 - RNA, 22 nt, Homo sapiens
uuguuuuggagaugagcuaaaa

SEQ ID NO: 148265 - RNA, 22 nt, Homo sapiens
uuuauggagagauauuuauggu

SEQ ID NO: 148266 - RNA, 22 nt, Homo sapiens
uuucacagagggcuucuuucua

SEQ ID NO: 148267 - RNA, 22 nt, Homo sapiens
uuucaguagagacacgguuuug

SEQ ID NO: 148268 - RNA, 22 nt, Homo sapiens
uuucaucagccagggucagucu

SEQ ID NO: 148269 - RNA, 22 nt, Homo sapiens
uuucauggacgcaaugccuuuu

SEQ ID NO: 148270 - RNA, 22 nt, Homo sapiens
uuuccagguggccaacauuuua

SEQ ID NO: 148271 - RNA, 22 nt, Homo sapiens
uuucccuuugcuuugucagcca

SEQ ID NO: 148272 - RNA, 22 nt, Homo sapiens
uuucgugucuggucugugaugg

SEQ ID NO: 148273 - RNA, 22 nt, Homo sapiens
uuucuacagugaacgauuucua

SEQ ID NO: 148274 - RNA, 17 nt, Homo sapiens
uuucucagcccucuucu

SEQ ID NO: 148275 - RNA, 23 nt, Homo sapiens
uuugagugugauaaacacuguca

SEQ ID NO: 148276 - RNA, 22 nt, Homo sapiens
uuugcacauauuugggcaaaag

SEQ ID NO: 148277 - RNA, 22 nt, Homo sapiens
uuugcacuuuaauauaauguga

SEQ ID NO: 148278 - RNA, 22 nt, Homo sapiens
uuugccaauauuuuauugagga

SEQ ID NO: 148279 - RNA, 22 nt, Homo sapiens
uuugcuuaguaaauguagaaaa

SEQ ID NO: 148280 - RNA, 22 nt, Homo sapiens
uuuggcaauaaacuccccuaac

SEQ ID NO: 148281 - RNA, 22 nt, Homo sapiens
uuuggcagaaaacaagaaucug

SEQ ID NO: 148282 - RNA, 22 nt, Homo sapiens
uuugggcuuuuaaucuagagca

SEQ ID NO: 148283 - RNA, 22 nt, Homo sapiens
uuugucauagcagcaggaaugg

SEQ ID NO: 148284 - RNA, 21 nt, Homo sapiens
uuuguccaccuguguucacca

SEQ ID NO: 148285 - RNA, 22 nt, Homo sapiens
uuugugacacaaacacauauau

SEQ ID NO: 148286 - RNA, 22 nt, Homo sapiens
uuugugcuauguuauauauucu

SEQ ID NO: 148287 - RNA, 22 nt, Homo sapiens
uuuuacacuucgguugugugca

SEQ ID NO: 148288 - RNA, 22 nt, Homo sapiens
uuuucaguggccauaguggaga

SEQ ID NO: 148289 - RNA, 22 nt, Homo sapiens
uuuugguguacaauucuaugga

SEQ ID NO: 148290 - RNA, 19 nt, Homo sapiens
uugcauauguugaaccagc

SEQ ID NO: 148291 - RNA, 22 nt, Homo sapiens
uugcaucagcuccugauguacu

SEQ ID NO: 148292 - RNA, 22 nt, Homo sapiens
uugcauguacguacagagagag

SEQ ID NO: 148293 - RNA, 22 nt, Homo sapiens
uugccauggaguagaauugaag

SEQ ID NO: 148294 - RNA, 22 nt, Homo sapiens
uugccgggugcaguggcucaug

SEQ ID NO: 148295 - RNA, 18 nt, Homo sapiens
uugccuauucacucugau

SEQ ID NO: 148296 - RNA, 22 nt, Homo sapiens
uugcuauguugcccagucugga

SEQ ID NO: 148297 - RNA, 22 nt, Homo sapiens
uuggaaauauguuaagugucau

SEQ ID NO: 148298 - RNA, 22 nt, Homo sapiens
uuggaaauguguuugcauucag

SEQ ID NO: 148299 - RNA, 22 nt, Homo sapiens
uuggaaguguguauguauagcu

SEQ ID NO: 148300 - RNA, 22 nt, Homo sapiens
uuggaaugcacacugagccugc

SEQ ID NO: 148301 - RNA, 22 nt, Homo sapiens
uuggauggucuuuauauaguau

SEQ ID NO: 148302 - RNA, 22 nt, Homo sapiens
uuggcaacauagugagaccccc

SEQ ID NO: 148303 - RNA, 22 nt, Homo sapiens
uuggcacugggaaaaugaccac

SEQ ID NO: 148304 - RNA, 22 nt, Homo sapiens
uuggcagucugaggcacagacu

SEQ ID NO: 148305 - RNA, 22 nt, Homo sapiens
uuggccccucccaaauuucaug

SEQ ID NO: 148306 - RNA, 22 nt, Homo sapiens
uugggagugucucuggacugca

SEQ ID NO: 148307 - RNA, 21 nt, Homo sapiens
uuggggaauggagagguuuuc

SEQ ID NO: 148308 - RNA, 22 nt, Homo sapiens
uugguaguuucugucuuuagau

SEQ ID NO: 148309 - RNA, 22 nt, Homo sapiens
uuggucaggcuaaucucgaacg

SEQ ID NO: 148310 - RNA, 22 nt, Homo sapiens
uugguccccacuccccugccaa

SEQ ID NO: 148311 - RNA, 22 nt, Homo sapiens
uugguccucccaugcucaagag

SEQ ID NO: 148312 - RNA, 20 nt, Homo sapiens
uuggugaccuguuugguauu

SEQ ID NO: 148313 - RNA, 22 nt, Homo sapiens
uuguaaagaucauaugcuguuc

SEQ ID NO: 148314 - RNA, 22 nt, Homo sapiens
uuguaacaugcuuucacuucag

SEQ ID NO: 148315 - RNA, 22 nt, Homo sapiens
uuguaacucugaauacauccua

SEQ ID NO: 148316 - RNA, 22 nt, Homo sapiens
uuguaauguuaccaaauggugu

SEQ ID NO: 148317 - RNA, 22 nt, Homo sapiens
uuguaauguuaggguguccaug

SEQ ID NO: 148318 - RNA, 22 nt, Homo sapiens
uuguacaggaguguaagcuuca

SEQ ID NO: 148319 - RNA, 22 nt, Homo sapiens
uuguauguuuguucuuucagau

SEQ ID NO: 148320 - RNA, 22 nt, Homo sapiens
uugucacauggggcggcugccc

SEQ ID NO: 148321 - RNA, 22 nt, Homo sapiens
uugucaguguucacucaaagcu

SEQ ID NO: 148322 - RNA, 22 nt, Homo sapiens
uugucuagugaauacauuaaug

SEQ ID NO: 148323 - RNA, 22 nt, Homo sapiens
uugugaagaugugaagcaagca

SEQ ID NO: 148324 - RNA, 22 nt, Homo sapiens
uugugaauggugccucaguaaa

SEQ ID NO: 148325 - RNA, 22 nt, Homo sapiens
uugugaauggugcugcaguaaa

SEQ ID NO: 148326 - RNA, 22 nt, Homo sapiens
uugugcuuaauaaaaaguggua

SEQ ID NO: 148327 - RNA, 22 nt, Homo sapiens
uugugcuuaaugaguguaaggu

SEQ ID NO: 148328 - RNA, 22 nt, Homo sapiens
uugugcuugcuguguucuaugc

SEQ ID NO: 148329 - RNA, 22 nt, Homo sapiens
uugugcuuuugagcugagauga

SEQ ID NO: 148330 - RNA, 19 nt, Homo sapiens
uugugggaggacagagggg

SEQ ID NO: 148331 - RNA, 22 nt, Homo sapiens
uuguuugguugaguauggaagu

SEQ ID NO: 148332 - RNA, 22 nt, Homo sapiens
uuuaucuguuuaaaacuguuca

SEQ ID NO: 148333 - RNA, 22 nt, Homo sapiens
uuucaagugcugucuuagcugu

SEQ ID NO: 148334 - RNA, 22 nt, Homo sapiens
uuucacagcaauugccuauugu

SEQ ID NO: 148335 - RNA, 22 nt, Homo sapiens
uuuccaguuuggaggaugcauu

SEQ ID NO: 148336 - RNA, 22 nt, Homo sapiens
uuucccagugguacaguuuaua

SEQ ID NO: 148337 - RNA, 22 nt, Homo sapiens
uuucccuuacuuaaacuuacuc

SEQ ID NO: 148338 - RNA, 22 nt, Homo sapiens
uuucccuuuagcuuagugauuu

SEQ ID NO: 148339 - RNA, 22 nt, Homo sapiens
uuuccuggagaaucuuaacaaa

SEQ ID NO: 148340 - RNA, 22 nt, Homo sapiens
uuucucaguguuucaggguagg

SEQ ID NO: 148341 - RNA, 22 nt, Homo sapiens
uuucugcuugagagaauugcug

SEQ ID NO: 148342 - RNA, 22 nt, Homo sapiens
uuugaagugugaugccuugaug

SEQ ID NO: 148343 - RNA, 22 nt, Homo sapiens
uuugaaguguggcacugaguuu

SEQ ID NO: 148344 - RNA, 20 nt, Homo sapiens
uuugaauguaaagcauguca

SEQ ID NO: 148345 - RNA, 22 nt, Homo sapiens
uuugacuagaguguuuuacaac

SEQ ID NO: 148346 - RNA, 22 nt, Homo sapiens
uuugccaauauuuuacugagga

SEQ ID NO: 148347 - RNA, 22 nt, Homo sapiens
uuugcugagucugacuucaugg

SEQ ID NO: 148348 - RNA, 22 nt, Homo sapiens
uuugcuuaaaucuuaaucagau

SEQ ID NO: 148349 - RNA, 22 nt, Homo sapiens
uuuggcaguuauuuacucagug

SEQ ID NO: 148350 - RNA, 22 nt, Homo sapiens
uuuggcauauuuuaagcugguu

SEQ ID NO: 148351 - RNA, 22 nt, Homo sapiens
uuuggcauuagagagacuugca

SEQ ID NO: 148352 - RNA, 23 nt, Homo sapiens
uuuggcauuccagaaauuuucau

SEQ ID NO: 148353 - RNA, 22 nt, Homo sapiens
uuuggcauuuuacuacucaaau

SEQ ID NO: 148354 - RNA, 22 nt, Homo sapiens
uuugguugcauucacauauuuc

SEQ ID NO: 148355 - RNA, 22 nt, Homo sapiens
uuugguugucacaacuggggga

SEQ ID NO: 148356 - RNA, 18 nt, Homo sapiens
uuuguacuuuuucuaaug

SEQ ID NO: 148357 - RNA, 22 nt, Homo sapiens
uuuguuugaagucgagacaacu

SEQ ID NO: 148358 - RNA, 22 nt, Homo sapiens
uuuuacacuguugguuggaaug

SEQ ID NO: 148359 - RNA, 22 nt, Homo sapiens
uuuuaguggacaaagguauuua

SEQ ID NO: 148360 - RNA, 22 nt, Homo sapiens
uuuuaguugcucagguauucuc

SEQ ID NO: 148361 - RNA, 22 nt, Homo sapiens
uuuucaguuuuccagguagccg

SEQ ID NO: 148362 - RNA, 19 nt, Homo sapiens
uuuugcucuuuauaccuau

SEQ ID NO: 148363 - RNA, 19 nt, Homo sapiens
uuuuggaaaugugaacagc

SEQ ID NO: 148364 - RNA, 22 nt, Homo sapiens
uuuuguacgccuguguccauca

SEQ ID NO: 148365 - RNA, 22 nt, Homo sapiens
aaagugcugggauuaggccagg

SEQ ID NO: 148366 - RNA, 22 nt, Homo sapiens
aaaugcugcuuuggccucuucu

SEQ ID NO: 148367 - RNA, 22 nt, Homo sapiens
aaauggcaccggcucuucccuc

SEQ ID NO: 148368 - RNA, 22 nt, Homo sapiens
aaaugguguuaguagaucuuua

SEQ ID NO: 148369 - RNA, 22 nt, Homo sapiens
aacagaauccucuuuuccuggg

SEQ ID NO: 148370 - RNA, 22 nt, Homo sapiens
aacagucuccaguuguauccau

SEQ ID NO: 148371 - RNA, 22 nt, Homo sapiens
aacuacaucucuuugaggcagg

SEQ ID NO: 148372 - RNA, 22 nt, Homo sapiens
aacuaugucaaauaaaaugagg

SEQ ID NO: 148373 - RNA, 22 nt, Homo sapiens
aacuccauuuuagacccuagau

SEQ ID NO: 148374 - RNA, 21 nt, Homo sapiens
aagaaagcuggacuugccgcu

SEQ ID NO: 148375 - RNA, 22 nt, Homo sapiens
aagcaggugucugugucuguaa

SEQ ID NO: 148376 - RNA, 22 nt, Homo sapiens
aagcuggcuuucauugagugcu

SEQ ID NO: 148377 - RNA, 22 nt, Homo sapiens
aaggagcagagagcccuguuuc

SEQ ID NO: 148378 - RNA, 22 nt, Homo sapiens
aaggaguguggugaucuugggc

SEQ ID NO: 148379 - RNA, 22 nt, Homo sapiens
aaggcaauuuguugugaggauu

SEQ ID NO: 148380 - RNA, 22 nt, Homo sapiens
aaggcagugugcacauaacacu

SEQ ID NO: 148381 - RNA, 22 nt, Homo sapiens
aaggcucuuucaacguaaauua

SEQ ID NO: 148382 - RNA, 22 nt, Homo sapiens
aagggagcugcauaaucuugug

SEQ ID NO: 148383 - RNA, 22 nt, Homo sapiens
aagguuguauuuaauauacugu

SEQ ID NO: 148384 - RNA, 21 nt, Homo sapiens
gucuuacagccagaugccucu

SEQ ID NO: 148385 - RNA, 22 nt, Homo sapiens
gugaaauauuuaacguccaggu

SEQ ID NO: 148386 - RNA, 17 nt, Homo sapiens
gugaaaucaucauuuuu

SEQ ID NO: 148387 - RNA, 22 nt, Homo sapiens
gugaaaugaaucuggaaauauu

SEQ ID NO: 148388 - RNA, 22 nt, Homo sapiens
gugaaugaaugggugaauacau

SEQ ID NO: 148389 - RNA, 22 nt, Homo sapiens
gugaauguuuucuuacauggua

SEQ ID NO: 148390 - RNA, 22 nt, Homo sapiens
gugacauuauuucagcuacaug

SEQ ID NO: 148391 - RNA, 22 nt, Homo sapiens
gugaccagaugggcaggggugu

SEQ ID NO: 148392 - RNA, 22 nt, Homo sapiens
gugacuggacucugaagaaaau

SEQ ID NO: 148393 - RNA, 22 nt, Homo sapiens
gugagcacugaaagaaggcaag

SEQ ID NO: 148394 - RNA, 22 nt, Homo sapiens
gugagcauaacaacagaguuua

SEQ ID NO: 148395 - RNA, 22 nt, Homo sapiens
gugagcuagaccacuuggcucc

SEQ ID NO: 148396 - RNA, 21 nt, Homo sapiens
gugaggucauugggcuuucug

SEQ ID NO: 148397 - RNA, 22 nt, Homo sapiens
gugcaaugaguguggcaaagcc

SEQ ID NO: 148398 - RNA, 22 nt, Homo sapiens
gugcacaaaucuuaaauguaca

SEQ ID NO: 148399 - RNA, 22 nt, Homo sapiens
gugcacaacgugcagguuaguu

SEQ ID NO: 148400 - RNA, 22 nt, Homo sapiens
gugcaguuuacaguuacccagu

SEQ ID NO: 148401 - RNA, 22 nt, Homo sapiens
gugcaguuuuaagugaguuucu

SEQ ID NO: 148402 - RNA, 22 nt, Homo sapiens
gugcaugucugugacgacccug

SEQ ID NO: 148403 - RNA, 22 nt, Homo sapiens
gugcgggaggcgcgccuaggug

SEQ ID NO: 148404 - RNA, 22 nt, Homo sapiens
guggaaagaacacaaaauuagg

SEQ ID NO: 148405 - RNA, 22 nt, Homo sapiens
guggaaucuagagaggcaguag

SEQ ID NO: 148406 - RNA, 22 nt, Homo sapiens
ucacacgugaacucaucacaga

SEQ ID NO: 148407 - RNA, 22 nt, Homo sapiens
ucacacugcaucuguuggaauu

SEQ ID NO: 148408 - RNA, 23 nt, Homo sapiens
ucacacuuaagagaaaugcagcu

SEQ ID NO: 148409 - RNA, 22 nt, Homo sapiens
ucacagacugagccaaauagag

SEQ ID NO: 148410 - RNA, 22 nt, Homo sapiens
ucacaggguguuauuagaauua

SEQ ID NO: 148411 - RNA, 18 nt, Homo sapiens
ucacagguaauuaggauu

SEQ ID NO: 148412 - RNA, 22 nt, Homo sapiens
ucacaguagcaaauguuagaaa

SEQ ID NO: 148413 - RNA, 20 nt, Homo sapiens
ucacauccucucccaacaug

SEQ ID NO: 148414 - RNA, 22 nt, Homo sapiens
ucacaugaagauuuuaguauac

SEQ ID NO: 148415 - RNA, 22 nt, Homo sapiens
ucacauguguaugagcuuugau

SEQ ID NO: 148416 - RNA, 22 nt, Homo sapiens
ucacauuguacaaacagguaag

SEQ ID NO: 148417 - RNA, 22 nt, Homo sapiens
ucaccuggggcacagcugaaga

SEQ ID NO: 148418 - RNA, 21 nt, Homo sapiens
ucaccuguagcugcauguucu

SEQ ID NO: 148419 - RNA, 20 nt, Homo sapiens
ucacugaguaucuacgauua

SEQ ID NO: 148420 - RNA, 22 nt, Homo sapiens
ucacugcacuccagccuuuaug

SEQ ID NO: 148421 - RNA, 18 nt, Homo sapiens
ucacugugugucuugggu

SEQ ID NO: 148422 - RNA, 22 nt, Homo sapiens
ucagaucaguuccacaagaacu

SEQ ID NO: 148423 - RNA, 22 nt, Homo sapiens
ucaguccccucgcugagucuac

SEQ ID NO: 148424 - RNA, 22 nt, Homo sapiens
ucagugcuuggcacagagagcu

SEQ ID NO: 148425 - RNA, 22 nt, Homo sapiens
ucaguggagccucacucugugg

SEQ ID NO: 148426 - RNA, 22 nt, Homo sapiens
ucaguguugauggcugcugacu

SEQ ID NO: 148427 - RNA, 22 nt, Homo sapiens
ucauacuguuaaaugguuuagu

SEQ ID NO: 148428 - RNA, 22 nt, Homo sapiens
ucauacuguugugaaacaaaac

SEQ ID NO: 148429 - RNA, 22 nt, Homo sapiens
ucauauguaugugcaauuuugu

SEQ ID NO: 148430 - RNA, 23 nt, Homo sapiens
ucaucacagcauuuccugguauu

SEQ ID NO: 148431 - RNA, 21 nt, Homo sapiens
ucaucagucaaagacaauggu

SEQ ID NO: 148432 - RNA, 22 nt, Homo sapiens
ucauccauacaguuagcaaagg

SEQ ID NO: 148433 - RNA, 22 nt, Homo sapiens
ucaucuggcgaaugugaagagu

SEQ ID NO: 148434 - RNA, 22 nt, Homo sapiens
ucaugugagcaaguugggcuca

SEQ ID NO: 148435 - RNA, 22 nt, Homo sapiens
ucauguguugcacugaggaccu

SEQ ID NO: 148436 - RNA, 22 nt, Homo sapiens
ucauucacucccuugaaguuag

SEQ ID NO: 148437 - RNA, 22 nt, Homo sapiens
uccaguguuccucagucacccc

SEQ ID NO: 148438 - RNA, 19 nt, Homo sapiens
uccaugagcccacagugau

SEQ ID NO: 148439 - RNA, 22 nt, Homo sapiens
uccauuuguucagcuucaggaa

SEQ ID NO: 148440 - RNA, 19 nt, Homo sapiens
uccccuguggauaccaaga

SEQ ID NO: 148441 - RNA, 22 nt, Homo sapiens
ucccuggagcaagagaagaagg

SEQ ID NO: 148442 - RNA, 22 nt, Homo sapiens
ucccugguguuaguuuguucuu

SEQ ID NO: 148443 - RNA, 22 nt, Homo sapiens
ucccuugagccuggcuucucac

SEQ ID NO: 148444 - RNA, 19 nt, Homo sapiens
ucccuuuguauggacauac

SEQ ID NO: 148445 - RNA, 22 nt, Homo sapiens
ucccuuuguccaacggauccac

SEQ ID NO: 148446 - RNA, 22 nt, Homo sapiens
uccuugaaacaggaagaauuca

SEQ ID NO: 148447 - RNA, 22 nt, Homo sapiens
ucgcauuucccucuguagcuuc

SEQ ID NO: 148448 - RNA, 22 nt, Homo sapiens
ucgcugggaaccagagguaaag

SEQ ID NO: 148449 - RNA, 22 nt, Homo sapiens
ucuaaaguacuacuacuguugg

SEQ ID NO: 148450 - RNA, 22 nt, Homo sapiens
ucuagcacuuacuggcugugug

SEQ ID NO: 148451 - RNA, 22 nt, Homo sapiens
ucucaguguuaucuaucugccu

SEQ ID NO: 148452 - RNA, 22 nt, Homo sapiens
ucucaugaagauagagaauaga

SEQ ID NO: 148453 - RNA, 22 nt, Homo sapiens
ucucaugaagguggagaguagg

SEQ ID NO: 148454 - RNA, 22 nt, Homo sapiens
ucucauggagguagagaguaaa

SEQ ID NO: 148455 - RNA, 23 nt, Homo sapiens
ucucauuccuugaaaauaaugac

SEQ ID NO: 148456 - RNA, 17 nt, Homo sapiens
ucucccaucccuuucuc

SEQ ID NO: 148457 - RNA, 22 nt, Homo sapiens
ucuccggguggcggcgaaggga

SEQ ID NO: 148458 - RNA, 22 nt, Homo sapiens
ucucugagaccacuccaaacuc

SEQ ID NO: 148459 - RNA, 22 nt, Homo sapiens
ucugcauaucaugcagaacuau

SEQ ID NO: 148460 - RNA, 22 nt, Homo sapiens
ucugccaaccacaaaauuuauu

SEQ ID NO: 148461 - RNA, 22 nt, Homo sapiens
ucugccacugucauugugugau

SEQ ID NO: 148462 - RNA, 22 nt, Homo sapiens
ucuggagugugaaguggauaug

SEQ ID NO: 148463 - RNA, 22 nt, Homo sapiens
ucuggcaagagccgagggcagu

SEQ ID NO: 148464 - RNA, 20 nt, Homo sapiens
ucuggccccuccaaaucuca

SEQ ID NO: 148465 - RNA, 22 nt, Homo sapiens
ucugucuuugucaggaccagag

SEQ ID NO: 148466 - RNA, 22 nt, Homo sapiens
ucugugaaugugaccuuauuug

SEQ ID NO: 148467 - RNA, 22 nt, Homo sapiens
ucugugcauggcagaggaauga

SEQ ID NO: 148468 - RNA, 22 nt, Homo sapiens
ucugugcauuuucuuuuagacu

SEQ ID NO: 148469 - RNA, 19 nt, Homo sapiens
ucugugcuugucccccugu

SEQ ID NO: 148470 - RNA, 22 nt, Homo sapiens
ucugugguuguugcauggaaug

SEQ ID NO: 148471 - RNA, 22 nt, Homo sapiens
ucuguuguuguuuuaagagaca

SEQ ID NO: 148472 - RNA, 22 nt, Homo sapiens
ucuuggacuuuugugagaaauc

SEQ ID NO: 148473 - RNA, 23 nt, Homo sapiens
ucuuguacuuugagugagcaugg

SEQ ID NO: 148474 - RNA, 22 nt, Homo sapiens
ucuuuaguaauuucuguaaggc

SEQ ID NO: 148475 - RNA, 22 nt, Homo sapiens
ucuuugguauugugaauagugu

SEQ ID NO: 148476 - RNA, 22 nt, Homo sapiens
ucuuuguguucaggagccacgu

SEQ ID NO: 148477 - RNA, 22 nt, Homo sapiens
ucuuuguuagaacccucuccuu

SEQ ID NO: 148478 - RNA, 22 nt, Homo sapiens
ucuuuuugagucaguuucggua

SEQ ID NO: 148479 - RNA, 22 nt, Homo sapiens
ugaaaagucuaagauuaagguu

SEQ ID NO: 148480 - RNA, 22 nt, Homo sapiens
ugaaaguaauugcaguuuuuac

SEQ ID NO: 148481 - RNA, 21 nt, Homo sapiens
ugaaaugcaugugcacauuaa

SEQ ID NO: 148482 - RNA, 22 nt, Homo sapiens
ugaaaugcuaauucguagcuaa

SEQ ID NO: 148483 - RNA, 21 nt, Homo sapiens
ugaacacuggacugagugucc

SEQ ID NO: 148484 - RNA, 22 nt, Homo sapiens
ugaacagcacguuuauucagaa

SEQ ID NO: 148485 - RNA, 22 nt, Homo sapiens
ugaacucagcauccagggccaa

SEQ ID NO: 148486 - RNA, 22 nt, Homo sapiens
ugaacugagacuagacuuguuc

SEQ ID NO: 148487 - RNA, 22 nt, Homo sapiens
ugaaguaauguuuuauucuauu

SEQ ID NO: 148488 - RNA, 22 nt, Homo sapiens
ugaagugaagacucacagaagg

SEQ ID NO: 148489 - RNA, 22 nt, Homo sapiens
ugaauacuucguucaaagauaa

SEQ ID NO: 148490 - RNA, 22 nt, Homo sapiens
ugaauaggcaguuaaguuuaug

SEQ ID NO: 148491 - RNA, 22 nt, Homo sapiens
ugaauauguuucuaaaagugca

SEQ ID NO: 148492 - RNA, 22 nt, Homo sapiens
ugaaugcaucauguagggcuca

SEQ ID NO: 148493 - RNA, 22 nt, Homo sapiens
ugaauguacuuaacacuggauu

SEQ ID NO: 148494 - RNA, 18 nt, Homo sapiens
ugacaaugcuaguccugg

SEQ ID NO: 148495 - RNA, 22 nt, Homo sapiens
ugacagaggucuuuuaauagcu

SEQ ID NO: 148496 - RNA, 22 nt, Homo sapiens
ugacaggagauuaugugauguu

SEQ ID NO: 148497 - RNA, 22 nt, Homo sapiens
ugacaggauggagaucgguauu

SEQ ID NO: 148498 - RNA, 22 nt, Homo sapiens
ugacaugaagaaaaacagauuu

SEQ ID NO: 148499 - RNA, 22 nt, Homo sapiens
ugacauguugcauuauauuucc

SEQ ID NO: 148500 - RNA, 22 nt, Homo sapiens
ugacggaggacaccugcggaau

SEQ ID NO: 148501 - RNA, 22 nt, Homo sapiens
ugacuauaguaaucacuucaca

SEQ ID NO: 148502 - RNA, 22 nt, Homo sapiens
ugacucaguuucucagguagua

SEQ ID NO: 148503 - RNA, 22 nt, Homo sapiens
ugacugguguuuaaugagucaa

SEQ ID NO: 148504 - RNA, 22 nt, Homo sapiens
ugacuucagacugaaaugauuc

SEQ ID NO: 148505 - RNA, 22 nt, Homo sapiens
ugacuucauuuuuggccaugag

SEQ ID NO: 148506 - RNA, 22 nt, Homo sapiens
ugacuuuagaauuuuauccaga

SEQ ID NO: 148507 - RNA, 22 nt, Homo sapiens
ugagaagacaucagcuuucgga

SEQ ID NO: 148508 - RNA, 22 nt, Homo sapiens
ugagaagaugaacuccuugguc

SEQ ID NO: 148509 - RNA, 22 nt, Homo sapiens
ugagaagugauauagaaguuaa

SEQ ID NO: 148510 - RNA, 22 nt, Homo sapiens
ugagaaugacugggcaugcugc

SEQ ID NO: 148511 - RNA, 17 nt, Homo sapiens
acagugcuuugcuuucc

SEQ ID NO: 148512 - RNA, 22 nt, Homo sapiens
acauaaagaagcaggacauugu

SEQ ID NO: 148513 - RNA, 22 nt, Homo sapiens
acaugcauauguuggaagaaag

SEQ ID NO: 148514 - RNA, 22 nt, Homo sapiens
accaugcaguccaauaugcaca

SEQ ID NO: 148515 - RNA, 22 nt, Homo sapiens
acccagaagucauucaggaaca

SEQ ID NO: 148516 - RNA, 22 nt, Homo sapiens
acccagaauucagucuuaggcc

SEQ ID NO: 148517 - RNA, 22 nt, Homo sapiens
acccuggaguaguaggaaucug

SEQ ID NO: 148518 - RNA, 18 nt, Homo sapiens
acccuucagcacugggcc

SEQ ID NO: 148519 - RNA, 22 nt, Homo sapiens
acccuuugucaaucaguacuaa

SEQ ID NO: 148520 - RNA, 23 nt, Homo sapiens
accuucauucauucagcugaagu

SEQ ID NO: 148521 - RNA, 22 nt, Homo sapiens
acgagguuaggaguuaaaggcu

SEQ ID NO: 148522 - RNA, 22 nt, Homo sapiens
acgugcaugcacacacaugcgc

SEQ ID NO: 148523 - RNA, 22 nt, Homo sapiens
acuaaggcacaauuuucucaua

SEQ ID NO: 148524 - RNA, 22 nt, Homo sapiens
acuagagaugcauuuguaguuu

SEQ ID NO: 148525 - RNA, 22 nt, Homo sapiens
acucagagauuagcacauguuu

SEQ ID NO: 148526 - RNA, 22 nt, Homo sapiens
acugagaucuuuaaauaaauaa

SEQ ID NO: 148527 - RNA, 22 nt, Homo sapiens
acuggaguuuguucaagaaaua

SEQ ID NO: 148528 - RNA, 22 nt, Homo sapiens
agaaacauucucuugccuccuu

SEQ ID NO: 148529 - RNA, 22 nt, Homo sapiens
agaaagugcuucccuuugguga

SEQ ID NO: 148530 - RNA, 22 nt, Homo sapiens
agaauaauguccccccaaggga

SEQ ID NO: 148531 - RNA, 22 nt, Homo sapiens
agaauucugucauguuuauauu

SEQ ID NO: 148532 - RNA, 22 nt, Homo sapiens
agacaagauggcuugagguuca

SEQ ID NO: 148533 - RNA, 20 nt, Homo sapiens
agacagcugcagcccacauc

SEQ ID NO: 148534 - RNA, 22 nt, Homo sapiens
agacagcugguagcacuuccug

SEQ ID NO: 148535 - RNA, 22 nt, Homo sapiens
agacuagaaaucauuuguugag

SEQ ID NO: 148536 - RNA, 22 nt, Homo sapiens
agacuagagcagagcccucucu

SEQ ID NO: 148537 - RNA, 22 nt, Homo sapiens
agacuagagggaaaugaguugg

SEQ ID NO: 148538 - RNA, 22 nt, Homo sapiens
agagaucaauaugaaggaaaug

SEQ ID NO: 148539 - RNA, 22 nt, Homo sapiens
agagauuauccuggcuucucug

SEQ ID NO: 148540 - RNA, 22 nt, Homo sapiens
agagcaaugggugaauauuaaa

SEQ ID NO: 148541 - RNA, 22 nt, Homo sapiens
agagcaccauuuagcaagguga

SEQ ID NO: 148542 - RNA, 22 nt, Homo sapiens
agagccacauuaaauaugggaa

SEQ ID NO: 148543 - RNA, 20 nt, Homo sapiens
agaugcaugcacauaaacac

SEQ ID NO: 148544 - RNA, 22 nt, Homo sapiens
agaugcuguuaucaacuguagc

SEQ ID NO: 148545 - RNA, 22 nt, Homo sapiens
agcaagacauggcuuccaaaug

SEQ ID NO: 148546 - RNA, 22 nt, Homo sapiens
agcacauauauuucccaaaaca

SEQ ID NO: 148547 - RNA, 22 nt, Homo sapiens
agcacgaaaccaaauucuguga

SEQ ID NO: 148548 - RNA, 17 nt, Homo sapiens
agcagcccauaucccca

SEQ ID NO: 148549 - RNA, 22 nt, Homo sapiens
agcaggucuuaacuugugaggu

SEQ ID NO: 148550 - RNA, 22 nt, Homo sapiens
agcagguguggcuuauccugaa

SEQ ID NO: 148551 - RNA, 22 nt, Homo sapiens
agcagugucauuuucuggugag

SEQ ID NO: 148552 - RNA, 22 nt, Homo sapiens
agcaugauugggguugggcaca

SEQ ID NO: 148553 - RNA, 22 nt, Homo sapiens
agccaagacucuguuccccuug

SEQ ID NO: 148554 - RNA, 22 nt, Homo sapiens
agcccagagacuguguaaauuu

SEQ ID NO: 148555 - RNA, 22 nt, Homo sapiens
agcuaguggucauucaauccuu

SEQ ID NO: 148556 - RNA, 22 nt, Homo sapiens
agcuccuuucugcagguagguu

SEQ ID NO: 148557 - RNA, 22 nt, Homo sapiens
agcucuuguuaguauuagcagu

SEQ ID NO: 148558 - RNA, 22 nt, Homo sapiens
agcugcacgugguaaauguaaa

SEQ ID NO: 148559 - RNA, 22 nt, Homo sapiens
agcugcauuuacuuuugcacaa

SEQ ID NO: 148560 - RNA, 22 nt, Homo sapiens
agcuuaugcuuggaagagauga

SEQ ID NO: 148561 - RNA, 21 nt, Homo sapiens
aggcaagacuuuuagguuugu

SEQ ID NO: 148562 - RNA, 22 nt, Homo sapiens
aggcaagagugacuacgugaaa

SEQ ID NO: 148563 - RNA, 22 nt, Homo sapiens
aggcuagaaucuuccaucuugg

SEQ ID NO: 148564 - RNA, 22 nt, Homo sapiens
agggcaagacuuguuaagaaca

SEQ ID NO: 148565 - RNA, 22 nt, Homo sapiens
agggguauuauguaaaucugac

SEQ ID NO: 148566 - RNA, 22 nt, Homo sapiens
agguagcauagcgggaauauca

SEQ ID NO: 148567 - RNA, 22 nt, Homo sapiens
agguauguaugucuguacagcg

SEQ ID NO: 148568 - RNA, 20 nt, Homo sapiens
agguuauuauaauuagaaga

SEQ ID NO: 148569 - RNA, 22 nt, Homo sapiens
agguucccuuuuggccugggau

SEQ ID NO: 148570 - RNA, 22 nt, Homo sapiens
aguacugucugguuaccugaca

SEQ ID NO: 148571 - RNA, 22 nt, Homo sapiens
aguaucaagccacacaugguca

SEQ ID NO: 148572 - RNA, 22 nt, Homo sapiens
aguccauuugaugaugauucca

SEQ ID NO: 148573 - RNA, 17 nt, Homo sapiens
agugagaucauggcuua

SEQ ID NO: 148574 - RNA, 22 nt, Homo sapiens
agugagcuguuuuuacuuucug

SEQ ID NO: 148575 - RNA, 22 nt, Homo sapiens
agugcauugagacuugugaguu

SEQ ID NO: 148576 - RNA, 22 nt, Homo sapiens
agugcauuuguucugugucagg

SEQ ID NO: 148577 - RNA, 22 nt, Homo sapiens
agugcuuaauagauguccagca

SEQ ID NO: 148578 - RNA, 22 nt, Homo sapiens
aguggauguuguggccugggag

SEQ ID NO: 148579 - RNA, 22 nt, Homo sapiens
agugguguugccuguugaccua

SEQ ID NO: 148580 - RNA, 22 nt, Homo sapiens
agugucaggagacagguagcug

SEQ ID NO: 148581 - RNA, 22 nt, Homo sapiens
aguguuuuuaucaugaaagggu

SEQ ID NO: 148582 - RNA, 22 nt, Homo sapiens
auaaaagcaggucuaggucagg

SEQ ID NO: 148583 - RNA, 22 nt, Homo sapiens
auaaacagcuuauccucuauuc

SEQ ID NO: 148584 - RNA, 22 nt, Homo sapiens
auaaaugccuguuguuuuaagc

SEQ ID NO: 148585 - RNA, 20 nt, Homo sapiens
auaaauguauagguguacau

SEQ ID NO: 148586 - RNA, 22 nt, Homo sapiens
auaagaugaaggaagccauauc

SEQ ID NO: 148587 - RNA, 22 nt, Homo sapiens
auaagucaauggaacagauuaa

SEQ ID NO: 148588 - RNA, 22 nt, Homo sapiens
auaauacugggaagaugagcau

SEQ ID NO: 148589 - RNA, 22 nt, Homo sapiens
auaauacuuuuauuuugaggaa

SEQ ID NO: 148590 - RNA, 22 nt, Homo sapiens
auacaagcaguccaacuccaua

SEQ ID NO: 148591 - RNA, 22 nt, Homo sapiens
auacaguguauguauaguacau

SEQ ID NO: 148592 - RNA, 22 nt, Homo sapiens
auacaugugcaggucagguuac

SEQ ID NO: 148593 - RNA, 22 nt, Homo sapiens
auacaugugugagcgaagaugu

SEQ ID NO: 148594 - RNA, 22 nt, Homo sapiens
auacuguauaggauuguagccu

SEQ ID NO: 148595 - RNA, 22 nt, Homo sapiens
auagcacacuauagcuucaaac

SEQ ID NO: 148596 - RNA, 22 nt, Homo sapiens
auagcagcauauguaauguuga

SEQ ID NO: 148597 - RNA, 22 nt, Homo sapiens
auagcagcuugucagggcagac

SEQ ID NO: 148598 - RNA, 22 nt, Homo sapiens
auagcaggagaauggucauggg

SEQ ID NO: 148599 - RNA, 22 nt, Homo sapiens
auaguacuauugcaguguuaua

SEQ ID NO: 148600 - RNA, 22 nt, Homo sapiens
auaguauaguugaggauggcau

SEQ ID NO: 148601 - RNA, 22 nt, Homo sapiens
auagugcugcaauaaacacacg

SEQ ID NO: 148602 - RNA, 22 nt, Homo sapiens
auauagcaaugaaagagaugaa

SEQ ID NO: 148603 - RNA, 22 nt, Homo sapiens
auaucaagugacuggaguucca

SEQ ID NO: 148604 - RNA, 22 nt, Homo sapiens
auaucccaguguguaaacacug

SEQ ID NO: 148605 - RNA, 22 nt, Homo sapiens
auaugcaaauccauagagacag

SEQ ID NO: 148606 - RNA, 20 nt, Homo sapiens
auaugcauguguuuucacuu

SEQ ID NO: 148607 - RNA, 22 nt, Homo sapiens
auauggcuaugugagcauacca

SEQ ID NO: 148608 - RNA, 22 nt, Homo sapiens
auaugugacuucaugcaaggcu

SEQ ID NO: 148609 - RNA, 22 nt, Homo sapiens
auauuagguuggugcaaaagua

SEQ ID NO: 148610 - RNA, 22 nt, Homo sapiens
aucacacuguuauuuuaguuaa

SEQ ID NO: 148611 - RNA, 22 nt, Homo sapiens
aucacagguacuauggcugaca

SEQ ID NO: 148612 - RNA, 20 nt, Homo sapiens
aucaccacagcucguucaug

SEQ ID NO: 148613 - RNA, 22 nt, Homo sapiens
aucaccauguguacauuagacc

SEQ ID NO: 148614 - RNA, 22 nt, Homo sapiens
aucacuggccuuuuuaaaugcu

SEQ ID NO: 148615 - RNA, 22 nt, Homo sapiens
aucacuuugcucuccagugugg

SEQ ID NO: 148616 - RNA, 21 nt, Homo sapiens
aucagagacccaggcuuccuc

SEQ ID NO: 148617 - RNA, 22 nt, Homo sapiens
aucagugaaagugaaaucuccg

SEQ ID NO: 148618 - RNA, 22 nt, Homo sapiens
aucagugagugguuagugaaug

SEQ ID NO: 148619 - RNA, 22 nt, Homo sapiens
aucauccugucaggagcuguga

SEQ ID NO: 148620 - RNA, 22 nt, Homo sapiens
aucccagaaacucggguuucuc

SEQ ID NO: 148621 - RNA, 22 nt, Homo sapiens
aucccuagaaaaaucagcacau

SEQ ID NO: 148622 - RNA, 16 nt, Homo sapiens
aucucagaccugcuga

SEQ ID NO: 148623 - RNA, 22 nt, Homo sapiens
aucucugagauguucugauuuu

SEQ ID NO: 148624 - RNA, 19 nt, Homo sapiens
aucuggaguuccuggggcu

SEQ ID NO: 148625 - RNA, 22 nt, Homo sapiens
aucuuuggauacuugauauagu

SEQ ID NO: 148626 - RNA, 22 nt, Homo sapiens
aucuuuggucaucacagcuaga

SEQ ID NO: 148627 - RNA, 22 nt, Homo sapiens
augaaacuggcuaauuuuugua

SEQ ID NO: 148628 - RNA, 23 nt, Homo sapiens
augaaagcccuugcaaaugcugg

SEQ ID NO: 148629 - RNA, 22 nt, Homo sapiens
augaaagguauguuuucuguga

SEQ ID NO: 148630 - RNA, 22 nt, Homo sapiens
augaaauugcuaucgcaguacu

SEQ ID NO: 148631 - RNA, 19 nt, Homo sapiens
augaacucaucauuucuca

SEQ ID NO: 148632 - RNA, 17 nt, Homo sapiens
augaacucaucauuuuu

SEQ ID NO: 148633 - RNA, 21 nt, Homo sapiens
augaacucaucauuuuuuaug

SEQ ID NO: 148634 - RNA, 22 nt, Homo sapiens
augaacucaucauuuuuuaugg

SEQ ID NO: 148635 - RNA, 22 nt, Homo sapiens
augaaguuagcucauuucuuuu

SEQ ID NO: 148636 - RNA, 21 nt, Homo sapiens
augaauguaaagaauguggga

SEQ ID NO: 148637 - RNA, 23 nt, Homo sapiens
augaauguaaggaguguaagaaa

SEQ ID NO: 148638 - RNA, 22 nt, Homo sapiens
augaauuuucugauguugggua

SEQ ID NO: 148639 - RNA, 22 nt, Homo sapiens
augacaaugaaucccuguuuca

SEQ ID NO: 148640 - RNA, 22 nt, Homo sapiens
augacauugaugcucuggcugg

SEQ ID NO: 148641 - RNA, 18 nt, Homo sapiens
augacucuggguguuccu

SEQ ID NO: 148642 - RNA, 22 nt, Homo sapiens
augagacauuaaaguguguuug

SEQ ID NO: 148643 - RNA, 22 nt, Homo sapiens
augagagcaacaccuucacuug

SEQ ID NO: 148644 - RNA, 18 nt, Homo sapiens
augagagccgauuccugg

SEQ ID NO: 148645 - RNA, 22 nt, Homo sapiens
augagauucuuagagaagucug

SEQ ID NO: 148646 - RNA, 22 nt, Homo sapiens
augagcacuuguuuugggcaca

SEQ ID NO: 148647 - RNA, 22 nt, Homo sapiens
augauaaguuauuagaagaaga

SEQ ID NO: 148648 - RNA, 22 nt, Homo sapiens
augaucaucugaaagcuuuuac

SEQ ID NO: 148649 - RNA, 22 nt, Homo sapiens
augaucuguagaacuaguccuu

SEQ ID NO: 148650 - RNA, 22 nt, Homo sapiens
augcaaggaugguuagauauau

SEQ ID NO: 148651 - RNA, 22 nt, Homo sapiens
augcaauucuagauugauagua

SEQ ID NO: 148652 - RNA, 22 nt, Homo sapiens
augcagguguuuugcacugagu

SEQ ID NO: 148653 - RNA, 19 nt, Homo sapiens
augccacagugaggucaga

SEQ ID NO: 148654 - RNA, 22 nt, Homo sapiens
augccacugcacucuagccugg

SEQ ID NO: 148655 - RNA, 22 nt, Homo sapiens
augccacugcacuucagcuugg

SEQ ID NO: 148656 - RNA, 19 nt, Homo sapiens
augccuggagaugguuaua

SEQ ID NO: 148657 - RNA, 22 nt, Homo sapiens
augcuacauucuacaauuaggc

SEQ ID NO: 148658 - RNA, 22 nt, Homo sapiens
augcuaugugugacuucuuaug

SEQ ID NO: 148659 - RNA, 22 nt, Homo sapiens
augcuggugcuagaaacuggaa

SEQ ID NO: 148660 - RNA, 22 nt, Homo sapiens
auggaggccuacagaauuuugg

SEQ ID NO: 148661 - RNA, 22 nt, Homo sapiens
auggcacuaaguucaacacuua

SEQ ID NO: 148662 - RNA, 22 nt, Homo sapiens
auggcacugccuggcuucaugg

SEQ ID NO: 148663 - RNA, 22 nt, Homo sapiens
auggcagagucagaaagucagg

SEQ ID NO: 148664 - RNA, 22 nt, Homo sapiens
auggcagugucuagggguguuu

SEQ ID NO: 148665 - RNA, 22 nt, Homo sapiens
auggccugaugcaccuguccca

SEQ ID NO: 148666 - RNA, 22 nt, Homo sapiens
augguacucucuugucugcaaa

SEQ ID NO: 148667 - RNA, 22 nt, Homo sapiens
augguguauugauuauugcugu

SEQ ID NO: 148668 - RNA, 21 nt, Homo sapiens
auguaaugaagaagccacugg

SEQ ID NO: 148669 - RNA, 22 nt, Homo sapiens
auguaauugagguuuuugccau

SEQ ID NO: 148670 - RNA, 22 nt, Homo sapiens
cagcagguuuuuaucaguuaag

SEQ ID NO: 148671 - RNA, 22 nt, Homo sapiens
cagcuaaauuguuaaauccaag

SEQ ID NO: 148672 - RNA, 22 nt, Homo sapiens
cagcugaugucgaaugcacucu

SEQ ID NO: 148673 - RNA, 22 nt, Homo sapiens
caggcacgcuugggagacacac

SEQ ID NO: 148674 - RNA, 22 nt, Homo sapiens
cagugucugcauuuggaacuca

SEQ ID NO: 148675 - RNA, 22 nt, Homo sapiens
cauagcacacauuuaccuaugu

SEQ ID NO: 148676 - RNA, 22 nt, Homo sapiens
cauagcacacguauaccuaugu

SEQ ID NO: 148677 - RNA, 23 nt, Homo sapiens
caucacagagccuuccuugacuc

SEQ ID NO: 148678 - RNA, 22 nt, Homo sapiens
caucacuguugguacaaguaau

SEQ ID NO: 148679 - RNA, 22 nt, Homo sapiens
caucauugcacccuauagagaa

SEQ ID NO: 148680 - RNA, 22 nt, Homo sapiens
caugaacacugugcggcuuccu

SEQ ID NO: 148681 - RNA, 19 nt, Homo sapiens
caugccacugcacuugagu

SEQ ID NO: 148682 - RNA, 22 nt, Homo sapiens
cauggcacuggugggagugucu

SEQ ID NO: 148683 - RNA, 22 nt, Homo sapiens
cauggcccuggguccauaggaa

SEQ ID NO: 148684 - RNA, 22 nt, Homo sapiens
cauguaacaucccgcuguagga

SEQ ID NO: 148685 - RNA, 22 nt, Homo sapiens
caugucacuuccucucugaugg

SEQ ID NO: 148686 - RNA, 22 nt, Homo sapiens
caugugcaugagcacauacgug

SEQ ID NO: 148687 - RNA, 22 nt, Homo sapiens
cauugguuuuucaggaguauau

SEQ ID NO: 148688 - RNA, 22 nt, Homo sapiens
cauuguacauaaguauggagua

SEQ ID NO: 148689 - RNA, 22 nt, Homo sapiens
cauuugcacugagacucagcuu

SEQ ID NO: 148690 - RNA, 22 nt, Homo sapiens
ccaggguugcuuuagauucuga

SEQ ID NO: 148691 - RNA, 20 nt, Homo sapiens
ccaguguuauuuauguucua

SEQ ID NO: 148692 - RNA, 22 nt, Homo sapiens
ccaguuuucaagauaaugguuu

SEQ ID NO: 148693 - RNA, 22 nt, Homo sapiens
ccaguuuuucauuuauacuagu

SEQ ID NO: 148694 - RNA, 22 nt, Homo sapiens
ccaucacaggccucagugggaa

SEQ ID NO: 148695 - RNA, 22 nt, Homo sapiens
ccauuucacucuuccugaagga

SEQ ID NO: 148696 - RNA, 22 nt, Homo sapiens
cccaguuuugccacuuacuagc

SEQ ID NO: 148697 - RNA, 22 nt, Homo sapiens
ccccauguucucucugcagcuc

SEQ ID NO: 148698 - RNA, 22 nt, Homo sapiens
cccuuagacuacuaauaugagc

SEQ ID NO: 148699 - RNA, 19 nt, Homo sapiens
ccugcuguucuuuugcacc

SEQ ID NO: 148700 - RNA, 22 nt, Homo sapiens
ccuugguggccacaagacauug

SEQ ID NO: 148701 - RNA, 22 nt, Homo sapiens
cuaaaugucucuacuaaguuua

SEQ ID NO: 148702 - RNA, 22 nt, Homo sapiens
cuacugauuaaaagaacagguc

SEQ ID NO: 148703 - RNA, 22 nt, Homo sapiens
cuagcagacaggcugggagcag

SEQ ID NO: 148704 - RNA, 22 nt, Homo sapiens
cuaggcuguagagaaguucagu

SEQ ID NO: 148705 - RNA, 22 nt, Homo sapiens
cuagguuauacucugaaauggu

SEQ ID NO: 148706 - RNA, 22 nt, Homo sapiens
cuauaacagugugguuuggaga

SEQ ID NO: 148707 - RNA, 22 nt, Homo sapiens
cuauauacugccugcugauuag

SEQ ID NO: 148708 - RNA, 21 nt, Homo sapiens
cuaucucaguguuuacauuug

SEQ ID NO: 148709 - RNA, 22 nt, Homo sapiens
cuaugcuucuuaaauuaguuau

SEQ ID NO: 148710 - RNA, 22 nt, Homo sapiens
cuauucacaggcaauauguaca

SEQ ID NO: 148711 - RNA, 22 nt, Homo sapiens
cucaaaugguccagcuaguggu

SEQ ID NO: 148712 - RNA, 22 nt, Homo sapiens
cucaugcugucuucugggguaa

SEQ ID NO: 148713 - RNA, 22 nt, Homo sapiens
cucauggaauacuucacagcca

SEQ ID NO: 148714 - RNA, 23 nt, Homo sapiens
cuccaugagccguccagggccug

SEQ ID NO: 148715 - RNA, 22 nt, Homo sapiens
cucugguuucgcaggaaauaga

SEQ ID NO: 148716 - RNA, 21 nt, Homo sapiens
cucugguuugcauuggauuau

SEQ ID NO: 148717 - RNA, 22 nt, Homo sapiens
cucuuuuguuccuaguuugauc

SEQ ID NO: 148718 - RNA, 22 nt, Homo sapiens
cucuuuuguuuagcugagaggg

SEQ ID NO: 148719 - RNA, 22 nt, Homo sapiens
cugaaaagcaucugcauagcug

SEQ ID NO: 148720 - RNA, 22 nt, Homo sapiens
cugaaauggaaugugugcacag

SEQ ID NO: 148721 - RNA, 22 nt, Homo sapiens
cugaaauguccaucgacugaug

SEQ ID NO: 148722 - RNA, 22 nt, Homo sapiens
cugacagucucauugauuugcu

SEQ ID NO: 148723 - RNA, 22 nt, Homo sapiens
cugacuaguuuuaaugcagauu

SEQ ID NO: 148724 - RNA, 22 nt, Homo sapiens
cugagcaaagaagugauaauga

SEQ ID NO: 148725 - RNA, 22 nt, Homo sapiens
cugaggugggaggauuacuuga

SEQ ID NO: 148726 - RNA, 22 nt, Homo sapiens
cugaggugggaggauuggcuug

SEQ ID NO: 148727 - RNA, 22 nt, Homo sapiens
cugcaagaaucguaguauuuga

SEQ ID NO: 148728 - RNA, 22 nt, Homo sapiens
cuggaaagaaacccuuaauucu

SEQ ID NO: 148729 - RNA, 22 nt, Homo sapiens
cuggaaagaaucaggcuaaacu

SEQ ID NO: 148730 - RNA, 22 nt, Homo sapiens
ugacagagcaggacuucaucuc

SEQ ID NO: 148731 - RNA, 20 nt, Homo sapiens
ugacaguuaagggauagaag

SEQ ID NO: 148732 - RNA, 22 nt, Homo sapiens
ugacaguuuccagggcugucuc

SEQ ID NO: 148733 - RNA, 22 nt, Homo sapiens
ugacaucugcuugugcccagga

SEQ ID NO: 148734 - RNA, 22 nt, Homo sapiens
ugacaugaugagcaauaauggc

SEQ ID NO: 148735 - RNA, 21 nt, Homo sapiens
ugacauuauuucaugucagua

SEQ ID NO: 148736 - RNA, 22 nt, Homo sapiens
ugacuacaggucaggaagcugu

SEQ ID NO: 148737 - RNA, 21 nt, Homo sapiens
ugacuacuggucucuuggguc

SEQ ID NO: 148738 - RNA, 22 nt, Homo sapiens
ugacuauaucucuguauaaacu

SEQ ID NO: 148739 - RNA, 22 nt, Homo sapiens
ugagaacucaugaaucuuucca

SEQ ID NO: 148740 - RNA, 22 nt, Homo sapiens
ugagaacuuauggugauuuuuu

SEQ ID NO: 148741 - RNA, 22 nt, Homo sapiens
ugagaagcauaccagugucugu

SEQ ID NO: 148742 - RNA, 22 nt, Homo sapiens
ugagacaucugagauuuuaagc

SEQ ID NO: 148743 - RNA, 22 nt, Homo sapiens
ugagacggaguuuugcucuugu

SEQ ID NO: 148744 - RNA, 22 nt, Homo sapiens
ugagacugaguuucgcucuugu

SEQ ID NO: 148745 - RNA, 19 nt, Homo sapiens
ugagagcacaacugaacaa

SEQ ID NO: 148746 - RNA, 22 nt, Homo sapiens
ugagauaacuaaaaacauuuug

SEQ ID NO: 148747 - RNA, 22 nt, Homo sapiens
ugagauaaucaugugauuucau

SEQ ID NO: 148748 - RNA, 22 nt, Homo sapiens
ugagaucaagguuaauauaauc

SEQ ID NO: 148749 - RNA, 22 nt, Homo sapiens
ugagaucacgccacugcacucc

SEQ ID NO: 148750 - RNA, 18 nt, Homo sapiens
ugagaucagcaucaaggg

SEQ ID NO: 148751 - RNA, 22 nt, Homo sapiens
ugagauccugugacuacacuga

SEQ ID NO: 148752 - RNA, 23 nt, Homo sapiens
ugagaucuacagaucucagaucu

SEQ ID NO: 148753 - RNA, 22 nt, Homo sapiens
ugagaucuguaaagucugacau

SEQ ID NO: 148754 - RNA, 22 nt, Homo sapiens
ugagaucuuaucagaaauggug

SEQ ID NO: 148755 - RNA, 22 nt, Homo sapiens
ugagaucuuggaggcuuuguga

SEQ ID NO: 148756 - RNA, 22 nt, Homo sapiens
ugagaucuuuuguggcugagaa

SEQ ID NO: 148757 - RNA, 22 nt, Homo sapiens
ugagaugagggaagccuaggca

SEQ ID NO: 148758 - RNA, 22 nt, Homo sapiens
ugagaugaguucucgcucuguc

SEQ ID NO: 148759 - RNA, 22 nt, Homo sapiens
ugagaugaguugcuggcucuga

SEQ ID NO: 148760 - RNA, 22 nt, Homo sapiens
ugagaugaugggauaagagggc

SEQ ID NO: 148761 - RNA, 22 nt, Homo sapiens
ugagauggagucuugucgccua

SEQ ID NO: 148762 - RNA, 22 nt, Homo sapiens
ugagauggaguuucgcccuugu

SEQ ID NO: 148763 - RNA, 22 nt, Homo sapiens
ugagauggaguuucgcucuugu

SEQ ID NO: 148764 - RNA, 22 nt, Homo sapiens
ugagauggcuuuauugcugaau

SEQ ID NO: 148765 - RNA, 22 nt, Homo sapiens
ugagaugguaaauuuuuguugu

SEQ ID NO: 148766 - RNA, 22 nt, Homo sapiens
ugagauguguccagaucuaguu

SEQ ID NO: 148767 - RNA, 22 nt, Homo sapiens
ugagauguuuguuucagugccu

SEQ ID NO: 148768 - RNA, 22 nt, Homo sapiens
ugagauuaaucuuuaaguaaga

SEQ ID NO: 148769 - RNA, 22 nt, Homo sapiens
ugagauuauauuucuuaacaga

SEQ ID NO: 148770 - RNA, 22 nt, Homo sapiens
ugagauuaucuugaucuugaaa

SEQ ID NO: 148771 - RNA, 22 nt, Homo sapiens
ugagcacagagccugggguggc

SEQ ID NO: 148772 - RNA, 22 nt, Homo sapiens
ugagcagagaucacggcauugu

SEQ ID NO: 148773 - RNA, 22 nt, Homo sapiens
ugagcagugaguguggugcagg

SEQ ID NO: 148774 - RNA, 22 nt, Homo sapiens
ugagccauggcaccuugucuaa

SEQ ID NO: 148775 - RNA, 22 nt, Homo sapiens
ugagccaugguuagcuucucau

SEQ ID NO: 148776 - RNA, 22 nt, Homo sapiens
ugagcucagcuaguugaggugu

SEQ ID NO: 148777 - RNA, 22 nt, Homo sapiens
ugaggcaaggcugaaugaaggc

SEQ ID NO: 148778 - RNA, 22 nt, Homo sapiens
ugaggugaaguaauauucuaag

SEQ ID NO: 148779 - RNA, 22 nt, Homo sapiens
ugagguuggguaauuuaugaag

SEQ ID NO: 148780 - RNA, 22 nt, Homo sapiens
ugagguugucagugucauucuu

SEQ ID NO: 148781 - RNA, 22 nt, Homo sapiens
ugaguuauuaguagaggcuaug

SEQ ID NO: 148782 - RNA, 22 nt, Homo sapiens
ugauaacugaucuggauuugua

SEQ ID NO: 148783 - RNA, 22 nt, Homo sapiens
ugauaagaaauuguucauguag

SEQ ID NO: 148784 - RNA, 22 nt, Homo sapiens
ugauaagugaaagugcucuauc

SEQ ID NO: 148785 - RNA, 22 nt, Homo sapiens
ugauauggcuuggcuaugucac

SEQ ID NO: 148786 - RNA, 20 nt, Homo sapiens
ugaugcaaaucuuuaaaagu

SEQ ID NO: 148787 - RNA, 21 nt, Homo sapiens
ugaugcuuuucuuaaccuugc

SEQ ID NO: 148788 - RNA, 19 nt, Homo sapiens
ugcaaauucuaaaaacuga

SEQ ID NO: 148789 - RNA, 22 nt, Homo sapiens
ugcaagcacacccagggauugu

SEQ ID NO: 148790 - RNA, 22 nt, Homo sapiens
ugcaaucauuuggaggagaaga

SEQ ID NO: 148791 - RNA, 22 nt, Homo sapiens
ugcaccacacuccauccugggc

SEQ ID NO: 148792 - RNA, 22 nt, Homo sapiens
ugcaccaucuugcuucuguggu

SEQ ID NO: 148793 - RNA, 22 nt, Homo sapiens
ugcauacugaaauauuuuagag

SEQ ID NO: 148794 - RNA, 22 nt, Homo sapiens
ugcauauucaaggcaggccauu

SEQ ID NO: 148795 - RNA, 22 nt, Homo sapiens
ugcaucaggcugcuuauuacaa

SEQ ID NO: 148796 - RNA, 22 nt, Homo sapiens
ugcauggaagggagggaaagag

SEQ ID NO: 148797 - RNA, 22 nt, Homo sapiens
ugcauuagucuguucucacacu

SEQ ID NO: 148798 - RNA, 22 nt, Homo sapiens
ugcauuguuccgaauguguccu

SEQ ID NO: 148799 - RNA, 22 nt, Homo sapiens
ugccagaugcuggugugagggg

SEQ ID NO: 148800 - RNA, 22 nt, Homo sapiens
ugccaggaugaggucaauguuu

SEQ ID NO: 148801 - RNA, 22 nt, Homo sapiens
uuauugcuaaaucaugaccaca

SEQ ID NO: 148802 - RNA, 22 nt, Homo sapiens
uuauuugguuauuguaauuggg

SEQ ID NO: 148803 - RNA, 22 nt, Homo sapiens
uucaaaguaaaaauguguucac

SEQ ID NO: 148804 - RNA, 22 nt, Homo sapiens
uucaaauguucuuucaccaccc

SEQ ID NO: 148805 - RNA, 22 nt, Homo sapiens
uucaauuaauauuauacucuca

SEQ ID NO: 148806 - RNA, 22 nt, Homo sapiens
uucacagucacccuucuccaug

SEQ ID NO: 148807 - RNA, 22 nt, Homo sapiens
uucaccggggaccccuggcugu

SEQ ID NO: 148808 - RNA, 22 nt, Homo sapiens
uucaccuggguuggccaucauu

SEQ ID NO: 148809 - RNA, 22 nt, Homo sapiens
uucacuggagcccaggaguugg

SEQ ID NO: 148810 - RNA, 22 nt, Homo sapiens
uucacugggugugguggcucac

SEQ ID NO: 148811 - RNA, 22 nt, Homo sapiens
uucagagagggagggauaccua

SEQ ID NO: 148812 - RNA, 22 nt, Homo sapiens
uucaggcuuuuauuuacugaua

SEQ ID NO: 148813 - RNA, 22 nt, Homo sapiens
uucagugagacgaaaacaacaa

SEQ ID NO: 148814 - RNA, 22 nt, Homo sapiens
uucaguggagaggcugaguggu

SEQ ID NO: 148815 - RNA, 22 nt, Homo sapiens
uucagugucauuaacacaguag

SEQ ID NO: 148816 - RNA, 22 nt, Homo sapiens
uucaucaggaauauugaccugu

SEQ ID NO: 148817 - RNA, 22 nt, Homo sapiens
uucauggaguugagaaggcuaa

SEQ ID NO: 148818 - RNA, 22 nt, Homo sapiens
uuccauagucauagugcugaug

SEQ ID NO: 148819 - RNA, 22 nt, Homo sapiens
uuccauuuguucggugucgcca

SEQ ID NO: 148820 - RNA, 22 nt, Homo sapiens
uucccauuguuggccagcaugu

SEQ ID NO: 148821 - RNA, 22 nt, Homo sapiens
uucccuagaacacauggaggga

SEQ ID NO: 148822 - RNA, 22 nt, Homo sapiens
uucccuuuguuaaauuggaaga

SEQ ID NO: 148823 - RNA, 22 nt, Homo sapiens
uuccuuguagcaaaugcgauga

SEQ ID NO: 148824 - RNA, 22 nt, Homo sapiens
uucuacuccucauggcagguug

SEQ ID NO: 148825 - RNA, 23 nt, Homo sapiens
uucuaucaggcccaggagcccug

SEQ ID NO: 148826 - RNA, 21 nt, Homo sapiens
uucucaggguguguccuaccc

SEQ ID NO: 148827 - RNA, 22 nt, Homo sapiens
uucucagugaaguuuagaacau

SEQ ID NO: 148828 - RNA, 22 nt, Homo sapiens
aaaagagcugagagguauucuu

SEQ ID NO: 148829 - RNA, 22 nt, Homo sapiens
aaagcuacaggaccugcucauu

SEQ ID NO: 148830 - RNA, 21 nt, Homo sapiens
aaaugcacauuacugcuggug

SEQ ID NO: 148831 - RNA, 22 nt, Homo sapiens
aaaugcaccacucuggugcagg

SEQ ID NO: 148832 - RNA, 22 nt, Homo sapiens
aaaugcauugagggaaaaggca

SEQ ID NO: 148833 - RNA, 22 nt, Homo sapiens
aaaugcuuucuuggaccauuug

SEQ ID NO: 148834 - RNA, 22 nt, Homo sapiens
aaaugucauggaguguuucccc

SEQ ID NO: 148835 - RNA, 19 nt, Homo sapiens
aaaugugcacuguuuucca

SEQ ID NO: 148836 - RNA, 22 nt, Homo sapiens
aacacuaucugccuuacaggga

SEQ ID NO: 148837 - RNA, 22 nt, Homo sapiens
aacagacugucacauaaaauug

SEQ ID NO: 148838 - RNA, 22 nt, Homo sapiens
aacaggguggugccugguccau

SEQ ID NO: 148839 - RNA, 22 nt, Homo sapiens
aacaguaucuaacgagugauga

SEQ ID NO: 148840 - RNA, 22 nt, Homo sapiens
aacagugcauuccuguccauau

SEQ ID NO: 148841 - RNA, 22 nt, Homo sapiens
aacagugcuucauucacacauu

SEQ ID NO: 148842 - RNA, 22 nt, Homo sapiens
aacaguguuuuggguuuucugg

SEQ ID NO: 148843 - RNA, 22 nt, Homo sapiens
aaccuacauucuuaacuguugc

SEQ ID NO: 148844 - RNA, 22 nt, Homo sapiens
aacugcauuuucugauugugug

SEQ ID NO: 148845 - RNA, 21 nt, Homo sapiens
aacuggugugagaugguaugu

SEQ ID NO: 148846 - RNA, 22 nt, Homo sapiens
aagagcauuauuuaguaauuuc

SEQ ID NO: 148847 - RNA, 18 nt, Homo sapiens
aagagcucagcacagguu

SEQ ID NO: 148848 - RNA, 23 nt, Homo sapiens
aagagguaugacuaugaagugga

SEQ ID NO: 148849 - RNA, 22 nt, Homo sapiens
aagagguuauagaguguauacu

SEQ ID NO: 148850 - RNA, 22 nt, Homo sapiens
aagaguaguaguggcacucucu

SEQ ID NO: 148851 - RNA, 22 nt, Homo sapiens
aagaugcagucauacuggagga

SEQ ID NO: 148852 - RNA, 22 nt, Homo sapiens
aagaugcagucauacuggagua

SEQ ID NO: 148853 - RNA, 22 nt, Homo sapiens
aagaugguauuucauuaguuuu

SEQ ID NO: 148854 - RNA, 20 nt, Homo sapiens
aagcagacauuuggaugaaa

SEQ ID NO: 148855 - RNA, 22 nt, Homo sapiens
aagcaguguggacuaaugggaa

SEQ ID NO: 148856 - RNA, 20 nt, Homo sapiens
aagcugaguguuuuuuuaau

SEQ ID NO: 148857 - RNA, 22 nt, Homo sapiens
aagcuggagugcaguggugcga

SEQ ID NO: 148858 - RNA, 22 nt, Homo sapiens
aagcuggcauucaugagauuac

SEQ ID NO: 148859 - RNA, 22 nt, Homo sapiens
aagcugugucuugucagcuacc

SEQ ID NO: 148860 - RNA, 22 nt, Homo sapiens
aaggagugugauucuucaguuu

SEQ ID NO: 148861 - RNA, 22 nt, Homo sapiens
aaggugcucucuuauguagaaa

SEQ ID NO: 148862 - RNA, 22 nt, Homo sapiens
aaggugcuguaagcauccaugu

SEQ ID NO: 148863 - RNA, 22 nt, Homo sapiens
aagguggaguugacaauuuuca

SEQ ID NO: 148864 - RNA, 22 nt, Homo sapiens
aaguaagcauccaauaaauguu

SEQ ID NO: 148865 - RNA, 22 nt, Homo sapiens
aaguaauggaguuauuuuauga

SEQ ID NO: 148866 - RNA, 22 nt, Homo sapiens
aaguauuaugaguccuuguuuu

SEQ ID NO: 148867 - RNA, 22 nt, Homo sapiens
aagugacuagacuaugaaaccu

SEQ ID NO: 148868 - RNA, 23 nt, Homo sapiens
aagugagcuccaauugggugaga

SEQ ID NO: 148869 - RNA, 22 nt, Homo sapiens
aagugcaaaucuguggcugaaa

SEQ ID NO: 148870 - RNA, 22 nt, Homo sapiens
aagugcuguaugggagccuagg

SEQ ID NO: 148871 - RNA, 22 nt, Homo sapiens
aagugcuguccuaccuuuggga

SEQ ID NO: 148872 - RNA, 22 nt, Homo sapiens
aagugcuuccuuucagaggguu

SEQ ID NO: 148873 - RNA, 22 nt, Homo sapiens
aagugcuuuguacagggguuga

SEQ ID NO: 148874 - RNA, 22 nt, Homo sapiens
aagugucuuaccgggagggagu

SEQ ID NO: 148875 - RNA, 22 nt, Homo sapiens
aaguugcuuuagguaagucaau

SEQ ID NO: 148876 - RNA, 21 nt, Homo sapiens
aauaaagcaaccuuaugccau

SEQ ID NO: 148877 - RNA, 22 nt, Homo sapiens
aauaagcugagagaauucuaca

SEQ ID NO: 148878 - RNA, 22 nt, Homo sapiens
aauaauggcaccaaagcacaag

SEQ ID NO: 148879 - RNA, 21 nt, Homo sapiens
aauacucuagguuaagagagc

SEQ ID NO: 148880 - RNA, 22 nt, Homo sapiens
aauauguccaguguuuugggag

SEQ ID NO: 148881 - RNA, 21 nt, Homo sapiens
aaucacaguuguucugccuuc

SEQ ID NO: 148882 - RNA, 22 nt, Homo sapiens
aaucacuuugcuacaaggcagu

SEQ ID NO: 148883 - RNA, 22 nt, Homo sapiens
aaucagagcccucugagcuuca

SEQ ID NO: 148884 - RNA, 22 nt, Homo sapiens
aauccugucuugccauccaaua

SEQ ID NO: 148885 - RNA, 22 nt, Homo sapiens
aaucuguagaaggugcacauuc

SEQ ID NO: 148886 - RNA, 22 nt, Homo sapiens
aaucugucuagacaaggagucu

SEQ ID NO: 148887 - RNA, 22 nt, Homo sapiens
aaugccaucagagaaaacucuu

SEQ ID NO: 148888 - RNA, 22 nt, Homo sapiens
aauggagcuguuuggaugacuu

SEQ ID NO: 148889 - RNA, 22 nt, Homo sapiens
aauggcagaugaaauugucauu

SEQ ID NO: 148890 - RNA, 22 nt, Homo sapiens
aaugggacugacgccucccaga

SEQ ID NO: 148891 - RNA, 22 nt, Homo sapiens
aaugugcuguucagaggagucc

SEQ ID NO: 148892 - RNA, 22 nt, Homo sapiens
aaugugcuuucuuucacacagu

SEQ ID NO: 148893 - RNA, 22 nt, Homo sapiens
aauugccucaagugaucauggc

SEQ ID NO: 148894 - RNA, 22 nt, Homo sapiens
aauuguacucccauaauucccu

SEQ ID NO: 148895 - RNA, 21 nt, Homo sapiens
acaaagcuggagggagacugc

SEQ ID NO: 148896 - RNA, 17 nt, Homo sapiens
acaaauugccagcuagg

SEQ ID NO: 148897 - RNA, 22 nt, Homo sapiens
acaagcacaaaugcauagaugg

SEQ ID NO: 148898 - RNA, 22 nt, Homo sapiens
acacaguaagcacaguguagau

SEQ ID NO: 148899 - RNA, 22 nt, Homo sapiens
acacauacacauaugguguaua

SEQ ID NO: 148900 - RNA, 22 nt, Homo sapiens
acacuggaguuaaaggugauuu

SEQ ID NO: 148901 - RNA, 22 nt, Homo sapiens
acagguacaagggauuaggaug

SEQ ID NO: 148902 - RNA, 22 nt, Homo sapiens
acaguacuguuguuugcugcca

SEQ ID NO: 148903 - RNA, 22 nt, Homo sapiens
acagugcuguggucaugggucu

SEQ ID NO: 148904 - RNA, 22 nt, Homo sapiens
acagugcuguuguguuuucacg

SEQ ID NO: 148905 - RNA, 22 nt, Homo sapiens
acagugucugacacguaggaag

SEQ ID NO: 148906 - RNA, 22 nt, Homo sapiens
acaguguuacuugauaguguau

SEQ ID NO: 148907 - RNA, 22 nt, Homo sapiens
acaucauugggggcuacaggug

SEQ ID NO: 148908 - RNA, 22 nt, Homo sapiens
acaucccaugccuggguacucc

SEQ ID NO: 148909 - RNA, 22 nt, Homo sapiens
acaugacauugggguggggaua

SEQ ID NO: 148910 - RNA, 22 nt, Homo sapiens
acauguaauugauuuuguguua

SEQ ID NO: 148911 - RNA, 18 nt, Homo sapiens
acauucagcuugaagaua

SEQ ID NO: 148912 - RNA, 22 nt, Homo sapiens
accauugcacuccagcccgggc

SEQ ID NO: 148913 - RNA, 22 nt, Homo sapiens
acccgcccagguguggccggga

SEQ ID NO: 148914 - RNA, 22 nt, Homo sapiens
acccuggaggucuacagugcag

SEQ ID NO: 148915 - RNA, 22 nt, Homo sapiens
acccuggauucguggccuugaa

SEQ ID NO: 148916 - RNA, 22 nt, Homo sapiens
accgggcugagcgcaggccccg

SEQ ID NO: 148917 - RNA, 22 nt, Homo sapiens
acucagagaacauucccagucu

SEQ ID NO: 148918 - RNA, 22 nt, Homo sapiens
acugacaugaucaggcauguuc

SEQ ID NO: 148919 - RNA, 22 nt, Homo sapiens
acugggauauuauugguaauau

SEQ ID NO: 148920 - RNA, 22 nt, Homo sapiens
augcaagcacacaagaggaaau

SEQ ID NO: 148921 - RNA, 22 nt, Homo sapiens
augcagcugaggguaguggagc

SEQ ID NO: 148922 - RNA, 20 nt, Homo sapiens
augccacugagcagugguga

SEQ ID NO: 148923 - RNA, 22 nt, Homo sapiens
augccacugcacuucagccugg

SEQ ID NO: 148924 - RNA, 22 nt, Homo sapiens
augccacugcgcucuagccugg

SEQ ID NO: 148925 - RNA, 22 nt, Homo sapiens
auggaagaaacgauuuucugga

SEQ ID NO: 148926 - RNA, 22 nt, Homo sapiens
auggaagaaaguuggguucuug

SEQ ID NO: 148927 - RNA, 22 nt, Homo sapiens
auggagagaauuauucucucag

SEQ ID NO: 148928 - RNA, 22 nt, Homo sapiens
auggagaugaacuuggguaaag

SEQ ID NO: 148929 - RNA, 22 nt, Homo sapiens
auggauagucucacucacauac

SEQ ID NO: 148930 - RNA, 22 nt, Homo sapiens
auggcacagacucuuggucaag

SEQ ID NO: 148931 - RNA, 22 nt, Homo sapiens
auggcacuacugggaaugucuu

SEQ ID NO: 148932 - RNA, 22 nt, Homo sapiens
auggcacucaaucaaguugaga

SEQ ID NO: 148933 - RNA, 22 nt, Homo sapiens
auggcacugaagcguauugaca

SEQ ID NO: 148934 - RNA, 22 nt, Homo sapiens
auggcacuguguauuuuucugu

SEQ ID NO: 148935 - RNA, 20 nt, Homo sapiens
auggcccugcugggaguguc

SEQ ID NO: 148936 - RNA, 22 nt, Homo sapiens
auggcuuuuuaaaucauguugu

SEQ ID NO: 148937 - RNA, 22 nt, Homo sapiens
auguaaacuacagauuuugggu

SEQ ID NO: 148938 - RNA, 22 nt, Homo sapiens
auguaacaguauuuggagaugu

SEQ ID NO: 148939 - RNA, 22 nt, Homo sapiens
auguaauguuaaauugcuaauu

SEQ ID NO: 148940 - RNA, 22 nt, Homo sapiens
augucaaggugggugauaguuu

SEQ ID NO: 148941 - RNA, 22 nt, Homo sapiens
augugcacaacgugcagguuug

SEQ ID NO: 148942 - RNA, 21 nt, Homo sapiens
augugcacuaugucauuuaau

SEQ ID NO: 148943 - RNA, 22 nt, Homo sapiens
augugcaugcuguucugccaga

SEQ ID NO: 148944 - RNA, 22 nt, Homo sapiens
augugcuugagggaaaucaguu

SEQ ID NO: 148945 - RNA, 23 nt, Homo sapiens
augugugcuuggagagcaggaug

SEQ ID NO: 148946 - RNA, 18 nt, Homo sapiens
auguuauguuuguagaag

SEQ ID NO: 148947 - RNA, 20 nt, Homo sapiens
auguucuggaggacagaagc

SEQ ID NO: 148948 - RNA, 22 nt, Homo sapiens
auguuugguagugaauauggua

SEQ ID NO: 148949 - RNA, 22 nt, Homo sapiens
auuagugaaugugaugucuuga

SEQ ID NO: 148950 - RNA, 22 nt, Homo sapiens
auuauugacucauagaaaggau

SEQ ID NO: 148951 - RNA, 22 nt, Homo sapiens
auucaacuaauuauugaagaug

SEQ ID NO: 148952 - RNA, 22 nt, Homo sapiens
auucaagugaugugauucuucu

SEQ ID NO: 148953 - RNA, 22 nt, Homo sapiens
auucacagggggagaaggguau

SEQ ID NO: 148954 - RNA, 22 nt, Homo sapiens
auuccauaguacagugaugagu

SEQ ID NO: 148955 - RNA, 22 nt, Homo sapiens
auugcacaaagagggaaacuga

SEQ ID NO: 148956 - RNA, 18 nt, Homo sapiens
auugcacaccagccuggg

SEQ ID NO: 148957 - RNA, 22 nt, Homo sapiens
auugcacaccagucugggcaaa

SEQ ID NO: 148958 - RNA, 22 nt, Homo sapiens
auugcacuccagccuugugaca

SEQ ID NO: 148959 - RNA, 22 nt, Homo sapiens
auugcaguuucaacuccagggc

SEQ ID NO: 148960 - RNA, 22 nt, Homo sapiens
auugcucaaaucaguacuugag

SEQ ID NO: 148961 - RNA, 22 nt, Homo sapiens
auuggacagcauuucuagacuu

SEQ ID NO: 148962 - RNA, 22 nt, Homo sapiens
auuggauagucuuuaucuguug

SEQ ID NO: 148963 - RNA, 22 nt, Homo sapiens
auuguaccccaauguacaauau

SEQ ID NO: 148964 - RNA, 22 nt, Homo sapiens
auuuuuggauauagggaaggau

SEQ ID NO: 148965 - RNA, 22 nt, Homo sapiens
auuuuugguugguaggcuauua

SEQ ID NO: 148966 - RNA, 22 nt, Homo sapiens
auuuuugguugucagcacuagg

SEQ ID NO: 148967 - RNA, 22 nt, Homo sapiens
caaaggugcuuuccagguccaa

SEQ ID NO: 148968 - RNA, 22 nt, Homo sapiens
caaauccucaccucaucaugaa

SEQ ID NO: 148969 - RNA, 22 nt, Homo sapiens
caagacuguccaacauauuggg

SEQ ID NO: 148970 - RNA, 22 nt, Homo sapiens
caagaggcuguguauaaagcca

SEQ ID NO: 148971 - RNA, 22 nt, Homo sapiens
caaggcacagccccuacuuccu

SEQ ID NO: 148972 - RNA, 22 nt, Homo sapiens
caaggugcugagacaggagccc

SEQ ID NO: 148973 - RNA, 22 nt, Homo sapiens
caagugcuacagagaaaucuuu

SEQ ID NO: 148974 - RNA, 22 nt, Homo sapiens
cacaaugucugguaggccacuu

SEQ ID NO: 148975 - RNA, 22 nt, Homo sapiens
cacagcacaggcaugaguguca

SEQ ID NO: 148976 - RNA, 22 nt, Homo sapiens
cacagugaacaauauccucugu

SEQ ID NO: 148977 - RNA, 22 nt, Homo sapiens
cacaguguuacugguaugaagu

SEQ ID NO: 148978 - RNA, 22 nt, Homo sapiens
cacaguguuccagcuauuugaa

SEQ ID NO: 148979 - RNA, 22 nt, Homo sapiens
cacauguucaggagcacuuaga

SEQ ID NO: 148980 - RNA, 22 nt, Homo sapiens
caccacauuccauugaucaggc

SEQ ID NO: 148981 - RNA, 22 nt, Homo sapiens
cagaaguauugguaugcucugu

SEQ ID NO: 148982 - RNA, 22 nt, Homo sapiens
cagcacauagcaguugcucagu

SEQ ID NO: 148983 - RNA, 22 nt, Homo sapiens
cagcacauuacaaguacuuggu

SEQ ID NO: 148984 - RNA, 22 nt, Homo sapiens
cagcgaggucugcgucacauug

SEQ ID NO: 148985 - RNA, 22 nt, Homo sapiens
cagcuaguaauuuauugaagau

SEQ ID NO: 148986 - RNA, 22 nt, Homo sapiens
cagcugcuuuggaaaauauuuu

SEQ ID NO: 148987 - RNA, 22 nt, Homo sapiens
cagcuugugguauugcugguug

SEQ ID NO: 148988 - RNA, 22 nt, Homo sapiens
caggaccucuugccuggaagcc

SEQ ID NO: 148989 - RNA, 22 nt, Homo sapiens
caggcauuguauuguaaucccc

SEQ ID NO: 148990 - RNA, 22 nt, Homo sapiens
caguagcaugccucagaaugag

SEQ ID NO: 148991 - RNA, 22 nt, Homo sapiens
cagugguuuuuagcuugcuggg

SEQ ID NO: 148992 - RNA, 22 nt, Homo sapiens
caguguuuuuaacaggugcccg

SEQ ID NO: 148993 - RNA, 22 nt, Homo sapiens
cauaaagauggaggaggccagg

SEQ ID NO: 148994 - RNA, 21 nt, Homo sapiens
caucacauuacucaaaguccu

SEQ ID NO: 148995 - RNA, 22 nt, Homo sapiens
caucagagugagauauaagauc

SEQ ID NO: 148996 - RNA, 22 nt, Homo sapiens
caucagauugagaucaucuaag

SEQ ID NO: 148997 - RNA, 22 nt, Homo sapiens
caucagcaauguaugaggguuc

SEQ ID NO: 148998 - RNA, 22 nt, Homo sapiens
caugacacuggcauguuucuuu

SEQ ID NO: 148999 - RNA, 22 nt, Homo sapiens
caugcauuggucuauuauguga

SEQ ID NO: 149000 - RNA, 22 nt, Homo sapiens
cauggcacauauauaucuaggu

SEQ ID NO: 149001 - RNA, 22 nt, Homo sapiens
cauggcacaucuuuucugacua

SEQ ID NO: 149002 - RNA, 22 nt, Homo sapiens
cauggcauuugcagaguugaaa

SEQ ID NO: 149003 - RNA, 22 nt, Homo sapiens
cauugcuaaaagucauauauaa

SEQ ID NO: 149004 - RNA, 22 nt, Homo sapiens
cauugguuccaguuuguccuua

SEQ ID NO: 149005 - RNA, 22 nt, Homo sapiens
ccaagccucaguuucccucugu

SEQ ID NO: 149006 - RNA, 22 nt, Homo sapiens
ccacccuuccauucuuccucuu

SEQ ID NO: 149007 - RNA, 22 nt, Homo sapiens
ccaccgggucccagcucugcuc

SEQ ID NO: 149008 - RNA, 20 nt, Homo sapiens
ccagcaucauuagauucugg

SEQ ID NO: 149009 - RNA, 22 nt, Homo sapiens
ccagguuucuagaauaauuccu

SEQ ID NO: 149010 - RNA, 21 nt, Homo sapiens
ccagugguuggaaacuauggg

SEQ ID NO: 149011 - RNA, 17 nt, Homo sapiens
ccaguuuucccucagug

SEQ ID NO: 149012 - RNA, 22 nt, Homo sapiens
ccaucacacugugauuauuauc

SEQ ID NO: 149013 - RNA, 22 nt, Homo sapiens
ccauggcaauggucagucuauu

SEQ ID NO: 149014 - RNA, 22 nt, Homo sapiens
ccccagguuucaauaaagccca

SEQ ID NO: 149015 - RNA, 20 nt, Homo sapiens
ccccaguuuuucuauuagcu

SEQ ID NO: 149016 - RNA, 22 nt, Homo sapiens
cccgugucuuggucuagggccu

SEQ ID NO: 149017 - RNA, 22 nt, Homo sapiens
ccuggcacugagcaguguucua

SEQ ID NO: 149018 - RNA, 22 nt, Homo sapiens
cuaagguacuguuaacauugua

SEQ ID NO: 149019 - RNA, 18 nt, Homo sapiens
cuaauacuauucaacaag

SEQ ID NO: 149020 - RNA, 22 nt, Homo sapiens
cuacacaugcaggcucccugcc

SEQ ID NO: 149021 - RNA, 22 nt, Homo sapiens
cuagaauguauaaaaccaagcu

SEQ ID NO: 149022 - RNA, 22 nt, Homo sapiens
cuauaugucuguuuugguacca

SEQ ID NO: 149023 - RNA, 22 nt, Homo sapiens
gagauaauuugaaucauggggg

SEQ ID NO: 149024 - RNA, 22 nt, Homo sapiens
gagauauuuagaaauguguucu

SEQ ID NO: 149025 - RNA, 22 nt, Homo sapiens
gagaugaagugucaauaaggau

SEQ ID NO: 149026 - RNA, 22 nt, Homo sapiens
gagaugugguucaaggguguuu

SEQ ID NO: 149027 - RNA, 22 nt, Homo sapiens
gagcucauuguugcuaaagaga

SEQ ID NO: 149028 - RNA, 22 nt, Homo sapiens
gagcugaucuuuauguaaauuc

SEQ ID NO: 149029 - RNA, 22 nt, Homo sapiens
gaggaaguuuacaaagcaucug

SEQ ID NO: 149030 - RNA, 22 nt, Homo sapiens
gaggcaaguggccaccgagucu

SEQ ID NO: 149031 - RNA, 22 nt, Homo sapiens
gaggcagucuguccauucucag

SEQ ID NO: 149032 - RNA, 17 nt, Homo sapiens
gagguaguuuacuuuca

SEQ ID NO: 149033 - RNA, 22 nt, Homo sapiens
gaguaaauguccuagcuucuug

SEQ ID NO: 149034 - RNA, 23 nt, Homo sapiens
gagugcaaugacaugaucucgga

SEQ ID NO: 149035 - RNA, 22 nt, Homo sapiens
gagugcugagcccacuuccuug

SEQ ID NO: 149036 - RNA, 22 nt, Homo sapiens
gagugcuguuagcccuggguuu

SEQ ID NO: 149037 - RNA, 22 nt, Homo sapiens
gagugguaguuucuagaggugu

SEQ ID NO: 149038 - RNA, 22 nt, Homo sapiens
gaguuguuuuaaggcacugacu

SEQ ID NO: 149039 - RNA, 22 nt, Homo sapiens
gauauugacuuauucuauguuu

SEQ ID NO: 149040 - RNA, 22 nt, Homo sapiens
gaucagagugaaccuuguuaug

SEQ ID NO: 149041 - RNA, 22 nt, Homo sapiens
gaugaggcuagagacaugugua

SEQ ID NO: 149042 - RNA, 22 nt, Homo sapiens
gaugauauuugagucauuagaa

SEQ ID NO: 149043 - RNA, 22 nt, Homo sapiens
gauggcucugcaggugagggua

SEQ ID NO: 149044 - RNA, 22 nt, Homo sapiens
gauuccauuuguggcuauuuac

SEQ ID NO: 149045 - RNA, 22 nt, Homo sapiens
gauuuuuggggaagccucuuau

SEQ ID NO: 149046 - RNA, 22 nt, Homo sapiens
gcaaggaugagugcccaugaga

SEQ ID NO: 149047 - RNA, 22 nt, Homo sapiens
gcaauacugacagcauuaguuu

SEQ ID NO: 149048 - RNA, 22 nt, Homo sapiens
gcagcacaugacuguauguaua

SEQ ID NO: 149049 - RNA, 22 nt, Homo sapiens
gcagcagugcccuggauggaaa

SEQ ID NO: 149050 - RNA, 23 nt, Homo sapiens
gcagucauuuggaaaagguugaa

SEQ ID NO: 149051 - RNA, 20 nt, Homo sapiens
gcaguguucacuguauuccu

SEQ ID NO: 149052 - RNA, 22 nt, Homo sapiens
gcaugcacuguauuuaaguauc

SEQ ID NO: 149053 - RNA, 22 nt, Homo sapiens
gcauggagcauacauuucuguu

SEQ ID NO: 149054 - RNA, 22 nt, Homo sapiens
gcaugguaguaaccuacauuug

SEQ ID NO: 149055 - RNA, 20 nt, Homo sapiens
gccacaguuaagcuucugcc

SEQ ID NO: 149056 - RNA, 22 nt, Homo sapiens
gcccacuguuaaauuuguuuua

SEQ ID NO: 149057 - RNA, 22 nt, Homo sapiens
gcccuguugcccugaauacaua

SEQ ID NO: 149058 - RNA, 17 nt, Homo sapiens
gcccuuugugccucuuc

SEQ ID NO: 149059 - RNA, 22 nt, Homo sapiens
gcccuuugugucuggcuggggu

SEQ ID NO: 149060 - RNA, 23 nt, Homo sapiens
gcuaggagagaugaaacacaggu

SEQ ID NO: 149061 - RNA, 22 nt, Homo sapiens
gcucugguuacaaaggcaaauu

SEQ ID NO: 149062 - RNA, 22 nt, Homo sapiens
gcugagcuaugccauauaugcc

SEQ ID NO: 149063 - RNA, 22 nt, Homo sapiens
gcugcuguggcagauuggauuc

SEQ ID NO: 149064 - RNA, 22 nt, Homo sapiens
gcugcuguuauucaucagaacu

SEQ ID NO: 149065 - RNA, 22 nt, Homo sapiens
gcuguauugacuuuguaucaua

SEQ ID NO: 149066 - RNA, 22 nt, Homo sapiens
gcuguguugugcccagcaucau

SEQ ID NO: 149067 - RNA, 21 nt, Homo sapiens
gcuuuuucggaagucuuuggc

SEQ ID NO: 149068 - RNA, 18 nt, Homo sapiens
ggaaaacuuuucuaagua

SEQ ID NO: 149069 - RNA, 22 nt, Homo sapiens
ggaaagcuagguguggguguac

SEQ ID NO: 149070 - RNA, 21 nt, Homo sapiens
ggaaaguuaaggaaauacccc

SEQ ID NO: 149071 - RNA, 22 nt, Homo sapiens
ggaagccugcacucgggcaggg

SEQ ID NO: 149072 - RNA, 22 nt, Homo sapiens
ggaaguuaauacagauagagua

SEQ ID NO: 149073 - RNA, 17 nt, Homo sapiens
ggaaugaauuccagccc

SEQ ID NO: 149074 - RNA, 22 nt, Homo sapiens
ggaaugcagugagcauuagaua

SEQ ID NO: 149075 - RNA, 22 nt, Homo sapiens
ggacaaaguauuuucaaaugua

SEQ ID NO: 149076 - RNA, 22 nt, Homo sapiens
ggacacaucaugugaccaaggu

SEQ ID NO: 149077 - RNA, 22 nt, Homo sapiens
ggacauuaacugcaagauagau

SEQ ID NO: 149078 - RNA, 22 nt, Homo sapiens
ggagagcuaggcagagguuugu

SEQ ID NO: 149079 - RNA, 22 nt, Homo sapiens
ggagguaauaaguuccagugua

SEQ ID NO: 149080 - RNA, 22 nt, Homo sapiens
ggagguagguuugugauuugua

SEQ ID NO: 149081 - RNA, 16 nt, Homo sapiens
ggaggucaucugggaa

SEQ ID NO: 149082 - RNA, 22 nt, Homo sapiens
ggagucugauuuuuauguugcu

SEQ ID NO: 149083 - RNA, 22 nt, Homo sapiens
ggaucacuugagaccaggaguu

SEQ ID NO: 149084 - RNA, 23 nt, Homo sapiens
ggauggaaaguuuugagggccac

SEQ ID NO: 149085 - RNA, 22 nt, Homo sapiens
ggcaagaaccucaauuaccuuu

SEQ ID NO: 149086 - RNA, 22 nt, Homo sapiens
ggcaagaagagaguuuaaacau

SEQ ID NO: 149087 - RNA, 22 nt, Homo sapiens
ggcaaggaggggcacuuucacu

SEQ ID NO: 149088 - RNA, 22 nt, Homo sapiens
ggcaaggugcuacagacaguga

SEQ ID NO: 149089 - RNA, 22 nt, Homo sapiens
ggcagcacaauuuucugaugga

SEQ ID NO: 149090 - RNA, 22 nt, Homo sapiens
gggaugaagcccuaggguuggu

SEQ ID NO: 149091 - RNA, 22 nt, Homo sapiens
ggggucauuaaauuccgcuggu

SEQ ID NO: 149092 - RNA, 22 nt, Homo sapiens
gguauguaggucuacgguacaa

SEQ ID NO: 149093 - RNA, 19 nt, Homo sapiens
ggucagcaaagucuagcug

SEQ ID NO: 149094 - RNA, 22 nt, Homo sapiens
ggucaggagaaugguaacugag

SEQ ID NO: 149095 - RNA, 22 nt, Homo sapiens
ggugacugguuuaucuggcagu

SEQ ID NO: 149096 - RNA, 22 nt, Homo sapiens
ggugaucauugucucuaguaug

SEQ ID NO: 149097 - RNA, 22 nt, Homo sapiens
guaagucucaugagaucugaug

SEQ ID NO: 149098 - RNA, 23 nt, Homo sapiens
guaauacuagucauaguagcagg

SEQ ID NO: 149099 - RNA, 22 nt, Homo sapiens
guacagugcucacaaugagagc

SEQ ID NO: 149100 - RNA, 22 nt, Homo sapiens
guacaugcauacaugcacaucu

SEQ ID NO: 149101 - RNA, 22 nt, Homo sapiens
guagaaagcauuucagauuugc

SEQ ID NO: 149102 - RNA, 22 nt, Homo sapiens
guagcaucauuugcaauuucau

SEQ ID NO: 149103 - RNA, 19 nt, Homo sapiens
guauuugguaaacucucca

SEQ ID NO: 149104 - RNA, 22 nt, Homo sapiens
guauuuggugaugccuccaaac

SEQ ID NO: 149105 - RNA, 22 nt, Homo sapiens
gucaaaugcacagaaccauuaa

SEQ ID NO: 149106 - RNA, 22 nt, Homo sapiens
gucaagugaagaccugacucuu

SEQ ID NO: 149107 - RNA, 22 nt, Homo sapiens
gucaagugaagcagugggagua

SEQ ID NO: 149108 - RNA, 22 nt, Homo sapiens
gucaauguaucuagcuguauua

SEQ ID NO: 149109 - RNA, 22 nt, Homo sapiens
gucacagcacuuuuaguaagug

SEQ ID NO: 149110 - RNA, 22 nt, Homo sapiens
gucacauugaugcccauggugg

SEQ ID NO: 149111 - RNA, 22 nt, Homo sapiens
gucauauaggguuuaccuguau

SEQ ID NO: 149112 - RNA, 22 nt, Homo sapiens
gucauugagucagggaguaucu

SEQ ID NO: 149113 - RNA, 20 nt, Homo sapiens
guccauuugcugccauugcu

SEQ ID NO: 149114 - RNA, 18 nt, Homo sapiens
guccauuuguugguacac

SEQ ID NO: 149115 - RNA, 22 nt, Homo sapiens
guccuggagaagcguggaccgg

SEQ ID NO: 149116 - RNA, 22 nt, Homo sapiens
gucugucuuuugucuuugaaau

SEQ ID NO: 149117 - RNA, 22 nt, Homo sapiens
gucugugcauuaauacgugcug

SEQ ID NO: 149118 - RNA, 20 nt, Homo sapiens
gucuugcuccguugcccagg

SEQ ID NO: 149119 - RNA, 22 nt, Homo sapiens
gucuuugaugucuaugugcuuc

SEQ ID NO: 149120 - RNA, 17 nt, Homo sapiens
gucuuugguugaguuua

SEQ ID NO: 149121 - RNA, 22 nt, Homo sapiens
gugaaacuggguggugagagac

SEQ ID NO: 149122 - RNA, 22 nt, Homo sapiens
gugaacaagcaaaggcaggagg

SEQ ID NO: 149123 - RNA, 22 nt, Homo sapiens
gugaacaauguuuuauccuggg

SEQ ID NO: 149124 - RNA, 22 nt, Homo sapiens
gugaacuguuugaggaagagaa

SEQ ID NO: 149125 - RNA, 22 nt, Homo sapiens
ggaaguauaaacuuaguggagu

SEQ ID NO: 149126 - RNA, 22 nt, Homo sapiens
ggagaucuuuaggaguuggacu

SEQ ID NO: 149127 - RNA, 22 nt, Homo sapiens
ggagaucuuugaaguguugugc

SEQ ID NO: 149128 - RNA, 22 nt, Homo sapiens
ggagaugauuaugaaucacuua

SEQ ID NO: 149129 - RNA, 20 nt, Homo sapiens
ggagguguugauuuuucuuu

SEQ ID NO: 149130 - RNA, 22 nt, Homo sapiens
ggaguaggaaggaaauguuaaa

SEQ ID NO: 149131 - RNA, 22 nt, Homo sapiens
ggaguguguaggagaaagguaa

SEQ ID NO: 149132 - RNA, 22 nt, Homo sapiens
ggaucacagccagcucccagaa

SEQ ID NO: 149133 - RNA, 22 nt, Homo sapiens
ggcaagaaccagggauuugcgu

SEQ ID NO: 149134 - RNA, 22 nt, Homo sapiens
ggcaaguucuaaugauuagaau

SEQ ID NO: 149135 - RNA, 23 nt, Homo sapiens
ggcacggaauucaaagaggcauu

SEQ ID NO: 149136 - RNA, 22 nt, Homo sapiens
ggccggguggccauggcugccc

SEQ ID NO: 149137 - RNA, 18 nt, Homo sapiens
ggcggguguuuuauucac

SEQ ID NO: 149138 - RNA, 22 nt, Homo sapiens
ggcuagagacaaguugcugaga

SEQ ID NO: 149139 - RNA, 22 nt, Homo sapiens
gggaugaauuagguauguuuau

SEQ ID NO: 149140 - RNA, 19 nt, Homo sapiens
gggcaaaucuggaaauuua

SEQ ID NO: 149141 - RNA, 22 nt, Homo sapiens
gggcaugaugucuuaugccuau

SEQ ID NO: 149142 - RNA, 22 nt, Homo sapiens
gggguaggcuacacugaguucc

SEQ ID NO: 149143 - RNA, 22 nt, Homo sapiens
gggguaguuacuguuguucuuu

SEQ ID NO: 149144 - RNA, 22 nt, Homo sapiens
ggguaaaucucuuuucauggcu

SEQ ID NO: 149145 - RNA, 22 nt, Homo sapiens
ggguaggcaagcggaugucaga

SEQ ID NO: 149146 - RNA, 15 nt, Homo sapiens
ggguccucucccaaa

SEQ ID NO: 149147 - RNA, 22 nt, Homo sapiens
ggucaacaucaucaugguaagu

SEQ ID NO: 149148 - RNA, 19 nt, Homo sapiens
ggucacagggguuacaagg

SEQ ID NO: 149149 - RNA, 19 nt, Homo sapiens
ggucccucucaagucauuc

SEQ ID NO: 149150 - RNA, 22 nt, Homo sapiens
guacacauacauauaugugugu

SEQ ID NO: 149151 - RNA, 22 nt, Homo sapiens
guacauggaaugaaauucaaaa

SEQ ID NO: 149152 - RNA, 22 nt, Homo sapiens
guacaugugcacagugugcagg

SEQ ID NO: 149153 - RNA, 22 nt, Homo sapiens
guagcagcuacuaaguugcugu

SEQ ID NO: 149154 - RNA, 22 nt, Homo sapiens
guaucacacuuauugaccugca

SEQ ID NO: 149155 - RNA, 22 nt, Homo sapiens
gucaccauugagucauuuccuc

SEQ ID NO: 149156 - RNA, 22 nt, Homo sapiens
gucagaaucucagaugacaacg

SEQ ID NO: 149157 - RNA, 22 nt, Homo sapiens
gucaguggagaaaaggacaugu

SEQ ID NO: 149158 - RNA, 22 nt, Homo sapiens
gucucccagccuacaucuuucu

SEQ ID NO: 149159 - RNA, 22 nt, Homo sapiens
gucuggagacuugggucaucaa

SEQ ID NO: 149160 - RNA, 22 nt, Homo sapiens
gucuugcacuuaccuaagaacu

SEQ ID NO: 149161 - RNA, 22 nt, Homo sapiens
gucuuuaguugaaacauguggu

SEQ ID NO: 149162 - RNA, 22 nt, Homo sapiens
gugaaaagaugagcaccauaca

SEQ ID NO: 149163 - RNA, 22 nt, Homo sapiens
gugaaagacagcauuaauggcu

SEQ ID NO: 149164 - RNA, 22 nt, Homo sapiens
gugaauguaaagucaugugacu

SEQ ID NO: 149165 - RNA, 22 nt, Homo sapiens
gugagauuaccauuuaaaucag

SEQ ID NO: 149166 - RNA, 22 nt, Homo sapiens
gugagcauaggaggcuucuguu

SEQ ID NO: 149167 - RNA, 22 nt, Homo sapiens
gugagcauauuaguauugcacu

SEQ ID NO: 149168 - RNA, 22 nt, Homo sapiens
gugagcauucaaggaaggagcu

SEQ ID NO: 149169 - RNA, 22 nt, Homo sapiens
gugagccaugauuuuaccacug

SEQ ID NO: 149170 - RNA, 22 nt, Homo sapiens
gugagcuccucuucugcugcag

SEQ ID NO: 149171 - RNA, 22 nt, Homo sapiens
gugaggaaggaaaccugcuagc

SEQ ID NO: 149172 - RNA, 22 nt, Homo sapiens
gugaggcugguccugccuccca

SEQ ID NO: 149173 - RNA, 22 nt, Homo sapiens
gugaggcuuuuccuguuagacu

SEQ ID NO: 149174 - RNA, 17 nt, Homo sapiens
gugagguggguaguauc

SEQ ID NO: 149175 - RNA, 22 nt, Homo sapiens
gugauauguuaggaucuaaguc

SEQ ID NO: 149176 - RNA, 22 nt, Homo sapiens
gugcacauuguuuaugucuguu

SEQ ID NO: 149177 - RNA, 22 nt, Homo sapiens
gugcacuguagaacccuuuguu

SEQ ID NO: 149178 - RNA, 21 nt, Homo sapiens
gugcagacacacauauaggcu

SEQ ID NO: 149179 - RNA, 22 nt, Homo sapiens
gugcaguguuugcauggaauca

SEQ ID NO: 149180 - RNA, 22 nt, Homo sapiens
gugcaguuugaaaguagaaaca

SEQ ID NO: 149181 - RNA, 22 nt, Homo sapiens
gugaaagacauauaugguuuga

SEQ ID NO: 149182 - RNA, 22 nt, Homo sapiens
gugaaugcauuaagaaggggga

SEQ ID NO: 149183 - RNA, 22 nt, Homo sapiens
gugacaguggagacuuacuuca

SEQ ID NO: 149184 - RNA, 22 nt, Homo sapiens
gugagaccaauguacuaccuuc

SEQ ID NO: 149185 - RNA, 22 nt, Homo sapiens
gugagauaaugucucauugugg

SEQ ID NO: 149186 - RNA, 22 nt, Homo sapiens
gugagauuagcugagauccuug

SEQ ID NO: 149187 - RNA, 22 nt, Homo sapiens
gugagauuaguucuggaccugg

SEQ ID NO: 149188 - RNA, 22 nt, Homo sapiens
gugauaucacuguaucacucca

SEQ ID NO: 149189 - RNA, 21 nt, Homo sapiens
gugaucaugucacugcacucc

SEQ ID NO: 149190 - RNA, 22 nt, Homo sapiens
gugcaacaucccuccauaauuu

SEQ ID NO: 149191 - RNA, 22 nt, Homo sapiens
gugcaacaugccuggcuaauuu

SEQ ID NO: 149192 - RNA, 22 nt, Homo sapiens
gugcaagagugacugcaguuuu

SEQ ID NO: 149193 - RNA, 22 nt, Homo sapiens
gugcaagagugauugcaguuuu

SEQ ID NO: 149194 - RNA, 22 nt, Homo sapiens
gugcacaugcgugcgcacauau

SEQ ID NO: 149195 - RNA, 22 nt, Homo sapiens
gugcuaggugcuaggaagauag

SEQ ID NO: 149196 - RNA, 22 nt, Homo sapiens
gugcuauguuauccagcaagau

SEQ ID NO: 149197 - RNA, 22 nt, Homo sapiens
guggaauuauagagacaucuug

SEQ ID NO: 149198 - RNA, 22 nt, Homo sapiens
guggcacgaugaucugggcuca

SEQ ID NO: 149199 - RNA, 22 nt, Homo sapiens
guguaaaucaaucuguugucuu

SEQ ID NO: 149200 - RNA, 22 nt, Homo sapiens
guguaacaacagcacuccacug

SEQ ID NO: 149201 - RNA, 22 nt, Homo sapiens
guguaauaaucguggacuaugu

SEQ ID NO: 149202 - RNA, 22 nt, Homo sapiens
guguaauacauuagcaaaccaa

SEQ ID NO: 149203 - RNA, 22 nt, Homo sapiens
gugucacagcuuccaucucggu

SEQ ID NO: 149204 - RNA, 22 nt, Homo sapiens
gugucuccugccuucaugcagc

SEQ ID NO: 149205 - RNA, 22 nt, Homo sapiens
gugugcaugucuuuuuaguagg

SEQ ID NO: 149206 - RNA, 20 nt, Homo sapiens
gugugcauuucagauuuugg

SEQ ID NO: 149207 - RNA, 22 nt, Homo sapiens
guuaaagacauccacauaggag

SEQ ID NO: 149208 - RNA, 22 nt, Homo sapiens
guuagugcuuauuaaauaguau

SEQ ID NO: 149209 - RNA, 21 nt, Homo sapiens
guucaagugauccuccugucu

SEQ ID NO: 149210 - RNA, 22 nt, Homo sapiens
guuccuuguagaugcuggauau

SEQ ID NO: 149211 - RNA, 22 nt, Homo sapiens
guugcacagucuuuccuggacu

SEQ ID NO: 149212 - RNA, 22 nt, Homo sapiens
guugccuaggcuggagugcagu

SEQ ID NO: 149213 - RNA, 22 nt, Homo sapiens
guugcucaggccggagugcagu

SEQ ID NO: 149214 - RNA, 22 nt, Homo sapiens
guugggcccauagacugccagu

SEQ ID NO: 149215 - RNA, 22 nt, Homo sapiens
guugugcuuaagccuauugauu

SEQ ID NO: 149216 - RNA, 17 nt, Homo sapiens
guuuggguacuggguaa

SEQ ID NO: 149217 - RNA, 15 nt, Homo sapiens
guuuuuggauacaau

SEQ ID NO: 149218 - RNA, 22 nt, Homo sapiens
uaaagagcuuuugaggugucau

SEQ ID NO: 149219 - RNA, 22 nt, Homo sapiens
uaaagcauguaauuagguuaga

SEQ ID NO: 149220 - RNA, 22 nt, Homo sapiens
uaaagcuacaguauaugguauu

SEQ ID NO: 149221 - RNA, 22 nt, Homo sapiens
uaaaugcucuuuaaaagugcuu

SEQ ID NO: 149222 - RNA, 22 nt, Homo sapiens
uaacaguggucugugguaucug

SEQ ID NO: 149223 - RNA, 22 nt, Homo sapiens
uaacccagugucugugaugggu

SEQ ID NO: 149224 - RNA, 19 nt, Homo sapiens
uaagaugaagcugucuggg

SEQ ID NO: 149225 - RNA, 22 nt, Homo sapiens
uaagcuauagugaauaaauugc

SEQ ID NO: 149226 - RNA, 22 nt, Homo sapiens
uaaggaaccagaaguggguagc

SEQ ID NO: 149227 - RNA, 18 nt, Homo sapiens
uaaggcacuauaggcauu

SEQ ID NO: 149228 - RNA, 22 nt, Homo sapiens
uaaggcauuuuuuugaguugca

SEQ ID NO: 149229 - RNA, 22 nt, Homo sapiens
uaaggcuaggaauucucugaag

SEQ ID NO: 149230 - RNA, 22 nt, Homo sapiens
uaagggacgcccccuucucucu

SEQ ID NO: 149231 - RNA, 22 nt, Homo sapiens
uaaguaauugugguuucugcca

SEQ ID NO: 149232 - RNA, 22 nt, Homo sapiens
uaaguacaugcuagauggaaug

SEQ ID NO: 149233 - RNA, 22 nt, Homo sapiens
uaaguugcagguugugauucca

SEQ ID NO: 149234 - RNA, 22 nt, Homo sapiens
uaauaauguuaggcuuacucaa

SEQ ID NO: 149235 - RNA, 22 nt, Homo sapiens
uaauacauucaaggugguaguu

SEQ ID NO: 149236 - RNA, 22 nt, Homo sapiens
uaauacuguaauggugguuccg

SEQ ID NO: 149237 - RNA, 22 nt, Homo sapiens
uaauagagucauuauuauuguu

SEQ ID NO: 149238 - RNA, 22 nt, Homo sapiens
uacaaaguaacaguuccuguau

SEQ ID NO: 149239 - RNA, 22 nt, Homo sapiens
uacagccacauaauguaugauu

SEQ ID NO: 149240 - RNA, 22 nt, Homo sapiens
uacaggauagacaauuuauuaa

SEQ ID NO: 149241 - RNA, 22 nt, Homo sapiens
uacagugcauagaggcaugaua

SEQ ID NO: 149242 - RNA, 22 nt, Homo sapiens
uacagugcuugguaucuaguaa

SEQ ID NO: 149243 - RNA, 22 nt, Homo sapiens
uacauacuguaugguucuguuu

SEQ ID NO: 149244 - RNA, 22 nt, Homo sapiens
uacccaguaacaaguauuuugg

SEQ ID NO: 149245 - RNA, 22 nt, Homo sapiens
uacugcacucuagccuggguga

SEQ ID NO: 149246 - RNA, 22 nt, Homo sapiens
ucacauuguguagccugcucac

SEQ ID NO: 149247 - RNA, 22 nt, Homo sapiens
ucaccuggagacaugaagacug

SEQ ID NO: 149248 - RNA, 22 nt, Homo sapiens
ucacugagcuagaucacuugac

SEQ ID NO: 149249 - RNA, 22 nt, Homo sapiens
ucacugcacuagguaaugccac

SEQ ID NO: 149250 - RNA, 19 nt, Homo sapiens
ucacuggacagcacacuca

SEQ ID NO: 149251 - RNA, 22 nt, Homo sapiens
ucacuggacucuagccugggug

SEQ ID NO: 149252 - RNA, 22 nt, Homo sapiens
ucagaaccuccuagcaguguuc

SEQ ID NO: 149253 - RNA, 22 nt, Homo sapiens
ucagaccauuucauuacagacu

SEQ ID NO: 149254 - RNA, 22 nt, Homo sapiens
ucagaugaucugguaagaacuu

SEQ ID NO: 149255 - RNA, 19 nt, Homo sapiens
ucagcaguaaucaacuuca

SEQ ID NO: 149256 - RNA, 22 nt, Homo sapiens
ucagcaguggacagaaugguag

SEQ ID NO: 149257 - RNA, 22 nt, Homo sapiens
ucaggcuuuucccagagugaug

SEQ ID NO: 149258 - RNA, 22 nt, Homo sapiens
ucagggacuuacaaaccagaag

SEQ ID NO: 149259 - RNA, 19 nt, Homo sapiens
ucaguagugcacauaagcc

SEQ ID NO: 149260 - RNA, 22 nt, Homo sapiens
ucagucauucaauuguugaaug

SEQ ID NO: 149261 - RNA, 21 nt, Homo sapiens
ucagugcugugggcaaggugc

SEQ ID NO: 149262 - RNA, 23 nt, Homo sapiens
ucagugucuggauccugcucagu

SEQ ID NO: 149263 - RNA, 22 nt, Homo sapiens
ucaguguuuggaaucucaauuu

SEQ ID NO: 149264 - RNA, 21 nt, Homo sapiens
ucaguuacugagagagaagug

SEQ ID NO: 149265 - RNA, 22 nt, Homo sapiens
ucaguucauggaggugucugcu

SEQ ID NO: 149266 - RNA, 20 nt, Homo sapiens
ucauacuguggaguaccagg

SEQ ID NO: 149267 - RNA, 22 nt, Homo sapiens
ucauaugucauaguaugaucuu

SEQ ID NO: 149268 - RNA, 22 nt, Homo sapiens
ucaucaguuuuuuauaugugau

SEQ ID NO: 149269 - RNA, 22 nt, Homo sapiens
ucaugagacacacuggaaagga

SEQ ID NO: 149270 - RNA, 21 nt, Homo sapiens
ucaugccacugcacuuuagcc

SEQ ID NO: 149271 - RNA, 22 nt, Homo sapiens
ucauggcacugaugagaguuuc

SEQ ID NO: 149272 - RNA, 22 nt, Homo sapiens
ucauucauuugcucacuccaca

SEQ ID NO: 149273 - RNA, 22 nt, Homo sapiens
ucauuggauggaaugcucugua

SEQ ID NO: 149274 - RNA, 22 nt, Homo sapiens
ucauugguagcucauggaaccg

SEQ ID NO: 149275 - RNA, 21 nt, Homo sapiens
ucauugguuggcugcccugua

SEQ ID NO: 149276 - RNA, 20 nt, Homo sapiens
uccacugagcgucacggcag

SEQ ID NO: 149277 - RNA, 22 nt, Homo sapiens
uccagguuuggcuuuauaacuu

SEQ ID NO: 149278 - RNA, 22 nt, Homo sapiens
uccaguuguucucgaagcuccu

SEQ ID NO: 149279 - RNA, 22 nt, Homo sapiens
uccaguuuuguuaacauauggu

SEQ ID NO: 149280 - RNA, 22 nt, Homo sapiens
uccauggagacacauuuuauau

SEQ ID NO: 149281 - RNA, 22 nt, Homo sapiens
uccauguagaagacaggggaga

SEQ ID NO: 149282 - RNA, 22 nt, Homo sapiens
ucccauguagcuaggauuacag

SEQ ID NO: 149283 - RNA, 22 nt, Homo sapiens
ucccgaggacaucugggggcaa

SEQ ID NO: 149284 - RNA, 18 nt, Homo sapiens
ucccuuuguagaugaccc

SEQ ID NO: 149285 - RNA, 22 nt, Homo sapiens
uccuacaugcaguacauucaaa

SEQ ID NO: 149286 - RNA, 19 nt, Homo sapiens
uccuugauugcaccacugc

SEQ ID NO: 149287 - RNA, 22 nt, Homo sapiens
ucgagcaauugucaugucucag

SEQ ID NO: 149288 - RNA, 22 nt, Homo sapiens
ucgcaccauugcacuccagcca

SEQ ID NO: 149289 - RNA, 22 nt, Homo sapiens
ucuaaagcauccagauugcuuc

SEQ ID NO: 149290 - RNA, 22 nt, Homo sapiens
ucuauggaguuugaaugagaaa

SEQ ID NO: 149291 - RNA, 22 nt, Homo sapiens
ucucacaccccucucauauacc

SEQ ID NO: 149292 - RNA, 22 nt, Homo sapiens
ucucacagccauuucucccucu

SEQ ID NO: 149293 - RNA, 22 nt, Homo sapiens
ucucagagccuaggguuuuuca

SEQ ID NO: 149294 - RNA, 22 nt, Homo sapiens
ucucagcacaaacaaaauugcu

SEQ ID NO: 149295 - RNA, 22 nt, Homo sapiens
ucucagugaauugguuuugucu

SEQ ID NO: 149296 - RNA, 22 nt, Homo sapiens
ucucuagagagccugguguuca

SEQ ID NO: 149297 - RNA, 22 nt, Homo sapiens
ucugagguuaaauuuuauaguu

SEQ ID NO: 149298 - RNA, 22 nt, Homo sapiens
ucugagucaucacaaaugaugc

SEQ ID NO: 149299 - RNA, 22 nt, Homo sapiens
ucuggccccucccaaaucucau

SEQ ID NO: 149300 - RNA, 22 nt, Homo sapiens
ucugucuugugguuugagugcc

SEQ ID NO: 149301 - RNA, 22 nt, Homo sapiens
ucugugaaugaacacuugaaaa

SEQ ID NO: 149302 - RNA, 22 nt, Homo sapiens
ucugugcuugucauaugcuuug

SEQ ID NO: 149303 - RNA, 22 nt, Homo sapiens
ucugugguaagaaacgcauguc

SEQ ID NO: 149304 - RNA, 22 nt, Homo sapiens
ucuguggugggcuccacccagu

SEQ ID NO: 149305 - RNA, 18 nt, Homo sapiens
ucugugguguaaauacgu

SEQ ID NO: 149306 - RNA, 22 nt, Homo sapiens
ucugugguucuagcuacuuugg

SEQ ID NO: 149307 - RNA, 22 nt, Homo sapiens
ucuugcaccuacaugcuuuguc

SEQ ID NO: 149308 - RNA, 22 nt, Homo sapiens
ucuugcaguucccaaauucaca

SEQ ID NO: 149309 - RNA, 22 nt, Homo sapiens
ucuuggguuuguccuucuccua

SEQ ID NO: 149310 - RNA, 22 nt, Homo sapiens
ucuugguugaaaauucauaaua

SEQ ID NO: 149311 - RNA, 20 nt, Homo sapiens
ucuugguuggaggucuuuua

SEQ ID NO: 149312 - RNA, 22 nt, Homo sapiens
ucuugguuuauugugguaugaa

SEQ ID NO: 149313 - RNA, 22 nt, Homo sapiens
ucuuugauguucugaaagaugg

SEQ ID NO: 149314 - RNA, 22 nt, Homo sapiens
ucuuuggcugugaagaauaaug

SEQ ID NO: 149315 - RNA, 22 nt, Homo sapiens
ucuuugguaauggaugucugau

SEQ ID NO: 149316 - RNA, 22 nt, Homo sapiens
ucuuugguaugugcaugugcuu

SEQ ID NO: 149317 - RNA, 22 nt, Homo sapiens
ucuuugguugcacugcaggugu

SEQ ID NO: 149318 - RNA, 22 nt, Homo sapiens
ucuuuguguaggucaaucuggc

SEQ ID NO: 149319 - RNA, 22 nt, Homo sapiens
ucuuuguuggaguccaaggaua

SEQ ID NO: 149320 - RNA, 22 nt, Homo sapiens
ucuuuuguucuauucaggccuu

SEQ ID NO: 149321 - RNA, 22 nt, Homo sapiens
ugaaauacuuaauuucuccaug

SEQ ID NO: 149322 - RNA, 22 nt, Homo sapiens
ugaaauacuuuggcucuuuguu

SEQ ID NO: 149323 - RNA, 22 nt, Homo sapiens
ugaaaucauguaguuauugcaa

SEQ ID NO: 149324 - RNA, 22 nt, Homo sapiens
ugaaauggugcggucugcagca

SEQ ID NO: 149325 - RNA, 22 nt, Homo sapiens
ugaaauguaaguugucuagucu

SEQ ID NO: 149326 - RNA, 22 nt, Homo sapiens
ugaaauguuaaacaaguggcuc

SEQ ID NO: 149327 - RNA, 22 nt, Homo sapiens
ugaaauguugggugauggaauc

SEQ ID NO: 149328 - RNA, 22 nt, Homo sapiens
ugaacagucaucucucuuguau

SEQ ID NO: 149329 - RNA, 19 nt, Homo sapiens
ugaaguauagggcuucuga

SEQ ID NO: 149330 - RNA, 20 nt, Homo sapiens
ugaauguaauuacagaugua

SEQ ID NO: 149331 - RNA, 22 nt, Homo sapiens
ugaauguuguugguugagauau

SEQ ID NO: 149332 - RNA, 22 nt, Homo sapiens
ugaauucaucucacagaguuaa

SEQ ID NO: 149333 - RNA, 22 nt, Homo sapiens
ugaauucuguccaaaauaacug

SEQ ID NO: 149334 - RNA, 22 nt, Homo sapiens
ugacacagcaagauggaaccau

SEQ ID NO: 149335 - RNA, 23 nt, Homo sapiens
ugacagaccuucuggaagaaguc

SEQ ID NO: 149336 - RNA, 22 nt, Homo sapiens
ugacaggucuaauuuacugaca

SEQ ID NO: 149337 - RNA, 23 nt, Homo sapiens
ugacagugcuugaaauugcucuu

SEQ ID NO: 149338 - RNA, 18 nt, Homo sapiens
ugacaguuucuuuauauu

SEQ ID NO: 149339 - RNA, 22 nt, Homo sapiens
ugacauggaaguagguauacau

SEQ ID NO: 149340 - RNA, 22 nt, Homo sapiens
ugacuagagacagaaacuaaaa

SEQ ID NO: 149341 - RNA, 17 nt, Homo sapiens
ugacuagugcccuuauu

SEQ ID NO: 149342 - RNA, 21 nt, Homo sapiens
ugagacaauccuggucaauau

SEQ ID NO: 149343 - RNA, 22 nt, Homo sapiens
ugagacugagucucgcucuugu

SEQ ID NO: 149344 - RNA, 22 nt, Homo sapiens
ugagacugagucuugcucuauu

SEQ ID NO: 149345 - RNA, 22 nt, Homo sapiens
ugagacugaguuuugcucguug

SEQ ID NO: 149346 - RNA, 22 nt, Homo sapiens
ugagacugaguuuugcucuugu

SEQ ID NO: 149347 - RNA, 21 nt, Homo sapiens
ugagauaauauguuucugaug

SEQ ID NO: 149348 - RNA, 22 nt, Homo sapiens
uugcacuguaauuuauuuaugu

SEQ ID NO: 149349 - RNA, 22 nt, Homo sapiens
uugcauagaggugaguauagua

SEQ ID NO: 149350 - RNA, 22 nt, Homo sapiens
uugcaugcacaguucucaauag

SEQ ID NO: 149351 - RNA, 22 nt, Homo sapiens
uugccaucaucucuuacucagu

SEQ ID NO: 149352 - RNA, 22 nt, Homo sapiens
uugcuuagucaugaaucacuga

SEQ ID NO: 149353 - RNA, 22 nt, Homo sapiens
uugcuucuuucgucuggcccca

SEQ ID NO: 149354 - RNA, 22 nt, Homo sapiens
uuggaaacauuuaugguaacag

SEQ ID NO: 149355 - RNA, 22 nt, Homo sapiens
uuggaaaguuguuguaguuauu

SEQ ID NO: 149356 - RNA, 22 nt, Homo sapiens
uuggaaaugguaaaggguuaau

SEQ ID NO: 149357 - RNA, 22 nt, Homo sapiens
uuggaacuguucguauugaaau

SEQ ID NO: 149358 - RNA, 22 nt, Homo sapiens
uuggaauuuuaaaauaggcaac

SEQ ID NO: 149359 - RNA, 22 nt, Homo sapiens
uuggacuuuaagauagagaugu

SEQ ID NO: 149360 - RNA, 22 nt, Homo sapiens
uuggacuuuuauucugcaggca

SEQ ID NO: 149361 - RNA, 22 nt, Homo sapiens
uuggagagaaaggcaguuccug

SEQ ID NO: 149362 - RNA, 22 nt, Homo sapiens
uuggauagugcaaugccuccag

SEQ ID NO: 149363 - RNA, 22 nt, Homo sapiens
uuggauaguuuaugaaaaaugg

SEQ ID NO: 149364 - RNA, 22 nt, Homo sapiens
uuggauggugauaugguuugga

SEQ ID NO: 149365 - RNA, 22 nt, Homo sapiens
uuggauuuuaacaaacuaggug

SEQ ID NO: 149366 - RNA, 21 nt, Homo sapiens
uuggcacucuucucuccuuau

SEQ ID NO: 149367 - RNA, 22 nt, Homo sapiens
uuggcacuugauaauauucugg

SEQ ID NO: 149368 - RNA, 22 nt, Homo sapiens
uuggcagcacgcaguccagagg

SEQ ID NO: 149369 - RNA, 22 nt, Homo sapiens
uuggcauaguugcacuuacuag

SEQ ID NO: 149370 - RNA, 22 nt, Homo sapiens
uuggccccuccaaaucucaugu

SEQ ID NO: 149371 - RNA, 19 nt, Homo sapiens
uuggcccugguucucuucu

SEQ ID NO: 149372 - RNA, 22 nt, Homo sapiens
uuggcuaugaguccuaugugca

SEQ ID NO: 149373 - RNA, 22 nt, Homo sapiens
uuggcuguguuccucaaggagu

SEQ ID NO: 149374 - RNA, 22 nt, Homo sapiens
uuggcuguguuucccuacaaau

SEQ ID NO: 149375 - RNA, 22 nt, Homo sapiens
uugguccccuucaaccagcugu

SEQ ID NO: 149376 - RNA, 22 nt, Homo sapiens
uuguaaagucugucucagucag

SEQ ID NO: 149377 - RNA, 22 nt, Homo sapiens
uuguaacaguuuauugacucga

SEQ ID NO: 149378 - RNA, 22 nt, Homo sapiens
uuguagaucuucaguugcuaca

SEQ ID NO: 149379 - RNA, 22 nt, Homo sapiens
uuguauguaaccauuuggcaaa

SEQ ID NO: 149380 - RNA, 22 nt, Homo sapiens
uugugaaaaaccucucguggaa

SEQ ID NO: 149381 - RNA, 22 nt, Homo sapiens
uugugaaaucuaggcagagguu

SEQ ID NO: 149382 - RNA, 22 nt, Homo sapiens
uugugauggugcauacugagcu

SEQ ID NO: 149383 - RNA, 22 nt, Homo sapiens
uugugcaaaguugugguuucug

SEQ ID NO: 149384 - RNA, 22 nt, Homo sapiens
uugugcauaucagagguuugcu

SEQ ID NO: 149385 - RNA, 20 nt, Homo sapiens
uugugcauugggccauuggg

SEQ ID NO: 149386 - RNA, 22 nt, Homo sapiens
uugugccccuucucagucgggc

SEQ ID NO: 149387 - RNA, 22 nt, Homo sapiens
uugugcuccuaugagaaucuaa

SEQ ID NO: 149388 - RNA, 22 nt, Homo sapiens
uugugcuuguaacuacauucag

SEQ ID NO: 149389 - RNA, 22 nt, Homo sapiens
uugugcuuuuuaaauagcuucc

SEQ ID NO: 149390 - RNA, 22 nt, Homo sapiens
uugugguuuuagcacuguggau

SEQ ID NO: 149391 - RNA, 22 nt, Homo sapiens
uuguuauguuggucaguaaugu

SEQ ID NO: 149392 - RNA, 22 nt, Homo sapiens
uuuaauagcagggacuuccggg

SEQ ID NO: 149393 - RNA, 22 nt, Homo sapiens
uuuagguaauauuaaguagcug

SEQ ID NO: 149394 - RNA, 22 nt, Homo sapiens
uuuagguagucaaagguuaguc

SEQ ID NO: 149395 - RNA, 22 nt, Homo sapiens
uuucaguguggcaggcauagcu

SEQ ID NO: 149396 - RNA, 22 nt, Homo sapiens
uuucauagaucaugcuuuugga

SEQ ID NO: 149397 - RNA, 22 nt, Homo sapiens
uuuccaagaugcuuacuuucuc

SEQ ID NO: 149398 - RNA, 22 nt, Homo sapiens
uuuccaguuguucuagaaagcu

SEQ ID NO: 149399 - RNA, 22 nt, Homo sapiens
uuugacaaugugugcuuguauu

SEQ ID NO: 149400 - RNA, 20 nt, Homo sapiens
uuugcagaaucuaagaagag

SEQ ID NO: 149401 - RNA, 22 nt, Homo sapiens
uuugccaaucagaggcaucuug

SEQ ID NO: 149402 - RNA, 22 nt, Homo sapiens
uuugccaaugggaauuuuccua

SEQ ID NO: 149403 - RNA, 22 nt, Homo sapiens
uuugccuguagacacuuacccu

SEQ ID NO: 149404 - RNA, 22 nt, Homo sapiens
uuugcuauagugaauagugcug

SEQ ID NO: 149405 - RNA, 22 nt, Homo sapiens
uuuggaagaugccacuguauca

SEQ ID NO: 149406 - RNA, 22 nt, Homo sapiens
uuuggcaaagaucaacauguua

SEQ ID NO: 149407 - RNA, 22 nt, Homo sapiens
uuuggcaacguuggaucccuca

SEQ ID NO: 149408 - RNA, 20 nt, Homo sapiens
uuuggcaauaggguuuuugu

SEQ ID NO: 149409 - RNA, 22 nt, Homo sapiens
uuuggcaauuugacuguauagg

SEQ ID NO: 149410 - RNA, 22 nt, Homo sapiens
uuuggcacuauagguaaauuug

SEQ ID NO: 149411 - RNA, 20 nt, Homo sapiens
uuuggcacugagugguauaa

SEQ ID NO: 149412 - RNA, 22 nt, Homo sapiens
uuuggcauuaagaugcuguauc

SEQ ID NO: 149413 - RNA, 21 nt, Homo sapiens
uuuggcauuaugucaccagag

SEQ ID NO: 149414 - RNA, 22 nt, Homo sapiens
uuuggcauuugaguuuguagga

SEQ ID NO: 149415 - RNA, 22 nt, Homo sapiens
uuuggccauguuggucaggcug

SEQ ID NO: 149416 - RNA, 22 nt, Homo sapiens
uuuggcuuuugugauacguaau

SEQ ID NO: 149417 - RNA, 22 nt, Homo sapiens
uuugguugccucuaugagccug

SEQ ID NO: 149418 - RNA, 22 nt, Homo sapiens
uuuguacacuguuggugguuau

SEQ ID NO: 149419 - RNA, 22 nt, Homo sapiens
uuuguacucccuuuagauaaaa

SEQ ID NO: 149420 - RNA, 22 nt, Homo sapiens
uuuguacuugaagaaucuuuau

SEQ ID NO: 149421 - RNA, 20 nt, Homo sapiens
uuuguaucucuggguacugg

SEQ ID NO: 149422 - RNA, 22 nt, Homo sapiens
uuuuaguggaauauuuacaguu

SEQ ID NO: 149423 - RNA, 22 nt, Homo sapiens
uuuugcacuagaaccagagguu

SEQ ID NO: 149424 - RNA, 22 nt, Homo sapiens
uuuuggacuugcuccccugucc

SEQ ID NO: 149425 - RNA, 22 nt, Homo sapiens
uuuuuggaggagguuagaucau

SEQ ID NO: 149426 - RNA, 23 nt, Homo sapiens
ugacagucucccgauggcuaggc

SEQ ID NO: 149427 - RNA, 22 nt, Homo sapiens
ugacaguguccucauucccaac

SEQ ID NO: 149428 - RNA, 22 nt, Homo sapiens
ugacaguguccuccuccugaga

SEQ ID NO: 149429 - RNA, 22 nt, Homo sapiens
ugacaugagauuugggaggggc

SEQ ID NO: 149430 - RNA, 22 nt, Homo sapiens
ugacauggagagagaagccuuu

SEQ ID NO: 149431 - RNA, 22 nt, Homo sapiens
ugacauggagggugcggcugca

SEQ ID NO: 149432 - RNA, 22 nt, Homo sapiens
ugacauggagguggaggaagau

SEQ ID NO: 149433 - RNA, 22 nt, Homo sapiens
ugacauguauuagcucagugcu

SEQ ID NO: 149434 - RNA, 21 nt, Homo sapiens
ugacauguuggugugcugcac

SEQ ID NO: 149435 - RNA, 19 nt, Homo sapiens
ugaccagggacagaaacca

SEQ ID NO: 149436 - RNA, 22 nt, Homo sapiens
ugacuacauaaguaaucucaaa

SEQ ID NO: 149437 - RNA, 19 nt, Homo sapiens
ugacuauagccugaucagu

SEQ ID NO: 149438 - RNA, 19 nt, Homo sapiens
ugagaaccucuacagaguc

SEQ ID NO: 149439 - RNA, 22 nt, Homo sapiens
ugagaacucaugggucugcugg

SEQ ID NO: 149440 - RNA, 22 nt, Homo sapiens
ugagaacugccuguauuuaucu

SEQ ID NO: 149441 - RNA, 22 nt, Homo sapiens
ugagaacugguagcacuuguga

SEQ ID NO: 149442 - RNA, 22 nt, Homo sapiens
ugagaacuuugucuuuuacucu

SEQ ID NO: 149443 - RNA, 22 nt, Homo sapiens
ugagaagacaucuuugcuuugu

SEQ ID NO: 149444 - RNA, 22 nt, Homo sapiens
ugagacaaucucaucucaguga

SEQ ID NO: 149445 - RNA, 22 nt, Homo sapiens
ugagagacaguuuguuaaaauu

SEQ ID NO: 149446 - RNA, 22 nt, Homo sapiens
ugagagcuuugaugcacuguuu

SEQ ID NO: 149447 - RNA, 22 nt, Homo sapiens
ugagauagggucucacucuguc

SEQ ID NO: 149448 - RNA, 22 nt, Homo sapiens
ugagaucaugccacugcacuuc

SEQ ID NO: 149449 - RNA, 22 nt, Homo sapiens
ugagaucucauuaugguuuuaa

SEQ ID NO: 149450 - RNA, 22 nt, Homo sapiens
ugagaucugauaggccuggguu

SEQ ID NO: 149451 - RNA, 22 nt, Homo sapiens
ugagaucuuaccuuccugccuu

SEQ ID NO: 149452 - RNA, 22 nt, Homo sapiens
ugagaucuuugcuguccucacc

SEQ ID NO: 149453 - RNA, 22 nt, Homo sapiens
ugagaugaagcuagaagaaugg

SEQ ID NO: 149454 - RNA, 22 nt, Homo sapiens
ugagaugaagucucacucuguc

SEQ ID NO: 149455 - RNA, 22 nt, Homo sapiens
ugagaugaagucuugcucuguu

SEQ ID NO: 149456 - RNA, 22 nt, Homo sapiens
ugagaugagaaucaguucuaau

SEQ ID NO: 149457 - RNA, 22 nt, Homo sapiens
ugagaugagggcugcacucaaa

SEQ ID NO: 149458 - RNA, 22 nt, Homo sapiens
ugagauggaucuuggauuugaa

SEQ ID NO: 149459 - RNA, 22 nt, Homo sapiens
ugagauggguucugguccccug

SEQ ID NO: 149460 - RNA, 22 nt, Homo sapiens
ugagauguagauauggauuaga

SEQ ID NO: 149461 - RNA, 22 nt, Homo sapiens
ugagaugugaagaucacaugaa

SEQ ID NO: 149462 - RNA, 22 nt, Homo sapiens
ugagauguuccaaugacuauua

SEQ ID NO: 149463 - RNA, 22 nt, Homo sapiens
ugagauguugcucugaaacaag

SEQ ID NO: 149464 - RNA, 23 nt, Homo sapiens
ugagauuauaaucuuuuacuucu

SEQ ID NO: 149465 - RNA, 22 nt, Homo sapiens
ugagauuguaucugcaaugugu

SEQ ID NO: 149466 - RNA, 22 nt, Homo sapiens
ugagcacauuuacaucaguucc

SEQ ID NO: 149467 - RNA, 23 nt, Homo sapiens
ugagccaugggacuccaagggag

SEQ ID NO: 149468 - RNA, 17 nt, Homo sapiens
ugagcuaagauuacccc

SEQ ID NO: 149469 - RNA, 22 nt, Homo sapiens
ugagcuaggucuugcucuguca

SEQ ID NO: 149470 - RNA, 22 nt, Homo sapiens
ugagcugagaucacacuacugu

SEQ ID NO: 149471 - RNA, 22 nt, Homo sapiens
ugaggaacuagcuacccuaaua

SEQ ID NO: 149472 - RNA, 22 nt, Homo sapiens
ugagguguuugugcaccaucug

SEQ ID NO: 149473 - RNA, 22 nt, Homo sapiens
ugagguugaaggacauuuuuau

SEQ ID NO: 149474 - RNA, 22 nt, Homo sapiens
ugagucaugcuggagucauggc

SEQ ID NO: 149475 - RNA, 22 nt, Homo sapiens
ugaguuccuuucccaguccagu

SEQ ID NO: 149476 - RNA, 22 nt, Homo sapiens
ugaguuguugcauucuuggugu

SEQ ID NO: 149477 - RNA, 22 nt, Homo sapiens
ugauaacauugggggaagcuga

SEQ ID NO: 149478 - RNA, 22 nt, Homo sapiens
ugauacuggcuucauagaauga

SEQ ID NO: 149479 - RNA, 22 nt, Homo sapiens
ugauagugccuuuuauaucucu

SEQ ID NO: 149480 - RNA, 22 nt, Homo sapiens
ugauauguaugugaccuagaaa

SEQ ID NO: 149481 - RNA, 22 nt, Homo sapiens
ugaucuguccaccucagcuucc

SEQ ID NO: 149482 - RNA, 22 nt, Homo sapiens
ugauuuguuucaggaguuuucu

SEQ ID NO: 149483 - RNA, 18 nt, Homo sapiens
ugcaaacauguguguguu

SEQ ID NO: 149484 - RNA, 22 nt, Homo sapiens
ugcaaauguuaguaacaccacu

SEQ ID NO: 149485 - RNA, 22 nt, Homo sapiens
ugcaaauguuauuuugguuucu

SEQ ID NO: 149486 - RNA, 22 nt, Homo sapiens
ugcaaauuauugggccccaacu

SEQ ID NO: 149487 - RNA, 21 nt, Homo sapiens
ugcaagaaucaggaagcugcc

SEQ ID NO: 149488 - RNA, 22 nt, Homo sapiens
ugcaagaaucuuucaggcuagc

SEQ ID NO: 149489 - RNA, 22 nt, Homo sapiens
ugcaaugugaaauaagcacauc

SEQ ID NO: 149490 - RNA, 22 nt, Homo sapiens
ugcagagaaacauuuuguauuu

SEQ ID NO: 149491 - RNA, 21 nt, Homo sapiens
ugcagccauucagcccuaugc

SEQ ID NO: 149492 - RNA, 23 nt, Homo sapiens
ugcagcuacauguggccaugugc

SEQ ID NO: 149493 - RNA, 22 nt, Homo sapiens
ugcagugugaaagagccugaca

SEQ ID NO: 149494 - RNA, 18 nt, Homo sapiens
ugcauacuaucugauuuu

SEQ ID NO: 149495 - RNA, 22 nt, Homo sapiens
ugcauauucgaguuauuuuggg

SEQ ID NO: 149496 - RNA, 22 nt, Homo sapiens
ugcauggauguuugaacacacu

SEQ ID NO: 149497 - RNA, 22 nt, Homo sapiens
ugcauguucuuacucauacaug

SEQ ID NO: 149498 - RNA, 22 nt, Homo sapiens
ugcauuguggaucuaaaugcau

SEQ ID NO: 149499 - RNA, 20 nt, Homo sapiens
ugccaagaaaugaggguauu

SEQ ID NO: 149500 - RNA, 22 nt, Homo sapiens
ugccaguguuuuguugaagauu

SEQ ID NO: 149501 - RNA, 22 nt, Homo sapiens
ugccaugaaguaauggcaaaaa

SEQ ID NO: 149502 - RNA, 22 nt, Homo sapiens
ugccuacuuugcaucugucagg

SEQ ID NO: 149503 - RNA, 23 nt, Homo sapiens
ugcuauguaagcauuuauuaaau

SEQ ID NO: 149504 - RNA, 22 nt, Homo sapiens
ugcuauguccccacccaaaucu

SEQ ID NO: 149505 - RNA, 22 nt, Homo sapiens
ugcugcauuggggauuaaguuu

SEQ ID NO: 149506 - RNA, 22 nt, Homo sapiens
ugcugcuguuaucauuuuacca

SEQ ID NO: 149507 - RNA, 22 nt, Homo sapiens
ugcuggcguuacucuccaucag

SEQ ID NO: 149508 - RNA, 17 nt, Homo sapiens
ugcuuagagagccucag

SEQ ID NO: 149509 - RNA, 21 nt, Homo sapiens
ugcuuuggucauacuucuucc

SEQ ID NO: 149510 - RNA, 20 nt, Homo sapiens
uggaaaguaagucaugauau

SEQ ID NO: 149511 - RNA, 22 nt, Homo sapiens
uggaacacauaaauagcauagu

SEQ ID NO: 149512 - RNA, 22 nt, Homo sapiens
uggaagacauugggugaagggu

SEQ ID NO: 149513 - RNA, 22 nt, Homo sapiens
uggaagacuuuagaggcuuaua

SEQ ID NO: 149514 - RNA, 22 nt, Homo sapiens
uggaagucuauggcauuugagu

SEQ ID NO: 149515 - RNA, 22 nt, Homo sapiens
uggaaucuacuaaagcaaaauc

SEQ ID NO: 149516 - RNA, 22 nt, Homo sapiens
uggacagagagaccggcauuuu

SEQ ID NO: 149517 - RNA, 22 nt, Homo sapiens
uggacaugaagggcacaggagg

SEQ ID NO: 149518 - RNA, 22 nt, Homo sapiens
uggaccccugcucgggagcccu

SEQ ID NO: 149519 - RNA, 21 nt, Homo sapiens
uggaccccuuccuugcaccau

SEQ ID NO: 149520 - RNA, 22 nt, Homo sapiens
uggaguauuauguaauuucaau

SEQ ID NO: 149521 - RNA, 22 nt, Homo sapiens
uggaguguaaauuaguucagcc

SEQ ID NO: 149522 - RNA, 22 nt, Homo sapiens
uggaguguguugcagaugaagg

SEQ ID NO: 149523 - RNA, 22 nt, Homo sapiens
uggauugcaaaaucuuuuugag

SEQ ID NO: 149524 - RNA, 22 nt, Homo sapiens
uggcaaauuccaaaguuaauuc

SEQ ID NO: 149525 - RNA, 22 nt, Homo sapiens
uggcaacuugcaaccucauucu

SEQ ID NO: 149526 - RNA, 22 nt, Homo sapiens
uggcaagaagagcaugagacca

SEQ ID NO: 149527 - RNA, 22 nt, Homo sapiens
uggcacaaugacccuugugggc

SEQ ID NO: 149528 - RNA, 22 nt, Homo sapiens
gacuagaaauuauuuagugagc

SEQ ID NO: 149529 - RNA, 22 nt, Homo sapiens
gacuagauauuguucuauguca

SEQ ID NO: 149530 - RNA, 19 nt, Homo sapiens
gacuccagaguugugugcu

SEQ ID NO: 149531 - RNA, 22 nt, Homo sapiens
gacucuguagacaaucacaucu

SEQ ID NO: 149532 - RNA, 22 nt, Homo sapiens
gacuuagagauguuguauuugg

SEQ ID NO: 149533 - RNA, 22 nt, Homo sapiens
gagaacaguguuguauuuuuuc

SEQ ID NO: 149534 - RNA, 22 nt, Homo sapiens
gagacugagucuugcccuguca

SEQ ID NO: 149535 - RNA, 22 nt, Homo sapiens
gagacugagucuugcucuguca

SEQ ID NO: 149536 - RNA, 22 nt, Homo sapiens
gagauaauagcuauaggaucuu

SEQ ID NO: 149537 - RNA, 22 nt, Homo sapiens
gagaucaaugggauggaauuga

SEQ ID NO: 149538 - RNA, 22 nt, Homo sapiens
gagaucaugcugguucucucau

SEQ ID NO: 149539 - RNA, 22 nt, Homo sapiens
gagauuaacauuugaggagcug

SEQ ID NO: 149540 - RNA, 22 nt, Homo sapiens
gagauuaauacacaucaaaugc

SEQ ID NO: 149541 - RNA, 22 nt, Homo sapiens
gagauucaucuagguccagaga

SEQ ID NO: 149542 - RNA, 22 nt, Homo sapiens
gagauuuucagcuugacuggga

SEQ ID NO: 149543 - RNA, 22 nt, Homo sapiens
gagcaacaguggcagugguggg

SEQ ID NO: 149544 - RNA, 22 nt, Homo sapiens
gagcaaugauugagccacugua

SEQ ID NO: 149545 - RNA, 22 nt, Homo sapiens
gagcacauguggagagucuggg

SEQ ID NO: 149546 - RNA, 22 nt, Homo sapiens
gagccuguaggaggagaggugg

SEQ ID NO: 149547 - RNA, 22 nt, Homo sapiens
gagcugaauugcugccauuugc

SEQ ID NO: 149548 - RNA, 22 nt, Homo sapiens
gaggaaguaauuuuaggccugu

SEQ ID NO: 149549 - RNA, 22 nt, Homo sapiens
gaggaucucuugagcccagaag

SEQ ID NO: 149550 - RNA, 22 nt, Homo sapiens
gaggcagucugucccuuagcag

SEQ ID NO: 149551 - RNA, 22 nt, Homo sapiens
gagguaaguaagaauggcaagc

SEQ ID NO: 149552 - RNA, 22 nt, Homo sapiens
gagguaggggccuuaaagaugc

SEQ ID NO: 149553 - RNA, 22 nt, Homo sapiens
gagugcaauggcgcgaucucgg

SEQ ID NO: 149554 - RNA, 22 nt, Homo sapiens
gagugcauaugggccuguguca

SEQ ID NO: 149555 - RNA, 22 nt, Homo sapiens
gaguuuguaaacuauucacuaa

SEQ ID NO: 149556 - RNA, 22 nt, Homo sapiens
gaucacauggccauuucuagcu

SEQ ID NO: 149557 - RNA, 22 nt, Homo sapiens
gaugacagcugacucccuugcu

SEQ ID NO: 149558 - RNA, 19 nt, Homo sapiens
gaugcaaugcacugagguc

SEQ ID NO: 149559 - RNA, 22 nt, Homo sapiens
gauggauuuuaagugaaugaaa

SEQ ID NO: 149560 - RNA, 22 nt, Homo sapiens
gauuuguauuaaaagugugacg

SEQ ID NO: 149561 - RNA, 22 nt, Homo sapiens
gcaaaguguuuuccaacuuggu

SEQ ID NO: 149562 - RNA, 22 nt, Homo sapiens
gcacauuacaaguauuagcuca

SEQ ID NO: 149563 - RNA, 22 nt, Homo sapiens
gcaccauugacaagaaauaggu

SEQ ID NO: 149564 - RNA, 22 nt, Homo sapiens
gcacccugucaaaauggaccaa

SEQ ID NO: 149565 - RNA, 22 nt, Homo sapiens
gcagugaugugaucauagcuca

SEQ ID NO: 149566 - RNA, 22 nt, Homo sapiens
gcaguguggguagagggcaaga

SEQ ID NO: 149567 - RNA, 17 nt, Homo sapiens
gcauauguugaaccagu

SEQ ID NO: 149568 - RNA, 22 nt, Homo sapiens
gcauauuuuaaaguguaaccug

SEQ ID NO: 149569 - RNA, 22 nt, Homo sapiens
gcaugauuuuauaucuauguaa

SEQ ID NO: 149570 - RNA, 22 nt, Homo sapiens
gccaagauuuaauucaucaguu

SEQ ID NO: 149571 - RNA, 22 nt, Homo sapiens
gccccgggugaugcagccguca

SEQ ID NO: 149572 - RNA, 22 nt, Homo sapiens
gccuagagaguuaucaggcugu

SEQ ID NO: 149573 - RNA, 22 nt, Homo sapiens
gcgcagugggcugugccaucca

SEQ ID NO: 149574 - RNA, 19 nt, Homo sapiens
gcggcacuggagacacagc

SEQ ID NO: 149575 - RNA, 22 nt, Homo sapiens
gcgguagcauagacugcaggac

SEQ ID NO: 149576 - RNA, 22 nt, Homo sapiens
gcgugguguuagaaugagaagu

SEQ ID NO: 149577 - RNA, 22 nt, Homo sapiens
gcuaggagaucugcugcucucu

SEQ ID NO: 149578 - RNA, 19 nt, Homo sapiens
gcucaccuugcugcuccag

SEQ ID NO: 149579 - RNA, 22 nt, Homo sapiens
gcugcacuuuaaggcauccccu

SEQ ID NO: 149580 - RNA, 22 nt, Homo sapiens
gcugcuguaccagaugugguua

SEQ ID NO: 149581 - RNA, 22 nt, Homo sapiens
gcugcuguuuaguuucuccugg

SEQ ID NO: 149582 - RNA, 22 nt, Homo sapiens
gcugguguucaggcccucaguc

SEQ ID NO: 149583 - RNA, 22 nt, Homo sapiens
gcuguaguugaggauuuuaaga

SEQ ID NO: 149584 - RNA, 20 nt, Homo sapiens
gcugugcuuaauacacuuuc

SEQ ID NO: 149585 - RNA, 22 nt, Homo sapiens
gcuguugugaacuauacaucua

SEQ ID NO: 149586 - RNA, 22 nt, Homo sapiens
gcuuguguuuacuguaguuacu

SEQ ID NO: 149587 - RNA, 22 nt, Homo sapiens
gcuuugcaauggcauugaccau

SEQ ID NO: 149588 - RNA, 22 nt, Homo sapiens
gcuuuggcauguagauguaugg

SEQ ID NO: 149589 - RNA, 22 nt, Homo sapiens
ggaaaguaacccauucucuuac

SEQ ID NO: 149590 - RNA, 22 nt, Homo sapiens
ggaaaucaucauucucgguaua

SEQ ID NO: 149591 - RNA, 18 nt, Homo sapiens
uacugcacucuccagccu

SEQ ID NO: 149592 - RNA, 22 nt, Homo sapiens
uacugcugucagugccaaguag

SEQ ID NO: 149593 - RNA, 22 nt, Homo sapiens
uagaacauuccaggugauguug

SEQ ID NO: 149594 - RNA, 23 nt, Homo sapiens
uagaauguuuuuccauguuucuu

SEQ ID NO: 149595 - RNA, 18 nt, Homo sapiens
uagagcacaagcuuuggc

SEQ ID NO: 149596 - RNA, 22 nt, Homo sapiens
uagaggaaggauuggaaacgca

SEQ ID NO: 149597 - RNA, 22 nt, Homo sapiens
uagauaauuagaggguuuuaag

SEQ ID NO: 149598 - RNA, 22 nt, Homo sapiens
uagaucauauacuugccaugac

SEQ ID NO: 149599 - RNA, 22 nt, Homo sapiens
uagauucaucuguuccuuuuga

SEQ ID NO: 149600 - RNA, 22 nt, Homo sapiens
uagcacugucuugcaccugugc

SEQ ID NO: 149601 - RNA, 22 nt, Homo sapiens
uagcaucagauuccauauucua

SEQ ID NO: 149602 - RNA, 22 nt, Homo sapiens
uagcugcuguauguacacggau

SEQ ID NO: 149603 - RNA, 18 nt, Homo sapiens
uaggaacauugauuggag

SEQ ID NO: 149604 - RNA, 22 nt, Homo sapiens
uaggagugugaacccuaugaac

SEQ ID NO: 149605 - RNA, 22 nt, Homo sapiens
uagguagguggaaaaguaauug

SEQ ID NO: 149606 - RNA, 22 nt, Homo sapiens
uagugcugugauuaacauaaug

SEQ ID NO: 149607 - RNA, 22 nt, Homo sapiens
uaguuauggaguaauuuuaagc

SEQ ID NO: 149608 - RNA, 22 nt, Homo sapiens
uauaacaaugcaagaauggccu

SEQ ID NO: 149609 - RNA, 22 nt, Homo sapiens
uauacugucuuuguaugccuag

SEQ ID NO: 149610 - RNA, 22 nt, Homo sapiens
uauacuguuuucuauaguggcu

SEQ ID NO: 149611 - RNA, 21 nt, Homo sapiens
uauagcagcacgauuuauagu

SEQ ID NO: 149612 - RNA, 22 nt, Homo sapiens
uauagcaguguaagaaucgagu

SEQ ID NO: 149613 - RNA, 22 nt, Homo sapiens
uaucaaucuagggaaacuccaa

SEQ ID NO: 149614 - RNA, 22 nt, Homo sapiens
uaucacaguagaacucuuucca

SEQ ID NO: 149615 - RNA, 22 nt, Homo sapiens
uaucauugccucaaucuguauu

SEQ ID NO: 149616 - RNA, 21 nt, Homo sapiens
uaucccagucacaucuaccca

SEQ ID NO: 149617 - RNA, 22 nt, Homo sapiens
uaucccaguggauguaccccau

SEQ ID NO: 149618 - RNA, 22 nt, Homo sapiens
uaucuacauguagguauguaug

SEQ ID NO: 149619 - RNA, 22 nt, Homo sapiens
uaugaacacuuuugggaggcau

SEQ ID NO: 149620 - RNA, 22 nt, Homo sapiens
uaugagcacauauguaucuaug

SEQ ID NO: 149621 - RNA, 22 nt, Homo sapiens
uaugauuuuugggagaggucaa

SEQ ID NO: 149622 - RNA, 22 nt, Homo sapiens
uaugcacacacguguuuaugug

SEQ ID NO: 149623 - RNA, 22 nt, Homo sapiens
uaugcagacauuguuccaacca

SEQ ID NO: 149624 - RNA, 22 nt, Homo sapiens
uaugccuuugaccauuuuguga

SEQ ID NO: 149625 - RNA, 22 nt, Homo sapiens
uauggaaaucuuaccuuauggu

SEQ ID NO: 149626 - RNA, 22 nt, Homo sapiens
uauggauuuuuuugacaagagc

SEQ ID NO: 149627 - RNA, 22 nt, Homo sapiens
uauuacuguuauuccuaucaaa

SEQ ID NO: 149628 - RNA, 22 nt, Homo sapiens
uuuuuugguaauugaacaauga

SEQ ID NO: 149629 - RNA, 21 nt, Homo sapiens
uucuuugcucaguguuagagu

SEQ ID NO: 149630 - RNA, 22 nt, Homo sapiens
uugaaagucauuucuucuaagu

SEQ ID NO: 149631 - RNA, 22 nt, Homo sapiens
uugaacuagaaccugcaaauuu

SEQ ID NO: 149632 - RNA, 22 nt, Homo sapiens
uugaaguagaaagacgaaauuu

SEQ ID NO: 149633 - RNA, 22 nt, Homo sapiens
uugacagagaaaagugugacuu

SEQ ID NO: 149634 - RNA, 22 nt, Homo sapiens
uugacauaguuucugaaauaga

SEQ ID NO: 149635 - RNA, 22 nt, Homo sapiens
uugacauguaaguacucuauag

SEQ ID NO: 149636 - RNA, 22 nt, Homo sapiens
uugacuuuuauucacucugcua

SEQ ID NO: 149637 - RNA, 22 nt, Homo sapiens
uugagauaggaacucacuaugc

SEQ ID NO: 149638 - RNA, 22 nt, Homo sapiens
uugagauagggucuaccucugu

SEQ ID NO: 149639 - RNA, 22 nt, Homo sapiens
uugagaucaugcuacugcacuc

SEQ ID NO: 149640 - RNA, 22 nt, Homo sapiens
uugagauuuuccucaaauauuu

SEQ ID NO: 149641 - RNA, 22 nt, Homo sapiens
uugagcaaaacauuaauauuag

SEQ ID NO: 149642 - RNA, 22 nt, Homo sapiens
uugagcauugguauagguuuua

SEQ ID NO: 149643 - RNA, 22 nt, Homo sapiens
uugagcuuuuuacuuguccaau

SEQ ID NO: 149644 - RNA, 22 nt, Homo sapiens
uugaggaagugguuccccagag

SEQ ID NO: 149645 - RNA, 22 nt, Homo sapiens
uugaggccugauaacacacuga

SEQ ID NO: 149646 - RNA, 22 nt, Homo sapiens
uugaggguggcauauauugauu

SEQ ID NO: 149647 - RNA, 21 nt, Homo sapiens
uugaguugaagcaaggaggga

SEQ ID NO: 149648 - RNA, 22 nt, Homo sapiens
uugauauucugagaagcugaag

SEQ ID NO: 149649 - RNA, 22 nt, Homo sapiens
uugcaaagaccucuucacuucc

SEQ ID NO: 149650 - RNA, 22 nt, Homo sapiens
uugcaacuuagaaaaaucauuu

SEQ ID NO: 149651 - RNA, 22 nt, Homo sapiens
uugcacagucuagcuccaccuu

SEQ ID NO: 149652 - RNA, 22 nt, Homo sapiens
uugcacauugauuuuguauccu

SEQ ID NO: 149653 - RNA, 22 nt, Homo sapiens
uugcacuccagcucgggugaca

SEQ ID NO: 149654 - RNA, 22 nt, Homo sapiens
uugcagcaacauggaugaaacu

SEQ ID NO: 149655 - RNA, 22 nt, Homo sapiens
uugcagugguuucacuggcaaa

SEQ ID NO: 149656 - RNA, 22 nt, Homo sapiens
uggccuguaacccucucauagg

SEQ ID NO: 149657 - RNA, 18 nt, Homo sapiens
ugggaagaaauucuucuc

SEQ ID NO: 149658 - RNA, 22 nt, Homo sapiens
ugggaagaagguuuacuugcca

SEQ ID NO: 149659 - RNA, 22 nt, Homo sapiens
ugggcaaauugugagggaggua

SEQ ID NO: 149660 - RNA, 21 nt, Homo sapiens
ugggccccuuccuuacaucau

SEQ ID NO: 149661 - RNA, 22 nt, Homo sapiens
ugggccgcugcaggaugguccc

SEQ ID NO: 149662 - RNA, 22 nt, Homo sapiens
ugguucaguugcacaggcuguu

SEQ ID NO: 149663 - RNA, 21 nt, Homo sapiens
uguaacugcaaaccucagauu

SEQ ID NO: 149664 - RNA, 22 nt, Homo sapiens
uguagacagcacguaguugagu

SEQ ID NO: 149665 - RNA, 21 nt, Homo sapiens
uguagcagcaugauucauagu

SEQ ID NO: 149666 - RNA, 22 nt, Homo sapiens
uguagcagccauaaacacagug

SEQ ID NO: 149667 - RNA, 22 nt, Homo sapiens
uguauaacucacauugaaguuu

SEQ ID NO: 149668 - RNA, 23 nt, Homo sapiens
uguauacacccugugcaucuggg

SEQ ID NO: 149669 - RNA, 22 nt, Homo sapiens
uguauauguuuguacauauguc

SEQ ID NO: 149670 - RNA, 22 nt, Homo sapiens
uguauguaaagacaggauaaca

SEQ ID NO: 149671 - RNA, 22 nt, Homo sapiens
ugucacauccaagaaggugcag

SEQ ID NO: 149672 - RNA, 22 nt, Homo sapiens
uguccaaaucagagguaccaaa

SEQ ID NO: 149673 - RNA, 22 nt, Homo sapiens
uguccauuuuuaugcuuauggu

SEQ ID NO: 149674 - RNA, 22 nt, Homo sapiens
ugucccguuuucgaggcugcag

SEQ ID NO: 149675 - RNA, 22 nt, Homo sapiens
ugucucccuucccauuaggaag

SEQ ID NO: 149676 - RNA, 22 nt, Homo sapiens
ugucuggaaggguggccuccug

SEQ ID NO: 149677 - RNA, 22 nt, Homo sapiens
ugucuguuugcgaaauugcuuc

SEQ ID NO: 149678 - RNA, 22 nt, Homo sapiens
ugugaacacagaggcuauggca

SEQ ID NO: 149679 - RNA, 22 nt, Homo sapiens
ugugaacagaauuagucaccua

SEQ ID NO: 149680 - RNA, 22 nt, Homo sapiens
ugugaacaugacagugggcuag

SEQ ID NO: 149681 - RNA, 22 nt, Homo sapiens
ugugaagaaagucauugguagc

SEQ ID NO: 149682 - RNA, 22 nt, Homo sapiens
ugugaagaugagaugacgcccu

SEQ ID NO: 149683 - RNA, 22 nt, Homo sapiens
ugugaaugauggagugucgaau

SEQ ID NO: 149684 - RNA, 22 nt, Homo sapiens
ugugaugauuugauaaacguau

SEQ ID NO: 149685 - RNA, 22 nt, Homo sapiens
ugugcacaauguacagguuagu

SEQ ID NO: 149686 - RNA, 22 nt, Homo sapiens
ugugcacuggaccuugucuucu

SEQ ID NO: 149687 - RNA, 22 nt, Homo sapiens
ugugcaguuuugagugaauuuc

SEQ ID NO: 149688 - RNA, 22 nt, Homo sapiens
ugugcaugaaauuuaccuuuaa

SEQ ID NO: 149689 - RNA, 22 nt, Homo sapiens
ugugccacuccaaccuggguga

SEQ ID NO: 149690 - RNA, 22 nt, Homo sapiens
ugugcuugcuucuucuccuagu

SEQ ID NO: 149691 - RNA, 22 nt, Homo sapiens
uguggaaauggugcuacgaaca

SEQ ID NO: 149692 - RNA, 22 nt, Homo sapiens
uguggaaauuguuguauuuaau

SEQ ID NO: 149693 - RNA, 19 nt, Homo sapiens
uguggucauccugggacga

SEQ ID NO: 149694 - RNA, 22 nt, Homo sapiens
ugugucuugaauuuuguaugua

SEQ ID NO: 149695 - RNA, 22 nt, Homo sapiens
ugugucuuguuuauagcuuucu

SEQ ID NO: 149696 - RNA, 21 nt, Homo sapiens
uguuaacaugcagauuacugg

SEQ ID NO: 149697 - RNA, 22 nt, Homo sapiens
uguuaugaagaugccugguaca

SEQ ID NO: 149698 - RNA, 22 nt, Homo sapiens
uguuauugagguuacuuauaag

SEQ ID NO: 149699 - RNA, 22 nt, Homo sapiens
uguucuggagccgguucaaaug

SEQ ID NO: 149700 - RNA, 22 nt, Homo sapiens
uguuucuacugucucuguagua

SEQ ID NO: 149701 - RNA, 22 nt, Homo sapiens
uguuuuggaguggacuuugcau

SEQ ID NO: 149702 - RNA, 22 nt, Homo sapiens
uuaaagugaucauaaggauagu

SEQ ID NO: 149703 - RNA, 22 nt, Homo sapiens
uuaaagugcacacgggucaggc

SEQ ID NO: 149704 - RNA, 22 nt, Homo sapiens
uuaaaguguuugcagacaggug

SEQ ID NO: 149705 - RNA, 22 nt, Homo sapiens
uuaacagucacuuagcucauuu

SEQ ID NO: 149706 - RNA, 23 nt, Homo sapiens
uuaagcaacggcugcuuuucaga

SEQ ID NO: 149707 - RNA, 22 nt, Homo sapiens
uuaaggcuccuguuggcuuuua

SEQ ID NO: 149708 - RNA, 22 nt, Homo sapiens
uuaaggcuuucccuauguaaaa

SEQ ID NO: 149709 - RNA, 21 nt, Homo sapiens
uuaaguaauuacccaacucuc

SEQ ID NO: 149710 - RNA, 22 nt, Homo sapiens
uuaauacugcuuaacuuuagga

SEQ ID NO: 149711 - RNA, 22 nt, Homo sapiens
uuaaugcuuggggaguaguucu

SEQ ID NO: 149712 - RNA, 22 nt, Homo sapiens
uuaauuguaucuauagauguca

SEQ ID NO: 149713 - RNA, 22 nt, Homo sapiens
uuaauuguccaaguucaucucu

SEQ ID NO: 149714 - RNA, 21 nt, Homo sapiens
uuacaauggcuccuugaaggu

SEQ ID NO: 149715 - RNA, 19 nt, Homo sapiens
uuacacaaccuaguggggc

SEQ ID NO: 149716 - RNA, 17 nt, Homo sapiens
uuacaggugcugagagu

SEQ ID NO: 149717 - RNA, 22 nt, Homo sapiens
uuacaguugugagccaccaugc

SEQ ID NO: 149718 - RNA, 22 nt, Homo sapiens
uuagaaaguagaaaagcugguu

SEQ ID NO: 149719 - RNA, 22 nt, Homo sapiens
uuagaacuagaggaguuugagu

SEQ ID NO: 149720 - RNA, 17 nt, Homo sapiens
uuagagguagacucauu

SEQ ID NO: 149721 - RNA, 22 nt, Homo sapiens
uuagcacaguucauucauguua

SEQ ID NO: 149722 - RNA, 22 nt, Homo sapiens
uuagcagcucuggugacaaggu

SEQ ID NO: 149723 - RNA, 19 nt, Homo sapiens
uuauacuguauuguuuagg

SEQ ID NO: 149724 - RNA, 21 nt, Homo sapiens
uuauccagcacuguuucggac

SEQ ID NO: 149725 - RNA, 22 nt, Homo sapiens
uuaugccuauugugccuuggau

SEQ ID NO: 149726 - RNA, 22 nt, Homo sapiens
uuauucauuaacagggaccaaa

SEQ ID NO: 149727 - RNA, 22 nt, Homo sapiens
uuauuugguugcugacuuggaa

SEQ ID NO: 149728 - RNA, 23 nt, Homo sapiens
uucaaauguucucugguugucag

SEQ ID NO: 149729 - RNA, 22 nt, Homo sapiens
uucaaguguucaggagcuacag

SEQ ID NO: 149730 - RNA, 22 nt, Homo sapiens
uucacagacaacuggucccuua

SEQ ID NO: 149731 - RNA, 22 nt, Homo sapiens
uucacugcacuccagccugggu

SEQ ID NO: 149732 - RNA, 22 nt, Homo sapiens
uucaggcuccugugagaaucua

SEQ ID NO: 149733 - RNA, 22 nt, Homo sapiens
uucaguaaauguucuuacuaua

SEQ ID NO: 149734 - RNA, 18 nt, Homo sapiens
uucagugaauucuuuuga

SEQ ID NO: 149735 - RNA, 22 nt, Homo sapiens
uucagugguuauuugugagauu

SEQ ID NO: 149736 - RNA, 22 nt, Homo sapiens
uucaguucugcacugaucuuag

SEQ ID NO: 149737 - RNA, 22 nt, Homo sapiens
uucaguucugcucugaucuuag

SEQ ID NO: 149738 - RNA, 22 nt, Homo sapiens
uucauaguuuauacugauauuu

SEQ ID NO: 149739 - RNA, 18 nt, Homo sapiens
uucauauguugaaccaga

SEQ ID NO: 149740 - RNA, 20 nt, Homo sapiens
uucaugggagcaaagaggcc

SEQ ID NO: 149741 - RNA, 22 nt, Homo sapiens
uucauguaauauuucacagcuu

SEQ ID NO: 149742 - RNA, 22 nt, Homo sapiens
uucauguaauuccauaagguaa

SEQ ID NO: 149743 - RNA, 22 nt, Homo sapiens
uucauuggacuuguguucuuga

SEQ ID NO: 149744 - RNA, 22 nt, Homo sapiens
uuccacaggguugaacuaguuu

SEQ ID NO: 149745 - RNA, 22 nt, Homo sapiens
uuccaugugggcuugucaagua

SEQ ID NO: 149746 - RNA, 22 nt, Homo sapiens
uucccaguuggggaaagcgacc

SEQ ID NO: 149747 - RNA, 22 nt, Homo sapiens
uucccuuucugaaaaucucauu

SEQ ID NO: 149748 - RNA, 22 nt, Homo sapiens
uucccuuugugcauaggauuug

SEQ ID NO: 149749 - RNA, 22 nt, Homo sapiens
uuccguguaguugagcaguuuu

SEQ ID NO: 149750 - RNA, 22 nt, Homo sapiens
uuccuagagauuagcaagcugc

SEQ ID NO: 149751 - RNA, 22 nt, Homo sapiens
uucuagagagaagacuuaagcu

SEQ ID NO: 149752 - RNA, 22 nt, Homo sapiens
uucucaguuccuacuuugguga

SEQ ID NO: 149753 - RNA, 22 nt, Homo sapiens
uucugauggaguaguccacaga

SEQ ID NO: 149754 - RNA, 23 nt, Homo sapiens
uucugccacugaaaaugccucag

SEQ ID NO: 149755 - RNA, 19 nt, Homo sapiens
uucugguguuuuaagccaa

SEQ ID NO: 149756 - RNA, 20 nt, Homo sapiens
uucuugaguuaacaaguuac

SEQ ID NO: 149757 - RNA, 22 nt, Homo sapiens
uucuugguuggcaaccaacagu

SEQ ID NO: 149758 - RNA, 22 nt, Homo sapiens
ucugacagugugaauauugacu

SEQ ID NO: 149759 - RNA, 23 nt, Homo sapiens
ucugcggguguggacccuagugc

SEQ ID NO: 149760 - RNA, 22 nt, Homo sapiens
ucuggcacucagaggccuugcu

SEQ ID NO: 149761 - RNA, 21 nt, Homo sapiens
ucuggcccccucaaaucucau

SEQ ID NO: 149762 - RNA, 20 nt, Homo sapiens
ucuggccccucuaaaucuca

SEQ ID NO: 149763 - RNA, 22 nt, Homo sapiens
ucuggccccucucaaaucucau

SEQ ID NO: 149764 - RNA, 22 nt, Homo sapiens
ucuggcuuauuucacuuagcau

SEQ ID NO: 149765 - RNA, 22 nt, Homo sapiens
ucuggcuugugaacugucuucu

SEQ ID NO: 149766 - RNA, 22 nt, Homo sapiens
ucuguaacauccaccuucuggg

SEQ ID NO: 149767 - RNA, 22 nt, Homo sapiens
ucugugcugagaguugaaaguu

SEQ ID NO: 149768 - RNA, 22 nt, Homo sapiens
ucugugguucaggcuggagugc

SEQ ID NO: 149769 - RNA, 22 nt, Homo sapiens
ucuguuguuaucauaauauuga

SEQ ID NO: 149770 - RNA, 20 nt, Homo sapiens
ucuugggaauguagccuagg

SEQ ID NO: 149771 - RNA, 22 nt, Homo sapiens
ucuuugccuaacccaaggucau

SEQ ID NO: 149772 - RNA, 22 nt, Homo sapiens
ucuuuggguguauuucacagcc

SEQ ID NO: 149773 - RNA, 22 nt, Homo sapiens
ucuuuguuuucugauccugaag

SEQ ID NO: 149774 - RNA, 22 nt, Homo sapiens
ugaaacugcagugggcuuggca

SEQ ID NO: 149775 - RNA, 22 nt, Homo sapiens
ugaaagguuuaauucugugaga

SEQ ID NO: 149776 - RNA, 22 nt, Homo sapiens
ugaaauaguuaaguugccuagu

SEQ ID NO: 149777 - RNA, 22 nt, Homo sapiens
ugaaaucuuugaugguggcauu

SEQ ID NO: 149778 - RNA, 22 nt, Homo sapiens
ugaaauggaagaagucccuuuu

SEQ ID NO: 149779 - RNA, 22 nt, Homo sapiens
ugaaaugguuaugugaggagau

SEQ ID NO: 149780 - RNA, 22 nt, Homo sapiens
ugaaauuuuuuauucguuggcu

SEQ ID NO: 149781 - RNA, 21 nt, Homo sapiens
ugaaccccugcucucaagaaa

SEQ ID NO: 149782 - RNA, 22 nt, Homo sapiens
ugaaggcaggagggagaaaagu

SEQ ID NO: 149783 - RNA, 22 nt, Homo sapiens
ugaagggcauuguuuugccaaa

SEQ ID NO: 149784 - RNA, 22 nt, Homo sapiens
ugaauagacacuaaagacugua

SEQ ID NO: 149785 - RNA, 22 nt, Homo sapiens
ugaauauguuaaauaauguucu

SEQ ID NO: 149786 - RNA, 22 nt, Homo sapiens
ugaauauguuaauuagcaucau

SEQ ID NO: 149787 - RNA, 21 nt, Homo sapiens
ugaauauuuggguugugucca

SEQ ID NO: 149788 - RNA, 22 nt, Homo sapiens
ugaaucauuucuugucuucagu

SEQ ID NO: 149789 - RNA, 22 nt, Homo sapiens
ugaaugcauggggccaagaagg

SEQ ID NO: 149790 - RNA, 22 nt, Homo sapiens
ugacaagggaaaugcaaaaugu

SEQ ID NO: 149791 - RNA, 22 nt, Homo sapiens
ugacagagaagcauugaguuca

SEQ ID NO: 149792 - RNA, 20 nt, Homo sapiens
ugccugacacucuuugcuuc

SEQ ID NO: 149793 - RNA, 22 nt, Homo sapiens
ugcuaugucuucucucacagag

SEQ ID NO: 149794 - RNA, 20 nt, Homo sapiens
ugcugcacuuaagcaugggc

SEQ ID NO: 149795 - RNA, 21 nt, Homo sapiens
ugcugcacuucuuuugcugug

SEQ ID NO: 149796 - RNA, 22 nt, Homo sapiens
ugcuguuguuugaugaaguaau

SEQ ID NO: 149797 - RNA, 22 nt, Homo sapiens
uggaaauuaacagggauugucc

SEQ ID NO: 149798 - RNA, 22 nt, Homo sapiens
uggaacacaucuaaggaagcag

SEQ ID NO: 149799 - RNA, 22 nt, Homo sapiens
uggaagcauagcagcgugugug

SEQ ID NO: 149800 - RNA, 22 nt, Homo sapiens
uggaagcaugcaaucugugggg

SEQ ID NO: 149801 - RNA, 20 nt, Homo sapiens
uggaaggcaucugcauuauu

SEQ ID NO: 149802 - RNA, 21 nt, Homo sapiens
uggaaugaauggccaacaugg

SEQ ID NO: 149803 - RNA, 22 nt, Homo sapiens
uggacacugguggauauggaau

SEQ ID NO: 149804 - RNA, 21 nt, Homo sapiens
uggaccccuacuucucaccau

SEQ ID NO: 149805 - RNA, 22 nt, Homo sapiens
uggagagcaaagaauuuguuag

SEQ ID NO: 149806 - RNA, 19 nt, Homo sapiens
uggagauauccccuucaca

SEQ ID NO: 149807 - RNA, 20 nt, Homo sapiens
uggaggucaucugucacuac

SEQ ID NO: 149808 - RNA, 22 nt, Homo sapiens
uggagugcaauggcaccaucuu

SEQ ID NO: 149809 - RNA, 22 nt, Homo sapiens
uggaucuguucuauuuaucuga

SEQ ID NO: 149810 - RNA, 20 nt, Homo sapiens
uggauugugaugggauuugc

SEQ ID NO: 149811 - RNA, 22 nt, Homo sapiens
uggcaaaaaaacgcaauuacgu

SEQ ID NO: 149812 - RNA, 22 nt, Homo sapiens
uggcaaaugugagaugagaacu

SEQ ID NO: 149813 - RNA, 22 nt, Homo sapiens
uggcaagaacgaaauguagggu

SEQ ID NO: 149814 - RNA, 22 nt, Homo sapiens
uggcaagaacugcaauugcuuu

SEQ ID NO: 149815 - RNA, 22 nt, Homo sapiens
uggcaguuuugauguggagaga

SEQ ID NO: 149816 - RNA, 20 nt, Homo sapiens
uggcaugaaauuuuccaagc

SEQ ID NO: 149817 - RNA, 22 nt, Homo sapiens
uggcaugauccuagauucaaca

SEQ ID NO: 149818 - RNA, 22 nt, Homo sapiens
uggcgagaugcucgugugcaga

SEQ ID NO: 149819 - RNA, 22 nt, Homo sapiens
uggcuacagaaaguacuaguga

SEQ ID NO: 149820 - RNA, 20 nt, Homo sapiens
ugggaacaugugguauaugg

SEQ ID NO: 149821 - RNA, 22 nt, Homo sapiens
ugggaucaugagcaccgcuucc

SEQ ID NO: 149822 - RNA, 22 nt, Homo sapiens
ugggcaagagagcaugacccug

SEQ ID NO: 149823 - RNA, 20 nt, Homo sapiens
uggaaauuaaccuuucaggu

SEQ ID NO: 149824 - RNA, 22 nt, Homo sapiens
uggaaauuaagucuuuccugag

SEQ ID NO: 149825 - RNA, 23 nt, Homo sapiens
uggaacugaauuucuuagcauuu

SEQ ID NO: 149826 - RNA, 19 nt, Homo sapiens
uggaacugauucaguucug

SEQ ID NO: 149827 - RNA, 22 nt, Homo sapiens
uggaagauggaguuuuaucauu

SEQ ID NO: 149828 - RNA, 22 nt, Homo sapiens
uggaauacaugucgcugagcug

SEQ ID NO: 149829 - RNA, 22 nt, Homo sapiens
uggacagaaacauguuuucagu

SEQ ID NO: 149830 - RNA, 22 nt, Homo sapiens
uggacagacaagguuauagauc

SEQ ID NO: 149831 - RNA, 22 nt, Homo sapiens
uggacuguaauagagaacagaa

SEQ ID NO: 149832 - RNA, 22 nt, Homo sapiens
uggagagucauuuauaguauuu

SEQ ID NO: 149833 - RNA, 22 nt, Homo sapiens
uggagagugauaaguaaaugga

SEQ ID NO: 149834 - RNA, 22 nt, Homo sapiens
uggaggucauuggaucaugggg

SEQ ID NO: 149835 - RNA, 22 nt, Homo sapiens
uggauagauacuauccaggacu

SEQ ID NO: 149836 - RNA, 22 nt, Homo sapiens
uggauaguaaagucagauuccc

SEQ ID NO: 149837 - RNA, 22 nt, Homo sapiens
uggauauguuuauuacccugaa

SEQ ID NO: 149838 - RNA, 21 nt, Homo sapiens
uggcaacgaggugugcauuau

SEQ ID NO: 149839 - RNA, 23 nt, Homo sapiens
uggcaagaauucuuaccgugugg

SEQ ID NO: 149840 - RNA, 22 nt, Homo sapiens
uggcaagagggaugcaagguuu

SEQ ID NO: 149841 - RNA, 22 nt, Homo sapiens
uggcaagcuuuaauugacucuu

SEQ ID NO: 149842 - RNA, 20 nt, Homo sapiens
uggcaccugacagauagcca

SEQ ID NO: 149843 - RNA, 22 nt, Homo sapiens
uggcagacaaauuugagcauau

SEQ ID NO: 149844 - RNA, 22 nt, Homo sapiens
uggcagcgcaguugaaaaagaa

SEQ ID NO: 149845 - RNA, 22 nt, Homo sapiens
uggcaugucguuuuucauagga

SEQ ID NO: 149846 - RNA, 22 nt, Homo sapiens
uggcaugugugaagugcccagc

SEQ ID NO: 149847 - RNA, 22 nt, Homo sapiens
uggcuuucuggggcuucuguuc

SEQ ID NO: 149848 - RNA, 22 nt, Homo sapiens
uggcuuuuccuugaaucugccu

SEQ ID NO: 149849 - RNA, 22 nt, Homo sapiens
ugggaaacauccagcacauacu

SEQ ID NO: 149850 - RNA, 22 nt, Homo sapiens
ugggaagaugcugcuucuuccu

SEQ ID NO: 149851 - RNA, 22 nt, Homo sapiens
ugggaagauucuguguuuuucc

SEQ ID NO: 149852 - RNA, 22 nt, Homo sapiens
ugggaauaugauacaggucuuu

SEQ ID NO: 149853 - RNA, 22 nt, Homo sapiens
ugggaugaaaauagcuucuucc

SEQ ID NO: 149854 - RNA, 22 nt, Homo sapiens
ugggaugaugcuugagaauauc

SEQ ID NO: 149855 - RNA, 22 nt, Homo sapiens
uuuuuggauaaugguacaugua

SEQ ID NO: 149856 - RNA, 22 nt, Homo sapiens
uuuuuugcuguaugcaaacauc

SEQ ID NO: 149857 - RNA, 22 nt, Homo sapiens
aguguuuuucaugggauacuuu

SEQ ID NO: 149858 - RNA, 22 nt, Homo sapiens
auaaagccaugagcuugagaug

SEQ ID NO: 149859 - RNA, 22 nt, Homo sapiens
auaagauaguggaagugggauu

SEQ ID NO: 149860 - RNA, 22 nt, Homo sapiens
auaaugcuggaacuagagggca

SEQ ID NO: 149861 - RNA, 22 nt, Homo sapiens
auaauguuugauugagcagaua

SEQ ID NO: 149862 - RNA, 18 nt, Homo sapiens
auacaagcagcagagauu

SEQ ID NO: 149863 - RNA, 22 nt, Homo sapiens
auacacauuccugggccucacc

SEQ ID NO: 149864 - RNA, 22 nt, Homo sapiens
auacagugaauaucuggggcag

SEQ ID NO: 149865 - RNA, 22 nt, Homo sapiens
auagaauguauuaguaaauuug

SEQ ID NO: 149866 - RNA, 22 nt, Homo sapiens
auagcaaugccccacuccuugg

SEQ ID NO: 149867 - RNA, 22 nt, Homo sapiens
auagcaauuugggaaucagacu

SEQ ID NO: 149868 - RNA, 22 nt, Homo sapiens
auagugcugcaauaaccauggg

SEQ ID NO: 149869 - RNA, 22 nt, Homo sapiens
auauaugcacacgugugcauau

SEQ ID NO: 149870 - RNA, 17 nt, Homo sapiens
auaugaauuuuggagau

SEQ ID NO: 149871 - RNA, 22 nt, Homo sapiens
auauucaagugaggauggcuaa

SEQ ID NO: 149872 - RNA, 22 nt, Homo sapiens
auauuugguuaccugugggucu

SEQ ID NO: 149873 - RNA, 22 nt, Homo sapiens
aucaaagugaauuaaugagaau

SEQ ID NO: 149874 - RNA, 22 nt, Homo sapiens
aucaaaugcuggcagagugccu

SEQ ID NO: 149875 - RNA, 22 nt, Homo sapiens
aucacauggccagguaguaauc

SEQ ID NO: 149876 - RNA, 22 nt, Homo sapiens
aucacugggagcagccauuaau

SEQ ID NO: 149877 - RNA, 22 nt, Homo sapiens
aucacugggauggaacugcuga

SEQ ID NO: 149878 - RNA, 22 nt, Homo sapiens
aucacuuucuauuucugugcca

SEQ ID NO: 149879 - RNA, 22 nt, Homo sapiens
aucagaaucucuugagaguguu

SEQ ID NO: 149880 - RNA, 22 nt, Homo sapiens
aucagagugaugguuuaaguau

SEQ ID NO: 149881 - RNA, 23 nt, Homo sapiens
aucagauaguuguagguaugugg

SEQ ID NO: 149882 - RNA, 22 nt, Homo sapiens
aucauacuguuuugauuacugu

SEQ ID NO: 149883 - RNA, 22 nt, Homo sapiens
aucauaucauuggugaacagug

SEQ ID NO: 149884 - RNA, 22 nt, Homo sapiens
aucauguaguaagacacauuua

SEQ ID NO: 149885 - RNA, 22 nt, Homo sapiens
aucauuaguuguggaauucuug

SEQ ID NO: 149886 - RNA, 23 nt, Homo sapiens
auccacauucuaguccuuuaugc

SEQ ID NO: 149887 - RNA, 22 nt, Homo sapiens
aucccuuccuagcacuuggugu

SEQ ID NO: 149888 - RNA, 22 nt, Homo sapiens
aucuacagccagucugguuugu

SEQ ID NO: 149889 - RNA, 22 nt, Homo sapiens
aucucagagaaaauuacuaaga

SEQ ID NO: 149890 - RNA, 22 nt, Homo sapiens
aucucauggagguagagaguaa

SEQ ID NO: 149891 - RNA, 22 nt, Homo sapiens
aucugcaaagcugggcugagac

SEQ ID NO: 149892 - RNA, 22 nt, Homo sapiens
aucugguguuuuucucccucgu

SEQ ID NO: 149893 - RNA, 22 nt, Homo sapiens
aucuuugcugagaugcauggca

SEQ ID NO: 149894 - RNA, 22 nt, Homo sapiens
augaaaacaugauuugccuguu

SEQ ID NO: 149895 - RNA, 22 nt, Homo sapiens
augaaagguugucuuaagccau

SEQ ID NO: 149896 - RNA, 22 nt, Homo sapiens
augaaaguguguggaaacuuga

SEQ ID NO: 149897 - RNA, 22 nt, Homo sapiens
augaaaucuuuggcagaucuua

SEQ ID NO: 149898 - RNA, 18 nt, Homo sapiens
augaacucaucaguucuu

SEQ ID NO: 149899 - RNA, 22 nt, Homo sapiens
augaacucaucaucuagguuuu

SEQ ID NO: 149900 - RNA, 18 nt, Homo sapiens
augaacucaucauuuuua

SEQ ID NO: 149901 - RNA, 19 nt, Homo sapiens
augaacucauucuuuuuau

SEQ ID NO: 149902 - RNA, 22 nt, Homo sapiens
augaagucguuacuaccaauug

SEQ ID NO: 149903 - RNA, 22 nt, Homo sapiens
augaauguaaagaaugugggaa

SEQ ID NO: 149904 - RNA, 23 nt, Homo sapiens
augaauguaaagaaugugggaag

SEQ ID NO: 149905 - RNA, 22 nt, Homo sapiens
augaccagagagugcgcagggu

SEQ ID NO: 149906 - RNA, 17 nt, Homo sapiens
augacuucuucagugug

SEQ ID NO: 149907 - RNA, 22 nt, Homo sapiens
augagaauguaaguuaaugaaa

SEQ ID NO: 149908 - RNA, 22 nt, Homo sapiens
augagauuauguaaagagacca

SEQ ID NO: 149909 - RNA, 22 nt, Homo sapiens
augagcagaagagauacacugu

SEQ ID NO: 149910 - RNA, 22 nt, Homo sapiens
augagcagaugcuccugccucu

SEQ ID NO: 149911 - RNA, 22 nt, Homo sapiens
augagcuccucaaggucagaga

SEQ ID NO: 149912 - RNA, 22 nt, Homo sapiens
augagcuguuuggaagacacuu

SEQ ID NO: 149913 - RNA, 22 nt, Homo sapiens
augaggaaggagccuuugucug

SEQ ID NO: 149914 - RNA, 22 nt, Homo sapiens
augaggagguaugauuuucuga

SEQ ID NO: 149915 - RNA, 22 nt, Homo sapiens
augaggcuauaauuuuuaugua

SEQ ID NO: 149916 - RNA, 22 nt, Homo sapiens
augagggagggguggugccgca

SEQ ID NO: 149917 - RNA, 22 nt, Homo sapiens
augaugaaguaagugcuuagga

SEQ ID NO: 149918 - RNA, 20 nt, Homo sapiens
augcaaacccugcuuugugg

SEQ ID NO: 149919 - RNA, 22 nt, Homo sapiens
augcacuuggcaggaugauucc

SEQ ID NO: 149920 - RNA, 22 nt, Homo sapiens
augcaugucaaauuuguagguu

SEQ ID NO: 149921 - RNA, 22 nt, Homo sapiens
augccacugcacuccaaccugg

SEQ ID NO: 149922 - RNA, 22 nt, Homo sapiens
augccacugcacuucagccugc

SEQ ID NO: 149923 - RNA, 22 nt, Homo sapiens
augccacuguuuaugucacuua

SEQ ID NO: 149924 - RNA, 22 nt, Homo sapiens
augccagggagaauuguucaag

SEQ ID NO: 149925 - RNA, 22 nt, Homo sapiens
augcuggugguucacaugcgca

SEQ ID NO: 149926 - RNA, 19 nt, Homo sapiens
augcugguguugcucaaac

SEQ ID NO: 149927 - RNA, 21 nt, Homo sapiens
auggaaagacugccucuucaa

SEQ ID NO: 149928 - RNA, 22 nt, Homo sapiens
auggaaagcuguuccuacacaa

SEQ ID NO: 149929 - RNA, 22 nt, Homo sapiens
auggagaugugcgaacugagua

SEQ ID NO: 149930 - RNA, 22 nt, Homo sapiens
auggaguguggaacugggaauc

SEQ ID NO: 149931 - RNA, 22 nt, Homo sapiens
auggauaugcuuccaacugccu

SEQ ID NO: 149932 - RNA, 22 nt, Homo sapiens
auggcacuccagccugggcaac

SEQ ID NO: 149933 - RNA, 22 nt, Homo sapiens
auggcagaaucaagccgacagc

SEQ ID NO: 149934 - RNA, 22 nt, Homo sapiens
auggcaguuuauucuaaaucaa

SEQ ID NO: 149935 - RNA, 22 nt, Homo sapiens
auggcccccuguuugugaacau

SEQ ID NO: 149936 - RNA, 22 nt, Homo sapiens
auggcuuguuaugcauuaguac

SEQ ID NO: 149937 - RNA, 22 nt, Homo sapiens
auggcuuuaagagugucugaau

SEQ ID NO: 149938 - RNA, 22 nt, Homo sapiens
auggcuuuggucucccagugau

SEQ ID NO: 149939 - RNA, 22 nt, Homo sapiens
augggacugggugccguggagc

SEQ ID NO: 149940 - RNA, 22 nt, Homo sapiens
augggcaaauguuggaaauucc

SEQ ID NO: 149941 - RNA, 17 nt, Homo sapiens
augggguuguagcccca

SEQ ID NO: 149942 - RNA, 20 nt, Homo sapiens
augguaguagcaccuuuaca

SEQ ID NO: 149943 - RNA, 21 nt, Homo sapiens
auguaacugggaaugugagag

SEQ ID NO: 149944 - RNA, 22 nt, Homo sapiens
augucacagguccuagccaagu

SEQ ID NO: 149945 - RNA, 22 nt, Homo sapiens
augugcacaugcuuacauguga

SEQ ID NO: 149946 - RNA, 22 nt, Homo sapiens
augugcauaugaagcacagaca

SEQ ID NO: 149947 - RNA, 22 nt, Homo sapiens
augugcuuuuuaaacagaugcu

SEQ ID NO: 149948 - RNA, 22 nt, Homo sapiens
augugugcuugauguaaaaagu

SEQ ID NO: 149949 - RNA, 22 nt, Homo sapiens
augugugcuugugacacagccu

SEQ ID NO: 149950 - RNA, 22 nt, Homo sapiens
auguuugguaagaauauuguua

SEQ ID NO: 149951 - RNA, 23 nt, Homo sapiens
auuaagguuacuacaguaugagg

SEQ ID NO: 149952 - RNA, 22 nt, Homo sapiens
auuaagugaaugaaguuguucc

SEQ ID NO: 149953 - RNA, 22 nt, Homo sapiens
auuccaguuguaagguuuuuca

SEQ ID NO: 149954 - RNA, 22 nt, Homo sapiens
auuccaguuugugagaagcugu

SEQ ID NO: 149955 - RNA, 22 nt, Homo sapiens
auuccauuuguuaucacacccg

SEQ ID NO: 149956 - RNA, 22 nt, Homo sapiens
auucccuuggucaacggaugca

SEQ ID NO: 149957 - RNA, 22 nt, Homo sapiens
auugaacacagaguagcuuucc

SEQ ID NO: 149958 - RNA, 22 nt, Homo sapiens
auugaauuugguuugcuaagaa

SEQ ID NO: 149959 - RNA, 19 nt, Homo sapiens
cugcaugagacaguugguu

SEQ ID NO: 149960 - RNA, 22 nt, Homo sapiens
cugcauuugaugacguauggug

SEQ ID NO: 149961 - RNA, 22 nt, Homo sapiens
cugccugagaaaauggagggca

SEQ ID NO: 149962 - RNA, 22 nt, Homo sapiens
cuggaaaguagacaaucuaaaa

SEQ ID NO: 149963 - RNA, 22 nt, Homo sapiens
cuggaauuacaggguugagcua

SEQ ID NO: 149964 - RNA, 22 nt, Homo sapiens
cuggagauauuggaagaaagaa

SEQ ID NO: 149965 - RNA, 22 nt, Homo sapiens
cuggaguaugaaccauguauca

SEQ ID NO: 149966 - RNA, 22 nt, Homo sapiens
cuggaguuugaggcugcaguga

SEQ ID NO: 149967 - RNA, 22 nt, Homo sapiens
cuggauagagauugaugaugcu

SEQ ID NO: 149968 - RNA, 19 nt, Homo sapiens
cuggcaaaugcuuuggcca

SEQ ID NO: 149969 - RNA, 22 nt, Homo sapiens
cuggcacccuugcuuaggaaga

SEQ ID NO: 149970 - RNA, 22 nt, Homo sapiens
cugggcaaugcggcuggauaga

SEQ ID NO: 149971 - RNA, 22 nt, Homo sapiens
cugguaugcuucauaugcaaac

SEQ ID NO: 149972 - RNA, 22 nt, Homo sapiens
cuguagcuuuuauaugcuuagc

SEQ ID NO: 149973 - RNA, 22 nt, Homo sapiens
cuguaguuagcagaugaugaau

SEQ ID NO: 149974 - RNA, 22 nt, Homo sapiens
cuguaugugagaaauaauaagu

SEQ ID NO: 149975 - RNA, 22 nt, Homo sapiens
cugucacaguuuuggaggccag

SEQ ID NO: 149976 - RNA, 22 nt, Homo sapiens
cugugcacaucuggcggcccga

SEQ ID NO: 149977 - RNA, 22 nt, Homo sapiens
cugugcuuggagucccccuagg

SEQ ID NO: 149978 - RNA, 22 nt, Homo sapiens
cuguggguuuuacuguuuuacu

SEQ ID NO: 149979 - RNA, 22 nt, Homo sapiens
cuguugguuaaauuccaugcag

SEQ ID NO: 149980 - RNA, 22 nt, Homo sapiens
cuguuugguuaucuuuuccugu

SEQ ID NO: 149981 - RNA, 22 nt, Homo sapiens
cuguuuguuuaggguacucaga

SEQ ID NO: 149982 - RNA, 22 nt, Homo sapiens
cuuaaguaguuguggaaugaau

SEQ ID NO: 149983 - RNA, 22 nt, Homo sapiens
cuucaucugguuugugaacuuu

SEQ ID NO: 149984 - RNA, 22 nt, Homo sapiens
cuucuguuaguucugauaacuu

SEQ ID NO: 149985 - RNA, 22 nt, Homo sapiens
cuugagcauauucuauauuaaa

SEQ ID NO: 149986 - RNA, 20 nt, Homo sapiens
cuuggcuuucuugguguuaa

SEQ ID NO: 149987 - RNA, 22 nt, Homo sapiens
cuuguggugcuuuuacgugggc

SEQ ID NO: 149988 - RNA, 22 nt, Homo sapiens
cuuguucuccuaagaugaaugc

SEQ ID NO: 149989 - RNA, 22 nt, Homo sapiens
cuuugcacaucucugcuuuccc

SEQ ID NO: 149990 - RNA, 21 nt, Homo sapiens
cuuugguuucugacuugcaua

SEQ ID NO: 149991 - RNA, 22 nt, Homo sapiens
cuuugugugggccaagggcugg

SEQ ID NO: 149992 - RNA, 22 nt, Homo sapiens
cuuuuacacuguuggcaggauu

SEQ ID NO: 149993 - RNA, 22 nt, Homo sapiens
gaaaauccauccccagggagua

SEQ ID NO: 149994 - RNA, 22 nt, Homo sapiens
gaaaguaauuaacgauuguugc

SEQ ID NO: 149995 - RNA, 22 nt, Homo sapiens
gaaagugcugcaaggccaugca

SEQ ID NO: 149996 - RNA, 23 nt, Homo sapiens
gaaauguaagugaugccccacag

SEQ ID NO: 149997 - RNA, 22 nt, Homo sapiens
gaagcagcauucugguuuuugg

SEQ ID NO: 149998 - RNA, 22 nt, Homo sapiens
gaagguauauucuguuaaugcu

SEQ ID NO: 149999 - RNA, 22 nt, Homo sapiens
gaaguaauaaauggauucuuaa

SEQ ID NO: 150000 - RNA, 23 nt, Homo sapiens
gaaguaauaaauggauucuuaac

SEQ ID NO: 150001 - RNA, 22 nt, Homo sapiens
gaaguaggugcuguuauuaucu

SEQ ID NO: 150002 - RNA, 22 nt, Homo sapiens
gaagugcaguggcacagucaug

SEQ ID NO: 150003 - RNA, 22 nt, Homo sapiens
gaauagugcugcaaugaacaua

SEQ ID NO: 150004 - RNA, 22 nt, Homo sapiens
gaaucauuggguugauucaaga

SEQ ID NO: 150005 - RNA, 22 nt, Homo sapiens
gaaucauuguuucuaaguuugu

SEQ ID NO: 150006 - RNA, 20 nt, Homo sapiens
gaaugguuucgggguucuug

SEQ ID NO: 150007 - RNA, 22 nt, Homo sapiens
gaauucugucgcuuacuagaug

SEQ ID NO: 150008 - RNA, 22 nt, Homo sapiens
gaauuguacugcaaucagggga

SEQ ID NO: 150009 - RNA, 22 nt, Homo sapiens
gacagacacaauugauccauga

SEQ ID NO: 150010 - RNA, 22 nt, Homo sapiens
gacagugagaugucaugugaaa

SEQ ID NO: 150011 - RNA, 22 nt, Homo sapiens
gacauagagccuugacuucauu

SEQ ID NO: 150012 - RNA, 22 nt, Homo sapiens
gacuuugguagaggaaaaaucu

SEQ ID NO: 150013 - RNA, 22 nt, Homo sapiens
gagaacagaagcauuccuaauu

SEQ ID NO: 150014 - RNA, 22 nt, Homo sapiens
gagaacagagauaauuuuacuu

SEQ ID NO: 150015 - RNA, 20 nt, Homo sapiens
gagaacugagaugcguuuga

SEQ ID NO: 150016 - RNA, 22 nt, Homo sapiens
gagaaguaaauuuauuugcaaa

SEQ ID NO: 150017 - RNA, 22 nt, Homo sapiens
gagacugagucuugcucugucg

SEQ ID NO: 150018 - RNA, 22 nt, Homo sapiens
gagacugagucuugcuuuguca

SEQ ID NO: 150019 - RNA, 22 nt, Homo sapiens
gagacugaguuuugcucuuguu

SEQ ID NO: 150020 - RNA, 22 nt, Homo sapiens
gagcaaaaguauguauugguua

SEQ ID NO: 150021 - RNA, 22 nt, Homo sapiens
gagcacugaauacugugguggu

SEQ ID NO: 150022 - RNA, 22 nt, Homo sapiens
gagcagacaugaggaccgcugg

SEQ ID NO: 150023 - RNA, 22 nt, Homo sapiens
gagcaucaguggccucaucuca

SEQ ID NO: 150024 - RNA, 22 nt, Homo sapiens
gagcuacauggauagucugcau

SEQ ID NO: 150025 - RNA, 22 nt, Homo sapiens
gagcugaaguuuccauuuguac

SEQ ID NO: 150026 - RNA, 22 nt, Homo sapiens
gagcugguccuuuaaggaugca

SEQ ID NO: 150027 - RNA, 22 nt, Homo sapiens
gaggaaguagcuacugucuuuc

SEQ ID NO: 150028 - RNA, 22 nt, Homo sapiens
gaggagucagacugugcaaggu

SEQ ID NO: 150029 - RNA, 22 nt, Homo sapiens
gaggcagucugacccuuagcag

SEQ ID NO: 150030 - RNA, 22 nt, Homo sapiens
gaggcaguguguccguucucgg

SEQ ID NO: 150031 - RNA, 22 nt, Homo sapiens
gaggcuagauggggaugugucc

SEQ ID NO: 150032 - RNA, 22 nt, Homo sapiens
gagggcacugcuuuccuuucaa

SEQ ID NO: 150033 - RNA, 22 nt, Homo sapiens
gagguaggaggauugcuuaagg

SEQ ID NO: 150034 - RNA, 22 nt, Homo sapiens
gagguagugagcagcugaacua

SEQ ID NO: 150035 - RNA, 22 nt, Homo sapiens
gagguauggauaucuggagagg

SEQ ID NO: 150036 - RNA, 22 nt, Homo sapiens
gagguggauacauuaaauaaug

SEQ ID NO: 150037 - RNA, 18 nt, Homo sapiens
gagguuagguucugacag

SEQ ID NO: 150038 - RNA, 21 nt, Homo sapiens
gagugcaaauaaagagagggc

SEQ ID NO: 150039 - RNA, 22 nt, Homo sapiens
gagugcaauggcagaucuccgc

SEQ ID NO: 150040 - RNA, 22 nt, Homo sapiens
gagugcaauggcaugaucuugg

SEQ ID NO: 150041 - RNA, 22 nt, Homo sapiens
gaguucaaaucucagcucuguu

SEQ ID NO: 150042 - RNA, 22 nt, Homo sapiens
gauacuguauccuaaaagcuuu

SEQ ID NO: 150043 - RNA, 22 nt, Homo sapiens
gauauguacagcucucuaggau

SEQ ID NO: 150044 - RNA, 22 nt, Homo sapiens
gaucacauuguuucauacauau

SEQ ID NO: 150045 - RNA, 22 nt, Homo sapiens
gaugauguugaauguucucacc

SEQ ID NO: 150046 - RNA, 22 nt, Homo sapiens
gaugcaguaagaaugcauagcg

SEQ ID NO: 150047 - RNA, 22 nt, Homo sapiens
gaugguuuuucuccgauuuaua

SEQ ID NO: 150048 - RNA, 20 nt, Homo sapiens
gcaaauggaucccacaagcc

SEQ ID NO: 150049 - RNA, 22 nt, Homo sapiens
gcacauauguaaauagcugccu

SEQ ID NO: 150050 - RNA, 22 nt, Homo sapiens
gcaccguggaguauggggagga

SEQ ID NO: 150051 - RNA, 22 nt, Homo sapiens
gcacgcauuguccuucuaguca

SEQ ID NO: 150052 - RNA, 22 nt, Homo sapiens
gcagcacauggcagaacauauu

SEQ ID NO: 150053 - RNA, 22 nt, Homo sapiens
gcagugcaugacgguauauaua

SEQ ID NO: 150054 - RNA, 17 nt, Homo sapiens
gcauauguugaaccagc

SEQ ID NO: 150055 - RNA, 22 nt, Homo sapiens
gcauggagaaggggacugauuc

SEQ ID NO: 150056 - RNA, 22 nt, Homo sapiens
gcauggaguggaaauucuuggg

SEQ ID NO: 150057 - RNA, 22 nt, Homo sapiens
gccaagaugcugcccacagaca

SEQ ID NO: 150058 - RNA, 22 nt, Homo sapiens
gccucaguuguggccagggauu

SEQ ID NO: 150059 - RNA, 17 nt, Homo sapiens
gcugcauucauguagaa

SEQ ID NO: 150060 - RNA, 22 nt, Homo sapiens
gcugcuguuucucuuucagcau

SEQ ID NO: 150061 - RNA, 22 nt, Homo sapiens
uaaauggauaaaugaauaccua

SEQ ID NO: 150062 - RNA, 22 nt, Homo sapiens
uaacaccuuugauagcacuuuu

SEQ ID NO: 150063 - RNA, 22 nt, Homo sapiens
uaacauucacaugcugcaaaaa

SEQ ID NO: 150064 - RNA, 22 nt, Homo sapiens
uaacuccauuuggacucaguau

SEQ ID NO: 150065 - RNA, 22 nt, Homo sapiens
uaacuucaucauaagucaagaa

SEQ ID NO: 150066 - RNA, 16 nt, Homo sapiens
uaagccccacgugcau

SEQ ID NO: 150067 - RNA, 21 nt, Homo sapiens
uaagcuaaacauucaguuaac

SEQ ID NO: 150068 - RNA, 22 nt, Homo sapiens
uaaggcuuugucuuaggacuuu

SEQ ID NO: 150069 - RNA, 22 nt, Homo sapiens
uaagggcaugcugcaugagagu

SEQ ID NO: 150070 - RNA, 22 nt, Homo sapiens
uaaguaauugugguuuuugcca

SEQ ID NO: 150071 - RNA, 22 nt, Homo sapiens
uaaguaauuguuaauagggaag

SEQ ID NO: 150072 - RNA, 22 nt, Homo sapiens
uaaguagaggaaucauuuugug

SEQ ID NO: 150073 - RNA, 22 nt, Homo sapiens
uaaguagugugcauguauguau

SEQ ID NO: 150074 - RNA, 20 nt, Homo sapiens
uaagugcuugagacuucuga

SEQ ID NO: 150075 - RNA, 18 nt, Homo sapiens
uaagugcuuuaaacacau

SEQ ID NO: 150076 - RNA, 18 nt, Homo sapiens
uaauaacugugaccuuga

SEQ ID NO: 150077 - RNA, 22 nt, Homo sapiens
uaaucucagcuacucaggaggc

SEQ ID NO: 150078 - RNA, 22 nt, Homo sapiens
uaauucuguauguaucagaguu

SEQ ID NO: 150079 - RNA, 22 nt, Homo sapiens
uaauugcaguucuguguuauau

SEQ ID NO: 150080 - RNA, 22 nt, Homo sapiens
uacaaguauuuuuauuagugcc

SEQ ID NO: 150081 - RNA, 20 nt, Homo sapiens
uacacguguagcauucucua

SEQ ID NO: 150082 - RNA, 22 nt, Homo sapiens
uacaggugcuuauguggacaua

SEQ ID NO: 150083 - RNA, 19 nt, Homo sapiens
uacccagaagcagcauugu

SEQ ID NO: 150084 - RNA, 22 nt, Homo sapiens
uaccucaguucaauaacagaua

SEQ ID NO: 150085 - RNA, 22 nt, Homo sapiens
uaccugagcccucugcugaguu

SEQ ID NO: 150086 - RNA, 23 nt, Homo sapiens
uacuaguaagcguguucuuugca

SEQ ID NO: 150087 - RNA, 22 nt, Homo sapiens
uacugagagaggaauauugaaa

SEQ ID NO: 150088 - RNA, 22 nt, Homo sapiens
uacugcacuggaggccucagau

SEQ ID NO: 150089 - RNA, 22 nt, Homo sapiens
uacugcacuugaccuccugggc

SEQ ID NO: 150090 - RNA, 22 nt, Homo sapiens
uacugguuuuggugggcaggug

SEQ ID NO: 150091 - RNA, 22 nt, Homo sapiens
uagaaagcaugaccuucagaua

SEQ ID NO: 150092 - RNA, 22 nt, Homo sapiens
uagaaucuaacucgcaugaaaa

SEQ ID NO: 150093 - RNA, 22 nt, Homo sapiens
uagagcacagugauuagaccua

SEQ ID NO: 150094 - RNA, 22 nt, Homo sapiens
uagagcacauuaucauuuccaa

SEQ ID NO: 150095 - RNA, 22 nt, Homo sapiens
uagagguagguguaugaacuag

SEQ ID NO: 150096 - RNA, 23 nt, Homo sapiens
uagaucaucaaguuuacugugcu

SEQ ID NO: 150097 - RNA, 22 nt, Homo sapiens
uagauuaucccugauuugucca

SEQ ID NO: 150098 - RNA, 22 nt, Homo sapiens
uagcacaucccuaaaaugcugu

SEQ ID NO: 150099 - RNA, 22 nt, Homo sapiens
uagcacuaucuauugcaugcaa

SEQ ID NO: 150100 - RNA, 22 nt, Homo sapiens
uagcagcaccccacucuacugg

SEQ ID NO: 150101 - RNA, 19 nt, Homo sapiens
uagcagcaugauuuauaau

SEQ ID NO: 150102 - RNA, 22 nt, Homo sapiens
uagcagcuuuauugagguaaau

SEQ ID NO: 150103 - RNA, 22 nt, Homo sapiens
uagcagguggugaccacauuuu

SEQ ID NO: 150104 - RNA, 20 nt, Homo sapiens
uagcaggugucaggugauau

SEQ ID NO: 150105 - RNA, 22 nt, Homo sapiens
uagcagugugaaaacagacuaa

SEQ ID NO: 150106 - RNA, 22 nt, Homo sapiens
uagcagugugaaaacggacuaa

SEQ ID NO: 150107 - RNA, 22 nt, Homo sapiens
uagcaguucauuguugugugaa

SEQ ID NO: 150108 - RNA, 22 nt, Homo sapiens
uagcaugucagucgccacacgu

SEQ ID NO: 150109 - RNA, 21 nt, Homo sapiens
uagcugaugauguaggggaug

SEQ ID NO: 150110 - RNA, 22 nt, Homo sapiens
uagcugauguuugucuaguagc

SEQ ID NO: 150111 - RNA, 22 nt, Homo sapiens
uaggacacagaccuggauggaa

SEQ ID NO: 150112 - RNA, 22 nt, Homo sapiens
uaggcaguuuuccuuucacagu

SEQ ID NO: 150113 - RNA, 22 nt, Homo sapiens
uagggcaaggaacaguuaaaaa

SEQ ID NO: 150114 - RNA, 19 nt, Homo sapiens
uagggcacgaggcagaguc

SEQ ID NO: 150115 - RNA, 22 nt, Homo sapiens
uaggggcacacuucgguuagca

SEQ ID NO: 150116 - RNA, 22 nt, Homo sapiens
uaggucaguuuuggcuuggcuu

SEQ ID NO: 150117 - RNA, 22 nt, Homo sapiens
uaguaacacauugaacgaucgc

SEQ ID NO: 150118 - RNA, 22 nt, Homo sapiens
uaguaucacaagguguacaccc

SEQ ID NO: 150119 - RNA, 22 nt, Homo sapiens
uagugcuguaauucuaaugaaa

SEQ ID NO: 150120 - RNA, 18 nt, Homo sapiens
uagugcuguucucaugau

SEQ ID NO: 150121 - RNA, 22 nt, Homo sapiens
uaguggucccccagucccagcu

SEQ ID NO: 150122 - RNA, 20 nt, Homo sapiens
uauagcaauuuuuuucuccu

SEQ ID NO: 150123 - RNA, 21 nt, Homo sapiens
uaucacauuggugauuaaguu

SEQ ID NO: 150124 - RNA, 21 nt, Homo sapiens
uaucagagacauugagaggca

SEQ ID NO: 150125 - RNA, 22 nt, Homo sapiens
uaucauggaaagauguugaaau

SEQ ID NO: 150126 - RNA, 21 nt, Homo sapiens
uaucauggccauccucuucuc

SEQ ID NO: 150127 - RNA, 22 nt, Homo sapiens
uaucaugggggguguacacucc

SEQ ID NO: 150128 - RNA, 21 nt, Homo sapiens
uaucauggugaaacccugucu

SEQ ID NO: 150129 - RNA, 22 nt, Homo sapiens
uaucaugucuguguguaccuag

SEQ ID NO: 150130 - RNA, 23 nt, Homo sapiens
uaucucaaugcacagagaggaaa

SEQ ID NO: 150131 - RNA, 22 nt, Homo sapiens
uaucucuuuucauguguaaaug

SEQ ID NO: 150132 - RNA, 22 nt, Homo sapiens
uaugaaagcuacuucucacaau

SEQ ID NO: 150133 - RNA, 22 nt, Homo sapiens
uaugaagccaggauuuauuauu

SEQ ID NO: 150134 - RNA, 22 nt, Homo sapiens
uaugaaucugagagaucuggaa

SEQ ID NO: 150135 - RNA, 20 nt, Homo sapiens
uaugacaaagccuagugagu

SEQ ID NO: 150136 - RNA, 22 nt, Homo sapiens
uaugacugagacuuaaauugug

SEQ ID NO: 150137 - RNA, 22 nt, Homo sapiens
uaugagagcugguagguagaga

SEQ ID NO: 150138 - RNA, 22 nt, Homo sapiens
uaugcacacguguccaugugca

SEQ ID NO: 150139 - RNA, 22 nt, Homo sapiens
uaugcacaugcaugcuugaaua

SEQ ID NO: 150140 - RNA, 22 nt, Homo sapiens
uaugcuguuucugauuuaggga

SEQ ID NO: 150141 - RNA, 21 nt, Homo sapiens
uauggauuugccuauucugga

SEQ ID NO: 150142 - RNA, 22 nt, Homo sapiens
uauggcuauggcuguggcuaug

SEQ ID NO: 150143 - RNA, 22 nt, Homo sapiens
uauggguauuuuauacauaacc

SEQ ID NO: 150144 - RNA, 22 nt, Homo sapiens
uaugguuuuaagguuaaggacu

SEQ ID NO: 150145 - RNA, 22 nt, Homo sapiens
uauucacaggugugggacaaag

SEQ ID NO: 150146 - RNA, 22 nt, Homo sapiens
uauuugcacucccaucauggug

SEQ ID NO: 150147 - RNA, 22 nt, Homo sapiens
uauuugguagcuauuuugcagu

SEQ ID NO: 150148 - RNA, 22 nt, Homo sapiens
uauuugguuacuugaauagcua

SEQ ID NO: 150149 - RNA, 22 nt, Homo sapiens
uauuugguuauaugaguaaguu

SEQ ID NO: 150150 - RNA, 20 nt, Homo sapiens
ucaaaguaugcucugcacua

SEQ ID NO: 150151 - RNA, 22 nt, Homo sapiens
ucaaagugagcuccuucucacu

SEQ ID NO: 150152 - RNA, 22 nt, Homo sapiens
ucaagaccucacauagaggaga

SEQ ID NO: 150153 - RNA, 22 nt, Homo sapiens
ucaagcaauucuccugccucag

SEQ ID NO: 150154 - RNA, 19 nt, Homo sapiens
ucaagcuauucuccugccu

SEQ ID NO: 150155 - RNA, 22 nt, Homo sapiens
ucaaugggcuacacauugagug

SEQ ID NO: 150156 - RNA, 22 nt, Homo sapiens
ucacacugaauuugaagcaaug

SEQ ID NO: 150157 - RNA, 22 nt, Homo sapiens
ucacagcuaaaaugaaaguagu

SEQ ID NO: 150158 - RNA, 23 nt, Homo sapiens
ucacaguggcugcuuaauuguga

SEQ ID NO: 150159 - RNA, 22 nt, Homo sapiens
ucacaguguuaaaccuuucuuu

SEQ ID NO: 150160 - RNA, 22 nt, Homo sapiens
ucacauagcauaaugucugcaa

SEQ ID NO: 150161 - RNA, 22 nt, Homo sapiens
ucacaucucagguuucuugaca

SEQ ID NO: 150162 - RNA, 22 nt, Homo sapiens
ucacauggggaagggacuagcu

SEQ ID NO: 150163 - RNA, 22 nt, Homo sapiens
ugagaucugucuuuauaguauu

SEQ ID NO: 150164 - RNA, 22 nt, Homo sapiens
ugagaucuucgcucuucacaga

SEQ ID NO: 150165 - RNA, 19 nt, Homo sapiens
ugagaucuuuacuggguuu

SEQ ID NO: 150166 - RNA, 22 nt, Homo sapiens
ugagaugaagugauguaaaaca

SEQ ID NO: 150167 - RNA, 22 nt, Homo sapiens
ugagaugacgacacaccucagu

SEQ ID NO: 150168 - RNA, 22 nt, Homo sapiens
ugagaugauaucuuauuguaau

SEQ ID NO: 150169 - RNA, 22 nt, Homo sapiens
ugagaugugaucaccugaaggg

SEQ ID NO: 150170 - RNA, 22 nt, Homo sapiens
ugagcacagcgugugggagagc

SEQ ID NO: 150171 - RNA, 22 nt, Homo sapiens
ugagcacaggugcgcgguuacu

SEQ ID NO: 150172 - RNA, 22 nt, Homo sapiens
ugagcagaaagcugcaaggucg

SEQ ID NO: 150173 - RNA, 22 nt, Homo sapiens
ugagccaugggguaaaugugau

SEQ ID NO: 150174 - RNA, 22 nt, Homo sapiens
ugagcuauguucuucuuguuuu

SEQ ID NO: 150175 - RNA, 20 nt, Homo sapiens
ugagcucaugacauuuuucu

SEQ ID NO: 150176 - RNA, 22 nt, Homo sapiens
ugagcugagaucaugcuauugu

SEQ ID NO: 150177 - RNA, 22 nt, Homo sapiens
ugagcugagaucgugccauugu

SEQ ID NO: 150178 - RNA, 22 nt, Homo sapiens
ugagcugagaucuuaccacugc

SEQ ID NO: 150179 - RNA, 20 nt, Homo sapiens
ugagcuuguaaacacuguuu

SEQ ID NO: 150180 - RNA, 22 nt, Homo sapiens
ugaggauaguguugaaggcagg

SEQ ID NO: 150181 - RNA, 22 nt, Homo sapiens
ugagguaagauguucauuuuuc

SEQ ID NO: 150182 - RNA, 22 nt, Homo sapiens
ugagguaugugaugucuuuuag

SEQ ID NO: 150183 - RNA, 22 nt, Homo sapiens
ugagguuguccacuauaaucca

SEQ ID NO: 150184 - RNA, 22 nt, Homo sapiens
ugagucuguucucacauugcua

SEQ ID NO: 150185 - RNA, 22 nt, Homo sapiens
ugaguggagacuguguguagag

SEQ ID NO: 150186 - RNA, 22 nt, Homo sapiens
ugagugugaggaagaauuagaa

SEQ ID NO: 150187 - RNA, 22 nt, Homo sapiens
ugauagaucugggcaaaguaaa

SEQ ID NO: 150188 - RNA, 20 nt, Homo sapiens
ugauauuucuggaaguggag

SEQ ID NO: 150189 - RNA, 22 nt, Homo sapiens
ugaucuuuuuaauguccauggg

SEQ ID NO: 150190 - RNA, 22 nt, Homo sapiens
ugauuagagcccaagcuuugaa

SEQ ID NO: 150191 - RNA, 22 nt, Homo sapiens
ugcaacacauugccccugcucu

SEQ ID NO: 150192 - RNA, 22 nt, Homo sapiens
ugcaagacacuguccugggcau

SEQ ID NO: 150193 - RNA, 22 nt, Homo sapiens
ugcaagauaggcaguuugcacu

SEQ ID NO: 150194 - RNA, 18 nt, Homo sapiens
ugcaauggagaugcagcc

SEQ ID NO: 150195 - RNA, 23 nt, Homo sapiens
ugcauaguacccaauacuuuauc

SEQ ID NO: 150196 - RNA, 18 nt, Homo sapiens
ugcauauguugaaccagc

SEQ ID NO: 150197 - RNA, 22 nt, Homo sapiens
ugcauauucuaggauuuuguau

SEQ ID NO: 150198 - RNA, 21 nt, Homo sapiens
ugcauauuggaacuuucucuc

SEQ ID NO: 150199 - RNA, 22 nt, Homo sapiens
ugccaacaugccuggcuguuuu

SEQ ID NO: 150200 - RNA, 22 nt, Homo sapiens
ugccaugaagaucccugaaaug

SEQ ID NO: 150201 - RNA, 22 nt, Homo sapiens
ugcccuuugucagaugaguagg

SEQ ID NO: 150202 - RNA, 22 nt, Homo sapiens
ugccuagaaacacuauuucucc

SEQ ID NO: 150203 - RNA, 22 nt, Homo sapiens
ugcugcacaguucuuaagauua

SEQ ID NO: 150204 - RNA, 19 nt, Homo sapiens
ugcugcauugugaccuugc

SEQ ID NO: 150205 - RNA, 22 nt, Homo sapiens
ugcuuugguagaaaucuuuggu

SEQ ID NO: 150206 - RNA, 22 nt, Homo sapiens
uggaaaguacuugaguuuguau

SEQ ID NO: 150207 - RNA, 22 nt, Homo sapiens
uggaaaguccaagccaaccggg

SEQ ID NO: 150208 - RNA, 22 nt, Homo sapiens
uggaacugauauugauggaaaa

SEQ ID NO: 150209 - RNA, 22 nt, Homo sapiens
uggaagccuagauucuuuucuu

SEQ ID NO: 150210 - RNA, 20 nt, Homo sapiens
uggaagccuggugcuaucuu

SEQ ID NO: 150211 - RNA, 22 nt, Homo sapiens
uggaaggcuucauauguaaaga

SEQ ID NO: 150212 - RNA, 22 nt, Homo sapiens
uggaagucuucauuauguauag

SEQ ID NO: 150213 - RNA, 22 nt, Homo sapiens
uggaaucaucaacgaaugaaau

SEQ ID NO: 150214 - RNA, 22 nt, Homo sapiens
uggaaucuagagaaaugcaaac

SEQ ID NO: 150215 - RNA, 21 nt, Homo sapiens
uggaaucuauagaggcaguag

SEQ ID NO: 150216 - RNA, 20 nt, Homo sapiens
uggaaucugaagaucucagu

SEQ ID NO: 150217 - RNA, 22 nt, Homo sapiens
uggaauuuacuuauuuaggggc

SEQ ID NO: 150218 - RNA, 22 nt, Homo sapiens
uggacacuggagauucgucagu

SEQ ID NO: 150219 - RNA, 19 nt, Homo sapiens
uggaccccuuccuuacacc

SEQ ID NO: 150220 - RNA, 22 nt, Homo sapiens
uggagagcaaaaucaauccaaa

SEQ ID NO: 150221 - RNA, 22 nt, Homo sapiens
uggagagugagggccuccuuaa

SEQ ID NO: 150222 - RNA, 22 nt, Homo sapiens
uggaguguuggggcaggaucuc

SEQ ID NO: 150223 - RNA, 21 nt, Homo sapiens
uggaugccuaggcagaaguuu

SEQ ID NO: 150224 - RNA, 22 nt, Homo sapiens
uggauggagaggcuugugaugc

SEQ ID NO: 150225 - RNA, 22 nt, Homo sapiens
uggcaaaauauuuugguuucug

SEQ ID NO: 150226 - RNA, 22 nt, Homo sapiens
uggcaaaauggaauauguuggg

SEQ ID NO: 150227 - RNA, 22 nt, Homo sapiens
uggcaaauagcaauaggagggu

SEQ ID NO: 150228 - RNA, 22 nt, Homo sapiens
uggcaaauauuuuguuuuguaa

SEQ ID NO: 150229 - RNA, 22 nt, Homo sapiens
uggcaagagcaaaauguacagu

SEQ ID NO: 150230 - RNA, 22 nt, Homo sapiens
uggcaucuguucuacacauaaa

SEQ ID NO: 150231 - RNA, 22 nt, Homo sapiens
uggcauguuggguguugacucc

SEQ ID NO: 150232 - RNA, 22 nt, Homo sapiens
uggccaagagcacagauauugg

SEQ ID NO: 150233 - RNA, 23 nt, Homo sapiens
uggccaagauaaucucaguuuuc

SEQ ID NO: 150234 - RNA, 18 nt, Homo sapiens
uggccaauggcaaacaga

SEQ ID NO: 150235 - RNA, 22 nt, Homo sapiens
uggccuguaacgcugucucagc

SEQ ID NO: 150236 - RNA, 22 nt, Homo sapiens
uggcuugauggcacaagguuuc

SEQ ID NO: 150237 - RNA, 22 nt, Homo sapiens
ugggaaauguagccuagcugug

SEQ ID NO: 150238 - RNA, 22 nt, Homo sapiens
ugggaacaugaagguuaaagag

SEQ ID NO: 150239 - RNA, 22 nt, Homo sapiens
ugggaagagggagcgauuuugg

SEQ ID NO: 150240 - RNA, 22 nt, Homo sapiens
ugggaagcugcauuuuaacaag

SEQ ID NO: 150241 - RNA, 22 nt, Homo sapiens
ugggaccccuacucuuuccaca

SEQ ID NO: 150242 - RNA, 22 nt, Homo sapiens
ugggaugaauacaaugggauca

SEQ ID NO: 150243 - RNA, 22 nt, Homo sapiens
ugggaugaugaaaaggcuuucu

SEQ ID NO: 150244 - RNA, 22 nt, Homo sapiens
ugggguaggcuguauacucugu

SEQ ID NO: 150245 - RNA, 22 nt, Homo sapiens
uggguccccuacucuuuccaca

SEQ ID NO: 150246 - RNA, 20 nt, Homo sapiens
ugguccccugagucuggcuu

SEQ ID NO: 150247 - RNA, 22 nt, Homo sapiens
ugguccucugcuuccagaauuc

SEQ ID NO: 150248 - RNA, 22 nt, Homo sapiens
uggucuccuuuguacccugggc

SEQ ID NO: 150249 - RNA, 22 nt, Homo sapiens
uguaaaaagcccagccgcugag

SEQ ID NO: 150250 - RNA, 22 nt, Homo sapiens
uguaaaucuauuuuuaguguuu

SEQ ID NO: 150251 - RNA, 22 nt, Homo sapiens
uguagcaaauaaaagucuggau

SEQ ID NO: 150252 - RNA, 21 nt, Homo sapiens
uguagcagcauaauuuauaau

SEQ ID NO: 150253 - RNA, 22 nt, Homo sapiens
uguaugagagugaaagcauuuc

SEQ ID NO: 150254 - RNA, 22 nt, Homo sapiens
uguauguuguaagacuuagacc

SEQ ID NO: 150255 - RNA, 22 nt, Homo sapiens
ugucaggaggguccagagaaaa

SEQ ID NO: 150256 - RNA, 22 nt, Homo sapiens
ugucaggaguuuuagaaucuua

SEQ ID NO: 150257 - RNA, 22 nt, Homo sapiens
ugucaucauuugagagaagaaa

SEQ ID NO: 150258 - RNA, 16 nt, Homo sapiens
uguccaaauaaauaca

SEQ ID NO: 150259 - RNA, 21 nt, Homo sapiens
uguccagcuuuuggaauauaa

SEQ ID NO: 150260 - RNA, 22 nt, Homo sapiens
ugucucaguuucuguggguuag

SEQ ID NO: 150261 - RNA, 22 nt, Homo sapiens
ugugaacagcuccaaaugugga

SEQ ID NO: 150262 - RNA, 22 nt, Homo sapiens
ugugaacauuuuguauauauua

SEQ ID NO: 150263 - RNA, 19 nt, Homo sapiens
ugugaagaaaugcugcaag

SEQ ID NO: 150264 - RNA, 22 nt, Homo sapiens
ugugaauggugcugccgugaag

SEQ ID NO: 150265 - RNA, 22 nt, Homo sapiens
ugugaauguaagaaaauccaac

SEQ ID NO: 150266 - RNA, 18 nt, Homo sapiens
ugugacauugagcauguc

SEQ ID NO: 150267 - RNA, 22 nt, Homo sapiens
ugugagaucucagaauugaacu

SEQ ID NO: 150268 - RNA, 22 nt, Homo sapiens
ugugaucaaccugcagggcugg

SEQ ID NO: 150269 - RNA, 22 nt, Homo sapiens
ugugaucaugugugccuuaguc

SEQ ID NO: 150270 - RNA, 22 nt, Homo sapiens
ugugaugaagaguccaagaaca

SEQ ID NO: 150271 - RNA, 22 nt, Homo sapiens
ugugaugaaggcauagggaugu

SEQ ID NO: 150272 - RNA, 22 nt, Homo sapiens
ugugcacauugugcagguugau

SEQ ID NO: 150273 - RNA, 22 nt, Homo sapiens
ugugcaccucuucacacaggga

SEQ ID NO: 150274 - RNA, 22 nt, Homo sapiens
ugugccacugcacucuggccug

SEQ ID NO: 150275 - RNA, 22 nt, Homo sapiens
uguggaaauaaaagaaagguua

SEQ ID NO: 150276 - RNA, 22 nt, Homo sapiens
uguggcauugaauaaccuugga

SEQ ID NO: 150277 - RNA, 22 nt, Homo sapiens
ugugguuuuucacauuuagaga

SEQ ID NO: 150278 - RNA, 22 nt, Homo sapiens
uguguaaauaugauagaggaau

SEQ ID NO: 150279 - RNA, 22 nt, Homo sapiens
ugugucuuguuuuuucccaggc

SEQ ID NO: 150280 - RNA, 22 nt, Homo sapiens
ugugucuuuuaucacacaaugu

SEQ ID NO: 150281 - RNA, 22 nt, Homo sapiens
uguuauuuuguguuagggcaca

SEQ ID NO: 150282 - RNA, 22 nt, Homo sapiens
uguuggacuuacuuggcagauu

SEQ ID NO: 150283 - RNA, 18 nt, Homo sapiens
uguugguguucacucacu

SEQ ID NO: 150284 - RNA, 22 nt, Homo sapiens
uguuuuggagguccucacuaga

SEQ ID NO: 150285 - RNA, 22 nt, Homo sapiens
uguuuugguugucccuggccag

SEQ ID NO: 150286 - RNA, 22 nt, Homo sapiens
uuaaagugcuguuuuugccggg

SEQ ID NO: 150287 - RNA, 22 nt, Homo sapiens
uuaaaguguuuucaaaauguca

SEQ ID NO: 150288 - RNA, 21 nt, Homo sapiens
uuaacagacaagugucuuccc

SEQ ID NO: 150289 - RNA, 22 nt, Homo sapiens
uuaacagugucaaucuguagua

SEQ ID NO: 150290 - RNA, 22 nt, Homo sapiens
uuaagcaaagguaacaugagaa

SEQ ID NO: 150291 - RNA, 22 nt, Homo sapiens
uuaaggcauucuuugucuucau

SEQ ID NO: 150292 - RNA, 22 nt, Homo sapiens
uuaagguaugugggcauuuugu

SEQ ID NO: 150293 - RNA, 22 nt, Homo sapiens
uuaauccugccuuauuucagua

SEQ ID NO: 150294 - RNA, 22 nt, Homo sapiens
uuacagauggauggcagcuggc

SEQ ID NO: 150295 - RNA, 22 nt, Homo sapiens
uuacagauggcacacucaaggg

SEQ ID NO: 150296 - RNA, 22 nt, Homo sapiens
uuacaugagacugucgcuaguu

SEQ ID NO: 150297 - RNA, 22 nt, Homo sapiens
uuaccacagugccugucuaaug

SEQ ID NO: 150298 - RNA, 22 nt, Homo sapiens
uuacugcauaauuccugggaag

SEQ ID NO: 150299 - RNA, 22 nt, Homo sapiens
uuacuguagugucauaucguau

SEQ ID NO: 150300 - RNA, 22 nt, Homo sapiens
uuaugcaucuuccacacucauu

SEQ ID NO: 150301 - RNA, 22 nt, Homo sapiens
uuaugcuguuuucuggagauuu

SEQ ID NO: 150302 - RNA, 22 nt, Homo sapiens
uucaacugcuucagccucccaa

SEQ ID NO: 150303 - RNA, 22 nt, Homo sapiens
uucaagauggccccagugagcc

SEQ ID NO: 150304 - RNA, 22 nt, Homo sapiens
uucaagucuuggcuuugccacc

SEQ ID NO: 150305 - RNA, 20 nt, Homo sapiens
uucaagugauucucaugccu

SEQ ID NO: 150306 - RNA, 22 nt, Homo sapiens
uucacaauuaaaugugguuauu

SEQ ID NO: 150307 - RNA, 22 nt, Homo sapiens
uucacaguguuucucacgguua

SEQ ID NO: 150308 - RNA, 22 nt, Homo sapiens
uucacugcaugaaaaggacagc

SEQ ID NO: 150309 - RNA, 22 nt, Homo sapiens
uucacugcauuucagccugggc

SEQ ID NO: 150310 - RNA, 22 nt, Homo sapiens
uucacugugcuuaaauucugcu

SEQ ID NO: 150311 - RNA, 22 nt, Homo sapiens
uucagcaggccaggcccugacu

SEQ ID NO: 150312 - RNA, 22 nt, Homo sapiens
uucaggcuccgugccagcuccg

SEQ ID NO: 150313 - RNA, 22 nt, Homo sapiens
uucauacaguggcugcacucca

SEQ ID NO: 150314 - RNA, 23 nt, Homo sapiens
uucaucagggauauuggccugaa

SEQ ID NO: 150315 - RNA, 22 nt, Homo sapiens
uucauccccuccaaaucucaug

SEQ ID NO: 150316 - RNA, 22 nt, Homo sapiens
uucaucuggcaauucagagauu

SEQ ID NO: 150317 - RNA, 22 nt, Homo sapiens
uucaugcaucuguagugguuaa

SEQ ID NO: 150318 - RNA, 22 nt, Homo sapiens
uucauggaauauugaccauuuu

SEQ ID NO: 150319 - RNA, 22 nt, Homo sapiens
uucauggauggaaaugauuuug

SEQ ID NO: 150320 - RNA, 22 nt, Homo sapiens
uucauggugguacaaaagcaau

SEQ ID NO: 150321 - RNA, 22 nt, Homo sapiens
uucauguaauauauuucaggcc

SEQ ID NO: 150322 - RNA, 22 nt, Homo sapiens
uucaugucuuggcuguuagagu

SEQ ID NO: 150323 - RNA, 22 nt, Homo sapiens
uucauuggauguuacacugugu

SEQ ID NO: 150324 - RNA, 22 nt, Homo sapiens
uuccaagugggaaacaaaaaug

SEQ ID NO: 150325 - RNA, 22 nt, Homo sapiens
uuccacuuuuuccuugugcucc

SEQ ID NO: 150326 - RNA, 22 nt, Homo sapiens
uuccauguaguugagcaguuuu

SEQ ID NO: 150327 - RNA, 22 nt, Homo sapiens
uucccagagaaaaggguuucuu

SEQ ID NO: 150328 - RNA, 22 nt, Homo sapiens
uucccagagccugggagugagg

SEQ ID NO: 150329 - RNA, 22 nt, Homo sapiens
uucccagucaaacgaaggacuu

SEQ ID NO: 150330 - RNA, 22 nt, Homo sapiens
uuccugagccuuguaucuagua

SEQ ID NO: 150331 - RNA, 22 nt, Homo sapiens
uucuauguuguuagacccacca

SEQ ID NO: 150332 - RNA, 22 nt, Homo sapiens
uucucaauggcaacuuguugcu

SEQ ID NO: 150333 - RNA, 22 nt, Homo sapiens
uucucacaguacagggagcucu

SEQ ID NO: 150334 - RNA, 21 nt, Homo sapiens
uucucagaggcaggggauaaa

SEQ ID NO: 150335 - RNA, 22 nt, Homo sapiens
uucugccaaucaacccacaucc

SEQ ID NO: 150336 - RNA, 22 nt, Homo sapiens
uucuggaaaucagcagagggug

SEQ ID NO: 150337 - RNA, 22 nt, Homo sapiens
uucuggcucaggucaacacuuc

SEQ ID NO: 150338 - RNA, 22 nt, Homo sapiens
uucuuaguggcaccacuuuuuu

SEQ ID NO: 150339 - RNA, 22 nt, Homo sapiens
uugaaagacagaggggcaaguu

SEQ ID NO: 150340 - RNA, 22 nt, Homo sapiens
uugaaaguaaacaucacaaaga

SEQ ID NO: 150341 - RNA, 22 nt, Homo sapiens
uugaaaguguucacaaugguau

SEQ ID NO: 150342 - RNA, 22 nt, Homo sapiens
uugaaguaguacuuuauuauag

SEQ ID NO: 150343 - RNA, 22 nt, Homo sapiens
uugaauguaugcuggguuuacu

SEQ ID NO: 150344 - RNA, 22 nt, Homo sapiens
uugacaaugcacugugcuaagu

SEQ ID NO: 150345 - RNA, 22 nt, Homo sapiens
uugacagaccuuggucauaucc

SEQ ID NO: 150346 - RNA, 22 nt, Homo sapiens
uugagaugaagucuugcucucu

SEQ ID NO: 150347 - RNA, 22 nt, Homo sapiens
uugagaugaaguuuugcucuuu

SEQ ID NO: 150348 - RNA, 22 nt, Homo sapiens
uugagauggagucucacgcauu

SEQ ID NO: 150349 - RNA, 22 nt, Homo sapiens
uugagauggagucuugcucucu

SEQ ID NO: 150350 - RNA, 22 nt, Homo sapiens
uugagauggagucuugcucugu

SEQ ID NO: 150351 - RNA, 22 nt, Homo sapiens
uugagauggaguguugcucugu

SEQ ID NO: 150352 - RNA, 22 nt, Homo sapiens
uugagauguggguuggugacuu

SEQ ID NO: 150353 - RNA, 22 nt, Homo sapiens
uugagcaaugaacgauucaggg

SEQ ID NO: 150354 - RNA, 22 nt, Homo sapiens
uugagcaaugucacugaggcuu

SEQ ID NO: 150355 - RNA, 22 nt, Homo sapiens
uugagcaucauguuagcacuca

SEQ ID NO: 150356 - RNA, 22 nt, Homo sapiens
uugaggacugagacagaccaag

SEQ ID NO: 150357 - RNA, 22 nt, Homo sapiens
uugaggcuuuugaccucaugug

SEQ ID NO: 150358 - RNA, 22 nt, Homo sapiens
uugaucaauagaauacaacaga

SEQ ID NO: 150359 - RNA, 22 nt, Homo sapiens
uugcaacauuguaaguuuauau

SEQ ID NO: 150360 - RNA, 20 nt, Homo sapiens
uugcacagagaaggaggcag

SEQ ID NO: 150361 - RNA, 22 nt, Homo sapiens
uugcacauggcaggugcucaau

SEQ ID NO: 150362 - RNA, 22 nt, Homo sapiens
uugcacauguugaaccagcaaa

SEQ ID NO: 150363 - RNA, 22 nt, Homo sapiens
uugcacauugauuuuguaucuu

SEQ ID NO: 150364 - RNA, 22 nt, Homo sapiens
uugcacuccagucuggggggca

SEQ ID NO: 150365 - RNA, 22 nt, Homo sapiens
uugcacuccggccuggguaaca

SEQ ID NO: 150366 - RNA, 22 nt, Homo sapiens
uugcacugagauuuugcuuaca

SEQ ID NO: 150367 - RNA, 22 nt, Homo sapiens
aaccuauaguauugaaaucaag

SEQ ID NO: 150368 - RNA, 22 nt, Homo sapiens
aaccugaagaaaauauuugcug

SEQ ID NO: 150369 - RNA, 22 nt, Homo sapiens
aacuggcauagccagacuucuc

SEQ ID NO: 150370 - RNA, 22 nt, Homo sapiens
aacuggcauguuuuaaggcuua

SEQ ID NO: 150371 - RNA, 22 nt, Homo sapiens
aacuugcacuugauugagagcu

SEQ ID NO: 150372 - RNA, 20 nt, Homo sapiens
aagacacuguccccacugga

SEQ ID NO: 150373 - RNA, 22 nt, Homo sapiens
aagagaacugacaguaccuggg

SEQ ID NO: 150374 - RNA, 18 nt, Homo sapiens
aagagcucagcacagguu

SEQ ID NO: 150375 - RNA, 22 nt, Homo sapiens
aagagcucauccauaguuguca

SEQ ID NO: 150376 - RNA, 22 nt, Homo sapiens
aagagguaauaacaaagcuucu

SEQ ID NO: 150377 - RNA, 22 nt, Homo sapiens
aagcaucauuuggaauuugaga

SEQ ID NO: 150378 - RNA, 23 nt, Homo sapiens
aagcaugcacagcuguuuguggu

SEQ ID NO: 150379 - RNA, 22 nt, Homo sapiens
aagcaugguuuccaggggucac

SEQ ID NO: 150380 - RNA, 22 nt, Homo sapiens
aagcuggagugcaguggugcga

SEQ ID NO: 150381 - RNA, 22 nt, Homo sapiens
aagcuggauuuaguguggagca

SEQ ID NO: 150382 - RNA, 22 nt, Homo sapiens
aagcuggauuucgcauccuguu

SEQ ID NO: 150383 - RNA, 22 nt, Homo sapiens
aagcuggcuuucauugagugcu

SEQ ID NO: 150384 - RNA, 22 nt, Homo sapiens
aaggaacuggaauauuuugaac

SEQ ID NO: 150385 - RNA, 22 nt, Homo sapiens
aaggaauucaaauuuucucugg

SEQ ID NO: 150386 - RNA, 22 nt, Homo sapiens
aaggaguauugaaugaccaagu

SEQ ID NO: 150387 - RNA, 22 nt, Homo sapiens
aaggcaagaaugcgugcuuuca

SEQ ID NO: 150388 - RNA, 22 nt, Homo sapiens
aaggcaagauacugguugcuga

SEQ ID NO: 150389 - RNA, 22 nt, Homo sapiens
aaggcagucacuaaauagugag

SEQ ID NO: 150390 - RNA, 22 nt, Homo sapiens
aaggcaguggcagaagauguca

SEQ ID NO: 150391 - RNA, 22 nt, Homo sapiens
aaggcaugcugaguccuaaaag

SEQ ID NO: 150392 - RNA, 22 nt, Homo sapiens
aaggcauggugacuauuuaggc

SEQ ID NO: 150393 - RNA, 22 nt, Homo sapiens
aaggcuagagaagaagggcauc

SEQ ID NO: 150394 - RNA, 20 nt, Homo sapiens
aaggcuuucgaguuccaggg

SEQ ID NO: 150395 - RNA, 22 nt, Homo sapiens
aagguacuggaaagaggaaugg

SEQ ID NO: 150396 - RNA, 22 nt, Homo sapiens
aagguauuuuugucuauaucuu

SEQ ID NO: 150397 - RNA, 22 nt, Homo sapiens
aagguucuugcuugcaugacug

SEQ ID NO: 150398 - RNA, 22 nt, Homo sapiens
aaguaaacauugagagacaaga

SEQ ID NO: 150399 - RNA, 22 nt, Homo sapiens
aaguacuguuuaaauugcagaa

SEQ ID NO: 150400 - RNA, 22 nt, Homo sapiens
aagucauggagaagguggaggu

SEQ ID NO: 150401 - RNA, 22 nt, Homo sapiens
aagucauggaggaguaugugag

SEQ ID NO: 150402 - RNA, 20 nt, Homo sapiens
aagugcaucguugugucugc

SEQ ID NO: 150403 - RNA, 22 nt, Homo sapiens
aagugcuguaugggagccuagg

SEQ ID NO: 150404 - RNA, 22 nt, Homo sapiens
aagugcuucagaagacaauauu

SEQ ID NO: 150405 - RNA, 22 nt, Homo sapiens
aagugcuuuacacaugcaugau

SEQ ID NO: 150406 - RNA, 22 nt, Homo sapiens
aauaaagucugaagugugcuua

SEQ ID NO: 150407 - RNA, 22 nt, Homo sapiens
aauaagcugagagaauucuaca

SEQ ID NO: 150408 - RNA, 22 nt, Homo sapiens
aauacagcacacagaugggucu

SEQ ID NO: 150409 - RNA, 22 nt, Homo sapiens
aauaucacaguggguguacacc

SEQ ID NO: 150410 - RNA, 23 nt, Homo sapiens
aauaucacaguggguguacaccc

SEQ ID NO: 150411 - RNA, 22 nt, Homo sapiens
aaucacagccagcuuccgcuau

SEQ ID NO: 150412 - RNA, 21 nt, Homo sapiens
aaucacaguuguucugccuuc

SEQ ID NO: 150413 - RNA, 22 nt, Homo sapiens
aaucacuuuggcaccaaccuaa

SEQ ID NO: 150414 - RNA, 22 nt, Homo sapiens
aaucccuuuguccagucucuuu

SEQ ID NO: 150415 - RNA, 22 nt, Homo sapiens
aaucucaacacuuugggaggcu

SEQ ID NO: 150416 - RNA, 22 nt, Homo sapiens
aaucucagcauuuugggcugag

SEQ ID NO: 150417 - RNA, 22 nt, Homo sapiens
aaugacagccagauucuucucu

SEQ ID NO: 150418 - RNA, 22 nt, Homo sapiens
aaugacagugcuaaagaacccu

SEQ ID NO: 150419 - RNA, 22 nt, Homo sapiens
aaugcaucuagaaaggugaauu

SEQ ID NO: 150420 - RNA, 22 nt, Homo sapiens
aauggcagaugaaauugucauu

SEQ ID NO: 150421 - RNA, 22 nt, Homo sapiens
aauggcauuugccagggcaaag

SEQ ID NO: 150422 - RNA, 22 nt, Homo sapiens
aauggcucuguuggcccaagac

SEQ ID NO: 150423 - RNA, 22 nt, Homo sapiens
aaugguguuuccguuaagcuga

SEQ ID NO: 150424 - RNA, 22 nt, Homo sapiens
aaugugcacuuggagccuugcu

SEQ ID NO: 150425 - RNA, 22 nt, Homo sapiens
aaugugcuucuggcugugguca

SEQ ID NO: 150426 - RNA, 22 nt, Homo sapiens
aaugugcuuugaaaagagcuga

SEQ ID NO: 150427 - RNA, 22 nt, Homo sapiens
acaaaguguuuucugaaggccu

SEQ ID NO: 150428 - RNA, 23 nt, Homo sapiens
acacaguaaacuaaaagcuagcu

SEQ ID NO: 150429 - RNA, 22 nt, Homo sapiens
acacaguauaugacaaugcuuu

SEQ ID NO: 150430 - RNA, 22 nt, Homo sapiens
acacaugugcguagacucuuua

SEQ ID NO: 150431 - RNA, 22 nt, Homo sapiens
acaccaucuccuuauuucucuu

SEQ ID NO: 150432 - RNA, 22 nt, Homo sapiens
acacuauugagguuuguuugca

SEQ ID NO: 150433 - RNA, 20 nt, Homo sapiens
acacuggaguaucaaggccc

SEQ ID NO: 150434 - RNA, 22 nt, Homo sapiens
acacuguaacucuuugagggca

SEQ ID NO: 150435 - RNA, 22 nt, Homo sapiens
acacugucucuugcugaccaug

SEQ ID NO: 150436 - RNA, 22 nt, Homo sapiens
acacuguuuuguggagaaugua

SEQ ID NO: 150437 - RNA, 22 nt, Homo sapiens
acacuugcuugcaauagccucc

SEQ ID NO: 150438 - RNA, 22 nt, Homo sapiens
acagaauucucagaacugggag

SEQ ID NO: 150439 - RNA, 22 nt, Homo sapiens
acagaccuauuucaaucauuua

SEQ ID NO: 150440 - RNA, 22 nt, Homo sapiens
acagaucagagauauuuagguu

SEQ ID NO: 150441 - RNA, 22 nt, Homo sapiens
acagcacugccaagugacccau

SEQ ID NO: 150442 - RNA, 22 nt, Homo sapiens
acagguacacagaauauccaga

SEQ ID NO: 150443 - RNA, 22 nt, Homo sapiens
acaguaaugggccccuuuuccu

SEQ ID NO: 150444 - RNA, 22 nt, Homo sapiens
acaguacuguuguuugcugcca

SEQ ID NO: 150445 - RNA, 22 nt, Homo sapiens
acaguagugggcuacagaauca

SEQ ID NO: 150446 - RNA, 22 nt, Homo sapiens
acagucauagcagccuuuguua

SEQ ID NO: 150447 - RNA, 22 nt, Homo sapiens
acagugucugacacguaggaag

SEQ ID NO: 150448 - RNA, 18 nt, Homo sapiens
acagugucuuacaccugu

SEQ ID NO: 150449 - RNA, 22 nt, Homo sapiens
acaucauugggggcuacaggug

SEQ ID NO: 150450 - RNA, 18 nt, Homo sapiens
acaucccaugcuggggug

SEQ ID NO: 150451 - RNA, 22 nt, Homo sapiens
acaugacauugggguggggaua

SEQ ID NO: 150452 - RNA, 22 nt, Homo sapiens
acauggcacugcgggcuucuug

SEQ ID NO: 150453 - RNA, 22 nt, Homo sapiens
acauucagcuguuguuucaaug

SEQ ID NO: 150454 - RNA, 22 nt, Homo sapiens
acauugcucuuaccaaguuugu

SEQ ID NO: 150455 - RNA, 22 nt, Homo sapiens
accacagugcuuccugcucacg

SEQ ID NO: 150456 - RNA, 19 nt, Homo sapiens
accagauugcauucuugga

SEQ ID NO: 150457 - RNA, 17 nt, Homo sapiens
accagugcaugugcuuu

SEQ ID NO: 150458 - RNA, 22 nt, Homo sapiens
acccagaagucauucaggaaca

SEQ ID NO: 150459 - RNA, 22 nt, Homo sapiens
acccagaguuccuugucuuuca

SEQ ID NO: 150460 - RNA, 22 nt, Homo sapiens
accccugagaucgaaucaugcu

SEQ ID NO: 150461 - RNA, 22 nt, Homo sapiens
accccugugacggguauuugag

SEQ ID NO: 150462 - RNA, 22 nt, Homo sapiens
acccuggauucguggccuugaa

SEQ ID NO: 150463 - RNA, 22 nt, Homo sapiens
acccugucauccacauggugcu

SEQ ID NO: 150464 - RNA, 19 nt, Homo sapiens
acccuguccccaccuuuac

SEQ ID NO: 150465 - RNA, 22 nt, Homo sapiens
acccuguugguggaucagauug

SEQ ID NO: 150466 - RNA, 23 nt, Homo sapiens
accugauguuucuguggggagcc

SEQ ID NO: 150467 - RNA, 22 nt, Homo sapiens
accuggacacuuugggcuccuc

SEQ ID NO: 150468 - RNA, 18 nt, Homo sapiens
accuucauuccuuugccu

SEQ ID NO: 150469 - RNA, 22 nt, Homo sapiens
acuacuucuaaguuuuggaaga

SEQ ID NO: 150470 - RNA, 22 nt, Homo sapiens
acuauacugaagcaaauuaaca

SEQ ID NO: 150471 - RNA, 22 nt, Homo sapiens
acuccacuuucaccacagcgga

SEQ ID NO: 150472 - RNA, 21 nt, Homo sapiens
acugagagaucuggggcacau

SEQ ID NO: 150473 - RNA, 19 nt, Homo sapiens
acugagcuaccugggggca

SEQ ID NO: 150474 - RNA, 21 nt, Homo sapiens
acugcacuccaaccucaacag

SEQ ID NO: 150475 - RNA, 22 nt, Homo sapiens
acugcacuccagccuaggcgac

SEQ ID NO: 150476 - RNA, 22 nt, Homo sapiens
acugcacuccagccuccugggu

SEQ ID NO: 150477 - RNA, 22 nt, Homo sapiens
acugcacuccagccugcuggca

SEQ ID NO: 150478 - RNA, 22 nt, Homo sapiens
acugcacuccagccuggacgac

SEQ ID NO: 150479 - RNA, 22 nt, Homo sapiens
acugcacuccagccuggcggac

SEQ ID NO: 150480 - RNA, 22 nt, Homo sapiens
acugcacuccagccuuggagac

SEQ ID NO: 150481 - RNA, 20 nt, Homo sapiens
acugcacuccaggcugccca

SEQ ID NO: 150482 - RNA, 20 nt, Homo sapiens
acugcacuucagccugcugg

SEQ ID NO: 150483 - RNA, 22 nt, Homo sapiens
acugcacuucagccuguugaca

SEQ ID NO: 150484 - RNA, 22 nt, Homo sapiens
acugcauuugucugucucaauu

SEQ ID NO: 150485 - RNA, 22 nt, Homo sapiens
acuggcaauggcagaaauaguu

SEQ ID NO: 150486 - RNA, 22 nt, Homo sapiens
acuggcuguuaggaauuaccuc

SEQ ID NO: 150487 - RNA, 22 nt, Homo sapiens
acugguguaugggaggucccaa

SEQ ID NO: 150488 - RNA, 19 nt, Homo sapiens
acuguacuccagucugggc

SEQ ID NO: 150489 - RNA, 22 nt, Homo sapiens
acuucauucucuggaucagaau

SEQ ID NO: 150490 - RNA, 22 nt, Homo sapiens
acuugacacuuauauuacucac

SEQ ID NO: 150491 - RNA, 22 nt, Homo sapiens
acuuugcuuaucccaggcacug

SEQ ID NO: 150492 - RNA, 19 nt, Homo sapiens
acuuuggugauuagaggga

SEQ ID NO: 150493 - RNA, 17 nt, Homo sapiens
acuuuuugaggaggcau

SEQ ID NO: 150494 - RNA, 22 nt, Homo sapiens
acuuuuugauggggagaacauu

SEQ ID NO: 150495 - RNA, 22 nt, Homo sapiens
agaacccuuugaaauguguuug

SEQ ID NO: 150496 - RNA, 22 nt, Homo sapiens
agaagacuauucuggguugggc

SEQ ID NO: 150497 - RNA, 22 nt, Homo sapiens
agaaugucaguauuggcuaaaa

SEQ ID NO: 150498 - RNA, 22 nt, Homo sapiens
agacacuguugaaaaggcccca

SEQ ID NO: 150499 - RNA, 20 nt, Homo sapiens
agacagcugcagcccacauc

SEQ ID NO: 150500 - RNA, 22 nt, Homo sapiens
agacagcuggaguaucauagcu

SEQ ID NO: 150501 - RNA, 22 nt, Homo sapiens
agaccacuuuagagauuguuca

SEQ ID NO: 150502 - RNA, 22 nt, Homo sapiens
agacucauuuuuaucgagcaug

SEQ ID NO: 150503 - RNA, 21 nt, Homo sapiens
agagaacugaaacaugugacu

SEQ ID NO: 150504 - RNA, 22 nt, Homo sapiens
agagauacauucugagaagugc

SEQ ID NO: 150505 - RNA, 20 nt, Homo sapiens
agagcaaagccgcaccccua

SEQ ID NO: 150506 - RNA, 18 nt, Homo sapiens
agagcuaugaacauaugc

SEQ ID NO: 150507 - RNA, 22 nt, Homo sapiens
agagguaugccugggcuggagc

SEQ ID NO: 150508 - RNA, 22 nt, Homo sapiens
agaguacugacguuugcaaauu

SEQ ID NO: 150509 - RNA, 22 nt, Homo sapiens
agagucacaugaggcccuucau

SEQ ID NO: 150510 - RNA, 20 nt, Homo sapiens
agagugcuggacugaggagc

SEQ ID NO: 150511 - RNA, 22 nt, Homo sapiens
agagugcuuuauuagauguagc

SEQ ID NO: 150512 - RNA, 22 nt, Homo sapiens
agaucacagucuuugguuuuag

SEQ ID NO: 150513 - RNA, 22 nt, Homo sapiens
agaugauguuucuggcacauga

SEQ ID NO: 150514 - RNA, 22 nt, Homo sapiens
agaugcuguuaucaacuguagc

SEQ ID NO: 150515 - RNA, 22 nt, Homo sapiens
agaugguauuauagguuucugu

SEQ ID NO: 150516 - RNA, 22 nt, Homo sapiens
agcaaaucuaugaauguauauu

SEQ ID NO: 150517 - RNA, 23 nt, Homo sapiens
agcaaaugcucuagcacuccaac

SEQ ID NO: 150518 - RNA, 22 nt, Homo sapiens
agcaacauuguucauaauagcu

SEQ ID NO: 150519 - RNA, 22 nt, Homo sapiens
agcacacuggguggcuuaaaca

SEQ ID NO: 150520 - RNA, 22 nt, Homo sapiens
agcaccauuucucuaaagcacu

SEQ ID NO: 150521 - RNA, 22 nt, Homo sapiens
agcaccguucaaacccagguua

SEQ ID NO: 150522 - RNA, 19 nt, Homo sapiens
agcagaacaaauguguggg

SEQ ID NO: 150523 - RNA, 22 nt, Homo sapiens
agcagauguuuagugagcgccu

SEQ ID NO: 150524 - RNA, 22 nt, Homo sapiens
agcagcucaagacuuaaauuug

SEQ ID NO: 150525 - RNA, 22 nt, Homo sapiens
agcaggacaauaugggaucagg

SEQ ID NO: 150526 - RNA, 22 nt, Homo sapiens
agcaggucuuaacuugugaggu

SEQ ID NO: 150527 - RNA, 22 nt, Homo sapiens
agcaucaugcaguugcuauuca

SEQ ID NO: 150528 - RNA, 16 nt, Homo sapiens
agccaccauuuacuug

SEQ ID NO: 150529 - RNA, 22 nt, Homo sapiens
agcccagagacuguguaaauuu

SEQ ID NO: 150530 - RNA, 23 nt, Homo sapiens
agcccugugacucgaacgaggag

SEQ ID NO: 150531 - RNA, 22 nt, Homo sapiens
agccuguguugaauuauagaaa

SEQ ID NO: 150532 - RNA, 23 nt, Homo sapiens
agccuguugccuaggcagcucau

SEQ ID NO: 150533 - RNA, 22 nt, Homo sapiens
agcuaacauuuuuccucuucca

SEQ ID NO: 150534 - RNA, 22 nt, Homo sapiens
agcuagcauucauaguuugagg

SEQ ID NO: 150535 - RNA, 22 nt, Homo sapiens
agcucacagccuagcacuguga

SEQ ID NO: 150536 - RNA, 22 nt, Homo sapiens
agcuccauuguaaucaccuggu

SEQ ID NO: 150537 - RNA, 22 nt, Homo sapiens
agcugauuuuaaguccuugucc

SEQ ID NO: 150538 - RNA, 22 nt, Homo sapiens
agcuggauuguuuaccuggggc

SEQ ID NO: 150539 - RNA, 22 nt, Homo sapiens
agcuggucucaggugcccugcu

SEQ ID NO: 150540 - RNA, 22 nt, Homo sapiens
agcuucauucugaauagguuga

SEQ ID NO: 150541 - RNA, 22 nt, Homo sapiens
agcuucauuguuaugaauguca

SEQ ID NO: 150542 - RNA, 22 nt, Homo sapiens
aggaacuguaacuaugucucug

SEQ ID NO: 150543 - RNA, 22 nt, Homo sapiens
aggaaguaauaaguuugguucu

SEQ ID NO: 150544 - RNA, 22 nt, Homo sapiens
aggaagugucuucuuuuaggca

SEQ ID NO: 150545 - RNA, 18 nt, Homo sapiens
aggaaugguaauacuuca

SEQ ID NO: 150546 - RNA, 22 nt, Homo sapiens
aggaaugucaaugguaguuuaa

SEQ ID NO: 150547 - RNA, 22 nt, Homo sapiens
aggagaugaagcuuuaucuaaa

SEQ ID NO: 150548 - RNA, 21 nt, Homo sapiens
aggagauguuuguccuuuuag

SEQ ID NO: 150549 - RNA, 22 nt, Homo sapiens
aggagcacaauggucaugugga

SEQ ID NO: 150550 - RNA, 22 nt, Homo sapiens
augaagaucaugaagacggcuu

SEQ ID NO: 150551 - RNA, 20 nt, Homo sapiens
augaaggcaggugugaguuu

SEQ ID NO: 150552 - RNA, 18 nt, Homo sapiens
augaagucaucacuuuua

SEQ ID NO: 150553 - RNA, 22 nt, Homo sapiens
augaauucaucugguuuuggga

SEQ ID NO: 150554 - RNA, 22 nt, Homo sapiens
augacauugaaaagcaagugga

SEQ ID NO: 150555 - RNA, 22 nt, Homo sapiens
augaccaaugggcagagcuaga

SEQ ID NO: 150556 - RNA, 20 nt, Homo sapiens
augaccuauggugguauaag

SEQ ID NO: 150557 - RNA, 22 nt, Homo sapiens
augacuauugcacuuuccuggu

SEQ ID NO: 150558 - RNA, 22 nt, Homo sapiens
augacugagacuaacuuacuuu

SEQ ID NO: 150559 - RNA, 22 nt, Homo sapiens
augacuggauaauggacacaca

SEQ ID NO: 150560 - RNA, 22 nt, Homo sapiens
augagaacugucaaugagagcu

SEQ ID NO: 150561 - RNA, 22 nt, Homo sapiens
augagacaguucccuuuaucuu

SEQ ID NO: 150562 - RNA, 18 nt, Homo sapiens
augagagccgauuccugg

SEQ ID NO: 150563 - RNA, 22 nt, Homo sapiens
augagauaggaacaaacuuaca

SEQ ID NO: 150564 - RNA, 22 nt, Homo sapiens
augagauauuuuauaagaucau

SEQ ID NO: 150565 - RNA, 22 nt, Homo sapiens
augagauuauguaaagagacca

SEQ ID NO: 150566 - RNA, 22 nt, Homo sapiens
augagcuaggacagaaugucag

SEQ ID NO: 150567 - RNA, 22 nt, Homo sapiens
augagcuauggagacagggcca

SEQ ID NO: 150568 - RNA, 22 nt, Homo sapiens
augagggcggacgcccuggaga

SEQ ID NO: 150569 - RNA, 19 nt, Homo sapiens
augagucugcaagaaccag

SEQ ID NO: 150570 - RNA, 19 nt, Homo sapiens
augaguuaggggaaauuuc

SEQ ID NO: 150571 - RNA, 22 nt, Homo sapiens
augauacugaguugaguucuca

SEQ ID NO: 150572 - RNA, 22 nt, Homo sapiens
augauagucuugagaagcauuu

SEQ ID NO: 150573 - RNA, 22 nt, Homo sapiens
augaucaucugaaagcuuuuac

SEQ ID NO: 150574 - RNA, 22 nt, Homo sapiens
augauguccacagggguguuca

SEQ ID NO: 150575 - RNA, 22 nt, Homo sapiens
augauucugaucuagagcuugg

SEQ ID NO: 150576 - RNA, 22 nt, Homo sapiens
augcaaacaucauagaguguac

SEQ ID NO: 150577 - RNA, 22 nt, Homo sapiens
augcaacugcacuccagccugg

SEQ ID NO: 150578 - RNA, 22 nt, Homo sapiens
augcaagcacacaagaggaaau

SEQ ID NO: 150579 - RNA, 22 nt, Homo sapiens
augcacuguauaggaucuugcg

SEQ ID NO: 150580 - RNA, 22 nt, Homo sapiens
augccacugcacuucagccugg

SEQ ID NO: 150581 - RNA, 22 nt, Homo sapiens
augccacuguacucuagccuag

SEQ ID NO: 150582 - RNA, 22 nt, Homo sapiens
augccauugcacuccagccuag

SEQ ID NO: 150583 - RNA, 22 nt, Homo sapiens
augcuguuuugaauucucuaga

SEQ ID NO: 150584 - RNA, 22 nt, Homo sapiens
auggaaacauaagaguauagau

SEQ ID NO: 150585 - RNA, 22 nt, Homo sapiens
auggaacauaacuauuugggga

SEQ ID NO: 150586 - RNA, 22 nt, Homo sapiens
auggaacuggagaucauuaugu

SEQ ID NO: 150587 - RNA, 22 nt, Homo sapiens
auggaagaaaguuggguucuug

SEQ ID NO: 150588 - RNA, 22 nt, Homo sapiens
auggaaucauccuccugggagc

SEQ ID NO: 150589 - RNA, 22 nt, Homo sapiens
auggaaugccauuuauaaugga

SEQ ID NO: 150590 - RNA, 22 nt, Homo sapiens
auggaaugguugggucauaagg

SEQ ID NO: 150591 - RNA, 22 nt, Homo sapiens
auggagaugaauaucaucuguu

SEQ ID NO: 150592 - RNA, 22 nt, Homo sapiens
auggagaugugcgaacugagua

SEQ ID NO: 150593 - RNA, 22 nt, Homo sapiens
auggagcaaaacagauuuggga

SEQ ID NO: 150594 - RNA, 22 nt, Homo sapiens
auggaggaggaagcugaaacaa

SEQ ID NO: 150595 - RNA, 22 nt, Homo sapiens
auggaguguucugaauccuuug

SEQ ID NO: 150596 - RNA, 22 nt, Homo sapiens
auggauauugccuaggguagua

SEQ ID NO: 150597 - RNA, 22 nt, Homo sapiens
auggauguucuagggaugugau

SEQ ID NO: 150598 - RNA, 22 nt, Homo sapiens
auggcaaaaaaugcaauuacuu

SEQ ID NO: 150599 - RNA, 22 nt, Homo sapiens
auggcacuacugggaaugucuu

SEQ ID NO: 150600 - RNA, 22 nt, Homo sapiens
auggcacuccagccugggcaac

SEQ ID NO: 150601 - RNA, 22 nt, Homo sapiens
auggcacugauggaaguaccuu

SEQ ID NO: 150602 - RNA, 22 nt, Homo sapiens
auggcacuuuggacugcuagau

SEQ ID NO: 150603 - RNA, 22 nt, Homo sapiens
auggcagcaccccacucuacug

SEQ ID NO: 150604 - RNA, 22 nt, Homo sapiens
auggcagcugguuuuacccuag

SEQ ID NO: 150605 - RNA, 22 nt, Homo sapiens
auggcagugagucucuaguauu

SEQ ID NO: 150606 - RNA, 22 nt, Homo sapiens
auggcaguuucacucugggauu

SEQ ID NO: 150607 - RNA, 22 nt, Homo sapiens
auggcaguuuggucucugugcu

SEQ ID NO: 150608 - RNA, 22 nt, Homo sapiens
auggcccuguguggagcugcug

SEQ ID NO: 150609 - RNA, 22 nt, Homo sapiens
auggccuuucuggcacauuucc

SEQ ID NO: 150610 - RNA, 22 nt, Homo sapiens
auggcucaguguguaucuauca

SEQ ID NO: 150611 - RNA, 22 nt, Homo sapiens
auggcuuguuaugcauuaguac

SEQ ID NO: 150612 - RNA, 22 nt, Homo sapiens
auggcuuuaagagugucugaau

SEQ ID NO: 150613 - RNA, 22 nt, Homo sapiens
augguacuccagagaagcagaa

SEQ ID NO: 150614 - RNA, 22 nt, Homo sapiens
augguauuuugugauaccuugu

SEQ ID NO: 150615 - RNA, 22 nt, Homo sapiens
augguugguuaaaucuguguau

SEQ ID NO: 150616 - RNA, 22 nt, Homo sapiens
augguuuuacugcaaaauggga

SEQ ID NO: 150617 - RNA, 22 nt, Homo sapiens
auguaaacuacagauuuugggu

SEQ ID NO: 150618 - RNA, 22 nt, Homo sapiens
auguaacaguauuuggagaugu

SEQ ID NO: 150619 - RNA, 22 nt, Homo sapiens
auguaguaugaagaagaugcuu

SEQ ID NO: 150620 - RNA, 21 nt, Homo sapiens
augucauggaugacuaauuca

SEQ ID NO: 150621 - RNA, 22 nt, Homo sapiens
augucugguagccaccuggagg

SEQ ID NO: 150622 - RNA, 22 nt, Homo sapiens
augugacugauggagaauaugu

SEQ ID NO: 150623 - RNA, 22 nt, Homo sapiens
augugacuggaucauggggacg

SEQ ID NO: 150624 - RNA, 22 nt, Homo sapiens
augugcaacugcuggaacaguc

SEQ ID NO: 150625 - RNA, 22 nt, Homo sapiens
augugcaauggugucaccacau

SEQ ID NO: 150626 - RNA, 18 nt, Homo sapiens
augugcaauuuuguauuu

SEQ ID NO: 150627 - RNA, 22 nt, Homo sapiens
augugcauaugaagcacagaca

SEQ ID NO: 150628 - RNA, 22 nt, Homo sapiens
augugcaugcuguucugccaga

SEQ ID NO: 150629 - RNA, 22 nt, Homo sapiens
augugccauucucauggcgcuu

SEQ ID NO: 150630 - RNA, 20 nt, Homo sapiens
augugcuaauauuaauaugu

SEQ ID NO: 150631 - RNA, 22 nt, Homo sapiens
auguggauaucuauaucuggau

SEQ ID NO: 150632 - RNA, 18 nt, Homo sapiens
auguggcuuuugaaggcu

SEQ ID NO: 150633 - RNA, 22 nt, Homo sapiens
augugggaggacuuggcuguug

SEQ ID NO: 150634 - RNA, 19 nt, Homo sapiens
augugguuagcaugacugc

SEQ ID NO: 150635 - RNA, 22 nt, Homo sapiens
augugucaaaucuaggccaaag

SEQ ID NO: 150636 - RNA, 22 nt, Homo sapiens
augugugcuugugacacagccu

SEQ ID NO: 150637 - RNA, 20 nt, Homo sapiens
auguucuggaggacagaagc

SEQ ID NO: 150638 - RNA, 22 nt, Homo sapiens
auguugcuugaaggcauuuugu

SEQ ID NO: 150639 - RNA, 22 nt, Homo sapiens
auguuguaguaugagucaaaau

SEQ ID NO: 150640 - RNA, 22 nt, Homo sapiens
auguuuagagagggugucaaau

SEQ ID NO: 150641 - RNA, 22 nt, Homo sapiens
cagguaggccaauguuuuccaa

SEQ ID NO: 150642 - RNA, 22 nt, Homo sapiens
caguacaauguugauuagaagu

SEQ ID NO: 150643 - RNA, 22 nt, Homo sapiens
cagucacagugacaggaugugg

SEQ ID NO: 150644 - RNA, 22 nt, Homo sapiens
caguccuaugauaaccauuuac

SEQ ID NO: 150645 - RNA, 22 nt, Homo sapiens
cagugcaaagccucugcccaga

SEQ ID NO: 150646 - RNA, 22 nt, Homo sapiens
cagugcauaggaucuaaaauuu

SEQ ID NO: 150647 - RNA, 22 nt, Homo sapiens
cagugcuuguuauuguucuauu

SEQ ID NO: 150648 - RNA, 22 nt, Homo sapiens
cauagcacugagcucuacccuc

SEQ ID NO: 150649 - RNA, 22 nt, Homo sapiens
caucaaaguggagggaaggacc

SEQ ID NO: 150650 - RNA, 22 nt, Homo sapiens
caucacaguacuaaucgucaua

SEQ ID NO: 150651 - RNA, 23 nt, Homo sapiens
caucacauagaggaaagaggaca

SEQ ID NO: 150652 - RNA, 22 nt, Homo sapiens
caucacaugcuuauuuuccuca

SEQ ID NO: 150653 - RNA, 21 nt, Homo sapiens
caucacauuacucaaaguccu

SEQ ID NO: 150654 - RNA, 22 nt, Homo sapiens
caucacuuugccuccgucucua

SEQ ID NO: 150655 - RNA, 22 nt, Homo sapiens
caucacuuuuccuuuuacagau

SEQ ID NO: 150656 - RNA, 21 nt, Homo sapiens
cauccccugccauuguggucu

SEQ ID NO: 150657 - RNA, 22 nt, Homo sapiens
caucccugaaccccagaaaucu

SEQ ID NO: 150658 - RNA, 22 nt, Homo sapiens
caucccugucgucaagucucug

SEQ ID NO: 150659 - RNA, 22 nt, Homo sapiens
caugacacauguuuaccuaugu

SEQ ID NO: 150660 - RNA, 22 nt, Homo sapiens
caugcauagccauucauucguu

SEQ ID NO: 150661 - RNA, 19 nt, Homo sapiens
caugccacugcacuugagu

SEQ ID NO: 150662 - RNA, 22 nt, Homo sapiens
cauggcacagagaauguguucu

SEQ ID NO: 150663 - RNA, 22 nt, Homo sapiens
cauggcaucuguguggccucca

SEQ ID NO: 150664 - RNA, 22 nt, Homo sapiens
cauggcuacugcagauguaggg

SEQ ID NO: 150665 - RNA, 22 nt, Homo sapiens
cauggcuuguauaagauucuca

SEQ ID NO: 150666 - RNA, 22 nt, Homo sapiens
cauggcuuuaagcaacaccaag

SEQ ID NO: 150667 - RNA, 22 nt, Homo sapiens
cauggucaccuuccaaguuauu

SEQ ID NO: 150668 - RNA, 22 nt, Homo sapiens
caugucuuuuauucugugugau

SEQ ID NO: 150669 - RNA, 22 nt, Homo sapiens
caugugcaugagcacauacgug

SEQ ID NO: 150670 - RNA, 20 nt, Homo sapiens
cauuacacuccaaccugggu

SEQ ID NO: 150671 - RNA, 22 nt, Homo sapiens
cauugcauuccagucugggcaa

SEQ ID NO: 150672 - RNA, 22 nt, Homo sapiens
cauuguccuccuggggcuauuu

SEQ ID NO: 150673 - RNA, 22 nt, Homo sapiens
cauuuugguuaaauagguagcu

SEQ ID NO: 150674 - RNA, 22 nt, Homo sapiens
ccaaaguauuuucacugauauc

SEQ ID NO: 150675 - RNA, 22 nt, Homo sapiens
ccaagccucaguuucccucugu

SEQ ID NO: 150676 - RNA, 22 nt, Homo sapiens
ccaaggcacugauucuguacuc

SEQ ID NO: 150677 - RNA, 22 nt, Homo sapiens
ccacugggcaguuuauuaucag

SEQ ID NO: 150678 - RNA, 22 nt, Homo sapiens
ccagaguucuaggcauuggaaa

SEQ ID NO: 150679 - RNA, 22 nt, Homo sapiens
ccagugguucccuguggccuga

SEQ ID NO: 150680 - RNA, 19 nt, Homo sapiens
ccaguguugccagagcuga

SEQ ID NO: 150681 - RNA, 22 nt, Homo sapiens
ccaguuuuucauuuauacuagu

SEQ ID NO: 150682 - RNA, 22 nt, Homo sapiens
ccauacugucaaauagauuucc

SEQ ID NO: 150683 - RNA, 21 nt, Homo sapiens
ccaugggacggaaugaauaca

SEQ ID NO: 150684 - RNA, 22 nt, Homo sapiens
ccauugaacaugaaggaaugug

SEQ ID NO: 150685 - RNA, 22 nt, Homo sapiens
cccaguuuugcuucucaugagg

SEQ ID NO: 150686 - RNA, 22 nt, Homo sapiens
ccccagguuucaauaaagccca

SEQ ID NO: 150687 - RNA, 20 nt, Homo sapiens
ccccaguuuuucuauuagcu

SEQ ID NO: 150688 - RNA, 18 nt, Homo sapiens
cccgggugggcuguuccc

SEQ ID NO: 150689 - RNA, 22 nt, Homo sapiens
ccggguguuuuguucucucaga

SEQ ID NO: 150690 - RNA, 22 nt, Homo sapiens
ccuaaguaauggcaguuuuugc

SEQ ID NO: 150691 - RNA, 22 nt, Homo sapiens
ccucacaaccuuuauugaagag

SEQ ID NO: 150692 - RNA, 21 nt, Homo sapiens
ccucuuugagggaagaaaggg

SEQ ID NO: 150693 - RNA, 22 nt, Homo sapiens
ccuggaagaaaggugcuaaaua

SEQ ID NO: 150694 - RNA, 22 nt, Homo sapiens
ccuggaucauugucauucccaa

SEQ ID NO: 150695 - RNA, 22 nt, Homo sapiens
ccuggguuacaggugugagcca

SEQ ID NO: 150696 - RNA, 22 nt, Homo sapiens
ccugugguuaaccagcuagaug

SEQ ID NO: 150697 - RNA, 18 nt, Homo sapiens
ccuuaguuauagagaguc

SEQ ID NO: 150698 - RNA, 22 nt, Homo sapiens
ccuugcacuucccaagugaggc

SEQ ID NO: 150699 - RNA, 22 nt, Homo sapiens
ccuuuuuguaguggaaguagga

SEQ ID NO: 150700 - RNA, 22 nt, Homo sapiens
cgcuggugaucuagacccccaa

SEQ ID NO: 150701 - RNA, 22 nt, Homo sapiens
cuaaaacuuucugagugcagca

SEQ ID NO: 150702 - RNA, 22 nt, Homo sapiens
cuaaagauagugacaugauuug

SEQ ID NO: 150703 - RNA, 22 nt, Homo sapiens
cuaaaguagccaggacugcagg

SEQ ID NO: 150704 - RNA, 22 nt, Homo sapiens
cuaaaguucuucugagagaaca

SEQ ID NO: 150705 - RNA, 22 nt, Homo sapiens
cuaaaugucucuacuaaguuua

SEQ ID NO: 150706 - RNA, 18 nt, Homo sapiens
cuaagacacuuggcagag

SEQ ID NO: 150707 - RNA, 22 nt, Homo sapiens
cuaaucugugcauagaagaggc

SEQ ID NO: 150708 - RNA, 22 nt, Homo sapiens
cuacagcacugagcugugugca

SEQ ID NO: 150709 - RNA, 22 nt, Homo sapiens
cuacagugggucuguaguccuu

SEQ ID NO: 150710 - RNA, 22 nt, Homo sapiens
cuacaguuauguuuuaaaugug

SEQ ID NO: 150711 - RNA, 22 nt, Homo sapiens
cuagaacuagaacugcuggggu

SEQ ID NO: 150712 - RNA, 22 nt, Homo sapiens
cuagauuauccaacuuauuagc

SEQ ID NO: 150713 - RNA, 22 nt, Homo sapiens
cuagcccagugcuccuggauca

SEQ ID NO: 150714 - RNA, 22 nt, Homo sapiens
cuaggcacgccugggucuccag

SEQ ID NO: 150715 - RNA, 18 nt, Homo sapiens
cuaguguuucuugaauca

SEQ ID NO: 150716 - RNA, 22 nt, Homo sapiens
cuauaguauaguuugaagucag

SEQ ID NO: 150717 - RNA, 22 nt, Homo sapiens
cuaucucauugguuuuugaaag

SEQ ID NO: 150718 - RNA, 22 nt, Homo sapiens
cuauggcuguaaggauaguaac

SEQ ID NO: 150719 - RNA, 22 nt, Homo sapiens
cuaugguuucuccauaucauca

SEQ ID NO: 150720 - RNA, 22 nt, Homo sapiens
cuauucacaggcaauauguaca

SEQ ID NO: 150721 - RNA, 21 nt, Homo sapiens
cucaaaguacugauauuacag

SEQ ID NO: 150722 - RNA, 22 nt, Homo sapiens
cucaaaguacuuugguuauugu

SEQ ID NO: 150723 - RNA, 22 nt, Homo sapiens
cucaaagucaagggaaagcagg

SEQ ID NO: 150724 - RNA, 22 nt, Homo sapiens
cucaaaguguggucuguggguu

SEQ ID NO: 150725 - RNA, 18 nt, Homo sapiens
cucacacccuaaucagga

SEQ ID NO: 150726 - RNA, 22 nt, Homo sapiens
cucaggguacuucuccuuugcu

SEQ ID NO: 150727 - RNA, 22 nt, Homo sapiens
cucaguagaaaauacauggacu

SEQ ID NO: 150728 - RNA, 22 nt, Homo sapiens
cucagugguugauuuauuuauc

SEQ ID NO: 150729 - RNA, 22 nt, Homo sapiens
cucagugucuggcacacagaaa

SEQ ID NO: 150730 - RNA, 22 nt, Homo sapiens
cucagugucuggggccccaggg

SEQ ID NO: 150731 - RNA, 22 nt, Homo sapiens
cucaguuuugccuuguuuaagg

SEQ ID NO: 150732 - RNA, 22 nt, Homo sapiens
ugucucagugauuggcuuucug

SEQ ID NO: 150733 - RNA, 22 nt, Homo sapiens
ugucucaguucccuucucugga

SEQ ID NO: 150734 - RNA, 22 nt, Homo sapiens
ugucuggaguccauagaagugu

SEQ ID NO: 150735 - RNA, 19 nt, Homo sapiens
ugugaacaucacagagugu

SEQ ID NO: 150736 - RNA, 22 nt, Homo sapiens
ugugaacauuuuguauauauua

SEQ ID NO: 150737 - RNA, 22 nt, Homo sapiens
ugugaauguaaccuuauuugga

SEQ ID NO: 150738 - RNA, 22 nt, Homo sapiens
ugugacagcacagcaucucuuu

SEQ ID NO: 150739 - RNA, 22 nt, Homo sapiens
ugugacagcacgguucaacugc

SEQ ID NO: 150740 - RNA, 22 nt, Homo sapiens
ugugacaguguuacauuucaug

SEQ ID NO: 150741 - RNA, 20 nt, Homo sapiens
ugugagacugguuuugaacu

SEQ ID NO: 150742 - RNA, 22 nt, Homo sapiens
ugugaucaaccugcagggcugg

SEQ ID NO: 150743 - RNA, 17 nt, Homo sapiens
ugugaucaucacccuug

SEQ ID NO: 150744 - RNA, 18 nt, Homo sapiens
ugugauggauauguuaau

SEQ ID NO: 150745 - RNA, 22 nt, Homo sapiens
ugugaugguuuagcauuuucuu

SEQ ID NO: 150746 - RNA, 22 nt, Homo sapiens
ugugcaaaaacaauugcgguuu

SEQ ID NO: 150747 - RNA, 22 nt, Homo sapiens
ugugcaaucuuccauuuuuagg

SEQ ID NO: 150748 - RNA, 22 nt, Homo sapiens
ugugcacaacaugcagguuugu

SEQ ID NO: 150749 - RNA, 22 nt, Homo sapiens
ugugcacaacgugcagguuugu

SEQ ID NO: 150750 - RNA, 22 nt, Homo sapiens
ugugcacaauguacagguuagu

SEQ ID NO: 150751 - RNA, 22 nt, Homo sapiens
ugugcaguuuuagcguauuuua

SEQ ID NO: 150752 - RNA, 22 nt, Homo sapiens
ugugccacugcacucccgccug

SEQ ID NO: 150753 - RNA, 22 nt, Homo sapiens
ugugccacugcacucugggcaa

SEQ ID NO: 150754 - RNA, 22 nt, Homo sapiens
ugugccuaguaauguguccaga

SEQ ID NO: 150755 - RNA, 22 nt, Homo sapiens
ugugccuucuaagaaggagucu

SEQ ID NO: 150756 - RNA, 22 nt, Homo sapiens
ugugcuugaaauucaguuuuga

SEQ ID NO: 150757 - RNA, 22 nt, Homo sapiens
ugugcuugaauuuaguagcuua

SEQ ID NO: 150758 - RNA, 22 nt, Homo sapiens
uguggcaaagucuugugaauau

SEQ ID NO: 150759 - RNA, 22 nt, Homo sapiens
uguggcuuuacagcaugguuca

SEQ ID NO: 150760 - RNA, 22 nt, Homo sapiens
ugugggugguaaaauacaauga

SEQ ID NO: 150761 - RNA, 22 nt, Homo sapiens
ugugguagugcuuaccugcagu

SEQ ID NO: 150762 - RNA, 19 nt, Homo sapiens
uguggucauccugggacga

SEQ ID NO: 150763 - RNA, 22 nt, Homo sapiens
ugugguuuuucacauuuagaga

SEQ ID NO: 150764 - RNA, 22 nt, Homo sapiens
uguguaaauaugauagaggaau

SEQ ID NO: 150765 - RNA, 22 nt, Homo sapiens
ugugucuugcuggugccugcau

SEQ ID NO: 150766 - RNA, 22 nt, Homo sapiens
uguuacagcagaauugauugca

SEQ ID NO: 150767 - RNA, 22 nt, Homo sapiens
uguuauuuuguguuagggcaca

SEQ ID NO: 150768 - RNA, 22 nt, Homo sapiens
uguuggcauugcugcugacccu

SEQ ID NO: 150769 - RNA, 22 nt, Homo sapiens
uguuuuguuagcacucugggaa

SEQ ID NO: 150770 - RNA, 22 nt, Homo sapiens
uuaaaagcuaucuccaagguca

SEQ ID NO: 150771 - RNA, 22 nt, Homo sapiens
uuaaaaguauaggccuggcaua

SEQ ID NO: 150772 - RNA, 22 nt, Homo sapiens
uuaaaggcauguacacuagagu

SEQ ID NO: 150773 - RNA, 22 nt, Homo sapiens
uuaaaguaauugaaauggccuu

SEQ ID NO: 150774 - RNA, 22 nt, Homo sapiens
uuaaagugaucauaaggauagu

SEQ ID NO: 150775 - RNA, 22 nt, Homo sapiens
uuaaaugcacauacuugagaaa

SEQ ID NO: 150776 - RNA, 22 nt, Homo sapiens
uuaaaugcuagaauuuucuuug

SEQ ID NO: 150777 - RNA, 22 nt, Homo sapiens
uuaaaugcucacauaaagguag

SEQ ID NO: 150778 - RNA, 22 nt, Homo sapiens
uuaagaagugauuuuccucauu

SEQ ID NO: 150779 - RNA, 22 nt, Homo sapiens
uuaagacaccaaucauuggauu

SEQ ID NO: 150780 - RNA, 23 nt, Homo sapiens
uuaagcaacggcugcuuuucaga

SEQ ID NO: 150781 - RNA, 22 nt, Homo sapiens
uuaagccacucaagagauagag

SEQ ID NO: 150782 - RNA, 22 nt, Homo sapiens
uuaagccaggugugguggcaca

SEQ ID NO: 150783 - RNA, 23 nt, Homo sapiens
uuaaggugaugucuuugugccuc

SEQ ID NO: 150784 - RNA, 22 nt, Homo sapiens
uuaagugaauuaucuaacaugu

SEQ ID NO: 150785 - RNA, 22 nt, Homo sapiens
uuaauucugucugcccucaucc

SEQ ID NO: 150786 - RNA, 22 nt, Homo sapiens
uuaauuguaucuauagauguca

SEQ ID NO: 150787 - RNA, 22 nt, Homo sapiens
uuacacaguugguaggggcaga

SEQ ID NO: 150788 - RNA, 22 nt, Homo sapiens
uuacaggacuaagcagcuuugc

SEQ ID NO: 150789 - RNA, 22 nt, Homo sapiens
uuacagucaaguuacauuucuc

SEQ ID NO: 150790 - RNA, 22 nt, Homo sapiens
uuacaguggugaccuuguauug

SEQ ID NO: 150791 - RNA, 22 nt, Homo sapiens
uuacaguguuuguucuguuacu

SEQ ID NO: 150792 - RNA, 22 nt, Homo sapiens
uuacaguugugagccaccaugc

SEQ ID NO: 150793 - RNA, 22 nt, Homo sapiens
uuacaucaucacauuaguuugc

SEQ ID NO: 150794 - RNA, 22 nt, Homo sapiens
uuacaugcaugacaaggugcca

SEQ ID NO: 150795 - RNA, 22 nt, Homo sapiens
uuaccucuguggcucucggacu

SEQ ID NO: 150796 - RNA, 22 nt, Homo sapiens
uuacuagaacauuuagggaacu

SEQ ID NO: 150797 - RNA, 20 nt, Homo sapiens
uuacuccuuaaugagguuuu

SEQ ID NO: 150798 - RNA, 22 nt, Homo sapiens
uuacuguagugucauaucguau

SEQ ID NO: 150799 - RNA, 22 nt, Homo sapiens
uuagaguguagcaggaagaggc

SEQ ID NO: 150800 - RNA, 22 nt, Homo sapiens
uuagauguuugacugggccuua

SEQ ID NO: 150801 - RNA, 22 nt, Homo sapiens
uuagcaauagccugcaucugca

SEQ ID NO: 150802 - RNA, 22 nt, Homo sapiens
uuagcaauugauucucauaagc

SEQ ID NO: 150803 - RNA, 22 nt, Homo sapiens
uuagcacaucuuucuauguaag

SEQ ID NO: 150804 - RNA, 22 nt, Homo sapiens
uuagcaccacacacuuuagagg

SEQ ID NO: 150805 - RNA, 22 nt, Homo sapiens
uuagcagugugagcacagacua

SEQ ID NO: 150806 - RNA, 22 nt, Homo sapiens
uuagcauccauaggagauuggu

SEQ ID NO: 150807 - RNA, 22 nt, Homo sapiens
uuagcccaucuugaggaaagua

SEQ ID NO: 150808 - RNA, 22 nt, Homo sapiens
uuagggaggcucaggacaagag

SEQ ID NO: 150809 - RNA, 22 nt, Homo sapiens
uuagguagaauugauuaaguuu

SEQ ID NO: 150810 - RNA, 22 nt, Homo sapiens
uuagguagucucugucagaggg

SEQ ID NO: 150811 - RNA, 22 nt, Homo sapiens
uuagucaaguguacugugaaug

SEQ ID NO: 150812 - RNA, 22 nt, Homo sapiens
uuagugcaaacucuucaaugcu

SEQ ID NO: 150813 - RNA, 22 nt, Homo sapiens
uuagugcuuacgaugagcuaag

SEQ ID NO: 150814 - RNA, 20 nt, Homo sapiens
uuauagcuacaucuugacug

SEQ ID NO: 150815 - RNA, 22 nt, Homo sapiens
uuauauguuuguacuuaggccu

SEQ ID NO: 150816 - RNA, 22 nt, Homo sapiens
uuaucauagugcaguuuucuga

SEQ ID NO: 150817 - RNA, 22 nt, Homo sapiens
uuaugacaggcucaggagcccc

SEQ ID NO: 150818 - RNA, 22 nt, Homo sapiens
uuauggcaaugccccacuccua

SEQ ID NO: 150819 - RNA, 22 nt, Homo sapiens
uuauggccauucuuguaggagu

SEQ ID NO: 150820 - RNA, 22 nt, Homo sapiens
uuaugucacuguucagucuccc

SEQ ID NO: 150821 - RNA, 22 nt, Homo sapiens
uuaugucuuugagcaaugcugu

SEQ ID NO: 150822 - RNA, 22 nt, Homo sapiens
uuauuauguuggugcaaaggua

SEQ ID NO: 150823 - RNA, 22 nt, Homo sapiens
uugagauggagucuugcgcugu

SEQ ID NO: 150824 - RNA, 22 nt, Homo sapiens
uugagauggagucuugcucuug

SEQ ID NO: 150825 - RNA, 22 nt, Homo sapiens
uugagauggaguuucaauauug

SEQ ID NO: 150826 - RNA, 22 nt, Homo sapiens
uugagauggaguuucacucucg

SEQ ID NO: 150827 - RNA, 22 nt, Homo sapiens
uugagauggaguuucacucugu

SEQ ID NO: 150828 - RNA, 22 nt, Homo sapiens
uugagauggaguuucacucuug

SEQ ID NO: 150829 - RNA, 22 nt, Homo sapiens
uugagauggaguuucgcucuug

SEQ ID NO: 150830 - RNA, 22 nt, Homo sapiens
uugagauggaguuucgcucuuu

SEQ ID NO: 150831 - RNA, 22 nt, Homo sapiens
uugagauguaagauguuaauau

SEQ ID NO: 150832 - RNA, 22 nt, Homo sapiens
uugagauuuuccucaaauauuu

SEQ ID NO: 150833 - RNA, 22 nt, Homo sapiens
uugagcaaugaacgauucaggg

SEQ ID NO: 150834 - RNA, 22 nt, Homo sapiens
uugagcuaguugcaccagcagg

SEQ ID NO: 150835 - RNA, 22 nt, Homo sapiens
uugaggaagugguuccccagag

SEQ ID NO: 150836 - RNA, 22 nt, Homo sapiens
uugaggaaugugauuucaaaua

SEQ ID NO: 150837 - RNA, 22 nt, Homo sapiens
uugagggaagccagaggucugc

SEQ ID NO: 150838 - RNA, 22 nt, Homo sapiens
uugaggucagagguucgagacc

SEQ ID NO: 150839 - RNA, 22 nt, Homo sapiens
uugaggucuuugagcaaacgca

SEQ ID NO: 150840 - RNA, 22 nt, Homo sapiens
uugaguagugugaugcaugucu

SEQ ID NO: 150841 - RNA, 22 nt, Homo sapiens
uugaguuuaucuaaagaccugg

SEQ ID NO: 150842 - RNA, 22 nt, Homo sapiens
uugauauuaaguacugaagugg

SEQ ID NO: 150843 - RNA, 22 nt, Homo sapiens
uugauguugaggacauaaaccu

SEQ ID NO: 150844 - RNA, 22 nt, Homo sapiens
uugcaaagaccucuucacuucc

SEQ ID NO: 150845 - RNA, 22 nt, Homo sapiens
uugcacaguguguacagcacca

SEQ ID NO: 150846 - RNA, 22 nt, Homo sapiens
uugcacauugauuuuguaucuu

SEQ ID NO: 150847 - RNA, 22 nt, Homo sapiens
uugcacuccagccuggaugaca

SEQ ID NO: 150848 - RNA, 22 nt, Homo sapiens
uugcacuccagcucuaggugac

SEQ ID NO: 150849 - RNA, 22 nt, Homo sapiens
uugcagagaaauuucugguuua

SEQ ID NO: 150850 - RNA, 22 nt, Homo sapiens
uugcagagccccacacugggcu

SEQ ID NO: 150851 - RNA, 22 nt, Homo sapiens
uugcaugguggaacuuggagcu

SEQ ID NO: 150852 - RNA, 22 nt, Homo sapiens
uugcaugguuuuuaucugaaau

SEQ ID NO: 150853 - RNA, 22 nt, Homo sapiens
uugccaauauuuuacugagaag

SEQ ID NO: 150854 - RNA, 22 nt, Homo sapiens
uugcuacuuggauguacaugug

SEQ ID NO: 150855 - RNA, 22 nt, Homo sapiens
uugcuggugguucgagcaacac

SEQ ID NO: 150856 - RNA, 22 nt, Homo sapiens
uugcuuagagccaaucuugauu

SEQ ID NO: 150857 - RNA, 22 nt, Homo sapiens
uuggaacacauguuuuucuacc

SEQ ID NO: 150858 - RNA, 22 nt, Homo sapiens
uuggaaggcugaauggccucuc

SEQ ID NO: 150859 - RNA, 22 nt, Homo sapiens
uuggaaugcacacugagccugc

SEQ ID NO: 150860 - RNA, 22 nt, Homo sapiens
uuggaaugugacugauaauauu

SEQ ID NO: 150861 - RNA, 22 nt, Homo sapiens
uuggacugggauggccgaggcu

SEQ ID NO: 150862 - RNA, 22 nt, Homo sapiens
uuggacuucuaacugacaugga

SEQ ID NO: 150863 - RNA, 22 nt, Homo sapiens
uuggacuucucaaggcaauaaa

SEQ ID NO: 150864 - RNA, 22 nt, Homo sapiens
uuggagagaaaggcaguuccug

SEQ ID NO: 150865 - RNA, 22 nt, Homo sapiens
uuggauggucuuuauauaguau

SEQ ID NO: 150866 - RNA, 22 nt, Homo sapiens
uuggauggugauaugguuugga

SEQ ID NO: 150867 - RNA, 22 nt, Homo sapiens
uuggcaauauuuacugaaguug

SEQ ID NO: 150868 - RNA, 22 nt, Homo sapiens
uuggcagaguuaauuuguugag

SEQ ID NO: 150869 - RNA, 22 nt, Homo sapiens
uuggcagcauuccagccaagca

SEQ ID NO: 150870 - RNA, 22 nt, Homo sapiens
uuggcagcuguggaaucugggc

SEQ ID NO: 150871 - RNA, 22 nt, Homo sapiens
uuggcaguaucuacuacagcua

SEQ ID NO: 150872 - RNA, 22 nt, Homo sapiens
uuggccauggagcacuuuucua

SEQ ID NO: 150873 - RNA, 22 nt, Homo sapiens
uuggccccucccaaauuucaug

SEQ ID NO: 150874 - RNA, 22 nt, Homo sapiens
uuggccccuuucauccacagcu

SEQ ID NO: 150875 - RNA, 22 nt, Homo sapiens
uuggcuguguuccucaaggagu

SEQ ID NO: 150876 - RNA, 22 nt, Homo sapiens
uugguaaucccuagugucuaga

SEQ ID NO: 150877 - RNA, 22 nt, Homo sapiens
uugguacuagcugaucgcagag

SEQ ID NO: 150878 - RNA, 22 nt, Homo sapiens
uuggucaggagccucccucuuu

SEQ ID NO: 150879 - RNA, 22 nt, Homo sapiens
uuggucaggcuaaucucgaacg

SEQ ID NO: 150880 - RNA, 22 nt, Homo sapiens
uugguuaucaucauuucagcaa

SEQ ID NO: 150881 - RNA, 22 nt, Homo sapiens
uugguuuccuuccugcuuaacu

SEQ ID NO: 150882 - RNA, 22 nt, Homo sapiens
uuguaaacaucuguacauugcu

SEQ ID NO: 150883 - RNA, 22 nt, Homo sapiens
uuguaauguuaggguguccaug

SEQ ID NO: 150884 - RNA, 22 nt, Homo sapiens
uuguagaucuucaguugcuaca

SEQ ID NO: 150885 - RNA, 22 nt, Homo sapiens
uuguaguguuuauucugucaac

SEQ ID NO: 150886 - RNA, 22 nt, Homo sapiens
uugucaccucuaaaucucauau

SEQ ID NO: 150887 - RNA, 22 nt, Homo sapiens
uugucacuauaaauaagcauuu

SEQ ID NO: 150888 - RNA, 22 nt, Homo sapiens
uuguccccacccaaaugucauc

SEQ ID NO: 150889 - RNA, 22 nt, Homo sapiens
uuguccuccacauuugaucagu

SEQ ID NO: 150890 - RNA, 22 nt, Homo sapiens
uugucuugcagcuuaggcauca

SEQ ID NO: 150891 - RNA, 22 nt, Homo sapiens
uugugaaaucuaggcagagguu

SEQ ID NO: 150892 - RNA, 16 nt, Homo sapiens
uuguggcuuuugcaca

SEQ ID NO: 150893 - RNA, 22 nt, Homo sapiens
uugugucccuacccaaaucuca

SEQ ID NO: 150894 - RNA, 17 nt, Homo sapiens
uuguucccauuaaaaag

SEQ ID NO: 150895 - RNA, 22 nt, Homo sapiens
uuguucccuucuggcuuuuaug

SEQ ID NO: 150896 - RNA, 22 nt, Homo sapiens
uuguuuagagacuggaauuaaa

SEQ ID NO: 150897 - RNA, 22 nt, Homo sapiens
uuguuuuggagaugagcuaaaa

SEQ ID NO: 150898 - RNA, 22 nt, Homo sapiens
uuuaaagcacggaguuuguggc

SEQ ID NO: 150899 - RNA, 22 nt, Homo sapiens
uuuaaagcuaaaauauguuuau

SEQ ID NO: 150900 - RNA, 22 nt, Homo sapiens
uuuaaagcuccaagcaugucug

SEQ ID NO: 150901 - RNA, 22 nt, Homo sapiens
uuuaaguguuuguuccugaaaa

SEQ ID NO: 150902 - RNA, 22 nt, Homo sapiens
uuuaauacugcaucuuuacucu

SEQ ID NO: 150903 - RNA, 22 nt, Homo sapiens
uuuaaugcgucucugaguuuug

SEQ ID NO: 150904 - RNA, 22 nt, Homo sapiens
uuuaauguuacaguauugguau

SEQ ID NO: 150905 - RNA, 18 nt, Homo sapiens
uuuacaguagaaggacuu

SEQ ID NO: 150906 - RNA, 22 nt, Homo sapiens
uuuacugugggguuucuuagag

SEQ ID NO: 150907 - RNA, 22 nt, Homo sapiens
uuuagguaauauuaaguagcug

SEQ ID NO: 150908 - RNA, 22 nt, Homo sapiens
uuuagguauuugguauagcagu

SEQ ID NO: 150909 - RNA, 22 nt, Homo sapiens
uuuaucaggccuuuggaaaaau

SEQ ID NO: 150910 - RNA, 22 nt, Homo sapiens
uuuauccagccucuagcaaggu

SEQ ID NO: 150911 - RNA, 22 nt, Homo sapiens
uuuauguggagcacuugacaca

SEQ ID NO: 150912 - RNA, 22 nt, Homo sapiens
uuucaagugcugucuuagcugu

SEQ ID NO: 150913 - RNA, 23 nt, Homo sapiens
uuucacagaaggauuguagggcc

SEQ ID NO: 150914 - RNA, 22 nt, Homo sapiens
uuucacagagggcuucuuucua

SEQ ID NO: 150915 - RNA, 22 nt, Homo sapiens
uuucacagcaauugccuauugu

SEQ ID NO: 150916 - RNA, 22 nt, Homo sapiens
uuucacagcugucuuccgucuc

SEQ ID NO: 150917 - RNA, 22 nt, Homo sapiens
uuucacaguguucucccccaga

SEQ ID NO: 150918 - RNA, 18 nt, Homo sapiens
uuucaggguggacaugag

SEQ ID NO: 150919 - RNA, 22 nt, Homo sapiens
uuucaguguggcaggcauagcu

SEQ ID NO: 150920 - RNA, 22 nt, Homo sapiens
uuucauagccuucuaaugaguu

SEQ ID NO: 150921 - RNA, 22 nt, Homo sapiens
uuucauagccuuugucgucuga

SEQ ID NO: 150922 - RNA, 22 nt, Homo sapiens
uuucauccggcuguguauuaug

SEQ ID NO: 150923 - RNA, 22 nt, Homo sapiens
uuuccaagaugcuuacuuucuc

SEQ ID NO: 150924 - RNA, 22 nt, Homo sapiens
uuuccagguggccaacauuuua

SEQ ID NO: 150925 - RNA, 19 nt, Homo sapiens
uuuccaguaaucuuaugug

SEQ ID NO: 150926 - RNA, 22 nt, Homo sapiens
uuucccagugguacaguuuaua

SEQ ID NO: 150927 - RNA, 22 nt, Homo sapiens
uuucccauuguucugcucugug

SEQ ID NO: 150928 - RNA, 22 nt, Homo sapiens
uuucccuuacuuaaacuuacuc

SEQ ID NO: 150929 - RNA, 22 nt, Homo sapiens
uuucccuuugcuuugucagcca

SEQ ID NO: 150930 - RNA, 22 nt, Homo sapiens
uuucucaguguuucaggguagg

SEQ ID NO: 150931 - RNA, 22 nt, Homo sapiens
uuucugagaccaaaacuuguaa

SEQ ID NO: 150932 - RNA, 22 nt, Homo sapiens
uuucugcuugagagaauugcug

SEQ ID NO: 150933 - RNA, 21 nt, Homo sapiens
uuucugggggagcauggcagg

SEQ ID NO: 150934 - RNA, 22 nt, Homo sapiens
uuucugguuaauuucuaagagc

SEQ ID NO: 150935 - RNA, 22 nt, Homo sapiens
uuugaagcaauugugaauggga

SEQ ID NO: 150936 - RNA, 22 nt, Homo sapiens
uuugacuacugaugguguacgc

SEQ ID NO: 150937 - RNA, 22 nt, Homo sapiens
uuugacucacagccuggcugcc

SEQ ID NO: 150938 - RNA, 22 nt, Homo sapiens
uuugagcauuagggcaaaggca

SEQ ID NO: 150939 - RNA, 22 nt, Homo sapiens
uuugaggaaaggcauaaguagg

SEQ ID NO: 150940 - RNA, 22 nt, Homo sapiens
uuugauguugagacuauaaagc

SEQ ID NO: 150941 - RNA, 22 nt, Homo sapiens
uuugcagagacuuguuaggaau

SEQ ID NO: 150942 - RNA, 19 nt, Homo sapiens
uuugcauagugagaauaua

SEQ ID NO: 150943 - RNA, 22 nt, Homo sapiens
uuugcaucuuagaaaguucucc

SEQ ID NO: 150944 - RNA, 19 nt, Homo sapiens
uuugccuaggcacauggcc

SEQ ID NO: 150945 - RNA, 22 nt, Homo sapiens
uuugcugagucauuccaugcug

SEQ ID NO: 150946 - RNA, 20 nt, Homo sapiens
uuuggcacugagugguauaa

SEQ ID NO: 150947 - RNA, 22 nt, Homo sapiens
uuuggcacuguaaauuucucuu

SEQ ID NO: 150948 - RNA, 22 nt, Homo sapiens
uuuggcagaaaacuaaaaggua

SEQ ID NO: 150949 - RNA, 22 nt, Homo sapiens
uuuggcccugagggauggcaua

SEQ ID NO: 150950 - RNA, 22 nt, Homo sapiens
uuuggcuuugagaagcagugga

SEQ ID NO: 150951 - RNA, 22 nt, Homo sapiens
uuuggcuuuuguaauaacugcc

SEQ ID NO: 150952 - RNA, 22 nt, Homo sapiens
uuuggguuaguuuuccaaucuu

SEQ ID NO: 150953 - RNA, 22 nt, Homo sapiens
uuuggucagcugcgggucagcu

SEQ ID NO: 150954 - RNA, 22 nt, Homo sapiens
uuugguuuuuguuaucacucau

SEQ ID NO: 150955 - RNA, 22 nt, Homo sapiens
uuuguaagaugcauagauugca

SEQ ID NO: 150956 - RNA, 22 nt, Homo sapiens
uuuguacacuguugguaggauu

SEQ ID NO: 150957 - RNA, 22 nt, Homo sapiens
uuuguacuaugguuuuucacua

SEQ ID NO: 150958 - RNA, 22 nt, Homo sapiens
uuuguacugagccaagauggua

SEQ ID NO: 150959 - RNA, 22 nt, Homo sapiens
uuuguacuucauugguucuacu

SEQ ID NO: 150960 - RNA, 22 nt, Homo sapiens
uuugucacucuuggagguuguu

SEQ ID NO: 150961 - RNA, 22 nt, Homo sapiens
uuugugcugcaauuaauuuccc

SEQ ID NO: 150962 - RNA, 22 nt, Homo sapiens
uuuguggaaugcucauguguag

SEQ ID NO: 150963 - RNA, 22 nt, Homo sapiens
uuuguucaccucaaggauggga

SEQ ID NO: 150964 - RNA, 22 nt, Homo sapiens
uuuuacacuucgguugugugca

SEQ ID NO: 150965 - RNA, 22 nt, Homo sapiens
uuuuagcagccaugacaaagau

SEQ ID NO: 150966 - RNA, 20 nt, Homo sapiens
uuuugaacuuggcaaccugu

SEQ ID NO: 150967 - RNA, 23 nt, Homo sapiens
uuuugcaauaagucacuggaaua

SEQ ID NO: 150968 - RNA, 22 nt, Homo sapiens
uuuugcaggcauuggaaguuua

SEQ ID NO: 150969 - RNA, 22 nt, Homo sapiens
uuuugcauuggcugaggagugu

SEQ ID NO: 150970 - RNA, 19 nt, Homo sapiens
uuuugcucuuuauaccuau

SEQ ID NO: 150971 - RNA, 22 nt, Homo sapiens
uuuuggacuugcuccccugucc

SEQ ID NO: 150972 - RNA, 22 nt, Homo sapiens
uuuuggcuagaaauauaccucc

SEQ ID NO: 150973 - RNA, 22 nt, Homo sapiens
uuuugguaaugaacuuaggaag

SEQ ID NO: 150974 - RNA, 22 nt, Homo sapiens
uuuugguauauacggggguccu

SEQ ID NO: 150975 - RNA, 22 nt, Homo sapiens
uuuuguacgccuguguccauca

SEQ ID NO: 150976 - RNA, 22 nt, Homo sapiens
uuuuuuaguuagcugggcauga

SEQ ID NO: 150977 - RNA, 22 nt, Homo sapiens
uuuuuugcuguaugcaaacauc

SEQ ID NO: 150978 - RNA, 22 nt, Homo sapiens
aaaagcuuagaugggcuuguau

SEQ ID NO: 150979 - RNA, 22 nt, Homo sapiens
aaacaccacgcggucccucgga

SEQ ID NO: 150980 - RNA, 22 nt, Homo sapiens
aaacuugucuaauuauaagcau

SEQ ID NO: 150981 - RNA, 22 nt, Homo sapiens
aaagaagucagccuguccuuug

SEQ ID NO: 150982 - RNA, 22 nt, Homo sapiens
aaagcgcuguuaagaagacuga

SEQ ID NO: 150983 - RNA, 22 nt, Homo sapiens
aaagcuaccagauucuguugga

SEQ ID NO: 150984 - RNA, 22 nt, Homo sapiens
aaagcugucaaggcaggaggcu

SEQ ID NO: 150985 - RNA, 22 nt, Homo sapiens
aaaggcacuagaaguuaccuuu

SEQ ID NO: 150986 - RNA, 22 nt, Homo sapiens
aaaggcaucauuaguaccaagu

SEQ ID NO: 150987 - RNA, 22 nt, Homo sapiens
aaagggcuguuucuugacuugg

SEQ ID NO: 150988 - RNA, 22 nt, Homo sapiens
aaagggcuuuguaaacuucaag

SEQ ID NO: 150989 - RNA, 22 nt, Homo sapiens
aaaguaauugcaguuuuugcaa

SEQ ID NO: 150990 - RNA, 22 nt, Homo sapiens
aaagucuagaggaucaugugug

SEQ ID NO: 150991 - RNA, 22 nt, Homo sapiens
aaagucuguuuugucagagacu

SEQ ID NO: 150992 - RNA, 22 nt, Homo sapiens
aaagugcaguauuugggcagaa

SEQ ID NO: 150993 - RNA, 22 nt, Homo sapiens
aaagugcaguauuugggcagga

SEQ ID NO: 150994 - RNA, 22 nt, Homo sapiens
aaaguggacuaagugaauauga

SEQ ID NO: 150995 - RNA, 22 nt, Homo sapiens
aaaugacuuuuuaugcagagua

SEQ ID NO: 150996 - RNA, 21 nt, Homo sapiens
aaaugcacauuacugcuggug

SEQ ID NO: 150997 - RNA, 22 nt, Homo sapiens
aaaugcauugagggaaaaggca

SEQ ID NO: 150998 - RNA, 22 nt, Homo sapiens
aaaugcugucaaauuguguucu

SEQ ID NO: 150999 - RNA, 22 nt, Homo sapiens
aaaugcuguuccaggaccuauc

SEQ ID NO: 151000 - RNA, 22 nt, Homo sapiens
aaauugcuuuugaagacuuagu

SEQ ID NO: 151001 - RNA, 22 nt, Homo sapiens
aacaccaucccuuugaugcuuu

SEQ ID NO: 151002 - RNA, 22 nt, Homo sapiens
aacagaccuagauaguauaguc

SEQ ID NO: 151003 - RNA, 22 nt, Homo sapiens
aacagacugucacauaaaauug

SEQ ID NO: 151004 - RNA, 22 nt, Homo sapiens
aacagagcuggugacuccaggu

SEQ ID NO: 151005 - RNA, 22 nt, Homo sapiens
aacaucaaccaugaggguugga

SEQ ID NO: 151006 - RNA, 22 nt, Homo sapiens
aacugccucugacauaggcagg

SEQ ID NO: 151007 - RNA, 22 nt, Homo sapiens
aacuggccuccuugggaaauua

SEQ ID NO: 151008 - RNA, 21 nt, Homo sapiens
aagaaagcuggacuugccgcu

SEQ ID NO: 151009 - RNA, 19 nt, Homo sapiens
ucuugcacaugugaacuca

SEQ ID NO: 151010 - RNA, 22 nt, Homo sapiens
ucuugcaguucccaaauucaca

SEQ ID NO: 151011 - RNA, 20 nt, Homo sapiens
ucuugggaauguagccuagg

SEQ ID NO: 151012 - RNA, 22 nt, Homo sapiens
ucuugggugaguuugugaauaa

SEQ ID NO: 151013 - RNA, 22 nt, Homo sapiens
ucuuggguggauucauucuuuc

SEQ ID NO: 151014 - RNA, 22 nt, Homo sapiens
ucuuggguuuguccuucuccua

SEQ ID NO: 151015 - RNA, 17 nt, Homo sapiens
ucuugugguucuugaau

SEQ ID NO: 151016 - RNA, 22 nt, Homo sapiens
ucuuuaguaauuucuguaaggc

SEQ ID NO: 151017 - RNA, 19 nt, Homo sapiens
ucuuugaggcaucgcccuc

SEQ ID NO: 151018 - RNA, 22 nt, Homo sapiens
ucuuugauguucugaaagaugg

SEQ ID NO: 151019 - RNA, 22 nt, Homo sapiens
ucuuuggguagauauguagcug

SEQ ID NO: 151020 - RNA, 19 nt, Homo sapiens
ucuuugguacgugcuuuga

SEQ ID NO: 151021 - RNA, 22 nt, Homo sapiens
ucuuugguauugugaauagugu

SEQ ID NO: 151022 - RNA, 22 nt, Homo sapiens
ucuuuuggguauggagccauca

SEQ ID NO: 151023 - RNA, 22 nt, Homo sapiens
ucuuuuugagucaguuucggua

SEQ ID NO: 151024 - RNA, 22 nt, Homo sapiens
ugaaagcuacagucuccuagga

SEQ ID NO: 151025 - RNA, 22 nt, Homo sapiens
ugaaauacuuuggcucuuuguu

SEQ ID NO: 151026 - RNA, 22 nt, Homo sapiens
ugaaauggugcggucugcagca

SEQ ID NO: 151027 - RNA, 22 nt, Homo sapiens
ugaacacuggauaaggagucag

SEQ ID NO: 151028 - RNA, 20 nt, Homo sapiens
ugaacugguuacuuucuguc

SEQ ID NO: 151029 - RNA, 22 nt, Homo sapiens
ugaagacauuuuugggugugua

SEQ ID NO: 151030 - RNA, 22 nt, Homo sapiens
ugaagacucaguuugagggaca

SEQ ID NO: 151031 - RNA, 22 nt, Homo sapiens
ugaagacucauacuugaaucag

SEQ ID NO: 151032 - RNA, 22 nt, Homo sapiens
ugaagggcauuguuuugccaaa

SEQ ID NO: 151033 - RNA, 22 nt, Homo sapiens
ugaagugcugugggccaggcgu

SEQ ID NO: 151034 - RNA, 22 nt, Homo sapiens
ugaauacuucaaaaaaauagcu

SEQ ID NO: 151035 - RNA, 22 nt, Homo sapiens
ugaauagacacuaaagacugua

SEQ ID NO: 151036 - RNA, 22 nt, Homo sapiens
ugaauauguuaaauaauguucu

SEQ ID NO: 151037 - RNA, 22 nt, Homo sapiens
ugaauauguuucuaaaagugca

SEQ ID NO: 151038 - RNA, 21 nt, Homo sapiens
ugaauauuuggguugugucca

SEQ ID NO: 151039 - RNA, 22 nt, Homo sapiens
ugaaugauuuuaaaagccucuc

SEQ ID NO: 151040 - RNA, 22 nt, Homo sapiens
ugaaugguaauuuaguaggcac

SEQ ID NO: 151041 - RNA, 22 nt, Homo sapiens
ugaauucuguccaaaauaacug

SEQ ID NO: 151042 - RNA, 22 nt, Homo sapiens
ugacaagaaagcgucuucuuuu

SEQ ID NO: 151043 - RNA, 22 nt, Homo sapiens
ugacacagugggggauccuuuu

SEQ ID NO: 151044 - RNA, 22 nt, Homo sapiens
ugacacauguagacaucuggug

SEQ ID NO: 151045 - RNA, 19 nt, Homo sapiens
ugacacuguuggugggagg

SEQ ID NO: 151046 - RNA, 22 nt, Homo sapiens
ugacagaggucuuuuaauagcu

SEQ ID NO: 151047 - RNA, 22 nt, Homo sapiens
ugacaggagauuaugugauguu

SEQ ID NO: 151048 - RNA, 22 nt, Homo sapiens
ugacagguugauaggugcagca

SEQ ID NO: 151049 - RNA, 22 nt, Homo sapiens
ugacagugaauaagucucuuaa

SEQ ID NO: 151050 - RNA, 22 nt, Homo sapiens
ugacaguuuccagggcugucuc

SEQ ID NO: 151051 - RNA, 19 nt, Homo sapiens
ugacaugaaacccaagauc

SEQ ID NO: 151052 - RNA, 22 nt, Homo sapiens
ugacaugaugagcaauaauggc

SEQ ID NO: 151053 - RNA, 22 nt, Homo sapiens
ugacauggaagauguucaugau

SEQ ID NO: 151054 - RNA, 22 nt, Homo sapiens
ugacauggaaguagguauacau

SEQ ID NO: 151055 - RNA, 22 nt, Homo sapiens
ugacauggagagagaagccuuu

SEQ ID NO: 151056 - RNA, 22 nt, Homo sapiens
ugacauguauuagcucagugcu

SEQ ID NO: 151057 - RNA, 22 nt, Homo sapiens
ugacauguugcauuauauuucc

SEQ ID NO: 151058 - RNA, 22 nt, Homo sapiens
ugacggaggcauuggaagcuug

SEQ ID NO: 151059 - RNA, 22 nt, Homo sapiens
ugacuacacacaauuugucaag

SEQ ID NO: 151060 - RNA, 22 nt, Homo sapiens
ugacuacagauuugcugccaga

SEQ ID NO: 151061 - RNA, 22 nt, Homo sapiens
ugacuauaggauaacaugcauu

SEQ ID NO: 151062 - RNA, 22 nt, Homo sapiens
ugacuuaugcaacucugaugug

SEQ ID NO: 151063 - RNA, 22 nt, Homo sapiens
ugagaacagcagcuugggacac

SEQ ID NO: 151064 - RNA, 22 nt, Homo sapiens
ugagaacaugcacuugagguug

SEQ ID NO: 151065 - RNA, 20 nt, Homo sapiens
ugagaacauguggcauuugg

SEQ ID NO: 151066 - RNA, 22 nt, Homo sapiens
ugagaacuagagaacaagguga

SEQ ID NO: 151067 - RNA, 22 nt, Homo sapiens
ugagaacuguuuugguuugggu

SEQ ID NO: 151068 - RNA, 22 nt, Homo sapiens
ugagaagacaucuuugcuuugu

SEQ ID NO: 151069 - RNA, 22 nt, Homo sapiens
ugagaauauuuuccaugucuca

SEQ ID NO: 151070 - RNA, 21 nt, Homo sapiens
ugagacaauccuggucaauau

SEQ ID NO: 151071 - RNA, 22 nt, Homo sapiens
ugagacaaucucaucucaguga

SEQ ID NO: 151072 - RNA, 22 nt, Homo sapiens
ugagacacuucccagaucccuu

SEQ ID NO: 151073 - RNA, 22 nt, Homo sapiens
ugagacaugugaauauuuguac

SEQ ID NO: 151074 - RNA, 22 nt, Homo sapiens
ugagacggagucucgcucuguc

SEQ ID NO: 151075 - RNA, 22 nt, Homo sapiens
ugagacggagucucgcucuguu

SEQ ID NO: 151076 - RNA, 22 nt, Homo sapiens
ugagacggagucuugcucuguc

SEQ ID NO: 151077 - RNA, 22 nt, Homo sapiens
ugagacggaguuucgcucuugu

SEQ ID NO: 151078 - RNA, 22 nt, Homo sapiens
ugagacgucuucucuucuucaa

SEQ ID NO: 151079 - RNA, 22 nt, Homo sapiens
ugagacugagucucccucuguc

SEQ ID NO: 151080 - RNA, 22 nt, Homo sapiens
ugagacugaguuucgcucuugu

SEQ ID NO: 151081 - RNA, 22 nt, Homo sapiens
ugagacugaguuucucucuugu

SEQ ID NO: 151082 - RNA, 22 nt, Homo sapiens
ugagacugaguuuugccuuugu

SEQ ID NO: 151083 - RNA, 22 nt, Homo sapiens
ugagacugaguuuugcucuugu

SEQ ID NO: 151084 - RNA, 22 nt, Homo sapiens
ugagagcugguuguuuaaagga

SEQ ID NO: 151085 - RNA, 22 nt, Homo sapiens
ugagagcuuuuuugccugguga

SEQ ID NO: 151086 - RNA, 22 nt, Homo sapiens
ugagaggugauaaagcaagggu

SEQ ID NO: 151087 - RNA, 22 nt, Homo sapiens
ugagauaaagcauguacugugu

SEQ ID NO: 151088 - RNA, 22 nt, Homo sapiens
ugagauaaggaaauugaggcuc

SEQ ID NO: 151089 - RNA, 21 nt, Homo sapiens
ugagauaauauguuucugaug

SEQ ID NO: 151090 - RNA, 22 nt, Homo sapiens
ucagggacuuacaaaccagaag

SEQ ID NO: 151091 - RNA, 22 nt, Homo sapiens
ucagguaaucuauuugucuuuu

SEQ ID NO: 151092 - RNA, 23 nt, Homo sapiens
ucagguaggccuagaguauucuu

SEQ ID NO: 151093 - RNA, 22 nt, Homo sapiens
ucagguagugccaugauugauu

SEQ ID NO: 151094 - RNA, 22 nt, Homo sapiens
ucagguaucucuauagcaaugu

SEQ ID NO: 151095 - RNA, 22 nt, Homo sapiens
ucagguauuuuaucacaugaag

SEQ ID NO: 151096 - RNA, 22 nt, Homo sapiens
ucaguaaauguuaggacauuuc

SEQ ID NO: 151097 - RNA, 19 nt, Homo sapiens
ucaguagugcacauaagcc

SEQ ID NO: 151098 - RNA, 22 nt, Homo sapiens
ucagucauucacucacucggac

SEQ ID NO: 151099 - RNA, 22 nt, Homo sapiens
ucagugacugcugcuuguauac

SEQ ID NO: 151100 - RNA, 22 nt, Homo sapiens
ucagugcuguaccaucuaagga

SEQ ID NO: 151101 - RNA, 22 nt, Homo sapiens
ucagugguuaaaagauucuaga

SEQ ID NO: 151102 - RNA, 22 nt, Homo sapiens
ucaguucauggaggugucugcu

SEQ ID NO: 151103 - RNA, 22 nt, Homo sapiens
ucauagucuaagguucuuuugc

SEQ ID NO: 151104 - RNA, 21 nt, Homo sapiens
ucauauguaucuuugugccuc

SEQ ID NO: 151105 - RNA, 22 nt, Homo sapiens
ucauauugguuaaaauaguggg

SEQ ID NO: 151106 - RNA, 22 nt, Homo sapiens
ucaucagaaucccuuagggaug

SEQ ID NO: 151107 - RNA, 22 nt, Homo sapiens
ucaucagaguuuacaagcucag

SEQ ID NO: 151108 - RNA, 22 nt, Homo sapiens
ucaucaggcucauucaagcuga

SEQ ID NO: 151109 - RNA, 22 nt, Homo sapiens
ucaucagguaugucagcggagu

SEQ ID NO: 151110 - RNA, 23 nt, Homo sapiens
ucaugaggccauucaaauccauu

SEQ ID NO: 151111 - RNA, 22 nt, Homo sapiens
ucauggcacugaugagaguuuc

SEQ ID NO: 151112 - RNA, 19 nt, Homo sapiens
ucaugugcauacauuuggg

SEQ ID NO: 151113 - RNA, 22 nt, Homo sapiens
ucauuagagaucuuggggaaaa

SEQ ID NO: 151114 - RNA, 22 nt, Homo sapiens
ucauucacucccuugaaguuag

SEQ ID NO: 151115 - RNA, 22 nt, Homo sapiens
ucauucuuucuguggaggggcu

SEQ ID NO: 151116 - RNA, 20 nt, Homo sapiens
uccaguuuuggagacauucu

SEQ ID NO: 151117 - RNA, 22 nt, Homo sapiens
uccauaguugcacucuggagcc

SEQ ID NO: 151118 - RNA, 22 nt, Homo sapiens
uccaugaggcuacaguaaucuc

SEQ ID NO: 151119 - RNA, 22 nt, Homo sapiens
uccaugugaaaaggucgugaua

SEQ ID NO: 151120 - RNA, 23 nt, Homo sapiens
uccccgggagcaccagcuuguug

SEQ ID NO: 151121 - RNA, 19 nt, Homo sapiens
uccccgggucuagugcagc

SEQ ID NO: 151122 - RNA, 22 nt, Homo sapiens
uccccugagaccccucagcacu

SEQ ID NO: 151123 - RNA, 22 nt, Homo sapiens
uccccugagucaccugcuucuc

SEQ ID NO: 151124 - RNA, 22 nt, Homo sapiens
ucccuagagaagugauuuuuga

SEQ ID NO: 151125 - RNA, 22 nt, Homo sapiens
ucccugaaucucagguucugua

SEQ ID NO: 151126 - RNA, 19 nt, Homo sapiens
ucccugagucuuagcuuga

SEQ ID NO: 151127 - RNA, 22 nt, Homo sapiens
ucccuggacagccuugccuggg

SEQ ID NO: 151128 - RNA, 22 nt, Homo sapiens
ucccugguguuaguuuguucuu

SEQ ID NO: 151129 - RNA, 19 nt, Homo sapiens
ucccuguagaccacagugc

SEQ ID NO: 151130 - RNA, 22 nt, Homo sapiens
ucccuugguaauucuguuccuu

SEQ ID NO: 151131 - RNA, 19 nt, Homo sapiens
ucccuuuguauggacauac

SEQ ID NO: 151132 - RNA, 22 nt, Homo sapiens
uccucaguggauuggauggugc

SEQ ID NO: 151133 - RNA, 22 nt, Homo sapiens
uccugagagcagacccucuaua

SEQ ID NO: 151134 - RNA, 22 nt, Homo sapiens
uccuguaaucccagcuaccaga

SEQ ID NO: 151135 - RNA, 22 nt, Homo sapiens
uccuugagucugaacuuuggau

SEQ ID NO: 151136 - RNA, 22 nt, Homo sapiens
uccuugcacuaacuuaaggagg

SEQ ID NO: 151137 - RNA, 22 nt, Homo sapiens
ucgcgccauucuccugccucag

SEQ ID NO: 151138 - RNA, 22 nt, Homo sapiens
ucgugccacugcacuccagccu

SEQ ID NO: 151139 - RNA, 22 nt, Homo sapiens
ucguucuugucaguuuauaaag

SEQ ID NO: 151140 - RNA, 22 nt, Homo sapiens
ucuaguaaugagaggcaggaga

SEQ ID NO: 151141 - RNA, 22 nt, Homo sapiens
ucuauggaguuugaaugagaaa

SEQ ID NO: 151142 - RNA, 22 nt, Homo sapiens
ucucaaccuccacacuacaaua

SEQ ID NO: 151143 - RNA, 22 nt, Homo sapiens
ucucaagaugguagaugggaau

SEQ ID NO: 151144 - RNA, 22 nt, Homo sapiens
ucucaaguggucgcaguuagau

SEQ ID NO: 151145 - RNA, 22 nt, Homo sapiens
ucucaauuugauuacauucaua

SEQ ID NO: 151146 - RNA, 22 nt, Homo sapiens
ucucacagccauuucucccucu

SEQ ID NO: 151147 - RNA, 22 nt, Homo sapiens
ucucagugaauguggaaaaagc

SEQ ID NO: 151148 - RNA, 22 nt, Homo sapiens
ucucaguguuaucuaucugccu

SEQ ID NO: 151149 - RNA, 19 nt, Homo sapiens
ucucaguguuggucaggug

SEQ ID NO: 151150 - RNA, 22 nt, Homo sapiens
ucuccauugaaauggacauaau

SEQ ID NO: 151151 - RNA, 22 nt, Homo sapiens
ucuccauuuguaaggguuucuc

SEQ ID NO: 151152 - RNA, 20 nt, Homo sapiens
ucucccaaacagcaggcccu

SEQ ID NO: 151153 - RNA, 22 nt, Homo sapiens
ucucuguuuagagccagcaauu

SEQ ID NO: 151154 - RNA, 22 nt, Homo sapiens
ucugagcaauagauguggauau

SEQ ID NO: 151155 - RNA, 22 nt, Homo sapiens
ucugagguaggugcauggauac

SEQ ID NO: 151156 - RNA, 22 nt, Homo sapiens
ucugagguuaaauuuuauaguu

SEQ ID NO: 151157 - RNA, 22 nt, Homo sapiens
ucugaguggcagaaugagcuga

SEQ ID NO: 151158 - RNA, 22 nt, Homo sapiens
ucugccuacugagcacacagug

SEQ ID NO: 151159 - RNA, 22 nt, Homo sapiens
ucuggccccucccaaaucucau

SEQ ID NO: 151160 - RNA, 22 nt, Homo sapiens
ucuggcuucugacuuaggggac

SEQ ID NO: 151161 - RNA, 17 nt, Homo sapiens
ucuggcuuucacaccug

SEQ ID NO: 151162 - RNA, 23 nt, Homo sapiens
ucuggcuuugggaugcucaaggg

SEQ ID NO: 151163 - RNA, 22 nt, Homo sapiens
ucuggugugcucuggacuugca

SEQ ID NO: 151164 - RNA, 22 nt, Homo sapiens
ucuguacuuccguaccuaaagu

SEQ ID NO: 151165 - RNA, 22 nt, Homo sapiens
ucugucacugaaucccugucac

SEQ ID NO: 151166 - RNA, 19 nt, Homo sapiens
ucugucacuggggguauuc

SEQ ID NO: 151167 - RNA, 21 nt, Homo sapiens
ugagaugauccugcaugcaug

SEQ ID NO: 151168 - RNA, 22 nt, Homo sapiens
ugagaugguaaauuuuuguugu

SEQ ID NO: 151169 - RNA, 22 nt, Homo sapiens
ugagaugugaagaucacaugaa

SEQ ID NO: 151170 - RNA, 22 nt, Homo sapiens
ugagauguugcucugaaacaag

SEQ ID NO: 151171 - RNA, 22 nt, Homo sapiens
ugagauguuuguuucagugccu

SEQ ID NO: 151172 - RNA, 22 nt, Homo sapiens
ugagauuaucuugaucuugaaa

SEQ ID NO: 151173 - RNA, 22 nt, Homo sapiens
ugagauuguaucugcaaugugu

SEQ ID NO: 151174 - RNA, 22 nt, Homo sapiens
ugagcagaaagcugcaaggucg

SEQ ID NO: 151175 - RNA, 22 nt, Homo sapiens
ugagcagaguuguuucuccuga

SEQ ID NO: 151176 - RNA, 22 nt, Homo sapiens
ugagcagugagugugcugcagg

SEQ ID NO: 151177 - RNA, 21 nt, Homo sapiens
ugagcauuaguacaguaggga

SEQ ID NO: 151178 - RNA, 20 nt, Homo sapiens
ugagccccuggacucaagcg

SEQ ID NO: 151179 - RNA, 22 nt, Homo sapiens
ugagcucagcuaguugaggugu

SEQ ID NO: 151180 - RNA, 22 nt, Homo sapiens
ugagcucaguauuucauaaaca

SEQ ID NO: 151181 - RNA, 20 nt, Homo sapiens
ugagcuuguaaacacuguuu

SEQ ID NO: 151182 - RNA, 22 nt, Homo sapiens
ugaggagugagaaauugguuuc

SEQ ID NO: 151183 - RNA, 22 nt, Homo sapiens
ugagguaacaaacuaugaguua

SEQ ID NO: 151184 - RNA, 22 nt, Homo sapiens
ugagguagaaugauucuaauau

SEQ ID NO: 151185 - RNA, 22 nt, Homo sapiens
ugagguagguaccauuaucacu

SEQ ID NO: 151186 - RNA, 20 nt, Homo sapiens
ugaggucaggaguuacagac

SEQ ID NO: 151187 - RNA, 22 nt, Homo sapiens
ugaggucauguucugucagguu

SEQ ID NO: 151188 - RNA, 22 nt, Homo sapiens
ugagguuggggucagggcuagc

SEQ ID NO: 151189 - RNA, 22 nt, Homo sapiens
ugaguagaacaucaagucauac

SEQ ID NO: 151190 - RNA, 22 nt, Homo sapiens
ugaguagauccaagacuguccu

SEQ ID NO: 151191 - RNA, 23 nt, Homo sapiens
ugaguagguccacguaugugagu

SEQ ID NO: 151192 - RNA, 22 nt, Homo sapiens
ugaguagucagugggcaggaag

SEQ ID NO: 151193 - RNA, 22 nt, Homo sapiens
ugaguagugccacaauaagcau

SEQ ID NO: 151194 - RNA, 22 nt, Homo sapiens
ugaguauagaucaguucaagug

SEQ ID NO: 151195 - RNA, 22 nt, Homo sapiens
ugaguaucuugaugaauuugaa

SEQ ID NO: 151196 - RNA, 22 nt, Homo sapiens
ugaguaugaguucaggaaaggc

SEQ ID NO: 151197 - RNA, 23 nt, Homo sapiens
ugagucacuuugcuggggucucu

SEQ ID NO: 151198 - RNA, 22 nt, Homo sapiens
ugaguguccaaguaaggugaaa

SEQ ID NO: 151199 - RNA, 22 nt, Homo sapiens
ugagugugacuuagcagaagga

SEQ ID NO: 151200 - RNA, 22 nt, Homo sapiens
ugaguugagauaagguuacauu

SEQ ID NO: 151201 - RNA, 22 nt, Homo sapiens
ugauagaucugggcaaaguaaa

SEQ ID NO: 151202 - RNA, 22 nt, Homo sapiens
ugauauauugaaugaugaaaca

SEQ ID NO: 151203 - RNA, 22 nt, Homo sapiens
ugauauguaugugaccuagaaa

SEQ ID NO: 151204 - RNA, 22 nt, Homo sapiens
ugauauguguaaacaauguaua

SEQ ID NO: 151205 - RNA, 20 nt, Homo sapiens
ugauauuuucugagcaggaa

SEQ ID NO: 151206 - RNA, 21 nt, Homo sapiens
ugaucacaugaaaaccaugca

SEQ ID NO: 151207 - RNA, 22 nt, Homo sapiens
ugaugcugaguggcuauuugaa

SEQ ID NO: 151208 - RNA, 22 nt, Homo sapiens
ugauggcauuucauguuuguaa

SEQ ID NO: 151209 - RNA, 22 nt, Homo sapiens
ugauggcauuuggaguugggac

SEQ ID NO: 151210 - RNA, 22 nt, Homo sapiens
ugaugguccauaguucauggua

SEQ ID NO: 151211 - RNA, 22 nt, Homo sapiens
ugauguugacuguaggcagaga

SEQ ID NO: 151212 - RNA, 18 nt, Homo sapiens
ugauugacuuauuuaggu

SEQ ID NO: 151213 - RNA, 22 nt, Homo sapiens
ugauuugucucucagcccuacu

SEQ ID NO: 151214 - RNA, 22 nt, Homo sapiens
ugcaaagaaauuuuggugacca

SEQ ID NO: 151215 - RNA, 22 nt, Homo sapiens
ugcaaaugcugcuauuucucuu

SEQ ID NO: 151216 - RNA, 22 nt, Homo sapiens
ugcaaaugucaaggguuagugu

SEQ ID NO: 151217 - RNA, 22 nt, Homo sapiens
ugcaaauguuaguaacaccacu

SEQ ID NO: 151218 - RNA, 22 nt, Homo sapiens
ugcaagaaucuuucaggcuagc

SEQ ID NO: 151219 - RNA, 22 nt, Homo sapiens
ugcaaguaauuccagcuacuga

SEQ ID NO: 151220 - RNA, 20 nt, Homo sapiens
ugcaaguugccuuuggaggc

SEQ ID NO: 151221 - RNA, 22 nt, Homo sapiens
ugcaccacuacacuccaggcug

SEQ ID NO: 151222 - RNA, 22 nt, Homo sapiens
ugcaccacugcacuccaggcug

SEQ ID NO: 151223 - RNA, 16 nt, Homo sapiens
ugcagaguaggugaau

SEQ ID NO: 151224 - RNA, 22 nt, Homo sapiens
ugcagagucuguccugccugcc

SEQ ID NO: 151225 - RNA, 19 nt, Homo sapiens
ugcagcaauguaaaagaca

SEQ ID NO: 151226 - RNA, 22 nt, Homo sapiens
ugcagcacugaacuucugggcu

SEQ ID NO: 151227 - RNA, 22 nt, Homo sapiens
ugcagcucagcugcggaguuuu

SEQ ID NO: 151228 - RNA, 22 nt, Homo sapiens
ugcaguguucuuuagaggaaau

SEQ ID NO: 151229 - RNA, 22 nt, Homo sapiens
ugcauaucuucuuuugagaaau

SEQ ID NO: 151230 - RNA, 22 nt, Homo sapiens
ugcauauguucaaaguauucug

SEQ ID NO: 151231 - RNA, 22 nt, Homo sapiens
ugcauauucuaggauuuuguau

SEQ ID NO: 151232 - RNA, 21 nt, Homo sapiens
ugcauggagaacacugagggu

SEQ ID NO: 151233 - RNA, 22 nt, Homo sapiens
ugcauugccgugauuacugucu

SEQ ID NO: 151234 - RNA, 22 nt, Homo sapiens
ugcauuguuccgaauguguccu

SEQ ID NO: 151235 - RNA, 22 nt, Homo sapiens
ugcccguaauuccagcacuuug

SEQ ID NO: 151236 - RNA, 22 nt, Homo sapiens
ugcccuguaucccacuguuuca

SEQ ID NO: 151237 - RNA, 22 nt, Homo sapiens
ugccuaguggaaggagagcaaa

SEQ ID NO: 151238 - RNA, 22 nt, Homo sapiens
ugccuaguggccuuaugaguau

SEQ ID NO: 151239 - RNA, 22 nt, Homo sapiens
ugccugagcccagcccuguagu

SEQ ID NO: 151240 - RNA, 22 nt, Homo sapiens
ugccugcugucuaauauauucu

SEQ ID NO: 151241 - RNA, 22 nt, Homo sapiens
ugcgccauugaacuccaggcug

SEQ ID NO: 151242 - RNA, 22 nt, Homo sapiens
ugcuaugucagccaggcugguc

SEQ ID NO: 151243 - RNA, 22 nt, Homo sapiens
ugcucaguuuaaaacuuuugag

SEQ ID NO: 151244 - RNA, 23 nt, Homo sapiens
ugcucgguguugacagucacauc

SEQ ID NO: 151245 - RNA, 22 nt, Homo sapiens
ugcugguguggucuagccgcuu

SEQ ID NO: 151246 - RNA, 22 nt, Homo sapiens
ugcugguguuuaggaauaagaa

SEQ ID NO: 151247 - RNA, 19 nt, Homo sapiens
ugcuuaguuuuauguguaa

SEQ ID NO: 151248 - RNA, 22 nt, Homo sapiens
ugcuugagacacauaugaauuu

SEQ ID NO: 151249 - RNA, 22 nt, Homo sapiens
uggaaaguccaagccaaccggg

SEQ ID NO: 151250 - RNA, 22 nt, Homo sapiens
uggaaaucuaaguuuggauuga

SEQ ID NO: 151251 - RNA, 22 nt, Homo sapiens
uggaacaccaggcuggcguggc

SEQ ID NO: 151252 - RNA, 22 nt, Homo sapiens
gcagcagugcccuggauggaaa

SEQ ID NO: 151253 - RNA, 22 nt, Homo sapiens
gcagcaucaaaucacacaagau

SEQ ID NO: 151254 - RNA, 22 nt, Homo sapiens
gcaguacuuuauguccuaauua

SEQ ID NO: 151255 - RNA, 22 nt, Homo sapiens
gcaguagugugaucuuggcuca

SEQ ID NO: 151256 - RNA, 22 nt, Homo sapiens
gcagugacaugugccaguuuau

SEQ ID NO: 151257 - RNA, 22 nt, Homo sapiens
gcagugaugugaucauagcuca

SEQ ID NO: 151258 - RNA, 22 nt, Homo sapiens
gcaguguggguagagggcaaga

SEQ ID NO: 151259 - RNA, 22 nt, Homo sapiens
gcaguguucaaaucaugcccau

SEQ ID NO: 151260 - RNA, 22 nt, Homo sapiens
gcaguguuggggccggaggcug

SEQ ID NO: 151261 - RNA, 22 nt, Homo sapiens
gcaguucuguaguugaaauuua

SEQ ID NO: 151262 - RNA, 22 nt, Homo sapiens
gcauaugucuuuauagcagcau

SEQ ID NO: 151263 - RNA, 22 nt, Homo sapiens
gcauauguuuggguguguauau

SEQ ID NO: 151264 - RNA, 22 nt, Homo sapiens
gcaucacagcuccugugcuggc

SEQ ID NO: 151265 - RNA, 22 nt, Homo sapiens
gcaucacagggagacaggccuc

SEQ ID NO: 151266 - RNA, 22 nt, Homo sapiens
gcaugauuuuauaucuauguaa

SEQ ID NO: 151267 - RNA, 22 nt, Homo sapiens
gcaugcacaugugaaaaaauga

SEQ ID NO: 151268 - RNA, 22 nt, Homo sapiens
gcccagauguuuggggucaugg

SEQ ID NO: 151269 - RNA, 22 nt, Homo sapiens
gcccuguugcccaggcuggagu

SEQ ID NO: 151270 - RNA, 22 nt, Homo sapiens
gccuagggacaaaccguccgac

SEQ ID NO: 151271 - RNA, 22 nt, Homo sapiens
gcgcagugggcugugccaucca

SEQ ID NO: 151272 - RNA, 22 nt, Homo sapiens
gcuauggccugaauguuugugu

SEQ ID NO: 151273 - RNA, 22 nt, Homo sapiens
gcucaguuuccucagcugcaaa

SEQ ID NO: 151274 - RNA, 22 nt, Homo sapiens
gcucguuuuugccucugguugc

SEQ ID NO: 151275 - RNA, 22 nt, Homo sapiens
gcucugguuacaaaggcaaauu

SEQ ID NO: 151276 - RNA, 22 nt, Homo sapiens
gcugaaauguuuaauuugggag

SEQ ID NO: 151277 - RNA, 22 nt, Homo sapiens
gcugaguaguauuucauuguau

SEQ ID NO: 151278 - RNA, 22 nt, Homo sapiens
gcuggauguuucaauacaaaua

SEQ ID NO: 151279 - RNA, 22 nt, Homo sapiens
gcuucauggaggcugggcgcag

SEQ ID NO: 151280 - RNA, 22 nt, Homo sapiens
ggaaagacuauuguaaaggaug

SEQ ID NO: 151281 - RNA, 22 nt, Homo sapiens
ggaaagaucagcuaaauguaag

SEQ ID NO: 151282 - RNA, 22 nt, Homo sapiens
ggaaagauguaauauuaucuaa

SEQ ID NO: 151283 - RNA, 22 nt, Homo sapiens
ggaaauguuuagcauccacuuu

SEQ ID NO: 151284 - RNA, 20 nt, Homo sapiens
ggaagagugacacaagguau

SEQ ID NO: 151285 - RNA, 22 nt, Homo sapiens
ggaagguaauugucagcucaua

SEQ ID NO: 151286 - RNA, 22 nt, Homo sapiens
ggaaggucaaagggaaagcaga

SEQ ID NO: 151287 - RNA, 22 nt, Homo sapiens
ggaaugcuaaaauaggaugcug

SEQ ID NO: 151288 - RNA, 22 nt, Homo sapiens
ggacauguauauauaugugugu

SEQ ID NO: 151289 - RNA, 22 nt, Homo sapiens
ggagagugacauauuucuaggc

SEQ ID NO: 151290 - RNA, 22 nt, Homo sapiens
ggagauaauccagggagggacu

SEQ ID NO: 151291 - RNA, 22 nt, Homo sapiens
ggagaucuuguuaaaguacaga

SEQ ID NO: 151292 - RNA, 22 nt, Homo sapiens
ggagggugagaucaauuuggga

SEQ ID NO: 151293 - RNA, 22 nt, Homo sapiens
ggagguaauaaguuccagugua

SEQ ID NO: 151294 - RNA, 22 nt, Homo sapiens
ggagguagguuugugauuugua

SEQ ID NO: 151295 - RNA, 22 nt, Homo sapiens
ggagucuugcuauguugccaag

SEQ ID NO: 151296 - RNA, 23 nt, Homo sapiens
ggaguguauuggcacgaucucag

SEQ ID NO: 151297 - RNA, 22 nt, Homo sapiens
ggagugucagaaacaguguccu

SEQ ID NO: 151298 - RNA, 21 nt, Homo sapiens
ggauagaaaacuuggcuguau

SEQ ID NO: 151299 - RNA, 22 nt, Homo sapiens
ggaucacagccagcucccagaa

SEQ ID NO: 151300 - RNA, 22 nt, Homo sapiens
ggaugcauuuuugguugucaca

SEQ ID NO: 151301 - RNA, 23 nt, Homo sapiens
ggauggaaaguuuugagggccac

SEQ ID NO: 151302 - RNA, 22 nt, Homo sapiens
ggauggcauuucuuuagcuuuu

SEQ ID NO: 151303 - RNA, 22 nt, Homo sapiens
ggaugugugcacgcgcacaugc

SEQ ID NO: 151304 - RNA, 22 nt, Homo sapiens
ggauugcuuaagaaguuucauu

SEQ ID NO: 151305 - RNA, 22 nt, Homo sapiens
ggcaaagagacaugcaucgggg

SEQ ID NO: 151306 - RNA, 22 nt, Homo sapiens
ggcaaagaugaccauuacuuuu

SEQ ID NO: 151307 - RNA, 22 nt, Homo sapiens
ggcaagaacuucacucacuuuu

SEQ ID NO: 151308 - RNA, 22 nt, Homo sapiens
ggcaaggauguuuuucuggcaa

SEQ ID NO: 151309 - RNA, 22 nt, Homo sapiens
ggcaagugucagcagcaacacc

SEQ ID NO: 151310 - RNA, 23 nt, Homo sapiens
ggcacggaauucaaagaggcauu

SEQ ID NO: 151311 - RNA, 22 nt, Homo sapiens
ggcacugugaugugagggggua

SEQ ID NO: 151312 - RNA, 22 nt, Homo sapiens
ggcacuguugccggccugaauu

SEQ ID NO: 151313 - RNA, 22 nt, Homo sapiens
ggcagcacaauuuucugaugga

SEQ ID NO: 151314 - RNA, 22 nt, Homo sapiens
ggcagcgugcacuuucgccacu

SEQ ID NO: 151315 - RNA, 17 nt, Homo sapiens
ggcaggauccaggaucc

SEQ ID NO: 151316 - RNA, 22 nt, Homo sapiens
ggcaguguauuacuuaggguuc

SEQ ID NO: 151317 - RNA, 22 nt, Homo sapiens
ggcaugauguauuugagguuug

SEQ ID NO: 151318 - RNA, 22 nt, Homo sapiens
ggcauguugauagguagaugua

SEQ ID NO: 151319 - RNA, 22 nt, Homo sapiens
ggcauguuuaguagaauguggu

SEQ ID NO: 151320 - RNA, 22 nt, Homo sapiens
ggccagaugcaguggcucacac

SEQ ID NO: 151321 - RNA, 22 nt, Homo sapiens
ggcuagagaauagugccacuaa

SEQ ID NO: 151322 - RNA, 22 nt, Homo sapiens
ggcucaguugcaaaucaguuca

SEQ ID NO: 151323 - RNA, 22 nt, Homo sapiens
ggcuuuggucacacaggggcaa

SEQ ID NO: 151324 - RNA, 22 nt, Homo sapiens
gggaggucauuguaaggucuua

SEQ ID NO: 151325 - RNA, 22 nt, Homo sapiens
gggagugugcacacaugguaua

SEQ ID NO: 151326 - RNA, 22 nt, Homo sapiens
gggaugaagaagaauaguucgu

SEQ ID NO: 151327 - RNA, 22 nt, Homo sapiens
gggccagaugcauuuguuauuu

SEQ ID NO: 151328 - RNA, 22 nt, Homo sapiens
gggcgagaaucggcugcucagc

SEQ ID NO: 151329 - RNA, 22 nt, Homo sapiens
ggggcauugugucuggguuccu

SEQ ID NO: 151330 - RNA, 22 nt, Homo sapiens
gggggagugugguacccagcau

SEQ ID NO: 151331 - RNA, 22 nt, Homo sapiens
ggggucauuaaauuccgcuggu

SEQ ID NO: 151332 - RNA, 22 nt, Homo sapiens
gguauguuuagaccauuuacau

SEQ ID NO: 151333 - RNA, 22 nt, Homo sapiens
ggucacccugaugcuggugguc

SEQ ID NO: 151334 - RNA, 19 nt, Homo sapiens
ggucauggagguuguguga

SEQ ID NO: 151335 - RNA, 22 nt, Homo sapiens
ggugagcacagaaugcccugag

SEQ ID NO: 151336 - RNA, 22 nt, Homo sapiens
ggugcagcacaccaacauggca

SEQ ID NO: 151337 - RNA, 22 nt, Homo sapiens
gguggcuuuuugugauggcuga

SEQ ID NO: 151338 - RNA, 22 nt, Homo sapiens
guaaaugcagaugcaugaccuu

SEQ ID NO: 151339 - RNA, 22 nt, Homo sapiens
guaagagaauggguuacuuucc

SEQ ID NO: 151340 - RNA, 22 nt, Homo sapiens
guaagguuguauuucaagaaac

SEQ ID NO: 151341 - RNA, 22 nt, Homo sapiens
guaagugauagaauuaggauuc

SEQ ID NO: 151342 - RNA, 22 nt, Homo sapiens
cuggagaucuugacauugaagu

SEQ ID NO: 151343 - RNA, 22 nt, Homo sapiens
cuggagauuaaccaauugccau

SEQ ID NO: 151344 - RNA, 22 nt, Homo sapiens
cuggaguaugaaccauguauca

SEQ ID NO: 151345 - RNA, 22 nt, Homo sapiens
cuggauguaaaugaaacuacag

SEQ ID NO: 151346 - RNA, 20 nt, Homo sapiens
cuggaugucgaggcagaggu

SEQ ID NO: 151347 - RNA, 22 nt, Homo sapiens
cuggcacccuugcuuaggaaga

SEQ ID NO: 151348 - RNA, 22 nt, Homo sapiens
cuggcagugcuuguuauccugg

SEQ ID NO: 151349 - RNA, 22 nt, Homo sapiens
cuggcaguguuucuugugggcu

SEQ ID NO: 151350 - RNA, 22 nt, Homo sapiens
cuggcucugagguguuuagggc

SEQ ID NO: 151351 - RNA, 22 nt, Homo sapiens
cugggaucaguucuagucagaa

SEQ ID NO: 151352 - RNA, 22 nt, Homo sapiens
cugggauggaggagaauuagag

SEQ ID NO: 151353 - RNA, 22 nt, Homo sapiens
cuggucaugggggcacccucug

SEQ ID NO: 151354 - RNA, 22 nt, Homo sapiens
cuguaaagaucacagagcuggu

SEQ ID NO: 151355 - RNA, 22 nt, Homo sapiens
cuguaacagaauaaauuuguuu

SEQ ID NO: 151356 - RNA, 22 nt, Homo sapiens
cugucucagccucuccaguagc

SEQ ID NO: 151357 - RNA, 22 nt, Homo sapiens
cugugaacaugggagaaauggc

SEQ ID NO: 151358 - RNA, 22 nt, Homo sapiens
cugugauagguuagucaugaau

SEQ ID NO: 151359 - RNA, 22 nt, Homo sapiens
cuguggauguauugcacagucu

SEQ ID NO: 151360 - RNA, 19 nt, Homo sapiens
cuguggucauuauuuugcu

SEQ ID NO: 151361 - RNA, 23 nt, Homo sapiens
cuguggugaggcccuagaaucug

SEQ ID NO: 151362 - RNA, 22 nt, Homo sapiens
cugugguugagcuuugccauga

SEQ ID NO: 151363 - RNA, 22 nt, Homo sapiens
cuguuugguaaggaugccucag

SEQ ID NO: 151364 - RNA, 22 nt, Homo sapiens
cuuagguaggugccagguuuuu

SEQ ID NO: 151365 - RNA, 22 nt, Homo sapiens
cuucaaaguuggcuaggagaca

SEQ ID NO: 151366 - RNA, 22 nt, Homo sapiens
cuucaagucuuuggauaauuag

SEQ ID NO: 151367 - RNA, 22 nt, Homo sapiens
cuuccauaguauuuuuacaaaa

SEQ ID NO: 151368 - RNA, 22 nt, Homo sapiens
cuucucagugcucaucuuauuu

SEQ ID NO: 151369 - RNA, 22 nt, Homo sapiens
cuucuguuaguucugauaacuu

SEQ ID NO: 151370 - RNA, 22 nt, Homo sapiens
cuugagcaaacaaaggugguag

SEQ ID NO: 151371 - RNA, 22 nt, Homo sapiens
cuugaucaaugugguacuugau

SEQ ID NO: 151372 - RNA, 19 nt, Homo sapiens
cuugccccauucauccucu

SEQ ID NO: 151373 - RNA, 22 nt, Homo sapiens
cuugccuaaucugcaugauuuu

SEQ ID NO: 151374 - RNA, 20 nt, Homo sapiens
cuuggcuuucuugguguuaa

SEQ ID NO: 151375 - RNA, 22 nt, Homo sapiens
cuuguacacuguuggugggaau

SEQ ID NO: 151376 - RNA, 22 nt, Homo sapiens
cuugugcaugaccccagguggg

SEQ ID NO: 151377 - RNA, 22 nt, Homo sapiens
cuuguguuacauauuuaagaga

SEQ ID NO: 151378 - RNA, 22 nt, Homo sapiens
guaaucucagcuacucgggaga

SEQ ID NO: 151379 - RNA, 22 nt, Homo sapiens
guacaggcagcaaacaccauaa

SEQ ID NO: 151380 - RNA, 22 nt, Homo sapiens
guacaguaguaaaagugaauga

SEQ ID NO: 151381 - RNA, 22 nt, Homo sapiens
guacaugugcacagugugcagg

SEQ ID NO: 151382 - RNA, 22 nt, Homo sapiens
guagaagcacagggccuguauu

SEQ ID NO: 151383 - RNA, 22 nt, Homo sapiens
guagcagcuacuaaguugcugu

SEQ ID NO: 151384 - RNA, 22 nt, Homo sapiens
guaguuuaucagaaagaauagg

SEQ ID NO: 151385 - RNA, 23 nt, Homo sapiens
guaguuugaugcaauccacuugu

SEQ ID NO: 151386 - RNA, 22 nt, Homo sapiens
guauacaguugacccuugaacc

SEQ ID NO: 151387 - RNA, 22 nt, Homo sapiens
guauacuucugaaaauagcuau

SEQ ID NO: 151388 - RNA, 22 nt, Homo sapiens
gucaagagaacuuucuaucacu

SEQ ID NO: 151389 - RNA, 22 nt, Homo sapiens
gucaccagcuguguuagccccu

SEQ ID NO: 151390 - RNA, 21 nt, Homo sapiens
gucacuggggcuggauaauuc

SEQ ID NO: 151391 - RNA, 22 nt, Homo sapiens
gucagguauguuccaaaggcgg

SEQ ID NO: 151392 - RNA, 22 nt, Homo sapiens
gucagugcauguaaacauaaaa

SEQ ID NO: 151393 - RNA, 22 nt, Homo sapiens
gucaguuugguuaaucauucca

SEQ ID NO: 151394 - RNA, 22 nt, Homo sapiens
guccauuuguuuccagagcacu

SEQ ID NO: 151395 - RNA, 22 nt, Homo sapiens
gucccaguggaaccuccaagcu

SEQ ID NO: 151396 - RNA, 22 nt, Homo sapiens
guccuguuuuuaagguucauag

SEQ ID NO: 151397 - RNA, 22 nt, Homo sapiens
gucugugguuccuaugucaccu

SEQ ID NO: 151398 - RNA, 22 nt, Homo sapiens
gucuugaaggcugaguaccugu

SEQ ID NO: 151399 - RNA, 22 nt, Homo sapiens
gucuuggagacauugccauuga

SEQ ID NO: 151400 - RNA, 20 nt, Homo sapiens
gucuuguagcucaaguuauu

SEQ ID NO: 151401 - RNA, 22 nt, Homo sapiens
gucuuuggaaaaaaugucuguu

SEQ ID NO: 151402 - RNA, 22 nt, Homo sapiens
gugaaauacauaaucccaagug

SEQ ID NO: 151403 - RNA, 17 nt, Homo sapiens
gugaaaucaucauuuuu

SEQ ID NO: 151404 - RNA, 22 nt, Homo sapiens
gugaacaauguuuuauccuggg

SEQ ID NO: 151405 - RNA, 22 nt, Homo sapiens
gugaauagggaauaaugggauc

SEQ ID NO: 151406 - RNA, 22 nt, Homo sapiens
gugaaucuguuuucuucuguuc

SEQ ID NO: 151407 - RNA, 22 nt, Homo sapiens
gugagaugaggucucacucugu

SEQ ID NO: 151408 - RNA, 22 nt, Homo sapiens
gugagauggaguuggugucuuu

SEQ ID NO: 151409 - RNA, 22 nt, Homo sapiens
gugagcaguguccuugggggca

SEQ ID NO: 151410 - RNA, 22 nt, Homo sapiens
gugaggcugguccugccuccca

SEQ ID NO: 151411 - RNA, 22 nt, Homo sapiens
gugagguagagcaugugaaaga

SEQ ID NO: 151412 - RNA, 21 nt, Homo sapiens
gugaggucauugggcuuucug

SEQ ID NO: 151413 - RNA, 22 nt, Homo sapiens
gugaggucguagucauaggcaa

SEQ ID NO: 151414 - RNA, 22 nt, Homo sapiens
gugagguguuaaccaaccugug

SEQ ID NO: 151415 - RNA, 22 nt, Homo sapiens
gugaugacauucagagaugaag

SEQ ID NO: 151416 - RNA, 22 nt, Homo sapiens
gugcaacaucccuccauaauuu

SEQ ID NO: 151417 - RNA, 22 nt, Homo sapiens
gugcaaugaguguggcaaagcc

SEQ ID NO: 151418 - RNA, 22 nt, Homo sapiens
gugcaaugucaggagaugcagc

SEQ ID NO: 151419 - RNA, 22 nt, Homo sapiens
gugcacaaugugcagguuuguu

SEQ ID NO: 151420 - RNA, 23 nt, Homo sapiens
gugcaguggcgagauuucggcuc

SEQ ID NO: 151421 - RNA, 22 nt, Homo sapiens
gugcagugugauccuuccguau

SEQ ID NO: 151422 - RNA, 18 nt, Homo sapiens
gugcauagccauggcagc

SEQ ID NO: 151423 - RNA, 19 nt, Homo sapiens
gugcauaguuauuaaagag

SEQ ID NO: 151424 - RNA, 22 nt, Homo sapiens
gugcauaugcaugugcaugcac

SEQ ID NO: 151425 - RNA, 23 nt, Homo sapiens
gugcaugagucuuuauaguagca

SEQ ID NO: 151426 - RNA, 22 nt, Homo sapiens
guggaaaaguaguugcgguuuu

SEQ ID NO: 151427 - RNA, 22 nt, Homo sapiens
guggaagaaaucagguuauuug

SEQ ID NO: 151428 - RNA, 22 nt, Homo sapiens
guggaagauaguguguuaaugu

SEQ ID NO: 151429 - RNA, 22 nt, Homo sapiens
guggaaguuaagugacuuucug

SEQ ID NO: 151430 - RNA, 22 nt, Homo sapiens
guggaaucuagagaggcaguag

SEQ ID NO: 151431 - RNA, 22 nt, Homo sapiens
guggaaugauaucucauugugg

SEQ ID NO: 151432 - RNA, 22 nt, Homo sapiens
guggacaugaauuuuggaggca

SEQ ID NO: 151433 - RNA, 22 nt, Homo sapiens
guggagacaaaggcugagugag

SEQ ID NO: 151434 - RNA, 22 nt, Homo sapiens
guggaggagaaagaagcauuuc

SEQ ID NO: 151435 - RNA, 22 nt, Homo sapiens
guggcacaauuaaguagcuauu

SEQ ID NO: 151436 - RNA, 22 nt, Homo sapiens
guggcagcacauauagguuguu

SEQ ID NO: 151437 - RNA, 22 nt, Homo sapiens
guggcaguuuuaaauaugaaaa

SEQ ID NO: 151438 - RNA, 23 nt, Homo sapiens
guggccuuuggccaguccgaguc

SEQ ID NO: 151439 - RNA, 22 nt, Homo sapiens
gugggaagcuggaacucccucc

SEQ ID NO: 151440 - RNA, 22 nt, Homo sapiens
gugggguaggcaauuccuagug

SEQ ID NO: 151441 - RNA, 22 nt, Homo sapiens
guggguaaaucucuguuugagg

SEQ ID NO: 151442 - RNA, 22 nt, Homo sapiens
gugguucuaaaccuuuuuuggu

SEQ ID NO: 151443 - RNA, 22 nt, Homo sapiens
gugguucuagaauugaguaucc

SEQ ID NO: 151444 - RNA, 22 nt, Homo sapiens
gugguuuuacaaagagaaagau

SEQ ID NO: 151445 - RNA, 22 nt, Homo sapiens
gugguuuuuuucugccuuauag

SEQ ID NO: 151446 - RNA, 22 nt, Homo sapiens
guguauauccuauuaguucugu

SEQ ID NO: 151447 - RNA, 21 nt, Homo sapiens
gugucacagacaugacagaug

SEQ ID NO: 151448 - RNA, 22 nt, Homo sapiens
gugucuccuguggagcuaugua

SEQ ID NO: 151449 - RNA, 20 nt, Homo sapiens
gugugcauuucagauuuugg

SEQ ID NO: 151450 - RNA, 22 nt, Homo sapiens
guguuauugagaaauagggugu

SEQ ID NO: 151451 - RNA, 22 nt, Homo sapiens
guguuauuuugcugggaaugau

SEQ ID NO: 151452 - RNA, 22 nt, Homo sapiens
guguucaaauucugacagagag

SEQ ID NO: 151453 - RNA, 22 nt, Homo sapiens
guguucauggaauuugcaauug

SEQ ID NO: 151454 - RNA, 22 nt, Homo sapiens
guuaugcagcaauugauaaucu

SEQ ID NO: 151455 - RNA, 22 nt, Homo sapiens
guuauguuaaauuguuguaugc

SEQ ID NO: 151456 - RNA, 22 nt, Homo sapiens
guuauuguccauuuauuuagca

SEQ ID NO: 151457 - RNA, 21 nt, Homo sapiens
guucaagugauccuccugucu

SEQ ID NO: 151458 - RNA, 22 nt, Homo sapiens
guucacaguuaggacaacugcu

SEQ ID NO: 151459 - RNA, 22 nt, Homo sapiens
guucacaguucagccuguaaca

SEQ ID NO: 151460 - RNA, 22 nt, Homo sapiens
guucagcaggggcuucaauggu

SEQ ID NO: 151461 - RNA, 22 nt, Homo sapiens
guucaucaggcuuucucuagag

SEQ ID NO: 151462 - RNA, 17 nt, Homo sapiens
guucccaguggcauuug

SEQ ID NO: 151463 - RNA, 22 nt, Homo sapiens
guucucacuggugcugguaagu

SEQ ID NO: 151464 - RNA, 22 nt, Homo sapiens
guugcaugucugggaggccagc

SEQ ID NO: 151465 - RNA, 22 nt, Homo sapiens
guuggugaccugaagagaguaa

SEQ ID NO: 151466 - RNA, 22 nt, Homo sapiens
guuuaacugguacuucaagucu

SEQ ID NO: 151467 - RNA, 22 nt, Homo sapiens
guuugcagaucaugaagaaccc

SEQ ID NO: 151468 - RNA, 22 nt, Homo sapiens
uguuaucauuacguucuuaguu

SEQ ID NO: 151469 - RNA, 22 nt, Homo sapiens
uguucaauucccaccuaugagu

SEQ ID NO: 151470 - RNA, 22 nt, Homo sapiens
uguugcacacacugaaauacac

SEQ ID NO: 151471 - RNA, 22 nt, Homo sapiens
uguugcacuccagccugggcaa

SEQ ID NO: 151472 - RNA, 22 nt, Homo sapiens
uguugcacuccagccuggguga

SEQ ID NO: 151473 - RNA, 19 nt, Homo sapiens
uguugcacuccagcuuggg

SEQ ID NO: 151474 - RNA, 22 nt, Homo sapiens
uguugcacucuagccugggcaa

SEQ ID NO: 151475 - RNA, 22 nt, Homo sapiens
uguuggacuuacuuggcagauu

SEQ ID NO: 151476 - RNA, 22 nt, Homo sapiens
uguuuaguuaagacauagaauu

SEQ ID NO: 151477 - RNA, 22 nt, Homo sapiens
uguuugcuuaacguggagccag

SEQ ID NO: 151478 - RNA, 22 nt, Homo sapiens
uguuuguuugagauggagucuc

SEQ ID NO: 151479 - RNA, 22 nt, Homo sapiens
uguuuguuugugauacgguaca

SEQ ID NO: 151480 - RNA, 22 nt, Homo sapiens
uuaaaguguuugcagacaggug

SEQ ID NO: 151481 - RNA, 22 nt, Homo sapiens
uuaaauacagcaugguguuucu

SEQ ID NO: 151482 - RNA, 22 nt, Homo sapiens
uuaacacugccauugauacugu

SEQ ID NO: 151483 - RNA, 21 nt, Homo sapiens
uuaacagacaagugucuuccc

SEQ ID NO: 151484 - RNA, 22 nt, Homo sapiens
uuaaggaaggagucuuaaaugg

SEQ ID NO: 151485 - RNA, 22 nt, Homo sapiens
uuaaggcagugcaucuggaguu

SEQ ID NO: 151486 - RNA, 22 nt, Homo sapiens
uuaaguagaugaaugugaaugu

SEQ ID NO: 151487 - RNA, 22 nt, Homo sapiens
uuaagugguagguggugcccaa

SEQ ID NO: 151488 - RNA, 22 nt, Homo sapiens
uuaaucucaggaguuugggacc

SEQ ID NO: 151489 - RNA, 22 nt, Homo sapiens
uuaaugaacuuuauuuuguaga

SEQ ID NO: 151490 - RNA, 22 nt, Homo sapiens
uuaaugacaucauaggugaagu

SEQ ID NO: 151491 - RNA, 22 nt, Homo sapiens
uuaaugcuuggggaguaguucu

SEQ ID NO: 151492 - RNA, 22 nt, Homo sapiens
uuacaacugucuuacugguuau

SEQ ID NO: 151493 - RNA, 22 nt, Homo sapiens
uuacagcugcuccccaucacuc

SEQ ID NO: 151494 - RNA, 22 nt, Homo sapiens
uuacaguaugaguaagaguucu

SEQ ID NO: 151495 - RNA, 22 nt, Homo sapiens
uuacagucuuaggcagugcuuu

SEQ ID NO: 151496 - RNA, 19 nt, Homo sapiens
uuacauccauugcauuuca

SEQ ID NO: 151497 - RNA, 22 nt, Homo sapiens
uuacugcuagcugugugcucuu

SEQ ID NO: 151498 - RNA, 22 nt, Homo sapiens
ugggaaauguagccuagcugug

SEQ ID NO: 151499 - RNA, 20 nt, Homo sapiens
ugggaacaugugguauaugg

SEQ ID NO: 151500 - RNA, 18 nt, Homo sapiens
ugggaagaaauucuucuc

SEQ ID NO: 151501 - RNA, 22 nt, Homo sapiens
ugggaagauucuguguuuuucc

SEQ ID NO: 151502 - RNA, 22 nt, Homo sapiens
ugggaaugaaauuacauagcuu

SEQ ID NO: 151503 - RNA, 22 nt, Homo sapiens
ugggagugugcacaauuucagc

SEQ ID NO: 151504 - RNA, 22 nt, Homo sapiens
ugggaugaugcuugagaauauc

SEQ ID NO: 151505 - RNA, 22 nt, Homo sapiens
ugggccgcugcaggaugguccc

SEQ ID NO: 151506 - RNA, 22 nt, Homo sapiens
ugguauuuaauauaugagaguu

SEQ ID NO: 151507 - RNA, 21 nt, Homo sapiens
uggucccauaagauuacaaug

SEQ ID NO: 151508 - RNA, 22 nt, Homo sapiens
uggucucuuugcuuuagucauc

SEQ ID NO: 151509 - RNA, 20 nt, Homo sapiens
ugguguuugaacagugaaug

SEQ ID NO: 151510 - RNA, 23 nt, Homo sapiens
uguaaaagcauuugucagccugg

SEQ ID NO: 151511 - RNA, 22 nt, Homo sapiens
uguaagcagcagagacuauccu

SEQ ID NO: 151512 - RNA, 22 nt, Homo sapiens
uguaagcauugggcaugcaguc

SEQ ID NO: 151513 - RNA, 22 nt, Homo sapiens
uguaaugaucaaaucagaguaa

SEQ ID NO: 151514 - RNA, 22 nt, Homo sapiens
uguacaaaacaagaugggggua

SEQ ID NO: 151515 - RNA, 22 nt, Homo sapiens
uguacaugggacaggaggagag

SEQ ID NO: 151516 - RNA, 22 nt, Homo sapiens
uguagcagccauaaacacagug

SEQ ID NO: 151517 - RNA, 22 nt, Homo sapiens
uguagucauuugaaggaugucc

SEQ ID NO: 151518 - RNA, 22 nt, Homo sapiens
uguauacugucuaauauguugu

SEQ ID NO: 151519 - RNA, 22 nt, Homo sapiens
uguaugagagugaaagcauuuc

SEQ ID NO: 151520 - RNA, 22 nt, Homo sapiens
uguaugucugcucuuuggaacu

SEQ ID NO: 151521 - RNA, 22 nt, Homo sapiens
ugucaaauucuggguuaaaaca

SEQ ID NO: 151522 - RNA, 20 nt, Homo sapiens
ugucaagaaacauuacuuau

SEQ ID NO: 151523 - RNA, 21 nt, Homo sapiens
ugucaagaugacugcugcggc

SEQ ID NO: 151524 - RNA, 22 nt, Homo sapiens
ugucaauauguaauaacugaau

SEQ ID NO: 151525 - RNA, 22 nt, Homo sapiens
ugucaggaggguccagagaaaa

SEQ ID NO: 151526 - RNA, 22 nt, Homo sapiens
ugucaguggacugugaaaggca

SEQ ID NO: 151527 - RNA, 22 nt, Homo sapiens
ugucaguggucuggaugcagcc

SEQ ID NO: 151528 - RNA, 22 nt, Homo sapiens
ugucaguuuuaacuagggaaua

SEQ ID NO: 151529 - RNA, 22 nt, Homo sapiens
ugucuaaagaauggcagacuca

SEQ ID NO: 151530 - RNA, 22 nt, Homo sapiens
ugucuguuugcgaaauugcuuc

SEQ ID NO: 151531 - RNA, 22 nt, Homo sapiens
ugucuuguagacugaaggcuuc

SEQ ID NO: 151532 - RNA, 22 nt, Homo sapiens
ugugaacaaaauuuguugcaua

SEQ ID NO: 151533 - RNA, 22 nt, Homo sapiens
ugugaacacagaggcuauggca

SEQ ID NO: 151534 - RNA, 22 nt, Homo sapiens
ugugaacagcuccaaaugugga

SEQ ID NO: 151535 - RNA, 22 nt, Homo sapiens
ugugaagauggacuaauauagu

SEQ ID NO: 151536 - RNA, 22 nt, Homo sapiens
ugugaaugaagaaugcuaaccu

SEQ ID NO: 151537 - RNA, 22 nt, Homo sapiens
ugugaauggugcuuccuagaug

SEQ ID NO: 151538 - RNA, 22 nt, Homo sapiens
ugugacagguauccuguguucu

SEQ ID NO: 151539 - RNA, 22 nt, Homo sapiens
ugugacaguuaguuugguguua

SEQ ID NO: 151540 - RNA, 22 nt, Homo sapiens
ugugaccaaaaucaacauaccu

SEQ ID NO: 151541 - RNA, 22 nt, Homo sapiens
ugugagaaaugcagaaucucag

SEQ ID NO: 151542 - RNA, 22 nt, Homo sapiens
ugugaguguguacuaguuauca

SEQ ID NO: 151543 - RNA, 22 nt, Homo sapiens
ugugaucaugguauuaaucugc

SEQ ID NO: 151544 - RNA, 22 nt, Homo sapiens
ugugaucauuucaggaauuuug

SEQ ID NO: 151545 - RNA, 22 nt, Homo sapiens
ugugcacaaccugcagguuugu

SEQ ID NO: 151546 - RNA, 22 nt, Homo sapiens
ugugcacaaugugcagguuuga

SEQ ID NO: 151547 - RNA, 22 nt, Homo sapiens
ugugcacaaugugcagguuugu

SEQ ID NO: 151548 - RNA, 22 nt, Homo sapiens
ugugcacauugugcagguugau

SEQ ID NO: 151549 - RNA, 22 nt, Homo sapiens
ugugccacuccagcucuagcuu

SEQ ID NO: 151550 - RNA, 22 nt, Homo sapiens
uguggcauuuucagaaaggaug

SEQ ID NO: 151551 - RNA, 22 nt, Homo sapiens
uguggccccuagcuacuagaga

SEQ ID NO: 151552 - RNA, 22 nt, Homo sapiens
uguggccuuuguuucaguuggg

SEQ ID NO: 151553 - RNA, 18 nt, Homo sapiens
uguggcuguuuuccaaua

SEQ ID NO: 151554 - RNA, 22 nt, Homo sapiens
uguggcuuuguaaccauggguc

SEQ ID NO: 151555 - RNA, 22 nt, Homo sapiens
ugugguuuuaguaaaacuaugu

SEQ ID NO: 151556 - RNA, 22 nt, Homo sapiens
ugugguuuuauaaacgugaccu

SEQ ID NO: 151557 - RNA, 22 nt, Homo sapiens
ugugguuuuuuucuccaauagg

SEQ ID NO: 151558 - RNA, 22 nt, Homo sapiens
uguguacugcagaguauucugu

SEQ ID NO: 151559 - RNA, 22 nt, Homo sapiens
uguguuuuuauguaaaauggaa

SEQ ID NO: 151560 - RNA, 21 nt, Homo sapiens
uguuaacaugcagauuacugg

SEQ ID NO: 151561 - RNA, 18 nt, Homo sapiens
cuuugcagcuuccagagg

SEQ ID NO: 151562 - RNA, 22 nt, Homo sapiens
cuuuggcaaugucauuuucaau

SEQ ID NO: 151563 - RNA, 23 nt, Homo sapiens
cuuugguaggaaauuugaauuau

SEQ ID NO: 151564 - RNA, 22 nt, Homo sapiens
cuuuggucaaaauaaguaaguu

SEQ ID NO: 151565 - RNA, 22 nt, Homo sapiens
cuuugguucuguuuauaugcug

SEQ ID NO: 151566 - RNA, 22 nt, Homo sapiens
cuuuuacacuguuggcaggauu

SEQ ID NO: 151567 - RNA, 21 nt, Homo sapiens
cuuuugcacuccagccugggu

SEQ ID NO: 151568 - RNA, 22 nt, Homo sapiens
cuuuuggcuuaagauugucuug

SEQ ID NO: 151569 - RNA, 20 nt, Homo sapiens
gaaacaucuauccucuccuu

SEQ ID NO: 151570 - RNA, 22 nt, Homo sapiens
gaaagcugguauagauacauua

SEQ ID NO: 151571 - RNA, 22 nt, Homo sapiens
gaacccuggaggcggagguugc

SEQ ID NO: 151572 - RNA, 22 nt, Homo sapiens
gaacuuguguugcuucacaugu

SEQ ID NO: 151573 - RNA, 22 nt, Homo sapiens
gaagacauuuacaugggagacc

SEQ ID NO: 151574 - RNA, 22 nt, Homo sapiens
gaagugcuuuuggacuaacagu

SEQ ID NO: 151575 - RNA, 21 nt, Homo sapiens
gaauggcaccauuagcauaua

SEQ ID NO: 151576 - RNA, 22 nt, Homo sapiens
gaaugugcuguuggcugggcgu

SEQ ID NO: 151577 - RNA, 22 nt, Homo sapiens
gaauguuuacuuuguuuaauac

SEQ ID NO: 151578 - RNA, 22 nt, Homo sapiens
gacagugagaugucaugugaaa

SEQ ID NO: 151579 - RNA, 18 nt, Homo sapiens
gacaguguggcaauuccu

SEQ ID NO: 151580 - RNA, 18 nt, Homo sapiens
gacaguguggcgauuccu

SEQ ID NO: 151581 - RNA, 22 nt, Homo sapiens
gacaguuuggugaggaagacga

SEQ ID NO: 151582 - RNA, 22 nt, Homo sapiens
gacauagcuagauaaccucaug

SEQ ID NO: 151583 - RNA, 17 nt, Homo sapiens
gacauaggaaaaggaga

SEQ ID NO: 151584 - RNA, 22 nt, Homo sapiens
gacucagaacuaaggguguuuc

SEQ ID NO: 151585 - RNA, 18 nt, Homo sapiens
gacuccauuucagccaga

SEQ ID NO: 151586 - RNA, 22 nt, Homo sapiens
gacuuagagauguuguauuugg

SEQ ID NO: 151587 - RNA, 22 nt, Homo sapiens
gagaacauacggcauuugguuu

SEQ ID NO: 151588 - RNA, 22 nt, Homo sapiens
gagaacuggcugauucaaggac

SEQ ID NO: 151589 - RNA, 22 nt, Homo sapiens
gagacggagucacgcccuguca

SEQ ID NO: 151590 - RNA, 22 nt, Homo sapiens
gagacugagucuugcucuguca

SEQ ID NO: 151591 - RNA, 22 nt, Homo sapiens
gagacugagucuugcuuuguca

SEQ ID NO: 151592 - RNA, 22 nt, Homo sapiens
gagagcaugugcuggcaucagu

SEQ ID NO: 151593 - RNA, 22 nt, Homo sapiens
gagagucacagugaauguggca

SEQ ID NO: 151594 - RNA, 22 nt, Homo sapiens
gagagugugucagaggcugcga

SEQ ID NO: 151595 - RNA, 22 nt, Homo sapiens
gagaugaaaucuugcucuguca

SEQ ID NO: 151596 - RNA, 22 nt, Homo sapiens
gagaugcaccuugucacguuuc

SEQ ID NO: 151597 - RNA, 22 nt, Homo sapiens
gagauguagucuugcccuguca

SEQ ID NO: 151598 - RNA, 22 nt, Homo sapiens
gagauucaucuagguccagaga

SEQ ID NO: 151599 - RNA, 22 nt, Homo sapiens
gagcaaugauugagccacugua

SEQ ID NO: 151600 - RNA, 22 nt, Homo sapiens
gagcacccuuuguugauugcaa

SEQ ID NO: 151601 - RNA, 22 nt, Homo sapiens
gagcagacaugaggaccgcugg

SEQ ID NO: 151602 - RNA, 22 nt, Homo sapiens
gagcuagggucaugcuacugca

SEQ ID NO: 151603 - RNA, 22 nt, Homo sapiens
gagcuagguuuugaauccagac

SEQ ID NO: 151604 - RNA, 22 nt, Homo sapiens
gagcugaaguuuccauuuguac

SEQ ID NO: 151605 - RNA, 22 nt, Homo sapiens
gagcugaauugcugccauuugc

SEQ ID NO: 151606 - RNA, 22 nt, Homo sapiens
gagcugaucuuuauguaaauuc

SEQ ID NO: 151607 - RNA, 22 nt, Homo sapiens
gagcuggacuucuuaccuuuuc

SEQ ID NO: 151608 - RNA, 22 nt, Homo sapiens
gagcuguugguuugaaagaauu

SEQ ID NO: 151609 - RNA, 22 nt, Homo sapiens
gaggaaguaauuuuaggccugu

SEQ ID NO: 151610 - RNA, 22 nt, Homo sapiens
gaggagauauucugcuggaugg

SEQ ID NO: 151611 - RNA, 22 nt, Homo sapiens
gaggcaagaguaguuaaguuag

SEQ ID NO: 151612 - RNA, 22 nt, Homo sapiens
gaggcagucugacccuuagcag

SEQ ID NO: 151613 - RNA, 22 nt, Homo sapiens
gaggcagucuguccauucucag

SEQ ID NO: 151614 - RNA, 22 nt, Homo sapiens
gagggcacugcuuuccuuucaa

SEQ ID NO: 151615 - RNA, 22 nt, Homo sapiens
gagguaagaaagucaguccuuc

SEQ ID NO: 151616 - RNA, 22 nt, Homo sapiens
gaguagugcugcaguaaacaua

SEQ ID NO: 151617 - RNA, 22 nt, Homo sapiens
gaguagugcuguaauaaacaua

SEQ ID NO: 151618 - RNA, 22 nt, Homo sapiens
gagugcuguuagcccuggguuu

SEQ ID NO: 151619 - RNA, 18 nt, Homo sapiens
gaguggugcuucccuugu

SEQ ID NO: 151620 - RNA, 22 nt, Homo sapiens
gaguggugguucugaaacuuuu

SEQ ID NO: 151621 - RNA, 22 nt, Homo sapiens
gaguuuguaaacuauucacuaa

SEQ ID NO: 151622 - RNA, 21 nt, Homo sapiens
gauaucuuuauucccaagagc

SEQ ID NO: 151623 - RNA, 22 nt, Homo sapiens
gauauguaguaguugaaaaaga

SEQ ID NO: 151624 - RNA, 22 nt, Homo sapiens
gauaugucuauuagcuugauug

SEQ ID NO: 151625 - RNA, 22 nt, Homo sapiens
gauaugugauaagaguuaucuu

SEQ ID NO: 151626 - RNA, 22 nt, Homo sapiens
gauauguguaucuauguacaug

SEQ ID NO: 151627 - RNA, 22 nt, Homo sapiens
gaucacaguuccucacgggcau

SEQ ID NO: 151628 - RNA, 22 nt, Homo sapiens
gaucacauuguuucauacauau

SEQ ID NO: 151629 - RNA, 22 nt, Homo sapiens
gaucugagaaagugucauaaca

SEQ ID NO: 151630 - RNA, 22 nt, Homo sapiens
gaucugugugauuggaugcauu

SEQ ID NO: 151631 - RNA, 22 nt, Homo sapiens
gaucuguguuuguaugcauaag

SEQ ID NO: 151632 - RNA, 22 nt, Homo sapiens
gaugaacugucuuacuacucac

SEQ ID NO: 151633 - RNA, 22 nt, Homo sapiens
gaugagauguucucauggauug

SEQ ID NO: 151634 - RNA, 22 nt, Homo sapiens
gaugagcuaaguucucacagca

SEQ ID NO: 151635 - RNA, 22 nt, Homo sapiens
gauggcaugugcugccaccaag

SEQ ID NO: 151636 - RNA, 22 nt, Homo sapiens
gauggcauuucuggaucugaca

SEQ ID NO: 151637 - RNA, 22 nt, Homo sapiens
gauggcucugcaggugagggua

SEQ ID NO: 151638 - RNA, 22 nt, Homo sapiens
gauguguuuguuucuggaggag

SEQ ID NO: 151639 - RNA, 22 nt, Homo sapiens
gauuuguuggccugugagcuag

SEQ ID NO: 151640 - RNA, 22 nt, Homo sapiens
gauuuuuggggaagccucuuau

SEQ ID NO: 151641 - RNA, 22 nt, Homo sapiens
gcaaaauugagaagggaauaua

SEQ ID NO: 151642 - RNA, 21 nt, Homo sapiens
gcaaaggaauugccuaagcuu

SEQ ID NO: 151643 - RNA, 22 nt, Homo sapiens
gcaaaugcuaugccauuuuaua

SEQ ID NO: 151644 - RNA, 22 nt, Homo sapiens
gcaagaguauuucaaggaagau

SEQ ID NO: 151645 - RNA, 22 nt, Homo sapiens
gcaauacugacagcauuaguuu

SEQ ID NO: 151646 - RNA, 22 nt, Homo sapiens
gcaccacugcacucucagcuug

SEQ ID NO: 151647 - RNA, 22 nt, Homo sapiens
gcaccauugacaagaaauaggu

SEQ ID NO: 151648 - RNA, 22 nt, Homo sapiens
gcacgugcacccacaugcacgu

SEQ ID NO: 151649 - RNA, 22 nt, Homo sapiens
gcagagaaacaggucuaaggag

SEQ ID NO: 151650 - RNA, 20 nt, Homo sapiens
gcagcaccauauuucuaaga

SEQ ID NO: 151651 - RNA, 22 nt, Homo sapiens
uggaaucuacuaaagcaaaauc

SEQ ID NO: 151652 - RNA, 22 nt, Homo sapiens
uggaaucuagagaaaugcaaac

SEQ ID NO: 151653 - RNA, 22 nt, Homo sapiens
uggaaugguuggugugauuuua

SEQ ID NO: 151654 - RNA, 22 nt, Homo sapiens
uggaaugucuauguuuuugauu

SEQ ID NO: 151655 - RNA, 22 nt, Homo sapiens
uggaaugucuuuuccccaaagc

SEQ ID NO: 151656 - RNA, 22 nt, Homo sapiens
uggacauguacauauguguaug

SEQ ID NO: 151657 - RNA, 22 nt, Homo sapiens
uggacuguaagugccuugagua

SEQ ID NO: 151658 - RNA, 22 nt, Homo sapiens
uggagacaaagauagaaaagca

SEQ ID NO: 151659 - RNA, 22 nt, Homo sapiens
uggagagcaaagaauuuguuag

SEQ ID NO: 151660 - RNA, 22 nt, Homo sapiens
uggagcccuaguuccucauaac

SEQ ID NO: 151661 - RNA, 22 nt, Homo sapiens
uggagguagggccuaggaaucu

SEQ ID NO: 151662 - RNA, 22 nt, Homo sapiens
uggaguaggccuaagaaugaca

SEQ ID NO: 151663 - RNA, 22 nt, Homo sapiens
uggaguguguuaacuuuacaag

SEQ ID NO: 151664 - RNA, 22 nt, Homo sapiens
uggaguguguugcagaugaagg

SEQ ID NO: 151665 - RNA, 22 nt, Homo sapiens
uggaguguuggggcaggaucuc

SEQ ID NO: 151666 - RNA, 20 nt, Homo sapiens
uggaguuugaguucuuggag

SEQ ID NO: 151667 - RNA, 22 nt, Homo sapiens
uggauagaacuaagugcuuaga

SEQ ID NO: 151668 - RNA, 22 nt, Homo sapiens
uggaucaugcgaggccuccccu

SEQ ID NO: 151669 - RNA, 22 nt, Homo sapiens
uggaucauucuuucuugcaggg

SEQ ID NO: 151670 - RNA, 22 nt, Homo sapiens
uggcaaaaaaccgcaguugccu

SEQ ID NO: 151671 - RNA, 22 nt, Homo sapiens
uggcaaaauggaauauguuggg

SEQ ID NO: 151672 - RNA, 22 nt, Homo sapiens
uggcaagaacugcaauugcuuu

SEQ ID NO: 151673 - RNA, 22 nt, Homo sapiens
uggcaagugggaccuaguuaaa

SEQ ID NO: 151674 - RNA, 19 nt, Homo sapiens
uggcacauguauacauaug

SEQ ID NO: 151675 - RNA, 22 nt, Homo sapiens
uggcaccauccaggugucucua

SEQ ID NO: 151676 - RNA, 20 nt, Homo sapiens
uggcaccugacagauagcca

SEQ ID NO: 151677 - RNA, 22 nt, Homo sapiens
uggcagauaggauacaggacua

SEQ ID NO: 151678 - RNA, 22 nt, Homo sapiens
uggcagaugggugagcuggaga

SEQ ID NO: 151679 - RNA, 22 nt, Homo sapiens
uggcagcgcaguugaaaaagaa

SEQ ID NO: 151680 - RNA, 22 nt, Homo sapiens
uggcagcugcuucaugggaugc

SEQ ID NO: 151681 - RNA, 22 nt, Homo sapiens
uggcauauaaagauguguucaa

SEQ ID NO: 151682 - RNA, 19 nt, Homo sapiens
uggcaugaaugugaacuaa

SEQ ID NO: 151683 - RNA, 22 nt, Homo sapiens
uggcaugauauauauucguuug

SEQ ID NO: 151684 - RNA, 22 nt, Homo sapiens
uggcaugggguaguagcgcugg

SEQ ID NO: 151685 - RNA, 22 nt, Homo sapiens
uggcauguagucugggaccugg

SEQ ID NO: 151686 - RNA, 22 nt, Homo sapiens
uggcauguauuuuguguauuaa

SEQ ID NO: 151687 - RNA, 22 nt, Homo sapiens
uggcauguuggguguugacucc

SEQ ID NO: 151688 - RNA, 22 nt, Homo sapiens
uggcauuguccaauaaaauuuu

SEQ ID NO: 151689 - RNA, 22 nt, Homo sapiens
uggcauuuuguuuuagaauuag

SEQ ID NO: 151690 - RNA, 22 nt, Homo sapiens
uggccagugucggaggccagga

SEQ ID NO: 151691 - RNA, 22 nt, Homo sapiens
uggccaguguuuuuccugggcu

SEQ ID NO: 151692 - RNA, 22 nt, Homo sapiens
uggcuacugaccugcuaggggg

SEQ ID NO: 151693 - RNA, 21 nt, Homo sapiens
uggcuauuucuguggcauaca

SEQ ID NO: 151694 - RNA, 22 nt, Homo sapiens
uggcuguuuauuucaccugggc

SEQ ID NO: 151695 - RNA, 21 nt, Homo sapiens
uggcuuauuugaaucuggcuu

SEQ ID NO: 151696 - RNA, 22 nt, Homo sapiens
uggcuugauggcacaagguuuc

SEQ ID NO: 151697 - RNA, 22 nt, Homo sapiens
uggcuuuuccaggcauuacgau

SEQ ID NO: 151698 - RNA, 22 nt, Homo sapiens
ugggaagagggagcgauuuugg

SEQ ID NO: 151699 - RNA, 22 nt, Homo sapiens
ugggaagaugcugcuucuuccu

SEQ ID NO: 151700 - RNA, 22 nt, Homo sapiens
ugggagacuacauuuuuaacaa

SEQ ID NO: 151701 - RNA, 22 nt, Homo sapiens
ugggagcauugcauuagaagcc

SEQ ID NO: 151702 - RNA, 22 nt, Homo sapiens
ugggaucgucaagugaggcucg

SEQ ID NO: 151703 - RNA, 22 nt, Homo sapiens
ugggcaaaacuaagagcugugg

SEQ ID NO: 151704 - RNA, 22 nt, Homo sapiens
uggggcuuuuucuuguauucuc

SEQ ID NO: 151705 - RNA, 22 nt, Homo sapiens
uggguaggcccucauuggacag

SEQ ID NO: 151706 - RNA, 23 nt, Homo sapiens
ugggucaguuuuucugacaucau

SEQ ID NO: 151707 - RNA, 22 nt, Homo sapiens
uggguccccuacucuuuccaca

SEQ ID NO: 151708 - RNA, 22 nt, Homo sapiens
ugguaagaucugugagccaggc

SEQ ID NO: 151709 - RNA, 22 nt, Homo sapiens
ugguacuucaugcucacagaua

SEQ ID NO: 151710 - RNA, 22 nt, Homo sapiens
ugguaugucuagauggggaagu

SEQ ID NO: 151711 - RNA, 22 nt, Homo sapiens
ugguauguuuauaaguauagga

SEQ ID NO: 151712 - RNA, 22 nt, Homo sapiens
uggucagaugcugaguggaucu

SEQ ID NO: 151713 - RNA, 19 nt, Homo sapiens
uggucaguucugggagcug

SEQ ID NO: 151714 - RNA, 22 nt, Homo sapiens
uggucaguugugccucaauucc

SEQ ID NO: 151715 - RNA, 22 nt, Homo sapiens
uggucauggaaauagaaugcac

SEQ ID NO: 151716 - RNA, 22 nt, Homo sapiens
ugguccaguucugugauauugc

SEQ ID NO: 151717 - RNA, 21 nt, Homo sapiens
uggucccauaagauuauaaug

SEQ ID NO: 151718 - RNA, 19 nt, Homo sapiens
uggucccccgcaaucucau

SEQ ID NO: 151719 - RNA, 22 nt, Homo sapiens
uggugagaaacuagauauuuuu

SEQ ID NO: 151720 - RNA, 22 nt, Homo sapiens
uggugagaaaugagaugcuuuu

SEQ ID NO: 151721 - RNA, 23 nt, Homo sapiens
ugguuuguaagagauggacugga

SEQ ID NO: 151722 - RNA, 22 nt, Homo sapiens
uguaaaaagcccagccgcugag

SEQ ID NO: 151723 - RNA, 22 nt, Homo sapiens
uguagauauucuuucaguuuuu

SEQ ID NO: 151724 - RNA, 22 nt, Homo sapiens
uguauauguuuguacauauguc

SEQ ID NO: 151725 - RNA, 22 nt, Homo sapiens
ugucaaaugcagugauauuuga

SEQ ID NO: 151726 - RNA, 22 nt, Homo sapiens
ugucaagaugguuugauguugu

SEQ ID NO: 151727 - RNA, 20 nt, Homo sapiens
ugucaaggaauucccaaauc

SEQ ID NO: 151728 - RNA, 22 nt, Homo sapiens
ugucacagagauuuugguaugu

SEQ ID NO: 151729 - RNA, 22 nt, Homo sapiens
ugucagcacaacucagguuccu

SEQ ID NO: 151730 - RNA, 22 nt, Homo sapiens
ugucaugguguuaauuuuccug

SEQ ID NO: 151731 - RNA, 22 nt, Homo sapiens
ugucauucaggaaauucuaagu

SEQ ID NO: 151732 - RNA, 21 nt, Homo sapiens
ugucuuggagccagacgccag

SEQ ID NO: 151733 - RNA, 22 nt, Homo sapiens
ugugaaaucagauagccuuuuu

SEQ ID NO: 151734 - RNA, 20 nt, Homo sapiens
ugugaacuguagauagucuu

SEQ ID NO: 151735 - RNA, 22 nt, Homo sapiens
ugugaagauguuucuuaauuga

SEQ ID NO: 151736 - RNA, 22 nt, Homo sapiens
ugugacaaauuuaguggacugu

SEQ ID NO: 151737 - RNA, 18 nt, Homo sapiens
ugugacauugagcauguc

SEQ ID NO: 151738 - RNA, 22 nt, Homo sapiens
ugugagcuauggaguuguagag

SEQ ID NO: 151739 - RNA, 19 nt, Homo sapiens
uucagcagugucugcucuu

SEQ ID NO: 151740 - RNA, 22 nt, Homo sapiens
uucagcuaccugggaugcugaa

SEQ ID NO: 151741 - RNA, 22 nt, Homo sapiens
uucagcuacuuggaaacagcaa

SEQ ID NO: 151742 - RNA, 22 nt, Homo sapiens
uucagguacugggggaguaugg

SEQ ID NO: 151743 - RNA, 22 nt, Homo sapiens
uucagguaguuuaacuguucca

SEQ ID NO: 151744 - RNA, 22 nt, Homo sapiens
uucaguaaauguucuuacuaua

SEQ ID NO: 151745 - RNA, 22 nt, Homo sapiens
uguaugaguuguuuauaaauuu

SEQ ID NO: 151746 - RNA, 22 nt, Homo sapiens
uguaugucuucuuuagauaagu

SEQ ID NO: 151747 - RNA, 22 nt, Homo sapiens
uguauugcuugaagagugaauu

SEQ ID NO: 151748 - RNA, 22 nt, Homo sapiens
ugucaacauuuaucaaguuauu

SEQ ID NO: 151749 - RNA, 22 nt, Homo sapiens
ugucaccauuuguaggugagga

SEQ ID NO: 151750 - RNA, 22 nt, Homo sapiens
ugucacugugcagucaugcauu

SEQ ID NO: 151751 - RNA, 22 nt, Homo sapiens
ugucaggaguuuuagaaucuua

SEQ ID NO: 151752 - RNA, 23 nt, Homo sapiens
ugucaucaagaugaggucacacu

SEQ ID NO: 151753 - RNA, 22 nt, Homo sapiens
ugucaucauuccaucagggcuu

SEQ ID NO: 151754 - RNA, 19 nt, Homo sapiens
ugucccagccauagaggca

SEQ ID NO: 151755 - RNA, 22 nt, Homo sapiens
uguccuggugaugcccaaauuc

SEQ ID NO: 151756 - RNA, 19 nt, Homo sapiens
ugugaagaaaugcugcaag

SEQ ID NO: 151757 - RNA, 22 nt, Homo sapiens
ugugaagaugagaugacgcccu

SEQ ID NO: 151758 - RNA, 22 nt, Homo sapiens
ugugaauggugcugcaaugaac

SEQ ID NO: 151759 - RNA, 23 nt, Homo sapiens
ugugacacuuccgucaguucauu

SEQ ID NO: 151760 - RNA, 22 nt, Homo sapiens
ugugacagguagguaauuuuug

SEQ ID NO: 151761 - RNA, 19 nt, Homo sapiens
ugugacugguugucucgcu

SEQ ID NO: 151762 - RNA, 22 nt, Homo sapiens
ugugaucaauuagugaugucug

SEQ ID NO: 151763 - RNA, 16 nt, Homo sapiens
ugugaucuuuuuucuu

SEQ ID NO: 151764 - RNA, 22 nt, Homo sapiens
ugugauuauuuaaauaggacag

SEQ ID NO: 151765 - RNA, 20 nt, Homo sapiens
ugugauuauuuaguugcaug

SEQ ID NO: 151766 - RNA, 22 nt, Homo sapiens
ugugauuauuuauagacaguca

SEQ ID NO: 151767 - RNA, 22 nt, Homo sapiens
ugugcaaaaguaauugcgguuu

SEQ ID NO: 151768 - RNA, 22 nt, Homo sapiens
ugugcaaauguuaaacuaacuu

SEQ ID NO: 151769 - RNA, 23 nt, Homo sapiens
ugugcacauuuacauauauacac

SEQ ID NO: 151770 - RNA, 22 nt, Homo sapiens
guguaauaaucguggacuaugu

SEQ ID NO: 151771 - RNA, 22 nt, Homo sapiens
guguaugugagaaugcucaugu

SEQ ID NO: 151772 - RNA, 22 nt, Homo sapiens
gugucacuguauaauauuuauu

SEQ ID NO: 151773 - RNA, 22 nt, Homo sapiens
gugucccagugugcauacaggu

SEQ ID NO: 151774 - RNA, 22 nt, Homo sapiens
gugucuccugccuucaugcagc

SEQ ID NO: 151775 - RNA, 22 nt, Homo sapiens
gugugauggcgcacacagggug

SEQ ID NO: 151776 - RNA, 19 nt, Homo sapiens
gugugcauaucacagagca

SEQ ID NO: 151777 - RNA, 22 nt, Homo sapiens
guguggcaggugggggcucaga

SEQ ID NO: 151778 - RNA, 22 nt, Homo sapiens
guguuaaucucaaguacucuca

SEQ ID NO: 151779 - RNA, 22 nt, Homo sapiens
guuaaugcuggaauaaguuaag

SEQ ID NO: 151780 - RNA, 22 nt, Homo sapiens
guuagaugaagaccaagggcaa

SEQ ID NO: 151781 - RNA, 22 nt, Homo sapiens
guucaagugauagcugggauua

SEQ ID NO: 151782 - RNA, 22 nt, Homo sapiens
guucaagugauucuacugccuc

SEQ ID NO: 151783 - RNA, 20 nt, Homo sapiens
guucacaggcuuccuuucag

SEQ ID NO: 151784 - RNA, 22 nt, Homo sapiens
guucaucagggauauuggcuua

SEQ ID NO: 151785 - RNA, 22 nt, Homo sapiens
guucccaguugaaaugauuagu

SEQ ID NO: 151786 - RNA, 22 nt, Homo sapiens
guucuggagauaaagccaaggu

SEQ ID NO: 151787 - RNA, 22 nt, Homo sapiens
guugcaauugauguaugucuga

SEQ ID NO: 151788 - RNA, 22 nt, Homo sapiens
guugcucaggccggagugcagu

SEQ ID NO: 151789 - RNA, 22 nt, Homo sapiens
guugcucaggcuggagugcagu

SEQ ID NO: 151790 - RNA, 22 nt, Homo sapiens
guuggaauguauugcuacuucu

SEQ ID NO: 151791 - RNA, 22 nt, Homo sapiens
guuggaguuaagcaguaaugaa

SEQ ID NO: 151792 - RNA, 22 nt, Homo sapiens
guuuacagucgacuugggaaua

SEQ ID NO: 151793 - RNA, 22 nt, Homo sapiens
guuuguaacucuagugacuaga

SEQ ID NO: 151794 - RNA, 22 nt, Homo sapiens
uaaacugucuugcaguuacaug

SEQ ID NO: 151795 - RNA, 22 nt, Homo sapiens
uaaagcgaggucuccuacaaga

SEQ ID NO: 151796 - RNA, 16 nt, Homo sapiens
uaaagcuaaucacuuu

SEQ ID NO: 151797 - RNA, 22 nt, Homo sapiens
uaaagcuaucacauuggugauu

SEQ ID NO: 151798 - RNA, 22 nt, Homo sapiens
uaaagcuuggauuuaggcuaau

SEQ ID NO: 151799 - RNA, 21 nt, Homo sapiens
uaaaggcuccaauuauacccc

SEQ ID NO: 151800 - RNA, 22 nt, Homo sapiens
uaaagugaggauggcaguaggu

SEQ ID NO: 151801 - RNA, 22 nt, Homo sapiens
uaaaguguuuguuauuaaaggu

SEQ ID NO: 151802 - RNA, 22 nt, Homo sapiens
uaaaguucuuuuaugggccggg

SEQ ID NO: 151803 - RNA, 22 nt, Homo sapiens
uaaaugcuuaauugaaugugga

SEQ ID NO: 151804 - RNA, 22 nt, Homo sapiens
uaaaugcuugagaugauggaua

SEQ ID NO: 151805 - RNA, 22 nt, Homo sapiens
uaacaacauucuaacugacggc

SEQ ID NO: 151806 - RNA, 22 nt, Homo sapiens
uaacaagagagucagucagucc

SEQ ID NO: 151807 - RNA, 22 nt, Homo sapiens
uaacauucacaugcugcaaaaa

SEQ ID NO: 151808 - RNA, 22 nt, Homo sapiens
uaacuccauuuggacucaguau

SEQ ID NO: 151809 - RNA, 21 nt, Homo sapiens
uaagacugccaguagggcugu

SEQ ID NO: 151810 - RNA, 22 nt, Homo sapiens
uaagaugaaggcucaccuagaa

SEQ ID NO: 151811 - RNA, 22 nt, Homo sapiens
uaaggcaaguuuuuaguggaca

SEQ ID NO: 151812 - RNA, 22 nt, Homo sapiens
uaaggcacccuucugaguagag

SEQ ID NO: 151813 - RNA, 22 nt, Homo sapiens
uaaggcuuugcuggacucaguc

SEQ ID NO: 151814 - RNA, 22 nt, Homo sapiens
uaaguagugugcauguauguau

SEQ ID NO: 151815 - RNA, 22 nt, Homo sapiens
uaaguauuuuaauuccuggcau

SEQ ID NO: 151816 - RNA, 22 nt, Homo sapiens
uaagucuuuuuggaguuuauaa

SEQ ID NO: 151817 - RNA, 22 nt, Homo sapiens
uaagugaauguuggcuacugaa

SEQ ID NO: 151818 - RNA, 22 nt, Homo sapiens
uaaguggaagaugucaaucaua

SEQ ID NO: 151819 - RNA, 22 nt, Homo sapiens
uaauacauucaaggugguaguu

SEQ ID NO: 151820 - RNA, 22 nt, Homo sapiens
uaauucacauaaagcacuuaga

SEQ ID NO: 151821 - RNA, 16 nt, Homo sapiens
uacaacagugaguaug

SEQ ID NO: 151822 - RNA, 22 nt, Homo sapiens
gguguguaaauuacuuaucucu

SEQ ID NO: 151823 - RNA, 22 nt, Homo sapiens
guaaagacacaugcacacguau

SEQ ID NO: 151824 - RNA, 22 nt, Homo sapiens
guaaauaccaguuucuggaaca

SEQ ID NO: 151825 - RNA, 18 nt, Homo sapiens
guaaauguaucuauugcc

SEQ ID NO: 151826 - RNA, 22 nt, Homo sapiens
guaaauguccugcuacagagug

SEQ ID NO: 151827 - RNA, 22 nt, Homo sapiens
guaacuggccuucaauuucuuc

SEQ ID NO: 151828 - RNA, 22 nt, Homo sapiens
guaaggaguaguguaacagugc

SEQ ID NO: 151829 - RNA, 22 nt, Homo sapiens
guaagugguagagcugggcuau

SEQ ID NO: 151830 - RNA, 22 nt, Homo sapiens
guaauaacuguggaaaaagguu

SEQ ID NO: 151831 - RNA, 22 nt, Homo sapiens
guaaucucagcuacucgggagg

SEQ ID NO: 151832 - RNA, 22 nt, Homo sapiens
guaaugaacuugaaagccuguu

SEQ ID NO: 151833 - RNA, 22 nt, Homo sapiens
guaaugcacucccaaagaucca

SEQ ID NO: 151834 - RNA, 22 nt, Homo sapiens
guacacaacaugcagguuuguu

SEQ ID NO: 151835 - RNA, 22 nt, Homo sapiens
guacauguaugcaugcaugcau

SEQ ID NO: 151836 - RNA, 22 nt, Homo sapiens
guaccugggugacaggauuauu

SEQ ID NO: 151837 - RNA, 22 nt, Homo sapiens
guagaauguauacaguauacag

SEQ ID NO: 151838 - RNA, 22 nt, Homo sapiens
guagaggaauggcuccaccaua

SEQ ID NO: 151839 - RNA, 18 nt, Homo sapiens
guaggucaguaccaagca

SEQ ID NO: 151840 - RNA, 22 nt, Homo sapiens
guauugcuugagcccaggaguu

SEQ ID NO: 151841 - RNA, 22 nt, Homo sapiens
guauuguacuacaagcucuuua

SEQ ID NO: 151842 - RNA, 19 nt, Homo sapiens
guauuugacuuucuuguuu

SEQ ID NO: 151843 - RNA, 22 nt, Homo sapiens
guauuuuguuagggugugguau

SEQ ID NO: 151844 - RNA, 19 nt, Homo sapiens
gucaaagucgguauucaaa

SEQ ID NO: 151845 - RNA, 22 nt, Homo sapiens
gucaaagucuauuggcuaauuc

SEQ ID NO: 151846 - RNA, 22 nt, Homo sapiens
gucaaagugauuguaauuaggu

SEQ ID NO: 151847 - RNA, 22 nt, Homo sapiens
gucacuguggagaagaaagugg

SEQ ID NO: 151848 - RNA, 22 nt, Homo sapiens
gucaggcaccgauacaguuuuu

SEQ ID NO: 151849 - RNA, 22 nt, Homo sapiens
gucagucugucccugccuggcg

SEQ ID NO: 151850 - RNA, 22 nt, Homo sapiens
gucagugccugucccaggcuuu

SEQ ID NO: 151851 - RNA, 22 nt, Homo sapiens
gucauggacaguuugcuaauug

SEQ ID NO: 151852 - RNA, 22 nt, Homo sapiens
gucauguuuaacuucuugagga

SEQ ID NO: 151853 - RNA, 22 nt, Homo sapiens
guccaguguuggagguuuuacc

SEQ ID NO: 151854 - RNA, 22 nt, Homo sapiens
gucccugcgauugugggauccu

SEQ ID NO: 151855 - RNA, 22 nt, Homo sapiens
gucuggcuccuucuacuacaug

SEQ ID NO: 151856 - RNA, 21 nt, Homo sapiens
gucugguguuuuaaugaggac

SEQ ID NO: 151857 - RNA, 22 nt, Homo sapiens
gucugugcauuaauacgugcug

SEQ ID NO: 151858 - RNA, 22 nt, Homo sapiens
gucuguuuggggaccuguggcc

SEQ ID NO: 151859 - RNA, 21 nt, Homo sapiens
gucuuacagccagaugccucu

SEQ ID NO: 151860 - RNA, 20 nt, Homo sapiens
gucuugcuccguugcccagg

SEQ ID NO: 151861 - RNA, 22 nt, Homo sapiens
gucuuugcuuuuaaccagaggu

SEQ ID NO: 151862 - RNA, 17 nt, Homo sapiens
gucuuugguugaguuua

SEQ ID NO: 151863 - RNA, 22 nt, Homo sapiens
gucuuuguuauuaugaaucaac

SEQ ID NO: 151864 - RNA, 22 nt, Homo sapiens
gugaaagcaucugacugugcca

SEQ ID NO: 151865 - RNA, 22 nt, Homo sapiens
gugaaauauuuaacguccaggu

SEQ ID NO: 151866 - RNA, 20 nt, Homo sapiens
gugaauacauuugguuucau

SEQ ID NO: 151867 - RNA, 22 nt, Homo sapiens
gugaaugaaugggugaauacau

SEQ ID NO: 151868 - RNA, 22 nt, Homo sapiens
gugaauguaaagucaugugacu

SEQ ID NO: 151869 - RNA, 22 nt, Homo sapiens
gugacagaguaagacccuguau

SEQ ID NO: 151870 - RNA, 22 nt, Homo sapiens
gugaccagaugggcaggggugu

SEQ ID NO: 151871 - RNA, 22 nt, Homo sapiens
aaaagagcugagagguauucuu

SEQ ID NO: 151872 - RNA, 22 nt, Homo sapiens
aaaccaccauuacuuuugcacc

SEQ ID NO: 151873 - RNA, 22 nt, Homo sapiens
aaacugcuuuccaugguggcug

SEQ ID NO: 151874 - RNA, 23 nt, Homo sapiens
aaagacuagucaggugcaguggu

SEQ ID NO: 151875 - RNA, 22 nt, Homo sapiens
aaagagcugagaccugguggag

SEQ ID NO: 151876 - RNA, 22 nt, Homo sapiens
aaagcacugaauaaauuugcuu

SEQ ID NO: 151877 - RNA, 22 nt, Homo sapiens
aaagcuacaggaccugcucauu

SEQ ID NO: 151878 - RNA, 22 nt, Homo sapiens
aaaggcuucggaucagaaggua

SEQ ID NO: 151879 - RNA, 22 nt, Homo sapiens
aaagucacuggagaaggaauau

SEQ ID NO: 151880 - RNA, 22 nt, Homo sapiens
aaagugaauguaucccguaagu

SEQ ID NO: 151881 - RNA, 22 nt, Homo sapiens
aaagugcacuuggaagagggcc

SEQ ID NO: 151882 - RNA, 22 nt, Homo sapiens
aaagugcugggauuggcugggc

SEQ ID NO: 151883 - RNA, 22 nt, Homo sapiens
aaagugucuguuccuagcauga

SEQ ID NO: 151884 - RNA, 22 nt, Homo sapiens
aaaguguguuuccaaccugugg

SEQ ID NO: 151885 - RNA, 22 nt, Homo sapiens
aaaucccuugcucucucagacc

SEQ ID NO: 151886 - RNA, 22 nt, Homo sapiens
aaaugcaugaggugggaagaaa

SEQ ID NO: 151887 - RNA, 22 nt, Homo sapiens
aaauucaugucaccucuaggua

SEQ ID NO: 151888 - RNA, 18 nt, Homo sapiens
aaauucugucccuucuuc

SEQ ID NO: 151889 - RNA, 22 nt, Homo sapiens
aacagaauccucuuuuccuggg

SEQ ID NO: 151890 - RNA, 22 nt, Homo sapiens
aacaggcuccuaggggugcacc

SEQ ID NO: 151891 - RNA, 22 nt, Homo sapiens
aacaggguggugccugguccau

SEQ ID NO: 151892 - RNA, 22 nt, Homo sapiens
aacagucuccaguuguauccau

SEQ ID NO: 151893 - RNA, 22 nt, Homo sapiens
aaccuacauucuuaacuguugc

SEQ ID NO: 151894 - RNA, 22 nt, Homo sapiens
aacugcauuuucugauugugug

SEQ ID NO: 151895 - RNA, 22 nt, Homo sapiens
aagagcauuggauggggagauu

SEQ ID NO: 151896 - RNA, 21 nt, Homo sapiens
accugauguuucaguuggagu

SEQ ID NO: 151897 - RNA, 22 nt, Homo sapiens
accuugcacugagccgagauug

SEQ ID NO: 151898 - RNA, 22 nt, Homo sapiens
acucacagcaaccuccgccucc

SEQ ID NO: 151899 - RNA, 22 nt, Homo sapiens
acuccauuuggacucugggagg

SEQ ID NO: 151900 - RNA, 18 nt, Homo sapiens
acucuguauguggagugg

SEQ ID NO: 151901 - RNA, 23 nt, Homo sapiens
acugagcaauguuuacauacuug

SEQ ID NO: 151902 - RNA, 22 nt, Homo sapiens
acugagccuuuaaaugacuuca

SEQ ID NO: 151903 - RNA, 22 nt, Homo sapiens
acugcacuccagccucggggac

SEQ ID NO: 151904 - RNA, 22 nt, Homo sapiens
acugcacuccagccugagccug

SEQ ID NO: 151905 - RNA, 22 nt, Homo sapiens
acugcacuccagccugcuggau

SEQ ID NO: 151906 - RNA, 22 nt, Homo sapiens
acugcacuccagccuugugaca

SEQ ID NO: 151907 - RNA, 22 nt, Homo sapiens
acugcacuccagccuuugcgau

SEQ ID NO: 151908 - RNA, 22 nt, Homo sapiens
acugcacucuagccuuggcaac

SEQ ID NO: 151909 - RNA, 22 nt, Homo sapiens
acugcacuuauccuccaauguu

SEQ ID NO: 151910 - RNA, 22 nt, Homo sapiens
acugcacuucagccuuggggac

SEQ ID NO: 151911 - RNA, 22 nt, Homo sapiens
acugcacuucagccuugugaca

SEQ ID NO: 151912 - RNA, 18 nt, Homo sapiens
acuggauguaaagggucc

SEQ ID NO: 151913 - RNA, 22 nt, Homo sapiens
acuggcuuauuucacuuagcau

SEQ ID NO: 151914 - RNA, 22 nt, Homo sapiens
acuggguuaauuugaagguuga

SEQ ID NO: 151915 - RNA, 22 nt, Homo sapiens
acuuaguauggggcuuuugaga

SEQ ID NO: 151916 - RNA, 21 nt, Homo sapiens
acuuucuguggcaguccauuc

SEQ ID NO: 151917 - RNA, 22 nt, Homo sapiens
acuuuuguuauacagugugaua

SEQ ID NO: 151918 - RNA, 22 nt, Homo sapiens
acuuuuugcaaccauuuggacc

SEQ ID NO: 151919 - RNA, 21 nt, Homo sapiens
agaaaaucuuaugggaaacau

SEQ ID NO: 151920 - RNA, 22 nt, Homo sapiens
agaaacacagguggaauugcuu

SEQ ID NO: 151921 - RNA, 22 nt, Homo sapiens
agaaauguuuauucaaacccgu

SEQ ID NO: 151922 - RNA, 22 nt, Homo sapiens
agaaccauuagagggagauauu

SEQ ID NO: 151923 - RNA, 22 nt, Homo sapiens
agaagaacauagggugacugaa

SEQ ID NO: 151924 - RNA, 22 nt, Homo sapiens
agacaguauuggcaaagugugu

SEQ ID NO: 151925 - RNA, 22 nt, Homo sapiens
agacaguguguguauauauggu

SEQ ID NO: 151926 - RNA, 22 nt, Homo sapiens
agacaucauuugauggugggag

SEQ ID NO: 151927 - RNA, 22 nt, Homo sapiens
agacuagagggaaaugaguugg

SEQ ID NO: 151928 - RNA, 19 nt, Homo sapiens
agacuggcccaggcgggug

SEQ ID NO: 151929 - RNA, 22 nt, Homo sapiens
agagaacuguuuacacguuaau

SEQ ID NO: 151930 - RNA, 22 nt, Homo sapiens
agagaccuguaaaguucaggca

SEQ ID NO: 151931 - RNA, 22 nt, Homo sapiens
agagaucauuuuguuucaaauc

SEQ ID NO: 151932 - RNA, 22 nt, Homo sapiens
agagcacugcugcaggguucug

SEQ ID NO: 151933 - RNA, 22 nt, Homo sapiens
agagcacuguggguccaaauau

SEQ ID NO: 151934 - RNA, 22 nt, Homo sapiens
agagguaagcaguggcaagugc

SEQ ID NO: 151935 - RNA, 22 nt, Homo sapiens
agaugccuaugaagagaaauua

SEQ ID NO: 151936 - RNA, 23 nt, Homo sapiens
agauggcauuucaguucuuuagg

SEQ ID NO: 151937 - RNA, 22 nt, Homo sapiens
agauucauccaaguuguugcau

SEQ ID NO: 151938 - RNA, 22 nt, Homo sapiens
agcacauuaguaucuaagaaca

SEQ ID NO: 151939 - RNA, 22 nt, Homo sapiens
agcaccaccguugcucuauccc

SEQ ID NO: 151940 - RNA, 22 nt, Homo sapiens
agcaccaugggcugaguaagug

SEQ ID NO: 151941 - RNA, 22 nt, Homo sapiens
agcaccauuagcguugggccgg

SEQ ID NO: 151942 - RNA, 22 nt, Homo sapiens
agcaccauugcacuccagccug

SEQ ID NO: 151943 - RNA, 22 nt, Homo sapiens
agcaccauuguacuccagccug

SEQ ID NO: 151944 - RNA, 22 nt, Homo sapiens
agcaccauuuauugaaaagaca

SEQ ID NO: 151945 - RNA, 22 nt, Homo sapiens
agcagcaauuuuguaugguuua

SEQ ID NO: 151946 - RNA, 22 nt, Homo sapiens
agcagcuuugcauggccugugg

SEQ ID NO: 151947 - RNA, 22 nt, Homo sapiens
agcagguauucgggucaugggg

SEQ ID NO: 151948 - RNA, 22 nt, Homo sapiens
agcaguagugaaaguagacuua

SEQ ID NO: 151949 - RNA, 22 nt, Homo sapiens
agcauagugccuugaaaacaau

SEQ ID NO: 151950 - RNA, 22 nt, Homo sapiens
agcaucacaugggcugcuuggg

SEQ ID NO: 151951 - RNA, 22 nt, Homo sapiens
agcaucauuugauguucccgag

SEQ ID NO: 151952 - RNA, 17 nt, Homo sapiens
agcauguguuugagauu

SEQ ID NO: 151953 - RNA, 22 nt, Homo sapiens
agccaguauuuccacagagugg

SEQ ID NO: 151954 - RNA, 17 nt, Homo sapiens
agccccauuagcuaguu

SEQ ID NO: 151955 - RNA, 22 nt, Homo sapiens
agcccuuagauggcuccuucca

SEQ ID NO: 151956 - RNA, 20 nt, Homo sapiens
aagagcucaccagaauaucu

SEQ ID NO: 151957 - RNA, 23 nt, Homo sapiens
aagagguaugacuaugaagugga

SEQ ID NO: 151958 - RNA, 22 nt, Homo sapiens
aagagugucuuugugcuggccc

SEQ ID NO: 151959 - RNA, 22 nt, Homo sapiens
aagcacaauuucaccuucuugu

SEQ ID NO: 151960 - RNA, 22 nt, Homo sapiens
aagcaccaauaggagauuuguc

SEQ ID NO: 151961 - RNA, 22 nt, Homo sapiens
aagcacccuuugucuggacaug

SEQ ID NO: 151962 - RNA, 20 nt, Homo sapiens
aagcagacauuuggaugaaa

SEQ ID NO: 151963 - RNA, 22 nt, Homo sapiens
aagcaucacauaauggaucaug

SEQ ID NO: 151964 - RNA, 22 nt, Homo sapiens
aagcgguguugaauuuuguuga

SEQ ID NO: 151965 - RNA, 22 nt, Homo sapiens
aagcucuuguugaaucuuguca

SEQ ID NO: 151966 - RNA, 22 nt, Homo sapiens
aagcugccuugcugaggagaaa

SEQ ID NO: 151967 - RNA, 22 nt, Homo sapiens
aagcugccuugugaaggcauuc

SEQ ID NO: 151968 - RNA, 22 nt, Homo sapiens
aagcugugucuugucagcuacc

SEQ ID NO: 151969 - RNA, 22 nt, Homo sapiens
aaggaagcuagcaggaauuggu

SEQ ID NO: 151970 - RNA, 22 nt, Homo sapiens
aaggcaagguggauaaugaagc

SEQ ID NO: 151971 - RNA, 22 nt, Homo sapiens
aaggcauucucaaacuaguucu

SEQ ID NO: 151972 - RNA, 22 nt, Homo sapiens
aagggaaugcuuccaguuugug

SEQ ID NO: 151973 - RNA, 22 nt, Homo sapiens
aagguagcugagugaagugguu

SEQ ID NO: 151974 - RNA, 22 nt, Homo sapiens
aaguauguaucaagucauacuu

SEQ ID NO: 151975 - RNA, 22 nt, Homo sapiens
aagucaugaagaggaaaggaca

SEQ ID NO: 151976 - RNA, 23 nt, Homo sapiens
aagucauggaaucaaaugaggug

SEQ ID NO: 151977 - RNA, 22 nt, Homo sapiens
aaguccccugacagaggggagg

SEQ ID NO: 151978 - RNA, 22 nt, Homo sapiens
aagugaauucauuguguuauau

SEQ ID NO: 151979 - RNA, 22 nt, Homo sapiens
aagugaccuaacaaugaaggcc

SEQ ID NO: 151980 - RNA, 22 nt, Homo sapiens
aagugcugggauuggccgggca

SEQ ID NO: 151981 - RNA, 22 nt, Homo sapiens
aagugcuguccuaccuuuggga

SEQ ID NO: 151982 - RNA, 20 nt, Homo sapiens
aagugcuuccuuuuagaggg

SEQ ID NO: 151983 - RNA, 22 nt, Homo sapiens
aagugcuuuguacagggguuga

SEQ ID NO: 151984 - RNA, 22 nt, Homo sapiens
aaguggccuagagcgaccauuu

SEQ ID NO: 151985 - RNA, 22 nt, Homo sapiens
aagugguguuuguauuuaugca

SEQ ID NO: 151986 - RNA, 22 nt, Homo sapiens
aagugucagaguugcuaaugac

SEQ ID NO: 151987 - RNA, 22 nt, Homo sapiens
aaguugcuuuagguaagucaau

SEQ ID NO: 151988 - RNA, 22 nt, Homo sapiens
aauaaagccugucucuuuagag

SEQ ID NO: 151989 - RNA, 22 nt, Homo sapiens
aauacugaaaguauuuucaaau

SEQ ID NO: 151990 - RNA, 22 nt, Homo sapiens
aauauagcuauguacaugucca

SEQ ID NO: 151991 - RNA, 22 nt, Homo sapiens
aauaugucuugaaauuggguaa

SEQ ID NO: 151992 - RNA, 22 nt, Homo sapiens
aaucaacauuguuuuaagucaa

SEQ ID NO: 151993 - RNA, 22 nt, Homo sapiens
aaucacaggucuuggcugcaug

SEQ ID NO: 151994 - RNA, 22 nt, Homo sapiens
aaucacuaugccaugaaguaca

SEQ ID NO: 151995 - RNA, 22 nt, Homo sapiens
aaucugucuuuuguuauugagg

SEQ ID NO: 151996 - RNA, 22 nt, Homo sapiens
aaugcaagauguuaauuauagg

SEQ ID NO: 151997 - RNA, 22 nt, Homo sapiens
aauggcaguagauggaugggua

SEQ ID NO: 151998 - RNA, 22 nt, Homo sapiens
aauggcaucuagaguggugaau

SEQ ID NO: 151999 - RNA, 22 nt, Homo sapiens
aauggcucugauguuguuguga

SEQ ID NO: 152000 - RNA, 22 nt, Homo sapiens
aauggcuuucagcuuuucccca

SEQ ID NO: 152001 - RNA, 21 nt, Homo sapiens
aaugguguugccaacaaggug

SEQ ID NO: 152002 - RNA, 22 nt, Homo sapiens
aaugucaugaguccaaccagaa

SEQ ID NO: 152003 - RNA, 22 nt, Homo sapiens
aaugugcacuauuagggugaua

SEQ ID NO: 152004 - RNA, 22 nt, Homo sapiens
aauucuguauuguuuagggacu

SEQ ID NO: 152005 - RNA, 22 nt, Homo sapiens
aauugcaauggacaaugcagca

SEQ ID NO: 152006 - RNA, 22 nt, Homo sapiens
aauugguuaagauaagaucaua

SEQ ID NO: 152007 - RNA, 22 nt, Homo sapiens
acaaagugccuccuuuuagagu

SEQ ID NO: 152008 - RNA, 22 nt, Homo sapiens
acaauguauauuuuacuguagg

SEQ ID NO: 152009 - RNA, 22 nt, Homo sapiens
acacaaugguaaguguuugugu

SEQ ID NO: 152010 - RNA, 22 nt, Homo sapiens
acacaugugaaaaaaauguuac

SEQ ID NO: 152011 - RNA, 22 nt, Homo sapiens
acaccaugucuguuucugguuu

SEQ ID NO: 152012 - RNA, 22 nt, Homo sapiens
acacuacuggguauauguguuu

SEQ ID NO: 152013 - RNA, 22 nt, Homo sapiens
acacuggaggagagcuguugcu

SEQ ID NO: 152014 - RNA, 22 nt, Homo sapiens
acacuguacuuauguuuugcag

SEQ ID NO: 152015 - RNA, 22 nt, Homo sapiens
acacugucaugucucacaggca

SEQ ID NO: 152016 - RNA, 20 nt, Homo sapiens
acacugugcuaaggauuuuc

SEQ ID NO: 152017 - RNA, 23 nt, Homo sapiens
acacuugcugaguaaaucaaaua

SEQ ID NO: 152018 - RNA, 22 nt, Homo sapiens
acaguacucugcucuuuugauu

SEQ ID NO: 152019 - RNA, 23 nt, Homo sapiens
acaguauguggauguggcuaagu

SEQ ID NO: 152020 - RNA, 22 nt, Homo sapiens
uuggcaaauagguuuuauugca

SEQ ID NO: 152021 - RNA, 22 nt, Homo sapiens
uuggcaauugcuaugauuugaa

SEQ ID NO: 152022 - RNA, 22 nt, Homo sapiens
uuggcagcacgcaguccagagg

SEQ ID NO: 152023 - RNA, 22 nt, Homo sapiens
uuggcagugguucugacggacc

SEQ ID NO: 152024 - RNA, 22 nt, Homo sapiens
uuggccccuccaaaucucaugu

SEQ ID NO: 152025 - RNA, 22 nt, Homo sapiens
uuggcccugcugaccauucccu

SEQ ID NO: 152026 - RNA, 21 nt, Homo sapiens
uuggccuggaggccugaaugu

SEQ ID NO: 152027 - RNA, 22 nt, Homo sapiens
uuggcuucuggacuauugugca

SEQ ID NO: 152028 - RNA, 22 nt, Homo sapiens
uugguaggcuggccucucucag

SEQ ID NO: 152029 - RNA, 22 nt, Homo sapiens
uugguucucuuuauaugcugga

SEQ ID NO: 152030 - RNA, 22 nt, Homo sapiens
ucaccuggagccuucacauucu

SEQ ID NO: 152031 - RNA, 22 nt, Homo sapiens
ucaccuggggaucuuguuuaca

SEQ ID NO: 152032 - RNA, 21 nt, Homo sapiens
ucaccuguugcgaugaagcug

SEQ ID NO: 152033 - RNA, 18 nt, Homo sapiens
ucaccuugaugcuggguc

SEQ ID NO: 152034 - RNA, 22 nt, Homo sapiens
ucacgguggaaucccagauccc

SEQ ID NO: 152035 - RNA, 22 nt, Homo sapiens
ucacuauugacaacagugugga

SEQ ID NO: 152036 - RNA, 22 nt, Homo sapiens
ucacucagaccuggugauaugc

SEQ ID NO: 152037 - RNA, 22 nt, Homo sapiens
ucacugcgaccuccgccucccg

SEQ ID NO: 152038 - RNA, 20 nt, Homo sapiens
ucacuggagcucauuugauu

SEQ ID NO: 152039 - RNA, 22 nt, Homo sapiens
ucacuggaggagaggaagugga

SEQ ID NO: 152040 - RNA, 20 nt, Homo sapiens
ucacuggguucuugaagucu

SEQ ID NO: 152041 - RNA, 22 nt, Homo sapiens
ucacuggucuaaguggaggggg

SEQ ID NO: 152042 - RNA, 22 nt, Homo sapiens
ucacuguguauguauaugcagg

SEQ ID NO: 152043 - RNA, 22 nt, Homo sapiens
ucacuguugaugggcaugcagg

SEQ ID NO: 152044 - RNA, 22 nt, Homo sapiens
ucagagcaaagacacuuuauca

SEQ ID NO: 152045 - RNA, 22 nt, Homo sapiens
ucagaugaucugguaagaacuu

SEQ ID NO: 152046 - RNA, 22 nt, Homo sapiens
ucagcagugagagaccucaccc

SEQ ID NO: 152047 - RNA, 22 nt, Homo sapiens
ucagcaucacaggcagugagug

SEQ ID NO: 152048 - RNA, 16 nt, Homo sapiens
ucagcgagggagccag

SEQ ID NO: 152049 - RNA, 22 nt, Homo sapiens
ucagggacgcuugacacaagcc

SEQ ID NO: 152050 - RNA, 22 nt, Homo sapiens
ucagguagcuagauuaugugag

SEQ ID NO: 152051 - RNA, 20 nt, Homo sapiens
ucagguagggcuucaacauu

SEQ ID NO: 152052 - RNA, 22 nt, Homo sapiens
ucagguaucuucauagcaaugc

SEQ ID NO: 152053 - RNA, 22 nt, Homo sapiens
ucagguauuuauagcaaugcaa

SEQ ID NO: 152054 - RNA, 23 nt, Homo sapiens
ucaguacuccacuuucaauagug

SEQ ID NO: 152055 - RNA, 23 nt, Homo sapiens
ucaguacucuauaagugccagcu

SEQ ID NO: 152056 - RNA, 22 nt, Homo sapiens
ucaguacuuuggagcucacaua

SEQ ID NO: 152057 - RNA, 22 nt, Homo sapiens
ucagugaacgaggaggagggug

SEQ ID NO: 152058 - RNA, 20 nt, Homo sapiens
ucagugcagauuguccaagu

SEQ ID NO: 152059 - RNA, 22 nt, Homo sapiens
ucaguggagcuacaauucuggg

SEQ ID NO: 152060 - RNA, 22 nt, Homo sapiens
ucaguggauuuaaccugaauca

SEQ ID NO: 152061 - RNA, 22 nt, Homo sapiens
ucagugggcuauguaauuaacu

SEQ ID NO: 152062 - RNA, 23 nt, Homo sapiens
ucagugucuggauccugcucagu

SEQ ID NO: 152063 - RNA, 22 nt, Homo sapiens
ucagugucugugauggagaggu

SEQ ID NO: 152064 - RNA, 22 nt, Homo sapiens
ucagugucugugcaccgcugga

SEQ ID NO: 152065 - RNA, 22 nt, Homo sapiens
ucauacaguaguccucacuugu

SEQ ID NO: 152066 - RNA, 22 nt, Homo sapiens
ucaugacacuggcaggagcuaa

SEQ ID NO: 152067 - RNA, 22 nt, Homo sapiens
ucaugagacacacuggaaagga

SEQ ID NO: 152068 - RNA, 20 nt, Homo sapiens
ucaugccacugcgcuccagc

SEQ ID NO: 152069 - RNA, 22 nt, Homo sapiens
ucauggcuuuuauuauguugag

SEQ ID NO: 152070 - RNA, 19 nt, Homo sapiens
ucauggcuuuuucagcugu

SEQ ID NO: 152071 - RNA, 22 nt, Homo sapiens
ucauuagagacagggugucacu

SEQ ID NO: 152072 - RNA, 22 nt, Homo sapiens
ucauucauuugcucacuccaca

SEQ ID NO: 152073 - RNA, 22 nt, Homo sapiens
uccacaauggcugaacuagauu

SEQ ID NO: 152074 - RNA, 22 nt, Homo sapiens
uccagaguggugaugcuggggc

SEQ ID NO: 152075 - RNA, 22 nt, Homo sapiens
uccaguacaggucucucauuuc

SEQ ID NO: 152076 - RNA, 22 nt, Homo sapiens
uccaguguuauaauaugcgucu

SEQ ID NO: 152077 - RNA, 19 nt, Homo sapiens
uccaugagcccacagugau

SEQ ID NO: 152078 - RNA, 22 nt, Homo sapiens
uccaugaguccauuagaaaaaa

SEQ ID NO: 152079 - RNA, 22 nt, Homo sapiens
uccauuugucuauguuucuguu

SEQ ID NO: 152080 - RNA, 22 nt, Homo sapiens
ucccaguauucauuuacagaag

SEQ ID NO: 152081 - RNA, 22 nt, Homo sapiens
ucccagugaaaccccaccuuca

SEQ ID NO: 152082 - RNA, 22 nt, Homo sapiens
ucccauguagcuaggauuacag

SEQ ID NO: 152083 - RNA, 22 nt, Homo sapiens
ucccuagacuccugccuuucag

SEQ ID NO: 152084 - RNA, 22 nt, Homo sapiens
ucccugaaaaauuggcuuaaca

SEQ ID NO: 152085 - RNA, 22 nt, Homo sapiens
ucccuguuaggcacagauuuau

SEQ ID NO: 152086 - RNA, 22 nt, Homo sapiens
ucccuguuguuucauaauuuua

SEQ ID NO: 152087 - RNA, 22 nt, Homo sapiens
auggagagaauuauucucucag

SEQ ID NO: 152088 - RNA, 22 nt, Homo sapiens
auggagguguggggagugaguu

SEQ ID NO: 152089 - RNA, 22 nt, Homo sapiens
auggagugagaauggagguucc

SEQ ID NO: 152090 - RNA, 22 nt, Homo sapiens
auggaguuuacuuaguguaaua

SEQ ID NO: 152091 - RNA, 22 nt, Homo sapiens
auggauagucucacucacauac

SEQ ID NO: 152092 - RNA, 22 nt, Homo sapiens
auggaucauauucuugaggagg

SEQ ID NO: 152093 - RNA, 22 nt, Homo sapiens
auggauuuuaggauacaguuga

SEQ ID NO: 152094 - RNA, 22 nt, Homo sapiens
auggcaauguaagucagaaaaa

SEQ ID NO: 152095 - RNA, 22 nt, Homo sapiens
auggcacugccuggcuucaugg

SEQ ID NO: 152096 - RNA, 18 nt, Homo sapiens
auggcagaacaauuuaca

SEQ ID NO: 152097 - RNA, 22 nt, Homo sapiens
auggcaguuucagcuauaguuu

SEQ ID NO: 152098 - RNA, 22 nt, Homo sapiens
auggcauggugcaggguuuaag

SEQ ID NO: 152099 - RNA, 22 nt, Homo sapiens
auggcccccuguuugugaacau

SEQ ID NO: 152100 - RNA, 22 nt, Homo sapiens
auggcccugaguucaauauauu

SEQ ID NO: 152101 - RNA, 22 nt, Homo sapiens
auggccugaugcaccuguccca

SEQ ID NO: 152102 - RNA, 22 nt, Homo sapiens
auggcucuggauagaaugcagg

SEQ ID NO: 152103 - RNA, 22 nt, Homo sapiens
auggcucuuauuauuuugaggu

SEQ ID NO: 152104 - RNA, 22 nt, Homo sapiens
augggaaaaucagaaggccugg

SEQ ID NO: 152105 - RNA, 22 nt, Homo sapiens
augggcaaauguuggaaauucc

SEQ ID NO: 152106 - RNA, 22 nt, Homo sapiens
augggguaggcuugcuguagua

SEQ ID NO: 152107 - RNA, 22 nt, Homo sapiens
augggguaggcuuugcugcagu

SEQ ID NO: 152108 - RNA, 22 nt, Homo sapiens
augguacucucuugucugcaaa

SEQ ID NO: 152109 - RNA, 22 nt, Homo sapiens
augguacuggggucccggaguu

SEQ ID NO: 152110 - RNA, 22 nt, Homo sapiens
augguacuggguaaaagugggg

SEQ ID NO: 152111 - RNA, 21 nt, Homo sapiens
augguacugucucuggagaua

SEQ ID NO: 152112 - RNA, 22 nt, Homo sapiens
augguagacucucgggucaugg

SEQ ID NO: 152113 - RNA, 22 nt, Homo sapiens
auguagugugauuuucacuaga

SEQ ID NO: 152114 - RNA, 22 nt, Homo sapiens
augucaaggugaagaaagauca

SEQ ID NO: 152115 - RNA, 22 nt, Homo sapiens
augucuagagcaagagaugcug

SEQ ID NO: 152116 - RNA, 22 nt, Homo sapiens
augugacagugguuuuaagcgu

SEQ ID NO: 152117 - RNA, 22 nt, Homo sapiens
augugacuugugaaaaguucag

SEQ ID NO: 152118 - RNA, 22 nt, Homo sapiens
augugaugguuaauuuuaugug

SEQ ID NO: 152119 - RNA, 22 nt, Homo sapiens
augugcaagaucauuaaagcuc

SEQ ID NO: 152120 - RNA, 20 nt, Homo sapiens
augugcaguguggcaaccaa

SEQ ID NO: 152121 - RNA, 22 nt, Homo sapiens
augugccaauuaggauuccaag

SEQ ID NO: 152122 - RNA, 22 nt, Homo sapiens
augugcuaguaucaaacgagac

SEQ ID NO: 152123 - RNA, 22 nt, Homo sapiens
auguggaaauguauaugugucu

SEQ ID NO: 152124 - RNA, 22 nt, Homo sapiens
auguggcuuuccuagaucuuag

SEQ ID NO: 152125 - RNA, 22 nt, Homo sapiens
augugggaggaauguguuucca

SEQ ID NO: 152126 - RNA, 22 nt, Homo sapiens
augugguaggcccaugagucau

SEQ ID NO: 152127 - RNA, 22 nt, Homo sapiens
auguggugguagccaggacagg

SEQ ID NO: 152128 - RNA, 22 nt, Homo sapiens
caagugaauaguugcucucaga

SEQ ID NO: 152129 - RNA, 22 nt, Homo sapiens
caagugcucuaggauccugagu

SEQ ID NO: 152130 - RNA, 21 nt, Homo sapiens
caaugacacuguagcugugcu

SEQ ID NO: 152131 - RNA, 22 nt, Homo sapiens
cacaggaagaggcacggucccu

SEQ ID NO: 152132 - RNA, 22 nt, Homo sapiens
cacaguagaauagagcacuagg

SEQ ID NO: 152133 - RNA, 22 nt, Homo sapiens
cacauagcuagucaguagugaa

SEQ ID NO: 152134 - RNA, 22 nt, Homo sapiens
caccagguuggagugcaguggu

SEQ ID NO: 152135 - RNA, 19 nt, Homo sapiens
caccagugcaugcuacuau

SEQ ID NO: 152136 - RNA, 22 nt, Homo sapiens
cacccaguaagcaugaggcccu

SEQ ID NO: 152137 - RNA, 22 nt, Homo sapiens
cacccgugcucccuccagcugc

SEQ ID NO: 152138 - RNA, 22 nt, Homo sapiens
cacucaguuugugguacuuugu

SEQ ID NO: 152139 - RNA, 22 nt, Homo sapiens
cacugcauuggaugguuccucc

SEQ ID NO: 152140 - RNA, 22 nt, Homo sapiens
cacuggcacuguguuuagaugg

SEQ ID NO: 152141 - RNA, 23 nt, Homo sapiens
cacugggcagcagguguucccag

SEQ ID NO: 152142 - RNA, 17 nt, Homo sapiens
cacugggugcaagagga

SEQ ID NO: 152143 - RNA, 22 nt, Homo sapiens
cacuggguuagaacaugcuccu

SEQ ID NO: 152144 - RNA, 22 nt, Homo sapiens
cacugugcaaccuccaccuccc

SEQ ID NO: 152145 - RNA, 22 nt, Homo sapiens
cagagcacugauacuggguucu

SEQ ID NO: 152146 - RNA, 22 nt, Homo sapiens
cagagugcauguuuagaugagu

SEQ ID NO: 152147 - RNA, 22 nt, Homo sapiens
cagauaguuguagauaugcagc

SEQ ID NO: 152148 - RNA, 22 nt, Homo sapiens
cagauggucuuaaggcagccuu

SEQ ID NO: 152149 - RNA, 22 nt, Homo sapiens
cagcaaaucauccuauuugagc

SEQ ID NO: 152150 - RNA, 22 nt, Homo sapiens
cagcaagucucuaagaguucau

SEQ ID NO: 152151 - RNA, 22 nt, Homo sapiens
cagcacauagcaguugcucagu

SEQ ID NO: 152152 - RNA, 20 nt, Homo sapiens
cagcuagugguaggagucgg

SEQ ID NO: 152153 - RNA, 22 nt, Homo sapiens
caggaccucuugccuggaagcc

SEQ ID NO: 152154 - RNA, 22 nt, Homo sapiens
caggcaacauggcgaaacucug

SEQ ID NO: 152155 - RNA, 21 nt, Homo sapiens
cagguagugucugaagccaga

SEQ ID NO: 152156 - RNA, 22 nt, Homo sapiens
cagugacacugaaaaguucggg

SEQ ID NO: 152157 - RNA, 22 nt, Homo sapiens
cagugcauagaugugccacauu

SEQ ID NO: 152158 - RNA, 22 nt, Homo sapiens
cagugcuuuaucaaguccucca

SEQ ID NO: 152159 - RNA, 23 nt, Homo sapiens
cagugguguuagagaaaucuuuu

SEQ ID NO: 152160 - RNA, 22 nt, Homo sapiens
cagugguuuuuagcuugcuggg

SEQ ID NO: 152161 - RNA, 22 nt, Homo sapiens
caguuguuuuaugacauaagau

SEQ ID NO: 152162 - RNA, 22 nt, Homo sapiens
cauauaguaggugcucuguguu

SEQ ID NO: 152163 - RNA, 22 nt, Homo sapiens
cauauucacuuuacagagcugu

SEQ ID NO: 152164 - RNA, 23 nt, Homo sapiens
caucacagagccuuccuugacuc

SEQ ID NO: 152165 - RNA, 22 nt, Homo sapiens
caucacauucugagauacugag

SEQ ID NO: 152166 - RNA, 22 nt, Homo sapiens
caucagcaauguaugaggguuc

SEQ ID NO: 152167 - RNA, 22 nt, Homo sapiens
caucauugcacccuauagagaa

SEQ ID NO: 152168 - RNA, 22 nt, Homo sapiens
caucucauugaauugcugagca

SEQ ID NO: 152169 - RNA, 23 nt, Homo sapiens
caugaacuaguuugcagccauga

SEQ ID NO: 152170 - RNA, 22 nt, Homo sapiens
caugauauugcagaauguuggu

SEQ ID NO: 152171 - RNA, 22 nt, Homo sapiens
uauugcaaauggugaucccagg

SEQ ID NO: 152172 - RNA, 22 nt, Homo sapiens
uauugcaauuggcagagugcua

SEQ ID NO: 152173 - RNA, 20 nt, Homo sapiens
uauugcacuccagucugggc

SEQ ID NO: 152174 - RNA, 22 nt, Homo sapiens
uauugccugucuccaaaaauca

SEQ ID NO: 152175 - RNA, 22 nt, Homo sapiens
uauugcucaugcauuuaauuuc

SEQ ID NO: 152176 - RNA, 22 nt, Homo sapiens
uauuugauugacuuuagcagga

SEQ ID NO: 152177 - RNA, 22 nt, Homo sapiens
uauuuggauagucuggaaaaaa

SEQ ID NO: 152178 - RNA, 22 nt, Homo sapiens
uauuugguagcuauuuugcagu

SEQ ID NO: 152179 - RNA, 22 nt, Homo sapiens
uauuugguuacuugaauagcua

SEQ ID NO: 152180 - RNA, 20 nt, Homo sapiens
uauuugguuauuuccauggu

SEQ ID NO: 152181 - RNA, 22 nt, Homo sapiens
uauuuguccccuccaaaaguca

SEQ ID NO: 152182 - RNA, 22 nt, Homo sapiens
ucaaaaccucagagaguagagc

SEQ ID NO: 152183 - RNA, 22 nt, Homo sapiens
ucaaagacacacaaggagaagg

SEQ ID NO: 152184 - RNA, 20 nt, Homo sapiens
ucaaagacauggcugucaga

SEQ ID NO: 152185 - RNA, 22 nt, Homo sapiens
ucaaaguagaaaaggggcaauu

SEQ ID NO: 152186 - RNA, 22 nt, Homo sapiens
ucaaaugcacguagagaaaaua

SEQ ID NO: 152187 - RNA, 22 nt, Homo sapiens
ucaaaugcuguauuguaguaau

SEQ ID NO: 152188 - RNA, 22 nt, Homo sapiens
ucaaauguucccuguacuggcc

SEQ ID NO: 152189 - RNA, 21 nt, Homo sapiens
ucaacccuugcgucaccaagc

SEQ ID NO: 152190 - RNA, 22 nt, Homo sapiens
ucaagcaauucuccucucagcc

SEQ ID NO: 152191 - RNA, 22 nt, Homo sapiens
ucaagcaauucuccugccucag

SEQ ID NO: 152192 - RNA, 18 nt, Homo sapiens
ucaauguggauguucuuu

SEQ ID NO: 152193 - RNA, 22 nt, Homo sapiens
ucacaaagcuuggccugcuucu

SEQ ID NO: 152194 - RNA, 22 nt, Homo sapiens
ucacacugucuugguuacucuu

SEQ ID NO: 152195 - RNA, 22 nt, Homo sapiens
ucacagauaaauaaagaugauu

SEQ ID NO: 152196 - RNA, 22 nt, Homo sapiens
ucacagcuaaaaugaaaguagu

SEQ ID NO: 152197 - RNA, 22 nt, Homo sapiens
ucacaguagggaacugacaaag

SEQ ID NO: 152198 - RNA, 22 nt, Homo sapiens
ucacagugaguggaguggggug

SEQ ID NO: 152199 - RNA, 22 nt, Homo sapiens
ucacauggaggugauaguugaa

SEQ ID NO: 152200 - RNA, 22 nt, Homo sapiens
ucacauggcagagaagaagcuc

SEQ ID NO: 152201 - RNA, 22 nt, Homo sapiens
ucacauguguaaauugguguaa

SEQ ID NO: 152202 - RNA, 22 nt, Homo sapiens
ucacauuguauauguaccuauc

SEQ ID NO: 152203 - RNA, 22 nt, Homo sapiens
ucaccggcagacguggccugau

SEQ ID NO: 152204 - RNA, 22 nt, Homo sapiens
ucaccuggagacaugaagacug

SEQ ID NO: 152205 - RNA, 22 nt, Homo sapiens
ucaccuggagagcuugcuaaua

SEQ ID NO: 152206 - RNA, 22 nt, Homo sapiens
auauguauuuuaacguguaagg

SEQ ID NO: 152207 - RNA, 22 nt, Homo sapiens
auaugugacuucaugcaaggcu

SEQ ID NO: 152208 - RNA, 22 nt, Homo sapiens
auauguucucauucauaugugg

SEQ ID NO: 152209 - RNA, 22 nt, Homo sapiens
auauuacagagaggaccuggga

SEQ ID NO: 152210 - RNA, 22 nt, Homo sapiens
auauuacuggccauaucgcagg

SEQ ID NO: 152211 - RNA, 21 nt, Homo sapiens
auauuacuguuagaggacugc

SEQ ID NO: 152212 - RNA, 18 nt, Homo sapiens
auauugcauuggauggau

SEQ ID NO: 152213 - RNA, 18 nt, Homo sapiens
auauugccuucagacuag

SEQ ID NO: 152214 - RNA, 22 nt, Homo sapiens
aucaaaguaucucaauauggua

SEQ ID NO: 152215 - RNA, 22 nt, Homo sapiens
aucaaagugaauuaaugagaau

SEQ ID NO: 152216 - RNA, 22 nt, Homo sapiens
aucaaaguuucccagaaguugu

SEQ ID NO: 152217 - RNA, 22 nt, Homo sapiens
aucaaaucuccagaaccugucu

SEQ ID NO: 152218 - RNA, 22 nt, Homo sapiens
aucaaauugucauuuuaaggau

SEQ ID NO: 152219 - RNA, 22 nt, Homo sapiens
aucacaauuguacguaggagcc

SEQ ID NO: 152220 - RNA, 22 nt, Homo sapiens
aucacagaguuaaaacuuucuu

SEQ ID NO: 152221 - RNA, 22 nt, Homo sapiens
aucacagguacuauggcugaca

SEQ ID NO: 152222 - RNA, 22 nt, Homo sapiens
aucacaguuaagaggugaugaa

SEQ ID NO: 152223 - RNA, 22 nt, Homo sapiens
aucacauggccuagccuaaccu

SEQ ID NO: 152224 - RNA, 22 nt, Homo sapiens
aucacuuucuauuucugugcca

SEQ ID NO: 152225 - RNA, 22 nt, Homo sapiens
aucagaaucucuagaggacugu

SEQ ID NO: 152226 - RNA, 21 nt, Homo sapiens
aucagagacccaggcuuccuc

SEQ ID NO: 152227 - RNA, 22 nt, Homo sapiens
aucagagugaauaaugacaaaa

SEQ ID NO: 152228 - RNA, 22 nt, Homo sapiens
aucagauuccagaggcagcacc

SEQ ID NO: 152229 - RNA, 19 nt, Homo sapiens
aucagcacaagugugcuuu

SEQ ID NO: 152230 - RNA, 22 nt, Homo sapiens
aucagcagcaugaaaacaggcu

SEQ ID NO: 152231 - RNA, 22 nt, Homo sapiens
aucaggaaccuuuuuggugugu

SEQ ID NO: 152232 - RNA, 22 nt, Homo sapiens
aucauauccuagauauaacuuc

SEQ ID NO: 152233 - RNA, 22 nt, Homo sapiens
aucaucacaguuguguguaaug

SEQ ID NO: 152234 - RNA, 22 nt, Homo sapiens
aucauguuuauguguaggauau

SEQ ID NO: 152235 - RNA, 22 nt, Homo sapiens
auccacauucauggaccagucc

SEQ ID NO: 152236 - RNA, 22 nt, Homo sapiens
aucccaguucagccucugacac

SEQ ID NO: 152237 - RNA, 22 nt, Homo sapiens
aucccuguguccagcaccugug

SEQ ID NO: 152238 - RNA, 22 nt, Homo sapiens
aucccuuucucuggcuaggggg

SEQ ID NO: 152239 - RNA, 22 nt, Homo sapiens
auccucugagaucuaggcagag

SEQ ID NO: 152240 - RNA, 22 nt, Homo sapiens
auccuuuagacuguccaguuga

SEQ ID NO: 152241 - RNA, 22 nt, Homo sapiens
aucgcugagaaagggacuuuca

SEQ ID NO: 152242 - RNA, 22 nt, Homo sapiens
aucucuugccagucagaauggu

SEQ ID NO: 152243 - RNA, 22 nt, Homo sapiens
aucugcauuagggugaagaccu

SEQ ID NO: 152244 - RNA, 22 nt, Homo sapiens
aucugggguuggcaaaguuugg

SEQ ID NO: 152245 - RNA, 22 nt, Homo sapiens
aucuguguuuaaggucccagaa

SEQ ID NO: 152246 - RNA, 22 nt, Homo sapiens
aucuugggugggaacugagaau

SEQ ID NO: 152247 - RNA, 22 nt, Homo sapiens
aucuuuggauacuugauauagu

SEQ ID NO: 152248 - RNA, 22 nt, Homo sapiens
aucuuuggcgggaauaucacag

SEQ ID NO: 152249 - RNA, 22 nt, Homo sapiens
augaaaagcauaaacgcugaag

SEQ ID NO: 152250 - RNA, 22 nt, Homo sapiens
augaaagugauaaaugucucua

SEQ ID NO: 152251 - RNA, 22 nt, Homo sapiens
augaacucaucaucuagguuuu

SEQ ID NO: 152252 - RNA, 22 nt, Homo sapiens
augaagauguugccuuuuuaau

SEQ ID NO: 152253 - RNA, 20 nt, Homo sapiens
augaagugaaguuagggaac

SEQ ID NO: 152254 - RNA, 22 nt, Homo sapiens
augaauacugcugcaaugaaca

SEQ ID NO: 152255 - RNA, 22 nt, Homo sapiens
augaaugcaugaagguugggug

SEQ ID NO: 152256 - RNA, 21 nt, Homo sapiens
augaauguaaagaauguggga

SEQ ID NO: 152257 - RNA, 22 nt, Homo sapiens
augaauguaaagaaugugggaa

SEQ ID NO: 152258 - RNA, 22 nt, Homo sapiens
augaaugucuuauuuugagaaa

SEQ ID NO: 152259 - RNA, 22 nt, Homo sapiens
augacuaaaggguuuauguuga

SEQ ID NO: 152260 - RNA, 22 nt, Homo sapiens
augagaauguaaguuaaugaaa

SEQ ID NO: 152261 - RNA, 22 nt, Homo sapiens
augagagugagagcagccccuu

SEQ ID NO: 152262 - RNA, 22 nt, Homo sapiens
augagauaaaccaucucuuaag

SEQ ID NO: 152263 - RNA, 22 nt, Homo sapiens
augagauucuuagagaagucug

SEQ ID NO: 152264 - RNA, 22 nt, Homo sapiens
augagcaaagagaugagacccu

SEQ ID NO: 152265 - RNA, 22 nt, Homo sapiens
augagcucauugggugacuggg

SEQ ID NO: 152266 - RNA, 22 nt, Homo sapiens
augaggaaggagccuuugucug

SEQ ID NO: 152267 - RNA, 22 nt, Homo sapiens
augaggagauauuaaauaccau

SEQ ID NO: 152268 - RNA, 22 nt, Homo sapiens
augaggcacugcgcccuacuga

SEQ ID NO: 152269 - RNA, 22 nt, Homo sapiens
augagguaauaaguccuuggaa

SEQ ID NO: 152270 - RNA, 22 nt, Homo sapiens
augagguccuagccaacuuuuu

SEQ ID NO: 152271 - RNA, 22 nt, Homo sapiens
augaggugggagaaucacuuga

SEQ ID NO: 152272 - RNA, 22 nt, Homo sapiens
augaucauggaagugcacccau

SEQ ID NO: 152273 - RNA, 22 nt, Homo sapiens
augaugaaguaagugcuuagga

SEQ ID NO: 152274 - RNA, 22 nt, Homo sapiens
augcaagaaauaucucuuuuuc

SEQ ID NO: 152275 - RNA, 22 nt, Homo sapiens
augcacaugcgaaaacuugugu

SEQ ID NO: 152276 - RNA, 22 nt, Homo sapiens
augcacuuggcaggaugauucc

SEQ ID NO: 152277 - RNA, 22 nt, Homo sapiens
augcagaucacauuuuucuguc

SEQ ID NO: 152278 - RNA, 22 nt, Homo sapiens
augcagcugaggguaguggagc

SEQ ID NO: 152279 - RNA, 22 nt, Homo sapiens
augcauauuccugggccucacu

SEQ ID NO: 152280 - RNA, 18 nt, Homo sapiens
augcauauuuuaaguugu

SEQ ID NO: 152281 - RNA, 22 nt, Homo sapiens
augcauggagucuuucacaagu

SEQ ID NO: 152282 - RNA, 22 nt, Homo sapiens
augccacagaaauaaccaaaau

SEQ ID NO: 152283 - RNA, 22 nt, Homo sapiens
augccacugcacucuagccugg

SEQ ID NO: 152284 - RNA, 22 nt, Homo sapiens
augccacuguccuccugccuag

SEQ ID NO: 152285 - RNA, 22 nt, Homo sapiens
augccauugcacuccagccugg

SEQ ID NO: 152286 - RNA, 22 nt, Homo sapiens
augcuggugcuagaaacuggaa

SEQ ID NO: 152287 - RNA, 22 nt, Homo sapiens
auggaagaaacgauuuucugga

SEQ ID NO: 152288 - RNA, 22 nt, Homo sapiens
auggaagacuccucuuugggua

SEQ ID NO: 152289 - RNA, 22 nt, Homo sapiens
auggaagcauaguauucuauug

SEQ ID NO: 152290 - RNA, 22 nt, Homo sapiens
auggaaggagaauggucuuuga

SEQ ID NO: 152291 - RNA, 22 nt, Homo sapiens
auggaauggcacuuugaagauu

SEQ ID NO: 152292 - RNA, 22 nt, Homo sapiens
auggaauguggaaugguaagua

SEQ ID NO: 152293 - RNA, 22 nt, Homo sapiens
auggacagaaaaaaauagaugu

SEQ ID NO: 152294 - RNA, 21 nt, Homo sapiens
auggacaugguuaggcuuugu

SEQ ID NO: 152295 - RNA, 22 nt, Homo sapiens
auggacauuaaagcgauguaga

SEQ ID NO: 152296 - RNA, 22 nt, Homo sapiens
aaaagcauucagagugcugggc

SEQ ID NO: 152297 - RNA, 22 nt, Homo sapiens
aaaagucuguagugaaagguga

SEQ ID NO: 152298 - RNA, 22 nt, Homo sapiens
aaaaugcugauauugggcccca

SEQ ID NO: 152299 - RNA, 22 nt, Homo sapiens
aaacugucuggaugcuugugga

SEQ ID NO: 152300 - RNA, 22 nt, Homo sapiens
aaagagaucuaugggcacuaug

SEQ ID NO: 152301 - RNA, 22 nt, Homo sapiens
aaagaguucagguagauuucaa

SEQ ID NO: 152302 - RNA, 22 nt, Homo sapiens
aaagcuagagaagcugcuguca

SEQ ID NO: 152303 - RNA, 22 nt, Homo sapiens
aaaggcacacacuccuuguuau

SEQ ID NO: 152304 - RNA, 22 nt, Homo sapiens
aaaggcacugaucuuauccagu

SEQ ID NO: 152305 - RNA, 20 nt, Homo sapiens
aaaggcugugagaacgagau

SEQ ID NO: 152306 - RNA, 22 nt, Homo sapiens
aaaguacucaguucaguuccgu

SEQ ID NO: 152307 - RNA, 22 nt, Homo sapiens
aaagugacuuagugccccauuu

SEQ ID NO: 152308 - RNA, 22 nt, Homo sapiens
aaagugcugagacagacuggga

SEQ ID NO: 152309 - RNA, 22 nt, Homo sapiens
aaaguggugggauuccaggcau

SEQ ID NO: 152310 - RNA, 22 nt, Homo sapiens
aaauccauuuguucagcuaugc

SEQ ID NO: 152311 - RNA, 22 nt, Homo sapiens
aaaugcacaaagauuuugcacu

SEQ ID NO: 152312 - RNA, 22 nt, Homo sapiens
aaaugcacagaaaggaugugga

SEQ ID NO: 152313 - RNA, 22 nt, Homo sapiens
aaaugcaucauuaggugauuuu

SEQ ID NO: 152314 - RNA, 22 nt, Homo sapiens
aaaugcccuaaaauggagcauc

SEQ ID NO: 152315 - RNA, 22 nt, Homo sapiens
aaaugggacugggguccuuuga

SEQ ID NO: 152316 - RNA, 22 nt, Homo sapiens
aaauucaucaaaugguuuguau

SEQ ID NO: 152317 - RNA, 22 nt, Homo sapiens
aggagcacaggacuuugauuau

SEQ ID NO: 152318 - RNA, 22 nt, Homo sapiens
aggagcuuuggggaaaacagau

SEQ ID NO: 152319 - RNA, 22 nt, Homo sapiens
aggauacugguaugggcugaau

SEQ ID NO: 152320 - RNA, 22 nt, Homo sapiens
agggagcaaaguggucuuucuc

SEQ ID NO: 152321 - RNA, 22 nt, Homo sapiens
aggugcaugcuucacuggauau

SEQ ID NO: 152322 - RNA, 22 nt, Homo sapiens
aguacaauguugaguagaagug

SEQ ID NO: 152323 - RNA, 20 nt, Homo sapiens
aguauucacuuuuuucaugg

SEQ ID NO: 152324 - RNA, 22 nt, Homo sapiens
agucaaguuuuuucagagaaua

SEQ ID NO: 152325 - RNA, 22 nt, Homo sapiens
agucacagugaccuugucugac

SEQ ID NO: 152326 - RNA, 22 nt, Homo sapiens
agucauuguugagaugguguca

SEQ ID NO: 152327 - RNA, 22 nt, Homo sapiens
agugaauguuggaaaguuauuu

SEQ ID NO: 152328 - RNA, 22 nt, Homo sapiens
agugcaauaaggauguagaacu

SEQ ID NO: 152329 - RNA, 22 nt, Homo sapiens
agugcaguugucacgugccuuc

SEQ ID NO: 152330 - RNA, 22 nt, Homo sapiens
agugcauaugucuuuuuggaag

SEQ ID NO: 152331 - RNA, 22 nt, Homo sapiens
agugcauugcaucucugcuuca

SEQ ID NO: 152332 - RNA, 22 nt, Homo sapiens
agugccacugcacucuagccug

SEQ ID NO: 152333 - RNA, 22 nt, Homo sapiens
aguggguguuccauuggauaaa

SEQ ID NO: 152334 - RNA, 22 nt, Homo sapiens
aguugcaagucuugaguaaaga

SEQ ID NO: 152335 - RNA, 18 nt, Homo sapiens
auaaacucaucauuuuua

SEQ ID NO: 152336 - RNA, 22 nt, Homo sapiens
auaaagacacuuggcaugauuu

SEQ ID NO: 152337 - RNA, 22 nt, Homo sapiens
auaacagcauuauugcauacgu

SEQ ID NO: 152338 - RNA, 22 nt, Homo sapiens
auaacauggaguuugucauuua

SEQ ID NO: 152339 - RNA, 22 nt, Homo sapiens
auaaggcugguauagacauuca

SEQ ID NO: 152340 - RNA, 22 nt, Homo sapiens
auacagguauacaaugcauaau

SEQ ID NO: 152341 - RNA, 22 nt, Homo sapiens
auagaccuggagaguagauaua

SEQ ID NO: 152342 - RNA, 22 nt, Homo sapiens
auagaggacugaggugaucuuu

SEQ ID NO: 152343 - RNA, 22 nt, Homo sapiens
auagcaaugcaagaauggcuua

SEQ ID NO: 152344 - RNA, 22 nt, Homo sapiens
auagcaaugccccacuccuugg

SEQ ID NO: 152345 - RNA, 20 nt, Homo sapiens
auagcaccagacagcccuag

SEQ ID NO: 152346 - RNA, 22 nt, Homo sapiens
auagcacuuaccacaggcugca

SEQ ID NO: 152347 - RNA, 22 nt, Homo sapiens
auagcagaagaagggacaauuc

SEQ ID NO: 152348 - RNA, 22 nt, Homo sapiens
auagcagaauuuggucaagucu

SEQ ID NO: 152349 - RNA, 22 nt, Homo sapiens
auagcagaccaccucucccacu

SEQ ID NO: 152350 - RNA, 22 nt, Homo sapiens
auagcagugugaaaauugacug

SEQ ID NO: 152351 - RNA, 22 nt, Homo sapiens
auagggcacgagaugugagccu

SEQ ID NO: 152352 - RNA, 22 nt, Homo sapiens
auagguuuucacuguagauucu

SEQ ID NO: 152353 - RNA, 22 nt, Homo sapiens
auagugaacuuugugagaacaa

SEQ ID NO: 152354 - RNA, 22 nt, Homo sapiens
auagugcugcaacaaauauacg

SEQ ID NO: 152355 - RNA, 22 nt, Homo sapiens
auagugcugcaauuaacauaca

SEQ ID NO: 152356 - RNA, 22 nt, Homo sapiens
auauaccuaggcuacaugguuu

SEQ ID NO: 152357 - RNA, 22 nt, Homo sapiens
auaucaaggccauuuucuaaau

SEQ ID NO: 152358 - RNA, 22 nt, Homo sapiens
auaucacaggaaaggaagauac

SEQ ID NO: 152359 - RNA, 22 nt, Homo sapiens
auaucugcauugccauuuaugu

SEQ ID NO: 152360 - RNA, 22 nt, Homo sapiens
auaugcaaauccauagagacag

SEQ ID NO: 152361 - RNA, 22 nt, Homo sapiens
auaugcauacauguaugcagga

SEQ ID NO: 152362 - RNA, 20 nt, Homo sapiens
auaugcauguguuuucacuu

SEQ ID NO: 152363 - RNA, 19 nt, Homo sapiens
auaugggguuugaacugug

SEQ ID NO: 152364 - RNA, 22 nt, Homo sapiens
auauugguuaaauauuauguga

SEQ ID NO: 152365 - RNA, 22 nt, Homo sapiens
aucacacucaccuucuguccuu

SEQ ID NO: 152366 - RNA, 22 nt, Homo sapiens
aucacagaacuuugagcagaga

SEQ ID NO: 152367 - RNA, 22 nt, Homo sapiens
aucacagauauggguuuaaauc

SEQ ID NO: 152368 - RNA, 22 nt, Homo sapiens
aucacaguggucagguauagau

SEQ ID NO: 152369 - RNA, 22 nt, Homo sapiens
aucacauggccagguaguaauc

SEQ ID NO: 152370 - RNA, 22 nt, Homo sapiens
aucaccagaugcuucaagcaga

SEQ ID NO: 152371 - RNA, 19 nt, Homo sapiens
aucaccagucuuuccacug

SEQ ID NO: 152372 - RNA, 22 nt, Homo sapiens
aucaccugagcaguauacacug

SEQ ID NO: 152373 - RNA, 22 nt, Homo sapiens
aucaccuggaguagcccguccc

SEQ ID NO: 152374 - RNA, 22 nt, Homo sapiens
aucacuggucaugagagaagua

SEQ ID NO: 152375 - RNA, 22 nt, Homo sapiens
aucacuguaaguuuacacuuug

SEQ ID NO: 152376 - RNA, 20 nt, Homo sapiens
aucagagccggugaaagggc

SEQ ID NO: 152377 - RNA, 22 nt, Homo sapiens
aucagagccugugugcccugaa

SEQ ID NO: 152378 - RNA, 22 nt, Homo sapiens
aucagagugaugguuuaaguau

SEQ ID NO: 152379 - RNA, 22 nt, Homo sapiens
aucagcacugaucauacagcuu

SEQ ID NO: 152380 - RNA, 22 nt, Homo sapiens
aucagcagcaugaaaagcaacu

SEQ ID NO: 152381 - RNA, 22 nt, Homo sapiens
aucaggcacacauuggaguuug

SEQ ID NO: 152382 - RNA, 22 nt, Homo sapiens
aucauccugucaggagcuguga

SEQ ID NO: 152383 - RNA, 22 nt, Homo sapiens
aucaugcacaugcauagguaug

SEQ ID NO: 152384 - RNA, 22 nt, Homo sapiens
aucauugugcaucuucauucca

SEQ ID NO: 152385 - RNA, 22 nt, Homo sapiens
aucauugugugaguugauggga

SEQ ID NO: 152386 - RNA, 22 nt, Homo sapiens
auccaagagacugaugacuucc

SEQ ID NO: 152387 - RNA, 22 nt, Homo sapiens
auccagaugggcuuaauguaau

SEQ ID NO: 152388 - RNA, 22 nt, Homo sapiens
auccaguuuuaggagauuucua

SEQ ID NO: 152389 - RNA, 22 nt, Homo sapiens
aucccaguaaaaauggcuucua

SEQ ID NO: 152390 - RNA, 20 nt, Homo sapiens
aucccauuccugaagauacu

SEQ ID NO: 152391 - RNA, 22 nt, Homo sapiens
aucccuugacguggagucucug

SEQ ID NO: 152392 - RNA, 22 nt, Homo sapiens
aucccuuucugauacuuucccu

SEQ ID NO: 152393 - RNA, 22 nt, Homo sapiens
auccuguagagaugagggugga

SEQ ID NO: 152394 - RNA, 22 nt, Homo sapiens
auccuugagaaaauaaaugacc

SEQ ID NO: 152395 - RNA, 21 nt, Homo sapiens
aucucacuugaauguaaaagc

SEQ ID NO: 152396 - RNA, 22 nt, Homo sapiens
aucugcaaagcugggcugagac

SEQ ID NO: 152397 - RNA, 22 nt, Homo sapiens
aucugcauucccauguuuauug

SEQ ID NO: 152398 - RNA, 19 nt, Homo sapiens
aucuggaguuccuggggcu

SEQ ID NO: 152399 - RNA, 22 nt, Homo sapiens
aucuggcuccuuuugacaaugc

SEQ ID NO: 152400 - RNA, 22 nt, Homo sapiens
aucugguguauuggugcugggu

SEQ ID NO: 152401 - RNA, 22 nt, Homo sapiens
aucugugaaugaaguuauuuug

SEQ ID NO: 152402 - RNA, 22 nt, Homo sapiens
aucuugcauuugcuaaaaugca

SEQ ID NO: 152403 - RNA, 22 nt, Homo sapiens
aucuuuggugcaugauacuuug

SEQ ID NO: 152404 - RNA, 22 nt, Homo sapiens
augaaacuggagcgccuggagg

SEQ ID NO: 152405 - RNA, 23 nt, Homo sapiens
augaaagcccuugcaaaugcugg

SEQ ID NO: 152406 - RNA, 22 nt, Homo sapiens
augaaaugcauguuaaguccgu

SEQ ID NO: 152407 - RNA, 22 nt, Homo sapiens
augaacacuccaauuguacucc

SEQ ID NO: 152408 - RNA, 22 nt, Homo sapiens
auuaaauguuggacguauacau

SEQ ID NO: 152409 - RNA, 22 nt, Homo sapiens
auuaagugcuugccagugcugg

SEQ ID NO: 152410 - RNA, 22 nt, Homo sapiens
auuagugaaugugaugucuuga

SEQ ID NO: 152411 - RNA, 22 nt, Homo sapiens
auuauauguguaugugcauacc

SEQ ID NO: 152412 - RNA, 22 nt, Homo sapiens
auuaucacaguuuugcauaugg

SEQ ID NO: 152413 - RNA, 22 nt, Homo sapiens
auuauguuguauuuccuugcag

SEQ ID NO: 152414 - RNA, 22 nt, Homo sapiens
auuauuagucggccagcuguua

SEQ ID NO: 152415 - RNA, 22 nt, Homo sapiens
auuauugacucauagaaaggau

SEQ ID NO: 152416 - RNA, 22 nt, Homo sapiens
auucaccauggcuaccaagggu

SEQ ID NO: 152417 - RNA, 22 nt, Homo sapiens
auucaucagggauauugguuga

SEQ ID NO: 152418 - RNA, 20 nt, Homo sapiens
auucauggugguacguuguc

SEQ ID NO: 152419 - RNA, 22 nt, Homo sapiens
auuccacagccgauaccaugac

SEQ ID NO: 152420 - RNA, 23 nt, Homo sapiens
auuccaguggcaauuggagaaac

SEQ ID NO: 152421 - RNA, 22 nt, Homo sapiens
auucccuuagcugccucagccu

SEQ ID NO: 152422 - RNA, 22 nt, Homo sapiens
auucccuuggucaacggaugca

SEQ ID NO: 152423 - RNA, 22 nt, Homo sapiens
auugaacacagaguagcuuucc

SEQ ID NO: 152424 - RNA, 23 nt, Homo sapiens
auugaacacuuucauaugugagg

SEQ ID NO: 152425 - RNA, 22 nt, Homo sapiens
auugaacaugccauauguacca

SEQ ID NO: 152426 - RNA, 22 nt, Homo sapiens
auugacaguuggccaguaagug

SEQ ID NO: 152427 - RNA, 22 nt, Homo sapiens
auugacuugauauauagcugau

SEQ ID NO: 152428 - RNA, 22 nt, Homo sapiens
auugagcaauuccuaugugcuu

SEQ ID NO: 152429 - RNA, 22 nt, Homo sapiens
auugaguaaaaaauagugaugu

SEQ ID NO: 152430 - RNA, 22 nt, Homo sapiens
auugaguaaaugaaaauugccu

SEQ ID NO: 152431 - RNA, 22 nt, Homo sapiens
auugcaaagcguagacucuaaa

SEQ ID NO: 152432 - RNA, 22 nt, Homo sapiens
auugcaauuaguccauagaguu

SEQ ID NO: 152433 - RNA, 22 nt, Homo sapiens
auugcacuccagccuggaugac

SEQ ID NO: 152434 - RNA, 22 nt, Homo sapiens
auugcagauucgcuuuguguug

SEQ ID NO: 152435 - RNA, 22 nt, Homo sapiens
auugcauaaacacauuucuuau

SEQ ID NO: 152436 - RNA, 22 nt, Homo sapiens
auugcauugugaucuucccaga

SEQ ID NO: 152437 - RNA, 22 nt, Homo sapiens
auugccacaucucagaggcaga

SEQ ID NO: 152438 - RNA, 22 nt, Homo sapiens
auugccuaacauagauguucag

SEQ ID NO: 152439 - RNA, 22 nt, Homo sapiens
auugcucuuagaaauauuucuu

SEQ ID NO: 152440 - RNA, 22 nt, Homo sapiens
auuggacagcauuucuagacuu

SEQ ID NO: 152441 - RNA, 18 nt, Homo sapiens
auuguaagauguauggga

SEQ ID NO: 152442 - RNA, 22 nt, Homo sapiens
auuguaauuuuagagaaagugg

SEQ ID NO: 152443 - RNA, 22 nt, Homo sapiens
auuguacuccagccuuggggac

SEQ ID NO: 152444 - RNA, 22 nt, Homo sapiens
auuguacucuagccucugggca

SEQ ID NO: 152445 - RNA, 22 nt, Homo sapiens
auuguacuuaagccugggugaa

SEQ ID NO: 152446 - RNA, 22 nt, Homo sapiens
auuguacuuauugccagaauuu

SEQ ID NO: 152447 - RNA, 22 nt, Homo sapiens
auugucacuuaaaagugcaugu

SEQ ID NO: 152448 - RNA, 22 nt, Homo sapiens
auugucccucuuaaucccagca

SEQ ID NO: 152449 - RNA, 22 nt, Homo sapiens
auugugauugcugcuaggccua

SEQ ID NO: 152450 - RNA, 22 nt, Homo sapiens
auuuaugguuaauauaggaagu

SEQ ID NO: 152451 - RNA, 19 nt, Homo sapiens
auuuccuggagcuggucuc

SEQ ID NO: 152452 - RNA, 22 nt, Homo sapiens
auuucuacuccuguguccagaa

SEQ ID NO: 152453 - RNA, 22 nt, Homo sapiens
auuuggcaguauaaugcuuugg

SEQ ID NO: 152454 - RNA, 21 nt, Homo sapiens
auuugguggcugugugacacu

SEQ ID NO: 152455 - RNA, 22 nt, Homo sapiens
auuugguguuguuuggagccua

SEQ ID NO: 152456 - RNA, 22 nt, Homo sapiens
auuuuugguugucagcacuagg

SEQ ID NO: 152457 - RNA, 22 nt, Homo sapiens
caaaggcuguuauaggccagga

SEQ ID NO: 152458 - RNA, 22 nt, Homo sapiens
caaaguaauugugguuuugcca

SEQ ID NO: 152459 - RNA, 19 nt, Homo sapiens
caaaguguucuucuuugcc

SEQ ID NO: 152460 - RNA, 22 nt, Homo sapiens
caagacuguccaacauauuggg

SEQ ID NO: 152461 - RNA, 22 nt, Homo sapiens
caagaggcuguguauaaagcca

SEQ ID NO: 152462 - RNA, 22 nt, Homo sapiens
caagugcuacagagaaaucuuu

SEQ ID NO: 152463 - RNA, 22 nt, Homo sapiens
caagugcuuucuuggggauuua

SEQ ID NO: 152464 - RNA, 22 nt, Homo sapiens
caauacuguuaccugaaauagg

SEQ ID NO: 152465 - RNA, 19 nt, Homo sapiens
caauacuucuuggcauaca

SEQ ID NO: 152466 - RNA, 22 nt, Homo sapiens
caaugugcuuggggcacaugag

SEQ ID NO: 152467 - RNA, 22 nt, Homo sapiens
cacaaugucugguaggccacuu

SEQ ID NO: 152468 - RNA, 22 nt, Homo sapiens
cacacugucuucaauggguggu

SEQ ID NO: 152469 - RNA, 22 nt, Homo sapiens
cacagcacaggcaugaguguca

SEQ ID NO: 152470 - RNA, 22 nt, Homo sapiens
cacaguguuacugguaugaagu

SEQ ID NO: 152471 - RNA, 22 nt, Homo sapiens
cacaguguuccagcuauuugaa

SEQ ID NO: 152472 - RNA, 22 nt, Homo sapiens
cacauguuuuagcauggcuguu

SEQ ID NO: 152473 - RNA, 23 nt, Homo sapiens
caccaguagaaugugugggaggg

SEQ ID NO: 152474 - RNA, 23 nt, Homo sapiens
caccaguauaauuagcuuuuaaa

SEQ ID NO: 152475 - RNA, 22 nt, Homo sapiens
caccccuaccugagucaggagu

SEQ ID NO: 152476 - RNA, 22 nt, Homo sapiens
cacccuuagaguuggaaguggg

SEQ ID NO: 152477 - RNA, 18 nt, Homo sapiens
cacugagcccuucacucu

SEQ ID NO: 152478 - RNA, 22 nt, Homo sapiens
cacugcacuccagccuaagagg

SEQ ID NO: 152479 - RNA, 22 nt, Homo sapiens
cacugcacuccaguuuggauga

SEQ ID NO: 152480 - RNA, 22 nt, Homo sapiens
cacugcaguaaauugcgucggu

SEQ ID NO: 152481 - RNA, 21 nt, Homo sapiens
cacugguguugcuauaucaaa

SEQ ID NO: 152482 - RNA, 20 nt, Homo sapiens
cagagcaaagcaguccuggc

SEQ ID NO: 152483 - RNA, 22 nt, Homo sapiens
cagagcacuaaagguaaaaggc

SEQ ID NO: 152484 - RNA, 22 nt, Homo sapiens
cagauacuggaguccugaaguu

SEQ ID NO: 152485 - RNA, 22 nt, Homo sapiens
cagaugcaugaccugggcuugg

SEQ ID NO: 152486 - RNA, 22 nt, Homo sapiens
cagcacauuacaaguacuuggu

SEQ ID NO: 152487 - RNA, 22 nt, Homo sapiens
cagcaucauucaucugggguaa

SEQ ID NO: 152488 - RNA, 22 nt, Homo sapiens
cagcgaggucugcgucacauug

SEQ ID NO: 152489 - RNA, 22 nt, Homo sapiens
cagcucauugcagucucgaccu

SEQ ID NO: 152490 - RNA, 23 nt, Homo sapiens
cagcucauuuggguccccuuguc

SEQ ID NO: 152491 - RNA, 22 nt, Homo sapiens
cagcugcuuuggaaaauauuuu

SEQ ID NO: 152492 - RNA, 22 nt, Homo sapiens
cagcuggugcugcaccaguggg

SEQ ID NO: 152493 - RNA, 22 nt, Homo sapiens
cagcuggugggagcuggguucc

SEQ ID NO: 152494 - RNA, 22 nt, Homo sapiens
caggcacgcuugggagacacac

SEQ ID NO: 152495 - RNA, 22 nt, Homo sapiens
caggcagucuggcucccaagug

SEQ ID NO: 152496 - RNA, 22 nt, Homo sapiens
caggcagugggagacaaaacug

SEQ ID NO: 152497 - RNA, 22 nt, Homo sapiens
cagguacauuuuaaagggcuca

SEQ ID NO: 152498 - RNA, 22 nt, Homo sapiens
cagguacuucugggcugagcag

SEQ ID NO: 152499 - RNA, 22 nt, Homo sapiens
uggaaaacaugcacauuggauu

SEQ ID NO: 152500 - RNA, 20 nt, Homo sapiens
uggaaaguaagucaugauau

SEQ ID NO: 152501 - RNA, 22 nt, Homo sapiens
uggaacacaucuaaggaagcag

SEQ ID NO: 152502 - RNA, 22 nt, Homo sapiens
uggaagacaaguguuagcaugg

SEQ ID NO: 152503 - RNA, 22 nt, Homo sapiens
uggaagacucuagucucuugag

SEQ ID NO: 152504 - RNA, 22 nt, Homo sapiens
uggaagaugggaccucaguuuu

SEQ ID NO: 152505 - RNA, 22 nt, Homo sapiens
uggaagcauagcagcgugugug

SEQ ID NO: 152506 - RNA, 22 nt, Homo sapiens
uggaagccuagauucuuuucuu

SEQ ID NO: 152507 - RNA, 20 nt, Homo sapiens
uggaagccuggugcuaucuu

SEQ ID NO: 152508 - RNA, 20 nt, Homo sapiens
uggaaggcaucugcauuauu

SEQ ID NO: 152509 - RNA, 22 nt, Homo sapiens
uggaaggucauuguucauuuga

SEQ ID NO: 152510 - RNA, 23 nt, Homo sapiens
uggaaguauggaggaggcagaau

SEQ ID NO: 152511 - RNA, 22 nt, Homo sapiens
uggaagucaugcugcaagaaca

SEQ ID NO: 152512 - RNA, 22 nt, Homo sapiens
uggaaucaucaacgaaugaaau

SEQ ID NO: 152513 - RNA, 21 nt, Homo sapiens
uggaaugaauggccaacaugg

SEQ ID NO: 152514 - RNA, 22 nt, Homo sapiens
uggaauggagagagggugcacg

SEQ ID NO: 152515 - RNA, 22 nt, Homo sapiens
uggaaugggauuggaaauuuug

SEQ ID NO: 152516 - RNA, 22 nt, Homo sapiens
uggaaugguaucuuguuggggu

SEQ ID NO: 152517 - RNA, 18 nt, Homo sapiens
uggaauguuuggguuaau

SEQ ID NO: 152518 - RNA, 22 nt, Homo sapiens
uggacaagugcccuccaccuca

SEQ ID NO: 152519 - RNA, 22 nt, Homo sapiens
uggacagaaacauguuuucagu

SEQ ID NO: 152520 - RNA, 22 nt, Homo sapiens
uggacaugaagggcacaggagg

SEQ ID NO: 152521 - RNA, 20 nt, Homo sapiens
uggaccagagagguggggac

SEQ ID NO: 152522 - RNA, 21 nt, Homo sapiens
uggaccccuacuucucaccau

SEQ ID NO: 152523 - RNA, 22 nt, Homo sapiens
uggagaacugaugucuccaaga

SEQ ID NO: 152524 - RNA, 22 nt, Homo sapiens
uggagcccuaaacuucuaauau

SEQ ID NO: 152525 - RNA, 16 nt, Homo sapiens
uggagucauccuugac

SEQ ID NO: 152526 - RNA, 22 nt, Homo sapiens
uggaguguagcggcaccuauua

SEQ ID NO: 152527 - RNA, 22 nt, Homo sapiens
uggauaguaaagucagauuccc

SEQ ID NO: 152528 - RNA, 22 nt, Homo sapiens
uggauaguucuucuacuagagu

SEQ ID NO: 152529 - RNA, 22 nt, Homo sapiens
uggauccaucacgccucuuccc

SEQ ID NO: 152530 - RNA, 22 nt, Homo sapiens
uggauggagaggcuugugaugc

SEQ ID NO: 152531 - RNA, 22 nt, Homo sapiens
uggcaaaaaaacgcaauuacgu

SEQ ID NO: 152532 - RNA, 21 nt, Homo sapiens
uggcaaaaugggcaguggguu

SEQ ID NO: 152533 - RNA, 22 nt, Homo sapiens
uggcaacaucuggggacauguu

SEQ ID NO: 152534 - RNA, 21 nt, Homo sapiens
uggcaacgaggugugcauuau

SEQ ID NO: 152535 - RNA, 22 nt, Homo sapiens
uggcaagaacgaaauguagggu

SEQ ID NO: 152536 - RNA, 22 nt, Homo sapiens
uggcaagaagagcaugagacca

SEQ ID NO: 152537 - RNA, 22 nt, Homo sapiens
uggcaagagauaugugucuaua

SEQ ID NO: 152538 - RNA, 19 nt, Homo sapiens
uggcaaugucagcagagau

SEQ ID NO: 152539 - RNA, 19 nt, Homo sapiens
uggcacuugacguccggau

SEQ ID NO: 152540 - RNA, 22 nt, Homo sapiens
uggcagugggagauauuuuauu

SEQ ID NO: 152541 - RNA, 22 nt, Homo sapiens
uggcaugaagaccccauccuuu

SEQ ID NO: 152542 - RNA, 22 nt, Homo sapiens
uggcaugcauuguggguaauua

SEQ ID NO: 152543 - RNA, 22 nt, Homo sapiens
uggcauggaaagcuuuucauac

SEQ ID NO: 152544 - RNA, 22 nt, Homo sapiens
uggcaugucguuuuucauagga

SEQ ID NO: 152545 - RNA, 22 nt, Homo sapiens
uggcauguguuugaaugaguau

SEQ ID NO: 152546 - RNA, 23 nt, Homo sapiens
uggcauuuuuggcaaugccuucu

SEQ ID NO: 152547 - RNA, 22 nt, Homo sapiens
uggccuguaacccucucauagg

SEQ ID NO: 152548 - RNA, 22 nt, Homo sapiens
uggccuguaacgcugucucagc

SEQ ID NO: 152549 - RNA, 22 nt, Homo sapiens
uggcuacuguacuugagcuauu

SEQ ID NO: 152550 - RNA, 22 nt, Homo sapiens
uggcuagauauccagaguucug

SEQ ID NO: 152551 - RNA, 22 nt, Homo sapiens
uggcuccguuguacaggcugga

SEQ ID NO: 152552 - RNA, 22 nt, Homo sapiens
uggcucuuucuagacuuaauua

SEQ ID NO: 152553 - RNA, 22 nt, Homo sapiens
uggcuguguccucucccaaauc

SEQ ID NO: 152554 - RNA, 22 nt, Homo sapiens
uggcuguuuauuucacaugggu

SEQ ID NO: 152555 - RNA, 20 nt, Homo sapiens
uggcuucuuaauugcaggca

SEQ ID NO: 152556 - RNA, 22 nt, Homo sapiens
uggcuuuguaagguuucauuuu

SEQ ID NO: 152557 - RNA, 22 nt, Homo sapiens
uggcuuuuccuugaaucugccu

SEQ ID NO: 152558 - RNA, 22 nt, Homo sapiens
uggcuuuuguuauuuggaagcu

SEQ ID NO: 152559 - RNA, 22 nt, Homo sapiens
ugggaacugaggugaaaagaca

SEQ ID NO: 152560 - RNA, 22 nt, Homo sapiens
ugggaagaagguuuacuugcca

SEQ ID NO: 152561 - RNA, 22 nt, Homo sapiens
ugggaccccuacucuuuccaca

SEQ ID NO: 152562 - RNA, 22 nt, Homo sapiens
ugggaucagcugggcucucugu

SEQ ID NO: 152563 - RNA, 22 nt, Homo sapiens
ugggcaaaugcuuuuuagucaa

SEQ ID NO: 152564 - RNA, 22 nt, Homo sapiens
ugggcggagacgugcagccgcc

SEQ ID NO: 152565 - RNA, 22 nt, Homo sapiens
uggguagagaaucaggaucuua

SEQ ID NO: 152566 - RNA, 22 nt, Homo sapiens
uggguaggaccagaaaugcacu

SEQ ID NO: 152567 - RNA, 22 nt, Homo sapiens
ugggucaguagcauguaugucu

SEQ ID NO: 152568 - RNA, 23 nt, Homo sapiens
ugguaacauguuguggcagggga

SEQ ID NO: 152569 - RNA, 21 nt, Homo sapiens
uggucaguuuucucacuagga

SEQ ID NO: 152570 - RNA, 22 nt, Homo sapiens
uggucauggggcagcugacacu

SEQ ID NO: 152571 - RNA, 22 nt, Homo sapiens
ugguccuuuccauuggagacac

SEQ ID NO: 152572 - RNA, 22 nt, Homo sapiens
uggucuucuggccuccagaacc

SEQ ID NO: 152573 - RNA, 22 nt, Homo sapiens
uggugccgugguccuggggcca

SEQ ID NO: 152574 - RNA, 22 nt, Homo sapiens
ugguggcuuuucguagguucac

SEQ ID NO: 152575 - RNA, 15 nt, Homo sapiens
uggugguguugagac

SEQ ID NO: 152576 - RNA, 22 nt, Homo sapiens
uguacaaauuucugugguggug

SEQ ID NO: 152577 - RNA, 22 nt, Homo sapiens
uguagacaccaaagacagcaua

SEQ ID NO: 152578 - RNA, 22 nt, Homo sapiens
uguagcaaauaaaagucuggau

SEQ ID NO: 152579 - RNA, 21 nt, Homo sapiens
uguagcagcaugauucauagu

SEQ ID NO: 152580 - RNA, 22 nt, Homo sapiens
uguagggagagggaguugcacc

SEQ ID NO: 152581 - RNA, 22 nt, Homo sapiens
uguagguguacauacaugguua

SEQ ID NO: 152582 - RNA, 22 nt, Homo sapiens
uguauguugggucaaaguacau

SEQ ID NO: 152583 - RNA, 22 nt, Homo sapiens
uguauguuguaagacuuagacc

SEQ ID NO: 152584 - RNA, 16 nt, Homo sapiens
uguauugcuaaaaaga

SEQ ID NO: 152585 - RNA, 22 nt, Homo sapiens
ugucaagaaaucaaggugugag

SEQ ID NO: 152586 - RNA, 22 nt, Homo sapiens
ugucaccuugcucauccucgga

SEQ ID NO: 152587 - RNA, 22 nt, Homo sapiens
ugucaggaugcuccuuuuggcu

SEQ ID NO: 152588 - RNA, 22 nt, Homo sapiens
ugucaguuucccuccucuuccu

SEQ ID NO: 152589 - RNA, 22 nt, Homo sapiens
ugucaucauuugagagaagaaa

SEQ ID NO: 152590 - RNA, 22 nt, Homo sapiens
uuauucauuaauugcuaagguu

SEQ ID NO: 152591 - RNA, 22 nt, Homo sapiens
uucaaaguaaaaauguguucac

SEQ ID NO: 152592 - RNA, 22 nt, Homo sapiens
uucaaaucuuuggcucccacua

SEQ ID NO: 152593 - RNA, 22 nt, Homo sapiens
uucaauuaauauuauacucuca

SEQ ID NO: 152594 - RNA, 21 nt, Homo sapiens
uucacaagggaaguagggggc

SEQ ID NO: 152595 - RNA, 22 nt, Homo sapiens
uucacagugugaucuaugggca

SEQ ID NO: 152596 - RNA, 22 nt, Homo sapiens
uucacaguguuucucacgguua

SEQ ID NO: 152597 - RNA, 22 nt, Homo sapiens
uucacaugacagggugaagcau

SEQ ID NO: 152598 - RNA, 22 nt, Homo sapiens
uucaccuggaguucaggauaag

SEQ ID NO: 152599 - RNA, 22 nt, Homo sapiens
uucaccuguagcaugcccuugg

SEQ ID NO: 152600 - RNA, 22 nt, Homo sapiens
uucacuggagcccaggaguugg

SEQ ID NO: 152601 - RNA, 22 nt, Homo sapiens
uucagagugaggcucucggaac

SEQ ID NO: 152602 - RNA, 22 nt, Homo sapiens
uucagagugguaugaagugaug

SEQ ID NO: 152603 - RNA, 22 nt, Homo sapiens
uucagaucaucccagcuccacu

SEQ ID NO: 152604 - RNA, 22 nt, Homo sapiens
uucagaugcacacuguagucua

SEQ ID NO: 152605 - RNA, 22 nt, Homo sapiens
uucagggacuuuagacaagaga

SEQ ID NO: 152606 - RNA, 22 nt, Homo sapiens
uucagggagaaggcaaacguug

SEQ ID NO: 152607 - RNA, 22 nt, Homo sapiens
uucaguagucuccauagaaccg

SEQ ID NO: 152608 - RNA, 18 nt, Homo sapiens
uucagugaauucuuuuga

SEQ ID NO: 152609 - RNA, 22 nt, Homo sapiens
uucagugccuggaagucgugcu

SEQ ID NO: 152610 - RNA, 22 nt, Homo sapiens
uucauaguguaccugaaggcac

SEQ ID NO: 152611 - RNA, 20 nt, Homo sapiens
uucaucaggauauuggucua

SEQ ID NO: 152612 - RNA, 22 nt, Homo sapiens
uucaucagggagaaauaauuuc

SEQ ID NO: 152613 - RNA, 23 nt, Homo sapiens
uucaucagggauauuggccugaa

SEQ ID NO: 152614 - RNA, 22 nt, Homo sapiens
uucauggaacaaguggguucaa

SEQ ID NO: 152615 - RNA, 22 nt, Homo sapiens
uucauggaguugagaaggcuaa

SEQ ID NO: 152616 - RNA, 22 nt, Homo sapiens
uucauugcugcuuaucuccaga

SEQ ID NO: 152617 - RNA, 22 nt, Homo sapiens
uuccacaaugguugaacuaauu

SEQ ID NO: 152618 - RNA, 22 nt, Homo sapiens
uuccacaaugguugaacuaguu

SEQ ID NO: 152619 - RNA, 20 nt, Homo sapiens
uuccagcacauuagggaagc

SEQ ID NO: 152620 - RNA, 22 nt, Homo sapiens
uuccagcugggggcaacucugc

SEQ ID NO: 152621 - RNA, 22 nt, Homo sapiens
uuccaguggaguaaauggacaa

SEQ ID NO: 152622 - RNA, 22 nt, Homo sapiens
uuccagugggacgagaugugga

SEQ ID NO: 152623 - RNA, 22 nt, Homo sapiens
uuccaguguuugacucaccuuu

SEQ ID NO: 152624 - RNA, 22 nt, Homo sapiens
uuccaguuauuauaccucuuaa

SEQ ID NO: 152625 - RNA, 22 nt, Homo sapiens
uucccagucaaacgaaggacuu

SEQ ID NO: 152626 - RNA, 22 nt, Homo sapiens
uucccguugcugugcuccugcc

SEQ ID NO: 152627 - RNA, 22 nt, Homo sapiens
uucccuagaacacauggaggga

SEQ ID NO: 152628 - RNA, 22 nt, Homo sapiens
uucccugugggcuggugcucca

SEQ ID NO: 152629 - RNA, 19 nt, Homo sapiens
uuccugagaacaagggcuu

SEQ ID NO: 152630 - RNA, 20 nt, Homo sapiens
uuccuuaggcauuggaagaa

SEQ ID NO: 152631 - RNA, 22 nt, Homo sapiens
uuccuugagagcuugauaucac

SEQ ID NO: 152632 - RNA, 22 nt, Homo sapiens
uuccuugguucagggaaggucc

SEQ ID NO: 152633 - RNA, 22 nt, Homo sapiens
uucuaaacaucuuacaaugcau

SEQ ID NO: 152634 - RNA, 22 nt, Homo sapiens
uucuacaggcuguucaagaagc

SEQ ID NO: 152635 - RNA, 22 nt, Homo sapiens
uucuagcacuuugggagacuga

SEQ ID NO: 152636 - RNA, 22 nt, Homo sapiens
uucuaugguuuaauaguuuggg

SEQ ID NO: 152637 - RNA, 21 nt, Homo sapiens
uucucaggguguguccuaccc

SEQ ID NO: 152638 - RNA, 22 nt, Homo sapiens
uucucagugaaguuuagaacau

SEQ ID NO: 152639 - RNA, 22 nt, Homo sapiens
uucucauggugauggcaaaauc

SEQ ID NO: 152640 - RNA, 22 nt, Homo sapiens
uucugccaaucaacccacaucc

SEQ ID NO: 152641 - RNA, 22 nt, Homo sapiens
uucuggccccucccaaucucau

SEQ ID NO: 152642 - RNA, 22 nt, Homo sapiens
uucugguuaauacuugcaaaaa

SEQ ID NO: 152643 - RNA, 22 nt, Homo sapiens
uucugugguuucauuuaccugu

SEQ ID NO: 152644 - RNA, 22 nt, Homo sapiens
uucuuagucaaguuguauuuca

SEQ ID NO: 152645 - RNA, 22 nt, Homo sapiens
uucuucaguuacaacaaggggg

SEQ ID NO: 152646 - RNA, 20 nt, Homo sapiens
uucuugaguuaacaaguuac

SEQ ID NO: 152647 - RNA, 22 nt, Homo sapiens
uucuugcugaauugugcccuuc

SEQ ID NO: 152648 - RNA, 22 nt, Homo sapiens
uucuugcuguauccucacaugg

SEQ ID NO: 152649 - RNA, 22 nt, Homo sapiens
uucuugguuggcaaccaacagu

SEQ ID NO: 152650 - RNA, 22 nt, Homo sapiens
uucuuugcaugaucucaaaguc

SEQ ID NO: 152651 - RNA, 21 nt, Homo sapiens
uucuuugcucaguguuagagu

SEQ ID NO: 152652 - RNA, 22 nt, Homo sapiens
uucuuuggaaacaguacuaauu

SEQ ID NO: 152653 - RNA, 23 nt, Homo sapiens
uugaaaagucaguagccucugau

SEQ ID NO: 152654 - RNA, 22 nt, Homo sapiens
uugaaagaaaggagacugaguu

SEQ ID NO: 152655 - RNA, 22 nt, Homo sapiens
uugaaagacagaggggcaaguu

SEQ ID NO: 152656 - RNA, 22 nt, Homo sapiens
uugaaagacaucaccuacugcu

SEQ ID NO: 152657 - RNA, 22 nt, Homo sapiens
uugaaagucauggcacaggcaa

SEQ ID NO: 152658 - RNA, 22 nt, Homo sapiens
uugaaagucuaggcuuacagua

SEQ ID NO: 152659 - RNA, 22 nt, Homo sapiens
uugaagacuaaguuaucaggau

SEQ ID NO: 152660 - RNA, 22 nt, Homo sapiens
uugaagguagaaguucucaauu

SEQ ID NO: 152661 - RNA, 22 nt, Homo sapiens
uugaagguaggaugugcuauca

SEQ ID NO: 152662 - RNA, 17 nt, Homo sapiens
uugaaugcauuacuugg

SEQ ID NO: 152663 - RNA, 23 nt, Homo sapiens
uugaauguuuccccucccaaauu

SEQ ID NO: 152664 - RNA, 22 nt, Homo sapiens
uugacagaccuuggucauaucc

SEQ ID NO: 152665 - RNA, 22 nt, Homo sapiens
uugacauaaucauuucacagug

SEQ ID NO: 152666 - RNA, 22 nt, Homo sapiens
uugacauugcuguaguguccag

SEQ ID NO: 152667 - RNA, 22 nt, Homo sapiens
uugacgagaguaguagucuacc

SEQ ID NO: 152668 - RNA, 22 nt, Homo sapiens
uugagacggagucuugcucuuu

SEQ ID NO: 152669 - RNA, 22 nt, Homo sapiens
uugagacggaguuuugcucuug

SEQ ID NO: 152670 - RNA, 22 nt, Homo sapiens
uugagacugaacauuuguguac

SEQ ID NO: 152671 - RNA, 22 nt, Homo sapiens
uugagacugagucucgcccugu

SEQ ID NO: 152672 - RNA, 22 nt, Homo sapiens
uugagaguggaggcuauaucuu

SEQ ID NO: 152673 - RNA, 22 nt, Homo sapiens
uugagauacauaauuaugaaug

SEQ ID NO: 152674 - RNA, 22 nt, Homo sapiens
uugagauaggagcuguuguucu

SEQ ID NO: 152675 - RNA, 22 nt, Homo sapiens
uugagauggagucucacucugu

SEQ ID NO: 152676 - RNA, 22 nt, Homo sapiens
uugagauggagucucacucuug

SEQ ID NO: 152677 - RNA, 22 nt, Homo sapiens
uugagauggagucucacucuuu

SEQ ID NO: 152678 - RNA, 22 nt, Homo sapiens
uugagauggagucucgcucugu

SEQ ID NO: 152679 - RNA, 22 nt, Homo sapiens
uugagauggagucucgcucuuu

SEQ ID NO: 152680 - RNA, 22 nt, Homo sapiens
uugagauggagucuugcacugu

SEQ ID NO: 152681 - RNA, 22 nt, Homo sapiens
auguguauuaccucgauuguga

SEQ ID NO: 152682 - RNA, 22 nt, Homo sapiens
auguguucaucacagcacaauu

SEQ ID NO: 152683 - RNA, 22 nt, Homo sapiens
auuaagugaaugaaguuguucc

SEQ ID NO: 152684 - RNA, 22 nt, Homo sapiens
auuaaucaggcaaugcuugcua

SEQ ID NO: 152685 - RNA, 22 nt, Homo sapiens
auuaauguaauuaguaaaguug

SEQ ID NO: 152686 - RNA, 22 nt, Homo sapiens
auuacauagucaaggugucuca

SEQ ID NO: 152687 - RNA, 22 nt, Homo sapiens
auuagaugguuauaggugugag

SEQ ID NO: 152688 - RNA, 22 nt, Homo sapiens
auuagguaauauaaucauggca

SEQ ID NO: 152689 - RNA, 22 nt, Homo sapiens
auucaaagugcauguucccacu

SEQ ID NO: 152690 - RNA, 22 nt, Homo sapiens
auucaagucaucucuccgcauu

SEQ ID NO: 152691 - RNA, 22 nt, Homo sapiens
auucacagcuuuaaaaggcgug

SEQ ID NO: 152692 - RNA, 22 nt, Homo sapiens
auucacagggggagaaggguau

SEQ ID NO: 152693 - RNA, 22 nt, Homo sapiens
auucacuguggguccuuuggau

SEQ ID NO: 152694 - RNA, 22 nt, Homo sapiens
auucacuuuuauagacaggucu

SEQ ID NO: 152695 - RNA, 22 nt, Homo sapiens
auucaugggagcuacuuuaaaa

SEQ ID NO: 152696 - RNA, 22 nt, Homo sapiens
auuccacuuccacuaguuucuc

SEQ ID NO: 152697 - RNA, 22 nt, Homo sapiens
auuccaguuguaagguuuuuca

SEQ ID NO: 152698 - RNA, 22 nt, Homo sapiens
auuccauagugucuguggcaga

SEQ ID NO: 152699 - RNA, 22 nt, Homo sapiens
auuccauuuguuaucacacccg

SEQ ID NO: 152700 - RNA, 22 nt, Homo sapiens
auugaauuugguuugcuaagaa

SEQ ID NO: 152701 - RNA, 22 nt, Homo sapiens
auugagguauaauugcuaugca

SEQ ID NO: 152702 - RNA, 19 nt, Homo sapiens
auugauuaaguuugcuguc

SEQ ID NO: 152703 - RNA, 22 nt, Homo sapiens
auugcaacaguguugagaggug

SEQ ID NO: 152704 - RNA, 22 nt, Homo sapiens
auugcacaucugcacuacagcc

SEQ ID NO: 152705 - RNA, 22 nt, Homo sapiens
auugcacuccagccugggggac

SEQ ID NO: 152706 - RNA, 22 nt, Homo sapiens
auugcagcuugcagggugugua

SEQ ID NO: 152707 - RNA, 22 nt, Homo sapiens
auugcccaggcuggagugcagu

SEQ ID NO: 152708 - RNA, 22 nt, Homo sapiens
auugcucacacaaagccuguuu

SEQ ID NO: 152709 - RNA, 22 nt, Homo sapiens
auugcuuaagucccuguauuag

SEQ ID NO: 152710 - RNA, 22 nt, Homo sapiens
auugcuuacccuguauuagauc

SEQ ID NO: 152711 - RNA, 22 nt, Homo sapiens
auugcuuuuacugggagcuuug

SEQ ID NO: 152712 - RNA, 22 nt, Homo sapiens
auuggaguuguacgcacgcuca

SEQ ID NO: 152713 - RNA, 22 nt, Homo sapiens
auuggcuuuugaaagucugcga

SEQ ID NO: 152714 - RNA, 22 nt, Homo sapiens
auugucauuuauaacuguguag

SEQ ID NO: 152715 - RNA, 22 nt, Homo sapiens
auuguuccccggucauuuuugu

SEQ ID NO: 152716 - RNA, 22 nt, Homo sapiens
auuucacugagacaugugccca

SEQ ID NO: 152717 - RNA, 22 nt, Homo sapiens
auuuccuguaggggcuugcgaa

SEQ ID NO: 152718 - RNA, 22 nt, Homo sapiens
auuuggcaacguagggaggcau

SEQ ID NO: 152719 - RNA, 20 nt, Homo sapiens
auuuggcauaguuuaagcaa

SEQ ID NO: 152720 - RNA, 22 nt, Homo sapiens
auuugguaauauuuaaggacuu

SEQ ID NO: 152721 - RNA, 22 nt, Homo sapiens
auuugguagaguucgauaccug

SEQ ID NO: 152722 - RNA, 21 nt, Homo sapiens
auuugguguuagaaauaaauu

SEQ ID NO: 152723 - RNA, 22 nt, Homo sapiens
auuugucacuuaacagccauua

SEQ ID NO: 152724 - RNA, 22 nt, Homo sapiens
caaaagugauugcgguuuuugc

SEQ ID NO: 152725 - RNA, 22 nt, Homo sapiens
caaagugcugaaagaggccagg

SEQ ID NO: 152726 - RNA, 22 nt, Homo sapiens
caaauccucaccucaucaugaa

SEQ ID NO: 152727 - RNA, 22 nt, Homo sapiens
caacauccaccuccuggguuca

SEQ ID NO: 152728 - RNA, 22 nt, Homo sapiens
caaggaauucucaauagaguua

SEQ ID NO: 152729 - RNA, 22 nt, Homo sapiens
caaggugcugagacaggagccc

SEQ ID NO: 152730 - RNA, 22 nt, Homo sapiens
ucccuugagccuggcuucucac

SEQ ID NO: 152731 - RNA, 18 nt, Homo sapiens
ucccuuuguagaugaccc

SEQ ID NO: 152732 - RNA, 19 nt, Homo sapiens
ucccuuuguagguaaccug

SEQ ID NO: 152733 - RNA, 22 nt, Homo sapiens
ucccuuuguccaacggauccac

SEQ ID NO: 152734 - RNA, 21 nt, Homo sapiens
uccugagagaggaguaacucu

SEQ ID NO: 152735 - RNA, 22 nt, Homo sapiens
uccugcauucauccugguguug

SEQ ID NO: 152736 - RNA, 22 nt, Homo sapiens
uccuggcuccacuguuuauucc

SEQ ID NO: 152737 - RNA, 22 nt, Homo sapiens
uccuugaaacaggaagaauuca

SEQ ID NO: 152738 - RNA, 22 nt, Homo sapiens
uccuugagaggacagagccaua

SEQ ID NO: 152739 - RNA, 22 nt, Homo sapiens
uccuugagucuuugcucagaug

SEQ ID NO: 152740 - RNA, 22 nt, Homo sapiens
uccuuggucauggaagagacag

SEQ ID NO: 152741 - RNA, 22 nt, Homo sapiens
uccuuuggucaguauucuuuug

SEQ ID NO: 152742 - RNA, 22 nt, Homo sapiens
uccuuugguggagucuuuaggg

SEQ ID NO: 152743 - RNA, 22 nt, Homo sapiens
ucgcagcacgagcaugcaaggu

SEQ ID NO: 152744 - RNA, 19 nt, Homo sapiens
ucgcgccauucuccugccu

SEQ ID NO: 152745 - RNA, 22 nt, Homo sapiens
ucggcucagugcaagcucugcc

SEQ ID NO: 152746 - RNA, 22 nt, Homo sapiens
ucuaaaacuagauugugaugau

SEQ ID NO: 152747 - RNA, 22 nt, Homo sapiens
ucuaaaguacuacuacuguugg

SEQ ID NO: 152748 - RNA, 17 nt, Homo sapiens
ucuaauaauaugcauuu

SEQ ID NO: 152749 - RNA, 22 nt, Homo sapiens
ucuagccuaugaagcuugucca

SEQ ID NO: 152750 - RNA, 22 nt, Homo sapiens
ucucacagaguugaacuuucuu

SEQ ID NO: 152751 - RNA, 22 nt, Homo sapiens
ucucagugaaauaaauuauuuu

SEQ ID NO: 152752 - RNA, 22 nt, Homo sapiens
ucucaguggcacccccaacacc

SEQ ID NO: 152753 - RNA, 22 nt, Homo sapiens
ucucaugaagguggagaguagg

SEQ ID NO: 152754 - RNA, 22 nt, Homo sapiens
ucucauggagguagagaguaaa

SEQ ID NO: 152755 - RNA, 21 nt, Homo sapiens
ucucauuacugaugagccaga

SEQ ID NO: 152756 - RNA, 22 nt, Homo sapiens
ucucauuggucugagucaccug

SEQ ID NO: 152757 - RNA, 22 nt, Homo sapiens
ucucccauccguacacggauug

SEQ ID NO: 152758 - RNA, 22 nt, Homo sapiens
ucucugaaacucuugacauccu

SEQ ID NO: 152759 - RNA, 22 nt, Homo sapiens
ucucugacacugaccccaaaaa

SEQ ID NO: 152760 - RNA, 19 nt, Homo sapiens
ucucugguguuggagggga

SEQ ID NO: 152761 - RNA, 22 nt, Homo sapiens
ucucugguuuguggaaucuuag

SEQ ID NO: 152762 - RNA, 22 nt, Homo sapiens
ucucuguuuauuuuugguguau

SEQ ID NO: 152763 - RNA, 22 nt, Homo sapiens
uauacuguuuucuauaguggcu

SEQ ID NO: 152764 - RNA, 22 nt, Homo sapiens
uauagcacaucuguguguacau

SEQ ID NO: 152765 - RNA, 22 nt, Homo sapiens
uauagcacugagaauguaauuc

SEQ ID NO: 152766 - RNA, 17 nt, Homo sapiens
uauagcacuucucacau

SEQ ID NO: 152767 - RNA, 21 nt, Homo sapiens
uauagcagcacgauuuauaau

SEQ ID NO: 152768 - RNA, 22 nt, Homo sapiens
uauaugcacucagguguaugug

SEQ ID NO: 152769 - RNA, 22 nt, Homo sapiens
uauaugcucugggauccugaaa

SEQ ID NO: 152770 - RNA, 22 nt, Homo sapiens
uaucacagauauuaugggccaa

SEQ ID NO: 152771 - RNA, 22 nt, Homo sapiens
uaucacagcgggguguacaccc

SEQ ID NO: 152772 - RNA, 22 nt, Homo sapiens
uaucacaggucaggaaccuugu

SEQ ID NO: 152773 - RNA, 22 nt, Homo sapiens
uaucacagguggacugcacacc

SEQ ID NO: 152774 - RNA, 20 nt, Homo sapiens
uaucacaguucaggaacucu

SEQ ID NO: 152775 - RNA, 21 nt, Homo sapiens
uaucacauuggugauuaaguu

SEQ ID NO: 152776 - RNA, 22 nt, Homo sapiens
uaucacccuuucauuguucuuc

SEQ ID NO: 152777 - RNA, 22 nt, Homo sapiens
uaucaccuugguagucuugggg

SEQ ID NO: 152778 - RNA, 22 nt, Homo sapiens
uaucauuguguuauuucuucca

SEQ ID NO: 152779 - RNA, 23 nt, Homo sapiens
uaucccuugccuuaugaugugag

SEQ ID NO: 152780 - RNA, 22 nt, Homo sapiens
uaucucagaguguacaagauua

SEQ ID NO: 152781 - RNA, 22 nt, Homo sapiens
uaucucaguguacaggaugaua

SEQ ID NO: 152782 - RNA, 18 nt, Homo sapiens
uaucucauuucuuagguc

SEQ ID NO: 152783 - RNA, 22 nt, Homo sapiens
uaucugcacauacacuuauagc

SEQ ID NO: 152784 - RNA, 22 nt, Homo sapiens
uaugacuuuggaaaaauuacuu

SEQ ID NO: 152785 - RNA, 22 nt, Homo sapiens
uaugagacugugagugagaaau

SEQ ID NO: 152786 - RNA, 22 nt, Homo sapiens
uaugaucauuauguuauugcag

SEQ ID NO: 152787 - RNA, 22 nt, Homo sapiens
uaugcacuaggcacuguguuug

SEQ ID NO: 152788 - RNA, 22 nt, Homo sapiens
uaugcacuauggaaguagcuca

SEQ ID NO: 152789 - RNA, 22 nt, Homo sapiens
uaugcaugucucuguacacgug

SEQ ID NO: 152790 - RNA, 22 nt, Homo sapiens
uaugcccauuuaaauugaacaa

SEQ ID NO: 152791 - RNA, 22 nt, Homo sapiens
uaugccuuucucacuaagcuua

SEQ ID NO: 152792 - RNA, 22 nt, Homo sapiens
uaugccuuugaccauuuuguga

SEQ ID NO: 152793 - RNA, 22 nt, Homo sapiens
uaugccuuuuggcucaagaaac

SEQ ID NO: 152794 - RNA, 22 nt, Homo sapiens
uaugcuuauaaacauuugucag

SEQ ID NO: 152795 - RNA, 22 nt, Homo sapiens
uauggccccuacaugugcaaaa

SEQ ID NO: 152796 - RNA, 22 nt, Homo sapiens
uauggcccuuaaguauugguug

SEQ ID NO: 152797 - RNA, 21 nt, Homo sapiens
uauggcuuagucaguguuucc

SEQ ID NO: 152798 - RNA, 22 nt, Homo sapiens
uauggcuucuauaaggaagcuu

SEQ ID NO: 152799 - RNA, 22 nt, Homo sapiens
uauggcuucuuauucuuucccg

SEQ ID NO: 152800 - RNA, 22 nt, Homo sapiens
uauggcuucuuuaaauugaggu

SEQ ID NO: 152801 - RNA, 22 nt, Homo sapiens
uauggcuuuuaacugucguaug

SEQ ID NO: 152802 - RNA, 22 nt, Homo sapiens
uauggcuuuucacuuaaguccu

SEQ ID NO: 152803 - RNA, 22 nt, Homo sapiens
uauggguuucagagggugauag

SEQ ID NO: 152804 - RNA, 22 nt, Homo sapiens
uauggguuuuugucuguuuacu

SEQ ID NO: 152805 - RNA, 22 nt, Homo sapiens
uaugucuucuuuagagaaaugu

SEQ ID NO: 152806 - RNA, 22 nt, Homo sapiens
uaugucuuuugcuugcaaauag

SEQ ID NO: 152807 - RNA, 22 nt, Homo sapiens
uaugugcaaauuaauugcuaga

SEQ ID NO: 152808 - RNA, 22 nt, Homo sapiens
uaugugguuaauaggaauuugu

SEQ ID NO: 152809 - RNA, 22 nt, Homo sapiens
uauguuaucaaaaagcuaagga

SEQ ID NO: 152810 - RNA, 22 nt, Homo sapiens
uauuacuugucugugucucaau

SEQ ID NO: 152811 - RNA, 22 nt, Homo sapiens
uauuagguuggggcaaaaguaa

SEQ ID NO: 152812 - RNA, 22 nt, Homo sapiens
uauuagguuggugcaaaaguaa

SEQ ID NO: 152813 - RNA, 22 nt, Homo sapiens
uauuaguuuucuguggauuaca

SEQ ID NO: 152814 - RNA, 22 nt, Homo sapiens
uauuauuguccuucuauaccca

SEQ ID NO: 152815 - RNA, 22 nt, Homo sapiens
uauucaucuuaagcuuuggcuu

SEQ ID NO: 152816 - RNA, 22 nt, Homo sapiens
uauuccacuuacaugagguauc

SEQ ID NO: 152817 - RNA, 18 nt, Homo sapiens
uauuccucuuccucuauc

SEQ ID NO: 152818 - RNA, 22 nt, Homo sapiens
ugugcauagugugugcggggcg

SEQ ID NO: 152819 - RNA, 22 nt, Homo sapiens
ugugcaugacagcauacaaacg

SEQ ID NO: 152820 - RNA, 22 nt, Homo sapiens
ugugccacuccaaccuggguga

SEQ ID NO: 152821 - RNA, 22 nt, Homo sapiens
ugugccacuccaggaggcuguu

SEQ ID NO: 152822 - RNA, 22 nt, Homo sapiens
ugugccacugcacuccugccug

SEQ ID NO: 152823 - RNA, 22 nt, Homo sapiens
ugugccuacugauagagccaag

SEQ ID NO: 152824 - RNA, 22 nt, Homo sapiens
ugugcguguaagagaucuaggu

SEQ ID NO: 152825 - RNA, 22 nt, Homo sapiens
uguggaaauuguuguauuuaau

SEQ ID NO: 152826 - RNA, 22 nt, Homo sapiens
uguggcugguggcaccuuuucc

SEQ ID NO: 152827 - RNA, 22 nt, Homo sapiens
uguggcuuuuucuuggcugagg

SEQ ID NO: 152828 - RNA, 22 nt, Homo sapiens
uguguacaucucuacacacaug

SEQ ID NO: 152829 - RNA, 22 nt, Homo sapiens
ugugucuugaauuuuguaugua

SEQ ID NO: 152830 - RNA, 22 nt, Homo sapiens
ugugucuuuuaucacacaaugu

SEQ ID NO: 152831 - RNA, 22 nt, Homo sapiens
uguguuugauaaguccauaguu

SEQ ID NO: 152832 - RNA, 22 nt, Homo sapiens
uguuauguauggagugauccca

SEQ ID NO: 152833 - RNA, 20 nt, Homo sapiens
uguugcacucuagccugggu

SEQ ID NO: 152834 - RNA, 22 nt, Homo sapiens
uguugcauuugucaaggucaag

SEQ ID NO: 152835 - RNA, 22 nt, Homo sapiens
uguuuugguugucccuggccag

SEQ ID NO: 152836 - RNA, 22 nt, Homo sapiens
uuaaagugcacacgggucaggc

SEQ ID NO: 152837 - RNA, 22 nt, Homo sapiens
uuaaagugcuguuuuugccggg

SEQ ID NO: 152838 - RNA, 22 nt, Homo sapiens
uuaaaguguuuucaaaauguca

SEQ ID NO: 152839 - RNA, 22 nt, Homo sapiens
uuaaaugucuguagaugugcug

SEQ ID NO: 152840 - RNA, 22 nt, Homo sapiens
uuaacagcacuacguggggauc

SEQ ID NO: 152841 - RNA, 22 nt, Homo sapiens
uuaacaguuaauucuuuggcaa

SEQ ID NO: 152842 - RNA, 22 nt, Homo sapiens
uuaagcaguaguuaaggagagg

SEQ ID NO: 152843 - RNA, 22 nt, Homo sapiens
uuaagcaguggauuagaauuuu

SEQ ID NO: 152844 - RNA, 22 nt, Homo sapiens
uuaagggaggagcuucaagaug

SEQ ID NO: 152845 - RNA, 19 nt, Homo sapiens
uuaagguacuuagaugugu

SEQ ID NO: 152846 - RNA, 22 nt, Homo sapiens
uuaaguagcugggcaugguggu

SEQ ID NO: 152847 - RNA, 19 nt, Homo sapiens
uuaaguaguuagagggucu

SEQ ID NO: 152848 - RNA, 22 nt, Homo sapiens
uuaauaccgucacauggcugaa

SEQ ID NO: 152849 - RNA, 22 nt, Homo sapiens
uuaauagcaaagaguuuagacu

SEQ ID NO: 152850 - RNA, 22 nt, Homo sapiens
uuaaucuguucucuguauucua

SEQ ID NO: 152851 - RNA, 22 nt, Homo sapiens
uuaaugugaaucaggaugcauu

SEQ ID NO: 152852 - RNA, 22 nt, Homo sapiens
uuacacaguaggucccuaguaa

SEQ ID NO: 152853 - RNA, 22 nt, Homo sapiens
uuaccugagaaggugacauuug

SEQ ID NO: 152854 - RNA, 22 nt, Homo sapiens
uuaccuuuuuaagacagguuag

SEQ ID NO: 152855 - RNA, 22 nt, Homo sapiens
uuacguaguuuuggagaucaua

SEQ ID NO: 152856 - RNA, 22 nt, Homo sapiens
uuacuguauagaaucaucuuga

SEQ ID NO: 152857 - RNA, 22 nt, Homo sapiens
uuagagcacugaucugcucuuu

SEQ ID NO: 152858 - RNA, 18 nt, Homo sapiens
uuagaugguuuuaaaacu

SEQ ID NO: 152859 - RNA, 22 nt, Homo sapiens
uuagcagcaugagaauggacua

SEQ ID NO: 152860 - RNA, 22 nt, Homo sapiens
uuagggcaggcaugagagaacu

SEQ ID NO: 152861 - RNA, 22 nt, Homo sapiens
uuagguacuuuggagagauuca

SEQ ID NO: 152862 - RNA, 18 nt, Homo sapiens
uuagguaggucuuugugu

SEQ ID NO: 152863 - RNA, 22 nt, Homo sapiens
uuaggugguacacagccccagu

SEQ ID NO: 152864 - RNA, 22 nt, Homo sapiens
uuaucccacuuucuguuccugu

SEQ ID NO: 152865 - RNA, 21 nt, Homo sapiens
uuaucccagugucucugcagg

SEQ ID NO: 152866 - RNA, 22 nt, Homo sapiens
uuaugacauugacaguuuuuag

SEQ ID NO: 152867 - RNA, 22 nt, Homo sapiens
uuaugcaucuuccacacucauu

SEQ ID NO: 152868 - RNA, 22 nt, Homo sapiens
uuauggcuauugaugacaauug

SEQ ID NO: 152869 - RNA, 22 nt, Homo sapiens
uuauuacuccuauuuuguagau

SEQ ID NO: 152870 - RNA, 22 nt, Homo sapiens
uuauuagagauauuugguuagg

SEQ ID NO: 152871 - RNA, 22 nt, Homo sapiens
uuauugaguaaaaagaaugguu

SEQ ID NO: 152872 - RNA, 22 nt, Homo sapiens
uuauugcuaaaucaugaccaca

SEQ ID NO: 152873 - RNA, 22 nt, Homo sapiens
uuauugcucauuugggcauucu

SEQ ID NO: 152874 - RNA, 22 nt, Homo sapiens
uuauugcuccagaggcugauuu

SEQ ID NO: 152875 - RNA, 22 nt, Homo sapiens
uucaaaggauagauuaagauca

SEQ ID NO: 152876 - RNA, 22 nt, Homo sapiens
uucaaaguaaagggauggagac

SEQ ID NO: 152877 - RNA, 22 nt, Homo sapiens
uucaaauguucuuucaccaccc

SEQ ID NO: 152878 - RNA, 22 nt, Homo sapiens
uucaagcuauggugaucuuuuc

SEQ ID NO: 152879 - RNA, 22 nt, Homo sapiens
uucacaaugccuuguugauggu

SEQ ID NO: 152880 - RNA, 22 nt, Homo sapiens
uucacagaaaaaggcgaugagg

SEQ ID NO: 152881 - RNA, 22 nt, Homo sapiens
uucacagaguuauuuuuaugcu

SEQ ID NO: 152882 - RNA, 22 nt, Homo sapiens
uucacagccgcaccccaucacu

SEQ ID NO: 152883 - RNA, 22 nt, Homo sapiens
uucacagucacccuucuccaug

SEQ ID NO: 152884 - RNA, 21 nt, Homo sapiens
uucaccauggcuccacacucu

SEQ ID NO: 152885 - RNA, 22 nt, Homo sapiens
ugccagaugcuggugugagggg

SEQ ID NO: 152886 - RNA, 22 nt, Homo sapiens
ugccaguauuuuauugagcauu

SEQ ID NO: 152887 - RNA, 22 nt, Homo sapiens
ugccaugucauagguuaagccu

SEQ ID NO: 152888 - RNA, 22 nt, Homo sapiens
ugccauugcacuccagccuggg

SEQ ID NO: 152889 - RNA, 22 nt, Homo sapiens
ugccuaggcuggaaugcagugg

SEQ ID NO: 152890 - RNA, 22 nt, Homo sapiens
ugccuaggcuggaguguagugg

SEQ ID NO: 152891 - RNA, 20 nt, Homo sapiens
ugccugacacucuuugcuuc

SEQ ID NO: 152892 - RNA, 22 nt, Homo sapiens
ugcgccauugcacuccagucuu

SEQ ID NO: 152893 - RNA, 22 nt, Homo sapiens
ugcguaggcuagagugcagugg

SEQ ID NO: 152894 - RNA, 19 nt, Homo sapiens
ugcugcauugugaccuugc

SEQ ID NO: 152895 - RNA, 22 nt, Homo sapiens
ugcugguaguuuaugacuaauu

SEQ ID NO: 152896 - RNA, 22 nt, Homo sapiens
ugcuggugauuaaauccugaag

SEQ ID NO: 152897 - RNA, 22 nt, Homo sapiens
ugcuggugauucagauucaaau

SEQ ID NO: 152898 - RNA, 22 nt, Homo sapiens
uggaaaauuaggggagguuaua

SEQ ID NO: 152899 - RNA, 19 nt, Homo sapiens
uggaacauaaaaguugguu

SEQ ID NO: 152900 - RNA, 23 nt, Homo sapiens
uggaacugaauuucuuagcauuu

SEQ ID NO: 152901 - RNA, 20 nt, Homo sapiens
uggaacuuaauugauggaca

SEQ ID NO: 152902 - RNA, 22 nt, Homo sapiens
uggaagacucaagguggugaau

SEQ ID NO: 152903 - RNA, 22 nt, Homo sapiens
uggaagcaugcaaucugugggg

SEQ ID NO: 152904 - RNA, 22 nt, Homo sapiens
uggaaguaaucaugagguagca

SEQ ID NO: 152905 - RNA, 22 nt, Homo sapiens
uggaagucuauggcauuugagu

SEQ ID NO: 152906 - RNA, 19 nt, Homo sapiens
uggaauggauuuaaaugug

SEQ ID NO: 152907 - RNA, 22 nt, Homo sapiens
uggaaugugaauaacuuccuuc

SEQ ID NO: 152908 - RNA, 22 nt, Homo sapiens
uggaauuuacuuauuuaggggc

SEQ ID NO: 152909 - RNA, 22 nt, Homo sapiens
uggacagacaagguuauagauc

SEQ ID NO: 152910 - RNA, 22 nt, Homo sapiens
uggaccccugcucgggagcccu

SEQ ID NO: 152911 - RNA, 22 nt, Homo sapiens
uggagacugaucccucuuuccu

SEQ ID NO: 152912 - RNA, 22 nt, Homo sapiens
uggagauguuuaaaauccacug

SEQ ID NO: 152913 - RNA, 22 nt, Homo sapiens
uacaccauuugauucuuuaagc

SEQ ID NO: 152914 - RNA, 22 nt, Homo sapiens
uacacgugcacaacgugcacgu

SEQ ID NO: 152915 - RNA, 22 nt, Homo sapiens
uacagaauauuucugcccugag

SEQ ID NO: 152916 - RNA, 22 nt, Homo sapiens
uacagccacauaauguaugauu

SEQ ID NO: 152917 - RNA, 22 nt, Homo sapiens
uacagcuaugugcaugcaugcu

SEQ ID NO: 152918 - RNA, 22 nt, Homo sapiens
uacauugucauauucucucucu

SEQ ID NO: 152919 - RNA, 16 nt, Homo sapiens
uacauuuguuacaugg

SEQ ID NO: 152920 - RNA, 22 nt, Homo sapiens
uaccacaggcuggguaaucuau

SEQ ID NO: 152921 - RNA, 22 nt, Homo sapiens
uaccacugccgagaaaacagau

SEQ ID NO: 152922 - RNA, 22 nt, Homo sapiens
uaccaguaaugggucaaaggca

SEQ ID NO: 152923 - RNA, 19 nt, Homo sapiens
uacccagaagcagcauugu

SEQ ID NO: 152924 - RNA, 22 nt, Homo sapiens
uaccugagucuagagucuagaa

SEQ ID NO: 152925 - RNA, 22 nt, Homo sapiens
uacuccccuuguucugugagcu

SEQ ID NO: 152926 - RNA, 22 nt, Homo sapiens
uacugcaucgaaaugcuuuuau

SEQ ID NO: 152927 - RNA, 22 nt, Homo sapiens
uacugcauucuccgccuccggg

SEQ ID NO: 152928 - RNA, 22 nt, Homo sapiens
uagaauguauaauauuuuacuu

SEQ ID NO: 152929 - RNA, 22 nt, Homo sapiens
uagaaugucagcuucuugaggg

SEQ ID NO: 152930 - RNA, 22 nt, Homo sapiens
uagagcaaugacucuggaaacc

SEQ ID NO: 152931 - RNA, 22 nt, Homo sapiens
uagaguguuuuguuaggcagca

SEQ ID NO: 152932 - RNA, 21 nt, Homo sapiens
uagauaguugguucugaaucu

SEQ ID NO: 152933 - RNA, 22 nt, Homo sapiens
uagaucauauacuugccaugac

SEQ ID NO: 152934 - RNA, 19 nt, Homo sapiens
uagcacagggucccagacu

SEQ ID NO: 152935 - RNA, 22 nt, Homo sapiens
uagcacccucuccuaguccugc

SEQ ID NO: 152936 - RNA, 20 nt, Homo sapiens
uagcagcagacagagggagg

SEQ ID NO: 152937 - RNA, 22 nt, Homo sapiens
uagcaggaaaggggucagaucu

SEQ ID NO: 152938 - RNA, 22 nt, Homo sapiens
uagcaguauugaaagaugaggg

SEQ ID NO: 152939 - RNA, 22 nt, Homo sapiens
uagcaucagauuccauauucua

SEQ ID NO: 152940 - RNA, 22 nt, Homo sapiens
uagcaugucagucgccacacgu

SEQ ID NO: 152941 - RNA, 22 nt, Homo sapiens
uaggacuuuucuugagagugac

SEQ ID NO: 152942 - RNA, 22 nt, Homo sapiens
uaggcacacaucuacuacaaau

SEQ ID NO: 152943 - RNA, 22 nt, Homo sapiens
uaggcaguuuuccuuucacagu

SEQ ID NO: 152944 - RNA, 22 nt, Homo sapiens
uagggcuugugaucagguguag

SEQ ID NO: 152945 - RNA, 22 nt, Homo sapiens
uagguacuuaagaucucagcua

SEQ ID NO: 152946 - RNA, 22 nt, Homo sapiens
uagguucuccacagguucucca

SEQ ID NO: 152947 - RNA, 22 nt, Homo sapiens
uaguagagauggggcacaugcc

SEQ ID NO: 152948 - RNA, 22 nt, Homo sapiens
uaguagcaccucucaugagcuu

SEQ ID NO: 152949 - RNA, 22 nt, Homo sapiens
uagucaaaucugaaggaaauuu

SEQ ID NO: 152950 - RNA, 22 nt, Homo sapiens
uagugcugagauugagaagccc

SEQ ID NO: 152951 - RNA, 22 nt, Homo sapiens
gcacauggccccaucgugccga

SEQ ID NO: 152952 - RNA, 22 nt, Homo sapiens
gcaccaugguagaauaauggua

SEQ ID NO: 152953 - RNA, 22 nt, Homo sapiens
gcaccccuuaccgggcuggguu

SEQ ID NO: 152954 - RNA, 22 nt, Homo sapiens
gcacugggccacauuuauuuuc

SEQ ID NO: 152955 - RNA, 22 nt, Homo sapiens
gcagaguauagagggcugggcc

SEQ ID NO: 152956 - RNA, 22 nt, Homo sapiens
gcagcacauggcagaacauauu

SEQ ID NO: 152957 - RNA, 22 nt, Homo sapiens
gcagcagugugggcugaaccua

SEQ ID NO: 152958 - RNA, 22 nt, Homo sapiens
gcagcauuaccaagacauggca

SEQ ID NO: 152959 - RNA, 22 nt, Homo sapiens
gcagguaguuucugacuuuuac

SEQ ID NO: 152960 - RNA, 22 nt, Homo sapiens
gcaguagugcgaucucagcuca

SEQ ID NO: 152961 - RNA, 22 nt, Homo sapiens
gcaguguucugggcaggaagaa

SEQ ID NO: 152962 - RNA, 19 nt, Homo sapiens
gcaucauuaguugcuuuuc

SEQ ID NO: 152963 - RNA, 22 nt, Homo sapiens
gcaugcacuguauuuaaguauc

SEQ ID NO: 152964 - RNA, 22 nt, Homo sapiens
gcauggagaaggggacugauuc

SEQ ID NO: 152965 - RNA, 22 nt, Homo sapiens
gcauggccuuuaaaugucacag

SEQ ID NO: 152966 - RNA, 20 nt, Homo sapiens
gccacaguuaagcuucugcc

SEQ ID NO: 152967 - RNA, 22 nt, Homo sapiens
gccagugugaugugaucauggc

SEQ ID NO: 152968 - RNA, 22 nt, Homo sapiens
gcccacuguuaaauuuguuuua

SEQ ID NO: 152969 - RNA, 22 nt, Homo sapiens
gcccagcguucagggaggggcu

SEQ ID NO: 152970 - RNA, 22 nt, Homo sapiens
gcccauuguuccuaggcuacaa

SEQ ID NO: 152971 - RNA, 22 nt, Homo sapiens
gccccaguacaggcuccuuaga

SEQ ID NO: 152972 - RNA, 22 nt, Homo sapiens
gcccuguaguauaguuugaagu

SEQ ID NO: 152973 - RNA, 22 nt, Homo sapiens
gcccuuugugucuggcuggggu

SEQ ID NO: 152974 - RNA, 19 nt, Homo sapiens
gcggcacuggagacacagc

SEQ ID NO: 152975 - RNA, 20 nt, Homo sapiens
gcuaaggcacgggaauuacu

SEQ ID NO: 152976 - RNA, 23 nt, Homo sapiens
gcuaggagagaugaaacacaggu

SEQ ID NO: 152977 - RNA, 22 nt, Homo sapiens
gcucuuuugggguaauucugag

SEQ ID NO: 152978 - RNA, 22 nt, Homo sapiens
gcugagguucaagaagguuaaa

SEQ ID NO: 152979 - RNA, 22 nt, Homo sapiens
gcugcuguuauucaucagaacu

SEQ ID NO: 152980 - RNA, 22 nt, Homo sapiens
gcuggcaagaugcugaugcaac

SEQ ID NO: 152981 - RNA, 22 nt, Homo sapiens
gcuggcuuucuccugaucucag

SEQ ID NO: 152982 - RNA, 22 nt, Homo sapiens
gcugugguuuaguagaaagaag

SEQ ID NO: 152983 - RNA, 22 nt, Homo sapiens
ggaaaucucugaggcucccuuc

SEQ ID NO: 152984 - RNA, 22 nt, Homo sapiens
ggaaauguuggugucaugaguu

SEQ ID NO: 152985 - RNA, 22 nt, Homo sapiens
ggaagagugaauuaucuugacu

SEQ ID NO: 152986 - RNA, 22 nt, Homo sapiens
ggaauauaaaaagccccagaau

SEQ ID NO: 152987 - RNA, 19 nt, Homo sapiens
ggaaugcaccaguccuugc

SEQ ID NO: 152988 - RNA, 22 nt, Homo sapiens
ggaauguauuaaggcauugggc

SEQ ID NO: 152989 - RNA, 22 nt, Homo sapiens
ggaauguuaaagacuacacuga

SEQ ID NO: 152990 - RNA, 20 nt, Homo sapiens
ggaauguuaaucuccaugau

SEQ ID NO: 152991 - RNA, 22 nt, Homo sapiens
ggacagaugggcucccgggucu

SEQ ID NO: 152992 - RNA, 22 nt, Homo sapiens
ggacuagggacauggggagcug

SEQ ID NO: 152993 - RNA, 20 nt, Homo sapiens
ggagagugacauaauucugg

SEQ ID NO: 152994 - RNA, 22 nt, Homo sapiens
ggagauuauugaaucaugaggg

SEQ ID NO: 152995 - RNA, 22 nt, Homo sapiens
ggaguaggcuguccggcaccca

SEQ ID NO: 152996 - RNA, 21 nt, Homo sapiens
ggaguauaaggcaaaggagug

SEQ ID NO: 152997 - RNA, 22 nt, Homo sapiens
ggagugucccaaucucagcuca

SEQ ID NO: 152998 - RNA, 22 nt, Homo sapiens
ggagugucugugcuggucaaag

SEQ ID NO: 152999 - RNA, 18 nt, Homo sapiens
gugagaaugacuguucug

SEQ ID NO: 153000 - RNA, 22 nt, Homo sapiens
gugagacugaguuucgcucuug

SEQ ID NO: 153001 - RNA, 22 nt, Homo sapiens
gugagaggaggcagcuuuuaca

SEQ ID NO: 153002 - RNA, 22 nt, Homo sapiens
gugagauaucuagacuagggaa

SEQ ID NO: 153003 - RNA, 22 nt, Homo sapiens
gugagauggagucuugcuuugu

SEQ ID NO: 153004 - RNA, 22 nt, Homo sapiens
gugagaugguaucucauugugg

SEQ ID NO: 153005 - RNA, 22 nt, Homo sapiens
gugagaugugacuucugccucu

SEQ ID NO: 153006 - RNA, 22 nt, Homo sapiens
gugagcauauuaguauugcacu

SEQ ID NO: 153007 - RNA, 22 nt, Homo sapiens
gugagcauuacucaugggauca

SEQ ID NO: 153008 - RNA, 22 nt, Homo sapiens
gugagcauucaaggaaggagcu

SEQ ID NO: 153009 - RNA, 22 nt, Homo sapiens
gugagcuccucuucugcugcag

SEQ ID NO: 153010 - RNA, 22 nt, Homo sapiens
gugaggaaggaaaccugcuagc

SEQ ID NO: 153011 - RNA, 22 nt, Homo sapiens
gugagguacgugucaagaacca

SEQ ID NO: 153012 - RNA, 22 nt, Homo sapiens
gugaggucagggcuguggacag

SEQ ID NO: 153013 - RNA, 17 nt, Homo sapiens
gugagguggguaguauc

SEQ ID NO: 153014 - RNA, 22 nt, Homo sapiens
gugauagaucugggauucagaa

SEQ ID NO: 153015 - RNA, 22 nt, Homo sapiens
gugauguguuucaacagcuccu

SEQ ID NO: 153016 - RNA, 22 nt, Homo sapiens
gugauuuaguagaugcuaguua

SEQ ID NO: 153017 - RNA, 22 nt, Homo sapiens
gugcaagagugauugcaguuuu

SEQ ID NO: 153018 - RNA, 22 nt, Homo sapiens
gugcacauuguuuaugucuguu

SEQ ID NO: 153019 - RNA, 21 nt, Homo sapiens
gugcagacacacauauaggcu

SEQ ID NO: 153020 - RNA, 22 nt, Homo sapiens
gugccacugcacuccggccugg

SEQ ID NO: 153021 - RNA, 21 nt, Homo sapiens
guggaaauggaauuuacuaau

SEQ ID NO: 153022 - RNA, 22 nt, Homo sapiens
guggaaggucaugaauguucuu

SEQ ID NO: 153023 - RNA, 18 nt, Homo sapiens
guggagugucuuccugga

SEQ ID NO: 153024 - RNA, 22 nt, Homo sapiens
guggcaaagaugccuucuccaa

SEQ ID NO: 153025 - RNA, 22 nt, Homo sapiens
guggcaaggaaaugcugcucac

SEQ ID NO: 153026 - RNA, 22 nt, Homo sapiens
guggcacgaugaucugggcuca

SEQ ID NO: 153027 - RNA, 22 nt, Homo sapiens
guggcagaaaagagaagcaaug

SEQ ID NO: 153028 - RNA, 22 nt, Homo sapiens
guggcagaacagguaggguucu

SEQ ID NO: 153029 - RNA, 22 nt, Homo sapiens
guggcagugugaggauccugcu

SEQ ID NO: 153030 - RNA, 22 nt, Homo sapiens
guggcaugaaagcaucugugau

SEQ ID NO: 153031 - RNA, 22 nt, Homo sapiens
gugggauaauuuuuggugcugu

SEQ ID NO: 153032 - RNA, 22 nt, Homo sapiens
gugggauggagagaagguauga

SEQ ID NO: 153033 - RNA, 20 nt, Homo sapiens
gugggcaaauccuuuccucu

SEQ ID NO: 153034 - RNA, 22 nt, Homo sapiens
gugguuuuaauauucagucuag

SEQ ID NO: 153035 - RNA, 22 nt, Homo sapiens
gugguuuuaucccagaaauuaa

SEQ ID NO: 153036 - RNA, 22 nt, Homo sapiens
gugguuuucaacuccaccugca

SEQ ID NO: 153037 - RNA, 22 nt, Homo sapiens
gugguuuuuaaaguaccugugg

SEQ ID NO: 153038 - RNA, 22 nt, Homo sapiens
gugguuuuuagauuucuacagu

SEQ ID NO: 153039 - RNA, 22 nt, Homo sapiens
guguaaaucaaucuguugucuu

SEQ ID NO: 153040 - RNA, 22 nt, Homo sapiens
ucauugguagcucauggaaccg

SEQ ID NO: 153041 - RNA, 22 nt, Homo sapiens
uccaauguaaucaucauugaau

SEQ ID NO: 153042 - RNA, 22 nt, Homo sapiens
uccacagugguugaacuaguaa

SEQ ID NO: 153043 - RNA, 22 nt, Homo sapiens
uccacagugguugaacuaguuu

SEQ ID NO: 153044 - RNA, 22 nt, Homo sapiens
uccagguacucagggggcugag

SEQ ID NO: 153045 - RNA, 22 nt, Homo sapiens
uccagguuuggcuuuauaacuu

SEQ ID NO: 153046 - RNA, 22 nt, Homo sapiens
uccagugugcaggcaaguuuga

SEQ ID NO: 153047 - RNA, 22 nt, Homo sapiens
uccaguuuggaggcuugaugug

SEQ ID NO: 153048 - RNA, 16 nt, Homo sapiens
ucccaccauugcuugu

SEQ ID NO: 153049 - RNA, 22 nt, Homo sapiens
ucccacugucuucucgugcucg

SEQ ID NO: 153050 - RNA, 20 nt, Homo sapiens
ucccaguaggagaaggaagg

SEQ ID NO: 153051 - RNA, 22 nt, Homo sapiens
uccccaguaggcaauuaacacc

SEQ ID NO: 153052 - RNA, 19 nt, Homo sapiens
uccccaguuuuccguucag

SEQ ID NO: 153053 - RNA, 22 nt, Homo sapiens
uccccugauaccaaccaccaug

SEQ ID NO: 153054 - RNA, 22 nt, Homo sapiens
uccccuuuguaagauggaaacg

SEQ ID NO: 153055 - RNA, 20 nt, Homo sapiens
ucccucaaacuuuuccacug

SEQ ID NO: 153056 - RNA, 22 nt, Homo sapiens
ucccugaacacauguugagaag

SEQ ID NO: 153057 - RNA, 22 nt, Homo sapiens
ucccuguagugccuagaucaga

SEQ ID NO: 153058 - RNA, 17 nt, Homo sapiens
ucccuguuuuuucaguc

SEQ ID NO: 153059 - RNA, 22 nt, Homo sapiens
ucccuuaaugaugaacaaugag

SEQ ID NO: 153060 - RNA, 22 nt, Homo sapiens
uccuucacucuacaucuuuguu

SEQ ID NO: 153061 - RNA, 22 nt, Homo sapiens
uccuucaugcaucaauguaucc

SEQ ID NO: 153062 - RNA, 22 nt, Homo sapiens
uccuucauuugucaacucuagu

SEQ ID NO: 153063 - RNA, 22 nt, Homo sapiens
uccuuggugacauuucuugucu

SEQ ID NO: 153064 - RNA, 22 nt, Homo sapiens
uccuuugguuauaggcaccucu

SEQ ID NO: 153065 - RNA, 22 nt, Homo sapiens
uccuuuguuacaguuggcucug

SEQ ID NO: 153066 - RNA, 22 nt, Homo sapiens
ucgugcaaacguaauugugguu

SEQ ID NO: 153067 - RNA, 22 nt, Homo sapiens
ucgugcugugucaucuuguggc

SEQ ID NO: 153068 - RNA, 22 nt, Homo sapiens
ucuaaagcauccagauugcuuc

SEQ ID NO: 153069 - RNA, 22 nt, Homo sapiens
ucuaauguaaccugcaaauauu

SEQ ID NO: 153070 - RNA, 20 nt, Homo sapiens
ucuaccuguagguaauuggu

SEQ ID NO: 153071 - RNA, 22 nt, Homo sapiens
ucucaauggguuguagacaaag

SEQ ID NO: 153072 - RNA, 22 nt, Homo sapiens
ucucacagaguugaauguuucu

SEQ ID NO: 153073 - RNA, 19 nt, Homo sapiens
ucucacagcucuacuaugu

SEQ ID NO: 153074 - RNA, 22 nt, Homo sapiens
ucucagagccuaggguuuuuca

SEQ ID NO: 153075 - RNA, 22 nt, Homo sapiens
ucucaguuuucuggggaagaaa

SEQ ID NO: 153076 - RNA, 22 nt, Homo sapiens
ucucauagaggcagagaguaaa

SEQ ID NO: 153077 - RNA, 22 nt, Homo sapiens
ucucugagaaaaguuucuccca

SEQ ID NO: 153078 - RNA, 22 nt, Homo sapiens
ucucuuggcggaaguugcagug

SEQ ID NO: 153079 - RNA, 22 nt, Homo sapiens
ucucuuggugacuuaaaauguu

SEQ ID NO: 153080 - RNA, 22 nt, Homo sapiens
ucugaaucguucccaugcagga

SEQ ID NO: 153081 - RNA, 22 nt, Homo sapiens
ucugacacagugauuaguaaau

SEQ ID NO: 153082 - RNA, 22 nt, Homo sapiens
ucugacucuggagucucagguu

SEQ ID NO: 153083 - RNA, 22 nt, Homo sapiens
ucugccuuuucaugugggaugg

SEQ ID NO: 153084 - RNA, 22 nt, Homo sapiens
ucuggcaagagccgagggcagu

SEQ ID NO: 153085 - RNA, 22 nt, Homo sapiens
ucuggcacugaugugggaugcu

SEQ ID NO: 153086 - RNA, 21 nt, Homo sapiens
ucuggcccccucaaaucucau

SEQ ID NO: 153087 - RNA, 21 nt, Homo sapiens
ucuggccccuccaaaucucau

SEQ ID NO: 153088 - RNA, 22 nt, Homo sapiens
ucuggcuccaaagucuauuuuu

SEQ ID NO: 153089 - RNA, 22 nt, Homo sapiens
ucuggcuccacacuuuauuaac

SEQ ID NO: 153090 - RNA, 16 nt, Homo sapiens
ucuggcucuacaguuc

SEQ ID NO: 153091 - RNA, 22 nt, Homo sapiens
ucuggcuugugaacugucuucu

SEQ ID NO: 153092 - RNA, 22 nt, Homo sapiens
ucugggguuagucaaagguaug

SEQ ID NO: 153093 - RNA, 22 nt, Homo sapiens
ucugggguuuccacuuuuacuu

SEQ ID NO: 153094 - RNA, 20 nt, Homo sapiens
ucuggguuuuggccacgccc

SEQ ID NO: 153095 - RNA, 22 nt, Homo sapiens
ucuggucccugcacauauuuuc

SEQ ID NO: 153096 - RNA, 22 nt, Homo sapiens
ucuguaguuaacagcuucagcu

SEQ ID NO: 153097 - RNA, 22 nt, Homo sapiens
ucugugcugagaguugaaaguu

SEQ ID NO: 153098 - RNA, 18 nt, Homo sapiens
ucugugguguaaauacgu

SEQ ID NO: 153099 - RNA, 22 nt, Homo sapiens
ucugugguucaaaccagcaacu

SEQ ID NO: 153100 - RNA, 22 nt, Homo sapiens
ucugugguuguugcauggaaug

SEQ ID NO: 153101 - RNA, 22 nt, Homo sapiens
ucuuaguuugggguggggauag

SEQ ID NO: 153102 - RNA, 22 nt, Homo sapiens
ucuugcaauuuccuuaguggug

SEQ ID NO: 153103 - RNA, 22 nt, Homo sapiens
ucuuuggagacaaccccagucu

SEQ ID NO: 153104 - RNA, 23 nt, Homo sapiens
ucuuuggcucuaauauaccuugu

SEQ ID NO: 153105 - RNA, 22 nt, Homo sapiens
ucuuugguaauggaugucugau

SEQ ID NO: 153106 - RNA, 21 nt, Homo sapiens
ucuuuggucaccaguuuucau

SEQ ID NO: 153107 - RNA, 22 nt, Homo sapiens
ucuuugguucugugcagccuau

SEQ ID NO: 153108 - RNA, 22 nt, Homo sapiens
ucuuugguuucugucucuguaa

SEQ ID NO: 153109 - RNA, 22 nt, Homo sapiens
ucuuuguugcauaggcuuguuc

SEQ ID NO: 153110 - RNA, 22 nt, Homo sapiens
ucuuuguuuucugauccugaag

SEQ ID NO: 153111 - RNA, 20 nt, Homo sapiens
ucuuuuuguggccccagagu

SEQ ID NO: 153112 - RNA, 22 nt, Homo sapiens
ugagcacagcgugugggagagc

SEQ ID NO: 153113 - RNA, 22 nt, Homo sapiens
ugagcagaaguuuugauuggcg

SEQ ID NO: 153114 - RNA, 22 nt, Homo sapiens
ugagcauauuuaagguaugcua

SEQ ID NO: 153115 - RNA, 22 nt, Homo sapiens
ugagccaaugauuugaauagag

SEQ ID NO: 153116 - RNA, 22 nt, Homo sapiens
ugagcuauguucuucuuguuuu

SEQ ID NO: 153117 - RNA, 22 nt, Homo sapiens
ugaggacugagaggcacugugg

SEQ ID NO: 153118 - RNA, 22 nt, Homo sapiens
ugaggcaagauacugauuucau

SEQ ID NO: 153119 - RNA, 22 nt, Homo sapiens
ugaggcaaggcugaaugaaggc

SEQ ID NO: 153120 - RNA, 22 nt, Homo sapiens
ugagggaugcguacccuaugcc

SEQ ID NO: 153121 - RNA, 22 nt, Homo sapiens
ugagguacaacauggacugaag

SEQ ID NO: 153122 - RNA, 22 nt, Homo sapiens
ugagguagaggugaacuugacc

SEQ ID NO: 153123 - RNA, 22 nt, Homo sapiens
ugagguaucauugcccaggcug

SEQ ID NO: 153124 - RNA, 21 nt, Homo sapiens
ugaggucaugaugcugcuucc

SEQ ID NO: 153125 - RNA, 22 nt, Homo sapiens
ugaggucuuuauuuagugcuca

SEQ ID NO: 153126 - RNA, 22 nt, Homo sapiens
ugagguuauuuguucaagaagu

SEQ ID NO: 153127 - RNA, 22 nt, Homo sapiens
ugaguagaaauaaacgcaaacu

SEQ ID NO: 153128 - RNA, 22 nt, Homo sapiens
ugaguagaacuagucuagagcu

SEQ ID NO: 153129 - RNA, 22 nt, Homo sapiens
ugagugagguucuacucuguga

SEQ ID NO: 153130 - RNA, 22 nt, Homo sapiens
ugagugccuggagggcagggac

SEQ ID NO: 153131 - RNA, 22 nt, Homo sapiens
ugagugugaggaagaauuagaa

SEQ ID NO: 153132 - RNA, 22 nt, Homo sapiens
ugaguguguaugugcauacaca

SEQ ID NO: 153133 - RNA, 22 nt, Homo sapiens
ugaguuaaucucuacgauagaa

SEQ ID NO: 153134 - RNA, 22 nt, Homo sapiens
ugaguuaauuuuuguaucaugu

SEQ ID NO: 153135 - RNA, 22 nt, Homo sapiens
ugaguuagguaauaauaaauau

SEQ ID NO: 153136 - RNA, 22 nt, Homo sapiens
ugaguuaguguggugcuuggaa

SEQ ID NO: 153137 - RNA, 22 nt, Homo sapiens
ugaguucaauguuaaugaagca

SEQ ID NO: 153138 - RNA, 22 nt, Homo sapiens
ugauaagaaauuguucauguag

SEQ ID NO: 153139 - RNA, 22 nt, Homo sapiens
ugauaugucccucgacaucagg

SEQ ID NO: 153140 - RNA, 22 nt, Homo sapiens
ugaucucagcucacugguugaa

SEQ ID NO: 153141 - RNA, 22 nt, Homo sapiens
ugaucucauuagcaccuuuagc

SEQ ID NO: 153142 - RNA, 22 nt, Homo sapiens
ugaucuguguaacauaggaguc

SEQ ID NO: 153143 - RNA, 22 nt, Homo sapiens
ugaugacccugcaguucucaag

SEQ ID NO: 153144 - RNA, 22 nt, Homo sapiens
ugaugcugaugccugccagaag

SEQ ID NO: 153145 - RNA, 22 nt, Homo sapiens
ugauggcaauggcauucauuuu

SEQ ID NO: 153146 - RNA, 22 nt, Homo sapiens
ugauggcacagugaguuccagg

SEQ ID NO: 153147 - RNA, 22 nt, Homo sapiens
ugaugguguuaccaucuuuacu

SEQ ID NO: 153148 - RNA, 22 nt, Homo sapiens
ugauuagaggaaugguagauua

SEQ ID NO: 153149 - RNA, 22 nt, Homo sapiens
ugcaaagucgaaacugcaguuu

SEQ ID NO: 153150 - RNA, 22 nt, Homo sapiens
ugcaaaucuuguguaguuguga

SEQ ID NO: 153151 - RNA, 22 nt, Homo sapiens
ugcaaauguuaggugucauuau

SEQ ID NO: 153152 - RNA, 19 nt, Homo sapiens
ugcaaauucuaaaaacuga

SEQ ID NO: 153153 - RNA, 22 nt, Homo sapiens
ugcaagaggagacuguacucag

SEQ ID NO: 153154 - RNA, 22 nt, Homo sapiens
ugcaaguaauuggcgaggaguu

SEQ ID NO: 153155 - RNA, 22 nt, Homo sapiens
ugcaauagcuucaggagaaggg

SEQ ID NO: 153156 - RNA, 22 nt, Homo sapiens
ugcaauauccucuacuauaggu

SEQ ID NO: 153157 - RNA, 22 nt, Homo sapiens
ugcaaucaucgcuguuggccac

SEQ ID NO: 153158 - RNA, 20 nt, Homo sapiens
ugcagauucaaccaacugug

SEQ ID NO: 153159 - RNA, 22 nt, Homo sapiens
ugcagcucaaauuccuaacaag

SEQ ID NO: 153160 - RNA, 22 nt, Homo sapiens
ugcagugucaauaauaauuagu

SEQ ID NO: 153161 - RNA, 20 nt, Homo sapiens
ugcaguguccucacuuguca

SEQ ID NO: 153162 - RNA, 22 nt, Homo sapiens
ugcauaggcuaaaauccuggcc

SEQ ID NO: 153163 - RNA, 18 nt, Homo sapiens
ugcauauguugaaccagc

SEQ ID NO: 153164 - RNA, 22 nt, Homo sapiens
ugcauauguugaaccagccuug

SEQ ID NO: 153165 - RNA, 20 nt, Homo sapiens
ugcauguccucacuuacuug

SEQ ID NO: 153166 - RNA, 22 nt, Homo sapiens
ugcauuguggaucuaaaugcau

SEQ ID NO: 153167 - RNA, 22 nt, Homo sapiens
ugccaaaaugggcuuuauaccg

SEQ ID NO: 153168 - RNA, 22 nt, Homo sapiens
ugccaguauuuuacugaggauu

SEQ ID NO: 153169 - RNA, 22 nt, Homo sapiens
ugccuaggcccaguccucagaa

SEQ ID NO: 153170 - RNA, 22 nt, Homo sapiens
ugcuagaugaaguuugaguuuu

SEQ ID NO: 153171 - RNA, 16 nt, Homo sapiens
ugcuauguuggccagg

SEQ ID NO: 153172 - RNA, 21 nt, Homo sapiens
ugcuauguuguccaggcuggc

SEQ ID NO: 153173 - RNA, 23 nt, Homo sapiens
ugcugagaccuagauccuaaaga

SEQ ID NO: 153174 - RNA, 22 nt, Homo sapiens
ugcugcacaguucuuaagauua

SEQ ID NO: 153175 - RNA, 20 nt, Homo sapiens
ugcugcacuuaagcaugggc

SEQ ID NO: 153176 - RNA, 22 nt, Homo sapiens
ugcugcacuuauggcucugagg

SEQ ID NO: 153177 - RNA, 22 nt, Homo sapiens
ugcugguggucccauaugauua

SEQ ID NO: 153178 - RNA, 22 nt, Homo sapiens
ugcuggugucaucaaggcuuug

SEQ ID NO: 153179 - RNA, 21 nt, Homo sapiens
ugcuuacugaauguuaauuuc

SEQ ID NO: 153180 - RNA, 22 nt, Homo sapiens
ugcuuaggcuaacaaaaauagc

SEQ ID NO: 153181 - RNA, 22 nt, Homo sapiens
uggaaaguaguucuaaucuaag

SEQ ID NO: 153182 - RNA, 23 nt, Homo sapiens
uggaagacuccucucuuggcugc

SEQ ID NO: 153183 - RNA, 22 nt, Homo sapiens
uggaagugucugugcccagcuc

SEQ ID NO: 153184 - RNA, 19 nt, Homo sapiens
uggaaugaaauguuagggg

SEQ ID NO: 153185 - RNA, 22 nt, Homo sapiens
uggaaugcuaagcaugugggag

SEQ ID NO: 153186 - RNA, 17 nt, Homo sapiens
uggaaugucuaagccug

SEQ ID NO: 153187 - RNA, 22 nt, Homo sapiens
uggaauuaauuaaaauauacug

SEQ ID NO: 153188 - RNA, 22 nt, Homo sapiens
uggaauuuagguugauaguaua

SEQ ID NO: 153189 - RNA, 19 nt, Homo sapiens
uggaccccuuccuuacacc

SEQ ID NO: 153190 - RNA, 21 nt, Homo sapiens
uggaccccuuccuugcaccau

SEQ ID NO: 153191 - RNA, 22 nt, Homo sapiens
uggaccccuucuccuauuaaaa

SEQ ID NO: 153192 - RNA, 22 nt, Homo sapiens
uggacuguaauagagaacagaa

SEQ ID NO: 153193 - RNA, 22 nt, Homo sapiens
uggagagucauuuauaguauuu

SEQ ID NO: 153194 - RNA, 22 nt, Homo sapiens
uggaggacugcagaacugaggc

SEQ ID NO: 153195 - RNA, 22 nt, Homo sapiens
uggagggcuagucauuucuuuu

SEQ ID NO: 153196 - RNA, 22 nt, Homo sapiens
uggagguagacauugggaagag

SEQ ID NO: 153197 - RNA, 22 nt, Homo sapiens
uggagguagagaugggaucucc

SEQ ID NO: 153198 - RNA, 22 nt, Homo sapiens
uggagguaggacgaagaacucu

SEQ ID NO: 153199 - RNA, 22 nt, Homo sapiens
uggaggucauuggaucaugggg

SEQ ID NO: 153200 - RNA, 22 nt, Homo sapiens
uggagucuugcucuguugccca

SEQ ID NO: 153201 - RNA, 22 nt, Homo sapiens
uggagugcaauggcaccaucuu

SEQ ID NO: 153202 - RNA, 22 nt, Homo sapiens
augauguguguuuaagaugucu

SEQ ID NO: 153203 - RNA, 22 nt, Homo sapiens
augcaaaucuuaaguaugugug

SEQ ID NO: 153204 - RNA, 22 nt, Homo sapiens
augcaagacaccgauuagcuuu

SEQ ID NO: 153205 - RNA, 19 nt, Homo sapiens
augcaaugucacaggcugc

SEQ ID NO: 153206 - RNA, 22 nt, Homo sapiens
augcacaguccagcccaugugg

SEQ ID NO: 153207 - RNA, 22 nt, Homo sapiens
augcacuguuuucuugaugaga

SEQ ID NO: 153208 - RNA, 22 nt, Homo sapiens
augcagagaaaucuaaaauaug

SEQ ID NO: 153209 - RNA, 22 nt, Homo sapiens
augcagagucccagccccuagc

SEQ ID NO: 153210 - RNA, 22 nt, Homo sapiens
augcagauauuuuugugguugc

SEQ ID NO: 153211 - RNA, 22 nt, Homo sapiens
augcagguguuuugcacugagu

SEQ ID NO: 153212 - RNA, 22 nt, Homo sapiens
augcauggcagagucaggguac

SEQ ID NO: 153213 - RNA, 22 nt, Homo sapiens
augcauggucugaagucaaccu

SEQ ID NO: 153214 - RNA, 19 nt, Homo sapiens
augccacagugaggucaga

SEQ ID NO: 153215 - RNA, 22 nt, Homo sapiens
augccacugcacuccaaccugg

SEQ ID NO: 153216 - RNA, 19 nt, Homo sapiens
augccucaguuuuguacuu

SEQ ID NO: 153217 - RNA, 22 nt, Homo sapiens
augcuacuggauuuguauaaau

SEQ ID NO: 153218 - RNA, 22 nt, Homo sapiens
augcuuguguuggggcagugga

SEQ ID NO: 153219 - RNA, 22 nt, Homo sapiens
auggaaggagaggaaugaauga

SEQ ID NO: 153220 - RNA, 22 nt, Homo sapiens
auggcacagaguagaugcucaa

SEQ ID NO: 153221 - RNA, 22 nt, Homo sapiens
auggcacugaagcguauugaca

SEQ ID NO: 153222 - RNA, 22 nt, Homo sapiens
auggcagcugacacuuccgucu

SEQ ID NO: 153223 - RNA, 22 nt, Homo sapiens
auggcaguguaugauuauauua

SEQ ID NO: 153224 - RNA, 22 nt, Homo sapiens
auggcagugucuagggguguuu

SEQ ID NO: 153225 - RNA, 22 nt, Homo sapiens
auggcauggugaagucuuugga

SEQ ID NO: 153226 - RNA, 22 nt, Homo sapiens
auggccauuacuaagaauguuu

SEQ ID NO: 153227 - RNA, 22 nt, Homo sapiens
auggccuuuacaauuugguaug

SEQ ID NO: 153228 - RNA, 22 nt, Homo sapiens
auggcuucuuacucuucugcau

SEQ ID NO: 153229 - RNA, 22 nt, Homo sapiens
auggcuugugacccaugcuuca

SEQ ID NO: 153230 - RNA, 22 nt, Homo sapiens
auggcuuuuccugucuugcaug

SEQ ID NO: 153231 - RNA, 22 nt, Homo sapiens
augguauuuaacagucuuucua

SEQ ID NO: 153232 - RNA, 22 nt, Homo sapiens
auggucccuguuccaugcuccu

SEQ ID NO: 153233 - RNA, 22 nt, Homo sapiens
augguuugugcuccuauaagaa

SEQ ID NO: 153234 - RNA, 22 nt, Homo sapiens
auguaaacauuuggucuaaauu

SEQ ID NO: 153235 - RNA, 21 nt, Homo sapiens
auguaacugggaaugugagag

SEQ ID NO: 153236 - RNA, 20 nt, Homo sapiens
auguaauguaugauauguac

SEQ ID NO: 153237 - RNA, 22 nt, Homo sapiens
augucacagguccuagccaagu

SEQ ID NO: 153238 - RNA, 22 nt, Homo sapiens
auguccauggaaucuguagcaa

SEQ ID NO: 153239 - RNA, 22 nt, Homo sapiens
augugcaaagcacuguucagca

SEQ ID NO: 153240 - RNA, 22 nt, Homo sapiens
augugcacaugcuuacauguga

SEQ ID NO: 153241 - RNA, 22 nt, Homo sapiens
augugcagauguuacaaauugu

SEQ ID NO: 153242 - RNA, 22 nt, Homo sapiens
auguggcauuucucauucauuu

SEQ ID NO: 153243 - RNA, 22 nt, Homo sapiens
augugugaaucccagaaccugu

SEQ ID NO: 153244 - RNA, 22 nt, Homo sapiens
auguuauguuaaugauaaugga

SEQ ID NO: 153245 - RNA, 23 nt, Homo sapiens
auuaagguuacuacaguaugagg

SEQ ID NO: 153246 - RNA, 22 nt, Homo sapiens
auuaaguuaggauuuugagaua

SEQ ID NO: 153247 - RNA, 22 nt, Homo sapiens
auuagguauuuguccuaaauau

SEQ ID NO: 153248 - RNA, 22 nt, Homo sapiens
auuauaguguauacuugaaauu

SEQ ID NO: 153249 - RNA, 22 nt, Homo sapiens
auuauaugucaucacagacacc

SEQ ID NO: 153250 - RNA, 22 nt, Homo sapiens
auuccacuuauaugagguaucu

SEQ ID NO: 153251 - RNA, 20 nt, Homo sapiens
auuccacuuauaugaggucc

SEQ ID NO: 153252 - RNA, 22 nt, Homo sapiens
auuccagauggaguugaggguu

SEQ ID NO: 153253 - RNA, 22 nt, Homo sapiens
auuccaguggguuuacauccca

SEQ ID NO: 153254 - RNA, 22 nt, Homo sapiens
auuccauaguacagugaugagu

SEQ ID NO: 153255 - RNA, 22 nt, Homo sapiens
auuccuuaggcccuuugguuag

SEQ ID NO: 153256 - RNA, 22 nt, Homo sapiens
auugaacacuucugugugccag

SEQ ID NO: 153257 - RNA, 22 nt, Homo sapiens
auugagacaaauuuguaugcag

SEQ ID NO: 153258 - RNA, 22 nt, Homo sapiens
auugcaaugggaaacuaugaaa

SEQ ID NO: 153259 - RNA, 22 nt, Homo sapiens
auugcacuccagccuggcaaua

SEQ ID NO: 153260 - RNA, 22 nt, Homo sapiens
auugcacuccagccugggcgac

SEQ ID NO: 153261 - RNA, 22 nt, Homo sapiens
auugcacuccagccuugugaca

SEQ ID NO: 153262 - RNA, 22 nt, Homo sapiens
auugcagaaaugacagagcgcc

SEQ ID NO: 153263 - RNA, 22 nt, Homo sapiens
auugcucaaaucaguacuugag

SEQ ID NO: 153264 - RNA, 22 nt, Homo sapiens
auuggcuuuauacauaagaaua

SEQ ID NO: 153265 - RNA, 22 nt, Homo sapiens
auuguacauacaccggugugua

SEQ ID NO: 153266 - RNA, 22 nt, Homo sapiens
auuguacuccagccugggugac

SEQ ID NO: 153267 - RNA, 22 nt, Homo sapiens
auuguaguuugcuauggcaaua

SEQ ID NO: 153268 - RNA, 22 nt, Homo sapiens
auuguucuuacaugcugucauc

SEQ ID NO: 153269 - RNA, 22 nt, Homo sapiens
auuguucuuguguccuuuuccu

SEQ ID NO: 153270 - RNA, 22 nt, Homo sapiens
auuugacacugagagccucagu

SEQ ID NO: 153271 - RNA, 20 nt, Homo sapiens
auuugcauuauggagcaccc

SEQ ID NO: 153272 - RNA, 22 nt, Homo sapiens
auuuggcaauuuugaagaugcc

SEQ ID NO: 153273 - RNA, 22 nt, Homo sapiens
auuuggcagugaagggaucaca

SEQ ID NO: 153274 - RNA, 22 nt, Homo sapiens
auuuggcauagaguaucauucu

SEQ ID NO: 153275 - RNA, 22 nt, Homo sapiens
auuugucacuauguggcuaaua

SEQ ID NO: 153276 - RNA, 22 nt, Homo sapiens
auuuugcauugcuguaaaggaa

SEQ ID NO: 153277 - RNA, 22 nt, Homo sapiens
auuuuuggauauagggaaggau

SEQ ID NO: 153278 - RNA, 22 nt, Homo sapiens
auuuuugguugguaggcuauua

SEQ ID NO: 153279 - RNA, 22 nt, Homo sapiens
auuuuugguuucaccugcacgc

SEQ ID NO: 153280 - RNA, 22 nt, Homo sapiens
caaagcacuuggcuuggaagau

SEQ ID NO: 153281 - RNA, 22 nt, Homo sapiens
caaaguaauugcuguuuugcca

SEQ ID NO: 153282 - RNA, 22 nt, Homo sapiens
caaagugguuuauacaugauug

SEQ ID NO: 153283 - RNA, 22 nt, Homo sapiens
caaauacuuucauguugucuug

SEQ ID NO: 153284 - RNA, 22 nt, Homo sapiens
caacaguaaagcauuuuuaagu

SEQ ID NO: 153285 - RNA, 22 nt, Homo sapiens
caaggcacagccccuacuuccu

SEQ ID NO: 153286 - RNA, 22 nt, Homo sapiens
caagggguggaaaugguagugu

SEQ ID NO: 153287 - RNA, 23 nt, Homo sapiens
caauacugaccucacguuaauag

SEQ ID NO: 153288 - RNA, 22 nt, Homo sapiens
caaugcauuauucucccacuuc

SEQ ID NO: 153289 - RNA, 22 nt, Homo sapiens
cucacugugguguccuuaggua

SEQ ID NO: 153290 - RNA, 22 nt, Homo sapiens
cucaggcacucugauuccagug

SEQ ID NO: 153291 - RNA, 20 nt, Homo sapiens
cucagguauuugaggcugca

SEQ ID NO: 153292 - RNA, 22 nt, Homo sapiens
cucaguguuaaggccaccucug

SEQ ID NO: 153293 - RNA, 22 nt, Homo sapiens
cucaguguucccauucuaccuu

SEQ ID NO: 153294 - RNA, 22 nt, Homo sapiens
cucauugcaaucuccaccuccc

SEQ ID NO: 153295 - RNA, 22 nt, Homo sapiens
cucccuuugcugaauguuuuuc

SEQ ID NO: 153296 - RNA, 17 nt, Homo sapiens
cucucugguuuaaagca

SEQ ID NO: 153297 - RNA, 22 nt, Homo sapiens
cucugacagugguuagcacugu

SEQ ID NO: 153298 - RNA, 22 nt, Homo sapiens
cucugagccugagguuccuacu

SEQ ID NO: 153299 - RNA, 22 nt, Homo sapiens
cucugauggagauauacaagga

SEQ ID NO: 153300 - RNA, 22 nt, Homo sapiens
cucuuacaguguguggugaaag

SEQ ID NO: 153301 - RNA, 22 nt, Homo sapiens
cugaaaguuauucaggggcaag

SEQ ID NO: 153302 - RNA, 22 nt, Homo sapiens
cugaaggcagguagaauagaga

SEQ ID NO: 153303 - RNA, 22 nt, Homo sapiens
cugaagugugaaagucuuuuuu

SEQ ID NO: 153304 - RNA, 22 nt, Homo sapiens
cugaaucauugguuaugaguac

SEQ ID NO: 153305 - RNA, 20 nt, Homo sapiens
cugaaugucaaggcagaggu

SEQ ID NO: 153306 - RNA, 22 nt, Homo sapiens
cugaauguucuauagaagccgc

SEQ ID NO: 153307 - RNA, 22 nt, Homo sapiens
cugacaucuucaagugaggaga

SEQ ID NO: 153308 - RNA, 22 nt, Homo sapiens
cugacuuuagaacccaaaaagu

SEQ ID NO: 153309 - RNA, 22 nt, Homo sapiens
cugagacacucuuaucugcaua

SEQ ID NO: 153310 - RNA, 22 nt, Homo sapiens
cugagagugguauguuuaagug

SEQ ID NO: 153311 - RNA, 22 nt, Homo sapiens
cugagauaggacucugcuggcu

SEQ ID NO: 153312 - RNA, 22 nt, Homo sapiens
cugagcaaagaagugauaauga

SEQ ID NO: 153313 - RNA, 22 nt, Homo sapiens
cugagcaagucauuuuguuaaa

SEQ ID NO: 153314 - RNA, 22 nt, Homo sapiens
cugagcaauauagugagaucuu

SEQ ID NO: 153315 - RNA, 22 nt, Homo sapiens
cugagcacugagauccucuagc

SEQ ID NO: 153316 - RNA, 18 nt, Homo sapiens
cugagcacugcuuuauga

SEQ ID NO: 153317 - RNA, 22 nt, Homo sapiens
cugagcucauuucuuuugcuac

SEQ ID NO: 153318 - RNA, 22 nt, Homo sapiens
cugaggacaucagggaagcauc

SEQ ID NO: 153319 - RNA, 22 nt, Homo sapiens
cugagguauuuaggugaaagaa

SEQ ID NO: 153320 - RNA, 22 nt, Homo sapiens
cugagguuaggaguuugagacc

SEQ ID NO: 153321 - RNA, 22 nt, Homo sapiens
cugagugcaagugauccuccca

SEQ ID NO: 153322 - RNA, 19 nt, Homo sapiens
cugcacugagaaaaggagg

SEQ ID NO: 153323 - RNA, 22 nt, Homo sapiens
cugcacugagacccucuuugcu

SEQ ID NO: 153324 - RNA, 22 nt, Homo sapiens
cugcuauauugguucaggcuug

SEQ ID NO: 153325 - RNA, 20 nt, Homo sapiens
cugcuccccuacaaaucuca

SEQ ID NO: 153326 - RNA, 22 nt, Homo sapiens
cuggaaagcaaguccauugcuc

SEQ ID NO: 153327 - RNA, 22 nt, Homo sapiens
cuggaaugcagcuuuaggggcu

SEQ ID NO: 153328 - RNA, 22 nt, Homo sapiens
cuggagcaaaggugacucuugu

SEQ ID NO: 153329 - RNA, 22 nt, Homo sapiens
cuggagcauugguggauuuguu

SEQ ID NO: 153330 - RNA, 22 nt, Homo sapiens
cuggauagagauugaugaugcu

SEQ ID NO: 153331 - RNA, 22 nt, Homo sapiens
cuggccagagacauucauuaaa

SEQ ID NO: 153332 - RNA, 22 nt, Homo sapiens
cuggcucauuucauuuagcaua

SEQ ID NO: 153333 - RNA, 22 nt, Homo sapiens
cuggcugagugguaaguagagg

SEQ ID NO: 153334 - RNA, 22 nt, Homo sapiens
cuggugagaugucuuuccucuu

SEQ ID NO: 153335 - RNA, 22 nt, Homo sapiens
cuguaaggcacuaagcauaugu

SEQ ID NO: 153336 - RNA, 22 nt, Homo sapiens
cuguauguuucuaugaauguga

SEQ ID NO: 153337 - RNA, 17 nt, Homo sapiens
cugugaugaucuugucu

SEQ ID NO: 153338 - RNA, 22 nt, Homo sapiens
cugugcaaagcgcucucggggu

SEQ ID NO: 153339 - RNA, 19 nt, Homo sapiens
cugugcauuucuguggaag

SEQ ID NO: 153340 - RNA, 20 nt, Homo sapiens
cugugguagggaccaggaau

SEQ ID NO: 153341 - RNA, 22 nt, Homo sapiens
cuguguaguacuagauugagca

SEQ ID NO: 153342 - RNA, 22 nt, Homo sapiens
cuguuagguuaaggaauggcaa

SEQ ID NO: 153343 - RNA, 22 nt, Homo sapiens
cuguugcaguuauggcugcagg

SEQ ID NO: 153344 - RNA, 22 nt, Homo sapiens
cuuaagcauugacuuuggacag

SEQ ID NO: 153345 - RNA, 22 nt, Homo sapiens
cuuaaggccagauaauuucuau

SEQ ID NO: 153346 - RNA, 22 nt, Homo sapiens
cuuaaguaguuguggaaugaau

SEQ ID NO: 153347 - RNA, 22 nt, Homo sapiens
cuuagcaugucagcaccggguu

SEQ ID NO: 153348 - RNA, 20 nt, Homo sapiens
cuuaucaguggcaaguauaa

SEQ ID NO: 153349 - RNA, 22 nt, Homo sapiens
cuucaaguuggaagggaccuaa

SEQ ID NO: 153350 - RNA, 20 nt, Homo sapiens
cuucacagaaguggaaucau

SEQ ID NO: 153351 - RNA, 22 nt, Homo sapiens
cuucaguucuguaaggacagca

SEQ ID NO: 153352 - RNA, 22 nt, Homo sapiens
cuuccagcuggguucagucagu

SEQ ID NO: 153353 - RNA, 22 nt, Homo sapiens
cuucuugcuguguccucacaug

SEQ ID NO: 153354 - RNA, 20 nt, Homo sapiens
cuugaagacuaugcugcuga

SEQ ID NO: 153355 - RNA, 22 nt, Homo sapiens
cuugaauguaaauaauguacag

SEQ ID NO: 153356 - RNA, 22 nt, Homo sapiens
cuugcauuuuggagaaugcuga

SEQ ID NO: 153357 - RNA, 22 nt, Homo sapiens
cuuggacaccucaugcccaccu

SEQ ID NO: 153358 - RNA, 22 nt, Homo sapiens
cuuggcacucuguggaguuagg

SEQ ID NO: 153359 - RNA, 22 nt, Homo sapiens
cuuggcauugccccuggaauuu

SEQ ID NO: 153360 - RNA, 22 nt, Homo sapiens
cuuggcuugguaucaaauaacc

SEQ ID NO: 153361 - RNA, 21 nt, Homo sapiens
cuugucuugcuuagaauagac

SEQ ID NO: 153362 - RNA, 22 nt, Homo sapiens
cuuguuguggaggggagugcag

SEQ ID NO: 153363 - RNA, 22 nt, Homo sapiens
cuuuacaguuggacucacgagg

SEQ ID NO: 153364 - RNA, 22 nt, Homo sapiens
cuuugcuaauccaacccucauc

SEQ ID NO: 153365 - RNA, 20 nt, Homo sapiens
cuuuggcaaugagaacaggg

SEQ ID NO: 153366 - RNA, 22 nt, Homo sapiens
cuuuggcacuuccuaagugcca

SEQ ID NO: 153367 - RNA, 22 nt, Homo sapiens
cuuuggcauuagccuguauaga

SEQ ID NO: 153368 - RNA, 22 nt, Homo sapiens
cuuugguguauuuucagagacc

SEQ ID NO: 153369 - RNA, 21 nt, Homo sapiens
cuuugguuucugacuugcaua

SEQ ID NO: 153370 - RNA, 23 nt, Homo sapiens
cuuuguacagcuugacuacuggg

SEQ ID NO: 153371 - RNA, 22 nt, Homo sapiens
cuuuuggcuuagaauugucuug

SEQ ID NO: 153372 - RNA, 22 nt, Homo sapiens
cuuuuggugugaagaagcucuu

SEQ ID NO: 153373 - RNA, 20 nt, Homo sapiens
cuuuuugcugugcugggagc

SEQ ID NO: 153374 - RNA, 22 nt, Homo sapiens
gaaagcuaaugacuuuggguga

SEQ ID NO: 153375 - RNA, 22 nt, Homo sapiens
gaaauguugauagugggcauug

SEQ ID NO: 153376 - RNA, 22 nt, Homo sapiens
gaagagacagguucccacaaaa

SEQ ID NO: 153377 - RNA, 22 nt, Homo sapiens
gaagguauauucuguuaaugcu

SEQ ID NO: 153378 - RNA, 22 nt, Homo sapiens
gaaguaauaaauggauucuuaa

SEQ ID NO: 153379 - RNA, 22 nt, Homo sapiens
uugcuuuguuacugcaguuucc

SEQ ID NO: 153380 - RNA, 22 nt, Homo sapiens
uuggaaauauguuaagugucau

SEQ ID NO: 153381 - RNA, 22 nt, Homo sapiens
uuggaagacaaugcugauucuc

SEQ ID NO: 153382 - RNA, 22 nt, Homo sapiens
uuggaaggcuccuaaugaaugg

SEQ ID NO: 153383 - RNA, 22 nt, Homo sapiens
uuggaauguacucuagccuaug

SEQ ID NO: 153384 - RNA, 22 nt, Homo sapiens
uuggaauuuuaaaauaggcaac

SEQ ID NO: 153385 - RNA, 22 nt, Homo sapiens
uuggagagucacuaguuagugc

SEQ ID NO: 153386 - RNA, 22 nt, Homo sapiens
uuggagagugauauucagaugc

SEQ ID NO: 153387 - RNA, 22 nt, Homo sapiens
uuggagcacuggggcacugaca

SEQ ID NO: 153388 - RNA, 22 nt, Homo sapiens
uuggagugugcucauaacugcu

SEQ ID NO: 153389 - RNA, 22 nt, Homo sapiens
uuggaugauaaagaagccuaag

SEQ ID NO: 153390 - RNA, 22 nt, Homo sapiens
uuggauuauaaacugagauuug

SEQ ID NO: 153391 - RNA, 22 nt, Homo sapiens
uuggcaaucaauucugacgucu

SEQ ID NO: 153392 - RNA, 22 nt, Homo sapiens
uuggcacgugguggggcucgga

SEQ ID NO: 153393 - RNA, 22 nt, Homo sapiens
uuggcagugcccgaugcugggg

SEQ ID NO: 153394 - RNA, 22 nt, Homo sapiens
uuggcauagaggcucucaagcu

SEQ ID NO: 153395 - RNA, 22 nt, Homo sapiens
uuggcauugaguuucaaaucau

SEQ ID NO: 153396 - RNA, 22 nt, Homo sapiens
uuggcauuuauucuaaggucaa

SEQ ID NO: 153397 - RNA, 22 nt, Homo sapiens
uuggccauaugacuugcuuugg

SEQ ID NO: 153398 - RNA, 22 nt, Homo sapiens
uuggcucuggcugggcuccagc

SEQ ID NO: 153399 - RNA, 23 nt, Homo sapiens
cacagggugaacaccccuaaucc

SEQ ID NO: 153400 - RNA, 22 nt, Homo sapiens
cacaggucauccuggaucaagg

SEQ ID NO: 153401 - RNA, 22 nt, Homo sapiens
cacagucuugcaauauugagau

SEQ ID NO: 153402 - RNA, 22 nt, Homo sapiens
cacaguguucauagccaucagg

SEQ ID NO: 153403 - RNA, 22 nt, Homo sapiens
cacaguugccuaucuccugaag

SEQ ID NO: 153404 - RNA, 22 nt, Homo sapiens
caccacagccauuauugucccc

SEQ ID NO: 153405 - RNA, 22 nt, Homo sapiens
caccagcuggcauugaauaccu

SEQ ID NO: 153406 - RNA, 22 nt, Homo sapiens
cacccgugacgcugucugaaau

SEQ ID NO: 153407 - RNA, 19 nt, Homo sapiens
caccgccugcccccugcug

SEQ ID NO: 153408 - RNA, 22 nt, Homo sapiens
caccuguagucccagcugaggc

SEQ ID NO: 153409 - RNA, 22 nt, Homo sapiens
cacuaggcuggagugcaguggc

SEQ ID NO: 153410 - RNA, 22 nt, Homo sapiens
cacugcacuccagucugacgac

SEQ ID NO: 153411 - RNA, 22 nt, Homo sapiens
cacugggugccauauguuugcu

SEQ ID NO: 153412 - RNA, 22 nt, Homo sapiens
cacuguggauggaacuauguga

SEQ ID NO: 153413 - RNA, 22 nt, Homo sapiens
cacuuugguucaccugaguuuc

SEQ ID NO: 153414 - RNA, 22 nt, Homo sapiens
cagagaacauucagagcuguag

SEQ ID NO: 153415 - RNA, 21 nt, Homo sapiens
cagagaucaucucuguuuuaa

SEQ ID NO: 153416 - RNA, 22 nt, Homo sapiens
caggaaugugaggguucccugc

SEQ ID NO: 153417 - RNA, 22 nt, Homo sapiens
caggcaaggugaaguguacugg

SEQ ID NO: 153418 - RNA, 22 nt, Homo sapiens
caggcagucuggggguguaucc

SEQ ID NO: 153419 - RNA, 22 nt, Homo sapiens
caggcuuuuccacacauggguu

SEQ ID NO: 153420 - RNA, 22 nt, Homo sapiens
caggguccccuaccuuuugaug

SEQ ID NO: 153421 - RNA, 22 nt, Homo sapiens
caguagcaugccucagaaugag

SEQ ID NO: 153422 - RNA, 22 nt, Homo sapiens
cagucacugggauuauggucau

SEQ ID NO: 153423 - RNA, 20 nt, Homo sapiens
cagugcacuuucccacuggu

SEQ ID NO: 153424 - RNA, 22 nt, Homo sapiens
cagugcaugacuguauauuauc

SEQ ID NO: 153425 - RNA, 22 nt, Homo sapiens
cagugucugcauuuggaacuca

SEQ ID NO: 153426 - RNA, 22 nt, Homo sapiens
caguuacuugacacaaccaauu

SEQ ID NO: 153427 - RNA, 22 nt, Homo sapiens
cauaaaucuuguugaauagcac

SEQ ID NO: 153428 - RNA, 22 nt, Homo sapiens
cauacagcuaguaaguguaaga

SEQ ID NO: 153429 - RNA, 22 nt, Homo sapiens
cauacaguaggcacuauuugua

SEQ ID NO: 153430 - RNA, 22 nt, Homo sapiens
caucacacuuggauguaagaca

SEQ ID NO: 153431 - RNA, 22 nt, Homo sapiens
caucacaucugcaugguaagua

SEQ ID NO: 153432 - RNA, 22 nt, Homo sapiens
caucagagugagauauaagauc

SEQ ID NO: 153433 - RNA, 19 nt, Homo sapiens
caucccugagcugaagugg

SEQ ID NO: 153434 - RNA, 22 nt, Homo sapiens
caugacacuggcauguuucuuu

SEQ ID NO: 153435 - RNA, 22 nt, Homo sapiens
caugaugcuagguauggaugaa

SEQ ID NO: 153436 - RNA, 22 nt, Homo sapiens
caugccacugcacuccaaccug

SEQ ID NO: 153437 - RNA, 22 nt, Homo sapiens
cauggagcuaggcuugaucccu

SEQ ID NO: 153438 - RNA, 22 nt, Homo sapiens
cauggcacugagcagguaugca

SEQ ID NO: 153439 - RNA, 22 nt, Homo sapiens
cauggcacuggugggagugucu

SEQ ID NO: 153440 - RNA, 22 nt, Homo sapiens
cauggcacuguaugaaaugugc

SEQ ID NO: 153441 - RNA, 22 nt, Homo sapiens
cauggcucuuguuuacucccag

SEQ ID NO: 153442 - RNA, 22 nt, Homo sapiens
cauggcuuuuauaacaagaaau

SEQ ID NO: 153443 - RNA, 21 nt, Homo sapiens
caugucacugcacucuagccu

SEQ ID NO: 153444 - RNA, 22 nt, Homo sapiens
cauugcaacuucugccucccag

SEQ ID NO: 153445 - RNA, 22 nt, Homo sapiens
cauugcaugccagccugggcaa

SEQ ID NO: 153446 - RNA, 22 nt, Homo sapiens
cauugcccuccagccugggcaa

SEQ ID NO: 153447 - RNA, 22 nt, Homo sapiens
cauuguacauaaguauggagua

SEQ ID NO: 153448 - RNA, 22 nt, Homo sapiens
cauuugcacugagacucagcuu

SEQ ID NO: 153449 - RNA, 22 nt, Homo sapiens
ccaaggaauacccucccuuuuu

SEQ ID NO: 153450 - RNA, 23 nt, Homo sapiens
ccacacuguuuagaauggcauca

SEQ ID NO: 153451 - RNA, 22 nt, Homo sapiens
ccacauuaccuugcuugcucca

SEQ ID NO: 153452 - RNA, 22 nt, Homo sapiens
ccacccuggagaauuugagguc

SEQ ID NO: 153453 - RNA, 22 nt, Homo sapiens
ccacccuuccacacccugggua

SEQ ID NO: 153454 - RNA, 22 nt, Homo sapiens
ccagcaccauuuauuaaauagg

SEQ ID NO: 153455 - RNA, 22 nt, Homo sapiens
ccaucacacugugauuauuauc

SEQ ID NO: 153456 - RNA, 22 nt, Homo sapiens
ccauuucacucuuccugaagga

SEQ ID NO: 153457 - RNA, 22 nt, Homo sapiens
cccagcguucggcauggcugag

SEQ ID NO: 153458 - RNA, 18 nt, Homo sapiens
cccagugacuuauggccu

SEQ ID NO: 153459 - RNA, 17 nt, Homo sapiens
cccuaguagcugggacu

SEQ ID NO: 153460 - RNA, 22 nt, Homo sapiens
cccugagaugugaauuucagag

SEQ ID NO: 153461 - RNA, 22 nt, Homo sapiens
cccuucauucaaggguugugag

SEQ ID NO: 153462 - RNA, 22 nt, Homo sapiens
cccuugcacuucagagcugcau

SEQ ID NO: 153463 - RNA, 22 nt, Homo sapiens
ccucuuuguugagacuucacca

SEQ ID NO: 153464 - RNA, 22 nt, Homo sapiens
ccugagaucauacuguuaguaa

SEQ ID NO: 153465 - RNA, 22 nt, Homo sapiens
ccuugcacuucccaggugaggc

SEQ ID NO: 153466 - RNA, 22 nt, Homo sapiens
ccuugucacugaguggaaugaa

SEQ ID NO: 153467 - RNA, 22 nt, Homo sapiens
ccuuuguggggcgguggguaau

SEQ ID NO: 153468 - RNA, 22 nt, Homo sapiens
ccuuuguuuaguugaauuguau

SEQ ID NO: 153469 - RNA, 22 nt, Homo sapiens
cgcccuguagcuagcuagaggu

SEQ ID NO: 153470 - RNA, 22 nt, Homo sapiens
cuaaaguauugagugguaaaga

SEQ ID NO: 153471 - RNA, 22 nt, Homo sapiens
cuaaagugcuuaaaaucucauu

SEQ ID NO: 153472 - RNA, 22 nt, Homo sapiens
cuaagggaggaagcugugcagg

SEQ ID NO: 153473 - RNA, 23 nt, Homo sapiens
cuacagugccugucucuuuggcc

SEQ ID NO: 153474 - RNA, 22 nt, Homo sapiens
cuacauuguagguauucaaacu

SEQ ID NO: 153475 - RNA, 22 nt, Homo sapiens
cuaccuggguggcucaugacuu

SEQ ID NO: 153476 - RNA, 22 nt, Homo sapiens
cuacuauguagagauauugaau

SEQ ID NO: 153477 - RNA, 22 nt, Homo sapiens
cuagacuagacccaaauugaag

SEQ ID NO: 153478 - RNA, 22 nt, Homo sapiens
cuagcacauuuaucuuuauaca

SEQ ID NO: 153479 - RNA, 22 nt, Homo sapiens
cuagcagacaugggcugaacca

SEQ ID NO: 153480 - RNA, 22 nt, Homo sapiens
cuagccuggagugcaguggugc

SEQ ID NO: 153481 - RNA, 22 nt, Homo sapiens
cuagcugcacuuccugcuacug

SEQ ID NO: 153482 - RNA, 22 nt, Homo sapiens
cuaggaaguauguguuauugcu

SEQ ID NO: 153483 - RNA, 22 nt, Homo sapiens
cuagugcaguuccccugucuua

SEQ ID NO: 153484 - RNA, 21 nt, Homo sapiens
cuaucucaguguuuacauuug

SEQ ID NO: 153485 - RNA, 22 nt, Homo sapiens
cucacaaccuuaugaagcauga

SEQ ID NO: 153486 - RNA, 22 nt, Homo sapiens
cucacagucucucccuaauuuu

SEQ ID NO: 153487 - RNA, 20 nt, Homo sapiens
cucaccagguguaggcugag

SEQ ID NO: 153488 - RNA, 22 nt, Homo sapiens
cucacugggaccacucugaagu

SEQ ID NO: 153489 - RNA, 19 nt, Homo sapiens
uggagucaucaugcugcua

SEQ ID NO: 153490 - RNA, 22 nt, Homo sapiens
uggagugaaaacacacuaaucu

SEQ ID NO: 153491 - RNA, 20 nt, Homo sapiens
uggagugaagguucuggacc

SEQ ID NO: 153492 - RNA, 22 nt, Homo sapiens
uggaguguaaauuaguucagcc

SEQ ID NO: 153493 - RNA, 22 nt, Homo sapiens
uggaguguaauuagccaucagu

SEQ ID NO: 153494 - RNA, 16 nt, Homo sapiens
uggaguguuuguuaga

SEQ ID NO: 153495 - RNA, 22 nt, Homo sapiens
uggauagaaauguacuguuuuc

SEQ ID NO: 153496 - RNA, 22 nt, Homo sapiens
uggaugaagagaugguaguugc

SEQ ID NO: 153497 - RNA, 18 nt, Homo sapiens
uggauuguacuguguucu

SEQ ID NO: 153498 - RNA, 22 nt, Homo sapiens
uggauuguuucucuugguauga

SEQ ID NO: 153499 - RNA, 21 nt, Homo sapiens
uggcaacauggauggauucug

SEQ ID NO: 153500 - RNA, 22 nt, Homo sapiens
uggcaagagcaaaauguacagu

SEQ ID NO: 153501 - RNA, 22 nt, Homo sapiens
uggcaagaucacaauuacuuuu

SEQ ID NO: 153502 - RNA, 22 nt, Homo sapiens
uggcaagauuguuccgguuugg

SEQ ID NO: 153503 - RNA, 22 nt, Homo sapiens
uggcaccugacuccgagaugca

SEQ ID NO: 153504 - RNA, 22 nt, Homo sapiens
uggcagacaaauuugagcauau

SEQ ID NO: 153505 - RNA, 22 nt, Homo sapiens
uggcagauagaaaugugguuaa

SEQ ID NO: 153506 - RNA, 22 nt, Homo sapiens
uggcagcgugaaagacuuuuuc

SEQ ID NO: 153507 - RNA, 22 nt, Homo sapiens
uggcagcgugaauguggcugaa

SEQ ID NO: 153508 - RNA, 22 nt, Homo sapiens
uggcaguuucacauggcucaac

SEQ ID NO: 153509 - RNA, 22 nt, Homo sapiens
uggcaguuucauaugguucaac

SEQ ID NO: 153510 - RNA, 22 nt, Homo sapiens
uggcaucuguucuacacauaaa

SEQ ID NO: 153511 - RNA, 20 nt, Homo sapiens
uggcaugaaauuuuccaagc

SEQ ID NO: 153512 - RNA, 22 nt, Homo sapiens
uggcaugaaguguguuuuaucu

SEQ ID NO: 153513 - RNA, 22 nt, Homo sapiens
uggcaugauccuagauucaaca

SEQ ID NO: 153514 - RNA, 22 nt, Homo sapiens
uggcauggaguggauggcccca

SEQ ID NO: 153515 - RNA, 23 nt, Homo sapiens
uggccaagauaaucucaguuuuc

SEQ ID NO: 153516 - RNA, 22 nt, Homo sapiens
uggcccccucccaaaucucaua

SEQ ID NO: 153517 - RNA, 22 nt, Homo sapiens
uggcucuguuuguuaacuagac

SEQ ID NO: 153518 - RNA, 22 nt, Homo sapiens
uggcuuuuaucuacucucaacu

SEQ ID NO: 153519 - RNA, 20 nt, Homo sapiens
ugggaaauguccaggacaua

SEQ ID NO: 153520 - RNA, 22 nt, Homo sapiens
ugggaacaugaagguuaaagag

SEQ ID NO: 153521 - RNA, 22 nt, Homo sapiens
ugggaauaugauacaggucuuu

SEQ ID NO: 153522 - RNA, 22 nt, Homo sapiens
ugggaucauuaugcauagugua

SEQ ID NO: 153523 - RNA, 22 nt, Homo sapiens
ugggaucauucaaugacgaaau

SEQ ID NO: 153524 - RNA, 22 nt, Homo sapiens
ugggaugaaaauagcuucuucc

SEQ ID NO: 153525 - RNA, 22 nt, Homo sapiens
ugggaugaauacaaugggauca

SEQ ID NO: 153526 - RNA, 22 nt, Homo sapiens
ugggguaggccugguuaugugc

SEQ ID NO: 153527 - RNA, 22 nt, Homo sapiens
uggggucguaggugcccgccag

SEQ ID NO: 153528 - RNA, 22 nt, Homo sapiens
uggguaaaucucuguucagggc

SEQ ID NO: 153529 - RNA, 22 nt, Homo sapiens
ugggugugaccgcucaaggggg

SEQ ID NO: 153530 - RNA, 22 nt, Homo sapiens
ugguacugucucuauuuuguag

SEQ ID NO: 153531 - RNA, 22 nt, Homo sapiens
uggucagaaaauuacuugauau

SEQ ID NO: 153532 - RNA, 22 nt, Homo sapiens
uggucaugaggugaggcuucuc

SEQ ID NO: 153533 - RNA, 22 nt, Homo sapiens
uggucccaugaacuuuagguca

SEQ ID NO: 153534 - RNA, 20 nt, Homo sapiens
ugguccccugagucuggcuu

SEQ ID NO: 153535 - RNA, 22 nt, Homo sapiens
uggucccucugaaaauugggug

SEQ ID NO: 153536 - RNA, 22 nt, Homo sapiens
ugguccucugcuuccagaauuc

SEQ ID NO: 153537 - RNA, 22 nt, Homo sapiens
uggucuccuuuguacccugggc

SEQ ID NO: 153538 - RNA, 22 nt, Homo sapiens
uggucuggagagucccgcccag

SEQ ID NO: 153539 - RNA, 22 nt, Homo sapiens
uggugagaaaagaugucuuugu

SEQ ID NO: 153540 - RNA, 22 nt, Homo sapiens
uggugcccuguccuucuguggc

SEQ ID NO: 153541 - RNA, 22 nt, Homo sapiens
ugguguccugucucugcgcuug

SEQ ID NO: 153542 - RNA, 22 nt, Homo sapiens
ugguguuugagaagcugauguc

SEQ ID NO: 153543 - RNA, 21 nt, Homo sapiens
ugguucaguucguuacgugug

SEQ ID NO: 153544 - RNA, 22 nt, Homo sapiens
uguaaaucugguuaauuggaua

SEQ ID NO: 153545 - RNA, 22 nt, Homo sapiens
uguaaaucuuucacaguugaug

SEQ ID NO: 153546 - RNA, 16 nt, Homo sapiens
uguaaauguuuugcau

SEQ ID NO: 153547 - RNA, 22 nt, Homo sapiens
uguaauguuucaucauuauuaa

SEQ ID NO: 153548 - RNA, 22 nt, Homo sapiens
uguaauuuaaaugauccuugga

SEQ ID NO: 153549 - RNA, 19 nt, Homo sapiens
uguacacuguaaaccugug

SEQ ID NO: 153550 - RNA, 22 nt, Homo sapiens
uguacuagaaauuaaggcaggg

SEQ ID NO: 153551 - RNA, 22 nt, Homo sapiens
uguaguuugaaagcucccucug

SEQ ID NO: 153552 - RNA, 21 nt, Homo sapiens
uguauacauauguuaggugca

SEQ ID NO: 153553 - RNA, 21 nt, Homo sapiens
uguauacauggaagaaugguc

SEQ ID NO: 153554 - RNA, 22 nt, Homo sapiens
ugugauaguugcuguucugggc

SEQ ID NO: 153555 - RNA, 22 nt, Homo sapiens
ugugaugaagaguccaagaaca

SEQ ID NO: 153556 - RNA, 22 nt, Homo sapiens
ugugauggaguuucauggacug

SEQ ID NO: 153557 - RNA, 22 nt, Homo sapiens
cuaagugaacugucacugagaa

SEQ ID NO: 153558 - RNA, 23 nt, Homo sapiens
cuacuagucaagucuuuuccagu

SEQ ID NO: 153559 - RNA, 22 nt, Homo sapiens
cuacucuggagagugacaauca

SEQ ID NO: 153560 - RNA, 22 nt, Homo sapiens
cuagaagguaagagcuggaugc

SEQ ID NO: 153561 - RNA, 22 nt, Homo sapiens
cuagcagcaugagaauggacca

SEQ ID NO: 153562 - RNA, 22 nt, Homo sapiens
cuaggcuguagagaaguucagu

SEQ ID NO: 153563 - RNA, 22 nt, Homo sapiens
cuauauacugccugcugauuag

SEQ ID NO: 153564 - RNA, 22 nt, Homo sapiens
cuauggccugcuuagaacauac

SEQ ID NO: 153565 - RNA, 22 nt, Homo sapiens
cuauggcuguagucccugugua

SEQ ID NO: 153566 - RNA, 22 nt, Homo sapiens
cuauuacuuuuauugaacucag

SEQ ID NO: 153567 - RNA, 22 nt, Homo sapiens
cuauucacaauggugaagauau

SEQ ID NO: 153568 - RNA, 22 nt, Homo sapiens
cucaaagugcugggacuggcug

SEQ ID NO: 153569 - RNA, 22 nt, Homo sapiens
cucaaagugcugggauuggcca

SEQ ID NO: 153570 - RNA, 18 nt, Homo sapiens
cucaaccucaugcagggc

SEQ ID NO: 153571 - RNA, 22 nt, Homo sapiens
cucaaguagugguuuucauuga

SEQ ID NO: 153572 - RNA, 22 nt, Homo sapiens
cucaauuuggaauugucaguaa

SEQ ID NO: 153573 - RNA, 18 nt, Homo sapiens
cucacaguaacuuuuaag

SEQ ID NO: 153574 - RNA, 22 nt, Homo sapiens
cucacaguucuaaaggcaagaa

SEQ ID NO: 153575 - RNA, 22 nt, Homo sapiens
cucagagcacaguuuaugacag

SEQ ID NO: 153576 - RNA, 22 nt, Homo sapiens
cucagauacuugggagguugag

SEQ ID NO: 153577 - RNA, 20 nt, Homo sapiens
cucagauuauucugaagcaa

SEQ ID NO: 153578 - RNA, 22 nt, Homo sapiens
cucagugaagggcaagaggcaa

SEQ ID NO: 153579 - RNA, 21 nt, Homo sapiens
cucauauugcuuuuccauggu

SEQ ID NO: 153580 - RNA, 22 nt, Homo sapiens
cuccauguggcuaacuuuuaaa

SEQ ID NO: 153581 - RNA, 22 nt, Homo sapiens
cuccauuuaguccuuuuagaag

SEQ ID NO: 153582 - RNA, 22 nt, Homo sapiens
cuccauuuaucugaaauuuuau

SEQ ID NO: 153583 - RNA, 22 nt, Homo sapiens
cucccacccucauuuuuaggca

SEQ ID NO: 153584 - RNA, 22 nt, Homo sapiens
cucccagagccaguuauaggcu

SEQ ID NO: 153585 - RNA, 22 nt, Homo sapiens
cuccuggugauuggagugugaa

SEQ ID NO: 153586 - RNA, 22 nt, Homo sapiens
cucucaguugucuaauuaguuu

SEQ ID NO: 153587 - RNA, 22 nt, Homo sapiens
cucucugagccccagacaccuu

SEQ ID NO: 153588 - RNA, 22 nt, Homo sapiens
cucugcuuaaugucccacuuga

SEQ ID NO: 153589 - RNA, 22 nt, Homo sapiens
cucuggauauuccugucuaaaa

SEQ ID NO: 153590 - RNA, 22 nt, Homo sapiens
cucugguggaagcagggggcaa

SEQ ID NO: 153591 - RNA, 22 nt, Homo sapiens
cucuuuaguaagcaguugauga

SEQ ID NO: 153592 - RNA, 22 nt, Homo sapiens
cucuuugaggugagcugcccau

SEQ ID NO: 153593 - RNA, 22 nt, Homo sapiens
cucuuugaugugaaccgugguu

SEQ ID NO: 153594 - RNA, 22 nt, Homo sapiens
cucuuuggaugccuuaggguua

SEQ ID NO: 153595 - RNA, 22 nt, Homo sapiens
cucuuuuguuuagcugagaggg

SEQ ID NO: 153596 - RNA, 22 nt, Homo sapiens
cugaaucauugcauuaucaagg

SEQ ID NO: 153597 - RNA, 22 nt, Homo sapiens
cugaauguccaggcagagguuu

SEQ ID NO: 153598 - RNA, 22 nt, Homo sapiens
cugaauguuucacucugaaaug

SEQ ID NO: 153599 - RNA, 22 nt, Homo sapiens
cugaauguuuucuucuauucug

SEQ ID NO: 153600 - RNA, 22 nt, Homo sapiens
cugacauggggauccaccuuag

SEQ ID NO: 153601 - RNA, 22 nt, Homo sapiens
cugaccauagacuacucugggc

SEQ ID NO: 153602 - RNA, 22 nt, Homo sapiens
cugagaagaaacagguaaggac

SEQ ID NO: 153603 - RNA, 22 nt, Homo sapiens
cugagaaugaugauuuccaguu

SEQ ID NO: 153604 - RNA, 22 nt, Homo sapiens
cugagagaggagcuaaaacugc

SEQ ID NO: 153605 - RNA, 22 nt, Homo sapiens
cugagaguugaugaaauauggu

SEQ ID NO: 153606 - RNA, 22 nt, Homo sapiens
cugagauaauuucuagguguca

SEQ ID NO: 153607 - RNA, 22 nt, Homo sapiens
cugagaucaagucuugcucugu

SEQ ID NO: 153608 - RNA, 22 nt, Homo sapiens
cugagcaucauggcagaaucuu

SEQ ID NO: 153609 - RNA, 22 nt, Homo sapiens
cugaggaaguucuuuaacaguu

SEQ ID NO: 153610 - RNA, 22 nt, Homo sapiens
cugaggguagaaggaucacuug

SEQ ID NO: 153611 - RNA, 22 nt, Homo sapiens
cugagguaggugaucagugcuu

SEQ ID NO: 153612 - RNA, 22 nt, Homo sapiens
cugaucuguagcagccaccaca

SEQ ID NO: 153613 - RNA, 19 nt, Homo sapiens
cugcaagguaauaggucag

SEQ ID NO: 153614 - RNA, 19 nt, Homo sapiens
cugcaugagacaguugguu

SEQ ID NO: 153615 - RNA, 22 nt, Homo sapiens
cugcauuugaugacguauggug

SEQ ID NO: 153616 - RNA, 22 nt, Homo sapiens
cuggaaagaaucaggcuaaacu

SEQ ID NO: 153617 - RNA, 22 nt, Homo sapiens
cuggaaucuagaaaagguaagg

SEQ ID NO: 153618 - RNA, 22 nt, Homo sapiens
cuggaaugugagccccaaaaag

SEQ ID NO: 153619 - RNA, 22 nt, Homo sapiens
cuggaauguuccuaaagauuca

SEQ ID NO: 153620 - RNA, 22 nt, Homo sapiens
cuggauggugagauaaagaaaa

SEQ ID NO: 153621 - RNA, 19 nt, Homo sapiens
cuggcaaaugcuuuggcca

SEQ ID NO: 153622 - RNA, 22 nt, Homo sapiens
cuggcagucugccucuucacug

SEQ ID NO: 153623 - RNA, 22 nt, Homo sapiens
cugggaugauguaaauaggcua

SEQ ID NO: 153624 - RNA, 22 nt, Homo sapiens
cugggaugugacuguugccccc

SEQ ID NO: 153625 - RNA, 22 nt, Homo sapiens
cugggcaaugcggcuggauaga

SEQ ID NO: 153626 - RNA, 22 nt, Homo sapiens
cugggucaguuucugauuauug

SEQ ID NO: 153627 - RNA, 21 nt, Homo sapiens
cugguccccuuuauguaugug

SEQ ID NO: 153628 - RNA, 22 nt, Homo sapiens
cugucagugggaguucaggcuu

SEQ ID NO: 153629 - RNA, 22 nt, Homo sapiens
cugugaagaaagucauugguag

SEQ ID NO: 153630 - RNA, 22 nt, Homo sapiens
cugugauuauauaguuaaggua

SEQ ID NO: 153631 - RNA, 22 nt, Homo sapiens
cugugcaaacaagugaaccccu

SEQ ID NO: 153632 - RNA, 22 nt, Homo sapiens
cugugcaaguuauaggccaggu

SEQ ID NO: 153633 - RNA, 22 nt, Homo sapiens
cugugcaugcgcggagcugaaa

SEQ ID NO: 153634 - RNA, 22 nt, Homo sapiens
cugugcauguaugcgugaguuc

SEQ ID NO: 153635 - RNA, 22 nt, Homo sapiens
cugugcuugauuauaugagugu

SEQ ID NO: 153636 - RNA, 22 nt, Homo sapiens
cuguuugauuaagugguggaaa

SEQ ID NO: 153637 - RNA, 22 nt, Homo sapiens
cuuacagucuaucagccacaac

SEQ ID NO: 153638 - RNA, 17 nt, Homo sapiens
cuucaaauaauuucccc

SEQ ID NO: 153639 - RNA, 22 nt, Homo sapiens
cuucaaguguggccaccugacc

SEQ ID NO: 153640 - RNA, 22 nt, Homo sapiens
cuucacuuuguuaaacuccaau

SEQ ID NO: 153641 - RNA, 22 nt, Homo sapiens
cuucaucugguuugugaacuuu

SEQ ID NO: 153642 - RNA, 22 nt, Homo sapiens
cuucaugucuucaauggggggg

SEQ ID NO: 153643 - RNA, 22 nt, Homo sapiens
cuugauagugguaaucauuuuu

SEQ ID NO: 153644 - RNA, 22 nt, Homo sapiens
cuugcacauuacagaucugcau

SEQ ID NO: 153645 - RNA, 22 nt, Homo sapiens
cuuggcacugcucacccuccuu

SEQ ID NO: 153646 - RNA, 22 nt, Homo sapiens
cuuggcuucuuuauguggcuau

SEQ ID NO: 153647 - RNA, 22 nt, Homo sapiens
caugcacugaguccaccucugg

SEQ ID NO: 153648 - RNA, 22 nt, Homo sapiens
caugcauuggucuauuauguga

SEQ ID NO: 153649 - RNA, 22 nt, Homo sapiens
caugccacuguggacaaagaca

SEQ ID NO: 153650 - RNA, 22 nt, Homo sapiens
caugccauugcucuccugggug

SEQ ID NO: 153651 - RNA, 22 nt, Homo sapiens
cauggcccugggcugggcgaac

SEQ ID NO: 153652 - RNA, 22 nt, Homo sapiens
cauggcccuggguccauaggaa

SEQ ID NO: 153653 - RNA, 23 nt, Homo sapiens
cauggcuguuaacacuguuugag

SEQ ID NO: 153654 - RNA, 19 nt, Homo sapiens
cauggcuuauaauuuuaau

SEQ ID NO: 153655 - RNA, 22 nt, Homo sapiens
cauggcuuuauuuucagcuucu

SEQ ID NO: 153656 - RNA, 22 nt, Homo sapiens
cauguaguagaaggagccagac

SEQ ID NO: 153657 - RNA, 22 nt, Homo sapiens
caugucuuuuaaacauucaacu

SEQ ID NO: 153658 - RNA, 22 nt, Homo sapiens
cauuaagcuacuuagaaggugc

SEQ ID NO: 153659 - RNA, 22 nt, Homo sapiens
cauuacacuuguaagguuuuuc

SEQ ID NO: 153660 - RNA, 22 nt, Homo sapiens
cauuccacuggauaaacaaggu

SEQ ID NO: 153661 - RNA, 22 nt, Homo sapiens
cauugcacucuagucuggguga

SEQ ID NO: 153662 - RNA, 22 nt, Homo sapiens
cauugcaguaagagugggcucu

SEQ ID NO: 153663 - RNA, 23 nt, Homo sapiens
ccacaaugguugaacuagauuac

SEQ ID NO: 153664 - RNA, 22 nt, Homo sapiens
ccacaguggauuaaaguuacug

SEQ ID NO: 153665 - RNA, 22 nt, Homo sapiens
ccacaguugaaauuuugacugu

SEQ ID NO: 153666 - RNA, 22 nt, Homo sapiens
ccacccuuccauucuuccucuu

SEQ ID NO: 153667 - RNA, 22 nt, Homo sapiens
ccagaguugccucagguuucug

SEQ ID NO: 153668 - RNA, 22 nt, Homo sapiens
ccagcaccauuuguugaauagg

SEQ ID NO: 153669 - RNA, 22 nt, Homo sapiens
ccaggguugcuuuagauucuga

SEQ ID NO: 153670 - RNA, 18 nt, Homo sapiens
ccagugcaaggaaagccc

SEQ ID NO: 153671 - RNA, 21 nt, Homo sapiens
ccagugguuggaaacuauggg

SEQ ID NO: 153672 - RNA, 22 nt, Homo sapiens
ccagugguugggccggagacgg

SEQ ID NO: 153673 - RNA, 22 nt, Homo sapiens
ccagugucugacagacacggcg

SEQ ID NO: 153674 - RNA, 20 nt, Homo sapiens
ccaguguuauuuauguucua

SEQ ID NO: 153675 - RNA, 22 nt, Homo sapiens
ccaugaacuagaauagaacaug

SEQ ID NO: 153676 - RNA, 22 nt, Homo sapiens
ccauggcuauucuguaaggguu

SEQ ID NO: 153677 - RNA, 22 nt, Homo sapiens
ccauggcuucugcauucuguca

SEQ ID NO: 153678 - RNA, 22 nt, Homo sapiens
cccaguagagauugccgaauug

SEQ ID NO: 153679 - RNA, 22 nt, Homo sapiens
cccagugugaacuuggcauuuu

SEQ ID NO: 153680 - RNA, 22 nt, Homo sapiens
ccccugaaacucacucauuauc

SEQ ID NO: 153681 - RNA, 23 nt, Homo sapiens
cccucagaagugcagggagagaa

SEQ ID NO: 153682 - RNA, 22 nt, Homo sapiens
cccugagcagccugaguuuccc

SEQ ID NO: 153683 - RNA, 22 nt, Homo sapiens
ccuucauucauuaauuuagccc

SEQ ID NO: 153684 - RNA, 22 nt, Homo sapiens
ccuucauugcaucuuuaagaga

SEQ ID NO: 153685 - RNA, 21 nt, Homo sapiens
ccuugagaacaucaauuugcu

SEQ ID NO: 153686 - RNA, 22 nt, Homo sapiens
ccuugguggccacaagacauug

SEQ ID NO: 153687 - RNA, 22 nt, Homo sapiens
ccuuuuugaguugccagaguuc

SEQ ID NO: 153688 - RNA, 22 nt, Homo sapiens
cgcuggugucuaagcgacagcu

SEQ ID NO: 153689 - RNA, 22 nt, Homo sapiens
cggaaugaaaauguccuucagu

SEQ ID NO: 153690 - RNA, 22 nt, Homo sapiens
cggcaguggguaagccaagcuu

SEQ ID NO: 153691 - RNA, 22 nt, Homo sapiens
cuaaaugcacugucaaaggaag

SEQ ID NO: 153692 - RNA, 22 nt, Homo sapiens
cuaagauugucuuaguguguug

SEQ ID NO: 153693 - RNA, 17 nt, Homo sapiens
cuaaggcaagagucugc

SEQ ID NO: 153694 - RNA, 22 nt, Homo sapiens
cagcuugugguauugcugguug

SEQ ID NO: 153695 - RNA, 22 nt, Homo sapiens
cagggaauguuauuuaauagca

SEQ ID NO: 153696 - RNA, 20 nt, Homo sapiens
cagggcaaugaggagguaaa

SEQ ID NO: 153697 - RNA, 22 nt, Homo sapiens
cagggcauuggcugguaccugg

SEQ ID NO: 153698 - RNA, 22 nt, Homo sapiens
cagguaagaugcuuucucuuau

SEQ ID NO: 153699 - RNA, 22 nt, Homo sapiens
caggugcauuggcugacaccug

SEQ ID NO: 153700 - RNA, 22 nt, Homo sapiens
caguguaugcuucuauuuuugg

SEQ ID NO: 153701 - RNA, 22 nt, Homo sapiens
cauaaagauggaggaggccagg

SEQ ID NO: 153702 - RNA, 22 nt, Homo sapiens
cauacaugugcuugucuuaugc

SEQ ID NO: 153703 - RNA, 19 nt, Homo sapiens
caucacagagucuuccauu

SEQ ID NO: 153704 - RNA, 22 nt, Homo sapiens
caucacagcaaguagggagugg

SEQ ID NO: 153705 - RNA, 20 nt, Homo sapiens
caucaccuggcaggauuugu

SEQ ID NO: 153706 - RNA, 22 nt, Homo sapiens
caucacuguugguacaaguaau

SEQ ID NO: 153707 - RNA, 22 nt, Homo sapiens
caucccauucgaggggcacagc

SEQ ID NO: 153708 - RNA, 22 nt, Homo sapiens
caugccacugcacgccauccug

SEQ ID NO: 153709 - RNA, 22 nt, Homo sapiens
cauggauuuuuuugaauggcag

SEQ ID NO: 153710 - RNA, 22 nt, Homo sapiens
cauggccuuuggaaugugucua

SEQ ID NO: 153711 - RNA, 22 nt, Homo sapiens
cauggcuuucacaguaaagccu

SEQ ID NO: 153712 - RNA, 22 nt, Homo sapiens
caugguacugccacagaagagu

SEQ ID NO: 153713 - RNA, 22 nt, Homo sapiens
caugucacuuccucucugaugg

SEQ ID NO: 153714 - RNA, 19 nt, Homo sapiens
caugugcacuacuggcuuc

SEQ ID NO: 153715 - RNA, 22 nt, Homo sapiens
caugugcaugcuuucuuaugug

SEQ ID NO: 153716 - RNA, 22 nt, Homo sapiens
cauuaguugaagugcagggaga

SEQ ID NO: 153717 - RNA, 20 nt, Homo sapiens
cauuccacuuuccugucagu

SEQ ID NO: 153718 - RNA, 20 nt, Homo sapiens
cauugcccuccagccugggc

SEQ ID NO: 153719 - RNA, 22 nt, Homo sapiens
cauugcucuuacagagugagua

SEQ ID NO: 153720 - RNA, 22 nt, Homo sapiens
cauuugguggcuacagaguaac

SEQ ID NO: 153721 - RNA, 22 nt, Homo sapiens
ccaaguguucucauuguucaau

SEQ ID NO: 153722 - RNA, 22 nt, Homo sapiens
ccaaguguuuucauuguuccau

SEQ ID NO: 153723 - RNA, 22 nt, Homo sapiens
ccacaaccuccauauccugggu

SEQ ID NO: 153724 - RNA, 19 nt, Homo sapiens
ccacaaugguugaacuaga

SEQ ID NO: 153725 - RNA, 22 nt, Homo sapiens
ccacagucuaugcaacaagguc

SEQ ID NO: 153726 - RNA, 22 nt, Homo sapiens
ccacugggcuagguguuuugga

SEQ ID NO: 153727 - RNA, 22 nt, Homo sapiens
ccaggguugagacccacugacu

SEQ ID NO: 153728 - RNA, 22 nt, Homo sapiens
ccagugauggcugccucauuug

SEQ ID NO: 153729 - RNA, 22 nt, Homo sapiens
cccacaguggccucauauccuu

SEQ ID NO: 153730 - RNA, 22 nt, Homo sapiens
cccagaguucuuaaauacugag

SEQ ID NO: 153731 - RNA, 22 nt, Homo sapiens
cccagugaagagaaccuuacga

SEQ ID NO: 153732 - RNA, 22 nt, Homo sapiens
ccccauuugaacuccuucaacu

SEQ ID NO: 153733 - RNA, 20 nt, Homo sapiens
ccccuggaguggggcugcuu

SEQ ID NO: 153734 - RNA, 22 nt, Homo sapiens
cccugaagacuccaccgucaug

SEQ ID NO: 153735 - RNA, 22 nt, Homo sapiens
ucugucacugguggacgaucac

SEQ ID NO: 153736 - RNA, 22 nt, Homo sapiens
ucugugcauuguaacaacuaaa

SEQ ID NO: 153737 - RNA, 22 nt, Homo sapiens
ucugugcauuguaggauguuua

SEQ ID NO: 153738 - RNA, 19 nt, Homo sapiens
ucugugcuugucccccugu

SEQ ID NO: 153739 - RNA, 22 nt, Homo sapiens
ucuguggugggcuccacccagu

SEQ ID NO: 153740 - RNA, 22 nt, Homo sapiens
ucugugguucaggcuggagugc

SEQ ID NO: 153741 - RNA, 22 nt, Homo sapiens
ucugugguucuagcuacuuugg

SEQ ID NO: 153742 - RNA, 22 nt, Homo sapiens
ucuuaggauacugaagucgguu

SEQ ID NO: 153743 - RNA, 22 nt, Homo sapiens
ucuuaguuuagauuagcaauuc

SEQ ID NO: 153744 - RNA, 22 nt, Homo sapiens
ucuucagucauauuggccugga

SEQ ID NO: 153745 - RNA, 22 nt, Homo sapiens
ucuucuagcggaacccucuugu

SEQ ID NO: 153746 - RNA, 17 nt, Homo sapiens
ucuucuguuacuguggc

SEQ ID NO: 153747 - RNA, 22 nt, Homo sapiens
ucuugcacaaauuauuuuaacu

SEQ ID NO: 153748 - RNA, 22 nt, Homo sapiens
ugagauagggucucacucuguc

SEQ ID NO: 153749 - RNA, 22 nt, Homo sapiens
ugagaucgaguuucgcucuugu

SEQ ID NO: 153750 - RNA, 22 nt, Homo sapiens
ugagaucucauuaugguuuuaa

SEQ ID NO: 153751 - RNA, 22 nt, Homo sapiens
ugagaucuuuuguggcugagaa

SEQ ID NO: 153752 - RNA, 22 nt, Homo sapiens
ugagaugaacuugauuguuuua

SEQ ID NO: 153753 - RNA, 22 nt, Homo sapiens
ugagaugaagcuagaagaaugg

SEQ ID NO: 153754 - RNA, 22 nt, Homo sapiens
ugagaugaagucuugcucuguu

SEQ ID NO: 153755 - RNA, 22 nt, Homo sapiens
ugagaugagucucgcucuguca

SEQ ID NO: 153756 - RNA, 22 nt, Homo sapiens
ugagaugauaucuuauuguaau

SEQ ID NO: 153757 - RNA, 22 nt, Homo sapiens
uggaagacaggcuguauuuuaa

SEQ ID NO: 153758 - RNA, 22 nt, Homo sapiens
uggaagauggaguuuuaucauu

SEQ ID NO: 153759 - RNA, 22 nt, Homo sapiens
uggaaguaaccaugaauggaau

SEQ ID NO: 153760 - RNA, 22 nt, Homo sapiens
uggaagugaacaaccaaggcag

SEQ ID NO: 153761 - RNA, 22 nt, Homo sapiens
uggaaguuaaauuaguugauga

SEQ ID NO: 153762 - RNA, 23 nt, Homo sapiens
uucaccguguuggccaggcuggu

SEQ ID NO: 153763 - RNA, 22 nt, Homo sapiens
uucaccuggguuggccaucauu

SEQ ID NO: 153764 - RNA, 22 nt, Homo sapiens
uucacuguuaagcaguuaaacu

SEQ ID NO: 153765 - RNA, 22 nt, Homo sapiens
uucagagcauugguuuuuugaa

SEQ ID NO: 153766 - RNA, 20 nt, Homo sapiens
uucagcaaaggaaugggagu

SEQ ID NO: 153767 - RNA, 22 nt, Homo sapiens
uucagcacaguguggaucauuc

SEQ ID NO: 153768 - RNA, 22 nt, Homo sapiens
uucagcacugaaaauaugucau

SEQ ID NO: 153769 - RNA, 22 nt, Homo sapiens
uucagcaguggccaguggaaau

SEQ ID NO: 153770 - RNA, 22 nt, Homo sapiens
uucagcuacuugggaggcugaa

SEQ ID NO: 153771 - RNA, 22 nt, Homo sapiens
uucaggcuuuuauuuacugaua

SEQ ID NO: 153772 - RNA, 22 nt, Homo sapiens
uucaguagucaaaagauaaggg

SEQ ID NO: 153773 - RNA, 19 nt, Homo sapiens
uucauacagugagagcagc

SEQ ID NO: 153774 - RNA, 22 nt, Homo sapiens
uucauaguaacaguaacuaugg

SEQ ID NO: 153775 - RNA, 22 nt, Homo sapiens
uucauagucacauucgaugucu

SEQ ID NO: 153776 - RNA, 22 nt, Homo sapiens
uucauagucuaugcaaguaaga

SEQ ID NO: 153777 - RNA, 22 nt, Homo sapiens
uucauagugaaaaauucaaagu

SEQ ID NO: 153778 - RNA, 22 nt, Homo sapiens
uucaucacagucuccgaugccc

SEQ ID NO: 153779 - RNA, 21 nt, Homo sapiens
uucaucagccagaaaucaagc

SEQ ID NO: 153780 - RNA, 22 nt, Homo sapiens
uucaucaguuauauuggccuga

SEQ ID NO: 153781 - RNA, 22 nt, Homo sapiens
uucaugcaucuguagugguuaa

SEQ ID NO: 153782 - RNA, 22 nt, Homo sapiens
uucauguaauauuucacagcuu

SEQ ID NO: 153783 - RNA, 22 nt, Homo sapiens
uucauguagucaucauccugcu

SEQ ID NO: 153784 - RNA, 22 nt, Homo sapiens
uuccacaauggcugaacuaguu

SEQ ID NO: 153785 - RNA, 22 nt, Homo sapiens
ugugaugguuuggaagcuucuu

SEQ ID NO: 153786 - RNA, 22 nt, Homo sapiens
ugugauguggagggcagaucca

SEQ ID NO: 153787 - RNA, 22 nt, Homo sapiens
ugugcaaggcucucaaccugug

SEQ ID NO: 153788 - RNA, 18 nt, Homo sapiens
ugugcaauauuaaccacc

SEQ ID NO: 153789 - RNA, 22 nt, Homo sapiens
ugugcaaucagcuucauuacau

SEQ ID NO: 153790 - RNA, 22 nt, Homo sapiens
ugugcaauucgauggagcucau

SEQ ID NO: 153791 - RNA, 22 nt, Homo sapiens
ugugcacaugauauaucacaua

SEQ ID NO: 153792 - RNA, 22 nt, Homo sapiens
ugugcacuggaccuugucuucu

SEQ ID NO: 153793 - RNA, 22 nt, Homo sapiens
ugugcauauaaguguguauaua

SEQ ID NO: 153794 - RNA, 22 nt, Homo sapiens
ugugcauaugucuuuauaguag

SEQ ID NO: 153795 - RNA, 22 nt, Homo sapiens
ugugccacugcacuccugggug

SEQ ID NO: 153796 - RNA, 22 nt, Homo sapiens
ugugccacugcacucuggccug

SEQ ID NO: 153797 - RNA, 22 nt, Homo sapiens
ugugccacugcacuucagccug

SEQ ID NO: 153798 - RNA, 22 nt, Homo sapiens
ugugccacuguucuguaaagug

SEQ ID NO: 153799 - RNA, 22 nt, Homo sapiens
ugugcgugugccuguaagaauu

SEQ ID NO: 153800 - RNA, 22 nt, Homo sapiens
ugugcuaaaaugggacuucuaa

SEQ ID NO: 153801 - RNA, 22 nt, Homo sapiens
ugugcuuguaaaggccagagca

SEQ ID NO: 153802 - RNA, 22 nt, Homo sapiens
uguggcaaauggucaggaagaa

SEQ ID NO: 153803 - RNA, 20 nt, Homo sapiens
uguggcacuguaucucucag

SEQ ID NO: 153804 - RNA, 22 nt, Homo sapiens
uguggcauugaauaaccuugga

SEQ ID NO: 153805 - RNA, 17 nt, Homo sapiens
uguggcucuuaugcuga

SEQ ID NO: 153806 - RNA, 22 nt, Homo sapiens
uguggcucuucuguucuccacu

SEQ ID NO: 153807 - RNA, 22 nt, Homo sapiens
uguggcuucuuugguucaguau

SEQ ID NO: 153808 - RNA, 23 nt, Homo sapiens
ugugguauuauuccauuuauagg

SEQ ID NO: 153809 - RNA, 22 nt, Homo sapiens
uguguaaagcuuguuccagaaa

SEQ ID NO: 153810 - RNA, 22 nt, Homo sapiens
ugugucuugagagucucgagaa

SEQ ID NO: 153811 - RNA, 22 nt, Homo sapiens
uguuaagaugucaauuuuccac

SEQ ID NO: 153812 - RNA, 22 nt, Homo sapiens
uguucacaguguuucuuugaga

SEQ ID NO: 153813 - RNA, 22 nt, Homo sapiens
uguucuggagaggcaggccaca

SEQ ID NO: 153814 - RNA, 22 nt, Homo sapiens
uguucuggagccgguucaaaug

SEQ ID NO: 153815 - RNA, 22 nt, Homo sapiens
uguugcacuccagccuagguga

SEQ ID NO: 153816 - RNA, 22 nt, Homo sapiens
uguugcacuccauccugggcga

SEQ ID NO: 153817 - RNA, 22 nt, Homo sapiens
uguugcuuaagccacccagucu

SEQ ID NO: 153818 - RNA, 22 nt, Homo sapiens
uguuucuacugucucuguagua

SEQ ID NO: 153819 - RNA, 22 nt, Homo sapiens
uguuuguuugauaugggauaaa

SEQ ID NO: 153820 - RNA, 22 nt, Homo sapiens
uuaaacugcuugaauuggguuu

SEQ ID NO: 153821 - RNA, 22 nt, Homo sapiens
uuaaagcuggcguuacaguuug

SEQ ID NO: 153822 - RNA, 22 nt, Homo sapiens
uuaaaggcaugguuagacaugg

SEQ ID NO: 153823 - RNA, 20 nt, Homo sapiens
uuaaaucuagugcagacuca

SEQ ID NO: 153824 - RNA, 22 nt, Homo sapiens
uuaaaugcauagaauguguagu

SEQ ID NO: 153825 - RNA, 22 nt, Homo sapiens
uuaacagcacaugcugucccuu

SEQ ID NO: 153826 - RNA, 22 nt, Homo sapiens
uuaagcaaagguaacaugagaa

SEQ ID NO: 153827 - RNA, 22 nt, Homo sapiens
uuaagugcucaguuacucaguu

SEQ ID NO: 153828 - RNA, 22 nt, Homo sapiens
uuaaguguaaguggugugggac

SEQ ID NO: 153829 - RNA, 19 nt, Homo sapiens
uuaagugugauaucucagu

SEQ ID NO: 153830 - RNA, 22 nt, Homo sapiens
uuaauacucuucuaaguagucc

SEQ ID NO: 153831 - RNA, 22 nt, Homo sapiens
uuaauagugacucauuuuccac

SEQ ID NO: 153832 - RNA, 21 nt, Homo sapiens
uuaaugcuaugcagaaaaucu

SEQ ID NO: 153833 - RNA, 22 nt, Homo sapiens
uuaaugcuuuugggauauuucu

SEQ ID NO: 153834 - RNA, 22 nt, Homo sapiens
uuaauuguccaaguucaucucu

SEQ ID NO: 153835 - RNA, 22 nt, Homo sapiens
uuacaccuguaauccagcacuu

SEQ ID NO: 153836 - RNA, 22 nt, Homo sapiens
uuacagauggauggcagcuggc

SEQ ID NO: 153837 - RNA, 17 nt, Homo sapiens
uuacaggugcugagagu

SEQ ID NO: 153838 - RNA, 22 nt, Homo sapiens
uuacagugguugcuauugugaa

SEQ ID NO: 153839 - RNA, 20 nt, Homo sapiens
uuacuauguaguauuggcuc

SEQ ID NO: 153840 - RNA, 22 nt, Homo sapiens
uuagaaaguagaaaagcugguu

SEQ ID NO: 153841 - RNA, 17 nt, Homo sapiens
uuagacagacauccugc

SEQ ID NO: 153842 - RNA, 22 nt, Homo sapiens
uuagcacaguucauucauguua

SEQ ID NO: 153843 - RNA, 22 nt, Homo sapiens
uuagcagcaugaaaauggacug

SEQ ID NO: 153844 - RNA, 22 nt, Homo sapiens
uuagcaugucuacuaauuugcu

SEQ ID NO: 153845 - RNA, 22 nt, Homo sapiens
uuagcccagugggugcuucucu

SEQ ID NO: 153846 - RNA, 22 nt, Homo sapiens
uuaguaguagugcuguaauuuu

SEQ ID NO: 153847 - RNA, 22 nt, Homo sapiens
uuaguggaugcugaauaaagaa

SEQ ID NO: 153848 - RNA, 20 nt, Homo sapiens
uuaguucauuuagaagguuu

SEQ ID NO: 153849 - RNA, 22 nt, Homo sapiens
uuauacucgucugaaugauucu

SEQ ID NO: 153850 - RNA, 22 nt, Homo sapiens
uuauagcagugcccaacuccug

SEQ ID NO: 153851 - RNA, 22 nt, Homo sapiens
uuauagguuucuacaggacuau

SEQ ID NO: 153852 - RNA, 22 nt, Homo sapiens
uuauccugucaguaaauauuuu

SEQ ID NO: 153853 - RNA, 22 nt, Homo sapiens
uuaucucagugaacugagugga

SEQ ID NO: 153854 - RNA, 22 nt, Homo sapiens
uuaucucaguguuuguaaacaa

SEQ ID NO: 153855 - RNA, 17 nt, Homo sapiens
uuaugagacuucuuagc

SEQ ID NO: 153856 - RNA, 22 nt, Homo sapiens
uuauguaggcuauagcucugca

SEQ ID NO: 153857 - RNA, 22 nt, Homo sapiens
uuaugucauuuuuggauguuaa

SEQ ID NO: 153858 - RNA, 17 nt, Homo sapiens
uuauugcuauaagcuga

SEQ ID NO: 153859 - RNA, 22 nt, Homo sapiens
uuauugcuuuugugcaggugag

SEQ ID NO: 153860 - RNA, 22 nt, Homo sapiens
uucaaaguguugguuuugggcu

SEQ ID NO: 153861 - RNA, 22 nt, Homo sapiens
uucaaaucuucguuuugccaua

SEQ ID NO: 153862 - RNA, 23 nt, Homo sapiens
uucaacagguagacccucccugc

SEQ ID NO: 153863 - RNA, 22 nt, Homo sapiens
uucaagaauuaaaguggcuuuu

SEQ ID NO: 153864 - RNA, 22 nt, Homo sapiens
uucaagauggcaccagugagug

SEQ ID NO: 153865 - RNA, 22 nt, Homo sapiens
uucaagucaaggaaagaggucu

SEQ ID NO: 153866 - RNA, 22 nt, Homo sapiens
uucaagucuuggcuuugccacc

SEQ ID NO: 153867 - RNA, 22 nt, Homo sapiens
uucaaguguucaggagcuacag

SEQ ID NO: 153868 - RNA, 22 nt, Homo sapiens
uucacagacaacuggucccuua

SEQ ID NO: 153869 - RNA, 22 nt, Homo sapiens
uucacagagagaacucaaacca

SEQ ID NO: 153870 - RNA, 22 nt, Homo sapiens
uucacaguacucccuggaauua

SEQ ID NO: 153871 - RNA, 22 nt, Homo sapiens
uucaccagggaagucucaacuc

SEQ ID NO: 153872 - RNA, 22 nt, Homo sapiens
uucacgguguucacgggggucc

SEQ ID NO: 153873 - RNA, 22 nt, Homo sapiens
uucagaguggacagaaauuaag

SEQ ID NO: 153874 - RNA, 22 nt, Homo sapiens
aagaccuaugcaggaagaaaug

SEQ ID NO: 153875 - RNA, 22 nt, Homo sapiens
aagagaugaagguccugacugu

SEQ ID NO: 153876 - RNA, 22 nt, Homo sapiens
aagagcauuauuuaguaauuuc

SEQ ID NO: 153877 - RNA, 22 nt, Homo sapiens
aagagguuuaacugacucacag

SEQ ID NO: 153878 - RNA, 22 nt, Homo sapiens
aagaugauguucuuuuucuuag

SEQ ID NO: 153879 - RNA, 20 nt, Homo sapiens
aagcaagcauuugcaaucau

SEQ ID NO: 153880 - RNA, 22 nt, Homo sapiens
aagcagauguguugaaaguacu

SEQ ID NO: 153881 - RNA, 22 nt, Homo sapiens
aagcaggugaugagugggugug

SEQ ID NO: 153882 - RNA, 22 nt, Homo sapiens
aagcaggugucugugucuguaa

SEQ ID NO: 153883 - RNA, 22 nt, Homo sapiens
aagcaggugugggaggaaaugg

SEQ ID NO: 153884 - RNA, 22 nt, Homo sapiens
aagccagugugacaggaaacuu

SEQ ID NO: 153885 - RNA, 22 nt, Homo sapiens
aagcuccauuucugccaugaga

SEQ ID NO: 153886 - RNA, 22 nt, Homo sapiens
aagcuggagugcaguggugcaa

SEQ ID NO: 153887 - RNA, 22 nt, Homo sapiens
aagcuggcauucauucguucuu

SEQ ID NO: 153888 - RNA, 22 nt, Homo sapiens
aagcuguuguucauccugaauu

SEQ ID NO: 153889 - RNA, 22 nt, Homo sapiens
aaggagcuaagagaucauacau

SEQ ID NO: 153890 - RNA, 22 nt, Homo sapiens
aaggcaagaagagaaccaucgg

SEQ ID NO: 153891 - RNA, 22 nt, Homo sapiens
aaggcuauuugagaaugugugu

SEQ ID NO: 153892 - RNA, 22 nt, Homo sapiens
aaggcuuuuugcugacguccuu

SEQ ID NO: 153893 - RNA, 22 nt, Homo sapiens
aaguaauggaguuauuuuauga

SEQ ID NO: 153894 - RNA, 22 nt, Homo sapiens
aaguagcagaggcaagacuuga

SEQ ID NO: 153895 - RNA, 19 nt, Homo sapiens
aagugaaugcuuuguucac

SEQ ID NO: 153896 - RNA, 22 nt, Homo sapiens
aagugcauguauuaguguaguc

SEQ ID NO: 153897 - RNA, 22 nt, Homo sapiens
aagugcuuacagggaacaugau

SEQ ID NO: 153898 - RNA, 22 nt, Homo sapiens
aagugcuuccuuucagaggguu

SEQ ID NO: 153899 - RNA, 22 nt, Homo sapiens
aaguguaaguuaauguuuaggu

SEQ ID NO: 153900 - RNA, 23 nt, Homo sapiens
aaguucaugcucaucuguuacac

SEQ ID NO: 153901 - RNA, 22 nt, Homo sapiens
aauaaaguaggaggugaggaaa

SEQ ID NO: 153902 - RNA, 22 nt, Homo sapiens
aauaucacaggguguacacuca

SEQ ID NO: 153903 - RNA, 22 nt, Homo sapiens
aauccaugugcuuuaccauuuu

SEQ ID NO: 153904 - RNA, 17 nt, Homo sapiens
aaugagacauuucugcu

SEQ ID NO: 153905 - RNA, 22 nt, Homo sapiens
aaugcacauaaaauccuccagg

SEQ ID NO: 153906 - RNA, 22 nt, Homo sapiens
aaugcuaucuggaacauuguug

SEQ ID NO: 153907 - RNA, 22 nt, Homo sapiens
aauggcaaauguuuucuguuga

SEQ ID NO: 153908 - RNA, 22 nt, Homo sapiens
aauggccuuuuucauuauacug

SEQ ID NO: 153909 - RNA, 22 nt, Homo sapiens
aauggcuuuuaauauccauaau

SEQ ID NO: 153910 - RNA, 19 nt, Homo sapiens
aauggcuuuuccuguuccc

SEQ ID NO: 153911 - RNA, 18 nt, Homo sapiens
aaugggacuacaaagcca

SEQ ID NO: 153912 - RNA, 22 nt, Homo sapiens
aaugggacugacgccucccaga

SEQ ID NO: 153913 - RNA, 22 nt, Homo sapiens
aaugugccuacuggagcuugca

SEQ ID NO: 153914 - RNA, 22 nt, Homo sapiens
aauuacauggcaauugggaaau

SEQ ID NO: 153915 - RNA, 22 nt, Homo sapiens
aauugcaccaucuagaucaaga

SEQ ID NO: 153916 - RNA, 22 nt, Homo sapiens
aauugcaucuguucuuugccag

SEQ ID NO: 153917 - RNA, 22 nt, Homo sapiens
aauugugcuuguaggccaggca

SEQ ID NO: 153918 - RNA, 21 nt, Homo sapiens
acaaagcuggagggagacugc

SEQ ID NO: 153919 - RNA, 20 nt, Homo sapiens
acaaaugcauucugugacau

SEQ ID NO: 153920 - RNA, 22 nt, Homo sapiens
acacaguaagcacaguguagau

SEQ ID NO: 153921 - RNA, 22 nt, Homo sapiens
acaccaguacuuuauacaagca

SEQ ID NO: 153922 - RNA, 22 nt, Homo sapiens
acacuggaguuaaaggugauuu

SEQ ID NO: 153923 - RNA, 22 nt, Homo sapiens
acacuggguaacauaucuguua

SEQ ID NO: 153924 - RNA, 22 nt, Homo sapiens
acacuguagcugagggcaugcg

SEQ ID NO: 153925 - RNA, 22 nt, Homo sapiens
acacuguccaguuaggcuacau

SEQ ID NO: 153926 - RNA, 19 nt, Homo sapiens
acagcugguuuugguuucu

SEQ ID NO: 153927 - RNA, 22 nt, Homo sapiens
acaguacaugauaaauaaggua

SEQ ID NO: 153928 - RNA, 22 nt, Homo sapiens
acaguacuuuuggauuugugaa

SEQ ID NO: 153929 - RNA, 22 nt, Homo sapiens
acaguagaaaacaauggauuug

SEQ ID NO: 153930 - RNA, 22 nt, Homo sapiens
acaguaugcuuuaaacuuuguu

SEQ ID NO: 153931 - RNA, 22 nt, Homo sapiens
uuccugagaucagaauucaaau

SEQ ID NO: 153932 - RNA, 22 nt, Homo sapiens
uuccugagccuuguaucuagua

SEQ ID NO: 153933 - RNA, 22 nt, Homo sapiens
uuccuugaaacagucaagagaa

SEQ ID NO: 153934 - RNA, 21 nt, Homo sapiens
uucuacuccggcguuguuuuu

SEQ ID NO: 153935 - RNA, 22 nt, Homo sapiens
uucuauguuguuagacccacca

SEQ ID NO: 153936 - RNA, 22 nt, Homo sapiens
uucuauugguaauauuuucugu

SEQ ID NO: 153937 - RNA, 22 nt, Homo sapiens
uucucaauggaugugggaccag

SEQ ID NO: 153938 - RNA, 21 nt, Homo sapiens
uucucagaggcaggggauaaa

SEQ ID NO: 153939 - RNA, 22 nt, Homo sapiens
uucucagcccccugacagucag

SEQ ID NO: 153940 - RNA, 22 nt, Homo sapiens
uucucaguaauuccagauuuuu

SEQ ID NO: 153941 - RNA, 22 nt, Homo sapiens
uucucaguucgguggcagugcu

SEQ ID NO: 153942 - RNA, 17 nt, Homo sapiens
uucucaguucugaucuc

SEQ ID NO: 153943 - RNA, 22 nt, Homo sapiens
uucuccugguggacccuaaacg

SEQ ID NO: 153944 - RNA, 22 nt, Homo sapiens
uucucgcuuuuuccaccuguau

SEQ ID NO: 153945 - RNA, 22 nt, Homo sapiens
uucucugggacauaggucgggu

SEQ ID NO: 153946 - RNA, 22 nt, Homo sapiens
uucucuggucagaggggagguu

SEQ ID NO: 153947 - RNA, 22 nt, Homo sapiens
uucuggcuuuuaaagaaauguu

SEQ ID NO: 153948 - RNA, 22 nt, Homo sapiens
uucugugcuuguggaugaagug

SEQ ID NO: 153949 - RNA, 22 nt, Homo sapiens
uucuucaggcauucccagaagc

SEQ ID NO: 153950 - RNA, 22 nt, Homo sapiens
uugaagacuaauuuagauaaug

SEQ ID NO: 153951 - RNA, 22 nt, Homo sapiens
uugaaguaugaccgcugagaau

SEQ ID NO: 153952 - RNA, 22 nt, Homo sapiens
uugaaugaaaugaugucauuug

SEQ ID NO: 153953 - RNA, 22 nt, Homo sapiens
uugaauguacuuguucucacua

SEQ ID NO: 153954 - RNA, 22 nt, Homo sapiens
uugaauguaugcuggguuuacu

SEQ ID NO: 153955 - RNA, 22 nt, Homo sapiens
uugacaaggagccauugcaucu

SEQ ID NO: 153956 - RNA, 22 nt, Homo sapiens
uugacagagaaaagugugacuu

SEQ ID NO: 153957 - RNA, 22 nt, Homo sapiens
uugacauauuugugcuuaagaa

SEQ ID NO: 153958 - RNA, 22 nt, Homo sapiens
uugacauguaaguacucuauag

SEQ ID NO: 153959 - RNA, 21 nt, Homo sapiens
uugagacggagucucacucug

SEQ ID NO: 153960 - RNA, 22 nt, Homo sapiens
uugagacggagucucacucugu

SEQ ID NO: 153961 - RNA, 22 nt, Homo sapiens
uugagagcugaugaaagauaaa

SEQ ID NO: 153962 - RNA, 17 nt, Homo sapiens
uugagaguauaucuuac

SEQ ID NO: 153963 - RNA, 22 nt, Homo sapiens
uugagauaggaacucacuaugc

SEQ ID NO: 153964 - RNA, 20 nt, Homo sapiens
uugagaucuguaucugguuu

SEQ ID NO: 153965 - RNA, 22 nt, Homo sapiens
gucagagcacugaguugugggc

SEQ ID NO: 153966 - RNA, 22 nt, Homo sapiens
gucagcuuguccagagacucug

SEQ ID NO: 153967 - RNA, 22 nt, Homo sapiens
gucaggugcuuacgcggagauc

SEQ ID NO: 153968 - RNA, 22 nt, Homo sapiens
gucagugucuuaacagagauua

SEQ ID NO: 153969 - RNA, 22 nt, Homo sapiens
gucagugucuuugcagcucaga

SEQ ID NO: 153970 - RNA, 22 nt, Homo sapiens
gucaguuucacucagcuggaac

SEQ ID NO: 153971 - RNA, 22 nt, Homo sapiens
gucaugaaguuuugaaugaaau

SEQ ID NO: 153972 - RNA, 22 nt, Homo sapiens
gucauggguuaaagguggauac

SEQ ID NO: 153973 - RNA, 22 nt, Homo sapiens
gucauugcuuaaggguucaugc

SEQ ID NO: 153974 - RNA, 22 nt, Homo sapiens
guccaaauccaugggauguaca

SEQ ID NO: 153975 - RNA, 22 nt, Homo sapiens
guccaguacucuuuccugaaaa

SEQ ID NO: 153976 - RNA, 22 nt, Homo sapiens
guccaguuguuuucugagguug

SEQ ID NO: 153977 - RNA, 22 nt, Homo sapiens
ugaaucaugcugcuauaaagac

SEQ ID NO: 153978 - RNA, 21 nt, Homo sapiens
ugaaugcuuuaaauauuagaa

SEQ ID NO: 153979 - RNA, 20 nt, Homo sapiens
ugaauguaauuacagaugua

SEQ ID NO: 153980 - RNA, 22 nt, Homo sapiens
ugaauguuguugguugagauau

SEQ ID NO: 153981 - RNA, 23 nt, Homo sapiens
ugacaaccucaugcuuugucaug

SEQ ID NO: 153982 - RNA, 22 nt, Homo sapiens
ugacaacugauuaacuccuuua

SEQ ID NO: 153983 - RNA, 22 nt, Homo sapiens
ugacaagauauggucuuaucaa

SEQ ID NO: 153984 - RNA, 21 nt, Homo sapiens
ugacagaaaauugaguuugcu

SEQ ID NO: 153985 - RNA, 18 nt, Homo sapiens
ugacagcacaugugggga

SEQ ID NO: 153986 - RNA, 22 nt, Homo sapiens
ugacagcaucaggauuggagag

SEQ ID NO: 153987 - RNA, 22 nt, Homo sapiens
ugacagcugaagauguugaacc

SEQ ID NO: 153988 - RNA, 22 nt, Homo sapiens
ugacaguaucuacagcuucuua

SEQ ID NO: 153989 - RNA, 22 nt, Homo sapiens
ugacaguguccucauucccaac

SEQ ID NO: 153990 - RNA, 20 nt, Homo sapiens
ugacaguuaagggauagaag

SEQ ID NO: 153991 - RNA, 20 nt, Homo sapiens
ugacaucagcaauguaauaa

SEQ ID NO: 153992 - RNA, 18 nt, Homo sapiens
ugacaucauuuagaaagg

SEQ ID NO: 153993 - RNA, 22 nt, Homo sapiens
ugacaugaagaaaaacagauuu

SEQ ID NO: 153994 - RNA, 22 nt, Homo sapiens
ugacaugaagucucccucuguu

SEQ ID NO: 153995 - RNA, 22 nt, Homo sapiens
ugacaugagauuugggaggggc

SEQ ID NO: 153996 - RNA, 22 nt, Homo sapiens
ugacccauagaaauguggauaa

SEQ ID NO: 153997 - RNA, 22 nt, Homo sapiens
ugacuacaggucaggaagcugu

SEQ ID NO: 153998 - RNA, 21 nt, Homo sapiens
ugacuagauuccagauuggcc

SEQ ID NO: 153999 - RNA, 21 nt, Homo sapiens
ugacuagggauaugugccacu

SEQ ID NO: 154000 - RNA, 22 nt, Homo sapiens
ugacuaggggcccuggcuucuu

SEQ ID NO: 154001 - RNA, 22 nt, Homo sapiens
ugacuauaguuuucuugacaca

SEQ ID NO: 154002 - RNA, 22 nt, Homo sapiens
ugacuauugauuuagacgugcu

SEQ ID NO: 154003 - RNA, 22 nt, Homo sapiens
ugacucagauagguguguauuc

SEQ ID NO: 154004 - RNA, 22 nt, Homo sapiens
ugacuggagucuugcucugucg

SEQ ID NO: 154005 - RNA, 22 nt, Homo sapiens
ugacuugaguaacuggcucagg

SEQ ID NO: 154006 - RNA, 22 nt, Homo sapiens
ugacuuuagaauuuuauccaga

SEQ ID NO: 154007 - RNA, 16 nt, Homo sapiens
ugagaacaugugacau

SEQ ID NO: 154008 - RNA, 22 nt, Homo sapiens
ugagaacaugugauauuuggug

SEQ ID NO: 154009 - RNA, 17 nt, Homo sapiens
ugagaacaugugguauu

SEQ ID NO: 154010 - RNA, 19 nt, Homo sapiens
ugagaacaugugguauuug

SEQ ID NO: 154011 - RNA, 18 nt, Homo sapiens
ugagaacauguguacaca

SEQ ID NO: 154012 - RNA, 22 nt, Homo sapiens
ugagaacauuccucuuccuggc

SEQ ID NO: 154013 - RNA, 22 nt, Homo sapiens
ugagaacucaugaaucuuucca

SEQ ID NO: 154014 - RNA, 22 nt, Homo sapiens
ugagaacugccuguauuuaucu

SEQ ID NO: 154015 - RNA, 22 nt, Homo sapiens
ugagaacugguagcacuuguga

SEQ ID NO: 154016 - RNA, 22 nt, Homo sapiens
ugagaacuuauggugauuuuuu

SEQ ID NO: 154017 - RNA, 22 nt, Homo sapiens
ugagaauauuugaagauguuag

SEQ ID NO: 154018 - RNA, 22 nt, Homo sapiens
ugagacauacuuacaggggaug

SEQ ID NO: 154019 - RNA, 23 nt, Homo sapiens
ugagacauuggaaaguuaggcag

SEQ ID NO: 154020 - RNA, 22 nt, Homo sapiens
ugagaccaacagauuccaguuc

SEQ ID NO: 154021 - RNA, 22 nt, Homo sapiens
ugagaccuuucauuucucagug

SEQ ID NO: 154022 - RNA, 22 nt, Homo sapiens
ugagacgaagucuugcucuguu

SEQ ID NO: 154023 - RNA, 22 nt, Homo sapiens
ugagacggagucucacucuguu

SEQ ID NO: 154024 - RNA, 22 nt, Homo sapiens
ugagacggagucuggcacuguc

SEQ ID NO: 154025 - RNA, 22 nt, Homo sapiens
ugagacggaguuucacucuugu

SEQ ID NO: 154026 - RNA, 22 nt, Homo sapiens
ugagacggaguuuugcucuugu

SEQ ID NO: 154027 - RNA, 22 nt, Homo sapiens
ugagacugagucuugcucuauu

SEQ ID NO: 154028 - RNA, 22 nt, Homo sapiens
ugagagacaguuuguuaaaauu

SEQ ID NO: 154029 - RNA, 22 nt, Homo sapiens
ugagauaacuaaaaacauuuug

SEQ ID NO: 154030 - RNA, 22 nt, Homo sapiens
ugagauagaaaacauaggagaa

SEQ ID NO: 154031 - RNA, 22 nt, Homo sapiens
ugagauaggaucuugcucuguu

SEQ ID NO: 154032 - RNA, 22 nt, Homo sapiens
ugagaucaagguuaauauaauc

SEQ ID NO: 154033 - RNA, 22 nt, Homo sapiens
ugagaucgagucucgcucuguc

SEQ ID NO: 154034 - RNA, 22 nt, Homo sapiens
ugagaucuguaaagucugacau

SEQ ID NO: 154035 - RNA, 22 nt, Homo sapiens
ugagaucuucgcucuucacaga

SEQ ID NO: 154036 - RNA, 19 nt, Homo sapiens
ugagaugaagacagggguu

SEQ ID NO: 154037 - RNA, 22 nt, Homo sapiens
ugagaugauagauauguuaauu

SEQ ID NO: 154038 - RNA, 22 nt, Homo sapiens
ugagaugaucaaaguauaggcu

SEQ ID NO: 154039 - RNA, 22 nt, Homo sapiens
ugagauggaguuucgcucuugu

SEQ ID NO: 154040 - RNA, 22 nt, Homo sapiens
ugagauggaguuucgcuuuugu

SEQ ID NO: 154041 - RNA, 22 nt, Homo sapiens
ugagauggcuuuauugcugaau

SEQ ID NO: 154042 - RNA, 22 nt, Homo sapiens
ugagauguguccagaucuaguu

SEQ ID NO: 154043 - RNA, 23 nt, Homo sapiens
ugagauuacccagaaagaguaua

SEQ ID NO: 154044 - RNA, 23 nt, Homo sapiens
ugagauuauaaucuuuuacuucu

SEQ ID NO: 154045 - RNA, 22 nt, Homo sapiens
ugagauuauauuucuuaacaga

SEQ ID NO: 154046 - RNA, 22 nt, Homo sapiens
ugagauuaucguaauguaucuc

SEQ ID NO: 154047 - RNA, 23 nt, Homo sapiens
uuccaccauugacuaguuacaua

SEQ ID NO: 154048 - RNA, 22 nt, Homo sapiens
uuccagagucaccuuucugucg

SEQ ID NO: 154049 - RNA, 22 nt, Homo sapiens
uuccagaugggaguucuauucu

SEQ ID NO: 154050 - RNA, 22 nt, Homo sapiens
uuccaguauuugggcaagcgca

SEQ ID NO: 154051 - RNA, 22 nt, Homo sapiens
uuccaguggacuacuucauccu

SEQ ID NO: 154052 - RNA, 22 nt, Homo sapiens
uuccauguaguugagcaguuuu

SEQ ID NO: 154053 - RNA, 22 nt, Homo sapiens
uuccauuuguucggugucgcca

SEQ ID NO: 154054 - RNA, 22 nt, Homo sapiens
uucccaguggaacauguaguca

SEQ ID NO: 154055 - RNA, 22 nt, Homo sapiens
uucccaguuggggaaagcgacc

SEQ ID NO: 154056 - RNA, 22 nt, Homo sapiens
uucccuuucuuaaagaguuagg

SEQ ID NO: 154057 - RNA, 22 nt, Homo sapiens
uuccuagagauuagcaagcugc

SEQ ID NO: 154058 - RNA, 20 nt, Homo sapiens
uucuacagucacaggaagau

SEQ ID NO: 154059 - RNA, 22 nt, Homo sapiens
uucuacagugacugcagccaua

SEQ ID NO: 154060 - RNA, 22 nt, Homo sapiens
uucucacaguacagggagcucu

SEQ ID NO: 154061 - RNA, 19 nt, Homo sapiens
uucucugguuguacuaccc

SEQ ID NO: 154062 - RNA, 22 nt, Homo sapiens
uucucuguggauugggugagag

SEQ ID NO: 154063 - RNA, 22 nt, Homo sapiens
uucugacuggugugagauggua

SEQ ID NO: 154064 - RNA, 22 nt, Homo sapiens
uucugcacaucgaucacaagau

SEQ ID NO: 154065 - RNA, 22 nt, Homo sapiens
uucugcuugaucuaguguguug

SEQ ID NO: 154066 - RNA, 22 nt, Homo sapiens
uucugugcugaaucaaagacug

SEQ ID NO: 154067 - RNA, 22 nt, Homo sapiens
uucugugguagaaaucucaaau

SEQ ID NO: 154068 - RNA, 21 nt, Homo sapiens
uucuucaggcagaaggauuau

SEQ ID NO: 154069 - RNA, 22 nt, Homo sapiens
uucuuuggauaaaguuuuaugc

SEQ ID NO: 154070 - RNA, 22 nt, Homo sapiens
uucuuugguacaagggccgacc

SEQ ID NO: 154071 - RNA, 22 nt, Homo sapiens
uugaaagaugaacuggauugga

SEQ ID NO: 154072 - RNA, 22 nt, Homo sapiens
uugaagagaaccgcggcuuauu

SEQ ID NO: 154073 - RNA, 22 nt, Homo sapiens
uugaaggaggugcucacucucg

SEQ ID NO: 154074 - RNA, 22 nt, Homo sapiens
uugaagugaagaacaauaucac

SEQ ID NO: 154075 - RNA, 22 nt, Homo sapiens
uugaauaguggugaaaguuuga

SEQ ID NO: 154076 - RNA, 22 nt, Homo sapiens
uugaaugucuauuaaguuguuu

SEQ ID NO: 154077 - RNA, 22 nt, Homo sapiens
uugacaaggagugggguugaga

SEQ ID NO: 154078 - RNA, 22 nt, Homo sapiens
uugacuuagacauucaguugga

SEQ ID NO: 154079 - RNA, 22 nt, Homo sapiens
uugacuuuuaggaggaaaauga

SEQ ID NO: 154080 - RNA, 22 nt, Homo sapiens
uugagaguggcagagguggaac

SEQ ID NO: 154081 - RNA, 22 nt, Homo sapiens
uugagauaucuuggccuuugca

SEQ ID NO: 154082 - RNA, 22 nt, Homo sapiens
uugagauggagccucacucugc

SEQ ID NO: 154083 - RNA, 22 nt, Homo sapiens
uugagauggagucucacucugc

SEQ ID NO: 154084 - RNA, 22 nt, Homo sapiens
uugagauggagucucacucuuc

SEQ ID NO: 154085 - RNA, 22 nt, Homo sapiens
uugagauggagucucacugugu

SEQ ID NO: 154086 - RNA, 22 nt, Homo sapiens
uugagauggagucucgcugugu

SEQ ID NO: 154087 - RNA, 22 nt, Homo sapiens
uugagauggagucuuguucucu

SEQ ID NO: 154088 - RNA, 22 nt, Homo sapiens
uugagauggagucuuguucuuu

SEQ ID NO: 154089 - RNA, 22 nt, Homo sapiens
uugagauggaguuuugcucuug

SEQ ID NO: 154090 - RNA, 22 nt, Homo sapiens
uugagauguauguauauaaugu

SEQ ID NO: 154091 - RNA, 22 nt, Homo sapiens
uugagcacaguagguuguggcu

SEQ ID NO: 154092 - RNA, 22 nt, Homo sapiens
uugagcacugucugugugcagu

SEQ ID NO: 154093 - RNA, 22 nt, Homo sapiens
uugaggaaugucauuuguguuu

SEQ ID NO: 154094 - RNA, 22 nt, Homo sapiens
uugagggcugaauaccaaucag

SEQ ID NO: 154095 - RNA, 22 nt, Homo sapiens
uugaggucuucaggaucaggcu

SEQ ID NO: 154096 - RNA, 22 nt, Homo sapiens
uugaggugaauuugcaggaugc

SEQ ID NO: 154097 - RNA, 22 nt, Homo sapiens
uugagguggugucuugcucugu

SEQ ID NO: 154098 - RNA, 22 nt, Homo sapiens
uugaguagaaguaugucaguau

SEQ ID NO: 154099 - RNA, 22 nt, Homo sapiens
uugaguaguaagugguucaccg

SEQ ID NO: 154100 - RNA, 22 nt, Homo sapiens
uugagugaaggcuguguucuug

SEQ ID NO: 154101 - RNA, 22 nt, Homo sapiens
uugauauucugagaagcugaag

SEQ ID NO: 154102 - RNA, 22 nt, Homo sapiens
uugaucaucagcuuugucaucu

SEQ ID NO: 154103 - RNA, 22 nt, Homo sapiens
uugauuuguagaaugccccaac

SEQ ID NO: 154104 - RNA, 22 nt, Homo sapiens
uugcaacauguauucuggugau

SEQ ID NO: 154105 - RNA, 22 nt, Homo sapiens
uugcacaauccugugagugagu

SEQ ID NO: 154106 - RNA, 22 nt, Homo sapiens
uugcacucugaagaccuacugu

SEQ ID NO: 154107 - RNA, 22 nt, Homo sapiens
uugcacuuccgccugggugaca

SEQ ID NO: 154108 - RNA, 22 nt, Homo sapiens
uugcagagccccugcaaggguc

SEQ ID NO: 154109 - RNA, 22 nt, Homo sapiens
uugcagagucaguuauuuugcc

SEQ ID NO: 154110 - RNA, 22 nt, Homo sapiens
uugcagcauucugguuccuggu

SEQ ID NO: 154111 - RNA, 22 nt, Homo sapiens
uugcauaagugcauucugugau

SEQ ID NO: 154112 - RNA, 22 nt, Homo sapiens
uugccacuucucuugccccauu

SEQ ID NO: 154113 - RNA, 22 nt, Homo sapiens
uugcccuuuagguaacuauaua

SEQ ID NO: 154114 - RNA, 22 nt, Homo sapiens
uugcuccucugccaggaccugu

SEQ ID NO: 154115 - RNA, 20 nt, Homo sapiens
uugcugguguuagaggaggc

SEQ ID NO: 154116 - RNA, 22 nt, Homo sapiens
uugcuucauucaacauugaggg

SEQ ID NO: 154117 - RNA, 22 nt, Homo sapiens
uuuugcaaauuccaguggccau

SEQ ID NO: 154118 - RNA, 20 nt, Homo sapiens
uuuugcacuccuacuaaggu

SEQ ID NO: 154119 - RNA, 22 nt, Homo sapiens
uuuugcacuguuuuaucugaca

SEQ ID NO: 154120 - RNA, 22 nt, Homo sapiens
uuuugcuccuggcaaacucaua

SEQ ID NO: 154121 - RNA, 20 nt, Homo sapiens
uuuuggacuaaaggcauccc

SEQ ID NO: 154122 - RNA, 22 nt, Homo sapiens
uuuuggacuucaauuugacacu

SEQ ID NO: 154123 - RNA, 17 nt, Homo sapiens
uuuuggauuagaaaucc

SEQ ID NO: 154124 - RNA, 22 nt, Homo sapiens
uuuuggcuuaaagagaauguau

SEQ ID NO: 154125 - RNA, 22 nt, Homo sapiens
uuuugguauaugcaggggucuu

SEQ ID NO: 154126 - RNA, 22 nt, Homo sapiens
uuuuggugguuaugugucaaug

SEQ ID NO: 154127 - RNA, 19 nt, Homo sapiens
uuuuguacucugugacuug

SEQ ID NO: 154128 - RNA, 16 nt, Homo sapiens
uuuuugcagaaaugac

SEQ ID NO: 154129 - RNA, 22 nt, Homo sapiens
uuuuuggaggagguuagaucau

SEQ ID NO: 154130 - RNA, 18 nt, Homo sapiens
aaaaagugcucaggccua

SEQ ID NO: 154131 - RNA, 22 nt, Homo sapiens
aaaagugguguuguuucuaaau

SEQ ID NO: 154132 - RNA, 22 nt, Homo sapiens
aaaaguucuuugagccuugaca

SEQ ID NO: 154133 - RNA, 18 nt, Homo sapiens
aaacagugucucuuucug

SEQ ID NO: 154134 - RNA, 22 nt, Homo sapiens
aaaccacagugugcugcugggg

SEQ ID NO: 154135 - RNA, 22 nt, Homo sapiens
aaagcacuggagucaucaucua

SEQ ID NO: 154136 - RNA, 22 nt, Homo sapiens
aaagcuaagguagcauuggaga

SEQ ID NO: 154137 - RNA, 22 nt, Homo sapiens
aaaggcacugugacuuuauagg

SEQ ID NO: 154138 - RNA, 20 nt, Homo sapiens
aaaguaggcuaauaccaaaa

SEQ ID NO: 154139 - RNA, 17 nt, Homo sapiens
aaaguccuuugcuaucu

SEQ ID NO: 154140 - RNA, 22 nt, Homo sapiens
aaagucuguuacagcuauuucu

SEQ ID NO: 154141 - RNA, 22 nt, Homo sapiens
aaagugcaguacuucguauauu

SEQ ID NO: 154142 - RNA, 22 nt, Homo sapiens
aaagugguuuuucagacuuuga

SEQ ID NO: 154143 - RNA, 22 nt, Homo sapiens
aaauaacugucagguucuggaa

SEQ ID NO: 154144 - RNA, 22 nt, Homo sapiens
aaauaguagcugaaugagggaa

SEQ ID NO: 154145 - RNA, 22 nt, Homo sapiens
aaaugcauaucaagauugcccu

SEQ ID NO: 154146 - RNA, 22 nt, Homo sapiens
aaaugcaugaauaagcucgugu

SEQ ID NO: 154147 - RNA, 22 nt, Homo sapiens
aaaugcauggacagcuggucuu

SEQ ID NO: 154148 - RNA, 22 nt, Homo sapiens
aaaugcuucuauguggcauguu

SEQ ID NO: 154149 - RNA, 22 nt, Homo sapiens
aaaugcuuucuuggaccauuug

SEQ ID NO: 154150 - RNA, 22 nt, Homo sapiens
aaauggcuuuuugggcaaggug

SEQ ID NO: 154151 - RNA, 22 nt, Homo sapiens
aaauucauuucagcucugggua

SEQ ID NO: 154152 - RNA, 22 nt, Homo sapiens
aaauugcaguuaggaugauggu

SEQ ID NO: 154153 - RNA, 22 nt, Homo sapiens
aaauugcauugagcugcuuauu

SEQ ID NO: 154154 - RNA, 22 nt, Homo sapiens
aacaccauucucuguaacaaga

SEQ ID NO: 154155 - RNA, 22 nt, Homo sapiens
aacacuaucugccuuacaggga

SEQ ID NO: 154156 - RNA, 22 nt, Homo sapiens
aacacuggcugcucgaguucuc

SEQ ID NO: 154157 - RNA, 22 nt, Homo sapiens
aacaggguguuugcaguuucuu

SEQ ID NO: 154158 - RNA, 22 nt, Homo sapiens
aacauguuuagcagauaccugu

SEQ ID NO: 154159 - RNA, 22 nt, Homo sapiens
aacccugacacaagcagaauuu

SEQ ID NO: 154160 - RNA, 22 nt, Homo sapiens
aacuaugucaaauaaaaugagg

SEQ ID NO: 154161 - RNA, 22 nt, Homo sapiens
aacuggcacuacaucaagagcu

SEQ ID NO: 154162 - RNA, 22 nt, Homo sapiens
aacuggccugagaugaaaagug

SEQ ID NO: 154163 - RNA, 22 nt, Homo sapiens
aacuggccuggcgugcagaggg

SEQ ID NO: 154164 - RNA, 22 nt, Homo sapiens
aagacuguaauccaucuugagu

SEQ ID NO: 154165 - RNA, 22 nt, Homo sapiens
aagaggcuguaggauaaugccu

SEQ ID NO: 154166 - RNA, 22 nt, Homo sapiens
aagagguaggaaauggucauuu

SEQ ID NO: 154167 - RNA, 22 nt, Homo sapiens
aagagguuguaccuaaaguguu

SEQ ID NO: 154168 - RNA, 22 nt, Homo sapiens
aagaguaguaguggcacucucu

SEQ ID NO: 154169 - RNA, 22 nt, Homo sapiens
aagauaguaaacauuuucugcu

SEQ ID NO: 154170 - RNA, 22 nt, Homo sapiens
aagaugcagaagcccagauguu

SEQ ID NO: 154171 - RNA, 22 nt, Homo sapiens
aagaugguauuucauuaguuuu

SEQ ID NO: 154172 - RNA, 22 nt, Homo sapiens
aagcacccagccucacgccugc

SEQ ID NO: 154173 - RNA, 22 nt, Homo sapiens
aagcuacauuuuauuuauguca

SEQ ID NO: 154174 - RNA, 22 nt, Homo sapiens
aagcuggcauucaugagauuac

SEQ ID NO: 154175 - RNA, 22 nt, Homo sapiens
aagcugguguguauuauucacu

SEQ ID NO: 154176 - RNA, 22 nt, Homo sapiens
aagcuguauuguguugcuauaa

SEQ ID NO: 154177 - RNA, 22 nt, Homo sapiens
aagcuguguguaagcucucaca

SEQ ID NO: 154178 - RNA, 22 nt, Homo sapiens
aagcuguugguggaucuaccau

SEQ ID NO: 154179 - RNA, 22 nt, Homo sapiens
aagcuuucaacuguuugccauu

SEQ ID NO: 154180 - RNA, 23 nt, Homo sapiens
aaggacacugaacacuucccagc

SEQ ID NO: 154181 - RNA, 22 nt, Homo sapiens
aaggagcagagagcccuguuuc

SEQ ID NO: 154182 - RNA, 22 nt, Homo sapiens
aaggagcuuaagugacuuguac

SEQ ID NO: 154183 - RNA, 22 nt, Homo sapiens
aaggaguagaauagaugcaccu

SEQ ID NO: 154184 - RNA, 22 nt, Homo sapiens
aaggaguagaggaauagcaaug

SEQ ID NO: 154185 - RNA, 22 nt, Homo sapiens
aaggaguguggugaucuugggc

SEQ ID NO: 154186 - RNA, 22 nt, Homo sapiens
aaggcagugugcacauaacacu

SEQ ID NO: 154187 - RNA, 22 nt, Homo sapiens
aaggcaugcaaagaacauuuua

SEQ ID NO: 154188 - RNA, 22 nt, Homo sapiens
aaggcucuuucaacguaaauua

SEQ ID NO: 154189 - RNA, 22 nt, Homo sapiens
aagguauuucuaugggaauaga

SEQ ID NO: 154190 - RNA, 22 nt, Homo sapiens
aaguaaacauuuuguacaauaa

SEQ ID NO: 154191 - RNA, 22 nt, Homo sapiens
aaguagcuggaugcaguggcac

SEQ ID NO: 154192 - RNA, 18 nt, Homo sapiens
aaguauagagagcccuua

SEQ ID NO: 154193 - RNA, 22 nt, Homo sapiens
aaguaucaggaauaguuauugg

SEQ ID NO: 154194 - RNA, 22 nt, Homo sapiens
aaguauuaagacuaagaggcuu

SEQ ID NO: 154195 - RNA, 22 nt, Homo sapiens
aaguccaugaagucuugugggu

SEQ ID NO: 154196 - RNA, 22 nt, Homo sapiens
caaugguuuuuuaguauaagua

SEQ ID NO: 154197 - RNA, 22 nt, Homo sapiens
cacaaaguagauuagucuucca

SEQ ID NO: 154198 - RNA, 22 nt, Homo sapiens
cacagcuaacaacuguuucuuc

SEQ ID NO: 154199 - RNA, 22 nt, Homo sapiens
gcuuuggauaaaugucaguuua

SEQ ID NO: 154200 - RNA, 18 nt, Homo sapiens
ggaaaacuuuucuaagua

SEQ ID NO: 154201 - RNA, 22 nt, Homo sapiens
ggaagaauaaugggccuuagag

SEQ ID NO: 154202 - RNA, 18 nt, Homo sapiens
ggaagauuggcuaugugc

SEQ ID NO: 154203 - RNA, 18 nt, Homo sapiens
ggaagccuauuuaguaac

SEQ ID NO: 154204 - RNA, 22 nt, Homo sapiens
ggaagccugcacucgggcaggg

SEQ ID NO: 154205 - RNA, 17 nt, Homo sapiens
ggaagccuuugguuuaa

SEQ ID NO: 154206 - RNA, 22 nt, Homo sapiens
ggaagguaauuggcuaaugaga

SEQ ID NO: 154207 - RNA, 22 nt, Homo sapiens
ggaaguauaaacuuaguggagu

SEQ ID NO: 154208 - RNA, 22 nt, Homo sapiens
ggaagugcuguguggaagucug

SEQ ID NO: 154209 - RNA, 22 nt, Homo sapiens
ggaaugagaaauauuacacaau

SEQ ID NO: 154210 - RNA, 22 nt, Homo sapiens
ggacaaaguauuuucaaaugua

SEQ ID NO: 154211 - RNA, 22 nt, Homo sapiens
ggacagaaaggguucaccaaac

SEQ ID NO: 154212 - RNA, 22 nt, Homo sapiens
ggacagugaaugccacuccucc

SEQ ID NO: 154213 - RNA, 22 nt, Homo sapiens
ggacauuaacugcaagauagau

SEQ ID NO: 154214 - RNA, 22 nt, Homo sapiens
ggacuaggagcuaggaagaucu

SEQ ID NO: 154215 - RNA, 22 nt, Homo sapiens
ggacuguacuccuggccagugu

SEQ ID NO: 154216 - RNA, 22 nt, Homo sapiens
ggagaauguaauugguauuuug

SEQ ID NO: 154217 - RNA, 22 nt, Homo sapiens
ggagagcuaggcagagguuugu

SEQ ID NO: 154218 - RNA, 22 nt, Homo sapiens
ggagaucuuuguuaucuuuuga

SEQ ID NO: 154219 - RNA, 22 nt, Homo sapiens
ggagaugaaaugagcuacuuaa

SEQ ID NO: 154220 - RNA, 20 nt, Homo sapiens
ggagguuguauaaguacauc

SEQ ID NO: 154221 - RNA, 22 nt, Homo sapiens
ggagucugaacuggacaaugac

SEQ ID NO: 154222 - RNA, 22 nt, Homo sapiens
ggcaagaaaaugcaauuacugu

SEQ ID NO: 154223 - RNA, 17 nt, Homo sapiens
ggcaagaaguggaacuc

SEQ ID NO: 154224 - RNA, 22 nt, Homo sapiens
ggcaagaggagauucugcuccc

SEQ ID NO: 154225 - RNA, 19 nt, Homo sapiens
ggcaagaguuguucugugu

SEQ ID NO: 154226 - RNA, 22 nt, Homo sapiens
ggcaaggugcuacagacaguga

SEQ ID NO: 154227 - RNA, 22 nt, Homo sapiens
ggcaaguauguuuuaggaugcu

SEQ ID NO: 154228 - RNA, 22 nt, Homo sapiens
ggcaaugaggcggaccagcagg

SEQ ID NO: 154229 - RNA, 22 nt, Homo sapiens
ggcacaguuaagugcuaccuaa

SEQ ID NO: 154230 - RNA, 22 nt, Homo sapiens
ggcaccauggaaggacgggagc

SEQ ID NO: 154231 - RNA, 22 nt, Homo sapiens
ggcacgguggcucacaccugua

SEQ ID NO: 154232 - RNA, 22 nt, Homo sapiens
ggcacuguggcucaagccugua

SEQ ID NO: 154233 - RNA, 22 nt, Homo sapiens
ggcagagucuugcaucuuuaga

SEQ ID NO: 154234 - RNA, 22 nt, Homo sapiens
ggcagaguggacauuuaaaugu

SEQ ID NO: 154235 - RNA, 22 nt, Homo sapiens
ggcagcucaggccccgcgcuga

SEQ ID NO: 154236 - RNA, 22 nt, Homo sapiens
ggcaugaaguagcccacaggca

SEQ ID NO: 154237 - RNA, 22 nt, Homo sapiens
ggcaugaugcgcacgccuguag

SEQ ID NO: 154238 - RNA, 22 nt, Homo sapiens
ggcaugauggcugaggcuucug

SEQ ID NO: 154239 - RNA, 22 nt, Homo sapiens
ggccagaugcgguggcucacac

SEQ ID NO: 154240 - RNA, 22 nt, Homo sapiens
ggcuagaauagggauagaccuu

SEQ ID NO: 154241 - RNA, 22 nt, Homo sapiens
ggcucagugggguccugguucu

SEQ ID NO: 154242 - RNA, 22 nt, Homo sapiens
ggcucaguuuccuccgucugcu

SEQ ID NO: 154243 - RNA, 22 nt, Homo sapiens
gggaagguaaucauuacuugau

SEQ ID NO: 154244 - RNA, 22 nt, Homo sapiens
gggaagugugcagaguucucuu

SEQ ID NO: 154245 - RNA, 22 nt, Homo sapiens
gggaguguguaggacccagugu

SEQ ID NO: 154246 - RNA, 22 nt, Homo sapiens
gggaugauuaugguucacuaca

SEQ ID NO: 154247 - RNA, 22 nt, Homo sapiens
gggauguaaaagugggcacauu

SEQ ID NO: 154248 - RNA, 22 nt, Homo sapiens
gggauguuuuauacugagccug

SEQ ID NO: 154249 - RNA, 22 nt, Homo sapiens
gggcaacauugaguacccugaa

SEQ ID NO: 154250 - RNA, 22 nt, Homo sapiens
ggggucaucagagaaucuaccc

SEQ ID NO: 154251 - RNA, 22 nt, Homo sapiens
ggguucccuucuggcucagggu

SEQ ID NO: 154252 - RNA, 19 nt, Homo sapiens
ggucacagggguuacaagg

SEQ ID NO: 154253 - RNA, 22 nt, Homo sapiens
ggucauggauaagauccagaag

SEQ ID NO: 154254 - RNA, 22 nt, Homo sapiens
ggugacagugguuaaaauuugu

SEQ ID NO: 154255 - RNA, 22 nt, Homo sapiens
ggugauguuugaguugagacag

SEQ ID NO: 154256 - RNA, 22 nt, Homo sapiens
ggugcuugaggaacggaggcug

SEQ ID NO: 154257 - RNA, 20 nt, Homo sapiens
guaaacucucagcauagaug

SEQ ID NO: 154258 - RNA, 16 nt, Homo sapiens
guacacaguaaguaug

SEQ ID NO: 154259 - RNA, 22 nt, Homo sapiens
guacaguucucuuuguugucag

SEQ ID NO: 154260 - RNA, 22 nt, Homo sapiens
guacugagagacaguuacuguu

SEQ ID NO: 154261 - RNA, 22 nt, Homo sapiens
guagaaaguuugcugucacaug

SEQ ID NO: 154262 - RNA, 22 nt, Homo sapiens
guagaauguauguauaacgcaa

SEQ ID NO: 154263 - RNA, 22 nt, Homo sapiens
guagagugcugggcacuggcuc

SEQ ID NO: 154264 - RNA, 22 nt, Homo sapiens
guagcaccagugcucuucucaa

SEQ ID NO: 154265 - RNA, 22 nt, Homo sapiens
guagcagcaauuuacuccauac

SEQ ID NO: 154266 - RNA, 22 nt, Homo sapiens
guagguaaguacuucuggugag

SEQ ID NO: 154267 - RNA, 22 nt, Homo sapiens
guauaguaguacaaaaguuuuu

SEQ ID NO: 154268 - RNA, 22 nt, Homo sapiens
guaucauuggcauguaaccaga

SEQ ID NO: 154269 - RNA, 22 nt, Homo sapiens
guaugucuugucuauggcugcu

SEQ ID NO: 154270 - RNA, 22 nt, Homo sapiens
guauugccacuuuugaacaguu

SEQ ID NO: 154271 - RNA, 22 nt, Homo sapiens
guauuugauuauagcaugcuua

SEQ ID NO: 154272 - RNA, 22 nt, Homo sapiens
guauuuguugcagcagcacuau

SEQ ID NO: 154273 - RNA, 22 nt, Homo sapiens
gucaacauauuaauuauguucu

SEQ ID NO: 154274 - RNA, 22 nt, Homo sapiens
gucaagauuuguaggacagaga

SEQ ID NO: 154275 - RNA, 22 nt, Homo sapiens
gucaaggaauuuauccauuucu

SEQ ID NO: 154276 - RNA, 22 nt, Homo sapiens
gucaagugaagcagugggagua

SEQ ID NO: 154277 - RNA, 20 nt, Homo sapiens
gucacuggcccagggcuugu

SEQ ID NO: 154278 - RNA, 22 nt, Homo sapiens
gucacugugacggcaguuacau

SEQ ID NO: 154279 - RNA, 22 nt, Homo sapiens
gaauggaacugacuauagcuga

SEQ ID NO: 154280 - RNA, 22 nt, Homo sapiens
gacagguuuucuguuucugaaa

SEQ ID NO: 154281 - RNA, 22 nt, Homo sapiens
gacaguguggcgauuccucaag

SEQ ID NO: 154282 - RNA, 21 nt, Homo sapiens
gacauggcgauacuccgucuc

SEQ ID NO: 154283 - RNA, 22 nt, Homo sapiens
gacauguuuucauguauuugga

SEQ ID NO: 154284 - RNA, 22 nt, Homo sapiens
gacuauguuaccuuacacauca

SEQ ID NO: 154285 - RNA, 20 nt, Homo sapiens
gacuucagaagcuucagagu

SEQ ID NO: 154286 - RNA, 20 nt, Homo sapiens
gacuugagagugggagagua

SEQ ID NO: 154287 - RNA, 22 nt, Homo sapiens
gacuuugguagaggaaaaaucu

SEQ ID NO: 154288 - RNA, 22 nt, Homo sapiens
gagaaugaacagacugccucuu

SEQ ID NO: 154289 - RNA, 22 nt, Homo sapiens
gagacggagucucgcucugucg

SEQ ID NO: 154290 - RNA, 22 nt, Homo sapiens
gagacggagucuugcucuguug

SEQ ID NO: 154291 - RNA, 22 nt, Homo sapiens
gagacuaaagagcuugcccugg

SEQ ID NO: 154292 - RNA, 22 nt, Homo sapiens
gagacugagucucgcucugccg

SEQ ID NO: 154293 - RNA, 21 nt, Homo sapiens
gagauagguaccgaagcuuag

SEQ ID NO: 154294 - RNA, 22 nt, Homo sapiens
gagauauuuagaaauguguucu

SEQ ID NO: 154295 - RNA, 22 nt, Homo sapiens
gagaucuauuccucacccuucu

SEQ ID NO: 154296 - RNA, 22 nt, Homo sapiens
gagaucuuggccaaguuucuua

SEQ ID NO: 154297 - RNA, 22 nt, Homo sapiens
gagauggaguuucacuucgcuc

SEQ ID NO: 154298 - RNA, 22 nt, Homo sapiens
gagauuuucagcuugacuggga

SEQ ID NO: 154299 - RNA, 22 nt, Homo sapiens
gagcaaaaguauguauugguua

SEQ ID NO: 154300 - RNA, 22 nt, Homo sapiens
gagcaguugagagugcuggcca

SEQ ID NO: 154301 - RNA, 22 nt, Homo sapiens
gagccuguaggaggagaggugg

SEQ ID NO: 154302 - RNA, 22 nt, Homo sapiens
gagcuacacugauucauuuguu

SEQ ID NO: 154303 - RNA, 22 nt, Homo sapiens
gagcucaccuuaccucuggagc

SEQ ID NO: 154304 - RNA, 22 nt, Homo sapiens
gaggagucagacugugcaaggu

SEQ ID NO: 154305 - RNA, 22 nt, Homo sapiens
gaggcaguguguccguucucgg

SEQ ID NO: 154306 - RNA, 22 nt, Homo sapiens
gagguaagagaauaaacaguuu

SEQ ID NO: 154307 - RNA, 22 nt, Homo sapiens
gagguaaguggauuaugagguc

SEQ ID NO: 154308 - RNA, 22 nt, Homo sapiens
gaggugauaucucauugugguu

SEQ ID NO: 154309 - RNA, 22 nt, Homo sapiens
gagguguagagauauaccugaa

SEQ ID NO: 154310 - RNA, 22 nt, Homo sapiens
gaguaaaugucaaguacuuagg

SEQ ID NO: 154311 - RNA, 22 nt, Homo sapiens
gaguaaauguccuagcuucuug

SEQ ID NO: 154312 - RNA, 22 nt, Homo sapiens
gagucagugucuugcucuguca

SEQ ID NO: 154313 - RNA, 22 nt, Homo sapiens
gagugcaauggcaagaucuugg

SEQ ID NO: 154314 - RNA, 22 nt, Homo sapiens
gagugcaauggcaccgucucgg

SEQ ID NO: 154315 - RNA, 22 nt, Homo sapiens
gagugcugagcccacuuccuug

SEQ ID NO: 154316 - RNA, 21 nt, Homo sapiens
gaguggcuuuuguuucaccag

SEQ ID NO: 154317 - RNA, 22 nt, Homo sapiens
gaguuacauuguaauugccgag

SEQ ID NO: 154318 - RNA, 22 nt, Homo sapiens
gauaaagauagcaauagggaca

SEQ ID NO: 154319 - RNA, 22 nt, Homo sapiens
gauaaaucuuggcuagucuaag

SEQ ID NO: 154320 - RNA, 22 nt, Homo sapiens
gauaucuuuuguauggugagcu

SEQ ID NO: 154321 - RNA, 22 nt, Homo sapiens
gauauguuucuucaauaccuag

SEQ ID NO: 154322 - RNA, 22 nt, Homo sapiens
gaucagauggcuguuggugugu

SEQ ID NO: 154323 - RNA, 20 nt, Homo sapiens
gaucaguuuggaguaagugc

SEQ ID NO: 154324 - RNA, 22 nt, Homo sapiens
gaucuguuuuccuauuguuugu

SEQ ID NO: 154325 - RNA, 22 nt, Homo sapiens
gaugacagcugacucccuugcu

SEQ ID NO: 154326 - RNA, 22 nt, Homo sapiens
gaugagguaggccugcuuugaa

SEQ ID NO: 154327 - RNA, 22 nt, Homo sapiens
gaugaucucuggugguaaagac

SEQ ID NO: 154328 - RNA, 22 nt, Homo sapiens
gauggauuuuaagugaaugaaa

SEQ ID NO: 154329 - RNA, 22 nt, Homo sapiens
gauggcacuaagccauguagga

SEQ ID NO: 154330 - RNA, 22 nt, Homo sapiens
gauggcagugcagccccuggcu

SEQ ID NO: 154331 - RNA, 22 nt, Homo sapiens
gaugugaaaucauaguuucuag

SEQ ID NO: 154332 - RNA, 22 nt, Homo sapiens
gauguuguuuagccuuugaugu

SEQ ID NO: 154333 - RNA, 22 nt, Homo sapiens
gauuugagagaggguguuuaua

SEQ ID NO: 154334 - RNA, 22 nt, Homo sapiens
gauuugguguucuggcucaaga

SEQ ID NO: 154335 - RNA, 20 nt, Homo sapiens
gcaacauggccagagugaau

SEQ ID NO: 154336 - RNA, 22 nt, Homo sapiens
gcaagagguaucuuauuuuccc

SEQ ID NO: 154337 - RNA, 22 nt, Homo sapiens
gcacagaugaggagaggucuca

SEQ ID NO: 154338 - RNA, 22 nt, Homo sapiens
gcacaggguuacauucuaaggu

SEQ ID NO: 154339 - RNA, 22 nt, Homo sapiens
gcacauuacaaguauuagcuca

SEQ ID NO: 154340 - RNA, 22 nt, Homo sapiens
gcacugagagaagccccaagua

SEQ ID NO: 154341 - RNA, 22 nt, Homo sapiens
gcagcacaugacuguauguaua

SEQ ID NO: 154342 - RNA, 17 nt, Homo sapiens
gcaguacuuaguaagga

SEQ ID NO: 154343 - RNA, 20 nt, Homo sapiens
gcaguacuuuuaguucuaag

SEQ ID NO: 154344 - RNA, 23 nt, Homo sapiens
gcagucauuuggaaaagguugaa

SEQ ID NO: 154345 - RNA, 22 nt, Homo sapiens
gcaguggugugugccagccuag

SEQ ID NO: 154346 - RNA, 22 nt, Homo sapiens
gcauaaagcuaauaagacgaag

SEQ ID NO: 154347 - RNA, 20 nt, Homo sapiens
gcauaugucuuuauggcagc

SEQ ID NO: 154348 - RNA, 17 nt, Homo sapiens
gcauauguugaaccagc

SEQ ID NO: 154349 - RNA, 20 nt, Homo sapiens
gcaugagucuuuauaguaga

SEQ ID NO: 154350 - RNA, 22 nt, Homo sapiens
gcauggauguugauggcugcug

SEQ ID NO: 154351 - RNA, 22 nt, Homo sapiens
gcauugcacuuggcauagacug

SEQ ID NO: 154352 - RNA, 22 nt, Homo sapiens
gccaacauggcgcuccauucuu

SEQ ID NO: 154353 - RNA, 18 nt, Homo sapiens
gccaacauguaaacaggu

SEQ ID NO: 154354 - RNA, 19 nt, Homo sapiens
gccaccuggugcguguucu

SEQ ID NO: 154355 - RNA, 22 nt, Homo sapiens
gccauggaggauuuauagaggc

SEQ ID NO: 154356 - RNA, 22 nt, Homo sapiens
gcccaguagcaguacaucccuu

SEQ ID NO: 154357 - RNA, 22 nt, Homo sapiens
gccccgggugaugcagccguca

SEQ ID NO: 154358 - RNA, 22 nt, Homo sapiens
gcccuguugcccugaauacaua

SEQ ID NO: 154359 - RNA, 22 nt, Homo sapiens
gccuuuggugacaggcaugugu

SEQ ID NO: 154360 - RNA, 22 nt, Homo sapiens
gcuaaggcaggagcauugcuug

SEQ ID NO: 154361 - RNA, 22 nt, Homo sapiens
gcucaugagacaagcaggagua

SEQ ID NO: 154362 - RNA, 22 nt, Homo sapiens
gcucguccccuccugacucugc

SEQ ID NO: 154363 - RNA, 22 nt, Homo sapiens
guuugcauagugcugggagggg

SEQ ID NO: 154364 - RNA, 21 nt, Homo sapiens
uaaaacuguaacuuuguccug

SEQ ID NO: 154365 - RNA, 22 nt, Homo sapiens
uaaacugcuugaaaugguguca

SEQ ID NO: 154366 - RNA, 22 nt, Homo sapiens
uaaacugucuuuggagcuuugc

SEQ ID NO: 154367 - RNA, 22 nt, Homo sapiens
uaaagaugcugggaaggcuagg

SEQ ID NO: 154368 - RNA, 22 nt, Homo sapiens
uaaagcacuuuuuucugcaugg

SEQ ID NO: 154369 - RNA, 17 nt, Homo sapiens
uaaagccagucaaguca

SEQ ID NO: 154370 - RNA, 22 nt, Homo sapiens
uaaagccauugucaaguuugua

SEQ ID NO: 154371 - RNA, 22 nt, Homo sapiens
uaaagccuagaacuuucagccc

SEQ ID NO: 154372 - RNA, 22 nt, Homo sapiens
uaaagcuuagauccaugguggc

SEQ ID NO: 154373 - RNA, 21 nt, Homo sapiens
uaaagcuuagcuauaguggcu

SEQ ID NO: 154374 - RNA, 22 nt, Homo sapiens
uaacacagagcuccuaaucccu

SEQ ID NO: 154375 - RNA, 22 nt, Homo sapiens
uaacagucaagguuugaccagg

SEQ ID NO: 154376 - RNA, 22 nt, Homo sapiens
uaacaguguauuuacuacuucc

SEQ ID NO: 154377 - RNA, 22 nt, Homo sapiens
uaacucugccuagugacauggu

SEQ ID NO: 154378 - RNA, 18 nt, Homo sapiens
uaacuggugugagauggu

SEQ ID NO: 154379 - RNA, 21 nt, Homo sapiens
uaagcuaaacauucaguuaac

SEQ ID NO: 154380 - RNA, 22 nt, Homo sapiens
uaagcuagcauagggguaaauu

SEQ ID NO: 154381 - RNA, 22 nt, Homo sapiens
uaaggaaggcugugugcuuuua

SEQ ID NO: 154382 - RNA, 22 nt, Homo sapiens
uaaggcucuuguuauuuugagg

SEQ ID NO: 154383 - RNA, 22 nt, Homo sapiens
uaaggcuuuuguucagcguggg

SEQ ID NO: 154384 - RNA, 22 nt, Homo sapiens
uaagguauuuacauuucuguuu

SEQ ID NO: 154385 - RNA, 22 nt, Homo sapiens
uaaguaaaugaaagguugauuu

SEQ ID NO: 154386 - RNA, 22 nt, Homo sapiens
uaaguacuuuacagacauuauc

SEQ ID NO: 154387 - RNA, 22 nt, Homo sapiens
uaaguauagguaacagaagcaa

SEQ ID NO: 154388 - RNA, 22 nt, Homo sapiens
uaagugaauauggacaguuagc

SEQ ID NO: 154389 - RNA, 22 nt, Homo sapiens
uaagugaauuucacuacugagu

SEQ ID NO: 154390 - RNA, 22 nt, Homo sapiens
uaagugaauuugacagguaaug

SEQ ID NO: 154391 - RNA, 20 nt, Homo sapiens
uaagugcauaggauauuucu

SEQ ID NO: 154392 - RNA, 22 nt, Homo sapiens
uaagugcuguguuguuaccuaa

SEQ ID NO: 154393 - RNA, 20 nt, Homo sapiens
uaagugcuugagacuucuga

SEQ ID NO: 154394 - RNA, 20 nt, Homo sapiens
uaagugcuugaugaaugaac

SEQ ID NO: 154395 - RNA, 22 nt, Homo sapiens
uaauacuagugaauagcaggau

SEQ ID NO: 154396 - RNA, 22 nt, Homo sapiens
uaauacucuucucauuuuacag

SEQ ID NO: 154397 - RNA, 22 nt, Homo sapiens
uaaugcacucgaaucauggaau

SEQ ID NO: 154398 - RNA, 22 nt, Homo sapiens
uaaugcauacagaagguguuuu

SEQ ID NO: 154399 - RNA, 22 nt, Homo sapiens
uaaugcaucagugguaguucuu

SEQ ID NO: 154400 - RNA, 22 nt, Homo sapiens
uacaaaguaacaguuccuguau

SEQ ID NO: 154401 - RNA, 22 nt, Homo sapiens
uacaagcacaggcagcaggcug

SEQ ID NO: 154402 - RNA, 22 nt, Homo sapiens
uacaauagugacaaaucagcau

SEQ ID NO: 154403 - RNA, 22 nt, Homo sapiens
uacacacguguguauauauaca

SEQ ID NO: 154404 - RNA, 22 nt, Homo sapiens
uacacagucaaaaauuuccagg

SEQ ID NO: 154405 - RNA, 22 nt, Homo sapiens
uacagaauucugucccuugagu

SEQ ID NO: 154406 - RNA, 22 nt, Homo sapiens
uacagaauugcagguguggcag

SEQ ID NO: 154407 - RNA, 22 nt, Homo sapiens
uacaggcaccuggcuaauuuuu

SEQ ID NO: 154408 - RNA, 22 nt, Homo sapiens
uacagguauagauguguguucu

SEQ ID NO: 154409 - RNA, 22 nt, Homo sapiens
uacagguaugugucuauauaca

SEQ ID NO: 154410 - RNA, 22 nt, Homo sapiens
uacaguagagaucagcaaacua

SEQ ID NO: 154411 - RNA, 22 nt, Homo sapiens
uacaguaggauuuucagggucu

SEQ ID NO: 154412 - RNA, 22 nt, Homo sapiens
uacauacuucacagacuuuaaa

SEQ ID NO: 154413 - RNA, 19 nt, Homo sapiens
uacaugcagcaggcacgca

SEQ ID NO: 154414 - RNA, 22 nt, Homo sapiens
uacaugcaugggcaugugugca

SEQ ID NO: 154415 - RNA, 22 nt, Homo sapiens
uacauguauguguuuauggcug

SEQ ID NO: 154416 - RNA, 22 nt, Homo sapiens
uacaugugcaggucuguggggg

SEQ ID NO: 154417 - RNA, 22 nt, Homo sapiens
uacaugugccauguugguuugc

SEQ ID NO: 154418 - RNA, 22 nt, Homo sapiens
uaccaaaguuucggccucuguu

SEQ ID NO: 154419 - RNA, 22 nt, Homo sapiens
uaccaugaagguggagagagaa

SEQ ID NO: 154420 - RNA, 22 nt, Homo sapiens
uaccucaguucaauaacagaua

SEQ ID NO: 154421 - RNA, 22 nt, Homo sapiens
uacuauugcaucggugauuagg

SEQ ID NO: 154422 - RNA, 22 nt, Homo sapiens
uacucaauugcagucaccuggc

SEQ ID NO: 154423 - RNA, 22 nt, Homo sapiens
uacucacauucuguuucuugcu

SEQ ID NO: 154424 - RNA, 22 nt, Homo sapiens
uacugcacuggaggccucagau

SEQ ID NO: 154425 - RNA, 22 nt, Homo sapiens
uagaagcacuaucccuccuagu

SEQ ID NO: 154426 - RNA, 23 nt, Homo sapiens
uagaauguuuuuccauguuucuu

SEQ ID NO: 154427 - RNA, 22 nt, Homo sapiens
uagacuguaagauccaggagag

SEQ ID NO: 154428 - RNA, 20 nt, Homo sapiens
uagagagauauggggguucc

SEQ ID NO: 154429 - RNA, 21 nt, Homo sapiens
uagagagcaauaccuccagag

SEQ ID NO: 154430 - RNA, 22 nt, Homo sapiens
uagaggaaggauuggaaacgca

SEQ ID NO: 154431 - RNA, 22 nt, Homo sapiens
uagaguaguggcgugaucucgg

SEQ ID NO: 154432 - RNA, 22 nt, Homo sapiens
uagauuauuccuuugaauggcc

SEQ ID NO: 154433 - RNA, 22 nt, Homo sapiens
uagcaaaucaauggaauugaag

SEQ ID NO: 154434 - RNA, 22 nt, Homo sapiens
uagcacaucccuaaaaugcugu

SEQ ID NO: 154435 - RNA, 22 nt, Homo sapiens
uagcaccaaacauauacucagu

SEQ ID NO: 154436 - RNA, 22 nt, Homo sapiens
uagcaccaggguugacugaccu

SEQ ID NO: 154437 - RNA, 22 nt, Homo sapiens
uagcagacuauuuugugauaau

SEQ ID NO: 154438 - RNA, 22 nt, Homo sapiens
uagcagcaccccacucuacugg

SEQ ID NO: 154439 - RNA, 22 nt, Homo sapiens
uagcaggaaaccuguguugagg

SEQ ID NO: 154440 - RNA, 20 nt, Homo sapiens
uagcaggugucaggugauau

SEQ ID NO: 154441 - RNA, 22 nt, Homo sapiens
uagcagguguuccacaaauauu

SEQ ID NO: 154442 - RNA, 22 nt, Homo sapiens
uagcuaguauuuugcugaggau

SEQ ID NO: 154443 - RNA, 22 nt, Homo sapiens
uagcuccagugggguuacugcu

SEQ ID NO: 154444 - RNA, 22 nt, Homo sapiens
uagcuggaguuuuuguuauagg

SEQ ID NO: 154445 - RNA, 22 nt, Homo sapiens
uagcuucuccauagcuccaugu

SEQ ID NO: 154446 - RNA, 22 nt, Homo sapiens
uaggaaugaacgauuuauuggu

SEQ ID NO: 154447 - RNA, 22 nt, Homo sapiens
uaggacacagaccuggauggaa

SEQ ID NO: 154448 - RNA, 20 nt, Homo sapiens
uaggagcaaugagaguagaa

SEQ ID NO: 154449 - RNA, 22 nt, Homo sapiens
uaggcaguggagaaauaaacag

SEQ ID NO: 154450 - RNA, 22 nt, Homo sapiens
uaggcuuuucugggaugugggc

SEQ ID NO: 154451 - RNA, 22 nt, Homo sapiens
uagguaguuuucccguauccaa

SEQ ID NO: 154452 - RNA, 22 nt, Homo sapiens
uagguucucaggaaugagcuuc

SEQ ID NO: 154453 - RNA, 22 nt, Homo sapiens
uaguauguuuauagcauugagu

SEQ ID NO: 154454 - RNA, 22 nt, Homo sapiens
uagucacacacucaacuuuuca

SEQ ID NO: 154455 - RNA, 22 nt, Homo sapiens
uagugcugugauauuuuuggcc

SEQ ID NO: 154456 - RNA, 20 nt, Homo sapiens
uaguggcaugcaccuguagc

SEQ ID NO: 154457 - RNA, 22 nt, Homo sapiens
uauagcacugcaauauuucccu

SEQ ID NO: 154458 - RNA, 22 nt, Homo sapiens
uauagcagccugaacaaaguaa

SEQ ID NO: 154459 - RNA, 22 nt, Homo sapiens
uauagcagugugagaacagacu

SEQ ID NO: 154460 - RNA, 22 nt, Homo sapiens
uauagcuaugggauguauuugc

SEQ ID NO: 154461 - RNA, 22 nt, Homo sapiens
uauagcuugaaggaauggucau

SEQ ID NO: 154462 - RNA, 22 nt, Homo sapiens
uauagcuugauuauggugaugg

SEQ ID NO: 154463 - RNA, 22 nt, Homo sapiens
uauauguucugugucccuuucg

SEQ ID NO: 154464 - RNA, 22 nt, Homo sapiens
uauauguuuucauaaggcuaga

SEQ ID NO: 154465 - RNA, 22 nt, Homo sapiens
uaucacagcauugucuauaaua

SEQ ID NO: 154466 - RNA, 21 nt, Homo sapiens
uaucacaguagaauaggaucu

SEQ ID NO: 154467 - RNA, 22 nt, Homo sapiens
uaucacagugcuggaguauucc

SEQ ID NO: 154468 - RNA, 22 nt, Homo sapiens
uaucagcagcaggggcugcaga

SEQ ID NO: 154469 - RNA, 22 nt, Homo sapiens
uaucaucauguuuuugcugugu

SEQ ID NO: 154470 - RNA, 22 nt, Homo sapiens
uaucccaauguaauaucacaaa

SEQ ID NO: 154471 - RNA, 22 nt, Homo sapiens
uaugaauuuuauccaggauaua

SEQ ID NO: 154472 - RNA, 20 nt, Homo sapiens
uaugacaaagccuagugagu

SEQ ID NO: 154473 - RNA, 22 nt, Homo sapiens
uaugaccuuguccccucucgcc

SEQ ID NO: 154474 - RNA, 22 nt, Homo sapiens
uaugagacugguuaauuuuugu

SEQ ID NO: 154475 - RNA, 19 nt, Homo sapiens
uaugagcuaugacaugcau

SEQ ID NO: 154476 - RNA, 22 nt, Homo sapiens
uaugagguagguaugacuauca

SEQ ID NO: 154477 - RNA, 22 nt, Homo sapiens
uaugaugcugagguuuggagug

SEQ ID NO: 154478 - RNA, 22 nt, Homo sapiens
uaugaugcuguuuagaaucucu

SEQ ID NO: 154479 - RNA, 22 nt, Homo sapiens
uaugcacacguguccaugugca

SEQ ID NO: 154480 - RNA, 22 nt, Homo sapiens
uauggcauuauuuugauagaca

SEQ ID NO: 154481 - RNA, 22 nt, Homo sapiens
uauggcuuucuacuugaguucu

SEQ ID NO: 154482 - RNA, 22 nt, Homo sapiens
uauggcuuuguucaacagccuc

SEQ ID NO: 154483 - RNA, 22 nt, Homo sapiens
uauggcuuuuauuauguuguag

SEQ ID NO: 154484 - RNA, 22 nt, Homo sapiens
uauggguuuauuucuggucuca

SEQ ID NO: 154485 - RNA, 22 nt, Homo sapiens
uaugugcacaugcccuggugac

SEQ ID NO: 154486 - RNA, 22 nt, Homo sapiens
uauuacagaccauaucgccggg

SEQ ID NO: 154487 - RNA, 22 nt, Homo sapiens
uauuacugucaauaucacagaa

SEQ ID NO: 154488 - RNA, 22 nt, Homo sapiens
uauuccacuggcacugcauuug

SEQ ID NO: 154489 - RNA, 22 nt, Homo sapiens
uauuccagcccuggugagccag

SEQ ID NO: 154490 - RNA, 22 nt, Homo sapiens
uauugaacgugggauauugaag

SEQ ID NO: 154491 - RNA, 22 nt, Homo sapiens
uauugcagauacccaggaaguu

SEQ ID NO: 154492 - RNA, 22 nt, Homo sapiens
uauugcuaacaucccuuaugua

SEQ ID NO: 154493 - RNA, 22 nt, Homo sapiens
uauugcugaaaaugcuaaugau

SEQ ID NO: 154494 - RNA, 22 nt, Homo sapiens
uauugcuggauguauuacaugu

SEQ ID NO: 154495 - RNA, 22 nt, Homo sapiens
uauugucaccaucccuguuuua

SEQ ID NO: 154496 - RNA, 22 nt, Homo sapiens
uauugugcauguugaauaacua

SEQ ID NO: 154497 - RNA, 22 nt, Homo sapiens
uauuguuaaagauguuaaugau

SEQ ID NO: 154498 - RNA, 22 nt, Homo sapiens
uauuugguuauaugaguaaguu

SEQ ID NO: 154499 - RNA, 22 nt, Homo sapiens
ucaaaaucucuuagcugugucu

SEQ ID NO: 154500 - RNA, 22 nt, Homo sapiens
ucaaagugagcuccuucucacu

SEQ ID NO: 154501 - RNA, 22 nt, Homo sapiens
ucaaaucaucuuuuccaaagcu

SEQ ID NO: 154502 - RNA, 22 nt, Homo sapiens
ucaaaugauucacccaccuuug

SEQ ID NO: 154503 - RNA, 17 nt, Homo sapiens
ucaaaugcucccaguga

SEQ ID NO: 154504 - RNA, 22 nt, Homo sapiens
ucaaauguuuguuuaaggcuua

SEQ ID NO: 154505 - RNA, 22 nt, Homo sapiens
ucaaauuccaagucuagguagg

SEQ ID NO: 154506 - RNA, 19 nt, Homo sapiens
ucaagcuauucuccugccu

SEQ ID NO: 154507 - RNA, 22 nt, Homo sapiens
ucaaggcacauuugacauuuuc

SEQ ID NO: 154508 - RNA, 20 nt, Homo sapiens
ucaaggcacgaauaaaaguu

SEQ ID NO: 154509 - RNA, 22 nt, Homo sapiens
ucaaggcaguggccuuccuucu

SEQ ID NO: 154510 - RNA, 22 nt, Homo sapiens
ucaaguacuuauuugauaauua

SEQ ID NO: 154511 - RNA, 22 nt, Homo sapiens
ucaaguacuuugcauagugccg

SEQ ID NO: 154512 - RNA, 22 nt, Homo sapiens
ucaaugaaugaugguugguaug

SEQ ID NO: 154513 - RNA, 22 nt, Homo sapiens
ucaauguaucuccaagaauuga

SEQ ID NO: 154514 - RNA, 21 nt, Homo sapiens
ucacaaugaacagcagcagaa

SEQ ID NO: 154515 - RNA, 22 nt, Homo sapiens
ucacaauggagacucgggcgga

SEQ ID NO: 154516 - RNA, 22 nt, Homo sapiens
ucacaauucacuacaggcuuga

SEQ ID NO: 154517 - RNA, 23 nt, Homo sapiens
ucacacuuaagagaaaugcagcu

SEQ ID NO: 154518 - RNA, 22 nt, Homo sapiens
ucacagacugagccaaauagag

SEQ ID NO: 154519 - RNA, 22 nt, Homo sapiens
ucacagaggagaagaccuuuaa

SEQ ID NO: 154520 - RNA, 21 nt, Homo sapiens
ucacagccuaggaccugaaga

SEQ ID NO: 154521 - RNA, 22 nt, Homo sapiens
ucacagccuaguuuuauacauu

SEQ ID NO: 154522 - RNA, 18 nt, Homo sapiens
ucacagguaaaguugaca

SEQ ID NO: 154523 - RNA, 18 nt, Homo sapiens
ucacagguaauuaggauu

SEQ ID NO: 154524 - RNA, 22 nt, Homo sapiens
ucacaguaaauccagaagaaau

SEQ ID NO: 154525 - RNA, 22 nt, Homo sapiens
ucacaguagagcuucuuucaga

SEQ ID NO: 154526 - RNA, 22 nt, Homo sapiens
ucacaguauucaugaacaugga

SEQ ID NO: 154527 - RNA, 22 nt, Homo sapiens
ucucuugguugaacaguuugga

SEQ ID NO: 154528 - RNA, 22 nt, Homo sapiens
ucugacagugugaauauugacu

SEQ ID NO: 154529 - RNA, 22 nt, Homo sapiens
ucugagcaugcaucuugccugg

SEQ ID NO: 154530 - RNA, 22 nt, Homo sapiens
ucugcaagucuaaacuagccau

SEQ ID NO: 154531 - RNA, 22 nt, Homo sapiens
ucugccacugucauugugugau

SEQ ID NO: 154532 - RNA, 22 nt, Homo sapiens
ucuggcaagauauccauugcuu

SEQ ID NO: 154533 - RNA, 22 nt, Homo sapiens
ucuggcauuuucucugcuugca

SEQ ID NO: 154534 - RNA, 20 nt, Homo sapiens
ucuggccccuccaaaucuca

SEQ ID NO: 154535 - RNA, 22 nt, Homo sapiens
ucuggccccucucaaaucucau

SEQ ID NO: 154536 - RNA, 15 nt, Homo sapiens
ucuggcucugucacu

SEQ ID NO: 154537 - RNA, 22 nt, Homo sapiens
ucuggguuuuguaccgugcucg

SEQ ID NO: 154538 - RNA, 22 nt, Homo sapiens
ucuggguuuuuccauugccggu

SEQ ID NO: 154539 - RNA, 22 nt, Homo sapiens
ucugguggugaugagagacagu

SEQ ID NO: 154540 - RNA, 23 nt, Homo sapiens
ucugguguugucaaaugcugguu

SEQ ID NO: 154541 - RNA, 22 nt, Homo sapiens
ucugucuuugucaggaccagag

SEQ ID NO: 154542 - RNA, 22 nt, Homo sapiens
ucugugaaugaacacuugaaaa

SEQ ID NO: 154543 - RNA, 22 nt, Homo sapiens
ucugugcauuuucuuuuagacu

SEQ ID NO: 154544 - RNA, 22 nt, Homo sapiens
ucuguggucagaguccuuggcc

SEQ ID NO: 154545 - RNA, 22 nt, Homo sapiens
ucuuagugcggcugcugcagcc

SEQ ID NO: 154546 - RNA, 22 nt, Homo sapiens
ucuugguuaggggaaauaggca

SEQ ID NO: 154547 - RNA, 23 nt, Homo sapiens
ucuugguuauagaaaaauaguug

SEQ ID NO: 154548 - RNA, 22 nt, Homo sapiens
ucuuuagugacaguugugcaag

SEQ ID NO: 154549 - RNA, 22 nt, Homo sapiens
ucuuugaguuauugugcagacu

SEQ ID NO: 154550 - RNA, 22 nt, Homo sapiens
ucuuugccuaacccaaggucau

SEQ ID NO: 154551 - RNA, 19 nt, Homo sapiens
ucuuugcuuuucuaagagg

SEQ ID NO: 154552 - RNA, 22 nt, Homo sapiens
ucuuuggucuacuuucauaugu

SEQ ID NO: 154553 - RNA, 22 nt, Homo sapiens
ucuuugguuguuuagggugcau

SEQ ID NO: 154554 - RNA, 22 nt, Homo sapiens
ucuuuguguaggucaaucuggc

SEQ ID NO: 154555 - RNA, 22 nt, Homo sapiens
ugaaagacugaaagcuuuucuu

SEQ ID NO: 154556 - RNA, 22 nt, Homo sapiens
ugaaauacuuaauuucuccaug

SEQ ID NO: 154557 - RNA, 22 nt, Homo sapiens
ugaaauaguuaaguugccuagu

SEQ ID NO: 154558 - RNA, 22 nt, Homo sapiens
ugaaaucuaaaauguuccaaga

SEQ ID NO: 154559 - RNA, 22 nt, Homo sapiens
ugaaaugcugucuaggggaaau

SEQ ID NO: 154560 - RNA, 22 nt, Homo sapiens
ugaaauggaaagaguguagacu

SEQ ID NO: 154561 - RNA, 22 nt, Homo sapiens
ugaaauuauucuuaccaaggug

SEQ ID NO: 154562 - RNA, 22 nt, Homo sapiens
ugaacacaucuccugguaccug

SEQ ID NO: 154563 - RNA, 22 nt, Homo sapiens
ugaacagcaccuccuagaguug

SEQ ID NO: 154564 - RNA, 22 nt, Homo sapiens
ugaacugagacuagacuuguuc

SEQ ID NO: 154565 - RNA, 22 nt, Homo sapiens
ugaagacucaauuauuaugaac

SEQ ID NO: 154566 - RNA, 22 nt, Homo sapiens
ugaaggcaggagggagaaaagu

SEQ ID NO: 154567 - RNA, 21 nt, Homo sapiens
ugaaguguaaccgugcagggc

SEQ ID NO: 154568 - RNA, 22 nt, Homo sapiens
ugaauagaaguggcaggaguag

SEQ ID NO: 154569 - RNA, 22 nt, Homo sapiens
ugaauagaaguuuacuccuuuu

SEQ ID NO: 154570 - RNA, 22 nt, Homo sapiens
ugaaugcuaaaggaaaacagua

SEQ ID NO: 154571 - RNA, 22 nt, Homo sapiens
ugaaugguuuuuagagaacaau

SEQ ID NO: 154572 - RNA, 22 nt, Homo sapiens
ugaauguccauugauguuuuga

SEQ ID NO: 154573 - RNA, 22 nt, Homo sapiens
ugaauguuugcuuacuuccaua

SEQ ID NO: 154574 - RNA, 22 nt, Homo sapiens
ugacacuugcccuuagaaacau

SEQ ID NO: 154575 - RNA, 22 nt, Homo sapiens
ugacaguaaacagucuugauua

SEQ ID NO: 154576 - RNA, 22 nt, Homo sapiens
ugacagucaccaggacccacag

SEQ ID NO: 154577 - RNA, 22 nt, Homo sapiens
ugacaucugcuugugcccagga

SEQ ID NO: 154578 - RNA, 22 nt, Homo sapiens
ugacaugaaggcaccucugucc

SEQ ID NO: 154579 - RNA, 22 nt, Homo sapiens
ugacauggagggugcggcugca

SEQ ID NO: 154580 - RNA, 22 nt, Homo sapiens
ugacauggugcucuuucaggca

SEQ ID NO: 154581 - RNA, 22 nt, Homo sapiens
ugaccaaugacauugaagagcu

SEQ ID NO: 154582 - RNA, 22 nt, Homo sapiens
ugaccacagaaagugagggagc

SEQ ID NO: 154583 - RNA, 22 nt, Homo sapiens
ugacccuguggcagcgucuaag

SEQ ID NO: 154584 - RNA, 22 nt, Homo sapiens
ugacuaggaggcuggaggauga

SEQ ID NO: 154585 - RNA, 22 nt, Homo sapiens
ugacuagggacauucuuccacg

SEQ ID NO: 154586 - RNA, 22 nt, Homo sapiens
ugacucaguuucucagguagua

SEQ ID NO: 154587 - RNA, 23 nt, Homo sapiens
ugacugaguauauguuuggugcu

SEQ ID NO: 154588 - RNA, 22 nt, Homo sapiens
ugacuucauuuuuggccaugag

SEQ ID NO: 154589 - RNA, 22 nt, Homo sapiens
ugacuugaucauuacacauucu

SEQ ID NO: 154590 - RNA, 20 nt, Homo sapiens
ugagaacaugugguauuugg

SEQ ID NO: 154591 - RNA, 22 nt, Homo sapiens
ugagaacuaaaaugugguauau

SEQ ID NO: 154592 - RNA, 22 nt, Homo sapiens
ugagaacuaaugaagaauuuau

SEQ ID NO: 154593 - RNA, 22 nt, Homo sapiens
ugagaacucaugggucugcugg

SEQ ID NO: 154594 - RNA, 22 nt, Homo sapiens
ugagaacuuugucuuuuacucu

SEQ ID NO: 154595 - RNA, 22 nt, Homo sapiens
ugagaagugacgcagcaggguu

SEQ ID NO: 154596 - RNA, 22 nt, Homo sapiens
ugagaaugacugggcaugcugc

SEQ ID NO: 154597 - RNA, 19 nt, Homo sapiens
ugagaauguuaccaggucc

SEQ ID NO: 154598 - RNA, 22 nt, Homo sapiens
ugagacaugugaacuguaguuc

SEQ ID NO: 154599 - RNA, 22 nt, Homo sapiens
ugagacgaagucucguucugua

SEQ ID NO: 154600 - RNA, 22 nt, Homo sapiens
ugagacggagucucgcucucua

SEQ ID NO: 154601 - RNA, 22 nt, Homo sapiens
ugagacggagucucgcuguguc

SEQ ID NO: 154602 - RNA, 22 nt, Homo sapiens
ugagacggaguuauuuauaaua

SEQ ID NO: 154603 - RNA, 22 nt, Homo sapiens
ugagacugagucucgcucuugu

SEQ ID NO: 154604 - RNA, 22 nt, Homo sapiens
ugagacugagucuugcucuugu

SEQ ID NO: 154605 - RNA, 22 nt, Homo sapiens
ugagagacagacauuaucuuau

SEQ ID NO: 154606 - RNA, 20 nt, Homo sapiens
ugagauaguaauccccuaca

SEQ ID NO: 154607 - RNA, 22 nt, Homo sapiens
ugagauauugggaguaauguca

SEQ ID NO: 154608 - RNA, 22 nt, Homo sapiens
ugagaucaacugagucagagca

SEQ ID NO: 154609 - RNA, 22 nt, Homo sapiens
ugagaucacuaagagguaaugg

SEQ ID NO: 154610 - RNA, 18 nt, Homo sapiens
ugagaucagcaucaaggg

SEQ ID NO: 154611 - RNA, 23 nt, Homo sapiens
ugagaucuacagaucucagaucu

SEQ ID NO: 154612 - RNA, 22 nt, Homo sapiens
ugagaucuuggaggcuuuguga

SEQ ID NO: 154613 - RNA, 19 nt, Homo sapiens
ugagaucuuuacuggguuu

SEQ ID NO: 154614 - RNA, 22 nt, Homo sapiens
ugagaugaagucucacucuguc

SEQ ID NO: 154615 - RNA, 22 nt, Homo sapiens
ugagaugagaaucaguucuaau

SEQ ID NO: 154616 - RNA, 22 nt, Homo sapiens
ugagaugaggucucacucuguu

SEQ ID NO: 154617 - RNA, 22 nt, Homo sapiens
ggagugugauucaguauaauau

SEQ ID NO: 154618 - RNA, 22 nt, Homo sapiens
ggagugugauuguucucuguua

SEQ ID NO: 154619 - RNA, 22 nt, Homo sapiens
ggaguguguaggagaaagguaa

SEQ ID NO: 154620 - RNA, 22 nt, Homo sapiens
ggaguguuccauuugucacauu

SEQ ID NO: 154621 - RNA, 22 nt, Homo sapiens
ggaucauaugauagcucaauuu

SEQ ID NO: 154622 - RNA, 22 nt, Homo sapiens
ggauugugauaauuguugcaaa

SEQ ID NO: 154623 - RNA, 22 nt, Homo sapiens
ggcaacaugccgaaaccacguc

SEQ ID NO: 154624 - RNA, 21 nt, Homo sapiens
ggcaagaaacacaaucaagua

SEQ ID NO: 154625 - RNA, 21 nt, Homo sapiens
ggcaagagaauacaacauaaa

SEQ ID NO: 154626 - RNA, 22 nt, Homo sapiens
ggcaaggaggggcacuuucacu

SEQ ID NO: 154627 - RNA, 22 nt, Homo sapiens
ggcaaggauuagauucuccccu

SEQ ID NO: 154628 - RNA, 22 nt, Homo sapiens
ggcaccacagacgccaggcgug

SEQ ID NO: 154629 - RNA, 22 nt, Homo sapiens
ggcacgguggcucacgccugua

SEQ ID NO: 154630 - RNA, 19 nt, Homo sapiens
ggcacugugugagugagga

SEQ ID NO: 154631 - RNA, 22 nt, Homo sapiens
ggcagaucauuggccucaguuu

SEQ ID NO: 154632 - RNA, 22 nt, Homo sapiens
ggcagcaugggugccuuuguga

SEQ ID NO: 154633 - RNA, 22 nt, Homo sapiens
ggcagcuguguccuucguaagg

SEQ ID NO: 154634 - RNA, 22 nt, Homo sapiens
ggcagguaaggagugggagccu

SEQ ID NO: 154635 - RNA, 22 nt, Homo sapiens
ggcaguggaagugccaguuucu

SEQ ID NO: 154636 - RNA, 22 nt, Homo sapiens
ggcccaguugcgggugguaccg

SEQ ID NO: 154637 - RNA, 19 nt, Homo sapiens
ggcucagucaacugacugu

SEQ ID NO: 154638 - RNA, 22 nt, Homo sapiens
ggcucagugaucuguuucugua

SEQ ID NO: 154639 - RNA, 22 nt, Homo sapiens
ggcucguguuuucuguccaguu

SEQ ID NO: 154640 - RNA, 21 nt, Homo sapiens
ggcucuguggucucagguuuc

SEQ ID NO: 154641 - RNA, 22 nt, Homo sapiens
gggaacaugagaaugugaauga

SEQ ID NO: 154642 - RNA, 22 nt, Homo sapiens
gggaauggaagacauuaugaug

SEQ ID NO: 154643 - RNA, 19 nt, Homo sapiens
gggaggaugcgucuucagg

SEQ ID NO: 154644 - RNA, 22 nt, Homo sapiens
gggagugucuaaccuguuaaca

SEQ ID NO: 154645 - RNA, 22 nt, Homo sapiens
gggauauguagauuuuuaucuu

SEQ ID NO: 154646 - RNA, 16 nt, Homo sapiens
gggcaugugaagccua

SEQ ID NO: 154647 - RNA, 22 nt, Homo sapiens
gggcauguggacuuguauguuu

SEQ ID NO: 154648 - RNA, 22 nt, Homo sapiens
gggcaugugugugcacacacau

SEQ ID NO: 154649 - RNA, 22 nt, Homo sapiens
ggggaauguuaaagaauuugca

SEQ ID NO: 154650 - RNA, 15 nt, Homo sapiens
ggguccucucccaaa

SEQ ID NO: 154651 - RNA, 22 nt, Homo sapiens
gguaggcacuggugggaagaga

SEQ ID NO: 154652 - RNA, 19 nt, Homo sapiens
ggucagcaaagucuagcug

SEQ ID NO: 154653 - RNA, 22 nt, Homo sapiens
ggugagaaaaacauagucucag

SEQ ID NO: 154654 - RNA, 22 nt, Homo sapiens
ggugagaaagggauuccuguuc

SEQ ID NO: 154655 - RNA, 22 nt, Homo sapiens
ggugaggaaaguugaguuucua

SEQ ID NO: 154656 - RNA, 23 nt, Homo sapiens
ggugaggaguacagagucuucau

SEQ ID NO: 154657 - RNA, 22 nt, Homo sapiens
ggugaguggugcuuaaguucag

SEQ ID NO: 154658 - RNA, 22 nt, Homo sapiens
ggugaucauugucucuaguaug

SEQ ID NO: 154659 - RNA, 22 nt, Homo sapiens
ugagaugaguugcgcucugucg

SEQ ID NO: 154660 - RNA, 22 nt, Homo sapiens
ugagaugauuuaauggagccca

SEQ ID NO: 154661 - RNA, 22 nt, Homo sapiens
ugagaugcuuguaaauucauuu

SEQ ID NO: 154662 - RNA, 22 nt, Homo sapiens
ugagauggagucuugucgccua

SEQ ID NO: 154663 - RNA, 22 nt, Homo sapiens
ugagauggaguuucacuuuugu

SEQ ID NO: 154664 - RNA, 22 nt, Homo sapiens
ugagauggaguuucgcccuugu

SEQ ID NO: 154665 - RNA, 22 nt, Homo sapiens
ugagauggguaauuaaauggug

SEQ ID NO: 154666 - RNA, 22 nt, Homo sapiens
ugagauguuccaaugacuauua

SEQ ID NO: 154667 - RNA, 22 nt, Homo sapiens
ugagcaaaauuuuggacauaga

SEQ ID NO: 154668 - RNA, 22 nt, Homo sapiens
ugagcacagagccugggguggc

SEQ ID NO: 154669 - RNA, 22 nt, Homo sapiens
ugagcacauuuacaucaguucc

SEQ ID NO: 154670 - RNA, 22 nt, Homo sapiens
ugagcgaugggaggaagugaua

SEQ ID NO: 154671 - RNA, 22 nt, Homo sapiens
ugagcuacuacacccagcuugg

SEQ ID NO: 154672 - RNA, 22 nt, Homo sapiens
ugagcuaggauccugucacugu

SEQ ID NO: 154673 - RNA, 17 nt, Homo sapiens
ugagcuaugauccuguc

SEQ ID NO: 154674 - RNA, 20 nt, Homo sapiens
ugagcucaauuguugcaagu

SEQ ID NO: 154675 - RNA, 22 nt, Homo sapiens
ugagcugagaaaugcagcagcu

SEQ ID NO: 154676 - RNA, 22 nt, Homo sapiens
ugagcugagaucacacuacugu

SEQ ID NO: 154677 - RNA, 22 nt, Homo sapiens
ugagcugagauuaagcugcugc

SEQ ID NO: 154678 - RNA, 18 nt, Homo sapiens
ugaggaaaggguuugcua

SEQ ID NO: 154679 - RNA, 22 nt, Homo sapiens
ugaggcacucccuagcggggug

SEQ ID NO: 154680 - RNA, 22 nt, Homo sapiens
ugagguaaaacaaggauuggau

SEQ ID NO: 154681 - RNA, 22 nt, Homo sapiens
ugagguaaugcuguagcuguga

SEQ ID NO: 154682 - RNA, 22 nt, Homo sapiens
ugagguguauugggggaaauuc

SEQ ID NO: 154683 - RNA, 22 nt, Homo sapiens
ugagguguuugugcaccaucug

SEQ ID NO: 154684 - RNA, 22 nt, Homo sapiens
ugaguacugauuuaagauacac

SEQ ID NO: 154685 - RNA, 22 nt, Homo sapiens
ugaguaggauugguauuucuuc

SEQ ID NO: 154686 - RNA, 23 nt, Homo sapiens
ugaguaggcaguuuuccccucac

SEQ ID NO: 154687 - RNA, 23 nt, Homo sapiens
ugaguaggugguuuuccccucac

SEQ ID NO: 154688 - RNA, 22 nt, Homo sapiens
ugaguaguauucuaugguaugu

SEQ ID NO: 154689 - RNA, 22 nt, Homo sapiens
ugaguagugcugcaauaaacau

SEQ ID NO: 154690 - RNA, 22 nt, Homo sapiens
ugaguauguuuagaaguaaagg

SEQ ID NO: 154691 - RNA, 22 nt, Homo sapiens
ugagucaauucuaacaauggca

SEQ ID NO: 154692 - RNA, 22 nt, Homo sapiens
ugagugaaugugaaggcuaggg

SEQ ID NO: 154693 - RNA, 22 nt, Homo sapiens
ugagugaggcugggcagucccu

SEQ ID NO: 154694 - RNA, 22 nt, Homo sapiens
ugaguucuuccuaucucugccu

SEQ ID NO: 154695 - RNA, 22 nt, Homo sapiens
ugaguucuuuguagauucugug

SEQ ID NO: 154696 - RNA, 22 nt, Homo sapiens
ugaguuuaucuaaagaccuggg

SEQ ID NO: 154697 - RNA, 22 nt, Homo sapiens
ugauaacauuucuucugguaca

SEQ ID NO: 154698 - RNA, 22 nt, Homo sapiens
ugauacugugcauuagaggcua

SEQ ID NO: 154699 - RNA, 22 nt, Homo sapiens
ugauauuuuugauccuuaaguu

SEQ ID NO: 154700 - RNA, 22 nt, Homo sapiens
ugaucuuuuuaauguccauggg

SEQ ID NO: 154701 - RNA, 22 nt, Homo sapiens
ugaugaaguauaggaagggcuu

SEQ ID NO: 154702 - RNA, 22 nt, Homo sapiens
ugauuguucuguccccaggggc

SEQ ID NO: 154703 - RNA, 18 nt, Homo sapiens
ugcaaacauguguguguu

SEQ ID NO: 154704 - RNA, 22 nt, Homo sapiens
ugcaaauguuauuuugguuucu

SEQ ID NO: 154705 - RNA, 22 nt, Homo sapiens
ugcaagaaacauauuccacaag

SEQ ID NO: 154706 - RNA, 18 nt, Homo sapiens
ugcaauggagaugcagcc

SEQ ID NO: 154707 - RNA, 17 nt, Homo sapiens
ugcaauuuaagcuagau

SEQ ID NO: 154708 - RNA, 22 nt, Homo sapiens
ugcaccaucuugcuucuguggu

SEQ ID NO: 154709 - RNA, 17 nt, Homo sapiens
ugcagcacacugauggg

SEQ ID NO: 154710 - RNA, 22 nt, Homo sapiens
ugcaggauguucaguaauuucc

SEQ ID NO: 154711 - RNA, 22 nt, Homo sapiens
ugcagugcaugacuguguuaug

SEQ ID NO: 154712 - RNA, 22 nt, Homo sapiens
ugcauacugaaauauuuuagag

SEQ ID NO: 154713 - RNA, 23 nt, Homo sapiens
ugcauaguacccaauacuuuauc

SEQ ID NO: 154714 - RNA, 22 nt, Homo sapiens
ugcauauguauacaugugccau

SEQ ID NO: 154715 - RNA, 22 nt, Homo sapiens
ugcauaugucuuuauagcagca

SEQ ID NO: 154716 - RNA, 22 nt, Homo sapiens
ugcauauguugagaugcauauu

SEQ ID NO: 154717 - RNA, 22 nt, Homo sapiens
ugcauauucaaggcaggccauu

SEQ ID NO: 154718 - RNA, 21 nt, Homo sapiens
ugcauauuggaacuuucucuc

SEQ ID NO: 154719 - RNA, 22 nt, Homo sapiens
ugcauugcacuugcaugagaua

SEQ ID NO: 154720 - RNA, 21 nt, Homo sapiens
ugcauuguugcugagagcagg

SEQ ID NO: 154721 - RNA, 22 nt, Homo sapiens
acagucuggagaaugggugcuc

SEQ ID NO: 154722 - RNA, 22 nt, Homo sapiens
acagugacagaaagcugauuau

SEQ ID NO: 154723 - RNA, 18 nt, Homo sapiens
acagugcugucacugcuu

SEQ ID NO: 154724 - RNA, 22 nt, Homo sapiens
acagugcuuggcacacaguaau

SEQ ID NO: 154725 - RNA, 22 nt, Homo sapiens
acagugcuuucaauguucagua

SEQ ID NO: 154726 - RNA, 17 nt, Homo sapiens
acagugcuuugcuuucc

SEQ ID NO: 154727 - RNA, 23 nt, Homo sapiens
acaguggugugaucuuggcucag

SEQ ID NO: 154728 - RNA, 18 nt, Homo sapiens
acagugucauggcucaau

SEQ ID NO: 154729 - RNA, 17 nt, Homo sapiens
acagugucuaugaaaug

SEQ ID NO: 154730 - RNA, 19 nt, Homo sapiens
acagugucucuauaaugau

SEQ ID NO: 154731 - RNA, 22 nt, Homo sapiens
acaguguuccuuuguugugacu

SEQ ID NO: 154732 - RNA, 22 nt, Homo sapiens
acauaaagaagcaggacauugu

SEQ ID NO: 154733 - RNA, 22 nt, Homo sapiens
acauacacuagggauguggugu

SEQ ID NO: 154734 - RNA, 22 nt, Homo sapiens
acauaguagacacugaaaauau

SEQ ID NO: 154735 - RNA, 21 nt, Homo sapiens
acaucagaguugugaagguag

SEQ ID NO: 154736 - RNA, 22 nt, Homo sapiens
acaucccuuucccacccuucac

SEQ ID NO: 154737 - RNA, 22 nt, Homo sapiens
acauguaauugauuuuguguua

SEQ ID NO: 154738 - RNA, 22 nt, Homo sapiens
acauugcauauggcacccucuu

SEQ ID NO: 154739 - RNA, 22 nt, Homo sapiens
acccagaauucagucuuaggcc

SEQ ID NO: 154740 - RNA, 22 nt, Homo sapiens
acccaguagccagauguagcug

SEQ ID NO: 154741 - RNA, 22 nt, Homo sapiens
acccaguguucagacuaccugu

SEQ ID NO: 154742 - RNA, 22 nt, Homo sapiens
acccucagaccaguuucccugg

SEQ ID NO: 154743 - RNA, 22 nt, Homo sapiens
acccugaagccaugaguggaac

SEQ ID NO: 154744 - RNA, 22 nt, Homo sapiens
acccuggaggucuacagugcag

SEQ ID NO: 154745 - RNA, 22 nt, Homo sapiens
acccuggaguaguaggaaucug

SEQ ID NO: 154746 - RNA, 22 nt, Homo sapiens
acccugucagcuggccugggca

SEQ ID NO: 154747 - RNA, 22 nt, Homo sapiens
acccuguugucagaauguggau

SEQ ID NO: 154748 - RNA, 22 nt, Homo sapiens
acccuuugucaaucaguacuaa

SEQ ID NO: 154749 - RNA, 22 nt, Homo sapiens
accgaguguucucccgcagcgg

SEQ ID NO: 154750 - RNA, 22 nt, Homo sapiens
accugagacuaggcauuuuaua

SEQ ID NO: 154751 - RNA, 22 nt, Homo sapiens
cuugggcagugugcauguguau

SEQ ID NO: 154752 - RNA, 17 nt, Homo sapiens
cuuguugugguaguuug

SEQ ID NO: 154753 - RNA, 22 nt, Homo sapiens
cuuuaguugucuccucaagggu

SEQ ID NO: 154754 - RNA, 22 nt, Homo sapiens
cuuucugaggagaauagagaac

SEQ ID NO: 154755 - RNA, 22 nt, Homo sapiens
cuuugauuauaaaaggguguuu

SEQ ID NO: 154756 - RNA, 21 nt, Homo sapiens
cuuugcacugcuccucagcuc

SEQ ID NO: 154757 - RNA, 21 nt, Homo sapiens
cuuugguagaguuuuuagggu

SEQ ID NO: 154758 - RNA, 18 nt, Homo sapiens
cuuugguccccgcacccu

SEQ ID NO: 154759 - RNA, 22 nt, Homo sapiens
cuuuggugagggauaaauuuca

SEQ ID NO: 154760 - RNA, 22 nt, Homo sapiens
cuuuggugauagauaccccaua

SEQ ID NO: 154761 - RNA, 22 nt, Homo sapiens
cuuugguuaauaggauauggca

SEQ ID NO: 154762 - RNA, 22 nt, Homo sapiens
cuuuuggugguucugaugcagg

SEQ ID NO: 154763 - RNA, 22 nt, Homo sapiens
gaaaacugcuucucuggguuuc

SEQ ID NO: 154764 - RNA, 22 nt, Homo sapiens
gaaaauccauccccagggagua

SEQ ID NO: 154765 - RNA, 22 nt, Homo sapiens
gaaaguaauuaacgauuguugc

SEQ ID NO: 154766 - RNA, 22 nt, Homo sapiens
gaaaugcucagggguuuuccag

SEQ ID NO: 154767 - RNA, 22 nt, Homo sapiens
gaaauguuuuucaugugggcaa

SEQ ID NO: 154768 - RNA, 22 nt, Homo sapiens
gaaccagcagacuuugacaggu

SEQ ID NO: 154769 - RNA, 22 nt, Homo sapiens
gaacuguuucuggugaaagagu

SEQ ID NO: 154770 - RNA, 22 nt, Homo sapiens
gaagaacuaggugagaucuaga

SEQ ID NO: 154771 - RNA, 18 nt, Homo sapiens
gaagaaguaggcauggca

SEQ ID NO: 154772 - RNA, 22 nt, Homo sapiens
gaagacauuugcugcacguccu

SEQ ID NO: 154773 - RNA, 22 nt, Homo sapiens
gaagauaucuaguaccauuguc

SEQ ID NO: 154774 - RNA, 22 nt, Homo sapiens
gaagauguugcuuaccuuggag

SEQ ID NO: 154775 - RNA, 22 nt, Homo sapiens
gaagcauugauccacaggcgug

SEQ ID NO: 154776 - RNA, 22 nt, Homo sapiens
gaaucaauugaucuaugugucu

SEQ ID NO: 154777 - RNA, 22 nt, Homo sapiens
gaaucccuugcauuaucccuuu

SEQ ID NO: 154778 - RNA, 22 nt, Homo sapiens
gaaugaauguuuauccuuagau

SEQ ID NO: 154779 - RNA, 22 nt, Homo sapiens
gaaugauacuguuaacgaaaga

SEQ ID NO: 154780 - RNA, 22 nt, Homo sapiens
gaaugcaugaggggaucagaug

SEQ ID NO: 154781 - RNA, 22 nt, Homo sapiens
gaauuguacugcaaucagggga

SEQ ID NO: 154782 - RNA, 22 nt, Homo sapiens
gacaagagaacacugcuauauu

SEQ ID NO: 154783 - RNA, 22 nt, Homo sapiens
gacaccauuucaguacuagguu

SEQ ID NO: 154784 - RNA, 22 nt, Homo sapiens
gacagacacaauugauccauga

SEQ ID NO: 154785 - RNA, 18 nt, Homo sapiens
gacagugugaagauuccu

SEQ ID NO: 154786 - RNA, 22 nt, Homo sapiens
gacauguuuucaagauuuauaa

SEQ ID NO: 154787 - RNA, 22 nt, Homo sapiens
gacauguuuuuuaagguuuaug

SEQ ID NO: 154788 - RNA, 22 nt, Homo sapiens
gacauuaucagguuuguuuucu

SEQ ID NO: 154789 - RNA, 22 nt, Homo sapiens
gaccugagagguacauguauuu

SEQ ID NO: 154790 - RNA, 22 nt, Homo sapiens
gaccuggugguccacccgccuu

SEQ ID NO: 154791 - RNA, 22 nt, Homo sapiens
gacucuguagacaaucacaucu

SEQ ID NO: 154792 - RNA, 22 nt, Homo sapiens
gacugaggaagcgcucucuccu

SEQ ID NO: 154793 - RNA, 16 nt, Homo sapiens
gacugggcugaggaau

SEQ ID NO: 154794 - RNA, 22 nt, Homo sapiens
gacuugaagaaucuaagggagg

SEQ ID NO: 154795 - RNA, 22 nt, Homo sapiens
gagaacagaagcauuccuaauu

SEQ ID NO: 154796 - RNA, 22 nt, Homo sapiens
gagaacugacauuaucguguau

SEQ ID NO: 154797 - RNA, 22 nt, Homo sapiens
gagacagugucagccauugaaa

SEQ ID NO: 154798 - RNA, 22 nt, Homo sapiens
gagacugagucucacucuguca

SEQ ID NO: 154799 - RNA, 22 nt, Homo sapiens
gagacugagucuugcucugucg

SEQ ID NO: 154800 - RNA, 22 nt, Homo sapiens
gagagcuaggccacuggggcuu

SEQ ID NO: 154801 - RNA, 22 nt, Homo sapiens
gagagugcuuuggguguaggcc

SEQ ID NO: 154802 - RNA, 22 nt, Homo sapiens
gagauauuauuucccuuucaca

SEQ ID NO: 154803 - RNA, 22 nt, Homo sapiens
gagaucuucguguggggagaca

SEQ ID NO: 154804 - RNA, 22 nt, Homo sapiens
gagaucuuuaagaacuacugcu

SEQ ID NO: 154805 - RNA, 22 nt, Homo sapiens
gagauggagucuuuuucuguca

SEQ ID NO: 154806 - RNA, 22 nt, Homo sapiens
gagaugucuauuucagagaugu

SEQ ID NO: 154807 - RNA, 22 nt, Homo sapiens
gagcaccagucccugucagugc

SEQ ID NO: 154808 - RNA, 22 nt, Homo sapiens
gagcccauuucacuuguccagc

SEQ ID NO: 154809 - RNA, 20 nt, Homo sapiens
gagcugguguacugccgggc

SEQ ID NO: 154810 - RNA, 22 nt, Homo sapiens
gaggacauuaugcuaaguggaa

SEQ ID NO: 154811 - RNA, 22 nt, Homo sapiens
gaggcaaguggccaccgagucu

SEQ ID NO: 154812 - RNA, 22 nt, Homo sapiens
gagguauggauaucuggagagg

SEQ ID NO: 154813 - RNA, 22 nt, Homo sapiens
gagguguaaggacaacagagac

SEQ ID NO: 154814 - RNA, 22 nt, Homo sapiens
gagguguagucaugccaagauc

SEQ ID NO: 154815 - RNA, 22 nt, Homo sapiens
gagguugggaugagggauacag

SEQ ID NO: 154816 - RNA, 22 nt, Homo sapiens
gaguagaacugguuaucuaaua

SEQ ID NO: 154817 - RNA, 22 nt, Homo sapiens
gaguagugcugcaauaaacaua

SEQ ID NO: 154818 - RNA, 22 nt, Homo sapiens
gaguagugcugcaguaaacaca

SEQ ID NO: 154819 - RNA, 23 nt, Homo sapiens
gagugcaaugacaugaucucgga

SEQ ID NO: 154820 - RNA, 22 nt, Homo sapiens
gagugcaauggcgcgaucucgg

SEQ ID NO: 154821 - RNA, 23 nt, Homo sapiens
gaguggagacucauugauuuccu

SEQ ID NO: 154822 - RNA, 22 nt, Homo sapiens
gaguucaauuuccagcuguucu

SEQ ID NO: 154823 - RNA, 22 nt, Homo sapiens
gaguuuguacuaauuuguugua

SEQ ID NO: 154824 - RNA, 22 nt, Homo sapiens
gauacaguaugcaugugguauu

SEQ ID NO: 154825 - RNA, 22 nt, Homo sapiens
gauauguguuuuagucaggguu

SEQ ID NO: 154826 - RNA, 22 nt, Homo sapiens
gauauguugaguagaguuuuug

SEQ ID NO: 154827 - RNA, 22 nt, Homo sapiens
gauauuacuuccaauauugcaa

SEQ ID NO: 154828 - RNA, 22 nt, Homo sapiens
gaucaauuggcugaagacacgu

SEQ ID NO: 154829 - RNA, 22 nt, Homo sapiens
gaucacauggccauuucuagcu

SEQ ID NO: 154830 - RNA, 22 nt, Homo sapiens
gaugccuuuuuguccucaguua

SEQ ID NO: 154831 - RNA, 22 nt, Homo sapiens
gauggcaucugagaguguuaga

SEQ ID NO: 154832 - RNA, 18 nt, Homo sapiens
gauguaguauggugugga

SEQ ID NO: 154833 - RNA, 22 nt, Homo sapiens
gauuccacuuucaaauucaaau

SEQ ID NO: 154834 - RNA, 22 nt, Homo sapiens
gcaaaaaguagugcugguuagg

SEQ ID NO: 154835 - RNA, 22 nt, Homo sapiens
gcaaagaaugcagauuugccuc

SEQ ID NO: 154836 - RNA, 21 nt, Homo sapiens
gcaaaguggcuaccuugcucc

SEQ ID NO: 154837 - RNA, 22 nt, Homo sapiens
gcaaaugcuacaccauuuugua

SEQ ID NO: 154838 - RNA, 22 nt, Homo sapiens
gcaagaugagagcccgggcagu

SEQ ID NO: 154839 - RNA, 22 nt, Homo sapiens
gcaauggaaucccuugaucaau

SEQ ID NO: 154840 - RNA, 22 nt, Homo sapiens
gcacaguguuacuugauauauu

SEQ ID NO: 154841 - RNA, 20 nt, Homo sapiens
agcuccauuccugaaggcug

SEQ ID NO: 154842 - RNA, 22 nt, Homo sapiens
agcuccuuugcuuuuuccagga

SEQ ID NO: 154843 - RNA, 22 nt, Homo sapiens
agcugcaaagggagagaugauu

SEQ ID NO: 154844 - RNA, 20 nt, Homo sapiens
agcugcagauauaaauccgc

SEQ ID NO: 154845 - RNA, 17 nt, Homo sapiens
agcuggaauuacgggag

SEQ ID NO: 154846 - RNA, 22 nt, Homo sapiens
agcuggaauuuaagguagauag

SEQ ID NO: 154847 - RNA, 22 nt, Homo sapiens
agcuguuguucucagaggcuuu

SEQ ID NO: 154848 - RNA, 22 nt, Homo sapiens
agcuuaugcuuggaagagauga

SEQ ID NO: 154849 - RNA, 22 nt, Homo sapiens
agcuuguagugauuugugguaa

SEQ ID NO: 154850 - RNA, 21 nt, Homo sapiens
aggaagacuaugaucaauugg

SEQ ID NO: 154851 - RNA, 22 nt, Homo sapiens
aggaagacugaaauugcuguuc

SEQ ID NO: 154852 - RNA, 22 nt, Homo sapiens
aggaagcuagcauuuguucagu

SEQ ID NO: 154853 - RNA, 22 nt, Homo sapiens
aggaagguaaacuaacuugccu

SEQ ID NO: 154854 - RNA, 22 nt, Homo sapiens
aggaauuuaauguaugauaaua

SEQ ID NO: 154855 - RNA, 22 nt, Homo sapiens
aggaccauuguguagcagacau

SEQ ID NO: 154856 - RNA, 20 nt, Homo sapiens
aggagcauuuacauuggcuc

SEQ ID NO: 154857 - RNA, 23 nt, Homo sapiens
aggagcuuagaaguugccauugc

SEQ ID NO: 154858 - RNA, 22 nt, Homo sapiens
aggagguaggaauugugcuagg

SEQ ID NO: 154859 - RNA, 22 nt, Homo sapiens
aggagguugguaccaucuguuu

SEQ ID NO: 154860 - RNA, 21 nt, Homo sapiens
aggcaaaugaagcagccgcuc

SEQ ID NO: 154861 - RNA, 22 nt, Homo sapiens
aggcaaaugccagcaaucacac

SEQ ID NO: 154862 - RNA, 22 nt, Homo sapiens
aggcaagaaugcuuguuucacc

SEQ ID NO: 154863 - RNA, 22 nt, Homo sapiens
aggcaagcaucuugcucccuuc

SEQ ID NO: 154864 - RNA, 22 nt, Homo sapiens
aggcaaguugcucaaaugcaaa

SEQ ID NO: 154865 - RNA, 22 nt, Homo sapiens
aggcacacaacccuggaccuga

SEQ ID NO: 154866 - RNA, 22 nt, Homo sapiens
aggcagcuguuauauacugagu

SEQ ID NO: 154867 - RNA, 22 nt, Homo sapiens
aggcaggugaaagauaguuuua

SEQ ID NO: 154868 - RNA, 22 nt, Homo sapiens
aggcaugaguucagaggguaug

SEQ ID NO: 154869 - RNA, 22 nt, Homo sapiens
aggcaugauggcuccagaucau

SEQ ID NO: 154870 - RNA, 22 nt, Homo sapiens
aggcauguugcuucgggcuuug

SEQ ID NO: 154871 - RNA, 22 nt, Homo sapiens
aggccaguuuuuggagggaaac

SEQ ID NO: 154872 - RNA, 22 nt, Homo sapiens
aggcuagaaucuuccaucuugg

SEQ ID NO: 154873 - RNA, 22 nt, Homo sapiens
aggcugguauuuacaaaagcuc

SEQ ID NO: 154874 - RNA, 21 nt, Homo sapiens
aggcuguuguuuugggaugga

SEQ ID NO: 154875 - RNA, 22 nt, Homo sapiens
aggcuuuuggagaacacugcac

SEQ ID NO: 154876 - RNA, 22 nt, Homo sapiens
aggcuuuuguuuuggucucagg

SEQ ID NO: 154877 - RNA, 22 nt, Homo sapiens
agggaagugugcuaugcauuua

SEQ ID NO: 154878 - RNA, 22 nt, Homo sapiens
agggcaagacuuguuaagaaca

SEQ ID NO: 154879 - RNA, 22 nt, Homo sapiens
agggcaguguuaggacugucug

SEQ ID NO: 154880 - RNA, 22 nt, Homo sapiens
agggcuuaucuguguagaguuc

SEQ ID NO: 154881 - RNA, 22 nt, Homo sapiens
agguaauagcacaugauaccuu

SEQ ID NO: 154882 - RNA, 20 nt, Homo sapiens
agguacacugacaugccuuc

SEQ ID NO: 154883 - RNA, 22 nt, Homo sapiens
agguagaguguuuuguucuucu

SEQ ID NO: 154884 - RNA, 22 nt, Homo sapiens
agguauguauguaugggagaaa

SEQ ID NO: 154885 - RNA, 21 nt, Homo sapiens
aggucaugaagauguucuaau

SEQ ID NO: 154886 - RNA, 22 nt, Homo sapiens
agguccauuauuuucauucaug

SEQ ID NO: 154887 - RNA, 22 nt, Homo sapiens
aggugcuugaaucuaugagcuc

SEQ ID NO: 154888 - RNA, 22 nt, Homo sapiens
aggugguauuucaaaguggcag

SEQ ID NO: 154889 - RNA, 22 nt, Homo sapiens
agguucccuuuuggccugggau

SEQ ID NO: 154890 - RNA, 22 nt, Homo sapiens
agucaaaugcuuauguauaaag

SEQ ID NO: 154891 - RNA, 22 nt, Homo sapiens
agucaagaaucucagcaucuuu

SEQ ID NO: 154892 - RNA, 22 nt, Homo sapiens
agucaagugggguuagauaguu

SEQ ID NO: 154893 - RNA, 22 nt, Homo sapiens
agucacaugcauuuucuucaau

SEQ ID NO: 154894 - RNA, 22 nt, Homo sapiens
agucagugcauaagaaugaagu

SEQ ID NO: 154895 - RNA, 22 nt, Homo sapiens
agucaguggaguaaauguaauu

SEQ ID NO: 154896 - RNA, 23 nt, Homo sapiens
agucuguguuuacaggcucucug

SEQ ID NO: 154897 - RNA, 22 nt, Homo sapiens
agugagcugcagucuggggucc

SEQ ID NO: 154898 - RNA, 22 nt, Homo sapiens
agugcaaugauccggugcuggg

SEQ ID NO: 154899 - RNA, 22 nt, Homo sapiens
agugcaauggcgugaucuuggc

SEQ ID NO: 154900 - RNA, 22 nt, Homo sapiens
agugcaauggugccaucauagc

SEQ ID NO: 154901 - RNA, 22 nt, Homo sapiens
agugcaguggcacaaucuuggc

SEQ ID NO: 154902 - RNA, 22 nt, Homo sapiens
agugcaguggugccaucauaac

SEQ ID NO: 154903 - RNA, 22 nt, Homo sapiens
agugcagugguuaggagccagg

SEQ ID NO: 154904 - RNA, 22 nt, Homo sapiens
agugccauggcugcuagauggc

SEQ ID NO: 154905 - RNA, 19 nt, Homo sapiens
aguggguguuuucuguuug

SEQ ID NO: 154906 - RNA, 22 nt, Homo sapiens
aguguuuuuaacaagaaagggu

SEQ ID NO: 154907 - RNA, 22 nt, Homo sapiens
aguuggugauugauugggucug

SEQ ID NO: 154908 - RNA, 22 nt, Homo sapiens
auaaaagcaggucuaggucagg

SEQ ID NO: 154909 - RNA, 22 nt, Homo sapiens
auaaagccaggagacguaauug

SEQ ID NO: 154910 - RNA, 22 nt, Homo sapiens
auaaagguaagcacuauccuga

SEQ ID NO: 154911 - RNA, 22 nt, Homo sapiens
auaaaugcauugagaacugcug

SEQ ID NO: 154912 - RNA, 22 nt, Homo sapiens
auaaggaguaucauauuaaaac

SEQ ID NO: 154913 - RNA, 22 nt, Homo sapiens
auaagguuagcucugagaaagu

SEQ ID NO: 154914 - RNA, 22 nt, Homo sapiens
auacauguucaagggcauauau

SEQ ID NO: 154915 - RNA, 22 nt, Homo sapiens
auaccugguagucuugcuacac

SEQ ID NO: 154916 - RNA, 22 nt, Homo sapiens
auagcaaugccccauucccagu

SEQ ID NO: 154917 - RNA, 22 nt, Homo sapiens
auagcaauuugggaaucagacu

SEQ ID NO: 154918 - RNA, 22 nt, Homo sapiens
auagcauaucccacaugucaga

SEQ ID NO: 154919 - RNA, 20 nt, Homo sapiens
auagcauugauggacucaaa

SEQ ID NO: 154920 - RNA, 22 nt, Homo sapiens
auagucaaaucucauuaccccc

SEQ ID NO: 154921 - RNA, 22 nt, Homo sapiens
auagucaguagucucauaauga

SEQ ID NO: 154922 - RNA, 22 nt, Homo sapiens
auagugcagugaugaaccuagg

SEQ ID NO: 154923 - RNA, 23 nt, Homo sapiens
auauaguagaugugcaguaacau

SEQ ID NO: 154924 - RNA, 22 nt, Homo sapiens
auauaugcuaagugcuaauaaa

SEQ ID NO: 154925 - RNA, 22 nt, Homo sapiens
auaucacaaacaagucuguacu

SEQ ID NO: 154926 - RNA, 22 nt, Homo sapiens
auaucagugucuuacuguuuuu

SEQ ID NO: 154927 - RNA, 22 nt, Homo sapiens
auaucccagugaugauugauag

SEQ ID NO: 154928 - RNA, 22 nt, Homo sapiens
auauccuggagcauuuuugcaa

SEQ ID NO: 154929 - RNA, 22 nt, Homo sapiens
auauggcauucagaacuguaua

SEQ ID NO: 154930 - RNA, 22 nt, Homo sapiens
auaugguuuuuggaagcauauc

SEQ ID NO: 154931 - RNA, 22 nt, Homo sapiens
auggagcuugacaguuguagag

SEQ ID NO: 154932 - RNA, 22 nt, Homo sapiens
auggaguguaauauugagagcu

SEQ ID NO: 154933 - RNA, 22 nt, Homo sapiens
auggaguguggaacugggaauc

SEQ ID NO: 154934 - RNA, 22 nt, Homo sapiens
auggauauuuuuugaacauaga

SEQ ID NO: 154935 - RNA, 22 nt, Homo sapiens
auggcacucaaucaaguugaga

SEQ ID NO: 154936 - RNA, 22 nt, Homo sapiens
auggcacuguguccugggguca

SEQ ID NO: 154937 - RNA, 22 nt, Homo sapiens
auggcagaaucaagccgacagc

SEQ ID NO: 154938 - RNA, 22 nt, Homo sapiens
auggcagcccucuuuauccaug

SEQ ID NO: 154939 - RNA, 22 nt, Homo sapiens
auggcaguuuauucuaaaucaa

SEQ ID NO: 154940 - RNA, 22 nt, Homo sapiens
auggcauugaagaguugucccu

SEQ ID NO: 154941 - RNA, 22 nt, Homo sapiens
auggcccaguuugcuaucccua

SEQ ID NO: 154942 - RNA, 22 nt, Homo sapiens
auggcucaauucuuucccugaa

SEQ ID NO: 154943 - RNA, 22 nt, Homo sapiens
auggcugugaaaugguaggugg

SEQ ID NO: 154944 - RNA, 22 nt, Homo sapiens
auggcuguuuaagaguuucauu

SEQ ID NO: 154945 - RNA, 22 nt, Homo sapiens
auggcuguuucugcaaugucua

SEQ ID NO: 154946 - RNA, 22 nt, Homo sapiens
auggcuucuucuaaaagugggg

SEQ ID NO: 154947 - RNA, 22 nt, Homo sapiens
auggcuugugggaacuuuuaaa

SEQ ID NO: 154948 - RNA, 22 nt, Homo sapiens
augggugaguaugaguugacuu

SEQ ID NO: 154949 - RNA, 22 nt, Homo sapiens
augguacuagaguaagaauugu

SEQ ID NO: 154950 - RNA, 21 nt, Homo sapiens
auggugagaaaguagugucaa

SEQ ID NO: 154951 - RNA, 22 nt, Homo sapiens
auguauggaguuuaggggaugg

SEQ ID NO: 154952 - RNA, 22 nt, Homo sapiens
auguccuggacccagacaaagc

SEQ ID NO: 154953 - RNA, 22 nt, Homo sapiens
augucuagagugauacugaagc

SEQ ID NO: 154954 - RNA, 22 nt, Homo sapiens
augugacugauguaaucagaca

SEQ ID NO: 154955 - RNA, 22 nt, Homo sapiens
augugcaaaguuaagaucccag

SEQ ID NO: 154956 - RNA, 22 nt, Homo sapiens
augugcaaauuuccaaacucuu

SEQ ID NO: 154957 - RNA, 22 nt, Homo sapiens
augugcaauguguacguagccc

SEQ ID NO: 154958 - RNA, 22 nt, Homo sapiens
auguggaaagcagcaugauaug

SEQ ID NO: 154959 - RNA, 22 nt, Homo sapiens
auguggcacuugacuuucucgc

SEQ ID NO: 154960 - RNA, 22 nt, Homo sapiens
auguggcuuuucaacuguguga

SEQ ID NO: 154961 - RNA, 22 nt, Homo sapiens
auuaacaucuagaguuuuggug

SEQ ID NO: 154962 - RNA, 22 nt, Homo sapiens
auuaaguaaugguuccaauaau

SEQ ID NO: 154963 - RNA, 22 nt, Homo sapiens
auuaagugcuugcagaagucca

SEQ ID NO: 154964 - RNA, 22 nt, Homo sapiens
auuaaguugugccugaaaacuu

SEQ ID NO: 154965 - RNA, 22 nt, Homo sapiens
auuacacuuucuauucaaugag

SEQ ID NO: 154966 - RNA, 22 nt, Homo sapiens
auuacuuugcaccaaccuaaua

SEQ ID NO: 154967 - RNA, 22 nt, Homo sapiens
auuagguuaggcaaacuucugu

SEQ ID NO: 154968 - RNA, 22 nt, Homo sapiens
auuagguuggugcaaaacuuuc

SEQ ID NO: 154969 - RNA, 22 nt, Homo sapiens
auuauuaguuguugaaugaagu

SEQ ID NO: 154970 - RNA, 23 nt, Homo sapiens
auucaaguagugagagugguuau

SEQ ID NO: 154971 - RNA, 20 nt, Homo sapiens
auucaaguaugccuugagaa

SEQ ID NO: 154972 - RNA, 22 nt, Homo sapiens
auucaagugaugcagcuguuuu

SEQ ID NO: 154973 - RNA, 22 nt, Homo sapiens
auucaagugaugugauucuucu

SEQ ID NO: 154974 - RNA, 22 nt, Homo sapiens
auucccuguagaauaaggaugg

SEQ ID NO: 154975 - RNA, 22 nt, Homo sapiens
auucuauaguccuaggauuggg

SEQ ID NO: 154976 - RNA, 22 nt, Homo sapiens
uggaguguagaagccagccucc

SEQ ID NO: 154977 - RNA, 22 nt, Homo sapiens
uggagugucaguuuccagaguu

SEQ ID NO: 154978 - RNA, 22 nt, Homo sapiens
uggauagugauaagguagauga

SEQ ID NO: 154979 - RNA, 22 nt, Homo sapiens
uggauauguucuuuguguaagg

SEQ ID NO: 154980 - RNA, 22 nt, Homo sapiens
uggauauguuuauuacccugaa

SEQ ID NO: 154981 - RNA, 21 nt, Homo sapiens
uggauuguacacccuaucauu

SEQ ID NO: 154982 - RNA, 22 nt, Homo sapiens
uggcaaaaaucacaaguaccuu

SEQ ID NO: 154983 - RNA, 22 nt, Homo sapiens
uggcaaaugugagaugagaacu

SEQ ID NO: 154984 - RNA, 22 nt, Homo sapiens
uggcaaauuccaaaguuaauuc

SEQ ID NO: 154985 - RNA, 22 nt, Homo sapiens
uggcaagaaccacaguuacuuu

SEQ ID NO: 154986 - RNA, 19 nt, Homo sapiens
uggcacauguauacuuaug

SEQ ID NO: 154987 - RNA, 22 nt, Homo sapiens
uggcagauggugacaccauuag

SEQ ID NO: 154988 - RNA, 22 nt, Homo sapiens
uggcaguuuuaugugguucaac

SEQ ID NO: 154989 - RNA, 22 nt, Homo sapiens
uggcaguuuugauguggagaga

SEQ ID NO: 154990 - RNA, 17 nt, Homo sapiens
uggcaugaggguguggg

SEQ ID NO: 154991 - RNA, 22 nt, Homo sapiens
uggcaugauguguucauugaaa

SEQ ID NO: 154992 - RNA, 22 nt, Homo sapiens
uggcauguaaugcagaaguugc

SEQ ID NO: 154993 - RNA, 22 nt, Homo sapiens
uggcaugucagguuucuggguu

SEQ ID NO: 154994 - RNA, 22 nt, Homo sapiens
uggcaugugugaagugcccagc

SEQ ID NO: 154995 - RNA, 22 nt, Homo sapiens
uggcauuuucucuguucuuaga

SEQ ID NO: 154996 - RNA, 22 nt, Homo sapiens
uggcgagaugcucgugugcaga

SEQ ID NO: 154997 - RNA, 22 nt, Homo sapiens
uggcggagacauggacuucaga

SEQ ID NO: 154998 - RNA, 23 nt, Homo sapiens
uggcuagacguccuuuccugaug

SEQ ID NO: 154999 - RNA, 19 nt, Homo sapiens
uggcuagaggccaggcguu

SEQ ID NO: 155000 - RNA, 22 nt, Homo sapiens
uggcucauuucuaaacccagcu

SEQ ID NO: 155001 - RNA, 22 nt, Homo sapiens
uggcuguuuauuucaccuggau

SEQ ID NO: 155002 - RNA, 22 nt, Homo sapiens
uggcuguuuauuucaccugggu

SEQ ID NO: 155003 - RNA, 22 nt, Homo sapiens
uuagacaguggugcacugcacu

SEQ ID NO: 155004 - RNA, 22 nt, Homo sapiens
uuagaugaaugucucuuaaaca

SEQ ID NO: 155005 - RNA, 22 nt, Homo sapiens
uuagauguuuagaagugggcca

SEQ ID NO: 155006 - RNA, 22 nt, Homo sapiens
uuagcagcacaaaagcagacua

SEQ ID NO: 155007 - RNA, 22 nt, Homo sapiens
uuagcagugugaaaaaagacua

SEQ ID NO: 155008 - RNA, 21 nt, Homo sapiens
uuagcauccauguucaucaac

SEQ ID NO: 155009 - RNA, 21 nt, Homo sapiens
uuagccuguaagcacuuugca

SEQ ID NO: 155010 - RNA, 22 nt, Homo sapiens
uuaggcaggauaguuacauauu

SEQ ID NO: 155011 - RNA, 22 nt, Homo sapiens
uuaguagcacagaguaucagca

SEQ ID NO: 155012 - RNA, 22 nt, Homo sapiens
uuaguaguagcugcaugucagu

SEQ ID NO: 155013 - RNA, 22 nt, Homo sapiens
uuaguucccucauucuugacuu

SEQ ID NO: 155014 - RNA, 20 nt, Homo sapiens
uuauaacuuuuguucugggg

SEQ ID NO: 155015 - RNA, 22 nt, Homo sapiens
uuauagcagugcaggaacagac

SEQ ID NO: 155016 - RNA, 21 nt, Homo sapiens
uuauaguggcaugauuuauaa

SEQ ID NO: 155017 - RNA, 18 nt, Homo sapiens
uuauaugcauguguagga

SEQ ID NO: 155018 - RNA, 22 nt, Homo sapiens
uuaucaaacccuaggagguggu

SEQ ID NO: 155019 - RNA, 22 nt, Homo sapiens
uuaugcuuauugguguacggua

SEQ ID NO: 155020 - RNA, 22 nt, Homo sapiens
uuaugguuuuucugugagaugg

SEQ ID NO: 155021 - RNA, 22 nt, Homo sapiens
uuauguaaaucaaucuggaauc

SEQ ID NO: 155022 - RNA, 22 nt, Homo sapiens
uuauugcacuccagccugggua

SEQ ID NO: 155023 - RNA, 22 nt, Homo sapiens
uuauugcuuaugauuagguguu

SEQ ID NO: 155024 - RNA, 22 nt, Homo sapiens
uucaaaguuggaggacaaacug

SEQ ID NO: 155025 - RNA, 22 nt, Homo sapiens
uucaagauggccccagugagcc

SEQ ID NO: 155026 - RNA, 22 nt, Homo sapiens
uucaagcugggcaaauaagggg

SEQ ID NO: 155027 - RNA, 22 nt, Homo sapiens
uucaaggacuaaggauuuuugg

SEQ ID NO: 155028 - RNA, 22 nt, Homo sapiens
uucaaguaagaaagacaucagg

SEQ ID NO: 155029 - RNA, 22 nt, Homo sapiens
uucaagucaacaagcacuugag

SEQ ID NO: 155030 - RNA, 20 nt, Homo sapiens
uucaagugauucucaugccu

SEQ ID NO: 155031 - RNA, 22 nt, Homo sapiens
uucaagugguucagaagucuga

SEQ ID NO: 155032 - RNA, 22 nt, Homo sapiens
uucacaugguugccuuuugauc

SEQ ID NO: 155033 - RNA, 22 nt, Homo sapiens
uucaccaguuuugucacgaaug

SEQ ID NO: 155034 - RNA, 22 nt, Homo sapiens
uucacuguagccucagccucuu

SEQ ID NO: 155035 - RNA, 22 nt, Homo sapiens
uucagcaggccaggcccugacu

SEQ ID NO: 155036 - RNA, 22 nt, Homo sapiens
uucaggcaccauggucauugau

SEQ ID NO: 155037 - RNA, 22 nt, Homo sapiens
uucaggcaccauugucauugau

SEQ ID NO: 155038 - RNA, 22 nt, Homo sapiens
uucaggcuccgugccagcuccg

SEQ ID NO: 155039 - RNA, 22 nt, Homo sapiens
uucagguaucccuugucuauag

SEQ ID NO: 155040 - RNA, 22 nt, Homo sapiens
uucagguucauuugcugcuauu

SEQ ID NO: 155041 - RNA, 22 nt, Homo sapiens
uucaguaguaaguuggaacucu

SEQ ID NO: 155042 - RNA, 22 nt, Homo sapiens
uucaguggguggaugaauauga

SEQ ID NO: 155043 - RNA, 22 nt, Homo sapiens
uucaguucugcucugaucuuag

SEQ ID NO: 155044 - RNA, 18 nt, Homo sapiens
uucaguuuguaucugggg

SEQ ID NO: 155045 - RNA, 22 nt, Homo sapiens
uucauccccuccaaaucucaug

SEQ ID NO: 155046 - RNA, 22 nt, Homo sapiens
uuccacuuuuuccuugugcucc

SEQ ID NO: 155047 - RNA, 22 nt, Homo sapiens
uuccaggugggcgugggccugg

SEQ ID NO: 155048 - RNA, 21 nt, Homo sapiens
uuccagugagccuagaugccu

SEQ ID NO: 155049 - RNA, 22 nt, Homo sapiens
uuccaguguguucauccucaga

SEQ ID NO: 155050 - RNA, 22 nt, Homo sapiens
uuccaugagaugcaucaaagcu

SEQ ID NO: 155051 - RNA, 22 nt, Homo sapiens
uucccagagagggacuucuaau

SEQ ID NO: 155052 - RNA, 22 nt, Homo sapiens
uucccaguaaacucuaucccuc

SEQ ID NO: 155053 - RNA, 22 nt, Homo sapiens
uucccagugccaggcacuggga

SEQ ID NO: 155054 - RNA, 22 nt, Homo sapiens
uucccagugguuagcucugguc

SEQ ID NO: 155055 - RNA, 22 nt, Homo sapiens
uucccuguaucuucugccaugu

SEQ ID NO: 155056 - RNA, 22 nt, Homo sapiens
uucccugugugcagaugggugu

SEQ ID NO: 155057 - RNA, 22 nt, Homo sapiens
uucccuuucugccuugaaucuu

SEQ ID NO: 155058 - RNA, 22 nt, Homo sapiens
uucccuuugaaacuaaacuugc

SEQ ID NO: 155059 - RNA, 22 nt, Homo sapiens
uucccuuugugcauaggauuug

SEQ ID NO: 155060 - RNA, 22 nt, Homo sapiens
uucccuuuguuaaauuggaaga

SEQ ID NO: 155061 - RNA, 22 nt, Homo sapiens
uucccuuuuuucuaguagguag

SEQ ID NO: 155062 - RNA, 22 nt, Homo sapiens
uuccugagagggcugggugcag

SEQ ID NO: 155063 - RNA, 21 nt, Homo sapiens
auugcacaauauacccaugua

SEQ ID NO: 155064 - RNA, 21 nt, Homo sapiens
auugcacuccagccugggcga

SEQ ID NO: 155065 - RNA, 22 nt, Homo sapiens
auugcauuuucagguuggucug

SEQ ID NO: 155066 - RNA, 22 nt, Homo sapiens
auugcuuacuaaucaucuucag

SEQ ID NO: 155067 - RNA, 22 nt, Homo sapiens
auuggccaaugggacgucagca

SEQ ID NO: 155068 - RNA, 22 nt, Homo sapiens
auuggggaaugguggcuuuagu

SEQ ID NO: 155069 - RNA, 22 nt, Homo sapiens
auuggugaccugcggcaguaug

SEQ ID NO: 155070 - RNA, 22 nt, Homo sapiens
auugucacccgggcaguaagca

SEQ ID NO: 155071 - RNA, 22 nt, Homo sapiens
auuuagcaauggagguagugua

SEQ ID NO: 155072 - RNA, 22 nt, Homo sapiens
auuugucaauacacuucuucca

SEQ ID NO: 155073 - RNA, 22 nt, Homo sapiens
auuuugguuacauaguugagcu

SEQ ID NO: 155074 - RNA, 22 nt, Homo sapiens
caaaagugguucuuauccuuuu

SEQ ID NO: 155075 - RNA, 22 nt, Homo sapiens
caaagcuauagcaccagaggga

SEQ ID NO: 155076 - RNA, 22 nt, Homo sapiens
caaaggcuucugaaacugcaga

SEQ ID NO: 155077 - RNA, 22 nt, Homo sapiens
caaagucuucaguugauucuga

SEQ ID NO: 155078 - RNA, 22 nt, Homo sapiens
caaaugacaucauuucauucaa

SEQ ID NO: 155079 - RNA, 22 nt, Homo sapiens
caaaugcuucuauggacugucu

SEQ ID NO: 155080 - RNA, 19 nt, Homo sapiens
caacccugcagagaaagga

SEQ ID NO: 155081 - RNA, 22 nt, Homo sapiens
caagagaccugagugucauucu

SEQ ID NO: 155082 - RNA, 22 nt, Homo sapiens
caauacuguguugaauaagagu

SEQ ID NO: 155083 - RNA, 22 nt, Homo sapiens
cacaaugucuaagauguuucua

SEQ ID NO: 155084 - RNA, 22 nt, Homo sapiens
cacaccuacuagggccgugggc

SEQ ID NO: 155085 - RNA, 22 nt, Homo sapiens
cacacugucuuucagaaugguu

SEQ ID NO: 155086 - RNA, 22 nt, Homo sapiens
cacagaauucauuggauuaccu

SEQ ID NO: 155087 - RNA, 22 nt, Homo sapiens
cacagcgacuuccgccuaccgg

SEQ ID NO: 155088 - RNA, 22 nt, Homo sapiens
cacagcuagucaaugguagaca

SEQ ID NO: 155089 - RNA, 22 nt, Homo sapiens
cacauguuugcuacauuuuucu

SEQ ID NO: 155090 - RNA, 22 nt, Homo sapiens
caccaggugcccagcacggcca

SEQ ID NO: 155091 - RNA, 22 nt, Homo sapiens
caccagguggcugaggccauga

SEQ ID NO: 155092 - RNA, 22 nt, Homo sapiens
caccauguguucagaaggauug

SEQ ID NO: 155093 - RNA, 22 nt, Homo sapiens
cacugcaguguaauuaagguug

SEQ ID NO: 155094 - RNA, 22 nt, Homo sapiens
cacugcauccucugccuggcgg

SEQ ID NO: 155095 - RNA, 22 nt, Homo sapiens
cacugggugagauccauguuua

SEQ ID NO: 155096 - RNA, 21 nt, Homo sapiens
cacuggguucaggcuugugga

SEQ ID NO: 155097 - RNA, 22 nt, Homo sapiens
cacuggucucauggcaugagag

SEQ ID NO: 155098 - RNA, 16 nt, Homo sapiens
cacuggucuuaccaug

SEQ ID NO: 155099 - RNA, 22 nt, Homo sapiens
cagagaacugaguuauuuucuu

SEQ ID NO: 155100 - RNA, 22 nt, Homo sapiens
cagagagcuugcccuuguauau

SEQ ID NO: 155101 - RNA, 22 nt, Homo sapiens
cagagguauugcaaaagccuag

SEQ ID NO: 155102 - RNA, 22 nt, Homo sapiens
cagauacuccuggucucaggag

SEQ ID NO: 155103 - RNA, 22 nt, Homo sapiens
cagaucaucuugagcuuaggaa

SEQ ID NO: 155104 - RNA, 22 nt, Homo sapiens
cagcagguuuuuaucaguuaag

SEQ ID NO: 155105 - RNA, 22 nt, Homo sapiens
cagcccguaaucccagcacuuu

SEQ ID NO: 155106 - RNA, 22 nt, Homo sapiens
cagcccuacacagacugacuca

SEQ ID NO: 155107 - RNA, 22 nt, Homo sapiens
cagcuaaauuguuaaauccaag

SEQ ID NO: 155108 - RNA, 22 nt, Homo sapiens
cagcuaguaauuuauugaagau

SEQ ID NO: 155109 - RNA, 22 nt, Homo sapiens
cagcugaugucgaaugcacucu

SEQ ID NO: 155110 - RNA, 23 nt, Homo sapiens
cagcuggugauuuuaaguugaag

SEQ ID NO: 155111 - RNA, 22 nt, Homo sapiens
cagcugguggcaagaagacaga

SEQ ID NO: 155112 - RNA, 22 nt, Homo sapiens
uuggcuuguaaaaugaaaagcu

SEQ ID NO: 155113 - RNA, 22 nt, Homo sapiens
uugggaauguccuaauaucucg

SEQ ID NO: 155114 - RNA, 22 nt, Homo sapiens
uugggccacuuuaguuuccuua

SEQ ID NO: 155115 - RNA, 22 nt, Homo sapiens
uugggcuugagggugcccaguc

SEQ ID NO: 155116 - RNA, 21 nt, Homo sapiens
uuggggaauggagagguuuuc

SEQ ID NO: 155117 - RNA, 22 nt, Homo sapiens
uugguacuaaaaaguagggugu

SEQ ID NO: 155118 - RNA, 22 nt, Homo sapiens
uuggucagcucaauggagaggg

SEQ ID NO: 155119 - RNA, 22 nt, Homo sapiens
uugguccucccaugcucaagag

SEQ ID NO: 155120 - RNA, 22 nt, Homo sapiens
uuguagcaaauguguaaacaaa

SEQ ID NO: 155121 - RNA, 22 nt, Homo sapiens
uuguauacucuauuuuagcagu

SEQ ID NO: 155122 - RNA, 22 nt, Homo sapiens
uuguauaggcucaguaagaauc

SEQ ID NO: 155123 - RNA, 22 nt, Homo sapiens
uuguaugucuucauuugaaaaa

SEQ ID NO: 155124 - RNA, 22 nt, Homo sapiens
uuguccccaucugcugccagaa

SEQ ID NO: 155125 - RNA, 23 nt, Homo sapiens
uuguccccuccaaagcucauguu

SEQ ID NO: 155126 - RNA, 22 nt, Homo sapiens
uugugacacagcugggccuaua

SEQ ID NO: 155127 - RNA, 22 nt, Homo sapiens
uugugcaaaguugugguuucug

SEQ ID NO: 155128 - RNA, 20 nt, Homo sapiens
uugugcauugggccauuggg

SEQ ID NO: 155129 - RNA, 22 nt, Homo sapiens
uugugcuucaucaccuagcaga

SEQ ID NO: 155130 - RNA, 22 nt, Homo sapiens
uugugucaaauggcaauuagca

SEQ ID NO: 155131 - RNA, 19 nt, Homo sapiens
uuguguccccacaaaauuc

SEQ ID NO: 155132 - RNA, 22 nt, Homo sapiens
uugugucccugcccaaaucuca

SEQ ID NO: 155133 - RNA, 22 nt, Homo sapiens
uuguguuugaugcugacacgca

SEQ ID NO: 155134 - RNA, 22 nt, Homo sapiens
uuguuaagaugcagauucugga

SEQ ID NO: 155135 - RNA, 22 nt, Homo sapiens
uuuaaagcaugacgagaagaag

SEQ ID NO: 155136 - RNA, 22 nt, Homo sapiens
uuuaaggcacuucaugguuuca

SEQ ID NO: 155137 - RNA, 22 nt, Homo sapiens
uuuaugcuacauguguuggaaa

SEQ ID NO: 155138 - RNA, 17 nt, Homo sapiens
uuucagaguggaagugu

SEQ ID NO: 155139 - RNA, 22 nt, Homo sapiens
uuucagcguggggugcugaaga

SEQ ID NO: 155140 - RNA, 22 nt, Homo sapiens
uuucaggcaagggugacccuga

SEQ ID NO: 155141 - RNA, 22 nt, Homo sapiens
uuucaguagagacacgguuuug

SEQ ID NO: 155142 - RNA, 22 nt, Homo sapiens
uuuccacauggacuuaccuucg

SEQ ID NO: 155143 - RNA, 22 nt, Homo sapiens
uuucccuuuagcuuagugauuu

SEQ ID NO: 155144 - RNA, 16 nt, Homo sapiens
uuucccuuugguguuu

SEQ ID NO: 155145 - RNA, 22 nt, Homo sapiens
uuucuauguugaccagucuaga

SEQ ID NO: 155146 - RNA, 22 nt, Homo sapiens
uuugaagacuacugggagugaa

SEQ ID NO: 155147 - RNA, 22 nt, Homo sapiens
uuugaaguguggcacugaguuu

SEQ ID NO: 155148 - RNA, 22 nt, Homo sapiens
uuugacuuuuagaauaugaguu

SEQ ID NO: 155149 - RNA, 22 nt, Homo sapiens
uuugagcaugcagauugccagg

SEQ ID NO: 155150 - RNA, 22 nt, Homo sapiens
uuugagguguauggcaaguuga

SEQ ID NO: 155151 - RNA, 22 nt, Homo sapiens
uuugaguaggcuuauauuuugg

SEQ ID NO: 155152 - RNA, 22 nt, Homo sapiens
uuugaguuugaggugcugauga

SEQ ID NO: 155153 - RNA, 22 nt, Homo sapiens
uuugcaauguugugauggugaa

SEQ ID NO: 155154 - RNA, 22 nt, Homo sapiens
uuugcacuuuaauauaauguga

SEQ ID NO: 155155 - RNA, 20 nt, Homo sapiens
uuugcagaaucuaagaagag

SEQ ID NO: 155156 - RNA, 22 nt, Homo sapiens
uuugcaguguaguuggccagca

SEQ ID NO: 155157 - RNA, 22 nt, Homo sapiens
uuugcaugcuccuuaugagaau

SEQ ID NO: 155158 - RNA, 23 nt, Homo sapiens
uuugccacuuauuagcugggagg

SEQ ID NO: 155159 - RNA, 22 nt, Homo sapiens
uuuggcaaagaucaacauguua

SEQ ID NO: 155160 - RNA, 22 nt, Homo sapiens
uuuggcaguuauuuacucagug

SEQ ID NO: 155161 - RNA, 22 nt, Homo sapiens
uuuggcauauuuuaagcugguu

SEQ ID NO: 155162 - RNA, 22 nt, Homo sapiens
uuuggcauuagauaauugugua

SEQ ID NO: 155163 - RNA, 21 nt, Homo sapiens
uuuggcauuaugucaccagag

SEQ ID NO: 155164 - RNA, 22 nt, Homo sapiens
uuuggcuuuugugauacguaau

SEQ ID NO: 155165 - RNA, 22 nt, Homo sapiens
uuugggaaugguuugucuccca

SEQ ID NO: 155166 - RNA, 22 nt, Homo sapiens
uuuggucacugccgccgccagc

SEQ ID NO: 155167 - RNA, 22 nt, Homo sapiens
uuugguugucacaacuggggga

SEQ ID NO: 155168 - RNA, 22 nt, Homo sapiens
uuuguaauccuauuccaaagga

SEQ ID NO: 155169 - RNA, 22 nt, Homo sapiens
uuuguacacuguuggugguuau

SEQ ID NO: 155170 - RNA, 22 nt, Homo sapiens
uuuguacuugguguucuggaaa

SEQ ID NO: 155171 - RNA, 18 nt, Homo sapiens
uuuguacuuuuucuaaug

SEQ ID NO: 155172 - RNA, 21 nt, Homo sapiens
uuuguaguagcaugauuuaua

SEQ ID NO: 155173 - RNA, 23 nt, Homo sapiens
uuuguaguagcaugauuuauaau

SEQ ID NO: 155174 - RNA, 22 nt, Homo sapiens
uuugucauagcagcaggaaugg

SEQ ID NO: 155175 - RNA, 22 nt, Homo sapiens
uuuguccccgcccagaucucau

SEQ ID NO: 155176 - RNA, 22 nt, Homo sapiens
uuugugcuccugugagaaucua

SEQ ID NO: 155177 - RNA, 22 nt, Homo sapiens
uuuguucuucguuccugagcca

SEQ ID NO: 155178 - RNA, 22 nt, Homo sapiens
uuuguuugaagucgagacaacu

SEQ ID NO: 155179 - RNA, 22 nt, Homo sapiens
uuuuaagcuacaagagacauau

SEQ ID NO: 155180 - RNA, 22 nt, Homo sapiens
uuuuacagaggagguugcugau

SEQ ID NO: 155181 - RNA, 20 nt, Homo sapiens
uuuuagcuuuuauugaaagc

SEQ ID NO: 155182 - RNA, 22 nt, Homo sapiens
uuuuaguugcucagguauucuc

SEQ ID NO: 155183 - RNA, 22 nt, Homo sapiens
uuuuaugggcuauuugcauuag

SEQ ID NO: 155184 - RNA, 22 nt, Homo sapiens
aagugagugacaaaaacugggc

SEQ ID NO: 155185 - RNA, 22 nt, Homo sapiens
aagugcacuguaagugcaggau

SEQ ID NO: 155186 - RNA, 22 nt, Homo sapiens
aagugcuuuuuagauaugguuu

SEQ ID NO: 155187 - RNA, 22 nt, Homo sapiens
aaguggcauugaggaaaaaaau

SEQ ID NO: 155188 - RNA, 22 nt, Homo sapiens
aagugguguuugggagcuggac

SEQ ID NO: 155189 - RNA, 22 nt, Homo sapiens
aagugguucuaugaguuugcaa

SEQ ID NO: 155190 - RNA, 22 nt, Homo sapiens
aagugucuuaccgggagggagu

SEQ ID NO: 155191 - RNA, 22 nt, Homo sapiens
aauaagaaguggaagggaccgg

SEQ ID NO: 155192 - RNA, 21 nt, Homo sapiens
aauacucuagguuaagagagc

SEQ ID NO: 155193 - RNA, 22 nt, Homo sapiens
aauacugcuuugauguaagcua

SEQ ID NO: 155194 - RNA, 22 nt, Homo sapiens
aauacuuccaaaucuagucauu

SEQ ID NO: 155195 - RNA, 22 nt, Homo sapiens
aauagcauugaaucuaccaauu

SEQ ID NO: 155196 - RNA, 22 nt, Homo sapiens
aaucacaguguucuugugaggg

SEQ ID NO: 155197 - RNA, 22 nt, Homo sapiens
aaucacaguuaguaagggagaa

SEQ ID NO: 155198 - RNA, 22 nt, Homo sapiens
aaucacuuugcuacaaggcagu

SEQ ID NO: 155199 - RNA, 17 nt, Homo sapiens
aaucagauuucugagga

SEQ ID NO: 155200 - RNA, 22 nt, Homo sapiens
aaucuguagaaggugcacauuc

SEQ ID NO: 155201 - RNA, 22 nt, Homo sapiens
aaugacugugauauuuuucuuc

SEQ ID NO: 155202 - RNA, 22 nt, Homo sapiens
aaugauacuguguacaagggca

SEQ ID NO: 155203 - RNA, 22 nt, Homo sapiens
aaugcacauauauuuccuuauu

SEQ ID NO: 155204 - RNA, 22 nt, Homo sapiens
aaugcacuccagccugggcgac

SEQ ID NO: 155205 - RNA, 22 nt, Homo sapiens
aaugccaucagagaaaacucuu

SEQ ID NO: 155206 - RNA, 22 nt, Homo sapiens
aauggcacacaccuggucuaac

SEQ ID NO: 155207 - RNA, 22 nt, Homo sapiens
aauggcacuuuauaaauguuaa

SEQ ID NO: 155208 - RNA, 22 nt, Homo sapiens
aauggcaucuacguuaaauguc

SEQ ID NO: 155209 - RNA, 22 nt, Homo sapiens
aauguguuuugaaaucaggaag

SEQ ID NO: 155210 - RNA, 22 nt, Homo sapiens
aauuaguaaccuaauuccaucu

SEQ ID NO: 155211 - RNA, 22 nt, Homo sapiens
aauuaguugaaagucugcuuuu

SEQ ID NO: 155212 - RNA, 22 nt, Homo sapiens
aauucugugagauggugcagau

SEQ ID NO: 155213 - RNA, 22 nt, Homo sapiens
aauugaaugauaugggacauuu

SEQ ID NO: 155214 - RNA, 23 nt, Homo sapiens
aauugcuuuugaggacuuaguug

SEQ ID NO: 155215 - RNA, 22 nt, Homo sapiens
aauuugucaccucucucccuuu

SEQ ID NO: 155216 - RNA, 22 nt, Homo sapiens
acaaaguaggcagugggcugga

SEQ ID NO: 155217 - RNA, 22 nt, Homo sapiens
acaaaguauggaauguuggugu

SEQ ID NO: 155218 - RNA, 22 nt, Homo sapiens
acaagcacaaaugcauagaugg

SEQ ID NO: 155219 - RNA, 22 nt, Homo sapiens
acacaguaaauauguauugaau

SEQ ID NO: 155220 - RNA, 22 nt, Homo sapiens
acacaguaaauauugucuccuc

SEQ ID NO: 155221 - RNA, 22 nt, Homo sapiens
acaccauugcauuccagccugg

SEQ ID NO: 155222 - RNA, 22 nt, Homo sapiens
acacguguugaaauuuaauugc

SEQ ID NO: 155223 - RNA, 22 nt, Homo sapiens
acacuguauccuucuguccuuu

SEQ ID NO: 155224 - RNA, 22 nt, Homo sapiens
acacugucugaugaaaguaguu

SEQ ID NO: 155225 - RNA, 22 nt, Homo sapiens
acagauagacauauauagcuca

SEQ ID NO: 155226 - RNA, 20 nt, Homo sapiens
acagcacugguuucaagcaa

SEQ ID NO: 155227 - RNA, 20 nt, Homo sapiens
acagcauagccuuuuaaagc

SEQ ID NO: 155228 - RNA, 22 nt, Homo sapiens
acagccauuccagccaaauacu

SEQ ID NO: 155229 - RNA, 21 nt, Homo sapiens
acaguacuugagaucuuuuga

SEQ ID NO: 155230 - RNA, 20 nt, Homo sapiens
acaguagaagggauuucaaa

SEQ ID NO: 155231 - RNA, 20 nt, Homo sapiens
acaguauguuuggaugcaua

SEQ ID NO: 155232 - RNA, 22 nt, Homo sapiens
acagugcuuuuguuccucuccu

SEQ ID NO: 155233 - RNA, 22 nt, Homo sapiens
acaguguagugacugccaacuu

SEQ ID NO: 155234 - RNA, 22 nt, Homo sapiens
acaguguuacuugauaguguau

SEQ ID NO: 155235 - RNA, 22 nt, Homo sapiens
acaucacuguuugauugauuga

SEQ ID NO: 155236 - RNA, 22 nt, Homo sapiens
acaucaggcuugugaugauuac

SEQ ID NO: 155237 - RNA, 22 nt, Homo sapiens
acauccauuugcuuuauuugcu

SEQ ID NO: 155238 - RNA, 22 nt, Homo sapiens
acaucccaugccuggguacucc

SEQ ID NO: 155239 - RNA, 22 nt, Homo sapiens
acaugcauccaugugaagagac

SEQ ID NO: 155240 - RNA, 22 nt, Homo sapiens
acauggcuuaugaauuuggaga

SEQ ID NO: 155241 - RNA, 18 nt, Homo sapiens
acauucagcuugaagaua

SEQ ID NO: 155242 - RNA, 22 nt, Homo sapiens
accacaggguaaaguuagauau

SEQ ID NO: 155243 - RNA, 22 nt, Homo sapiens
accaccacucccgcauucuaaa

SEQ ID NO: 155244 - RNA, 22 nt, Homo sapiens
accaguuuuuuauacaucuucu

SEQ ID NO: 155245 - RNA, 22 nt, Homo sapiens
acccaguaacauaugggaggga

SEQ ID NO: 155246 - RNA, 22 nt, Homo sapiens
acccaguagucauucaggagca

SEQ ID NO: 155247 - RNA, 22 nt, Homo sapiens
acccggagagcaggcgagaagg

SEQ ID NO: 155248 - RNA, 22 nt, Homo sapiens
acccgugcugaauauguaggug

SEQ ID NO: 155249 - RNA, 21 nt, Homo sapiens
acccucuaguuuucaacaggc

SEQ ID NO: 155250 - RNA, 22 nt, Homo sapiens
acccuggagagugcuguaguaa

SEQ ID NO: 155251 - RNA, 22 nt, Homo sapiens
acccuguaggugcuggcagaga

SEQ ID NO: 155252 - RNA, 22 nt, Homo sapiens
acccuguugagcaacuggccau

SEQ ID NO: 155253 - RNA, 22 nt, Homo sapiens
acccuuagguuaaaguugaguc

SEQ ID NO: 155254 - RNA, 18 nt, Homo sapiens
acccuucagcacugggcc

SEQ ID NO: 155255 - RNA, 22 nt, Homo sapiens
accucagcccggggaaguugag

SEQ ID NO: 155256 - RNA, 22 nt, Homo sapiens
accugagauuacaggugcuggc

SEQ ID NO: 155257 - RNA, 23 nt, Homo sapiens
accuucauucauucagcugaagu

SEQ ID NO: 155258 - RNA, 22 nt, Homo sapiens
acgugcaugcacacacaugcgc

SEQ ID NO: 155259 - RNA, 22 nt, Homo sapiens
acuacugucagacugccacuga

SEQ ID NO: 155260 - RNA, 22 nt, Homo sapiens
acucugucuaguuguaaaauuu

SEQ ID NO: 155261 - RNA, 22 nt, Homo sapiens
acugaguguugauuuagauuaa

SEQ ID NO: 155262 - RNA, 22 nt, Homo sapiens
acugcaaugucgaauagagaug

SEQ ID NO: 155263 - RNA, 22 nt, Homo sapiens
acugcacuccacccuuggcagc

SEQ ID NO: 155264 - RNA, 22 nt, Homo sapiens
acugcacuccagacucugucuc

SEQ ID NO: 155265 - RNA, 22 nt, Homo sapiens
acugcacuccagccugugcgua

SEQ ID NO: 155266 - RNA, 22 nt, Homo sapiens
acugcacuccagccuguugaca

SEQ ID NO: 155267 - RNA, 22 nt, Homo sapiens
acugcacuccagccuugcgaca

SEQ ID NO: 155268 - RNA, 22 nt, Homo sapiens
acugcacuccagccuuggcaac

SEQ ID NO: 155269 - RNA, 20 nt, Homo sapiens
acugcacuccagucucuggg

SEQ ID NO: 155270 - RNA, 22 nt, Homo sapiens
acugcacuucagccuuggcuac

SEQ ID NO: 155271 - RNA, 22 nt, Homo sapiens
acugccuaaugacuuauguuuu

SEQ ID NO: 155272 - RNA, 21 nt, Homo sapiens
acuggaccccuuccauacacc

SEQ ID NO: 155273 - RNA, 22 nt, Homo sapiens
acuggaguuuguucaagaaaua

SEQ ID NO: 155274 - RNA, 22 nt, Homo sapiens
acuggauguuagggauuuuauu

SEQ ID NO: 155275 - RNA, 22 nt, Homo sapiens
ugaaacacacagagaagggaga

SEQ ID NO: 155276 - RNA, 20 nt, Homo sapiens
ugaaacacauggacuggggu

SEQ ID NO: 155277 - RNA, 18 nt, Homo sapiens
ugaaacacauuuuuuccu

SEQ ID NO: 155278 - RNA, 22 nt, Homo sapiens
ugaaacugcagugggcuuggca

SEQ ID NO: 155279 - RNA, 22 nt, Homo sapiens
ugaaagacacagaaguugccca

SEQ ID NO: 155280 - RNA, 22 nt, Homo sapiens
ugaaagacugaagaauaggcau

SEQ ID NO: 155281 - RNA, 22 nt, Homo sapiens
ugaaaucauguaguuauugcaa

SEQ ID NO: 155282 - RNA, 22 nt, Homo sapiens
ugaaaugcuaauucguagcuaa

SEQ ID NO: 155283 - RNA, 22 nt, Homo sapiens
ugaaauguuaaacaaguggcuc

SEQ ID NO: 155284 - RNA, 22 nt, Homo sapiens
ugaacagcuaucuugucagugu

SEQ ID NO: 155285 - RNA, 22 nt, Homo sapiens
ugaacucagcauccagggccaa

SEQ ID NO: 155286 - RNA, 22 nt, Homo sapiens
ugaagagucuaaaucugucuuc

SEQ ID NO: 155287 - RNA, 22 nt, Homo sapiens
ugaaggacauucuaugguagau

SEQ ID NO: 155288 - RNA, 22 nt, Homo sapiens
ugaaggaguauggauaagucgu

SEQ ID NO: 155289 - RNA, 22 nt, Homo sapiens
ugaaguaauguuuuauucuauu

SEQ ID NO: 155290 - RNA, 22 nt, Homo sapiens
ugaaguaggcauaaguuaagcu

SEQ ID NO: 155291 - RNA, 22 nt, Homo sapiens
ugaagugaagacucacagaagg

SEQ ID NO: 155292 - RNA, 22 nt, Homo sapiens
ugaauacugugcaaaggauuug

SEQ ID NO: 155293 - RNA, 22 nt, Homo sapiens
ugaauaguuugacagaacucuu

SEQ ID NO: 155294 - RNA, 22 nt, Homo sapiens
ugaauauuugcuacucacucuu

SEQ ID NO: 155295 - RNA, 22 nt, Homo sapiens
gaaguaggugcuguuauuaucu

SEQ ID NO: 155296 - RNA, 22 nt, Homo sapiens
gaagugcaguggcacagucaug

SEQ ID NO: 155297 - RNA, 22 nt, Homo sapiens
gaaucacaguuauuagagcagc

SEQ ID NO: 155298 - RNA, 22 nt, Homo sapiens
gaaucacugugguaucccaugc

SEQ ID NO: 155299 - RNA, 22 nt, Homo sapiens
gaaucauuguuucuaaguuugu

SEQ ID NO: 155300 - RNA, 22 nt, Homo sapiens
gaaugcuaccagcaucuagugg

SEQ ID NO: 155301 - RNA, 22 nt, Homo sapiens
uaaaagucaucacaacuggagu

SEQ ID NO: 155302 - RNA, 22 nt, Homo sapiens
uaaagcacaaguaaagaauacu

SEQ ID NO: 155303 - RNA, 22 nt, Homo sapiens
uaaagcauguaauuagguuaga

SEQ ID NO: 155304 - RNA, 22 nt, Homo sapiens
uaaagcuacaguauaugguauu

SEQ ID NO: 155305 - RNA, 21 nt, Homo sapiens
uaaagcuagaaccuuagcuuu

SEQ ID NO: 155306 - RNA, 22 nt, Homo sapiens
uaaagcuauuauaguuauguuu

SEQ ID NO: 155307 - RNA, 20 nt, Homo sapiens
uaaaugccucaugcuuuauu

SEQ ID NO: 155308 - RNA, 22 nt, Homo sapiens
uaaaugcucuuuaaaagugcuu

SEQ ID NO: 155309 - RNA, 22 nt, Homo sapiens
uaacauugucuugcuuaguuuu

SEQ ID NO: 155310 - RNA, 22 nt, Homo sapiens
uaacccagugucugugaugggu

SEQ ID NO: 155311 - RNA, 22 nt, Homo sapiens
uaagacacuuaaaauguuacau

SEQ ID NO: 155312 - RNA, 20 nt, Homo sapiens
uaagacaugguccacaugcc

SEQ ID NO: 155313 - RNA, 22 nt, Homo sapiens
uaagagagcuccaucuuuuccu

SEQ ID NO: 155314 - RNA, 22 nt, Homo sapiens
uaagcaguaaaugaagucuugc

SEQ ID NO: 155315 - RNA, 22 nt, Homo sapiens
uaagcaguguggauccaccuug

SEQ ID NO: 155316 - RNA, 16 nt, Homo sapiens
uaagccccacgugcau

SEQ ID NO: 155317 - RNA, 22 nt, Homo sapiens
uaagcucauuccagccaugucc

SEQ ID NO: 155318 - RNA, 22 nt, Homo sapiens
uaaggcauuuuuuugaguugca

SEQ ID NO: 155319 - RNA, 22 nt, Homo sapiens
uaaggcuuaugguaaaguccug

SEQ ID NO: 155320 - RNA, 22 nt, Homo sapiens
uaaggcuugaucuuggugagau

SEQ ID NO: 155321 - RNA, 22 nt, Homo sapiens
uaaggcuugcuucagucuugaa

SEQ ID NO: 155322 - RNA, 22 nt, Homo sapiens
uaaguaauugugguuucugcca

SEQ ID NO: 155323 - RNA, 22 nt, Homo sapiens
uaagugaaggaaguguguuuac

SEQ ID NO: 155324 - RNA, 22 nt, Homo sapiens
uaagugcaugauuacaugcaua

SEQ ID NO: 155325 - RNA, 22 nt, Homo sapiens
uaagugcuugacuuugauguuu

SEQ ID NO: 155326 - RNA, 20 nt, Homo sapiens
uaagugcuuuauauugauua

SEQ ID NO: 155327 - RNA, 23 nt, Homo sapiens
uaaguucaucucuaauaggugga

SEQ ID NO: 155328 - RNA, 22 nt, Homo sapiens
uaaguucauucaugaaacuuag

SEQ ID NO: 155329 - RNA, 22 nt, Homo sapiens
uaauacuguaauggugguuccg

SEQ ID NO: 155330 - RNA, 22 nt, Homo sapiens
uaauaguuggcacuggagaaag

SEQ ID NO: 155331 - RNA, 22 nt, Homo sapiens
uaaugcuugguuguuuggaaaa

SEQ ID NO: 155332 - RNA, 22 nt, Homo sapiens
uaauucuguauguaucagaguu

SEQ ID NO: 155333 - RNA, 22 nt, Homo sapiens
uaauugcaguucuguguuauau

SEQ ID NO: 155334 - RNA, 22 nt, Homo sapiens
uacaagcuaaaauggaagauca

SEQ ID NO: 155335 - RNA, 19 nt, Homo sapiens
uacaggacugagcugaggu

SEQ ID NO: 155336 - RNA, 22 nt, Homo sapiens
uacaggacuucucagaguuauu

SEQ ID NO: 155337 - RNA, 22 nt, Homo sapiens
uacaguaauguuaaucuuugug

SEQ ID NO: 155338 - RNA, 22 nt, Homo sapiens
uacaguagaaugucuuucaaaa

SEQ ID NO: 155339 - RNA, 22 nt, Homo sapiens
uacagucuagaggagaaucagg

SEQ ID NO: 155340 - RNA, 22 nt, Homo sapiens
uacaguggugugaucucagcuc

SEQ ID NO: 155341 - RNA, 22 nt, Homo sapiens
uacauguauccauuguuuuugg

SEQ ID NO: 155342 - RNA, 22 nt, Homo sapiens
uaccaccauuguaguuuggaaa

SEQ ID NO: 155343 - RNA, 22 nt, Homo sapiens
uaccaguaaugguucuagagga

SEQ ID NO: 155344 - RNA, 22 nt, Homo sapiens
uacuacuuucugacaucuuuaa

SEQ ID NO: 155345 - RNA, 22 nt, Homo sapiens
uacuagaggaauugcuauaacu

SEQ ID NO: 155346 - RNA, 22 nt, Homo sapiens
uacugcuaccuccagcuucugg

SEQ ID NO: 155347 - RNA, 22 nt, Homo sapiens
uacugcugucagugccaaguag

SEQ ID NO: 155348 - RNA, 22 nt, Homo sapiens
uacugcuuaagggcaugggccc

SEQ ID NO: 155349 - RNA, 21 nt, Homo sapiens
uacuggagauacagucugcaa

SEQ ID NO: 155350 - RNA, 19 nt, Homo sapiens
uacuggcucgggaauuuuc

SEQ ID NO: 155351 - RNA, 22 nt, Homo sapiens
uacuggguguucugagaaaaua

SEQ ID NO: 155352 - RNA, 22 nt, Homo sapiens
uagaaagcaugaccuucagaua

SEQ ID NO: 155353 - RNA, 22 nt, Homo sapiens
uagaacaauugcuggauccgaa

SEQ ID NO: 155354 - RNA, 22 nt, Homo sapiens
uagaauggaagguugagaagaa

SEQ ID NO: 155355 - RNA, 22 nt, Homo sapiens
uagacacugcauauuuuuuuaa

SEQ ID NO: 155356 - RNA, 22 nt, Homo sapiens
uagagcacagugauuagaccua

SEQ ID NO: 155357 - RNA, 22 nt, Homo sapiens
uagagcacauuaucauuuccaa

SEQ ID NO: 155358 - RNA, 21 nt, Homo sapiens
uagauacuguauuaaaccuag

SEQ ID NO: 155359 - RNA, 22 nt, Homo sapiens
uagaucaacuuugguaagagaa

SEQ ID NO: 155360 - RNA, 22 nt, Homo sapiens
uagaucuuuaaaaggugcuaga

SEQ ID NO: 155361 - RNA, 22 nt, Homo sapiens
uagauucauuuuagcaaaaguu

SEQ ID NO: 155362 - RNA, 20 nt, Homo sapiens
uagcacacauguagaauagu

SEQ ID NO: 155363 - RNA, 22 nt, Homo sapiens
uagcacagggaauugguucucu

SEQ ID NO: 155364 - RNA, 17 nt, Homo sapiens
uagcacagugccuggua

SEQ ID NO: 155365 - RNA, 22 nt, Homo sapiens
uagcacaguucacccucgauuu

SEQ ID NO: 155366 - RNA, 22 nt, Homo sapiens
uagcaccacaaucaagauacag

SEQ ID NO: 155367 - RNA, 22 nt, Homo sapiens
uagcaccugugcacaccaggca

SEQ ID NO: 155368 - RNA, 22 nt, Homo sapiens
uagcagaauauaccucuuacuu

SEQ ID NO: 155369 - RNA, 22 nt, Homo sapiens
uagcagcaaagcaggaucugcu

SEQ ID NO: 155370 - RNA, 22 nt, Homo sapiens
uagcagcaucucuggcuucuac

SEQ ID NO: 155371 - RNA, 22 nt, Homo sapiens
uagcagcauuuuuguagaguau

SEQ ID NO: 155372 - RNA, 22 nt, Homo sapiens
uagcaguaaagaaugugauguu

SEQ ID NO: 155373 - RNA, 22 nt, Homo sapiens
uagcaguaucccaccaucuggu

SEQ ID NO: 155374 - RNA, 21 nt, Homo sapiens
uagcuacacugugauucaugg

SEQ ID NO: 155375 - RNA, 22 nt, Homo sapiens
uagcucagcccagcuaagcuca

SEQ ID NO: 155376 - RNA, 21 nt, Homo sapiens
uagcucagugguguugccaua

SEQ ID NO: 155377 - RNA, 22 nt, Homo sapiens
uagcugcuguauguacacggau

SEQ ID NO: 155378 - RNA, 22 nt, Homo sapiens
uagcuggaauuacuugcaccug

SEQ ID NO: 155379 - RNA, 18 nt, Homo sapiens
uaggaacauugauuggag

SEQ ID NO: 155380 - RNA, 22 nt, Homo sapiens
uaggaaguacaucucagaaucu

SEQ ID NO: 155381 - RNA, 22 nt, Homo sapiens
uaggacacagauggagaaaagc

SEQ ID NO: 155382 - RNA, 22 nt, Homo sapiens
uaggacacucucuccaccagua

SEQ ID NO: 155383 - RNA, 22 nt, Homo sapiens
uaggcuuuuggacccugucucu

SEQ ID NO: 155384 - RNA, 22 nt, Homo sapiens
uagguagcuuuggcguuucuug

SEQ ID NO: 155385 - RNA, 22 nt, Homo sapiens
uagguaguugugggcuugaaug

SEQ ID NO: 155386 - RNA, 22 nt, Homo sapiens
uaggucccguuucagacugaga

SEQ ID NO: 155387 - RNA, 22 nt, Homo sapiens
uaguaguuuuguguauaauaau

SEQ ID NO: 155388 - RNA, 22 nt, Homo sapiens
uaguuaguagacucugauuauu

SEQ ID NO: 155389 - RNA, 22 nt, Homo sapiens
uauaacaaugcaagaauggccu

SEQ ID NO: 155390 - RNA, 22 nt, Homo sapiens
uauacugucuuuguaugccuag

SEQ ID NO: 155391 - RNA, 22 nt, Homo sapiens
augaauacagcuaugcgugcau

SEQ ID NO: 155392 - RNA, 23 nt, Homo sapiens
augaauguaaggaguguaagaaa

SEQ ID NO: 155393 - RNA, 20 nt, Homo sapiens
augaauguccuugauggcau

SEQ ID NO: 155394 - RNA, 22 nt, Homo sapiens
augacaaugaaucccuguuuca

SEQ ID NO: 155395 - RNA, 22 nt, Homo sapiens
augacacugcagagauguccca

SEQ ID NO: 155396 - RNA, 22 nt, Homo sapiens
augacagagauaugugaauuuu

SEQ ID NO: 155397 - RNA, 22 nt, Homo sapiens
augacaguaugacuccaaaagu

SEQ ID NO: 155398 - RNA, 22 nt, Homo sapiens
augaccaugauccuugccgacc

SEQ ID NO: 155399 - RNA, 22 nt, Homo sapiens
augagaacauaucaagugauug

SEQ ID NO: 155400 - RNA, 22 nt, Homo sapiens
augagaaugaagccuggcgugu

SEQ ID NO: 155401 - RNA, 22 nt, Homo sapiens
augagaccagcagaaaaccugu

SEQ ID NO: 155402 - RNA, 22 nt, Homo sapiens
augagacuagaagagaauaaua

SEQ ID NO: 155403 - RNA, 22 nt, Homo sapiens
augagacuguucuuccucauug

SEQ ID NO: 155404 - RNA, 22 nt, Homo sapiens
augagagcuaacuguggguaca

SEQ ID NO: 155405 - RNA, 22 nt, Homo sapiens
augagauauguuaaaaguuaaa

SEQ ID NO: 155406 - RNA, 22 nt, Homo sapiens
augagcagaagagauacacugu

SEQ ID NO: 155407 - RNA, 22 nt, Homo sapiens
augagcagaugcuccugccucu

SEQ ID NO: 155408 - RNA, 17 nt, Homo sapiens
augagcucaucauuuuu

SEQ ID NO: 155409 - RNA, 22 nt, Homo sapiens
augaggaagucaggcccagggg

SEQ ID NO: 155410 - RNA, 22 nt, Homo sapiens
augaggcuauaauuuuuaugua

SEQ ID NO: 155411 - RNA, 20 nt, Homo sapiens
augagguguaugacacugaa

SEQ ID NO: 155412 - RNA, 22 nt, Homo sapiens
augagguguuuauuguauccug

SEQ ID NO: 155413 - RNA, 22 nt, Homo sapiens
augaguaugagaauacauuaag

SEQ ID NO: 155414 - RNA, 22 nt, Homo sapiens
augaguuccuuccuugccuagg

SEQ ID NO: 155415 - RNA, 15 nt, Homo sapiens
augaguuuuauggag

SEQ ID NO: 155416 - RNA, 22 nt, Homo sapiens
augauacuggcuucauagaaug

SEQ ID NO: 155417 - RNA, 22 nt, Homo sapiens
augaucacuguggaaauucagc

SEQ ID NO: 155418 - RNA, 22 nt, Homo sapiens
augaucuguuuggugaucuugu

SEQ ID NO: 155419 - RNA, 22 nt, Homo sapiens
augcaaggaugguuagauauau

SEQ ID NO: 155420 - RNA, 22 nt, Homo sapiens
augcacuguuguuauuggauaa

SEQ ID NO: 155421 - RNA, 22 nt, Homo sapiens
augcauagcaucugcaaauguu

SEQ ID NO: 155422 - RNA, 22 nt, Homo sapiens
augcauagugggaugcucugug

SEQ ID NO: 155423 - RNA, 20 nt, Homo sapiens
augccacugagcagugguga

SEQ ID NO: 155424 - RNA, 22 nt, Homo sapiens
augccacugcacuucagccugc

SEQ ID NO: 155425 - RNA, 22 nt, Homo sapiens
augccacugcgcucuagccugg

SEQ ID NO: 155426 - RNA, 22 nt, Homo sapiens
augccacuguuuaugucacuua

SEQ ID NO: 155427 - RNA, 22 nt, Homo sapiens
augccagggagaauuguucaag

SEQ ID NO: 155428 - RNA, 22 nt, Homo sapiens
augcccauuuguuuucugaaag

SEQ ID NO: 155429 - RNA, 22 nt, Homo sapiens
augccucugacaauuggauucu

SEQ ID NO: 155430 - RNA, 22 nt, Homo sapiens
augcuacugaccccuacuuaca

SEQ ID NO: 155431 - RNA, 22 nt, Homo sapiens
auggaagaauugucggggaugu

SEQ ID NO: 155432 - RNA, 22 nt, Homo sapiens
auggaauguauagucauguagg

SEQ ID NO: 155433 - RNA, 22 nt, Homo sapiens
auggacagacacuggccuucug

SEQ ID NO: 155434 - RNA, 22 nt, Homo sapiens
auggacguagauucucaaggau

SEQ ID NO: 155435 - RNA, 22 nt, Homo sapiens
auggagaugaacuuggguaaag

SEQ ID NO: 155436 - RNA, 22 nt, Homo sapiens
aggugaaugcucacauucuaau

SEQ ID NO: 155437 - RNA, 22 nt, Homo sapiens
aggugguguuggguuccagccc

SEQ ID NO: 155438 - RNA, 21 nt, Homo sapiens
agguuguguuuccucuuacuu

SEQ ID NO: 155439 - RNA, 22 nt, Homo sapiens
aguaaaucacuaauggcuuccg

SEQ ID NO: 155440 - RNA, 22 nt, Homo sapiens
aguagguguugguagagguuuc

SEQ ID NO: 155441 - RNA, 22 nt, Homo sapiens
aguaucaagccacacaugguca

SEQ ID NO: 155442 - RNA, 22 nt, Homo sapiens
agucaguguguauugauggcac

SEQ ID NO: 155443 - RNA, 20 nt, Homo sapiens
agucaguuuauuuucucucu

SEQ ID NO: 155444 - RNA, 22 nt, Homo sapiens
agucauggaucacaguagccuc

SEQ ID NO: 155445 - RNA, 19 nt, Homo sapiens
agucaugugaggacccuug

SEQ ID NO: 155446 - RNA, 22 nt, Homo sapiens
aguccauuugaugaugauucca

SEQ ID NO: 155447 - RNA, 22 nt, Homo sapiens
agucgguguuacugacagaaug

SEQ ID NO: 155448 - RNA, 22 nt, Homo sapiens
agugauggagccaggauuuaau

SEQ ID NO: 155449 - RNA, 22 nt, Homo sapiens
agugcaaggacauuuagguugu

SEQ ID NO: 155450 - RNA, 19 nt, Homo sapiens
agugcaauugccuuugugc

SEQ ID NO: 155451 - RNA, 22 nt, Homo sapiens
aguggauguuguggccugggag

SEQ ID NO: 155452 - RNA, 22 nt, Homo sapiens
aguggcaaugugauguccugaa

SEQ ID NO: 155453 - RNA, 22 nt, Homo sapiens
agugggccccuagaggugaggu

SEQ ID NO: 155454 - RNA, 19 nt, Homo sapiens
agugggcuagaaaucaggg

SEQ ID NO: 155455 - RNA, 22 nt, Homo sapiens
aguggugucugaguggccaggg

SEQ ID NO: 155456 - RNA, 22 nt, Homo sapiens
agugguguugccuguugaccua

SEQ ID NO: 155457 - RNA, 22 nt, Homo sapiens
aguucaaugcucuuucuacuau

SEQ ID NO: 155458 - RNA, 22 nt, Homo sapiens
aguuggcacugagcugugauug

SEQ ID NO: 155459 - RNA, 22 nt, Homo sapiens
auaaauaguaguugugguggcc

SEQ ID NO: 155460 - RNA, 19 nt, Homo sapiens
auaaaugccuacaagggug

SEQ ID NO: 155461 - RNA, 22 nt, Homo sapiens
auaaaugccuguuguuuuaagc

SEQ ID NO: 155462 - RNA, 22 nt, Homo sapiens
auaaaugcuuccagucauuaaa

SEQ ID NO: 155463 - RNA, 20 nt, Homo sapiens
auaaauguauagguguacau

SEQ ID NO: 155464 - RNA, 22 nt, Homo sapiens
auaaucaugucugaaaccuuug

SEQ ID NO: 155465 - RNA, 22 nt, Homo sapiens
auaaugcuggaacuagagggca

SEQ ID NO: 155466 - RNA, 22 nt, Homo sapiens
auacaugugccaugcuggugug

SEQ ID NO: 155467 - RNA, 22 nt, Homo sapiens
auacauguuucauguuggugug

SEQ ID NO: 155468 - RNA, 19 nt, Homo sapiens
auacccacuagguuacuua

SEQ ID NO: 155469 - RNA, 22 nt, Homo sapiens
auaccuuuuaggggaacguucu

SEQ ID NO: 155470 - RNA, 22 nt, Homo sapiens
auacuagucaagaauguaugag

SEQ ID NO: 155471 - RNA, 22 nt, Homo sapiens
auacuccugucucagcugagau

SEQ ID NO: 155472 - RNA, 22 nt, Homo sapiens
auacuguuuuacaucauugccu

SEQ ID NO: 155473 - RNA, 20 nt, Homo sapiens
auagaagacuagugcagcag

SEQ ID NO: 155474 - RNA, 22 nt, Homo sapiens
auagcagaacagugucucacug

SEQ ID NO: 155475 - RNA, 22 nt, Homo sapiens
auagcagacauuucaaggcagg

SEQ ID NO: 155476 - RNA, 22 nt, Homo sapiens
auagcuguccuuacuagcuagg

SEQ ID NO: 155477 - RNA, 22 nt, Homo sapiens
auaggagugugaacccuaucgu

SEQ ID NO: 155478 - RNA, 22 nt, Homo sapiens
auaggagugugcacagaguagg

SEQ ID NO: 155479 - RNA, 21 nt, Homo sapiens
auagugcuagagaguagcagg

SEQ ID NO: 155480 - RNA, 22 nt, Homo sapiens
auagugcuggaauaaauauacg

SEQ ID NO: 155481 - RNA, 22 nt, Homo sapiens
auauagcaaugaaagagaugaa

SEQ ID NO: 155482 - RNA, 22 nt, Homo sapiens
auaucccaguguguaaacacug

SEQ ID NO: 155483 - RNA, 22 nt, Homo sapiens
auaugcacaguggaguacuauu

SEQ ID NO: 155484 - RNA, 22 nt, Homo sapiens
auaugcacgugcauacacacuu

SEQ ID NO: 155485 - RNA, 22 nt, Homo sapiens
auaugcacuauacacacguaua

SEQ ID NO: 155486 - RNA, 22 nt, Homo sapiens
auaugcauacccucaccaacua

SEQ ID NO: 155487 - RNA, 22 nt, Homo sapiens
auaugcauguacccacacaggc

SEQ ID NO: 155488 - RNA, 22 nt, Homo sapiens
auauggguuuuauauuaggcuc

SEQ ID NO: 155489 - RNA, 21 nt, Homo sapiens
auaugugcuguggaagucagc

SEQ ID NO: 155490 - RNA, 22 nt, Homo sapiens
auauuacuggcuauaucgcaag

SEQ ID NO: 155491 - RNA, 22 nt, Homo sapiens
auauugcuccuaauaccacggu

SEQ ID NO: 155492 - RNA, 22 nt, Homo sapiens
auauuguacugcuacugguucu

SEQ ID NO: 155493 - RNA, 22 nt, Homo sapiens
auauuguuggcugcuggcugau

SEQ ID NO: 155494 - RNA, 19 nt, Homo sapiens
aucaaacugcucuuugagg

SEQ ID NO: 155495 - RNA, 20 nt, Homo sapiens
aucaaagacuuagaggggga

SEQ ID NO: 155496 - RNA, 22 nt, Homo sapiens
aucacagagucacgggcaacuu

SEQ ID NO: 155497 - RNA, 22 nt, Homo sapiens
aucacagugaaaacagucaauu

SEQ ID NO: 155498 - RNA, 22 nt, Homo sapiens
aucacagugagcauaugucuau

SEQ ID NO: 155499 - RNA, 22 nt, Homo sapiens
aucacaguggcucacaagagcc

SEQ ID NO: 155500 - RNA, 22 nt, Homo sapiens
aucacauuuauaguggcacgca

SEQ ID NO: 155501 - RNA, 22 nt, Homo sapiens
aucacugggauggaacugcuga

SEQ ID NO: 155502 - RNA, 22 nt, Homo sapiens
aucacugggcaagauaucauga

SEQ ID NO: 155503 - RNA, 23 nt, Homo sapiens
aucacuguuaacaauuucuuccu

SEQ ID NO: 155504 - RNA, 22 nt, Homo sapiens
aucagcaugcagaagucggggg

SEQ ID NO: 155505 - RNA, 22 nt, Homo sapiens
aucauguaguaagacacauuua

SEQ ID NO: 155506 - RNA, 22 nt, Homo sapiens
auccacagugucaauguuguga

SEQ ID NO: 155507 - RNA, 22 nt, Homo sapiens
auccaucagacggcaggcguug

SEQ ID NO: 155508 - RNA, 22 nt, Homo sapiens
auccucugagagaguuucauaa

SEQ ID NO: 155509 - RNA, 22 nt, Homo sapiens
auccugaagcuuuacugaauuc

SEQ ID NO: 155510 - RNA, 22 nt, Homo sapiens
aucucaguuaaugacccuaugc

SEQ ID NO: 155511 - RNA, 22 nt, Homo sapiens
aucuccaggugccagcugcgcc

SEQ ID NO: 155512 - RNA, 22 nt, Homo sapiens
aucucugagauguucugauuuu

SEQ ID NO: 155513 - RNA, 20 nt, Homo sapiens
aucucugggcaaaggaaaau

SEQ ID NO: 155514 - RNA, 22 nt, Homo sapiens
aucugguguccucgugggaguc

SEQ ID NO: 155515 - RNA, 22 nt, Homo sapiens
aucuucucuugaagggugggga

SEQ ID NO: 155516 - RNA, 22 nt, Homo sapiens
aucuuuaguggcuguuuucaga

SEQ ID NO: 155517 - RNA, 22 nt, Homo sapiens
aucuuuggucaucacagcuaga

SEQ ID NO: 155518 - RNA, 22 nt, Homo sapiens
aucuuuggugaguucuuugguc

SEQ ID NO: 155519 - RNA, 22 nt, Homo sapiens
augaaacuggcuaauuuuugua

SEQ ID NO: 155520 - RNA, 22 nt, Homo sapiens
augaaaguguguggaaacuuga

SEQ ID NO: 155521 - RNA, 22 nt, Homo sapiens
augaaaucuuuggcagaucuua

SEQ ID NO: 155522 - RNA, 22 nt, Homo sapiens
augaaauugcuaucgcaguacu

SEQ ID NO: 155523 - RNA, 18 nt, Homo sapiens
augaacucaucaguucuu

SEQ ID NO: 155524 - RNA, 19 nt, Homo sapiens
augaacucaucauuucuca

SEQ ID NO: 155525 - RNA, 17 nt, Homo sapiens
augaagucaucauuuuu

SEQ ID NO: 155526 - RNA, 20 nt, Homo sapiens
ucacagucacacauaauccu

SEQ ID NO: 155527 - RNA, 23 nt, Homo sapiens
ucacaguggcugcuuaauuguga

SEQ ID NO: 155528 - RNA, 22 nt, Homo sapiens
ucacaugugacauauauauuug

SEQ ID NO: 155529 - RNA, 22 nt, Homo sapiens
ucaccaguggcacuccagccug

SEQ ID NO: 155530 - RNA, 22 nt, Homo sapiens
ucaccuugcacaguuguguggg

SEQ ID NO: 155531 - RNA, 19 nt, Homo sapiens
ucaccuugcccugcacaca

SEQ ID NO: 155532 - RNA, 18 nt, Homo sapiens
ucaccuugugagagagag

SEQ ID NO: 155533 - RNA, 22 nt, Homo sapiens
ucacuagaucaagggagagaaa

SEQ ID NO: 155534 - RNA, 22 nt, Homo sapiens
ucacugagcacaggagaugugc

SEQ ID NO: 155535 - RNA, 22 nt, Homo sapiens
ucacuggacucuagccugggug

SEQ ID NO: 155536 - RNA, 22 nt, Homo sapiens
ucacugggagcauuugagccuu

SEQ ID NO: 155537 - RNA, 22 nt, Homo sapiens
ucagaucauauucuucgcugcu

SEQ ID NO: 155538 - RNA, 19 nt, Homo sapiens
ucagaugcauuagggguua

SEQ ID NO: 155539 - RNA, 22 nt, Homo sapiens
ucagauugaugcauacuuaaau

SEQ ID NO: 155540 - RNA, 22 nt, Homo sapiens
ucaggcaccuuccucuuaucug

SEQ ID NO: 155541 - RNA, 22 nt, Homo sapiens
ucaggcaugcagcaaugcagug

SEQ ID NO: 155542 - RNA, 22 nt, Homo sapiens
uucaguggagaggcugaguggu

SEQ ID NO: 155543 - RNA, 22 nt, Homo sapiens
uucagugucauuaacacaguag

SEQ ID NO: 155544 - RNA, 22 nt, Homo sapiens
uucaguucugcacugaucuuag

SEQ ID NO: 155545 - RNA, 22 nt, Homo sapiens
uucaguugcaucaguugaccag

SEQ ID NO: 155546 - RNA, 22 nt, Homo sapiens
uucaucaggaauauugaccugu

SEQ ID NO: 155547 - RNA, 22 nt, Homo sapiens
uucaucagggguauuggccaau

SEQ ID NO: 155548 - RNA, 22 nt, Homo sapiens
uucauggaauauugaccauuuu

SEQ ID NO: 155549 - RNA, 22 nt, Homo sapiens
uucaugucuuggcuguuagagu

SEQ ID NO: 155550 - RNA, 22 nt, Homo sapiens
uucauugaaugauuuuuagaag

SEQ ID NO: 155551 - RNA, 22 nt, Homo sapiens
uuccacaaugguugaacuagcu

SEQ ID NO: 155552 - RNA, 22 nt, Homo sapiens
uuccaguaauagcacagcauug

SEQ ID NO: 155553 - RNA, 22 nt, Homo sapiens
uucccagagccugggagugagg

SEQ ID NO: 155554 - RNA, 22 nt, Homo sapiens
uucccucagaaacacacagccc

SEQ ID NO: 155555 - RNA, 22 nt, Homo sapiens
uucccuuucugaaaaucucauu

SEQ ID NO: 155556 - RNA, 22 nt, Homo sapiens
uucccuuugaauuggaaaggug

SEQ ID NO: 155557 - RNA, 22 nt, Homo sapiens
uuccugaggccuccccagaagc

SEQ ID NO: 155558 - RNA, 22 nt, Homo sapiens
uuccuguagcgauuuuaguaau

SEQ ID NO: 155559 - RNA, 21 nt, Homo sapiens
uucuaaguaaauguuggacau

SEQ ID NO: 155560 - RNA, 22 nt, Homo sapiens
uucuacaugggucgucggugag

SEQ ID NO: 155561 - RNA, 22 nt, Homo sapiens
uucuagagagaagacuuaagcu

SEQ ID NO: 155562 - RNA, 22 nt, Homo sapiens
uucuaguacucccuggagcugg

SEQ ID NO: 155563 - RNA, 22 nt, Homo sapiens
uucucagugaacuccagcuugu

SEQ ID NO: 155564 - RNA, 22 nt, Homo sapiens
uucucagugcuaucuuuuaugc

SEQ ID NO: 155565 - RNA, 22 nt, Homo sapiens
uucucaguuccuacuuugguga

SEQ ID NO: 155566 - RNA, 22 nt, Homo sapiens
uucucauggaacaucuguacug

SEQ ID NO: 155567 - RNA, 22 nt, Homo sapiens
uucucuaguuacuuuaauggag

SEQ ID NO: 155568 - RNA, 22 nt, Homo sapiens
uucuggcucaggucaacacuuc

SEQ ID NO: 155569 - RNA, 22 nt, Homo sapiens
uucuggcucgauucucugaccg

SEQ ID NO: 155570 - RNA, 22 nt, Homo sapiens
uucuuaguggcaccacuuuuuu

SEQ ID NO: 155571 - RNA, 22 nt, Homo sapiens
uucuucaggccacaaaaauggu

SEQ ID NO: 155572 - RNA, 22 nt, Homo sapiens
uucuuccagccuugaggggccc

SEQ ID NO: 155573 - RNA, 22 nt, Homo sapiens
uucuuuaguucacuugcuccag

SEQ ID NO: 155574 - RNA, 19 nt, Homo sapiens
uugaaggccgccuugcaga

SEQ ID NO: 155575 - RNA, 22 nt, Homo sapiens
uugaaguguguauacauugugg

SEQ ID NO: 155576 - RNA, 18 nt, Homo sapiens
uugaauagagccaagcac

SEQ ID NO: 155577 - RNA, 22 nt, Homo sapiens
uugaauguguugggaagcccuu

SEQ ID NO: 155578 - RNA, 22 nt, Homo sapiens
uugacaggaugcucagggccca

SEQ ID NO: 155579 - RNA, 22 nt, Homo sapiens
uugacauaguuucugaaauaga

SEQ ID NO: 155580 - RNA, 21 nt, Homo sapiens
uugagaagaauuagcucuucc

SEQ ID NO: 155581 - RNA, 22 nt, Homo sapiens
uugagacgaagucucacucuug

SEQ ID NO: 155582 - RNA, 22 nt, Homo sapiens
uugagagaaaaaauuuauuggu

SEQ ID NO: 155583 - RNA, 22 nt, Homo sapiens
uugagagaaaaggccaugccuu

SEQ ID NO: 155584 - RNA, 22 nt, Homo sapiens
uugagagagaacauuuguuaca

SEQ ID NO: 155585 - RNA, 22 nt, Homo sapiens
uugagauagaauaggaauggga

SEQ ID NO: 155586 - RNA, 22 nt, Homo sapiens
uugagauagggucuaccucugu

SEQ ID NO: 155587 - RNA, 22 nt, Homo sapiens
uugagauauccauaaaugggaa

SEQ ID NO: 155588 - RNA, 22 nt, Homo sapiens
uugagauggagcuucacucuug

SEQ ID NO: 155589 - RNA, 22 nt, Homo sapiens
uugagauggagucuugcucucu

SEQ ID NO: 155590 - RNA, 22 nt, Homo sapiens
uugagauggagucuugcucugu

SEQ ID NO: 155591 - RNA, 22 nt, Homo sapiens
uugagauggaguguugcucugu

SEQ ID NO: 155592 - RNA, 22 nt, Homo sapiens
uugagauggaguucauuuuugu

SEQ ID NO: 155593 - RNA, 22 nt, Homo sapiens
uugagauggugccacuguacuc

SEQ ID NO: 155594 - RNA, 22 nt, Homo sapiens
uugagcaaugucacugaggcuu

SEQ ID NO: 155595 - RNA, 22 nt, Homo sapiens
uugagccaaggauugucuuucc

SEQ ID NO: 155596 - RNA, 22 nt, Homo sapiens
uugaggaggcagucugcccauu

SEQ ID NO: 155597 - RNA, 22 nt, Homo sapiens
uugaggcuuuugaccucaugug

SEQ ID NO: 155598 - RNA, 22 nt, Homo sapiens
uugagguaauaaacagccauuc

SEQ ID NO: 155599 - RNA, 20 nt, Homo sapiens
uugaggucaggaguuuggga

SEQ ID NO: 155600 - RNA, 22 nt, Homo sapiens
uugaggugggaggaucacuuga

SEQ ID NO: 155601 - RNA, 20 nt, Homo sapiens
uugaggugugaggggcagag

SEQ ID NO: 155602 - RNA, 22 nt, Homo sapiens
uugagguuggaggccuugccug

SEQ ID NO: 155603 - RNA, 22 nt, Homo sapiens
uugauagaucagggauuugauu

SEQ ID NO: 155604 - RNA, 22 nt, Homo sapiens
uugaucaauagaauacaacaga

SEQ ID NO: 155605 - RNA, 22 nt, Homo sapiens
uugaucuguguuagaagcuaag

SEQ ID NO: 155606 - RNA, 22 nt, Homo sapiens
uugauuagauccaguugauuga

SEQ ID NO: 155607 - RNA, 20 nt, Homo sapiens
uugcacagagaaggaggcag

SEQ ID NO: 155608 - RNA, 22 nt, Homo sapiens
uugcacagugcuuucuuugccc

SEQ ID NO: 155609 - RNA, 22 nt, Homo sapiens
uugcacauguugaaccagcaaa

SEQ ID NO: 155610 - RNA, 22 nt, Homo sapiens
uugcacauugcaccuuuuguau

SEQ ID NO: 155611 - RNA, 22 nt, Homo sapiens
uugcacuauaggaaaauguguc

SEQ ID NO: 155612 - RNA, 22 nt, Homo sapiens
uugcagcaacauggaugaaacu

SEQ ID NO: 155613 - RNA, 22 nt, Homo sapiens
uugcaggcaugagccaccgugc

SEQ ID NO: 155614 - RNA, 22 nt, Homo sapiens
uugcaugggagcugggugaagc

SEQ ID NO: 155615 - RNA, 22 nt, Homo sapiens
uugcucaggcuagaguucagcu

SEQ ID NO: 155616 - RNA, 22 nt, Homo sapiens
uugcucaggcuggaguacaaug

SEQ ID NO: 155617 - RNA, 22 nt, Homo sapiens
uuggaagagaagggagauaaac

SEQ ID NO: 155618 - RNA, 22 nt, Homo sapiens
uuggaauuaagagauauuuucu

SEQ ID NO: 155619 - RNA, 22 nt, Homo sapiens
uuggaauuuauuuggaugggag

SEQ ID NO: 155620 - RNA, 19 nt, Homo sapiens
uuggaauuuuagaguuuga

SEQ ID NO: 155621 - RNA, 22 nt, Homo sapiens
uuggacagaugguuacauuuuu

SEQ ID NO: 155622 - RNA, 22 nt, Homo sapiens
uuggacugagaguuccaccauu

SEQ ID NO: 155623 - RNA, 22 nt, Homo sapiens
uuggacuuuaagauagagaugu

SEQ ID NO: 155624 - RNA, 22 nt, Homo sapiens
uuggagugugucuuauuccauu

SEQ ID NO: 155625 - RNA, 22 nt, Homo sapiens
uuggaguguucugguccgggcu

SEQ ID NO: 155626 - RNA, 22 nt, Homo sapiens
uuguaaaguucucucccgaaaa

SEQ ID NO: 155627 - RNA, 22 nt, Homo sapiens
uuguaaaguucuuaggaagcuc

SEQ ID NO: 155628 - RNA, 22 nt, Homo sapiens
uuguaacaguuuauugacucga

SEQ ID NO: 155629 - RNA, 22 nt, Homo sapiens
uuguacaggaguguaagcuuca

SEQ ID NO: 155630 - RNA, 22 nt, Homo sapiens
uuguacuccagccugggugaca

SEQ ID NO: 155631 - RNA, 22 nt, Homo sapiens
uuguauaguucuauguguuuug

SEQ ID NO: 155632 - RNA, 22 nt, Homo sapiens
uuguauguaaccauuuggcaaa

SEQ ID NO: 155633 - RNA, 22 nt, Homo sapiens
uuguauguuucugugcacauga

SEQ ID NO: 155634 - RNA, 22 nt, Homo sapiens
uuguauguuuguucuuucagau

SEQ ID NO: 155635 - RNA, 22 nt, Homo sapiens
uugucaaugggugagugcagag

SEQ ID NO: 155636 - RNA, 22 nt, Homo sapiens
uugucacucuuccuaggguagg

SEQ ID NO: 155637 - RNA, 22 nt, Homo sapiens
uugucacugcacuccagucugg

SEQ ID NO: 155638 - RNA, 19 nt, Homo sapiens
uuguccccucuaaaucuca

SEQ ID NO: 155639 - RNA, 22 nt, Homo sapiens
uuguccucuccaaaucucaugu

SEQ ID NO: 155640 - RNA, 22 nt, Homo sapiens
uugucucacuggaguuuaguaa

SEQ ID NO: 155641 - RNA, 19 nt, Homo sapiens
uugucuuagaguugucauu

SEQ ID NO: 155642 - RNA, 22 nt, Homo sapiens
uugugaauggaguagcaggauc

SEQ ID NO: 155643 - RNA, 22 nt, Homo sapiens
uugugaauggugccgcgauaaa

SEQ ID NO: 155644 - RNA, 22 nt, Homo sapiens
uugugaauggugccucaguaaa

SEQ ID NO: 155645 - RNA, 22 nt, Homo sapiens
uugugcaaaaguaauugcgguu

SEQ ID NO: 155646 - RNA, 22 nt, Homo sapiens
uugugcaugaugcauacauggu

SEQ ID NO: 155647 - RNA, 22 nt, Homo sapiens
uugugcauguauauuaguucac

SEQ ID NO: 155648 - RNA, 22 nt, Homo sapiens
uuguguccccacccaaaucuca

SEQ ID NO: 155649 - RNA, 22 nt, Homo sapiens
uugugucccugcggcugaggag

SEQ ID NO: 155650 - RNA, 22 nt, Homo sapiens
uuguguuuuuaguagggaaggg

SEQ ID NO: 155651 - RNA, 22 nt, Homo sapiens
uuuaaacugucuuggguuugga

SEQ ID NO: 155652 - RNA, 20 nt, Homo sapiens
uuuaagacaugcugaauuga

SEQ ID NO: 155653 - RNA, 23 nt, Homo sapiens
uuuaagcuucauguccuaacauc

SEQ ID NO: 155654 - RNA, 22 nt, Homo sapiens
uuuaaugcugcccagucauggg

SEQ ID NO: 155655 - RNA, 21 nt, Homo sapiens
uuuagguagcuuuucugggag

SEQ ID NO: 155656 - RNA, 22 nt, Homo sapiens
uuuaguacugcuuuaugugugu

SEQ ID NO: 155657 - RNA, 22 nt, Homo sapiens
uuuaguucauuaaggaaucucc

SEQ ID NO: 155658 - RNA, 22 nt, Homo sapiens
uuuaucuguuuaaaacuguuca

SEQ ID NO: 155659 - RNA, 23 nt, Homo sapiens
uuucacaguagcuggaucagccu

SEQ ID NO: 155660 - RNA, 22 nt, Homo sapiens
uuucaccguguuggccaggcug

SEQ ID NO: 155661 - RNA, 22 nt, Homo sapiens
uuucaggcagggagcuucagug

SEQ ID NO: 155662 - RNA, 22 nt, Homo sapiens
uuuccuguaggaaggaaauaga

SEQ ID NO: 155663 - RNA, 22 nt, Homo sapiens
uuucugugguccucuugaaggu

SEQ ID NO: 155664 - RNA, 19 nt, Homo sapiens
uuugaauauaaugcagcua

SEQ ID NO: 155665 - RNA, 22 nt, Homo sapiens
uuugaauguaaugagcaggaag

SEQ ID NO: 155666 - RNA, 22 nt, Homo sapiens
uuugagaaugcuaccagagaag

SEQ ID NO: 155667 - RNA, 22 nt, Homo sapiens
uuugagcaagaggugacauuau

SEQ ID NO: 155668 - RNA, 22 nt, Homo sapiens
uuugagcaggcuaaucaauaua

SEQ ID NO: 155669 - RNA, 22 nt, Homo sapiens
uuugagcauggaaauggcauga

SEQ ID NO: 155670 - RNA, 22 nt, Homo sapiens
uuugagcuagagucucacucug

SEQ ID NO: 155671 - RNA, 21 nt, Homo sapiens
uuugaucauuaaaagugaauc

SEQ ID NO: 155672 - RNA, 22 nt, Homo sapiens
uuugauguccaccucagcccac

SEQ ID NO: 155673 - RNA, 21 nt, Homo sapiens
uuugcauauguugaaccagcc

SEQ ID NO: 155674 - RNA, 22 nt, Homo sapiens
uuugcugagucugacuucaugg

SEQ ID NO: 155675 - RNA, 22 nt, Homo sapiens
uuuggaaugaaacagcagagcc

SEQ ID NO: 155676 - RNA, 22 nt, Homo sapiens
uuuggaaugugcacucagauug

SEQ ID NO: 155677 - RNA, 22 nt, Homo sapiens
uuuggcauuaagaugcuguauc

SEQ ID NO: 155678 - RNA, 22 nt, Homo sapiens
uuuggcauuagagagacuugca

SEQ ID NO: 155679 - RNA, 22 nt, Homo sapiens
uuuggcauuuuacuacucaaau

SEQ ID NO: 155680 - RNA, 22 nt, Homo sapiens
uuuggcuuaagauugacugcaa

SEQ ID NO: 155681 - RNA, 22 nt, Homo sapiens
uuugggaaugaguuuaucauuu

SEQ ID NO: 155682 - RNA, 22 nt, Homo sapiens
uuugugauugcacacucaagau

SEQ ID NO: 155683 - RNA, 22 nt, Homo sapiens
uuugugcuaaugcuagauuacu

SEQ ID NO: 155684 - RNA, 22 nt, Homo sapiens
uuuuagcaaagagacugguggc

SEQ ID NO: 155685 - RNA, 22 nt, Homo sapiens
uuuuagcuuuucccaggacucc

SEQ ID NO: 155686 - RNA, 22 nt, Homo sapiens
uuuucaguuuuccagguagccg

SEQ ID NO: 155687 - RNA, 22 nt, Homo sapiens
uuuugcaccauccuaauaguau

SEQ ID NO: 155688 - RNA, 22 nt, Homo sapiens
uuuugcucuucauagguccugu

SEQ ID NO: 155689 - RNA, 22 nt, Homo sapiens
uuuugcucuugguaaugaaaga

SEQ ID NO: 155690 - RNA, 22 nt, Homo sapiens
uuuugcuugugaauagccacau

SEQ ID NO: 155691 - RNA, 22 nt, Homo sapiens
uuuuggcacuuugucugauucu

SEQ ID NO: 155692 - RNA, 22 nt, Homo sapiens
uuuuggcucugucuguaucuuu

SEQ ID NO: 155693 - RNA, 22 nt, Homo sapiens
uuuuggcucuugguaggucaga

SEQ ID NO: 155694 - RNA, 22 nt, Homo sapiens
uuuuguacaacagcucugggga

SEQ ID NO: 155695 - RNA, 22 nt, Homo sapiens
uuuuugaguagcuggagagcag

SEQ ID NO: 155696 - RNA, 23 nt, Homo sapiens
uuuuuguguuucauggaaauagg

SEQ ID NO: 155697 - RNA, 20 nt, Homo sapiens
ucagguagaucuuugagguc

SEQ ID NO: 155698 - RNA, 23 nt, Homo sapiens
ucagguaguuucagaggaccuug

SEQ ID NO: 155699 - RNA, 22 nt, Homo sapiens
ucagguaguuugugggagauga

SEQ ID NO: 155700 - RNA, 22 nt, Homo sapiens
ucagguauuucuuuuagcugug

SEQ ID NO: 155701 - RNA, 22 nt, Homo sapiens
ucaggucauuccaggagggcca

SEQ ID NO: 155702 - RNA, 22 nt, Homo sapiens
ucaguaaaugcuguucucuuuu

SEQ ID NO: 155703 - RNA, 19 nt, Homo sapiens
ucagugcuauguaauguag

SEQ ID NO: 155704 - RNA, 22 nt, Homo sapiens
ucagugcuuggcacagagagcu

SEQ ID NO: 155705 - RNA, 22 nt, Homo sapiens
ucagugucaucuggguuguuug

SEQ ID NO: 155706 - RNA, 22 nt, Homo sapiens
ucauaaaguuguuuuaauggga

SEQ ID NO: 155707 - RNA, 22 nt, Homo sapiens
ucauagaucaaguaauaagaca

SEQ ID NO: 155708 - RNA, 22 nt, Homo sapiens
ucauaguagucacuuaauaaau

SEQ ID NO: 155709 - RNA, 19 nt, Homo sapiens
ucauagucuaagaugagaa

SEQ ID NO: 155710 - RNA, 21 nt, Homo sapiens
ucaucaagcuguagacaugau

SEQ ID NO: 155711 - RNA, 22 nt, Homo sapiens
ucaucaggaaacuuaugcagug

SEQ ID NO: 155712 - RNA, 22 nt, Homo sapiens
ucaucucaguuucuugccguac

SEQ ID NO: 155713 - RNA, 22 nt, Homo sapiens
ucaugcaucuuguggaauuuga

SEQ ID NO: 155714 - RNA, 22 nt, Homo sapiens
ucauggcauuguuaaggguuuu

SEQ ID NO: 155715 - RNA, 22 nt, Homo sapiens
uugagaucuuuuaggccuuugu

SEQ ID NO: 155716 - RNA, 22 nt, Homo sapiens
uugagaugaagucuugcucucu

SEQ ID NO: 155717 - RNA, 22 nt, Homo sapiens
uugagaugaaguuuugcucuuu

SEQ ID NO: 155718 - RNA, 22 nt, Homo sapiens
uugagauggagucucguucugu

SEQ ID NO: 155719 - RNA, 22 nt, Homo sapiens
uugagcaaaacauuaauauuag

SEQ ID NO: 155720 - RNA, 22 nt, Homo sapiens
uugagcacaggaguuugagacc

SEQ ID NO: 155721 - RNA, 22 nt, Homo sapiens
uugagcuauguacagaugcugu

SEQ ID NO: 155722 - RNA, 22 nt, Homo sapiens
uugaggacugcuaagcauuuga

SEQ ID NO: 155723 - RNA, 22 nt, Homo sapiens
uugagggagcacagauucuuau

SEQ ID NO: 155724 - RNA, 22 nt, Homo sapiens
uugagguaguacuuauuauugg

SEQ ID NO: 155725 - RNA, 22 nt, Homo sapiens
uugaggugaagggcagagcagc

SEQ ID NO: 155726 - RNA, 22 nt, Homo sapiens
uugaguuugaguauucuaaagc

SEQ ID NO: 155727 - RNA, 22 nt, Homo sapiens
uugauagguuuuauguauaguu

SEQ ID NO: 155728 - RNA, 23 nt, Homo sapiens
uugcaaagccugaaacucuucag

SEQ ID NO: 155729 - RNA, 22 nt, Homo sapiens
uugcaaaguuugccuccuguag

SEQ ID NO: 155730 - RNA, 22 nt, Homo sapiens
uugcaacauuguaaguuuauau

SEQ ID NO: 155731 - RNA, 22 nt, Homo sapiens
uugcacaauggaauuuaucuuu

SEQ ID NO: 155732 - RNA, 22 nt, Homo sapiens
uugcacauggcaggugcucaau

SEQ ID NO: 155733 - RNA, 22 nt, Homo sapiens
uugcacauugauuuuguauccu

SEQ ID NO: 155734 - RNA, 22 nt, Homo sapiens
uugcacauuuuuucuggcagaa

SEQ ID NO: 155735 - RNA, 20 nt, Homo sapiens
uugcagagcccaacccugga

SEQ ID NO: 155736 - RNA, 22 nt, Homo sapiens
uugcagcaaauaggaaugagga

SEQ ID NO: 155737 - RNA, 22 nt, Homo sapiens
uugcaggugguuuaugcaagac

SEQ ID NO: 155738 - RNA, 22 nt, Homo sapiens
uugcaugcacaguucucaauag

SEQ ID NO: 155739 - RNA, 22 nt, Homo sapiens
uugcaugggagcugggugaggc

SEQ ID NO: 155740 - RNA, 22 nt, Homo sapiens
uugcauuuucuaggagggcaaa

SEQ ID NO: 155741 - RNA, 22 nt, Homo sapiens
uugccauagugcugccagauau

SEQ ID NO: 155742 - RNA, 22 nt, Homo sapiens
uugcuagagaugagggaugugu

SEQ ID NO: 155743 - RNA, 22 nt, Homo sapiens
uuggaaaaauccaccuugaucu

SEQ ID NO: 155744 - RNA, 22 nt, Homo sapiens
uuggaagacauucugucugcua

SEQ ID NO: 155745 - RNA, 22 nt, Homo sapiens
uuggaagauuacuuaguuuucu

SEQ ID NO: 155746 - RNA, 22 nt, Homo sapiens
uuggaagguaaucaaaaguucu

SEQ ID NO: 155747 - RNA, 22 nt, Homo sapiens
uuggaauacuuguuaaagucca

SEQ ID NO: 155748 - RNA, 23 nt, Homo sapiens
uuggaaugagaccuaagaguuuu

SEQ ID NO: 155749 - RNA, 22 nt, Homo sapiens
uuggaaugcaacagaaggauaa

SEQ ID NO: 155750 - RNA, 22 nt, Homo sapiens
uuggaauguauggcaucuugcg

SEQ ID NO: 155751 - RNA, 22 nt, Homo sapiens
uuggaauuaaccuggugcugga

SEQ ID NO: 155752 - RNA, 22 nt, Homo sapiens
uuggaauuagacaagugguggu

SEQ ID NO: 155753 - RNA, 22 nt, Homo sapiens
uuggaauuuuacuucuguaaga

SEQ ID NO: 155754 - RNA, 22 nt, Homo sapiens
uuggagagagaggacucccggc

SEQ ID NO: 155755 - RNA, 22 nt, Homo sapiens
uuggagugugagagcagccugg

SEQ ID NO: 155756 - RNA, 22 nt, Homo sapiens
uuggcaacauagugagaccccc

SEQ ID NO: 155757 - RNA, 22 nt, Homo sapiens
uuggcacugagcaagaacaggg

SEQ ID NO: 155758 - RNA, 22 nt, Homo sapiens
uuggcagucugaggcacagacu

SEQ ID NO: 155759 - RNA, 20 nt, Homo sapiens
uuggcauuuagacaagaguu

SEQ ID NO: 155760 - RNA, 22 nt, Homo sapiens
uuggcuuggagaguugaaaugu

SEQ ID NO: 155761 - RNA, 22 nt, Homo sapiens
uugggaaugcuaaaccucuauu

SEQ ID NO: 155762 - RNA, 22 nt, Homo sapiens
uuggggcacggccucuguugcc

SEQ ID NO: 155763 - RNA, 22 nt, Homo sapiens
uugguacuacacuucuaaucuu

SEQ ID NO: 155764 - RNA, 22 nt, Homo sapiens
uuggucaggcuagaguguggug

SEQ ID NO: 155765 - RNA, 22 nt, Homo sapiens
uuggucaucucccuccuuuuag

SEQ ID NO: 155766 - RNA, 22 nt, Homo sapiens
uugguucucuuagccaucuuaa

SEQ ID NO: 155767 - RNA, 22 nt, Homo sapiens
uuguacuuuuaguagagacggg

SEQ ID NO: 155768 - RNA, 22 nt, Homo sapiens
uuguaguagucucguucuuuua

SEQ ID NO: 155769 - RNA, 22 nt, Homo sapiens
uuguauguuguuugucagagaa

SEQ ID NO: 155770 - RNA, 22 nt, Homo sapiens
uugucauuuucagaguguuacg

SEQ ID NO: 155771 - RNA, 22 nt, Homo sapiens
acagugcuguuguguuuucacg

SEQ ID NO: 155772 - RNA, 22 nt, Homo sapiens
acaguggugcgaucucggcuca

SEQ ID NO: 155773 - RNA, 22 nt, Homo sapiens
acagugucaugucguguucccc

SEQ ID NO: 155774 - RNA, 18 nt, Homo sapiens
acaguguguaaggguucu

SEQ ID NO: 155775 - RNA, 22 nt, Homo sapiens
acauagaguaguggugaggaug

SEQ ID NO: 155776 - RNA, 22 nt, Homo sapiens
acaugcauauguuggaagaaag

SEQ ID NO: 155777 - RNA, 22 nt, Homo sapiens
acaugccucccugguccgcugu

SEQ ID NO: 155778 - RNA, 22 nt, Homo sapiens
acaugguacugauuuacgaaau

SEQ ID NO: 155779 - RNA, 21 nt, Homo sapiens
acauguacacauguaugcaca

SEQ ID NO: 155780 - RNA, 22 nt, Homo sapiens
acccaguguugggcagaacugu

SEQ ID NO: 155781 - RNA, 22 nt, Homo sapiens
acccauguaggugggauuacag

SEQ ID NO: 155782 - RNA, 21 nt, Homo sapiens
acccccacaccuccuuaguuc

SEQ ID NO: 155783 - RNA, 22 nt, Homo sapiens
acccgugcucacugccucugcc

SEQ ID NO: 155784 - RNA, 22 nt, Homo sapiens
acccucaagggacugacagaau

SEQ ID NO: 155785 - RNA, 22 nt, Homo sapiens
acccugcuaaacagcccccugc

SEQ ID NO: 155786 - RNA, 22 nt, Homo sapiens
accuucauuguugccaugucca

SEQ ID NO: 155787 - RNA, 22 nt, Homo sapiens
acuauacuguaacuguauucag

SEQ ID NO: 155788 - RNA, 22 nt, Homo sapiens
acucagagugggccccuagaua

SEQ ID NO: 155789 - RNA, 22 nt, Homo sapiens
acugagacugagaauguuucuu

SEQ ID NO: 155790 - RNA, 22 nt, Homo sapiens
acugcacuccagccugcccaac

SEQ ID NO: 155791 - RNA, 22 nt, Homo sapiens
acugcacuccagccugcugggu

SEQ ID NO: 155792 - RNA, 22 nt, Homo sapiens
acugcacuccagccuggacgaa

SEQ ID NO: 155793 - RNA, 22 nt, Homo sapiens
acugcacuccagccugugagac

SEQ ID NO: 155794 - RNA, 22 nt, Homo sapiens
acugcacuccagccuuggcggc

SEQ ID NO: 155795 - RNA, 22 nt, Homo sapiens
acuggcucugcuuuacaaacag

SEQ ID NO: 155796 - RNA, 20 nt, Homo sapiens
acugggcuaccgaaguaagg

SEQ ID NO: 155797 - RNA, 22 nt, Homo sapiens
acuguacuacagccugggugac

SEQ ID NO: 155798 - RNA, 22 nt, Homo sapiens
acuguacuccauccugggugac

SEQ ID NO: 155799 - RNA, 22 nt, Homo sapiens
acuuugcuuagagggcauuaaa

SEQ ID NO: 155800 - RNA, 22 nt, Homo sapiens
agaaauguuuacucacccccuu

SEQ ID NO: 155801 - RNA, 22 nt, Homo sapiens
agaaccaaucccacauggauac

SEQ ID NO: 155802 - RNA, 22 nt, Homo sapiens
agaauguuuuagaccaauacaa

SEQ ID NO: 155803 - RNA, 22 nt, Homo sapiens
agacucauuuccauagucagcu

SEQ ID NO: 155804 - RNA, 22 nt, Homo sapiens
agagaacugauuggaugugggc

SEQ ID NO: 155805 - RNA, 22 nt, Homo sapiens
agagacauugcuccaacucacc

SEQ ID NO: 155806 - RNA, 22 nt, Homo sapiens
agagagcuuuugguugcccuaa

SEQ ID NO: 155807 - RNA, 22 nt, Homo sapiens
agagauaauuagguuaaaugag

SEQ ID NO: 155808 - RNA, 22 nt, Homo sapiens
agagcaaugggugaauauuaaa

SEQ ID NO: 155809 - RNA, 22 nt, Homo sapiens
agagcuaguauuuacggagcau

SEQ ID NO: 155810 - RNA, 22 nt, Homo sapiens
agagguaagaauaguaguugga

SEQ ID NO: 155811 - RNA, 22 nt, Homo sapiens
agagguuuaauugauucacagu

SEQ ID NO: 155812 - RNA, 20 nt, Homo sapiens
agagguuuugauagguucug

SEQ ID NO: 155813 - RNA, 22 nt, Homo sapiens
agagguuuuggggcugagagcu

SEQ ID NO: 155814 - RNA, 22 nt, Homo sapiens
agaguaguuucuauauucuuca

SEQ ID NO: 155815 - RNA, 22 nt, Homo sapiens
agaucauaugcaguaaugaacu

SEQ ID NO: 155816 - RNA, 22 nt, Homo sapiens
agaugauguuuacugagcauca

SEQ ID NO: 155817 - RNA, 22 nt, Homo sapiens
agauggguuuucacauguuggc

SEQ ID NO: 155818 - RNA, 22 nt, Homo sapiens
agcaacauuuuugaccuuucuu

SEQ ID NO: 155819 - RNA, 22 nt, Homo sapiens
agcaauaugacauugcuacauc

SEQ ID NO: 155820 - RNA, 22 nt, Homo sapiens
agcacagugaaugguuuacuca

SEQ ID NO: 155821 - RNA, 22 nt, Homo sapiens
agcacagugguuaaguuucuua

SEQ ID NO: 155822 - RNA, 21 nt, Homo sapiens
agcagaguggcagcucuuuug

SEQ ID NO: 155823 - RNA, 22 nt, Homo sapiens
agcagcucaugccuuugggagg

SEQ ID NO: 155824 - RNA, 22 nt, Homo sapiens
agcagcuuugcauggccuguga

SEQ ID NO: 155825 - RNA, 22 nt, Homo sapiens
agcaguagaauuccugcaucac

SEQ ID NO: 155826 - RNA, 22 nt, Homo sapiens
agcagugucauuuucuggugag

SEQ ID NO: 155827 - RNA, 22 nt, Homo sapiens
agcaucacacacuacagggaaa

SEQ ID NO: 155828 - RNA, 22 nt, Homo sapiens
agcaugacauauuguagagaaa

SEQ ID NO: 155829 - RNA, 22 nt, Homo sapiens
agcauuaguugugaagccuuua

SEQ ID NO: 155830 - RNA, 19 nt, Homo sapiens
agccaguuuucccagcacc

SEQ ID NO: 155831 - RNA, 22 nt, Homo sapiens
agcggcuguuccccuggucuau

SEQ ID NO: 155832 - RNA, 22 nt, Homo sapiens
agcgguguuaggaaggugaggg

SEQ ID NO: 155833 - RNA, 22 nt, Homo sapiens
agcuauauugaggaugccauuc

SEQ ID NO: 155834 - RNA, 22 nt, Homo sapiens
agcucauugcaaccuccgccuc

SEQ ID NO: 155835 - RNA, 22 nt, Homo sapiens
agcucauugcuguccuggagga

SEQ ID NO: 155836 - RNA, 22 nt, Homo sapiens
agcugcacugguauaggagaaa

SEQ ID NO: 155837 - RNA, 22 nt, Homo sapiens
agcuggcuguagcugcaagucu

SEQ ID NO: 155838 - RNA, 20 nt, Homo sapiens
agcuggguguguuggugcau

SEQ ID NO: 155839 - RNA, 22 nt, Homo sapiens
agcugguauuuguuagggaguu

SEQ ID NO: 155840 - RNA, 22 nt, Homo sapiens
agcuguuguuuuaagauacuaa

SEQ ID NO: 155841 - RNA, 22 nt, Homo sapiens
aggaaaucuuagcugaggggau

SEQ ID NO: 155842 - RNA, 22 nt, Homo sapiens
aggaagacauauagaacuaaaa

SEQ ID NO: 155843 - RNA, 22 nt, Homo sapiens
aggaccccucaucagcaccagu

SEQ ID NO: 155844 - RNA, 22 nt, Homo sapiens
aggagcacuggccuuggaguca

SEQ ID NO: 155845 - RNA, 21 nt, Homo sapiens
aggagcauucucuugcuuugu

SEQ ID NO: 155846 - RNA, 21 nt, Homo sapiens
aggagcauuguugugguggag

SEQ ID NO: 155847 - RNA, 22 nt, Homo sapiens
aggagguagggugugaaacagc

SEQ ID NO: 155848 - RNA, 22 nt, Homo sapiens
aggaguguguauuaaugaaauu

SEQ ID NO: 155849 - RNA, 21 nt, Homo sapiens
aggcaagacuuuuagguuugu

SEQ ID NO: 155850 - RNA, 21 nt, Homo sapiens
aggcaagauuacuuacgagca

SEQ ID NO: 155851 - RNA, 22 nt, Homo sapiens
aggcacggugucucaugccugu

SEQ ID NO: 155852 - RNA, 22 nt, Homo sapiens
aggcagaugagguccucagcug

SEQ ID NO: 155853 - RNA, 22 nt, Homo sapiens
aggcaugaaauacaugcauuga

SEQ ID NO: 155854 - RNA, 22 nt, Homo sapiens
aggcaugauuguauuuugcucu

SEQ ID NO: 155855 - RNA, 22 nt, Homo sapiens
aggcaugugugcagacugucug

SEQ ID NO: 155856 - RNA, 23 nt, Homo sapiens
aggccaguuuuuccugcuugcug

SEQ ID NO: 155857 - RNA, 22 nt, Homo sapiens
aggcuguguggauaauauuggg

SEQ ID NO: 155858 - RNA, 22 nt, Homo sapiens
agggaauguaaguuuuaugaga

SEQ ID NO: 155859 - RNA, 22 nt, Homo sapiens
agguaagaugugacuugguguu

SEQ ID NO: 155860 - RNA, 22 nt, Homo sapiens
agguaguguuauuugcagcuga

SEQ ID NO: 155861 - RNA, 22 nt, Homo sapiens
uuguccacugcuagccucugca

SEQ ID NO: 155862 - RNA, 22 nt, Homo sapiens
uugucccauggggucuuccuuu

SEQ ID NO: 155863 - RNA, 22 nt, Homo sapiens
uuguccccuuccaaaucucaug

SEQ ID NO: 155864 - RNA, 22 nt, Homo sapiens
uugugauugagugauccuuguu

SEQ ID NO: 155865 - RNA, 18 nt, Homo sapiens
uuguggccccuacaaauu

SEQ ID NO: 155866 - RNA, 22 nt, Homo sapiens
uuguggcuuaucucauuuagcg

SEQ ID NO: 155867 - RNA, 19 nt, Homo sapiens
uugugggaggacagagggg

SEQ ID NO: 155868 - RNA, 22 nt, Homo sapiens
uuuaaaguuagaaggaaagggc

SEQ ID NO: 155869 - RNA, 22 nt, Homo sapiens
uuuaacauuggaugagaucguc

SEQ ID NO: 155870 - RNA, 22 nt, Homo sapiens
uuuaagguauguggugaaaauu

SEQ ID NO: 155871 - RNA, 22 nt, Homo sapiens
uuuaaugcacuaggugguguuc

SEQ ID NO: 155872 - RNA, 22 nt, Homo sapiens
uuuaaugcaucccaaaauguag

SEQ ID NO: 155873 - RNA, 22 nt, Homo sapiens
uuuacagucuuuugugugaguc

SEQ ID NO: 155874 - RNA, 22 nt, Homo sapiens
uuuagcaauucauuuugugucu

SEQ ID NO: 155875 - RNA, 22 nt, Homo sapiens
uuuagcacugugauugacaaaa

SEQ ID NO: 155876 - RNA, 22 nt, Homo sapiens
uuuagcagcaaagagcuguguu

SEQ ID NO: 155877 - RNA, 22 nt, Homo sapiens
uuuagggcaggccuggugguga

SEQ ID NO: 155878 - RNA, 22 nt, Homo sapiens
uuuauggcaugcucccucucaa

SEQ ID NO: 155879 - RNA, 19 nt, Homo sapiens
uuucacacucgccuacuuc

SEQ ID NO: 155880 - RNA, 23 nt, Homo sapiens
uuucaggcaggugaaagaccagc

SEQ ID NO: 155881 - RNA, 16 nt, Homo sapiens
uuucaucaguuuuaau

SEQ ID NO: 155882 - RNA, 22 nt, Homo sapiens
uuucauggcgaggcuucauggg

SEQ ID NO: 155883 - RNA, 22 nt, Homo sapiens
uuuccauguuggugaaaugagg

SEQ ID NO: 155884 - RNA, 22 nt, Homo sapiens
uuucuacagggcuugccaggua

SEQ ID NO: 155885 - RNA, 22 nt, Homo sapiens
uuucuacagugaacgauuucua

SEQ ID NO: 155886 - RNA, 22 nt, Homo sapiens
uuucuuggagcucuuagggucg

SEQ ID NO: 155887 - RNA, 22 nt, Homo sapiens
uuugaauggaaguuuugugaaa

SEQ ID NO: 155888 - RNA, 22 nt, Homo sapiens
uuugagaucuuuagaaucaggc

SEQ ID NO: 155889 - RNA, 22 nt, Homo sapiens
uuugauguugauacuaccuuca

SEQ ID NO: 155890 - RNA, 22 nt, Homo sapiens
uuugauugguguaccugaaagu

SEQ ID NO: 155891 - RNA, 22 nt, Homo sapiens
uuugcacuugaaaacacucuca

SEQ ID NO: 155892 - RNA, 22 nt, Homo sapiens
uuugcacuuuuguaauaugguu

SEQ ID NO: 155893 - RNA, 22 nt, Homo sapiens
uuugccaauauuuuacugagga

SEQ ID NO: 155894 - RNA, 22 nt, Homo sapiens
uuugccaauauuuuauugagga

SEQ ID NO: 155895 - RNA, 22 nt, Homo sapiens
uuugccuuugugauauggucua

SEQ ID NO: 155896 - RNA, 22 nt, Homo sapiens
uuugcuauagugaauagugcug

SEQ ID NO: 155897 - RNA, 22 nt, Homo sapiens
uuugcuuaaaguccuuguggga

SEQ ID NO: 155898 - RNA, 22 nt, Homo sapiens
uuugcuuaguaaauguagaaaa

SEQ ID NO: 155899 - RNA, 22 nt, Homo sapiens
uuugcuuguguaaaaaucugga

SEQ ID NO: 155900 - RNA, 22 nt, Homo sapiens
uuuggacuucuagccuccagag

SEQ ID NO: 155901 - RNA, 22 nt, Homo sapiens
uuuggcacuauagguaaauuug

SEQ ID NO: 155902 - RNA, 22 nt, Homo sapiens
uuuggcagaugacccucaaguu

SEQ ID NO: 155903 - RNA, 23 nt, Homo sapiens
uuuggcauuccagaaauuuucau

SEQ ID NO: 155904 - RNA, 21 nt, Homo sapiens
uuuggcuucucugcugcagcc

SEQ ID NO: 155905 - RNA, 22 nt, Homo sapiens
uuugguccaguguucagguccu

SEQ ID NO: 155906 - RNA, 22 nt, Homo sapiens
uuuguacacgugggugaauugu

SEQ ID NO: 155907 - RNA, 22 nt, Homo sapiens
uuuguacucccuuuagauaaaa

SEQ ID NO: 155908 - RNA, 22 nt, Homo sapiens
uuuguccugccaugguuuauuu

SEQ ID NO: 155909 - RNA, 22 nt, Homo sapiens
uuugugagguggauagauugca

SEQ ID NO: 155910 - RNA, 22 nt, Homo sapiens
uuugugcuccuaugagaaucua

SEQ ID NO: 155911 - RNA, 22 nt, Homo sapiens
uuuuaacagccaggggacggcc

SEQ ID NO: 155912 - RNA, 22 nt, Homo sapiens
uuuuacacuguugguuggaaug

SEQ ID NO: 155913 - RNA, 22 nt, Homo sapiens
uuuuaguggacaaagguauuua

SEQ ID NO: 155914 - RNA, 22 nt, Homo sapiens
uuuucaguggccauaguggaga

SEQ ID NO: 155915 - RNA, 22 nt, Homo sapiens
uuuuccagugggacucccauua

SEQ ID NO: 155916 - RNA, 22 nt, Homo sapiens
uuuugcaguuacagagagugag

SEQ ID NO: 155917 - RNA, 22 nt, Homo sapiens
uuuugcucuucggaagagcuug

SEQ ID NO: 155918 - RNA, 22 nt, Homo sapiens
uuuugguauacacaaggguccu

SEQ ID NO: 155919 - RNA, 22 nt, Homo sapiens
uuuugguguacaauucuaugga

SEQ ID NO: 155920 - RNA, 22 nt, Homo sapiens
uuuugguguauuguauaaggua

SEQ ID NO: 155921 - RNA, 22 nt, Homo sapiens
uuuugguucaauuaauuugcua

SEQ ID NO: 155922 - RNA, 22 nt, Homo sapiens
uuuuucacuuaaguuaggcuca

SEQ ID NO: 155923 - RNA, 18 nt, Homo sapiens
uuuuugaggcacagggga

SEQ ID NO: 155924 - RNA, 22 nt, Homo sapiens
uuuuugaguaaauauaaauugu

SEQ ID NO: 155925 - RNA, 22 nt, Homo sapiens
uuuuuggauaaugguacaugua

SEQ ID NO: 155926 - RNA, 21 nt, Homo sapiens
uuuuugguggucauggauaga

SEQ ID NO: 155927 - RNA, 22 nt, Homo sapiens
uuuuuugguaauugaacaauga

SEQ ID NO: 155928 - RNA, 21 nt, Homo sapiens
uauagcagcacgauuuauagu

SEQ ID NO: 155929 - RNA, 21 nt, Homo sapiens
uauaguaguaugauuuacaau

SEQ ID NO: 155930 - RNA, 22 nt, Homo sapiens
uauaugcauugugggguacuga

SEQ ID NO: 155931 - RNA, 22 nt, Homo sapiens
uaucaacaggguggccagugua

SEQ ID NO: 155932 - RNA, 22 nt, Homo sapiens
uaucaaggccacucauuuuaug

SEQ ID NO: 155933 - RNA, 22 nt, Homo sapiens
uaucacaguaaaucugggugca

SEQ ID NO: 155934 - RNA, 22 nt, Homo sapiens
uaucacaguagaacucuuucca

SEQ ID NO: 155935 - RNA, 22 nt, Homo sapiens
uaucacaguaucuagcacagug

SEQ ID NO: 155936 - RNA, 22 nt, Homo sapiens
uaucacaguugcauauuuaagg

SEQ ID NO: 155937 - RNA, 22 nt, Homo sapiens
uaucaccauguccguuuuaaaa

SEQ ID NO: 155938 - RNA, 22 nt, Homo sapiens
uaucagaguuacacugaagacu

SEQ ID NO: 155939 - RNA, 22 nt, Homo sapiens
uaucagauugcugccaucugcu

SEQ ID NO: 155940 - RNA, 22 nt, Homo sapiens
uaucauaguuuggacuuucauu

SEQ ID NO: 155941 - RNA, 21 nt, Homo sapiens
uauccacuugcaacagagaag

SEQ ID NO: 155942 - RNA, 22 nt, Homo sapiens
uaucucagagaaucagauuuac

SEQ ID NO: 155943 - RNA, 22 nt, Homo sapiens
uaucucagaugagacuuguaac

SEQ ID NO: 155944 - RNA, 20 nt, Homo sapiens
uaucucaguuuguccuaaac

SEQ ID NO: 155945 - RNA, 21 nt, Homo sapiens
uaucucaguuuuccuuugugg

SEQ ID NO: 155946 - RNA, 22 nt, Homo sapiens
uaugaagccaggauuuauuauu

SEQ ID NO: 155947 - RNA, 22 nt, Homo sapiens
uaugacucagaaggcacacaca

SEQ ID NO: 155948 - RNA, 22 nt, Homo sapiens
uaugccucuucauaaaguauga

SEQ ID NO: 155949 - RNA, 22 nt, Homo sapiens
uaugccuuuugguucaagcaac

SEQ ID NO: 155950 - RNA, 22 nt, Homo sapiens
uaugcuuauuaaaacagugugu

SEQ ID NO: 155951 - RNA, 22 nt, Homo sapiens
uauggaaaucuuaccuuauggu

SEQ ID NO: 155952 - RNA, 22 nt, Homo sapiens
uauggauguuaagguucacagc

SEQ ID NO: 155953 - RNA, 22 nt, Homo sapiens
uauggauuucauuagacuugag

SEQ ID NO: 155954 - RNA, 22 nt, Homo sapiens
uauggguguuauugcaugggag

SEQ ID NO: 155955 - RNA, 22 nt, Homo sapiens
uaugguuuucucuuacguguug

SEQ ID NO: 155956 - RNA, 22 nt, Homo sapiens
uaugucaugggguuuuugagau

SEQ ID NO: 155957 - RNA, 22 nt, Homo sapiens
uauuaagcuaguugucagugcu

SEQ ID NO: 155958 - RNA, 22 nt, Homo sapiens
uauuaugcacuuuauaaaaauu

SEQ ID NO: 155959 - RNA, 22 nt, Homo sapiens
uauucacaggugugggacaaag

SEQ ID NO: 155960 - RNA, 22 nt, Homo sapiens
uauucacuguaucauugauggg

SEQ ID NO: 155961 - RNA, 22 nt, Homo sapiens
uauugauuaauugugauuaggc

SEQ ID NO: 155962 - RNA, 22 nt, Homo sapiens
uauugcagugagauccaucugg

SEQ ID NO: 155963 - RNA, 22 nt, Homo sapiens
uauugcauauuauucuaguggc

SEQ ID NO: 155964 - RNA, 22 nt, Homo sapiens
uauugcuugaggaaaugguaau

SEQ ID NO: 155965 - RNA, 22 nt, Homo sapiens
uauuguacauguuauagauuuu

SEQ ID NO: 155966 - RNA, 22 nt, Homo sapiens
uauuugauuaacaagagccuaa

SEQ ID NO: 155967 - RNA, 22 nt, Homo sapiens
uauuuggugaaugaaugcaugu

SEQ ID NO: 155968 - RNA, 22 nt, Homo sapiens
ucaaagucuucucaaguaacau

SEQ ID NO: 155969 - RNA, 22 nt, Homo sapiens
ucaaagugacaaaguugcagca

SEQ ID NO: 155970 - RNA, 22 nt, Homo sapiens
ucaaagugcuauggcucagguu

SEQ ID NO: 155971 - RNA, 21 nt, Homo sapiens
ucaaaguguucuuuuguugaa

SEQ ID NO: 155972 - RNA, 22 nt, Homo sapiens
ucaaaugaucugcccgccuugg

SEQ ID NO: 155973 - RNA, 22 nt, Homo sapiens
ucaaaugauucagaagccaccu

SEQ ID NO: 155974 - RNA, 22 nt, Homo sapiens
ucaaaugauucuccugccucag

SEQ ID NO: 155975 - RNA, 21 nt, Homo sapiens
ucaaauugaaauuaggucauu

SEQ ID NO: 155976 - RNA, 22 nt, Homo sapiens
ucaacagugauggaaaguuaua

SEQ ID NO: 155977 - RNA, 21 nt, Homo sapiens
ucaaggaguauacguaugcca

SEQ ID NO: 155978 - RNA, 22 nt, Homo sapiens
ucaaggcacuagcugagcugca

SEQ ID NO: 155979 - RNA, 22 nt, Homo sapiens
ucaaguaauacucccaucuugg

SEQ ID NO: 155980 - RNA, 23 nt, Homo sapiens
ucaagugaugguggccacaaggg

SEQ ID NO: 155981 - RNA, 22 nt, Homo sapiens
ucaaugcaaccuccaccucugg

SEQ ID NO: 155982 - RNA, 18 nt, Homo sapiens
ucacaaccacagugcugu

SEQ ID NO: 155983 - RNA, 22 nt, Homo sapiens
ucacaagcuccugccuuugcuu

SEQ ID NO: 155984 - RNA, 22 nt, Homo sapiens
ucacaauggcugaacuaauuua

SEQ ID NO: 155985 - RNA, 22 nt, Homo sapiens
ucacaauguaaaugaggguugg

SEQ ID NO: 155986 - RNA, 22 nt, Homo sapiens
ucacaguaacuuuguugcuuuu

SEQ ID NO: 155987 - RNA, 22 nt, Homo sapiens
ucacaguagccccucccaucau

SEQ ID NO: 155988 - RNA, 22 nt, Homo sapiens
ucacagucggugacuucuugcu

SEQ ID NO: 155989 - RNA, 22 nt, Homo sapiens
ucacaugaauugucuuguucca

SEQ ID NO: 155990 - RNA, 21 nt, Homo sapiens
ucacauggccagaguaggaac

SEQ ID NO: 155991 - RNA, 22 nt, Homo sapiens
ucacauggggaagggacuagcu

SEQ ID NO: 155992 - RNA, 22 nt, Homo sapiens
ucacaugugcguuuuggcaugu

SEQ ID NO: 155993 - RNA, 22 nt, Homo sapiens
ucacauuaagcuguuauuucuu

SEQ ID NO: 155994 - RNA, 22 nt, Homo sapiens
ucacauuguuauguaaauguuu

SEQ ID NO: 155995 - RNA, 22 nt, Homo sapiens
ucaccuggagaagauggaucau

SEQ ID NO: 155996 - RNA, 22 nt, Homo sapiens
ucacuaaagaaaauggcaugga

SEQ ID NO: 155997 - RNA, 22 nt, Homo sapiens
ucacugagcuagaucacuugac

SEQ ID NO: 155998 - RNA, 22 nt, Homo sapiens
ucacugaggucugagcuuuaug

SEQ ID NO: 155999 - RNA, 20 nt, Homo sapiens
ucacugagugguccacagua

SEQ ID NO: 156000 - RNA, 19 nt, Homo sapiens
ucacuggacagcacacuca

SEQ ID NO: 156001 - RNA, 22 nt, Homo sapiens
ucacuggagauagcaaucuggu

SEQ ID NO: 156002 - RNA, 22 nt, Homo sapiens
ucacuggcaaauauauccguug

SEQ ID NO: 156003 - RNA, 22 nt, Homo sapiens
ucacuggccaaauucuggguga

SEQ ID NO: 156004 - RNA, 22 nt, Homo sapiens
ucacugggagaccaaagccauc

SEQ ID NO: 156005 - RNA, 22 nt, Homo sapiens
ucacugugcaugaaggaugcug

SEQ ID NO: 156006 - RNA, 22 nt, Homo sapiens
ucagagucuagaucacucacug

SEQ ID NO: 156007 - RNA, 18 nt, Homo sapiens
ucagagugcagacuauac

SEQ ID NO: 156008 - RNA, 22 nt, Homo sapiens
ucagagugcagggaguagcagc

SEQ ID NO: 156009 - RNA, 22 nt, Homo sapiens
ucagaucaugcuuaugauggga

SEQ ID NO: 156010 - RNA, 22 nt, Homo sapiens
ucagauguuugagaaguauacu

SEQ ID NO: 156011 - RNA, 22 nt, Homo sapiens
ucagcaaugaccuaagcaaaua

SEQ ID NO: 156012 - RNA, 19 nt, Homo sapiens
ucagcaguaaucaacuuca

SEQ ID NO: 156013 - RNA, 22 nt, Homo sapiens
ucagcagugccccacucuacug

SEQ ID NO: 156014 - RNA, 22 nt, Homo sapiens
ucagcagugugaaaacaaacua

SEQ ID NO: 156015 - RNA, 20 nt, Homo sapiens
ucaggcuccgcauuaacuua

SEQ ID NO: 156016 - RNA, 21 nt, Homo sapiens
ucaggcuuuuugagugccaau

SEQ ID NO: 156017 - RNA, 21 nt, Homo sapiens
ucagggaccugcuguacugau

SEQ ID NO: 156018 - RNA, 22 nt, Homo sapiens
aguuaguguugugauaaaucca

SEQ ID NO: 156019 - RNA, 22 nt, Homo sapiens
aguucaauggguuuucacucau

SEQ ID NO: 156020 - RNA, 22 nt, Homo sapiens
aguuuugguugaguuacuagca

SEQ ID NO: 156021 - RNA, 22 nt, Homo sapiens
auaaaguguuuaguauaggcaa

SEQ ID NO: 156022 - RNA, 22 nt, Homo sapiens
auaaaguucugcuggcauauau

SEQ ID NO: 156023 - RNA, 22 nt, Homo sapiens
auaaaugcaaugguauuuuuga

SEQ ID NO: 156024 - RNA, 22 nt, Homo sapiens
auaaaugcuuagaucuguauau

SEQ ID NO: 156025 - RNA, 22 nt, Homo sapiens
auaacaggaaauacagggcuuu

SEQ ID NO: 156026 - RNA, 22 nt, Homo sapiens
auaacucuguuuuuuucaugca

SEQ ID NO: 156027 - RNA, 22 nt, Homo sapiens
auaauaccugccacauuugaau

SEQ ID NO: 156028 - RNA, 22 nt, Homo sapiens
auaauacuuuuauuuugaggaa

SEQ ID NO: 156029 - RNA, 22 nt, Homo sapiens
auaauagguaguaauggauuga

SEQ ID NO: 156030 - RNA, 22 nt, Homo sapiens
auaaugcuuuucuagguugcau

SEQ ID NO: 156031 - RNA, 22 nt, Homo sapiens
auacaaggaaugaagagauuug

SEQ ID NO: 156032 - RNA, 22 nt, Homo sapiens
auacacauuccugggccucacc

SEQ ID NO: 156033 - RNA, 19 nt, Homo sapiens
auacacguguauacauaca

SEQ ID NO: 156034 - RNA, 22 nt, Homo sapiens
auacaguguauguauaguacau

SEQ ID NO: 156035 - RNA, 22 nt, Homo sapiens
auacaguugccauuucuugugc

SEQ ID NO: 156036 - RNA, 22 nt, Homo sapiens
auacaugugccauguugguaug

SEQ ID NO: 156037 - RNA, 22 nt, Homo sapiens
auacugguuuuugucaugugga

SEQ ID NO: 156038 - RNA, 22 nt, Homo sapiens
auacuguauaggauuguagccu

SEQ ID NO: 156039 - RNA, 22 nt, Homo sapiens
auagaucauugucauuuuagau

SEQ ID NO: 156040 - RNA, 22 nt, Homo sapiens
auagaucuauuuauguaucccu

SEQ ID NO: 156041 - RNA, 22 nt, Homo sapiens
auagauucauuugaggagauuu

SEQ ID NO: 156042 - RNA, 22 nt, Homo sapiens
auagcaaugccccaauccuugg

SEQ ID NO: 156043 - RNA, 22 nt, Homo sapiens
auagcagcuugucagggcagac

SEQ ID NO: 156044 - RNA, 22 nt, Homo sapiens
auagcagugugagaaugaacua

SEQ ID NO: 156045 - RNA, 22 nt, Homo sapiens
auaggcaagaugagguuuuuau

SEQ ID NO: 156046 - RNA, 22 nt, Homo sapiens
auagugcugcaaucaacauaca

SEQ ID NO: 156047 - RNA, 22 nt, Homo sapiens
auauaugcacacgugugcauau

SEQ ID NO: 156048 - RNA, 22 nt, Homo sapiens
auaucaacaucgugucauuagu

SEQ ID NO: 156049 - RNA, 22 nt, Homo sapiens
auaucacagguguuuaccugau

SEQ ID NO: 156050 - RNA, 22 nt, Homo sapiens
auaucacucccaauaucgcagg

SEQ ID NO: 156051 - RNA, 20 nt, Homo sapiens
auaugcagacacauacauac

SEQ ID NO: 156052 - RNA, 17 nt, Homo sapiens
auaugucugcuggggga

SEQ ID NO: 156053 - RNA, 22 nt, Homo sapiens
auauucaagugaggauggcuaa

SEQ ID NO: 156054 - RNA, 22 nt, Homo sapiens
auauugcuuagugaugaagucu

SEQ ID NO: 156055 - RNA, 22 nt, Homo sapiens
aucaaaguaggcauauguuuuu

SEQ ID NO: 156056 - RNA, 22 nt, Homo sapiens
aucaaagugaaauauuaguuau

SEQ ID NO: 156057 - RNA, 22 nt, Homo sapiens
aucaaaugcuggcagagugccu

SEQ ID NO: 156058 - RNA, 22 nt, Homo sapiens
aucacacuguuauuuuaguuaa

SEQ ID NO: 156059 - RNA, 22 nt, Homo sapiens
aucagaaucucuugagaguguu

SEQ ID NO: 156060 - RNA, 22 nt, Homo sapiens
aucagagugaaacaugggagau

SEQ ID NO: 156061 - RNA, 23 nt, Homo sapiens
aucagauaguuguagguaugugg

SEQ ID NO: 156062 - RNA, 22 nt, Homo sapiens
aucagauguuuguauaggagua

SEQ ID NO: 156063 - RNA, 22 nt, Homo sapiens
aucagauuccacauuuuaucag

SEQ ID NO: 156064 - RNA, 22 nt, Homo sapiens
aucauccagccccagaagggag

SEQ ID NO: 156065 - RNA, 22 nt, Homo sapiens
auccacaugcaguuggaaacag

SEQ ID NO: 156066 - RNA, 22 nt, Homo sapiens
auccaguguuuucuuuugucac

SEQ ID NO: 156067 - RNA, 22 nt, Homo sapiens
aucccugagccugacucucaga

SEQ ID NO: 156068 - RNA, 22 nt, Homo sapiens
aucccugugacgagcaucccua

SEQ ID NO: 156069 - RNA, 22 nt, Homo sapiens
auccugagacuuugcugaaguu

SEQ ID NO: 156070 - RNA, 22 nt, Homo sapiens
auccugagacuuuucugaaguu

SEQ ID NO: 156071 - RNA, 22 nt, Homo sapiens
aucgcaccauugcacuccagca

SEQ ID NO: 156072 - RNA, 22 nt, Homo sapiens
aucgcgccauuguacuccagcc

SEQ ID NO: 156073 - RNA, 22 nt, Homo sapiens
aucuacagccagucugguuugu

SEQ ID NO: 156074 - RNA, 22 nt, Homo sapiens
aucucaaugcuuuuguaggcca

SEQ ID NO: 156075 - RNA, 22 nt, Homo sapiens
aucucagcaacuaaagauccuu

SEQ ID NO: 156076 - RNA, 22 nt, Homo sapiens
aucucauggagguagagaguaa

SEQ ID NO: 156077 - RNA, 22 nt, Homo sapiens
aucuggcuucuuuuaguccaca

SEQ ID NO: 156078 - RNA, 22 nt, Homo sapiens
aucugguguggcugugauccuc

SEQ ID NO: 156079 - RNA, 22 nt, Homo sapiens
augaaaacaugauuugccuguu

SEQ ID NO: 156080 - RNA, 22 nt, Homo sapiens
augaaaucuuuccugugaggau

SEQ ID NO: 156081 - RNA, 22 nt, Homo sapiens
augaaauguaugagucuggguu

SEQ ID NO: 156082 - RNA, 22 nt, Homo sapiens
augaacuaugugggauguuuua

SEQ ID NO: 156083 - RNA, 17 nt, Homo sapiens
augaacucaucguucuu

SEQ ID NO: 156084 - RNA, 22 nt, Homo sapiens
augaagagaaaguggaucuugg

SEQ ID NO: 156085 - RNA, 22 nt, Homo sapiens
augaagcuagcugauugcugau

SEQ ID NO: 156086 - RNA, 22 nt, Homo sapiens
augaaguauuaggacacauuua

SEQ ID NO: 156087 - RNA, 22 nt, Homo sapiens
augaaugcagcacuguuuuucu

SEQ ID NO: 156088 - RNA, 23 nt, Homo sapiens
augaauguaaagaaugugggaag

SEQ ID NO: 156089 - RNA, 22 nt, Homo sapiens
augaauuuucugauguugggua

SEQ ID NO: 156090 - RNA, 23 nt, Homo sapiens
augacacuguccuugaccauuuc

SEQ ID NO: 156091 - RNA, 22 nt, Homo sapiens
augacauguauuuccaggauuu

SEQ ID NO: 156092 - RNA, 22 nt, Homo sapiens
augacauugaugcucuggcugg

SEQ ID NO: 156093 - RNA, 22 nt, Homo sapiens
augacugaguagcauuccauua

SEQ ID NO: 156094 - RNA, 22 nt, Homo sapiens
augacuuuucugaaaaccacca

SEQ ID NO: 156095 - RNA, 22 nt, Homo sapiens
augagauacuacaaaugaguuu

SEQ ID NO: 156096 - RNA, 22 nt, Homo sapiens
augagaucugugaacaccuguc

SEQ ID NO: 156097 - RNA, 22 nt, Homo sapiens
augagauuguuugugugaaaua

SEQ ID NO: 156098 - RNA, 19 nt, Homo sapiens
augagcaauaguuuuaauc

SEQ ID NO: 156099 - RNA, 22 nt, Homo sapiens
augagcuguuuggaagacacuu

SEQ ID NO: 156100 - RNA, 22 nt, Homo sapiens
augaggcaggaaaggcguaucu

SEQ ID NO: 156101 - RNA, 22 nt, Homo sapiens
augaggugaggucaguaaggua

SEQ ID NO: 156102 - RNA, 21 nt, Homo sapiens
augagguguacuguggugaaa

SEQ ID NO: 156103 - RNA, 22 nt, Homo sapiens
augauacuguucuaagauuuuu

SEQ ID NO: 156104 - RNA, 22 nt, Homo sapiens
augauaugagaaaggaucaaca

SEQ ID NO: 156105 - RNA, 22 nt, Homo sapiens
augaucacaccacugcacucca

SEQ ID NO: 156106 - RNA, 22 nt, Homo sapiens
augaugcaguacuuugggaaca

SEQ ID NO: 156107 - RNA, 22 nt, Homo sapiens
augauggaggccgugauggacg

SEQ ID NO: 156108 - RNA, 22 nt, Homo sapiens
gucccagagauauugugucuuu

SEQ ID NO: 156109 - RNA, 22 nt, Homo sapiens
gucuaugguucaggguggagug

SEQ ID NO: 156110 - RNA, 22 nt, Homo sapiens
gucucacagcuagcugcuuuau

SEQ ID NO: 156111 - RNA, 22 nt, Homo sapiens
gucuggagacuugggucaucaa

SEQ ID NO: 156112 - RNA, 22 nt, Homo sapiens
gucugguuuuuuauauccucac

SEQ ID NO: 156113 - RNA, 22 nt, Homo sapiens
gucuuggagaacucagcuuggc

SEQ ID NO: 156114 - RNA, 22 nt, Homo sapiens
gucuuggcaugugcagcuggga

SEQ ID NO: 156115 - RNA, 22 nt, Homo sapiens
gucuuugaugucuaugugcuuc

SEQ ID NO: 156116 - RNA, 22 nt, Homo sapiens
gucuuuggaaagacaaaguuca

SEQ ID NO: 156117 - RNA, 22 nt, Homo sapiens
gucuuuguuuugauuuaccaga

SEQ ID NO: 156118 - RNA, 22 nt, Homo sapiens
gugaaaagaugagcaccauaca

SEQ ID NO: 156119 - RNA, 22 nt, Homo sapiens
gugaaagacagcauuaauggcu

SEQ ID NO: 156120 - RNA, 22 nt, Homo sapiens
gugaaagacauauaugguuuga

SEQ ID NO: 156121 - RNA, 15 nt, Homo sapiens
gugaaauguuucaga

SEQ ID NO: 156122 - RNA, 22 nt, Homo sapiens
gugaacagaaccugggaucgaa

SEQ ID NO: 156123 - RNA, 22 nt, Homo sapiens
gugaacagcagaugagugagug

SEQ ID NO: 156124 - RNA, 22 nt, Homo sapiens
gugaacuguuugaggaagagaa

SEQ ID NO: 156125 - RNA, 22 nt, Homo sapiens
gugacacagcaagacuccgucu

SEQ ID NO: 156126 - RNA, 22 nt, Homo sapiens
gugacauuauuucagcuacaug

SEQ ID NO: 156127 - RNA, 22 nt, Homo sapiens
gugacauuuuuacugaugagag

SEQ ID NO: 156128 - RNA, 22 nt, Homo sapiens
gugaccaaagauagcucaaguu

SEQ ID NO: 156129 - RNA, 22 nt, Homo sapiens
gugaccucuguugcugucacua

SEQ ID NO: 156130 - RNA, 22 nt, Homo sapiens
gugagaacugcuggggccacag

SEQ ID NO: 156131 - RNA, 22 nt, Homo sapiens
gugagaaucaaacuacauaaau

SEQ ID NO: 156132 - RNA, 22 nt, Homo sapiens
gugagacugguucugaacccag

SEQ ID NO: 156133 - RNA, 22 nt, Homo sapiens
gugagagaaugacuauguguuu

SEQ ID NO: 156134 - RNA, 22 nt, Homo sapiens
gugagauaaugucucauugugg

SEQ ID NO: 156135 - RNA, 22 nt, Homo sapiens
gugagauacuagagauauagug

SEQ ID NO: 156136 - RNA, 22 nt, Homo sapiens
gugagcuaagcaaauaugagcc

SEQ ID NO: 156137 - RNA, 21 nt, Homo sapiens
gugaggaguuacuggcuuuga

SEQ ID NO: 156138 - RNA, 22 nt, Homo sapiens
gugaggcacugcugcuuuccag

SEQ ID NO: 156139 - RNA, 22 nt, Homo sapiens
gugagguaauuagcucccuuag

SEQ ID NO: 156140 - RNA, 22 nt, Homo sapiens
gugaucucagcucacuggaacc

SEQ ID NO: 156141 - RNA, 20 nt, Homo sapiens
gugauuggucacugguuguu

SEQ ID NO: 156142 - RNA, 22 nt, Homo sapiens
gugcaaaucucugaguaucuuu

SEQ ID NO: 156143 - RNA, 22 nt, Homo sapiens
gugcaagagugacugcaguuuu

SEQ ID NO: 156144 - RNA, 22 nt, Homo sapiens
gugcacaacgugcaaguuuguu

SEQ ID NO: 156145 - RNA, 22 nt, Homo sapiens
gugcacaacgugcagguuuguu

SEQ ID NO: 156146 - RNA, 22 nt, Homo sapiens
gugcacaacguguagguuuguu

SEQ ID NO: 156147 - RNA, 22 nt, Homo sapiens
gugcauauaaguuguuucuagu

SEQ ID NO: 156148 - RNA, 22 nt, Homo sapiens
gugccacaguguuaagggauuc

SEQ ID NO: 156149 - RNA, 22 nt, Homo sapiens
gugccuuuucugagcaaugagc

SEQ ID NO: 156150 - RNA, 22 nt, Homo sapiens
gugcuaggugcuaggaagauag

SEQ ID NO: 156151 - RNA, 22 nt, Homo sapiens
gugcuauguuauccagcaagau

SEQ ID NO: 156152 - RNA, 22 nt, Homo sapiens
guggaaaauuauugcuguuuuu

SEQ ID NO: 156153 - RNA, 22 nt, Homo sapiens
guggaaaucucugugugacuua

SEQ ID NO: 156154 - RNA, 22 nt, Homo sapiens
guggaagaccagacuuuccaac

SEQ ID NO: 156155 - RNA, 22 nt, Homo sapiens
guggaagguaaugcagcuuacu

SEQ ID NO: 156156 - RNA, 20 nt, Homo sapiens
guggaaguagaaacauaugu

SEQ ID NO: 156157 - RNA, 22 nt, Homo sapiens
guggaagugucuggggccaggg

SEQ ID NO: 156158 - RNA, 22 nt, Homo sapiens
guggaaugcaguguugauucaa

SEQ ID NO: 156159 - RNA, 17 nt, Homo sapiens
guggaaugucaugucaa

SEQ ID NO: 156160 - RNA, 22 nt, Homo sapiens
guggagcuguguggccuugggc

SEQ ID NO: 156161 - RNA, 22 nt, Homo sapiens
guggagucaucacucagagugg

SEQ ID NO: 156162 - RNA, 22 nt, Homo sapiens
guggaucacuugaggucaagag

SEQ ID NO: 156163 - RNA, 22 nt, Homo sapiens
guggaucacuugagguuagaag

SEQ ID NO: 156164 - RNA, 21 nt, Homo sapiens
guggccuuuggagcaugucag

SEQ ID NO: 156165 - RNA, 22 nt, Homo sapiens
gugggaugaucacaguucacug

SEQ ID NO: 156166 - RNA, 22 nt, Homo sapiens
gugggaugaucgcuugagccca

SEQ ID NO: 156167 - RNA, 22 nt, Homo sapiens
gugggcucguucguguuagaca

SEQ ID NO: 156168 - RNA, 22 nt, Homo sapiens
gugggguaggguaggacucaac

SEQ ID NO: 156169 - RNA, 22 nt, Homo sapiens
guggggucaucucauuugugga

SEQ ID NO: 156170 - RNA, 22 nt, Homo sapiens
gugguacuaucuuugguuucag

SEQ ID NO: 156171 - RNA, 22 nt, Homo sapiens
guggucagaaaucucaguggca

SEQ ID NO: 156172 - RNA, 22 nt, Homo sapiens
guguaaaucugcugugaacauu

SEQ ID NO: 156173 - RNA, 20 nt, Homo sapiens
guguaagagcaagcuuccua

SEQ ID NO: 156174 - RNA, 22 nt, Homo sapiens
gugucacagcuuccaucucggu

SEQ ID NO: 156175 - RNA, 22 nt, Homo sapiens
gugugaacaucauagaguguau

SEQ ID NO: 156176 - RNA, 22 nt, Homo sapiens
gugugauguaaagaacugggga

SEQ ID NO: 156177 - RNA, 22 nt, Homo sapiens
gugugcaacuuucauuaauauu

SEQ ID NO: 156178 - RNA, 22 nt, Homo sapiens
gugugcaugucuuuuuaguagg

SEQ ID NO: 156179 - RNA, 23 nt, Homo sapiens
guuaagugaauguguacucuauu

SEQ ID NO: 156180 - RNA, 22 nt, Homo sapiens
guuaugcagcuuagaaaaugaa

SEQ ID NO: 156181 - RNA, 22 nt, Homo sapiens
guuauugcucucgaagacucuc

SEQ ID NO: 156182 - RNA, 22 nt, Homo sapiens
guucaagcaauucugcugccuc

SEQ ID NO: 156183 - RNA, 22 nt, Homo sapiens
guucaucagggauacuggccuu

SEQ ID NO: 156184 - RNA, 22 nt, Homo sapiens
guugguuuccuguaacuggaca

SEQ ID NO: 156185 - RNA, 22 nt, Homo sapiens
guuugguugcauggaaaauuua

SEQ ID NO: 156186 - RNA, 22 nt, Homo sapiens
agacagcugguagcacuuccug

SEQ ID NO: 156187 - RNA, 20 nt, Homo sapiens
agacaguguggagauuccuu

SEQ ID NO: 156188 - RNA, 22 nt, Homo sapiens
agacccuguauguguuuaguuu

SEQ ID NO: 156189 - RNA, 20 nt, Homo sapiens
agacuagggagcagaaagcc

SEQ ID NO: 156190 - RNA, 22 nt, Homo sapiens
agagaacugauucagggaaaau

SEQ ID NO: 156191 - RNA, 22 nt, Homo sapiens
agagagcuuuaacuacccauuu

SEQ ID NO: 156192 - RNA, 22 nt, Homo sapiens
agagguauacauuugagagcca

SEQ ID NO: 156193 - RNA, 22 nt, Homo sapiens
agagguuuaacuggcuuauggu

SEQ ID NO: 156194 - RNA, 23 nt, Homo sapiens
agagguuuaaucaggcaguugcu

SEQ ID NO: 156195 - RNA, 22 nt, Homo sapiens
agagguuuugcacugguucuuu

SEQ ID NO: 156196 - RNA, 22 nt, Homo sapiens
agagguuuugcccucgagauaa

SEQ ID NO: 156197 - RNA, 22 nt, Homo sapiens
agaguaguaggaugaauggacu

SEQ ID NO: 156198 - RNA, 22 nt, Homo sapiens
agaguaguuuauuaugcuaagg

SEQ ID NO: 156199 - RNA, 19 nt, Homo sapiens
agaguauugaauuugcccu

SEQ ID NO: 156200 - RNA, 19 nt, Homo sapiens
agaguauuguuacuucucu

SEQ ID NO: 156201 - RNA, 22 nt, Homo sapiens
agagugaagcuuuuuauauucu

SEQ ID NO: 156202 - RNA, 22 nt, Homo sapiens
agagugcaaagguuggggcugg

SEQ ID NO: 156203 - RNA, 22 nt, Homo sapiens
agaugccucauguucuagguuc

SEQ ID NO: 156204 - RNA, 22 nt, Homo sapiens
agauggauuuuguagccccagc

SEQ ID NO: 156205 - RNA, 22 nt, Homo sapiens
agauggugauaaaugugguacc

SEQ ID NO: 156206 - RNA, 22 nt, Homo sapiens
agaugguuuuguucacagcucu

SEQ ID NO: 156207 - RNA, 22 nt, Homo sapiens
agcaacauagaaauuugggugg

SEQ ID NO: 156208 - RNA, 22 nt, Homo sapiens
agcaacauugagacugcaguug

SEQ ID NO: 156209 - RNA, 22 nt, Homo sapiens
agcacaguuaaaugaggcuucu

SEQ ID NO: 156210 - RNA, 22 nt, Homo sapiens
agcaccaauaaucagaguucuu

SEQ ID NO: 156211 - RNA, 22 nt, Homo sapiens
agcaccacaauuuccugccuaa

SEQ ID NO: 156212 - RNA, 22 nt, Homo sapiens
agcaccagaaucugaguuauuc

SEQ ID NO: 156213 - RNA, 22 nt, Homo sapiens
agcacgaaaccaaauucuguga

SEQ ID NO: 156214 - RNA, 22 nt, Homo sapiens
agcagcaugaggggacuucugc

SEQ ID NO: 156215 - RNA, 20 nt, Homo sapiens
agcagccacagauuccucag

SEQ ID NO: 156216 - RNA, 22 nt, Homo sapiens
agcagcgacacccuguggugag

SEQ ID NO: 156217 - RNA, 21 nt, Homo sapiens
agcagcuuugguugaagcaga

SEQ ID NO: 156218 - RNA, 22 nt, Homo sapiens
agcaggauuguuacaauaguaa

SEQ ID NO: 156219 - RNA, 22 nt, Homo sapiens
agcagguguccacaauguuugc

SEQ ID NO: 156220 - RNA, 22 nt, Homo sapiens
agcaucauaccaaucugguccu

SEQ ID NO: 156221 - RNA, 20 nt, Homo sapiens
agcaucguuguguuauagcc

SEQ ID NO: 156222 - RNA, 22 nt, Homo sapiens
agcccauguggcugaggcuucu

SEQ ID NO: 156223 - RNA, 22 nt, Homo sapiens
agcccugugauuacuuuuauaa

SEQ ID NO: 156224 - RNA, 22 nt, Homo sapiens
agccuagagagccacuuugaga

SEQ ID NO: 156225 - RNA, 22 nt, Homo sapiens
agcgccacugcacuccagccug

SEQ ID NO: 156226 - RNA, 21 nt, Homo sapiens
agcuaaauuggaaauuucugu

SEQ ID NO: 156227 - RNA, 22 nt, Homo sapiens
agcuaguguucaccagagguca

SEQ ID NO: 156228 - RNA, 18 nt, Homo sapiens
agcucaguguuugcuuac

SEQ ID NO: 156229 - RNA, 21 nt, Homo sapiens
agcuccacucguucccaaagc

SEQ ID NO: 156230 - RNA, 22 nt, Homo sapiens
agcucuuguuaguauuagcagu

SEQ ID NO: 156231 - RNA, 22 nt, Homo sapiens
agcugcaauguuuaguauaaua

SEQ ID NO: 156232 - RNA, 22 nt, Homo sapiens
agcugcacaaauggaugugagg

SEQ ID NO: 156233 - RNA, 22 nt, Homo sapiens
agcugcacgugguaaauguaaa

SEQ ID NO: 156234 - RNA, 22 nt, Homo sapiens
agcugccagucuuguaaggccu

SEQ ID NO: 156235 - RNA, 16 nt, Homo sapiens
agcuggaauuacaggc

SEQ ID NO: 156236 - RNA, 22 nt, Homo sapiens
agcuggcuguggagaaaccccu

SEQ ID NO: 156237 - RNA, 23 nt, Homo sapiens
agcugguacuagaggcuugcgcc

SEQ ID NO: 156238 - RNA, 22 nt, Homo sapiens
agcugguaguuuucuaguguuu

SEQ ID NO: 156239 - RNA, 22 nt, Homo sapiens
agcuggucuacguguguaugag

SEQ ID NO: 156240 - RNA, 22 nt, Homo sapiens
agcuugugauucuccaucaugu

SEQ ID NO: 156241 - RNA, 22 nt, Homo sapiens
agcuuguggugaauacugcuag

SEQ ID NO: 156242 - RNA, 22 nt, Homo sapiens
agcuuuuugggaggccuuagga

SEQ ID NO: 156243 - RNA, 22 nt, Homo sapiens
agcuuuuugggcagcuauugac

SEQ ID NO: 156244 - RNA, 22 nt, Homo sapiens
aggaauggaaacuuuugauggu

SEQ ID NO: 156245 - RNA, 22 nt, Homo sapiens
aggacacugagcaugggagguu

SEQ ID NO: 156246 - RNA, 19 nt, Homo sapiens
aggacuaaagacuagaagu

SEQ ID NO: 156247 - RNA, 18 nt, Homo sapiens
aggagcauagugcuauga

SEQ ID NO: 156248 - RNA, 21 nt, Homo sapiens
aggagcauucaugacgagguu

SEQ ID NO: 156249 - RNA, 22 nt, Homo sapiens
aggaucauugacuauuauaagg

SEQ ID NO: 156250 - RNA, 22 nt, Homo sapiens
aggcaacaugguaaaacccugu

SEQ ID NO: 156251 - RNA, 16 nt, Homo sapiens
aggcaagaauugaggu

SEQ ID NO: 156252 - RNA, 22 nt, Homo sapiens
aggcaagagugacuacgugaaa

SEQ ID NO: 156253 - RNA, 22 nt, Homo sapiens
aggcacgguggcucacaccugu

SEQ ID NO: 156254 - RNA, 22 nt, Homo sapiens
aggcauguggcucuguucugac

SEQ ID NO: 156255 - RNA, 20 nt, Homo sapiens
aggcauguugguuugcgugu

SEQ ID NO: 156256 - RNA, 22 nt, Homo sapiens
aggcuuauuaagauucccuuau

SEQ ID NO: 156257 - RNA, 22 nt, Homo sapiens
agguagguugagaugggcauca

SEQ ID NO: 156258 - RNA, 22 nt, Homo sapiens
agguauuuucaacuuagaaugg

SEQ ID NO: 156259 - RNA, 22 nt, Homo sapiens
aggucccauguccucccugacc

SEQ ID NO: 156260 - RNA, 22 nt, Homo sapiens
aggugcugagcagagaauccug

SEQ ID NO: 156261 - RNA, 22 nt, Homo sapiens
agguuaucccgcauuauuuggu

SEQ ID NO: 156262 - RNA, 22 nt, Homo sapiens
aguacacuguuaaaaagaagug

SEQ ID NO: 156263 - RNA, 22 nt, Homo sapiens
aguacugucugguuaccugaca

SEQ ID NO: 156264 - RNA, 22 nt, Homo sapiens
agucaagauggcaagguaaggc

SEQ ID NO: 156265 - RNA, 22 nt, Homo sapiens
agucacagguucuugggauuag

SEQ ID NO: 156266 - RNA, 22 nt, Homo sapiens
agucauagaguuugcccuucuc

SEQ ID NO: 156267 - RNA, 22 nt, Homo sapiens
agucauggcagaaggcaccucu

SEQ ID NO: 156268 - RNA, 22 nt, Homo sapiens
aguccagguuuuguaauggcaa

SEQ ID NO: 156269 - RNA, 22 nt, Homo sapiens
agucugguguucucacacuagu

SEQ ID NO: 156270 - RNA, 17 nt, Homo sapiens
agugagaucauggcuua

SEQ ID NO: 156271 - RNA, 21 nt, Homo sapiens
agugagucauuuggaaagcaa

SEQ ID NO: 156272 - RNA, 22 nt, Homo sapiens
agugccuacuauguagaugcug

SEQ ID NO: 156273 - RNA, 22 nt, Homo sapiens
aguggcuuuuuaguggcagaug

SEQ ID NO: 156274 - RNA, 22 nt, Homo sapiens
agugguuugaucacagcucacu

SEQ ID NO: 156275 - RNA, 19 nt, Homo sapiens
agugucauggucauuauuu

SEQ ID NO: 156276 - RNA, 22 nt, Homo sapiens
acuggcuuuugagaaaaacacu

SEQ ID NO: 156277 - RNA, 22 nt, Homo sapiens
acuguacuccagccugggugac

SEQ ID NO: 156278 - RNA, 22 nt, Homo sapiens
acuuugguuaucauacuuucag

SEQ ID NO: 156279 - RNA, 22 nt, Homo sapiens
acuuuguuauggcaacccuaag

SEQ ID NO: 156280 - RNA, 20 nt, Homo sapiens
acuuuuugaugaggucguuu

SEQ ID NO: 156281 - RNA, 22 nt, Homo sapiens
acuuuuugaugaggucguuugu

SEQ ID NO: 156282 - RNA, 22 nt, Homo sapiens
agaaacauucucuugccuccuu

SEQ ID NO: 156283 - RNA, 22 nt, Homo sapiens
agaaagcgcuucccuuugcugg

SEQ ID NO: 156284 - RNA, 22 nt, Homo sapiens
agaacuguccauucagcaugaa

SEQ ID NO: 156285 - RNA, 22 nt, Homo sapiens
agaauguauauucuguaguugu

SEQ ID NO: 156286 - RNA, 22 nt, Homo sapiens
agaaugucagcuggauucagcu

SEQ ID NO: 156287 - RNA, 22 nt, Homo sapiens
agaauucugucauguuuauauu

SEQ ID NO: 156288 - RNA, 22 nt, Homo sapiens
agacacugaaauguauugaaga

SEQ ID NO: 156289 - RNA, 22 nt, Homo sapiens
agacagcugggaaauggagugu

SEQ ID NO: 156290 - RNA, 22 nt, Homo sapiens
gcugauggugcaguucuagccu

SEQ ID NO: 156291 - RNA, 22 nt, Homo sapiens
gcugcuguuuaguuucuccugg

SEQ ID NO: 156292 - RNA, 22 nt, Homo sapiens
gcuggguugccagguuacuuaa

SEQ ID NO: 156293 - RNA, 22 nt, Homo sapiens
gcuggucugccguaguaggugc

SEQ ID NO: 156294 - RNA, 22 nt, Homo sapiens
gcugguguucaggcccucaguc

SEQ ID NO: 156295 - RNA, 19 nt, Homo sapiens
gcugguuguccacucucuc

SEQ ID NO: 156296 - RNA, 22 nt, Homo sapiens
gcuguauuguugaaggaaaugu

SEQ ID NO: 156297 - RNA, 20 nt, Homo sapiens
gcugugcuuaauacacuuuc

SEQ ID NO: 156298 - RNA, 22 nt, Homo sapiens
gcuuguguucaagucacccuua

SEQ ID NO: 156299 - RNA, 22 nt, Homo sapiens
gcuuguguuugcuccccagaau

SEQ ID NO: 156300 - RNA, 22 nt, Homo sapiens
cucauugcaaucucugccuccc

SEQ ID NO: 156301 - RNA, 23 nt, Homo sapiens
cuccaugagccguccagggccug

SEQ ID NO: 156302 - RNA, 22 nt, Homo sapiens
cucccagugacccaggaacagg

SEQ ID NO: 156303 - RNA, 21 nt, Homo sapiens
cucugguuugcauuggauuau

SEQ ID NO: 156304 - RNA, 22 nt, Homo sapiens
cucuuggguagauuuugcagag

SEQ ID NO: 156305 - RNA, 19 nt, Homo sapiens
cucuuuggugucucuucuu

SEQ ID NO: 156306 - RNA, 22 nt, Homo sapiens
cucuuuuguuccuaguuugauc

SEQ ID NO: 156307 - RNA, 19 nt, Homo sapiens
cugaaacacagagagggcu

SEQ ID NO: 156308 - RNA, 22 nt, Homo sapiens
cugaaagagcauguaacacagu

SEQ ID NO: 156309 - RNA, 22 nt, Homo sapiens
cugacaagauucaucacucagu

SEQ ID NO: 156310 - RNA, 22 nt, Homo sapiens
cugacugaggaucaguucauca

SEQ ID NO: 156311 - RNA, 22 nt, Homo sapiens
cugagacuggguaauguauaaa

SEQ ID NO: 156312 - RNA, 22 nt, Homo sapiens
cugagauacacuaauagucucu

SEQ ID NO: 156313 - RNA, 22 nt, Homo sapiens
cugagguacugggggccaggau

SEQ ID NO: 156314 - RNA, 22 nt, Homo sapiens
cugaggucugaauccagguauc

SEQ ID NO: 156315 - RNA, 22 nt, Homo sapiens
cugaggugggaggauuggcuug

SEQ ID NO: 156316 - RNA, 22 nt, Homo sapiens
cugauaaguuuuucuuuauaag

SEQ ID NO: 156317 - RNA, 22 nt, Homo sapiens
cugaucuggaggugucugggga

SEQ ID NO: 156318 - RNA, 22 nt, Homo sapiens
cugcaagaugcauaggaauuuu

SEQ ID NO: 156319 - RNA, 22 nt, Homo sapiens
cugcaauggagaaagugagacu

SEQ ID NO: 156320 - RNA, 22 nt, Homo sapiens
cugccacugacaccucaaggac

SEQ ID NO: 156321 - RNA, 18 nt, Homo sapiens
cugccagugugcucuccg

SEQ ID NO: 156322 - RNA, 22 nt, Homo sapiens
cuggaaggaaaaacaaccacag

SEQ ID NO: 156323 - RNA, 18 nt, Homo sapiens
cuggaaggcuacuacagu

SEQ ID NO: 156324 - RNA, 22 nt, Homo sapiens
cuggaauucaaaaucugaauuu

SEQ ID NO: 156325 - RNA, 22 nt, Homo sapiens
cuggaggccugaacauaaaugg

SEQ ID NO: 156326 - RNA, 22 nt, Homo sapiens
cuggauauguugcaacauuucc

SEQ ID NO: 156327 - RNA, 20 nt, Homo sapiens
cuggaucaucaguaaaguua

SEQ ID NO: 156328 - RNA, 22 nt, Homo sapiens
cuggcaucuaaauacuugaugu

SEQ ID NO: 156329 - RNA, 22 nt, Homo sapiens
cuggcccaguucugcguuuugc

SEQ ID NO: 156330 - RNA, 22 nt, Homo sapiens
cugguaugcuucauaugcaaac

SEQ ID NO: 156331 - RNA, 21 nt, Homo sapiens
cugguguuagcacuucuuccc

SEQ ID NO: 156332 - RNA, 22 nt, Homo sapiens
cugguuuguaaaguuccugaga

SEQ ID NO: 156333 - RNA, 22 nt, Homo sapiens
cuguagcuuuuauaugcuuagc

SEQ ID NO: 156334 - RNA, 22 nt, Homo sapiens
cugucacugggaggggcagcag

SEQ ID NO: 156335 - RNA, 22 nt, Homo sapiens
cugugcacaucuggcggcccga

SEQ ID NO: 156336 - RNA, 22 nt, Homo sapiens
cuguggguuuuacuguuuuacu

SEQ ID NO: 156337 - RNA, 22 nt, Homo sapiens
cugugguuacguucuuugugcu

SEQ ID NO: 156338 - RNA, 22 nt, Homo sapiens
cugugguuuaaggaauuuugac

SEQ ID NO: 156339 - RNA, 19 nt, Homo sapiens
cuguuguacuccaggcauu

SEQ ID NO: 156340 - RNA, 18 nt, Homo sapiens
cuuaacauugggaugaua

SEQ ID NO: 156341 - RNA, 22 nt, Homo sapiens
cuucaccaguuuggcagucuca

SEQ ID NO: 156342 - RNA, 22 nt, Homo sapiens
cuucagcaauauauccccuggg

SEQ ID NO: 156343 - RNA, 22 nt, Homo sapiens
cuucaugagacuuuuggaaggc

SEQ ID NO: 156344 - RNA, 18 nt, Homo sapiens
cuucauugcuguuuugcu

SEQ ID NO: 156345 - RNA, 22 nt, Homo sapiens
cuuccaaguggggcacgugcca

SEQ ID NO: 156346 - RNA, 22 nt, Homo sapiens
cuucccguuauugcccuugggu

SEQ ID NO: 156347 - RNA, 22 nt, Homo sapiens
cuuccugaguccugggcucaca

SEQ ID NO: 156348 - RNA, 21 nt, Homo sapiens
cuucuuggggcagggcagggu

SEQ ID NO: 156349 - RNA, 22 nt, Homo sapiens
cuugagacauuguuuuccaagu

SEQ ID NO: 156350 - RNA, 22 nt, Homo sapiens
cuugcacucagaagauucaguu

SEQ ID NO: 156351 - RNA, 22 nt, Homo sapiens
cuugcagagcccauggauguca

SEQ ID NO: 156352 - RNA, 22 nt, Homo sapiens
cuuggcacgugauagguguuga

SEQ ID NO: 156353 - RNA, 22 nt, Homo sapiens
cuuggcuagucaaaccuccccg

SEQ ID NO: 156354 - RNA, 22 nt, Homo sapiens
cuuggcuuguuguccccugcuc

SEQ ID NO: 156355 - RNA, 22 nt, Homo sapiens
cuugggauauguguuacucugu

SEQ ID NO: 156356 - RNA, 22 nt, Homo sapiens
cuuguacuacuuaggaucugga

SEQ ID NO: 156357 - RNA, 22 nt, Homo sapiens
cuuguucuccuaagaugaaugc

SEQ ID NO: 156358 - RNA, 22 nt, Homo sapiens
cuuuaugagguuggauggaucu

SEQ ID NO: 156359 - RNA, 22 nt, Homo sapiens
cuuuccauuguuggagcauaaa

SEQ ID NO: 156360 - RNA, 22 nt, Homo sapiens
cuuuggagaaaaguucuugggc

SEQ ID NO: 156361 - RNA, 20 nt, Homo sapiens
cuuuggugagucaacuccuu

SEQ ID NO: 156362 - RNA, 22 nt, Homo sapiens
cuuugguggagucuuuagguuc

SEQ ID NO: 156363 - RNA, 23 nt, Homo sapiens
cuuuugcaaugugaucuugccac

SEQ ID NO: 156364 - RNA, 22 nt, Homo sapiens
cuuuugugauucuucaguugcu

SEQ ID NO: 156365 - RNA, 22 nt, Homo sapiens
cuuuuguggaucuucuguugcu

SEQ ID NO: 156366 - RNA, 21 nt, Homo sapiens
cuuuuuacucguucauaugca

SEQ ID NO: 156367 - RNA, 22 nt, Homo sapiens
cuuuuugguagagcaggugugc

SEQ ID NO: 156368 - RNA, 22 nt, Homo sapiens
gaaagauuuccugagcuagaaa

SEQ ID NO: 156369 - RNA, 22 nt, Homo sapiens
gaaagauuuuaacugggagacu

SEQ ID NO: 156370 - RNA, 18 nt, Homo sapiens
gaaaugccucuugcuuac

SEQ ID NO: 156371 - RNA, 22 nt, Homo sapiens
gaaaugcucauuuuggauccuu

SEQ ID NO: 156372 - RNA, 22 nt, Homo sapiens
gaacacaucuuugguuagagga

SEQ ID NO: 156373 - RNA, 22 nt, Homo sapiens
gaacuggcuuagugaaacuucc

SEQ ID NO: 156374 - RNA, 22 nt, Homo sapiens
gaagcagcauucugguuuuugg

SEQ ID NO: 156375 - RNA, 22 nt, Homo sapiens
gaagcgaggugauuagcagaca

SEQ ID NO: 156376 - RNA, 22 nt, Homo sapiens
gaaggugcuuggugaaugcauu

SEQ ID NO: 156377 - RNA, 23 nt, Homo sapiens
gaaguaauaaauggauucuuaac

SEQ ID NO: 156378 - RNA, 17 nt, Homo sapiens
gaaguguuucagcagcu

SEQ ID NO: 156379 - RNA, 19 nt, Homo sapiens
gaaguguuuguucuccaug

SEQ ID NO: 156380 - RNA, 22 nt, Homo sapiens
gaauaaacuagagaggacugag

SEQ ID NO: 156381 - RNA, 22 nt, Homo sapiens
gaauacugacuauuucaucugg

SEQ ID NO: 156382 - RNA, 22 nt, Homo sapiens
gaauagugcugcaaugaacaua

SEQ ID NO: 156383 - RNA, 22 nt, Homo sapiens
gaaucacagauuaugaguaucu

SEQ ID NO: 156384 - RNA, 22 nt, Homo sapiens
gaaugcuaagcaugugggaguu

SEQ ID NO: 156385 - RNA, 22 nt, Homo sapiens
gaauucugucgcuuacuagaug

SEQ ID NO: 156386 - RNA, 22 nt, Homo sapiens
gacaccugguguggaacuggag

SEQ ID NO: 156387 - RNA, 22 nt, Homo sapiens
gacacugucuucugcucuuaaa

SEQ ID NO: 156388 - RNA, 22 nt, Homo sapiens
gacauguaaggcucucucuguu

SEQ ID NO: 156389 - RNA, 22 nt, Homo sapiens
gacauguuucucucuguuuacu

SEQ ID NO: 156390 - RNA, 22 nt, Homo sapiens
gaccaaagaggcaggcauuaga

SEQ ID NO: 156391 - RNA, 21 nt, Homo sapiens
gaccacagcagggaaugucag

SEQ ID NO: 156392 - RNA, 22 nt, Homo sapiens
gaccuaggaggauugcuugagc

SEQ ID NO: 156393 - RNA, 22 nt, Homo sapiens
gacuggagcuguaugugguuac

SEQ ID NO: 156394 - RNA, 22 nt, Homo sapiens
gacuggcuguuuucuuuauuau

SEQ ID NO: 156395 - RNA, 22 nt, Homo sapiens
gacuggguuaguuugaaagacu

SEQ ID NO: 156396 - RNA, 22 nt, Homo sapiens
gacuucaucauacuaugugugg

SEQ ID NO: 156397 - RNA, 18 nt, Homo sapiens
gacuuggaguuuacagug

SEQ ID NO: 156398 - RNA, 22 nt, Homo sapiens
gagaacaguguuguauuuuuuc

SEQ ID NO: 156399 - RNA, 22 nt, Homo sapiens
gagaaccauuuggagaaaaagu

SEQ ID NO: 156400 - RNA, 22 nt, Homo sapiens
gagaacuaaugguuugauaagg

SEQ ID NO: 156401 - RNA, 22 nt, Homo sapiens
gagaacugagauaagugauauu

SEQ ID NO: 156402 - RNA, 22 nt, Homo sapiens
gagaacuggcgugaacugcacg

SEQ ID NO: 156403 - RNA, 22 nt, Homo sapiens
gagaaugaugauuuccaauuuc

SEQ ID NO: 156404 - RNA, 22 nt, Homo sapiens
gagacauguuugccaauaauuu

SEQ ID NO: 156405 - RNA, 23 nt, Homo sapiens
gagaccagcuucagaaagcacga

SEQ ID NO: 156406 - RNA, 22 nt, Homo sapiens
gagaccauuuacugccuacuua

SEQ ID NO: 156407 - RNA, 22 nt, Homo sapiens
gagacggagucucgcucuguca

SEQ ID NO: 156408 - RNA, 22 nt, Homo sapiens
gagacugaguuuugcucuuguu

SEQ ID NO: 156409 - RNA, 22 nt, Homo sapiens
gagagugcuuggcaucugcuga

SEQ ID NO: 156410 - RNA, 22 nt, Homo sapiens
gagauaggauucacuuucaugu

SEQ ID NO: 156411 - RNA, 22 nt, Homo sapiens
gagauagguauuucauuuaccc

SEQ ID NO: 156412 - RNA, 22 nt, Homo sapiens
gagauauucugguuuacuaaau

SEQ ID NO: 156413 - RNA, 22 nt, Homo sapiens
gagaucauguacuagaacaccu

SEQ ID NO: 156414 - RNA, 22 nt, Homo sapiens
gagaugaaguuaaggaucuuua

SEQ ID NO: 156415 - RNA, 22 nt, Homo sapiens
gagaugguguuccacugccagu

SEQ ID NO: 156416 - RNA, 22 nt, Homo sapiens
gagaugugguucaaggguguuu

SEQ ID NO: 156417 - RNA, 22 nt, Homo sapiens
gagauguuuuguuaucaaagga

SEQ ID NO: 156418 - RNA, 22 nt, Homo sapiens
gagcacugaauacugugguggu

SEQ ID NO: 156419 - RNA, 22 nt, Homo sapiens
gagcuacauggauagucugcau

SEQ ID NO: 156420 - RNA, 22 nt, Homo sapiens
gagcuagcauuuagacaucugg

SEQ ID NO: 156421 - RNA, 21 nt, Homo sapiens
gagcuaggugaggcuguaaug

SEQ ID NO: 156422 - RNA, 22 nt, Homo sapiens
gagcuuguggucuucguguuau

SEQ ID NO: 156423 - RNA, 22 nt, Homo sapiens
gaggaaguuuacaaagcaucug

SEQ ID NO: 156424 - RNA, 22 nt, Homo sapiens
gaggaguauuuugucgaauguc

SEQ ID NO: 156425 - RNA, 22 nt, Homo sapiens
gaggcagucugucccuuagcag

SEQ ID NO: 156426 - RNA, 22 nt, Homo sapiens
gaggcauuauucccaucuuaca

SEQ ID NO: 156427 - RNA, 22 nt, Homo sapiens
gagguaaguaagaauggcaagc

SEQ ID NO: 156428 - RNA, 22 nt, Homo sapiens
gagguagaauguuuuucagcug

SEQ ID NO: 156429 - RNA, 22 nt, Homo sapiens
gagguagagaguuuugauucug

SEQ ID NO: 156430 - RNA, 22 nt, Homo sapiens
gaggugguagguucacagcagc

SEQ ID NO: 156431 - RNA, 21 nt, Homo sapiens
gagugcaaauaaagagagggc

SEQ ID NO: 156432 - RNA, 22 nt, Homo sapiens
gagugcaauggugccaucucgg

SEQ ID NO: 156433 - RNA, 22 nt, Homo sapiens
gagugguucuauauguaauugg

SEQ ID NO: 156434 - RNA, 22 nt, Homo sapiens
gaguucaaaucucagcucuguu

SEQ ID NO: 156435 - RNA, 22 nt, Homo sapiens
gauaaauccagauucugaugua

SEQ ID NO: 156436 - RNA, 22 nt, Homo sapiens
gauauguuagggggagaaguua

SEQ ID NO: 156437 - RNA, 22 nt, Homo sapiens
gauauugacuuauucuauguuu

SEQ ID NO: 156438 - RNA, 17 nt, Homo sapiens
gaucacagucgucuccu

SEQ ID NO: 156439 - RNA, 22 nt, Homo sapiens
gaucacuuugaugccaggaacu

SEQ ID NO: 156440 - RNA, 22 nt, Homo sapiens
gaucucaguggauacugugaug

SEQ ID NO: 156441 - RNA, 22 nt, Homo sapiens
gaucuguuucaauugucuuagu

SEQ ID NO: 156442 - RNA, 22 nt, Homo sapiens
gaugacacugggucaaaucuca

SEQ ID NO: 156443 - RNA, 22 nt, Homo sapiens
gaugacuaagaauuuuauaauu

SEQ ID NO: 156444 - RNA, 22 nt, Homo sapiens
gaugaggcuagagacaugugua

SEQ ID NO: 156445 - RNA, 22 nt, Homo sapiens
gaugauauuugagucauuagaa

SEQ ID NO: 156446 - RNA, 22 nt, Homo sapiens
gauggcauuucuggaucugccc

SEQ ID NO: 156447 - RNA, 22 nt, Homo sapiens
gaugguuuucaccugcaugcuu

SEQ ID NO: 156448 - RNA, 22 nt, Homo sapiens
gauguagaaagagugggcugga

SEQ ID NO: 156449 - RNA, 22 nt, Homo sapiens
gauuccauugcgaauuuucaga

SEQ ID NO: 156450 - RNA, 22 nt, Homo sapiens
gauuucaucuuuagaggaagga

SEQ ID NO: 156451 - RNA, 22 nt, Homo sapiens
gauuuguauuaaaagugugacg

SEQ ID NO: 156452 - RNA, 22 nt, Homo sapiens
gcaaaguguuuuccaacuuggu

SEQ ID NO: 156453 - RNA, 22 nt, Homo sapiens
gcaaaguguuuuuaggaagucu

SEQ ID NO: 156454 - RNA, 23 nt, Homo sapiens
gcaaauaucguagagugucccug

SEQ ID NO: 156455 - RNA, 22 nt, Homo sapiens
gcaagacaugucuaagguuuaa

SEQ ID NO: 156456 - RNA, 20 nt, Homo sapiens
gcaagcaugaagaguagaga

SEQ ID NO: 156457 - RNA, 22 nt, Homo sapiens
gcaaggaugagugcccaugaga

SEQ ID NO: 156458 - RNA, 22 nt, Homo sapiens
gcaaugcugucugugcacagau

SEQ ID NO: 156459 - RNA, 22 nt, Homo sapiens
gcacaaugccugacgaguccug

SEQ ID NO: 156460 - RNA, 22 nt, Homo sapiens
gcaggaaucuugagaaggauuc

SEQ ID NO: 156461 - RNA, 22 nt, Homo sapiens
gcagguguuaugcaaacaacug

SEQ ID NO: 156462 - RNA, 22 nt, Homo sapiens
gcaguacacuguugguaggaau

SEQ ID NO: 156463 - RNA, 20 nt, Homo sapiens
gcaguguucacuguauuccu

SEQ ID NO: 156464 - RNA, 20 nt, Homo sapiens
gcaguguucugaccugaauc

SEQ ID NO: 156465 - RNA, 22 nt, Homo sapiens
gcaguguugugauccaggucuu

SEQ ID NO: 156466 - RNA, 17 nt, Homo sapiens
gcauaugucgaaccagc

SEQ ID NO: 156467 - RNA, 20 nt, Homo sapiens
gcauaugucuuuauagcaga

SEQ ID NO: 156468 - RNA, 17 nt, Homo sapiens
gcauauguugaaccagu

SEQ ID NO: 156469 - RNA, 22 nt, Homo sapiens
gcauauuuuaaaguguaaccug

SEQ ID NO: 156470 - RNA, 17 nt, Homo sapiens
gcccuuugugccucuuc

SEQ ID NO: 156471 - RNA, 22 nt, Homo sapiens
gcuaggagauccacugcucucu

SEQ ID NO: 156472 - RNA, 22 nt, Homo sapiens
gcuaggagaucugcugcucucu

SEQ ID NO: 156473 - RNA, 22 nt, Homo sapiens
gcuaguguuugccagcguagcc

SEQ ID NO: 156474 - RNA, 22 nt, Homo sapiens
gcuccuuugaguagcuucugug

SEQ ID NO: 156475 - RNA, 22 nt, Homo sapiens
gcugcacuuuaaggcauccccu

SEQ ID NO: 156476 - RNA, 17 nt, Homo sapiens
gcugcauucauguagaa

SEQ ID NO: 156477 - RNA, 22 nt, Homo sapiens
gcugcuguaccagaugugguua

SEQ ID NO: 156478 - RNA, 22 nt, Homo sapiens
gcugcuguggcagauuggauuc

SEQ ID NO: 156479 - RNA, 22 nt, Homo sapiens
gcuggguucagagugggcugcg

SEQ ID NO: 156480 - RNA, 22 nt, Homo sapiens
gcugguauuacaggcaugagcc

SEQ ID NO: 156481 - RNA, 22 nt, Homo sapiens
gcuguaguugaggauuuuaaga

SEQ ID NO: 156482 - RNA, 22 nt, Homo sapiens
gcuguauugacuuuguaucaua

SEQ ID NO: 156483 - RNA, 19 nt, Homo sapiens
gcuucuugaggacgaugac

SEQ ID NO: 156484 - RNA, 23 nt, Homo sapiens
ggaaacauccagucuuucaccau

SEQ ID NO: 156485 - RNA, 22 nt, Homo sapiens
ggaaagacaccuuacuauguua

SEQ ID NO: 156486 - RNA, 22 nt, Homo sapiens
ggaagaauauuaggggauuucg

SEQ ID NO: 156487 - RNA, 22 nt, Homo sapiens
ggaagacaguguggugauuccu

SEQ ID NO: 156488 - RNA, 22 nt, Homo sapiens
ggaagacuggcuuguuuaccca

SEQ ID NO: 156489 - RNA, 22 nt, Homo sapiens
ggaagccuggaaaaaauuguga

SEQ ID NO: 156490 - RNA, 23 nt, Homo sapiens
ggaaugaaaccugguuaugauau

SEQ ID NO: 156491 - RNA, 22 nt, Homo sapiens
ggaaugggauuugaagucuggc

SEQ ID NO: 156492 - RNA, 22 nt, Homo sapiens
ggaauugcaucaaaugcaggua

SEQ ID NO: 156493 - RNA, 22 nt, Homo sapiens
ggacaagagacugggacacuga

SEQ ID NO: 156494 - RNA, 22 nt, Homo sapiens
ggacugagaggacuacagugua

SEQ ID NO: 156495 - RNA, 22 nt, Homo sapiens
ggagaugugccugcucugcucu

SEQ ID NO: 156496 - RNA, 23 nt, Homo sapiens
ggaguguaaugacucgaucucgg

SEQ ID NO: 156497 - RNA, 21 nt, Homo sapiens
ggauucaucccucaugaauuu

SEQ ID NO: 156498 - RNA, 22 nt, Homo sapiens
ggcaaaaucgcaauuacuuuug

SEQ ID NO: 156499 - RNA, 22 nt, Homo sapiens
ggcaaaugaagauggagaggcu

SEQ ID NO: 156500 - RNA, 22 nt, Homo sapiens
ggcaacauggugaaacucuguc

SEQ ID NO: 156501 - RNA, 22 nt, Homo sapiens
ggcaagaaccacaauuacuuuu

SEQ ID NO: 156502 - RNA, 22 nt, Homo sapiens
ggcaagaaccucaauuaccuuu

SEQ ID NO: 156503 - RNA, 22 nt, Homo sapiens
ggcaagaagaacuauaacuuuu

SEQ ID NO: 156504 - RNA, 22 nt, Homo sapiens
ggcaagugggagggaguguuuc

SEQ ID NO: 156505 - RNA, 22 nt, Homo sapiens
ggcaauauauucugaauucagu

SEQ ID NO: 156506 - RNA, 22 nt, Homo sapiens
ggcacaauugcagcaauaaaca

SEQ ID NO: 156507 - RNA, 22 nt, Homo sapiens
ggcagaauugcugaggaugcua

SEQ ID NO: 156508 - RNA, 22 nt, Homo sapiens
ggcagcauugccuuugcaguga

SEQ ID NO: 156509 - RNA, 22 nt, Homo sapiens
ggcuacauuguuacaauuagua

SEQ ID NO: 156510 - RNA, 22 nt, Homo sapiens
ggcuagagagcucagggauaug

SEQ ID NO: 156511 - RNA, 18 nt, Homo sapiens
ggcugguguuuuaguaua

SEQ ID NO: 156512 - RNA, 22 nt, Homo sapiens
gggaagauauaggcugggcacc

SEQ ID NO: 156513 - RNA, 22 nt, Homo sapiens
gggaaugaagagaaccuuccca

SEQ ID NO: 156514 - RNA, 22 nt, Homo sapiens
gggaugaauuagguauguuuau

SEQ ID NO: 156515 - RNA, 22 nt, Homo sapiens
gggcagaugucuggacaccuca

SEQ ID NO: 156516 - RNA, 22 nt, Homo sapiens
gggcaugauggugcacacaugu

SEQ ID NO: 156517 - RNA, 22 nt, Homo sapiens
gggcaugaugucuuaugccuau

SEQ ID NO: 156518 - RNA, 22 nt, Homo sapiens
gggcauugugggcagagggcag

SEQ ID NO: 156519 - RNA, 22 nt, Homo sapiens
ggggaguguggacaucacccug

SEQ ID NO: 156520 - RNA, 22 nt, Homo sapiens
ggucaggagaaugguaacugag

SEQ ID NO: 156521 - RNA, 22 nt, Homo sapiens
ggucaguguuaucaccgaagga

SEQ ID NO: 156522 - RNA, 22 nt, Homo sapiens
ggucccccuccacucucgcaaa

SEQ ID NO: 156523 - RNA, 19 nt, Homo sapiens
ggucccucucaagucauuc

SEQ ID NO: 156524 - RNA, 22 nt, Homo sapiens
ggucuagagagagggguggacu

SEQ ID NO: 156525 - RNA, 22 nt, Homo sapiens
ggucugguguugaaauucuuca

SEQ ID NO: 156526 - RNA, 22 nt, Homo sapiens
ggugacugguuuaucuggcagu

SEQ ID NO: 156527 - RNA, 22 nt, Homo sapiens
ggugagauaucugcugauguuu

SEQ ID NO: 156528 - RNA, 22 nt, Homo sapiens
gguggcaaaucugaguggcgcu

SEQ ID NO: 156529 - RNA, 22 nt, Homo sapiens
gguggucuuccccuggaguucg

SEQ ID NO: 156530 - RNA, 22 nt, Homo sapiens
gguggugguauuucagaaaaug

SEQ ID NO: 156531 - RNA, 22 nt, Homo sapiens
ggugucuuguuuaauacucauu

SEQ ID NO: 156532 - RNA, 22 nt, Homo sapiens
guaaaucucuguuuucauggac

SEQ ID NO: 156533 - RNA, 22 nt, Homo sapiens
guaaauguccccugugauauug

SEQ ID NO: 156534 - RNA, 22 nt, Homo sapiens
guaagucucaugagaucugaug

SEQ ID NO: 156535 - RNA, 22 nt, Homo sapiens
guaaucuguaguaaagcaccau

SEQ ID NO: 156536 - RNA, 22 nt, Homo sapiens
guacaguauaguaauaggauuu

SEQ ID NO: 156537 - RNA, 22 nt, Homo sapiens
guacauagucacacauauacau

SEQ ID NO: 156538 - RNA, 22 nt, Homo sapiens
guacccuauggauauagaugaa

SEQ ID NO: 156539 - RNA, 22 nt, Homo sapiens
guagcagaacauguuccuugua

SEQ ID NO: 156540 - RNA, 22 nt, Homo sapiens
guauacaugucaaaacucacau

SEQ ID NO: 156541 - RNA, 22 nt, Homo sapiens
guaucauugccuaaugcucuca

SEQ ID NO: 156542 - RNA, 22 nt, Homo sapiens
guaugacacaggaagcuuaacc

SEQ ID NO: 156543 - RNA, 22 nt, Homo sapiens
guaugcaagugauaugacauau

SEQ ID NO: 156544 - RNA, 22 nt, Homo sapiens
guaugguugaagugacaagcca

SEQ ID NO: 156545 - RNA, 22 nt, Homo sapiens
gucacagaaaaagauaugccaa

SEQ ID NO: 156546 - RNA, 22 nt, Homo sapiens
gucacugggugcugcgccuguc

SEQ ID NO: 156547 - RNA, 22 nt, Homo sapiens
gucacuguuuccuauuauauuu

SEQ ID NO: 156548 - RNA, 22 nt, Homo sapiens
gucagcaaagaggaauaguuug

SEQ ID NO: 156549 - RNA, 22 nt, Homo sapiens
gucagcaucaccaugucuauga

SEQ ID NO: 156550 - RNA, 22 nt, Homo sapiens
gucagguaccugaaagcagcca

SEQ ID NO: 156551 - RNA, 22 nt, Homo sapiens
gucagugauugauuuaaagacg

SEQ ID NO: 156552 - RNA, 22 nt, Homo sapiens
gucagugugauaucugcagggg

SEQ ID NO: 156553 - RNA, 22 nt, Homo sapiens
gucauugcuuaucugcugacgu

SEQ ID NO: 156554 - RNA, 22 nt, Homo sapiens
gucauugucaauugacaauugu

SEQ ID NO: 156555 - RNA, 21 nt, Homo sapiens
guccaaaacaguguccaaugc

SEQ ID NO: 156556 - RNA, 22 nt, Homo sapiens
gucucauugcaguuagaccugu

SEQ ID NO: 156557 - RNA, 22 nt, Homo sapiens
gucucccagccuacaucuuucu

SEQ ID NO: 156558 - RNA, 22 nt, Homo sapiens
gucucugguugcuuuuguacca

SEQ ID NO: 156559 - RNA, 22 nt, Homo sapiens
gucucuugguuuagagcauuua

SEQ ID NO: 156560 - RNA, 22 nt, Homo sapiens
gucucuuguuaucauuucugag

SEQ ID NO: 156561 - RNA, 22 nt, Homo sapiens
gucuggcaauggcagacuggca

SEQ ID NO: 156562 - RNA, 22 nt, Homo sapiens
gucuguuugauccagaucaaaa

SEQ ID NO: 156563 - RNA, 22 nt, Homo sapiens
gucuuccagccuccaucuuucu

SEQ ID NO: 156564 - RNA, 22 nt, Homo sapiens
gucuuuaguugaaacauguggu

SEQ ID NO: 156565 - RNA, 22 nt, Homo sapiens
gucuuugagauaggguuauuuu

SEQ ID NO: 156566 - RNA, 22 nt, Homo sapiens
gugaaagauuaaaccagugugu

SEQ ID NO: 156567 - RNA, 22 nt, Homo sapiens
gugaaaugaaacgcuaugucuu

SEQ ID NO: 156568 - RNA, 22 nt, Homo sapiens
gugaaauguguagaggaucugg

SEQ ID NO: 156569 - RNA, 22 nt, Homo sapiens
gugaagugugaccucagcaucu

SEQ ID NO: 156570 - RNA, 22 nt, Homo sapiens
gugaaugcauuaagaaggggga

SEQ ID NO: 156571 - RNA, 22 nt, Homo sapiens
gugaauguuuucuuacauggua

SEQ ID NO: 156572 - RNA, 22 nt, Homo sapiens
gugacagucaaagacaugacuu

SEQ ID NO: 156573 - RNA, 22 nt, Homo sapiens
gugaccauuugacauauccuug

SEQ ID NO: 156574 - RNA, 22 nt, Homo sapiens
gugacgucauuguuccuggcuc

SEQ ID NO: 156575 - RNA, 22 nt, Homo sapiens
gugacugcauccauccaggcuu

SEQ ID NO: 156576 - RNA, 22 nt, Homo sapiens
gugagaagaaaaauauggcugu

SEQ ID NO: 156577 - RNA, 22 nt, Homo sapiens
gugagacugguccugaacccag

SEQ ID NO: 156578 - RNA, 16 nt, Homo sapiens
gugagagaugacaaac

SEQ ID NO: 156579 - RNA, 22 nt, Homo sapiens
gugagauuaccauuuaaaucag

SEQ ID NO: 156580 - RNA, 22 nt, Homo sapiens
gugagcaaacuuaccuaagguu

SEQ ID NO: 156581 - RNA, 22 nt, Homo sapiens
gugagcaauugauacuugaagu

SEQ ID NO: 156582 - RNA, 22 nt, Homo sapiens
gugagccaugauuuuaccacug

SEQ ID NO: 156583 - RNA, 22 nt, Homo sapiens
gugagggaugugaaaaagguca

SEQ ID NO: 156584 - RNA, 22 nt, Homo sapiens
gugagguaagaguugcuuugcu

SEQ ID NO: 156585 - RNA, 20 nt, Homo sapiens
gugagguagaggguuaccug

SEQ ID NO: 156586 - RNA, 20 nt, Homo sapiens
gugagucauuaguaaccaaa

SEQ ID NO: 156587 - RNA, 21 nt, Homo sapiens
gugaucaugucacugcacucc

SEQ ID NO: 156588 - RNA, 22 nt, Homo sapiens
gugaucucauuuggaauuagag

SEQ ID NO: 156589 - RNA, 22 nt, Homo sapiens
gugaugcaguacguagaggaga

SEQ ID NO: 156590 - RNA, 22 nt, Homo sapiens
gugauguguuuguucuaucucu

SEQ ID NO: 156591 - RNA, 22 nt, Homo sapiens
gugcacaaaucuuaaauguaca

SEQ ID NO: 156592 - RNA, 22 nt, Homo sapiens
gugcacaacaugcagguuuguu

SEQ ID NO: 156593 - RNA, 22 nt, Homo sapiens
gugcacaacaugcaguuuuguu

SEQ ID NO: 156594 - RNA, 21 nt, Homo sapiens
gugcacaguaguguuuaauag

SEQ ID NO: 156595 - RNA, 21 nt, Homo sapiens
gugcagaugccacagucacuc

SEQ ID NO: 156596 - RNA, 22 nt, Homo sapiens
gugcaguguuugcauggaauca

SEQ ID NO: 156597 - RNA, 22 nt, Homo sapiens
gugcauaucugugguuggcuga

SEQ ID NO: 156598 - RNA, 22 nt, Homo sapiens
gugcaugcaucuuuauaguagc

SEQ ID NO: 156599 - RNA, 22 nt, Homo sapiens
gugcauguccacuaguccauau

SEQ ID NO: 156600 - RNA, 20 nt, Homo sapiens
guggaagauaaguagccuga

SEQ ID NO: 156601 - RNA, 22 nt, Homo sapiens
guggaagcacaggccuccugga

SEQ ID NO: 156602 - RNA, 22 nt, Homo sapiens
guggaagucuuugguauuggua

SEQ ID NO: 156603 - RNA, 22 nt, Homo sapiens
guggaaugaaaacucucucaca

SEQ ID NO: 156604 - RNA, 22 nt, Homo sapiens
guggaauuauagagacaucuug

SEQ ID NO: 156605 - RNA, 22 nt, Homo sapiens
guggacagagacuaaauguugu

SEQ ID NO: 156606 - RNA, 22 nt, Homo sapiens
guggcgagaucauagcucauug

SEQ ID NO: 156607 - RNA, 22 nt, Homo sapiens
guggcuaaagauuuggaaucug

SEQ ID NO: 156608 - RNA, 22 nt, Homo sapiens
guggcuagaaugaagguagcug

SEQ ID NO: 156609 - RNA, 22 nt, Homo sapiens
guggcuuguaggggucaaggga

SEQ ID NO: 156610 - RNA, 22 nt, Homo sapiens
gugggauauaaucaguccugua

SEQ ID NO: 156611 - RNA, 22 nt, Homo sapiens
gugguaaaauggcauagagcua

SEQ ID NO: 156612 - RNA, 22 nt, Homo sapiens
gugguauaaguaccuccuuuca

SEQ ID NO: 156613 - RNA, 22 nt, Homo sapiens
guguaaaacaauuagaggauuu

SEQ ID NO: 156614 - RNA, 22 nt, Homo sapiens
guguauucaucuggcugaggua

SEQ ID NO: 156615 - RNA, 22 nt, Homo sapiens
gugucaguggggagugaucuuc

SEQ ID NO: 156616 - RNA, 22 nt, Homo sapiens
guguccucgaguacacaucagg

SEQ ID NO: 156617 - RNA, 22 nt, Homo sapiens
gugugauuauuucaauugaugc

SEQ ID NO: 156618 - RNA, 22 nt, Homo sapiens
gugugcaaauguguaccuacau

SEQ ID NO: 156619 - RNA, 22 nt, Homo sapiens
gugugcaauuuugugggaggca

SEQ ID NO: 156620 - RNA, 22 nt, Homo sapiens
gugugcacaaucuggcaugugc

SEQ ID NO: 156621 - RNA, 22 nt, Homo sapiens
guguucaaagcugauugagauu

SEQ ID NO: 156622 - RNA, 22 nt, Homo sapiens
guucaaguuuucucuugugggu

SEQ ID NO: 156623 - RNA, 20 nt, Homo sapiens
guucacagagguuaugauua

SEQ ID NO: 156624 - RNA, 22 nt, Homo sapiens
guucacagugguugccuuccag

SEQ ID NO: 156625 - RNA, 22 nt, Homo sapiens
guucacaguuucuaaucccagc

SEQ ID NO: 156626 - RNA, 22 nt, Homo sapiens
guucagguauucuggaacagag

SEQ ID NO: 156627 - RNA, 22 nt, Homo sapiens
guucaucagggauacuggccug

SEQ ID NO: 156628 - RNA, 22 nt, Homo sapiens
guucaucagggauacuggcuua

SEQ ID NO: 156629 - RNA, 20 nt, Homo sapiens
guucauguaauuaguucagg

SEQ ID NO: 156630 - RNA, 22 nt, Homo sapiens
guugcaaaguaauugugguuuu

SEQ ID NO: 156631 - RNA, 22 nt, Homo sapiens
guugccuaggcuggagugcagu

SEQ ID NO: 156632 - RNA, 22 nt, Homo sapiens
guuggcuuuuuaaggaaauugc

SEQ ID NO: 156633 - RNA, 22 nt, Homo sapiens
guuuggauauuaggcaagagua

SEQ ID NO: 156634 - RNA, 15 nt, Homo sapiens
guuuuuggauacaau

SEQ ID NO: 156635 - RNA, 22 nt, Homo sapiens
guuuuuggggucacuauuaccg

SEQ ID NO: 156636 - RNA, 22 nt, Homo sapiens
uaaacacucacuucauagccau

SEQ ID NO: 156637 - RNA, 22 nt, Homo sapiens
uaaaccacguuuacauuugaga

SEQ ID NO: 156638 - RNA, 18 nt, Homo sapiens
uaaaggcacuguguuguu

SEQ ID NO: 156639 - RNA, 22 nt, Homo sapiens
uaaaugacugucaguagaugaa

SEQ ID NO: 156640 - RNA, 22 nt, Homo sapiens
uaaauggauauugccaucuccu

SEQ ID NO: 156641 - RNA, 21 nt, Homo sapiens
uaaaugucauacaaagcaaug

SEQ ID NO: 156642 - RNA, 22 nt, Homo sapiens
uaaauugcauaaguacaaauga

SEQ ID NO: 156643 - RNA, 22 nt, Homo sapiens
uaacauuguugauuauacuaag

SEQ ID NO: 156644 - RNA, 22 nt, Homo sapiens
uaacccuuaguaucuguggguu

SEQ ID NO: 156645 - RNA, 22 nt, Homo sapiens
uaacuaguggaauuugauuuca

SEQ ID NO: 156646 - RNA, 22 nt, Homo sapiens
uaacuucaucauaagucaagaa

SEQ ID NO: 156647 - RNA, 22 nt, Homo sapiens
uaagacugccccagacagcaag

SEQ ID NO: 156648 - RNA, 22 nt, Homo sapiens
uaagacuguguaauuuaugaag

SEQ ID NO: 156649 - RNA, 22 nt, Homo sapiens
uaagagcuaggauuuuaaauca

SEQ ID NO: 156650 - RNA, 22 nt, Homo sapiens
uaagcagugcaagaauggaaua

SEQ ID NO: 156651 - RNA, 22 nt, Homo sapiens
uaaggauuuuggugauuacacu

SEQ ID NO: 156652 - RNA, 22 nt, Homo sapiens
uaaggcccauucuaugaagcag

SEQ ID NO: 156653 - RNA, 22 nt, Homo sapiens
uaaggcuucuuggaauacugca

SEQ ID NO: 156654 - RNA, 22 nt, Homo sapiens
uaaggcuuugguagguuugguc

SEQ ID NO: 156655 - RNA, 22 nt, Homo sapiens
uaaggcuuugucuuaggacuuu

SEQ ID NO: 156656 - RNA, 22 nt, Homo sapiens
uaagguguagacuggucacaag

SEQ ID NO: 156657 - RNA, 22 nt, Homo sapiens
uaagugaugucuuuuugugugc

SEQ ID NO: 156658 - RNA, 22 nt, Homo sapiens
uaaguuguagaacguuuucuua

SEQ ID NO: 156659 - RNA, 21 nt, Homo sapiens
uaauaaugucucagacaccua

SEQ ID NO: 156660 - RNA, 22 nt, Homo sapiens
uaauaauguuaggcuuacucaa

SEQ ID NO: 156661 - RNA, 22 nt, Homo sapiens
uaauacugcugugcuugaguug

SEQ ID NO: 156662 - RNA, 22 nt, Homo sapiens
uaauagagucauuauuauuguu

SEQ ID NO: 156663 - RNA, 22 nt, Homo sapiens
uaaugcaucaugguuggcaaac

SEQ ID NO: 156664 - RNA, 22 nt, Homo sapiens
uaaugcauguaaugggcugaua

SEQ ID NO: 156665 - RNA, 22 nt, Homo sapiens
uaaugcucauuagcaggccaau

SEQ ID NO: 156666 - RNA, 22 nt, Homo sapiens
uaaugcuguggucugguuuaaa

SEQ ID NO: 156667 - RNA, 22 nt, Homo sapiens
uaaugugaauagugcuguaaug

SEQ ID NO: 156668 - RNA, 22 nt, Homo sapiens
uacaaagcuuucugcaaaucau

SEQ ID NO: 156669 - RNA, 22 nt, Homo sapiens
uacaaccucugccucccaaguu

SEQ ID NO: 156670 - RNA, 21 nt, Homo sapiens
uacaaugcacaggagagccuc

SEQ ID NO: 156671 - RNA, 22 nt, Homo sapiens
uacaccugcacucuagccuggg

SEQ ID NO: 156672 - RNA, 22 nt, Homo sapiens
uacagcacaggugcagguguug

SEQ ID NO: 156673 - RNA, 22 nt, Homo sapiens
uacaggaaugucagguugcugu

SEQ ID NO: 156674 - RNA, 22 nt, Homo sapiens
uacagugcauagaggcaugaua

SEQ ID NO: 156675 - RNA, 22 nt, Homo sapiens
uacaucagccugaaagagcucg

SEQ ID NO: 156676 - RNA, 22 nt, Homo sapiens
uacaugugcacaacgugcaggu

SEQ ID NO: 156677 - RNA, 22 nt, Homo sapiens
uaccaaguauuuucacaugaac

SEQ ID NO: 156678 - RNA, 22 nt, Homo sapiens
uaccacccuuuuuccagaagcc

SEQ ID NO: 156679 - RNA, 22 nt, Homo sapiens
uaccaugcagguguauguuugu

SEQ ID NO: 156680 - RNA, 22 nt, Homo sapiens
uacugcagucagacuccugggc

SEQ ID NO: 156681 - RNA, 23 nt, Homo sapiens
uacugcauccuccgccucuaggg

SEQ ID NO: 156682 - RNA, 22 nt, Homo sapiens
uacugcauuccaaucugggcga

SEQ ID NO: 156683 - RNA, 22 nt, Homo sapiens
uacuguguaguuagaccucaga

SEQ ID NO: 156684 - RNA, 22 nt, Homo sapiens
uacuucauucuugaccuugcau

SEQ ID NO: 156685 - RNA, 22 nt, Homo sapiens
uacuuuguagagugugagaauu

SEQ ID NO: 156686 - RNA, 22 nt, Homo sapiens
uagaccaauuggcauauaguaa

SEQ ID NO: 156687 - RNA, 22 nt, Homo sapiens
uagagauaucaauuucauggug

SEQ ID NO: 156688 - RNA, 22 nt, Homo sapiens
uagaggaaugaauuuggccaga

SEQ ID NO: 156689 - RNA, 22 nt, Homo sapiens
uagaguguaaaccacauaguga

SEQ ID NO: 156690 - RNA, 21 nt, Homo sapiens
uagcaaauugcuauuaaggca

SEQ ID NO: 156691 - RNA, 22 nt, Homo sapiens
uagcacagugucauucuaggua

SEQ ID NO: 156692 - RNA, 22 nt, Homo sapiens
uagcacaugucagguaauuugc

SEQ ID NO: 156693 - RNA, 23 nt, Homo sapiens
uagcacuuuuuacauauggacau

SEQ ID NO: 156694 - RNA, 22 nt, Homo sapiens
uagcagcagugguguauuuaga

SEQ ID NO: 156695 - RNA, 22 nt, Homo sapiens
uagcagcauaaauggacuaaga

SEQ ID NO: 156696 - RNA, 19 nt, Homo sapiens
uagcagcaugauuuauaau

SEQ ID NO: 156697 - RNA, 22 nt, Homo sapiens
uagcagguggugaccacauuuu

SEQ ID NO: 156698 - RNA, 22 nt, Homo sapiens
uagcagugucuagguaggccau

SEQ ID NO: 156699 - RNA, 22 nt, Homo sapiens
uagcauaauuuguagaaaauca

SEQ ID NO: 156700 - RNA, 18 nt, Homo sapiens
uagcaugaugcugagugc

SEQ ID NO: 156701 - RNA, 22 nt, Homo sapiens
uagcuccacagcuauauauaau

SEQ ID NO: 156702 - RNA, 22 nt, Homo sapiens
uagcugcugcuaggcuaaggau

SEQ ID NO: 156703 - RNA, 23 nt, Homo sapiens
uagcuucucccagaccugcuccc

SEQ ID NO: 156704 - RNA, 22 nt, Homo sapiens
uaggacaaugguacagcagaaa

SEQ ID NO: 156705 - RNA, 22 nt, Homo sapiens
uaggacacaggacauauguaga

SEQ ID NO: 156706 - RNA, 22 nt, Homo sapiens
uaggcaaguugcccaaucucuc

SEQ ID NO: 156707 - RNA, 22 nt, Homo sapiens
uaggcaguguucucacuuguaa

SEQ ID NO: 156708 - RNA, 22 nt, Homo sapiens
uaggggcacacuucgguuagca

SEQ ID NO: 156709 - RNA, 22 nt, Homo sapiens
uagguacuuuacauguuaucuc

SEQ ID NO: 156710 - RNA, 22 nt, Homo sapiens
uagguaguuagcauacuacaca

SEQ ID NO: 156711 - RNA, 22 nt, Homo sapiens
uagguugucuucccagaguuuu

SEQ ID NO: 156712 - RNA, 22 nt, Homo sapiens
uaguaggacaggauuucaguua

SEQ ID NO: 156713 - RNA, 22 nt, Homo sapiens
uagugcacuacuugugggaaug

SEQ ID NO: 156714 - RNA, 22 nt, Homo sapiens
uagugcaguggcuccaucucag

SEQ ID NO: 156715 - RNA, 21 nt, Homo sapiens
uagugcugaggcaguauggga

SEQ ID NO: 156716 - RNA, 22 nt, Homo sapiens
uauacaguaggcacucaguggc

SEQ ID NO: 156717 - RNA, 22 nt, Homo sapiens
uauagcuuaaaguuuagauccu

SEQ ID NO: 156718 - RNA, 22 nt, Homo sapiens
uauagcuuuuuagggaauuugg

SEQ ID NO: 156719 - RNA, 22 nt, Homo sapiens
uauauaagcugaugagccacaa

SEQ ID NO: 156720 - RNA, 21 nt, Homo sapiens
uauaugacuuacuauugccuc

SEQ ID NO: 156721 - RNA, 22 nt, Homo sapiens
uauaugcaacauaguguaugug

SEQ ID NO: 156722 - RNA, 23 nt, Homo sapiens
uauaugugucuaggagcuauggu

SEQ ID NO: 156723 - RNA, 19 nt, Homo sapiens
uaucaaguaugcacuguac

SEQ ID NO: 156724 - RNA, 22 nt, Homo sapiens
uaucaaguuggaagagaaguaa

SEQ ID NO: 156725 - RNA, 22 nt, Homo sapiens
uaucacaaacuuagcaguuuaa

SEQ ID NO: 156726 - RNA, 22 nt, Homo sapiens
uaucacacgccuugcuucauuu

SEQ ID NO: 156727 - RNA, 22 nt, Homo sapiens
uaucacagaggguauccuagag

SEQ ID NO: 156728 - RNA, 22 nt, Homo sapiens
uaucacagauucuccaggguuu

SEQ ID NO: 156729 - RNA, 22 nt, Homo sapiens
uaucacagcaaggacccauuau

SEQ ID NO: 156730 - RNA, 20 nt, Homo sapiens
uaucacaggucagaaacccu

SEQ ID NO: 156731 - RNA, 22 nt, Homo sapiens
uaucacaggucaggaaucuugc

SEQ ID NO: 156732 - RNA, 22 nt, Homo sapiens
uaucaccacccugggaaacaua

SEQ ID NO: 156733 - RNA, 22 nt, Homo sapiens
uaucaugucuguguguaccuag

SEQ ID NO: 156734 - RNA, 22 nt, Homo sapiens
uaucccuuagagcggggugguu

SEQ ID NO: 156735 - RNA, 22 nt, Homo sapiens
uaucuacauguagguauguaug

SEQ ID NO: 156736 - RNA, 23 nt, Homo sapiens
uaugacagaggaagggggagcug

SEQ ID NO: 156737 - RNA, 22 nt, Homo sapiens
uaugacuguuugcucauucagg

SEQ ID NO: 156738 - RNA, 20 nt, Homo sapiens
uaugagacugggagaaguuc

SEQ ID NO: 156739 - RNA, 22 nt, Homo sapiens
uaugaucacuacagcagggaug

SEQ ID NO: 156740 - RNA, 22 nt, Homo sapiens
uaugcacuauagcauauguggu

SEQ ID NO: 156741 - RNA, 22 nt, Homo sapiens
uaugcuuauugucucauccacu

SEQ ID NO: 156742 - RNA, 22 nt, Homo sapiens
uauggauuugccuauucuguau

SEQ ID NO: 156743 - RNA, 22 nt, Homo sapiens
uauggcauuguuggugaugaua

SEQ ID NO: 156744 - RNA, 22 nt, Homo sapiens
uauggcuuuguuaacauuuucu

SEQ ID NO: 156745 - RNA, 17 nt, Homo sapiens
uauguaguacuuauaaa

SEQ ID NO: 156746 - RNA, 22 nt, Homo sapiens
uaugugcuuuguuaaacagaug

SEQ ID NO: 156747 - RNA, 20 nt, Homo sapiens
uauuacagaguaauggugga

SEQ ID NO: 156748 - RNA, 22 nt, Homo sapiens
uauuagguuggugcaaaaguua

SEQ ID NO: 156749 - RNA, 22 nt, Homo sapiens
uauucaagccaaauucaagcca

SEQ ID NO: 156750 - RNA, 22 nt, Homo sapiens
uauugcaacagaagaaagaguc

SEQ ID NO: 156751 - RNA, 22 nt, Homo sapiens
uauugcuuuacucucuuauccu

SEQ ID NO: 156752 - RNA, 22 nt, Homo sapiens
uauuguccaauaggauguuccu

SEQ ID NO: 156753 - RNA, 22 nt, Homo sapiens
uauuucaguugcguuucccgag

SEQ ID NO: 156754 - RNA, 22 nt, Homo sapiens
uauuucaguugugcagguaguu

SEQ ID NO: 156755 - RNA, 22 nt, Homo sapiens
uauuugguuggugcaaaaguaa

SEQ ID NO: 156756 - RNA, 22 nt, Homo sapiens
ucaaaugcucuuugcagagagg

SEQ ID NO: 156757 - RNA, 22 nt, Homo sapiens
ucaacaggucaauugcauagaa

SEQ ID NO: 156758 - RNA, 22 nt, Homo sapiens
ucaacauugcugucaggcaucu

SEQ ID NO: 156759 - RNA, 22 nt, Homo sapiens
ucaacguauuuauauagcagag

SEQ ID NO: 156760 - RNA, 22 nt, Homo sapiens
ucaagcaauucugcugccucag

SEQ ID NO: 156761 - RNA, 22 nt, Homo sapiens
ucaaugcaugugacaaagagua

SEQ ID NO: 156762 - RNA, 22 nt, Homo sapiens
ucaauugcuuaugaagauacau

SEQ ID NO: 156763 - RNA, 22 nt, Homo sapiens
ucacaaguguauagacaugucc

SEQ ID NO: 156764 - RNA, 22 nt, Homo sapiens
ucacaauucucaauuugugaaa

SEQ ID NO: 156765 - RNA, 22 nt, Homo sapiens
ucacaccauucuucuacuucag

SEQ ID NO: 156766 - RNA, 22 nt, Homo sapiens
ucacacugaaacuaggguguga

SEQ ID NO: 156767 - RNA, 22 nt, Homo sapiens
ucacacugcaucuguuggaauu

SEQ ID NO: 156768 - RNA, 22 nt, Homo sapiens
ucacagacauugaggggaccuu

SEQ ID NO: 156769 - RNA, 22 nt, Homo sapiens
ucacagucacugucacguugaa

SEQ ID NO: 156770 - RNA, 22 nt, Homo sapiens
ucacagugcaggaucaguuaau

SEQ ID NO: 156771 - RNA, 17 nt, Homo sapiens
ucacaguguuaggauga

SEQ ID NO: 156772 - RNA, 22 nt, Homo sapiens
ucacaucucagguuucuugaca

SEQ ID NO: 156773 - RNA, 22 nt, Homo sapiens
ucacaugaagauuuuaguauac

SEQ ID NO: 156774 - RNA, 22 nt, Homo sapiens
ucacauggauuaacucauuuau

SEQ ID NO: 156775 - RNA, 22 nt, Homo sapiens
ucacaugucagccguggggaag

SEQ ID NO: 156776 - RNA, 22 nt, Homo sapiens
ucacaugugaagauugggagua

SEQ ID NO: 156777 - RNA, 22 nt, Homo sapiens
ucacauguguaugagcuuugau

SEQ ID NO: 156778 - RNA, 22 nt, Homo sapiens
ucacauuguguagccugcucac

SEQ ID NO: 156779 - RNA, 22 nt, Homo sapiens
ucaccaccugcugaucauagag

SEQ ID NO: 156780 - RNA, 22 nt, Homo sapiens
ucaccaccuuccaggaccacug

SEQ ID NO: 156781 - RNA, 16 nt, Homo sapiens
ucaccccuagagaucc

SEQ ID NO: 156782 - RNA, 22 nt, Homo sapiens
ucaccuggggcacagcugaaga

SEQ ID NO: 156783 - RNA, 18 nt, Homo sapiens
ucaccuugcuuuuagaac

SEQ ID NO: 156784 - RNA, 18 nt, Homo sapiens
ucacggggagcagcagcc

SEQ ID NO: 156785 - RNA, 20 nt, Homo sapiens
ucacugaguaucuacgauua

SEQ ID NO: 156786 - RNA, 22 nt, Homo sapiens
ucacugcacuucaggcuuucuc

SEQ ID NO: 156787 - RNA, 22 nt, Homo sapiens
ucacuggacagaaauaaaggug

SEQ ID NO: 156788 - RNA, 22 nt, Homo sapiens
ucacuggagguuccugaaguuc

SEQ ID NO: 156789 - RNA, 22 nt, Homo sapiens
ucacugugagaguuuauccugu

SEQ ID NO: 156790 - RNA, 22 nt, Homo sapiens
ucacugugcacauaugauaggu

SEQ ID NO: 156791 - RNA, 22 nt, Homo sapiens
ucacugugguuggaaggcuuaa

SEQ ID NO: 156792 - RNA, 22 nt, Homo sapiens
ucacugugguuugggaaagugc

SEQ ID NO: 156793 - RNA, 22 nt, Homo sapiens
ucagaacugaacaaaccagucu

SEQ ID NO: 156794 - RNA, 21 nt, Homo sapiens
ucagaagcucccagggaggac

SEQ ID NO: 156795 - RNA, 22 nt, Homo sapiens
ucagacacugagcaaacgacua

SEQ ID NO: 156796 - RNA, 22 nt, Homo sapiens
ucagacacugcccuccaccugu

SEQ ID NO: 156797 - RNA, 22 nt, Homo sapiens
ucagaccauuucauuacagacu

SEQ ID NO: 156798 - RNA, 22 nt, Homo sapiens
ucagaguagaaacacuuccaua

SEQ ID NO: 156799 - RNA, 22 nt, Homo sapiens
ucagaguggagucugcagccuu

SEQ ID NO: 156800 - RNA, 22 nt, Homo sapiens
ucagaucaguuccacaagaacu

SEQ ID NO: 156801 - RNA, 22 nt, Homo sapiens
ucagaucuucagcaggggcccc

SEQ ID NO: 156802 - RNA, 22 nt, Homo sapiens
ucagcaaugcugcacucuacug

SEQ ID NO: 156803 - RNA, 21 nt, Homo sapiens
ucagcucaucacugccuggag

SEQ ID NO: 156804 - RNA, 22 nt, Homo sapiens
ucaggcacuaguaagaaaaagg

SEQ ID NO: 156805 - RNA, 22 nt, Homo sapiens
ucaggcacucagcuuagagucu

SEQ ID NO: 156806 - RNA, 22 nt, Homo sapiens
ucaggcuuuucccagagugaug

SEQ ID NO: 156807 - RNA, 22 nt, Homo sapiens
ucagguagcauuuuggaaacag

SEQ ID NO: 156808 - RNA, 22 nt, Homo sapiens
ucagguccuuacugugcucccu

SEQ ID NO: 156809 - RNA, 22 nt, Homo sapiens
ucaggugcagagaagaaauggg

SEQ ID NO: 156810 - RNA, 22 nt, Homo sapiens
ucaggugcaguggcucaugcuu

SEQ ID NO: 156811 - RNA, 22 nt, Homo sapiens
ucaguagagacaggauuucacc

SEQ ID NO: 156812 - RNA, 22 nt, Homo sapiens
ucagucuuuuaccauuaaguau

SEQ ID NO: 156813 - RNA, 22 nt, Homo sapiens
ucagugaauacauguacucaug

SEQ ID NO: 156814 - RNA, 22 nt, Homo sapiens
ucagugacuggguauuaaauca

SEQ ID NO: 156815 - RNA, 17 nt, Homo sapiens
ucagugcauuuaagaga

SEQ ID NO: 156816 - RNA, 22 nt, Homo sapiens
ucagugucugcauucuuauugu

SEQ ID NO: 156817 - RNA, 22 nt, Homo sapiens
ucaguuuagguguaacggccac

SEQ ID NO: 156818 - RNA, 22 nt, Homo sapiens
ucauauguaugugcaauuuugu

SEQ ID NO: 156819 - RNA, 22 nt, Homo sapiens
ucauaugucauaguaugaucuu

SEQ ID NO: 156820 - RNA, 22 nt, Homo sapiens
ucaucaguggggaugugguuga

SEQ ID NO: 156821 - RNA, 22 nt, Homo sapiens
ucaucaguuuuuuauaugugau

SEQ ID NO: 156822 - RNA, 22 nt, Homo sapiens
ucauccauacaguuagcaaagg

SEQ ID NO: 156823 - RNA, 22 nt, Homo sapiens
ucauugcaaucucugccucccg

SEQ ID NO: 156824 - RNA, 22 nt, Homo sapiens
ucauuggauggaaugcucugua

SEQ ID NO: 156825 - RNA, 22 nt, Homo sapiens
uccacaguaaggacccugccuu

SEQ ID NO: 156826 - RNA, 22 nt, Homo sapiens
uccacagugguggaauuguuca

SEQ ID NO: 156827 - RNA, 19 nt, Homo sapiens
uccaccgcgugcaccucua

SEQ ID NO: 156828 - RNA, 20 nt, Homo sapiens
uccacugagcgucacggcag

SEQ ID NO: 156829 - RNA, 22 nt, Homo sapiens
uccagcuuuuucuaauucugug

SEQ ID NO: 156830 - RNA, 22 nt, Homo sapiens
uccaguggacagacauaccaug

SEQ ID NO: 156831 - RNA, 22 nt, Homo sapiens
uccaguguuucuuccacuauuu

SEQ ID NO: 156832 - RNA, 22 nt, Homo sapiens
uccaugagaauaguuaggcucu

SEQ ID NO: 156833 - RNA, 22 nt, Homo sapiens
uccaugugaaaucuaugaggac

SEQ ID NO: 156834 - RNA, 22 nt, Homo sapiens
uccauuuguucagcuucaggaa

SEQ ID NO: 156835 - RNA, 22 nt, Homo sapiens
ucccaagaugagaugggggcug

SEQ ID NO: 156836 - RNA, 19 nt, Homo sapiens
ucccaagaugcucauacau

SEQ ID NO: 156837 - RNA, 22 nt, Homo sapiens
ucccagugcuaugcaaaagccu

SEQ ID NO: 156838 - RNA, 22 nt, Homo sapiens
ucccaguggucuugaaacaggg

SEQ ID NO: 156839 - RNA, 22 nt, Homo sapiens
ucccaguguguagcuugucucu

SEQ ID NO: 156840 - RNA, 22 nt, Homo sapiens
ucccaguuuuucugaauaguca

SEQ ID NO: 156841 - RNA, 22 nt, Homo sapiens
uccccgaggcuggagugcagug

SEQ ID NO: 156842 - RNA, 22 nt, Homo sapiens
uccccugagaacuugcuagaaa

SEQ ID NO: 156843 - RNA, 22 nt, Homo sapiens
ucccugaaaauuagcauuuuaa

SEQ ID NO: 156844 - RNA, 22 nt, Homo sapiens
ucccugaaagcugagauuggaa

SEQ ID NO: 156845 - RNA, 22 nt, Homo sapiens
ucccugaagcugcagcaacaca

SEQ ID NO: 156846 - RNA, 22 nt, Homo sapiens
ucccuggagcaagagaagaagg

SEQ ID NO: 156847 - RNA, 22 nt, Homo sapiens
ucccuguguccugggggcaccu

SEQ ID NO: 156848 - RNA, 22 nt, Homo sapiens
ucccuguguuccuuuugaauug

SEQ ID NO: 156849 - RNA, 22 nt, Homo sapiens
ucccuuagccaaauccccagcc

SEQ ID NO: 156850 - RNA, 22 nt, Homo sapiens
ucccuuucuggaguuucccaag

SEQ ID NO: 156851 - RNA, 22 nt, Homo sapiens
uccuacaugcaguacauucaaa

SEQ ID NO: 156852 - RNA, 22 nt, Homo sapiens
uccuacugucuucggggcacug

SEQ ID NO: 156853 - RNA, 22 nt, Homo sapiens
uccugagaauagaguugcaugu

SEQ ID NO: 156854 - RNA, 20 nt, Homo sapiens
uccugagauucccaguucuc

SEQ ID NO: 156855 - RNA, 22 nt, Homo sapiens
uccuugagccugggaguuauag

SEQ ID NO: 156856 - RNA, 22 nt, Homo sapiens
uccuugagccuuaaauuauaaa

SEQ ID NO: 156857 - RNA, 22 nt, Homo sapiens
uccuuuggcuaacuuucuaagu

SEQ ID NO: 156858 - RNA, 22 nt, Homo sapiens
uccuuuggguagcuguucagau

SEQ ID NO: 156859 - RNA, 18 nt, Homo sapiens
uccuuuugggguaggaga

SEQ ID NO: 156860 - RNA, 22 nt, Homo sapiens
ucgcaccauugcacuccagcca

SEQ ID NO: 156861 - RNA, 22 nt, Homo sapiens
ucgcagcucacuggagccucga

SEQ ID NO: 156862 - RNA, 22 nt, Homo sapiens
ucgcugggaagacugaaguguc

SEQ ID NO: 156863 - RNA, 19 nt, Homo sapiens
ucuaaaucucuugauagac

SEQ ID NO: 156864 - RNA, 15 nt, Homo sapiens
ucuaguuuugaagac

SEQ ID NO: 156865 - RNA, 22 nt, Homo sapiens
ucuaucacagccccacacucuc

SEQ ID NO: 156866 - RNA, 22 nt, Homo sapiens
ucuauggauaaaaugcccucau

SEQ ID NO: 156867 - RNA, 22 nt, Homo sapiens
ucucaaccucccaaguagcugg

SEQ ID NO: 156868 - RNA, 22 nt, Homo sapiens
ucucacauuucacagggauggg

SEQ ID NO: 156869 - RNA, 22 nt, Homo sapiens
ucucagcacagucagggcgccu

SEQ ID NO: 156870 - RNA, 22 nt, Homo sapiens
ucucaguggcuuccucacuuuu

SEQ ID NO: 156871 - RNA, 22 nt, Homo sapiens
ucucaguggugcuggcagggga

SEQ ID NO: 156872 - RNA, 22 nt, Homo sapiens
ucucagugugguaaaaguuuuu

SEQ ID NO: 156873 - RNA, 22 nt, Homo sapiens
ucucaguuuucaagcugucgau

SEQ ID NO: 156874 - RNA, 20 nt, Homo sapiens
ucucauagagguagagaaua

SEQ ID NO: 156875 - RNA, 23 nt, Homo sapiens
ucucauuccuugaaaauaaugac

SEQ ID NO: 156876 - RNA, 21 nt, Homo sapiens
ucucauugugguuuuaauugg

SEQ ID NO: 156877 - RNA, 22 nt, Homo sapiens
ucuccauuguccagaugaggaa

SEQ ID NO: 156878 - RNA, 22 nt, Homo sapiens
ucucugguuuucaaagcaguau

SEQ ID NO: 156879 - RNA, 22 nt, Homo sapiens
ucugacaaugaacaaucuauag

SEQ ID NO: 156880 - RNA, 22 nt, Homo sapiens
ucugacagugagagaaaucuga

SEQ ID NO: 156881 - RNA, 22 nt, Homo sapiens
ucugacucugugaugggcccaa

SEQ ID NO: 156882 - RNA, 22 nt, Homo sapiens
ucugauggaguugccagggaga

SEQ ID NO: 156883 - RNA, 22 nt, Homo sapiens
ucuggagugugaaguggauaug

SEQ ID NO: 156884 - RNA, 22 nt, Homo sapiens
ucuggauuuuugaggcaauaua

SEQ ID NO: 156885 - RNA, 22 nt, Homo sapiens
ucuggcacucagaggccuugcu

SEQ ID NO: 156886 - RNA, 20 nt, Homo sapiens
ucuggccccucuaaaucuca

SEQ ID NO: 156887 - RNA, 22 nt, Homo sapiens
ucuggcuuugugaguugccaga

SEQ ID NO: 156888 - RNA, 22 nt, Homo sapiens
ucuggguuuuuacaauguuuac

SEQ ID NO: 156889 - RNA, 22 nt, Homo sapiens
ucugucaaaucuuauguuguag

SEQ ID NO: 156890 - RNA, 22 nt, Homo sapiens
ucugucuugugguuugagugcc

SEQ ID NO: 156891 - RNA, 22 nt, Homo sapiens
ucugucuuugccuaaguuuguc

SEQ ID NO: 156892 - RNA, 22 nt, Homo sapiens
ucugugcauggcagaggaauga

SEQ ID NO: 156893 - RNA, 22 nt, Homo sapiens
ucugugguaagaaacgcauguc

SEQ ID NO: 156894 - RNA, 22 nt, Homo sapiens
ucuguggucagcauccgccacu

SEQ ID NO: 156895 - RNA, 22 nt, Homo sapiens
ucuguuguuguuuuaagagaca

SEQ ID NO: 156896 - RNA, 22 nt, Homo sapiens
ucuuaguuggaaugggauaagg

SEQ ID NO: 156897 - RNA, 22 nt, Homo sapiens
ucuugaacuucugcacacucag

SEQ ID NO: 156898 - RNA, 22 nt, Homo sapiens
ucuugcauuuuuaaauagugcu

SEQ ID NO: 156899 - RNA, 22 nt, Homo sapiens
ucuugcuuguuguucccuucau

SEQ ID NO: 156900 - RNA, 22 nt, Homo sapiens
ucuugguugaaaauucauaaua

SEQ ID NO: 156901 - RNA, 19 nt, Homo sapiens
ucuuuagucacauuuuuau

SEQ ID NO: 156902 - RNA, 20 nt, Homo sapiens
ucuuucgguuaccaggcagu

SEQ ID NO: 156903 - RNA, 22 nt, Homo sapiens
ucuuugagugcccugagucccu

SEQ ID NO: 156904 - RNA, 22 nt, Homo sapiens
ucuuuggaggcgaucuguuuga

SEQ ID NO: 156905 - RNA, 22 nt, Homo sapiens
ucuuuggauggaaauuggaguc

SEQ ID NO: 156906 - RNA, 22 nt, Homo sapiens
ucuuugguaugugcaugugcuu

SEQ ID NO: 156907 - RNA, 22 nt, Homo sapiens
ucuuugguucuguuuauguaau

SEQ ID NO: 156908 - RNA, 22 nt, Homo sapiens
ucuuuguguucaggagccacgu

SEQ ID NO: 156909 - RNA, 22 nt, Homo sapiens
ucuuuguucaggagccaacucc

SEQ ID NO: 156910 - RNA, 22 nt, Homo sapiens
ucuuuugguuucuagaggccgc

SEQ ID NO: 156911 - RNA, 22 nt, Homo sapiens
ugaaacacaccuccucuccauc

SEQ ID NO: 156912 - RNA, 22 nt, Homo sapiens
ugaaagcuacaggaaaguauuu

SEQ ID NO: 156913 - RNA, 20 nt, Homo sapiens
ugaaaucuucacuaagucuc

SEQ ID NO: 156914 - RNA, 22 nt, Homo sapiens
ugaaaucuuugaugguggcauu

SEQ ID NO: 156915 - RNA, 22 nt, Homo sapiens
ugaaaugaucaguuugguuacu

SEQ ID NO: 156916 - RNA, 22 nt, Homo sapiens
ugaaaugguuaugugaggagau

SEQ ID NO: 156917 - RNA, 22 nt, Homo sapiens
ugaaauguugggugauggaauc

SEQ ID NO: 156918 - RNA, 22 nt, Homo sapiens
ugaacacagccugccucugcca

SEQ ID NO: 156919 - RNA, 21 nt, Homo sapiens
ugaacacuggacugagugucc

SEQ ID NO: 156920 - RNA, 22 nt, Homo sapiens
ugaaggccgggcaugguggcuc

SEQ ID NO: 156921 - RNA, 22 nt, Homo sapiens
ugaagugaaugguaaguaugcc

SEQ ID NO: 156922 - RNA, 22 nt, Homo sapiens
ugaaguguuuuuucaggcaugu

SEQ ID NO: 156923 - RNA, 22 nt, Homo sapiens
ugaauacuucguucaaagauaa

SEQ ID NO: 156924 - RNA, 22 nt, Homo sapiens
ugaauagacagucacugccucc

SEQ ID NO: 156925 - RNA, 22 nt, Homo sapiens
ugaauaggcaguuaaguuuaug

SEQ ID NO: 156926 - RNA, 22 nt, Homo sapiens
ugaaucauuucuugucuucagu

SEQ ID NO: 156927 - RNA, 22 nt, Homo sapiens
ugaaugcaucuagaaauuuauu

SEQ ID NO: 156928 - RNA, 22 nt, Homo sapiens
ugaaugguaaagaaaagcacug

SEQ ID NO: 156929 - RNA, 22 nt, Homo sapiens
ugaauguuugcagcuuauacca

SEQ ID NO: 156930 - RNA, 22 nt, Homo sapiens
ugacaagcucccucugcaccuu

SEQ ID NO: 156931 - RNA, 22 nt, Homo sapiens
ugacaagggaaaugcaaaaugu

SEQ ID NO: 156932 - RNA, 20 nt, Homo sapiens
ugacaaggugcaaagaauca

SEQ ID NO: 156933 - RNA, 20 nt, Homo sapiens
ugacaagugagaauuauggg

SEQ ID NO: 156934 - RNA, 22 nt, Homo sapiens
ugacagagaagcauugaguuca

SEQ ID NO: 156935 - RNA, 22 nt, Homo sapiens
ugacagagcaggacuucaucuc

SEQ ID NO: 156936 - RNA, 22 nt, Homo sapiens
ugacagugaacagguuaccacu

SEQ ID NO: 156937 - RNA, 18 nt, Homo sapiens
ugacaguuucuuuauauu

SEQ ID NO: 156938 - RNA, 22 nt, Homo sapiens
ugacaugauguuccuacacugu

SEQ ID NO: 156939 - RNA, 22 nt, Homo sapiens
ugacaugauuguauauuuagaa

SEQ ID NO: 156940 - RNA, 22 nt, Homo sapiens
ugacauggagguggaggaagau

SEQ ID NO: 156941 - RNA, 22 nt, Homo sapiens
ugacauguauaucuuacgcuau

SEQ ID NO: 156942 - RNA, 21 nt, Homo sapiens
ugacauuauuucaugucagua

SEQ ID NO: 156943 - RNA, 22 nt, Homo sapiens
ugaccuagaacucuaaugccug

SEQ ID NO: 156944 - RNA, 22 nt, Homo sapiens
ugacugguguuuaaugagucaa

SEQ ID NO: 156945 - RNA, 23 nt, Homo sapiens
ugacuuaggccucaacuaugacu

SEQ ID NO: 156946 - RNA, 22 nt, Homo sapiens
ugagaacagauggcuuuauuau

SEQ ID NO: 156947 - RNA, 22 nt, Homo sapiens
ugagaacauggagaacccccca

SEQ ID NO: 156948 - RNA, 22 nt, Homo sapiens
ugagaagaugaacuccuugguc

SEQ ID NO: 156949 - RNA, 22 nt, Homo sapiens
ugagaagcauaccagugucugu

SEQ ID NO: 156950 - RNA, 22 nt, Homo sapiens
ugagaaugaugauugguaaacc

SEQ ID NO: 156951 - RNA, 22 nt, Homo sapiens
ugagacauauuauacugcuuuu

SEQ ID NO: 156952 - RNA, 22 nt, Homo sapiens
ugagacaucugagauuuuaagc

SEQ ID NO: 156953 - RNA, 22 nt, Homo sapiens
ugagacggagucuugcccuguc

SEQ ID NO: 156954 - RNA, 22 nt, Homo sapiens
ugagacggagucuugcuaaguu

SEQ ID NO: 156955 - RNA, 22 nt, Homo sapiens
ugagacugaaauuaggaaacug

SEQ ID NO: 156956 - RNA, 22 nt, Homo sapiens
ugagacugagucucgcucuauu

SEQ ID NO: 156957 - RNA, 22 nt, Homo sapiens
ugagacugaguuucacuuuugu

SEQ ID NO: 156958 - RNA, 22 nt, Homo sapiens
ugagacugaguuuccaucuugu

SEQ ID NO: 156959 - RNA, 22 nt, Homo sapiens
ugagacugauaggacauuuucu

SEQ ID NO: 156960 - RNA, 22 nt, Homo sapiens
ugagacugguaauguguagggc

SEQ ID NO: 156961 - RNA, 22 nt, Homo sapiens
ugagagaugaacucugauaugu

SEQ ID NO: 156962 - RNA, 22 nt, Homo sapiens
ugagagcugcauucuugaaagc

SEQ ID NO: 156963 - RNA, 22 nt, Homo sapiens
ugagaggugaauggcaggcuca

SEQ ID NO: 156964 - RNA, 22 nt, Homo sapiens
ugagauaaucaugugauuucau

SEQ ID NO: 156965 - RNA, 22 nt, Homo sapiens
ugagauaauuuacuuguugagg

SEQ ID NO: 156966 - RNA, 22 nt, Homo sapiens
ugagauagcauaagggacagaa

SEQ ID NO: 156967 - RNA, 22 nt, Homo sapiens
ugagauauauauauuugagaca

SEQ ID NO: 156968 - RNA, 22 nt, Homo sapiens
ugagauaucauuucacacccag

SEQ ID NO: 156969 - RNA, 22 nt, Homo sapiens
ugagaucaaggugggcccuggg

SEQ ID NO: 156970 - RNA, 22 nt, Homo sapiens
ugagaucagugaagaaguguuu

SEQ ID NO: 156971 - RNA, 22 nt, Homo sapiens
ugagauccugagaguugggacu

SEQ ID NO: 156972 - RNA, 22 nt, Homo sapiens
ugagaucgaguaucgcugucac

SEQ ID NO: 156973 - RNA, 22 nt, Homo sapiens
ugagaugaaagcagaaagacuu

SEQ ID NO: 156974 - RNA, 22 nt, Homo sapiens
ugagaugagggaagccuaggca

SEQ ID NO: 156975 - RNA, 22 nt, Homo sapiens
ugagauggcugaauucagaaua

SEQ ID NO: 156976 - RNA, 21 nt, Homo sapiens
ugagauuaaguuguuuagaag

SEQ ID NO: 156977 - RNA, 22 nt, Homo sapiens
ugagcaauaaaguuacacaguu

SEQ ID NO: 156978 - RNA, 22 nt, Homo sapiens
ugagcagugaguguggugcagg

SEQ ID NO: 156979 - RNA, 22 nt, Homo sapiens
ugagcuaggaucacaccugcau

SEQ ID NO: 156980 - RNA, 22 nt, Homo sapiens
ugagcucaugcauucuugagga

SEQ ID NO: 156981 - RNA, 22 nt, Homo sapiens
ugaggaaugaccccgugugguc

SEQ ID NO: 156982 - RNA, 22 nt, Homo sapiens
ugaggaguguauuucauucgcu

SEQ ID NO: 156983 - RNA, 22 nt, Homo sapiens
ugaggcuagucagaucagauga

SEQ ID NO: 156984 - RNA, 22 nt, Homo sapiens
ugaguacuacuaguuacugcua

SEQ ID NO: 156985 - RNA, 22 nt, Homo sapiens
ugaguagaagugaagauagugg

SEQ ID NO: 156986 - RNA, 22 nt, Homo sapiens
ugaguagucuagaguggaaugu

SEQ ID NO: 156987 - RNA, 22 nt, Homo sapiens
ugagucgagauugcgccacugu

SEQ ID NO: 156988 - RNA, 22 nt, Homo sapiens
ugagugaacgcugagaccaaau

SEQ ID NO: 156989 - RNA, 21 nt, Homo sapiens
ugagugcugagugaggguuga

SEQ ID NO: 156990 - RNA, 22 nt, Homo sapiens
ugaguuaggagaguguggcucu

SEQ ID NO: 156991 - RNA, 18 nt, Homo sapiens
ugaguucauuagacuucc

SEQ ID NO: 156992 - RNA, 22 nt, Homo sapiens
ugauaagugaaagugcucuauc

SEQ ID NO: 156993 - RNA, 18 nt, Homo sapiens
ugauaucaucacaauuga

SEQ ID NO: 156994 - RNA, 22 nt, Homo sapiens
ugauaugaaagggaaauaagug

SEQ ID NO: 156995 - RNA, 21 nt, Homo sapiens
ugauaugguuuggauaugugu

SEQ ID NO: 156996 - RNA, 22 nt, Homo sapiens
ugauaugugaguauaugguuau

SEQ ID NO: 156997 - RNA, 22 nt, Homo sapiens
ugauauguggauucagcucaaa

SEQ ID NO: 156998 - RNA, 22 nt, Homo sapiens
ugaugacacugauuucuucaau

SEQ ID NO: 156999 - RNA, 22 nt, Homo sapiens
ugauggccuguucuccauaugu

SEQ ID NO: 157000 - RNA, 20 nt, Homo sapiens
ugauuaguccacuuggcucu

SEQ ID NO: 157001 - RNA, 22 nt, Homo sapiens
ugcaagaaucagccuaucauua

SEQ ID NO: 157002 - RNA, 22 nt, Homo sapiens
ugcaagacuaaaccuuccccuc

SEQ ID NO: 157003 - RNA, 22 nt, Homo sapiens
ugcaagaugagauuuuggaugg

SEQ ID NO: 157004 - RNA, 22 nt, Homo sapiens
ugcacaguccagugcccacuga

SEQ ID NO: 157005 - RNA, 22 nt, Homo sapiens
ugcaccauugucaccuggguga

SEQ ID NO: 157006 - RNA, 22 nt, Homo sapiens
ugcagaaucccuucagauccga

SEQ ID NO: 157007 - RNA, 22 nt, Homo sapiens
ugcagcacuguucacaauagcc

SEQ ID NO: 157008 - RNA, 22 nt, Homo sapiens
ugcagguacuugacaacuuggg

SEQ ID NO: 157009 - RNA, 22 nt, Homo sapiens
ugcagugugauuuucuggcuga

SEQ ID NO: 157010 - RNA, 18 nt, Homo sapiens
ugcauacuaucugauuuu

SEQ ID NO: 157011 - RNA, 19 nt, Homo sapiens
ugcauaggguuacauacuc

SEQ ID NO: 157012 - RNA, 22 nt, Homo sapiens
ugcauaugcagcauuuaugauu

SEQ ID NO: 157013 - RNA, 22 nt, Homo sapiens
ugcauaugucuuuauaguagca

SEQ ID NO: 157014 - RNA, 22 nt, Homo sapiens
ugcauauguugaaccaggcuug

SEQ ID NO: 157015 - RNA, 22 nt, Homo sapiens
ugcauauucgaguuauuuuggg

SEQ ID NO: 157016 - RNA, 22 nt, Homo sapiens
ugcauuaucagauguuugcuuu

SEQ ID NO: 157017 - RNA, 22 nt, Homo sapiens
ugccaggaugaggucaauguuu

SEQ ID NO: 157018 - RNA, 23 nt, Homo sapiens
ugccuagaccaucagccugaggu

SEQ ID NO: 157019 - RNA, 22 nt, Homo sapiens
ugccuaggcuggagugcagugg

SEQ ID NO: 157020 - RNA, 22 nt, Homo sapiens
ugccuggagagcuccuacauau

SEQ ID NO: 157021 - RNA, 22 nt, Homo sapiens
ugcuacccuucgucucucuggu

SEQ ID NO: 157022 - RNA, 22 nt, Homo sapiens
ugcuagagaaauauauuugggg

SEQ ID NO: 157023 - RNA, 18 nt, Homo sapiens
ugcuaugagauuauuuua

SEQ ID NO: 157024 - RNA, 22 nt, Homo sapiens
ugcuaugucuucucucacagag

SEQ ID NO: 157025 - RNA, 22 nt, Homo sapiens
ugcucaccugcugcucaccucc

SEQ ID NO: 157026 - RNA, 22 nt, Homo sapiens
ugcugcaaucucggcacuuugg

SEQ ID NO: 157027 - RNA, 22 nt, Homo sapiens
ugcuuagucuugcuuuagcuau

SEQ ID NO: 157028 - RNA, 22 nt, Homo sapiens
ccucauggagaaccucugcuag

SEQ ID NO: 157029 - RNA, 22 nt, Homo sapiens
ccucauugcuaucccaggcuga

SEQ ID NO: 157030 - RNA, 21 nt, Homo sapiens
ccugaagaagugaccucugag

SEQ ID NO: 157031 - RNA, 21 nt, Homo sapiens
ccugaugaccucugagaguua

SEQ ID NO: 157032 - RNA, 22 nt, Homo sapiens
ccuggcaagagacugaagauag

SEQ ID NO: 157033 - RNA, 22 nt, Homo sapiens
ccuggcacugggccccguggcu

SEQ ID NO: 157034 - RNA, 22 nt, Homo sapiens
ccugucuugauuaaauuacuua

SEQ ID NO: 157035 - RNA, 22 nt, Homo sapiens
ccuucacaggcacugguucaga

SEQ ID NO: 157036 - RNA, 22 nt, Homo sapiens
ccuucuuuuguaaggcugaaua

SEQ ID NO: 157037 - RNA, 22 nt, Homo sapiens
ccuuggcacuuugccacagugc

SEQ ID NO: 157038 - RNA, 19 nt, Homo sapiens
ccuugguuagguauauucc

SEQ ID NO: 157039 - RNA, 22 nt, Homo sapiens
cgcaguguuugugucccugggu

SEQ ID NO: 157040 - RNA, 22 nt, Homo sapiens
cggugcaauucuccugucucag

SEQ ID NO: 157041 - RNA, 22 nt, Homo sapiens
cuaaagugcugagauuauaggu

SEQ ID NO: 157042 - RNA, 22 nt, Homo sapiens
cuacaguucucaggaguuggcc

SEQ ID NO: 157043 - RNA, 22 nt, Homo sapiens
cuagagagaagcugugugaccu

SEQ ID NO: 157044 - RNA, 22 nt, Homo sapiens
cuagaggcacagccuaggcacu

SEQ ID NO: 157045 - RNA, 22 nt, Homo sapiens
cuagcagaacaauacaauucgg

SEQ ID NO: 157046 - RNA, 22 nt, Homo sapiens
cuagcagacaggcugggagcag

SEQ ID NO: 157047 - RNA, 22 nt, Homo sapiens
cuaugcuucuuaaauuaguuau

SEQ ID NO: 157048 - RNA, 22 nt, Homo sapiens
cucaaagugcuaagauuaggcu

SEQ ID NO: 157049 - RNA, 19 nt, Homo sapiens
cucaaagugguauuuggag

SEQ ID NO: 157050 - RNA, 22 nt, Homo sapiens
cucaaaugguccagcuaguggu

SEQ ID NO: 157051 - RNA, 22 nt, Homo sapiens
cucagcuacuugggaagcugag

SEQ ID NO: 157052 - RNA, 22 nt, Homo sapiens
cucaguguuucagcugcucaga

SEQ ID NO: 157053 - RNA, 22 nt, Homo sapiens
cucauuaguuguuuuaagauga

SEQ ID NO: 157054 - RNA, 22 nt, Homo sapiens
cuccacugagcaggugggaggc

SEQ ID NO: 157055 - RNA, 22 nt, Homo sapiens
cuccaggugucauccaccuccu

SEQ ID NO: 157056 - RNA, 22 nt, Homo sapiens
cuccaguacagagagguuccuc

SEQ ID NO: 157057 - RNA, 22 nt, Homo sapiens
cuccagugcaaagucaugauca

SEQ ID NO: 157058 - RNA, 23 nt, Homo sapiens
cucccugaacaugacacaccaga

SEQ ID NO: 157059 - RNA, 22 nt, Homo sapiens
cucucugagccauggcugcccu

SEQ ID NO: 157060 - RNA, 21 nt, Homo sapiens
cucucugcuuaugaauaguga

SEQ ID NO: 157061 - RNA, 22 nt, Homo sapiens
cugaaaagcaucugcauagcug

SEQ ID NO: 157062 - RNA, 22 nt, Homo sapiens
cugaaagagcauuugaaugggu

SEQ ID NO: 157063 - RNA, 22 nt, Homo sapiens
cugaaauggaaugugugcacag

SEQ ID NO: 157064 - RNA, 22 nt, Homo sapiens
cugaauguucuggauggaagag

SEQ ID NO: 157065 - RNA, 22 nt, Homo sapiens
cugagacuggugauuuaugaag

SEQ ID NO: 157066 - RNA, 22 nt, Homo sapiens
cugagaucugaaccaggagugu

SEQ ID NO: 157067 - RNA, 22 nt, Homo sapiens
cugagauggagucucgcauugu

SEQ ID NO: 157068 - RNA, 22 nt, Homo sapiens
cugagauuaagauauugggagu

SEQ ID NO: 157069 - RNA, 22 nt, Homo sapiens
cugagcaaaaugaagacacgau

SEQ ID NO: 157070 - RNA, 22 nt, Homo sapiens
cugaggcacggcgaccuuaagu

SEQ ID NO: 157071 - RNA, 20 nt, Homo sapiens
cugagguacgaggguuaaau

SEQ ID NO: 157072 - RNA, 22 nt, Homo sapiens
cugaggugggagaaucacauaa

SEQ ID NO: 157073 - RNA, 18 nt, Homo sapiens
cugagucauuccuggguc

SEQ ID NO: 157074 - RNA, 22 nt, Homo sapiens
cugauauuuuaaaauuggcugg

SEQ ID NO: 157075 - RNA, 22 nt, Homo sapiens
cugaucuguuauacuuuucuau

SEQ ID NO: 157076 - RNA, 22 nt, Homo sapiens
cugcaauguuugaaauggcaaa

SEQ ID NO: 157077 - RNA, 22 nt, Homo sapiens
cugcccguaauccucuccccag

SEQ ID NO: 157078 - RNA, 22 nt, Homo sapiens
cugccugagaaaauggagggca

SEQ ID NO: 157079 - RNA, 22 nt, Homo sapiens
cuggaagaaaaucacgccaucu

SEQ ID NO: 157080 - RNA, 22 nt, Homo sapiens
cuggaauuacaggguugagcua

SEQ ID NO: 157081 - RNA, 22 nt, Homo sapiens
cuggacaaaucuggaaagaacc

SEQ ID NO: 157082 - RNA, 22 nt, Homo sapiens
aaggcaacgugaguuguugauu

SEQ ID NO: 157083 - RNA, 22 nt, Homo sapiens
aagugcuuaggauagugugugg

SEQ ID NO: 157084 - RNA, 22 nt, Homo sapiens
aagugguguuugggagcuggac

SEQ ID NO: 157085 - RNA, 22 nt, Homo sapiens
aaugauacuguguacaagggca

SEQ ID NO: 157086 - RNA, 22 nt, Homo sapiens
aauggcuuucagcuuuucccca

SEQ ID NO: 157087 - RNA, 22 nt, Homo sapiens
aauuaguugaaagucugcuuuu

SEQ ID NO: 157088 - RNA, 22 nt, Homo sapiens
acagugcuuucaauguucagua

SEQ ID NO: 157089 - RNA, 22 nt, Homo sapiens
accaccacucccgcauucuaaa

SEQ ID NO: 157090 - RNA, 22 nt, Homo sapiens
accugcacagccgaacauagac

SEQ ID NO: 157091 - RNA, 22 nt, Homo sapiens
acugcacuccagcccaggugac

SEQ ID NO: 157092 - RNA, 22 nt, Homo sapiens
acugcacuccagcuccagggug

SEQ ID NO: 157093 - RNA, 20 nt, Homo sapiens
acugggcuaccgaaguaagg

SEQ ID NO: 157094 - RNA, 22 nt, Homo sapiens
aggacacugagcaugggagguu

SEQ ID NO: 157095 - RNA, 23 nt, Homo sapiens
aggagcuuagaaguugccauugc

SEQ ID NO: 157096 - RNA, 22 nt, Homo sapiens
agggccuuuguagauguacuca

SEQ ID NO: 157097 - RNA, 22 nt, Homo sapiens
agggcuuuugagcugagauggu

SEQ ID NO: 157098 - RNA, 21 nt, Homo sapiens
agugagucauuuggaaagcaa

SEQ ID NO: 157099 - RNA, 22 nt, Homo sapiens
auaaguauuuggacuuuacugu

SEQ ID NO: 157100 - RNA, 22 nt, Homo sapiens
auaauagcugaucauuuagaag

SEQ ID NO: 157101 - RNA, 22 nt, Homo sapiens
auacaguguauguauaguacau

SEQ ID NO: 157102 - RNA, 19 nt, Homo sapiens
auagggcuagcauauacug

SEQ ID NO: 157103 - RNA, 19 nt, Homo sapiens
aucaaacugcucuuugagg

SEQ ID NO: 157104 - RNA, 22 nt, Homo sapiens
aucacacuguuauuuuaguuaa

SEQ ID NO: 157105 - RNA, 22 nt, Homo sapiens
aucuccaggugccagcugcgcc

SEQ ID NO: 157106 - RNA, 22 nt, Homo sapiens
augcaaacaucugaagagacau

SEQ ID NO: 157107 - RNA, 22 nt, Homo sapiens
augccauugcacuccagccuag

SEQ ID NO: 157108 - RNA, 22 nt, Homo sapiens
augccauugcacuccagccugg

SEQ ID NO: 157109 - RNA, 22 nt, Homo sapiens
auggauuuuaggauacaguuga

SEQ ID NO: 157110 - RNA, 22 nt, Homo sapiens
auggcuuugggcugcucugccc

SEQ ID NO: 157111 - RNA, 22 nt, Homo sapiens
auggcuuuguguucagagcuga

SEQ ID NO: 157112 - RNA, 22 nt, Homo sapiens
auggucuuuuuguuaugagaga

SEQ ID NO: 157113 - RNA, 22 nt, Homo sapiens
augucacagguccuagccaagu

SEQ ID NO: 157114 - RNA, 22 nt, Homo sapiens
auucaaggagucuucgucccaa

SEQ ID NO: 157115 - RNA, 20 nt, Homo sapiens
auucaaguaugccuugagaa

SEQ ID NO: 157116 - RNA, 22 nt, Homo sapiens
auuccacaguuaacacagaccg

SEQ ID NO: 157117 - RNA, 21 nt, Homo sapiens
auuccacuuuuccuucaggga

SEQ ID NO: 157118 - RNA, 22 nt, Homo sapiens
auuccauaguacagugaugagu

SEQ ID NO: 157119 - RNA, 22 nt, Homo sapiens
auugcauaaacacauuucuuau

SEQ ID NO: 157120 - RNA, 22 nt, Homo sapiens
auugcucacacaaagccuguuu

SEQ ID NO: 157121 - RNA, 22 nt, Homo sapiens
caaagugcuggaauuggccggg

SEQ ID NO: 157122 - RNA, 22 nt, Homo sapiens
caaauccucaccucaucaugaa

SEQ ID NO: 157123 - RNA, 22 nt, Homo sapiens
caagggguggaaaugguagugu

SEQ ID NO: 157124 - RNA, 22 nt, Homo sapiens
cacagugaacaauauccucugu

SEQ ID NO: 157125 - RNA, 22 nt, Homo sapiens
cacuagagaauagguaguucug

SEQ ID NO: 157126 - RNA, 22 nt, Homo sapiens
cacugcacuccagcuugugggc

SEQ ID NO: 157127 - RNA, 22 nt, Homo sapiens
cacugcacuccaguuucgguaa

SEQ ID NO: 157128 - RNA, 20 nt, Homo sapiens
cagggcaaugaggagguaaa

SEQ ID NO: 157129 - RNA, 22 nt, Homo sapiens
caugcacugaguccaccucugg

SEQ ID NO: 157130 - RNA, 22 nt, Homo sapiens
cauggcacuggugggagugucu

SEQ ID NO: 157131 - RNA, 22 nt, Homo sapiens
cauuccacauguaggacaauuu

SEQ ID NO: 157132 - RNA, 22 nt, Homo sapiens
cauugcacuuagacaacuuuug

SEQ ID NO: 157133 - RNA, 22 nt, Homo sapiens
ccacacugucuuggugggaaac

SEQ ID NO: 157134 - RNA, 22 nt, Homo sapiens
ccacccuuccauucuuccucuu

SEQ ID NO: 157135 - RNA, 22 nt, Homo sapiens
ccagguuucuagaauaauuccu

SEQ ID NO: 157136 - RNA, 22 nt, Homo sapiens
cccagaguucuuaaauacugag

SEQ ID NO: 157137 - RNA, 22 nt, Homo sapiens
ccggguguuuuguucucucaga

SEQ ID NO: 157138 - RNA, 22 nt, Homo sapiens
ccucuuuguugagacuucacca

SEQ ID NO: 157139 - RNA, 22 nt, Homo sapiens
ccuggaaugaagcuuauauugc

SEQ ID NO: 157140 - RNA, 22 nt, Homo sapiens
ccuugguggccacaagacauug

SEQ ID NO: 157141 - RNA, 22 nt, Homo sapiens
cuaaaguagccaggacugcagg

SEQ ID NO: 157142 - RNA, 20 nt, Homo sapiens
cucagauuauucugaagcaa

SEQ ID NO: 157143 - RNA, 22 nt, Homo sapiens
cucccauugcaaacaacagaag

SEQ ID NO: 157144 - RNA, 23 nt, Homo sapiens
cucccugaacaugacacaccaga

SEQ ID NO: 157145 - RNA, 22 nt, Homo sapiens
cucuuugaguuccuccuggugu

SEQ ID NO: 157146 - RNA, 22 nt, Homo sapiens
cucuuuuguuuagcugagaggg

SEQ ID NO: 157147 - RNA, 22 nt, Homo sapiens
cugagauuaagauauugggagu

SEQ ID NO: 157148 - RNA, 22 nt, Homo sapiens
cugagcaaaaugaagacacgau

SEQ ID NO: 157149 - RNA, 22 nt, Homo sapiens
cugauguagguggucugugauc

SEQ ID NO: 157150 - RNA, 22 nt, Homo sapiens
cugcuguuguuaacuuuuggag

SEQ ID NO: 157151 - RNA, 22 nt, Homo sapiens
cuggaaagcaaguccauugcuc

SEQ ID NO: 157152 - RNA, 22 nt, Homo sapiens
cuggagauuaaccaauugccau

SEQ ID NO: 157153 - RNA, 22 nt, Homo sapiens
cuggagcaaaggugacucuugu

SEQ ID NO: 157154 - RNA, 22 nt, Homo sapiens
cuggagcauugguggauuuguu

SEQ ID NO: 157155 - RNA, 22 nt, Homo sapiens
cugggaugugacuguugccccc

SEQ ID NO: 157156 - RNA, 21 nt, Homo sapiens
cugguguuagcacuucuuccc

SEQ ID NO: 157157 - RNA, 22 nt, Homo sapiens
cuguaacagaauaaauuuguuu

SEQ ID NO: 157158 - RNA, 22 nt, Homo sapiens
cuucucagugcucaucuuauuu

SEQ ID NO: 157159 - RNA, 22 nt, Homo sapiens
cuuugguguauuuucagagacc

SEQ ID NO: 157160 - RNA, 22 nt, Homo sapiens
gaaaauccauccccagggagua

SEQ ID NO: 157161 - RNA, 20 nt, Homo sapiens
gagauguugaucagggcuau

SEQ ID NO: 157162 - RNA, 22 nt, Homo sapiens
gagauguuuuguuaucaaagga

SEQ ID NO: 157163 - RNA, 22 nt, Homo sapiens
gaguaacagcauaaauuuguga

SEQ ID NO: 157164 - RNA, 22 nt, Homo sapiens
gagugcugagcccacuuccuug

SEQ ID NO: 157165 - RNA, 22 nt, Homo sapiens
gaguuccuuugagccugagagg

SEQ ID NO: 157166 - RNA, 22 nt, Homo sapiens
gauuccauugcgaauuuucaga

SEQ ID NO: 157167 - RNA, 22 nt, Homo sapiens
gauuccauuuguggcuauuuac

SEQ ID NO: 157168 - RNA, 22 nt, Homo sapiens
gcaggaaucuugagaaggauuc

SEQ ID NO: 157169 - RNA, 22 nt, Homo sapiens
gcagguauuagagagccugaaa

SEQ ID NO: 157170 - RNA, 22 nt, Homo sapiens
gcagugcaguggcgcgaucucg

SEQ ID NO: 157171 - RNA, 19 nt, Homo sapiens
gccaccuggugcguguucu

SEQ ID NO: 157172 - RNA, 22 nt, Homo sapiens
gcucaaguaauggcaguuuugc

SEQ ID NO: 157173 - RNA, 19 nt, Homo sapiens
gcucaccuugcugcuccag

SEQ ID NO: 157174 - RNA, 22 nt, Homo sapiens
gcugcuguaccagaugugguua

SEQ ID NO: 157175 - RNA, 22 nt, Homo sapiens
gcuggguucagagugggcugcg

SEQ ID NO: 157176 - RNA, 22 nt, Homo sapiens
ggaaauguuggugucaugaguu

SEQ ID NO: 157177 - RNA, 22 nt, Homo sapiens
ggaacaccauuuuuccugccuu

SEQ ID NO: 157178 - RNA, 22 nt, Homo sapiens
ggcaaugaggcggaccagcagg

SEQ ID NO: 157179 - RNA, 19 nt, Homo sapiens
ggcacugugugagugagga

SEQ ID NO: 157180 - RNA, 22 nt, Homo sapiens
ggccggguggccauggcugccc

SEQ ID NO: 157181 - RNA, 18 nt, Homo sapiens
ggcugguguuuuaguaua

SEQ ID NO: 157182 - RNA, 22 nt, Homo sapiens
gggagguaggaguuauuauuuu

SEQ ID NO: 157183 - RNA, 22 nt, Homo sapiens
gggagguagguauuagcuuuuc

SEQ ID NO: 157184 - RNA, 19 nt, Homo sapiens
ggucauggagguuguguga

SEQ ID NO: 157185 - RNA, 22 nt, Homo sapiens
guaugacacaggaagcuuaacc

SEQ ID NO: 157186 - RNA, 22 nt, Homo sapiens
gucaguuugguuaaucauucca

SEQ ID NO: 157187 - RNA, 22 nt, Homo sapiens
guccaguuguuuucugagguug

SEQ ID NO: 157188 - RNA, 20 nt, Homo sapiens
gucuugcuccguugcccagg

SEQ ID NO: 157189 - RNA, 22 nt, Homo sapiens
gucuuuguuuggucuguaucag

SEQ ID NO: 157190 - RNA, 22 nt, Homo sapiens
gugaggcugguccugccuccca

SEQ ID NO: 157191 - RNA, 22 nt, Homo sapiens
gugaggucguagucauaggcaa

SEQ ID NO: 157192 - RNA, 22 nt, Homo sapiens
guguucaaacccaggucugucu

SEQ ID NO: 157193 - RNA, 22 nt, Homo sapiens
guucaaggaauguuggcuucuc

SEQ ID NO: 157194 - RNA, 22 nt, Homo sapiens
guucaagugauucuacugccuc

SEQ ID NO: 157195 - RNA, 22 nt, Homo sapiens
guucacaguuucuaaucccagc

SEQ ID NO: 157196 - RNA, 22 nt, Homo sapiens
guugcaaaguaauugugguuuu

SEQ ID NO: 157197 - RNA, 22 nt, Homo sapiens
guuuaacugguacuucaagucu

SEQ ID NO: 157198 - RNA, 22 nt, Homo sapiens
uaacugcaaccuccgccucccg

SEQ ID NO: 157199 - RNA, 22 nt, Homo sapiens
uaauccuggcacuuugggaggc

SEQ ID NO: 157200 - RNA, 22 nt, Homo sapiens
uaauucuguauguaucagaguu

SEQ ID NO: 157201 - RNA, 22 nt, Homo sapiens
uagaagcacuaucccuccuagu

SEQ ID NO: 157202 - RNA, 22 nt, Homo sapiens
uagcugcauccugugcacucaa

SEQ ID NO: 157203 - RNA, 22 nt, Homo sapiens
uaggaaguuuucuugcugggcc

SEQ ID NO: 157204 - RNA, 22 nt, Homo sapiens
uaggacaaugguacagcagaaa

SEQ ID NO: 157205 - RNA, 22 nt, Homo sapiens
uagggcuuuaguuugcuugugu

SEQ ID NO: 157206 - RNA, 22 nt, Homo sapiens
uagggcuuuccggccugucaga

SEQ ID NO: 157207 - RNA, 22 nt, Homo sapiens
uaguccauuuucaugcugcuau

SEQ ID NO: 157208 - RNA, 22 nt, Homo sapiens
uaucacaguugcauauuuaagg

SEQ ID NO: 157209 - RNA, 22 nt, Homo sapiens
uauuccacuuacaugagguauc

SEQ ID NO: 157210 - RNA, 22 nt, Homo sapiens
uauuccauuugggucaggauga

SEQ ID NO: 157211 - RNA, 22 nt, Homo sapiens
uauugcauuugagguugguuga

SEQ ID NO: 157212 - RNA, 22 nt, Homo sapiens
ucaaagugacaaaguugcagca

SEQ ID NO: 157213 - RNA, 22 nt, Homo sapiens
ucacaguauucaugaacaugga

SEQ ID NO: 157214 - RNA, 22 nt, Homo sapiens
ucacagucaaaguaaucauaga

SEQ ID NO: 157215 - RNA, 22 nt, Homo sapiens
ucaccaguacuccaaauugagg

SEQ ID NO: 157216 - RNA, 22 nt, Homo sapiens
ucacgcugcugcaaccagccug

SEQ ID NO: 157217 - RNA, 21 nt, Homo sapiens
ucaguuacugagagagaagug

SEQ ID NO: 157218 - RNA, 22 nt, Homo sapiens
ucaguuuagguguaacggccac

SEQ ID NO: 157219 - RNA, 20 nt, Homo sapiens
ucauacuguggaguaccagg

SEQ ID NO: 157220 - RNA, 22 nt, Homo sapiens
ucauacuguuaaaugguuuagu

SEQ ID NO: 157221 - RNA, 19 nt, Homo sapiens
ucccaauguuuccaggcag

SEQ ID NO: 157222 - RNA, 22 nt, Homo sapiens
ucccuguguccugggggcaccu

SEQ ID NO: 157223 - RNA, 22 nt, Homo sapiens
ucccuuagccaaauccccagcc

SEQ ID NO: 157224 - RNA, 22 nt, Homo sapiens
uccuacugucuucggggcacug

SEQ ID NO: 157225 - RNA, 22 nt, Homo sapiens
uccuuggucaaaaagaaagugu

SEQ ID NO: 157226 - RNA, 22 nt, Homo sapiens
uccuugguugauccugugcaga

SEQ ID NO: 157227 - RNA, 22 nt, Homo sapiens
ucgcaccauugcacuccagcca

SEQ ID NO: 157228 - RNA, 22 nt, Homo sapiens
ucucuuggcggaaguugcagug

SEQ ID NO: 157229 - RNA, 22 nt, Homo sapiens
ucugagcaauagauguggauau

SEQ ID NO: 157230 - RNA, 22 nt, Homo sapiens
ucuggcauuuucucugcuugca

SEQ ID NO: 157231 - RNA, 22 nt, Homo sapiens
ucuggcuuuagcaugugggaag

SEQ ID NO: 157232 - RNA, 22 nt, Homo sapiens
ucuggcuuugugaguugccaga

SEQ ID NO: 157233 - RNA, 19 nt, Homo sapiens
ucuuuagucacauuuuuau

SEQ ID NO: 157234 - RNA, 22 nt, Homo sapiens
ucuuuugugagucagccucucc

SEQ ID NO: 157235 - RNA, 22 nt, Homo sapiens
ucuuuuguucuauucaggccuu

SEQ ID NO: 157236 - RNA, 22 nt, Homo sapiens
ugaacugagacuagacuuguuc

SEQ ID NO: 157237 - RNA, 22 nt, Homo sapiens
ugaagggcauuguuuugccaaa

SEQ ID NO: 157238 - RNA, 22 nt, Homo sapiens
ugacaagaaagcgucuucuuuu

SEQ ID NO: 157239 - RNA, 22 nt, Homo sapiens
ugacuaguuuugcuguuguuau

SEQ ID NO: 157240 - RNA, 21 nt, Homo sapiens
ugagaugcaaucaccagggag

SEQ ID NO: 157241 - RNA, 20 nt, Homo sapiens
ugagaugcauugggauguuu

SEQ ID NO: 157242 - RNA, 22 nt, Homo sapiens
ugagaugcucgccggccagcau

SEQ ID NO: 157243 - RNA, 22 nt, Homo sapiens
ugaguucaauuguauuuuauua

SEQ ID NO: 157244 - RNA, 22 nt, Homo sapiens
ugauaagaaauuguucauguag

SEQ ID NO: 157245 - RNA, 22 nt, Homo sapiens
ugcaagaaacauauuccacaag

SEQ ID NO: 157246 - RNA, 22 nt, Homo sapiens
ugcaccauggcacuccaggcug

SEQ ID NO: 157247 - RNA, 22 nt, Homo sapiens
ugcaccauugcauacuuaauua

SEQ ID NO: 157248 - RNA, 22 nt, Homo sapiens
ugcaccauugcauuccagccug

SEQ ID NO: 157249 - RNA, 22 nt, Homo sapiens
ugcaguuuaggaacugguaaca

SEQ ID NO: 157250 - RNA, 22 nt, Homo sapiens
ugcauaugucuuuauagcagca

SEQ ID NO: 157251 - RNA, 22 nt, Homo sapiens
ugcauaugucuuuauaguagca

SEQ ID NO: 157252 - RNA, 22 nt, Homo sapiens
ugcauauguugaaccaggcuug

SEQ ID NO: 157253 - RNA, 22 nt, Homo sapiens
ugcauauucuaggauuuuguau

SEQ ID NO: 157254 - RNA, 22 nt, Homo sapiens
ugccugcugucuaauauauucu

SEQ ID NO: 157255 - RNA, 22 nt, Homo sapiens
uggaagacaaguguuagcaugg

SEQ ID NO: 157256 - RNA, 20 nt, Homo sapiens
uggaaugcagccuccuucug

SEQ ID NO: 157257 - RNA, 22 nt, Homo sapiens
uggagagucauuuauaguauuu

SEQ ID NO: 157258 - RNA, 22 nt, Homo sapiens
uggagagugauaaguaaaugga

SEQ ID NO: 157259 - RNA, 22 nt, Homo sapiens
uggcacuggagauacauuaaua

SEQ ID NO: 157260 - RNA, 22 nt, Homo sapiens
uggcauuuuguuuuagaauuag

SEQ ID NO: 157261 - RNA, 22 nt, Homo sapiens
uggcucuguuuguuaacuagac

SEQ ID NO: 157262 - RNA, 22 nt, Homo sapiens
uggcuguuuauuucaccuggau

SEQ ID NO: 157263 - RNA, 18 nt, Homo sapiens
ugggaagaaauucuucuc

SEQ ID NO: 157264 - RNA, 22 nt, Homo sapiens
ugggaagaugcugcuucuuccu

SEQ ID NO: 157265 - RNA, 22 nt, Homo sapiens
uggucucuuugcuuuagucauc

SEQ ID NO: 157266 - RNA, 22 nt, Homo sapiens
uggugcaaugaagugaucucaa

SEQ ID NO: 157267 - RNA, 22 nt, Homo sapiens
uguaaacauguauguguuuaug

SEQ ID NO: 157268 - RNA, 22 nt, Homo sapiens
ugucaaagagacaucugcacuc

SEQ ID NO: 157269 - RNA, 22 nt, Homo sapiens
ugucacauccaagaaggugcag

SEQ ID NO: 157270 - RNA, 22 nt, Homo sapiens
ugucauuguggugcagauauaa

SEQ ID NO: 157271 - RNA, 22 nt, Homo sapiens
uguggcuuuacagcaugguuca

SEQ ID NO: 157272 - RNA, 22 nt, Homo sapiens
uuaaguuguagcuacaaauaca

SEQ ID NO: 157273 - RNA, 21 nt, Homo sapiens
uuaucccagugucucugcagg

SEQ ID NO: 157274 - RNA, 22 nt, Homo sapiens
uucaaaguaaaaauguguucac

SEQ ID NO: 157275 - RNA, 20 nt, Homo sapiens
uucaagugauucucaugccu

SEQ ID NO: 157276 - RNA, 22 nt, Homo sapiens
uucacagucacccuucuccaug

SEQ ID NO: 157277 - RNA, 22 nt, Homo sapiens
uucagcaggccaggcccugacu

SEQ ID NO: 157278 - RNA, 22 nt, Homo sapiens
uucagcaguggccaguggaaau

SEQ ID NO: 157279 - RNA, 22 nt, Homo sapiens
uucaguaaauguucuuacuaua

SEQ ID NO: 157280 - RNA, 22 nt, Homo sapiens
uucaguugcaucaguugaccag

SEQ ID NO: 157281 - RNA, 18 nt, Homo sapiens
uucaguuuguaucugggg

SEQ ID NO: 157282 - RNA, 22 nt, Homo sapiens
uucauacaguggcugcacucca

SEQ ID NO: 157283 - RNA, 22 nt, Homo sapiens
uucauaguucuuuuagucauua

SEQ ID NO: 157284 - RNA, 22 nt, Homo sapiens
uucccagagagggacuucuaau

SEQ ID NO: 157285 - RNA, 22 nt, Homo sapiens
uuccuagagauuagcaagcugc

SEQ ID NO: 157286 - RNA, 22 nt, Homo sapiens
uuccuggaggggaaguguccaa

SEQ ID NO: 157287 - RNA, 22 nt, Homo sapiens
uuccuuguuuauuuacaggagg

SEQ ID NO: 157288 - RNA, 22 nt, Homo sapiens
uucuggcucgauucucugaccg

SEQ ID NO: 157289 - RNA, 20 nt, Homo sapiens
uucuugaguuaacaaguuac

SEQ ID NO: 157290 - RNA, 22 nt, Homo sapiens
uugaacuguaagggucugugug

SEQ ID NO: 157291 - RNA, 19 nt, Homo sapiens
uugaaggccgccuugcaga

SEQ ID NO: 157292 - RNA, 22 nt, Homo sapiens
uugagaagugucuguucauguc

SEQ ID NO: 157293 - RNA, 22 nt, Homo sapiens
uugauaguccuguaucuauuuu

SEQ ID NO: 157294 - RNA, 19 nt, Homo sapiens
uugcauauguugaaccagc

SEQ ID NO: 157295 - RNA, 22 nt, Homo sapiens
uugccaauauuuuacugagaag

SEQ ID NO: 157296 - RNA, 22 nt, Homo sapiens
uugccuauucacucugaugaua

SEQ ID NO: 157297 - RNA, 22 nt, Homo sapiens
uugcuccucugccaggaccugu

SEQ ID NO: 157298 - RNA, 22 nt, Homo sapiens
uuggaaacgucaccuuuuccuu

SEQ ID NO: 157299 - RNA, 19 nt, Homo sapiens
uuggaauuuuagaguuuga

SEQ ID NO: 157300 - RNA, 22 nt, Homo sapiens
uuggacucccuccccagcuuca

SEQ ID NO: 157301 - RNA, 22 nt, Homo sapiens
uuggacugagaguuccaccauu

SEQ ID NO: 157302 - RNA, 22 nt, Homo sapiens
uuggagcacuggggcacugaca

SEQ ID NO: 157303 - RNA, 22 nt, Homo sapiens
uuggcaaucaauucugacgucu

SEQ ID NO: 157304 - RNA, 22 nt, Homo sapiens
uugggaaugcuaaaccucuauu

SEQ ID NO: 157305 - RNA, 22 nt, Homo sapiens
uuucacagagggcuucuuucua

SEQ ID NO: 157306 - RNA, 17 nt, Homo sapiens
uuucucagcccucuucu

SEQ ID NO: 157307 - RNA, 22 nt, Homo sapiens
uuugugagguggauagauugca

SEQ ID NO: 157308 - RNA, 22 nt, Homo sapiens
uuuugguucaauuaauuugcua

SEQ ID NO: 157309 - RNA, 22 nt, Homo sapiens
aaagggcuugaauacucuuuuu

SEQ ID NO: 157310 - RNA, 22 nt, Homo sapiens
aaagugcugggaucacacugaa

SEQ ID NO: 157311 - RNA, 22 nt, Homo sapiens
aacagugcauuccuguccauau

SEQ ID NO: 157312 - RNA, 22 nt, Homo sapiens
aacugcacauauuuguaugggu

SEQ ID NO: 157313 - RNA, 22 nt, Homo sapiens
aagagagccagcugguauauuu

SEQ ID NO: 157314 - RNA, 22 nt, Homo sapiens
aaggagcuaagagaucauacau

SEQ ID NO: 157315 - RNA, 22 nt, Homo sapiens
aaggcucuuucaacguaaauua

SEQ ID NO: 157316 - RNA, 20 nt, Homo sapiens
aaggcuuucgaguuccaggg

SEQ ID NO: 157317 - RNA, 23 nt, Homo sapiens
aagguaagcuagaaagauguaga

SEQ ID NO: 157318 - RNA, 22 nt, Homo sapiens
aaguaaacauuuuguacaauaa

SEQ ID NO: 157319 - RNA, 22 nt, Homo sapiens
aagugaaugaugugaaguguaa

SEQ ID NO: 157320 - RNA, 17 nt, Homo sapiens
aaguggcuuguucacca

SEQ ID NO: 157321 - RNA, 22 nt, Homo sapiens
aauggcuuuuaauauccauaau

SEQ ID NO: 157322 - RNA, 22 nt, Homo sapiens
acaaagugccuccuuuuagagu

SEQ ID NO: 157323 - RNA, 22 nt, Homo sapiens
acaauguauauuuuacuguagg

SEQ ID NO: 157324 - RNA, 22 nt, Homo sapiens
acacuggguaacauaucuguua

SEQ ID NO: 157325 - RNA, 22 nt, Homo sapiens
accauugcacuccagccugggc

SEQ ID NO: 157326 - RNA, 22 nt, Homo sapiens
acccgcccagguguggccggga

SEQ ID NO: 157327 - RNA, 22 nt, Homo sapiens
acugagacugagaauguuucuu

SEQ ID NO: 157328 - RNA, 22 nt, Homo sapiens
agaaacauucucuugccuccuu

SEQ ID NO: 157329 - RNA, 22 nt, Homo sapiens
agagagcuuuugguugcccuaa

SEQ ID NO: 157330 - RNA, 22 nt, Homo sapiens
agagucacaugaggcccuucau

SEQ ID NO: 157331 - RNA, 22 nt, Homo sapiens
aaagggcuguuucuugacuugg

SEQ ID NO: 157332 - RNA, 22 nt, Homo sapiens
aaagugcuaggauuaccugggg

SEQ ID NO: 157333 - RNA, 22 nt, Homo sapiens
aaaugcucucuacacguuucug

SEQ ID NO: 157334 - RNA, 22 nt, Homo sapiens
aacacuggcugcucgaguucuc

SEQ ID NO: 157335 - RNA, 22 nt, Homo sapiens
aacacuguuuccagucaugauc

SEQ ID NO: 157336 - RNA, 22 nt, Homo sapiens
aaccuguggauuuugguaucug

SEQ ID NO: 157337 - RNA, 22 nt, Homo sapiens
aagcaggugaugagugggugug

SEQ ID NO: 157338 - RNA, 22 nt, Homo sapiens
aaggugcuguaagcauccaugu

SEQ ID NO: 157339 - RNA, 17 nt, Homo sapiens
aaggugcuucgaccucc

SEQ ID NO: 157340 - RNA, 22 nt, Homo sapiens
agcaccagaaucugaguuauuc

SEQ ID NO: 157341 - RNA, 22 nt, Homo sapiens
agcagcaccaaacagacuaaga

SEQ ID NO: 157342 - RNA, 21 nt, Homo sapiens
agcagcuuugguugaagcaga

SEQ ID NO: 157343 - RNA, 22 nt, Homo sapiens
agcuagugugauucuuuggggu

SEQ ID NO: 157344 - RNA, 20 nt, Homo sapiens
agcugcagauauaaauccgc

SEQ ID NO: 157345 - RNA, 22 nt, Homo sapiens
aggcugguauuuacaaaagcuc

SEQ ID NO: 157346 - RNA, 22 nt, Homo sapiens
aguaacauuucuaguagagagu

SEQ ID NO: 157347 - RNA, 22 nt, Homo sapiens
agucacagguucuugggauuag

SEQ ID NO: 157348 - RNA, 22 nt, Homo sapiens
agucacaugcauuuucuucaau

SEQ ID NO: 157349 - RNA, 22 nt, Homo sapiens
auaacauccuuucuuaucguug

SEQ ID NO: 157350 - RNA, 19 nt, Homo sapiens
auacacguguauacauaca

SEQ ID NO: 157351 - RNA, 22 nt, Homo sapiens
auacacuggagcaaaccuggag

SEQ ID NO: 157352 - RNA, 22 nt, Homo sapiens
auagugaacuuugugagaacaa

SEQ ID NO: 157353 - RNA, 22 nt, Homo sapiens
auaucacaaacaagucuguacu

SEQ ID NO: 157354 - RNA, 22 nt, Homo sapiens
auauuggacugugcuaguuaga

SEQ ID NO: 157355 - RNA, 22 nt, Homo sapiens
aucaaguacuguacugaaagug

SEQ ID NO: 157356 - RNA, 22 nt, Homo sapiens
aucuuuggugcaugauacuuug

SEQ ID NO: 157357 - RNA, 22 nt, Homo sapiens
augcaagcacacaagaggaaau

SEQ ID NO: 157358 - RNA, 22 nt, Homo sapiens
augcacauggcuaacuuuuuuc

SEQ ID NO: 157359 - RNA, 22 nt, Homo sapiens
augcacuuggcaggaugauucc

SEQ ID NO: 157360 - RNA, 19 nt, Homo sapiens
augccucaguuuuguacuu

SEQ ID NO: 157361 - RNA, 22 nt, Homo sapiens
augcuacauucuacaauuaggc

SEQ ID NO: 157362 - RNA, 22 nt, Homo sapiens
augcuacuggacaauggugacu

SEQ ID NO: 157363 - RNA, 22 nt, Homo sapiens
augcuacuggauuuguauaaau

SEQ ID NO: 157364 - RNA, 22 nt, Homo sapiens
auggaagucucuguuaaguuuc

SEQ ID NO: 157365 - RNA, 22 nt, Homo sapiens
auggcauggugaagucuuugga

SEQ ID NO: 157366 - RNA, 22 nt, Homo sapiens
augggugaguaugaguugacuu

SEQ ID NO: 157367 - RNA, 22 nt, Homo sapiens
auggucuuuucccuggauuaua

SEQ ID NO: 157368 - RNA, 22 nt, Homo sapiens
auguaacaguauuuggagaugu

SEQ ID NO: 157369 - RNA, 22 nt, Homo sapiens
augucaacauagacaguagagu

SEQ ID NO: 157370 - RNA, 19 nt, Homo sapiens
augugguuagcaugacugc

SEQ ID NO: 157371 - RNA, 22 nt, Homo sapiens
auucaaggacuggauugcggga

SEQ ID NO: 157372 - RNA, 23 nt, Homo sapiens
auugaacacuuucauaugugagg

SEQ ID NO: 157373 - RNA, 22 nt, Homo sapiens
auugacaguuggccaguaagug

SEQ ID NO: 157374 - RNA, 22 nt, Homo sapiens
caaagugcugaaagaggccagg

SEQ ID NO: 157375 - RNA, 22 nt, Homo sapiens
caaagugcugggaugggccagg

SEQ ID NO: 157376 - RNA, 22 nt, Homo sapiens
caagagagcugaugguuuuaaa

SEQ ID NO: 157377 - RNA, 22 nt, Homo sapiens
cacagcuaacaacuguuucuuc

SEQ ID NO: 157378 - RNA, 22 nt, Homo sapiens
cacccuugcagggacagcuuug

SEQ ID NO: 157379 - RNA, 22 nt, Homo sapiens
cacugcacuccagcuuugguga

SEQ ID NO: 157380 - RNA, 22 nt, Homo sapiens
caucccugucgucaagucucug

SEQ ID NO: 157381 - RNA, 22 nt, Homo sapiens
caucucauugaauugcugagca

SEQ ID NO: 157382 - RNA, 22 nt, Homo sapiens
cauugcaaugaggucuugcagu

SEQ ID NO: 157383 - RNA, 19 nt, Homo sapiens
ccaguguugccagagcuga

SEQ ID NO: 157384 - RNA, 21 nt, Homo sapiens
ccaugggacggaaugaauaca

SEQ ID NO: 157385 - RNA, 22 nt, Homo sapiens
cccagugugcugggugacagcu

SEQ ID NO: 157386 - RNA, 22 nt, Homo sapiens
cccaguguuacgugacagccug

SEQ ID NO: 157387 - RNA, 22 nt, Homo sapiens
ccccauguucucucugcagcuc

SEQ ID NO: 157388 - RNA, 21 nt, Homo sapiens
ccucuuugagggaagaaaggg

SEQ ID NO: 157389 - RNA, 22 nt, Homo sapiens
ccuucuuuuguaaggcugaaua

SEQ ID NO: 157390 - RNA, 21 nt, Homo sapiens
cgucauggagauguguuguac

SEQ ID NO: 157391 - RNA, 22 nt, Homo sapiens
cgugaggaaaacagaggguguu

SEQ ID NO: 157392 - RNA, 22 nt, Homo sapiens
cuaugcuucuuaaauuaguuau

SEQ ID NO: 157393 - RNA, 22 nt, Homo sapiens
cucaguuuugccuuguuuaagg

SEQ ID NO: 157394 - RNA, 22 nt, Homo sapiens
cucucuguuugucuguuauugg

SEQ ID NO: 157395 - RNA, 22 nt, Homo sapiens
cugaccucugucaaagacaccc

SEQ ID NO: 157396 - RNA, 22 nt, Homo sapiens
cuggcaaauaguagagccagga

SEQ ID NO: 157397 - RNA, 22 nt, Homo sapiens
cuggcugagugguaaguagagg

SEQ ID NO: 157398 - RNA, 22 nt, Homo sapiens
cuggguacccuuuaaacaggaa

SEQ ID NO: 157399 - RNA, 22 nt, Homo sapiens
cugggucaguuucugauuauug

SEQ ID NO: 157400 - RNA, 22 nt, Homo sapiens
cugugcaaguuauaggccaggu

SEQ ID NO: 157401 - RNA, 22 nt, Homo sapiens
cugugcauggauuuuaagauug

SEQ ID NO: 157402 - RNA, 22 nt, Homo sapiens
cuugagcauauucuauauuaaa

SEQ ID NO: 157403 - RNA, 22 nt, Homo sapiens
cuuggcacugcucacccuccuu

SEQ ID NO: 157404 - RNA, 22 nt, Homo sapiens
cuuuaguugucuccucaagggu

SEQ ID NO: 157405 - RNA, 22 nt, Homo sapiens
cuuuccauuguuggagcauaaa

SEQ ID NO: 157406 - RNA, 21 nt, Homo sapiens
cuuugcacugcuccucagcuc

SEQ ID NO: 157407 - RNA, 22 nt, Homo sapiens
cuuuuggugguucugaugcagg

SEQ ID NO: 157408 - RNA, 22 nt, Homo sapiens
gaaagugcugcaaggccaugca

SEQ ID NO: 157409 - RNA, 22 nt, Homo sapiens
gaaauguauuaaugaguugaaa

SEQ ID NO: 157410 - RNA, 22 nt, Homo sapiens
gaaaugucugagauguggcuca

SEQ ID NO: 157411 - RNA, 22 nt, Homo sapiens
gaagaacuaggugagaucuaga

SEQ ID NO: 157412 - RNA, 22 nt, Homo sapiens
gaaugucuuauugcucguugua

SEQ ID NO: 157413 - RNA, 22 nt, Homo sapiens
gacacuggguguuuguuggcgu

SEQ ID NO: 157414 - RNA, 22 nt, Homo sapiens
gagacggagucucgcucuguca

SEQ ID NO: 157415 - RNA, 22 nt, Homo sapiens
gagauuauuagauguucugcuu

SEQ ID NO: 157416 - RNA, 22 nt, Homo sapiens
gagcaaaaguauguauugguua

SEQ ID NO: 157417 - RNA, 22 nt, Homo sapiens
gaggugguagguucacagcagc

SEQ ID NO: 157418 - RNA, 22 nt, Homo sapiens
gcacauggccccaucgugccga

SEQ ID NO: 157419 - RNA, 22 nt, Homo sapiens
gcaccacugcacucucagcuug

SEQ ID NO: 157420 - RNA, 22 nt, Homo sapiens
gcaggaauuucucugcagaccc

SEQ ID NO: 157421 - RNA, 22 nt, Homo sapiens
gcggguguuuuacccuugcaga

SEQ ID NO: 157422 - RNA, 22 nt, Homo sapiens
gcugcuguggcagauuggauuc

SEQ ID NO: 157423 - RNA, 22 nt, Homo sapiens
gcugcuguuauucaucagaacu

SEQ ID NO: 157424 - RNA, 22 nt, Homo sapiens
gcugcuguuucucuuucagcau

SEQ ID NO: 157425 - RNA, 22 nt, Homo sapiens
gcuggcuuucuccugaucucag

SEQ ID NO: 157426 - RNA, 22 nt, Homo sapiens
ggaaugagaaauauuacacaau

SEQ ID NO: 157427 - RNA, 19 nt, Homo sapiens
ggaaugcuauucaaccuuu

SEQ ID NO: 157428 - RNA, 21 nt, Homo sapiens
ggaauguugccagcagccaga

SEQ ID NO: 157429 - RNA, 22 nt, Homo sapiens
ggcagaucauuggccucaguuu

SEQ ID NO: 157430 - RNA, 22 nt, Homo sapiens
ggucacauuggacuaucaaguu

SEQ ID NO: 157431 - RNA, 22 nt, Homo sapiens
ggugagaaagggauuccuguuc

SEQ ID NO: 157432 - RNA, 22 nt, Homo sapiens
ggugucaguuggccccuacugg

SEQ ID NO: 157433 - RNA, 22 nt, Homo sapiens
guaauacuggacaggguaucag

SEQ ID NO: 157434 - RNA, 22 nt, Homo sapiens
guagaagcacagggccuguauu

SEQ ID NO: 157435 - RNA, 22 nt, Homo sapiens
guauacaugucaaaacucacau

SEQ ID NO: 157436 - RNA, 22 nt, Homo sapiens
gucaccauugagucauuuccuc

SEQ ID NO: 157437 - RNA, 22 nt, Homo sapiens
gucugguuuuuuauauccucac

SEQ ID NO: 157438 - RNA, 22 nt, Homo sapiens
guggcaugaaagcagauaccac

SEQ ID NO: 157439 - RNA, 22 nt, Homo sapiens
guggcuauuguucccugguugc

SEQ ID NO: 157440 - RNA, 18 nt, Homo sapiens
gugucugguuaugggagu

SEQ ID NO: 157441 - RNA, 22 nt, Homo sapiens
gugugcaaauguguaccuacau

SEQ ID NO: 157442 - RNA, 22 nt, Homo sapiens
uaaggaaggcugugugcuuuua

SEQ ID NO: 157443 - RNA, 22 nt, Homo sapiens
uaccagugaauuccaggggcua

SEQ ID NO: 157444 - RNA, 22 nt, Homo sapiens
uaccauguaucugggaugcuuu

SEQ ID NO: 157445 - RNA, 18 nt, Homo sapiens
uagaauauaggucauucu

SEQ ID NO: 157446 - RNA, 22 nt, Homo sapiens
uagaauguaacuuccaugucau

SEQ ID NO: 157447 - RNA, 22 nt, Homo sapiens
uaucaaggccacucauuuuaug

SEQ ID NO: 157448 - RNA, 22 nt, Homo sapiens
uauuccacuauuaguccagaug

SEQ ID NO: 157449 - RNA, 22 nt, Homo sapiens
uauuccacucuguuggagguaa

SEQ ID NO: 157450 - RNA, 22 nt, Homo sapiens
uauuccuuuugcauuuccacau

SEQ ID NO: 157451 - RNA, 22 nt, Homo sapiens
ucacaucucagguuucuugaca

SEQ ID NO: 157452 - RNA, 22 nt, Homo sapiens
ucaccaccuuccaggaccacug

SEQ ID NO: 157453 - RNA, 22 nt, Homo sapiens
ucaccagugucagggaacugcu

SEQ ID NO: 157454 - RNA, 22 nt, Homo sapiens
ucaccuggagccuucacauucu

SEQ ID NO: 157455 - RNA, 22 nt, Homo sapiens
ucagucuuuuuuuggcaagcau

SEQ ID NO: 157456 - RNA, 22 nt, Homo sapiens
ucaguggacuuagucuuucccc

SEQ ID NO: 157457 - RNA, 21 nt, Homo sapiens
ucauaagcucaacaucuguag

SEQ ID NO: 157458 - RNA, 16 nt, Homo sapiens
ucauaguaucucuucu

SEQ ID NO: 157459 - RNA, 22 nt, Homo sapiens
ucaugcaaugagucaggaggca

SEQ ID NO: 157460 - RNA, 22 nt, Homo sapiens
ucccugagcaaaguuuucugua

SEQ ID NO: 157461 - RNA, 22 nt, Homo sapiens
uccuugagaggacagagccaua

SEQ ID NO: 157462 - RNA, 20 nt, Homo sapiens
ucuggguuuuggccacgccc

SEQ ID NO: 157463 - RNA, 22 nt, Homo sapiens
ucugucaaaucuuauguuguag

SEQ ID NO: 157464 - RNA, 22 nt, Homo sapiens
ucugugcauuguaggauguuua

SEQ ID NO: 157465 - RNA, 22 nt, Homo sapiens
ucuuuaguuaagggacauuuua

SEQ ID NO: 157466 - RNA, 19 nt, Homo sapiens
ucuuugcuuuucuaagagg

SEQ ID NO: 157467 - RNA, 22 nt, Homo sapiens
ugaaaugaucaguuugguuacu

SEQ ID NO: 157468 - RNA, 22 nt, Homo sapiens
ugaaguaauguuuuauucuauu

SEQ ID NO: 157469 - RNA, 22 nt, Homo sapiens
ugacaguaucuacagcuucuua

SEQ ID NO: 157470 - RNA, 22 nt, Homo sapiens
ugagaaccucugugugcccacu

SEQ ID NO: 157471 - RNA, 22 nt, Homo sapiens
ugagacggagucucgcucuguu

SEQ ID NO: 157472 - RNA, 18 nt, Homo sapiens
aaacagugucucuuucug

SEQ ID NO: 157473 - RNA, 22 nt, Homo sapiens
aaagggcuuuguaaacuucaag

SEQ ID NO: 157474 - RNA, 22 nt, Homo sapiens
aacauguuuagcagauaccugu

SEQ ID NO: 157475 - RNA, 22 nt, Homo sapiens
aacugcacuaggacagguuuuu

SEQ ID NO: 157476 - RNA, 22 nt, Homo sapiens
aagaggcuguaggauaaugccu

SEQ ID NO: 157477 - RNA, 22 nt, Homo sapiens
ugagaugaucaaaguauaggcu

SEQ ID NO: 157478 - RNA, 22 nt, Homo sapiens
ugagcaagaucuuuauaauuag

SEQ ID NO: 157479 - RNA, 22 nt, Homo sapiens
ugagcagaaagcugcaaggucg

SEQ ID NO: 157480 - RNA, 22 nt, Homo sapiens
ugaggaaugaccccgugugguc

SEQ ID NO: 157481 - RNA, 22 nt, Homo sapiens
ugaguucaugcuuguaguucua

SEQ ID NO: 157482 - RNA, 22 nt, Homo sapiens
ugcaagaaucagccuaucauua

SEQ ID NO: 157483 - RNA, 22 nt, Homo sapiens
ugcaagcacacccagggauugu

SEQ ID NO: 157484 - RNA, 17 nt, Homo sapiens
ugcaccauuugauuuuu

SEQ ID NO: 157485 - RNA, 22 nt, Homo sapiens
ugcaguagugugaucuuggcuc

SEQ ID NO: 157486 - RNA, 22 nt, Homo sapiens
ugcauauguucaaaguauucug

SEQ ID NO: 157487 - RNA, 22 nt, Homo sapiens
ugcauauucgaguuauuuuggg

SEQ ID NO: 157488 - RNA, 22 nt, Homo sapiens
ugcuacccuucgucucucuggu

SEQ ID NO: 157489 - RNA, 21 nt, Homo sapiens
ugcucaugaguaaugcaguga

SEQ ID NO: 157490 - RNA, 22 nt, Homo sapiens
ugcuggugauuaaauccugaag

SEQ ID NO: 157491 - RNA, 23 nt, Homo sapiens
uggaagacuccucucuuggcugc

SEQ ID NO: 157492 - RNA, 21 nt, Homo sapiens
uggaauguucugacuucaggg

SEQ ID NO: 157493 - RNA, 22 nt, Homo sapiens
uggagagcaaagaauuuguuag

SEQ ID NO: 157494 - RNA, 22 nt, Homo sapiens
uggagagugagggccuccuuaa

SEQ ID NO: 157495 - RNA, 22 nt, Homo sapiens
uggagugcaauggcaccaucuu

SEQ ID NO: 157496 - RNA, 22 nt, Homo sapiens
uggcaagaaggauuuauuccuu

SEQ ID NO: 157497 - RNA, 20 nt, Homo sapiens
uggcaccugacagauagcca

SEQ ID NO: 157498 - RNA, 22 nt, Homo sapiens
uggcuguuguuacuaacaguuc

SEQ ID NO: 157499 - RNA, 21 nt, Homo sapiens
uggcuguuuucaugcuagaac

SEQ ID NO: 157500 - RNA, 22 nt, Homo sapiens
ugggaagauucuguguuuuucc

SEQ ID NO: 157501 - RNA, 22 nt, Homo sapiens
ugggaugaugaaaaggcuuucu

SEQ ID NO: 157502 - RNA, 22 nt, Homo sapiens
uggguagauaucauaguugccc

SEQ ID NO: 157503 - RNA, 22 nt, Homo sapiens
ugucauggauucugagucuggg

SEQ ID NO: 157504 - RNA, 22 nt, Homo sapiens
ugugaucaugugugccuuaguc

SEQ ID NO: 157505 - RNA, 19 nt, Homo sapiens
uguggucauccugggacga

SEQ ID NO: 157506 - RNA, 22 nt, Homo sapiens
ugugucuugaauuuuguaugua

SEQ ID NO: 157507 - RNA, 22 nt, Homo sapiens
uguuaacauggucucagucugu

SEQ ID NO: 157508 - RNA, 22 nt, Homo sapiens
uguucuggagaguuuagucugg

SEQ ID NO: 157509 - RNA, 22 nt, Homo sapiens
uuaaguuaggcuucagcagucu

SEQ ID NO: 157510 - RNA, 22 nt, Homo sapiens
uuacugcuuaagugauucaaca

SEQ ID NO: 157511 - RNA, 22 nt, Homo sapiens
uuaggacaauguucguuuuuug

SEQ ID NO: 157512 - RNA, 22 nt, Homo sapiens
uuauuagguuagugcaaaaguu

SEQ ID NO: 157513 - RNA, 22 nt, Homo sapiens
uucaccuggguuggccaucauu

SEQ ID NO: 157514 - RNA, 22 nt, Homo sapiens
uucauggguuaauuuguucgau

SEQ ID NO: 157515 - RNA, 22 nt, Homo sapiens
uuccuugaaacagucaagagaa

SEQ ID NO: 157516 - RNA, 22 nt, Homo sapiens
uuccuugguucagggaaggucc

SEQ ID NO: 157517 - RNA, 22 nt, Homo sapiens
uucuugaggcaugccgcuggga

SEQ ID NO: 157518 - RNA, 22 nt, Homo sapiens
uugaaagaaaggagacugaguu

SEQ ID NO: 157519 - RNA, 19 nt, Homo sapiens
gcggcacuggagacacagc

SEQ ID NO: 157520 - RNA, 22 nt, Homo sapiens
gcugcuguuuaguuucuccugg

SEQ ID NO: 157521 - RNA, 22 nt, Homo sapiens
ggagucuugcuauguugccaag

SEQ ID NO: 157522 - RNA, 22 nt, Homo sapiens
ggagugucagaaacaguguccu

SEQ ID NO: 157523 - RNA, 19 nt, Homo sapiens
ggcaccuuuuccaaaaaug

SEQ ID NO: 157524 - RNA, 22 nt, Homo sapiens
gggaagugugcagaguucucuu

SEQ ID NO: 157525 - RNA, 20 nt, Homo sapiens
gggaugugagguacacucuu

SEQ ID NO: 157526 - RNA, 22 nt, Homo sapiens
ggggaguguggacaucacccug

SEQ ID NO: 157527 - RNA, 22 nt, Homo sapiens
ggguucaaaucuuggcucuuac

SEQ ID NO: 157528 - RNA, 19 nt, Homo sapiens
ggucacagggguuacaagg

SEQ ID NO: 157529 - RNA, 19 nt, Homo sapiens
ggugcuugaauauuccucc

SEQ ID NO: 157530 - RNA, 22 nt, Homo sapiens
gguggcuuuuugugauggcuga

SEQ ID NO: 157531 - RNA, 22 nt, Homo sapiens
gguggugguauuucagaaaaug

SEQ ID NO: 157532 - RNA, 22 nt, Homo sapiens
guagaagcacaggugaguuggu

SEQ ID NO: 157533 - RNA, 22 nt, Homo sapiens
guagagagaaauacaaagcugu

SEQ ID NO: 157534 - RNA, 22 nt, Homo sapiens
guaguggcaugaucuuggcuca

SEQ ID NO: 157535 - RNA, 18 nt, Homo sapiens
guauuccagccugaguga

SEQ ID NO: 157536 - RNA, 22 nt, Homo sapiens
uguggcacuguguccagagaaa

SEQ ID NO: 157537 - RNA, 22 nt, Homo sapiens
uguguaaauaugauagaggaau

SEQ ID NO: 157538 - RNA, 22 nt, Homo sapiens
uguuaacauuuuagagugggaa

SEQ ID NO: 157539 - RNA, 22 nt, Homo sapiens
uguucacaguguuucuuugaga

SEQ ID NO: 157540 - RNA, 22 nt, Homo sapiens
uuaccucuguggcucucggacu

SEQ ID NO: 157541 - RNA, 22 nt, Homo sapiens
uuaggacacuguggguggguca

SEQ ID NO: 157542 - RNA, 22 nt, Homo sapiens
uuauagcacuaagaagguaaua

SEQ ID NO: 157543 - RNA, 22 nt, Homo sapiens
uuaucacauugacugauuugca

SEQ ID NO: 157544 - RNA, 22 nt, Homo sapiens
uuaucauagugcaguuuucuga

SEQ ID NO: 157545 - RNA, 22 nt, Homo sapiens
uuauuagguuaaccuauagcua

SEQ ID NO: 157546 - RNA, 22 nt, Homo sapiens
uuauuagguugguggaaaagua

SEQ ID NO: 157547 - RNA, 22 nt, Homo sapiens
uuauucauuaauugcuaagguu

SEQ ID NO: 157548 - RNA, 22 nt, Homo sapiens
uucacagagagaacucaaacca

SEQ ID NO: 157549 - RNA, 22 nt, Homo sapiens
uucacugugugacccugggcca

SEQ ID NO: 157550 - RNA, 19 nt, Homo sapiens
uucagcagugucugcucuu

SEQ ID NO: 157551 - RNA, 22 nt, Homo sapiens
uucagggcauuggaguuucuga

SEQ ID NO: 157552 - RNA, 22 nt, Homo sapiens
uucauguaauauuucacagcuu

SEQ ID NO: 157553 - RNA, 22 nt, Homo sapiens
uuccauguaguugagcaguuuu

SEQ ID NO: 157554 - RNA, 22 nt, Homo sapiens
uuccauuuguucggugucgcca

SEQ ID NO: 157555 - RNA, 22 nt, Homo sapiens
uucccucagaaacacacagccc

SEQ ID NO: 157556 - RNA, 22 nt, Homo sapiens
uugaaagucuaggcuuacagua

SEQ ID NO: 157557 - RNA, 22 nt, Homo sapiens
uugacuguaagauggcuauuac

SEQ ID NO: 157558 - RNA, 22 nt, Homo sapiens
uugaggaguacugauuagguau

SEQ ID NO: 157559 - RNA, 22 nt, Homo sapiens
uugcacuucauguaggccaaag

SEQ ID NO: 157560 - RNA, 22 nt, Homo sapiens
uugcagcaaauaggaaugagga

SEQ ID NO: 157561 - RNA, 19 nt, Homo sapiens
uugcauauguugaaccagg

SEQ ID NO: 157562 - RNA, 22 nt, Homo sapiens
uuggucucuuaaucacacuuuu

SEQ ID NO: 157563 - RNA, 22 nt, Homo sapiens
uuguccauggacagcaccacag

SEQ ID NO: 157564 - RNA, 20 nt, Homo sapiens
uuuaagacaugcugaauuga

SEQ ID NO: 157565 - RNA, 22 nt, Homo sapiens
uuuacugugggguuucuuagag

SEQ ID NO: 157566 - RNA, 22 nt, Homo sapiens
uuuagcaaagcaauuuacacca

SEQ ID NO: 157567 - RNA, 22 nt, Homo sapiens
uuuauucggcuaggagcuucgg

SEQ ID NO: 157568 - RNA, 22 nt, Homo sapiens
uuugagaaugcuaccagagaag

SEQ ID NO: 157569 - RNA, 22 nt, Homo sapiens
uuuggcauuaagaugcuguauc

SEQ ID NO: 157570 - RNA, 22 nt, Homo sapiens
uuuggccauguuggucaggcug

SEQ ID NO: 157571 - RNA, 22 nt, Homo sapiens
uuugugaggugauggauauguc

SEQ ID NO: 157572 - RNA, 22 nt, Homo sapiens
uuuugguuuuauccagggucuc

SEQ ID NO: 157573 - RNA, 22 nt, Homo sapiens
uucuuccagccuugaggggccc

SEQ ID NO: 157574 - RNA, 22 nt, Homo sapiens
uugauaguuuuaaaauuaaucu

SEQ ID NO: 157575 - RNA, 22 nt, Homo sapiens
uugcacauugcaccuuuuguau

SEQ ID NO: 157576 - RNA, 22 nt, Homo sapiens
uugcagcaaagagggaggggca

SEQ ID NO: 157577 - RNA, 22 nt, Homo sapiens
uugcauauguugaaccaagcgu

SEQ ID NO: 157578 - RNA, 22 nt, Homo sapiens
uuggagugugagagcagccugg

SEQ ID NO: 157579 - RNA, 22 nt, Homo sapiens
uuggcuaugaguccuaugugca

SEQ ID NO: 157580 - RNA, 22 nt, Homo sapiens
uuggcuguguuucccuacaaau

SEQ ID NO: 157581 - RNA, 22 nt, Homo sapiens
uugggauggaaauuuguacccc

SEQ ID NO: 157582 - RNA, 22 nt, Homo sapiens
uugggucaguuccuugacuccu

SEQ ID NO: 157583 - RNA, 22 nt, Homo sapiens
uugguucaguuuaacgaguaau

SEQ ID NO: 157584 - RNA, 22 nt, Homo sapiens
uuuaaaguuagaaggaaagggc

SEQ ID NO: 157585 - RNA, 22 nt, Homo sapiens
uuuauccagccucuagcaaggu

SEQ ID NO: 157586 - RNA, 22 nt, Homo sapiens
uuucacagcaauugccuauugu

SEQ ID NO: 157587 - RNA, 23 nt, Homo sapiens
uuucaguaguuguauccuguugc

SEQ ID NO: 157588 - RNA, 23 nt, Homo sapiens
uuugccacuuauuagcugggagg

SEQ ID NO: 157589 - RNA, 22 nt, Homo sapiens
uuugguguauauguaaacuaug

SEQ ID NO: 157590 - RNA, 22 nt, Homo sapiens
uuuuaagcuacaagagacauau

SEQ ID NO: 157591 - RNA, 22 nt, Homo sapiens
uuuugcuccuggcaaacucaua

SEQ ID NO: 157592 - RNA, 17 nt, Homo sapiens
uuuuggauuagaaaucc

SEQ ID NO: 157593 - RNA, 22 nt, Homo sapiens
uuuugguuaggauggguggcau

SEQ ID NO: 157594 - RNA, 22 nt, Homo sapiens
uuuugguuguuggguaagagua

SEQ ID NO: 157595 - RNA, 21 nt, Homo sapiens
uuuuugguggucauggauaga

SEQ ID NO: 157596 - RNA, 22 nt, Homo sapiens
aucauaucaucugcaaacaaag

SEQ ID NO: 157597 - RNA, 22 nt, Homo sapiens
auccugagacuuuucugaaguu

SEQ ID NO: 157598 - RNA, 22 nt, Homo sapiens
aucuuugauuguagguacaaug

SEQ ID NO: 157599 - RNA, 22 nt, Homo sapiens
aucuuuggugaguucuuugguc

SEQ ID NO: 157600 - RNA, 22 nt, Homo sapiens
augaaagugauaaaugucucua

SEQ ID NO: 157601 - RNA, 22 nt, Homo sapiens
augcacuguauaggaucuugcg

SEQ ID NO: 157602 - RNA, 22 nt, Homo sapiens
augcuacugauaagcaaucauu

SEQ ID NO: 157603 - RNA, 22 nt, Homo sapiens
auggaagaaacgauuuucugga

SEQ ID NO: 157604 - RNA, 22 nt, Homo sapiens
auggcccugaguucaauauauu

SEQ ID NO: 157605 - RNA, 22 nt, Homo sapiens
auggcucuuauuauuugaggua

SEQ ID NO: 157606 - RNA, 20 nt, Homo sapiens
auguucuggaggacagaagc

SEQ ID NO: 157607 - RNA, 22 nt, Homo sapiens
caaagugcuggccgggcgcagu

SEQ ID NO: 157608 - RNA, 22 nt, Homo sapiens
caaagugcugggacuggccggg

SEQ ID NO: 157609 - RNA, 22 nt, Homo sapiens
caccaguuuuucagugauucaa

SEQ ID NO: 157610 - RNA, 22 nt, Homo sapiens
cacugcacuccagucccgucuc

SEQ ID NO: 157611 - RNA, 22 nt, Homo sapiens
cacugcacuccagucuggcgac

SEQ ID NO: 157612 - RNA, 22 nt, Homo sapiens
cacugcacuccaguuuggauga

SEQ ID NO: 157613 - RNA, 21 nt, Homo sapiens
cacugcacuugccuucugggu

SEQ ID NO: 157614 - RNA, 22 nt, Homo sapiens
cagagugcauguuuagaugagu

SEQ ID NO: 157615 - RNA, 22 nt, Homo sapiens
cagcuguguuauaaacuaccau

SEQ ID NO: 157616 - RNA, 22 nt, Homo sapiens
cagcuugugguauugcugguug

SEQ ID NO: 157617 - RNA, 22 nt, Homo sapiens
caggaaugugaggguucccugc

SEQ ID NO: 157618 - RNA, 22 nt, Homo sapiens
cauuccacuggauaaacaaggu

SEQ ID NO: 157619 - RNA, 22 nt, Homo sapiens
ccaagccucaguuucccucugu

SEQ ID NO: 157620 - RNA, 23 nt, Homo sapiens
ccacacuguuuagaauggcauca

SEQ ID NO: 157621 - RNA, 22 nt, Homo sapiens
ccucuguaguccugcaagagga

SEQ ID NO: 157622 - RNA, 22 nt, Homo sapiens
ccugucuugaagagauccuccu

SEQ ID NO: 157623 - RNA, 22 nt, Homo sapiens
cggucacagugauucaaggguc

SEQ ID NO: 157624 - RNA, 22 nt, Homo sapiens
cuagaagcauauucagaacaga

SEQ ID NO: 157625 - RNA, 20 nt, Homo sapiens
cucccugacaaauguggaaa

SEQ ID NO: 157626 - RNA, 22 nt, Homo sapiens
cuccuggugauuggagugugaa

SEQ ID NO: 157627 - RNA, 22 nt, Homo sapiens
cucugguggaagcagggggcaa

SEQ ID NO: 157628 - RNA, 22 nt, Homo sapiens
cucuuuggaugccuuaggguua

SEQ ID NO: 157629 - RNA, 22 nt, Homo sapiens
cuggcacccuugcuuaggaaga

SEQ ID NO: 157630 - RNA, 22 nt, Homo sapiens
cuggcucugagguguuuagggc

SEQ ID NO: 157631 - RNA, 22 nt, Homo sapiens
cugggaugauguaaauaggcua

SEQ ID NO: 157632 - RNA, 22 nt, Homo sapiens
cugugauagguuagucaugaau

SEQ ID NO: 157633 - RNA, 22 nt, Homo sapiens
cuuccugaguccugggcucaca

SEQ ID NO: 157634 - RNA, 22 nt, Homo sapiens
cuugagcaaacaaaggugguag

SEQ ID NO: 157635 - RNA, 22 nt, Homo sapiens
cuuuagcaauugauuaugccau

SEQ ID NO: 157636 - RNA, 22 nt, Homo sapiens
cuuucacacuguuggugggaau

SEQ ID NO: 157637 - RNA, 20 nt, Homo sapiens
gaaacaucuauccucuccuu

SEQ ID NO: 157638 - RNA, 22 nt, Homo sapiens
gaagguaguuuauagauguggu

SEQ ID NO: 157639 - RNA, 22 nt, Homo sapiens
gaaucacugugguaucccaugc

SEQ ID NO: 157640 - RNA, 22 nt, Homo sapiens
gacaccauuucaguacuagguu

SEQ ID NO: 157641 - RNA, 22 nt, Homo sapiens
gaccuuguagaaucucaugauu

SEQ ID NO: 157642 - RNA, 22 nt, Homo sapiens
gagacggagucucgcucugucg

SEQ ID NO: 157643 - RNA, 22 nt, Homo sapiens
gagacggagucuugcucuguug

SEQ ID NO: 157644 - RNA, 22 nt, Homo sapiens
gagauuuucagcuugacuggga

SEQ ID NO: 157645 - RNA, 20 nt, Homo sapiens
gagcugguguacugccgggc

SEQ ID NO: 157646 - RNA, 22 nt, Homo sapiens
gaggaaguagcuacugucuuuc

SEQ ID NO: 157647 - RNA, 22 nt, Homo sapiens
gaggagucagacugugcaaggu

SEQ ID NO: 157648 - RNA, 22 nt, Homo sapiens
gaggcacucuguacaaaucugc

SEQ ID NO: 157649 - RNA, 22 nt, Homo sapiens
gagguaaguggauuaugagguc

SEQ ID NO: 157650 - RNA, 22 nt, Homo sapiens
gaguucaauuuccagcuguucu

SEQ ID NO: 157651 - RNA, 22 nt, Homo sapiens
gcaccaugguagaauaauggua

SEQ ID NO: 157652 - RNA, 22 nt, Homo sapiens
gcaccccuuaccgggcuggguu

SEQ ID NO: 157653 - RNA, 22 nt, Homo sapiens
gcucaugggcagugugauuguu

SEQ ID NO: 157654 - RNA, 22 nt, Homo sapiens
gcuggguugccagguuacuuaa

SEQ ID NO: 157655 - RNA, 22 nt, Homo sapiens
ggaaaguccuucuguaggcucc

SEQ ID NO: 157656 - RNA, 22 nt, Homo sapiens
ggaagagugaauuaucuugacu

SEQ ID NO: 157657 - RNA, 20 nt, Homo sapiens
ggaagagugacacaagguau

SEQ ID NO: 157658 - RNA, 22 nt, Homo sapiens
ggagauccucugcgggcaaaga

SEQ ID NO: 157659 - RNA, 22 nt, Homo sapiens
ggcaccauggaaggacgggagc

SEQ ID NO: 157660 - RNA, 18 nt, Homo sapiens
ggcggguguuuuauucac

SEQ ID NO: 157661 - RNA, 22 nt, Homo sapiens
gggaagaaggagugguuuacuc

SEQ ID NO: 157662 - RNA, 22 nt, Homo sapiens
ggucacauugcuagcauggguu

SEQ ID NO: 157663 - RNA, 22 nt, Homo sapiens
guaaucucagcuacucaggagg

SEQ ID NO: 157664 - RNA, 22 nt, Homo sapiens
guagagugcugggcacuggcuc

SEQ ID NO: 157665 - RNA, 22 nt, Homo sapiens
gucaacauauuaauuauguucu

SEQ ID NO: 157666 - RNA, 22 nt, Homo sapiens
gucacauugaugcccauggugg

SEQ ID NO: 157667 - RNA, 22 nt, Homo sapiens
guccuggagaagcguggaccgg

SEQ ID NO: 157668 - RNA, 22 nt, Homo sapiens
gucucugguugcuuuuguacca

SEQ ID NO: 157669 - RNA, 22 nt, Homo sapiens
gucuuugcuuuuaaccagaggu

SEQ ID NO: 157670 - RNA, 22 nt, Homo sapiens
gugagaagaaaaauauggcugu

SEQ ID NO: 157671 - RNA, 22 nt, Homo sapiens
gugagcagagaucgcgugauug

SEQ ID NO: 157672 - RNA, 22 nt, Homo sapiens
gugagcauauuaguauugcacu

SEQ ID NO: 157673 - RNA, 22 nt, Homo sapiens
gugggaugcaaguaaaauuguc

SEQ ID NO: 157674 - RNA, 22 nt, Homo sapiens
gugggauggagagaagguauga

SEQ ID NO: 157675 - RNA, 22 nt, Homo sapiens
guguaaaucugcugugaacauu

SEQ ID NO: 157676 - RNA, 20 nt, Homo sapiens
guucacaggcuuccuuucag

SEQ ID NO: 157677 - RNA, 22 nt, Homo sapiens
guucagcaggggcuucaauggu

SEQ ID NO: 157678 - RNA, 22 nt, Homo sapiens
uaagagagcuccaucuuuuccu

SEQ ID NO: 157679 - RNA, 22 nt, Homo sapiens
uaagcuauagugaauaaauugc

SEQ ID NO: 157680 - RNA, 22 nt, Homo sapiens
uaauccugucuugaccaucagg

SEQ ID NO: 157681 - RNA, 22 nt, Homo sapiens
uacucugcaguaauuccagccc

SEQ ID NO: 157682 - RNA, 20 nt, Homo sapiens
uagaaaguagaguggugguu

SEQ ID NO: 157683 - RNA, 22 nt, Homo sapiens
uagcaggaaaccuguguugagg

SEQ ID NO: 157684 - RNA, 22 nt, Homo sapiens
uugauaguuuaauuaaugcuag

SEQ ID NO: 157685 - RNA, 22 nt, Homo sapiens
uugaucacuguacuaugacuau

SEQ ID NO: 157686 - RNA, 22 nt, Homo sapiens
uugcaaggugcagcuuaugcaa

SEQ ID NO: 157687 - RNA, 22 nt, Homo sapiens
uugcauauguugaaccagccuu

SEQ ID NO: 157688 - RNA, 22 nt, Homo sapiens
uugcauauucucugaggcagga

SEQ ID NO: 157689 - RNA, 22 nt, Homo sapiens
uugcauugacacaugaagcuca

SEQ ID NO: 157690 - RNA, 22 nt, Homo sapiens
uuggcagaaaaggucggggguu

SEQ ID NO: 157691 - RNA, 20 nt, Homo sapiens
uuggcagagucuuuagggua

SEQ ID NO: 157692 - RNA, 22 nt, Homo sapiens
uuggcuauagauacauggauua

SEQ ID NO: 157693 - RNA, 22 nt, Homo sapiens
uuggcuguguuccucaaggagu

SEQ ID NO: 157694 - RNA, 22 nt, Homo sapiens
uuggcuguguuuauaugcugga

SEQ ID NO: 157695 - RNA, 22 nt, Homo sapiens
uugggaauguccuaauaucucg

SEQ ID NO: 157696 - RNA, 22 nt, Homo sapiens
uuguaccacagggcaugaagug

SEQ ID NO: 157697 - RNA, 22 nt, Homo sapiens
uugugcuucaucaccuagcaga

SEQ ID NO: 157698 - RNA, 22 nt, Homo sapiens
uuuaugucuguacaucgggcgg

SEQ ID NO: 157699 - RNA, 22 nt, Homo sapiens
uuuggcauuagagagacuugca

SEQ ID NO: 157700 - RNA, 21 nt, Homo sapiens
uuuggcuucucugcugcagcc

SEQ ID NO: 157701 - RNA, 22 nt, Homo sapiens
uuuuccagugggacucccauua

SEQ ID NO: 157702 - RNA, 21 nt, Homo sapiens
uuuugugcaugugcagccugc

SEQ ID NO: 157703 - RNA, 22 nt, Homo sapiens
uuuuugaguaaauauaaauugu

SEQ ID NO: 157704 - RNA, 22 nt, Homo sapiens
uuuuugguugguaggcuauuaa

SEQ ID NO: 157705 - RNA, 22 nt, Homo sapiens
aaguaauggaguuauuuuauga

SEQ ID NO: 157706 - RNA, 22 nt, Homo sapiens
aagugcuuuacacaugcaugau

SEQ ID NO: 157707 - RNA, 22 nt, Homo sapiens
aauaagcauaguaccugauagg

SEQ ID NO: 157708 - RNA, 22 nt, Homo sapiens
acacugcugaguaaauaauuuu

SEQ ID NO: 157709 - RNA, 17 nt, Homo sapiens
accagugcaugugcuuu

SEQ ID NO: 157710 - RNA, 22 nt, Homo sapiens
accauugcacuccagccuuggc

SEQ ID NO: 157711 - RNA, 22 nt, Homo sapiens
acccugucacucccaucaauuu

SEQ ID NO: 157712 - RNA, 22 nt, Homo sapiens
accuggacacuuugggcuccuc

SEQ ID NO: 157713 - RNA, 23 nt, Homo sapiens
accugugguuauuuuacucuucc

SEQ ID NO: 157714 - RNA, 22 nt, Homo sapiens
acugcacugucaaccuccuggg

SEQ ID NO: 157715 - RNA, 22 nt, Homo sapiens
acuggaguuuguucaagaaaua

SEQ ID NO: 157716 - RNA, 22 nt, Homo sapiens
agagccacacucuccuaacuca

SEQ ID NO: 157717 - RNA, 22 nt, Homo sapiens
agaggaguacuacuccaagucu

SEQ ID NO: 157718 - RNA, 22 nt, Homo sapiens
agcaguagaauuccugcaucac

SEQ ID NO: 157719 - RNA, 22 nt, Homo sapiens
agcauggucacuuugggcccca

SEQ ID NO: 157720 - RNA, 22 nt, Homo sapiens
aggagguugguaccaucuguuu

SEQ ID NO: 157721 - RNA, 22 nt, Homo sapiens
aggcuuuauuacagggucucag

SEQ ID NO: 157722 - RNA, 20 nt, Homo sapiens
agguucaaaucccaaucaug

SEQ ID NO: 157723 - RNA, 22 nt, Homo sapiens
aguaaucaucugagggcagaaa

SEQ ID NO: 157724 - RNA, 20 nt, Homo sapiens
agucaguuuauuuucucucu

SEQ ID NO: 157725 - RNA, 22 nt, Homo sapiens
agugcaauggcgugaucuuggc

SEQ ID NO: 157726 - RNA, 22 nt, Homo sapiens
aguggcacuauucucagaguca

SEQ ID NO: 157727 - RNA, 22 nt, Homo sapiens
aguuccauuuauucucgucucu

SEQ ID NO: 157728 - RNA, 22 nt, Homo sapiens
auacaguugccauuucuugugc

SEQ ID NO: 157729 - RNA, 22 nt, Homo sapiens
aucacacucaccuucuguccuu

SEQ ID NO: 157730 - RNA, 22 nt, Homo sapiens
auccuguacuaagguuuuccca

SEQ ID NO: 157731 - RNA, 22 nt, Homo sapiens
aucgcugagaaagggacuuuca

SEQ ID NO: 157732 - RNA, 22 nt, Homo sapiens
aucucugagauguucugauuuu

SEQ ID NO: 157733 - RNA, 22 nt, Homo sapiens
aucugguguggcugugauccuc

SEQ ID NO: 157734 - RNA, 22 nt, Homo sapiens
aucuuuggucaucacagcuaga

SEQ ID NO: 157735 - RNA, 22 nt, Homo sapiens
augcacuguuguuauuggauaa

SEQ ID NO: 157736 - RNA, 22 nt, Homo sapiens
augcauaugucuuuauaguggc

SEQ ID NO: 157737 - RNA, 19 nt, Homo sapiens
augccacagugaggucaga

SEQ ID NO: 157738 - RNA, 22 nt, Homo sapiens
augcuacugaccccuacuuaca

SEQ ID NO: 157739 - RNA, 22 nt, Homo sapiens
auggagagaauuauucucucag

SEQ ID NO: 157740 - RNA, 22 nt, Homo sapiens
auggcucuggauagaaugcagg

SEQ ID NO: 157741 - RNA, 22 nt, Homo sapiens
auggcuuaagacaaccuuucau

SEQ ID NO: 157742 - RNA, 22 nt, Homo sapiens
auggcuucuuacucuucugcau

SEQ ID NO: 157743 - RNA, 22 nt, Homo sapiens
auggucuuuauuguguugagug

SEQ ID NO: 157744 - RNA, 22 nt, Homo sapiens
auguccauggaaucuguagcaa

SEQ ID NO: 157745 - RNA, 22 nt, Homo sapiens
auucaagggauuucaggaggcu

SEQ ID NO: 157746 - RNA, 22 nt, Homo sapiens
auuccauagugucuguggcaga

SEQ ID NO: 157747 - RNA, 22 nt, Homo sapiens
auucccuguagaauaaggaugg

SEQ ID NO: 157748 - RNA, 22 nt, Homo sapiens
auugcaaugggaaacuaugaaa

SEQ ID NO: 157749 - RNA, 22 nt, Homo sapiens
auuuuugguugguaggcuauua

SEQ ID NO: 157750 - RNA, 22 nt, Homo sapiens
caaaggcuuccacugcauccuu

SEQ ID NO: 157751 - RNA, 22 nt, Homo sapiens
caacacuguuuauuggauagcc

SEQ ID NO: 157752 - RNA, 22 nt, Homo sapiens
cacagggcuaacauuuuugccc

SEQ ID NO: 157753 - RNA, 22 nt, Homo sapiens
caccuagacuggagugcagugg

SEQ ID NO: 157754 - RNA, 22 nt, Homo sapiens
cacugcacuccagccuaagagg

SEQ ID NO: 157755 - RNA, 22 nt, Homo sapiens
cacugcacuccagucugacgac

SEQ ID NO: 157756 - RNA, 22 nt, Homo sapiens
cacugcacucuucuucugggca

SEQ ID NO: 157757 - RNA, 17 nt, Homo sapiens
cacugggugcaagagga

SEQ ID NO: 157758 - RNA, 22 nt, Homo sapiens
cagcccguaaucccagcacuuu

SEQ ID NO: 157759 - RNA, 22 nt, Homo sapiens
caucacagcaaguagggagugg

SEQ ID NO: 157760 - RNA, 22 nt, Homo sapiens
cauggcacaucuuuucugacua

SEQ ID NO: 157761 - RNA, 22 nt, Homo sapiens
ccagauguuuucauucagcaag

SEQ ID NO: 157762 - RNA, 22 nt, Homo sapiens
cccuugcacuucagagcugcau

SEQ ID NO: 157763 - RNA, 19 nt, Homo sapiens
ccugcuguucuuuugcacc

SEQ ID NO: 157764 - RNA, 22 nt, Homo sapiens
ccuggcacugagcaguguucua

SEQ ID NO: 157765 - RNA, 22 nt, Homo sapiens
ccuuggcacuuugccacagugc

SEQ ID NO: 157766 - RNA, 20 nt, Homo sapiens
cuaaucaucccagaagaaau

SEQ ID NO: 157767 - RNA, 22 nt, Homo sapiens
cuaaucuagccuuauaaguauu

SEQ ID NO: 157768 - RNA, 22 nt, Homo sapiens
cuagcuuuuuaugacaaucuug

SEQ ID NO: 157769 - RNA, 22 nt, Homo sapiens
cucaguguuucagcugcucaga

SEQ ID NO: 157770 - RNA, 22 nt, Homo sapiens
cuccuguagccccaucaucuuu

SEQ ID NO: 157771 - RNA, 21 nt, Homo sapiens
cucucugcuuaugaauaguga

SEQ ID NO: 157772 - RNA, 22 nt, Homo sapiens
cucugacagugguuagcacugu

SEQ ID NO: 157773 - RNA, 22 nt, Homo sapiens
cugagaaugaugauuuccaguu

SEQ ID NO: 157774 - RNA, 22 nt, Homo sapiens
cugaggugauauauacauauuu

SEQ ID NO: 157775 - RNA, 22 nt, Homo sapiens
cuggacguugaggcugcaguga

SEQ ID NO: 157776 - RNA, 22 nt, Homo sapiens
cuggcucauuucauuuagcaua

SEQ ID NO: 157777 - RNA, 22 nt, Homo sapiens
cugugcaugcgcggagcugaaa

SEQ ID NO: 157778 - RNA, 22 nt, Homo sapiens
cuucaccaguuuggcagucuca

SEQ ID NO: 157779 - RNA, 22 nt, Homo sapiens
cuuccauaguauuuuuacaaaa

SEQ ID NO: 157780 - RNA, 22 nt, Homo sapiens
gaaagugcugcuugacugggau

SEQ ID NO: 157781 - RNA, 23 nt, Homo sapiens
gaaauguaagugaugccccacag

SEQ ID NO: 157782 - RNA, 22 nt, Homo sapiens
gagaacauuuaagccacucagg

SEQ ID NO: 157783 - RNA, 22 nt, Homo sapiens
gagauguuuguuucacugucac

SEQ ID NO: 157784 - RNA, 22 nt, Homo sapiens
gagcacccuuuguugauugcaa

SEQ ID NO: 157785 - RNA, 21 nt, Homo sapiens
gaguggcuuuuguuucaccag

SEQ ID NO: 157786 - RNA, 22 nt, Homo sapiens
gaguuacauuguaauugccgag

SEQ ID NO: 157787 - RNA, 17 nt, Homo sapiens
gaucacagucgucuccu

SEQ ID NO: 157788 - RNA, 22 nt, Homo sapiens
gcacugggccacauuuauuuuc

SEQ ID NO: 157789 - RNA, 22 nt, Homo sapiens
gcagucacagggagauggugac

SEQ ID NO: 157790 - RNA, 22 nt, Homo sapiens
gcauauguuuggguguguauau

SEQ ID NO: 157791 - RNA, 22 nt, Homo sapiens
gcccuuugugucuggcuggggu

SEQ ID NO: 157792 - RNA, 22 nt, Homo sapiens
gucacaggaaacuaauaugcgc

SEQ ID NO: 157793 - RNA, 22 nt, Homo sapiens
gucaguuucacucagcuggaac

SEQ ID NO: 157794 - RNA, 22 nt, Homo sapiens
gucauggugcuagcgggaaugu

SEQ ID NO: 157795 - RNA, 22 nt, Homo sapiens
guccauuuguuuccagagcacu

SEQ ID NO: 157796 - RNA, 22 nt, Homo sapiens
gucugagcauggggccggcagg

SEQ ID NO: 157797 - RNA, 22 nt, Homo sapiens
gucugguuccugggagauuucu

SEQ ID NO: 157798 - RNA, 22 nt, Homo sapiens
gucugguugacagcauguggcc

SEQ ID NO: 157799 - RNA, 22 nt, Homo sapiens
gugagccaugauuuuaccacug

SEQ ID NO: 157800 - RNA, 22 nt, Homo sapiens
gugagucaugucccaucugauu

SEQ ID NO: 157801 - RNA, 22 nt, Homo sapiens
gugcaugucuaugcgagucuaa

SEQ ID NO: 157802 - RNA, 22 nt, Homo sapiens
guggagcuguguggccuugggc

SEQ ID NO: 157803 - RNA, 22 nt, Homo sapiens
guggaggagaaagaagcauuuc

SEQ ID NO: 157804 - RNA, 22 nt, Homo sapiens
gugggaugaucgcuugagccca

SEQ ID NO: 157805 - RNA, 22 nt, Homo sapiens
gugggauggaaaugggcuucag

SEQ ID NO: 157806 - RNA, 22 nt, Homo sapiens
guucaagcaauucugcugccuc

SEQ ID NO: 157807 - RNA, 20 nt, Homo sapiens
guucacagagguuaugauua

SEQ ID NO: 157808 - RNA, 22 nt, Homo sapiens
uaaacacucacuucauagccau

SEQ ID NO: 157809 - RNA, 22 nt, Homo sapiens
uaacauagucauauacuugcuu

SEQ ID NO: 157810 - RNA, 22 nt, Homo sapiens
uaacauucacaugcugcaaaaa

SEQ ID NO: 157811 - RNA, 23 nt, Homo sapiens
uaacauugcaugauuaccugcau

SEQ ID NO: 157812 - RNA, 22 nt, Homo sapiens
uaagccaccgugccuggccuaa

SEQ ID NO: 157813 - RNA, 22 nt, Homo sapiens
uaaguaauuuguauuuuaccca

SEQ ID NO: 157814 - RNA, 22 nt, Homo sapiens
uaccacugccgagaaaacagau

SEQ ID NO: 157815 - RNA, 18 nt, Homo sapiens
uauuccucuuccucuauc

SEQ ID NO: 157816 - RNA, 22 nt, Homo sapiens
uauuucccuuaacuuuccugca

SEQ ID NO: 157817 - RNA, 22 nt, Homo sapiens
ucaacacaguuaaauggggaaa

SEQ ID NO: 157818 - RNA, 21 nt, Homo sapiens
ucaacccuugcgucaccaagc

SEQ ID NO: 157819 - RNA, 23 nt, Homo sapiens
ucacacuuaagagaaaugcagcu

SEQ ID NO: 157820 - RNA, 22 nt, Homo sapiens
ucacaguaacuuuguugcuuuu

SEQ ID NO: 157821 - RNA, 22 nt, Homo sapiens
ucacugaaaccuccaccucucg

SEQ ID NO: 157822 - RNA, 21 nt, Homo sapiens
ucacugagguuaaauaggguu

SEQ ID NO: 157823 - RNA, 19 nt, Homo sapiens
ucacuggacagcacacuca

SEQ ID NO: 157824 - RNA, 22 nt, Homo sapiens
ucacuggaggagaggaagugga

SEQ ID NO: 157825 - RNA, 21 nt, Homo sapiens
ucagcucaucacugccuggag

SEQ ID NO: 157826 - RNA, 22 nt, Homo sapiens
ucaguguuuggaaucucaauuu

SEQ ID NO: 157827 - RNA, 22 nt, Homo sapiens
ucauacuguugugaaacaaaac

SEQ ID NO: 157828 - RNA, 22 nt, Homo sapiens
uccagaguggugaugcuggggc

SEQ ID NO: 157829 - RNA, 22 nt, Homo sapiens
uccugagucagcauccguuugu

SEQ ID NO: 157830 - RNA, 22 nt, Homo sapiens
uccuugagucuuugcucagaug

SEQ ID NO: 157831 - RNA, 21 nt, Homo sapiens
uccuuggugaugcccugcagu

SEQ ID NO: 157832 - RNA, 22 nt, Homo sapiens
uccuuuggguagcuguucagau

SEQ ID NO: 157833 - RNA, 22 nt, Homo sapiens
ucuucuagcggaacccucuugu

SEQ ID NO: 157834 - RNA, 22 nt, Homo sapiens
ucuugcuuguuguucccuucau

SEQ ID NO: 157835 - RNA, 21 nt, Homo sapiens
ucuuggguugaauucucccag

SEQ ID NO: 157836 - RNA, 22 nt, Homo sapiens
ucuuugauaagauccagaagaa

SEQ ID NO: 157837 - RNA, 22 nt, Homo sapiens
ugaaaugauuauaugguguuug

SEQ ID NO: 157838 - RNA, 22 nt, Homo sapiens
ugaagugaaugguaaguaugcc

SEQ ID NO: 157839 - RNA, 22 nt, Homo sapiens
ugacaagaguagagagggugcc

SEQ ID NO: 157840 - RNA, 22 nt, Homo sapiens
ugacaagauauggucuuaucaa

SEQ ID NO: 157841 - RNA, 22 nt, Homo sapiens
ugacaggagauuaugugauguu

SEQ ID NO: 157842 - RNA, 22 nt, Homo sapiens
ugaccacugucuaagauaggug

SEQ ID NO: 157843 - RNA, 19 nt, Homo sapiens
ugagaauguuaccaggucc

SEQ ID NO: 157844 - RNA, 22 nt, Homo sapiens
ugagagcuuuuuugccugguga

SEQ ID NO: 157845 - RNA, 22 nt, Homo sapiens
ugagauaacuaaaaacauuuug

SEQ ID NO: 157846 - RNA, 22 nt, Homo sapiens
ugagaugcauauucuggcuccu

SEQ ID NO: 157847 - RNA, 21 nt, Homo sapiens
ugagcauuaguacaguaggga

SEQ ID NO: 157848 - RNA, 18 nt, Homo sapiens
ugaggaaaggguuugcua

SEQ ID NO: 157849 - RNA, 22 nt, Homo sapiens
ugauuggagaacaaacugcaua

SEQ ID NO: 157850 - RNA, 22 nt, Homo sapiens
ugcaccauugucaccuggguga

SEQ ID NO: 157851 - RNA, 22 nt, Homo sapiens
ugcaguaggcccagcgggaggc

SEQ ID NO: 157852 - RNA, 22 nt, Homo sapiens
ugcauauguugaaccagccuug

SEQ ID NO: 157853 - RNA, 22 nt, Homo sapiens
ugcauauguugagaugcauauu

SEQ ID NO: 157854 - RNA, 22 nt, Homo sapiens
ugccagagacguagggaauauu

SEQ ID NO: 157855 - RNA, 20 nt, Homo sapiens
ugcugcacuuaagcaugggc

SEQ ID NO: 157856 - RNA, 22 nt, Homo sapiens
uggcagcgugaauguggcugaa

SEQ ID NO: 157857 - RNA, 22 nt, Homo sapiens
uggcauguguuugaaugaguau

SEQ ID NO: 157858 - RNA, 22 nt, Homo sapiens
uggcuguuuauuucaccugggu

SEQ ID NO: 157859 - RNA, 22 nt, Homo sapiens
uggcuuucuggggcuucuguuc

SEQ ID NO: 157860 - RNA, 22 nt, Homo sapiens
ugggaagaagguuuacuugcca

SEQ ID NO: 157861 - RNA, 22 nt, Homo sapiens
ugugaugcagggccugggccuc

SEQ ID NO: 157862 - RNA, 22 nt, Homo sapiens
aaagugcugagacagacuggga

SEQ ID NO: 157863 - RNA, 22 nt, Homo sapiens
aagagguagaagcuugccuucu

SEQ ID NO: 157864 - RNA, 23 nt, Homo sapiens
aagagguaugacuaugaagugga

SEQ ID NO: 157865 - RNA, 22 nt, Homo sapiens
aaggagugugauucuucaguuu

SEQ ID NO: 157866 - RNA, 18 nt, Homo sapiens
aaggugcuucuguucuga

SEQ ID NO: 157867 - RNA, 22 nt, Homo sapiens
aaggugguuuucucuuggaguc

SEQ ID NO: 157868 - RNA, 22 nt, Homo sapiens
aauacugaaaguauuuucaaau

SEQ ID NO: 157869 - RNA, 22 nt, Homo sapiens
aauacugagaugugagguacua

SEQ ID NO: 157870 - RNA, 22 nt, Homo sapiens
aauuaguuggcugccuaugauu

SEQ ID NO: 157871 - RNA, 22 nt, Homo sapiens
acacaguaaauauugucuccuc

SEQ ID NO: 157872 - RNA, 17 nt, Homo sapiens
acagugcuuugcuuucc

SEQ ID NO: 157873 - RNA, 22 nt, Homo sapiens
accauugcacuucagccuaggc

SEQ ID NO: 157874 - RNA, 22 nt, Homo sapiens
acccugguagcuaugaagucuu

SEQ ID NO: 157875 - RNA, 23 nt, Homo sapiens
acugagcaauguuuacauacuug

SEQ ID NO: 157876 - RNA, 17 nt, Homo sapiens
agcagcccauaucccca

SEQ ID NO: 157877 - RNA, 22 nt, Homo sapiens
agcaguagugaaaguagacuua

SEQ ID NO: 157878 - RNA, 22 nt, Homo sapiens
agcuaaaucucauguugaauug

SEQ ID NO: 157879 - RNA, 22 nt, Homo sapiens
agcuggauguggaugacccugu

SEQ ID NO: 157880 - RNA, 22 nt, Homo sapiens
aggaaugucaaugguaguuuaa

SEQ ID NO: 157881 - RNA, 22 nt, Homo sapiens
aggaauguuaguacuucuuagu

SEQ ID NO: 157882 - RNA, 22 nt, Homo sapiens
agggcauuguacaaaucaucau

SEQ ID NO: 157883 - RNA, 22 nt, Homo sapiens
agggcuuguuuaacuaucauua

SEQ ID NO: 157884 - RNA, 19 nt, Homo sapiens
agugagccaagauccuacc

SEQ ID NO: 157885 - RNA, 22 nt, Homo sapiens
agugcaguggcacaaucuuggc

SEQ ID NO: 157886 - RNA, 22 nt, Homo sapiens
aguggcacaauuuugacucccc

SEQ ID NO: 157887 - RNA, 22 nt, Homo sapiens
auacagugaauacuuacagugu

SEQ ID NO: 157888 - RNA, 19 nt, Homo sapiens
uagggcacgaggcagaguc

SEQ ID NO: 157889 - RNA, 22 nt, Homo sapiens
uagggcuugugaucagguguag

SEQ ID NO: 157890 - RNA, 22 nt, Homo sapiens
uagggcuuuuccaagcugccac

SEQ ID NO: 157891 - RNA, 22 nt, Homo sapiens
uaugcacuaggcacuguguuug

SEQ ID NO: 157892 - RNA, 22 nt, Homo sapiens
uauucacaggugugggacaaag

SEQ ID NO: 157893 - RNA, 22 nt, Homo sapiens
uauuccauuugugaaaggaagu

SEQ ID NO: 157894 - RNA, 22 nt, Homo sapiens
uauugcauauuauucuaguggc

SEQ ID NO: 157895 - RNA, 22 nt, Homo sapiens
uauugcauguugagcaguaccu

SEQ ID NO: 157896 - RNA, 22 nt, Homo sapiens
uauugcuuaugaugcugaauua

SEQ ID NO: 157897 - RNA, 22 nt, Homo sapiens
ucaaacacuccauaucgcgauu

SEQ ID NO: 157898 - RNA, 22 nt, Homo sapiens
ucaaagugcuauggcucagguu

SEQ ID NO: 157899 - RNA, 22 nt, Homo sapiens
ucacagucggugacuucuugcu

SEQ ID NO: 157900 - RNA, 22 nt, Homo sapiens
ucacugaaaccgccuccaccuc

SEQ ID NO: 157901 - RNA, 22 nt, Homo sapiens
ucaguccccucgcugagucuac

SEQ ID NO: 157902 - RNA, 22 nt, Homo sapiens
ucauacaguaguccucacuugu

SEQ ID NO: 157903 - RNA, 22 nt, Homo sapiens
ucaugguuuuauaacccucuug

SEQ ID NO: 157904 - RNA, 22 nt, Homo sapiens
uccagguuuggcuuuauaacuu

SEQ ID NO: 157905 - RNA, 22 nt, Homo sapiens
uccagguuuugugaguuuaaau

SEQ ID NO: 157906 - RNA, 23 nt, Homo sapiens
ucccaagauggaccagaccaagg

SEQ ID NO: 157907 - RNA, 22 nt, Homo sapiens
uccucauggagaaccucugcua

SEQ ID NO: 157908 - RNA, 23 nt, Homo sapiens
uccuugguuggcgcccuaugugu

SEQ ID NO: 157909 - RNA, 22 nt, Homo sapiens
uccuuuggcuaacuuucuaagu

SEQ ID NO: 157910 - RNA, 22 nt, Homo sapiens
ucucaguggugcuggcagggga

SEQ ID NO: 157911 - RNA, 19 nt, Homo sapiens
ucucaguguuggucaggug

SEQ ID NO: 157912 - RNA, 20 nt, Homo sapiens
ucucccaaacagcaggcccu

SEQ ID NO: 157913 - RNA, 22 nt, Homo sapiens
ucucugaaacucuugacauccu

SEQ ID NO: 157914 - RNA, 19 nt, Homo sapiens
ucucugguguuggagggga

SEQ ID NO: 157915 - RNA, 21 nt, Homo sapiens
ucuggcuuucauuccccuucu

SEQ ID NO: 157916 - RNA, 22 nt, Homo sapiens
ucuggguuuuguaccgugcucg

SEQ ID NO: 157917 - RNA, 22 nt, Homo sapiens
ucugguuccugcauucauucaa

SEQ ID NO: 157918 - RNA, 22 nt, Homo sapiens
ucugguuccuuggcuucggguc

SEQ ID NO: 157919 - RNA, 22 nt, Homo sapiens
ucuuggguuguuggcuucuccu

SEQ ID NO: 157920 - RNA, 22 nt, Homo sapiens
ucuuggguuuguccuucuccua

SEQ ID NO: 157921 - RNA, 22 nt, Homo sapiens
ucuuuagguguuauaguucaag

SEQ ID NO: 157922 - RNA, 20 nt, Homo sapiens
ucuuucgguuaccaggcagu

SEQ ID NO: 157923 - RNA, 22 nt, Homo sapiens
ucuuugccuaacccaaggucau

SEQ ID NO: 157924 - RNA, 22 nt, Homo sapiens
ucuuugguuguuuagggugcau

SEQ ID NO: 157925 - RNA, 22 nt, Homo sapiens
ugaaauguugggugauggaauc

SEQ ID NO: 157926 - RNA, 23 nt, Homo sapiens
ugaauguaucgaaugugggaaag

SEQ ID NO: 157927 - RNA, 22 nt, Homo sapiens
ugagaagugacgcagcaggguu

SEQ ID NO: 157928 - RNA, 22 nt, Homo sapiens
ugagacggagucucgcucuguc

SEQ ID NO: 157929 - RNA, 22 nt, Homo sapiens
ugagcagugagugugcugcagg

SEQ ID NO: 157930 - RNA, 22 nt, Homo sapiens
ugagcagugaguguggugcagg

SEQ ID NO: 157931 - RNA, 22 nt, Homo sapiens
ugagcauauuuaagguaugcua

SEQ ID NO: 157932 - RNA, 22 nt, Homo sapiens
ugaugguccauaguucauggua

SEQ ID NO: 157933 - RNA, 22 nt, Homo sapiens
ugcaccaucuugcuucuguggu

SEQ ID NO: 157934 - RNA, 22 nt, Homo sapiens
ugcaccauuacacuccaggcug

SEQ ID NO: 157935 - RNA, 22 nt, Homo sapiens
ugcaccauugcacuccagccug

SEQ ID NO: 157936 - RNA, 22 nt, Homo sapiens
ugcauaugcagcauuuaugauu

SEQ ID NO: 157937 - RNA, 22 nt, Homo sapiens
ugcauauguauacaugugccau

SEQ ID NO: 157938 - RNA, 18 nt, Homo sapiens
ugcauauguugaaccagc

SEQ ID NO: 157939 - RNA, 22 nt, Homo sapiens
uggaaugcuaagcaugugggag

SEQ ID NO: 157940 - RNA, 22 nt, Homo sapiens
uggaggacugcagaacugaggc

SEQ ID NO: 157941 - RNA, 22 nt, Homo sapiens
uggauagauacuauccaggacu

SEQ ID NO: 157942 - RNA, 22 nt, Homo sapiens
uggcaccugacuccgagaugca

SEQ ID NO: 157943 - RNA, 22 nt, Homo sapiens
uggcaugcauuguggguaauua

SEQ ID NO: 157944 - RNA, 22 nt, Homo sapiens
uggcuguuuauuucacaugggu

SEQ ID NO: 157945 - RNA, 22 nt, Homo sapiens
uggcuguuuauuucaccugggc

SEQ ID NO: 157946 - RNA, 22 nt, Homo sapiens
uggcuguuuauuucacgugggu

SEQ ID NO: 157947 - RNA, 22 nt, Homo sapiens
ugggaagagggagcgauuuugg

SEQ ID NO: 157948 - RNA, 22 nt, Homo sapiens
uggguagagaaucaggaucuua

SEQ ID NO: 157949 - RNA, 22 nt, Homo sapiens
ugggugaguaucuauuauucag

SEQ ID NO: 157950 - RNA, 22 nt, Homo sapiens
ugggugugaccgcucaaggggg

SEQ ID NO: 157951 - RNA, 23 nt, Homo sapiens
uggguucauucuugaagucagug

SEQ ID NO: 157952 - RNA, 21 nt, Homo sapiens
uguccagcuuuuggaauauaa

SEQ ID NO: 157953 - RNA, 22 nt, Homo sapiens
uguccuggugaugcccaaauuc

SEQ ID NO: 157954 - RNA, 22 nt, Homo sapiens
ugucucaguucccuucucugga

SEQ ID NO: 157955 - RNA, 22 nt, Homo sapiens
ugugaagauggacuaauauagu

SEQ ID NO: 157956 - RNA, 19 nt, Homo sapiens
ugugagcauuagcauuuag

SEQ ID NO: 157957 - RNA, 22 nt, Homo sapiens
uguggccuuuguuucaguuggg

SEQ ID NO: 157958 - RNA, 22 nt, Homo sapiens
uuacacaguugguaggggcaga

SEQ ID NO: 157959 - RNA, 22 nt, Homo sapiens
uuagcacaguucauucauguua

SEQ ID NO: 157960 - RNA, 22 nt, Homo sapiens
uuaucaaacccuaggagguggu

SEQ ID NO: 157961 - RNA, 22 nt, Homo sapiens
uuauguccuuuaacuucaucac

SEQ ID NO: 157962 - RNA, 22 nt, Homo sapiens
uucacacugggccuacucugug

SEQ ID NO: 157963 - RNA, 20 nt, Homo sapiens
uucacaggcagcuucuuucu

SEQ ID NO: 157964 - RNA, 22 nt, Homo sapiens
uucauggagccauccuuugauc

SEQ ID NO: 157965 - RNA, 22 nt, Homo sapiens
uuccacaggguugaacuaguuu

SEQ ID NO: 157966 - RNA, 22 nt, Homo sapiens
uuccaguaauagcacagcauug

SEQ ID NO: 157967 - RNA, 22 nt, Homo sapiens
uuccaugugggcuugucaagua

SEQ ID NO: 157968 - RNA, 22 nt, Homo sapiens
uuccauguugauacgugaaguu

SEQ ID NO: 157969 - RNA, 20 nt, Homo sapiens
uucccucagccuugagggua

SEQ ID NO: 157970 - RNA, 22 nt, Homo sapiens
uucccuuugaaacuaaacuugc

SEQ ID NO: 157971 - RNA, 22 nt, Homo sapiens
uucuagcacuuugggagacuga

SEQ ID NO: 157972 - RNA, 19 nt, Homo sapiens
uucucugguuguacuaccc

SEQ ID NO: 157973 - RNA, 22 nt, Homo sapiens
uucuggcucaggucaacacuuc

SEQ ID NO: 157974 - RNA, 22 nt, Homo sapiens
uugaaagaugaacuggauugga

SEQ ID NO: 157975 - RNA, 22 nt, Homo sapiens
uugaaagucauggcacaggcaa

SEQ ID NO: 157976 - RNA, 21 nt, Homo sapiens
augagauguuagacuuuagac

SEQ ID NO: 157977 - RNA, 22 nt, Homo sapiens
augaggcaggaaaggcguaucu

SEQ ID NO: 157978 - RNA, 22 nt, Homo sapiens
augcaauggaaaggacaauuac

SEQ ID NO: 157979 - RNA, 22 nt, Homo sapiens
augccauugcacuccagccuag

SEQ ID NO: 157980 - RNA, 22 nt, Homo sapiens
auggaacuggagaugguuauau

SEQ ID NO: 157981 - RNA, 21 nt, Homo sapiens
auggacugugugacccugcac

SEQ ID NO: 157982 - RNA, 22 nt, Homo sapiens
auggaguguaauauugagagcu

SEQ ID NO: 157983 - RNA, 22 nt, Homo sapiens
auggcacuacugggaaugucuu

SEQ ID NO: 157984 - RNA, 22 nt, Homo sapiens
augggcacugauguauucugug

SEQ ID NO: 157985 - RNA, 22 nt, Homo sapiens
augugacagugguuuuaagcgu

SEQ ID NO: 157986 - RNA, 22 nt, Homo sapiens
augugacuugugaaaaguucag

SEQ ID NO: 157987 - RNA, 22 nt, Homo sapiens
auguggaaagcagcaugauaug

SEQ ID NO: 157988 - RNA, 22 nt, Homo sapiens
auuaaucaggcaaugcuugcua

SEQ ID NO: 157989 - RNA, 22 nt, Homo sapiens
auucaaggacuggauugcggga

SEQ ID NO: 157990 - RNA, 22 nt, Homo sapiens
auucauagugcuaagguguauc

SEQ ID NO: 157991 - RNA, 22 nt, Homo sapiens
auugagcacugacucugugcca

SEQ ID NO: 157992 - RNA, 19 nt, Homo sapiens
auugcacuccaaccugggu

SEQ ID NO: 157993 - RNA, 22 nt, Homo sapiens
auugcacuccagcccgggugac

SEQ ID NO: 157994 - RNA, 22 nt, Homo sapiens
auugcacuccagccuggaugac

SEQ ID NO: 157995 - RNA, 21 nt, Homo sapiens
auugcacuccagccugggcga

SEQ ID NO: 157996 - RNA, 22 nt, Homo sapiens
auugcacuccagcuugggugac

SEQ ID NO: 157997 - RNA, 22 nt, Homo sapiens
auugcacuccauccuaggugac

SEQ ID NO: 157998 - RNA, 22 nt, Homo sapiens
auugcacuccggccugggugac

SEQ ID NO: 157999 - RNA, 22 nt, Homo sapiens
auugcacucuaaccuaggugac

SEQ ID NO: 158000 - RNA, 22 nt, Homo sapiens
auugcaguuucaacuccagggc

SEQ ID NO: 158001 - RNA, 22 nt, Homo sapiens
cacagugaacugguggguuuuu

SEQ ID NO: 158002 - RNA, 22 nt, Homo sapiens
cagcgaggucugcgucacauug

SEQ ID NO: 158003 - RNA, 22 nt, Homo sapiens
caggcagucuggcucccaagug

SEQ ID NO: 158004 - RNA, 22 nt, Homo sapiens
caggcagucuggggguguaucc

SEQ ID NO: 158005 - RNA, 22 nt, Homo sapiens
cagguacauuuuaaagggcuca

SEQ ID NO: 158006 - RNA, 22 nt, Homo sapiens
cagugauaggugguuguuggca

SEQ ID NO: 158007 - RNA, 18 nt, Homo sapiens
cagugcaauacaggagag

SEQ ID NO: 158008 - RNA, 22 nt, Homo sapiens
caguggaugaacaagaagugau

SEQ ID NO: 158009 - RNA, 22 nt, Homo sapiens
caucacagcaaguagggagugg

SEQ ID NO: 158010 - RNA, 22 nt, Homo sapiens
cauggcccugggcugggcgaac

SEQ ID NO: 158011 - RNA, 22 nt, Homo sapiens
cauugcacuccagccuugguga

SEQ ID NO: 158012 - RNA, 22 nt, Homo sapiens
cauugguuccaguuuguccuua

SEQ ID NO: 158013 - RNA, 22 nt, Homo sapiens
cauugguuggacaguucucucu

SEQ ID NO: 158014 - RNA, 19 nt, Homo sapiens
ccacaaugguugaacuaga

SEQ ID NO: 158015 - RNA, 22 nt, Homo sapiens
ccagaguugccucagguuucug

SEQ ID NO: 158016 - RNA, 22 nt, Homo sapiens
ccaguauugaacacaaugaaag

SEQ ID NO: 158017 - RNA, 22 nt, Homo sapiens
ccagugcauggaucccaggggg

SEQ ID NO: 158018 - RNA, 22 nt, Homo sapiens
ccaguuuucccagcaccauuaa

SEQ ID NO: 158019 - RNA, 22 nt, Homo sapiens
ccauugcacuccauccugggca

SEQ ID NO: 158020 - RNA, 23 nt, Homo sapiens
cccucagaagugcagggagagaa

SEQ ID NO: 158021 - RNA, 22 nt, Homo sapiens
ccuaggcacugggguccagccc

SEQ ID NO: 158022 - RNA, 22 nt, Homo sapiens
ccuucacaggcacugguucaga

SEQ ID NO: 158023 - RNA, 23 nt, Homo sapiens
cuacuagucaagucuuuuccagu

SEQ ID NO: 158024 - RNA, 22 nt, Homo sapiens
cuagaauguauaaaaccaagcu

SEQ ID NO: 158025 - RNA, 18 nt, Homo sapiens
cucacaguaacuuuuaag

SEQ ID NO: 158026 - RNA, 22 nt, Homo sapiens
cucaugcugucuucugggguaa

SEQ ID NO: 158027 - RNA, 19 nt, Homo sapiens
cucauggagaaggagaaua

SEQ ID NO: 158028 - RNA, 22 nt, Homo sapiens
cuccaugagauuguugaaguag

SEQ ID NO: 158029 - RNA, 22 nt, Homo sapiens
cuccccuuuaguuucuuaauaa

SEQ ID NO: 158030 - RNA, 22 nt, Homo sapiens
cugaauguucuggauggaagag

SEQ ID NO: 158031 - RNA, 22 nt, Homo sapiens
cugaggcacggcgaccuuaagu

SEQ ID NO: 158032 - RNA, 22 nt, Homo sapiens
cugagguacugggggccaggau

SEQ ID NO: 158033 - RNA, 22 nt, Homo sapiens
cugggaucaguucuagucagaa

SEQ ID NO: 158034 - RNA, 22 nt, Homo sapiens
cuuccagcuggguucagucagu

SEQ ID NO: 158035 - RNA, 22 nt, Homo sapiens
cuugaauguaaauaauguacag

SEQ ID NO: 158036 - RNA, 22 nt, Homo sapiens
cuuggcacgugauagguguuga

SEQ ID NO: 158037 - RNA, 22 nt, Homo sapiens
cuugggccccacccaaaucuua

SEQ ID NO: 158038 - RNA, 22 nt, Homo sapiens
cuuuuacacuguuagugggaau

SEQ ID NO: 158039 - RNA, 23 nt, Homo sapiens
cuuuugcaaugugaucuugccac

SEQ ID NO: 158040 - RNA, 22 nt, Homo sapiens
gaaauguauuaaugaguugaaa

SEQ ID NO: 158041 - RNA, 22 nt, Homo sapiens
gaagaacuaggugagaucuaga

SEQ ID NO: 158042 - RNA, 22 nt, Homo sapiens
gaaucacagauuaugaguaucu

SEQ ID NO: 158043 - RNA, 22 nt, Homo sapiens
gaaugcaugaggggaucagaug

SEQ ID NO: 158044 - RNA, 22 nt, Homo sapiens
gaauggaacugacuauagcuga

SEQ ID NO: 158045 - RNA, 20 nt, Homo sapiens
gacauggaggaggauuauua

SEQ ID NO: 158046 - RNA, 22 nt, Homo sapiens
gacuucaucauacuaugugugg

SEQ ID NO: 158047 - RNA, 22 nt, Homo sapiens
gagacugagucuugcucugucg

SEQ ID NO: 158048 - RNA, 22 nt, Homo sapiens
gagagcaugugcuggcaucagu

SEQ ID NO: 158049 - RNA, 21 nt, Homo sapiens
gagaggauucgccagccucuu

SEQ ID NO: 158050 - RNA, 22 nt, Homo sapiens
gagagugcuuggcaucugcuga

SEQ ID NO: 158051 - RNA, 22 nt, Homo sapiens
gagcacauguggagagucuggg

SEQ ID NO: 158052 - RNA, 22 nt, Homo sapiens
gagcaccagucccugucagugc

SEQ ID NO: 158053 - RNA, 22 nt, Homo sapiens
gaggaucucuugagcccagaag

SEQ ID NO: 158054 - RNA, 22 nt, Homo sapiens
gaggcagucugacccuuagcag

SEQ ID NO: 158055 - RNA, 22 nt, Homo sapiens
gaggcagucuguccauucucag

SEQ ID NO: 158056 - RNA, 22 nt, Homo sapiens
gaggcaguguguccguucucgg

SEQ ID NO: 158057 - RNA, 22 nt, Homo sapiens
gaggcuagauggggaugugucc

SEQ ID NO: 158058 - RNA, 22 nt, Homo sapiens
gagguaaguaagaauggcaagc

SEQ ID NO: 158059 - RNA, 22 nt, Homo sapiens
gaguucaauuuccagcuguucu

SEQ ID NO: 158060 - RNA, 22 nt, Homo sapiens
gauagguucuaagcagguguug

SEQ ID NO: 158061 - RNA, 22 nt, Homo sapiens
gauauguuucuucaauaccuag

SEQ ID NO: 158062 - RNA, 22 nt, Homo sapiens
gauuagaacagaagucagauua

SEQ ID NO: 158063 - RNA, 22 nt, Homo sapiens
gcacaguguuacuugauauauu

SEQ ID NO: 158064 - RNA, 22 nt, Homo sapiens
gcagugaugugaucauagcuca

SEQ ID NO: 158065 - RNA, 22 nt, Homo sapiens
gcagugcaguggcgcgaucucg

SEQ ID NO: 158066 - RNA, 18 nt, Homo sapiens
gccaacauguaaacaggu

SEQ ID NO: 158067 - RNA, 22 nt, Homo sapiens
gccauugcacuccagccuaggc

SEQ ID NO: 158068 - RNA, 22 nt, Homo sapiens
ucuggccuagaacaauuaauua

SEQ ID NO: 158069 - RNA, 22 nt, Homo sapiens
ucuuggcaaagaauuuuuggcu

SEQ ID NO: 158070 - RNA, 22 nt, Homo sapiens
ugaaaugguuaugugaggagau

SEQ ID NO: 158071 - RNA, 22 nt, Homo sapiens
ugaagaucuuaggagcugaggg

SEQ ID NO: 158072 - RNA, 22 nt, Homo sapiens
ugaaggacauucuaugguagau

SEQ ID NO: 158073 - RNA, 22 nt, Homo sapiens
ugaauagacagucacugccucc

SEQ ID NO: 158074 - RNA, 22 nt, Homo sapiens
ugaaugcaucauguagggcuca

SEQ ID NO: 158075 - RNA, 22 nt, Homo sapiens
ugacaagacuacauaucccauu

SEQ ID NO: 158076 - RNA, 22 nt, Homo sapiens
ugacaagaguagagagggugcc

SEQ ID NO: 158077 - RNA, 22 nt, Homo sapiens
ugacagaggucuuuuaauagcu

SEQ ID NO: 158078 - RNA, 22 nt, Homo sapiens
ugacaguaucuacagcuucuua

SEQ ID NO: 158079 - RNA, 22 nt, Homo sapiens
ugacaucaccaccuccgucauc

SEQ ID NO: 158080 - RNA, 22 nt, Homo sapiens
ugacauggagggugcggcugca

SEQ ID NO: 158081 - RNA, 22 nt, Homo sapiens
ugacauugggagugaagugaag

SEQ ID NO: 158082 - RNA, 22 nt, Homo sapiens
ugacuaaggaaggauuaugugc

SEQ ID NO: 158083 - RNA, 22 nt, Homo sapiens
ugacucagauagguguguauuc

SEQ ID NO: 158084 - RNA, 22 nt, Homo sapiens
ugacugucuagauagagcuugg

SEQ ID NO: 158085 - RNA, 22 nt, Homo sapiens
ugagaaugaugauugguaaacc

SEQ ID NO: 158086 - RNA, 22 nt, Homo sapiens
ugagaaugaugauuuccaguuu

SEQ ID NO: 158087 - RNA, 21 nt, Homo sapiens
ugagacaauccuggucaauau

SEQ ID NO: 158088 - RNA, 22 nt, Homo sapiens
ugagacgaagucuugcucuguu

SEQ ID NO: 158089 - RNA, 21 nt, Homo sapiens
ugagaugcaaucaccagggag

SEQ ID NO: 158090 - RNA, 20 nt, Homo sapiens
ugagaugcauugggauguuu

SEQ ID NO: 158091 - RNA, 21 nt, Homo sapiens
ugagauuauauuaacauggua

SEQ ID NO: 158092 - RNA, 22 nt, Homo sapiens
ugagcaucauucacaccuuggu

SEQ ID NO: 158093 - RNA, 20 nt, Homo sapiens
ugagccccuggacucaagcg

SEQ ID NO: 158094 - RNA, 22 nt, Homo sapiens
ugagguagaggugaacuugacc

SEQ ID NO: 158095 - RNA, 22 nt, Homo sapiens
ugcaaaguccucauucuuaccc

SEQ ID NO: 158096 - RNA, 22 nt, Homo sapiens
ugcaaucaucgcuguuggccac

SEQ ID NO: 158097 - RNA, 19 nt, Homo sapiens
ugccaagaaagucagcuua

SEQ ID NO: 158098 - RNA, 22 nt, Homo sapiens
ugccuaggcccaguccucagaa

SEQ ID NO: 158099 - RNA, 22 nt, Homo sapiens
ugcugcuguuguuguuacuagc

SEQ ID NO: 158100 - RNA, 22 nt, Homo sapiens
ugcuguuguuugaugaaguaau

SEQ ID NO: 158101 - RNA, 22 nt, Homo sapiens
uggaaucuuaggugaaggcuuu

SEQ ID NO: 158102 - RNA, 22 nt, Homo sapiens
uggaauguaacuugaaacuuuu

SEQ ID NO: 158103 - RNA, 22 nt, Homo sapiens
uggaauguauaucguuuuuugu

SEQ ID NO: 158104 - RNA, 22 nt, Homo sapiens
uggaauguuauggcuuuaaucu

SEQ ID NO: 158105 - RNA, 22 nt, Homo sapiens
uggagagcaaaaucaauccaaa

SEQ ID NO: 158106 - RNA, 22 nt, Homo sapiens
uggagggcuagucauuucuuuu

SEQ ID NO: 158107 - RNA, 22 nt, Homo sapiens
uggagguaggacgaagaacucu

SEQ ID NO: 158108 - RNA, 22 nt, Homo sapiens
uggaggucauuggaucaugggg

SEQ ID NO: 158109 - RNA, 22 nt, Homo sapiens
uggagucuugcucuguugccca

SEQ ID NO: 158110 - RNA, 22 nt, Homo sapiens
uggagugaaaacacacuaaucu

SEQ ID NO: 158111 - RNA, 21 nt, Homo sapiens
uggagugaagaguuuauugac

SEQ ID NO: 158112 - RNA, 22 nt, Homo sapiens
uggcagcgugaauguggcugaa

SEQ ID NO: 158113 - RNA, 22 nt, Homo sapiens
uggcauggaguggauggcccca

SEQ ID NO: 158114 - RNA, 22 nt, Homo sapiens
uggcauggucugcccaaguuuc

SEQ ID NO: 158115 - RNA, 22 nt, Homo sapiens
uggcauguagucugggaccugg

SEQ ID NO: 158116 - RNA, 22 nt, Homo sapiens
uggcauuguccaauaaaauuuu

SEQ ID NO: 158117 - RNA, 22 nt, Homo sapiens
ugggcggagacgugcagccgcc

SEQ ID NO: 158118 - RNA, 22 nt, Homo sapiens
uggguccccuacucuuuccaca

SEQ ID NO: 158119 - RNA, 21 nt, Homo sapiens
uggucccauaagauuacaaug

SEQ ID NO: 158120 - RNA, 22 nt, Homo sapiens
ugguuccauauuaauuuuagga

SEQ ID NO: 158121 - RNA, 22 nt, Homo sapiens
ugguugaucccaucacccaggu

SEQ ID NO: 158122 - RNA, 20 nt, Homo sapiens
uguaaaggagauugcagcug

SEQ ID NO: 158123 - RNA, 22 nt, Homo sapiens
ugucacguugcuuuucuguugu

SEQ ID NO: 158124 - RNA, 22 nt, Homo sapiens
ugucaugaaauauguuuuucua

SEQ ID NO: 158125 - RNA, 22 nt, Homo sapiens
ugucaugucuuuguguaucaau

SEQ ID NO: 158126 - RNA, 22 nt, Homo sapiens
ugucuguuugcgaaauugcuuc

SEQ ID NO: 158127 - RNA, 16 nt, Homo sapiens
ugucuguuugggcaca

SEQ ID NO: 158128 - RNA, 22 nt, Homo sapiens
ugugaagaaagucauugguagc

SEQ ID NO: 158129 - RNA, 22 nt, Homo sapiens
ugugauuauuuauagacaguca

SEQ ID NO: 158130 - RNA, 22 nt, Homo sapiens
ugugcacaauguacagguuagu

SEQ ID NO: 158131 - RNA, 20 nt, Homo sapiens
uguggcacuguaucucucag

SEQ ID NO: 158132 - RNA, 22 nt, Homo sapiens
uguuucuacugucucuguagua

SEQ ID NO: 158133 - RNA, 22 nt, Homo sapiens
uuaauuguaucuauagauguca

SEQ ID NO: 158134 - RNA, 22 nt, Homo sapiens
uuagcagcaugagaauggacua

SEQ ID NO: 158135 - RNA, 22 nt, Homo sapiens
uuagcagugugagcacagacua

SEQ ID NO: 158136 - RNA, 22 nt, Homo sapiens
uuaguucccucauucuugacuu

SEQ ID NO: 158137 - RNA, 22 nt, Homo sapiens
uuaugacaggcucaggagcccc

SEQ ID NO: 158138 - RNA, 22 nt, Homo sapiens
uucaaguagguaggaccacagg

SEQ ID NO: 158139 - RNA, 21 nt, Homo sapiens
uucacaagggaaguagggggc

SEQ ID NO: 158140 - RNA, 22 nt, Homo sapiens
uucaguagucuccauagaaccg

SEQ ID NO: 158141 - RNA, 18 nt, Homo sapiens
uucaguuuguaucugggg

SEQ ID NO: 158142 - RNA, 22 nt, Homo sapiens
uucauggagccauccuuugauc

SEQ ID NO: 158143 - RNA, 20 nt, Homo sapiens
uuccagcacauuagggaagc

SEQ ID NO: 158144 - RNA, 22 nt, Homo sapiens
uucccagagagggacuucuaau

SEQ ID NO: 158145 - RNA, 22 nt, Homo sapiens
uucuagcacuuugggagacuga

SEQ ID NO: 158146 - RNA, 22 nt, Homo sapiens
uucucacaguacagggagcucu

SEQ ID NO: 158147 - RNA, 17 nt, Homo sapiens
uucucaguucugaucuc

SEQ ID NO: 158148 - RNA, 22 nt, Homo sapiens
uugagauggagucuugcgcugu

SEQ ID NO: 158149 - RNA, 22 nt, Homo sapiens
uugagauggagucuugcucucu

SEQ ID NO: 158150 - RNA, 22 nt, Homo sapiens
uugagauggaguguugcucugu

SEQ ID NO: 158151 - RNA, 22 nt, Homo sapiens
uugagauguauguauauaaugu

SEQ ID NO: 158152 - RNA, 22 nt, Homo sapiens
uugagcaaugaacgauucaggg

SEQ ID NO: 158153 - RNA, 22 nt, Homo sapiens
uugagcauugguauagguuuua

SEQ ID NO: 158154 - RNA, 22 nt, Homo sapiens
uugcuauguugcccagucugga

SEQ ID NO: 158155 - RNA, 22 nt, Homo sapiens
uuggacugagaguuccaccauu

SEQ ID NO: 158156 - RNA, 22 nt, Homo sapiens
uuggcaaagugucuggcauuua

SEQ ID NO: 158157 - RNA, 22 nt, Homo sapiens
uuggcauuguggauggaaucau

SEQ ID NO: 158158 - RNA, 22 nt, Homo sapiens
uuggcauuuauucuaaggucaa

SEQ ID NO: 158159 - RNA, 22 nt, Homo sapiens
uuggcauuuuuagucaugggaa

SEQ ID NO: 158160 - RNA, 22 nt, Homo sapiens
uuggcucuggcugggcuccagc

SEQ ID NO: 158161 - RNA, 21 nt, Homo sapiens
uugguucccucugacaggucu

SEQ ID NO: 158162 - RNA, 22 nt, Homo sapiens
uugguuccuuagccuaggacua

SEQ ID NO: 158163 - RNA, 22 nt, Homo sapiens
uuguauguuucugugcacauga

SEQ ID NO: 158164 - RNA, 22 nt, Homo sapiens
uugugcaaaguugugguuucug

SEQ ID NO: 158165 - RNA, 22 nt, Homo sapiens
uuuacccugaggaaucuauuuu

SEQ ID NO: 158166 - RNA, 19 nt, Homo sapiens
uuucacacucgccuacuuc

SEQ ID NO: 158167 - RNA, 22 nt, Homo sapiens
uuuccaguuggaaagccuguuu

SEQ ID NO: 158168 - RNA, 22 nt, Homo sapiens
uuugagauaucuuccaucagua

SEQ ID NO: 158169 - RNA, 22 nt, Homo sapiens
uuuucaguuuuccagguagccg

SEQ ID NO: 158170 - RNA, 22 nt, Homo sapiens
augcagagucccagccccuagc

SEQ ID NO: 158171 - RNA, 22 nt, Homo sapiens
augccacuguuuaugucacuua

SEQ ID NO: 158172 - RNA, 22 nt, Homo sapiens
augccaguguccagaguggguu

SEQ ID NO: 158173 - RNA, 22 nt, Homo sapiens
augccauugcacuccagccugg

SEQ ID NO: 158174 - RNA, 22 nt, Homo sapiens
augcuauguagaugagggccca

SEQ ID NO: 158175 - RNA, 22 nt, Homo sapiens
auggaaacauaagaguauagau

SEQ ID NO: 158176 - RNA, 22 nt, Homo sapiens
auggaaagcuguuccuacacaa

SEQ ID NO: 158177 - RNA, 22 nt, Homo sapiens
auggaaggagaggaaugaauga

SEQ ID NO: 158178 - RNA, 22 nt, Homo sapiens
auggaguguggaacugggaauc

SEQ ID NO: 158179 - RNA, 22 nt, Homo sapiens
auggcaaaaaaugcaauuacuu

SEQ ID NO: 158180 - RNA, 22 nt, Homo sapiens
auggcaguuucagcuauaguuu

SEQ ID NO: 158181 - RNA, 22 nt, Homo sapiens
auggcauugaagaguugucccu

SEQ ID NO: 158182 - RNA, 22 nt, Homo sapiens
auggcuucuuacucuucugcau

SEQ ID NO: 158183 - RNA, 22 nt, Homo sapiens
auggcuuuugaccugguaggau

SEQ ID NO: 158184 - RNA, 22 nt, Homo sapiens
auggucuuuauuguguugagug

SEQ ID NO: 158185 - RNA, 22 nt, Homo sapiens
augucaaggugggugauaguuu

SEQ ID NO: 158186 - RNA, 22 nt, Homo sapiens
auguccauggaaucuguagcaa

SEQ ID NO: 158187 - RNA, 22 nt, Homo sapiens
augugaacaucauagaaugcac

SEQ ID NO: 158188 - RNA, 22 nt, Homo sapiens
augugugaaucccagaaccugu

SEQ ID NO: 158189 - RNA, 23 nt, Homo sapiens
augugugcuuggagagcaggaug

SEQ ID NO: 158190 - RNA, 22 nt, Homo sapiens
auucccuuagcugccucagccu

SEQ ID NO: 158191 - RNA, 22 nt, Homo sapiens
auugcaccccagccugggugac

SEQ ID NO: 158192 - RNA, 22 nt, Homo sapiens
auugcacuccagccugggcgac

SEQ ID NO: 158193 - RNA, 22 nt, Homo sapiens
auugcacuccagccugggugag

SEQ ID NO: 158194 - RNA, 22 nt, Homo sapiens
auugcagcccacccugggugau

SEQ ID NO: 158195 - RNA, 19 nt, Homo sapiens
auuuccuggagcuggucuc

SEQ ID NO: 158196 - RNA, 22 nt, Homo sapiens
caaaggcuguuauaggccagga

SEQ ID NO: 158197 - RNA, 22 nt, Homo sapiens
caccgagguuggagugcagugg

SEQ ID NO: 158198 - RNA, 22 nt, Homo sapiens
caccugagcgggaugcucgccu

SEQ ID NO: 158199 - RNA, 22 nt, Homo sapiens
cacugcauccuccaccuccugg

SEQ ID NO: 158200 - RNA, 22 nt, Homo sapiens
cacuggucagugaaacaguauu

SEQ ID NO: 158201 - RNA, 22 nt, Homo sapiens
cagcaguuguuucggauuggga

SEQ ID NO: 158202 - RNA, 22 nt, Homo sapiens
caggaaugugaggguucccugc

SEQ ID NO: 158203 - RNA, 22 nt, Homo sapiens
caggcauuguccaugcugaagg

SEQ ID NO: 158204 - RNA, 22 nt, Homo sapiens
caggcuuuuccacacauggguu

SEQ ID NO: 158205 - RNA, 22 nt, Homo sapiens
cagguaguguguagcacagcag

SEQ ID NO: 158206 - RNA, 22 nt, Homo sapiens
caguacaauguggaaaaggagu

SEQ ID NO: 158207 - RNA, 22 nt, Homo sapiens
cagugcauccauguucagcagu

SEQ ID NO: 158208 - RNA, 22 nt, Homo sapiens
caucaaaguggagggaaggacc

SEQ ID NO: 158209 - RNA, 22 nt, Homo sapiens
caucagauugagaucaucuaag

SEQ ID NO: 158210 - RNA, 22 nt, Homo sapiens
caucgcacuccagccuggguaa

SEQ ID NO: 158211 - RNA, 22 nt, Homo sapiens
cauuacacuccagccuggguga

SEQ ID NO: 158212 - RNA, 22 nt, Homo sapiens
cauugcaacuucugccucccag

SEQ ID NO: 158213 - RNA, 22 nt, Homo sapiens
cauugcacuccaccuuggguaa

SEQ ID NO: 158214 - RNA, 22 nt, Homo sapiens
cauugcacuccagccuagccaa

SEQ ID NO: 158215 - RNA, 20 nt, Homo sapiens
cauugcacuccagccugcug

SEQ ID NO: 158216 - RNA, 20 nt, Homo sapiens
cauugcacuccagcuugggc

SEQ ID NO: 158217 - RNA, 16 nt, Homo sapiens
cauugcacucuagccu

SEQ ID NO: 158218 - RNA, 22 nt, Homo sapiens
cauugcacucuagucuggguga

SEQ ID NO: 158219 - RNA, 22 nt, Homo sapiens
cauugcacugcuucuugggugu

SEQ ID NO: 158220 - RNA, 22 nt, Homo sapiens
ccagaguuucugauucagcagg

SEQ ID NO: 158221 - RNA, 22 nt, Homo sapiens
ccauugcacuccagccuaggca

SEQ ID NO: 158222 - RNA, 22 nt, Homo sapiens
ccauugcacuucagccuaggug

SEQ ID NO: 158223 - RNA, 22 nt, Homo sapiens
cccagcguucggcauggcugag

SEQ ID NO: 158224 - RNA, 22 nt, Homo sapiens
ccucauggagaaccucugcuag

SEQ ID NO: 158225 - RNA, 22 nt, Homo sapiens
ccuugguggccacaagacauug

SEQ ID NO: 158226 - RNA, 19 nt, Homo sapiens
ccuuugguuuccaugacau

SEQ ID NO: 158227 - RNA, 22 nt, Homo sapiens
cuaagugaguauaauuuuaaga

SEQ ID NO: 158228 - RNA, 21 nt, Homo sapiens
cuaucucaguguuuacauuug

SEQ ID NO: 158229 - RNA, 22 nt, Homo sapiens
cuauguaccuggaacuguauua

SEQ ID NO: 158230 - RNA, 20 nt, Homo sapiens
cucaccagguguaggcugag

SEQ ID NO: 158231 - RNA, 22 nt, Homo sapiens
cucagagcacaguuuaugacag

SEQ ID NO: 158232 - RNA, 22 nt, Homo sapiens
cucauugcaaucuccaccuccc

SEQ ID NO: 158233 - RNA, 17 nt, Homo sapiens
cugaccucauuguguac

SEQ ID NO: 158234 - RNA, 22 nt, Homo sapiens
cugagacuggguaauguauaaa

SEQ ID NO: 158235 - RNA, 20 nt, Homo sapiens
cugaggugggagaaucgcuu

SEQ ID NO: 158236 - RNA, 22 nt, Homo sapiens
cuggaaagaaucaggcuaaacu

SEQ ID NO: 158237 - RNA, 22 nt, Homo sapiens
cuggaaggaaaaacaaccacag

SEQ ID NO: 158238 - RNA, 22 nt, Homo sapiens
gcaaaaaguagugcugguuagg

SEQ ID NO: 158239 - RNA, 20 nt, Homo sapiens
gcaaauggaucccacaagcc

SEQ ID NO: 158240 - RNA, 20 nt, Homo sapiens
gcaacauggccagagugaau

SEQ ID NO: 158241 - RNA, 22 nt, Homo sapiens
gcaagaaucugggaguaaaauu

SEQ ID NO: 158242 - RNA, 22 nt, Homo sapiens
gcaauggaaucccuugaucaau

SEQ ID NO: 158243 - RNA, 22 nt, Homo sapiens
gcacaguggcucccgucuauaa

SEQ ID NO: 158244 - RNA, 22 nt, Homo sapiens
gccauugcacuccagccucggg

SEQ ID NO: 158245 - RNA, 22 nt, Homo sapiens
gcccagauguuuggggucaugg

SEQ ID NO: 158246 - RNA, 22 nt, Homo sapiens
gcuguuugccgccaucgcagac

SEQ ID NO: 158247 - RNA, 23 nt, Homo sapiens
ggaaugaaaccugguuaugauau

SEQ ID NO: 158248 - RNA, 22 nt, Homo sapiens
ggaaugcagugagcauuagaua

SEQ ID NO: 158249 - RNA, 22 nt, Homo sapiens
ggaaugggauuugaagucuggc

SEQ ID NO: 158250 - RNA, 22 nt, Homo sapiens
ggacagugaaugccacuccucc

SEQ ID NO: 158251 - RNA, 22 nt, Homo sapiens
ggacugucagggcuauuaguca

SEQ ID NO: 158252 - RNA, 19 nt, Homo sapiens
ggacugucauggaguaguu

SEQ ID NO: 158253 - RNA, 22 nt, Homo sapiens
ggaggcuaguaaaaagguagaa

SEQ ID NO: 158254 - RNA, 22 nt, Homo sapiens
ggcaaggugcuacagacaguga

SEQ ID NO: 158255 - RNA, 22 nt, Homo sapiens
ggcacaaugucagcucacugca

SEQ ID NO: 158256 - RNA, 22 nt, Homo sapiens
ggcacaauugcagcaauaaaca

SEQ ID NO: 158257 - RNA, 22 nt, Homo sapiens
ggcacgguggcucacaccugua

SEQ ID NO: 158258 - RNA, 22 nt, Homo sapiens
ggcacgguggcucacgccugua

SEQ ID NO: 158259 - RNA, 22 nt, Homo sapiens
gggaagguaaucauuacuugau

SEQ ID NO: 158260 - RNA, 22 nt, Homo sapiens
gggaauguagcaaaucugcaau

SEQ ID NO: 158261 - RNA, 22 nt, Homo sapiens
gggaguagagaguuucucugac

SEQ ID NO: 158262 - RNA, 22 nt, Homo sapiens
gggcauaucacuugaggucagg

SEQ ID NO: 158263 - RNA, 22 nt, Homo sapiens
gggggagugugguacccagcau

SEQ ID NO: 158264 - RNA, 22 nt, Homo sapiens
ggugagcacagaaugcccugag

SEQ ID NO: 158265 - RNA, 22 nt, Homo sapiens
guaaucucagcuacucgggaga

SEQ ID NO: 158266 - RNA, 22 nt, Homo sapiens
guaaucucagcuacuugggagc

SEQ ID NO: 158267 - RNA, 22 nt, Homo sapiens
guaaucucagcuacuugggagu

SEQ ID NO: 158268 - RNA, 22 nt, Homo sapiens
guacauggaaugaaauucaaaa

SEQ ID NO: 158269 - RNA, 22 nt, Homo sapiens
guacauguaugcaugcaugcau

SEQ ID NO: 158270 - RNA, 22 nt, Homo sapiens
guaguggcaugaucuuggcuca

SEQ ID NO: 158271 - RNA, 22 nt, Homo sapiens
guaucccuugcuaucugaaucu

SEQ ID NO: 158272 - RNA, 22 nt, Homo sapiens
gucaaaugcacagaaccauuaa

SEQ ID NO: 158273 - RNA, 22 nt, Homo sapiens
gucaagugaagcagugggagua

SEQ ID NO: 158274 - RNA, 20 nt, Homo sapiens
gucacuggcccagggcuugu

SEQ ID NO: 158275 - RNA, 22 nt, Homo sapiens
gugcaaauuccagcucaacucc

SEQ ID NO: 158276 - RNA, 22 nt, Homo sapiens
gugcacaaaucuuaaauguaca

SEQ ID NO: 158277 - RNA, 22 nt, Homo sapiens
gugcacaugguagguauugagu

SEQ ID NO: 158278 - RNA, 22 nt, Homo sapiens
guggcacaauuaaguagcuauu

SEQ ID NO: 158279 - RNA, 22 nt, Homo sapiens
guggcacgaugaucugggcuca

SEQ ID NO: 158280 - RNA, 22 nt, Homo sapiens
guggcaugaaagcaucugugau

SEQ ID NO: 158281 - RNA, 22 nt, Homo sapiens
guggcauuucccaaaguauucu

SEQ ID NO: 158282 - RNA, 21 nt, Homo sapiens
guggccuuuggagcaugucag

SEQ ID NO: 158283 - RNA, 22 nt, Homo sapiens
gugggcucguucguguuagaca

SEQ ID NO: 158284 - RNA, 21 nt, Homo sapiens
gugucacagacaugacagaug

SEQ ID NO: 158285 - RNA, 22 nt, Homo sapiens
gugugcaauuuugugggaggca

SEQ ID NO: 158286 - RNA, 22 nt, Homo sapiens
gugugcacaaucuggcaugugc

SEQ ID NO: 158287 - RNA, 22 nt, Homo sapiens
guucaucagggacacugguuug

SEQ ID NO: 158288 - RNA, 22 nt, Homo sapiens
guucaucagggauauuggcuua

SEQ ID NO: 158289 - RNA, 22 nt, Homo sapiens
guucucacuggacugugaaaau

SEQ ID NO: 158290 - RNA, 22 nt, Homo sapiens
guugaaauccuaacccccuagu

SEQ ID NO: 158291 - RNA, 22 nt, Homo sapiens
guugguauuacagaaauuaguu

SEQ ID NO: 158292 - RNA, 16 nt, Homo sapiens
uaaagcuaaucacuuu

SEQ ID NO: 158293 - RNA, 22 nt, Homo sapiens
uaaagcuagaauuguuccagca

SEQ ID NO: 158294 - RNA, 22 nt, Homo sapiens
uaacucugccuagugacauggu

SEQ ID NO: 158295 - RNA, 22 nt, Homo sapiens
uaaguauagguaacagaagcaa

SEQ ID NO: 158296 - RNA, 22 nt, Homo sapiens
uaagugaauuucacuacugagu

SEQ ID NO: 158297 - RNA, 23 nt, Homo sapiens
uaaguucaucucuaauaggugga

SEQ ID NO: 158298 - RNA, 22 nt, Homo sapiens
uacaaagcuuugaugugucuuu

SEQ ID NO: 158299 - RNA, 22 nt, Homo sapiens
uacagguaugugucuauauaca

SEQ ID NO: 158300 - RNA, 22 nt, Homo sapiens
uaccaaguauuuucacaugaac

SEQ ID NO: 158301 - RNA, 22 nt, Homo sapiens
uaccuuugucaguuacucaccu

SEQ ID NO: 158302 - RNA, 22 nt, Homo sapiens
uagaauguaaauuccaagggca

SEQ ID NO: 158303 - RNA, 22 nt, Homo sapiens
uccucauggagaaccucugcua

SEQ ID NO: 158304 - RNA, 22 nt, Homo sapiens
uccuugagccucccagacucag

SEQ ID NO: 158305 - RNA, 22 nt, Homo sapiens
ucucaagaugguagaugggaau

SEQ ID NO: 158306 - RNA, 22 nt, Homo sapiens
ucucagugacugcugggucccc

SEQ ID NO: 158307 - RNA, 22 nt, Homo sapiens
ucugccacugucauugugugau

SEQ ID NO: 158308 - RNA, 22 nt, Homo sapiens
ucuggcuuuuaacaucuauaaa

SEQ ID NO: 158309 - RNA, 22 nt, Homo sapiens
ucugugcauuguaacaacuaaa

SEQ ID NO: 158310 - RNA, 22 nt, Homo sapiens
ucuuugccuaacccaaggucau

SEQ ID NO: 158311 - RNA, 22 nt, Homo sapiens
ugaaugcauggggccaagaagg

SEQ ID NO: 158312 - RNA, 22 nt, Homo sapiens
ugaauggauccaauucuuagua

SEQ ID NO: 158313 - RNA, 22 nt, Homo sapiens
ugaauucuguccaaaauaacug

SEQ ID NO: 158314 - RNA, 23 nt, Homo sapiens
ugacaagagcgagacuuggucuc

SEQ ID NO: 158315 - RNA, 22 nt, Homo sapiens
ugacagagcaggacuucaucuc

SEQ ID NO: 158316 - RNA, 22 nt, Homo sapiens
ugacaugaaggcaccucugucc

SEQ ID NO: 158317 - RNA, 22 nt, Homo sapiens
ugacauggagguggaggaagau

SEQ ID NO: 158318 - RNA, 22 nt, Homo sapiens
ugacuggagaccucaguagggu

SEQ ID NO: 158319 - RNA, 18 nt, Homo sapiens
ugacuguccagguggacc

SEQ ID NO: 158320 - RNA, 22 nt, Homo sapiens
ugagacggaguuuugcucuugu

SEQ ID NO: 158321 - RNA, 22 nt, Homo sapiens
ugagaucacgccacugcacucc

SEQ ID NO: 158322 - RNA, 22 nt, Homo sapiens
ugagaucaugccacugcacuuc

SEQ ID NO: 158323 - RNA, 22 nt, Homo sapiens
ugagaugcauauucuggcuccu

SEQ ID NO: 158324 - RNA, 22 nt, Homo sapiens
ugagcacauuuacaucaguucc

SEQ ID NO: 158325 - RNA, 20 nt, Homo sapiens
ugagcucaauuguugcaagu

SEQ ID NO: 158326 - RNA, 22 nt, Homo sapiens
ugagcugagaucgugccauugu

SEQ ID NO: 158327 - RNA, 22 nt, Homo sapiens
ugaggcaggagaacggcuugaa

SEQ ID NO: 158328 - RNA, 22 nt, Homo sapiens
ugaguauguuuaaugugacaau

SEQ ID NO: 158329 - RNA, 22 nt, Homo sapiens
ugagugagguucuacucuguga

SEQ ID NO: 158330 - RNA, 22 nt, Homo sapiens
ugaguucuuuguagauucugug

SEQ ID NO: 158331 - RNA, 22 nt, Homo sapiens
ugauaagaaauuguucauguag

SEQ ID NO: 158332 - RNA, 22 nt, Homo sapiens
ugcaacacauugccccugcucu

SEQ ID NO: 158333 - RNA, 22 nt, Homo sapiens
ugcaguagugugaucuuggcuc

SEQ ID NO: 158334 - RNA, 22 nt, Homo sapiens
ugccaacaugccuggcuguuuu

SEQ ID NO: 158335 - RNA, 22 nt, Homo sapiens
ugccaguguuuuguugaagauu

SEQ ID NO: 158336 - RNA, 20 nt, Homo sapiens
ugcugcacuuaagcaugggc

SEQ ID NO: 158337 - RNA, 22 nt, Homo sapiens
ugcuggugucaucaaggcuuug

SEQ ID NO: 158338 - RNA, 22 nt, Homo sapiens
uggaaaguacugagguccaccu

SEQ ID NO: 158339 - RNA, 22 nt, Homo sapiens
uggaaauaaaauagaguuugcc

SEQ ID NO: 158340 - RNA, 19 nt, Homo sapiens
uggaacauaaaaguugguu

SEQ ID NO: 158341 - RNA, 20 nt, Homo sapiens
uggaagccuggugcuaucuu

SEQ ID NO: 158342 - RNA, 22 nt, Homo sapiens
uggaaucuagagaaaugcaaac

SEQ ID NO: 158343 - RNA, 17 nt, Homo sapiens
uggaaugucuaagccug

SEQ ID NO: 158344 - RNA, 22 nt, Homo sapiens
uggaaugugaauaacuuccuuc

SEQ ID NO: 158345 - RNA, 22 nt, Homo sapiens
uggaauguggacucuuaugggg

SEQ ID NO: 158346 - RNA, 21 nt, Homo sapiens
uggaauguucugacuucaggg

SEQ ID NO: 158347 - RNA, 18 nt, Homo sapiens
uggaauguuuggguuaau

SEQ ID NO: 158348 - RNA, 18 nt, Homo sapiens
uggagauaagaagaacuu

SEQ ID NO: 158349 - RNA, 19 nt, Homo sapiens
uggagucaucaugcugcua

SEQ ID NO: 158350 - RNA, 16 nt, Homo sapiens
uggagucauccuugac

SEQ ID NO: 158351 - RNA, 22 nt, Homo sapiens
uggagugauaugguuauauggg

SEQ ID NO: 158352 - RNA, 20 nt, Homo sapiens
uggaguuugaguucuuggag

SEQ ID NO: 158353 - RNA, 22 nt, Homo sapiens
uggcacaaugacccuugugggc

SEQ ID NO: 158354 - RNA, 22 nt, Homo sapiens
uggcagcugcuucaugggaugc

SEQ ID NO: 158355 - RNA, 22 nt, Homo sapiens
uggcaugggguaguagcgcugg

SEQ ID NO: 158356 - RNA, 22 nt, Homo sapiens
uggcuaagaugcacacuucacu

SEQ ID NO: 158357 - RNA, 22 nt, Homo sapiens
uggcuuuuguuauuuggaagcu

SEQ ID NO: 158358 - RNA, 22 nt, Homo sapiens
ugggaaugaaauuacauagcuu

SEQ ID NO: 158359 - RNA, 23 nt, Homo sapiens
uggguucauucuugaagucagug

SEQ ID NO: 158360 - RNA, 22 nt, Homo sapiens
uguaacugcuuagaagguuuua

SEQ ID NO: 158361 - RNA, 21 nt, Homo sapiens
ugucaagugggaaaacaugua

SEQ ID NO: 158362 - RNA, 22 nt, Homo sapiens
ugucauauagaauguucuauga

SEQ ID NO: 158363 - RNA, 22 nt, Homo sapiens
ugucauguagaaauuguccauu

SEQ ID NO: 158364 - RNA, 19 nt, Homo sapiens
ugugaacaucacagagugu

SEQ ID NO: 158365 - RNA, 22 nt, Homo sapiens
gccauugcacuccagccucggc

SEQ ID NO: 158366 - RNA, 22 nt, Homo sapiens
gccauugcacuccagccugagc

SEQ ID NO: 158367 - RNA, 22 nt, Homo sapiens
gccauugcacucuagccuaggu

SEQ ID NO: 158368 - RNA, 22 nt, Homo sapiens
gcuggauguuucaauacaaaua

SEQ ID NO: 158369 - RNA, 22 nt, Homo sapiens
ggagaucacucuuuguagcgug

SEQ ID NO: 158370 - RNA, 22 nt, Homo sapiens
ggaucacagagcuugggaaagg

SEQ ID NO: 158371 - RNA, 22 nt, Homo sapiens
ggaucacagccagcucccagaa

SEQ ID NO: 158372 - RNA, 22 nt, Homo sapiens
ggcaaugaggcggaccagcagg

SEQ ID NO: 158373 - RNA, 22 nt, Homo sapiens
ggcagcacaauuuucugaugga

SEQ ID NO: 158374 - RNA, 22 nt, Homo sapiens
ggcagcuguguccuucguaagg

SEQ ID NO: 158375 - RNA, 22 nt, Homo sapiens
ggcauugugauccaccagccuu

SEQ ID NO: 158376 - RNA, 22 nt, Homo sapiens
ggcuagagagcucagggauaug

SEQ ID NO: 158377 - RNA, 22 nt, Homo sapiens
gggaggucauuguaaggucuua

SEQ ID NO: 158378 - RNA, 22 nt, Homo sapiens
ggucaggagaaugguaacugag

SEQ ID NO: 158379 - RNA, 22 nt, Homo sapiens
ggucauggauaagauccagaag

SEQ ID NO: 158380 - RNA, 22 nt, Homo sapiens
ggugacagugguuaaaauuugu

SEQ ID NO: 158381 - RNA, 22 nt, Homo sapiens
ggugcagcacaccaacauggca

SEQ ID NO: 158382 - RNA, 22 nt, Homo sapiens
guaaacuuccccucaugaauga

SEQ ID NO: 158383 - RNA, 22 nt, Homo sapiens
guaaucucaccuacuugggagg

SEQ ID NO: 158384 - RNA, 19 nt, Homo sapiens
guaaucucaguacuuuggu

SEQ ID NO: 158385 - RNA, 22 nt, Homo sapiens
guacaguaguaaaagugaauga

SEQ ID NO: 158386 - RNA, 22 nt, Homo sapiens
guagcagcaauuuacuccauac

SEQ ID NO: 158387 - RNA, 22 nt, Homo sapiens
guaucauuggcauguaaccaga

SEQ ID NO: 158388 - RNA, 22 nt, Homo sapiens
guauugaguaaauguuuauugg

SEQ ID NO: 158389 - RNA, 22 nt, Homo sapiens
gucaaagucuauuggcuaauuc

SEQ ID NO: 158390 - RNA, 22 nt, Homo sapiens
gucauugcacuccagccuggac

SEQ ID NO: 158391 - RNA, 22 nt, Homo sapiens
gucugagcauggggccggcagg

SEQ ID NO: 158392 - RNA, 22 nt, Homo sapiens
gucuggcaauggcagacuggca

SEQ ID NO: 158393 - RNA, 22 nt, Homo sapiens
gugacagaguaagacccuguau

SEQ ID NO: 158394 - RNA, 22 nt, Homo sapiens
gugacugcauccauccaggcuu

SEQ ID NO: 158395 - RNA, 22 nt, Homo sapiens
gugagaagaaaaauauggcugu

SEQ ID NO: 158396 - RNA, 22 nt, Homo sapiens
gugagaugaggucucacucugu

SEQ ID NO: 158397 - RNA, 21 nt, Homo sapiens
gugaucaugucacugcacucc

SEQ ID NO: 158398 - RNA, 22 nt, Homo sapiens
gugauuauccacgucuuuguga

SEQ ID NO: 158399 - RNA, 22 nt, Homo sapiens
gugauuauuaugcacugcaugc

SEQ ID NO: 158400 - RNA, 22 nt, Homo sapiens
gugauugucuaaucaagauaca

SEQ ID NO: 158401 - RNA, 22 nt, Homo sapiens
gugcaacaucccuccauaauuu

SEQ ID NO: 158402 - RNA, 21 nt, Homo sapiens
gugcagaugccacagucacuc

SEQ ID NO: 158403 - RNA, 18 nt, Homo sapiens
guggagugucuuccugga

SEQ ID NO: 158404 - RNA, 22 nt, Homo sapiens
guggcaaguguuccaagaggcg

SEQ ID NO: 158405 - RNA, 22 nt, Homo sapiens
guguaaaacaauuagaggauuu

SEQ ID NO: 158406 - RNA, 22 nt, Homo sapiens
gugucucagcccagaccuauuu

SEQ ID NO: 158407 - RNA, 22 nt, Homo sapiens
gugucuccugccuucaugcagc

SEQ ID NO: 158408 - RNA, 22 nt, Homo sapiens
guguggaacucaauacaacgca

SEQ ID NO: 158409 - RNA, 22 nt, Homo sapiens
guugcucaggcugaagugcagu

SEQ ID NO: 158410 - RNA, 22 nt, Homo sapiens
guugggcccauagacugccagu

SEQ ID NO: 158411 - RNA, 22 nt, Homo sapiens
guuugugguuaaagccuuucau

SEQ ID NO: 158412 - RNA, 21 nt, Homo sapiens
uaaagcuagaaccuuagcuuu

SEQ ID NO: 158413 - RNA, 22 nt, Homo sapiens
uaaagcuaugagaacaccguag

SEQ ID NO: 158414 - RNA, 22 nt, Homo sapiens
uaacaguguauuccuuuggaca

SEQ ID NO: 158415 - RNA, 22 nt, Homo sapiens
uaacaguguauuuacuacuucc

SEQ ID NO: 158416 - RNA, 22 nt, Homo sapiens
uaacccagugucugugaugggu

SEQ ID NO: 158417 - RNA, 22 nt, Homo sapiens
uaaguuguugacauuaggggaa

SEQ ID NO: 158418 - RNA, 22 nt, Homo sapiens
uacaaaguaacaguuccuguau

SEQ ID NO: 158419 - RNA, 22 nt, Homo sapiens
uacaaaucuagguuuguuacug

SEQ ID NO: 158420 - RNA, 22 nt, Homo sapiens
uacaggcagguguucccugguu

SEQ ID NO: 158421 - RNA, 22 nt, Homo sapiens
uagaucaauuaauuguuacuug

SEQ ID NO: 158422 - RNA, 22 nt, Homo sapiens
uagauucaucuguuccuuuuga

SEQ ID NO: 158423 - RNA, 22 nt, Homo sapiens
uagcagccaggaagggcuggcu

SEQ ID NO: 158424 - RNA, 22 nt, Homo sapiens
uaggagcacaaacccuacugug

SEQ ID NO: 158425 - RNA, 22 nt, Homo sapiens
uaggagugugaacccuaugaac

SEQ ID NO: 158426 - RNA, 22 nt, Homo sapiens
uaggcaguuuuccuuucacagu

SEQ ID NO: 158427 - RNA, 19 nt, Homo sapiens
uagguacauucaagucucc

SEQ ID NO: 158428 - RNA, 22 nt, Homo sapiens
uaguaaacaccucagguaauuc

SEQ ID NO: 158429 - RNA, 22 nt, Homo sapiens
uauaugcauugugggguacuga

SEQ ID NO: 158430 - RNA, 23 nt, Homo sapiens
uaucccuugccuuaugaugugag

SEQ ID NO: 158431 - RNA, 22 nt, Homo sapiens
uaugcacacguguccaugugca

SEQ ID NO: 158432 - RNA, 22 nt, Homo sapiens
uaugcacacucucccaggaggg

SEQ ID NO: 158433 - RNA, 22 nt, Homo sapiens
uaugggucuuaaaucacuuagu

SEQ ID NO: 158434 - RNA, 22 nt, Homo sapiens
ucaaacacuccauaucgcgauu

SEQ ID NO: 158435 - RNA, 23 nt, Homo sapiens
ucaagugaugguggccacaaggg

SEQ ID NO: 158436 - RNA, 22 nt, Homo sapiens
ucacagaggagaagaccuuuaa

SEQ ID NO: 158437 - RNA, 23 nt, Homo sapiens
ucacaguggcugcuuaauuguga

SEQ ID NO: 158438 - RNA, 22 nt, Homo sapiens
ucacgugguucauaaggcagaa

SEQ ID NO: 158439 - RNA, 22 nt, Homo sapiens
ucagaucacuggcgcuggcgga

SEQ ID NO: 158440 - RNA, 22 nt, Homo sapiens
ucagugcaggaaucucuagcca

SEQ ID NO: 158441 - RNA, 22 nt, Homo sapiens
ucaguggauuuaaccugaauca

SEQ ID NO: 158442 - RNA, 23 nt, Homo sapiens
ucagugucuggauccugcucagu

SEQ ID NO: 158443 - RNA, 21 nt, Homo sapiens
ucauaagcucaacaucuguag

SEQ ID NO: 158444 - RNA, 22 nt, Homo sapiens
ucauaguacuuuguuuugaaaa

SEQ ID NO: 158445 - RNA, 22 nt, Homo sapiens
ucauggggugagcuacaggcac

SEQ ID NO: 158446 - RNA, 22 nt, Homo sapiens
ucauugcacuccagccugggug

SEQ ID NO: 158447 - RNA, 22 nt, Homo sapiens
uccauguagaugcuauguuguc

SEQ ID NO: 158448 - RNA, 22 nt, Homo sapiens
ucccaguauucauuuacagaag

SEQ ID NO: 158449 - RNA, 22 nt, Homo sapiens
ucccaguguguagcuugucucu

SEQ ID NO: 158450 - RNA, 22 nt, Homo sapiens
ucucacagaguugaacuuucuu

SEQ ID NO: 158451 - RNA, 22 nt, Homo sapiens
ucucaguggcuuccucacuuuu

SEQ ID NO: 158452 - RNA, 22 nt, Homo sapiens
ucucauggagguagagaguaaa

SEQ ID NO: 158453 - RNA, 22 nt, Homo sapiens
ucucauugauucuggggugaug

SEQ ID NO: 158454 - RNA, 22 nt, Homo sapiens
ucucccauccaugaacuucugu

SEQ ID NO: 158455 - RNA, 22 nt, Homo sapiens
ucuggccuacaaguaauuuuau

SEQ ID NO: 158456 - RNA, 22 nt, Homo sapiens
augccaagaugagcacgcgucu

SEQ ID NO: 158457 - RNA, 22 nt, Homo sapiens
augccacugcacuucagcuugg

SEQ ID NO: 158458 - RNA, 21 nt, Homo sapiens
auggaaagacugccucuucaa

SEQ ID NO: 158459 - RNA, 22 nt, Homo sapiens
auggaacuggagaucauuaugu

SEQ ID NO: 158460 - RNA, 22 nt, Homo sapiens
auggaauguaaguuauguuugc

SEQ ID NO: 158461 - RNA, 22 nt, Homo sapiens
auggacucauugaauuaagucc

SEQ ID NO: 158462 - RNA, 22 nt, Homo sapiens
auggagaugaauaucaucuguu

SEQ ID NO: 158463 - RNA, 22 nt, Homo sapiens
auggagguguggggagugaguu

SEQ ID NO: 158464 - RNA, 22 nt, Homo sapiens
auggagugagaauggagguucc

SEQ ID NO: 158465 - RNA, 22 nt, Homo sapiens
auggaguguucugaauccuuug

SEQ ID NO: 158466 - RNA, 22 nt, Homo sapiens
auggcacagacucuuggucaag

SEQ ID NO: 158467 - RNA, 22 nt, Homo sapiens
auggcaguguaugauuauauua

SEQ ID NO: 158468 - RNA, 22 nt, Homo sapiens
auggcaguuucacucugggauu

SEQ ID NO: 158469 - RNA, 22 nt, Homo sapiens
auggcauuuuuagggcugggug

SEQ ID NO: 158470 - RNA, 22 nt, Homo sapiens
auggcccaguuugcuaucccua

SEQ ID NO: 158471 - RNA, 20 nt, Homo sapiens
augucaggaagggagucagg

SEQ ID NO: 158472 - RNA, 22 nt, Homo sapiens
auguggaaauguauaugugucu

SEQ ID NO: 158473 - RNA, 22 nt, Homo sapiens
augugugcuugugacacagccu

SEQ ID NO: 158474 - RNA, 23 nt, Homo sapiens
auuccaguggcaauuggagaaac

SEQ ID NO: 158475 - RNA, 22 nt, Homo sapiens
auugagcaaggucuccuaguau

SEQ ID NO: 158476 - RNA, 22 nt, Homo sapiens
auugcacuccagccucggugac

SEQ ID NO: 158477 - RNA, 22 nt, Homo sapiens
auugcacuccagccugggugac

SEQ ID NO: 158478 - RNA, 18 nt, Homo sapiens
auugcacuccugccuggg

SEQ ID NO: 158479 - RNA, 22 nt, Homo sapiens
auugcacucuagccugggugac

SEQ ID NO: 158480 - RNA, 23 nt, Homo sapiens
auugcagucuugaacuccugggc

SEQ ID NO: 158481 - RNA, 22 nt, Homo sapiens
auugcaguuagaacagaagucu

SEQ ID NO: 158482 - RNA, 22 nt, Homo sapiens
auuguacuccagccugggugac

SEQ ID NO: 158483 - RNA, 22 nt, Homo sapiens
auuguacuuaagccugggugaa

SEQ ID NO: 158484 - RNA, 22 nt, Homo sapiens
auugucacugugcuccaccagu

SEQ ID NO: 158485 - RNA, 22 nt, Homo sapiens
caaaggcuuccacugcauccuu

SEQ ID NO: 158486 - RNA, 22 nt, Homo sapiens
caaaggcuucugaaacugcaga

SEQ ID NO: 158487 - RNA, 22 nt, Homo sapiens
caaagugguuuauacaugauug

SEQ ID NO: 158488 - RNA, 21 nt, Homo sapiens
caagugaugcuucugcuuuaa

SEQ ID NO: 158489 - RNA, 22 nt, Homo sapiens
cacagaauucauuggauuaccu

SEQ ID NO: 158490 - RNA, 22 nt, Homo sapiens
cacuuugguucaccugaguuuc

SEQ ID NO: 158491 - RNA, 22 nt, Homo sapiens
caggcagugggagacaaaacug

SEQ ID NO: 158492 - RNA, 22 nt, Homo sapiens
caguacaauguugauuagaagu

SEQ ID NO: 158493 - RNA, 22 nt, Homo sapiens
caguagcaugccucagaaugag

SEQ ID NO: 158494 - RNA, 22 nt, Homo sapiens
cagugcauagaugugccacauu

SEQ ID NO: 158495 - RNA, 22 nt, Homo sapiens
cauugcacuccagccugaggga

SEQ ID NO: 158496 - RNA, 22 nt, Homo sapiens
cauugcacuccagcucugggcg

SEQ ID NO: 158497 - RNA, 22 nt, Homo sapiens
cauugguugaacagauuguguu

SEQ ID NO: 158498 - RNA, 22 nt, Homo sapiens
cauuuugcaguuucugucucca

SEQ ID NO: 158499 - RNA, 22 nt, Homo sapiens
ccacaguagucuugggaugggc

SEQ ID NO: 158500 - RNA, 22 nt, Homo sapiens
ccacagucuaugcaacaagguc

SEQ ID NO: 158501 - RNA, 22 nt, Homo sapiens
ccagugcugugcaguguaugag

SEQ ID NO: 158502 - RNA, 21 nt, Homo sapiens
ccaguguaaugauagcaggca

SEQ ID NO: 158503 - RNA, 22 nt, Homo sapiens
ccauggcuucugcauucuguca

SEQ ID NO: 158504 - RNA, 22 nt, Homo sapiens
ccccauguucucucugcagcuc

SEQ ID NO: 158505 - RNA, 22 nt, Homo sapiens
ccuggcacugggccccguggcu

SEQ ID NO: 158506 - RNA, 22 nt, Homo sapiens
cggcaguggguaagccaagcuu

SEQ ID NO: 158507 - RNA, 20 nt, Homo sapiens
cguugcacuccagccugggc

SEQ ID NO: 158508 - RNA, 22 nt, Homo sapiens
cuagucacauuuucaucaaaua

SEQ ID NO: 158509 - RNA, 22 nt, Homo sapiens
cuaucucaggcccaggcccuug

SEQ ID NO: 158510 - RNA, 22 nt, Homo sapiens
cuauggguuauaauucauuagu

SEQ ID NO: 158511 - RNA, 22 nt, Homo sapiens
cucaauuuggaauugucaguaa

SEQ ID NO: 158512 - RNA, 22 nt, Homo sapiens
cugacauggggauccaccuuag

SEQ ID NO: 158513 - RNA, 22 nt, Homo sapiens
cugagcccauucuggggagaag

SEQ ID NO: 158514 - RNA, 22 nt, Homo sapiens
cuggaaagcaaagggugcauug

SEQ ID NO: 158515 - RNA, 18 nt, Homo sapiens
cuggaaggcuacuacagu

SEQ ID NO: 158516 - RNA, 22 nt, Homo sapiens
cugucacaguuuuggaggccag

SEQ ID NO: 158517 - RNA, 17 nt, Homo sapiens
cuucaaauaauuucccc

SEQ ID NO: 158518 - RNA, 20 nt, Homo sapiens
cuugcuccccuuguucuaga

SEQ ID NO: 158519 - RNA, 22 nt, Homo sapiens
cuuggcacucuguggaguuagg

SEQ ID NO: 158520 - RNA, 22 nt, Homo sapiens
cuuggcuuguuguccccugcuc

SEQ ID NO: 158521 - RNA, 22 nt, Homo sapiens
cuuuuacacugguggugggaau

SEQ ID NO: 158522 - RNA, 22 nt, Homo sapiens
cuuuuacacuguuggugggaau

SEQ ID NO: 158523 - RNA, 23 nt, Homo sapiens
gaaauguaagugaugccccacag

SEQ ID NO: 158524 - RNA, 22 nt, Homo sapiens
gaagguaguuuauagauguggu

SEQ ID NO: 158525 - RNA, 23 nt, Homo sapiens
gaaguauagcaugcacauggaaa

SEQ ID NO: 158526 - RNA, 22 nt, Homo sapiens
gaaugcuaccagcaucuagugg

SEQ ID NO: 158527 - RNA, 22 nt, Homo sapiens
gaaugugcuguuggcugggcgu

SEQ ID NO: 158528 - RNA, 21 nt, Homo sapiens
gacuacaccaggaugcuaguu

SEQ ID NO: 158529 - RNA, 22 nt, Homo sapiens
gacuuugguaaacucgguggca

SEQ ID NO: 158530 - RNA, 22 nt, Homo sapiens
gacuuugguagaggaaaaaucu

SEQ ID NO: 158531 - RNA, 22 nt, Homo sapiens
gagacggagucucgcucugucg

SEQ ID NO: 158532 - RNA, 22 nt, Homo sapiens
gagacggagucuugcucuguug

SEQ ID NO: 158533 - RNA, 22 nt, Homo sapiens
gagaucaguuaaugaagugagc

SEQ ID NO: 158534 - RNA, 22 nt, Homo sapiens
gagcacauaugacauuuucuuc

SEQ ID NO: 158535 - RNA, 22 nt, Homo sapiens
gagguauagaacaccuuucaag

SEQ ID NO: 158536 - RNA, 22 nt, Homo sapiens
gaggugguagguucacagcagc

SEQ ID NO: 158537 - RNA, 22 nt, Homo sapiens
gauauguucugagaaaugcauu

SEQ ID NO: 158538 - RNA, 22 nt, Homo sapiens
gaucuguuucaauugucuuagu

SEQ ID NO: 158539 - RNA, 22 nt, Homo sapiens
gauggcaugugcugccaccaag

SEQ ID NO: 158540 - RNA, 22 nt, Homo sapiens
gauugcaauuuaggugagagag

SEQ ID NO: 158541 - RNA, 22 nt, Homo sapiens
gcacaguuaaagggucauguga

SEQ ID NO: 158542 - RNA, 22 nt, Homo sapiens
gcacauggccccaucgugccga

SEQ ID NO: 158543 - RNA, 22 nt, Homo sapiens
gccaacauggcgcuccauucuu

SEQ ID NO: 158544 - RNA, 22 nt, Homo sapiens
gccaguauuuuauugagaauuu

SEQ ID NO: 158545 - RNA, 22 nt, Homo sapiens
gccaguauuuuguugagaauuu

SEQ ID NO: 158546 - RNA, 22 nt, Homo sapiens
gccauugcacuacagccuaggc

SEQ ID NO: 158547 - RNA, 22 nt, Homo sapiens
ucugguuccugcauucauucaa

SEQ ID NO: 158548 - RNA, 22 nt, Homo sapiens
ucugugcauggcagaggaauga

SEQ ID NO: 158549 - RNA, 22 nt, Homo sapiens
ucugugguaagaaacgcauguc

SEQ ID NO: 158550 - RNA, 17 nt, Homo sapiens
ucuugugguucuugaau

SEQ ID NO: 158551 - RNA, 22 nt, Homo sapiens
ucuuuggucuacuuucauaugu

SEQ ID NO: 158552 - RNA, 22 nt, Homo sapiens
ugaaagguauagguucuggagg

SEQ ID NO: 158553 - RNA, 22 nt, Homo sapiens
ugaaagguuuaauucugugaga

SEQ ID NO: 158554 - RNA, 22 nt, Homo sapiens
ugaaugcaucuagaaauuuauu

SEQ ID NO: 158555 - RNA, 22 nt, Homo sapiens
ugacagagaagcauugaguuca

SEQ ID NO: 158556 - RNA, 22 nt, Homo sapiens
ugacaugaagucucccucuguu

SEQ ID NO: 158557 - RNA, 22 nt, Homo sapiens
ugacauggaagauguucaugau

SEQ ID NO: 158558 - RNA, 22 nt, Homo sapiens
ugacuaaaacugaguuucauua

SEQ ID NO: 158559 - RNA, 22 nt, Homo sapiens
ugagacaaaguuguuggauguu

SEQ ID NO: 158560 - RNA, 22 nt, Homo sapiens
ugagaugcuccucuugcaaagc

SEQ ID NO: 158561 - RNA, 22 nt, Homo sapiens
ugagcaagaaauagaaacagau

SEQ ID NO: 158562 - RNA, 22 nt, Homo sapiens
ugagccaaugauuugaauagag

SEQ ID NO: 158563 - RNA, 22 nt, Homo sapiens
ugagcucagcuaguugaggugu

SEQ ID NO: 158564 - RNA, 22 nt, Homo sapiens
ugaggcacucuagacuuauuca

SEQ ID NO: 158565 - RNA, 22 nt, Homo sapiens
ugagugaggcugggcagucccu

SEQ ID NO: 158566 - RNA, 22 nt, Homo sapiens
ugaguucuuuuacauuuugaau

SEQ ID NO: 158567 - RNA, 23 nt, Homo sapiens
ugauaacagcauaugaagauucu

SEQ ID NO: 158568 - RNA, 22 nt, Homo sapiens
ugaucaaagugcuggaauuaca

SEQ ID NO: 158569 - RNA, 22 nt, Homo sapiens
ugaugcugaugccugccagaag

SEQ ID NO: 158570 - RNA, 22 nt, Homo sapiens
ugauggcauuucauguuuguaa

SEQ ID NO: 158571 - RNA, 19 nt, Homo sapiens
ugcaaagucuuuuccuauu

SEQ ID NO: 158572 - RNA, 22 nt, Homo sapiens
ugcaaaugucaaggguuagugu

SEQ ID NO: 158573 - RNA, 17 nt, Homo sapiens
ugcagcacacugauggg

SEQ ID NO: 158574 - RNA, 23 nt, Homo sapiens
ugcaguagugagaucuaggcuca

SEQ ID NO: 158575 - RNA, 22 nt, Homo sapiens
ugccagagacguagggaauauu

SEQ ID NO: 158576 - RNA, 22 nt, Homo sapiens
ugccaggaugaggucaauguuu

SEQ ID NO: 158577 - RNA, 22 nt, Homo sapiens
ugccaguuuuuacauuuccugu

SEQ ID NO: 158578 - RNA, 22 nt, Homo sapiens
ugccaugaagagaggaagcagu

SEQ ID NO: 158579 - RNA, 22 nt, Homo sapiens
ugccauugcacuccagccuggg

SEQ ID NO: 158580 - RNA, 22 nt, Homo sapiens
ugccuaggcuggaaugcagugg

SEQ ID NO: 158581 - RNA, 18 nt, Homo sapiens
ugcuaugagauuauuuua

SEQ ID NO: 158582 - RNA, 22 nt, Homo sapiens
ugcuaugucagccaggcugguc

SEQ ID NO: 158583 - RNA, 22 nt, Homo sapiens
ugcugguguggucuagccgcuu

SEQ ID NO: 158584 - RNA, 22 nt, Homo sapiens
uggaaggucauuguucauuuga

SEQ ID NO: 158585 - RNA, 22 nt, Homo sapiens
uggaauguagcguugacacgag

SEQ ID NO: 158586 - RNA, 22 nt, Homo sapiens
uggacacuggagauucgucagu

SEQ ID NO: 158587 - RNA, 20 nt, Homo sapiens
uggagugaagguucuggacc

SEQ ID NO: 158588 - RNA, 21 nt, Homo sapiens
uggagugcaacacuagguaua

SEQ ID NO: 158589 - RNA, 22 nt, Homo sapiens
uggagugcaauggugagaucuu

SEQ ID NO: 158590 - RNA, 22 nt, Homo sapiens
uggaugacuguuauaugcauau

SEQ ID NO: 158591 - RNA, 21 nt, Homo sapiens
uggaugccuaggcagaaguuu

SEQ ID NO: 158592 - RNA, 22 nt, Homo sapiens
uggauguaauugauucauguug

SEQ ID NO: 158593 - RNA, 19 nt, Homo sapiens
uggcaaugucagcagagau

SEQ ID NO: 158594 - RNA, 22 nt, Homo sapiens
uggcaugaagaccccauccuuu

SEQ ID NO: 158595 - RNA, 22 nt, Homo sapiens
uggcgggaaaguugggagaaga

SEQ ID NO: 158596 - RNA, 20 nt, Homo sapiens
uggcuucuuaauugcaggca

SEQ ID NO: 158597 - RNA, 22 nt, Homo sapiens
uggcuuuguaagguuucauuuu

SEQ ID NO: 158598 - RNA, 22 nt, Homo sapiens
uggcuuuuccaggcauuacgau

SEQ ID NO: 158599 - RNA, 21 nt, Homo sapiens
ugggccccuuccuuacaucau

SEQ ID NO: 158600 - RNA, 22 nt, Homo sapiens
uggucaaaugccaaucuguagu

SEQ ID NO: 158601 - RNA, 22 nt, Homo sapiens
ugguccacuaacccucaguauc

SEQ ID NO: 158602 - RNA, 22 nt, Homo sapiens
ugucauguaaagaguaaauggu

SEQ ID NO: 158603 - RNA, 22 nt, Homo sapiens
ugucauguugagaaacuuggau

SEQ ID NO: 158604 - RNA, 22 nt, Homo sapiens
ugucuaaagaauggcagacuca

SEQ ID NO: 158605 - RNA, 22 nt, Homo sapiens
ugugaacugagcauuaacuaca

SEQ ID NO: 158606 - RNA, 21 nt, Homo sapiens
uguggcaauggccucacagau

SEQ ID NO: 158607 - RNA, 22 nt, Homo sapiens
uuaaauacagcaugguguuucu

SEQ ID NO: 158608 - RNA, 22 nt, Homo sapiens
uuaaugugaaucaggaugcauu

SEQ ID NO: 158609 - RNA, 22 nt, Homo sapiens
uuagcagcaugaaaauggacug

SEQ ID NO: 158610 - RNA, 22 nt, Homo sapiens
uuaggagacuggauaucucuuu

SEQ ID NO: 158611 - RNA, 21 nt, Homo sapiens
uuaggcagugucagaggugag

SEQ ID NO: 158612 - RNA, 22 nt, Homo sapiens
uuaucucagugaacugagugga

SEQ ID NO: 158613 - RNA, 22 nt, Homo sapiens
uucaaaguuggaggacaaacug

SEQ ID NO: 158614 - RNA, 22 nt, Homo sapiens
uucaaguaagaaagacaucagg

SEQ ID NO: 158615 - RNA, 22 nt, Homo sapiens
uucacaaugccuuguugauggu

SEQ ID NO: 158616 - RNA, 22 nt, Homo sapiens
uucagaucaucccagcuccacu

SEQ ID NO: 158617 - RNA, 22 nt, Homo sapiens
uucauggaguuuaaauuguagu

SEQ ID NO: 158618 - RNA, 22 nt, Homo sapiens
uucuaugguuuaauaguuuggg

SEQ ID NO: 158619 - RNA, 22 nt, Homo sapiens
uugagacggaguuuugcucuug

SEQ ID NO: 158620 - RNA, 22 nt, Homo sapiens
uugagauguggcaguuuaugag

SEQ ID NO: 158621 - RNA, 22 nt, Homo sapiens
uugagcaaaacauuaauauuag

SEQ ID NO: 158622 - RNA, 22 nt, Homo sapiens
uugagcccuggagguggaggcu

SEQ ID NO: 158623 - RNA, 22 nt, Homo sapiens
uugaggaggcagucugcccauu

SEQ ID NO: 158624 - RNA, 22 nt, Homo sapiens
uugaggaggcagucuguccguu

SEQ ID NO: 158625 - RNA, 20 nt, Homo sapiens
uugaggucaggaguuuggga

SEQ ID NO: 158626 - RNA, 22 nt, Homo sapiens
uugaggucuuugagcaaacgca

SEQ ID NO: 158627 - RNA, 22 nt, Homo sapiens
uugaucaucagcuuugucaucu

SEQ ID NO: 158628 - RNA, 22 nt, Homo sapiens
uugcacuccagccuggaugaca

SEQ ID NO: 158629 - RNA, 22 nt, Homo sapiens
uugcacuccagcucgggugaca

SEQ ID NO: 158630 - RNA, 22 nt, Homo sapiens
uugcacuccauccuggguugac

SEQ ID NO: 158631 - RNA, 22 nt, Homo sapiens
uugcacuccggccuggguaaca

SEQ ID NO: 158632 - RNA, 18 nt, Homo sapiens
uugcacuccugccugggu

SEQ ID NO: 158633 - RNA, 22 nt, Homo sapiens
uugcagagccccacacugggcu

SEQ ID NO: 158634 - RNA, 22 nt, Homo sapiens
uugcucaggcuagaguucagcu

SEQ ID NO: 158635 - RNA, 22 nt, Homo sapiens
uugcucaggcuggaguacaaug

SEQ ID NO: 158636 - RNA, 22 nt, Homo sapiens
uuggaaugcaacagaaggauaa

SEQ ID NO: 158637 - RNA, 22 nt, Homo sapiens
uuggagcccuaacucucaguac

SEQ ID NO: 158638 - RNA, 22 nt, Homo sapiens
acugcacuucagccuugugaca

SEQ ID NO: 158639 - RNA, 22 nt, Homo sapiens
acuggcucugcuuuacaaacag

SEQ ID NO: 158640 - RNA, 20 nt, Homo sapiens
acugggcuaccgaaguaagg

SEQ ID NO: 158641 - RNA, 19 nt, Homo sapiens
agaagugcauggucuagag

SEQ ID NO: 158642 - RNA, 22 nt, Homo sapiens
agaagugcuggguucaggcugg

SEQ ID NO: 158643 - RNA, 22 nt, Homo sapiens
agagaacugauucagggaaaau

SEQ ID NO: 158644 - RNA, 22 nt, Homo sapiens
agaucacaguaccguaaggcug

SEQ ID NO: 158645 - RNA, 20 nt, Homo sapiens
agaugcaugcacauaaacac

SEQ ID NO: 158646 - RNA, 18 nt, Homo sapiens
agaugcaugcucacuaca

SEQ ID NO: 158647 - RNA, 22 nt, Homo sapiens
agaugcuguuaucaacuguagc

SEQ ID NO: 158648 - RNA, 22 nt, Homo sapiens
agaugguguuggcugaguguau

SEQ ID NO: 158649 - RNA, 22 nt, Homo sapiens
agcaagauccagucgcacagga

SEQ ID NO: 158650 - RNA, 22 nt, Homo sapiens
agcaagauugauggccugcagg

SEQ ID NO: 158651 - RNA, 22 nt, Homo sapiens
agcacacuggguggcuuaaaca

SEQ ID NO: 158652 - RNA, 22 nt, Homo sapiens
agcaccaugggcugaguaagug

SEQ ID NO: 158653 - RNA, 22 nt, Homo sapiens
agcaccauugcacuccagccug

SEQ ID NO: 158654 - RNA, 21 nt, Homo sapiens
agccugugggucauaguugcc

SEQ ID NO: 158655 - RNA, 21 nt, Homo sapiens
aggagcauuguugugguggag

SEQ ID NO: 158656 - RNA, 22 nt, Homo sapiens
aggcaacaugguaaaacccugu

SEQ ID NO: 158657 - RNA, 22 nt, Homo sapiens
aggcacgguggcucacaccugu

SEQ ID NO: 158658 - RNA, 22 nt, Homo sapiens
aggcagcuguuauauacugagu

SEQ ID NO: 158659 - RNA, 22 nt, Homo sapiens
agggagcaaaguggucuuucuc

SEQ ID NO: 158660 - RNA, 22 nt, Homo sapiens
agguccacuuacuacuccuguu

SEQ ID NO: 158661 - RNA, 22 nt, Homo sapiens
aguauguuuugaaaccaagaag

SEQ ID NO: 158662 - RNA, 22 nt, Homo sapiens
aguccaguguuaugaucaguag

SEQ ID NO: 158663 - RNA, 22 nt, Homo sapiens
aguggauguuguggccugggag

SEQ ID NO: 158664 - RNA, 22 nt, Homo sapiens
aguggauuuuauuugacaacua

SEQ ID NO: 158665 - RNA, 19 nt, Homo sapiens
auaaacuagaacugucccc

SEQ ID NO: 158666 - RNA, 22 nt, Homo sapiens
auaaagccaggagacguaauug

SEQ ID NO: 158667 - RNA, 22 nt, Homo sapiens
auacuguuucugaacuuugauu

SEQ ID NO: 158668 - RNA, 22 nt, Homo sapiens
auauuguuggcugcuggcugau

SEQ ID NO: 158669 - RNA, 22 nt, Homo sapiens
aucaaaucuccagaaccugucu

SEQ ID NO: 158670 - RNA, 22 nt, Homo sapiens
aucagugagugguuagugaaug

SEQ ID NO: 158671 - RNA, 22 nt, Homo sapiens
aucugugguuguaugcauauua

SEQ ID NO: 158672 - RNA, 22 nt, Homo sapiens
augaacacuccaauuguacucc

SEQ ID NO: 158673 - RNA, 22 nt, Homo sapiens
augagacaguucccuuuaucuu

SEQ ID NO: 158674 - RNA, 22 nt, Homo sapiens
augaggaaggagccuuugucug

SEQ ID NO: 158675 - RNA, 22 nt, Homo sapiens
augauauguuuguagcuaucuc

SEQ ID NO: 158676 - RNA, 22 nt, Homo sapiens
augcaagacaccgauuagcuuu

SEQ ID NO: 158677 - RNA, 22 nt, Homo sapiens
augcauagcaucugcaaauguu

SEQ ID NO: 158678 - RNA, 22 nt, Homo sapiens
uugcaagaaaugcagauucuca

SEQ ID NO: 158679 - RNA, 22 nt, Homo sapiens
uugcacuccagccugggugaca

SEQ ID NO: 158680 - RNA, 22 nt, Homo sapiens
uugcacucuagccugggugaca

SEQ ID NO: 158681 - RNA, 22 nt, Homo sapiens
uugcauguacguacagagagag

SEQ ID NO: 158682 - RNA, 22 nt, Homo sapiens
uugccauggaguagaauugaag

SEQ ID NO: 158683 - RNA, 22 nt, Homo sapiens
uugcuccucugccaggaccugu

SEQ ID NO: 158684 - RNA, 22 nt, Homo sapiens
uuggaaggcuccuaaugaaugg

SEQ ID NO: 158685 - RNA, 22 nt, Homo sapiens
uuggaaggcugaauggccucuc

SEQ ID NO: 158686 - RNA, 22 nt, Homo sapiens
uuggaagguaaucaaaaguucu

SEQ ID NO: 158687 - RNA, 22 nt, Homo sapiens
uuggaguguucugguccgggcu

SEQ ID NO: 158688 - RNA, 22 nt, Homo sapiens
uuggcaaagaggaaugccacuu

SEQ ID NO: 158689 - RNA, 22 nt, Homo sapiens
uuggcaaauagguuuuauugca

SEQ ID NO: 158690 - RNA, 22 nt, Homo sapiens
uuggccuccuggucauauccag

SEQ ID NO: 158691 - RNA, 22 nt, Homo sapiens
uuggccuuucucuaaauacuuu

SEQ ID NO: 158692 - RNA, 22 nt, Homo sapiens
uuggucaggcuaaucucgaacg

SEQ ID NO: 158693 - RNA, 22 nt, Homo sapiens
uugguccccacuccccugccaa

SEQ ID NO: 158694 - RNA, 20 nt, Homo sapiens
uuggugaccuacagaugugg

SEQ ID NO: 158695 - RNA, 16 nt, Homo sapiens
uuucuauguuuuacua

SEQ ID NO: 158696 - RNA, 22 nt, Homo sapiens
uuugcaguguaguuggccagca

SEQ ID NO: 158697 - RNA, 22 nt, Homo sapiens
uuugcaguuuauuccuggggcu

SEQ ID NO: 158698 - RNA, 22 nt, Homo sapiens
uuugggccaugcuucccgguca

SEQ ID NO: 158699 - RNA, 22 nt, Homo sapiens
uuugugcuccucucaguaugug

SEQ ID NO: 158700 - RNA, 22 nt, Homo sapiens
aaagugauugcgguuuuugcca

SEQ ID NO: 158701 - RNA, 22 nt, Homo sapiens
aaaugcaguugguggggauaug

SEQ ID NO: 158702 - RNA, 22 nt, Homo sapiens
aaaugguguuaguagaucuuua

SEQ ID NO: 158703 - RNA, 21 nt, Homo sapiens
aacagugcugaacagacaccu

SEQ ID NO: 158704 - RNA, 20 nt, Homo sapiens
aagacacuguccccacugga

SEQ ID NO: 158705 - RNA, 22 nt, Homo sapiens
aagcagauguguugaaaguacu

SEQ ID NO: 158706 - RNA, 22 nt, Homo sapiens
aaggagcagagagcccuguuuc

SEQ ID NO: 158707 - RNA, 22 nt, Homo sapiens
aaggagcaguggacggguccua

SEQ ID NO: 158708 - RNA, 22 nt, Homo sapiens
aaggaguagaauagaugcaccu

SEQ ID NO: 158709 - RNA, 22 nt, Homo sapiens
aaggcagugugcacauaacacu

SEQ ID NO: 158710 - RNA, 22 nt, Homo sapiens
aaggcaugcaguacguuucuau

SEQ ID NO: 158711 - RNA, 22 nt, Homo sapiens
aaggcuagagaagaagggcauc

SEQ ID NO: 158712 - RNA, 22 nt, Homo sapiens
aaggugcuguaagcauccaugu

SEQ ID NO: 158713 - RNA, 22 nt, Homo sapiens
aagugauguuauugggugacuc

SEQ ID NO: 158714 - RNA, 22 nt, Homo sapiens
aagugcuucagaagacaauauu

SEQ ID NO: 158715 - RNA, 22 nt, Homo sapiens
aagugucuuaccgggagggagu

SEQ ID NO: 158716 - RNA, 22 nt, Homo sapiens
acaauggaauggaguggaaagu

SEQ ID NO: 158717 - RNA, 22 nt, Homo sapiens
acacugucugaugaaaguaguu

SEQ ID NO: 158718 - RNA, 22 nt, Homo sapiens
accauugcacuccagccugggc

SEQ ID NO: 158719 - RNA, 22 nt, Homo sapiens
acccucagaccaguuucccugg

SEQ ID NO: 158720 - RNA, 22 nt, Homo sapiens
accuggcacuuagcaaaucuga

SEQ ID NO: 158721 - RNA, 22 nt, Homo sapiens
acgguauagauuguauccuagg

SEQ ID NO: 158722 - RNA, 22 nt, Homo sapiens
acgugguaguacaguauuuuaa

SEQ ID NO: 158723 - RNA, 22 nt, Homo sapiens
acucagagagaacugucauuug

SEQ ID NO: 158724 - RNA, 22 nt, Homo sapiens
acucagagugggccccuagaua

SEQ ID NO: 158725 - RNA, 22 nt, Homo sapiens
acugcacuccagcccaggugac

SEQ ID NO: 158726 - RNA, 22 nt, Homo sapiens
acugcacuccagccuguugaca

SEQ ID NO: 158727 - RNA, 22 nt, Homo sapiens
acugcacuccagccuuggccac

SEQ ID NO: 158728 - RNA, 20 nt, Homo sapiens
acugcacuucagccugcugg

SEQ ID NO: 158729 - RNA, 22 nt, Homo sapiens
acuggcaauggcagaaauaguu

SEQ ID NO: 158730 - RNA, 21 nt, Homo sapiens
agaaaaucuuaugggaaacau

SEQ ID NO: 158731 - RNA, 22 nt, Homo sapiens
agaaagugcuucccuuugguga

SEQ ID NO: 158732 - RNA, 22 nt, Homo sapiens
agaauguaaacagaauagagga

SEQ ID NO: 158733 - RNA, 22 nt, Homo sapiens
agaaugucagcuggauucagcu

SEQ ID NO: 158734 - RNA, 22 nt, Homo sapiens
agaggaguacuacuccaagucu

SEQ ID NO: 158735 - RNA, 22 nt, Homo sapiens
agauauguuuaguuucaaaaug

SEQ ID NO: 158736 - RNA, 22 nt, Homo sapiens
agauggugauaaaugugguacc

SEQ ID NO: 158737 - RNA, 23 nt, Homo sapiens
agcaaaugcucuagcacuccaac

SEQ ID NO: 158738 - RNA, 22 nt, Homo sapiens
agcaccagaaucugaguuauuc

SEQ ID NO: 158739 - RNA, 22 nt, Homo sapiens
agcaccauuguacuccagccug

SEQ ID NO: 158740 - RNA, 22 nt, Homo sapiens
agcaccauuucucuaaagcacu

SEQ ID NO: 158741 - RNA, 22 nt, Homo sapiens
agcuaaaucucauguugaauug

SEQ ID NO: 158742 - RNA, 22 nt, Homo sapiens
agcuaacauuuuuccucuucca

SEQ ID NO: 158743 - RNA, 22 nt, Homo sapiens
aggaauguuaguacuucuuagu

SEQ ID NO: 158744 - RNA, 22 nt, Homo sapiens
aggagcacaauggucaugugga

SEQ ID NO: 158745 - RNA, 22 nt, Homo sapiens
aggcaagugauagcugcguaau

SEQ ID NO: 158746 - RNA, 22 nt, Homo sapiens
aggcagucucugccggcugagg

SEQ ID NO: 158747 - RNA, 22 nt, Homo sapiens
aggguaguaggcuugggauugg

SEQ ID NO: 158748 - RNA, 22 nt, Homo sapiens
agguauuuuuuauccuccagca

SEQ ID NO: 158749 - RNA, 22 nt, Homo sapiens
agguuguugcaugcuccuuagg

SEQ ID NO: 158750 - RNA, 22 nt, Homo sapiens
agucaagaaucucagcaucuuu

SEQ ID NO: 158751 - RNA, 22 nt, Homo sapiens
agugaacaaagaagugcagaua

SEQ ID NO: 158752 - RNA, 22 nt, Homo sapiens
agugauuuuaacuuccagcaau

SEQ ID NO: 158753 - RNA, 22 nt, Homo sapiens
agugcauuuguucugugucagg

SEQ ID NO: 158754 - RNA, 22 nt, Homo sapiens
aguggcacaauuuugacucccc

SEQ ID NO: 158755 - RNA, 22 nt, Homo sapiens
aguucaaaucgagccuggccau

SEQ ID NO: 158756 - RNA, 22 nt, Homo sapiens
auaagaguaguacauaugagac

SEQ ID NO: 158757 - RNA, 22 nt, Homo sapiens
auagaauguauuaguaaauuug

SEQ ID NO: 158758 - RNA, 22 nt, Homo sapiens
auagaauguuugcgccagguga

SEQ ID NO: 158759 - RNA, 22 nt, Homo sapiens
auaguagcaugcacuggugcug

SEQ ID NO: 158760 - RNA, 22 nt, Homo sapiens
auaucccuguauaagugaaugu

SEQ ID NO: 158761 - RNA, 22 nt, Homo sapiens
aucaaagugaauuaaugagaau

SEQ ID NO: 158762 - RNA, 22 nt, Homo sapiens
aucacagaacuuugagcagaga

SEQ ID NO: 158763 - RNA, 22 nt, Homo sapiens
aucacagagucacgggcaacuu

SEQ ID NO: 158764 - RNA, 20 nt, Homo sapiens
aucagagccggugaaagggc

SEQ ID NO: 158765 - RNA, 18 nt, Homo sapiens
aucagggugaagagagga

SEQ ID NO: 158766 - RNA, 22 nt, Homo sapiens
auccugagacuuugcugaaguu

SEQ ID NO: 158767 - RNA, 22 nt, Homo sapiens
aucugcaaauaaugaagauugg

SEQ ID NO: 158768 - RNA, 19 nt, Homo sapiens
augacauuuggggguggac

SEQ ID NO: 158769 - RNA, 22 nt, Homo sapiens
augacuggauaauggacacaca

SEQ ID NO: 158770 - RNA, 22 nt, Homo sapiens
gccauugcacuccagcuugggc

SEQ ID NO: 158771 - RNA, 22 nt, Homo sapiens
gccauugcacuccgcccugggc

SEQ ID NO: 158772 - RNA, 22 nt, Homo sapiens
gcugguauuacaggcaugagcc

SEQ ID NO: 158773 - RNA, 22 nt, Homo sapiens
ggaagagugaauuaucuugacu

SEQ ID NO: 158774 - RNA, 22 nt, Homo sapiens
ggaagugcuguguggaagucug

SEQ ID NO: 158775 - RNA, 22 nt, Homo sapiens
ggaauguuaaggcgcuguuggu

SEQ ID NO: 158776 - RNA, 22 nt, Homo sapiens
ggacacaucaugugaccaaggu

SEQ ID NO: 158777 - RNA, 22 nt, Homo sapiens
ggagugucagaaacaguguccu

SEQ ID NO: 158778 - RNA, 22 nt, Homo sapiens
ggcaagugggagggaguguuuc

SEQ ID NO: 158779 - RNA, 23 nt, Homo sapiens
ggcacggaauucaaagaggcauu

SEQ ID NO: 158780 - RNA, 22 nt, Homo sapiens
ggcaguguauuacuuaggguuc

SEQ ID NO: 158781 - RNA, 22 nt, Homo sapiens
ggccagaugaucuaugaaggaa

SEQ ID NO: 158782 - RNA, 22 nt, Homo sapiens
ggccagaugcgguggcucacac

SEQ ID NO: 158783 - RNA, 22 nt, Homo sapiens
ggcgccauugcacuccagccug

SEQ ID NO: 158784 - RNA, 22 nt, Homo sapiens
ggcuagagacaaguugcugaga

SEQ ID NO: 158785 - RNA, 22 nt, Homo sapiens
gggaagauauaggcugggcacc

SEQ ID NO: 158786 - RNA, 22 nt, Homo sapiens
gggagguagguauuagcuuuuc

SEQ ID NO: 158787 - RNA, 22 nt, Homo sapiens
gggugguuuuaucucuucccuu

SEQ ID NO: 158788 - RNA, 19 nt, Homo sapiens
ggugcuugaauauuccucc

SEQ ID NO: 158789 - RNA, 22 nt, Homo sapiens
guaaauaccaguuucuggaaca

SEQ ID NO: 158790 - RNA, 22 nt, Homo sapiens
guaaucucagcuacucgggagg

SEQ ID NO: 158791 - RNA, 22 nt, Homo sapiens
guaaucucagcuacuugggagg

SEQ ID NO: 158792 - RNA, 22 nt, Homo sapiens
guacacguggcuguguaggagu

SEQ ID NO: 158793 - RNA, 22 nt, Homo sapiens
guaccucaguuggaaaugcaga

SEQ ID NO: 158794 - RNA, 19 nt, Homo sapiens
guauuugacuuucuuguuu

SEQ ID NO: 158795 - RNA, 22 nt, Homo sapiens
gucaauguaucuagcuguauua

SEQ ID NO: 158796 - RNA, 22 nt, Homo sapiens
gucuaugagucccugaauuuaa

SEQ ID NO: 158797 - RNA, 22 nt, Homo sapiens
gucucccaaccccugugcccag

SEQ ID NO: 158798 - RNA, 22 nt, Homo sapiens
gucuuugcuuuuaaccagaggu

SEQ ID NO: 158799 - RNA, 22 nt, Homo sapiens
gugaaacuggguggugagagac

SEQ ID NO: 158800 - RNA, 22 nt, Homo sapiens
gugagaugauggguauguuaau

SEQ ID NO: 158801 - RNA, 22 nt, Homo sapiens
gugagcauucaaggaaggagcu

SEQ ID NO: 158802 - RNA, 22 nt, Homo sapiens
gugaguuauuauuuauguaaac

SEQ ID NO: 158803 - RNA, 22 nt, Homo sapiens
guggaagguaaugcagcuuacu

SEQ ID NO: 158804 - RNA, 22 nt, Homo sapiens
gugugacagcuauagacaugau

SEQ ID NO: 158805 - RNA, 22 nt, Homo sapiens
guucuauguugggaguucacua

SEQ ID NO: 158806 - RNA, 21 nt, Homo sapiens
uaaaggcuccaauuauacccc

SEQ ID NO: 158807 - RNA, 22 nt, Homo sapiens
uaaauggauaaaugaauaccua

SEQ ID NO: 158808 - RNA, 22 nt, Homo sapiens
uaacuaaagagaagucaauguc

SEQ ID NO: 158809 - RNA, 22 nt, Homo sapiens
uaagacugccccagacagcaag

SEQ ID NO: 158810 - RNA, 22 nt, Homo sapiens
uaagaugaaggcucaccuagaa

SEQ ID NO: 158811 - RNA, 22 nt, Homo sapiens
uaagcagugcaagaauggaaua

SEQ ID NO: 158812 - RNA, 22 nt, Homo sapiens
uaagcuaauguguuuucucuua

SEQ ID NO: 158813 - RNA, 22 nt, Homo sapiens
uaaggaaggcugugugcuuuua

SEQ ID NO: 158814 - RNA, 22 nt, Homo sapiens
uaauauguauacagacagauac

SEQ ID NO: 158815 - RNA, 22 nt, Homo sapiens
uacaggcaccuggcuaauuuuu

SEQ ID NO: 158816 - RNA, 19 nt, Homo sapiens
uacaguacacaacaccuuu

SEQ ID NO: 158817 - RNA, 22 nt, Homo sapiens
uacaguagaaugucuuucaaaa

SEQ ID NO: 158818 - RNA, 22 nt, Homo sapiens
uacaguaguaucuucauuuguu

SEQ ID NO: 158819 - RNA, 22 nt, Homo sapiens
uaccaugaagguggagagagaa

SEQ ID NO: 158820 - RNA, 19 nt, Homo sapiens
uacccagaagcagcauugu

SEQ ID NO: 158821 - RNA, 22 nt, Homo sapiens
uaccucagccaaugcccagaag

SEQ ID NO: 158822 - RNA, 22 nt, Homo sapiens
uacuccccuuguucugugagcu

SEQ ID NO: 158823 - RNA, 23 nt, Homo sapiens
uagaauguuuuuccauguuucuu

SEQ ID NO: 158824 - RNA, 22 nt, Homo sapiens
uagacaacugaaacacugugca

SEQ ID NO: 158825 - RNA, 22 nt, Homo sapiens
uagcacuauguuaucacauacu

SEQ ID NO: 158826 - RNA, 22 nt, Homo sapiens
uagcagcuuuauugagguaaau

SEQ ID NO: 158827 - RNA, 22 nt, Homo sapiens
uagcccagugagguugauuugg

SEQ ID NO: 158828 - RNA, 22 nt, Homo sapiens
uaggaaugaacgauuuauuggu

SEQ ID NO: 158829 - RNA, 22 nt, Homo sapiens
uaggagcacagcagcauguggg

SEQ ID NO: 158830 - RNA, 22 nt, Homo sapiens
uaggcaaaugcaagaguagaac

SEQ ID NO: 158831 - RNA, 22 nt, Homo sapiens
uagugcugagauugagaagccc

SEQ ID NO: 158832 - RNA, 22 nt, Homo sapiens
uauaugcacucagguguaugug

SEQ ID NO: 158833 - RNA, 22 nt, Homo sapiens
uaucacaaacuuagcaguuuaa

SEQ ID NO: 158834 - RNA, 21 nt, Homo sapiens
uaucccagucacaucuaccca

SEQ ID NO: 158835 - RNA, 22 nt, Homo sapiens
uaucccuguggacuucccaaca

SEQ ID NO: 158836 - RNA, 22 nt, Homo sapiens
uaugacauaguccuuaacccuc

SEQ ID NO: 158837 - RNA, 22 nt, Homo sapiens
uaugcacaugugccugggugug

SEQ ID NO: 158838 - RNA, 22 nt, Homo sapiens
uauggaaaucuuaccuuauggu

SEQ ID NO: 158839 - RNA, 22 nt, Homo sapiens
uauggcauuauuuugauagaca

SEQ ID NO: 158840 - RNA, 22 nt, Homo sapiens
uauuauuguccuucuauaccca

SEQ ID NO: 158841 - RNA, 22 nt, Homo sapiens
uauugauuaauugugauuaggc

SEQ ID NO: 158842 - RNA, 22 nt, Homo sapiens
ucaaaugguccacgugaacauu

SEQ ID NO: 158843 - RNA, 22 nt, Homo sapiens
ucaagugauucuugugccuuag

SEQ ID NO: 158844 - RNA, 22 nt, Homo sapiens
ucaauguaucuccaagaauuga

SEQ ID NO: 158845 - RNA, 22 nt, Homo sapiens
ucacauggaggugauaguugaa

SEQ ID NO: 158846 - RNA, 22 nt, Homo sapiens
ucacugcacuucaggcuuucuc

SEQ ID NO: 158847 - RNA, 22 nt, Homo sapiens
ucacuuuguuuuuggauaaguu

SEQ ID NO: 158848 - RNA, 22 nt, Homo sapiens
ucagaccauuucauuacagacu

SEQ ID NO: 158849 - RNA, 22 nt, Homo sapiens
ucagaguggagucugcagccuu

SEQ ID NO: 158850 - RNA, 22 nt, Homo sapiens
ucaggcaugcagcaaugcagug

SEQ ID NO: 158851 - RNA, 22 nt, Homo sapiens
ucaggucauuccaggagggcca

SEQ ID NO: 158852 - RNA, 22 nt, Homo sapiens
ucaguagagacaggauuucacc

SEQ ID NO: 158853 - RNA, 22 nt, Homo sapiens
ucaguagcaugaaaacagacua

SEQ ID NO: 158854 - RNA, 22 nt, Homo sapiens
ucagugaauguuggccacuacu

SEQ ID NO: 158855 - RNA, 22 nt, Homo sapiens
ucagugcuuggcacagagagcu

SEQ ID NO: 158856 - RNA, 22 nt, Homo sapiens
ucaugaccaugguauagaccac

SEQ ID NO: 158857 - RNA, 20 nt, Homo sapiens
ucaugccacugcgcuccagc

SEQ ID NO: 158858 - RNA, 19 nt, Homo sapiens
ucgcgccauucuccugccu

SEQ ID NO: 158859 - RNA, 22 nt, Homo sapiens
ucucaguggugcuggcagggga

SEQ ID NO: 158860 - RNA, 22 nt, Homo sapiens
ucucaugaagguggagaguagg

SEQ ID NO: 158861 - RNA, 22 nt, Homo sapiens
ucugagcaugcaucuugccugg

SEQ ID NO: 158862 - RNA, 22 nt, Homo sapiens
aaacugccuuccuuguaggugc

SEQ ID NO: 158863 - RNA, 22 nt, Homo sapiens
aaagguaguacuucuagaaggg

SEQ ID NO: 158864 - RNA, 22 nt, Homo sapiens
aaagugauuguaguuuuugcca

SEQ ID NO: 158865 - RNA, 22 nt, Homo sapiens
aaaugcagauuccuaggcccca

SEQ ID NO: 158866 - RNA, 22 nt, Homo sapiens
aaauggauuaaguucacuugcu

SEQ ID NO: 158867 - RNA, 22 nt, Homo sapiens
aagccagugugacaggaaacuu

SEQ ID NO: 158868 - RNA, 22 nt, Homo sapiens
aagcuaccauuuguauauaaag

SEQ ID NO: 158869 - RNA, 22 nt, Homo sapiens
aagcuccauuucugccaugaga

SEQ ID NO: 158870 - RNA, 22 nt, Homo sapiens
aagcugcauuuucuagaugcuu

SEQ ID NO: 158871 - RNA, 22 nt, Homo sapiens
aaggcagucacuaaauagugag

SEQ ID NO: 158872 - RNA, 22 nt, Homo sapiens
aaggugcucucuuauguagaaa

SEQ ID NO: 158873 - RNA, 22 nt, Homo sapiens
aaucccuuuguccagucucuuu

SEQ ID NO: 158874 - RNA, 22 nt, Homo sapiens
aauggcaagagccacagaggcg

SEQ ID NO: 158875 - RNA, 22 nt, Homo sapiens
aauggcaucuacguuaaauguc

SEQ ID NO: 158876 - RNA, 22 nt, Homo sapiens
acaagugaauacaggauucucu

SEQ ID NO: 158877 - RNA, 19 nt, Homo sapiens
acagauagaauguucuaca

SEQ ID NO: 158878 - RNA, 20 nt, Homo sapiens
acaguagaagggauuucaaa

SEQ ID NO: 158879 - RNA, 22 nt, Homo sapiens
acauagaguaguggugaggaug

SEQ ID NO: 158880 - RNA, 22 nt, Homo sapiens
acauccauuugcuuuauuugcu

SEQ ID NO: 158881 - RNA, 22 nt, Homo sapiens
acugcacuccagcccgggugac

SEQ ID NO: 158882 - RNA, 22 nt, Homo sapiens
acugcacuccagccucggugac

SEQ ID NO: 158883 - RNA, 22 nt, Homo sapiens
acugcacuccagccugaugaaa

SEQ ID NO: 158884 - RNA, 22 nt, Homo sapiens
acugcacuccagccugcugaca

SEQ ID NO: 158885 - RNA, 22 nt, Homo sapiens
acugcacuccagccuugugaca

SEQ ID NO: 158886 - RNA, 22 nt, Homo sapiens
acugcacuccggccucgugaca

SEQ ID NO: 158887 - RNA, 22 nt, Homo sapiens
acugcacuucagccuguugaca

SEQ ID NO: 158888 - RNA, 22 nt, Homo sapiens
agaauacugucuauucauggua

SEQ ID NO: 158889 - RNA, 22 nt, Homo sapiens
agaauguauauucuguaguugu

SEQ ID NO: 158890 - RNA, 22 nt, Homo sapiens
agaaugucaguauuggcuaaaa

SEQ ID NO: 158891 - RNA, 22 nt, Homo sapiens
agacaguguguguauauauggu

SEQ ID NO: 158892 - RNA, 22 nt, Homo sapiens
agagugaagcuuuuuauauucu

SEQ ID NO: 158893 - RNA, 18 nt, Homo sapiens
agaugguguugcuucugu

SEQ ID NO: 158894 - RNA, 22 nt, Homo sapiens
agauucauccaaguuguugcau

SEQ ID NO: 158895 - RNA, 22 nt, Homo sapiens
agcacagugaaugguuuacuca

SEQ ID NO: 158896 - RNA, 22 nt, Homo sapiens
agcacagugguuaaguuucuua

SEQ ID NO: 158897 - RNA, 22 nt, Homo sapiens
agcagauguuuagugagcgccu

SEQ ID NO: 158898 - RNA, 22 nt, Homo sapiens
agccaguauuuuauugaggauu

SEQ ID NO: 158899 - RNA, 19 nt, Homo sapiens
agccaguuuucccagcacc

SEQ ID NO: 158900 - RNA, 22 nt, Homo sapiens
agcccauguggcugaggcuucu

SEQ ID NO: 158901 - RNA, 22 nt, Homo sapiens
agccuauccaauaucagugaga

SEQ ID NO: 158902 - RNA, 19 nt, Homo sapiens
agcuguguugccugugaga

SEQ ID NO: 158903 - RNA, 20 nt, Homo sapiens
aggagcauuuacauuggcuc

SEQ ID NO: 158904 - RNA, 23 nt, Homo sapiens
aggcauuguacaguaauggaaaa

SEQ ID NO: 158905 - RNA, 19 nt, Homo sapiens
aggcauugugcucaucugu

SEQ ID NO: 158906 - RNA, 22 nt, Homo sapiens
aggccaguuuuuggagggaaac

SEQ ID NO: 158907 - RNA, 22 nt, Homo sapiens
aggugguguuggguuccagccc

SEQ ID NO: 158908 - RNA, 20 nt, Homo sapiens
agguucaaaucccaaucaug

SEQ ID NO: 158909 - RNA, 22 nt, Homo sapiens
agucacaugccagcacacccag

SEQ ID NO: 158910 - RNA, 19 nt, Homo sapiens
agugagccaagauccuacc

SEQ ID NO: 158911 - RNA, 22 nt, Homo sapiens
agugcaguggcacaaucuuggc

SEQ ID NO: 158912 - RNA, 22 nt, Homo sapiens
agugccuacuugaauuguagug

SEQ ID NO: 158913 - RNA, 22 nt, Homo sapiens
aguggcacuauucucagaguca

SEQ ID NO: 158914 - RNA, 22 nt, Homo sapiens
auacaguaaugucuuaggcugu

SEQ ID NO: 158915 - RNA, 20 nt, Homo sapiens
auacccaguagcacaacagc

SEQ ID NO: 158916 - RNA, 22 nt, Homo sapiens
auagcaauuugggaaucagacu

SEQ ID NO: 158917 - RNA, 22 nt, Homo sapiens
auagugcugcaauaaccauggg

SEQ ID NO: 158918 - RNA, 22 nt, Homo sapiens
auaucccagugaugauugauag

SEQ ID NO: 158919 - RNA, 22 nt, Homo sapiens
auaugcaaauccauagagacag

SEQ ID NO: 158920 - RNA, 22 nt, Homo sapiens
auauugcuugaggccaggaggu

SEQ ID NO: 158921 - RNA, 22 nt, Homo sapiens
aucauccugucaggagcuguga

SEQ ID NO: 158922 - RNA, 22 nt, Homo sapiens
auccugaagcuuuacugaauuc

SEQ ID NO: 158923 - RNA, 22 nt, Homo sapiens
aucuaaucaucgcaaccuucaa

SEQ ID NO: 158924 - RNA, 22 nt, Homo sapiens
aucucagagaaaauuacuaaga

SEQ ID NO: 158925 - RNA, 22 nt, Homo sapiens
aucugguguuuuucucccucgu

SEQ ID NO: 158926 - RNA, 22 nt, Homo sapiens
augagcacuuguuuugggcaca

SEQ ID NO: 158927 - RNA, 22 nt, Homo sapiens
augagcuaguguaggguacuga

SEQ ID NO: 158928 - RNA, 22 nt, Homo sapiens
augagcuguuuggaagacacuu

SEQ ID NO: 158929 - RNA, 22 nt, Homo sapiens
augcaacugcacuccagccugg

SEQ ID NO: 158930 - RNA, 22 nt, Homo sapiens
augcaagcacacaagaggaaau

SEQ ID NO: 158931 - RNA, 22 nt, Homo sapiens
gaagugcaguggcacagucaug

SEQ ID NO: 158932 - RNA, 22 nt, Homo sapiens
gacuauguuaccuuacacauca

SEQ ID NO: 158933 - RNA, 22 nt, Homo sapiens
gagaagugcgucguuugaugau

SEQ ID NO: 158934 - RNA, 22 nt, Homo sapiens
gagacggagucacgcccuguca

SEQ ID NO: 158935 - RNA, 22 nt, Homo sapiens
gagacggagucucgcucuguca

SEQ ID NO: 158936 - RNA, 22 nt, Homo sapiens
gagacugagucuugcucuguca

SEQ ID NO: 158937 - RNA, 22 nt, Homo sapiens
gagagugcuuuggguguaggcc

SEQ ID NO: 158938 - RNA, 22 nt, Homo sapiens
gagcucauuguugcuaaagaga

SEQ ID NO: 158939 - RNA, 22 nt, Homo sapiens
gaggaaguaauuuuaggccugu

SEQ ID NO: 158940 - RNA, 22 nt, Homo sapiens
gagguauggauaucuggagagg

SEQ ID NO: 158941 - RNA, 22 nt, Homo sapiens
gagguugggaugagggauacag

SEQ ID NO: 158942 - RNA, 22 nt, Homo sapiens
gaguucaaaucucagcucuguu

SEQ ID NO: 158943 - RNA, 22 nt, Homo sapiens
gauggcacuaagccauguagga

SEQ ID NO: 158944 - RNA, 22 nt, Homo sapiens
gcaaaguguuuuuaggaagucu

SEQ ID NO: 158945 - RNA, 22 nt, Homo sapiens
gcacaaugccugacgaguccug

SEQ ID NO: 158946 - RNA, 22 nt, Homo sapiens
gcagaguauagagggcugggcc

SEQ ID NO: 158947 - RNA, 22 nt, Homo sapiens
gcaggaaucuugagaaggauuc

SEQ ID NO: 158948 - RNA, 22 nt, Homo sapiens
gcaggcaugacauuucacucuu

SEQ ID NO: 158949 - RNA, 22 nt, Homo sapiens
gcaguacacuguugguaggaau

SEQ ID NO: 158950 - RNA, 19 nt, Homo sapiens
gcaguauugaaggccaguc

SEQ ID NO: 158951 - RNA, 22 nt, Homo sapiens
gccauugcacuccagccuagcg

SEQ ID NO: 158952 - RNA, 22 nt, Homo sapiens
gccauugcacuccagccuaggu

SEQ ID NO: 158953 - RNA, 22 nt, Homo sapiens
gccauugcacucuagccugagc

SEQ ID NO: 158954 - RNA, 22 nt, Homo sapiens
gccucaguuguggccagggauu

SEQ ID NO: 158955 - RNA, 22 nt, Homo sapiens
gcuggucugccguaguaggugc

SEQ ID NO: 158956 - RNA, 22 nt, Homo sapiens
gcuguguugugcccagcaucau

SEQ ID NO: 158957 - RNA, 22 nt, Homo sapiens
gcuguugguaaaaaggacauga

SEQ ID NO: 158958 - RNA, 22 nt, Homo sapiens
gcuguugugaacuauacaucua

SEQ ID NO: 158959 - RNA, 22 nt, Homo sapiens
gcuugguccccacccaaaucgc

SEQ ID NO: 158960 - RNA, 19 nt, Homo sapiens
ggaaaugucuauuaagauc

SEQ ID NO: 158961 - RNA, 22 nt, Homo sapiens
ggaagguaauuggguaaugaga

SEQ ID NO: 158962 - RNA, 19 nt, Homo sapiens
ggaaugcaccaguccuugc

SEQ ID NO: 158963 - RNA, 22 nt, Homo sapiens
ggagguagguuugugauuugua

SEQ ID NO: 158964 - RNA, 23 nt, Homo sapiens
ggauggaaaguuuugagggccac

SEQ ID NO: 158965 - RNA, 19 nt, Homo sapiens
ggcacugugugagugagga

SEQ ID NO: 158966 - RNA, 17 nt, Homo sapiens
ggcaggauccaggaucc

SEQ ID NO: 158967 - RNA, 21 nt, Homo sapiens
ggcauugugcccuugcucuag

SEQ ID NO: 158968 - RNA, 22 nt, Homo sapiens
ggccagaugcaguggcucacac

SEQ ID NO: 158969 - RNA, 22 nt, Homo sapiens
ggccggguggccauggcugccc

SEQ ID NO: 158970 - RNA, 22 nt, Homo sapiens
gggaauggaagacauuaugaug

SEQ ID NO: 158971 - RNA, 22 nt, Homo sapiens
gggcauugugggcagagggcag

SEQ ID NO: 158972 - RNA, 22 nt, Homo sapiens
ggguaggcaagcggaugucaga

SEQ ID NO: 158973 - RNA, 22 nt, Homo sapiens
ggucacauuggacuaucaaguu

SEQ ID NO: 158974 - RNA, 22 nt, Homo sapiens
gguggcaaaucugaguggcgcu

SEQ ID NO: 158975 - RNA, 22 nt, Homo sapiens
guaaucucagcuucuugggagg

SEQ ID NO: 158976 - RNA, 19 nt, Homo sapiens
guaaugugcuucaguagca

SEQ ID NO: 158977 - RNA, 22 nt, Homo sapiens
guacauagucacacauauacau

SEQ ID NO: 158978 - RNA, 22 nt, Homo sapiens
guauacacccugugauauuauu

SEQ ID NO: 158979 - RNA, 22 nt, Homo sapiens
guaugcacauauguguauguau

SEQ ID NO: 158980 - RNA, 22 nt, Homo sapiens
gucauugcuuaucugcugacgu

SEQ ID NO: 158981 - RNA, 22 nt, Homo sapiens
guccaugagaugaauccacaca

SEQ ID NO: 158982 - RNA, 22 nt, Homo sapiens
guccuggagaagcguggaccgg

SEQ ID NO: 158983 - RNA, 22 nt, Homo sapiens
gugacacagcaagacuccgucu

SEQ ID NO: 158984 - RNA, 22 nt, Homo sapiens
gugagaugugacuucugccucu

SEQ ID NO: 158985 - RNA, 17 nt, Homo sapiens
gugagguggguaguauc

SEQ ID NO: 158986 - RNA, 22 nt, Homo sapiens
gugcaaauguuauugagguuuu

SEQ ID NO: 158987 - RNA, 22 nt, Homo sapiens
gugcgggaggcgcgccuaggug

SEQ ID NO: 158988 - RNA, 22 nt, Homo sapiens
gugcuaggugcuaggaagauag

SEQ ID NO: 158989 - RNA, 22 nt, Homo sapiens
guggaaggucaugaauguucuu

SEQ ID NO: 158990 - RNA, 22 nt, Homo sapiens
guggucagaaaucucaguggca

SEQ ID NO: 158991 - RNA, 22 nt, Homo sapiens
guucacacuugcaaccccagca

SEQ ID NO: 158992 - RNA, 22 nt, Homo sapiens
guugagcaagcuuuggagccua

SEQ ID NO: 158993 - RNA, 22 nt, Homo sapiens
guuggaauguauugcuacuucu

SEQ ID NO: 158994 - RNA, 22 nt, Homo sapiens
guuggcaagaggugcuguacac

SEQ ID NO: 158995 - RNA, 22 nt, Homo sapiens
uaaauggauauugccaucuccu

SEQ ID NO: 158996 - RNA, 22 nt, Homo sapiens
uaacaccuuugauagcacuuuu

SEQ ID NO: 158997 - RNA, 22 nt, Homo sapiens
uaacaguauauuuaccaaaccu

SEQ ID NO: 158998 - RNA, 21 nt, Homo sapiens
uaagcuaaacauucaguuaac

SEQ ID NO: 158999 - RNA, 22 nt, Homo sapiens
uaagguuuuugauaugcugcug

SEQ ID NO: 159000 - RNA, 22 nt, Homo sapiens
uaagugacuuugagauuccuca

SEQ ID NO: 159001 - RNA, 22 nt, Homo sapiens
uaagugaugucuuuuugugugc

SEQ ID NO: 159002 - RNA, 22 nt, Homo sapiens
uaaguggaagaugucaaucaua

SEQ ID NO: 159003 - RNA, 22 nt, Homo sapiens
uacaaagcuacucgagggcagg

SEQ ID NO: 159004 - RNA, 22 nt, Homo sapiens
uacucaguagacacucauaugu

SEQ ID NO: 159005 - RNA, 22 nt, Homo sapiens
uagaggaaggauuggaaacgca

SEQ ID NO: 159006 - RNA, 22 nt, Homo sapiens
uagaggaaugaauuuggccaga

SEQ ID NO: 159007 - RNA, 20 nt, Homo sapiens
uagcaggugucaggugauau

SEQ ID NO: 159008 - RNA, 22 nt, Homo sapiens
uagcugagacuacaguaggugc

SEQ ID NO: 159009 - RNA, 22 nt, Homo sapiens
uaggcaguggagaaauaaacag

SEQ ID NO: 159010 - RNA, 22 nt, Homo sapiens
uaucacagaggguauccuagag

SEQ ID NO: 159011 - RNA, 22 nt, Homo sapiens
uaucccaguggauguaccccau

SEQ ID NO: 159012 - RNA, 22 nt, Homo sapiens
uaugacugagacuuaaauugug

SEQ ID NO: 159013 - RNA, 19 nt, Homo sapiens
uaugcaacuuauagugcug

SEQ ID NO: 159014 - RNA, 22 nt, Homo sapiens
uauuucaguugugcagguaguu

SEQ ID NO: 159015 - RNA, 22 nt, Homo sapiens
ucaaagugagcuccuucucacu

SEQ ID NO: 159016 - RNA, 22 nt, Homo sapiens
ucaacacaguuaaauggggaaa

SEQ ID NO: 159017 - RNA, 18 nt, Homo sapiens
ucaauguggauguucuuu

SEQ ID NO: 159018 - RNA, 18 nt, Homo sapiens
ucacauggccgagagaga

SEQ ID NO: 159019 - RNA, 22 nt, Homo sapiens
ucacaugggugcaauauaauca

SEQ ID NO: 159020 - RNA, 20 nt, Homo sapiens
ucacuggagcucauuugauu

SEQ ID NO: 159021 - RNA, 22 nt, Homo sapiens
agcaccaauaaucagaguucuu

SEQ ID NO: 159022 - RNA, 23 nt, Homo sapiens
agcaccaccccaggucacaagug

SEQ ID NO: 159023 - RNA, 22 nt, Homo sapiens
agcaucagugauuuuguugaag

SEQ ID NO: 159024 - RNA, 22 nt, Homo sapiens
agccaguuuggcuaauuuuggc

SEQ ID NO: 159025 - RNA, 22 nt, Homo sapiens
ucacuuggugaacacauuaugu

SEQ ID NO: 159026 - RNA, 22 nt, Homo sapiens
ucagacacuguggccuuuggac

SEQ ID NO: 159027 - RNA, 22 nt, Homo sapiens
ucagaucaugcuuaugauggga

SEQ ID NO: 159028 - RNA, 22 nt, Homo sapiens
ucagcgcauggucgugcggcau

SEQ ID NO: 159029 - RNA, 22 nt, Homo sapiens
cuuuugcugggucagcgguggu

SEQ ID NO: 159030 - RNA, 22 nt, Homo sapiens
aaaaggcuagcuaguaacagaa

SEQ ID NO: 159031 - RNA, 22 nt, Homo sapiens
aaagaagucagccuguccuuug

SEQ ID NO: 159032 - RNA, 22 nt, Homo sapiens
aaagcacugaauaaauuugcuu

SEQ ID NO: 159033 - RNA, 22 nt, Homo sapiens
aaagcacuggagucaucaucua

SEQ ID NO: 159034 - RNA, 20 nt, Homo sapiens
aaaggcugugagaacgagau

SEQ ID NO: 159035 - RNA, 18 nt, Homo sapiens
aaagugaugucauucuuu

SEQ ID NO: 159036 - RNA, 22 nt, Homo sapiens
aaaguggacuaagugaauauga

SEQ ID NO: 159037 - RNA, 22 nt, Homo sapiens
aaccuacauucuuaacuguugc

SEQ ID NO: 159038 - RNA, 20 nt, Homo sapiens
aagcugaguguuuuuuuaau

SEQ ID NO: 159039 - RNA, 22 nt, Homo sapiens
aaggaagcuagcaggaauuggu

SEQ ID NO: 159040 - RNA, 22 nt, Homo sapiens
aaggcaugcugaguccuaaaag

SEQ ID NO: 159041 - RNA, 22 nt, Homo sapiens
aaggcauggugacuauuuaggc

SEQ ID NO: 159042 - RNA, 22 nt, Homo sapiens
aaggcuuuuugcugacguccuu

SEQ ID NO: 159043 - RNA, 22 nt, Homo sapiens
aagugacuagacuaugaaaccu

SEQ ID NO: 159044 - RNA, 22 nt, Homo sapiens
aagugagaugcaguggaguucc

SEQ ID NO: 159045 - RNA, 23 nt, Homo sapiens
aagugagcuccaauugggugaga

SEQ ID NO: 159046 - RNA, 22 nt, Homo sapiens
aaguggaauguuuguggcacaa

SEQ ID NO: 159047 - RNA, 22 nt, Homo sapiens
aagugguagggucaggauugga

SEQ ID NO: 159048 - RNA, 22 nt, Homo sapiens
aaugccuagugugugacaggug

SEQ ID NO: 159049 - RNA, 22 nt, Homo sapiens
aaugcuaucuggaacauuguug

SEQ ID NO: 159050 - RNA, 22 nt, Homo sapiens
aauggcacuuuauaaauguuaa

SEQ ID NO: 159051 - RNA, 22 nt, Homo sapiens
aauggcaguagauggaugggua

SEQ ID NO: 159052 - RNA, 22 nt, Homo sapiens
aauggccuuuuucauuauacug

SEQ ID NO: 159053 - RNA, 22 nt, Homo sapiens
aaugugcuguucagaggagucc

SEQ ID NO: 159054 - RNA, 22 nt, Homo sapiens
acaaccauuguaagggcuuugg

SEQ ID NO: 159055 - RNA, 22 nt, Homo sapiens
acaccuguggucccaguaacuu

SEQ ID NO: 159056 - RNA, 20 nt, Homo sapiens
acagcacugguuucaagcaa

SEQ ID NO: 159057 - RNA, 22 nt, Homo sapiens
acaguacaugauaaauaaggua

SEQ ID NO: 159058 - RNA, 21 nt, Homo sapiens
acauguacacauguaugcaca

SEQ ID NO: 159059 - RNA, 22 nt, Homo sapiens
accaugcaguccaauaugcaca

SEQ ID NO: 159060 - RNA, 22 nt, Homo sapiens
accuggguguauguucaguuug

SEQ ID NO: 159061 - RNA, 23 nt, Homo sapiens
accugugguuauuuuacucuucc

SEQ ID NO: 159062 - RNA, 22 nt, Homo sapiens
acugcacuccagccucgugaca

SEQ ID NO: 159063 - RNA, 22 nt, Homo sapiens
cugggaugugacuguugccccc

SEQ ID NO: 159064 - RNA, 22 nt, Homo sapiens
cugugcauucuuaaaucaggaa

SEQ ID NO: 159065 - RNA, 22 nt, Homo sapiens
cugugguuacguucuuugugcu

SEQ ID NO: 159066 - RNA, 22 nt, Homo sapiens
cuuggcauuguguugauagaag

SEQ ID NO: 159067 - RNA, 22 nt, Homo sapiens
cuuuuacacugcuggugggaau

SEQ ID NO: 159068 - RNA, 22 nt, Homo sapiens
cuuuuacacuguuggcaggauu

SEQ ID NO: 159069 - RNA, 22 nt, Homo sapiens
gaaauggaucagagcaagcuuu

SEQ ID NO: 159070 - RNA, 22 nt, Homo sapiens
gaacccuggaggcggagguugc

SEQ ID NO: 159071 - RNA, 22 nt, Homo sapiens
gaagaaguacaagacaaauuuu

SEQ ID NO: 159072 - RNA, 18 nt, Homo sapiens
gaagaaguaggcauggca

SEQ ID NO: 159073 - RNA, 22 nt, Homo sapiens
gaaugcagcagugacagggcug

SEQ ID NO: 159074 - RNA, 22 nt, Homo sapiens
gacaguuucucaggcuuccuua

SEQ ID NO: 159075 - RNA, 22 nt, Homo sapiens
gacucagaacuaaggguguuuc

SEQ ID NO: 159076 - RNA, 22 nt, Homo sapiens
gagagcauuaagccaucaucau

SEQ ID NO: 159077 - RNA, 22 nt, Homo sapiens
gagcugaaguuuccauuuguac

SEQ ID NO: 159078 - RNA, 22 nt, Homo sapiens
gaggaaguagcuacugucuuuc

SEQ ID NO: 159079 - RNA, 22 nt, Homo sapiens
gaggagucagacugugcaaggu

SEQ ID NO: 159080 - RNA, 22 nt, Homo sapiens
gaggcaauaugagggaggcuuc

SEQ ID NO: 159081 - RNA, 22 nt, Homo sapiens
gaggcagucugucccuuagcag

SEQ ID NO: 159082 - RNA, 22 nt, Homo sapiens
gagguagguuugguuacaaaag

SEQ ID NO: 159083 - RNA, 22 nt, Homo sapiens
gaguaaaugucacuguugcugu

SEQ ID NO: 159084 - RNA, 22 nt, Homo sapiens
gaugagguagaagacucagcaa

SEQ ID NO: 159085 - RNA, 22 nt, Homo sapiens
gaugauauuugagucauuagaa

SEQ ID NO: 159086 - RNA, 22 nt, Homo sapiens
gaugccuuuuuguccucaguua

SEQ ID NO: 159087 - RNA, 22 nt, Homo sapiens
gauggcacuguagcaacacaaa

SEQ ID NO: 159088 - RNA, 22 nt, Homo sapiens
gauguuguuuagccuuugaugu

SEQ ID NO: 159089 - RNA, 22 nt, Homo sapiens
uagaaugucagcuucuugaggg

SEQ ID NO: 159090 - RNA, 20 nt, Homo sapiens
uaggagcaaugagaguagaa

SEQ ID NO: 159091 - RNA, 22 nt, Homo sapiens
uaggagcacaaaccccauugug

SEQ ID NO: 159092 - RNA, 22 nt, Homo sapiens
uaggagcauaggauuguuugag

SEQ ID NO: 159093 - RNA, 22 nt, Homo sapiens
uaggcaguguucucacuuguaa

SEQ ID NO: 159094 - RNA, 22 nt, Homo sapiens
uagucccauaugauuuagugaa

SEQ ID NO: 159095 - RNA, 22 nt, Homo sapiens
uauagcauuuugauccuguaga

SEQ ID NO: 159096 - RNA, 22 nt, Homo sapiens
uauaugcaacauaguguaugug

SEQ ID NO: 159097 - RNA, 22 nt, Homo sapiens
uaucccuuagagcggggugguu

SEQ ID NO: 159098 - RNA, 22 nt, Homo sapiens
uaugaaacucuaagauucacau

SEQ ID NO: 159099 - RNA, 22 nt, Homo sapiens
uaugaccuuggacaaguuacuu

SEQ ID NO: 159100 - RNA, 22 nt, Homo sapiens
uaugacuguuugcucauucagg

SEQ ID NO: 159101 - RNA, 22 nt, Homo sapiens
uauuaguuuucuguggauuaca

SEQ ID NO: 159102 - RNA, 22 nt, Homo sapiens
uauuguuuuucccaggagucua

SEQ ID NO: 159103 - RNA, 22 nt, Homo sapiens
ucacagucuccucuagggaggg

SEQ ID NO: 159104 - RNA, 22 nt, Homo sapiens
ucacauaguuuucgggaccuug

SEQ ID NO: 159105 - RNA, 22 nt, Homo sapiens
ucacauggaaaaguccaguaaa

SEQ ID NO: 159106 - RNA, 22 nt, Homo sapiens
ucacccacacaggagacaggga

SEQ ID NO: 159107 - RNA, 23 nt, Homo sapiens
ucacuagaguccuggaguuugag

SEQ ID NO: 159108 - RNA, 22 nt, Homo sapiens
ucacucagaccuggugauaugc

SEQ ID NO: 159109 - RNA, 22 nt, Homo sapiens
ucacugagaaugauguuucuga

SEQ ID NO: 159110 - RNA, 21 nt, Homo sapiens
ucaggaccucuaguuagccag

SEQ ID NO: 159111 - RNA, 22 nt, Homo sapiens
ucauacaguaguccucacuugu

SEQ ID NO: 159112 - RNA, 22 nt, Homo sapiens
ucauaguagucacuuaauaaau

SEQ ID NO: 159113 - RNA, 23 nt, Homo sapiens
ucaugguagcaccaacaauaacu

SEQ ID NO: 159114 - RNA, 22 nt, Homo sapiens
ucauugagacuuguuuuguggc

SEQ ID NO: 159115 - RNA, 22 nt, Homo sapiens
uccacaguggugaggugcagca

SEQ ID NO: 159116 - RNA, 22 nt, Homo sapiens
uccccgaggcuggagugcagug

SEQ ID NO: 159117 - RNA, 18 nt, Homo sapiens
ucccucagaauuauagaa

SEQ ID NO: 159118 - RNA, 22 nt, Homo sapiens
ugugauuauuuaaauaggacag

SEQ ID NO: 159119 - RNA, 22 nt, Homo sapiens
ugugcacauugugcagguugau

SEQ ID NO: 159120 - RNA, 22 nt, Homo sapiens
uguggcagugcuuuaugaaacc

SEQ ID NO: 159121 - RNA, 22 nt, Homo sapiens
ugugucuuguuuauagcuuucu

SEQ ID NO: 159122 - RNA, 22 nt, Homo sapiens
uguuaucauuacguucuuaguu

SEQ ID NO: 159123 - RNA, 22 nt, Homo sapiens
uuaauuguccaaguucaucucu

SEQ ID NO: 159124 - RNA, 22 nt, Homo sapiens
uuacaccuguaauccagcacuu

SEQ ID NO: 159125 - RNA, 22 nt, Homo sapiens
uuaccaguggugcuguaaacuu

SEQ ID NO: 159126 - RNA, 22 nt, Homo sapiens
uuacccuuuaacccuuuaaagu

SEQ ID NO: 159127 - RNA, 22 nt, Homo sapiens
uuacccuuugcauuaccaacaa

SEQ ID NO: 159128 - RNA, 22 nt, Homo sapiens
uuagcagcaucccuggccugua

SEQ ID NO: 159129 - RNA, 22 nt, Homo sapiens
uuagcagcucuaauaacugcua

SEQ ID NO: 159130 - RNA, 22 nt, Homo sapiens
uucaaaguaaagggauggagac

SEQ ID NO: 159131 - RNA, 22 nt, Homo sapiens
uucacaugguugccuuuugauc

SEQ ID NO: 159132 - RNA, 22 nt, Homo sapiens
uucagcuacuugggaggcugaa

SEQ ID NO: 159133 - RNA, 22 nt, Homo sapiens
uucaguagucaaaagauaaggg

SEQ ID NO: 159134 - RNA, 22 nt, Homo sapiens
uucccuuucugaaaaucucauu

SEQ ID NO: 159135 - RNA, 22 nt, Homo sapiens
uucugauggaguaguccacaga

SEQ ID NO: 159136 - RNA, 22 nt, Homo sapiens
uucugcuugaucuaguguguug

SEQ ID NO: 159137 - RNA, 22 nt, Homo sapiens
uugacauguaggcagggaaugg

SEQ ID NO: 159138 - RNA, 22 nt, Homo sapiens
uugacuuuuaggaggaaaauga

SEQ ID NO: 159139 - RNA, 22 nt, Homo sapiens
uugagacggagucuugcucuuu

SEQ ID NO: 159140 - RNA, 22 nt, Homo sapiens
uugagaucugugcuuuugcguu

SEQ ID NO: 159141 - RNA, 22 nt, Homo sapiens
uugagaugaagucuugcucucu

SEQ ID NO: 159142 - RNA, 22 nt, Homo sapiens
uugagaugaaguuuugcucuuu

SEQ ID NO: 159143 - RNA, 22 nt, Homo sapiens
uugagauggagucuugcucugu

SEQ ID NO: 159144 - RNA, 22 nt, Homo sapiens
uugagauggagucuugcucuug

SEQ ID NO: 159145 - RNA, 22 nt, Homo sapiens
uugagauggaguuuugcucuug

SEQ ID NO: 159146 - RNA, 22 nt, Homo sapiens
uugagauguaagauguuaauau

SEQ ID NO: 159147 - RNA, 22 nt, Homo sapiens
uugaggucuucaggaucaggcu

SEQ ID NO: 159148 - RNA, 22 nt, Homo sapiens
uugauccucugagaaucuaucg

SEQ ID NO: 159149 - RNA, 20 nt, Homo sapiens
uucccucagccuugagggua

SEQ ID NO: 159150 - RNA, 22 nt, Homo sapiens
uuccuggaggggaaguguccaa

SEQ ID NO: 159151 - RNA, 22 nt, Homo sapiens
uucuagcaauggcagagugucu

SEQ ID NO: 159152 - RNA, 22 nt, Homo sapiens
uugaaaucuuccacagcccaag

SEQ ID NO: 159153 - RNA, 22 nt, Homo sapiens
uugagaugauggauaugcuaau

SEQ ID NO: 159154 - RNA, 22 nt, Homo sapiens
uugagauggauagacauagcau

SEQ ID NO: 159155 - RNA, 22 nt, Homo sapiens
uugagauguggguuggugacuu

SEQ ID NO: 159156 - RNA, 22 nt, Homo sapiens
uugagcaacauagugagacugu

SEQ ID NO: 159157 - RNA, 22 nt, Homo sapiens
uugagcacaggaguuuugagac

SEQ ID NO: 159158 - RNA, 22 nt, Homo sapiens
uugagccaaggauugucuuucc

SEQ ID NO: 159159 - RNA, 22 nt, Homo sapiens
uugagcccuggaggcagaggcu

SEQ ID NO: 159160 - RNA, 22 nt, Homo sapiens
uugaggucagagguucgagacc

SEQ ID NO: 159161 - RNA, 22 nt, Homo sapiens
uugcaagauguucaugggcugu

SEQ ID NO: 159162 - RNA, 22 nt, Homo sapiens
uugcacagucuagcuccaccuu

SEQ ID NO: 159163 - RNA, 22 nt, Homo sapiens
uugcacuccagcucuaggugac

SEQ ID NO: 159164 - RNA, 22 nt, Homo sapiens
uugcacuuccgccugggugaca

SEQ ID NO: 159165 - RNA, 22 nt, Homo sapiens
uugcagugguuucacuggcaaa

SEQ ID NO: 159166 - RNA, 22 nt, Homo sapiens
uugcagugugacgacuauauuu

SEQ ID NO: 159167 - RNA, 22 nt, Homo sapiens
uugcgaugaagacaaaacaugc

SEQ ID NO: 159168 - RNA, 22 nt, Homo sapiens
uuggagugugagagcagccugg

SEQ ID NO: 159169 - RNA, 22 nt, Homo sapiens
uuggagugugcucauaacugcu

SEQ ID NO: 159170 - RNA, 22 nt, Homo sapiens
uuggagugugucuuauuccauu

SEQ ID NO: 159171 - RNA, 22 nt, Homo sapiens
uuggcaaaugucacaaaucagg

SEQ ID NO: 159172 - RNA, 22 nt, Homo sapiens
uuggcauugccaaacugucaac

SEQ ID NO: 159173 - RNA, 22 nt, Homo sapiens
uugggccacuuuaguuuccuua

SEQ ID NO: 159174 - RNA, 20 nt, Homo sapiens
uuggugaccuguuugguauu

SEQ ID NO: 159175 - RNA, 22 nt, Homo sapiens
uugguuccauuuuaccagcucu

SEQ ID NO: 159176 - RNA, 19 nt, Homo sapiens
uugguugguuauuucuuac

SEQ ID NO: 159177 - RNA, 22 nt, Homo sapiens
uugucacauggggcggcugccc

SEQ ID NO: 159178 - RNA, 22 nt, Homo sapiens
uugucaugguuaauuuuaugua

SEQ ID NO: 159179 - RNA, 19 nt, Homo sapiens
uuucaauguaaggauggag

SEQ ID NO: 159180 - RNA, 22 nt, Homo sapiens
uuucaggcaagggugacccuga

SEQ ID NO: 159181 - RNA, 22 nt, Homo sapiens
uuucauggcgaggcuucauggg

SEQ ID NO: 159182 - RNA, 22 nt, Homo sapiens
uuucuauguugaccagucuaga

SEQ ID NO: 159183 - RNA, 22 nt, Homo sapiens
uuugacacugggagugugggug

SEQ ID NO: 159184 - RNA, 22 nt, Homo sapiens
uuugacuuuuagaauaugaguu

SEQ ID NO: 159185 - RNA, 22 nt, Homo sapiens
uuugcagugucagcuucugugu

SEQ ID NO: 159186 - RNA, 23 nt, Homo sapiens
uuuugcaauaagucacuggaaua

SEQ ID NO: 159187 - RNA, 22 nt, Homo sapiens
uuuugcacauugauuugguauc

SEQ ID NO: 159188 - RNA, 22 nt, Homo sapiens
agcuccuuucugcaggcagguc

SEQ ID NO: 159189 - RNA, 22 nt, Homo sapiens
agcuggucuacguguguaugag

SEQ ID NO: 159190 - RNA, 22 nt, Homo sapiens
aggaagguaaacuaacuugccu

SEQ ID NO: 159191 - RNA, 22 nt, Homo sapiens
aggaaucuaagguaucagguua

SEQ ID NO: 159192 - RNA, 22 nt, Homo sapiens
aggaaugucaaugguaguuuaa

SEQ ID NO: 159193 - RNA, 22 nt, Homo sapiens
aggcaugaguucagaggguaug

SEQ ID NO: 159194 - RNA, 22 nt, Homo sapiens
aggcauugugcaucgaugauuu

SEQ ID NO: 159195 - RNA, 22 nt, Homo sapiens
agggcacuguagguccugccuc

SEQ ID NO: 159196 - RNA, 22 nt, Homo sapiens
agggcaguguuaggacugucug

SEQ ID NO: 159197 - RNA, 22 nt, Homo sapiens
aggugcucuuccuguaggucac

SEQ ID NO: 159198 - RNA, 22 nt, Homo sapiens
agugcagugguuaggagccagg

SEQ ID NO: 159199 - RNA, 22 nt, Homo sapiens
aguggugucugaguggccaggg

SEQ ID NO: 159200 - RNA, 22 nt, Homo sapiens
auaaucaugucugaaaccuuug

SEQ ID NO: 159201 - RNA, 22 nt, Homo sapiens
auacaguauggagggcccagcu

SEQ ID NO: 159202 - RNA, 22 nt, Homo sapiens
auacaugugugagcgaagaugu

SEQ ID NO: 159203 - RNA, 22 nt, Homo sapiens
auagcaggagaauggucauggg

SEQ ID NO: 159204 - RNA, 21 nt, Homo sapiens
auagugcuagagaguagcagg

SEQ ID NO: 159205 - RNA, 22 nt, Homo sapiens
auauaugcacacgugugcauau

SEQ ID NO: 159206 - RNA, 22 nt, Homo sapiens
auaugcacaguggaguacuauu

SEQ ID NO: 159207 - RNA, 20 nt, Homo sapiens
auaugcagacacauacauac

SEQ ID NO: 159208 - RNA, 22 nt, Homo sapiens
aucacuuucuauuucugugcca

SEQ ID NO: 159209 - RNA, 22 nt, Homo sapiens
aucaggcacacauuggaguuug

SEQ ID NO: 159210 - RNA, 22 nt, Homo sapiens
aucccuguaguaauauucuagc

SEQ ID NO: 159211 - RNA, 22 nt, Homo sapiens
auccucaguggcuuaaguauag

SEQ ID NO: 159212 - RNA, 22 nt, Homo sapiens
auccuguagagaugagggugga

SEQ ID NO: 159213 - RNA, 22 nt, Homo sapiens
augaaagugauaaaugucucua

SEQ ID NO: 159214 - RNA, 22 nt, Homo sapiens
augaaugcaucuaucaaagcau

SEQ ID NO: 159215 - RNA, 20 nt, Homo sapiens
augaauguccuugauggcau

SEQ ID NO: 159216 - RNA, 21 nt, Homo sapiens
augacccuggguguccuuucc

SEQ ID NO: 159217 - RNA, 22 nt, Homo sapiens
augaccuuguccucagugucau

SEQ ID NO: 159218 - RNA, 19 nt, Homo sapiens
augcaaugucacaggcugc

SEQ ID NO: 159219 - RNA, 22 nt, Homo sapiens
augcagcugaggguaguggagc

SEQ ID NO: 159220 - RNA, 22 nt, Homo sapiens
augcagugugcaacagauuaag

SEQ ID NO: 159221 - RNA, 22 nt, Homo sapiens
augccuaagacccuguggggga

SEQ ID NO: 159222 - RNA, 22 nt, Homo sapiens
auggaaggagaauggucuuuga

SEQ ID NO: 159223 - RNA, 22 nt, Homo sapiens
auggagagaauuauucucucag

SEQ ID NO: 159224 - RNA, 22 nt, Homo sapiens
auggccuuucuggcacauuucc

SEQ ID NO: 159225 - RNA, 22 nt, Homo sapiens
auggucuuuuuguuaugagaga

SEQ ID NO: 159226 - RNA, 22 nt, Homo sapiens
augugggaggacuuggcuguug

SEQ ID NO: 159227 - RNA, 22 nt, Homo sapiens
auguuaagauggaacaugggaa

SEQ ID NO: 159228 - RNA, 22 nt, Homo sapiens
auuacccuuagacuccagagug

SEQ ID NO: 159229 - RNA, 22 nt, Homo sapiens
auucaacuaauuauugaagaug

SEQ ID NO: 159230 - RNA, 22 nt, Homo sapiens
auucacuuuuauagacaggucu

SEQ ID NO: 159231 - RNA, 23 nt, Homo sapiens
auugcacuccagccuaccugggc

SEQ ID NO: 159232 - RNA, 22 nt, Homo sapiens
auugcacuccagccugggcuag

SEQ ID NO: 159233 - RNA, 22 nt, Homo sapiens
auugcacuccagccuggggaac

SEQ ID NO: 159234 - RNA, 22 nt, Homo sapiens
auugcacuccagccugggggac

SEQ ID NO: 159235 - RNA, 22 nt, Homo sapiens
auugcacuccagccuggugaca

SEQ ID NO: 159236 - RNA, 19 nt, Homo sapiens
auugcaguguaaaacuauu

SEQ ID NO: 159237 - RNA, 22 nt, Homo sapiens
auuugucacuauguggcuaaua

SEQ ID NO: 159238 - RNA, 22 nt, Homo sapiens
caaggugcugagacaggagccc

SEQ ID NO: 159239 - RNA, 22 nt, Homo sapiens
caagugaauaguugcucucaga

SEQ ID NO: 159240 - RNA, 22 nt, Homo sapiens
cacugcacuccaguuucgguaa

SEQ ID NO: 159241 - RNA, 22 nt, Homo sapiens
cacugcauccuugaccuucugg

SEQ ID NO: 159242 - RNA, 22 nt, Homo sapiens
cagauggucuuaaggcagccuu

SEQ ID NO: 159243 - RNA, 20 nt, Homo sapiens
cagggcaaugaggagguaaa

SEQ ID NO: 159244 - RNA, 22 nt, Homo sapiens
cagugcauguggcacucuccag

SEQ ID NO: 159245 - RNA, 22 nt, Homo sapiens
cagugucugcauuuggaacuca

SEQ ID NO: 159246 - RNA, 22 nt, Homo sapiens
caguugguguacauauauguau

SEQ ID NO: 159247 - RNA, 22 nt, Homo sapiens
cauagcacacauuuaccuaugu

SEQ ID NO: 159248 - RNA, 22 nt, Homo sapiens
cauagcacacguauaccuaugu

SEQ ID NO: 159249 - RNA, 22 nt, Homo sapiens
caugaugcuagguauggaugaa

SEQ ID NO: 159250 - RNA, 22 nt, Homo sapiens
cauggcacaucuuuucugacua

SEQ ID NO: 159251 - RNA, 22 nt, Homo sapiens
cauguaguagaaggagccagac

SEQ ID NO: 159252 - RNA, 22 nt, Homo sapiens
cauugcacuccagccugaguga

SEQ ID NO: 159253 - RNA, 20 nt, Homo sapiens
cauugcccuccagccugggc

SEQ ID NO: 159254 - RNA, 22 nt, Homo sapiens
cauuuuacuuuccagacgugga

SEQ ID NO: 159255 - RNA, 22 nt, Homo sapiens
ccaaauccauccaaaucauaga

SEQ ID NO: 159256 - RNA, 22 nt, Homo sapiens
ccagugaacugcaagguuuuuc

SEQ ID NO: 159257 - RNA, 22 nt, Homo sapiens
ccauugcacuccagccucggca

SEQ ID NO: 159258 - RNA, 22 nt, Homo sapiens
ccauugcacucuggccuaggug

SEQ ID NO: 159259 - RNA, 19 nt, Homo sapiens
cccuggcacauggaaaaug

SEQ ID NO: 159260 - RNA, 22 nt, Homo sapiens
ccucacaaccuuuauugaagag

SEQ ID NO: 159261 - RNA, 22 nt, Homo sapiens
ccuggaucauugucauucccaa

SEQ ID NO: 159262 - RNA, 20 nt, Homo sapiens
cuaaucaucccagaagaaau

SEQ ID NO: 159263 - RNA, 22 nt, Homo sapiens
cuagaggcacagccuaggcacu

SEQ ID NO: 159264 - RNA, 22 nt, Homo sapiens
cucacagucagaagggacuugc

SEQ ID NO: 159265 - RNA, 22 nt, Homo sapiens
cucacuggguguaaaacaugua

SEQ ID NO: 159266 - RNA, 20 nt, Homo sapiens
cucagugcacccccauaaaa

SEQ ID NO: 159267 - RNA, 22 nt, Homo sapiens
cucauggagauagagaauagaa

SEQ ID NO: 159268 - RNA, 22 nt, Homo sapiens
cucauggauggucuggcagcca

SEQ ID NO: 159269 - RNA, 22 nt, Homo sapiens
cugaccauagacuacucugggc

SEQ ID NO: 159270 - RNA, 22 nt, Homo sapiens
cuggucaagagcaaaggccagg

SEQ ID NO: 159271 - RNA, 22 nt, Homo sapiens
cuguauguuucuaugaauguga

SEQ ID NO: 159272 - RNA, 22 nt, Homo sapiens
cugucuggaggccugcaaauaa

SEQ ID NO: 159273 - RNA, 22 nt, Homo sapiens
cuguugguuaaauuccaugcag

SEQ ID NO: 159274 - RNA, 22 nt, Homo sapiens
cuugacacugucacucaggcca

SEQ ID NO: 159275 - RNA, 20 nt, Homo sapiens
cuuggcuuucuugguguuaa

SEQ ID NO: 159276 - RNA, 22 nt, Homo sapiens
cuuucacacuguuggugggaau

SEQ ID NO: 159277 - RNA, 22 nt, Homo sapiens
cuuugggaccgcgguuuauacu

SEQ ID NO: 159278 - RNA, 22 nt, Homo sapiens
gaaggcaugcugcauggccaga

SEQ ID NO: 159279 - RNA, 22 nt, Homo sapiens
ucagggacuuacaaaccagaag

SEQ ID NO: 159280 - RNA, 22 nt, Homo sapiens
ucaucucaguuucuugccguac

SEQ ID NO: 159281 - RNA, 23 nt, Homo sapiens
ucaugaggccauucaaauccauu

SEQ ID NO: 159282 - RNA, 22 nt, Homo sapiens
ucauggguuuugguccaagcaa

SEQ ID NO: 159283 - RNA, 22 nt, Homo sapiens
uccagguacucagggggcugag

SEQ ID NO: 159284 - RNA, 22 nt, Homo sapiens
ucccacugucuucucgugcucg

SEQ ID NO: 159285 - RNA, 22 nt, Homo sapiens
ucccagugcuaugcaaaagccu

SEQ ID NO: 159286 - RNA, 22 nt, Homo sapiens
ucccuggacagccuugccuggg

SEQ ID NO: 159287 - RNA, 22 nt, Homo sapiens
ucgcagcucacuggagccucga

SEQ ID NO: 159288 - RNA, 22 nt, Homo sapiens
ucgcgccauucuccugccucag

SEQ ID NO: 159289 - RNA, 22 nt, Homo sapiens
ucucaaccucccaaguagcugg

SEQ ID NO: 159290 - RNA, 22 nt, Homo sapiens
ucucauggagucaggagcagaa

SEQ ID NO: 159291 - RNA, 22 nt, Homo sapiens
ucucauuggucugagucaccug

SEQ ID NO: 159292 - RNA, 22 nt, Homo sapiens
ucuggagugugaaguggauaug

SEQ ID NO: 159293 - RNA, 22 nt, Homo sapiens
ucugguguuacugagccuccca

SEQ ID NO: 159294 - RNA, 22 nt, Homo sapiens
ucugugcauuuucuuuuagacu

SEQ ID NO: 159295 - RNA, 22 nt, Homo sapiens
ucugugguucaaaccagcaacu

SEQ ID NO: 159296 - RNA, 19 nt, Homo sapiens
ucuuugcuuuucuaagagg

SEQ ID NO: 159297 - RNA, 22 nt, Homo sapiens
ugaaacacaccuccucuccauc

SEQ ID NO: 159298 - RNA, 21 nt, Homo sapiens
ugaacacuggacugagugucc

SEQ ID NO: 159299 - RNA, 22 nt, Homo sapiens
ugacaagggaaaugcaaaaugu

SEQ ID NO: 159300 - RNA, 18 nt, Homo sapiens
ugacaaugcuaguccugg

SEQ ID NO: 159301 - RNA, 22 nt, Homo sapiens
ugacagguugauaggugcagca

SEQ ID NO: 159302 - RNA, 19 nt, Homo sapiens
ugacaugaaacccaagauc

SEQ ID NO: 159303 - RNA, 22 nt, Homo sapiens
ugacauguccaggugguccugu

SEQ ID NO: 159304 - RNA, 18 nt, Homo sapiens
ugacauugagcugagaaa

SEQ ID NO: 159305 - RNA, 22 nt, Homo sapiens
ugacuucauuugguaauugggu

SEQ ID NO: 159306 - RNA, 19 nt, Homo sapiens
ugagaauguuaccaggucc

SEQ ID NO: 159307 - RNA, 22 nt, Homo sapiens
ugagacaaucucaucucaguga

SEQ ID NO: 159308 - RNA, 22 nt, Homo sapiens
ugagacaucacaaaauccucaa

SEQ ID NO: 159309 - RNA, 22 nt, Homo sapiens
ugagaccuuucauuucucagug

SEQ ID NO: 159310 - RNA, 22 nt, Homo sapiens
ugagacggagucucgcucuguc

SEQ ID NO: 159311 - RNA, 22 nt, Homo sapiens
ugagacggagucucgcucuguu

SEQ ID NO: 159312 - RNA, 22 nt, Homo sapiens
ugagacggagucuugcccuguc

SEQ ID NO: 159313 - RNA, 22 nt, Homo sapiens
ugagacggagucuugcucuguc

SEQ ID NO: 159314 - RNA, 22 nt, Homo sapiens
ugagaucucauuaugguuuuaa

SEQ ID NO: 159315 - RNA, 22 nt, Homo sapiens
ugagaugacgacacaccucagu

SEQ ID NO: 159316 - RNA, 21 nt, Homo sapiens
ugagaugauccugcaugcaug

SEQ ID NO: 159317 - RNA, 22 nt, Homo sapiens
ugagaugcaaaaugagaauugu

SEQ ID NO: 159318 - RNA, 22 nt, Homo sapiens
ugagaugcucgccggccagcau

SEQ ID NO: 159319 - RNA, 22 nt, Homo sapiens
ugagaugcuuguaaauucauuu

SEQ ID NO: 159320 - RNA, 22 nt, Homo sapiens
ugagcacaggugcgcgguuacu

SEQ ID NO: 159321 - RNA, 22 nt, Homo sapiens
ugagcuagggccuggaauaggg

SEQ ID NO: 159322 - RNA, 22 nt, Homo sapiens
ugagcuaugaucccaccucugu

SEQ ID NO: 159323 - RNA, 18 nt, Homo sapiens
ugaggaaaggguuugcua

SEQ ID NO: 159324 - RNA, 22 nt, Homo sapiens
ugaggauaguguugaaggcagg

SEQ ID NO: 159325 - RNA, 22 nt, Homo sapiens
ugagguugaaggacauuuuuau

SEQ ID NO: 159326 - RNA, 22 nt, Homo sapiens
ugagugaaugugaaggcuaggg

SEQ ID NO: 159327 - RNA, 22 nt, Homo sapiens
ugcaaauguuaggugucauuau

SEQ ID NO: 159328 - RNA, 22 nt, Homo sapiens
ugccaaggagucagucccuaga

SEQ ID NO: 159329 - RNA, 21 nt, Homo sapiens
ugcuauguuguccaggcuggc

SEQ ID NO: 159330 - RNA, 22 nt, Homo sapiens
uggaagccuagauucuuuucuu

SEQ ID NO: 159331 - RNA, 22 nt, Homo sapiens
uggaaggcuucauauguaaaga

SEQ ID NO: 159332 - RNA, 22 nt, Homo sapiens
uggaagguaaguuuugagcauu

SEQ ID NO: 159333 - RNA, 22 nt, Homo sapiens
uggaaugguuggugugauuuua

SEQ ID NO: 159334 - RNA, 22 nt, Homo sapiens
uggaaugucagcuacaagaggg

SEQ ID NO: 159335 - RNA, 22 nt, Homo sapiens
uggaaugucuauguuuuugauu

SEQ ID NO: 159336 - RNA, 22 nt, Homo sapiens
uggaaugucuuuuccccaaagc

SEQ ID NO: 159337 - RNA, 22 nt, Homo sapiens
uggaauguuuaucaaaacagua

SEQ ID NO: 159338 - RNA, 22 nt, Homo sapiens
uggagugagaacuucaaugaug

SEQ ID NO: 159339 - RNA, 20 nt, Homo sapiens
uggagugcuguguugagaag

SEQ ID NO: 159340 - RNA, 22 nt, Homo sapiens
uggaugacauccuuguaugcag

SEQ ID NO: 159341 - RNA, 22 nt, Homo sapiens
uggaugccuaauaaaugcagac

SEQ ID NO: 159342 - RNA, 22 nt, Homo sapiens
uggcaacaucuggggacauguu

SEQ ID NO: 159343 - RNA, 22 nt, Homo sapiens
uggcagaugggugagcuggaga

SEQ ID NO: 159344 - RNA, 19 nt, Homo sapiens
uggcaugaaugugaacuaa

SEQ ID NO: 159345 - RNA, 22 nt, Homo sapiens
uggccagugucggaggccagga

SEQ ID NO: 159346 - RNA, 22 nt, Homo sapiens
uggguaggaccagaaaugcacu

SEQ ID NO: 159347 - RNA, 22 nt, Homo sapiens
uggugagaaacuagauauuuuu

SEQ ID NO: 159348 - RNA, 22 nt, Homo sapiens
uguagggagagggaguugcacc

SEQ ID NO: 159349 - RNA, 22 nt, Homo sapiens
ugucaaugggaauuuguuuuag

SEQ ID NO: 159350 - RNA, 22 nt, Homo sapiens
ugucacccuuuauccauuuccu

SEQ ID NO: 159351 - RNA, 22 nt, Homo sapiens
ugucauacaguaacaugguugg

SEQ ID NO: 159352 - RNA, 22 nt, Homo sapiens
ugucaugguguuaauuuuccug

SEQ ID NO: 159353 - RNA, 20 nt, Homo sapiens
ugucuauggggguucucugc

SEQ ID NO: 159354 - RNA, 22 nt, Homo sapiens
ugugaaacauggauagaacugg

SEQ ID NO: 159355 - RNA, 19 nt, Homo sapiens
ugugaagaaaugcugcaag

SEQ ID NO: 159356 - RNA, 20 nt, Homo sapiens
ugugauuauuuaguugcaug

SEQ ID NO: 159357 - RNA, 22 nt, Homo sapiens
ugugcucaucucagucaacugu

SEQ ID NO: 159358 - RNA, 22 nt, Homo sapiens
uguggcaaauggucaggaagaa

SEQ ID NO: 159359 - RNA, 22 nt, Homo sapiens
uguggcacuguguccagagaaa

SEQ ID NO: 159360 - RNA, 22 nt, Homo sapiens
uuaaaguguuuucaaaauguca

SEQ ID NO: 159361 - RNA, 22 nt, Homo sapiens
uuaccagucugauaaacagaaa

SEQ ID NO: 159362 - RNA, 22 nt, Homo sapiens
uuaggcaaugcucucaaauuug

SEQ ID NO: 159363 - RNA, 22 nt, Homo sapiens
uuauugaguaaaaagaaugguu

SEQ ID NO: 159364 - RNA, 22 nt, Homo sapiens
uucaaaucuucguuuugccaua

SEQ ID NO: 159365 - RNA, 22 nt, Homo sapiens
uucauguaauuccauaagguaa

SEQ ID NO: 159366 - RNA, 22 nt, Homo sapiens
uuggcauugaguuucaaaucau

SEQ ID NO: 159367 - RNA, 20 nt, Homo sapiens
uuggcauuuagacaagaguu

SEQ ID NO: 159368 - RNA, 22 nt, Homo sapiens
uuggcauuuuggacacccagga

SEQ ID NO: 159369 - RNA, 19 nt, Homo sapiens
uuggucccuuuggguucuu

SEQ ID NO: 159370 - RNA, 22 nt, Homo sapiens
uuguacuccagccugggugaca

SEQ ID NO: 159371 - RNA, 22 nt, Homo sapiens
uugucaaugggugagugcagag

SEQ ID NO: 159372 - RNA, 22 nt, Homo sapiens
uugucauggucuugauccauua
